United States Patent 11,421,016 (CANCER NEOEPITOPES) - sequence listing, part 28

SEQ ID NO: 1244687 - protein, 9 aa, Homo Sapiens
CHGFEAASI

SEQ ID NO: 1244688 - protein, 9 aa, Homo Sapiens
QLLHMCLQD

SEQ ID NO: 1244689 - protein, 9 aa, Homo Sapiens
VHTRENPFE

SEQ ID NO: 1244690 - protein, 9 aa, Homo Sapiens
LSLTLPQLS

SEQ ID NO: 1244691 - protein, 9 aa, Homo Sapiens
NLSNMQCQP

SEQ ID NO: 1244692 - protein, 9 aa, Homo Sapiens
SPMSLHPWL

SEQ ID NO: 1244693 - protein, 9 aa, Homo Sapiens
RSLNVHMRL

SEQ ID NO: 1244694 - protein, 9 aa, Homo Sapiens
KNSIMKNQW

SEQ ID NO: 1244695 - protein, 9 aa, Homo Sapiens
GIVGSMKHP

SEQ ID NO: 1244696 - protein, 9 aa, Homo Sapiens
SGGHRYVNM

SEQ ID NO: 1244697 - protein, 9 aa, Homo Sapiens
EHFSALRKH

SEQ ID NO: 1244698 - protein, 9 aa, Homo Sapiens
QMNDSKGGE

SEQ ID NO: 1244699 - protein, 9 aa, Homo Sapiens
EMCFDCMYG

SEQ ID NO: 1244700 - protein, 9 aa, Homo Sapiens
MLPPWLLLG

SEQ ID NO: 1244701 - protein, 9 aa, Homo Sapiens
VQPAAAPGF

SEQ ID NO: 1244702 - protein, 9 aa, Homo Sapiens
ALAHQQQQH

SEQ ID NO: 1244703 - protein, 9 aa, Homo Sapiens
LKFTPQDAY

SEQ ID NO: 1244704 - protein, 9 aa, Homo Sapiens
AIVAGPEGK

SEQ ID NO: 1244705 - protein, 9 aa, Homo Sapiens
RQSCGGGGA

SEQ ID NO: 1244706 - protein, 9 aa, Homo Sapiens
GWGQWHLGA

SEQ ID NO: 1244707 - protein, 9 aa, Homo Sapiens
EKEARVWEA

SEQ ID NO: 1244708 - protein, 9 aa, Homo Sapiens
KHLHASRTQ

SEQ ID NO: 1244709 - protein, 9 aa, Homo Sapiens
RLQFASDGG

SEQ ID NO: 1244710 - protein, 9 aa, Homo Sapiens
KIQMGKKCD

SEQ ID NO: 1244711 - protein, 9 aa, Homo Sapiens
KHLQEEKEK

SEQ ID NO: 1244712 - protein, 9 aa, Homo Sapiens
LSVTSNLTV

SEQ ID NO: 1244713 - protein, 9 aa, Homo Sapiens
RACFEQAGE

SEQ ID NO: 1244714 - protein, 9 aa, Homo Sapiens
SGTKSSRKS

SEQ ID NO: 1244715 - protein, 9 aa, Homo Sapiens
AGGIHASKD

SEQ ID NO: 1244716 - protein, 9 aa, Homo Sapiens
SLWPCWFGA

SEQ ID NO: 1244717 - protein, 9 aa, Homo Sapiens
AMDKLMDRH

SEQ ID NO: 1244718 - protein, 9 aa, Homo Sapiens
SIYGQFVAG

SEQ ID NO: 1244719 - protein, 9 aa, Homo Sapiens
GFDEPTEQH

SEQ ID NO: 1244720 - protein, 9 aa, Homo Sapiens
FFKLQFLYV

SEQ ID NO: 1244721 - protein, 9 aa, Homo Sapiens
PTSNRCTSD

SEQ ID NO: 1244722 - protein, 9 aa, Homo Sapiens
KEVAGFLDR

SEQ ID NO: 1244723 - protein, 9 aa, Homo Sapiens
TDHNTLKLI

SEQ ID NO: 1244724 - protein, 9 aa, Homo Sapiens
LNVNIKSSS

SEQ ID NO: 1244725 - protein, 9 aa, Homo Sapiens
ALVEHETVA

SEQ ID NO: 1244726 - protein, 9 aa, Homo Sapiens
LNAIHALME

SEQ ID NO: 1244727 - protein, 9 aa, Homo Sapiens
RVPLCPSGR

SEQ ID NO: 1244728 - protein, 9 aa, Homo Sapiens
DRKVWSCSS

SEQ ID NO: 1244729 - protein, 9 aa, Homo Sapiens
SQTAPQENV

SEQ ID NO: 1244730 - protein, 9 aa, Homo Sapiens
PPQRMFDAE

SEQ ID NO: 1244731 - protein, 9 aa, Homo Sapiens
DGRYMHSWL

SEQ ID NO: 1244732 - protein, 9 aa, Homo Sapiens
ATFNWNTFL

SEQ ID NO: 1244733 - protein, 9 aa, Homo Sapiens
VRRVGIGHN

SEQ ID NO: 1244734 - protein, 9 aa, Homo Sapiens
NEIYHWFTC

SEQ ID NO: 1244735 - protein, 9 aa, Homo Sapiens
PSHMPPTTT

SEQ ID NO: 1244736 - protein, 9 aa, Homo Sapiens
GIHTDTHRN

SEQ ID NO: 1244737 - protein, 9 aa, Homo Sapiens
VHYYQSLQA

SEQ ID NO: 1244738 - protein, 9 aa, Homo Sapiens
ILVALVSSL

SEQ ID NO: 1244739 - protein, 9 aa, Homo Sapiens
LNHLAKIFY

SEQ ID NO: 1244740 - protein, 9 aa, Homo Sapiens
KRFRGLGDR

SEQ ID NO: 1244741 - protein, 9 aa, Homo Sapiens
CLLSTLQEI

SEQ ID NO: 1244742 - protein, 9 aa, Homo Sapiens
LIRPEYVWI

SEQ ID NO: 1244743 - protein, 9 aa, Homo Sapiens
PSPAQVLSF

SEQ ID NO: 1244744 - protein, 9 aa, Homo Sapiens
HILLVLSGV

SEQ ID NO: 1244745 - protein, 9 aa, Homo Sapiens
ADATINFAY

SEQ ID NO: 1244746 - protein, 9 aa, Homo Sapiens
LIFFSKDQF

SEQ ID NO: 1244747 - protein, 9 aa, Homo Sapiens
ASSILHTHI

SEQ ID NO: 1244748 - protein, 9 aa, Homo Sapiens
REVTDRFKL

SEQ ID NO: 1244749 - protein, 9 aa, Homo Sapiens
AFIYYKIKD

SEQ ID NO: 1244750 - protein, 9 aa, Homo Sapiens
IVHSTLSHD

SEQ ID NO: 1244751 - protein, 9 aa, Homo Sapiens
HNFCAEGHK

SEQ ID NO: 1244752 - protein, 9 aa, Homo Sapiens
ELEAVCKYF

SEQ ID NO: 1244753 - protein, 9 aa, Homo Sapiens
GDIFRSTRY

SEQ ID NO: 1244754 - protein, 9 aa, Homo Sapiens
VLYTSTAMI

SEQ ID NO: 1244755 - protein, 9 aa, Homo Sapiens
GTEGKLHFP

SEQ ID NO: 1244756 - protein, 9 aa, Homo Sapiens
IPGGIFFRC

SEQ ID NO: 1244757 - protein, 9 aa, Homo Sapiens
WYPCGLSQD

SEQ ID NO: 1244758 - protein, 9 aa, Homo Sapiens
DVLVAPRST

SEQ ID NO: 1244759 - protein, 9 aa, Homo Sapiens
ALALALKDV

SEQ ID NO: 1244760 - protein, 9 aa, Homo Sapiens
QGQLMGAGT

SEQ ID NO: 1244761 - protein, 9 aa, Homo Sapiens
KMSPKWCFL

SEQ ID NO: 1244762 - protein, 9 aa, Homo Sapiens
SMEQDKIVS

SEQ ID NO: 1244763 - protein, 9 aa, Homo Sapiens
MPTFIWMLH

SEQ ID NO: 1244764 - protein, 9 aa, Homo Sapiens
TTLSSSVIS

SEQ ID NO: 1244765 - protein, 9 aa, Homo Sapiens
IKVEGGIWA

SEQ ID NO: 1244766 - protein, 9 aa, Homo Sapiens
QQSHHGHPG

SEQ ID NO: 1244767 - protein, 9 aa, Homo Sapiens
YLLCDKIAI

SEQ ID NO: 1244768 - protein, 9 aa, Homo Sapiens
LYRLSILTL

SEQ ID NO: 1244769 - protein, 9 aa, Homo Sapiens
TGKPTDSAL

SEQ ID NO: 1244770 - protein, 9 aa, Homo Sapiens
CYFRVQFLV

SEQ ID NO: 1244771 - protein, 9 aa, Homo Sapiens
KEVKKSIQS

SEQ ID NO: 1244772 - protein, 9 aa, Homo Sapiens
GHLLQDPAR

SEQ ID NO: 1244773 - protein, 9 aa, Homo Sapiens
EPVLVQLVN

SEQ ID NO: 1244774 - protein, 9 aa, Homo Sapiens
REEMQPMMQ

SEQ ID NO: 1244775 - protein, 9 aa, Homo Sapiens
EHYERKLDR

SEQ ID NO: 1244776 - protein, 9 aa, Homo Sapiens
QCFCRICAV

SEQ ID NO: 1244777 - protein, 9 aa, Homo Sapiens
ILSLSNISK

SEQ ID NO: 1244778 - protein, 9 aa, Homo Sapiens
PQHTIQKTR

SEQ ID NO: 1244779 - protein, 9 aa, Homo Sapiens
ELDPVTLYN

SEQ ID NO: 1244780 - protein, 9 aa, Homo Sapiens
DINTHITCR

SEQ ID NO: 1244781 - protein, 9 aa, Homo Sapiens
NQRHTENRR

SEQ ID NO: 1244782 - protein, 9 aa, Homo Sapiens
GLVKLFKLP

SEQ ID NO: 1244783 - protein, 9 aa, Homo Sapiens
TSVVVSRLV

SEQ ID NO: 1244784 - protein, 9 aa, Homo Sapiens
NCPVNKRRR

SEQ ID NO: 1244785 - protein, 9 aa, Homo Sapiens
GRADLCHQH

SEQ ID NO: 1244786 - protein, 9 aa, Homo Sapiens
TGGQGPHHI

SEQ ID NO: 1244787 - protein, 9 aa, Homo Sapiens
DRHMENLVA

SEQ ID NO: 1244788 - protein, 9 aa, Homo Sapiens
IPDGSYMCL

SEQ ID NO: 1244789 - protein, 9 aa, Homo Sapiens
HFIDENGSH

SEQ ID NO: 1244790 - protein, 9 aa, Homo Sapiens
EECKDLINF

SEQ ID NO: 1244791 - protein, 9 aa, Homo Sapiens
SGHLLVLSY

SEQ ID NO: 1244792 - protein, 9 aa, Homo Sapiens
KRTCSEQSI

SEQ ID NO: 1244793 - protein, 9 aa, Homo Sapiens
EAANGLMAT

SEQ ID NO: 1244794 - protein, 9 aa, Homo Sapiens
QVLQGEPVP

SEQ ID NO: 1244795 - protein, 9 aa, Homo Sapiens
LLPCTHSLC

SEQ ID NO: 1244796 - protein, 9 aa, Homo Sapiens
RLMAHYLKV

SEQ ID NO: 1244797 - protein, 9 aa, Homo Sapiens
DYIPGSGLK

SEQ ID NO: 1244798 - protein, 9 aa, Homo Sapiens
SIMLPSQDD

SEQ ID NO: 1244799 - protein, 9 aa, Homo Sapiens
VIPLTKRDQ

SEQ ID NO: 1244800 - protein, 9 aa, Homo Sapiens
ITSLHDAHE

SEQ ID NO: 1244801 - protein, 9 aa, Homo Sapiens
PVIFRKDRE

SEQ ID NO: 1244802 - protein, 9 aa, Homo Sapiens
LLIKEWAAH

SEQ ID NO: 1244803 - protein, 9 aa, Homo Sapiens
VVVVPAKMY

SEQ ID NO: 1244804 - protein, 9 aa, Homo Sapiens
HRAPPRKPE

SEQ ID NO: 1244805 - protein, 9 aa, Homo Sapiens
PQCLSPTVC

SEQ ID NO: 1244806 - protein, 9 aa, Homo Sapiens
RFEITRSQP

SEQ ID NO: 1244807 - protein, 9 aa, Homo Sapiens
AVFQKYVGK

SEQ ID NO: 1244808 - protein, 9 aa, Homo Sapiens
VIEPSSSLP

SEQ ID NO: 1244809 - protein, 9 aa, Homo Sapiens
RLQRHRISG

SEQ ID NO: 1244810 - protein, 9 aa, Homo Sapiens
CQLRVLWEG

SEQ ID NO: 1244811 - protein, 9 aa, Homo Sapiens
KALKLLVME

SEQ ID NO: 1244812 - protein, 9 aa, Homo Sapiens
AIIYLFFDT

SEQ ID NO: 1244813 - protein, 9 aa, Homo Sapiens
DSSDFVLDI

SEQ ID NO: 1244814 - protein, 9 aa, Homo Sapiens
GDLLRRTPV

SEQ ID NO: 1244815 - protein, 9 aa, Homo Sapiens
YNFSYINDN

SEQ ID NO: 1244816 - protein, 9 aa, Homo Sapiens
KEGSLDSKH

SEQ ID NO: 1244817 - protein, 9 aa, Homo Sapiens
FIGIAIHGA

SEQ ID NO: 1244818 - protein, 9 aa, Homo Sapiens
ADMGMGGFS

SEQ ID NO: 1244819 - protein, 9 aa, Homo Sapiens
VFAVTDVNA

SEQ ID NO: 1244820 - protein, 9 aa, Homo Sapiens
VPAETVGHF

SEQ ID NO: 1244821 - protein, 9 aa, Homo Sapiens
PAWMTLSVS

SEQ ID NO: 1244822 - protein, 9 aa, Homo Sapiens
RTIQGRTFQ

SEQ ID NO: 1244823 - protein, 9 aa, Homo Sapiens
EHICQAIEA

SEQ ID NO: 1244824 - protein, 9 aa, Homo Sapiens
ATALPLYFV

SEQ ID NO: 1244825 - protein, 9 aa, Homo Sapiens
YCKKNGEEI

SEQ ID NO: 1244826 - protein, 9 aa, Homo Sapiens
SYSCCQHSS

SEQ ID NO: 1244827 - protein, 9 aa, Homo Sapiens
SKEETCINI

SEQ ID NO: 1244828 - protein, 9 aa, Homo Sapiens
EFEMEGFFA

SEQ ID NO: 1244829 - protein, 9 aa, Homo Sapiens
YAVPWHGTM

SEQ ID NO: 1244830 - protein, 9 aa, Homo Sapiens
RVTELFMFD

SEQ ID NO: 1244831 - protein, 9 aa, Homo Sapiens
TDDVPLSVL

SEQ ID NO: 1244832 - protein, 9 aa, Homo Sapiens
SADQEDHIK

SEQ ID NO: 1244833 - protein, 9 aa, Homo Sapiens
SSDMGRKCS

SEQ ID NO: 1244834 - protein, 9 aa, Homo Sapiens
DIIEVMDAT

SEQ ID NO: 1244835 - protein, 9 aa, Homo Sapiens
QCCMLLKRM

SEQ ID NO: 1244836 - protein, 9 aa, Homo Sapiens
IEAFSEPSV

SEQ ID NO: 1244837 - protein, 9 aa, Homo Sapiens
PRHVQNGLD

SEQ ID NO: 1244838 - protein, 9 aa, Homo Sapiens
SAWPFITTF

SEQ ID NO: 1244839 - protein, 9 aa, Homo Sapiens
PKGRVVSAI

SEQ ID NO: 1244840 - protein, 9 aa, Homo Sapiens
RENRIWELT

SEQ ID NO: 1244841 - protein, 9 aa, Homo Sapiens
DIIKLTGVH

SEQ ID NO: 1244842 - protein, 9 aa, Homo Sapiens
HYENGKQQY

SEQ ID NO: 1244843 - protein, 9 aa, Homo Sapiens
CRHEMTHSE

SEQ ID NO: 1244844 - protein, 9 aa, Homo Sapiens
LAKYSMDHG

SEQ ID NO: 1244845 - protein, 9 aa, Homo Sapiens
CIIAFVGSP

SEQ ID NO: 1244846 - protein, 9 aa, Homo Sapiens
RNCCYLWDV

SEQ ID NO: 1244847 - protein, 9 aa, Homo Sapiens
APSTMKIEI

SEQ ID NO: 1244848 - protein, 9 aa, Homo Sapiens
IKTTFINGS

SEQ ID NO: 1244849 - protein, 9 aa, Homo Sapiens
FGLSFKECN

SEQ ID NO: 1244850 - protein, 9 aa, Homo Sapiens
TITSLNLDF

SEQ ID NO: 1244851 - protein, 9 aa, Homo Sapiens
YQFSRCFHH

SEQ ID NO: 1244852 - protein, 9 aa, Homo Sapiens
TPSEASVLA

SEQ ID NO: 1244853 - protein, 9 aa, Homo Sapiens
TTYLVDMQH

SEQ ID NO: 1244854 - protein, 9 aa, Homo Sapiens
EYHFLSPYI

SEQ ID NO: 1244855 - protein, 9 aa, Homo Sapiens
KLLLEIYTQ

SEQ ID NO: 1244856 - protein, 9 aa, Homo Sapiens
ESDWGKHCV

SEQ ID NO: 1244857 - protein, 9 aa, Homo Sapiens
DVALPALVA

SEQ ID NO: 1244858 - protein, 9 aa, Homo Sapiens
NNGLDMETL

SEQ ID NO: 1244859 - protein, 9 aa, Homo Sapiens
STEPFPQVK

SEQ ID NO: 1244860 - protein, 9 aa, Homo Sapiens
IAVFQKYVG

SEQ ID NO: 1244861 - protein, 9 aa, Homo Sapiens
KAWEVDTCW

SEQ ID NO: 1244862 - protein, 9 aa, Homo Sapiens
FYGMVSKKN

SEQ ID NO: 1244863 - protein, 9 aa, Homo Sapiens
MAVRDRNLL

SEQ ID NO: 1244864 - protein, 9 aa, Homo Sapiens
CSTSTHGSG

SEQ ID NO: 1244865 - protein, 9 aa, Homo Sapiens
KLIYNLYAI

SEQ ID NO: 1244866 - protein, 9 aa, Homo Sapiens
GVPELRDSR

SEQ ID NO: 1244867 - protein, 9 aa, Homo Sapiens
GKPVRGVKF

SEQ ID NO: 1244868 - protein, 9 aa, Homo Sapiens
PPAGEGMGS

SEQ ID NO: 1244869 - protein, 9 aa, Homo Sapiens
TRQEMTVIV

SEQ ID NO: 1244870 - protein, 9 aa, Homo Sapiens
SPSERRHCS

SEQ ID NO: 1244871 - protein, 9 aa, Homo Sapiens
DLNAVKYVE

SEQ ID NO: 1244872 - protein, 9 aa, Homo Sapiens
GRLSVMVCD

SEQ ID NO: 1244873 - protein, 9 aa, Homo Sapiens
MSVDDLRIN

SEQ ID NO: 1244874 - protein, 9 aa, Homo Sapiens
PRSPAGVKL

SEQ ID NO: 1244875 - protein, 9 aa, Homo Sapiens
PLEVTCVVF

SEQ ID NO: 1244876 - protein, 9 aa, Homo Sapiens
KKLSLRFET

SEQ ID NO: 1244877 - protein, 9 aa, Homo Sapiens
DTTIKLNAE

SEQ ID NO: 1244878 - protein, 9 aa, Homo Sapiens
FVAKSQTAP

SEQ ID NO: 1244879 - protein, 9 aa, Homo Sapiens
WRGAMGIWK

SEQ ID NO: 1244880 - protein, 9 aa, Homo Sapiens
IPDVSLIGE

SEQ ID NO: 1244881 - protein, 9 aa, Homo Sapiens
DYDWYNVSY

SEQ ID NO: 1244882 - protein, 9 aa, Homo Sapiens
LVGEETQKW

SEQ ID NO: 1244883 - protein, 9 aa, Homo Sapiens
FDMEKIHSA

SEQ ID NO: 1244884 - protein, 9 aa, Homo Sapiens
FSIDQRYLC

SEQ ID NO: 1244885 - protein, 9 aa, Homo Sapiens
CAFAHCPLD

SEQ ID NO: 1244886 - protein, 9 aa, Homo Sapiens
NSRKALKAL

SEQ ID NO: 1244887 - protein, 9 aa, Homo Sapiens
TIPYLKTFL

SEQ ID NO: 1244888 - protein, 9 aa, Homo Sapiens
AISCFAYQK

SEQ ID NO: 1244889 - protein, 9 aa, Homo Sapiens
SEDDQERII

SEQ ID NO: 1244890 - protein, 9 aa, Homo Sapiens
VLVGICWYQ

SEQ ID NO: 1244891 - protein, 9 aa, Homo Sapiens
YDSGDCCTS

SEQ ID NO: 1244892 - protein, 9 aa, Homo Sapiens
MGERVHIKF

SEQ ID NO: 1244893 - protein, 9 aa, Homo Sapiens
VISSNEPYR

SEQ ID NO: 1244894 - protein, 9 aa, Homo Sapiens
PVAQMSNYQ

SEQ ID NO: 1244895 - protein, 9 aa, Homo Sapiens
SFLTDANQG

SEQ ID NO: 1244896 - protein, 9 aa, Homo Sapiens
SYETIAKHN

SEQ ID NO: 1244897 - protein, 9 aa, Homo Sapiens
STPIVGDQE

SEQ ID NO: 1244898 - protein, 9 aa, Homo Sapiens
APFSRRFDL

SEQ ID NO: 1244899 - protein, 9 aa, Homo Sapiens
RANTDPSVI

SEQ ID NO: 1244900 - protein, 9 aa, Homo Sapiens
RLSEHPDIH

SEQ ID NO: 1244901 - protein, 9 aa, Homo Sapiens
IVRSGHLTT

SEQ ID NO: 1244902 - protein, 9 aa, Homo Sapiens
TTMNNTHSN

SEQ ID NO: 1244903 - protein, 9 aa, Homo Sapiens
SLANNKIMT

SEQ ID NO: 1244904 - protein, 9 aa, Homo Sapiens
GMARSEDHA

SEQ ID NO: 1244905 - protein, 9 aa, Homo Sapiens
EHVVVRPYP

SEQ ID NO: 1244906 - protein, 9 aa, Homo Sapiens
YKLGREKPV

SEQ ID NO: 1244907 - protein, 9 aa, Homo Sapiens
TPDAARDLG

SEQ ID NO: 1244908 - protein, 9 aa, Homo Sapiens
DFHAEQSLR

SEQ ID NO: 1244909 - protein, 9 aa, Homo Sapiens
EIYHWFTCM

SEQ ID NO: 1244910 - protein, 9 aa, Homo Sapiens
CLALIGCFA

SEQ ID NO: 1244911 - protein, 9 aa, Homo Sapiens
HQIGSAEYC

SEQ ID NO: 1244912 - protein, 9 aa, Homo Sapiens
IVSHKEWGA

SEQ ID NO: 1244913 - protein, 9 aa, Homo Sapiens
ATYQVDVFC

SEQ ID NO: 1244914 - protein, 9 aa, Homo Sapiens
QRLNTCGRS

SEQ ID NO: 1244915 - protein, 9 aa, Homo Sapiens
LACAAAPQW

SEQ ID NO: 1244916 - protein, 9 aa, Homo Sapiens
EKHVMKTTT

SEQ ID NO: 1244917 - protein, 9 aa, Homo Sapiens
ERIQNASGS

SEQ ID NO: 1244918 - protein, 9 aa, Homo Sapiens
SSCGSRGSG

SEQ ID NO: 1244919 - protein, 9 aa, Homo Sapiens
KYDRMEKSV

SEQ ID NO: 1244920 - protein, 9 aa, Homo Sapiens
KKDLRLKNL

SEQ ID NO: 1244921 - protein, 9 aa, Homo Sapiens
VIHFDDNQC

SEQ ID NO: 1244922 - protein, 9 aa, Homo Sapiens
PANILISDQ

SEQ ID NO: 1244923 - protein, 9 aa, Homo Sapiens
HNYSAALGM

SEQ ID NO: 1244924 - protein, 9 aa, Homo Sapiens
VRVKRRKQS

SEQ ID NO: 1244925 - protein, 9 aa, Homo Sapiens
QGPAQAPLH

SEQ ID NO: 1244926 - protein, 9 aa, Homo Sapiens
LVTMKRLDS

SEQ ID NO: 1244927 - protein, 9 aa, Homo Sapiens
PEGSKHGTY

SEQ ID NO: 1244928 - protein, 9 aa, Homo Sapiens
LLSPNYSLN

SEQ ID NO: 1244929 - protein, 9 aa, Homo Sapiens
FAPDSRHIF

SEQ ID NO: 1244930 - protein, 9 aa, Homo Sapiens
FLCAVCGEI

SEQ ID NO: 1244931 - protein, 9 aa, Homo Sapiens
YGNDEGHSF

SEQ ID NO: 1244932 - protein, 9 aa, Homo Sapiens
VTEGGETEE

SEQ ID NO: 1244933 - protein, 9 aa, Homo Sapiens
AMSVAPQIG

SEQ ID NO: 1244934 - protein, 9 aa, Homo Sapiens
VKNVEYVVR

SEQ ID NO: 1244935 - protein, 9 aa, Homo Sapiens
YKPTRMLNI

SEQ ID NO: 1244936 - protein, 9 aa, Homo Sapiens
VALRSVAVH

SEQ ID NO: 1244937 - protein, 9 aa, Homo Sapiens
LVISLASTQ

SEQ ID NO: 1244938 - protein, 9 aa, Homo Sapiens
LETIQGQLT

SEQ ID NO: 1244939 - protein, 9 aa, Homo Sapiens
LEATDVKST

SEQ ID NO: 1244940 - protein, 9 aa, Homo Sapiens
CITMSNSMI

SEQ ID NO: 1244941 - protein, 9 aa, Homo Sapiens
TLEIHFHEI

SEQ ID NO: 1244942 - protein, 9 aa, Homo Sapiens
RPQPATYQT

SEQ ID NO: 1244943 - protein, 9 aa, Homo Sapiens
PEIFQRSEH

SEQ ID NO: 1244944 - protein, 9 aa, Homo Sapiens
LRTIHSVLN

SEQ ID NO: 1244945 - protein, 9 aa, Homo Sapiens
LVRLCNEGT

SEQ ID NO: 1244946 - protein, 9 aa, Homo Sapiens
ISRTEPSMA

SEQ ID NO: 1244947 - protein, 9 aa, Homo Sapiens
NSEHLKRDH

SEQ ID NO: 1244948 - protein, 9 aa, Homo Sapiens
TVAAAVLEK

SEQ ID NO: 1244949 - protein, 9 aa, Homo Sapiens
PLHSSGVAL

SEQ ID NO: 1244950 - protein, 9 aa, Homo Sapiens
AGVARGVDF

SEQ ID NO: 1244951 - protein, 9 aa, Homo Sapiens
GGVLIVLYI

SEQ ID NO: 1244952 - protein, 9 aa, Homo Sapiens
QACPQHTCP

SEQ ID NO: 1244953 - protein, 9 aa, Homo Sapiens
LQKTYNEAM

SEQ ID NO: 1244954 - protein, 9 aa, Homo Sapiens
PEAADMDYV

SEQ ID NO: 1244955 - protein, 9 aa, Homo Sapiens
RWLQQTTGC

SEQ ID NO: 1244956 - protein, 9 aa, Homo Sapiens
FLEHFDIDD

SEQ ID NO: 1244957 - protein, 9 aa, Homo Sapiens
AGLTKLDLL

SEQ ID NO: 1244958 - protein, 9 aa, Homo Sapiens
AVPWHGTMT

SEQ ID NO: 1244959 - protein, 9 aa, Homo Sapiens
KTPENYPNV

SEQ ID NO: 1244960 - protein, 9 aa, Homo Sapiens
ASVAIGKLA

SEQ ID NO: 1244961 - protein, 9 aa, Homo Sapiens
SPNYSLNYE

SEQ ID NO: 1244962 - protein, 9 aa, Homo Sapiens
ALAVKAGHS

SEQ ID NO: 1244963 - protein, 9 aa, Homo Sapiens
YIEASIAGS

SEQ ID NO: 1244964 - protein, 9 aa, Homo Sapiens
IHLWALLAG

SEQ ID NO: 1244965 - protein, 9 aa, Homo Sapiens
DVLPSHLHP

SEQ ID NO: 1244966 - protein, 9 aa, Homo Sapiens
VNCSILPCL

SEQ ID NO: 1244967 - protein, 9 aa, Homo Sapiens
FQASARRAD

SEQ ID NO: 1244968 - protein, 9 aa, Homo Sapiens
VLCDIKQAY

SEQ ID NO: 1244969 - protein, 9 aa, Homo Sapiens
WAILQNQGN

SEQ ID NO: 1244970 - protein, 9 aa, Homo Sapiens
TARAKGWAW

SEQ ID NO: 1244971 - protein, 9 aa, Homo Sapiens
EGSDSAILL

SEQ ID NO: 1244972 - protein, 9 aa, Homo Sapiens
PTIGIKRAW

SEQ ID NO: 1244973 - protein, 9 aa, Homo Sapiens
CDSLVLQSK

SEQ ID NO: 1244974 - protein, 9 aa, Homo Sapiens
KYDVAHVVS

SEQ ID NO: 1244975 - protein, 9 aa, Homo Sapiens
VQPDEPNVL

SEQ ID NO: 1244976 - protein, 9 aa, Homo Sapiens
HRDWAVFHE

SEQ ID NO: 1244977 - protein, 9 aa, Homo Sapiens
VHPISTQNP

SEQ ID NO: 1244978 - protein, 9 aa, Homo Sapiens
ADIEQSTSI

SEQ ID NO: 1244979 - protein, 9 aa, Homo Sapiens
MVDSKEEYA

SEQ ID NO: 1244980 - protein, 9 aa, Homo Sapiens
RFEEDKRTY

SEQ ID NO: 1244981 - protein, 9 aa, Homo Sapiens
VSRRIPALS

SEQ ID NO: 1244982 - protein, 9 aa, Homo Sapiens
FFITYGIQP

SEQ ID NO: 1244983 - protein, 9 aa, Homo Sapiens
NVMRVWFCN

SEQ ID NO: 1244984 - protein, 9 aa, Homo Sapiens
IQAMPSDLI

SEQ ID NO: 1244985 - protein, 9 aa, Homo Sapiens
ALVPTPHGL

SEQ ID NO: 1244986 - protein, 9 aa, Homo Sapiens
KYTKGNGDC

SEQ ID NO: 1244987 - protein, 9 aa, Homo Sapiens
EYFIHGTRL

SEQ ID NO: 1244988 - protein, 9 aa, Homo Sapiens
IKLAFKMSI

SEQ ID NO: 1244989 - protein, 9 aa, Homo Sapiens
DEDLAKADE

SEQ ID NO: 1244990 - protein, 9 aa, Homo Sapiens
HTEFMNPHL

SEQ ID NO: 1244991 - protein, 9 aa, Homo Sapiens
SSGKRTLSM

SEQ ID NO: 1244992 - protein, 9 aa, Homo Sapiens
YKVKYPIVG

SEQ ID NO: 1244993 - protein, 9 aa, Homo Sapiens
QSCRLEQGQ

SEQ ID NO: 1244994 - protein, 9 aa, Homo Sapiens
IRCTRMVDI

SEQ ID NO: 1244995 - protein, 9 aa, Homo Sapiens
RCPAKAWSG

SEQ ID NO: 1244996 - protein, 9 aa, Homo Sapiens
LPTKIAAVV

SEQ ID NO: 1244997 - protein, 9 aa, Homo Sapiens
RSTCTLWTW

SEQ ID NO: 1244998 - protein, 9 aa, Homo Sapiens
TYLVAIVIC

SEQ ID NO: 1244999 - protein, 9 aa, Homo Sapiens
LRNLMVQAA

SEQ ID NO: 1245000 - protein, 9 aa, Homo Sapiens
SPPAGEGMG

SEQ ID NO: 1245001 - protein, 9 aa, Homo Sapiens
TSQGCTVPV

SEQ ID NO: 1245002 - protein, 9 aa, Homo Sapiens
RHDMQTTTA

SEQ ID NO: 1245003 - protein, 9 aa, Homo Sapiens
SESLWQLKT

SEQ ID NO: 1245004 - protein, 9 aa, Homo Sapiens
PTVCATVAQ

SEQ ID NO: 1245005 - protein, 9 aa, Homo Sapiens
NIIYHFLTL

SEQ ID NO: 1245006 - protein, 9 aa, Homo Sapiens
LNTVFRNLA

SEQ ID NO: 1245007 - protein, 9 aa, Homo Sapiens
HLCITRKKV

SEQ ID NO: 1245008 - protein, 9 aa, Homo Sapiens
LRTSQEPAS

SEQ ID NO: 1245009 - protein, 9 aa, Homo Sapiens
DNRLTRATA

SEQ ID NO: 1245010 - protein, 9 aa, Homo Sapiens
SCGHPWVAY

SEQ ID NO: 1245011 - protein, 9 aa, Homo Sapiens
GYYRGEGTH

SEQ ID NO: 1245012 - protein, 9 aa, Homo Sapiens
IQESSDALL

SEQ ID NO: 1245013 - protein, 9 aa, Homo Sapiens
ILKKSYEDA

SEQ ID NO: 1245014 - protein, 9 aa, Homo Sapiens
MHGMKAAKH

SEQ ID NO: 1245015 - protein, 9 aa, Homo Sapiens
SLVPELPTP

SEQ ID NO: 1245016 - protein, 9 aa, Homo Sapiens
PKRWDLLTE

SEQ ID NO: 1245017 - protein, 9 aa, Homo Sapiens
RPIREVHVT

SEQ ID NO: 1245018 - protein, 9 aa, Homo Sapiens
DCECCLPFF

SEQ ID NO: 1245019 - protein, 9 aa, Homo Sapiens
SVVLLNFFP

SEQ ID NO: 1245020 - protein, 9 aa, Homo Sapiens
GLSRIIICN

SEQ ID NO: 1245021 - protein, 9 aa, Homo Sapiens
ETDEATHYI

SEQ ID NO: 1245022 - protein, 9 aa, Homo Sapiens
VIDLPVENP

SEQ ID NO: 1245023 - protein, 9 aa, Homo Sapiens
CPNHPAILN

SEQ ID NO: 1245024 - protein, 9 aa, Homo Sapiens
WVPAIGFTL

SEQ ID NO: 1245025 - protein, 9 aa, Homo Sapiens
DLITFLYLL

SEQ ID NO: 1245026 - protein, 9 aa, Homo Sapiens
MCAQLQLPQ

SEQ ID NO: 1245027 - protein, 9 aa, Homo Sapiens
CNTGDVCYY

SEQ ID NO: 1245028 - protein, 9 aa, Homo Sapiens
SSTEQSCAS

SEQ ID NO: 1245029 - protein, 9 aa, Homo Sapiens
AGVQWHYLG

SEQ ID NO: 1245030 - protein, 9 aa, Homo Sapiens
LYENCQEVL

SEQ ID NO: 1245031 - protein, 9 aa, Homo Sapiens
SAPTGIGGP

SEQ ID NO: 1245032 - protein, 9 aa, Homo Sapiens
IEASIAGSG

SEQ ID NO: 1245033 - protein, 9 aa, Homo Sapiens
NNRLKLLVL

SEQ ID NO: 1245034 - protein, 9 aa, Homo Sapiens
LAEPWRQEW

SEQ ID NO: 1245035 - protein, 9 aa, Homo Sapiens
TLLFCLLVV

SEQ ID NO: 1245036 - protein, 9 aa, Homo Sapiens
LIDEKAGGT

SEQ ID NO: 1245037 - protein, 9 aa, Homo Sapiens
NPWSCIFFI

SEQ ID NO: 1245038 - protein, 9 aa, Homo Sapiens
QHRDSYYSY

SEQ ID NO: 1245039 - protein, 9 aa, Homo Sapiens
CLSPEYDAI

SEQ ID NO: 1245040 - protein, 9 aa, Homo Sapiens
AEYNVIITV

SEQ ID NO: 1245041 - protein, 9 aa, Homo Sapiens
IGPAGEPMG

SEQ ID NO: 1245042 - protein, 9 aa, Homo Sapiens
SKSHGPVKV

SEQ ID NO: 1245043 - protein, 9 aa, Homo Sapiens
IASISNSTR

SEQ ID NO: 1245044 - protein, 9 aa, Homo Sapiens
LHVVISLMV

SEQ ID NO: 1245045 - protein, 9 aa, Homo Sapiens
EDDMLAKTF

SEQ ID NO: 1245046 - protein, 9 aa, Homo Sapiens
LDDLVAVDL

SEQ ID NO: 1245047 - protein, 9 aa, Homo Sapiens
QPFRLENLL

SEQ ID NO: 1245048 - protein, 9 aa, Homo Sapiens
LPLNSFPVP

SEQ ID NO: 1245049 - protein, 9 aa, Homo Sapiens
ASEDSRLAH

SEQ ID NO: 1245050 - protein, 9 aa, Homo Sapiens
RAHCPANGA

SEQ ID NO: 1245051 - protein, 9 aa, Homo Sapiens
KSVLQSRWH

SEQ ID NO: 1245052 - protein, 9 aa, Homo Sapiens
FAAVNMWRK

SEQ ID NO: 1245053 - protein, 9 aa, Homo Sapiens
LPSVNQIGS

SEQ ID NO: 1245054 - protein, 9 aa, Homo Sapiens
MRVLEYLFK

SEQ ID NO: 1245055 - protein, 9 aa, Homo Sapiens
RHLKVIQAS

SEQ ID NO: 1245056 - protein, 9 aa, Homo Sapiens
SMQPHKYIL

SEQ ID NO: 1245057 - protein, 9 aa, Homo Sapiens
LRKNYKCYI

SEQ ID NO: 1245058 - protein, 9 aa, Homo Sapiens
LSPGHGVSA

SEQ ID NO: 1245059 - protein, 9 aa, Homo Sapiens
LPFGAGPHS

SEQ ID NO: 1245060 - protein, 9 aa, Homo Sapiens
KKLLVSLEW

SEQ ID NO: 1245061 - protein, 9 aa, Homo Sapiens
ARIPPTSRC

SEQ ID NO: 1245062 - protein, 9 aa, Homo Sapiens
RHKQYPISL

SEQ ID NO: 1245063 - protein, 9 aa, Homo Sapiens
NLEDNNRCP

SEQ ID NO: 1245064 - protein, 9 aa, Homo Sapiens
DALETASRA

SEQ ID NO: 1245065 - protein, 9 aa, Homo Sapiens
EHLMLEELR

SEQ ID NO: 1245066 - protein, 9 aa, Homo Sapiens
FGARIPPTS

SEQ ID NO: 1245067 - protein, 9 aa, Homo Sapiens
EMSDGSQDT

SEQ ID NO: 1245068 - protein, 9 aa, Homo Sapiens
HQARAGVSH

SEQ ID NO: 1245069 - protein, 9 aa, Homo Sapiens
SSALKLVAA

SEQ ID NO: 1245070 - protein, 9 aa, Homo Sapiens
QTQLCLRIQ

SEQ ID NO: 1245071 - protein, 9 aa, Homo Sapiens
ECHGFEAAS

SEQ ID NO: 1245072 - protein, 9 aa, Homo Sapiens
STLLKTLAS

SEQ ID NO: 1245073 - protein, 9 aa, Homo Sapiens
ESPMSRQEN

SEQ ID NO: 1245074 - protein, 9 aa, Homo Sapiens
SESKALWEN

SEQ ID NO: 1245075 - protein, 9 aa, Homo Sapiens
TPAATETGT

SEQ ID NO: 1245076 - protein, 9 aa, Homo Sapiens
RGLDILKGK

SEQ ID NO: 1245077 - protein, 9 aa, Homo Sapiens
FLFSVLFVI

SEQ ID NO: 1245078 - protein, 9 aa, Homo Sapiens
VISEVRSKE

SEQ ID NO: 1245079 - protein, 9 aa, Homo Sapiens
QATFIKKGC

SEQ ID NO: 1245080 - protein, 9 aa, Homo Sapiens
MQRFRPEEE

SEQ ID NO: 1245081 - protein, 9 aa, Homo Sapiens
GMVIFNLYH

SEQ ID NO: 1245082 - protein, 9 aa, Homo Sapiens
PRPSSCFHP

SEQ ID NO: 1245083 - protein, 9 aa, Homo Sapiens
HSFGHFPGP

SEQ ID NO: 1245084 - protein, 9 aa, Homo Sapiens
RCDGKKIVS

SEQ ID NO: 1245085 - protein, 9 aa, Homo Sapiens
SLSLSQWMW

SEQ ID NO: 1245086 - protein, 9 aa, Homo Sapiens
KMQYFKRTG

SEQ ID NO: 1245087 - protein, 9 aa, Homo Sapiens
ESMEVHRAF

SEQ ID NO: 1245088 - protein, 9 aa, Homo Sapiens
SSPCQTTCY

SEQ ID NO: 1245089 - protein, 9 aa, Homo Sapiens
GEMVALKKY

SEQ ID NO: 1245090 - protein, 9 aa, Homo Sapiens
PGPVCYATD

SEQ ID NO: 1245091 - protein, 9 aa, Homo Sapiens
IATLAMVLG

SEQ ID NO: 1245092 - protein, 9 aa, Homo Sapiens
SDLELDKEG

SEQ ID NO: 1245093 - protein, 9 aa, Homo Sapiens
TIKGNPALC

SEQ ID NO: 1245094 - protein, 9 aa, Homo Sapiens
ESINDGHWD

SEQ ID NO: 1245095 - protein, 9 aa, Homo Sapiens
ILCKSFDIC

SEQ ID NO: 1245096 - protein, 9 aa, Homo Sapiens
SASTHRHPS

SEQ ID NO: 1245097 - protein, 9 aa, Homo Sapiens
KPQTPNYNH

SEQ ID NO: 1245098 - protein, 9 aa, Homo Sapiens
NFSKIIVVN

SEQ ID NO: 1245099 - protein, 9 aa, Homo Sapiens
DELGNHYQL

SEQ ID NO: 1245100 - protein, 9 aa, Homo Sapiens
GLHAVAPYW

SEQ ID NO: 1245101 - protein, 9 aa, Homo Sapiens
TDGCRLSGE

SEQ ID NO: 1245102 - protein, 9 aa, Homo Sapiens
QGDEVDINT

SEQ ID NO: 1245103 - protein, 9 aa, Homo Sapiens
QLSLMDIML

SEQ ID NO: 1245104 - protein, 9 aa, Homo Sapiens
CNLDCKAGL

SEQ ID NO: 1245105 - protein, 9 aa, Homo Sapiens
GHSSHRLCI

SEQ ID NO: 1245106 - protein, 9 aa, Homo Sapiens
RAQPQTKAE

SEQ ID NO: 1245107 - protein, 9 aa, Homo Sapiens
YFFTELNRD

SEQ ID NO: 1245108 - protein, 9 aa, Homo Sapiens
SLYIDLGTL

SEQ ID NO: 1245109 - protein, 9 aa, Homo Sapiens
SPFARTSLK

SEQ ID NO: 1245110 - protein, 9 aa, Homo Sapiens
PICWGGREQ

SEQ ID NO: 1245111 - protein, 9 aa, Homo Sapiens
GAAPTDIPV

SEQ ID NO: 1245112 - protein, 9 aa, Homo Sapiens
HEDYTMKMS

SEQ ID NO: 1245113 - protein, 9 aa, Homo Sapiens
AISFAGCFL

SEQ ID NO: 1245114 - protein, 9 aa, Homo Sapiens
KPVFVMEPR

SEQ ID NO: 1245115 - protein, 9 aa, Homo Sapiens
LDNATKPGP

SEQ ID NO: 1245116 - protein, 9 aa, Homo Sapiens
ASLQVDWLP

SEQ ID NO: 1245117 - protein, 9 aa, Homo Sapiens
KEVVGLKST

SEQ ID NO: 1245118 - protein, 9 aa, Homo Sapiens
VLEEQCHWL

SEQ ID NO: 1245119 - protein, 9 aa, Homo Sapiens
PSYSPYVSP

SEQ ID NO: 1245120 - protein, 9 aa, Homo Sapiens
QLMWIRQQE

SEQ ID NO: 1245121 - protein, 9 aa, Homo Sapiens
SYIFIDFAS

SEQ ID NO: 1245122 - protein, 9 aa, Homo Sapiens
THGAETRRI

SEQ ID NO: 1245123 - protein, 9 aa, Homo Sapiens
WDTLKYLIA

SEQ ID NO: 1245124 - protein, 9 aa, Homo Sapiens
GLSHISNMS

SEQ ID NO: 1245125 - protein, 9 aa, Homo Sapiens
CLKASIKGV

SEQ ID NO: 1245126 - protein, 9 aa, Homo Sapiens
VHKKKCSSA

SEQ ID NO: 1245127 - protein, 9 aa, Homo Sapiens
FGTTLNYLR

SEQ ID NO: 1245128 - protein, 9 aa, Homo Sapiens
PPSFSAPCC

SEQ ID NO: 1245129 - protein, 9 aa, Homo Sapiens
NFDILEREK

SEQ ID NO: 1245130 - protein, 9 aa, Homo Sapiens
VVSVVALFV

SEQ ID NO: 1245131 - protein, 9 aa, Homo Sapiens
SHYFHKVAD

SEQ ID NO: 1245132 - protein, 9 aa, Homo Sapiens
DSRLAHYNK

SEQ ID NO: 1245133 - protein, 9 aa, Homo Sapiens
DKIRMYNVR

SEQ ID NO: 1245134 - protein, 9 aa, Homo Sapiens
GLNMHVIQV

SEQ ID NO: 1245135 - protein, 9 aa, Homo Sapiens
RYPDSFSMR

SEQ ID NO: 1245136 - protein, 9 aa, Homo Sapiens
IHVEFQLSE

SEQ ID NO: 1245137 - protein, 9 aa, Homo Sapiens
ELVIAHILH

SEQ ID NO: 1245138 - protein, 9 aa, Homo Sapiens
DCLLDIMPY

SEQ ID NO: 1245139 - protein, 9 aa, Homo Sapiens
ATTGKVVCV

SEQ ID NO: 1245140 - protein, 9 aa, Homo Sapiens
GRLVKASTP

SEQ ID NO: 1245141 - protein, 9 aa, Homo Sapiens
CHRLKPSDR

SEQ ID NO: 1245142 - protein, 9 aa, Homo Sapiens
YCHKDFGKD

SEQ ID NO: 1245143 - protein, 9 aa, Homo Sapiens
SRVPLSVQP

SEQ ID NO: 1245144 - protein, 9 aa, Homo Sapiens
TNLKGLIHH

SEQ ID NO: 1245145 - protein, 9 aa, Homo Sapiens
LVALYLVRQ

SEQ ID NO: 1245146 - protein, 9 aa, Homo Sapiens
KEHTIYNMI

SEQ ID NO: 1245147 - protein, 9 aa, Homo Sapiens
ALLVKDIQW

SEQ ID NO: 1245148 - protein, 9 aa, Homo Sapiens
HVVIIHCRG

SEQ ID NO: 1245149 - protein, 9 aa, Homo Sapiens
QRFLCLLST

SEQ ID NO: 1245150 - protein, 9 aa, Homo Sapiens
SMSVTSLDA

SEQ ID NO: 1245151 - protein, 9 aa, Homo Sapiens
KLKLHQSAT

SEQ ID NO: 1245152 - protein, 9 aa, Homo Sapiens
TRLSTGRAS

SEQ ID NO: 1245153 - protein, 9 aa, Homo Sapiens
LEPCPPYPQ

SEQ ID NO: 1245154 - protein, 9 aa, Homo Sapiens
MVANILNND

SEQ ID NO: 1245155 - protein, 9 aa, Homo Sapiens
TCMFKQTAI

SEQ ID NO: 1245156 - protein, 9 aa, Homo Sapiens
KEAKEIAKK

SEQ ID NO: 1245157 - protein, 9 aa, Homo Sapiens
YLEVHQGPR

SEQ ID NO: 1245158 - protein, 9 aa, Homo Sapiens
MQYSCSLPC

SEQ ID NO: 1245159 - protein, 9 aa, Homo Sapiens
HGKAFSYHN

SEQ ID NO: 1245160 - protein, 9 aa, Homo Sapiens
AQQELDEKP

SEQ ID NO: 1245161 - protein, 9 aa, Homo Sapiens
PFALSPLHV

SEQ ID NO: 1245162 - protein, 9 aa, Homo Sapiens
RTVACASYK

SEQ ID NO: 1245163 - protein, 9 aa, Homo Sapiens
DNTLHLASE

SEQ ID NO: 1245164 - protein, 9 aa, Homo Sapiens
GTSISSISV

SEQ ID NO: 1245165 - protein, 9 aa, Homo Sapiens
GHLGPELWA

SEQ ID NO: 1245166 - protein, 9 aa, Homo Sapiens
LFPGERLMG

SEQ ID NO: 1245167 - protein, 9 aa, Homo Sapiens
WKLKQDKKF

SEQ ID NO: 1245168 - protein, 9 aa, Homo Sapiens
YEMLGRCSM

SEQ ID NO: 1245169 - protein, 9 aa, Homo Sapiens
PDSIMNSTE

SEQ ID NO: 1245170 - protein, 9 aa, Homo Sapiens
ARAAGHTPK

SEQ ID NO: 1245171 - protein, 9 aa, Homo Sapiens
YSEDSTPAF

SEQ ID NO: 1245172 - protein, 9 aa, Homo Sapiens
SYQEKVDIV

SEQ ID NO: 1245173 - protein, 9 aa, Homo Sapiens
CGCRWSGPI

SEQ ID NO: 1245174 - protein, 9 aa, Homo Sapiens
PAGKKKKYI

SEQ ID NO: 1245175 - protein, 9 aa, Homo Sapiens
CKDQCLPGF

SEQ ID NO: 1245176 - protein, 9 aa, Homo Sapiens
KTGPGTPRA

SEQ ID NO: 1245177 - protein, 9 aa, Homo Sapiens
QPDEPNVLN

SEQ ID NO: 1245178 - protein, 9 aa, Homo Sapiens
QDPQGPNLE

SEQ ID NO: 1245179 - protein, 9 aa, Homo Sapiens
VARRLGRCS

SEQ ID NO: 1245180 - protein, 9 aa, Homo Sapiens
AEKKLLVSL

SEQ ID NO: 1245181 - protein, 9 aa, Homo Sapiens
AAGAHEQRV

SEQ ID NO: 1245182 - protein, 9 aa, Homo Sapiens
CKRRRMSPS

SEQ ID NO: 1245183 - protein, 9 aa, Homo Sapiens
GFCATLSKP

SEQ ID NO: 1245184 - protein, 9 aa, Homo Sapiens
MWRKNLQDR

SEQ ID NO: 1245185 - protein, 9 aa, Homo Sapiens
EGYGIGVGY

SEQ ID NO: 1245186 - protein, 9 aa, Homo Sapiens
MRRYKTFMI

SEQ ID NO: 1245187 - protein, 9 aa, Homo Sapiens
EEKKGDENF

SEQ ID NO: 1245188 - protein, 9 aa, Homo Sapiens
MIIHMWPMA

SEQ ID NO: 1245189 - protein, 9 aa, Homo Sapiens
VGAPGPDGA

SEQ ID NO: 1245190 - protein, 9 aa, Homo Sapiens
ENTGLIKVF

SEQ ID NO: 1245191 - protein, 9 aa, Homo Sapiens
KSDLTTKKA

SEQ ID NO: 1245192 - protein, 9 aa, Homo Sapiens
EFRVFHLQN

SEQ ID NO: 1245193 - protein, 9 aa, Homo Sapiens
RLETGEDGE

SEQ ID NO: 1245194 - protein, 9 aa, Homo Sapiens
VIGKSKPKA

SEQ ID NO: 1245195 - protein, 9 aa, Homo Sapiens
LDFEHCTCT

SEQ ID NO: 1245196 - protein, 9 aa, Homo Sapiens
SVQVEKWVK

SEQ ID NO: 1245197 - protein, 9 aa, Homo Sapiens
YYQAMSVAP

SEQ ID NO: 1245198 - protein, 9 aa, Homo Sapiens
SKACQTLCN

SEQ ID NO: 1245199 - protein, 9 aa, Homo Sapiens
NNLVYSAPT

SEQ ID NO: 1245200 - protein, 9 aa, Homo Sapiens
HLLYFLFIC

SEQ ID NO: 1245201 - protein, 9 aa, Homo Sapiens
NDSVFTMLP

SEQ ID NO: 1245202 - protein, 9 aa, Homo Sapiens
ASISMRAQD

SEQ ID NO: 1245203 - protein, 9 aa, Homo Sapiens
HVFAKPLYE

SEQ ID NO: 1245204 - protein, 9 aa, Homo Sapiens
FPVGYFVSN

SEQ ID NO: 1245205 - protein, 9 aa, Homo Sapiens
EHILKMWVI

SEQ ID NO: 1245206 - protein, 9 aa, Homo Sapiens
KKYTKGVIP

SEQ ID NO: 1245207 - protein, 9 aa, Homo Sapiens
TSALSTGQI

SEQ ID NO: 1245208 - protein, 9 aa, Homo Sapiens
PAPGLAALA

SEQ ID NO: 1245209 - protein, 9 aa, Homo Sapiens
GENIGLDQG

SEQ ID NO: 1245210 - protein, 9 aa, Homo Sapiens
MDLTVGVGT

SEQ ID NO: 1245211 - protein, 9 aa, Homo Sapiens
PGVKVHSGR

SEQ ID NO: 1245212 - protein, 9 aa, Homo Sapiens
PGIPTGEDG

SEQ ID NO: 1245213 - protein, 9 aa, Homo Sapiens
FGMSRGIYS

SEQ ID NO: 1245214 - protein, 9 aa, Homo Sapiens
KKSPVPVEA

SEQ ID NO: 1245215 - protein, 9 aa, Homo Sapiens
PGCVLRLQF

SEQ ID NO: 1245216 - protein, 9 aa, Homo Sapiens
SAHIKMEED

SEQ ID NO: 1245217 - protein, 9 aa, Homo Sapiens
LPSLDVFLR

SEQ ID NO: 1245218 - protein, 9 aa, Homo Sapiens
GLTSVIYTD

SEQ ID NO: 1245219 - protein, 9 aa, Homo Sapiens
MNVTNVRRH

SEQ ID NO: 1245220 - protein, 9 aa, Homo Sapiens
EEIPEESDE

SEQ ID NO: 1245221 - protein, 9 aa, Homo Sapiens
YFFLGTSQD

SEQ ID NO: 1245222 - protein, 9 aa, Homo Sapiens
MSSAWPPTV

SEQ ID NO: 1245223 - protein, 9 aa, Homo Sapiens
PYGNLLDHL

SEQ ID NO: 1245224 - protein, 9 aa, Homo Sapiens
QSRNYYNFP

SEQ ID NO: 1245225 - protein, 9 aa, Homo Sapiens
DASFLTQWK

SEQ ID NO: 1245226 - protein, 9 aa, Homo Sapiens
DVPLSVLIL

SEQ ID NO: 1245227 - protein, 9 aa, Homo Sapiens
FVMYYFTYD

SEQ ID NO: 1245228 - protein, 9 aa, Homo Sapiens
FSEEQASVL

SEQ ID NO: 1245229 - protein, 9 aa, Homo Sapiens
FHSDTLACL

SEQ ID NO: 1245230 - protein, 9 aa, Homo Sapiens
SYMSEETHR

SEQ ID NO: 1245231 - protein, 9 aa, Homo Sapiens
LCARTQLRN

SEQ ID NO: 1245232 - protein, 9 aa, Homo Sapiens
LTSQFLKIK

SEQ ID NO: 1245233 - protein, 9 aa, Homo Sapiens
KFAYRGILN

SEQ ID NO: 1245234 - protein, 9 aa, Homo Sapiens
SPGATLTGE

SEQ ID NO: 1245235 - protein, 9 aa, Homo Sapiens
TGPQLQALA

SEQ ID NO: 1245236 - protein, 9 aa, Homo Sapiens
PGWFMCGPA

SEQ ID NO: 1245237 - protein, 9 aa, Homo Sapiens
EGWRAQQQL

SEQ ID NO: 1245238 - protein, 9 aa, Homo Sapiens
DEACFSLVI

SEQ ID NO: 1245239 - protein, 9 aa, Homo Sapiens
IAIDALGFY

SEQ ID NO: 1245240 - protein, 9 aa, Homo Sapiens
NLGPTGAKV

SEQ ID NO: 1245241 - protein, 9 aa, Homo Sapiens
VHEACDRLI

SEQ ID NO: 1245242 - protein, 9 aa, Homo Sapiens
EKLFICNEC

SEQ ID NO: 1245243 - protein, 9 aa, Homo Sapiens
ELELSNLDD

SEQ ID NO: 1245244 - protein, 9 aa, Homo Sapiens
LSSPNLWPD

SEQ ID NO: 1245245 - protein, 9 aa, Homo Sapiens
GQHLFIESR

SEQ ID NO: 1245246 - protein, 9 aa, Homo Sapiens
AKRRCSLHH

SEQ ID NO: 1245247 - protein, 9 aa, Homo Sapiens
CFLVPTFLR

SEQ ID NO: 1245248 - protein, 9 aa, Homo Sapiens
NRKTVLFLP

SEQ ID NO: 1245249 - protein, 9 aa, Homo Sapiens
LCGIVSTSS

SEQ ID NO: 1245250 - protein, 9 aa, Homo Sapiens
PTFSKKFVL

SEQ ID NO: 1245251 - protein, 9 aa, Homo Sapiens
HVSTHEQSE

SEQ ID NO: 1245252 - protein, 9 aa, Homo Sapiens
AVINQKLIE

SEQ ID NO: 1245253 - protein, 9 aa, Homo Sapiens
PEVPPASSV

SEQ ID NO: 1245254 - protein, 9 aa, Homo Sapiens
TTFKTDMYL

SEQ ID NO: 1245255 - protein, 9 aa, Homo Sapiens
AHPRPPALS

SEQ ID NO: 1245256 - protein, 9 aa, Homo Sapiens
AEEGHALGF

SEQ ID NO: 1245257 - protein, 9 aa, Homo Sapiens
MMLGLCYQI

SEQ ID NO: 1245258 - protein, 9 aa, Homo Sapiens
QICHKNSIN

SEQ ID NO: 1245259 - protein, 9 aa, Homo Sapiens
AEFRVFHLQ

SEQ ID NO: 1245260 - protein, 9 aa, Homo Sapiens
AFSPSTKYI

SEQ ID NO: 1245261 - protein, 9 aa, Homo Sapiens
RTPHWRLCG

SEQ ID NO: 1245262 - protein, 9 aa, Homo Sapiens
EAMARVQRA

SEQ ID NO: 1245263 - protein, 9 aa, Homo Sapiens
NEVRHIYTA

SEQ ID NO: 1245264 - protein, 9 aa, Homo Sapiens
IFSTEILLS

SEQ ID NO: 1245265 - protein, 9 aa, Homo Sapiens
VALKKYVWI

SEQ ID NO: 1245266 - protein, 9 aa, Homo Sapiens
PHSFSETLR

SEQ ID NO: 1245267 - protein, 9 aa, Homo Sapiens
INPVHYPGP

SEQ ID NO: 1245268 - protein, 9 aa, Homo Sapiens
VHFTTLGFE

SEQ ID NO: 1245269 - protein, 9 aa, Homo Sapiens
SFVGTAQHV

SEQ ID NO: 1245270 - protein, 9 aa, Homo Sapiens
SSTMRLQDP

SEQ ID NO: 1245271 - protein, 9 aa, Homo Sapiens
RKDQFVIQF

SEQ ID NO: 1245272 - protein, 9 aa, Homo Sapiens
LIVGILIAH

SEQ ID NO: 1245273 - protein, 9 aa, Homo Sapiens
IAGFQTHTT

SEQ ID NO: 1245274 - protein, 9 aa, Homo Sapiens
QGYENSGTG

SEQ ID NO: 1245275 - protein, 9 aa, Homo Sapiens
VDESEKKNP

SEQ ID NO: 1245276 - protein, 9 aa, Homo Sapiens
TVSNFSNQT

SEQ ID NO: 1245277 - protein, 9 aa, Homo Sapiens
THHISPQRL

SEQ ID NO: 1245278 - protein, 9 aa, Homo Sapiens
DLTPNPKNS

SEQ ID NO: 1245279 - protein, 9 aa, Homo Sapiens
SEHLKRDHS

SEQ ID NO: 1245280 - protein, 9 aa, Homo Sapiens
FMNLTKKQC

SEQ ID NO: 1245281 - protein, 9 aa, Homo Sapiens
TRMTKGFTT

SEQ ID NO: 1245282 - protein, 9 aa, Homo Sapiens
ADLALHTAA

SEQ ID NO: 1245283 - protein, 9 aa, Homo Sapiens
LECGVQSFF

SEQ ID NO: 1245284 - protein, 9 aa, Homo Sapiens
GILWYRVDF

SEQ ID NO: 1245285 - protein, 9 aa, Homo Sapiens
NMLQSTLKT

SEQ ID NO: 1245286 - protein, 9 aa, Homo Sapiens
KEDNGYLLE

SEQ ID NO: 1245287 - protein, 9 aa, Homo Sapiens
YFGSMGPQY

SEQ ID NO: 1245288 - protein, 9 aa, Homo Sapiens
CKFCMMKLL

SEQ ID NO: 1245289 - protein, 9 aa, Homo Sapiens
PIRRHSSNY

SEQ ID NO: 1245290 - protein, 9 aa, Homo Sapiens
WSIFMTLLY

SEQ ID NO: 1245291 - protein, 9 aa, Homo Sapiens
VHQGPRGSL

SEQ ID NO: 1245292 - protein, 9 aa, Homo Sapiens
VMCPGAGLL

SEQ ID NO: 1245293 - protein, 9 aa, Homo Sapiens
ANTRKRDIS

SEQ ID NO: 1245294 - protein, 9 aa, Homo Sapiens
VPSYTIKVS

SEQ ID NO: 1245295 - protein, 8 aa, Homo Sapiens
QPGLSPGS

SEQ ID NO: 1245296 - protein, 9 aa, Homo Sapiens
LELPRVQMD

SEQ ID NO: 1245297 - protein, 9 aa, Homo Sapiens
TVSVHPLNF

SEQ ID NO: 1245298 - protein, 9 aa, Homo Sapiens
AKNIIPMDP

SEQ ID NO: 1245299 - protein, 9 aa, Homo Sapiens
ELTNAQLHA

SEQ ID NO: 1245300 - protein, 9 aa, Homo Sapiens
VKPKTLLLD

SEQ ID NO: 1245301 - protein, 9 aa, Homo Sapiens
ARTQQEGKC

SEQ ID NO: 1245302 - protein, 9 aa, Homo Sapiens
GTETSDMVC

SEQ ID NO: 1245303 - protein, 9 aa, Homo Sapiens
PGGDMGQQT

SEQ ID NO: 1245304 - protein, 9 aa, Homo Sapiens
RIILEPDTS

SEQ ID NO: 1245305 - protein, 9 aa, Homo Sapiens
SKASKPSKG

SEQ ID NO: 1245306 - protein, 9 aa, Homo Sapiens
FLTQPGAGT

SEQ ID NO: 1245307 - protein, 9 aa, Homo Sapiens
KFVLKVDSP

SEQ ID NO: 1245308 - protein, 9 aa, Homo Sapiens
QCVLLLVLD

SEQ ID NO: 1245309 - protein, 9 aa, Homo Sapiens
RAGLRERDH

SEQ ID NO: 1245310 - protein, 9 aa, Homo Sapiens
LTTAILGAV

SEQ ID NO: 1245311 - protein, 9 aa, Homo Sapiens
DAHEFSNTY

SEQ ID NO: 1245312 - protein, 9 aa, Homo Sapiens
LDNGVCISK

SEQ ID NO: 1245313 - protein, 9 aa, Homo Sapiens
LECEEDIIP

SEQ ID NO: 1245314 - protein, 9 aa, Homo Sapiens
MNWAENGGR

SEQ ID NO: 1245315 - protein, 9 aa, Homo Sapiens
VREGSLPGN

SEQ ID NO: 1245316 - protein, 9 aa, Homo Sapiens
RVEHILKMW

SEQ ID NO: 1245317 - protein, 9 aa, Homo Sapiens
LVGYCCLEE

SEQ ID NO: 1245318 - protein, 9 aa, Homo Sapiens
IGLRVYFNL

SEQ ID NO: 1245319 - protein, 9 aa, Homo Sapiens
TIITVDRHL

SEQ ID NO: 1245320 - protein, 9 aa, Homo Sapiens
ITSPTHDPQ

SEQ ID NO: 1245321 - protein, 9 aa, Homo Sapiens
GLYHLSLEA

SEQ ID NO: 1245322 - protein, 9 aa, Homo Sapiens
PPSPSEMGS

SEQ ID NO: 1245323 - protein, 9 aa, Homo Sapiens
TRQDLWEER

SEQ ID NO: 1245324 - protein, 9 aa, Homo Sapiens
LVKSTLDAF

SEQ ID NO: 1245325 - protein, 9 aa, Homo Sapiens
EKQMHDSFS

SEQ ID NO: 1245326 - protein, 9 aa, Homo Sapiens
SYVEKKYTP

SEQ ID NO: 1245327 - protein, 9 aa, Homo Sapiens
RQILTTTDV

SEQ ID NO: 1245328 - protein, 9 aa, Homo Sapiens
LTQSPHRQT

SEQ ID NO: 1245329 - protein, 9 aa, Homo Sapiens
SPLHKRCQR

SEQ ID NO: 1245330 - protein, 9 aa, Homo Sapiens
QRGIPPSSV

SEQ ID NO: 1245331 - protein, 9 aa, Homo Sapiens
GNRGTDGYP

SEQ ID NO: 1245332 - protein, 9 aa, Homo Sapiens
EAHRVYGDI

SEQ ID NO: 1245333 - protein, 9 aa, Homo Sapiens
CPGPRHWSS

SEQ ID NO: 1245334 - protein, 9 aa, Homo Sapiens
AWDGSPDIG

SEQ ID NO: 1245335 - protein, 9 aa, Homo Sapiens
TEQSCASRL

SEQ ID NO: 1245336 - protein, 9 aa, Homo Sapiens
SGRRCRNGE

SEQ ID NO: 1245337 - protein, 9 aa, Homo Sapiens
DFRERNKGR

SEQ ID NO: 1245338 - protein, 9 aa, Homo Sapiens
EERRALRHS

SEQ ID NO: 1245339 - protein, 9 aa, Homo Sapiens
GFEFWYPVD

SEQ ID NO: 1245340 - protein, 9 aa, Homo Sapiens
AALKTSRWS

SEQ ID NO: 1245341 - protein, 9 aa, Homo Sapiens
GARVPPTRS

SEQ ID NO: 1245342 - protein, 9 aa, Homo Sapiens
RLCLVLSEL

SEQ ID NO: 1245343 - protein, 9 aa, Homo Sapiens
VPTFLRVAL

SEQ ID NO: 1245344 - protein, 9 aa, Homo Sapiens
SECGARPLT

SEQ ID NO: 1245345 - protein, 9 aa, Homo Sapiens
KRPPQRMFD

SEQ ID NO: 1245346 - protein, 9 aa, Homo Sapiens
SKPQAHGDP

SEQ ID NO: 1245347 - protein, 9 aa, Homo Sapiens
SLYNIHLQT

SEQ ID NO: 1245348 - protein, 9 aa, Homo Sapiens
KRKAPAVEV

SEQ ID NO: 1245349 - protein, 9 aa, Homo Sapiens
DGLTFQGLD

SEQ ID NO: 1245350 - protein, 9 aa, Homo Sapiens
GINEKKIAD

SEQ ID NO: 1245351 - protein, 9 aa, Homo Sapiens
MLDGHSRES

SEQ ID NO: 1245352 - protein, 9 aa, Homo Sapiens
CLRVPPLGA

SEQ ID NO: 1245353 - protein, 9 aa, Homo Sapiens
INVHIMSCN

SEQ ID NO: 1245354 - protein, 9 aa, Homo Sapiens
FEQHLLPAV

SEQ ID NO: 1245355 - protein, 9 aa, Homo Sapiens
WAGSRPQSP

SEQ ID NO: 1245356 - protein, 9 aa, Homo Sapiens
AANNGSSKG

SEQ ID NO: 1245357 - protein, 9 aa, Homo Sapiens
FIIHISHQD

SEQ ID NO: 1245358 - protein, 9 aa, Homo Sapiens
SLRSLQRSP

SEQ ID NO: 1245359 - protein, 9 aa, Homo Sapiens
LLVLSGVRA

SEQ ID NO: 1245360 - protein, 9 aa, Homo Sapiens
GVLQTHPSG

SEQ ID NO: 1245361 - protein, 9 aa, Homo Sapiens
DSKPSARHV

SEQ ID NO: 1245362 - protein, 9 aa, Homo Sapiens
SESEEDHSA

SEQ ID NO: 1245363 - protein, 9 aa, Homo Sapiens
IYPDRAWLI

SEQ ID NO: 1245364 - protein, 9 aa, Homo Sapiens
LNYHKHCAF

SEQ ID NO: 1245365 - protein, 9 aa, Homo Sapiens
TTEHIHTHF

SEQ ID NO: 1245366 - protein, 9 aa, Homo Sapiens
SMDPGGMMR

SEQ ID NO: 1245367 - protein, 9 aa, Homo Sapiens
ECDGTACGY

SEQ ID NO: 1245368 - protein, 9 aa, Homo Sapiens
TSDGEGMQI

SEQ ID NO: 1245369 - protein, 9 aa, Homo Sapiens
ILGADTFVD

SEQ ID NO: 1245370 - protein, 9 aa, Homo Sapiens
HSRDESADS

SEQ ID NO: 1245371 - protein, 9 aa, Homo Sapiens
DQPKSHYFL

SEQ ID NO: 1245372 - protein, 9 aa, Homo Sapiens
VHDSLVIFG

SEQ ID NO: 1245373 - protein, 9 aa, Homo Sapiens
HIMIQYLLS

SEQ ID NO: 1245374 - protein, 9 aa, Homo Sapiens
TVDRHLHSP

SEQ ID NO: 1245375 - protein, 9 aa, Homo Sapiens
LENANYKYH

SEQ ID NO: 1245376 - protein, 9 aa, Homo Sapiens
MCNDCGKAF

SEQ ID NO: 1245377 - protein, 9 aa, Homo Sapiens
FSGKVMQLQ

SEQ ID NO: 1245378 - protein, 9 aa, Homo Sapiens
WLAAVRCLH

SEQ ID NO: 1245379 - protein, 9 aa, Homo Sapiens
GLVISIILV

SEQ ID NO: 1245380 - protein, 9 aa, Homo Sapiens
KLGVVTPES

SEQ ID NO: 1245381 - protein, 9 aa, Homo Sapiens
NQVIVVLKD

SEQ ID NO: 1245382 - protein, 9 aa, Homo Sapiens
TTPSAATFQ

SEQ ID NO: 1245383 - protein, 9 aa, Homo Sapiens
NHEEIFPQC

SEQ ID NO: 1245384 - protein, 9 aa, Homo Sapiens
PGAHFHIES

SEQ ID NO: 1245385 - protein, 9 aa, Homo Sapiens
YVLRSTWTM

SEQ ID NO: 1245386 - protein, 9 aa, Homo Sapiens
SLPTLQPGT

SEQ ID NO: 1245387 - protein, 9 aa, Homo Sapiens
ILSMVCADP

SEQ ID NO: 1245388 - protein, 9 aa, Homo Sapiens
VVQKKSRLR

SEQ ID NO: 1245389 - protein, 9 aa, Homo Sapiens
KNEISAPFK

SEQ ID NO: 1245390 - protein, 9 aa, Homo Sapiens
EQAHRQRAV

SEQ ID NO: 1245391 - protein, 9 aa, Homo Sapiens
ENLCLESQQ

SEQ ID NO: 1245392 - protein, 9 aa, Homo Sapiens
FYSISGGGG

SEQ ID NO: 1245393 - protein, 9 aa, Homo Sapiens
FLYVRTGKA

SEQ ID NO: 1245394 - protein, 9 aa, Homo Sapiens
PARSYQGVR

SEQ ID NO: 1245395 - protein, 9 aa, Homo Sapiens
DALDLGLDE

SEQ ID NO: 1245396 - protein, 9 aa, Homo Sapiens
ALGFQTFLN

SEQ ID NO: 1245397 - protein, 9 aa, Homo Sapiens
AIKGMQRFA

SEQ ID NO: 1245398 - protein, 9 aa, Homo Sapiens
SAPLQLMIM

SEQ ID NO: 1245399 - protein, 9 aa, Homo Sapiens
YAITFPYPY

SEQ ID NO: 1245400 - protein, 9 aa, Homo Sapiens
ENKSKFGVN

SEQ ID NO: 1245401 - protein, 9 aa, Homo Sapiens
DVTCGQLMN

SEQ ID NO: 1245402 - protein, 9 aa, Homo Sapiens
KKNVMRVWF

SEQ ID NO: 1245403 - protein, 9 aa, Homo Sapiens
LLNTCMLKG

SEQ ID NO: 1245404 - protein, 9 aa, Homo Sapiens
LKRSEADKL

SEQ ID NO: 1245405 - protein, 9 aa, Homo Sapiens
RAELLVFLT

SEQ ID NO: 1245406 - protein, 9 aa, Homo Sapiens
EKHLLGEHL

SEQ ID NO: 1245407 - protein, 9 aa, Homo Sapiens
NIDLLLEAF

SEQ ID NO: 1245408 - protein, 9 aa, Homo Sapiens
PKELGRDRQ

SEQ ID NO: 1245409 - protein, 9 aa, Homo Sapiens
LSGSDSDEP

SEQ ID NO: 1245410 - protein, 9 aa, Homo Sapiens
PEGVASFET

SEQ ID NO: 1245411 - protein, 9 aa, Homo Sapiens
GPGGGRGGP

SEQ ID NO: 1245412 - protein, 9 aa, Homo Sapiens
ALRPTTGTL

SEQ ID NO: 1245413 - protein, 9 aa, Homo Sapiens
LWWREGTLA

SEQ ID NO: 1245414 - protein, 9 aa, Homo Sapiens
PQSQTHPLV

SEQ ID NO: 1245415 - protein, 9 aa, Homo Sapiens
DWEAFATSL

SEQ ID NO: 1245416 - protein, 9 aa, Homo Sapiens
VITPDNMCM

SEQ ID NO: 1245417 - protein, 9 aa, Homo Sapiens
YDGLGWRVS

SEQ ID NO: 1245418 - protein, 9 aa, Homo Sapiens
TDVRKIMNC

SEQ ID NO: 1245419 - protein, 9 aa, Homo Sapiens
KGGSNVGEC

SEQ ID NO: 1245420 - protein, 9 aa, Homo Sapiens
SSARAENTT

SEQ ID NO: 1245421 - protein, 9 aa, Homo Sapiens
LQNLFWQIL

SEQ ID NO: 1245422 - protein, 9 aa, Homo Sapiens
RQCEYLLDM

SEQ ID NO: 1245423 - protein, 9 aa, Homo Sapiens
NIARLNTIL

SEQ ID NO: 1245424 - protein, 9 aa, Homo Sapiens
PGLTKCVKK

SEQ ID NO: 1245425 - protein, 9 aa, Homo Sapiens
AVNFAVLKL

SEQ ID NO: 1245426 - protein, 9 aa, Homo Sapiens
LKEMLKEIK

SEQ ID NO: 1245427 - protein, 9 aa, Homo Sapiens
KEKFTASKD

SEQ ID NO: 1245428 - protein, 9 aa, Homo Sapiens
KCPLDVTDS

SEQ ID NO: 1245429 - protein, 9 aa, Homo Sapiens
HLSPCSSIG

SEQ ID NO: 1245430 - protein, 9 aa, Homo Sapiens
TQYCTNYPM

SEQ ID NO: 1245431 - protein, 9 aa, Homo Sapiens
GDSVEACPP

SEQ ID NO: 1245432 - protein, 9 aa, Homo Sapiens
GTKPLLYSQ

SEQ ID NO: 1245433 - protein, 9 aa, Homo Sapiens
ISYFGCMNA

SEQ ID NO: 1245434 - protein, 9 aa, Homo Sapiens
KNLPSKVLD

SEQ ID NO: 1245435 - protein, 9 aa, Homo Sapiens
STMRLQDPG

SEQ ID NO: 1245436 - protein, 9 aa, Homo Sapiens
LRLDRYHHH

SEQ ID NO: 1245437 - protein, 9 aa, Homo Sapiens
VYLSCRRWK

SEQ ID NO: 1245438 - protein, 9 aa, Homo Sapiens
IIHMWPMAR

SEQ ID NO: 1245439 - protein, 9 aa, Homo Sapiens
NGFQRPAIY

SEQ ID NO: 1245440 - protein, 9 aa, Homo Sapiens
CEQGFKGYE

SEQ ID NO: 1245441 - protein, 9 aa, Homo Sapiens
QCRDMPGHA

SEQ ID NO: 1245442 - protein, 9 aa, Homo Sapiens
KEHVHLLSL

SEQ ID NO: 1245443 - protein, 9 aa, Homo Sapiens
HQLATSYFI

SEQ ID NO: 1245444 - protein, 9 aa, Homo Sapiens
TENKSKFGV

SEQ ID NO: 1245445 - protein, 9 aa, Homo Sapiens
QELMRLFGI

SEQ ID NO: 1245446 - protein, 9 aa, Homo Sapiens
TFGNAPGFY

SEQ ID NO: 1245447 - protein, 9 aa, Homo Sapiens
PLPSPGCVL

SEQ ID NO: 1245448 - protein, 9 aa, Homo Sapiens
SLPGVVGGL

SEQ ID NO: 1245449 - protein, 9 aa, Homo Sapiens
YHTLYRYFV

SEQ ID NO: 1245450 - protein, 9 aa, Homo Sapiens
RTYHIDDVD

SEQ ID NO: 1245451 - protein, 9 aa, Homo Sapiens
MCMEACGTM

SEQ ID NO: 1245452 - protein, 9 aa, Homo Sapiens
SESSAQPSE

SEQ ID NO: 1245453 - protein, 9 aa, Homo Sapiens
DHYPVFLDK

SEQ ID NO: 1245454 - protein, 9 aa, Homo Sapiens
QILHVPNVV

SEQ ID NO: 1245455 - protein, 9 aa, Homo Sapiens
SDMVCKPCA

SEQ ID NO: 1245456 - protein, 9 aa, Homo Sapiens
YDYFWWEHL

SEQ ID NO: 1245457 - protein, 9 aa, Homo Sapiens
QKAKMEKFS

SEQ ID NO: 1245458 - protein, 9 aa, Homo Sapiens
KMCYHMPVK

SEQ ID NO: 1245459 - protein, 9 aa, Homo Sapiens
QNIHRKTTS

SEQ ID NO: 1245460 - protein, 9 aa, Homo Sapiens
NDFLQLLLP

SEQ ID NO: 1245461 - protein, 9 aa, Homo Sapiens
KGIGLSIVG

SEQ ID NO: 1245462 - protein, 9 aa, Homo Sapiens
SWRVASTQC

SEQ ID NO: 1245463 - protein, 9 aa, Homo Sapiens
KHNPTESIM

SEQ ID NO: 1245464 - protein, 9 aa, Homo Sapiens
WMHPCCTIK

SEQ ID NO: 1245465 - protein, 9 aa, Homo Sapiens
CNVGYPALK

SEQ ID NO: 1245466 - protein, 9 aa, Homo Sapiens
QVTPQTGPQ

SEQ ID NO: 1245467 - protein, 9 aa, Homo Sapiens
TKPVPWVEK

SEQ ID NO: 1245468 - protein, 9 aa, Homo Sapiens
PVTFDCDCA

SEQ ID NO: 1245469 - protein, 9 aa, Homo Sapiens
HVYENGGSQ

SEQ ID NO: 1245470 - protein, 9 aa, Homo Sapiens
QTRMLLANA

SEQ ID NO: 1245471 - protein, 9 aa, Homo Sapiens
GGSEEMDWL

SEQ ID NO: 1245472 - protein, 9 aa, Homo Sapiens
FLPLIYQGH

SEQ ID NO: 1245473 - protein, 9 aa, Homo Sapiens
LETWRQLRR

SEQ ID NO: 1245474 - protein, 9 aa, Homo Sapiens
IFDLLHKNH

SEQ ID NO: 1245475 - protein, 9 aa, Homo Sapiens
LVKEELNTI

SEQ ID NO: 1245476 - protein, 9 aa, Homo Sapiens
AHWDAHRRL

SEQ ID NO: 1245477 - protein, 9 aa, Homo Sapiens
TLLLQVRQD

SEQ ID NO: 1245478 - protein, 9 aa, Homo Sapiens
CHENMIRQT

SEQ ID NO: 1245479 - protein, 9 aa, Homo Sapiens
FQRHFAEWC

SEQ ID NO: 1245480 - protein, 9 aa, Homo Sapiens
CECELLWKV

SEQ ID NO: 1245481 - protein, 9 aa, Homo Sapiens
ENDFSKHIL

SEQ ID NO: 1245482 - protein, 9 aa, Homo Sapiens
SLASCASVA

SEQ ID NO: 1245483 - protein, 9 aa, Homo Sapiens
RPGPHRLVG

SEQ ID NO: 1245484 - protein, 9 aa, Homo Sapiens
CKTGPGTPR

SEQ ID NO: 1245485 - protein, 9 aa, Homo Sapiens
HHIDSVYVL

SEQ ID NO: 1245486 - protein, 9 aa, Homo Sapiens
FLSVRPVSS

SEQ ID NO: 1245487 - protein, 9 aa, Homo Sapiens
GPRPLLEFA

SEQ ID NO: 1245488 - protein, 9 aa, Homo Sapiens
PRLLSRVQT

SEQ ID NO: 1245489 - protein, 9 aa, Homo Sapiens
TADHSLLLY

SEQ ID NO: 1245490 - protein, 9 aa, Homo Sapiens
ISWGGPRKA

SEQ ID NO: 1245491 - protein, 9 aa, Homo Sapiens
LQALTRSNS

SEQ ID NO: 1245492 - protein, 9 aa, Homo Sapiens
GSPHLLCKA

SEQ ID NO: 1245493 - protein, 9 aa, Homo Sapiens
MIMVDDSKT

SEQ ID NO: 1245494 - protein, 9 aa, Homo Sapiens
EEQAKAKDA

SEQ ID NO: 1245495 - protein, 9 aa, Homo Sapiens
VLCVTVSIE

SEQ ID NO: 1245496 - protein, 9 aa, Homo Sapiens
FRVLSSSWL

SEQ ID NO: 1245497 - protein, 9 aa, Homo Sapiens
KDSGHDSTS

SEQ ID NO: 1245498 - protein, 9 aa, Homo Sapiens
QSRRRMKHV

SEQ ID NO: 1245499 - protein, 9 aa, Homo Sapiens
YPTMLVTFT

SEQ ID NO: 1245500 - protein, 9 aa, Homo Sapiens
LVISKETDA

SEQ ID NO: 1245501 - protein, 9 aa, Homo Sapiens
ETHDDCLQA

SEQ ID NO: 1245502 - protein, 9 aa, Homo Sapiens
GDTCQSDMD

SEQ ID NO: 1245503 - protein, 9 aa, Homo Sapiens
DHGVFLNVS

SEQ ID NO: 1245504 - protein, 9 aa, Homo Sapiens
KRSEADKLT

SEQ ID NO: 1245505 - protein, 9 aa, Homo Sapiens
QAGQQFAHQ

SEQ ID NO: 1245506 - protein, 9 aa, Homo Sapiens
SCALQERAE

SEQ ID NO: 1245507 - protein, 9 aa, Homo Sapiens
DPKDALFRE

SEQ ID NO: 1245508 - protein, 9 aa, Homo Sapiens
THVLPGGQL

SEQ ID NO: 1245509 - protein, 9 aa, Homo Sapiens
HLVCTCPSM

SEQ ID NO: 1245510 - protein, 9 aa, Homo Sapiens
QFKKVSEEK

SEQ ID NO: 1245511 - protein, 9 aa, Homo Sapiens
GSLNGTNMT

SEQ ID NO: 1245512 - protein, 9 aa, Homo Sapiens
VLLRFPQHV

SEQ ID NO: 1245513 - protein, 9 aa, Homo Sapiens
KTLKEISHN

SEQ ID NO: 1245514 - protein, 9 aa, Homo Sapiens
KLFPQVISY

SEQ ID NO: 1245515 - protein, 9 aa, Homo Sapiens
MEVLVKGLR

SEQ ID NO: 1245516 - protein, 9 aa, Homo Sapiens
STSTVAIPA

SEQ ID NO: 1245517 - protein, 9 aa, Homo Sapiens
GTKFETVYQ

SEQ ID NO: 1245518 - protein, 9 aa, Homo Sapiens
IAIFLVLVS

SEQ ID NO: 1245519 - protein, 9 aa, Homo Sapiens
TLIYYFVFD

SEQ ID NO: 1245520 - protein, 9 aa, Homo Sapiens
NVQQARSPT

SEQ ID NO: 1245521 - protein, 9 aa, Homo Sapiens
GENMNVTNV

SEQ ID NO: 1245522 - protein, 9 aa, Homo Sapiens
KKYIKAALY

SEQ ID NO: 1245523 - protein, 9 aa, Homo Sapiens
WTFAHRPTE

SEQ ID NO: 1245524 - protein, 9 aa, Homo Sapiens
SLEVTAMGT

SEQ ID NO: 1245525 - protein, 9 aa, Homo Sapiens
RLQCEIRLT

SEQ ID NO: 1245526 - protein, 9 aa, Homo Sapiens
ENQTMITEF

SEQ ID NO: 1245527 - protein, 9 aa, Homo Sapiens
PHQKDPVLD

SEQ ID NO: 1245528 - protein, 9 aa, Homo Sapiens
IPFYAGMDM

SEQ ID NO: 1245529 - protein, 9 aa, Homo Sapiens
SFNHVSNLV

SEQ ID NO: 1245530 - protein, 9 aa, Homo Sapiens
PSECHGFEA

SEQ ID NO: 1245531 - protein, 9 aa, Homo Sapiens
AFQLQQFEK

SEQ ID NO: 1245532 - protein, 9 aa, Homo Sapiens
QHKEVEFLQ

SEQ ID NO: 1245533 - protein, 9 aa, Homo Sapiens
SEASVLAAE

SEQ ID NO: 1245534 - protein, 9 aa, Homo Sapiens
LISDIETVK

SEQ ID NO: 1245535 - protein, 9 aa, Homo Sapiens
SKMFPIPAG

SEQ ID NO: 1245536 - protein, 9 aa, Homo Sapiens
LGQSTRAVY

SEQ ID NO: 1245537 - protein, 9 aa, Homo Sapiens
DLCTKIQRD

SEQ ID NO: 1245538 - protein, 9 aa, Homo Sapiens
LDGHSRESM

SEQ ID NO: 1245539 - protein, 9 aa, Homo Sapiens
FKKISSLDQ

SEQ ID NO: 1245540 - protein, 9 aa, Homo Sapiens
TFEFVVVSL

SEQ ID NO: 1245541 - protein, 9 aa, Homo Sapiens
EHLWLPVNL

SEQ ID NO: 1245542 - protein, 9 aa, Homo Sapiens
ELVQRHHIR

SEQ ID NO: 1245543 - protein, 9 aa, Homo Sapiens
LSFHVTWIT

SEQ ID NO: 1245544 - protein, 9 aa, Homo Sapiens
FTKLPIGTW

SEQ ID NO: 1245545 - protein, 9 aa, Homo Sapiens
SASNTQGCQ

SEQ ID NO: 1245546 - protein, 9 aa, Homo Sapiens
QSLVNVFLC

SEQ ID NO: 1245547 - protein, 9 aa, Homo Sapiens
KTVLTIIKW

SEQ ID NO: 1245548 - protein, 9 aa, Homo Sapiens
ATLVQYIPF

SEQ ID NO: 1245549 - protein, 9 aa, Homo Sapiens
TTHLKWFGL

SEQ ID NO: 1245550 - protein, 9 aa, Homo Sapiens
APAASQEAT

SEQ ID NO: 1245551 - protein, 9 aa, Homo Sapiens
LNGVTVKTD

SEQ ID NO: 1245552 - protein, 9 aa, Homo Sapiens
EVEEPESLR

SEQ ID NO: 1245553 - protein, 9 aa, Homo Sapiens
HLHPEGLGH

SEQ ID NO: 1245554 - protein, 9 aa, Homo Sapiens
SRGEHDLIE

SEQ ID NO: 1245555 - protein, 9 aa, Homo Sapiens
SINSHEVDY

SEQ ID NO: 1245556 - protein, 9 aa, Homo Sapiens
EMELLKEDV

SEQ ID NO: 1245557 - protein, 9 aa, Homo Sapiens
MDYCKKNGE

SEQ ID NO: 1245558 - protein, 9 aa, Homo Sapiens
RIADDTFSH

SEQ ID NO: 1245559 - protein, 9 aa, Homo Sapiens
SPQPGFLAR

SEQ ID NO: 1245560 - protein, 9 aa, Homo Sapiens
LPKTDCGEG

SEQ ID NO: 1245561 - protein, 9 aa, Homo Sapiens
VTKDLEMRV

SEQ ID NO: 1245562 - protein, 9 aa, Homo Sapiens
SPASAPPSI

SEQ ID NO: 1245563 - protein, 9 aa, Homo Sapiens
AGQERFRSM

SEQ ID NO: 1245564 - protein, 9 aa, Homo Sapiens
ANVVFFPCC

SEQ ID NO: 1245565 - protein, 9 aa, Homo Sapiens
ISGIALSFL

SEQ ID NO: 1245566 - protein, 9 aa, Homo Sapiens
DEFDDWEDD

SEQ ID NO: 1245567 - protein, 9 aa, Homo Sapiens
TFARCSLED

SEQ ID NO: 1245568 - protein, 9 aa, Homo Sapiens
QDTQNALRR

SEQ ID NO: 1245569 - protein, 9 aa, Homo Sapiens
PGSSNQIFT

SEQ ID NO: 1245570 - protein, 9 aa, Homo Sapiens
TIQGQLTHL

SEQ ID NO: 1245571 - protein, 9 aa, Homo Sapiens
SPPSGCPMY

SEQ ID NO: 1245572 - protein, 9 aa, Homo Sapiens
AGQILLRDQ

SEQ ID NO: 1245573 - protein, 9 aa, Homo Sapiens
IYDVGPTTI

SEQ ID NO: 1245574 - protein, 9 aa, Homo Sapiens
VHQEEKHKV

SEQ ID NO: 1245575 - protein, 9 aa, Homo Sapiens
LVTLLLTLL

SEQ ID NO: 1245576 - protein, 9 aa, Homo Sapiens
KYDTSAKKW

SEQ ID NO: 1245577 - protein, 9 aa, Homo Sapiens
VKPSSPVRL

SEQ ID NO: 1245578 - protein, 9 aa, Homo Sapiens
VVAKHPALC

SEQ ID NO: 1245579 - protein, 9 aa, Homo Sapiens
HFTVLTATG

SEQ ID NO: 1245580 - protein, 9 aa, Homo Sapiens
ATIAEKLDL

SEQ ID NO: 1245581 - protein, 9 aa, Homo Sapiens
VSMDVNPSW

SEQ ID NO: 1245582 - protein, 9 aa, Homo Sapiens
QVFHLNTLK

SEQ ID NO: 1245583 - protein, 9 aa, Homo Sapiens
ACLISKQLA

SEQ ID NO: 1245584 - protein, 9 aa, Homo Sapiens
KLYEEDDIF

SEQ ID NO: 1245585 - protein, 9 aa, Homo Sapiens
SIGTNEGLK

SEQ ID NO: 1245586 - protein, 9 aa, Homo Sapiens
IYLQNSSVK

SEQ ID NO: 1245587 - protein, 9 aa, Homo Sapiens
NTTKEVIML

SEQ ID NO: 1245588 - protein, 9 aa, Homo Sapiens
EFERLHRLL

SEQ ID NO: 1245589 - protein, 9 aa, Homo Sapiens
NSFPVPVST

SEQ ID NO: 1245590 - protein, 9 aa, Homo Sapiens
GEQLYLDPG

SEQ ID NO: 1245591 - protein, 9 aa, Homo Sapiens
TEEKRHRMR

SEQ ID NO: 1245592 - protein, 9 aa, Homo Sapiens
VYLTLTNKF

SEQ ID NO: 1245593 - protein, 9 aa, Homo Sapiens
LHLIVENVT

SEQ ID NO: 1245594 - protein, 9 aa, Homo Sapiens
VIHAEHVHT

SEQ ID NO: 1245595 - protein, 9 aa, Homo Sapiens
MSILMGLDA

SEQ ID NO: 1245596 - protein, 9 aa, Homo Sapiens
ALDLVRQYD

SEQ ID NO: 1245597 - protein, 9 aa, Homo Sapiens
NEKAKAHIL

SEQ ID NO: 1245598 - protein, 9 aa, Homo Sapiens
TKLTFKLTR

SEQ ID NO: 1245599 - protein, 9 aa, Homo Sapiens
LGSGQAVLG

SEQ ID NO: 1245600 - protein, 9 aa, Homo Sapiens
EKKLTSLPE

SEQ ID NO: 1245601 - protein, 9 aa, Homo Sapiens
PRPPALSLR

SEQ ID NO: 1245602 - protein, 9 aa, Homo Sapiens
WVVVSYVVA

SEQ ID NO: 1245603 - protein, 9 aa, Homo Sapiens
EQEQYIAIQ

SEQ ID NO: 1245604 - protein, 9 aa, Homo Sapiens
RNEIACLPQ

SEQ ID NO: 1245605 - protein, 9 aa, Homo Sapiens
KTTRNVNSS

SEQ ID NO: 1245606 - protein, 9 aa, Homo Sapiens
YSPYVSPRH

SEQ ID NO: 1245607 - protein, 9 aa, Homo Sapiens
CVRTVCTHE

SEQ ID NO: 1245608 - protein, 9 aa, Homo Sapiens
AVQMSDQQL

SEQ ID NO: 1245609 - protein, 9 aa, Homo Sapiens
TEAFTKNIF

SEQ ID NO: 1245610 - protein, 9 aa, Homo Sapiens
GDVEAVYPA

SEQ ID NO: 1245611 - protein, 9 aa, Homo Sapiens
DETLFGLKN

SEQ ID NO: 1245612 - protein, 9 aa, Homo Sapiens
QILAFTGLN

SEQ ID NO: 1245613 - protein, 9 aa, Homo Sapiens
PRVCITVDS

SEQ ID NO: 1245614 - protein, 9 aa, Homo Sapiens
AGAKHNTSI

SEQ ID NO: 1245615 - protein, 9 aa, Homo Sapiens
FLVLTQKTY

SEQ ID NO: 1245616 - protein, 9 aa, Homo Sapiens
IVCLKKHTA

SEQ ID NO: 1245617 - protein, 9 aa, Homo Sapiens
GPTLHLHDA

SEQ ID NO: 1245618 - protein, 9 aa, Homo Sapiens
SRRSQHLTR

SEQ ID NO: 1245619 - protein, 9 aa, Homo Sapiens
HRHTQAYTQ

SEQ ID NO: 1245620 - protein, 9 aa, Homo Sapiens
QQFEKLKFS

SEQ ID NO: 1245621 - protein, 9 aa, Homo Sapiens
QIVVQVNNG

SEQ ID NO: 1245622 - protein, 9 aa, Homo Sapiens
KNGSNRHEI

SEQ ID NO: 1245623 - protein, 9 aa, Homo Sapiens
VVFALRANT

SEQ ID NO: 1245624 - protein, 9 aa, Homo Sapiens
ISDEDSLVK

SEQ ID NO: 1245625 - protein, 9 aa, Homo Sapiens
CKPDIMLPL

SEQ ID NO: 1245626 - protein, 9 aa, Homo Sapiens
MGLGRRGAQ

SEQ ID NO: 1245627 - protein, 9 aa, Homo Sapiens
AEDKERPFH

SEQ ID NO: 1245628 - protein, 9 aa, Homo Sapiens
ELMPFLQNL

SEQ ID NO: 1245629 - protein, 9 aa, Homo Sapiens
MLQNLFWQI

SEQ ID NO: 1245630 - protein, 9 aa, Homo Sapiens
PGHFRHGAA

SEQ ID NO: 1245631 - protein, 9 aa, Homo Sapiens
LCPHPSKGE

SEQ ID NO: 1245632 - protein, 9 aa, Homo Sapiens
EWLVPDIQG

SEQ ID NO: 1245633 - protein, 9 aa, Homo Sapiens
LAEYMFDKL

SEQ ID NO: 1245634 - protein, 9 aa, Homo Sapiens
GCGEQVLSL

SEQ ID NO: 1245635 - protein, 9 aa, Homo Sapiens
LTSKAQDVQ

SEQ ID NO: 1245636 - protein, 9 aa, Homo Sapiens
IQVKVEEVG

SEQ ID NO: 1245637 - protein, 9 aa, Homo Sapiens
VLTASINGS

SEQ ID NO: 1245638 - protein, 9 aa, Homo Sapiens
ILRHGIGLS

SEQ ID NO: 1245639 - protein, 9 aa, Homo Sapiens
VLMITGSLI

SEQ ID NO: 1245640 - protein, 9 aa, Homo Sapiens
IKAAAKAKL

SEQ ID NO: 1245641 - protein, 9 aa, Homo Sapiens
SPASAPAPI

SEQ ID NO: 1245642 - protein, 9 aa, Homo Sapiens
VWNDMDKYS

SEQ ID NO: 1245643 - protein, 9 aa, Homo Sapiens
ETFWCERVM

SEQ ID NO: 1245644 - protein, 9 aa, Homo Sapiens
CYATDGGCI

SEQ ID NO: 1245645 - protein, 9 aa, Homo Sapiens
RFPDNDSLV

SEQ ID NO: 1245646 - protein, 9 aa, Homo Sapiens
TLSNRYMQV

SEQ ID NO: 1245647 - protein, 9 aa, Homo Sapiens
YYRGEGTHD

SEQ ID NO: 1245648 - protein, 9 aa, Homo Sapiens
RLPRRSCCS

SEQ ID NO: 1245649 - protein, 9 aa, Homo Sapiens
IAWGHAFVL

SEQ ID NO: 1245650 - protein, 9 aa, Homo Sapiens
TQIPLDLLP

SEQ ID NO: 1245651 - protein, 9 aa, Homo Sapiens
LGASAPCGA

SEQ ID NO: 1245652 - protein, 9 aa, Homo Sapiens
QKKTLIGTV

SEQ ID NO: 1245653 - protein, 9 aa, Homo Sapiens
DIFPQDVPV

SEQ ID NO: 1245654 - protein, 9 aa, Homo Sapiens
CHLVDLFRS

SEQ ID NO: 1245655 - protein, 9 aa, Homo Sapiens
NRYWRRGTF

SEQ ID NO: 1245656 - protein, 9 aa, Homo Sapiens
SLPSYKAGD

SEQ ID NO: 1245657 - protein, 9 aa, Homo Sapiens
DGMIIDNGV

SEQ ID NO: 1245658 - protein, 9 aa, Homo Sapiens
NGEKEDHFL

SEQ ID NO: 1245659 - protein, 9 aa, Homo Sapiens
KVTGLGMWG

SEQ ID NO: 1245660 - protein, 9 aa, Homo Sapiens
NTCFVDVVA

SEQ ID NO: 1245661 - protein, 9 aa, Homo Sapiens
LQGYRFTAD

SEQ ID NO: 1245662 - protein, 9 aa, Homo Sapiens
KRFEKLMKI

SEQ ID NO: 1245663 - protein, 9 aa, Homo Sapiens
QDLEELAVN

SEQ ID NO: 1245664 - protein, 9 aa, Homo Sapiens
YVTALFSVF

SEQ ID NO: 1245665 - protein, 9 aa, Homo Sapiens
IGEFRSNVD

SEQ ID NO: 1245666 - protein, 9 aa, Homo Sapiens
RRVLAEPNR

SEQ ID NO: 1245667 - protein, 9 aa, Homo Sapiens
RSFCKTHAI

SEQ ID NO: 1245668 - protein, 9 aa, Homo Sapiens
DNSDYIEQE

SEQ ID NO: 1245669 - protein, 9 aa, Homo Sapiens
AILTCIVIP

SEQ ID NO: 1245670 - protein, 9 aa, Homo Sapiens
RTSQEPASS

SEQ ID NO: 1245671 - protein, 9 aa, Homo Sapiens
KPIITPSEA

SEQ ID NO: 1245672 - protein, 9 aa, Homo Sapiens
NTQYENISI

SEQ ID NO: 1245673 - protein, 9 aa, Homo Sapiens
EMLIKPKEL

SEQ ID NO: 1245674 - protein, 9 aa, Homo Sapiens
ILDCLYGPI

SEQ ID NO: 1245675 - protein, 9 aa, Homo Sapiens
VPSSFYVKH

SEQ ID NO: 1245676 - protein, 9 aa, Homo Sapiens
SLVLSPAQV

SEQ ID NO: 1245677 - protein, 9 aa, Homo Sapiens
PDELGCQGH

SEQ ID NO: 1245678 - protein, 9 aa, Homo Sapiens
RETEKLSAK

SEQ ID NO: 1245679 - protein, 9 aa, Homo Sapiens
TSILRVKAA

SEQ ID NO: 1245680 - protein, 9 aa, Homo Sapiens
VESSPCQTT

SEQ ID NO: 1245681 - protein, 9 aa, Homo Sapiens
SKKGLNQRF

SEQ ID NO: 1245682 - protein, 9 aa, Homo Sapiens
CRNWRKSGP

SEQ ID NO: 1245683 - protein, 9 aa, Homo Sapiens
CRRSLDSLD

SEQ ID NO: 1245684 - protein, 9 aa, Homo Sapiens
VVFLVQDDT

SEQ ID NO: 1245685 - protein, 9 aa, Homo Sapiens
GTPSSSRNA

SEQ ID NO: 1245686 - protein, 9 aa, Homo Sapiens
INAELSLDF

SEQ ID NO: 1245687 - protein, 9 aa, Homo Sapiens
EVEWDYYPD

SEQ ID NO: 1245688 - protein, 9 aa, Homo Sapiens
RDAMYQEGL

SEQ ID NO: 1245689 - protein, 9 aa, Homo Sapiens
ELHNPKAIS

SEQ ID NO: 1245690 - protein, 9 aa, Homo Sapiens
NCTITLLKN

SEQ ID NO: 1245691 - protein, 9 aa, Homo Sapiens
IRQQDLKGF

SEQ ID NO: 1245692 - protein, 9 aa, Homo Sapiens
DDVCVNPYH

SEQ ID NO: 1245693 - protein, 9 aa, Homo Sapiens
NNADIVQAK

SEQ ID NO: 1245694 - protein, 9 aa, Homo Sapiens
LIACTVTTK

SEQ ID NO: 1245695 - protein, 9 aa, Homo Sapiens
DSSEVGPIF

SEQ ID NO: 1245696 - protein, 9 aa, Homo Sapiens
TCLQSSVNR

SEQ ID NO: 1245697 - protein, 9 aa, Homo Sapiens
SMTDFLLET

SEQ ID NO: 1245698 - protein, 9 aa, Homo Sapiens
DLEVNYLTK

SEQ ID NO: 1245699 - protein, 9 aa, Homo Sapiens
TFHITSAAL

SEQ ID NO: 1245700 - protein, 9 aa, Homo Sapiens
VPIYEGYTL

SEQ ID NO: 1245701 - protein, 9 aa, Homo Sapiens
NGVALEELI

SEQ ID NO: 1245702 - protein, 9 aa, Homo Sapiens
GPRLQQMWL

SEQ ID NO: 1245703 - protein, 9 aa, Homo Sapiens
HQAEGAVYP

SEQ ID NO: 1245704 - protein, 9 aa, Homo Sapiens
ELEMTGIDL

SEQ ID NO: 1245705 - protein, 9 aa, Homo Sapiens
AEATALYLA

SEQ ID NO: 1245706 - protein, 9 aa, Homo Sapiens
FCDLAVCKK

SEQ ID NO: 1245707 - protein, 9 aa, Homo Sapiens
LALGWVFIP

SEQ ID NO: 1245708 - protein, 9 aa, Homo Sapiens
ALERSEALL

SEQ ID NO: 1245709 - protein, 9 aa, Homo Sapiens
PGRGSNALH

SEQ ID NO: 1245710 - protein, 9 aa, Homo Sapiens
DLYMLNPCN

SEQ ID NO: 1245711 - protein, 9 aa, Homo Sapiens
TKPLKFQET

SEQ ID NO: 1245712 - protein, 9 aa, Homo Sapiens
LQLPLRGSA

SEQ ID NO: 1245713 - protein, 9 aa, Homo Sapiens
EETAKPKDI

SEQ ID NO: 1245714 - protein, 9 aa, Homo Sapiens
GGGWIIFQR

SEQ ID NO: 1245715 - protein, 9 aa, Homo Sapiens
EYGVMCVRN

SEQ ID NO: 1245716 - protein, 9 aa, Homo Sapiens
AHQIYVLQV

SEQ ID NO: 1245717 - protein, 9 aa, Homo Sapiens
CKIGSLKTL

SEQ ID NO: 1245718 - protein, 9 aa, Homo Sapiens
RLEQGQQCL

SEQ ID NO: 1245719 - protein, 9 aa, Homo Sapiens
LLPGWGQWH

SEQ ID NO: 1245720 - protein, 9 aa, Homo Sapiens
LPLKKRHTE

SEQ ID NO: 1245721 - protein, 9 aa, Homo Sapiens
QGRHPVRVP

SEQ ID NO: 1245722 - protein, 9 aa, Homo Sapiens
EHCLLELQY

SEQ ID NO: 1245723 - protein, 9 aa, Homo Sapiens
MMMDESVQH

SEQ ID NO: 1245724 - protein, 9 aa, Homo Sapiens
KTTFINGSA

SEQ ID NO: 1245725 - protein, 9 aa, Homo Sapiens
VCCAECLDS

SEQ ID NO: 1245726 - protein, 9 aa, Homo Sapiens
SPDKLKNIF

SEQ ID NO: 1245727 - protein, 9 aa, Homo Sapiens
VARSLGERT

SEQ ID NO: 1245728 - protein, 9 aa, Homo Sapiens
VRVQKIGNN

SEQ ID NO: 1245729 - protein, 9 aa, Homo Sapiens
VGVRVESNS

SEQ ID NO: 1245730 - protein, 9 aa, Homo Sapiens
HRRHREELG

SEQ ID NO: 1245731 - protein, 9 aa, Homo Sapiens
SVLLQHLHV

SEQ ID NO: 1245732 - protein, 9 aa, Homo Sapiens
CSSAHLLYF

SEQ ID NO: 1245733 - protein, 9 aa, Homo Sapiens
GAHLRLRLD

SEQ ID NO: 1245734 - protein, 9 aa, Homo Sapiens
AADRAAIIS

SEQ ID NO: 1245735 - protein, 9 aa, Homo Sapiens
GHEHYENGA

SEQ ID NO: 1245736 - protein, 9 aa, Homo Sapiens
VRAPAANLE

SEQ ID NO: 1245737 - protein, 9 aa, Homo Sapiens
SNNAEQSAA

SEQ ID NO: 1245738 - protein, 9 aa, Homo Sapiens
PFIDSKYDV

SEQ ID NO: 1245739 - protein, 9 aa, Homo Sapiens
SVAVHRLLV

SEQ ID NO: 1245740 - protein, 9 aa, Homo Sapiens
LCHENMIRQ

SEQ ID NO: 1245741 - protein, 9 aa, Homo Sapiens
EKKTARSHR

SEQ ID NO: 1245742 - protein, 9 aa, Homo Sapiens
FPRRPLSTP

SEQ ID NO: 1245743 - protein, 9 aa, Homo Sapiens
RTPPNRTIF

SEQ ID NO: 1245744 - protein, 9 aa, Homo Sapiens
MGNLEDTET

SEQ ID NO: 1245745 - protein, 9 aa, Homo Sapiens
LKRFRKSEG

SEQ ID NO: 1245746 - protein, 9 aa, Homo Sapiens
TVSFLLQES

SEQ ID NO: 1245747 - protein, 9 aa, Homo Sapiens
LVATTVCCY

SEQ ID NO: 1245748 - protein, 9 aa, Homo Sapiens
ETHHRVTLL

SEQ ID NO: 1245749 - protein, 9 aa, Homo Sapiens
GSGDPDSIR

SEQ ID NO: 1245750 - protein, 9 aa, Homo Sapiens
SCKGNITHG

SEQ ID NO: 1245751 - protein, 9 aa, Homo Sapiens
LFRENFSVL

SEQ ID NO: 1245752 - protein, 9 aa, Homo Sapiens
FCDDILYPN

SEQ ID NO: 1245753 - protein, 9 aa, Homo Sapiens
KADLLKRYT

SEQ ID NO: 1245754 - protein, 9 aa, Homo Sapiens
VGVDGAEKR

SEQ ID NO: 1245755 - protein, 9 aa, Homo Sapiens
APYQHQLLE

SEQ ID NO: 1245756 - protein, 9 aa, Homo Sapiens
SSQTPNPVD

SEQ ID NO: 1245757 - protein, 9 aa, Homo Sapiens
QHCSSLAQH

SEQ ID NO: 1245758 - protein, 9 aa, Homo Sapiens
LVIFGPVLD

SEQ ID NO: 1245759 - protein, 9 aa, Homo Sapiens
MIRVNSMSI

SEQ ID NO: 1245760 - protein, 9 aa, Homo Sapiens
SMSEITTNR

SEQ ID NO: 1245761 - protein, 9 aa, Homo Sapiens
RNHQGTLPP

SEQ ID NO: 1245762 - protein, 9 aa, Homo Sapiens
RNIQIDNNK

SEQ ID NO: 1245763 - protein, 9 aa, Homo Sapiens
KDKDTTENE

SEQ ID NO: 1245764 - protein, 9 aa, Homo Sapiens
KKEKLRDRD

SEQ ID NO: 1245765 - protein, 9 aa, Homo Sapiens
SVTVDVTAR

SEQ ID NO: 1245766 - protein, 9 aa, Homo Sapiens
WADEEEEVE

SEQ ID NO: 1245767 - protein, 9 aa, Homo Sapiens
LDIGPPVSG

SEQ ID NO: 1245768 - protein, 9 aa, Homo Sapiens
ISRELEEIS

SEQ ID NO: 1245769 - protein, 9 aa, Homo Sapiens
DIVIPGLNN

SEQ ID NO: 1245770 - protein, 9 aa, Homo Sapiens
VGTAQHVSP

SEQ ID NO: 1245771 - protein, 9 aa, Homo Sapiens
MKLPPCFPV

SEQ ID NO: 1245772 - protein, 9 aa, Homo Sapiens
AGGVMGAVN

SEQ ID NO: 1245773 - protein, 9 aa, Homo Sapiens
QACYRQLVS

SEQ ID NO: 1245774 - protein, 9 aa, Homo Sapiens
IYYKIKDGD

SEQ ID NO: 1245775 - protein, 9 aa, Homo Sapiens
FSHTIRCTR

SEQ ID NO: 1245776 - protein, 9 aa, Homo Sapiens
EVGWMVAGL

SEQ ID NO: 1245777 - protein, 9 aa, Homo Sapiens
AGHEWRYYF

SEQ ID NO: 1245778 - protein, 9 aa, Homo Sapiens
LFHTSYWES

SEQ ID NO: 1245779 - protein, 9 aa, Homo Sapiens
PPPPAQSSA

SEQ ID NO: 1245780 - protein, 9 aa, Homo Sapiens
LAESTVQEE

SEQ ID NO: 1245781 - protein, 9 aa, Homo Sapiens
RSMATQAMP

SEQ ID NO: 1245782 - protein, 9 aa, Homo Sapiens
KKYMDAETS

SEQ ID NO: 1245783 - protein, 9 aa, Homo Sapiens
EMLSSTSPL

SEQ ID NO: 1245784 - protein, 9 aa, Homo Sapiens
GPIFVRLCY

SEQ ID NO: 1245785 - protein, 9 aa, Homo Sapiens
KVEIVLLDH

SEQ ID NO: 1245786 - protein, 9 aa, Homo Sapiens
LSPYISPKE

SEQ ID NO: 1245787 - protein, 9 aa, Homo Sapiens
APSIFLDAD

SEQ ID NO: 1245788 - protein, 9 aa, Homo Sapiens
KKPGKGIGL

SEQ ID NO: 1245789 - protein, 9 aa, Homo Sapiens
DSQRKTDLT

SEQ ID NO: 1245790 - protein, 9 aa, Homo Sapiens
KPPSPPKPP

SEQ ID NO: 1245791 - protein, 9 aa, Homo Sapiens
RTYRAMQQR

SEQ ID NO: 1245792 - protein, 9 aa, Homo Sapiens
RLSTDSHFP

SEQ ID NO: 1245793 - protein, 9 aa, Homo Sapiens
AAYQSRNYY

SEQ ID NO: 1245794 - protein, 9 aa, Homo Sapiens
MCQVNIVGT

SEQ ID NO: 1245795 - protein, 9 aa, Homo Sapiens
AHALHFFRE

SEQ ID NO: 1245796 - protein, 9 aa, Homo Sapiens
GSTYSMMTR

SEQ ID NO: 1245797 - protein, 9 aa, Homo Sapiens
RERDHLLAI

SEQ ID NO: 1245798 - protein, 9 aa, Homo Sapiens
LLQKCIEVR

SEQ ID NO: 1245799 - protein, 9 aa, Homo Sapiens
CQFNLNGNS

SEQ ID NO: 1245800 - protein, 9 aa, Homo Sapiens
AHIKMEEDA

SEQ ID NO: 1245801 - protein, 9 aa, Homo Sapiens
DYGHLPREG

SEQ ID NO: 1245802 - protein, 9 aa, Homo Sapiens
KKNRHWHWS

SEQ ID NO: 1245803 - protein, 9 aa, Homo Sapiens
FFGNGEIGR

SEQ ID NO: 1245804 - protein, 9 aa, Homo Sapiens
KQMHDSFSH

SEQ ID NO: 1245805 - protein, 9 aa, Homo Sapiens
QCLLFITLV

SEQ ID NO: 1245806 - protein, 9 aa, Homo Sapiens
MSPSNSSNE

SEQ ID NO: 1245807 - protein, 9 aa, Homo Sapiens
PFGHPLDIQ

SEQ ID NO: 1245808 - protein, 9 aa, Homo Sapiens
AACWARGGC

SEQ ID NO: 1245809 - protein, 9 aa, Homo Sapiens
TETVSDLAS

SEQ ID NO: 1245810 - protein, 9 aa, Homo Sapiens
AADVHALRT

SEQ ID NO: 1245811 - protein, 9 aa, Homo Sapiens
GLCTLCIAK

SEQ ID NO: 1245812 - protein, 9 aa, Homo Sapiens
PRSANKAPG

SEQ ID NO: 1245813 - protein, 9 aa, Homo Sapiens
PGYLVIKVV

SEQ ID NO: 1245814 - protein, 9 aa, Homo Sapiens
EVSNNGSMR

SEQ ID NO: 1245815 - protein, 9 aa, Homo Sapiens
RANVTRMCQ

SEQ ID NO: 1245816 - protein, 9 aa, Homo Sapiens
EAPAPHPRP

SEQ ID NO: 1245817 - protein, 9 aa, Homo Sapiens
THQGFPTKV

SEQ ID NO: 1245818 - protein, 9 aa, Homo Sapiens
GQMADGMGG

SEQ ID NO: 1245819 - protein, 9 aa, Homo Sapiens
LVSTTAAFV

SEQ ID NO: 1245820 - protein, 9 aa, Homo Sapiens
QSAAFSLMP

SEQ ID NO: 1245821 - protein, 9 aa, Homo Sapiens
REQKLKLHQ

SEQ ID NO: 1245822 - protein, 9 aa, Homo Sapiens
GCGLESNKN

SEQ ID NO: 1245823 - protein, 9 aa, Homo Sapiens
LDLVISKET

SEQ ID NO: 1245824 - protein, 9 aa, Homo Sapiens
LFVASELGN

SEQ ID NO: 1245825 - protein, 9 aa, Homo Sapiens
HCIEKGFAP

SEQ ID NO: 1245826 - protein, 9 aa, Homo Sapiens
LQFWLGDMY

SEQ ID NO: 1245827 - protein, 9 aa, Homo Sapiens
KEGCAYIAK

SEQ ID NO: 1245828 - protein, 9 aa, Homo Sapiens
FPSGMRAAG

SEQ ID NO: 1245829 - protein, 9 aa, Homo Sapiens
KEALNGIIQ

SEQ ID NO: 1245830 - protein, 9 aa, Homo Sapiens
RLEAMFSMK

SEQ ID NO: 1245831 - protein, 9 aa, Homo Sapiens
RVHITLHDE

SEQ ID NO: 1245832 - protein, 9 aa, Homo Sapiens
MRLIKPMKD

SEQ ID NO: 1245833 - protein, 9 aa, Homo Sapiens
QGKYSSLTS

SEQ ID NO: 1245834 - protein, 9 aa, Homo Sapiens
RTTEALHRV

SEQ ID NO: 1245835 - protein, 9 aa, Homo Sapiens
QDEWAWNDV

SEQ ID NO: 1245836 - protein, 9 aa, Homo Sapiens
KHKLEIKVK

SEQ ID NO: 1245837 - protein, 9 aa, Homo Sapiens
GTLHIMDPG

SEQ ID NO: 1245838 - protein, 9 aa, Homo Sapiens
FGPILNFLW

SEQ ID NO: 1245839 - protein, 9 aa, Homo Sapiens
CAPEFQANE

SEQ ID NO: 1245840 - protein, 9 aa, Homo Sapiens
RKRREECLQ

SEQ ID NO: 1245841 - protein, 9 aa, Homo Sapiens
FYYGWAVFG

SEQ ID NO: 1245842 - protein, 9 aa, Homo Sapiens
INTAHAILS

SEQ ID NO: 1245843 - protein, 9 aa, Homo Sapiens
RPLHSSGVA

SEQ ID NO: 1245844 - protein, 9 aa, Homo Sapiens
SQYFNIVTL

SEQ ID NO: 1245845 - protein, 9 aa, Homo Sapiens
NYDSGDCCT

SEQ ID NO: 1245846 - protein, 9 aa, Homo Sapiens
LLTLPMAYL

SEQ ID NO: 1245847 - protein, 9 aa, Homo Sapiens
VVIHAEHVH

SEQ ID NO: 1245848 - protein, 9 aa, Homo Sapiens
RKKRLRHRA

SEQ ID NO: 1245849 - protein, 9 aa, Homo Sapiens
QQLNNIHIT

SEQ ID NO: 1245850 - protein, 9 aa, Homo Sapiens
DTDGETEVG

SEQ ID NO: 1245851 - protein, 9 aa, Homo Sapiens
IDGKEAKAV

SEQ ID NO: 1245852 - protein, 9 aa, Homo Sapiens
PLSKADYLK

SEQ ID NO: 1245853 - protein, 9 aa, Homo Sapiens
YISYCWVIG

SEQ ID NO: 1245854 - protein, 9 aa, Homo Sapiens
LKTLVVFWF

SEQ ID NO: 1245855 - protein, 9 aa, Homo Sapiens
SVLVESVFG

SEQ ID NO: 1245856 - protein, 9 aa, Homo Sapiens
LCLACTDTR

SEQ ID NO: 1245857 - protein, 9 aa, Homo Sapiens
ERKDMTIDF

SEQ ID NO: 1245858 - protein, 9 aa, Homo Sapiens
KKWGDHFVY

SEQ ID NO: 1245859 - protein, 9 aa, Homo Sapiens
LEVTVYTFS

SEQ ID NO: 1245860 - protein, 9 aa, Homo Sapiens
GSTLYCVPM

SEQ ID NO: 1245861 - protein, 9 aa, Homo Sapiens
DGSEEDIDT

SEQ ID NO: 1245862 - protein, 9 aa, Homo Sapiens
AILQQLSLE

SEQ ID NO: 1245863 - protein, 9 aa, Homo Sapiens
EWEMLHNFP

SEQ ID NO: 1245864 - protein, 9 aa, Homo Sapiens
KLSRFHVKF

SEQ ID NO: 1245865 - protein, 9 aa, Homo Sapiens
TGYSGYIQK

SEQ ID NO: 1245866 - protein, 9 aa, Homo Sapiens
TMQQTEARD

SEQ ID NO: 1245867 - protein, 9 aa, Homo Sapiens
KLSESGTIM

SEQ ID NO: 1245868 - protein, 9 aa, Homo Sapiens
VLFPTIVVA

SEQ ID NO: 1245869 - protein, 9 aa, Homo Sapiens
RTGRKHQGR

SEQ ID NO: 1245870 - protein, 9 aa, Homo Sapiens
CEGLCLLSL

SEQ ID NO: 1245871 - protein, 9 aa, Homo Sapiens
GIECMGPLG

SEQ ID NO: 1245872 - protein, 9 aa, Homo Sapiens
DPEEQSPSC

SEQ ID NO: 1245873 - protein, 9 aa, Homo Sapiens
DQIVLLKGC

SEQ ID NO: 1245874 - protein, 9 aa, Homo Sapiens
YALKQEIAK

SEQ ID NO: 1245875 - protein, 9 aa, Homo Sapiens
QKLTTALIV

SEQ ID NO: 1245876 - protein, 9 aa, Homo Sapiens
RTASPGRYG

SEQ ID NO: 1245877 - protein, 9 aa, Homo Sapiens
RKLRVSITP

SEQ ID NO: 1245878 - protein, 9 aa, Homo Sapiens
QKYGYSPCV

SEQ ID NO: 1245879 - protein, 9 aa, Homo Sapiens
KAEVNELKK

SEQ ID NO: 1245880 - protein, 9 aa, Homo Sapiens
VGDVTCGQL

SEQ ID NO: 1245881 - protein, 9 aa, Homo Sapiens
MKSLYLGRM

SEQ ID NO: 1245882 - protein, 9 aa, Homo Sapiens
STRAEMGGR

SEQ ID NO: 1245883 - protein, 9 aa, Homo Sapiens
HIWSSMRRT

SEQ ID NO: 1245884 - protein, 9 aa, Homo Sapiens
LQMKMRRRK

SEQ ID NO: 1245885 - protein, 9 aa, Homo Sapiens
VSRDITRGY

SEQ ID NO: 1245886 - protein, 9 aa, Homo Sapiens
HSLDFQATT

SEQ ID NO: 1245887 - protein, 9 aa, Homo Sapiens
INSYFKCKE

SEQ ID NO: 1245888 - protein, 9 aa, Homo Sapiens
TLLFLDTTG

SEQ ID NO: 1245889 - protein, 9 aa, Homo Sapiens
EEDPKSKQK

SEQ ID NO: 1245890 - protein, 9 aa, Homo Sapiens
CLYCNPLAS

SEQ ID NO: 1245891 - protein, 9 aa, Homo Sapiens
GGGLRIEGH

SEQ ID NO: 1245892 - protein, 9 aa, Homo Sapiens
VQYLCNEYQ

SEQ ID NO: 1245893 - protein, 9 aa, Homo Sapiens
NTGKQEGAN

SEQ ID NO: 1245894 - protein, 9 aa, Homo Sapiens
DLLCIAKTL

SEQ ID NO: 1245895 - protein, 9 aa, Homo Sapiens
VTCGQLMNG

SEQ ID NO: 1245896 - protein, 9 aa, Homo Sapiens
DFDHVYSGA

SEQ ID NO: 1245897 - protein, 9 aa, Homo Sapiens
QQMEQKNYN

SEQ ID NO: 1245898 - protein, 9 aa, Homo Sapiens
SLLNQQDEI

SEQ ID NO: 1245899 - protein, 9 aa, Homo Sapiens
PHWRLCGIV

SEQ ID NO: 1245900 - protein, 9 aa, Homo Sapiens
KKSFDTGPQ

SEQ ID NO: 1245901 - protein, 9 aa, Homo Sapiens
FNSSVNEMH

SEQ ID NO: 1245902 - protein, 9 aa, Homo Sapiens
QDMFYDEAR

SEQ ID NO: 1245903 - protein, 9 aa, Homo Sapiens
GALQKEDRP

SEQ ID NO: 1245904 - protein, 9 aa, Homo Sapiens
EGFYQLEKV

SEQ ID NO: 1245905 - protein, 9 aa, Homo Sapiens
QFGRVGPYT

SEQ ID NO: 1245906 - protein, 9 aa, Homo Sapiens
RHIYTAFDT

SEQ ID NO: 1245907 - protein, 9 aa, Homo Sapiens
LLSRRTLPK

SEQ ID NO: 1245908 - protein, 9 aa, Homo Sapiens
RIFLNKLLK

SEQ ID NO: 1245909 - protein, 9 aa, Homo Sapiens
AEHICQAIE

SEQ ID NO: 1245910 - protein, 9 aa, Homo Sapiens
PSTYVCCLN

SEQ ID NO: 1245911 - protein, 9 aa, Homo Sapiens
FFTLHIYHY

SEQ ID NO: 1245912 - protein, 9 aa, Homo Sapiens
DRLIVGTAS

SEQ ID NO: 1245913 - protein, 9 aa, Homo Sapiens
LDEHLLCHR

SEQ ID NO: 1245914 - protein, 9 aa, Homo Sapiens
LVEEHTQAY

SEQ ID NO: 1245915 - protein, 9 aa, Homo Sapiens
SMRILGAWL

SEQ ID NO: 1245916 - protein, 9 aa, Homo Sapiens
WEKRLTSPS

SEQ ID NO: 1245917 - protein, 9 aa, Homo Sapiens
LHHLGNDEV

SEQ ID NO: 1245918 - protein, 9 aa, Homo Sapiens
KDDLCALVF

SEQ ID NO: 1245919 - protein, 9 aa, Homo Sapiens
EHLIADGSH

SEQ ID NO: 1245920 - protein, 9 aa, Homo Sapiens
HTPPMIGEE

SEQ ID NO: 1245921 - protein, 9 aa, Homo Sapiens
SRRLLRDIS

SEQ ID NO: 1245922 - protein, 9 aa, Homo Sapiens
ELKMKNMDD

SEQ ID NO: 1245923 - protein, 9 aa, Homo Sapiens
QGEEEPQER

SEQ ID NO: 1245924 - protein, 9 aa, Homo Sapiens
GHQALGGDD

SEQ ID NO: 1245925 - protein, 9 aa, Homo Sapiens
KPVYKPGWQ

SEQ ID NO: 1245926 - protein, 9 aa, Homo Sapiens
AATETGTQW

SEQ ID NO: 1245927 - protein, 9 aa, Homo Sapiens
GELIPLMNI

SEQ ID NO: 1245928 - protein, 9 aa, Homo Sapiens
SFEYVRSFV

SEQ ID NO: 1245929 - protein, 9 aa, Homo Sapiens
PTATAAVEE

SEQ ID NO: 1245930 - protein, 9 aa, Homo Sapiens
VSSIQREYL

SEQ ID NO: 1245931 - protein, 9 aa, Homo Sapiens
GSLGSLLEH

SEQ ID NO: 1245932 - protein, 9 aa, Homo Sapiens
SRTPQKRCL

SEQ ID NO: 1245933 - protein, 9 aa, Homo Sapiens
YFMKLHSGL

SEQ ID NO: 1245934 - protein, 9 aa, Homo Sapiens
VLRERQLHV

SEQ ID NO: 1245935 - protein, 9 aa, Homo Sapiens
KEELHHLRL

SEQ ID NO: 1245936 - protein, 9 aa, Homo Sapiens
SIFSVLPYH

SEQ ID NO: 1245937 - protein, 9 aa, Homo Sapiens
AYITPRYIV

SEQ ID NO: 1245938 - protein, 9 aa, Homo Sapiens
GLSHLRCIF

SEQ ID NO: 1245939 - protein, 9 aa, Homo Sapiens
PVDSLMFGG

SEQ ID NO: 1245940 - protein, 9 aa, Homo Sapiens
VPTWYPCGL

SEQ ID NO: 1245941 - protein, 9 aa, Homo Sapiens
VCTCPSMEV

SEQ ID NO: 1245942 - protein, 9 aa, Homo Sapiens
YMGPWRPVV

SEQ ID NO: 1245943 - protein, 9 aa, Homo Sapiens
FIVYVQEVM

SEQ ID NO: 1245944 - protein, 9 aa, Homo Sapiens
KEYEENSWD

SEQ ID NO: 1245945 - protein, 9 aa, Homo Sapiens
KHKYQEASK

SEQ ID NO: 1245946 - protein, 9 aa, Homo Sapiens
LPPSGELYF

SEQ ID NO: 1245947 - protein, 9 aa, Homo Sapiens
SFMYSKATR

SEQ ID NO: 1245948 - protein, 9 aa, Homo Sapiens
IQGRRLADQ

SEQ ID NO: 1245949 - protein, 9 aa, Homo Sapiens
PEVETNVKT

SEQ ID NO: 1245950 - protein, 9 aa, Homo Sapiens
GNVKYANMW

SEQ ID NO: 1245951 - protein, 9 aa, Homo Sapiens
LQHLGTPIT

SEQ ID NO: 1245952 - protein, 9 aa, Homo Sapiens
PHPSKGEEL

SEQ ID NO: 1245953 - protein, 9 aa, Homo Sapiens
DTPGFGEQI

SEQ ID NO: 1245954 - protein, 9 aa, Homo Sapiens
YMDGATPAI

SEQ ID NO: 1245955 - protein, 9 aa, Homo Sapiens
LTQDVQMFS

SEQ ID NO: 1245956 - protein, 9 aa, Homo Sapiens
IKNTVYIIL

SEQ ID NO: 1245957 - protein, 9 aa, Homo Sapiens
HCKFYQLEC

SEQ ID NO: 1245958 - protein, 9 aa, Homo Sapiens
RFPLEAPRT

SEQ ID NO: 1245959 - protein, 9 aa, Homo Sapiens
LGRDRQSEE

SEQ ID NO: 1245960 - protein, 9 aa, Homo Sapiens
QRHKFCPLL

SEQ ID NO: 1245961 - protein, 9 aa, Homo Sapiens
ADDGVADVL

SEQ ID NO: 1245962 - protein, 9 aa, Homo Sapiens
VLVDLAIMG

SEQ ID NO: 1245963 - protein, 9 aa, Homo Sapiens
QQKPIEPCR

SEQ ID NO: 1245964 - protein, 9 aa, Homo Sapiens
KLAQLEEVK

SEQ ID NO: 1245965 - protein, 9 aa, Homo Sapiens
SLRGPAATT

SEQ ID NO: 1245966 - protein, 9 aa, Homo Sapiens
LGLGGVGMH

SEQ ID NO: 1245967 - protein, 9 aa, Homo Sapiens
FKTNPCGSM

SEQ ID NO: 1245968 - protein, 9 aa, Homo Sapiens
LTVKESAIM

SEQ ID NO: 1245969 - protein, 9 aa, Homo Sapiens
LNMHVIQVW

SEQ ID NO: 1245970 - protein, 9 aa, Homo Sapiens
LPSGRTVSL

SEQ ID NO: 1245971 - protein, 9 aa, Homo Sapiens
KICNICHIL

SEQ ID NO: 1245972 - protein, 9 aa, Homo Sapiens
EKGPNGYGS

SEQ ID NO: 1245973 - protein, 9 aa, Homo Sapiens
TSVYEELVN

SEQ ID NO: 1245974 - protein, 9 aa, Homo Sapiens
ITCLEQIKE

SEQ ID NO: 1245975 - protein, 9 aa, Homo Sapiens
QLECLMQEY

SEQ ID NO: 1245976 - protein, 9 aa, Homo Sapiens
LIWRHLMRP

SEQ ID NO: 1245977 - protein, 9 aa, Homo Sapiens
SVMNRIFKR

SEQ ID NO: 1245978 - protein, 9 aa, Homo Sapiens
HSRCPPKGY

SEQ ID NO: 1245979 - protein, 9 aa, Homo Sapiens
RAFLSYVEV

SEQ ID NO: 1245980 - protein, 9 aa, Homo Sapiens
SDYVCAMRE

SEQ ID NO: 1245981 - protein, 9 aa, Homo Sapiens
TRKVAVQPE

SEQ ID NO: 1245982 - protein, 9 aa, Homo Sapiens
LVRHNRCLY

SEQ ID NO: 1245983 - protein, 9 aa, Homo Sapiens
KLYIDSCTR

SEQ ID NO: 1245984 - protein, 9 aa, Homo Sapiens
MFICIILTA

SEQ ID NO: 1245985 - protein, 9 aa, Homo Sapiens
VIIQGAKRI

SEQ ID NO: 1245986 - protein, 9 aa, Homo Sapiens
LDITGNGHE

SEQ ID NO: 1245987 - protein, 9 aa, Homo Sapiens
DTSAKKWKP

SEQ ID NO: 1245988 - protein, 9 aa, Homo Sapiens
RPPSGMEHQ

SEQ ID NO: 1245989 - protein, 9 aa, Homo Sapiens
GHRRPPLHV

SEQ ID NO: 1245990 - protein, 9 aa, Homo Sapiens
GSDYDTFKN

SEQ ID NO: 1245991 - protein, 9 aa, Homo Sapiens
TGHEVKGLQ

SEQ ID NO: 1245992 - protein, 9 aa, Homo Sapiens
QTNMMIQRL

SEQ ID NO: 1245993 - protein, 9 aa, Homo Sapiens
RGNQARYVS

SEQ ID NO: 1245994 - protein, 9 aa, Homo Sapiens
APTDIPVPL

SEQ ID NO: 1245995 - protein, 9 aa, Homo Sapiens
ASHNETYRH

SEQ ID NO: 1245996 - protein, 9 aa, Homo Sapiens
ALQLCPVLG

SEQ ID NO: 1245997 - protein, 9 aa, Homo Sapiens
PLPPDFHPH

SEQ ID NO: 1245998 - protein, 9 aa, Homo Sapiens
LSPKASHCS

SEQ ID NO: 1245999 - protein, 9 aa, Homo Sapiens
NHTHGGKWT

SEQ ID NO: 1246000 - protein, 9 aa, Homo Sapiens
WKQRGRPGR

SEQ ID NO: 1246001 - protein, 9 aa, Homo Sapiens
HMLFPPLEK

SEQ ID NO: 1246002 - protein, 9 aa, Homo Sapiens
LTAYVQWHP

SEQ ID NO: 1246003 - protein, 9 aa, Homo Sapiens
SRGRWVMIL

SEQ ID NO: 1246004 - protein, 9 aa, Homo Sapiens
QSERSRAHY

SEQ ID NO: 1246005 - protein, 9 aa, Homo Sapiens
LTMLKPRLK

SEQ ID NO: 1246006 - protein, 9 aa, Homo Sapiens
CREMGYVEA

SEQ ID NO: 1246007 - protein, 9 aa, Homo Sapiens
DINIIVTQN

SEQ ID NO: 1246008 - protein, 9 aa, Homo Sapiens
SQHSSELNT

SEQ ID NO: 1246009 - protein, 9 aa, Homo Sapiens
WAIPVPQIK

SEQ ID NO: 1246010 - protein, 9 aa, Homo Sapiens
YHMVRCITS

SEQ ID NO: 1246011 - protein, 9 aa, Homo Sapiens
QIAQLKQKL

SEQ ID NO: 1246012 - protein, 9 aa, Homo Sapiens
TASRAEGLS

SEQ ID NO: 1246013 - protein, 9 aa, Homo Sapiens
IVLGNLKLR

SEQ ID NO: 1246014 - protein, 9 aa, Homo Sapiens
LCPPHMFWI

SEQ ID NO: 1246015 - protein, 9 aa, Homo Sapiens
MANPILFQK

SEQ ID NO: 1246016 - protein, 9 aa, Homo Sapiens
PALCLHLDG

SEQ ID NO: 1246017 - protein, 9 aa, Homo Sapiens
HTFRVNIFT

SEQ ID NO: 1246018 - protein, 9 aa, Homo Sapiens
ALKLHIQEE

SEQ ID NO: 1246019 - protein, 9 aa, Homo Sapiens
PHPQFAPPN

SEQ ID NO: 1246020 - protein, 9 aa, Homo Sapiens
LTQLLLNDN

SEQ ID NO: 1246021 - protein, 9 aa, Homo Sapiens
ENQRETYEC

SEQ ID NO: 1246022 - protein, 9 aa, Homo Sapiens
KVMCIGLRY

SEQ ID NO: 1246023 - protein, 9 aa, Homo Sapiens
EDHPMSAMN

SEQ ID NO: 1246024 - protein, 9 aa, Homo Sapiens
PATDLSTTE

SEQ ID NO: 1246025 - protein, 9 aa, Homo Sapiens
ARTLYTIMN

SEQ ID NO: 1246026 - protein, 9 aa, Homo Sapiens
QHREKKRGT

SEQ ID NO: 1246027 - protein, 9 aa, Homo Sapiens
EKHSSGLDL

SEQ ID NO: 1246028 - protein, 9 aa, Homo Sapiens
RNTSPSIPS

SEQ ID NO: 1246029 - protein, 9 aa, Homo Sapiens
MPPMLMPPL

SEQ ID NO: 1246030 - protein, 9 aa, Homo Sapiens
RWSTSFCLA

SEQ ID NO: 1246031 - protein, 9 aa, Homo Sapiens
PSRQLLRQR

SEQ ID NO: 1246032 - protein, 9 aa, Homo Sapiens
SEYTSYQRD

SEQ ID NO: 1246033 - protein, 9 aa, Homo Sapiens
WDVRWDAEG

SEQ ID NO: 1246034 - protein, 9 aa, Homo Sapiens
WASRGGNLY

SEQ ID NO: 1246035 - protein, 9 aa, Homo Sapiens
RGLLDRQWT

SEQ ID NO: 1246036 - protein, 9 aa, Homo Sapiens
ASTPINNIF

SEQ ID NO: 1246037 - protein, 9 aa, Homo Sapiens
KKMIVFEPY

SEQ ID NO: 1246038 - protein, 9 aa, Homo Sapiens
GVIAGIVDQ

SEQ ID NO: 1246039 - protein, 9 aa, Homo Sapiens
LSTPTRVCP

SEQ ID NO: 1246040 - protein, 9 aa, Homo Sapiens
LGLDSYFLL

SEQ ID NO: 1246041 - protein, 9 aa, Homo Sapiens
SMTERIREM

SEQ ID NO: 1246042 - protein, 9 aa, Homo Sapiens
EFIVCTHNV

SEQ ID NO: 1246043 - protein, 9 aa, Homo Sapiens
TVQANKLLQ

SEQ ID NO: 1246044 - protein, 9 aa, Homo Sapiens
GRDRIVTGN

SEQ ID NO: 1246045 - protein, 9 aa, Homo Sapiens
TIPCRVTDS

SEQ ID NO: 1246046 - protein, 9 aa, Homo Sapiens
TNVCYDVFS

SEQ ID NO: 1246047 - protein, 9 aa, Homo Sapiens
VKEKQKWDA

SEQ ID NO: 1246048 - protein, 9 aa, Homo Sapiens
SQAKRNNIV

SEQ ID NO: 1246049 - protein, 9 aa, Homo Sapiens
EGPIQHHPS

SEQ ID NO: 1246050 - protein, 9 aa, Homo Sapiens
NVNIKSSSR

SEQ ID NO: 1246051 - protein, 9 aa, Homo Sapiens
WLLAGWRGP

SEQ ID NO: 1246052 - protein, 9 aa, Homo Sapiens
KNNNGLSFE

SEQ ID NO: 1246053 - protein, 9 aa, Homo Sapiens
TGHADLKHF

SEQ ID NO: 1246054 - protein, 9 aa, Homo Sapiens
DLAEAGRGR

SEQ ID NO: 1246055 - protein, 9 aa, Homo Sapiens
LSEDARARV

SEQ ID NO: 1246056 - protein, 9 aa, Homo Sapiens
QCHGAADEL

SEQ ID NO: 1246057 - protein, 9 aa, Homo Sapiens
QKKEEKNME

SEQ ID NO: 1246058 - protein, 9 aa, Homo Sapiens
CTQFSDRDL

SEQ ID NO: 1246059 - protein, 9 aa, Homo Sapiens
WNERVVNRV

SEQ ID NO: 1246060 - protein, 9 aa, Homo Sapiens
YSYMTICKE

SEQ ID NO: 1246061 - protein, 9 aa, Homo Sapiens
KEVLQDLEE

SEQ ID NO: 1246062 - protein, 9 aa, Homo Sapiens
VTVPKMLVD

SEQ ID NO: 1246063 - protein, 9 aa, Homo Sapiens
HLLAAALKS

SEQ ID NO: 1246064 - protein, 9 aa, Homo Sapiens
RCPGRYMGR

SEQ ID NO: 1246065 - protein, 9 aa, Homo Sapiens
TLHTKLSSQ

SEQ ID NO: 1246066 - protein, 9 aa, Homo Sapiens
SPTAIWRIG

SEQ ID NO: 1246067 - protein, 9 aa, Homo Sapiens
MYLSFITLG

SEQ ID NO: 1246068 - protein, 9 aa, Homo Sapiens
GKCCDVPTN

SEQ ID NO: 1246069 - protein, 9 aa, Homo Sapiens
SVFNHPLPL

SEQ ID NO: 1246070 - protein, 9 aa, Homo Sapiens
DSDELEMTG

SEQ ID NO: 1246071 - protein, 9 aa, Homo Sapiens
LIFPPPLPA

SEQ ID NO: 1246072 - protein, 9 aa, Homo Sapiens
SPTAASVST

SEQ ID NO: 1246073 - protein, 9 aa, Homo Sapiens
DQEYSPEIP

SEQ ID NO: 1246074 - protein, 9 aa, Homo Sapiens
QLEGYGIGV

SEQ ID NO: 1246075 - protein, 9 aa, Homo Sapiens
RYTQNIKDA

SEQ ID NO: 1246076 - protein, 9 aa, Homo Sapiens
SLGLDTKNY

SEQ ID NO: 1246077 - protein, 9 aa, Homo Sapiens
ELLTWVRDH

SEQ ID NO: 1246078 - protein, 9 aa, Homo Sapiens
CQEQTDPVE

SEQ ID NO: 1246079 - protein, 9 aa, Homo Sapiens
ISFCGFVVF

SEQ ID NO: 1246080 - protein, 9 aa, Homo Sapiens
LILIMKVNF

SEQ ID NO: 1246081 - protein, 9 aa, Homo Sapiens
PSSPRLSRV

SEQ ID NO: 1246082 - protein, 9 aa, Homo Sapiens
LTDFAMSHF

SEQ ID NO: 1246083 - protein, 9 aa, Homo Sapiens
GNLYVLKLL

SEQ ID NO: 1246084 - protein, 9 aa, Homo Sapiens
GSLSRTHSP

SEQ ID NO: 1246085 - protein, 9 aa, Homo Sapiens
TLVPELGRS

SEQ ID NO: 1246086 - protein, 9 aa, Homo Sapiens
GELPSIGED

SEQ ID NO: 1246087 - protein, 9 aa, Homo Sapiens
ATMALLDQN

SEQ ID NO: 1246088 - protein, 9 aa, Homo Sapiens
EEFDISEAC

SEQ ID NO: 1246089 - protein, 9 aa, Homo Sapiens
VLCYLERAD

SEQ ID NO: 1246090 - protein, 9 aa, Homo Sapiens
QPWGAGALR

SEQ ID NO: 1246091 - protein, 9 aa, Homo Sapiens
CSARQAELG

SEQ ID NO: 1246092 - protein, 9 aa, Homo Sapiens
LRQWVRMAD

SEQ ID NO: 1246093 - protein, 9 aa, Homo Sapiens
KQYTIYITT

SEQ ID NO: 1246094 - protein, 9 aa, Homo Sapiens
PLLILHTED

SEQ ID NO: 1246095 - protein, 9 aa, Homo Sapiens
DHDNNPAIR

SEQ ID NO: 1246096 - protein, 9 aa, Homo Sapiens
SDYDTFKNS

SEQ ID NO: 1246097 - protein, 9 aa, Homo Sapiens
RASLRRKES

SEQ ID NO: 1246098 - protein, 9 aa, Homo Sapiens
PWRPNTYYK

SEQ ID NO: 1246099 - protein, 9 aa, Homo Sapiens
PSMHSRSLM

SEQ ID NO: 1246100 - protein, 9 aa, Homo Sapiens
QHGVYSAPC

SEQ ID NO: 1246101 - protein, 9 aa, Homo Sapiens
KDVKDKDTT

SEQ ID NO: 1246102 - protein, 9 aa, Homo Sapiens
DDFKGNFPE

SEQ ID NO: 1246103 - protein, 9 aa, Homo Sapiens
MALKAVGES

SEQ ID NO: 1246104 - protein, 9 aa, Homo Sapiens
KRIIIKGVG

SEQ ID NO: 1246105 - protein, 9 aa, Homo Sapiens
HVPQEDGVD

SEQ ID NO: 1246106 - protein, 9 aa, Homo Sapiens
VLMTSLPFC

SEQ ID NO: 1246107 - protein, 9 aa, Homo Sapiens
ATSRGVAAA

SEQ ID NO: 1246108 - protein, 9 aa, Homo Sapiens
PTTTTTTEE

SEQ ID NO: 1246109 - protein, 9 aa, Homo Sapiens
DIEQSTSIR

SEQ ID NO: 1246110 - protein, 9 aa, Homo Sapiens
VGAKQADVV

SEQ ID NO: 1246111 - protein, 9 aa, Homo Sapiens
TPTRVCPRP

SEQ ID NO: 1246112 - protein, 9 aa, Homo Sapiens
YTQADGGCF

SEQ ID NO: 1246113 - protein, 9 aa, Homo Sapiens
SSSPGKAMP

SEQ ID NO: 1246114 - protein, 9 aa, Homo Sapiens
IVLVEGGHT

SEQ ID NO: 1246115 - protein, 9 aa, Homo Sapiens
TPTLVFEHV

SEQ ID NO: 1246116 - protein, 9 aa, Homo Sapiens
APPLSKADY

SEQ ID NO: 1246117 - protein, 9 aa, Homo Sapiens
NYQVEQSQV

SEQ ID NO: 1246118 - protein, 9 aa, Homo Sapiens
ELLFRNGAD

SEQ ID NO: 1246119 - protein, 9 aa, Homo Sapiens
EIYLIFLKG

SEQ ID NO: 1246120 - protein, 9 aa, Homo Sapiens
QLSELEKIV

SEQ ID NO: 1246121 - protein, 9 aa, Homo Sapiens
LQAELGLGV

SEQ ID NO: 1246122 - protein, 9 aa, Homo Sapiens
RLTDIFRHY

SEQ ID NO: 1246123 - protein, 9 aa, Homo Sapiens
FAYPNHPDV

SEQ ID NO: 1246124 - protein, 9 aa, Homo Sapiens
SKVDQLQDE

SEQ ID NO: 1246125 - protein, 9 aa, Homo Sapiens
KANNEGVEC

SEQ ID NO: 1246126 - protein, 9 aa, Homo Sapiens
VAVHRLLVR

SEQ ID NO: 1246127 - protein, 9 aa, Homo Sapiens
RFDLLKTGS

SEQ ID NO: 1246128 - protein, 9 aa, Homo Sapiens
MRSWSSWGP

SEQ ID NO: 1246129 - protein, 9 aa, Homo Sapiens
YRLPRVETH

SEQ ID NO: 1246130 - protein, 9 aa, Homo Sapiens
RGRPMTKTW

SEQ ID NO: 1246131 - protein, 9 aa, Homo Sapiens
ETRHIHTLL

SEQ ID NO: 1246132 - protein, 9 aa, Homo Sapiens
GYDGKEPQV

SEQ ID NO: 1246133 - protein, 9 aa, Homo Sapiens
DIQWALHSY

SEQ ID NO: 1246134 - protein, 9 aa, Homo Sapiens
SLALSSMIC

SEQ ID NO: 1246135 - protein, 9 aa, Homo Sapiens
PMHHWRNSA

SEQ ID NO: 1246136 - protein, 9 aa, Homo Sapiens
ERKKEKASM

SEQ ID NO: 1246137 - protein, 9 aa, Homo Sapiens
LCGPTLHLH

SEQ ID NO: 1246138 - protein, 9 aa, Homo Sapiens
ASLEYAKVE

SEQ ID NO: 1246139 - protein, 9 aa, Homo Sapiens
SFCRRRRLP

SEQ ID NO: 1246140 - protein, 9 aa, Homo Sapiens
KKGRKTVES

SEQ ID NO: 1246141 - protein, 9 aa, Homo Sapiens
VYEELVNNV

SEQ ID NO: 1246142 - protein, 9 aa, Homo Sapiens
GSGGRLQGR

SEQ ID NO: 1246143 - protein, 9 aa, Homo Sapiens
GRMRGTKST

SEQ ID NO: 1246144 - protein, 9 aa, Homo Sapiens
KNDAEPRSL

SEQ ID NO: 1246145 - protein, 9 aa, Homo Sapiens
SYPASLPRC

SEQ ID NO: 1246146 - protein, 9 aa, Homo Sapiens
HCLLELQYF

SEQ ID NO: 1246147 - protein, 9 aa, Homo Sapiens
EFYVELKAN

SEQ ID NO: 1246148 - protein, 9 aa, Homo Sapiens
SAGQTDASV

SEQ ID NO: 1246149 - protein, 9 aa, Homo Sapiens
QSAMYEICQ

SEQ ID NO: 1246150 - protein, 9 aa, Homo Sapiens
SSVLRHQRT

SEQ ID NO: 1246151 - protein, 9 aa, Homo Sapiens
EKILCGLAV

SEQ ID NO: 1246152 - protein, 9 aa, Homo Sapiens
AYANDTFTP

SEQ ID NO: 1246153 - protein, 9 aa, Homo Sapiens
RTLGKPDSI

SEQ ID NO: 1246154 - protein, 9 aa, Homo Sapiens
SSSPAPRTK

SEQ ID NO: 1246155 - protein, 9 aa, Homo Sapiens
SSHFVPKHI

SEQ ID NO: 1246156 - protein, 9 aa, Homo Sapiens
WSSHVLEWL

SEQ ID NO: 1246157 - protein, 9 aa, Homo Sapiens
AQVSPGPRG

SEQ ID NO: 1246158 - protein, 9 aa, Homo Sapiens
HWDAHRRLQ

SEQ ID NO: 1246159 - protein, 9 aa, Homo Sapiens
VLRCTNNQL

SEQ ID NO: 1246160 - protein, 9 aa, Homo Sapiens
TMGLLVKRL

SEQ ID NO: 1246161 - protein, 9 aa, Homo Sapiens
HWPAVTSSP

SEQ ID NO: 1246162 - protein, 9 aa, Homo Sapiens
HILNAAYGV

SEQ ID NO: 1246163 - protein, 9 aa, Homo Sapiens
PVSVTYQFG

SEQ ID NO: 1246164 - protein, 9 aa, Homo Sapiens
FKSTVKKVL

SEQ ID NO: 1246165 - protein, 9 aa, Homo Sapiens
LLKTLVVFW

SEQ ID NO: 1246166 - protein, 9 aa, Homo Sapiens
TTLAVEKEG

SEQ ID NO: 1246167 - protein, 9 aa, Homo Sapiens
MTHLHMIEE

SEQ ID NO: 1246168 - protein, 9 aa, Homo Sapiens
PLDVKSKKD

SEQ ID NO: 1246169 - protein, 9 aa, Homo Sapiens
PRSQPLLFI

SEQ ID NO: 1246170 - protein, 9 aa, Homo Sapiens
MQSECREKN

SEQ ID NO: 1246171 - protein, 9 aa, Homo Sapiens
LQKEDRPQA

SEQ ID NO: 1246172 - protein, 9 aa, Homo Sapiens
THISLPQIS

SEQ ID NO: 1246173 - protein, 9 aa, Homo Sapiens
IDCHMTSIS

SEQ ID NO: 1246174 - protein, 9 aa, Homo Sapiens
VIFNQKISG

SEQ ID NO: 1246175 - protein, 9 aa, Homo Sapiens
DEATHYIAP

SEQ ID NO: 1246176 - protein, 9 aa, Homo Sapiens
HQVLMDRGD

SEQ ID NO: 1246177 - protein, 9 aa, Homo Sapiens
TWKMEHQLY

SEQ ID NO: 1246178 - protein, 9 aa, Homo Sapiens
GHKLITVSK

SEQ ID NO: 1246179 - protein, 9 aa, Homo Sapiens
FDLGYIQGM

SEQ ID NO: 1246180 - protein, 9 aa, Homo Sapiens
PEFIQMSNF

SEQ ID NO: 1246181 - protein, 9 aa, Homo Sapiens
FLTMLKPRL

SEQ ID NO: 1246182 - protein, 9 aa, Homo Sapiens
RCARYPKMY

SEQ ID NO: 1246183 - protein, 9 aa, Homo Sapiens
LGVQWAILM

SEQ ID NO: 1246184 - protein, 9 aa, Homo Sapiens
TNKWSTPSG

SEQ ID NO: 1246185 - protein, 9 aa, Homo Sapiens
CRKQGAGSL

SEQ ID NO: 1246186 - protein, 9 aa, Homo Sapiens
KLSAKGDPL

SEQ ID NO: 1246187 - protein, 9 aa, Homo Sapiens
KKQRKAEVN

SEQ ID NO: 1246188 - protein, 9 aa, Homo Sapiens
NIGLNAPVK

SEQ ID NO: 1246189 - protein, 9 aa, Homo Sapiens
LCKERACFE

SEQ ID NO: 1246190 - protein, 9 aa, Homo Sapiens
TTAEFPSAT

SEQ ID NO: 1246191 - protein, 9 aa, Homo Sapiens
NQPNDENIM

SEQ ID NO: 1246192 - protein, 9 aa, Homo Sapiens
LQPPTLGAA

SEQ ID NO: 1246193 - protein, 9 aa, Homo Sapiens
QGLDTGRRR

SEQ ID NO: 1246194 - protein, 9 aa, Homo Sapiens
WSSHAMESA

SEQ ID NO: 1246195 - protein, 9 aa, Homo Sapiens
NVKTVFFPS

SEQ ID NO: 1246196 - protein, 9 aa, Homo Sapiens
NYSAALGMF

SEQ ID NO: 1246197 - protein, 9 aa, Homo Sapiens
LKRCSFHIE

SEQ ID NO: 1246198 - protein, 9 aa, Homo Sapiens
VPWNCRTIQ

SEQ ID NO: 1246199 - protein, 9 aa, Homo Sapiens
LDGFVKLGL

SEQ ID NO: 1246200 - protein, 9 aa, Homo Sapiens
HPLNFDLSS

SEQ ID NO: 1246201 - protein, 9 aa, Homo Sapiens
SVTYLYLGH

SEQ ID NO: 1246202 - protein, 9 aa, Homo Sapiens
HGRGMVVVG

SEQ ID NO: 1246203 - protein, 9 aa, Homo Sapiens
KILCGLAVG

SEQ ID NO: 1246204 - protein, 9 aa, Homo Sapiens
EESLQSCIQ

SEQ ID NO: 1246205 - protein, 9 aa, Homo Sapiens
WTGGDAPVF

SEQ ID NO: 1246206 - protein, 9 aa, Homo Sapiens
ASVAARKRS

SEQ ID NO: 1246207 - protein, 9 aa, Homo Sapiens
FLYLETAAR

SEQ ID NO: 1246208 - protein, 9 aa, Homo Sapiens
FRGLGDRPK

SEQ ID NO: 1246209 - protein, 9 aa, Homo Sapiens
ARSSVPWSA

SEQ ID NO: 1246210 - protein, 9 aa, Homo Sapiens
LMCAQLQLP

SEQ ID NO: 1246211 - protein, 9 aa, Homo Sapiens
VLPTEKTAG

SEQ ID NO: 1246212 - protein, 9 aa, Homo Sapiens
QTYTFSITS

SEQ ID NO: 1246213 - protein, 9 aa, Homo Sapiens
AQKDLYRNV

SEQ ID NO: 1246214 - protein, 9 aa, Homo Sapiens
LSTTCGQMT

SEQ ID NO: 1246215 - protein, 9 aa, Homo Sapiens
HSFFSVNCS

SEQ ID NO: 1246216 - protein, 9 aa, Homo Sapiens
SSLGKLFKL

SEQ ID NO: 1246217 - protein, 9 aa, Homo Sapiens
IALHIADGL

SEQ ID NO: 1246218 - protein, 9 aa, Homo Sapiens
DLGGCWQRL

SEQ ID NO: 1246219 - protein, 9 aa, Homo Sapiens
IITVDRHLH

SEQ ID NO: 1246220 - protein, 9 aa, Homo Sapiens
HAGSSALGP

SEQ ID NO: 1246221 - protein, 9 aa, Homo Sapiens
IIEATSDRI

SEQ ID NO: 1246222 - protein, 9 aa, Homo Sapiens
LWNLMGDAM

SEQ ID NO: 1246223 - protein, 9 aa, Homo Sapiens
MWYLLKVQF

SEQ ID NO: 1246224 - protein, 9 aa, Homo Sapiens
TKTWTLTQS

SEQ ID NO: 1246225 - protein, 9 aa, Homo Sapiens
EKTGALWHI

SEQ ID NO: 1246226 - protein, 9 aa, Homo Sapiens
TGAYTSGTP

SEQ ID NO: 1246227 - protein, 9 aa, Homo Sapiens
STDTQEDQI

SEQ ID NO: 1246228 - protein, 9 aa, Homo Sapiens
QGQFKSLAL

SEQ ID NO: 1246229 - protein, 9 aa, Homo Sapiens
LGVSITFNG

SEQ ID NO: 1246230 - protein, 9 aa, Homo Sapiens
CYTNHDLDQ

SEQ ID NO: 1246231 - protein, 9 aa, Homo Sapiens
SAILEHCRS

SEQ ID NO: 1246232 - protein, 9 aa, Homo Sapiens
TSPVHGAPG

SEQ ID NO: 1246233 - protein, 9 aa, Homo Sapiens
SSFALTILL

SEQ ID NO: 1246234 - protein, 9 aa, Homo Sapiens
SLTSKAQDV

SEQ ID NO: 1246235 - protein, 9 aa, Homo Sapiens
HINSYFKCK

SEQ ID NO: 1246236 - protein, 9 aa, Homo Sapiens
GNEDHCECQ

SEQ ID NO: 1246237 - protein, 9 aa, Homo Sapiens
TQAPRLLSR

SEQ ID NO: 1246238 - protein, 9 aa, Homo Sapiens
TSISFSCSR

SEQ ID NO: 1246239 - protein, 9 aa, Homo Sapiens
HTIQRQKVW

SEQ ID NO: 1246240 - protein, 9 aa, Homo Sapiens
APSPTPDVV

SEQ ID NO: 1246241 - protein, 9 aa, Homo Sapiens
DLHVYIVGN

SEQ ID NO: 1246242 - protein, 9 aa, Homo Sapiens
SSVNHIIYG

SEQ ID NO: 1246243 - protein, 9 aa, Homo Sapiens
TVLISCIFV

SEQ ID NO: 1246244 - protein, 9 aa, Homo Sapiens
WQGPCRHAG

SEQ ID NO: 1246245 - protein, 9 aa, Homo Sapiens
PTMLVTFTD

SEQ ID NO: 1246246 - protein, 9 aa, Homo Sapiens
PGFLKTPLG

SEQ ID NO: 1246247 - protein, 9 aa, Homo Sapiens
VMLLAGVGF

SEQ ID NO: 1246248 - protein, 9 aa, Homo Sapiens
YNKIRYLDL

SEQ ID NO: 1246249 - protein, 9 aa, Homo Sapiens
TNTLIGRRV

SEQ ID NO: 1246250 - protein, 9 aa, Homo Sapiens
LRDVPDAIS

SEQ ID NO: 1246251 - protein, 9 aa, Homo Sapiens
SSFSFMVFF

SEQ ID NO: 1246252 - protein, 9 aa, Homo Sapiens
QAVKQVPKC

SEQ ID NO: 1246253 - protein, 9 aa, Homo Sapiens
EWYKKCLTR

SEQ ID NO: 1246254 - protein, 9 aa, Homo Sapiens
TCLSLWTAH

SEQ ID NO: 1246255 - protein, 9 aa, Homo Sapiens
PHLLCKAPQ

SEQ ID NO: 1246256 - protein, 9 aa, Homo Sapiens
SQNLHNSYY

SEQ ID NO: 1246257 - protein, 9 aa, Homo Sapiens
GLDSYFLLP

SEQ ID NO: 1246258 - protein, 9 aa, Homo Sapiens
MMVYITEFV

SEQ ID NO: 1246259 - protein, 9 aa, Homo Sapiens
GSSTLNVLS

SEQ ID NO: 1246260 - protein, 9 aa, Homo Sapiens
RQEREKQLR

SEQ ID NO: 1246261 - protein, 9 aa, Homo Sapiens
LILCQLTVS

SEQ ID NO: 1246262 - protein, 9 aa, Homo Sapiens
SEGSMQTLT

SEQ ID NO: 1246263 - protein, 9 aa, Homo Sapiens
ELHHLRLPT

SEQ ID NO: 1246264 - protein, 9 aa, Homo Sapiens
NKKTKPVPW

SEQ ID NO: 1246265 - protein, 9 aa, Homo Sapiens
VRSSSIEQA

SEQ ID NO: 1246266 - protein, 9 aa, Homo Sapiens
KRCHISSSA

SEQ ID NO: 1246267 - protein, 9 aa, Homo Sapiens
QHTIQKTRK

SEQ ID NO: 1246268 - protein, 9 aa, Homo Sapiens
QNLFWQILL

SEQ ID NO: 1246269 - protein, 9 aa, Homo Sapiens
LLKDIPSSE

SEQ ID NO: 1246270 - protein, 9 aa, Homo Sapiens
DEVGSEQMG

SEQ ID NO: 1246271 - protein, 9 aa, Homo Sapiens
CSTCSRLYV

SEQ ID NO: 1246272 - protein, 9 aa, Homo Sapiens
MNVVHDKVW

SEQ ID NO: 1246273 - protein, 9 aa, Homo Sapiens
IKDIPKMNQ

SEQ ID NO: 1246274 - protein, 9 aa, Homo Sapiens
PEDHIKTRK

SEQ ID NO: 1246275 - protein, 9 aa, Homo Sapiens
KLALSKKNP

SEQ ID NO: 1246276 - protein, 9 aa, Homo Sapiens
GLWLHHAFF

SEQ ID NO: 1246277 - protein, 9 aa, Homo Sapiens
GLEPQNKCI

SEQ ID NO: 1246278 - protein, 9 aa, Homo Sapiens
PYPSRPSVG

SEQ ID NO: 1246279 - protein, 9 aa, Homo Sapiens
TLNSHGTSS

SEQ ID NO: 1246280 - protein, 9 aa, Homo Sapiens
LHNDAHVPI

SEQ ID NO: 1246281 - protein, 9 aa, Homo Sapiens
KQVFECLVD

SEQ ID NO: 1246282 - protein, 9 aa, Homo Sapiens
HEHYENGAF

SEQ ID NO: 1246283 - protein, 9 aa, Homo Sapiens
EETFNAAVM

SEQ ID NO: 1246284 - protein, 9 aa, Homo Sapiens
MKEREHREK

SEQ ID NO: 1246285 - protein, 9 aa, Homo Sapiens
REEILRISL

SEQ ID NO: 1246286 - protein, 9 aa, Homo Sapiens
SGTAPTDSW

SEQ ID NO: 1246287 - protein, 9 aa, Homo Sapiens
VDKDSGQNT

SEQ ID NO: 1246288 - protein, 9 aa, Homo Sapiens
AGQVLEQVH

SEQ ID NO: 1246289 - protein, 9 aa, Homo Sapiens
YKLTGVVMH

SEQ ID NO: 1246290 - protein, 9 aa, Homo Sapiens
ASENIGLNA

SEQ ID NO: 1246291 - protein, 9 aa, Homo Sapiens
LDGGGITEE

SEQ ID NO: 1246292 - protein, 9 aa, Homo Sapiens
VAEWQRSLF

SEQ ID NO: 1246293 - protein, 9 aa, Homo Sapiens
MSFSTALHG

SEQ ID NO: 1246294 - protein, 9 aa, Homo Sapiens
REECLHGLE

SEQ ID NO: 1246295 - protein, 9 aa, Homo Sapiens
CLLDIMPYR

SEQ ID NO: 1246296 - protein, 9 aa, Homo Sapiens
AAGLPLAPQ

SEQ ID NO: 1246297 - protein, 9 aa, Homo Sapiens
SHLFALRSL

SEQ ID NO: 1246298 - protein, 9 aa, Homo Sapiens
KNSQLERES

SEQ ID NO: 1246299 - protein, 9 aa, Homo Sapiens
ETLTETVYD

SEQ ID NO: 1246300 - protein, 9 aa, Homo Sapiens
IKCVLRANS

SEQ ID NO: 1246301 - protein, 9 aa, Homo Sapiens
ALIVYAKTD

SEQ ID NO: 1246302 - protein, 9 aa, Homo Sapiens
GLHGSHISM

SEQ ID NO: 1246303 - protein, 9 aa, Homo Sapiens
ERMTFTRAQ

SEQ ID NO: 1246304 - protein, 9 aa, Homo Sapiens
RRPLVQVVD

SEQ ID NO: 1246305 - protein, 9 aa, Homo Sapiens
SPKLMIYLL

SEQ ID NO: 1246306 - protein, 9 aa, Homo Sapiens
MLSVLRAYN

SEQ ID NO: 1246307 - protein, 9 aa, Homo Sapiens
MWVQEGMRK

SEQ ID NO: 1246308 - protein, 9 aa, Homo Sapiens
GSASSLDNV

SEQ ID NO: 1246309 - protein, 9 aa, Homo Sapiens
PAQASAAVL

SEQ ID NO: 1246310 - protein, 9 aa, Homo Sapiens
CPYIMEEAD

SEQ ID NO: 1246311 - protein, 9 aa, Homo Sapiens
VISWGGPRK

SEQ ID NO: 1246312 - protein, 9 aa, Homo Sapiens
QMATYFAPN

SEQ ID NO: 1246313 - protein, 9 aa, Homo Sapiens
FCKMSGYHR

SEQ ID NO: 1246314 - protein, 9 aa, Homo Sapiens
SVRPGGSGQ

SEQ ID NO: 1246315 - protein, 9 aa, Homo Sapiens
TTLYLKCKL

SEQ ID NO: 1246316 - protein, 9 aa, Homo Sapiens
PSLPSYKAG

SEQ ID NO: 1246317 - protein, 9 aa, Homo Sapiens
LSWAPPSAT

SEQ ID NO: 1246318 - protein, 9 aa, Homo Sapiens
PHGSSFGNQ

SEQ ID NO: 1246319 - protein, 9 aa, Homo Sapiens
LQRMKWDWM

SEQ ID NO: 1246320 - protein, 9 aa, Homo Sapiens
EHLCHYFDG

SEQ ID NO: 1246321 - protein, 9 aa, Homo Sapiens
FLIAIPSHP

SEQ ID NO: 1246322 - protein, 9 aa, Homo Sapiens
DGLRLIAML

SEQ ID NO: 1246323 - protein, 9 aa, Homo Sapiens
AVVQSSPPT

SEQ ID NO: 1246324 - protein, 9 aa, Homo Sapiens
GYYFNTGTV

SEQ ID NO: 1246325 - protein, 9 aa, Homo Sapiens
SLACIGIRG

SEQ ID NO: 1246326 - protein, 9 aa, Homo Sapiens
QKPLPFDSM

SEQ ID NO: 1246327 - protein, 9 aa, Homo Sapiens
SPSPAPLRH

SEQ ID NO: 1246328 - protein, 9 aa, Homo Sapiens
PFNLVPSQK

SEQ ID NO: 1246329 - protein, 9 aa, Homo Sapiens
IDNSQLMEQ

SEQ ID NO: 1246330 - protein, 9 aa, Homo Sapiens
KHQGQHLFI

SEQ ID NO: 1246331 - protein, 9 aa, Homo Sapiens
MYSKATRMT

SEQ ID NO: 1246332 - protein, 9 aa, Homo Sapiens
FQAVLDGFD

SEQ ID NO: 1246333 - protein, 9 aa, Homo Sapiens
KEYNNLILL

SEQ ID NO: 1246334 - protein, 9 aa, Homo Sapiens
SFQENDRLF

SEQ ID NO: 1246335 - protein, 9 aa, Homo Sapiens
NSVGTTSDI

SEQ ID NO: 1246336 - protein, 9 aa, Homo Sapiens
SNLKMKETA

SEQ ID NO: 1246337 - protein, 9 aa, Homo Sapiens
QNFIKDKGV

SEQ ID NO: 1246338 - protein, 9 aa, Homo Sapiens
EGDMTKALG

SEQ ID NO: 1246339 - protein, 9 aa, Homo Sapiens
KETQQRRMS

SEQ ID NO: 1246340 - protein, 9 aa, Homo Sapiens
IMAKEGGAS

SEQ ID NO: 1246341 - protein, 9 aa, Homo Sapiens
TRGRHQKKI

SEQ ID NO: 1246342 - protein, 9 aa, Homo Sapiens
CQENSDETK

SEQ ID NO: 1246343 - protein, 9 aa, Homo Sapiens
SQFLKIKPP

SEQ ID NO: 1246344 - protein, 9 aa, Homo Sapiens
LLSWASAPS

SEQ ID NO: 1246345 - protein, 9 aa, Homo Sapiens
IFVHTSGFT

SEQ ID NO: 1246346 - protein, 9 aa, Homo Sapiens
PTKVRRFPL

SEQ ID NO: 1246347 - protein, 9 aa, Homo Sapiens
IKILGDCYH

SEQ ID NO: 1246348 - protein, 9 aa, Homo Sapiens
SNPNGCISP

SEQ ID NO: 1246349 - protein, 9 aa, Homo Sapiens
YKSKEFQLF

SEQ ID NO: 1246350 - protein, 9 aa, Homo Sapiens
YFTSNALSL

SEQ ID NO: 1246351 - protein, 9 aa, Homo Sapiens
SQLVVTLHE

SEQ ID NO: 1246352 - protein, 9 aa, Homo Sapiens
GLTKLDLLM

SEQ ID NO: 1246353 - protein, 9 aa, Homo Sapiens
AVAFSEDGH

SEQ ID NO: 1246354 - protein, 9 aa, Homo Sapiens
SPVCSSDGL

SEQ ID NO: 1246355 - protein, 9 aa, Homo Sapiens
DIQETHRQP

SEQ ID NO: 1246356 - protein, 9 aa, Homo Sapiens
CIFNWVLSY

SEQ ID NO: 1246357 - protein, 9 aa, Homo Sapiens
KCPWNEYKS

SEQ ID NO: 1246358 - protein, 9 aa, Homo Sapiens
PPHHRPLGP

SEQ ID NO: 1246359 - protein, 9 aa, Homo Sapiens
TCATCKGDK

SEQ ID NO: 1246360 - protein, 9 aa, Homo Sapiens
SDSDISEDP

SEQ ID NO: 1246361 - protein, 9 aa, Homo Sapiens
EVKNGEKDT

SEQ ID NO: 1246362 - protein, 9 aa, Homo Sapiens
NRIHATDVI

SEQ ID NO: 1246363 - protein, 9 aa, Homo Sapiens
MKNDEPPLD

SEQ ID NO: 1246364 - protein, 9 aa, Homo Sapiens
SDKMQYFKR

SEQ ID NO: 1246365 - protein, 9 aa, Homo Sapiens
SKWDISEEV

SEQ ID NO: 1246366 - protein, 9 aa, Homo Sapiens
IMKWCGYAL

SEQ ID NO: 1246367 - protein, 9 aa, Homo Sapiens
TWHSAEQFC

SEQ ID NO: 1246368 - protein, 9 aa, Homo Sapiens
ISRTPHWRL

SEQ ID NO: 1246369 - protein, 9 aa, Homo Sapiens
ADVWSLGCA

SEQ ID NO: 1246370 - protein, 9 aa, Homo Sapiens
YLDPGQTLI

SEQ ID NO: 1246371 - protein, 9 aa, Homo Sapiens
TRVMTNKKT

SEQ ID NO: 1246372 - protein, 9 aa, Homo Sapiens
KVYCGYSVS

SEQ ID NO: 1246373 - protein, 9 aa, Homo Sapiens
FNMYGGNPV

SEQ ID NO: 1246374 - protein, 9 aa, Homo Sapiens
VSDLASLTV

SEQ ID NO: 1246375 - protein, 9 aa, Homo Sapiens
HGVYVLLIR

SEQ ID NO: 1246376 - protein, 9 aa, Homo Sapiens
EKGEEKGLA

SEQ ID NO: 1246377 - protein, 9 aa, Homo Sapiens
YEQAEMMLK

SEQ ID NO: 1246378 - protein, 9 aa, Homo Sapiens
HFLDRDEEE

SEQ ID NO: 1246379 - protein, 9 aa, Homo Sapiens
PKSVDQYRK

SEQ ID NO: 1246380 - protein, 9 aa, Homo Sapiens
NIKRWQDIY

SEQ ID NO: 1246381 - protein, 9 aa, Homo Sapiens
SKEEATMFS

SEQ ID NO: 1246382 - protein, 9 aa, Homo Sapiens
AYTVIQAGR

SEQ ID NO: 1246383 - protein, 9 aa, Homo Sapiens
LLSKLSSDG

SEQ ID NO: 1246384 - protein, 9 aa, Homo Sapiens
EEGHALGFL

SEQ ID NO: 1246385 - protein, 9 aa, Homo Sapiens
EGMQVVVQQ

SEQ ID NO: 1246386 - protein, 9 aa, Homo Sapiens
QVTEKTRTK

SEQ ID NO: 1246387 - protein, 9 aa, Homo Sapiens
KVECTGYTL

SEQ ID NO: 1246388 - protein, 9 aa, Homo Sapiens
LDPAHWTIQ

SEQ ID NO: 1246389 - protein, 9 aa, Homo Sapiens
YCVRSRTPQ

SEQ ID NO: 1246390 - protein, 9 aa, Homo Sapiens
QCPAMVQTE

SEQ ID NO: 1246391 - protein, 9 aa, Homo Sapiens
SALLKKAID

SEQ ID NO: 1246392 - protein, 9 aa, Homo Sapiens
VCFLTLDHY

SEQ ID NO: 1246393 - protein, 9 aa, Homo Sapiens
RLGKCNSGQ

SEQ ID NO: 1246394 - protein, 9 aa, Homo Sapiens
RVWVVPMQL

SEQ ID NO: 1246395 - protein, 9 aa, Homo Sapiens
PKCVNKKKD

SEQ ID NO: 1246396 - protein, 9 aa, Homo Sapiens
EHLAIARQR

SEQ ID NO: 1246397 - protein, 9 aa, Homo Sapiens
LLFRNGADI

SEQ ID NO: 1246398 - protein, 9 aa, Homo Sapiens
ERIIPCLAL

SEQ ID NO: 1246399 - protein, 9 aa, Homo Sapiens
VGHLPWVKL

SEQ ID NO: 1246400 - protein, 9 aa, Homo Sapiens
EYDAYHTDL

SEQ ID NO: 1246401 - protein, 9 aa, Homo Sapiens
IEKIVTDID

SEQ ID NO: 1246402 - protein, 9 aa, Homo Sapiens
VSTDLNGQA

SEQ ID NO: 1246403 - protein, 9 aa, Homo Sapiens
LGGSREDHH

SEQ ID NO: 1246404 - protein, 9 aa, Homo Sapiens
LPLPPPVTY

SEQ ID NO: 1246405 - protein, 9 aa, Homo Sapiens
EHVSSGGKP

SEQ ID NO: 1246406 - protein, 9 aa, Homo Sapiens
LVIMAKEGG

SEQ ID NO: 1246407 - protein, 9 aa, Homo Sapiens
LILVSDICA

SEQ ID NO: 1246408 - protein, 9 aa, Homo Sapiens
QQHNFTHHL

SEQ ID NO: 1246409 - protein, 9 aa, Homo Sapiens
EPETQHRGR

SEQ ID NO: 1246410 - protein, 9 aa, Homo Sapiens
YLFAHVVDF

SEQ ID NO: 1246411 - protein, 9 aa, Homo Sapiens
TLQTNMAKL

SEQ ID NO: 1246412 - protein, 9 aa, Homo Sapiens
IVSKNVLQY

SEQ ID NO: 1246413 - protein, 9 aa, Homo Sapiens
YSAKHGEVL

SEQ ID NO: 1246414 - protein, 9 aa, Homo Sapiens
NLQKEKKRF

SEQ ID NO: 1246415 - protein, 9 aa, Homo Sapiens
QKLRYKDLC

SEQ ID NO: 1246416 - protein, 9 aa, Homo Sapiens
KCDRVLAVN

SEQ ID NO: 1246417 - protein, 9 aa, Homo Sapiens
EINRAGMGW

SEQ ID NO: 1246418 - protein, 9 aa, Homo Sapiens
YYIHRQCKE

SEQ ID NO: 1246419 - protein, 9 aa, Homo Sapiens
ITRGKGVGT

SEQ ID NO: 1246420 - protein, 9 aa, Homo Sapiens
GQQGQAGMA

SEQ ID NO: 1246421 - protein, 9 aa, Homo Sapiens
QHAYAVMKN

SEQ ID NO: 1246422 - protein, 9 aa, Homo Sapiens
SPSYLPTKI

SEQ ID NO: 1246423 - protein, 9 aa, Homo Sapiens
QATIARKSV

SEQ ID NO: 1246424 - protein, 9 aa, Homo Sapiens
QSLQPFCTV

SEQ ID NO: 1246425 - protein, 9 aa, Homo Sapiens
RNCTLPPPP

SEQ ID NO: 1246426 - protein, 9 aa, Homo Sapiens
LPVLLLKED

SEQ ID NO: 1246427 - protein, 9 aa, Homo Sapiens
IWDYGNDFA

SEQ ID NO: 1246428 - protein, 9 aa, Homo Sapiens
EPPPPGYES

SEQ ID NO: 1246429 - protein, 9 aa, Homo Sapiens
CNYAHALDG

SEQ ID NO: 1246430 - protein, 9 aa, Homo Sapiens
LSDHLDAGL

SEQ ID NO: 1246431 - protein, 9 aa, Homo Sapiens
FNDRHQVPR

SEQ ID NO: 1246432 - protein, 9 aa, Homo Sapiens
CFAWRKSIK

SEQ ID NO: 1246433 - protein, 9 aa, Homo Sapiens
EPPPTPPSY

SEQ ID NO: 1246434 - protein, 9 aa, Homo Sapiens
NYLTKILFG

SEQ ID NO: 1246435 - protein, 9 aa, Homo Sapiens
QPLPQPLPR

SEQ ID NO: 1246436 - protein, 9 aa, Homo Sapiens
NSFGGKGQG

SEQ ID NO: 1246437 - protein, 9 aa, Homo Sapiens
SDHLDAGLS

SEQ ID NO: 1246438 - protein, 9 aa, Homo Sapiens
RKKIHQKGR

SEQ ID NO: 1246439 - protein, 9 aa, Homo Sapiens
LPIYLQNSS

SEQ ID NO: 1246440 - protein, 9 aa, Homo Sapiens
HKYTKGNGD

SEQ ID NO: 1246441 - protein, 9 aa, Homo Sapiens
SPREGLMVK

SEQ ID NO: 1246442 - protein, 9 aa, Homo Sapiens
EIGLHCRTY

SEQ ID NO: 1246443 - protein, 9 aa, Homo Sapiens
NSGFEGQSH

SEQ ID NO: 1246444 - protein, 9 aa, Homo Sapiens
NLQHVVIIH

SEQ ID NO: 1246445 - protein, 9 aa, Homo Sapiens
VWHEEHCGM

SEQ ID NO: 1246446 - protein, 9 aa, Homo Sapiens
ERPATDLST

SEQ ID NO: 1246447 - protein, 9 aa, Homo Sapiens
KFMDDPTVH

SEQ ID NO: 1246448 - protein, 9 aa, Homo Sapiens
LCSVVRLPP

SEQ ID NO: 1246449 - protein, 9 aa, Homo Sapiens
AQPLRVGDT

SEQ ID NO: 1246450 - protein, 9 aa, Homo Sapiens
TGTWKPGTA

SEQ ID NO: 1246451 - protein, 9 aa, Homo Sapiens
VYNSMRTIN

SEQ ID NO: 1246452 - protein, 9 aa, Homo Sapiens
NRLKLLVLY

SEQ ID NO: 1246453 - protein, 9 aa, Homo Sapiens
LQLKAVDVV

SEQ ID NO: 1246454 - protein, 9 aa, Homo Sapiens
NFSIRTEIC

SEQ ID NO: 1246455 - protein, 9 aa, Homo Sapiens
QVEVLSRQI

SEQ ID NO: 1246456 - protein, 9 aa, Homo Sapiens
ITSTFARCS

SEQ ID NO: 1246457 - protein, 9 aa, Homo Sapiens
SKYDSVSNY

SEQ ID NO: 1246458 - protein, 9 aa, Homo Sapiens
PISLSSFPD

SEQ ID NO: 1246459 - protein, 9 aa, Homo Sapiens
SGRFGLCLD

SEQ ID NO: 1246460 - protein, 9 aa, Homo Sapiens
DCWDQDADA

SEQ ID NO: 1246461 - protein, 9 aa, Homo Sapiens
HTIYNMIFH

SEQ ID NO: 1246462 - protein, 9 aa, Homo Sapiens
SVDLPPEFI

SEQ ID NO: 1246463 - protein, 9 aa, Homo Sapiens
WRLNEWHYG

SEQ ID NO: 1246464 - protein, 9 aa, Homo Sapiens
KSPASAPPS

SEQ ID NO: 1246465 - protein, 9 aa, Homo Sapiens
SLQSLEFQT

SEQ ID NO: 1246466 - protein, 9 aa, Homo Sapiens
RARSKHWPA

SEQ ID NO: 1246467 - protein, 9 aa, Homo Sapiens
LVVLDVINL

SEQ ID NO: 1246468 - protein, 9 aa, Homo Sapiens
AFLSPVAST

SEQ ID NO: 1246469 - protein, 9 aa, Homo Sapiens
NQLVTTEPT

SEQ ID NO: 1246470 - protein, 9 aa, Homo Sapiens
DGIITKSDA

SEQ ID NO: 1246471 - protein, 9 aa, Homo Sapiens
AILDKFGGE

SEQ ID NO: 1246472 - protein, 9 aa, Homo Sapiens
NSPSLPEQI

SEQ ID NO: 1246473 - protein, 9 aa, Homo Sapiens
DWIIAMTYE

SEQ ID NO: 1246474 - protein, 9 aa, Homo Sapiens
QCGKQGHWK

SEQ ID NO: 1246475 - protein, 9 aa, Homo Sapiens
DPLKAIQWE

SEQ ID NO: 1246476 - protein, 9 aa, Homo Sapiens
TLTAFDLTK

SEQ ID NO: 1246477 - protein, 9 aa, Homo Sapiens
IEHTMEEEV

SEQ ID NO: 1246478 - protein, 9 aa, Homo Sapiens
FIFTTTHNY

SEQ ID NO: 1246479 - protein, 9 aa, Homo Sapiens
CNQLWHKEC

SEQ ID NO: 1246480 - protein, 9 aa, Homo Sapiens
HSASVPSSP

SEQ ID NO: 1246481 - protein, 9 aa, Homo Sapiens
ANVNLQEEE

SEQ ID NO: 1246482 - protein, 9 aa, Homo Sapiens
CSNYPAIIL

SEQ ID NO: 1246483 - protein, 9 aa, Homo Sapiens
AWITKMEIH

SEQ ID NO: 1246484 - protein, 9 aa, Homo Sapiens
EAHVSTNLK

SEQ ID NO: 1246485 - protein, 9 aa, Homo Sapiens
KPVRGVKFV

SEQ ID NO: 1246486 - protein, 9 aa, Homo Sapiens
HLVHQCYDS

SEQ ID NO: 1246487 - protein, 9 aa, Homo Sapiens
FLLDKHHTP

SEQ ID NO: 1246488 - protein, 9 aa, Homo Sapiens
VLLMGLMFA

SEQ ID NO: 1246489 - protein, 9 aa, Homo Sapiens
QMVERPTVK

SEQ ID NO: 1246490 - protein, 9 aa, Homo Sapiens
RRPATYRLM

SEQ ID NO: 1246491 - protein, 9 aa, Homo Sapiens
QQQLEEMCK

SEQ ID NO: 1246492 - protein, 9 aa, Homo Sapiens
IVMRQSKET

SEQ ID NO: 1246493 - protein, 9 aa, Homo Sapiens
CMVLEEEEG

SEQ ID NO: 1246494 - protein, 9 aa, Homo Sapiens
EICVRTVCT

SEQ ID NO: 1246495 - protein, 9 aa, Homo Sapiens
GAVGAPGPD

SEQ ID NO: 1246496 - protein, 9 aa, Homo Sapiens
KETFNLKGV

SEQ ID NO: 1246497 - protein, 9 aa, Homo Sapiens
DKFDDEEPL

SEQ ID NO: 1246498 - protein, 9 aa, Homo Sapiens
AIHYRILDD

SEQ ID NO: 1246499 - protein, 9 aa, Homo Sapiens
VILVWEKAT

SEQ ID NO: 1246500 - protein, 9 aa, Homo Sapiens
DNNKTVLER

SEQ ID NO: 1246501 - protein, 9 aa, Homo Sapiens
PGLVHMMLA

SEQ ID NO: 1246502 - protein, 9 aa, Homo Sapiens
NRNTSPSIP

SEQ ID NO: 1246503 - protein, 9 aa, Homo Sapiens
VFVHKKKCS

SEQ ID NO: 1246504 - protein, 9 aa, Homo Sapiens
VFVERGQQY

SEQ ID NO: 1246505 - protein, 9 aa, Homo Sapiens
WVANESFYT

SEQ ID NO: 1246506 - protein, 9 aa, Homo Sapiens
SVSLQTEEC

SEQ ID NO: 1246507 - protein, 9 aa, Homo Sapiens
TAGFSSSQT

SEQ ID NO: 1246508 - protein, 9 aa, Homo Sapiens
VGVREMKIW

SEQ ID NO: 1246509 - protein, 9 aa, Homo Sapiens
PSRLLLLAI

SEQ ID NO: 1246510 - protein, 9 aa, Homo Sapiens
LIVPVTFDC

SEQ ID NO: 1246511 - protein, 9 aa, Homo Sapiens
NGSNLQCEA

SEQ ID NO: 1246512 - protein, 9 aa, Homo Sapiens
NPPQYFAII

SEQ ID NO: 1246513 - protein, 9 aa, Homo Sapiens
NTGWTPLHE

SEQ ID NO: 1246514 - protein, 9 aa, Homo Sapiens
DFHSDTLAC

SEQ ID NO: 1246515 - protein, 9 aa, Homo Sapiens
REPRGGGVR

SEQ ID NO: 1246516 - protein, 9 aa, Homo Sapiens
ATTIAENIH

SEQ ID NO: 1246517 - protein, 9 aa, Homo Sapiens
KKRGNHITG

SEQ ID NO: 1246518 - protein, 9 aa, Homo Sapiens
MYAYFVMTC

SEQ ID NO: 1246519 - protein, 9 aa, Homo Sapiens
IMTINGLNK

SEQ ID NO: 1246520 - protein, 9 aa, Homo Sapiens
LPPWLLLGS

SEQ ID NO: 1246521 - protein, 9 aa, Homo Sapiens
SNTGDAIDQ

SEQ ID NO: 1246522 - protein, 9 aa, Homo Sapiens
CRCSAPANQ

SEQ ID NO: 1246523 - protein, 9 aa, Homo Sapiens
SATSVSVRT

SEQ ID NO: 1246524 - protein, 9 aa, Homo Sapiens
VPFDQGSPF

SEQ ID NO: 1246525 - protein, 9 aa, Homo Sapiens
LEERQRCRK

SEQ ID NO: 1246526 - protein, 9 aa, Homo Sapiens
DELVQRHHI

SEQ ID NO: 1246527 - protein, 9 aa, Homo Sapiens
MCPGAGLLF

SEQ ID NO: 1246528 - protein, 9 aa, Homo Sapiens
RAQTFSSYA

SEQ ID NO: 1246529 - protein, 9 aa, Homo Sapiens
SCGSTCGCR

SEQ ID NO: 1246530 - protein, 9 aa, Homo Sapiens
KLEDSPLVA

SEQ ID NO: 1246531 - protein, 9 aa, Homo Sapiens
GLFSNYITM

SEQ ID NO: 1246532 - protein, 9 aa, Homo Sapiens
AYAMEQYEC

SEQ ID NO: 1246533 - protein, 9 aa, Homo Sapiens
VTWMILTAG

SEQ ID NO: 1246534 - protein, 9 aa, Homo Sapiens
SISRTPHWR

SEQ ID NO: 1246535 - protein, 9 aa, Homo Sapiens
NMDYDIIKC

SEQ ID NO: 1246536 - protein, 9 aa, Homo Sapiens
MCVRNVKES

SEQ ID NO: 1246537 - protein, 9 aa, Homo Sapiens
CRNGENTDA

SEQ ID NO: 1246538 - protein, 9 aa, Homo Sapiens
KIQLIVMQP

SEQ ID NO: 1246539 - protein, 9 aa, Homo Sapiens
AVYYESQRP

SEQ ID NO: 1246540 - protein, 9 aa, Homo Sapiens
HHRPLGPEL

SEQ ID NO: 1246541 - protein, 9 aa, Homo Sapiens
GLDLCSVVR

SEQ ID NO: 1246542 - protein, 9 aa, Homo Sapiens
ENLVRVGLR

SEQ ID NO: 1246543 - protein, 9 aa, Homo Sapiens
VTVAFIVFW

SEQ ID NO: 1246544 - protein, 9 aa, Homo Sapiens
HGYNNDFRS

SEQ ID NO: 1246545 - protein, 9 aa, Homo Sapiens
QFEKLKFSG

SEQ ID NO: 1246546 - protein, 9 aa, Homo Sapiens
ILIAPSGPS

SEQ ID NO: 1246547 - protein, 9 aa, Homo Sapiens
DRVPQHLQC

SEQ ID NO: 1246548 - protein, 9 aa, Homo Sapiens
DYDEDSQKF

SEQ ID NO: 1246549 - protein, 9 aa, Homo Sapiens
ICCATVATS

SEQ ID NO: 1246550 - protein, 9 aa, Homo Sapiens
TVVPVPSMD

SEQ ID NO: 1246551 - protein, 9 aa, Homo Sapiens
DQCPSAWPL

SEQ ID NO: 1246552 - protein, 9 aa, Homo Sapiens
LVTQQISKS

SEQ ID NO: 1246553 - protein, 9 aa, Homo Sapiens
APEMLIYFF

SEQ ID NO: 1246554 - protein, 9 aa, Homo Sapiens
QEYVKVISE

SEQ ID NO: 1246555 - protein, 9 aa, Homo Sapiens
APFIMDTPR

SEQ ID NO: 1246556 - protein, 9 aa, Homo Sapiens
FLATGKLCK

SEQ ID NO: 1246557 - protein, 9 aa, Homo Sapiens
GKDCDSLVL

SEQ ID NO: 1246558 - protein, 9 aa, Homo Sapiens
WSECSKTCC

SEQ ID NO: 1246559 - protein, 9 aa, Homo Sapiens
RHVLQPPNE

SEQ ID NO: 1246560 - protein, 9 aa, Homo Sapiens
HTQAYTQTH

SEQ ID NO: 1246561 - protein, 9 aa, Homo Sapiens
VKTAMYFAW

SEQ ID NO: 1246562 - protein, 9 aa, Homo Sapiens
DTCQSDMDE

SEQ ID NO: 1246563 - protein, 9 aa, Homo Sapiens
TYIEHPDVN

SEQ ID NO: 1246564 - protein, 9 aa, Homo Sapiens
KVVCVFRPE

SEQ ID NO: 1246565 - protein, 9 aa, Homo Sapiens
EKELGSKHS

SEQ ID NO: 1246566 - protein, 9 aa, Homo Sapiens
INTDELCSE

SEQ ID NO: 1246567 - protein, 9 aa, Homo Sapiens
SKKKKECQE

SEQ ID NO: 1246568 - protein, 9 aa, Homo Sapiens
QTGFPNKHI

SEQ ID NO: 1246569 - protein, 9 aa, Homo Sapiens
LPTLQPGTR

SEQ ID NO: 1246570 - protein, 9 aa, Homo Sapiens
ISVKNHSLD

SEQ ID NO: 1246571 - protein, 9 aa, Homo Sapiens
ELCFLRADE

SEQ ID NO: 1246572 - protein, 9 aa, Homo Sapiens
NYSENTPFH

SEQ ID NO: 1246573 - protein, 9 aa, Homo Sapiens
VTLYNQALM

SEQ ID NO: 1246574 - protein, 9 aa, Homo Sapiens
RGVGPDLEV

SEQ ID NO: 1246575 - protein, 9 aa, Homo Sapiens
DLSTTEATT

SEQ ID NO: 1246576 - protein, 9 aa, Homo Sapiens
ARDLVERVL

SEQ ID NO: 1246577 - protein, 9 aa, Homo Sapiens
AGKKCLDVY

SEQ ID NO: 1246578 - protein, 9 aa, Homo Sapiens
QPKKYMNSV

SEQ ID NO: 1246579 - protein, 9 aa, Homo Sapiens
RKIVTMDSL

SEQ ID NO: 1246580 - protein, 9 aa, Homo Sapiens
SKAMSTLSA

SEQ ID NO: 1246581 - protein, 9 aa, Homo Sapiens
ILLKISEGN

SEQ ID NO: 1246582 - protein, 9 aa, Homo Sapiens
HVIRRNESH

SEQ ID NO: 1246583 - protein, 9 aa, Homo Sapiens
LGFSDYPHL

SEQ ID NO: 1246584 - protein, 9 aa, Homo Sapiens
LEMTGIDLG

SEQ ID NO: 1246585 - protein, 9 aa, Homo Sapiens
SHEQKGRCK

SEQ ID NO: 1246586 - protein, 9 aa, Homo Sapiens
KDVTHPCMR

SEQ ID NO: 1246587 - protein, 9 aa, Homo Sapiens
SAPSHQALG

SEQ ID NO: 1246588 - protein, 9 aa, Homo Sapiens
PGKSFSTRG

SEQ ID NO: 1246589 - protein, 9 aa, Homo Sapiens
CIKECIRLY

SEQ ID NO: 1246590 - protein, 9 aa, Homo Sapiens
QVTDLHVTN

SEQ ID NO: 1246591 - protein, 9 aa, Homo Sapiens
VLQKWSLPY

SEQ ID NO: 1246592 - protein, 9 aa, Homo Sapiens
KIECHSLDF

SEQ ID NO: 1246593 - protein, 9 aa, Homo Sapiens
RALDLFYGM

SEQ ID NO: 1246594 - protein, 9 aa, Homo Sapiens
RFQKKLYVE

SEQ ID NO: 1246595 - protein, 9 aa, Homo Sapiens
VLCGRNGVA

SEQ ID NO: 1246596 - protein, 9 aa, Homo Sapiens
HTFCWEQWP

SEQ ID NO: 1246597 - protein, 9 aa, Homo Sapiens
NQGLPLYIR

SEQ ID NO: 1246598 - protein, 9 aa, Homo Sapiens
RKIMSDPDS

SEQ ID NO: 1246599 - protein, 9 aa, Homo Sapiens
NIFLEKNVP

SEQ ID NO: 1246600 - protein, 9 aa, Homo Sapiens
NPEMCQLFT

SEQ ID NO: 1246601 - protein, 9 aa, Homo Sapiens
SEHYAQENF

SEQ ID NO: 1246602 - protein, 9 aa, Homo Sapiens
GETLRSNHP

SEQ ID NO: 1246603 - protein, 9 aa, Homo Sapiens
LAPCISLIK

SEQ ID NO: 1246604 - protein, 9 aa, Homo Sapiens
YHDSTQVGD

SEQ ID NO: 1246605 - protein, 9 aa, Homo Sapiens
DAVPEMNSS

SEQ ID NO: 1246606 - protein, 9 aa, Homo Sapiens
CNYCKKTPS

SEQ ID NO: 1246607 - protein, 9 aa, Homo Sapiens
PENIILDSV

SEQ ID NO: 1246608 - protein, 9 aa, Homo Sapiens
LKGTSDDDA

SEQ ID NO: 1246609 - protein, 9 aa, Homo Sapiens
PMSAAGRAS

SEQ ID NO: 1246610 - protein, 9 aa, Homo Sapiens
AHSGRCANG

SEQ ID NO: 1246611 - protein, 9 aa, Homo Sapiens
TMSSETTKF

SEQ ID NO: 1246612 - protein, 9 aa, Homo Sapiens
VWKTKQTCW

SEQ ID NO: 1246613 - protein, 9 aa, Homo Sapiens
MVNVDCMSW

SEQ ID NO: 1246614 - protein, 9 aa, Homo Sapiens
VLTMTTLSN

SEQ ID NO: 1246615 - protein, 9 aa, Homo Sapiens
LNDLRAEAG

SEQ ID NO: 1246616 - protein, 9 aa, Homo Sapiens
VSPYEFFAH

SEQ ID NO: 1246617 - protein, 9 aa, Homo Sapiens
AQLLGQALF

SEQ ID NO: 1246618 - protein, 9 aa, Homo Sapiens
LCQLRVLWE

SEQ ID NO: 1246619 - protein, 9 aa, Homo Sapiens
ILPVLMDGI

SEQ ID NO: 1246620 - protein, 9 aa, Homo Sapiens
VATSSWDSF

SEQ ID NO: 1246621 - protein, 9 aa, Homo Sapiens
ENIPIISED

SEQ ID NO: 1246622 - protein, 9 aa, Homo Sapiens
APAKPRSTR

SEQ ID NO: 1246623 - protein, 9 aa, Homo Sapiens
VGCLQVSLW

SEQ ID NO: 1246624 - protein, 9 aa, Homo Sapiens
PAGLIIVHA

SEQ ID NO: 1246625 - protein, 9 aa, Homo Sapiens
MTKLCSAFA

SEQ ID NO: 1246626 - protein, 9 aa, Homo Sapiens
MYGNDEGHS

SEQ ID NO: 1246627 - protein, 9 aa, Homo Sapiens
KTPQRYKED

SEQ ID NO: 1246628 - protein, 9 aa, Homo Sapiens
IRKMECHDG

SEQ ID NO: 1246629 - protein, 9 aa, Homo Sapiens
WGSRTSAGI

SEQ ID NO: 1246630 - protein, 9 aa, Homo Sapiens
SVRSLYQVI

SEQ ID NO: 1246631 - protein, 9 aa, Homo Sapiens
ILVVDTKIL

SEQ ID NO: 1246632 - protein, 9 aa, Homo Sapiens
NYGKCWEMK

SEQ ID NO: 1246633 - protein, 9 aa, Homo Sapiens
DMPGHAGWL

SEQ ID NO: 1246634 - protein, 9 aa, Homo Sapiens
LQLGLAKGR

SEQ ID NO: 1246635 - protein, 9 aa, Homo Sapiens
APAQAHMAT

SEQ ID NO: 1246636 - protein, 9 aa, Homo Sapiens
KPKVSSIST

SEQ ID NO: 1246637 - protein, 9 aa, Homo Sapiens
RTWASPCSL

SEQ ID NO: 1246638 - protein, 9 aa, Homo Sapiens
KENINKAQE

SEQ ID NO: 1246639 - protein, 9 aa, Homo Sapiens
EAHVFMPIS

SEQ ID NO: 1246640 - protein, 9 aa, Homo Sapiens
RWMRRKGQQ

SEQ ID NO: 1246641 - protein, 9 aa, Homo Sapiens
LSMCYCIYS

SEQ ID NO: 1246642 - protein, 9 aa, Homo Sapiens
TTGNGLDQK

SEQ ID NO: 1246643 - protein, 9 aa, Homo Sapiens
TQLTNPPDH

SEQ ID NO: 1246644 - protein, 9 aa, Homo Sapiens
VIDKSKSVK

SEQ ID NO: 1246645 - protein, 9 aa, Homo Sapiens
FYVIDIGTF

SEQ ID NO: 1246646 - protein, 9 aa, Homo Sapiens
HLRECNREE

SEQ ID NO: 1246647 - protein, 9 aa, Homo Sapiens
SLTSYTSYH

SEQ ID NO: 1246648 - protein, 9 aa, Homo Sapiens
TDELCSERK

SEQ ID NO: 1246649 - protein, 9 aa, Homo Sapiens
PFLTQWQRH

SEQ ID NO: 1246650 - protein, 9 aa, Homo Sapiens
YLKMTPHKS

SEQ ID NO: 1246651 - protein, 9 aa, Homo Sapiens
HISSSLTPP

SEQ ID NO: 1246652 - protein, 9 aa, Homo Sapiens
ADSGLSMSS

SEQ ID NO: 1246653 - protein, 9 aa, Homo Sapiens
NTRKRDISL

SEQ ID NO: 1246654 - protein, 9 aa, Homo Sapiens
MRSFPLFDN

SEQ ID NO: 1246655 - protein, 9 aa, Homo Sapiens
LLQDAIRIS

SEQ ID NO: 1246656 - protein, 9 aa, Homo Sapiens
DSLTKKLHH

SEQ ID NO: 1246657 - protein, 9 aa, Homo Sapiens
KEFLHQGQL

SEQ ID NO: 1246658 - protein, 9 aa, Homo Sapiens
TVKEALEEA

SEQ ID NO: 1246659 - protein, 9 aa, Homo Sapiens
MLPLLMRVL

SEQ ID NO: 1246660 - protein, 9 aa, Homo Sapiens
GETVPTWYP

SEQ ID NO: 1246661 - protein, 9 aa, Homo Sapiens
GCKKIKAEN

SEQ ID NO: 1246662 - protein, 9 aa, Homo Sapiens
GLGSTPDAM

SEQ ID NO: 1246663 - protein, 9 aa, Homo Sapiens
GTSQLMPPS

SEQ ID NO: 1246664 - protein, 9 aa, Homo Sapiens
SSGLDLFAF

SEQ ID NO: 1246665 - protein, 9 aa, Homo Sapiens
EIGPKRDHA

SEQ ID NO: 1246666 - protein, 9 aa, Homo Sapiens
TTECDLKVE

SEQ ID NO: 1246667 - protein, 9 aa, Homo Sapiens
GNECHLCAE

SEQ ID NO: 1246668 - protein, 9 aa, Homo Sapiens
PTSLAVGFY

SEQ ID NO: 1246669 - protein, 9 aa, Homo Sapiens
AMEMGQIYA

SEQ ID NO: 1246670 - protein, 9 aa, Homo Sapiens
AHTGIHTDT

SEQ ID NO: 1246671 - protein, 9 aa, Homo Sapiens
AFIITFHIT

SEQ ID NO: 1246672 - protein, 9 aa, Homo Sapiens
IWMLHCIYE

SEQ ID NO: 1246673 - protein, 9 aa, Homo Sapiens
VELHIMEVI

SEQ ID NO: 1246674 - protein, 9 aa, Homo Sapiens
KDDEFYQHW

SEQ ID NO: 1246675 - protein, 9 aa, Homo Sapiens
KQEVITPDN

SEQ ID NO: 1246676 - protein, 9 aa, Homo Sapiens
RRKKELKAH

SEQ ID NO: 1246677 - protein, 9 aa, Homo Sapiens
VTNQGMTSS

SEQ ID NO: 1246678 - protein, 9 aa, Homo Sapiens
FNCIPVDSD

SEQ ID NO: 1246679 - protein, 9 aa, Homo Sapiens
NDLYDAGEG

SEQ ID NO: 1246680 - protein, 9 aa, Homo Sapiens
KEEKKTARS

SEQ ID NO: 1246681 - protein, 9 aa, Homo Sapiens
QSSGTGWWR

SEQ ID NO: 1246682 - protein, 9 aa, Homo Sapiens
VKCYIIEHI

SEQ ID NO: 1246683 - protein, 9 aa, Homo Sapiens
GTMRFWDAS

SEQ ID NO: 1246684 - protein, 9 aa, Homo Sapiens
QVISLDLHS

SEQ ID NO: 1246685 - protein, 9 aa, Homo Sapiens
HLKNGPDSI

SEQ ID NO: 1246686 - protein, 9 aa, Homo Sapiens
YMSVDDLRI

SEQ ID NO: 1246687 - protein, 9 aa, Homo Sapiens
VVNLHFPNQ

SEQ ID NO: 1246688 - protein, 9 aa, Homo Sapiens
ETVTYTQCT

SEQ ID NO: 1246689 - protein, 9 aa, Homo Sapiens
EDNSKWDIS

SEQ ID NO: 1246690 - protein, 9 aa, Homo Sapiens
DSDESYIEK

SEQ ID NO: 1246691 - protein, 9 aa, Homo Sapiens
PICMDGYSD

SEQ ID NO: 1246692 - protein, 9 aa, Homo Sapiens
VKFTSLACG

SEQ ID NO: 1246693 - protein, 9 aa, Homo Sapiens
HNMELVKII

SEQ ID NO: 1246694 - protein, 9 aa, Homo Sapiens
FTTLFTFIW

SEQ ID NO: 1246695 - protein, 9 aa, Homo Sapiens
VSRRTSQNL

SEQ ID NO: 1246696 - protein, 9 aa, Homo Sapiens
EQIFCPNHP

SEQ ID NO: 1246697 - protein, 9 aa, Homo Sapiens
PDEDAFWAL

SEQ ID NO: 1246698 - protein, 9 aa, Homo Sapiens
FIKKGCLSS

SEQ ID NO: 1246699 - protein, 9 aa, Homo Sapiens
DSDRLRRCS

SEQ ID NO: 1246700 - protein, 9 aa, Homo Sapiens
ITSREIKTA

SEQ ID NO: 1246701 - protein, 9 aa, Homo Sapiens
ILLSRNSES

SEQ ID NO: 1246702 - protein, 9 aa, Homo Sapiens
LVLTQKTYG

SEQ ID NO: 1246703 - protein, 9 aa, Homo Sapiens
KNLQEEIDT

SEQ ID NO: 1246704 - protein, 9 aa, Homo Sapiens
GWGVPVGIM

SEQ ID NO: 1246705 - protein, 9 aa, Homo Sapiens
NFTCLEARE

SEQ ID NO: 1246706 - protein, 9 aa, Homo Sapiens
AGEGMGSSG

SEQ ID NO: 1246707 - protein, 9 aa, Homo Sapiens
GQTQVRALS

SEQ ID NO: 1246708 - protein, 9 aa, Homo Sapiens
LLEQVMIGP

SEQ ID NO: 1246709 - protein, 9 aa, Homo Sapiens
MKHPARNVE

SEQ ID NO: 1246710 - protein, 9 aa, Homo Sapiens
AKSMKSLYL

SEQ ID NO: 1246711 - protein, 9 aa, Homo Sapiens
WGEPEILVW

SEQ ID NO: 1246712 - protein, 9 aa, Homo Sapiens
IAQRASQCL

SEQ ID NO: 1246713 - protein, 9 aa, Homo Sapiens
YFLAFDQNS

SEQ ID NO: 1246714 - protein, 9 aa, Homo Sapiens
MHRHTHTQA

SEQ ID NO: 1246715 - protein, 9 aa, Homo Sapiens
RLKRCHISS

SEQ ID NO: 1246716 - protein, 9 aa, Homo Sapiens
AAGPRPRAP

SEQ ID NO: 1246717 - protein, 9 aa, Homo Sapiens
WGSKGKLEA

SEQ ID NO: 1246718 - protein, 9 aa, Homo Sapiens
KTYNEAMAR

SEQ ID NO: 1246719 - protein, 9 aa, Homo Sapiens
EGRLTGLGR

SEQ ID NO: 1246720 - protein, 9 aa, Homo Sapiens
LSCFTLFEN

SEQ ID NO: 1246721 - protein, 9 aa, Homo Sapiens
VLDSQHQRS

SEQ ID NO: 1246722 - protein, 9 aa, Homo Sapiens
VNDDINLLG

SEQ ID NO: 1246723 - protein, 9 aa, Homo Sapiens
MHTSQQSVE

SEQ ID NO: 1246724 - protein, 9 aa, Homo Sapiens
HQRLNTGQR

SEQ ID NO: 1246725 - protein, 9 aa, Homo Sapiens
LDRNQTHAI

SEQ ID NO: 1246726 - protein, 9 aa, Homo Sapiens
LASTASSSS

SEQ ID NO: 1246727 - protein, 9 aa, Homo Sapiens
SRLRLVPPK

SEQ ID NO: 1246728 - protein, 9 aa, Homo Sapiens
VCYEPGHQA

SEQ ID NO: 1246729 - protein, 9 aa, Homo Sapiens
STVKKVLPE

SEQ ID NO: 1246730 - protein, 9 aa, Homo Sapiens
MIAKQSLQP

SEQ ID NO: 1246731 - protein, 9 aa, Homo Sapiens
LPTPETVHF

SEQ ID NO: 1246732 - protein, 9 aa, Homo Sapiens
LFPIKIILR

SEQ ID NO: 1246733 - protein, 9 aa, Homo Sapiens
QSIKDKALN

SEQ ID NO: 1246734 - protein, 9 aa, Homo Sapiens
PSSSFLTML

SEQ ID NO: 1246735 - protein, 9 aa, Homo Sapiens
VLDIRMPGV

SEQ ID NO: 1246736 - protein, 9 aa, Homo Sapiens
TVQLNVKYT

SEQ ID NO: 1246737 - protein, 9 aa, Homo Sapiens
YNVDLMNCT

SEQ ID NO: 1246738 - protein, 9 aa, Homo Sapiens
HIVRIPYIL

SEQ ID NO: 1246739 - protein, 9 aa, Homo Sapiens
NRRTTTSPD

SEQ ID NO: 1246740 - protein, 9 aa, Homo Sapiens
KQQKQTIEH

SEQ ID NO: 1246741 - protein, 9 aa, Homo Sapiens
KTNILAAQS

SEQ ID NO: 1246742 - protein, 9 aa, Homo Sapiens
LLRFIMPTL

SEQ ID NO: 1246743 - protein, 9 aa, Homo Sapiens
LAMHYLDRF

SEQ ID NO: 1246744 - protein, 9 aa, Homo Sapiens
EFNGNLSSP

SEQ ID NO: 1246745 - protein, 9 aa, Homo Sapiens
HPYLTEEAR

SEQ ID NO: 1246746 - protein, 9 aa, Homo Sapiens
DVVMLIAFT

SEQ ID NO: 1246747 - protein, 9 aa, Homo Sapiens
STSILLFLF

SEQ ID NO: 1246748 - protein, 9 aa, Homo Sapiens
RASQVACWT

SEQ ID NO: 1246749 - protein, 9 aa, Homo Sapiens
EGMPVQVDG

SEQ ID NO: 1246750 - protein, 9 aa, Homo Sapiens
LPVEELCVY

SEQ ID NO: 1246751 - protein, 9 aa, Homo Sapiens
VLKISFHRN

SEQ ID NO: 1246752 - protein, 9 aa, Homo Sapiens
PWDKNHEAL

SEQ ID NO: 1246753 - protein, 9 aa, Homo Sapiens
ECGKVFGVR

SEQ ID NO: 1246754 - protein, 9 aa, Homo Sapiens
PYPWPLNHS

SEQ ID NO: 1246755 - protein, 9 aa, Homo Sapiens
IYSDTVQGQ

SEQ ID NO: 1246756 - protein, 9 aa, Homo Sapiens
EYLAFAKRH

SEQ ID NO: 1246757 - protein, 9 aa, Homo Sapiens
ITFLYLLGH

SEQ ID NO: 1246758 - protein, 9 aa, Homo Sapiens
VPSHHILPP

SEQ ID NO: 1246759 - protein, 9 aa, Homo Sapiens
LKDEKWKLE

SEQ ID NO: 1246760 - protein, 9 aa, Homo Sapiens
ILKSNSWLN

SEQ ID NO: 1246761 - protein, 9 aa, Homo Sapiens
NPRKRLRKK

SEQ ID NO: 1246762 - protein, 9 aa, Homo Sapiens
SLSAPAEAT

SEQ ID NO: 1246763 - protein, 9 aa, Homo Sapiens
PMYFFLSIM

SEQ ID NO: 1246764 - protein, 9 aa, Homo Sapiens
VFLNLVVLR

SEQ ID NO: 1246765 - protein, 9 aa, Homo Sapiens
VVHLLQFQE

SEQ ID NO: 1246766 - protein, 9 aa, Homo Sapiens
YTAIQEPML

SEQ ID NO: 1246767 - protein, 9 aa, Homo Sapiens
KRCPAKAWS

SEQ ID NO: 1246768 - protein, 9 aa, Homo Sapiens
WSFDDVPMS

SEQ ID NO: 1246769 - protein, 9 aa, Homo Sapiens
WNRIYSDTV

SEQ ID NO: 1246770 - protein, 9 aa, Homo Sapiens
AALRIHNIT

SEQ ID NO: 1246771 - protein, 9 aa, Homo Sapiens
SQDECLRYL

SEQ ID NO: 1246772 - protein, 9 aa, Homo Sapiens
TLSSSVISQ

SEQ ID NO: 1246773 - protein, 9 aa, Homo Sapiens
PVFTIYMGP

SEQ ID NO: 1246774 - protein, 9 aa, Homo Sapiens
VEALVMAMF

SEQ ID NO: 1246775 - protein, 9 aa, Homo Sapiens
TFPEIINYL

SEQ ID NO: 1246776 - protein, 9 aa, Homo Sapiens
SIFSLAIAL

SEQ ID NO: 1246777 - protein, 9 aa, Homo Sapiens
CRIICTYHP

SEQ ID NO: 1246778 - protein, 9 aa, Homo Sapiens
FECLVDVIC

SEQ ID NO: 1246779 - protein, 9 aa, Homo Sapiens
HLDRPVVGW

SEQ ID NO: 1246780 - protein, 9 aa, Homo Sapiens
NAAYGVENA

SEQ ID NO: 1246781 - protein, 9 aa, Homo Sapiens
QRMMSQQKR

SEQ ID NO: 1246782 - protein, 9 aa, Homo Sapiens
MSTIGNMMS

SEQ ID NO: 1246783 - protein, 9 aa, Homo Sapiens
SWSRGWGRG

SEQ ID NO: 1246784 - protein, 9 aa, Homo Sapiens
GLYVVITPS

SEQ ID NO: 1246785 - protein, 9 aa, Homo Sapiens
VHYDEPLGK

SEQ ID NO: 1246786 - protein, 9 aa, Homo Sapiens
QTVLLMGGA

SEQ ID NO: 1246787 - protein, 9 aa, Homo Sapiens
QYIAIQYKE

SEQ ID NO: 1246788 - protein, 9 aa, Homo Sapiens
DINDNPSIF

SEQ ID NO: 1246789 - protein, 9 aa, Homo Sapiens
LKMRSFPLF

SEQ ID NO: 1246790 - protein, 9 aa, Homo Sapiens
LGIIVRAFT

SEQ ID NO: 1246791 - protein, 9 aa, Homo Sapiens
KNGEEIHRK

SEQ ID NO: 1246792 - protein, 9 aa, Homo Sapiens
DFFRKWDDY

SEQ ID NO: 1246793 - protein, 9 aa, Homo Sapiens
FPGCVLRLQ

SEQ ID NO: 1246794 - protein, 9 aa, Homo Sapiens
ASKKVQSAG

SEQ ID NO: 1246795 - protein, 9 aa, Homo Sapiens
SSARYAILQ

SEQ ID NO: 1246796 - protein, 9 aa, Homo Sapiens
LAAHLGYFP

SEQ ID NO: 1246797 - protein, 9 aa, Homo Sapiens
RQAEDDEQC

SEQ ID NO: 1246798 - protein, 9 aa, Homo Sapiens
PATWGSRTS

SEQ ID NO: 1246799 - protein, 9 aa, Homo Sapiens
HTSQQSVEN

SEQ ID NO: 1246800 - protein, 9 aa, Homo Sapiens
NQYTLDNSL

SEQ ID NO: 1246801 - protein, 9 aa, Homo Sapiens
STDQRPSTG

SEQ ID NO: 1246802 - protein, 9 aa, Homo Sapiens
KFENPEVPR

SEQ ID NO: 1246803 - protein, 9 aa, Homo Sapiens
IVFEPYQAS

SEQ ID NO: 1246804 - protein, 9 aa, Homo Sapiens
SDQPHITKD

SEQ ID NO: 1246805 - protein, 9 aa, Homo Sapiens
HDAHEFSNT

SEQ ID NO: 1246806 - protein, 9 aa, Homo Sapiens
KDCDSLVLQ

SEQ ID NO: 1246807 - protein, 9 aa, Homo Sapiens
HPTSFIKIL

SEQ ID NO: 1246808 - protein, 9 aa, Homo Sapiens
APGKVGTAE

SEQ ID NO: 1246809 - protein, 9 aa, Homo Sapiens
SVAEKNKDP

SEQ ID NO: 1246810 - protein, 9 aa, Homo Sapiens
IYFVFYSFS

SEQ ID NO: 1246811 - protein, 9 aa, Homo Sapiens
LPSIRSQVV

SEQ ID NO: 1246812 - protein, 9 aa, Homo Sapiens
FNLKGVLNS

SEQ ID NO: 1246813 - protein, 9 aa, Homo Sapiens
PNTVEQRQG

SEQ ID NO: 1246814 - protein, 9 aa, Homo Sapiens
LEMVFKNQP

SEQ ID NO: 1246815 - protein, 9 aa, Homo Sapiens
GHWISRLSA

SEQ ID NO: 1246816 - protein, 9 aa, Homo Sapiens
TPDVVSSGL

SEQ ID NO: 1246817 - protein, 9 aa, Homo Sapiens
GVILFDFAA

SEQ ID NO: 1246818 - protein, 9 aa, Homo Sapiens
KHSTAFPEV

SEQ ID NO: 1246819 - protein, 9 aa, Homo Sapiens
LCKLEKIRQ

SEQ ID NO: 1246820 - protein, 9 aa, Homo Sapiens
HITLHDEEA

SEQ ID NO: 1246821 - protein, 9 aa, Homo Sapiens
HQCTKMYEL

SEQ ID NO: 1246822 - protein, 9 aa, Homo Sapiens
RGVLEEQCH

SEQ ID NO: 1246823 - protein, 9 aa, Homo Sapiens
YGSVKDMCT

SEQ ID NO: 1246824 - protein, 9 aa, Homo Sapiens
GRAPGCTGT

SEQ ID NO: 1246825 - protein, 9 aa, Homo Sapiens
DITVDLVIG

SEQ ID NO: 1246826 - protein, 9 aa, Homo Sapiens
IYKKRISNH

SEQ ID NO: 1246827 - protein, 9 aa, Homo Sapiens
SQSLVNVFL

SEQ ID NO: 1246828 - protein, 9 aa, Homo Sapiens
IVHVTCWFG

SEQ ID NO: 1246829 - protein, 9 aa, Homo Sapiens
DPKLKEKVK

SEQ ID NO: 1246830 - protein, 9 aa, Homo Sapiens
TAYIMSVQA

SEQ ID NO: 1246831 - protein, 9 aa, Homo Sapiens
RERRDRRPG

SEQ ID NO: 1246832 - protein, 9 aa, Homo Sapiens
SNVMDVKDI

SEQ ID NO: 1246833 - protein, 9 aa, Homo Sapiens
QKMSPKWCF

SEQ ID NO: 1246834 - protein, 9 aa, Homo Sapiens
GKDTLQRTD

SEQ ID NO: 1246835 - protein, 9 aa, Homo Sapiens
VTDLIMLRL

SEQ ID NO: 1246836 - protein, 9 aa, Homo Sapiens
PLQDLAFLS

SEQ ID NO: 1246837 - protein, 9 aa, Homo Sapiens
QDSAILEHC

SEQ ID NO: 1246838 - protein, 9 aa, Homo Sapiens
ELKPGELKS

SEQ ID NO: 1246839 - protein, 9 aa, Homo Sapiens
CVQPEYQRR

SEQ ID NO: 1246840 - protein, 9 aa, Homo Sapiens
SSSKSHGPV

SEQ ID NO: 1246841 - protein, 9 aa, Homo Sapiens
HPSHQAHWY

SEQ ID NO: 1246842 - protein, 9 aa, Homo Sapiens
HTGPTNYRL

SEQ ID NO: 1246843 - protein, 9 aa, Homo Sapiens
FTCVTDTKN

SEQ ID NO: 1246844 - protein, 9 aa, Homo Sapiens
ETLRRPASM

SEQ ID NO: 1246845 - protein, 9 aa, Homo Sapiens
LVKWLAAAQ

SEQ ID NO: 1246846 - protein, 9 aa, Homo Sapiens
PGDQQLHEV

SEQ ID NO: 1246847 - protein, 9 aa, Homo Sapiens
RGHLEGEVI

SEQ ID NO: 1246848 - protein, 9 aa, Homo Sapiens
RRKGTDVNM

SEQ ID NO: 1246849 - protein, 9 aa, Homo Sapiens
HTTLEHPDC

SEQ ID NO: 1246850 - protein, 9 aa, Homo Sapiens
WPCKYDWDS

SEQ ID NO: 1246851 - protein, 9 aa, Homo Sapiens
EEESKKGLN

SEQ ID NO: 1246852 - protein, 9 aa, Homo Sapiens
FETFTSASG

SEQ ID NO: 1246853 - protein, 9 aa, Homo Sapiens
VTRHSGSQD

SEQ ID NO: 1246854 - protein, 9 aa, Homo Sapiens
TEIPSHLPP

SEQ ID NO: 1246855 - protein, 9 aa, Homo Sapiens
QAQTRCHRI

SEQ ID NO: 1246856 - protein, 9 aa, Homo Sapiens
PGVKSVTKS

SEQ ID NO: 1246857 - protein, 9 aa, Homo Sapiens
LNMVPSIPY

SEQ ID NO: 1246858 - protein, 9 aa, Homo Sapiens
VSRQWKMKA

SEQ ID NO: 1246859 - protein, 9 aa, Homo Sapiens
GFCCLLPLG

SEQ ID NO: 1246860 - protein, 9 aa, Homo Sapiens
QEATAPAAS

SEQ ID NO: 1246861 - protein, 9 aa, Homo Sapiens
ACCKFSTPT

SEQ ID NO: 1246862 - protein, 9 aa, Homo Sapiens
HALTLAEHL

SEQ ID NO: 1246863 - protein, 9 aa, Homo Sapiens
HFDLGYIQG

SEQ ID NO: 1246864 - protein, 9 aa, Homo Sapiens
RSRAHYEMA

SEQ ID NO: 1246865 - protein, 9 aa, Homo Sapiens
NSTTTGVSI

SEQ ID NO: 1246866 - protein, 9 aa, Homo Sapiens
LVVLAQGSG

SEQ ID NO: 1246867 - protein, 9 aa, Homo Sapiens
NLREVTDRF

SEQ ID NO: 1246868 - protein, 9 aa, Homo Sapiens
SSEKSNTTT

SEQ ID NO: 1246869 - protein, 9 aa, Homo Sapiens
ELSCMDTYE

SEQ ID NO: 1246870 - protein, 9 aa, Homo Sapiens
WVTGGQAFF

SEQ ID NO: 1246871 - protein, 9 aa, Homo Sapiens
LCHYFDGPK

SEQ ID NO: 1246872 - protein, 9 aa, Homo Sapiens
MATATRVTT

SEQ ID NO: 1246873 - protein, 9 aa, Homo Sapiens
RKDHLGCKE

SEQ ID NO: 1246874 - protein, 9 aa, Homo Sapiens
LNKGTCLND

SEQ ID NO: 1246875 - protein, 9 aa, Homo Sapiens
LGATAAPPE

SEQ ID NO: 1246876 - protein, 9 aa, Homo Sapiens
FLDPFKHLS

SEQ ID NO: 1246877 - protein, 9 aa, Homo Sapiens
STADRSMRK

SEQ ID NO: 1246878 - protein, 9 aa, Homo Sapiens
GTQKSRVPL

SEQ ID NO: 1246879 - protein, 9 aa, Homo Sapiens
RMDSEPVLV

SEQ ID NO: 1246880 - protein, 9 aa, Homo Sapiens
KSYDCKEYK

SEQ ID NO: 1246881 - protein, 9 aa, Homo Sapiens
GNHPGTSFP

SEQ ID NO: 1246882 - protein, 9 aa, Homo Sapiens
ALKTSRWSS

SEQ ID NO: 1246883 - protein, 9 aa, Homo Sapiens
QKMISETCS

SEQ ID NO: 1246884 - protein, 9 aa, Homo Sapiens
QQCKQTSEC

SEQ ID NO: 1246885 - protein, 9 aa, Homo Sapiens
CELREPGPS

SEQ ID NO: 1246886 - protein, 9 aa, Homo Sapiens
SMCKRICIL

SEQ ID NO: 1246887 - protein, 9 aa, Homo Sapiens
SVSKSISMA

SEQ ID NO: 1246888 - protein, 9 aa, Homo Sapiens
NAVLSKSKR

SEQ ID NO: 1246889 - protein, 9 aa, Homo Sapiens
DEEEEVETL

SEQ ID NO: 1246890 - protein, 9 aa, Homo Sapiens
RVLAALIVT

SEQ ID NO: 1246891 - protein, 9 aa, Homo Sapiens
FPAACETPG

SEQ ID NO: 1246892 - protein, 9 aa, Homo Sapiens
DGVAVVDPV

SEQ ID NO: 1246893 - protein, 9 aa, Homo Sapiens
DYMPALPRQ

SEQ ID NO: 1246894 - protein, 9 aa, Homo Sapiens
RFLAVMAAV

SEQ ID NO: 1246895 - protein, 9 aa, Homo Sapiens
AGLRHNPAL

SEQ ID NO: 1246896 - protein, 9 aa, Homo Sapiens
DADEYYRKK

SEQ ID NO: 1246897 - protein, 9 aa, Homo Sapiens
MIDYEKGAI

SEQ ID NO: 1246898 - protein, 9 aa, Homo Sapiens
VDGLRVREG

SEQ ID NO: 1246899 - protein, 9 aa, Homo Sapiens
KESINDGHW

SEQ ID NO: 1246900 - protein, 9 aa, Homo Sapiens
MEYATHSTG

SEQ ID NO: 1246901 - protein, 9 aa, Homo Sapiens
LYQVFVGFL

SEQ ID NO: 1246902 - protein, 9 aa, Homo Sapiens
NGITMLDTG

SEQ ID NO: 1246903 - protein, 9 aa, Homo Sapiens
YEYDFECGR

SEQ ID NO: 1246904 - protein, 9 aa, Homo Sapiens
VYTLCIPYC

SEQ ID NO: 1246905 - protein, 9 aa, Homo Sapiens
PSTIFIMNR

SEQ ID NO: 1246906 - protein, 9 aa, Homo Sapiens
PKQFAAVIM

SEQ ID NO: 1246907 - protein, 9 aa, Homo Sapiens
QKREAEERR

SEQ ID NO: 1246908 - protein, 9 aa, Homo Sapiens
GPYGSKGDV

SEQ ID NO: 1246909 - protein, 9 aa, Homo Sapiens
KRLHSPALP

SEQ ID NO: 1246910 - protein, 9 aa, Homo Sapiens
LLLILPVLL

SEQ ID NO: 1246911 - protein, 9 aa, Homo Sapiens
PALVAVLRG

SEQ ID NO: 1246912 - protein, 9 aa, Homo Sapiens
REVHVTKLI

SEQ ID NO: 1246913 - protein, 9 aa, Homo Sapiens
TMKMAHTPP

SEQ ID NO: 1246914 - protein, 9 aa, Homo Sapiens
CHSSPGYPQ

SEQ ID NO: 1246915 - protein, 9 aa, Homo Sapiens
YVGFGGWGY

SEQ ID NO: 1246916 - protein, 9 aa, Homo Sapiens
PKTIAGFQT

SEQ ID NO: 1246917 - protein, 9 aa, Homo Sapiens
SYCSLEHLP

SEQ ID NO: 1246918 - protein, 9 aa, Homo Sapiens
APKVAKGAK

SEQ ID NO: 1246919 - protein, 9 aa, Homo Sapiens
LHLAAKYGY

SEQ ID NO: 1246920 - protein, 9 aa, Homo Sapiens
YCDGCGENI

SEQ ID NO: 1246921 - protein, 9 aa, Homo Sapiens
IVAGGSTGL

SEQ ID NO: 1246922 - protein, 9 aa, Homo Sapiens
NGQGLAGFF

SEQ ID NO: 1246923 - protein, 9 aa, Homo Sapiens
DIWDCDYSL

SEQ ID NO: 1246924 - protein, 9 aa, Homo Sapiens
SRQPSVDGD

SEQ ID NO: 1246925 - protein, 9 aa, Homo Sapiens
GSFVSKVYC

SEQ ID NO: 1246926 - protein, 9 aa, Homo Sapiens
DETITTKEL

SEQ ID NO: 1246927 - protein, 9 aa, Homo Sapiens
THFTCVTDT

SEQ ID NO: 1246928 - protein, 9 aa, Homo Sapiens
WKMSGKARV

SEQ ID NO: 1246929 - protein, 9 aa, Homo Sapiens
ATLKTIKKK

SEQ ID NO: 1246930 - protein, 9 aa, Homo Sapiens
WSSSEKKTS

SEQ ID NO: 1246931 - protein, 9 aa, Homo Sapiens
DVMPQLLKK

SEQ ID NO: 1246932 - protein, 9 aa, Homo Sapiens
TQPQPPVKV

SEQ ID NO: 1246933 - protein, 9 aa, Homo Sapiens
IVFMGAKGN

SEQ ID NO: 1246934 - protein, 9 aa, Homo Sapiens
LIVDPLKAI

SEQ ID NO: 1246935 - protein, 9 aa, Homo Sapiens
EEREDEYQR

SEQ ID NO: 1246936 - protein, 9 aa, Homo Sapiens
HILLIQGQS

SEQ ID NO: 1246937 - protein, 9 aa, Homo Sapiens
GDLTGDNSL

SEQ ID NO: 1246938 - protein, 9 aa, Homo Sapiens
SSATSGYGA

SEQ ID NO: 1246939 - protein, 9 aa, Homo Sapiens
GIYVDDVNV

SEQ ID NO: 1246940 - protein, 9 aa, Homo Sapiens
SFELDENAL

SEQ ID NO: 1246941 - protein, 9 aa, Homo Sapiens
REHAERRKL

SEQ ID NO: 1246942 - protein, 9 aa, Homo Sapiens
GTKLGLRDD

SEQ ID NO: 1246943 - protein, 9 aa, Homo Sapiens
LPSPDVPCL

SEQ ID NO: 1246944 - protein, 9 aa, Homo Sapiens
DAYHTDLEE

SEQ ID NO: 1246945 - protein, 9 aa, Homo Sapiens
LTPVTQCPS

SEQ ID NO: 1246946 - protein, 9 aa, Homo Sapiens
ILHFHKGGG

SEQ ID NO: 1246947 - protein, 9 aa, Homo Sapiens
TSFVSSWGC

SEQ ID NO: 1246948 - protein, 9 aa, Homo Sapiens
KCLTRLYQS

SEQ ID NO: 1246949 - protein, 9 aa, Homo Sapiens
QQGVLQKVI

SEQ ID NO: 1246950 - protein, 9 aa, Homo Sapiens
IHTFVQSES

SEQ ID NO: 1246951 - protein, 9 aa, Homo Sapiens
LNLDTMTWE

SEQ ID NO: 1246952 - protein, 9 aa, Homo Sapiens
TTASSPSTL

SEQ ID NO: 1246953 - protein, 9 aa, Homo Sapiens
ITGNGHEEV

SEQ ID NO: 1246954 - protein, 9 aa, Homo Sapiens
PVNEYACRV

SEQ ID NO: 1246955 - protein, 9 aa, Homo Sapiens
PPEGVASFE

SEQ ID NO: 1246956 - protein, 9 aa, Homo Sapiens
MNEKIERLN

SEQ ID NO: 1246957 - protein, 9 aa, Homo Sapiens
LKVFLLRHP

SEQ ID NO: 1246958 - protein, 9 aa, Homo Sapiens
ALIVLNNLI

SEQ ID NO: 1246959 - protein, 9 aa, Homo Sapiens
VDFVQFECG

SEQ ID NO: 1246960 - protein, 9 aa, Homo Sapiens
IFNRVNIAY

SEQ ID NO: 1246961 - protein, 9 aa, Homo Sapiens
YLHLETLVQ

SEQ ID NO: 1246962 - protein, 9 aa, Homo Sapiens
RENWQNNLT

SEQ ID NO: 1246963 - protein, 9 aa, Homo Sapiens
RQVAFHVGL

SEQ ID NO: 1246964 - protein, 9 aa, Homo Sapiens
HGALIYKLS

SEQ ID NO: 1246965 - protein, 9 aa, Homo Sapiens
SKWSLLAKM

SEQ ID NO: 1246966 - protein, 9 aa, Homo Sapiens
TSPKFHMTT

SEQ ID NO: 1246967 - protein, 9 aa, Homo Sapiens
HPRSLRSPT

SEQ ID NO: 1246968 - protein, 9 aa, Homo Sapiens
HGCRDVEQY

SEQ ID NO: 1246969 - protein, 9 aa, Homo Sapiens
RKKWAQEPS

SEQ ID NO: 1246970 - protein, 9 aa, Homo Sapiens
ANIASEMAD

SEQ ID NO: 1246971 - protein, 9 aa, Homo Sapiens
QSAPLQLMI

SEQ ID NO: 1246972 - protein, 9 aa, Homo Sapiens
PTTGTLHIM

SEQ ID NO: 1246973 - protein, 9 aa, Homo Sapiens
IHIGEIPYE

SEQ ID NO: 1246974 - protein, 9 aa, Homo Sapiens
PGIQGDTHF

SEQ ID NO: 1246975 - protein, 9 aa, Homo Sapiens
VSYQADLKN

SEQ ID NO: 1246976 - protein, 9 aa, Homo Sapiens
AFTKNIFGR

SEQ ID NO: 1246977 - protein, 9 aa, Homo Sapiens
VTDSTDTQE

SEQ ID NO: 1246978 - protein, 9 aa, Homo Sapiens
PRACGTPDH

SEQ ID NO: 1246979 - protein, 9 aa, Homo Sapiens
ICFTTSCVP

SEQ ID NO: 1246980 - protein, 9 aa, Homo Sapiens
TYYSADINL

SEQ ID NO: 1246981 - protein, 9 aa, Homo Sapiens
FTVEGEVTF

SEQ ID NO: 1246982 - protein, 9 aa, Homo Sapiens
CAQHQRLNT

SEQ ID NO: 1246983 - protein, 9 aa, Homo Sapiens
RGWFSMANT

SEQ ID NO: 1246984 - protein, 9 aa, Homo Sapiens
CNAGYEERC

SEQ ID NO: 1246985 - protein, 9 aa, Homo Sapiens
RVHYYQSLQ

SEQ ID NO: 1246986 - protein, 9 aa, Homo Sapiens
SEGNHPGTS

SEQ ID NO: 1246987 - protein, 9 aa, Homo Sapiens
VADVLARRG

SEQ ID NO: 1246988 - protein, 9 aa, Homo Sapiens
PRPHVLPVP

SEQ ID NO: 1246989 - protein, 9 aa, Homo Sapiens
NEGLKERKL

SEQ ID NO: 1246990 - protein, 9 aa, Homo Sapiens
TEAPYYLAT

SEQ ID NO: 1246991 - protein, 9 aa, Homo Sapiens
MIVRCVIAE

SEQ ID NO: 1246992 - protein, 9 aa, Homo Sapiens
RGPTGPPGP

SEQ ID NO: 1246993 - protein, 9 aa, Homo Sapiens
KNVLQYRGN

SEQ ID NO: 1246994 - protein, 9 aa, Homo Sapiens
RQVGVKGTY

SEQ ID NO: 1246995 - protein, 9 aa, Homo Sapiens
KACAFLEYR

SEQ ID NO: 1246996 - protein, 9 aa, Homo Sapiens
YATVYNGIS

SEQ ID NO: 1246997 - protein, 9 aa, Homo Sapiens
DGAQGEGQT

SEQ ID NO: 1246998 - protein, 9 aa, Homo Sapiens
REIRQSALC

SEQ ID NO: 1246999 - protein, 9 aa, Homo Sapiens
CLRYEDTLL

SEQ ID NO: 1247000 - protein, 9 aa, Homo Sapiens
NINKAQEVE

SEQ ID NO: 1247001 - protein, 9 aa, Homo Sapiens
ESVQDYDSD

SEQ ID NO: 1247002 - protein, 9 aa, Homo Sapiens
GLLPALVVL

SEQ ID NO: 1247003 - protein, 9 aa, Homo Sapiens
RESASIHDM

SEQ ID NO: 1247004 - protein, 9 aa, Homo Sapiens
HQLIVTRDS

SEQ ID NO: 1247005 - protein, 9 aa, Homo Sapiens
GSKNYGKCW

SEQ ID NO: 1247006 - protein, 9 aa, Homo Sapiens
SVLEKFTIL

SEQ ID NO: 1247007 - protein, 9 aa, Homo Sapiens
AYRKLLEAH

SEQ ID NO: 1247008 - protein, 9 aa, Homo Sapiens
VGPTGGPGF

SEQ ID NO: 1247009 - protein, 9 aa, Homo Sapiens
SNLSELDHL

SEQ ID NO: 1247010 - protein, 9 aa, Homo Sapiens
HRKFDAKGN

SEQ ID NO: 1247011 - protein, 9 aa, Homo Sapiens
YGNDFLQLL

SEQ ID NO: 1247012 - protein, 9 aa, Homo Sapiens
LNRESVRTP

SEQ ID NO: 1247013 - protein, 9 aa, Homo Sapiens
DWLQICEPT

SEQ ID NO: 1247014 - protein, 9 aa, Homo Sapiens
SPRRKQTGH

SEQ ID NO: 1247015 - protein, 9 aa, Homo Sapiens
SPVQRTMMK

SEQ ID NO: 1247016 - protein, 9 aa, Homo Sapiens
RSIMIQKGN

SEQ ID NO: 1247017 - protein, 9 aa, Homo Sapiens
CSESIKNKI

SEQ ID NO: 1247018 - protein, 9 aa, Homo Sapiens
CVPESTGEE

SEQ ID NO: 1247019 - protein, 9 aa, Homo Sapiens
FLNVSSSIQ

SEQ ID NO: 1247020 - protein, 9 aa, Homo Sapiens
SETAGSLSG

SEQ ID NO: 1247021 - protein, 9 aa, Homo Sapiens
VNRMIVSPD

SEQ ID NO: 1247022 - protein, 9 aa, Homo Sapiens
LDPYRSMST

SEQ ID NO: 1247023 - protein, 9 aa, Homo Sapiens
YVWIVQPVS

SEQ ID NO: 1247024 - protein, 9 aa, Homo Sapiens
VALLLSYVF

SEQ ID NO: 1247025 - protein, 9 aa, Homo Sapiens
KKHIKCRRC

SEQ ID NO: 1247026 - protein, 9 aa, Homo Sapiens
RAARPIHNL

SEQ ID NO: 1247027 - protein, 9 aa, Homo Sapiens
GFAPLNQTE

SEQ ID NO: 1247028 - protein, 9 aa, Homo Sapiens
AQRESASIH

SEQ ID NO: 1247029 - protein, 9 aa, Homo Sapiens
TKATNVRLH

SEQ ID NO: 1247030 - protein, 9 aa, Homo Sapiens
PDGGSMAHE

SEQ ID NO: 1247031 - protein, 9 aa, Homo Sapiens
RREDPEEQS

SEQ ID NO: 1247032 - protein, 9 aa, Homo Sapiens
MILTAGSME

SEQ ID NO: 1247033 - protein, 9 aa, Homo Sapiens
SDESYIEKS

SEQ ID NO: 1247034 - protein, 9 aa, Homo Sapiens
RTVCTHEEL

SEQ ID NO: 1247035 - protein, 9 aa, Homo Sapiens
KCNNQTIFE

SEQ ID NO: 1247036 - protein, 9 aa, Homo Sapiens
NDGSSDMGR

SEQ ID NO: 1247037 - protein, 9 aa, Homo Sapiens
VMSGLVISI

SEQ ID NO: 1247038 - protein, 9 aa, Homo Sapiens
TVASTTSVI

SEQ ID NO: 1247039 - protein, 9 aa, Homo Sapiens
LPKTISGDM

SEQ ID NO: 1247040 - protein, 9 aa, Homo Sapiens
RTHSEPLPP

SEQ ID NO: 1247041 - protein, 9 aa, Homo Sapiens
MAGRHQNCS

SEQ ID NO: 1247042 - protein, 9 aa, Homo Sapiens
QGVLLIYDI

SEQ ID NO: 1247043 - protein, 9 aa, Homo Sapiens
PPTYRYEWG

SEQ ID NO: 1247044 - protein, 9 aa, Homo Sapiens
EISSVQKKM

SEQ ID NO: 1247045 - protein, 9 aa, Homo Sapiens
HMRLELQMV

SEQ ID NO: 1247046 - protein, 9 aa, Homo Sapiens
HQQSENQAK

SEQ ID NO: 1247047 - protein, 9 aa, Homo Sapiens
VRVGHMELR

SEQ ID NO: 1247048 - protein, 9 aa, Homo Sapiens
THSLIKGPL

SEQ ID NO: 1247049 - protein, 9 aa, Homo Sapiens
KELKVLCID

SEQ ID NO: 1247050 - protein, 9 aa, Homo Sapiens
HHMGLFDHA

SEQ ID NO: 1247051 - protein, 9 aa, Homo Sapiens
LIGLVCVTQ

SEQ ID NO: 1247052 - protein, 9 aa, Homo Sapiens
VLEGHAVEW

SEQ ID NO: 1247053 - protein, 9 aa, Homo Sapiens
SFYVKHCRN

SEQ ID NO: 1247054 - protein, 9 aa, Homo Sapiens
PALLRPGCF

SEQ ID NO: 1247055 - protein, 9 aa, Homo Sapiens
IMFRDKENV

SEQ ID NO: 1247056 - protein, 9 aa, Homo Sapiens
THRHTHTHR

SEQ ID NO: 1247057 - protein, 9 aa, Homo Sapiens
SVASFGAIS

SEQ ID NO: 1247058 - protein, 9 aa, Homo Sapiens
MGRKEYEEE

SEQ ID NO: 1247059 - protein, 9 aa, Homo Sapiens
DQVNLRTSQ

SEQ ID NO: 1247060 - protein, 9 aa, Homo Sapiens
RVTQDLAEA

SEQ ID NO: 1247061 - protein, 9 aa, Homo Sapiens
LRKRDVRFE

SEQ ID NO: 1247062 - protein, 9 aa, Homo Sapiens
CKCYGHRTG

SEQ ID NO: 1247063 - protein, 9 aa, Homo Sapiens
THLLRMSAA

SEQ ID NO: 1247064 - protein, 9 aa, Homo Sapiens
LKWGLYIAV

SEQ ID NO: 1247065 - protein, 9 aa, Homo Sapiens
RVWEATVLE

SEQ ID NO: 1247066 - protein, 9 aa, Homo Sapiens
SSQNHHVLG

SEQ ID NO: 1247067 - protein, 9 aa, Homo Sapiens
IDSVIIGKD

SEQ ID NO: 1247068 - protein, 9 aa, Homo Sapiens
MSTSTWADG

SEQ ID NO: 1247069 - protein, 9 aa, Homo Sapiens
DKCVNSFQV

SEQ ID NO: 1247070 - protein, 9 aa, Homo Sapiens
FEWFLNKLC

SEQ ID NO: 1247071 - protein, 9 aa, Homo Sapiens
SKMFQKTRN

SEQ ID NO: 1247072 - protein, 9 aa, Homo Sapiens
VLATDFDDK

SEQ ID NO: 1247073 - protein, 9 aa, Homo Sapiens
VLGESASPA

SEQ ID NO: 1247074 - protein, 9 aa, Homo Sapiens
VAEAKSPRA

SEQ ID NO: 1247075 - protein, 9 aa, Homo Sapiens
VRNPASPNE

SEQ ID NO: 1247076 - protein, 9 aa, Homo Sapiens
FQAEGNISG

SEQ ID NO: 1247077 - protein, 9 aa, Homo Sapiens
HNWGHQSDT

SEQ ID NO: 1247078 - protein, 9 aa, Homo Sapiens
PLAHLHREV

SEQ ID NO: 1247079 - protein, 9 aa, Homo Sapiens
LEAYSLGLD

SEQ ID NO: 1247080 - protein, 9 aa, Homo Sapiens
VLNKGTCLN

SEQ ID NO: 1247081 - protein, 9 aa, Homo Sapiens
CYLERADAK

SEQ ID NO: 1247082 - protein, 9 aa, Homo Sapiens
YLLDDSVME

SEQ ID NO: 1247083 - protein, 9 aa, Homo Sapiens
MYGIRPHPT

SEQ ID NO: 1247084 - protein, 9 aa, Homo Sapiens
IPGVKVHSG

SEQ ID NO: 1247085 - protein, 9 aa, Homo Sapiens
SISIIGFAI

SEQ ID NO: 1247086 - protein, 9 aa, Homo Sapiens
AFPQADISI

SEQ ID NO: 1247087 - protein, 9 aa, Homo Sapiens
MVDAVAMDF

SEQ ID NO: 1247088 - protein, 9 aa, Homo Sapiens
TAMNRIRTD

SEQ ID NO: 1247089 - protein, 9 aa, Homo Sapiens
NNKASNSKA

SEQ ID NO: 1247090 - protein, 9 aa, Homo Sapiens
FLWHGKLVL

SEQ ID NO: 1247091 - protein, 9 aa, Homo Sapiens
IGKCLKQSG

SEQ ID NO: 1247092 - protein, 9 aa, Homo Sapiens
GGGITEEPS

SEQ ID NO: 1247093 - protein, 9 aa, Homo Sapiens
EMNVMVQNV

SEQ ID NO: 1247094 - protein, 9 aa, Homo Sapiens
DSLGRPTQE

SEQ ID NO: 1247095 - protein, 9 aa, Homo Sapiens
NEELLAEAS

SEQ ID NO: 1247096 - protein, 9 aa, Homo Sapiens
EPPLSPPNE

SEQ ID NO: 1247097 - protein, 9 aa, Homo Sapiens
ILLFLFSSF

SEQ ID NO: 1247098 - protein, 9 aa, Homo Sapiens
MPKTCILIL

SEQ ID NO: 1247099 - protein, 9 aa, Homo Sapiens
RTGYRPAGH

SEQ ID NO: 1247100 - protein, 9 aa, Homo Sapiens
GLRLIAMLE

SEQ ID NO: 1247101 - protein, 9 aa, Homo Sapiens
FLTLDHYPM

SEQ ID NO: 1247102 - protein, 9 aa, Homo Sapiens
VDNGADDWI

SEQ ID NO: 1247103 - protein, 9 aa, Homo Sapiens
GQQLNGLGL

SEQ ID NO: 1247104 - protein, 9 aa, Homo Sapiens
AGHTPKTAC

SEQ ID NO: 1247105 - protein, 9 aa, Homo Sapiens
CQDALETAS

SEQ ID NO: 1247106 - protein, 9 aa, Homo Sapiens
TPTTPSAAT

SEQ ID NO: 1247107 - protein, 9 aa, Homo Sapiens
GMPARAVST

SEQ ID NO: 1247108 - protein, 9 aa, Homo Sapiens
DLRLKNLPS

SEQ ID NO: 1247109 - protein, 9 aa, Homo Sapiens
CAGISYSTL

SEQ ID NO: 1247110 - protein, 9 aa, Homo Sapiens
YESHILVCF

SEQ ID NO: 1247111 - protein, 9 aa, Homo Sapiens
CNKETVVMK

SEQ ID NO: 1247112 - protein, 9 aa, Homo Sapiens
GQPREIRQS

SEQ ID NO: 1247113 - protein, 9 aa, Homo Sapiens
LQHDNIAKY

SEQ ID NO: 1247114 - protein, 9 aa, Homo Sapiens
HHFPQALTS

SEQ ID NO: 1247115 - protein, 9 aa, Homo Sapiens
NMIAAKQRL

SEQ ID NO: 1247116 - protein, 9 aa, Homo Sapiens
IKNYTKEYN

SEQ ID NO: 1247117 - protein, 9 aa, Homo Sapiens
VPVVSAAVK

SEQ ID NO: 1247118 - protein, 9 aa, Homo Sapiens
AATAAAFKL

SEQ ID NO: 1247119 - protein, 9 aa, Homo Sapiens
NSMRTINQQ

SEQ ID NO: 1247120 - protein, 9 aa, Homo Sapiens
PTESIMFMG

SEQ ID NO: 1247121 - protein, 9 aa, Homo Sapiens
TSMWLAGHP

SEQ ID NO: 1247122 - protein, 9 aa, Homo Sapiens
ALGGLVFAL

SEQ ID NO: 1247123 - protein, 9 aa, Homo Sapiens
ADSQEKGQG

SEQ ID NO: 1247124 - protein, 9 aa, Homo Sapiens
LQALQATIA

SEQ ID NO: 1247125 - protein, 9 aa, Homo Sapiens
IGNDMGYVR

SEQ ID NO: 1247126 - protein, 9 aa, Homo Sapiens
GRLPESLHY

SEQ ID NO: 1247127 - protein, 9 aa, Homo Sapiens
RPALQAQAR

SEQ ID NO: 1247128 - protein, 9 aa, Homo Sapiens
GATSRGVAA

SEQ ID NO: 1247129 - protein, 9 aa, Homo Sapiens
AFKPLKILA

SEQ ID NO: 1247130 - protein, 9 aa, Homo Sapiens
GQGHGQQGQ

SEQ ID NO: 1247131 - protein, 9 aa, Homo Sapiens
ETSDMVCKP

SEQ ID NO: 1247132 - protein, 9 aa, Homo Sapiens
LFPTIVVAR

SEQ ID NO: 1247133 - protein, 9 aa, Homo Sapiens
GSMSLSPPL

SEQ ID NO: 1247134 - protein, 9 aa, Homo Sapiens
ILRNVLWVH

SEQ ID NO: 1247135 - protein, 9 aa, Homo Sapiens
TNTHLPRQP

SEQ ID NO: 1247136 - protein, 9 aa, Homo Sapiens
IYKLTGVVM

SEQ ID NO: 1247137 - protein, 9 aa, Homo Sapiens
VRKPIVLKM

SEQ ID NO: 1247138 - protein, 9 aa, Homo Sapiens
NQWEVRIVA

SEQ ID NO: 1247139 - protein, 9 aa, Homo Sapiens
QKSVACNVG

SEQ ID NO: 1247140 - protein, 9 aa, Homo Sapiens
YGRKCIAKK

SEQ ID NO: 1247141 - protein, 9 aa, Homo Sapiens
GIVDQVVTE

SEQ ID NO: 1247142 - protein, 9 aa, Homo Sapiens
IVTAMRRIR

SEQ ID NO: 1247143 - protein, 9 aa, Homo Sapiens
LKKFENPEV

SEQ ID NO: 1247144 - protein, 9 aa, Homo Sapiens
EWEAAAELE

SEQ ID NO: 1247145 - protein, 9 aa, Homo Sapiens
RPYTCEECD

SEQ ID NO: 1247146 - protein, 9 aa, Homo Sapiens
VDCLDGTCL

SEQ ID NO: 1247147 - protein, 9 aa, Homo Sapiens
EIELEYSRI

SEQ ID NO: 1247148 - protein, 9 aa, Homo Sapiens
AEVMDTYIK

SEQ ID NO: 1247149 - protein, 9 aa, Homo Sapiens
FEKNHCDCN

SEQ ID NO: 1247150 - protein, 9 aa, Homo Sapiens
DRYNVYQSE

SEQ ID NO: 1247151 - protein, 9 aa, Homo Sapiens
IHTHFESKT

SEQ ID NO: 1247152 - protein, 9 aa, Homo Sapiens
NHSSARYAI

SEQ ID NO: 1247153 - protein, 9 aa, Homo Sapiens
LQAQAVAHI

SEQ ID NO: 1247154 - protein, 9 aa, Homo Sapiens
VLIYQKKYL

SEQ ID NO: 1247155 - protein, 9 aa, Homo Sapiens
PVFISKTNN

SEQ ID NO: 1247156 - protein, 9 aa, Homo Sapiens
LMVWDIAYL

SEQ ID NO: 1247157 - protein, 9 aa, Homo Sapiens
IEVLGHAHR

SEQ ID NO: 1247158 - protein, 9 aa, Homo Sapiens
ARVPPTRSQ

SEQ ID NO: 1247159 - protein, 9 aa, Homo Sapiens
KMHFQEGWR

SEQ ID NO: 1247160 - protein, 9 aa, Homo Sapiens
KEPAKEWNV

SEQ ID NO: 1247161 - protein, 9 aa, Homo Sapiens
PSSPAHSPS

SEQ ID NO: 1247162 - protein, 9 aa, Homo Sapiens
AGPRPGGGS

SEQ ID NO: 1247163 - protein, 9 aa, Homo Sapiens
HAFFSPWTL

SEQ ID NO: 1247164 - protein, 9 aa, Homo Sapiens
ETRGECVID

SEQ ID NO: 1247165 - protein, 9 aa, Homo Sapiens
NISKRTEYW

SEQ ID NO: 1247166 - protein, 9 aa, Homo Sapiens
ADIVQAKVE

SEQ ID NO: 1247167 - protein, 9 aa, Homo Sapiens
DFECGRRGS

SEQ ID NO: 1247168 - protein, 9 aa, Homo Sapiens
LNTGQRPYQ

SEQ ID NO: 1247169 - protein, 9 aa, Homo Sapiens
LVVFWFLQY

SEQ ID NO: 1247170 - protein, 9 aa, Homo Sapiens
HADLKHFDP

SEQ ID NO: 1247171 - protein, 9 aa, Homo Sapiens
SRTSLMDCQ

SEQ ID NO: 1247172 - protein, 9 aa, Homo Sapiens
CTVVMSAGA

SEQ ID NO: 1247173 - protein, 9 aa, Homo Sapiens
KMRVTGVII

SEQ ID NO: 1247174 - protein, 9 aa, Homo Sapiens
DSTMHSRVF

SEQ ID NO: 1247175 - protein, 9 aa, Homo Sapiens
DPELLKQML

SEQ ID NO: 1247176 - protein, 9 aa, Homo Sapiens
ARKFLDTAK

SEQ ID NO: 1247177 - protein, 9 aa, Homo Sapiens
VQSAPSSLP

SEQ ID NO: 1247178 - protein, 9 aa, Homo Sapiens
TSSWNRITT

SEQ ID NO: 1247179 - protein, 9 aa, Homo Sapiens
DREFIEILF

SEQ ID NO: 1247180 - protein, 9 aa, Homo Sapiens
FLNRIALMD

SEQ ID NO: 1247181 - protein, 9 aa, Homo Sapiens
IVKKGEEGG

SEQ ID NO: 1247182 - protein, 9 aa, Homo Sapiens
EEEGYDGKE

SEQ ID NO: 1247183 - protein, 9 aa, Homo Sapiens
FGGVAPRCP

SEQ ID NO: 1247184 - protein, 9 aa, Homo Sapiens
KVSVSIMGT

SEQ ID NO: 1247185 - protein, 9 aa, Homo Sapiens
CYTQADGGC

SEQ ID NO: 1247186 - protein, 9 aa, Homo Sapiens
GIPDFLGAP

SEQ ID NO: 1247187 - protein, 9 aa, Homo Sapiens
LAWSVHPLV

SEQ ID NO: 1247188 - protein, 9 aa, Homo Sapiens
FNHPLPLPP

SEQ ID NO: 1247189 - protein, 9 aa, Homo Sapiens
VWPPHLVPN

SEQ ID NO: 1247190 - protein, 9 aa, Homo Sapiens
ALPSSADDN

SEQ ID NO: 1247191 - protein, 9 aa, Homo Sapiens
LSRVPAQEP

SEQ ID NO: 1247192 - protein, 9 aa, Homo Sapiens
KSRVNEILS

SEQ ID NO: 1247193 - protein, 9 aa, Homo Sapiens
RPKQEKDFS

SEQ ID NO: 1247194 - protein, 9 aa, Homo Sapiens
QAEGNISGC

SEQ ID NO: 1247195 - protein, 9 aa, Homo Sapiens
NAEYNPKQF

SEQ ID NO: 1247196 - protein, 9 aa, Homo Sapiens
EEMRKTAED

SEQ ID NO: 1247197 - protein, 9 aa, Homo Sapiens
HYPSIMAGK

SEQ ID NO: 1247198 - protein, 9 aa, Homo Sapiens
DDHKYMDII

SEQ ID NO: 1247199 - protein, 9 aa, Homo Sapiens
RMTFTRAQL

SEQ ID NO: 1247200 - protein, 9 aa, Homo Sapiens
EYASNKLPC

SEQ ID NO: 1247201 - protein, 9 aa, Homo Sapiens
SAACGGRER

SEQ ID NO: 1247202 - protein, 9 aa, Homo Sapiens
ATPAHALQC

SEQ ID NO: 1247203 - protein, 9 aa, Homo Sapiens
FSDWDKWLS

SEQ ID NO: 1247204 - protein, 9 aa, Homo Sapiens
NYTINNKRN

SEQ ID NO: 1247205 - protein, 9 aa, Homo Sapiens
QSQQENTIN

SEQ ID NO: 1247206 - protein, 9 aa, Homo Sapiens
ECSSNCTTV

SEQ ID NO: 1247207 - protein, 9 aa, Homo Sapiens
PCPPPRAPP

SEQ ID NO: 1247208 - protein, 9 aa, Homo Sapiens
NEQAAHSTE

SEQ ID NO: 1247209 - protein, 9 aa, Homo Sapiens
RPVQHHEVQ

SEQ ID NO: 1247210 - protein, 9 aa, Homo Sapiens
AGGQTQVRA

SEQ ID NO: 1247211 - protein, 9 aa, Homo Sapiens
WSLDDLRDC

SEQ ID NO: 1247212 - protein, 9 aa, Homo Sapiens
ALHQCLSLT

SEQ ID NO: 1247213 - protein, 9 aa, Homo Sapiens
PTVTIWMCR

SEQ ID NO: 1247214 - protein, 9 aa, Homo Sapiens
LFLAVLNFT

SEQ ID NO: 1247215 - protein, 9 aa, Homo Sapiens
DMTALFQEA

SEQ ID NO: 1247216 - protein, 9 aa, Homo Sapiens
SVSTPDSVT

SEQ ID NO: 1247217 - protein, 9 aa, Homo Sapiens
GSQQCHHVY

SEQ ID NO: 1247218 - protein, 9 aa, Homo Sapiens
LEVYLTLTN

SEQ ID NO: 1247219 - protein, 9 aa, Homo Sapiens
CGSRGSGCR

SEQ ID NO: 1247220 - protein, 9 aa, Homo Sapiens
LSTFLDPFK

SEQ ID NO: 1247221 - protein, 9 aa, Homo Sapiens
DVKKEVDKE

SEQ ID NO: 1247222 - protein, 9 aa, Homo Sapiens
LVDFIISDF

SEQ ID NO: 1247223 - protein, 9 aa, Homo Sapiens
QHPPPGFTP

SEQ ID NO: 1247224 - protein, 9 aa, Homo Sapiens
RVVTNKQAV

SEQ ID NO: 1247225 - protein, 9 aa, Homo Sapiens
FSTEILLSR

SEQ ID NO: 1247226 - protein, 9 aa, Homo Sapiens
PWSRTLASM

SEQ ID NO: 1247227 - protein, 9 aa, Homo Sapiens
GAASAPAPP

SEQ ID NO: 1247228 - protein, 9 aa, Homo Sapiens
EEFWQQERS

SEQ ID NO: 1247229 - protein, 9 aa, Homo Sapiens
KTPPMSLSA

SEQ ID NO: 1247230 - protein, 9 aa, Homo Sapiens
LRPTRKVAV

SEQ ID NO: 1247231 - protein, 9 aa, Homo Sapiens
SSLNRHMKS

SEQ ID NO: 1247232 - protein, 9 aa, Homo Sapiens
ERMLTQADE

SEQ ID NO: 1247233 - protein, 9 aa, Homo Sapiens
AVGKPDFFS

SEQ ID NO: 1247234 - protein, 9 aa, Homo Sapiens
DANVKTAPQ

SEQ ID NO: 1247235 - protein, 9 aa, Homo Sapiens
KSERADRSL

SEQ ID NO: 1247236 - protein, 9 aa, Homo Sapiens
YIYPMIIHM

SEQ ID NO: 1247237 - protein, 9 aa, Homo Sapiens
LIKHEIQRK

SEQ ID NO: 1247238 - protein, 9 aa, Homo Sapiens
TEMSGRIVG

SEQ ID NO: 1247239 - protein, 9 aa, Homo Sapiens
VSHRTQPLS

SEQ ID NO: 1247240 - protein, 9 aa, Homo Sapiens
GLALCGIVS

SEQ ID NO: 1247241 - protein, 9 aa, Homo Sapiens
CSSCPTLIY

SEQ ID NO: 1247242 - protein, 9 aa, Homo Sapiens
GGDTTEHIH

SEQ ID NO: 1247243 - protein, 9 aa, Homo Sapiens
IVPQSPAAQ

SEQ ID NO: 1247244 - protein, 9 aa, Homo Sapiens
HPAQGLAGR

SEQ ID NO: 1247245 - protein, 9 aa, Homo Sapiens
MTPSCSVLH

SEQ ID NO: 1247246 - protein, 9 aa, Homo Sapiens
IGHTVMAPM

SEQ ID NO: 1247247 - protein, 9 aa, Homo Sapiens
VTEMSGRIV

SEQ ID NO: 1247248 - protein, 9 aa, Homo Sapiens
RTRPQKPIR

SEQ ID NO: 1247249 - protein, 9 aa, Homo Sapiens
KTPIAFRMN

SEQ ID NO: 1247250 - protein, 9 aa, Homo Sapiens
QELLIGMLT

SEQ ID NO: 1247251 - protein, 9 aa, Homo Sapiens
VKKVLPELI

SEQ ID NO: 1247252 - protein, 9 aa, Homo Sapiens
MRILGAWLA

SEQ ID NO: 1247253 - protein, 9 aa, Homo Sapiens
TTENLGAAN

SEQ ID NO: 1247254 - protein, 9 aa, Homo Sapiens
VSKNVLQYR

SEQ ID NO: 1247255 - protein, 9 aa, Homo Sapiens
VELELNDFM

SEQ ID NO: 1247256 - protein, 9 aa, Homo Sapiens
AILQNYWTE

SEQ ID NO: 1247257 - protein, 9 aa, Homo Sapiens
YSRDLRDHR

SEQ ID NO: 1247258 - protein, 9 aa, Homo Sapiens
QEHKTAVSV

SEQ ID NO: 1247259 - protein, 9 aa, Homo Sapiens
SLVFKRMDS

SEQ ID NO: 1247260 - protein, 9 aa, Homo Sapiens
EQECLTFTS

SEQ ID NO: 1247261 - protein, 9 aa, Homo Sapiens
QSPLVLKQV

SEQ ID NO: 1247262 - protein, 9 aa, Homo Sapiens
VFASMRILG

SEQ ID NO: 1247263 - protein, 9 aa, Homo Sapiens
LARAVREGM

SEQ ID NO: 1247264 - protein, 9 aa, Homo Sapiens
AYQSRNYYN

SEQ ID NO: 1247265 - protein, 9 aa, Homo Sapiens
AGHSQISHI

SEQ ID NO: 1247266 - protein, 9 aa, Homo Sapiens
PVFVWTLRD

SEQ ID NO: 1247267 - protein, 9 aa, Homo Sapiens
AALIVTSVV

SEQ ID NO: 1247268 - protein, 9 aa, Homo Sapiens
ISQPLPSQS

SEQ ID NO: 1247269 - protein, 9 aa, Homo Sapiens
HPFGYLQQE

SEQ ID NO: 1247270 - protein, 9 aa, Homo Sapiens
RSAVDISPG

SEQ ID NO: 1247271 - protein, 9 aa, Homo Sapiens
YLADQDRPI

SEQ ID NO: 1247272 - protein, 9 aa, Homo Sapiens
DMELPPLKL

SEQ ID NO: 1247273 - protein, 9 aa, Homo Sapiens
GIMGPFGIP

SEQ ID NO: 1247274 - protein, 9 aa, Homo Sapiens
EDIVGTMVF

SEQ ID NO: 1247275 - protein, 9 aa, Homo Sapiens
ISVCVFPAS

SEQ ID NO: 1247276 - protein, 9 aa, Homo Sapiens
VLDEAESTV

SEQ ID NO: 1247277 - protein, 9 aa, Homo Sapiens
EATQVVASL

SEQ ID NO: 1247278 - protein, 9 aa, Homo Sapiens
CVECEDPFD

SEQ ID NO: 1247279 - protein, 9 aa, Homo Sapiens
GHSIVGFVM

SEQ ID NO: 1247280 - protein, 9 aa, Homo Sapiens
RYAADINIR

SEQ ID NO: 1247281 - protein, 9 aa, Homo Sapiens
SRGLSRIII

SEQ ID NO: 1247282 - protein, 9 aa, Homo Sapiens
DQLEEIKEA

SEQ ID NO: 1247283 - protein, 9 aa, Homo Sapiens
TREAALDTR

SEQ ID NO: 1247284 - protein, 9 aa, Homo Sapiens
PHKYILVSC

SEQ ID NO: 1247285 - protein, 9 aa, Homo Sapiens
YPWTIDNTY

SEQ ID NO: 1247286 - protein, 9 aa, Homo Sapiens
AIDVPVGHS

SEQ ID NO: 1247287 - protein, 9 aa, Homo Sapiens
ASWVICFTI

SEQ ID NO: 1247288 - protein, 9 aa, Homo Sapiens
DGMMERRET

SEQ ID NO: 1247289 - protein, 9 aa, Homo Sapiens
KRTTYVMFG

SEQ ID NO: 1247290 - protein, 9 aa, Homo Sapiens
EALCKERAC

SEQ ID NO: 1247291 - protein, 9 aa, Homo Sapiens
MSAAAAATA

SEQ ID NO: 1247292 - protein, 9 aa, Homo Sapiens
KMCDPGMTS

SEQ ID NO: 1247293 - protein, 9 aa, Homo Sapiens
MVYITEFVN

SEQ ID NO: 1247294 - protein, 9 aa, Homo Sapiens
CESCLQNYI

SEQ ID NO: 1247295 - protein, 9 aa, Homo Sapiens
EYERWTGHE

SEQ ID NO: 1247296 - protein, 9 aa, Homo Sapiens
RQKIHSLDV

SEQ ID NO: 1247297 - protein, 9 aa, Homo Sapiens
FSEEAHRVY

SEQ ID NO: 1247298 - protein, 9 aa, Homo Sapiens
GMKFLEDCH

SEQ ID NO: 1247299 - protein, 9 aa, Homo Sapiens
VLVEGGHTQ

SEQ ID NO: 1247300 - protein, 9 aa, Homo Sapiens
SGMALDEET

SEQ ID NO: 1247301 - protein, 9 aa, Homo Sapiens
DVSFAYPNH

SEQ ID NO: 1247302 - protein, 9 aa, Homo Sapiens
PEDVTSPFP

SEQ ID NO: 1247303 - protein, 9 aa, Homo Sapiens
AGPWNTSSL

SEQ ID NO: 1247304 - protein, 9 aa, Homo Sapiens
AVDVVLFGP

SEQ ID NO: 1247305 - protein, 9 aa, Homo Sapiens
LDLFDNTRD

SEQ ID NO: 1247306 - protein, 9 aa, Homo Sapiens
HYKVLIFTS

SEQ ID NO: 1247307 - protein, 9 aa, Homo Sapiens
LVGTKLGLR

SEQ ID NO: 1247308 - protein, 9 aa, Homo Sapiens
LGGRIVRRE

SEQ ID NO: 1247309 - protein, 9 aa, Homo Sapiens
LVQQCVLLL

SEQ ID NO: 1247310 - protein, 9 aa, Homo Sapiens
VSLSLKGAP

SEQ ID NO: 1247311 - protein, 9 aa, Homo Sapiens
DTQDPPEDM

SEQ ID NO: 1247312 - protein, 9 aa, Homo Sapiens
REGLMVKRG

SEQ ID NO: 1247313 - protein, 9 aa, Homo Sapiens
AGASPTVCA

SEQ ID NO: 1247314 - protein, 9 aa, Homo Sapiens
RDEIQESSD

SEQ ID NO: 1247315 - protein, 9 aa, Homo Sapiens
GPTPRSGTT

SEQ ID NO: 1247316 - protein, 9 aa, Homo Sapiens
PNQHRSTYK

SEQ ID NO: 1247317 - protein, 9 aa, Homo Sapiens
SRAVLWLDW

SEQ ID NO: 1247318 - protein, 9 aa, Homo Sapiens
NFTQEEWKR

SEQ ID NO: 1247319 - protein, 9 aa, Homo Sapiens
LKPGELKSL

SEQ ID NO: 1247320 - protein, 9 aa, Homo Sapiens
HDGKEKTGA

SEQ ID NO: 1247321 - protein, 9 aa, Homo Sapiens
MGRPHSRRR

SEQ ID NO: 1247322 - protein, 9 aa, Homo Sapiens
RDAEALVDQ

SEQ ID NO: 1247323 - protein, 9 aa, Homo Sapiens
DIMRSEDPR

SEQ ID NO: 1247324 - protein, 9 aa, Homo Sapiens
LRIIFPLFM

SEQ ID NO: 1247325 - protein, 9 aa, Homo Sapiens
RFLAWKWDY

SEQ ID NO: 1247326 - protein, 9 aa, Homo Sapiens
GSALPNGLG

SEQ ID NO: 1247327 - protein, 9 aa, Homo Sapiens
DASVSFHHL

SEQ ID NO: 1247328 - protein, 9 aa, Homo Sapiens
CLLIFFSKD

SEQ ID NO: 1247329 - protein, 9 aa, Homo Sapiens
RPPALSLRS

SEQ ID NO: 1247330 - protein, 9 aa, Homo Sapiens
SGAQTARTH

SEQ ID NO: 1247331 - protein, 9 aa, Homo Sapiens
KISQENVKA

SEQ ID NO: 1247332 - protein, 9 aa, Homo Sapiens
GDQASSDVE

SEQ ID NO: 1247333 - protein, 9 aa, Homo Sapiens
IQFQPNSPA

SEQ ID NO: 1247334 - protein, 9 aa, Homo Sapiens
CFEGVTSII

SEQ ID NO: 1247335 - protein, 9 aa, Homo Sapiens
TNREGVPMH

SEQ ID NO: 1247336 - protein, 9 aa, Homo Sapiens
FTKASQGRS

SEQ ID NO: 1247337 - protein, 9 aa, Homo Sapiens
RKRLRKKHR

SEQ ID NO: 1247338 - protein, 9 aa, Homo Sapiens
VMCLAFHPT

SEQ ID NO: 1247339 - protein, 9 aa, Homo Sapiens
NDINNVLFT

SEQ ID NO: 1247340 - protein, 9 aa, Homo Sapiens
IDNEKNTAS

SEQ ID NO: 1247341 - protein, 9 aa, Homo Sapiens
HMAMCHRRM

SEQ ID NO: 1247342 - protein, 9 aa, Homo Sapiens
CVNLAKNAS

SEQ ID NO: 1247343 - protein, 9 aa, Homo Sapiens
IYFLIQKIF

SEQ ID NO: 1247344 - protein, 9 aa, Homo Sapiens
NNPEVTFHS

SEQ ID NO: 1247345 - protein, 9 aa, Homo Sapiens
GCLAGPVVE

SEQ ID NO: 1247346 - protein, 9 aa, Homo Sapiens
KANWKKISI

SEQ ID NO: 1247347 - protein, 9 aa, Homo Sapiens
TKGFTTLFT

SEQ ID NO: 1247348 - protein, 9 aa, Homo Sapiens
HHRKFDAKG

SEQ ID NO: 1247349 - protein, 9 aa, Homo Sapiens
RRKIPESVG

SEQ ID NO: 1247350 - protein, 9 aa, Homo Sapiens
ADSEPESDV

SEQ ID NO: 1247351 - protein, 9 aa, Homo Sapiens
PRPQLQSVV

SEQ ID NO: 1247352 - protein, 9 aa, Homo Sapiens
KSGGREYLR

SEQ ID NO: 1247353 - protein, 9 aa, Homo Sapiens
HLDHVLYEW

SEQ ID NO: 1247354 - protein, 9 aa, Homo Sapiens
VSAPSVSRE

SEQ ID NO: 1247355 - protein, 9 aa, Homo Sapiens
SHRGAGVLA

SEQ ID NO: 1247356 - protein, 9 aa, Homo Sapiens
HSITDFWKF

SEQ ID NO: 1247357 - protein, 9 aa, Homo Sapiens
EQVLQGEPV

SEQ ID NO: 1247358 - protein, 9 aa, Homo Sapiens
KIMSDPDSS

SEQ ID NO: 1247359 - protein, 9 aa, Homo Sapiens
NLLDQALQN

SEQ ID NO: 1247360 - protein, 9 aa, Homo Sapiens
REHREKERE

SEQ ID NO: 1247361 - protein, 9 aa, Homo Sapiens
NNPAIRDTK

SEQ ID NO: 1247362 - protein, 9 aa, Homo Sapiens
RSVAVHRLL

SEQ ID NO: 1247363 - protein, 9 aa, Homo Sapiens
EPWELNSGD

SEQ ID NO: 1247364 - protein, 9 aa, Homo Sapiens
EVDFDAFFT

SEQ ID NO: 1247365 - protein, 9 aa, Homo Sapiens
DIHHMFVRD

SEQ ID NO: 1247366 - protein, 9 aa, Homo Sapiens
EDMGQFIKH

SEQ ID NO: 1247367 - protein, 9 aa, Homo Sapiens
DVHAAVTAA

SEQ ID NO: 1247368 - protein, 9 aa, Homo Sapiens
PVACIHFTV

SEQ ID NO: 1247369 - protein, 9 aa, Homo Sapiens
NFFTGDVFG

SEQ ID NO: 1247370 - protein, 9 aa, Homo Sapiens
CFDSSVFGV

SEQ ID NO: 1247371 - protein, 9 aa, Homo Sapiens
VTGNRIGGK

SEQ ID NO: 1247372 - protein, 9 aa, Homo Sapiens
AQKLILEQL

SEQ ID NO: 1247373 - protein, 9 aa, Homo Sapiens
RLQQNVTEV

SEQ ID NO: 1247374 - protein, 9 aa, Homo Sapiens
SLIGIAGSG

SEQ ID NO: 1247375 - protein, 9 aa, Homo Sapiens
DVNKAIDQL

SEQ ID NO: 1247376 - protein, 9 aa, Homo Sapiens
CMVEKILVL

SEQ ID NO: 1247377 - protein, 9 aa, Homo Sapiens
DVMSSEGRA

SEQ ID NO: 1247378 - protein, 9 aa, Homo Sapiens
TTTSLVTSS

SEQ ID NO: 1247379 - protein, 9 aa, Homo Sapiens
KEGNHLLGG

SEQ ID NO: 1247380 - protein, 9 aa, Homo Sapiens
KPESKQDPV

SEQ ID NO: 1247381 - protein, 9 aa, Homo Sapiens
PMSLHPWLF

SEQ ID NO: 1247382 - protein, 9 aa, Homo Sapiens
LNPRPCQIH

SEQ ID NO: 1247383 - protein, 9 aa, Homo Sapiens
LEDSVIAYG

SEQ ID NO: 1247384 - protein, 9 aa, Homo Sapiens
LPLLEMYSK

SEQ ID NO: 1247385 - protein, 9 aa, Homo Sapiens
GIPPSSVLD

SEQ ID NO: 1247386 - protein, 9 aa, Homo Sapiens
PPDVDLKKL

SEQ ID NO: 1247387 - protein, 9 aa, Homo Sapiens
LIHKNRPDL

SEQ ID NO: 1247388 - protein, 9 aa, Homo Sapiens
IHLKLGAIR

SEQ ID NO: 1247389 - protein, 9 aa, Homo Sapiens
QSGRGEHPN

SEQ ID NO: 1247390 - protein, 9 aa, Homo Sapiens
ALCGIVSTS

SEQ ID NO: 1247391 - protein, 9 aa, Homo Sapiens
FYDQILCDV

SEQ ID NO: 1247392 - protein, 9 aa, Homo Sapiens
PCPFAPKEA

SEQ ID NO: 1247393 - protein, 9 aa, Homo Sapiens
MWDDSRNKR

SEQ ID NO: 1247394 - protein, 9 aa, Homo Sapiens
ESFRKVLIY

SEQ ID NO: 1247395 - protein, 9 aa, Homo Sapiens
LPDLEYLMK

SEQ ID NO: 1247396 - protein, 9 aa, Homo Sapiens
NMSFVNNCF

SEQ ID NO: 1247397 - protein, 9 aa, Homo Sapiens
IFFIGIAIH

SEQ ID NO: 1247398 - protein, 9 aa, Homo Sapiens
ETKHLSIGK

SEQ ID NO: 1247399 - protein, 9 aa, Homo Sapiens
DIMLVKLNS

SEQ ID NO: 1247400 - protein, 9 aa, Homo Sapiens
QPLLGALVP

SEQ ID NO: 1247401 - protein, 9 aa, Homo Sapiens
AAPPESPQT

SEQ ID NO: 1247402 - protein, 9 aa, Homo Sapiens
EAPEVEPHL

SEQ ID NO: 1247403 - protein, 9 aa, Homo Sapiens
VDDVNVYFS

SEQ ID NO: 1247404 - protein, 9 aa, Homo Sapiens
LVEGGHTQD

SEQ ID NO: 1247405 - protein, 9 aa, Homo Sapiens
RDFGVNGHV

SEQ ID NO: 1247406 - protein, 9 aa, Homo Sapiens
SIMGTRGES

SEQ ID NO: 1247407 - protein, 9 aa, Homo Sapiens
SLTAASPPA

SEQ ID NO: 1247408 - protein, 9 aa, Homo Sapiens
HDQVLIKQT

SEQ ID NO: 1247409 - protein, 9 aa, Homo Sapiens
RIIQLLCFL

SEQ ID NO: 1247410 - protein, 9 aa, Homo Sapiens
LYDSNLRIE

SEQ ID NO: 1247411 - protein, 9 aa, Homo Sapiens
AVRYQGHAQ

SEQ ID NO: 1247412 - protein, 9 aa, Homo Sapiens
PDDQGPWRP

SEQ ID NO: 1247413 - protein, 9 aa, Homo Sapiens
QLQHLGTPI

SEQ ID NO: 1247414 - protein, 9 aa, Homo Sapiens
LLIGTAWGR

SEQ ID NO: 1247415 - protein, 9 aa, Homo Sapiens
LGIWVLVTA

SEQ ID NO: 1247416 - protein, 9 aa, Homo Sapiens
SFSFMVFFF

SEQ ID NO: 1247417 - protein, 9 aa, Homo Sapiens
ASEAVLWEV

SEQ ID NO: 1247418 - protein, 9 aa, Homo Sapiens
WDGKYLSFT

SEQ ID NO: 1247419 - protein, 9 aa, Homo Sapiens
YYYSYLLKE

SEQ ID NO: 1247420 - protein, 9 aa, Homo Sapiens
LQQAAVLGL

SEQ ID NO: 1247421 - protein, 9 aa, Homo Sapiens
GEEIHRKQR

SEQ ID NO: 1247422 - protein, 9 aa, Homo Sapiens
KYILNEEMS

SEQ ID NO: 1247423 - protein, 9 aa, Homo Sapiens
VNIRDDERL

SEQ ID NO: 1247424 - protein, 9 aa, Homo Sapiens
GHLGQGGPR

SEQ ID NO: 1247425 - protein, 9 aa, Homo Sapiens
YEEEERKED

SEQ ID NO: 1247426 - protein, 9 aa, Homo Sapiens
DHCISRDLT

SEQ ID NO: 1247427 - protein, 9 aa, Homo Sapiens
ILPSGMVIF

SEQ ID NO: 1247428 - protein, 9 aa, Homo Sapiens
SCKNVCFDD

SEQ ID NO: 1247429 - protein, 9 aa, Homo Sapiens
DVTARAGPW

SEQ ID NO: 1247430 - protein, 9 aa, Homo Sapiens
QKAFSTCTT

SEQ ID NO: 1247431 - protein, 9 aa, Homo Sapiens
SQCKIMQKK

SEQ ID NO: 1247432 - protein, 9 aa, Homo Sapiens
REPAPEWAI

SEQ ID NO: 1247433 - protein, 9 aa, Homo Sapiens
RLNMLLRFS

SEQ ID NO: 1247434 - protein, 9 aa, Homo Sapiens
YDNATDLDD

SEQ ID NO: 1247435 - protein, 9 aa, Homo Sapiens
LDPHTCWEY

SEQ ID NO: 1247436 - protein, 9 aa, Homo Sapiens
AEKRKTTMK

SEQ ID NO: 1247437 - protein, 9 aa, Homo Sapiens
VTTIIAPMM

SEQ ID NO: 1247438 - protein, 9 aa, Homo Sapiens
SRQLLRQRG

SEQ ID NO: 1247439 - protein, 9 aa, Homo Sapiens
CTRINHSYT

SEQ ID NO: 1247440 - protein, 9 aa, Homo Sapiens
VSAISQKIF

SEQ ID NO: 1247441 - protein, 9 aa, Homo Sapiens
FSEDSVTVD

SEQ ID NO: 1247442 - protein, 9 aa, Homo Sapiens
SVNSRGLSR

SEQ ID NO: 1247443 - protein, 9 aa, Homo Sapiens
IMCWASDTM

SEQ ID NO: 1247444 - protein, 9 aa, Homo Sapiens
VLFFIIGVI

SEQ ID NO: 1247445 - protein, 9 aa, Homo Sapiens
LEPLKNAVV

SEQ ID NO: 1247446 - protein, 9 aa, Homo Sapiens
NFSHWSLQT

SEQ ID NO: 1247447 - protein, 9 aa, Homo Sapiens
VDSLMFGGN

SEQ ID NO: 1247448 - protein, 9 aa, Homo Sapiens
GCLGHGNLT

SEQ ID NO: 1247449 - protein, 9 aa, Homo Sapiens
FTLFENGPC

SEQ ID NO: 1247450 - protein, 9 aa, Homo Sapiens
FTDHAISMD

SEQ ID NO: 1247451 - protein, 9 aa, Homo Sapiens
VTKPSQVLE

SEQ ID NO: 1247452 - protein, 9 aa, Homo Sapiens
LSTQTINFG

SEQ ID NO: 1247453 - protein, 9 aa, Homo Sapiens
LGRLPESLH

SEQ ID NO: 1247454 - protein, 9 aa, Homo Sapiens
PGCVLYTWD

SEQ ID NO: 1247455 - protein, 9 aa, Homo Sapiens
PSSSATSSP

SEQ ID NO: 1247456 - protein, 9 aa, Homo Sapiens
QSPLLPAWM

SEQ ID NO: 1247457 - protein, 9 aa, Homo Sapiens
MQLYEAWKQ

SEQ ID NO: 1247458 - protein, 9 aa, Homo Sapiens
KLALLGASA

SEQ ID NO: 1247459 - protein, 9 aa, Homo Sapiens
DFEHCTCTL

SEQ ID NO: 1247460 - protein, 9 aa, Homo Sapiens
SSWGEVLFL

SEQ ID NO: 1247461 - protein, 9 aa, Homo Sapiens
EKIDGEDGI

SEQ ID NO: 1247462 - protein, 9 aa, Homo Sapiens
RHNLTGILE

SEQ ID NO: 1247463 - protein, 9 aa, Homo Sapiens
QVGCELKKV

SEQ ID NO: 1247464 - protein, 9 aa, Homo Sapiens
GGNAGVRGK

SEQ ID NO: 1247465 - protein, 9 aa, Homo Sapiens
ELDPLLCHS

SEQ ID NO: 1247466 - protein, 9 aa, Homo Sapiens
ETTQLAKIR

SEQ ID NO: 1247467 - protein, 9 aa, Homo Sapiens
FQTVKNVVL

SEQ ID NO: 1247468 - protein, 9 aa, Homo Sapiens
KTHRFLFNK

SEQ ID NO: 1247469 - protein, 9 aa, Homo Sapiens
LSELDHLLL

SEQ ID NO: 1247470 - protein, 9 aa, Homo Sapiens
EAEEWFECK

SEQ ID NO: 1247471 - protein, 9 aa, Homo Sapiens
EKRWGCVSA

SEQ ID NO: 1247472 - protein, 9 aa, Homo Sapiens
YQCGKCGKR

SEQ ID NO: 1247473 - protein, 9 aa, Homo Sapiens
VVVPAKMYP

SEQ ID NO: 1247474 - protein, 9 aa, Homo Sapiens
RYGKDKAPI

SEQ ID NO: 1247475 - protein, 9 aa, Homo Sapiens
IKNEADMTL

SEQ ID NO: 1247476 - protein, 9 aa, Homo Sapiens
YPDIYAREM

SEQ ID NO: 1247477 - protein, 9 aa, Homo Sapiens
MDAYTHVCI

SEQ ID NO: 1247478 - protein, 9 aa, Homo Sapiens
HGPPPPPGL

SEQ ID NO: 1247479 - protein, 9 aa, Homo Sapiens
ILDYHNLNL

SEQ ID NO: 1247480 - protein, 9 aa, Homo Sapiens
NVQPILNVI

SEQ ID NO: 1247481 - protein, 9 aa, Homo Sapiens
VYSAPCGGY

SEQ ID NO: 1247482 - protein, 9 aa, Homo Sapiens
LNRHMKSHT

SEQ ID NO: 1247483 - protein, 9 aa, Homo Sapiens
TFRMPSRVH

SEQ ID NO: 1247484 - protein, 9 aa, Homo Sapiens
STPWQPTRP

SEQ ID NO: 1247485 - protein, 9 aa, Homo Sapiens
YIPKALQKA

SEQ ID NO: 1247486 - protein, 9 aa, Homo Sapiens
RTHEPPRPE

SEQ ID NO: 1247487 - protein, 9 aa, Homo Sapiens
IFIHRDIIH

SEQ ID NO: 1247488 - protein, 9 aa, Homo Sapiens
SWLCGPATW

SEQ ID NO: 1247489 - protein, 9 aa, Homo Sapiens
NFFTKLPIG

SEQ ID NO: 1247490 - protein, 9 aa, Homo Sapiens
FDVCVKTCS

SEQ ID NO: 1247491 - protein, 9 aa, Homo Sapiens
GDLRENMTP

SEQ ID NO: 1247492 - protein, 9 aa, Homo Sapiens
VFKVPTSIT

SEQ ID NO: 1247493 - protein, 9 aa, Homo Sapiens
KLHCLCMCW

SEQ ID NO: 1247494 - protein, 9 aa, Homo Sapiens
SNSLMGIFN

SEQ ID NO: 1247495 - protein, 9 aa, Homo Sapiens
DAQPAETLP

SEQ ID NO: 1247496 - protein, 9 aa, Homo Sapiens
SPGPEPAPA

SEQ ID NO: 1247497 - protein, 9 aa, Homo Sapiens
RFHEYWRFV

SEQ ID NO: 1247498 - protein, 9 aa, Homo Sapiens
VKTAMIGAC

SEQ ID NO: 1247499 - protein, 9 aa, Homo Sapiens
REKTRWLSS

SEQ ID NO: 1247500 - protein, 9 aa, Homo Sapiens
YIMSGSRDA

SEQ ID NO: 1247501 - protein, 9 aa, Homo Sapiens
TTLHLAAEE

SEQ ID NO: 1247502 - protein, 9 aa, Homo Sapiens
APAQLCHRL

SEQ ID NO: 1247503 - protein, 9 aa, Homo Sapiens
SYTSQKTSG

SEQ ID NO: 1247504 - protein, 9 aa, Homo Sapiens
EDVLFAMST

SEQ ID NO: 1247505 - protein, 9 aa, Homo Sapiens
VILKLYPCM

SEQ ID NO: 1247506 - protein, 9 aa, Homo Sapiens
LPMVDAVAM

SEQ ID NO: 1247507 - protein, 9 aa, Homo Sapiens
HDGSEEDID

SEQ ID NO: 1247508 - protein, 9 aa, Homo Sapiens
GQAVRYQGH

SEQ ID NO: 1247509 - protein, 9 aa, Homo Sapiens
AEALVDQVL

SEQ ID NO: 1247510 - protein, 9 aa, Homo Sapiens
FCPLLCTME

SEQ ID NO: 1247511 - protein, 9 aa, Homo Sapiens
LGHALRLEH

SEQ ID NO: 1247512 - protein, 9 aa, Homo Sapiens
QMSAAAAAT

SEQ ID NO: 1247513 - protein, 9 aa, Homo Sapiens
WMVHIDEEM

SEQ ID NO: 1247514 - protein, 9 aa, Homo Sapiens
VDRLLKQDC

SEQ ID NO: 1247515 - protein, 9 aa, Homo Sapiens
EETAAMCVC

SEQ ID NO: 1247516 - protein, 9 aa, Homo Sapiens
VSMLHTMLR

SEQ ID NO: 1247517 - protein, 9 aa, Homo Sapiens
HYPGPAGPV

SEQ ID NO: 1247518 - protein, 9 aa, Homo Sapiens
LSSMICVPL

SEQ ID NO: 1247519 - protein, 9 aa, Homo Sapiens
VTNPDFKAG

SEQ ID NO: 1247520 - protein, 9 aa, Homo Sapiens
VNTTFEAGE

SEQ ID NO: 1247521 - protein, 9 aa, Homo Sapiens
EPASLKEAH

SEQ ID NO: 1247522 - protein, 9 aa, Homo Sapiens
MTRDADEYY

SEQ ID NO: 1247523 - protein, 9 aa, Homo Sapiens
TWASPCSLS

SEQ ID NO: 1247524 - protein, 9 aa, Homo Sapiens
NDGHWDINF

SEQ ID NO: 1247525 - protein, 9 aa, Homo Sapiens
KCLRVPPLG

SEQ ID NO: 1247526 - protein, 9 aa, Homo Sapiens
CNSMQSECR

SEQ ID NO: 1247527 - protein, 9 aa, Homo Sapiens
GEKPYQCGK

SEQ ID NO: 1247528 - protein, 9 aa, Homo Sapiens
HLVPNQHRS

SEQ ID NO: 1247529 - protein, 9 aa, Homo Sapiens
FIHRDIIHC

SEQ ID NO: 1247530 - protein, 9 aa, Homo Sapiens
TYSSGTFYE

SEQ ID NO: 1247531 - protein, 9 aa, Homo Sapiens
IRRPPSGME

SEQ ID NO: 1247532 - protein, 9 aa, Homo Sapiens
FIECLDCDM

SEQ ID NO: 1247533 - protein, 9 aa, Homo Sapiens
VYGVPHLLR

SEQ ID NO: 1247534 - protein, 9 aa, Homo Sapiens
EPSSTSFTP

SEQ ID NO: 1247535 - protein, 9 aa, Homo Sapiens
QDDLQCYRQ

SEQ ID NO: 1247536 - protein, 9 aa, Homo Sapiens
TVKFYWILT

SEQ ID NO: 1247537 - protein, 9 aa, Homo Sapiens
ITSSDFASL

SEQ ID NO: 1247538 - protein, 9 aa, Homo Sapiens
GTFGMYCRE

SEQ ID NO: 1247539 - protein, 9 aa, Homo Sapiens
NEAGKSTTF

SEQ ID NO: 1247540 - protein, 9 aa, Homo Sapiens
YAIGGYGPV

SEQ ID NO: 1247541 - protein, 9 aa, Homo Sapiens
WSAQPVTED

SEQ ID NO: 1247542 - protein, 9 aa, Homo Sapiens
CTFLDFSSG

SEQ ID NO: 1247543 - protein, 9 aa, Homo Sapiens
EKMLDQSPT

SEQ ID NO: 1247544 - protein, 9 aa, Homo Sapiens
QDHMVPGRP

SEQ ID NO: 1247545 - protein, 9 aa, Homo Sapiens
SNTYCFRVL

SEQ ID NO: 1247546 - protein, 9 aa, Homo Sapiens
PAKPKYFSA

SEQ ID NO: 1247547 - protein, 9 aa, Homo Sapiens
KMDIFEFQV

SEQ ID NO: 1247548 - protein, 9 aa, Homo Sapiens
NINLWLFLF

SEQ ID NO: 1247549 - protein, 9 aa, Homo Sapiens
SIIVLLLLA

SEQ ID NO: 1247550 - protein, 9 aa, Homo Sapiens
FSAKQKLIV

SEQ ID NO: 1247551 - protein, 9 aa, Homo Sapiens
RMEQLVFCQ

SEQ ID NO: 1247552 - protein, 9 aa, Homo Sapiens
QESLMVLEE

SEQ ID NO: 1247553 - protein, 9 aa, Homo Sapiens
LTCAVIKVA

SEQ ID NO: 1247554 - protein, 9 aa, Homo Sapiens
SPGVHPEVE

SEQ ID NO: 1247555 - protein, 9 aa, Homo Sapiens
LSSVSSFMI

SEQ ID NO: 1247556 - protein, 9 aa, Homo Sapiens
YKAPSFTSQ

SEQ ID NO: 1247557 - protein, 9 aa, Homo Sapiens
PKKPAKSKL

SEQ ID NO: 1247558 - protein, 9 aa, Homo Sapiens
HLAQGQVLR

SEQ ID NO: 1247559 - protein, 9 aa, Homo Sapiens
HRKPRKQNT

SEQ ID NO: 1247560 - protein, 9 aa, Homo Sapiens
LSEWRYVQR

SEQ ID NO: 1247561 - protein, 9 aa, Homo Sapiens
LSSVSSFMY

SEQ ID NO: 1247562 - protein, 9 aa, Homo Sapiens
RLQEQQRTV

SEQ ID NO: 1247563 - protein, 9 aa, Homo Sapiens
SFTSHIDAL

SEQ ID NO: 1247564 - protein, 9 aa, Homo Sapiens
STGATNISK

SEQ ID NO: 1247565 - protein, 9 aa, Homo Sapiens
LSSTLNLAN

SEQ ID NO: 1247566 - protein, 9 aa, Homo Sapiens
HPLRALSRF

SEQ ID NO: 1247567 - protein, 9 aa, Homo Sapiens
ACWTVDEVA

SEQ ID NO: 1247568 - protein, 9 aa, Homo Sapiens
KQREDDDED

SEQ ID NO: 1247569 - protein, 9 aa, Homo Sapiens
FLEEARRCL

SEQ ID NO: 1247570 - protein, 9 aa, Homo Sapiens
TDTVLINGT

SEQ ID NO: 1247571 - protein, 9 aa, Homo Sapiens
GHSQISHIK

SEQ ID NO: 1247572 - protein, 9 aa, Homo Sapiens
WLPIYLQNS

SEQ ID NO: 1247573 - protein, 9 aa, Homo Sapiens
TRRYSIISS

SEQ ID NO: 1247574 - protein, 9 aa, Homo Sapiens
PEQISPGGA

SEQ ID NO: 1247575 - protein, 9 aa, Homo Sapiens
KTLNEQHLE

SEQ ID NO: 1247576 - protein, 9 aa, Homo Sapiens
GDFKKPVLP

SEQ ID NO: 1247577 - protein, 9 aa, Homo Sapiens
HSTTPSWCE

SEQ ID NO: 1247578 - protein, 9 aa, Homo Sapiens
SEEPPLSPP

SEQ ID NO: 1247579 - protein, 9 aa, Homo Sapiens
MPEPRPTQS

SEQ ID NO: 1247580 - protein, 9 aa, Homo Sapiens
FEDTVVAYY

SEQ ID NO: 1247581 - protein, 9 aa, Homo Sapiens
LLKHEKIQL

SEQ ID NO: 1247582 - protein, 9 aa, Homo Sapiens
ENPFVQSMI

SEQ ID NO: 1247583 - protein, 9 aa, Homo Sapiens
EFLWQVSIQ

SEQ ID NO: 1247584 - protein, 9 aa, Homo Sapiens
RQELTETAD

SEQ ID NO: 1247585 - protein, 9 aa, Homo Sapiens
ILLEAGVFV

SEQ ID NO: 1247586 - protein, 9 aa, Homo Sapiens
DGPGAEGPR

SEQ ID NO: 1247587 - protein, 9 aa, Homo Sapiens
DSELMVWDI

SEQ ID NO: 1247588 - protein, 9 aa, Homo Sapiens
LQGTLLFMY

SEQ ID NO: 1247589 - protein, 9 aa, Homo Sapiens
VFFLTPKRK

SEQ ID NO: 1247590 - protein, 9 aa, Homo Sapiens
PPTDSACLL

SEQ ID NO: 1247591 - protein, 9 aa, Homo Sapiens
QPMWDDSRN

SEQ ID NO: 1247592 - protein, 9 aa, Homo Sapiens
SKRMPQELF

SEQ ID NO: 1247593 - protein, 9 aa, Homo Sapiens
RTQQEGKCL

SEQ ID NO: 1247594 - protein, 9 aa, Homo Sapiens
LLVGKPHFE

SEQ ID NO: 1247595 - protein, 9 aa, Homo Sapiens
GTVRRPDSR

SEQ ID NO: 1247596 - protein, 9 aa, Homo Sapiens
VSSGHLEEF

SEQ ID NO: 1247597 - protein, 9 aa, Homo Sapiens
EHKSMENTA

SEQ ID NO: 1247598 - protein, 9 aa, Homo Sapiens
NFSYDKPLN

SEQ ID NO: 1247599 - protein, 9 aa, Homo Sapiens
MVNGVMIFL

SEQ ID NO: 1247600 - protein, 9 aa, Homo Sapiens
MYQEGLGGQ

SEQ ID NO: 1247601 - protein, 9 aa, Homo Sapiens
LRMIDVFDG

SEQ ID NO: 1247602 - protein, 9 aa, Homo Sapiens
LLTEPDGQE

SEQ ID NO: 1247603 - protein, 9 aa, Homo Sapiens
VSDHCHHPL

SEQ ID NO: 1247604 - protein, 9 aa, Homo Sapiens
KIHSLDVVG

SEQ ID NO: 1247605 - protein, 9 aa, Homo Sapiens
AAIHYRILD

SEQ ID NO: 1247606 - protein, 9 aa, Homo Sapiens
AGDAPVGTQ

SEQ ID NO: 1247607 - protein, 9 aa, Homo Sapiens
KPIVLKMIV

SEQ ID NO: 1247608 - protein, 9 aa, Homo Sapiens
DQRPIHPVA

SEQ ID NO: 1247609 - protein, 9 aa, Homo Sapiens
KIKTRNQGI

SEQ ID NO: 1247610 - protein, 9 aa, Homo Sapiens
SFEMSLTPM

SEQ ID NO: 1247611 - protein, 9 aa, Homo Sapiens
NMCAALLSK

SEQ ID NO: 1247612 - protein, 9 aa, Homo Sapiens
GVVYKDVIV

SEQ ID NO: 1247613 - protein, 9 aa, Homo Sapiens
MAVTLAMLP

SEQ ID NO: 1247614 - protein, 9 aa, Homo Sapiens
EGRKKAFVT

SEQ ID NO: 1247615 - protein, 9 aa, Homo Sapiens
LVRVTEGIK

SEQ ID NO: 1247616 - protein, 9 aa, Homo Sapiens
LTEACYFRV

SEQ ID NO: 1247617 - protein, 9 aa, Homo Sapiens
KEPRPEVAA

SEQ ID NO: 1247618 - protein, 9 aa, Homo Sapiens
CINSLVAQL

SEQ ID NO: 1247619 - protein, 9 aa, Homo Sapiens
ALSSNMYGS

SEQ ID NO: 1247620 - protein, 9 aa, Homo Sapiens
ENGTVTDRQ

SEQ ID NO: 1247621 - protein, 9 aa, Homo Sapiens
RCMQYSCSL

SEQ ID NO: 1247622 - protein, 9 aa, Homo Sapiens
LNLPHGNVL

SEQ ID NO: 1247623 - protein, 9 aa, Homo Sapiens
KMSRAQTFS

SEQ ID NO: 1247624 - protein, 9 aa, Homo Sapiens
YSSSKGTIQ

SEQ ID NO: 1247625 - protein, 9 aa, Homo Sapiens
RQTPLPVSA

SEQ ID NO: 1247626 - protein, 9 aa, Homo Sapiens
HIQIKQEDP

SEQ ID NO: 1247627 - protein, 9 aa, Homo Sapiens
IFSARVIDG

SEQ ID NO: 1247628 - protein, 9 aa, Homo Sapiens
LDRSNSLYW

SEQ ID NO: 1247629 - protein, 9 aa, Homo Sapiens
ILGSEAIPG

SEQ ID NO: 1247630 - protein, 9 aa, Homo Sapiens
VGMHLASTL

SEQ ID NO: 1247631 - protein, 9 aa, Homo Sapiens
RLHLQITRT

SEQ ID NO: 1247632 - protein, 9 aa, Homo Sapiens
SNVRSNPHT

SEQ ID NO: 1247633 - protein, 9 aa, Homo Sapiens
LFKMFCTRK

SEQ ID NO: 1247634 - protein, 9 aa, Homo Sapiens
NSCRYDRPQ

SEQ ID NO: 1247635 - protein, 9 aa, Homo Sapiens
AFAHCPLDL

SEQ ID NO: 1247636 - protein, 9 aa, Homo Sapiens
LEMRTKLYP

SEQ ID NO: 1247637 - protein, 9 aa, Homo Sapiens
RIDTYVDEQ

SEQ ID NO: 1247638 - protein, 9 aa, Homo Sapiens
GTQWWKTNT

SEQ ID NO: 1247639 - protein, 9 aa, Homo Sapiens
GRIVRREWV

SEQ ID NO: 1247640 - protein, 9 aa, Homo Sapiens
TAHVMKQEV

SEQ ID NO: 1247641 - protein, 9 aa, Homo Sapiens
TRRRTKLET

SEQ ID NO: 1247642 - protein, 9 aa, Homo Sapiens
KENIMKLSG

SEQ ID NO: 1247643 - protein, 9 aa, Homo Sapiens
RIKEGCAYI

SEQ ID NO: 1247644 - protein, 9 aa, Homo Sapiens
FEENIQGGC

SEQ ID NO: 1247645 - protein, 9 aa, Homo Sapiens
PTYSCFSSS

SEQ ID NO: 1247646 - protein, 9 aa, Homo Sapiens
MLKLSYKEM

SEQ ID NO: 1247647 - protein, 9 aa, Homo Sapiens
SASPATHYA

SEQ ID NO: 1247648 - protein, 9 aa, Homo Sapiens
ESTLGIMYQ

SEQ ID NO: 1247649 - protein, 9 aa, Homo Sapiens
HCQEQTDPV

SEQ ID NO: 1247650 - protein, 9 aa, Homo Sapiens
RDPTDVSSE

SEQ ID NO: 1247651 - protein, 9 aa, Homo Sapiens
NMMSIYSEA

SEQ ID NO: 1247652 - protein, 9 aa, Homo Sapiens
HNLTECKNV

SEQ ID NO: 1247653 - protein, 9 aa, Homo Sapiens
TKEVSTTER

SEQ ID NO: 1247654 - protein, 9 aa, Homo Sapiens
DIMLICTTV

SEQ ID NO: 1247655 - protein, 9 aa, Homo Sapiens
SRLGDVAHV

SEQ ID NO: 1247656 - protein, 9 aa, Homo Sapiens
LHPPNRDTM

SEQ ID NO: 1247657 - protein, 9 aa, Homo Sapiens
LVRYGADVD

SEQ ID NO: 1247658 - protein, 9 aa, Homo Sapiens
GQILHVPNV

SEQ ID NO: 1247659 - protein, 9 aa, Homo Sapiens
LGEKSYKCY

SEQ ID NO: 1247660 - protein, 9 aa, Homo Sapiens
DADADLEEW

SEQ ID NO: 1247661 - protein, 9 aa, Homo Sapiens
KYDWDSDDD

SEQ ID NO: 1247662 - protein, 9 aa, Homo Sapiens
PTAWRVWRF

SEQ ID NO: 1247663 - protein, 9 aa, Homo Sapiens
FNDNSIETR

SEQ ID NO: 1247664 - protein, 9 aa, Homo Sapiens
PASQGIGPA

SEQ ID NO: 1247665 - protein, 9 aa, Homo Sapiens
VHAYISKIW

SEQ ID NO: 1247666 - protein, 9 aa, Homo Sapiens
KYSDLNEYG

SEQ ID NO: 1247667 - protein, 9 aa, Homo Sapiens
AQTARTHPK

SEQ ID NO: 1247668 - protein, 9 aa, Homo Sapiens
LHDTLQIRE

SEQ ID NO: 1247669 - protein, 9 aa, Homo Sapiens
RQSQEVETG

SEQ ID NO: 1247670 - protein, 9 aa, Homo Sapiens
VANPVVNAP

SEQ ID NO: 1247671 - protein, 9 aa, Homo Sapiens
FSIWCFAWR

SEQ ID NO: 1247672 - protein, 9 aa, Homo Sapiens
GVLQKVIVH

SEQ ID NO: 1247673 - protein, 9 aa, Homo Sapiens
VHMMLALSL

SEQ ID NO: 1247674 - protein, 9 aa, Homo Sapiens
SDMDECSAR

SEQ ID NO: 1247675 - protein, 9 aa, Homo Sapiens
KMVDSFHMV

SEQ ID NO: 1247676 - protein, 9 aa, Homo Sapiens
AFQHCSSLA

SEQ ID NO: 1247677 - protein, 9 aa, Homo Sapiens
KVFVNKRKK

SEQ ID NO: 1247678 - protein, 9 aa, Homo Sapiens
LTLLLYTVM

SEQ ID NO: 1247679 - protein, 9 aa, Homo Sapiens
DFEIHIAMC

SEQ ID NO: 1247680 - protein, 9 aa, Homo Sapiens
MCNLRGGAL

SEQ ID NO: 1247681 - protein, 9 aa, Homo Sapiens
YASIKDYIH

SEQ ID NO: 1247682 - protein, 9 aa, Homo Sapiens
HPLTVTAAL

SEQ ID NO: 1247683 - protein, 9 aa, Homo Sapiens
YDPTIENNF

SEQ ID NO: 1247684 - protein, 9 aa, Homo Sapiens
PGVMHISCP

SEQ ID NO: 1247685 - protein, 9 aa, Homo Sapiens
VRSLRMDSE

SEQ ID NO: 1247686 - protein, 9 aa, Homo Sapiens
SLQNCILFV

SEQ ID NO: 1247687 - protein, 9 aa, Homo Sapiens
VNCRYRCFT

SEQ ID NO: 1247688 - protein, 9 aa, Homo Sapiens
DTTTMKIIV

SEQ ID NO: 1247689 - protein, 9 aa, Homo Sapiens
GIPETKEKT

SEQ ID NO: 1247690 - protein, 9 aa, Homo Sapiens
AAFVAAISM

SEQ ID NO: 1247691 - protein, 9 aa, Homo Sapiens
RPGTETSDM

SEQ ID NO: 1247692 - protein, 9 aa, Homo Sapiens
EDEMEDEEE

SEQ ID NO: 1247693 - protein, 9 aa, Homo Sapiens
HQKIHTGEW

SEQ ID NO: 1247694 - protein, 9 aa, Homo Sapiens
MSVTSLDAE

SEQ ID NO: 1247695 - protein, 9 aa, Homo Sapiens
LHHNVWKNR

SEQ ID NO: 1247696 - protein, 9 aa, Homo Sapiens
ELLLEDRYN

SEQ ID NO: 1247697 - protein, 9 aa, Homo Sapiens
HFTDVDLHV

SEQ ID NO: 1247698 - protein, 9 aa, Homo Sapiens
LKRILEDQD

SEQ ID NO: 1247699 - protein, 9 aa, Homo Sapiens
HLVIYMPKV

SEQ ID NO: 1247700 - protein, 9 aa, Homo Sapiens
LEVMFALWE

SEQ ID NO: 1247701 - protein, 9 aa, Homo Sapiens
ENQESLQLQ

SEQ ID NO: 1247702 - protein, 9 aa, Homo Sapiens
LVRIGLERA

SEQ ID NO: 1247703 - protein, 9 aa, Homo Sapiens
GSAEIPTGS

SEQ ID NO: 1247704 - protein, 9 aa, Homo Sapiens
LTQWQRHYF

SEQ ID NO: 1247705 - protein, 9 aa, Homo Sapiens
AAGAAGASV

SEQ ID NO: 1247706 - protein, 9 aa, Homo Sapiens
EGGANVNLQ

SEQ ID NO: 1247707 - protein, 9 aa, Homo Sapiens
NIVPRHVFR

SEQ ID NO: 1247708 - protein, 9 aa, Homo Sapiens
LAFTQMAYV

SEQ ID NO: 1247709 - protein, 9 aa, Homo Sapiens
KLRVTNTSI

SEQ ID NO: 1247710 - protein, 9 aa, Homo Sapiens
PRSWLERDT

SEQ ID NO: 1247711 - protein, 9 aa, Homo Sapiens
TTNLFIAQS

SEQ ID NO: 1247712 - protein, 9 aa, Homo Sapiens
MGGTRTLQR

SEQ ID NO: 1247713 - protein, 9 aa, Homo Sapiens
VADQLLPLA

SEQ ID NO: 1247714 - protein, 9 aa, Homo Sapiens
GKRVVYYDD

SEQ ID NO: 1247715 - protein, 9 aa, Homo Sapiens
TEKAVAAMD

SEQ ID NO: 1247716 - protein, 9 aa, Homo Sapiens
VIQQMEQKN

SEQ ID NO: 1247717 - protein, 9 aa, Homo Sapiens
KLIYQGHLL

SEQ ID NO: 1247718 - protein, 9 aa, Homo Sapiens
VLQDASMDA

SEQ ID NO: 1247719 - protein, 9 aa, Homo Sapiens
LMANPILFQ

SEQ ID NO: 1247720 - protein, 9 aa, Homo Sapiens
KIHMHLIKD

SEQ ID NO: 1247721 - protein, 9 aa, Homo Sapiens
FNKLPKKLK

SEQ ID NO: 1247722 - protein, 9 aa, Homo Sapiens
YYYELWWFC

SEQ ID NO: 1247723 - protein, 9 aa, Homo Sapiens
HVPIIHRDL

SEQ ID NO: 1247724 - protein, 9 aa, Homo Sapiens
HTLLWDLAY

SEQ ID NO: 1247725 - protein, 9 aa, Homo Sapiens
APPRLQVLV

SEQ ID NO: 1247726 - protein, 9 aa, Homo Sapiens
HKVADQLLP

SEQ ID NO: 1247727 - protein, 9 aa, Homo Sapiens
SMVGRLPEP

SEQ ID NO: 1247728 - protein, 9 aa, Homo Sapiens
GMSRRAGCV

SEQ ID NO: 1247729 - protein, 9 aa, Homo Sapiens
TSTEAATHL

SEQ ID NO: 1247730 - protein, 9 aa, Homo Sapiens
DYTMKMSSG

SEQ ID NO: 1247731 - protein, 9 aa, Homo Sapiens
ASEPGIFSV

SEQ ID NO: 1247732 - protein, 9 aa, Homo Sapiens
SKGTIQLCD

SEQ ID NO: 1247733 - protein, 9 aa, Homo Sapiens
GINQFGPPM

SEQ ID NO: 1247734 - protein, 9 aa, Homo Sapiens
LLEVSLQNC

SEQ ID NO: 1247735 - protein, 9 aa, Homo Sapiens
TMGWVTRLS

SEQ ID NO: 1247736 - protein, 9 aa, Homo Sapiens
RDAREQWLR

SEQ ID NO: 1247737 - protein, 9 aa, Homo Sapiens
TVYGDQSMH

SEQ ID NO: 1247738 - protein, 9 aa, Homo Sapiens
LLKEDHPMS

SEQ ID NO: 1247739 - protein, 9 aa, Homo Sapiens
DIATNSKAT

SEQ ID NO: 1247740 - protein, 9 aa, Homo Sapiens
EHKTKSGLT

SEQ ID NO: 1247741 - protein, 9 aa, Homo Sapiens
FLSQCQRDL

SEQ ID NO: 1247742 - protein, 9 aa, Homo Sapiens
AAGILGHAN

SEQ ID NO: 1247743 - protein, 9 aa, Homo Sapiens
DNDKNCYSE

SEQ ID NO: 1247744 - protein, 9 aa, Homo Sapiens
NGAYKVDEG

SEQ ID NO: 1247745 - protein, 9 aa, Homo Sapiens
HAPPGSCCP

SEQ ID NO: 1247746 - protein, 9 aa, Homo Sapiens
CEDLKDQLK

SEQ ID NO: 1247747 - protein, 9 aa, Homo Sapiens
FFGLVPEII

SEQ ID NO: 1247748 - protein, 9 aa, Homo Sapiens
VPRCLVPEG

SEQ ID NO: 1247749 - protein, 9 aa, Homo Sapiens
SEVGRREPV

SEQ ID NO: 1247750 - protein, 9 aa, Homo Sapiens
TPLVYEATR

SEQ ID NO: 1247751 - protein, 9 aa, Homo Sapiens
DKKKPFVVS

SEQ ID NO: 1247752 - protein, 9 aa, Homo Sapiens
GNEIEAFSE

SEQ ID NO: 1247753 - protein, 9 aa, Homo Sapiens
CVEKHLLGE

SEQ ID NO: 1247754 - protein, 9 aa, Homo Sapiens
HLEPLVLQM

SEQ ID NO: 1247755 - protein, 9 aa, Homo Sapiens
YQRETRHIW

SEQ ID NO: 1247756 - protein, 9 aa, Homo Sapiens
VCSFMEPWA

SEQ ID NO: 1247757 - protein, 9 aa, Homo Sapiens
LGCAMYTLL

SEQ ID NO: 1247758 - protein, 9 aa, Homo Sapiens
GSHLHGEKG

SEQ ID NO: 1247759 - protein, 9 aa, Homo Sapiens
FTWKMEHQL

SEQ ID NO: 1247760 - protein, 9 aa, Homo Sapiens
KRNPRSWLE

SEQ ID NO: 1247761 - protein, 9 aa, Homo Sapiens
YDIYIHVHI

SEQ ID NO: 1247762 - protein, 9 aa, Homo Sapiens
PPTCTYECD

SEQ ID NO: 1247763 - protein, 9 aa, Homo Sapiens
FIHVSHLNV

SEQ ID NO: 1247764 - protein, 9 aa, Homo Sapiens
MVEEVWLAE

SEQ ID NO: 1247765 - protein, 9 aa, Homo Sapiens
TERRERIGQ

SEQ ID NO: 1247766 - protein, 9 aa, Homo Sapiens
LFHRCRHQS

SEQ ID NO: 1247767 - protein, 9 aa, Homo Sapiens
FCRHEMTHS

SEQ ID NO: 1247768 - protein, 9 aa, Homo Sapiens
MWRSIMIQK

SEQ ID NO: 1247769 - protein, 9 aa, Homo Sapiens
EHAILKMKG

SEQ ID NO: 1247770 - protein, 9 aa, Homo Sapiens
KLRVSITPG

SEQ ID NO: 1247771 - protein, 9 aa, Homo Sapiens
ADLLKRYTK

SEQ ID NO: 1247772 - protein, 9 aa, Homo Sapiens
SASSSSMVF

SEQ ID NO: 1247773 - protein, 9 aa, Homo Sapiens
NTPEVIQVY

SEQ ID NO: 1247774 - protein, 9 aa, Homo Sapiens
TTHVYVTIM

SEQ ID NO: 1247775 - protein, 9 aa, Homo Sapiens
FEKLKFSGS

SEQ ID NO: 1247776 - protein, 9 aa, Homo Sapiens
LTQQLAQTD

SEQ ID NO: 1247777 - protein, 9 aa, Homo Sapiens
WGHLVAFFV

SEQ ID NO: 1247778 - protein, 9 aa, Homo Sapiens
VTHLEFFLD

SEQ ID NO: 1247779 - protein, 9 aa, Homo Sapiens
DLELLTSND

SEQ ID NO: 1247780 - protein, 9 aa, Homo Sapiens
ADGLSKDTS

SEQ ID NO: 1247781 - protein, 9 aa, Homo Sapiens
DTVLINGTN

SEQ ID NO: 1247782 - protein, 9 aa, Homo Sapiens
FPRVCITVD

SEQ ID NO: 1247783 - protein, 9 aa, Homo Sapiens
FFFVCSFME

SEQ ID NO: 1247784 - protein, 9 aa, Homo Sapiens
DLDTFVNKA

SEQ ID NO: 1247785 - protein, 9 aa, Homo Sapiens
DEYQKHFLS

SEQ ID NO: 1247786 - protein, 9 aa, Homo Sapiens
QDFIFFVMP

SEQ ID NO: 1247787 - protein, 9 aa, Homo Sapiens
CKNADPILI

SEQ ID NO: 1247788 - protein, 9 aa, Homo Sapiens
NAGYEERCF

SEQ ID NO: 1247789 - protein, 9 aa, Homo Sapiens
EFWSRFRKL

SEQ ID NO: 1247790 - protein, 9 aa, Homo Sapiens
QIEKCIQEI

SEQ ID NO: 1247791 - protein, 9 aa, Homo Sapiens
SGEAMGLVR

SEQ ID NO: 1247792 - protein, 9 aa, Homo Sapiens
EEEKEHLAV

SEQ ID NO: 1247793 - protein, 9 aa, Homo Sapiens
GRYMGRAVR

SEQ ID NO: 1247794 - protein, 9 aa, Homo Sapiens
GRLAKNLNK

SEQ ID NO: 1247795 - protein, 9 aa, Homo Sapiens
EGSTPGTAI

SEQ ID NO: 1247796 - protein, 9 aa, Homo Sapiens
SLTPMIQQR

SEQ ID NO: 1247797 - protein, 9 aa, Homo Sapiens
HHVGHAGLE

SEQ ID NO: 1247798 - protein, 9 aa, Homo Sapiens
ILLWKRTLI

SEQ ID NO: 1247799 - protein, 9 aa, Homo Sapiens
PTFPDHLGC

SEQ ID NO: 1247800 - protein, 9 aa, Homo Sapiens
DVEDGTMYG

SEQ ID NO: 1247801 - protein, 9 aa, Homo Sapiens
KEDYGHLPR

SEQ ID NO: 1247802 - protein, 9 aa, Homo Sapiens
HGDRRGRPS

SEQ ID NO: 1247803 - protein, 9 aa, Homo Sapiens
ASIMLPSQD

SEQ ID NO: 1247804 - protein, 9 aa, Homo Sapiens
RPRVRYGKD

SEQ ID NO: 1247805 - protein, 9 aa, Homo Sapiens
AYDREVHLC

SEQ ID NO: 1247806 - protein, 9 aa, Homo Sapiens
ESLRGEGHG

SEQ ID NO: 1247807 - protein, 9 aa, Homo Sapiens
CAHTVYTLC

SEQ ID NO: 1247808 - protein, 9 aa, Homo Sapiens
SGFPTLSWS

SEQ ID NO: 1247809 - protein, 9 aa, Homo Sapiens
MPIKQNVCS

SEQ ID NO: 1247810 - protein, 9 aa, Homo Sapiens
AFSRRCPIS

SEQ ID NO: 1247811 - protein, 9 aa, Homo Sapiens
PPSWRKIMS

SEQ ID NO: 1247812 - protein, 9 aa, Homo Sapiens
RRSGGRMRG

SEQ ID NO: 1247813 - protein, 9 aa, Homo Sapiens
HNQQKPLPV

SEQ ID NO: 1247814 - protein, 9 aa, Homo Sapiens
EHLHSIGTN

SEQ ID NO: 1247815 - protein, 9 aa, Homo Sapiens
FNNWSTKIS

SEQ ID NO: 1247816 - protein, 9 aa, Homo Sapiens
RSDTSLTAA

SEQ ID NO: 1247817 - protein, 9 aa, Homo Sapiens
TVKKLKSVQ

SEQ ID NO: 1247818 - protein, 9 aa, Homo Sapiens
GLASGDCSA

SEQ ID NO: 1247819 - protein, 9 aa, Homo Sapiens
HPSSFSPHS

SEQ ID NO: 1247820 - protein, 9 aa, Homo Sapiens
WRGPRRLVD

SEQ ID NO: 1247821 - protein, 9 aa, Homo Sapiens
GRSGSFLYH

SEQ ID NO: 1247822 - protein, 9 aa, Homo Sapiens
KCGKRRYCN

SEQ ID NO: 1247823 - protein, 9 aa, Homo Sapiens
EGSGGRLQG

SEQ ID NO: 1247824 - protein, 9 aa, Homo Sapiens
LGKTAELTY

SEQ ID NO: 1247825 - protein, 9 aa, Homo Sapiens
LHQAEGAVY

SEQ ID NO: 1247826 - protein, 9 aa, Homo Sapiens
RKYGVATKL

SEQ ID NO: 1247827 - protein, 9 aa, Homo Sapiens
HLVYCYPVR

SEQ ID NO: 1247828 - protein, 9 aa, Homo Sapiens
ICQYVITHA

SEQ ID NO: 1247829 - protein, 9 aa, Homo Sapiens
VTRNLRQQS

SEQ ID NO: 1247830 - protein, 9 aa, Homo Sapiens
DVRRSLRQF

SEQ ID NO: 1247831 - protein, 9 aa, Homo Sapiens
GGDRFHHYP

SEQ ID NO: 1247832 - protein, 9 aa, Homo Sapiens
GVQCGVQGV

SEQ ID NO: 1247833 - protein, 9 aa, Homo Sapiens
RHTHTQAYT

SEQ ID NO: 1247834 - protein, 9 aa, Homo Sapiens
DQLHKYVRE

SEQ ID NO: 1247835 - protein, 9 aa, Homo Sapiens
KLEEEKHEA

SEQ ID NO: 1247836 - protein, 9 aa, Homo Sapiens
DMEDLGDKV

SEQ ID NO: 1247837 - protein, 9 aa, Homo Sapiens
ENRQEREKQ

SEQ ID NO: 1247838 - protein, 9 aa, Homo Sapiens
GLRHNPALP

SEQ ID NO: 1247839 - protein, 9 aa, Homo Sapiens
HNWQTACDA

SEQ ID NO: 1247840 - protein, 9 aa, Homo Sapiens
CVILAVMAY

SEQ ID NO: 1247841 - protein, 9 aa, Homo Sapiens
SGCTLQKFM

SEQ ID NO: 1247842 - protein, 9 aa, Homo Sapiens
HIPDVSLIG

SEQ ID NO: 1247843 - protein, 9 aa, Homo Sapiens
EQKDAWVWD

SEQ ID NO: 1247844 - protein, 9 aa, Homo Sapiens
VRRPDSRDG

SEQ ID NO: 1247845 - protein, 9 aa, Homo Sapiens
HLPREGAYL

SEQ ID NO: 1247846 - protein, 9 aa, Homo Sapiens
HLIVENVTD

SEQ ID NO: 1247847 - protein, 9 aa, Homo Sapiens
QLLAVGQED

SEQ ID NO: 1247848 - protein, 9 aa, Homo Sapiens
WTLTQSPHR

SEQ ID NO: 1247849 - protein, 9 aa, Homo Sapiens
ALPALVAVL

SEQ ID NO: 1247850 - protein, 9 aa, Homo Sapiens
LYISLALWS

SEQ ID NO: 1247851 - protein, 9 aa, Homo Sapiens
TKEKTSQLQ

SEQ ID NO: 1247852 - protein, 9 aa, Homo Sapiens
RRCSLHHKQ

SEQ ID NO: 1247853 - protein, 9 aa, Homo Sapiens
TLQHDEIKF

SEQ ID NO: 1247854 - protein, 9 aa, Homo Sapiens
YGTSMQPYS

SEQ ID NO: 1247855 - protein, 9 aa, Homo Sapiens
VMHGSSFSV

SEQ ID NO: 1247856 - protein, 9 aa, Homo Sapiens
VSPREPTSK

SEQ ID NO: 1247857 - protein, 9 aa, Homo Sapiens
KRTHYYETY

SEQ ID NO: 1247858 - protein, 9 aa, Homo Sapiens
VARTTAGWP

SEQ ID NO: 1247859 - protein, 9 aa, Homo Sapiens
LLLKEDHPM

SEQ ID NO: 1247860 - protein, 9 aa, Homo Sapiens
CHSKGTMIT

SEQ ID NO: 1247861 - protein, 9 aa, Homo Sapiens
LLVPAPPPE

SEQ ID NO: 1247862 - protein, 9 aa, Homo Sapiens
NRFTKASQG

SEQ ID NO: 1247863 - protein, 9 aa, Homo Sapiens
CVWPDVRVS

SEQ ID NO: 1247864 - protein, 9 aa, Homo Sapiens
CWARGGCLP

SEQ ID NO: 1247865 - protein, 9 aa, Homo Sapiens
EVDCDAIDG

SEQ ID NO: 1247866 - protein, 9 aa, Homo Sapiens
RLGDVAHVC

SEQ ID NO: 1247867 - protein, 9 aa, Homo Sapiens
YEAAPGRGL

SEQ ID NO: 1247868 - protein, 9 aa, Homo Sapiens
SATSGYGAP

SEQ ID NO: 1247869 - protein, 9 aa, Homo Sapiens
YTVFTPPVK

SEQ ID NO: 1247870 - protein, 9 aa, Homo Sapiens
GVGNTPAQQ

SEQ ID NO: 1247871 - protein, 9 aa, Homo Sapiens
PMAAHSGTR

SEQ ID NO: 1247872 - protein, 9 aa, Homo Sapiens
TMWWAFENP

SEQ ID NO: 1247873 - protein, 9 aa, Homo Sapiens
EGIQGHPDG

SEQ ID NO: 1247874 - protein, 9 aa, Homo Sapiens
KDSLIVPVT

SEQ ID NO: 1247875 - protein, 9 aa, Homo Sapiens
SVVALFVLC

SEQ ID NO: 1247876 - protein, 9 aa, Homo Sapiens
EMDSSMACS

SEQ ID NO: 1247877 - protein, 9 aa, Homo Sapiens
PGCRDTSLN

SEQ ID NO: 1247878 - protein, 9 aa, Homo Sapiens
KRRCSLHHK

SEQ ID NO: 1247879 - protein, 9 aa, Homo Sapiens
IKWVTGGQA

SEQ ID NO: 1247880 - protein, 9 aa, Homo Sapiens
CFLRRSGAP

SEQ ID NO: 1247881 - protein, 9 aa, Homo Sapiens
QLDVHEKTH

SEQ ID NO: 1247882 - protein, 9 aa, Homo Sapiens
HKDYPFHIK

SEQ ID NO: 1247883 - protein, 9 aa, Homo Sapiens
LYNFSYIND

SEQ ID NO: 1247884 - protein, 9 aa, Homo Sapiens
ENVGRQGIF

SEQ ID NO: 1247885 - protein, 9 aa, Homo Sapiens
SAGQIVLVD

SEQ ID NO: 1247886 - protein, 9 aa, Homo Sapiens
RSQHLTRYS

SEQ ID NO: 1247887 - protein, 9 aa, Homo Sapiens
AAPGRGLRP

SEQ ID NO: 1247888 - protein, 9 aa, Homo Sapiens
ATKDAGPIA

SEQ ID NO: 1247889 - protein, 9 aa, Homo Sapiens
TAPTPAAAA

SEQ ID NO: 1247890 - protein, 9 aa, Homo Sapiens
VVHAALGGA

SEQ ID NO: 1247891 - protein, 9 aa, Homo Sapiens
HCYPQLCLQ

SEQ ID NO: 1247892 - protein, 9 aa, Homo Sapiens
GNVCVNTDA

SEQ ID NO: 1247893 - protein, 9 aa, Homo Sapiens
CLMQEYIPD

SEQ ID NO: 1247894 - protein, 9 aa, Homo Sapiens
KKIHQKGRK

SEQ ID NO: 1247895 - protein, 9 aa, Homo Sapiens
IMHMISPSP

SEQ ID NO: 1247896 - protein, 9 aa, Homo Sapiens
ERVHIKFGD

SEQ ID NO: 1247897 - protein, 9 aa, Homo Sapiens
MNQNAGFPF

SEQ ID NO: 1247898 - protein, 9 aa, Homo Sapiens
HACMVGAGV

SEQ ID NO: 1247899 - protein, 9 aa, Homo Sapiens
GHKDSKTTA

SEQ ID NO: 1247900 - protein, 9 aa, Homo Sapiens
RASNHTFCW

SEQ ID NO: 1247901 - protein, 9 aa, Homo Sapiens
HFHEIVTKD

SEQ ID NO: 1247902 - protein, 9 aa, Homo Sapiens
TPQRVSGLH

SEQ ID NO: 1247903 - protein, 9 aa, Homo Sapiens
LPVPKEVNC

SEQ ID NO: 1247904 - protein, 9 aa, Homo Sapiens
PPPAQSSAT

SEQ ID NO: 1247905 - protein, 9 aa, Homo Sapiens
LRRAGESGT

SEQ ID NO: 1247906 - protein, 9 aa, Homo Sapiens
MPIFFELFV

SEQ ID NO: 1247907 - protein, 9 aa, Homo Sapiens
IGGGRNTDH

SEQ ID NO: 1247908 - protein, 9 aa, Homo Sapiens
DPSCWVRQA

SEQ ID NO: 1247909 - protein, 9 aa, Homo Sapiens
FMCGTNVFS

SEQ ID NO: 1247910 - protein, 9 aa, Homo Sapiens
VATGHLLRS

SEQ ID NO: 1247911 - protein, 9 aa, Homo Sapiens
HNFDTTKCF

SEQ ID NO: 1247912 - protein, 9 aa, Homo Sapiens
HLCPSQQSA

SEQ ID NO: 1247913 - protein, 9 aa, Homo Sapiens
PLSSSSLAI

SEQ ID NO: 1247914 - protein, 9 aa, Homo Sapiens
EGTVHFKCR

SEQ ID NO: 1247915 - protein, 9 aa, Homo Sapiens
FGNSSVNHI

SEQ ID NO: 1247916 - protein, 9 aa, Homo Sapiens
MDVNPSWTT

SEQ ID NO: 1247917 - protein, 9 aa, Homo Sapiens
MDVGQQAVE

SEQ ID NO: 1247918 - protein, 9 aa, Homo Sapiens
KSYILLWKR

SEQ ID NO: 1247919 - protein, 9 aa, Homo Sapiens
IENFRNSFV

SEQ ID NO: 1247920 - protein, 9 aa, Homo Sapiens
VLLASTEPF

SEQ ID NO: 1247921 - protein, 9 aa, Homo Sapiens
VWAIHRAYL

SEQ ID NO: 1247922 - protein, 9 aa, Homo Sapiens
YIAIQYKEA

SEQ ID NO: 1247923 - protein, 9 aa, Homo Sapiens
TCSSHLLMV

SEQ ID NO: 1247924 - protein, 9 aa, Homo Sapiens
NPQYPTAHP

SEQ ID NO: 1247925 - protein, 9 aa, Homo Sapiens
TYYIAFVEK

SEQ ID NO: 1247926 - protein, 9 aa, Homo Sapiens
ICWRSRWQG

SEQ ID NO: 1247927 - protein, 9 aa, Homo Sapiens
NPNQVRMWY

SEQ ID NO: 1247928 - protein, 9 aa, Homo Sapiens
SVALGTVEE

SEQ ID NO: 1247929 - protein, 9 aa, Homo Sapiens
SGRTTLHLA

SEQ ID NO: 1247930 - protein, 9 aa, Homo Sapiens
CMAAGSRCH

SEQ ID NO: 1247931 - protein, 9 aa, Homo Sapiens
EHPDVNNRH

SEQ ID NO: 1247932 - protein, 9 aa, Homo Sapiens
TEHIHTHFE

SEQ ID NO: 1247933 - protein, 9 aa, Homo Sapiens
SSDFASLTF

SEQ ID NO: 1247934 - protein, 9 aa, Homo Sapiens
AAAWDGSPD

SEQ ID NO: 1247935 - protein, 9 aa, Homo Sapiens
HLQHQDWAA

SEQ ID NO: 1247936 - protein, 9 aa, Homo Sapiens
EAMRVLEYL

SEQ ID NO: 1247937 - protein, 9 aa, Homo Sapiens
LELNLASNW

SEQ ID NO: 1247938 - protein, 9 aa, Homo Sapiens
ERKINKMMD

SEQ ID NO: 1247939 - protein, 9 aa, Homo Sapiens
VDMIPGLPA

SEQ ID NO: 1247940 - protein, 9 aa, Homo Sapiens
DFIRTTEAL

SEQ ID NO: 1247941 - protein, 9 aa, Homo Sapiens
LITIIVGYI

SEQ ID NO: 1247942 - protein, 9 aa, Homo Sapiens
VFSLGSMFQ

SEQ ID NO: 1247943 - protein, 9 aa, Homo Sapiens
DIEVLGHAH

SEQ ID NO: 1247944 - protein, 9 aa, Homo Sapiens
GATRIFEMR

SEQ ID NO: 1247945 - protein, 9 aa, Homo Sapiens
FFIHNCTIT

SEQ ID NO: 1247946 - protein, 9 aa, Homo Sapiens
PRDVMPQLL

SEQ ID NO: 1247947 - protein, 9 aa, Homo Sapiens
CVISIDRYT

SEQ ID NO: 1247948 - protein, 9 aa, Homo Sapiens
NDVTGSEDA

SEQ ID NO: 1247949 - protein, 9 aa, Homo Sapiens
AWETPSHLA

SEQ ID NO: 1247950 - protein, 9 aa, Homo Sapiens
QQAAVLGLV

SEQ ID NO: 1247951 - protein, 9 aa, Homo Sapiens
GEALGISSE

SEQ ID NO: 1247952 - protein, 9 aa, Homo Sapiens
VSAITIVSA

SEQ ID NO: 1247953 - protein, 9 aa, Homo Sapiens
FVALLLSYV

SEQ ID NO: 1247954 - protein, 9 aa, Homo Sapiens
KVMEERYKM

SEQ ID NO: 1247955 - protein, 9 aa, Homo Sapiens
CKGNITHGC

SEQ ID NO: 1247956 - protein, 9 aa, Homo Sapiens
EQSTSIRLT

SEQ ID NO: 1247957 - protein, 9 aa, Homo Sapiens
MSNLKMKET

SEQ ID NO: 1247958 - protein, 9 aa, Homo Sapiens
SKPKDSPPF

SEQ ID NO: 1247959 - protein, 9 aa, Homo Sapiens
QHHSLRAIQ

SEQ ID NO: 1247960 - protein, 9 aa, Homo Sapiens
GCPDGGDGG

SEQ ID NO: 1247961 - protein, 9 aa, Homo Sapiens
LSQSPAEVD

SEQ ID NO: 1247962 - protein, 9 aa, Homo Sapiens
QMRAVINQK

SEQ ID NO: 1247963 - protein, 9 aa, Homo Sapiens
TFKPFDGEE

SEQ ID NO: 1247964 - protein, 9 aa, Homo Sapiens
GQPRKTTIS

SEQ ID NO: 1247965 - protein, 9 aa, Homo Sapiens
SSVQKKMKI

SEQ ID NO: 1247966 - protein, 9 aa, Homo Sapiens
DTDPSNLGG

SEQ ID NO: 1247967 - protein, 9 aa, Homo Sapiens
KEFLFNMCL

SEQ ID NO: 1247968 - protein, 9 aa, Homo Sapiens
LSSFGMAQK

SEQ ID NO: 1247969 - protein, 9 aa, Homo Sapiens
HHPGKSNLK

SEQ ID NO: 1247970 - protein, 9 aa, Homo Sapiens
IEEFWQQER

SEQ ID NO: 1247971 - protein, 9 aa, Homo Sapiens
RNQGIRTVR

SEQ ID NO: 1247972 - protein, 9 aa, Homo Sapiens
LYIDLGTLA

SEQ ID NO: 1247973 - protein, 9 aa, Homo Sapiens
TLFPREAPD

SEQ ID NO: 1247974 - protein, 9 aa, Homo Sapiens
MKHVWDRAV

SEQ ID NO: 1247975 - protein, 9 aa, Homo Sapiens
DYLASLQSL

SEQ ID NO: 1247976 - protein, 9 aa, Homo Sapiens
PMIRQQELI

SEQ ID NO: 1247977 - protein, 9 aa, Homo Sapiens
PRYTIPPRM

SEQ ID NO: 1247978 - protein, 9 aa, Homo Sapiens
MMDILEIRK

SEQ ID NO: 1247979 - protein, 9 aa, Homo Sapiens
TYMAAVKKA

SEQ ID NO: 1247980 - protein, 9 aa, Homo Sapiens
VLASLIGIA

SEQ ID NO: 1247981 - protein, 9 aa, Homo Sapiens
SREKNPNTF

SEQ ID NO: 1247982 - protein, 9 aa, Homo Sapiens
TLGINVTSV

SEQ ID NO: 1247983 - protein, 9 aa, Homo Sapiens
LATVIRCRQ

SEQ ID NO: 1247984 - protein, 9 aa, Homo Sapiens
MRIGLMMEE

SEQ ID NO: 1247985 - protein, 9 aa, Homo Sapiens
SVKIECHSL

SEQ ID NO: 1247986 - protein, 9 aa, Homo Sapiens
QSRDAHQQR

SEQ ID NO: 1247987 - protein, 9 aa, Homo Sapiens
RSLNPELES

SEQ ID NO: 1247988 - protein, 9 aa, Homo Sapiens
CYIKNHEGG

SEQ ID NO: 1247989 - protein, 9 aa, Homo Sapiens
EIRDRREYD

SEQ ID NO: 1247990 - protein, 9 aa, Homo Sapiens
HFTCVTDTK

SEQ ID NO: 1247991 - protein, 9 aa, Homo Sapiens
SGDCCTSTV

SEQ ID NO: 1247992 - protein, 9 aa, Homo Sapiens
KTRTSPTFR

SEQ ID NO: 1247993 - protein, 9 aa, Homo Sapiens
DAQPWSEPT

SEQ ID NO: 1247994 - protein, 9 aa, Homo Sapiens
KAMPTTQSF

SEQ ID NO: 1247995 - protein, 9 aa, Homo Sapiens
RESTLLKTL

SEQ ID NO: 1247996 - protein, 9 aa, Homo Sapiens
HVLQPPNET

SEQ ID NO: 1247997 - protein, 9 aa, Homo Sapiens
TWADSQEKG

SEQ ID NO: 1247998 - protein, 9 aa, Homo Sapiens
HPLSFADEK

SEQ ID NO: 1247999 - protein, 9 aa, Homo Sapiens
CNTNDTIGD

SEQ ID NO: 1248000 - protein, 9 aa, Homo Sapiens
TPLPLLKDI

SEQ ID NO: 1248001 - protein, 9 aa, Homo Sapiens
SANYHTLYR

SEQ ID NO: 1248002 - protein, 9 aa, Homo Sapiens
VRKLRVSIT

SEQ ID NO: 1248003 - protein, 9 aa, Homo Sapiens
SWQDVIMKG

SEQ ID NO: 1248004 - protein, 9 aa, Homo Sapiens
YGIGVGYCK

SEQ ID NO: 1248005 - protein, 9 aa, Homo Sapiens
LHQHEGFPP

SEQ ID NO: 1248006 - protein, 9 aa, Homo Sapiens
CETPGRGPP

SEQ ID NO: 1248007 - protein, 9 aa, Homo Sapiens
LEPLLAHAN

SEQ ID NO: 1248008 - protein, 9 aa, Homo Sapiens
TMPFLYCNT

SEQ ID NO: 1248009 - protein, 9 aa, Homo Sapiens
INSHEVDYY

SEQ ID NO: 1248010 - protein, 9 aa, Homo Sapiens
LRNMLSHLS

SEQ ID NO: 1248011 - protein, 9 aa, Homo Sapiens
PYISPKESP

SEQ ID NO: 1248012 - protein, 9 aa, Homo Sapiens
QQHKVTLLD

SEQ ID NO: 1248013 - protein, 9 aa, Homo Sapiens
SRVLHVLDQ

SEQ ID NO: 1248014 - protein, 9 aa, Homo Sapiens
LQKCIEVRV

SEQ ID NO: 1248015 - protein, 9 aa, Homo Sapiens
AHAIILDFY

SEQ ID NO: 1248016 - protein, 9 aa, Homo Sapiens
VTDTVLING

SEQ ID NO: 1248017 - protein, 9 aa, Homo Sapiens
TTSAETSLD

SEQ ID NO: 1248018 - protein, 9 aa, Homo Sapiens
KYTLELQKL

SEQ ID NO: 1248019 - protein, 9 aa, Homo Sapiens
SHSFFSVNC

SEQ ID NO: 1248020 - protein, 9 aa, Homo Sapiens
SFKTVIKKR

SEQ ID NO: 1248021 - protein, 9 aa, Homo Sapiens
NEDLDRWRR

SEQ ID NO: 1248022 - protein, 9 aa, Homo Sapiens
MVEKILVLG

SEQ ID NO: 1248023 - protein, 9 aa, Homo Sapiens
KMVEDCEHC

SEQ ID NO: 1248024 - protein, 9 aa, Homo Sapiens
RKAEVNELK

SEQ ID NO: 1248025 - protein, 9 aa, Homo Sapiens
NAVFEWYIT

SEQ ID NO: 1248026 - protein, 9 aa, Homo Sapiens
RIEYANLTG

SEQ ID NO: 1248027 - protein, 9 aa, Homo Sapiens
ISWGTLGLE

SEQ ID NO: 1248028 - protein, 9 aa, Homo Sapiens
ENIRKEKND

SEQ ID NO: 1248029 - protein, 9 aa, Homo Sapiens
QWIRETLPS

SEQ ID NO: 1248030 - protein, 9 aa, Homo Sapiens
DLCSVQDGE

SEQ ID NO: 1248031 - protein, 9 aa, Homo Sapiens
RGHDTSIYV

SEQ ID NO: 1248032 - protein, 9 aa, Homo Sapiens
MQHQSQKCK

SEQ ID NO: 1248033 - protein, 9 aa, Homo Sapiens
GTPGERGPT

SEQ ID NO: 1248034 - protein, 9 aa, Homo Sapiens
SATFKPFED

SEQ ID NO: 1248035 - protein, 9 aa, Homo Sapiens
AGEQREVGK

SEQ ID NO: 1248036 - protein, 9 aa, Homo Sapiens
LPVSDDTCY

SEQ ID NO: 1248037 - protein, 9 aa, Homo Sapiens
VTYTTMIHT

SEQ ID NO: 1248038 - protein, 9 aa, Homo Sapiens
LLYTVMRCS

SEQ ID NO: 1248039 - protein, 9 aa, Homo Sapiens
GEEKGLAVV

SEQ ID NO: 1248040 - protein, 9 aa, Homo Sapiens
IIVKACQVC

SEQ ID NO: 1248041 - protein, 9 aa, Homo Sapiens
SPHRQTRPR

SEQ ID NO: 1248042 - protein, 9 aa, Homo Sapiens
LPGRSIIVG

SEQ ID NO: 1248043 - protein, 9 aa, Homo Sapiens
IIGSTNLIV

SEQ ID NO: 1248044 - protein, 9 aa, Homo Sapiens
QVGRLHGSV

SEQ ID NO: 1248045 - protein, 9 aa, Homo Sapiens
TVLSQPNAT

SEQ ID NO: 1248046 - protein, 9 aa, Homo Sapiens
LWEERSWSN

SEQ ID NO: 1248047 - protein, 9 aa, Homo Sapiens
EYEKTDRVK

SEQ ID NO: 1248048 - protein, 9 aa, Homo Sapiens
QERCVLVNA

SEQ ID NO: 1248049 - protein, 9 aa, Homo Sapiens
FRALLLNKR

SEQ ID NO: 1248050 - protein, 9 aa, Homo Sapiens
TPNYCKGTY

SEQ ID NO: 1248051 - protein, 9 aa, Homo Sapiens
SCFAYQKIS

SEQ ID NO: 1248052 - protein, 9 aa, Homo Sapiens
GQRRAGNVV

SEQ ID NO: 1248053 - protein, 9 aa, Homo Sapiens
YFIIMMRTT

SEQ ID NO: 1248054 - protein, 9 aa, Homo Sapiens
LVKEQGTVP

SEQ ID NO: 1248055 - protein, 9 aa, Homo Sapiens
LIQALRDGK

SEQ ID NO: 1248056 - protein, 9 aa, Homo Sapiens
AAATAAAFK

SEQ ID NO: 1248057 - protein, 9 aa, Homo Sapiens
GYAITFPYP

SEQ ID NO: 1248058 - protein, 9 aa, Homo Sapiens
VFFSLLTTA

SEQ ID NO: 1248059 - protein, 9 aa, Homo Sapiens
KTHAILFKK

SEQ ID NO: 1248060 - protein, 9 aa, Homo Sapiens
GFDALLTYY

SEQ ID NO: 1248061 - protein, 9 aa, Homo Sapiens
KVRSLKGHV

SEQ ID NO: 1248062 - protein, 9 aa, Homo Sapiens
PQKSSLSPP

SEQ ID NO: 1248063 - protein, 9 aa, Homo Sapiens
EEKEHLAVD

SEQ ID NO: 1248064 - protein, 9 aa, Homo Sapiens
ATKVMCIGL

SEQ ID NO: 1248065 - protein, 9 aa, Homo Sapiens
EATALYLAL

SEQ ID NO: 1248066 - protein, 9 aa, Homo Sapiens
TPREQTWLD

SEQ ID NO: 1248067 - protein, 9 aa, Homo Sapiens
GSIHTTAFP

SEQ ID NO: 1248068 - protein, 9 aa, Homo Sapiens
SSYAPEQSE

SEQ ID NO: 1248069 - protein, 9 aa, Homo Sapiens
CYLITATLT

SEQ ID NO: 1248070 - protein, 9 aa, Homo Sapiens
KKRTISFLQ

SEQ ID NO: 1248071 - protein, 9 aa, Homo Sapiens
PFANSPSDT

SEQ ID NO: 1248072 - protein, 9 aa, Homo Sapiens
VVPAKMYPA

SEQ ID NO: 1248073 - protein, 9 aa, Homo Sapiens
LCEDMGQFI

SEQ ID NO: 1248074 - protein, 9 aa, Homo Sapiens
ASPATHYAL

SEQ ID NO: 1248075 - protein, 9 aa, Homo Sapiens
VNTDAEKIF

SEQ ID NO: 1248076 - protein, 9 aa, Homo Sapiens
IQLLKCLAT

SEQ ID NO: 1248077 - protein, 9 aa, Homo Sapiens
TIDMGDLEM

SEQ ID NO: 1248078 - protein, 9 aa, Homo Sapiens
MLHRAYSKV

SEQ ID NO: 1248079 - protein, 9 aa, Homo Sapiens
MYVKNRNPR

SEQ ID NO: 1248080 - protein, 9 aa, Homo Sapiens
SATSSPRPM

SEQ ID NO: 1248081 - protein, 9 aa, Homo Sapiens
SLPIRVLSI

SEQ ID NO: 1248082 - protein, 9 aa, Homo Sapiens
ETRIAMETY

SEQ ID NO: 1248083 - protein, 9 aa, Homo Sapiens
ARSKFRQGY

SEQ ID NO: 1248084 - protein, 9 aa, Homo Sapiens
GHLLVLSYI

SEQ ID NO: 1248085 - protein, 9 aa, Homo Sapiens
MSRMFADGK

SEQ ID NO: 1248086 - protein, 9 aa, Homo Sapiens
DIQKQVWEW

SEQ ID NO: 1248087 - protein, 9 aa, Homo Sapiens
CGQWLPIYL

SEQ ID NO: 1248088 - protein, 9 aa, Homo Sapiens
GTAVNFSSI

SEQ ID NO: 1248089 - protein, 9 aa, Homo Sapiens
RHVADMNMC

SEQ ID NO: 1248090 - protein, 9 aa, Homo Sapiens
MFWWVSGLV

SEQ ID NO: 1248091 - protein, 9 aa, Homo Sapiens
DSIMTRGNV

SEQ ID NO: 1248092 - protein, 9 aa, Homo Sapiens
RSRPSSTSS

SEQ ID NO: 1248093 - protein, 9 aa, Homo Sapiens
KEVKKRSRK

SEQ ID NO: 1248094 - protein, 9 aa, Homo Sapiens
KKGCLSSLQ

SEQ ID NO: 1248095 - protein, 9 aa, Homo Sapiens
DGVNSIARG

SEQ ID NO: 1248096 - protein, 9 aa, Homo Sapiens
FALMASVPP

SEQ ID NO: 1248097 - protein, 9 aa, Homo Sapiens
KCSDNYEVQ

SEQ ID NO: 1248098 - protein, 9 aa, Homo Sapiens
LTSPDLQIT

SEQ ID NO: 1248099 - protein, 9 aa, Homo Sapiens
SNKNVTVVR

SEQ ID NO: 1248100 - protein, 9 aa, Homo Sapiens
LEYSAMDCE

SEQ ID NO: 1248101 - protein, 9 aa, Homo Sapiens
AAVGSVCYL

SEQ ID NO: 1248102 - protein, 9 aa, Homo Sapiens
SFNSLVNMA

SEQ ID NO: 1248103 - protein, 9 aa, Homo Sapiens
ATAATSPGS

SEQ ID NO: 1248104 - protein, 9 aa, Homo Sapiens
QPVHWEHCC

SEQ ID NO: 1248105 - protein, 9 aa, Homo Sapiens
ILEREKHHM

SEQ ID NO: 1248106 - protein, 9 aa, Homo Sapiens
ISPSRSSSA

SEQ ID NO: 1248107 - protein, 9 aa, Homo Sapiens
AFAGTSPVH

SEQ ID NO: 1248108 - protein, 9 aa, Homo Sapiens
ENLERQQNQ

SEQ ID NO: 1248109 - protein, 9 aa, Homo Sapiens
TGEDGPSCS

SEQ ID NO: 1248110 - protein, 9 aa, Homo Sapiens
GASGNLRSR

SEQ ID NO: 1248111 - protein, 9 aa, Homo Sapiens
TDTQEDQIN

SEQ ID NO: 1248112 - protein, 9 aa, Homo Sapiens
VFMCGTNVF

SEQ ID NO: 1248113 - protein, 9 aa, Homo Sapiens
CNGRRDARA

SEQ ID NO: 1248114 - protein, 9 aa, Homo Sapiens
RLSRRLLRD

SEQ ID NO: 1248115 - protein, 9 aa, Homo Sapiens
LWPDMTLVL

SEQ ID NO: 1248116 - protein, 9 aa, Homo Sapiens
SNLFYTPNS

SEQ ID NO: 1248117 - protein, 9 aa, Homo Sapiens
DYKRTVACA

SEQ ID NO: 1248118 - protein, 9 aa, Homo Sapiens
TKVIVQVFE

SEQ ID NO: 1248119 - protein, 9 aa, Homo Sapiens
QRMKWDWMH

SEQ ID NO: 1248120 - protein, 9 aa, Homo Sapiens
IGETVVNLE

SEQ ID NO: 1248121 - protein, 9 aa, Homo Sapiens
GQKGISFLE

SEQ ID NO: 1248122 - protein, 9 aa, Homo Sapiens
FCDRMNEIH

SEQ ID NO: 1248123 - protein, 9 aa, Homo Sapiens
RNKNVKEAI

SEQ ID NO: 1248124 - protein, 9 aa, Homo Sapiens
WLLCQAEEE

SEQ ID NO: 1248125 - protein, 9 aa, Homo Sapiens
LPAAEYQTT

SEQ ID NO: 1248126 - protein, 9 aa, Homo Sapiens
VYFFLGTSQ

SEQ ID NO: 1248127 - protein, 9 aa, Homo Sapiens
FHPPPLHYR

SEQ ID NO: 1248128 - protein, 9 aa, Homo Sapiens
SESFPYPGF

SEQ ID NO: 1248129 - protein, 9 aa, Homo Sapiens
RTLIPGSSN

SEQ ID NO: 1248130 - protein, 9 aa, Homo Sapiens
TNISHVMQY

SEQ ID NO: 1248131 - protein, 9 aa, Homo Sapiens
KAANDYNQK

SEQ ID NO: 1248132 - protein, 9 aa, Homo Sapiens
HIWTRFLTT

SEQ ID NO: 1248133 - protein, 9 aa, Homo Sapiens
THFTVLTAT

SEQ ID NO: 1248134 - protein, 9 aa, Homo Sapiens
LGGKPNNAH

SEQ ID NO: 1248135 - protein, 9 aa, Homo Sapiens
SSLHIHTRT

SEQ ID NO: 1248136 - protein, 9 aa, Homo Sapiens
QQSVLWNCA

SEQ ID NO: 1248137 - protein, 9 aa, Homo Sapiens
KGNEPSTKV

SEQ ID NO: 1248138 - protein, 9 aa, Homo Sapiens
LRLTGGEAA

SEQ ID NO: 1248139 - protein, 9 aa, Homo Sapiens
PIYCLFGDT

SEQ ID NO: 1248140 - protein, 9 aa, Homo Sapiens
SPEQFISNA

SEQ ID NO: 1248141 - protein, 9 aa, Homo Sapiens
ARAPHVCQD

SEQ ID NO: 1248142 - protein, 9 aa, Homo Sapiens
IMLCKGRVP

SEQ ID NO: 1248143 - protein, 9 aa, Homo Sapiens
HRHTGMHRH

SEQ ID NO: 1248144 - protein, 9 aa, Homo Sapiens
DALYESAKK

SEQ ID NO: 1248145 - protein, 9 aa, Homo Sapiens
TLLKKPALY

SEQ ID NO: 1248146 - protein, 9 aa, Homo Sapiens
KASSISPVE

SEQ ID NO: 1248147 - protein, 9 aa, Homo Sapiens
IEDFITHLK

SEQ ID NO: 1248148 - protein, 9 aa, Homo Sapiens
LQRRLPKPA

SEQ ID NO: 1248149 - protein, 9 aa, Homo Sapiens
CSGILQLGG

SEQ ID NO: 1248150 - protein, 9 aa, Homo Sapiens
KRLRHRAPP

SEQ ID NO: 1248151 - protein, 9 aa, Homo Sapiens
VRHNRCLYR

SEQ ID NO: 1248152 - protein, 9 aa, Homo Sapiens
DVSYLISNK

SEQ ID NO: 1248153 - protein, 9 aa, Homo Sapiens
VVNVNASKE

SEQ ID NO: 1248154 - protein, 9 aa, Homo Sapiens
WGINQFGPP

SEQ ID NO: 1248155 - protein, 9 aa, Homo Sapiens
SHLHPEGLG

SEQ ID NO: 1248156 - protein, 9 aa, Homo Sapiens
ERCIVGQYK

SEQ ID NO: 1248157 - protein, 9 aa, Homo Sapiens
VYRYTLLLY

SEQ ID NO: 1248158 - protein, 9 aa, Homo Sapiens
WYIHLKLGA

SEQ ID NO: 1248159 - protein, 9 aa, Homo Sapiens
KLQFLYVPV

SEQ ID NO: 1248160 - protein, 9 aa, Homo Sapiens
WIPSECHGF

SEQ ID NO: 1248161 - protein, 9 aa, Homo Sapiens
HCSHSSSCS

SEQ ID NO: 1248162 - protein, 9 aa, Homo Sapiens
ACISCITKF

SEQ ID NO: 1248163 - protein, 9 aa, Homo Sapiens
VSPESLKPS

SEQ ID NO: 1248164 - protein, 9 aa, Homo Sapiens
RAQTPEEEH

SEQ ID NO: 1248165 - protein, 9 aa, Homo Sapiens
LLHIKKTIQ

SEQ ID NO: 1248166 - protein, 9 aa, Homo Sapiens
DAMVMTQYI

SEQ ID NO: 1248167 - protein, 9 aa, Homo Sapiens
SIMSFVDIC

SEQ ID NO: 1248168 - protein, 9 aa, Homo Sapiens
NIIGFVKLR

SEQ ID NO: 1248169 - protein, 9 aa, Homo Sapiens
ITKMEIHRT

SEQ ID NO: 1248170 - protein, 9 aa, Homo Sapiens
PKCFKGLYV

SEQ ID NO: 1248171 - protein, 9 aa, Homo Sapiens
RYASIKDYI

SEQ ID NO: 1248172 - protein, 9 aa, Homo Sapiens
LDRAISCRN

SEQ ID NO: 1248173 - protein, 9 aa, Homo Sapiens
EEEEDELVD

SEQ ID NO: 1248174 - protein, 9 aa, Homo Sapiens
YDELGNHYQ

SEQ ID NO: 1248175 - protein, 9 aa, Homo Sapiens
EMAQAEGIP

SEQ ID NO: 1248176 - protein, 9 aa, Homo Sapiens
PVACLIFLC

SEQ ID NO: 1248177 - protein, 9 aa, Homo Sapiens
ICLLHGKIY

SEQ ID NO: 1248178 - protein, 9 aa, Homo Sapiens
VQPELLKRN

SEQ ID NO: 1248179 - protein, 9 aa, Homo Sapiens
HRISQHSSE

SEQ ID NO: 1248180 - protein, 9 aa, Homo Sapiens
NPIYDIDEL

SEQ ID NO: 1248181 - protein, 9 aa, Homo Sapiens
ADKCGLTPL

SEQ ID NO: 1248182 - protein, 9 aa, Homo Sapiens
GEAAVFPHG

SEQ ID NO: 1248183 - protein, 9 aa, Homo Sapiens
IQLLQSLQE

SEQ ID NO: 1248184 - protein, 9 aa, Homo Sapiens
GQREVRPQV

SEQ ID NO: 1248185 - protein, 9 aa, Homo Sapiens
HYFYLFPNR

SEQ ID NO: 1248186 - protein, 9 aa, Homo Sapiens
RVHQAAPLI

SEQ ID NO: 1248187 - protein, 9 aa, Homo Sapiens
APLTPREQT

SEQ ID NO: 1248188 - protein, 9 aa, Homo Sapiens
RCDDTAAAV

SEQ ID NO: 1248189 - protein, 9 aa, Homo Sapiens
GLDDSLLDL

SEQ ID NO: 1248190 - protein, 9 aa, Homo Sapiens
GDVGAPGVQ

SEQ ID NO: 1248191 - protein, 9 aa, Homo Sapiens
ASAPSHQAL

SEQ ID NO: 1248192 - protein, 9 aa, Homo Sapiens
SQCPACRIP

SEQ ID NO: 1248193 - protein, 9 aa, Homo Sapiens
PATTLYRHN

SEQ ID NO: 1248194 - protein, 9 aa, Homo Sapiens
KISKAHDKS

SEQ ID NO: 1248195 - protein, 9 aa, Homo Sapiens
ELERCIVGQ

SEQ ID NO: 1248196 - protein, 9 aa, Homo Sapiens
YQEKVDIVL

SEQ ID NO: 1248197 - protein, 9 aa, Homo Sapiens
ESSVSEDEF

SEQ ID NO: 1248198 - protein, 9 aa, Homo Sapiens
TREGDTLEL

SEQ ID NO: 1248199 - protein, 9 aa, Homo Sapiens
GGITFCNQL

SEQ ID NO: 1248200 - protein, 9 aa, Homo Sapiens
CSFVTEGGE

SEQ ID NO: 1248201 - protein, 9 aa, Homo Sapiens
VLAQGSGLT

SEQ ID NO: 1248202 - protein, 9 aa, Homo Sapiens
LKPKKTKNI

SEQ ID NO: 1248203 - protein, 9 aa, Homo Sapiens
HVFLACSFG

SEQ ID NO: 1248204 - protein, 9 aa, Homo Sapiens
PGHACMVGA

SEQ ID NO: 1248205 - protein, 9 aa, Homo Sapiens
WDLTKSLQK

SEQ ID NO: 1248206 - protein, 9 aa, Homo Sapiens
MFGGFRFHV

SEQ ID NO: 1248207 - protein, 9 aa, Homo Sapiens
SQPLDPNGT

SEQ ID NO: 1248208 - protein, 9 aa, Homo Sapiens
NPLDFEIFD

SEQ ID NO: 1248209 - protein, 9 aa, Homo Sapiens
KNQIRSGMG

SEQ ID NO: 1248210 - protein, 9 aa, Homo Sapiens
KIQEARKTL

SEQ ID NO: 1248211 - protein, 9 aa, Homo Sapiens
LNSGRRYDL

SEQ ID NO: 1248212 - protein, 9 aa, Homo Sapiens
RNDRVIRVA

SEQ ID NO: 1248213 - protein, 9 aa, Homo Sapiens
ARELSESTT

SEQ ID NO: 1248214 - protein, 9 aa, Homo Sapiens
TETVIDKSK

SEQ ID NO: 1248215 - protein, 9 aa, Homo Sapiens
NKNHGCAHV

SEQ ID NO: 1248216 - protein, 9 aa, Homo Sapiens
QRGRPGRPR

SEQ ID NO: 1248217 - protein, 9 aa, Homo Sapiens
VSRFAGSIF

SEQ ID NO: 1248218 - protein, 9 aa, Homo Sapiens
LIVTRDSQK

SEQ ID NO: 1248219 - protein, 9 aa, Homo Sapiens
PGVHGLQGV

SEQ ID NO: 1248220 - protein, 9 aa, Homo Sapiens
PTDAQDCEL

SEQ ID NO: 1248221 - protein, 9 aa, Homo Sapiens
IAVMGWLAS

SEQ ID NO: 1248222 - protein, 9 aa, Homo Sapiens
KQGKYQNKA

SEQ ID NO: 1248223 - protein, 9 aa, Homo Sapiens
VSVKLSTLH

SEQ ID NO: 1248224 - protein, 9 aa, Homo Sapiens
NFSVIDQYV

SEQ ID NO: 1248225 - protein, 9 aa, Homo Sapiens
KKISVLSFE

SEQ ID NO: 1248226 - protein, 9 aa, Homo Sapiens
TFLLTMDAC

SEQ ID NO: 1248227 - protein, 9 aa, Homo Sapiens
LVMAMFKLL

SEQ ID NO: 1248228 - protein, 9 aa, Homo Sapiens
QGSVSFKYV

SEQ ID NO: 1248229 - protein, 9 aa, Homo Sapiens
RTLPGGPWL

SEQ ID NO: 1248230 - protein, 9 aa, Homo Sapiens
EKVDIVLGP

SEQ ID NO: 1248231 - protein, 9 aa, Homo Sapiens
TYLHPRSLR

SEQ ID NO: 1248232 - protein, 9 aa, Homo Sapiens
ITSSWNRIT

SEQ ID NO: 1248233 - protein, 9 aa, Homo Sapiens
SVSGDMCSL

SEQ ID NO: 1248234 - protein, 9 aa, Homo Sapiens
RSHTGEKTY

SEQ ID NO: 1248235 - protein, 9 aa, Homo Sapiens
VPFNLVPSQ

SEQ ID NO: 1248236 - protein, 9 aa, Homo Sapiens
WRPLHTAGG

SEQ ID NO: 1248237 - protein, 9 aa, Homo Sapiens
IPMVHIINR

SEQ ID NO: 1248238 - protein, 9 aa, Homo Sapiens
ICRNWRKSG

SEQ ID NO: 1248239 - protein, 9 aa, Homo Sapiens
RCPRSAVDI

SEQ ID NO: 1248240 - protein, 9 aa, Homo Sapiens
QDVSGTDGK

SEQ ID NO: 1248241 - protein, 9 aa, Homo Sapiens
PLDKCLAAD

SEQ ID NO: 1248242 - protein, 9 aa, Homo Sapiens
PCTTAEFPS

SEQ ID NO: 1248243 - protein, 9 aa, Homo Sapiens
HFHKGGGYS

SEQ ID NO: 1248244 - protein, 9 aa, Homo Sapiens
GWSFAFRLC

SEQ ID NO: 1248245 - protein, 9 aa, Homo Sapiens
TFAEKLSRE

SEQ ID NO: 1248246 - protein, 9 aa, Homo Sapiens
KLHPFGYLQ

SEQ ID NO: 1248247 - protein, 9 aa, Homo Sapiens
PLPQPLPRS

SEQ ID NO: 1248248 - protein, 9 aa, Homo Sapiens
VLEWLKYGK

SEQ ID NO: 1248249 - protein, 9 aa, Homo Sapiens
SDQIQLWQF

SEQ ID NO: 1248250 - protein, 9 aa, Homo Sapiens
DHNTLKLIP

SEQ ID NO: 1248251 - protein, 9 aa, Homo Sapiens
MAHLSEDQK

SEQ ID NO: 1248252 - protein, 9 aa, Homo Sapiens
SLLKIQKFT

SEQ ID NO: 1248253 - protein, 9 aa, Homo Sapiens
STMDNSLKK

SEQ ID NO: 1248254 - protein, 9 aa, Homo Sapiens
TPLASRETT

SEQ ID NO: 1248255 - protein, 9 aa, Homo Sapiens
TTSLVTSSA

SEQ ID NO: 1248256 - protein, 9 aa, Homo Sapiens
PWDFFINMS

SEQ ID NO: 1248257 - protein, 9 aa, Homo Sapiens
VDGLGAPRQ

SEQ ID NO: 1248258 - protein, 9 aa, Homo Sapiens
ADHMASLLK

SEQ ID NO: 1248259 - protein, 9 aa, Homo Sapiens
MSVIITILV

SEQ ID NO: 1248260 - protein, 9 aa, Homo Sapiens
YEICQGMHQ

SEQ ID NO: 1248261 - protein, 9 aa, Homo Sapiens
LNEEEGIQG

SEQ ID NO: 1248262 - protein, 9 aa, Homo Sapiens
ETVHFRLTR

SEQ ID NO: 1248263 - protein, 9 aa, Homo Sapiens
KLLTAVHGS

SEQ ID NO: 1248264 - protein, 9 aa, Homo Sapiens
EAGLAEYMF

SEQ ID NO: 1248265 - protein, 9 aa, Homo Sapiens
YTIPPRMTP

SEQ ID NO: 1248266 - protein, 9 aa, Homo Sapiens
TKPQVKPGF

SEQ ID NO: 1248267 - protein, 9 aa, Homo Sapiens
ATVINYLPK

SEQ ID NO: 1248268 - protein, 9 aa, Homo Sapiens
FHTSAWGIP

SEQ ID NO: 1248269 - protein, 9 aa, Homo Sapiens
PVGGDLTSR

SEQ ID NO: 1248270 - protein, 9 aa, Homo Sapiens
AMRRYKTFM

SEQ ID NO: 1248271 - protein, 9 aa, Homo Sapiens
DSPGDKRLA

SEQ ID NO: 1248272 - protein, 9 aa, Homo Sapiens
QAKYREYIT

SEQ ID NO: 1248273 - protein, 9 aa, Homo Sapiens
SFVPSLFSP

SEQ ID NO: 1248274 - protein, 9 aa, Homo Sapiens
KVLLNEYNV

SEQ ID NO: 1248275 - protein, 9 aa, Homo Sapiens
CPAKAWSGR

SEQ ID NO: 1248276 - protein, 9 aa, Homo Sapiens
EDAVPEMNS

SEQ ID NO: 1248277 - protein, 9 aa, Homo Sapiens
GNVPVVSAA

SEQ ID NO: 1248278 - protein, 9 aa, Homo Sapiens
RLLPSVSYF

SEQ ID NO: 1248279 - protein, 9 aa, Homo Sapiens
NGSFHIRRG

SEQ ID NO: 1248280 - protein, 9 aa, Homo Sapiens
IYRDVMLEN

SEQ ID NO: 1248281 - protein, 9 aa, Homo Sapiens
FSSALKNSR

SEQ ID NO: 1248282 - protein, 9 aa, Homo Sapiens
LAPEYETAA

SEQ ID NO: 1248283 - protein, 9 aa, Homo Sapiens
DTQYMTMRQ

SEQ ID NO: 1248284 - protein, 9 aa, Homo Sapiens
SLSRQCSTE

SEQ ID NO: 1248285 - protein, 9 aa, Homo Sapiens
SISPVEISE

SEQ ID NO: 1248286 - protein, 9 aa, Homo Sapiens
QDITSKLLH

SEQ ID NO: 1248287 - protein, 9 aa, Homo Sapiens
ADGMFAYIF

SEQ ID NO: 1248288 - protein, 9 aa, Homo Sapiens
KVHYLQVPL

SEQ ID NO: 1248289 - protein, 9 aa, Homo Sapiens
QGGQMGRPH

SEQ ID NO: 1248290 - protein, 9 aa, Homo Sapiens
GCGKNFGKK

SEQ ID NO: 1248291 - protein, 9 aa, Homo Sapiens
KEEPKAQPL

SEQ ID NO: 1248292 - protein, 9 aa, Homo Sapiens
YSDDFCQPP

SEQ ID NO: 1248293 - protein, 9 aa, Homo Sapiens
GSLPEGVPQ

SEQ ID NO: 1248294 - protein, 9 aa, Homo Sapiens
TLHIYHYRM

SEQ ID NO: 1248295 - protein, 9 aa, Homo Sapiens
PPPVKFSSE

SEQ ID NO: 1248296 - protein, 9 aa, Homo Sapiens
PMLSIQPKG

SEQ ID NO: 1248297 - protein, 9 aa, Homo Sapiens
VGRQGIFPH

SEQ ID NO: 1248298 - protein, 9 aa, Homo Sapiens
VVSILLCNP

SEQ ID NO: 1248299 - protein, 9 aa, Homo Sapiens
SPKHSASPK

SEQ ID NO: 1248300 - protein, 9 aa, Homo Sapiens
GRPRNIVSR

SEQ ID NO: 1248301 - protein, 9 aa, Homo Sapiens
TNPDFKAGV

SEQ ID NO: 1248302 - protein, 9 aa, Homo Sapiens
GSEQMGEQV

SEQ ID NO: 1248303 - protein, 9 aa, Homo Sapiens
QFEDFVCYL

SEQ ID NO: 1248304 - protein, 9 aa, Homo Sapiens
TLIQSLDSS

SEQ ID NO: 1248305 - protein, 9 aa, Homo Sapiens
EPKGLHQLQ

SEQ ID NO: 1248306 - protein, 9 aa, Homo Sapiens
GSEADGLDS

SEQ ID NO: 1248307 - protein, 9 aa, Homo Sapiens
KTVLAICYD

SEQ ID NO: 1248308 - protein, 9 aa, Homo Sapiens
TTITRTINE

SEQ ID NO: 1248309 - protein, 9 aa, Homo Sapiens
MGYSYECVI

SEQ ID NO: 1248310 - protein, 9 aa, Homo Sapiens
KRSAFGVSE

SEQ ID NO: 1248311 - protein, 9 aa, Homo Sapiens
NHPLPLPPP

SEQ ID NO: 1248312 - protein, 9 aa, Homo Sapiens
RAHYEMASN

SEQ ID NO: 1248313 - protein, 9 aa, Homo Sapiens
YQISCVLFL

SEQ ID NO: 1248314 - protein, 9 aa, Homo Sapiens
ENVTDTTTT

SEQ ID NO: 1248315 - protein, 9 aa, Homo Sapiens
PKEAVTGNR

SEQ ID NO: 1248316 - protein, 9 aa, Homo Sapiens
AYVNSLVLQ

SEQ ID NO: 1248317 - protein, 9 aa, Homo Sapiens
GAPDPCCGA

SEQ ID NO: 1248318 - protein, 9 aa, Homo Sapiens
EDRTICEAL

SEQ ID NO: 1248319 - protein, 9 aa, Homo Sapiens
TSDFTLSNR

SEQ ID NO: 1248320 - protein, 9 aa, Homo Sapiens
IMFMGRVTN

SEQ ID NO: 1248321 - protein, 9 aa, Homo Sapiens
MGDAMVMTQ

SEQ ID NO: 1248322 - protein, 9 aa, Homo Sapiens
TFIGLLSSV

SEQ ID NO: 1248323 - protein, 9 aa, Homo Sapiens
AREAGRFAV

SEQ ID NO: 1248324 - protein, 9 aa, Homo Sapiens
ADECKTGFC

SEQ ID NO: 1248325 - protein, 9 aa, Homo Sapiens
RPVTPAATE

SEQ ID NO: 1248326 - protein, 9 aa, Homo Sapiens
GTEKLLALD

SEQ ID NO: 1248327 - protein, 9 aa, Homo Sapiens
VWIVSRRTS

SEQ ID NO: 1248328 - protein, 9 aa, Homo Sapiens
VYPLNAKVH

SEQ ID NO: 1248329 - protein, 9 aa, Homo Sapiens
IPHPYIKMY

SEQ ID NO: 1248330 - protein, 9 aa, Homo Sapiens
FHLAIYTVT

SEQ ID NO: 1248331 - protein, 9 aa, Homo Sapiens
GRAAELLVK

SEQ ID NO: 1248332 - protein, 9 aa, Homo Sapiens
DNKSIFKES

SEQ ID NO: 1248333 - protein, 9 aa, Homo Sapiens
RTHEMTHTG

SEQ ID NO: 1248334 - protein, 9 aa, Homo Sapiens
RDLGPNMRG

SEQ ID NO: 1248335 - protein, 9 aa, Homo Sapiens
SSLPRVTRC

SEQ ID NO: 1248336 - protein, 9 aa, Homo Sapiens
YGTFGMYCR

SEQ ID NO: 1248337 - protein, 9 aa, Homo Sapiens
SHTGTEHLA

SEQ ID NO: 1248338 - protein, 9 aa, Homo Sapiens
IVTERVIEP

SEQ ID NO: 1248339 - protein, 9 aa, Homo Sapiens
NFSVLDLMK

SEQ ID NO: 1248340 - protein, 9 aa, Homo Sapiens
TELDNEVNN

SEQ ID NO: 1248341 - protein, 9 aa, Homo Sapiens
DDILRVVIS

SEQ ID NO: 1248342 - protein, 9 aa, Homo Sapiens
AMADDDTAV

SEQ ID NO: 1248343 - protein, 9 aa, Homo Sapiens
FRIYKAPSF

SEQ ID NO: 1248344 - protein, 9 aa, Homo Sapiens
SLVATTTSL

SEQ ID NO: 1248345 - protein, 9 aa, Homo Sapiens
PNPPSWLSM

SEQ ID NO: 1248346 - protein, 9 aa, Homo Sapiens
GCRDTSLNH

SEQ ID NO: 1248347 - protein, 9 aa, Homo Sapiens
CGEQVLSLV

SEQ ID NO: 1248348 - protein, 9 aa, Homo Sapiens
DGSRAIHHK

SEQ ID NO: 1248349 - protein, 9 aa, Homo Sapiens
RMPQELFEA

SEQ ID NO: 1248350 - protein, 9 aa, Homo Sapiens
NTGPGTLPG

SEQ ID NO: 1248351 - protein, 9 aa, Homo Sapiens
YITTASGQF

SEQ ID NO: 1248352 - protein, 9 aa, Homo Sapiens
FYSFHHIDS

SEQ ID NO: 1248353 - protein, 9 aa, Homo Sapiens
EVVGLEMVF

SEQ ID NO: 1248354 - protein, 9 aa, Homo Sapiens
VWFFSADGN

SEQ ID NO: 1248355 - protein, 9 aa, Homo Sapiens
HNVQEVEKE

SEQ ID NO: 1248356 - protein, 9 aa, Homo Sapiens
LGSTPDAML

SEQ ID NO: 1248357 - protein, 9 aa, Homo Sapiens
QQATVMKQH

SEQ ID NO: 1248358 - protein, 9 aa, Homo Sapiens
ACDAATVRG

SEQ ID NO: 1248359 - protein, 9 aa, Homo Sapiens
GSDQIQLWQ

SEQ ID NO: 1248360 - protein, 9 aa, Homo Sapiens
LTQADEKIS

SEQ ID NO: 1248361 - protein, 9 aa, Homo Sapiens
TCNPLIHVF

SEQ ID NO: 1248362 - protein, 9 aa, Homo Sapiens
SDTGWVNAA

SEQ ID NO: 1248363 - protein, 9 aa, Homo Sapiens
RYLSEWRYV

SEQ ID NO: 1248364 - protein, 9 aa, Homo Sapiens
ACKRAKIPG

SEQ ID NO: 1248365 - protein, 9 aa, Homo Sapiens
IAHRHSLVE

SEQ ID NO: 1248366 - protein, 9 aa, Homo Sapiens
KSTCTKMVV

SEQ ID NO: 1248367 - protein, 9 aa, Homo Sapiens
HFLSSRAGI

SEQ ID NO: 1248368 - protein, 9 aa, Homo Sapiens
VAGIVAARR

SEQ ID NO: 1248369 - protein, 9 aa, Homo Sapiens
NSLGLLKVW

SEQ ID NO: 1248370 - protein, 9 aa, Homo Sapiens
VSSSIQAQP

SEQ ID NO: 1248371 - protein, 9 aa, Homo Sapiens
EEPPRVILY

SEQ ID NO: 1248372 - protein, 9 aa, Homo Sapiens
ADDLREGAH

SEQ ID NO: 1248373 - protein, 9 aa, Homo Sapiens
SNRVFVYCT

SEQ ID NO: 1248374 - protein, 9 aa, Homo Sapiens
RQEVLIRYQ

SEQ ID NO: 1248375 - protein, 9 aa, Homo Sapiens
TYGYKEDKP

SEQ ID NO: 1248376 - protein, 9 aa, Homo Sapiens
EFEFHTTTT

SEQ ID NO: 1248377 - protein, 9 aa, Homo Sapiens
EKPYECKQY

SEQ ID NO: 1248378 - protein, 9 aa, Homo Sapiens
AFIRLLSSV

SEQ ID NO: 1248379 - protein, 9 aa, Homo Sapiens
DLRDHRYSR

SEQ ID NO: 1248380 - protein, 9 aa, Homo Sapiens
AALGGLVFA

SEQ ID NO: 1248381 - protein, 9 aa, Homo Sapiens
ESKQQVSRP

SEQ ID NO: 1248382 - protein, 9 aa, Homo Sapiens
RHCSPSERR

SEQ ID NO: 1248383 - protein, 9 aa, Homo Sapiens
KDLRLKNLP

SEQ ID NO: 1248384 - protein, 9 aa, Homo Sapiens
KAYKESRVV

SEQ ID NO: 1248385 - protein, 9 aa, Homo Sapiens
KVFGVRSSL

SEQ ID NO: 1248386 - protein, 9 aa, Homo Sapiens
RNVLWVHSN

SEQ ID NO: 1248387 - protein, 9 aa, Homo Sapiens
ATTLGIIVR

SEQ ID NO: 1248388 - protein, 9 aa, Homo Sapiens
CAASCVLMT

SEQ ID NO: 1248389 - protein, 9 aa, Homo Sapiens
GSTPGTAIF

SEQ ID NO: 1248390 - protein, 9 aa, Homo Sapiens
KAIRNNRLG

SEQ ID NO: 1248391 - protein, 9 aa, Homo Sapiens
SGDDSLPAE

SEQ ID NO: 1248392 - protein, 9 aa, Homo Sapiens
FFGKYDSHG

SEQ ID NO: 1248393 - protein, 9 aa, Homo Sapiens
EIDTLESRV

SEQ ID NO: 1248394 - protein, 9 aa, Homo Sapiens
QHVSLQHLD

SEQ ID NO: 1248395 - protein, 9 aa, Homo Sapiens
QITTILREI

SEQ ID NO: 1248396 - protein, 9 aa, Homo Sapiens
LYRTTISQT

SEQ ID NO: 1248397 - protein, 9 aa, Homo Sapiens
PTFMPLAKQ

SEQ ID NO: 1248398 - protein, 9 aa, Homo Sapiens
TLRALHPLR

SEQ ID NO: 1248399 - protein, 9 aa, Homo Sapiens
EEVSKSLWF

SEQ ID NO: 1248400 - protein, 9 aa, Homo Sapiens
DAKLDKVQI

SEQ ID NO: 1248401 - protein, 9 aa, Homo Sapiens
LHCFQHVVT

SEQ ID NO: 1248402 - protein, 9 aa, Homo Sapiens
KRHTSSSDD

SEQ ID NO: 1248403 - protein, 9 aa, Homo Sapiens
FRHLCLEYL

SEQ ID NO: 1248404 - protein, 9 aa, Homo Sapiens
HCAFAHCPL

SEQ ID NO: 1248405 - protein, 9 aa, Homo Sapiens
CDFFKRTHY

SEQ ID NO: 1248406 - protein, 9 aa, Homo Sapiens
VDDDVLLVF

SEQ ID NO: 1248407 - protein, 9 aa, Homo Sapiens
CIASETHVV

SEQ ID NO: 1248408 - protein, 9 aa, Homo Sapiens
LQLAFLTSP

SEQ ID NO: 1248409 - protein, 9 aa, Homo Sapiens
TIMTDLEEN

SEQ ID NO: 1248410 - protein, 9 aa, Homo Sapiens
EVLFLMLQT

SEQ ID NO: 1248411 - protein, 9 aa, Homo Sapiens
SVPRHEQIT

SEQ ID NO: 1248412 - protein, 9 aa, Homo Sapiens
GSVFQTGPQ

SEQ ID NO: 1248413 - protein, 9 aa, Homo Sapiens
FLTHCLLVS

SEQ ID NO: 1248414 - protein, 9 aa, Homo Sapiens
VVIHTMAQE

SEQ ID NO: 1248415 - protein, 9 aa, Homo Sapiens
VLMPNWLHL

SEQ ID NO: 1248416 - protein, 9 aa, Homo Sapiens
FPVSNINSP

SEQ ID NO: 1248417 - protein, 9 aa, Homo Sapiens
LSPEYDAIT

SEQ ID NO: 1248418 - protein, 9 aa, Homo Sapiens
SHQDCHEKI

SEQ ID NO: 1248419 - protein, 9 aa, Homo Sapiens
KQDRDITLL

SEQ ID NO: 1248420 - protein, 9 aa, Homo Sapiens
RFTCVRHWH

SEQ ID NO: 1248421 - protein, 9 aa, Homo Sapiens
LKYEWMVSR

SEQ ID NO: 1248422 - protein, 9 aa, Homo Sapiens
NGEQTEAAI

SEQ ID NO: 1248423 - protein, 9 aa, Homo Sapiens
LKMKETALI

SEQ ID NO: 1248424 - protein, 9 aa, Homo Sapiens
PSGRRCRNG

SEQ ID NO: 1248425 - protein, 9 aa, Homo Sapiens
VTPPQGPAQ

SEQ ID NO: 1248426 - protein, 9 aa, Homo Sapiens
ATEAGPSRW

SEQ ID NO: 1248427 - protein, 9 aa, Homo Sapiens
PSGMSPYAY

SEQ ID NO: 1248428 - protein, 9 aa, Homo Sapiens
IDGTFVFVD

SEQ ID NO: 1248429 - protein, 9 aa, Homo Sapiens
ALDTRFLVM

SEQ ID NO: 1248430 - protein, 9 aa, Homo Sapiens
YRNIIGFVK

SEQ ID NO: 1248431 - protein, 9 aa, Homo Sapiens
RKIHTGETV

SEQ ID NO: 1248432 - protein, 9 aa, Homo Sapiens
DYAAHLELH

SEQ ID NO: 1248433 - protein, 9 aa, Homo Sapiens
HYPHLEQVQ

SEQ ID NO: 1248434 - protein, 9 aa, Homo Sapiens
GAEKRKTTM

SEQ ID NO: 1248435 - protein, 9 aa, Homo Sapiens
SSGNSGRNP

SEQ ID NO: 1248436 - protein, 9 aa, Homo Sapiens
PFMSVFRHL

SEQ ID NO: 1248437 - protein, 9 aa, Homo Sapiens
VEVLSRQIT

SEQ ID NO: 1248438 - protein, 9 aa, Homo Sapiens
RDVRFERAE

SEQ ID NO: 1248439 - protein, 9 aa, Homo Sapiens
GKYLSFTEE

SEQ ID NO: 1248440 - protein, 9 aa, Homo Sapiens
PKRPLLPRA

SEQ ID NO: 1248441 - protein, 9 aa, Homo Sapiens
EETVTYTQC

SEQ ID NO: 1248442 - protein, 9 aa, Homo Sapiens
IFAVEWMQD

SEQ ID NO: 1248443 - protein, 9 aa, Homo Sapiens
MVDEVSEKV

SEQ ID NO: 1248444 - protein, 9 aa, Homo Sapiens
GDDKGSMSL

SEQ ID NO: 1248445 - protein, 9 aa, Homo Sapiens
DHCRHVSLR

SEQ ID NO: 1248446 - protein, 9 aa, Homo Sapiens
HWPLSRTHS

SEQ ID NO: 1248447 - protein, 9 aa, Homo Sapiens
RYLCYLAEL

SEQ ID NO: 1248448 - protein, 9 aa, Homo Sapiens
KETQIPLDL

SEQ ID NO: 1248449 - protein, 9 aa, Homo Sapiens
KIGSETLSI

SEQ ID NO: 1248450 - protein, 9 aa, Homo Sapiens
VLSEDARAR

SEQ ID NO: 1248451 - protein, 9 aa, Homo Sapiens
LYQDQVNLR

SEQ ID NO: 1248452 - protein, 9 aa, Homo Sapiens
REKKSHPSI

SEQ ID NO: 1248453 - protein, 9 aa, Homo Sapiens
LNMHINVQN

SEQ ID NO: 1248454 - protein, 9 aa, Homo Sapiens
WWRSQEVLE

SEQ ID NO: 1248455 - protein, 9 aa, Homo Sapiens
EEIDTLESR

SEQ ID NO: 1248456 - protein, 9 aa, Homo Sapiens
LLDLTDNML

SEQ ID NO: 1248457 - protein, 9 aa, Homo Sapiens
VFYLLWTPS

SEQ ID NO: 1248458 - protein, 9 aa, Homo Sapiens
MVGRLPEPT

SEQ ID NO: 1248459 - protein, 9 aa, Homo Sapiens
RMAIGLLDI

SEQ ID NO: 1248460 - protein, 9 aa, Homo Sapiens
EAKYKLKSY

SEQ ID NO: 1248461 - protein, 9 aa, Homo Sapiens
SSVRQLDLS

SEQ ID NO: 1248462 - protein, 9 aa, Homo Sapiens
NGPEFEAMI

SEQ ID NO: 1248463 - protein, 9 aa, Homo Sapiens
DANSASVNA

SEQ ID NO: 1248464 - protein, 9 aa, Homo Sapiens
SSANWDETL

SEQ ID NO: 1248465 - protein, 9 aa, Homo Sapiens
MVNHMVENS

SEQ ID NO: 1248466 - protein, 9 aa, Homo Sapiens
VAFTSTEHA

SEQ ID NO: 1248467 - protein, 9 aa, Homo Sapiens
LSEALQTIH

SEQ ID NO: 1248468 - protein, 9 aa, Homo Sapiens
LEHFDIDDH

SEQ ID NO: 1248469 - protein, 9 aa, Homo Sapiens
GSHQDCHEK

SEQ ID NO: 1248470 - protein, 9 aa, Homo Sapiens
TVFTPPVKK

SEQ ID NO: 1248471 - protein, 9 aa, Homo Sapiens
SLLSAVFYL

SEQ ID NO: 1248472 - protein, 9 aa, Homo Sapiens
SSSQGKRWL

SEQ ID NO: 1248473 - protein, 9 aa, Homo Sapiens
IPTLCHLLH

SEQ ID NO: 1248474 - protein, 9 aa, Homo Sapiens
TQLLLNDNR

SEQ ID NO: 1248475 - protein, 9 aa, Homo Sapiens
CKKNDETNA

SEQ ID NO: 1248476 - protein, 9 aa, Homo Sapiens
VKFKILDEV

SEQ ID NO: 1248477 - protein, 9 aa, Homo Sapiens
VNDTKSGNV

SEQ ID NO: 1248478 - protein, 9 aa, Homo Sapiens
NHNDIVDSD

SEQ ID NO: 1248479 - protein, 9 aa, Homo Sapiens
VAEGMWLPQ

SEQ ID NO: 1248480 - protein, 9 aa, Homo Sapiens
LMLGPSLSL

SEQ ID NO: 1248481 - protein, 9 aa, Homo Sapiens
DLKVFLLRH

SEQ ID NO: 1248482 - protein, 9 aa, Homo Sapiens
CLDTAHQNL

SEQ ID NO: 1248483 - protein, 9 aa, Homo Sapiens
ADGGCFSFL

SEQ ID NO: 1248484 - protein, 9 aa, Homo Sapiens
PLWQGSRKK

SEQ ID NO: 1248485 - protein, 9 aa, Homo Sapiens
PEECGLIQW

SEQ ID NO: 1248486 - protein, 9 aa, Homo Sapiens
LITCIDSRA

SEQ ID NO: 1248487 - protein, 9 aa, Homo Sapiens
MALVVFVGI

SEQ ID NO: 1248488 - protein, 9 aa, Homo Sapiens
RLIVGFFIF

SEQ ID NO: 1248489 - protein, 9 aa, Homo Sapiens
PLTKGNAKS

SEQ ID NO: 1248490 - protein, 9 aa, Homo Sapiens
NDFDNDCNQ

SEQ ID NO: 1248491 - protein, 9 aa, Homo Sapiens
EFGAAGVNG

SEQ ID NO: 1248492 - protein, 9 aa, Homo Sapiens
ASHRESEEV

SEQ ID NO: 1248493 - protein, 9 aa, Homo Sapiens
KMILSFLPI

SEQ ID NO: 1248494 - protein, 9 aa, Homo Sapiens
DEFIHQHFT

SEQ ID NO: 1248495 - protein, 9 aa, Homo Sapiens
QLELFGDMY

SEQ ID NO: 1248496 - protein, 9 aa, Homo Sapiens
GYQSSSHFY

SEQ ID NO: 1248497 - protein, 9 aa, Homo Sapiens
ILSYCTLPP

SEQ ID NO: 1248498 - protein, 9 aa, Homo Sapiens
GEAFQSGQN

SEQ ID NO: 1248499 - protein, 9 aa, Homo Sapiens
FNGFQRPAI

SEQ ID NO: 1248500 - protein, 9 aa, Homo Sapiens
IDSKYDVRV

SEQ ID NO: 1248501 - protein, 9 aa, Homo Sapiens
GVHYDEPLG

SEQ ID NO: 1248502 - protein, 9 aa, Homo Sapiens
DATTAMDLY

SEQ ID NO: 1248503 - protein, 9 aa, Homo Sapiens
SASVPSSPA

SEQ ID NO: 1248504 - protein, 9 aa, Homo Sapiens
SITLDWMFW

SEQ ID NO: 1248505 - protein, 9 aa, Homo Sapiens
CTGDNEKAK

SEQ ID NO: 1248506 - protein, 9 aa, Homo Sapiens
PIPYLTTYR

SEQ ID NO: 1248507 - protein, 9 aa, Homo Sapiens
AGPDMVLTP

SEQ ID NO: 1248508 - protein, 9 aa, Homo Sapiens
SPSDTPEEI

SEQ ID NO: 1248509 - protein, 9 aa, Homo Sapiens
LCPGGRPGQ

SEQ ID NO: 1248510 - protein, 9 aa, Homo Sapiens
KVGDLILAT

SEQ ID NO: 1248511 - protein, 9 aa, Homo Sapiens
STSIRLTES

SEQ ID NO: 1248512 - protein, 9 aa, Homo Sapiens
DAKVKQRIE

SEQ ID NO: 1248513 - protein, 9 aa, Homo Sapiens
LFTSLLNNV

SEQ ID NO: 1248514 - protein, 9 aa, Homo Sapiens
QDGAIENCN

SEQ ID NO: 1248515 - protein, 9 aa, Homo Sapiens
EKHEAATCL

SEQ ID NO: 1248516 - protein, 9 aa, Homo Sapiens
ILCTVETPA

SEQ ID NO: 1248517 - protein, 9 aa, Homo Sapiens
HSSREYDGN

SEQ ID NO: 1248518 - protein, 9 aa, Homo Sapiens
FSYINDNDI

SEQ ID NO: 1248519 - protein, 9 aa, Homo Sapiens
LTSRLSSDE

SEQ ID NO: 1248520 - protein, 9 aa, Homo Sapiens
DSADYIHLT

SEQ ID NO: 1248521 - protein, 9 aa, Homo Sapiens
GPDFGGLGK

SEQ ID NO: 1248522 - protein, 9 aa, Homo Sapiens
RAHSEPEDP

SEQ ID NO: 1248523 - protein, 9 aa, Homo Sapiens
FPASNTERM

SEQ ID NO: 1248524 - protein, 9 aa, Homo Sapiens
DLRENMTPA

SEQ ID NO: 1248525 - protein, 9 aa, Homo Sapiens
VKFSSEPPT

SEQ ID NO: 1248526 - protein, 9 aa, Homo Sapiens
FHTTTTTGV

SEQ ID NO: 1248527 - protein, 9 aa, Homo Sapiens
NLIRHQITH

SEQ ID NO: 1248528 - protein, 9 aa, Homo Sapiens
YMYPYECEK

SEQ ID NO: 1248529 - protein, 9 aa, Homo Sapiens
KRNTTIPAK

SEQ ID NO: 1248530 - protein, 9 aa, Homo Sapiens
VIRCRQDDD

SEQ ID NO: 1248531 - protein, 9 aa, Homo Sapiens
NVVNNFFVT

SEQ ID NO: 1248532 - protein, 9 aa, Homo Sapiens
CKVMLGETM

SEQ ID NO: 1248533 - protein, 9 aa, Homo Sapiens
VDQLQDETN

SEQ ID NO: 1248534 - protein, 9 aa, Homo Sapiens
TTPEDVVSD

SEQ ID NO: 1248535 - protein, 9 aa, Homo Sapiens
CEQLLILVS

SEQ ID NO: 1248536 - protein, 9 aa, Homo Sapiens
RGGILASLQ

SEQ ID NO: 1248537 - protein, 9 aa, Homo Sapiens
LKTISDPYV

SEQ ID NO: 1248538 - protein, 9 aa, Homo Sapiens
QCLSLTMSS

SEQ ID NO: 1248539 - protein, 9 aa, Homo Sapiens
REYSLGPFV

SEQ ID NO: 1248540 - protein, 9 aa, Homo Sapiens
LVVWSKTHR

SEQ ID NO: 1248541 - protein, 9 aa, Homo Sapiens
HANDQQHIH

SEQ ID NO: 1248542 - protein, 9 aa, Homo Sapiens
GKPFLYDNA

SEQ ID NO: 1248543 - protein, 9 aa, Homo Sapiens
EALIHFVDS

SEQ ID NO: 1248544 - protein, 9 aa, Homo Sapiens
LLLMALLEA

SEQ ID NO: 1248545 - protein, 9 aa, Homo Sapiens
DVTYSCIVS

SEQ ID NO: 1248546 - protein, 9 aa, Homo Sapiens
ALTILLVAL

SEQ ID NO: 1248547 - protein, 9 aa, Homo Sapiens
MSLYICLVE

SEQ ID NO: 1248548 - protein, 9 aa, Homo Sapiens
QHVRKLRVS

SEQ ID NO: 1248549 - protein, 9 aa, Homo Sapiens
GPWIQVKVE

SEQ ID NO: 1248550 - protein, 9 aa, Homo Sapiens
AIGLLKRFR

SEQ ID NO: 1248551 - protein, 9 aa, Homo Sapiens
FEKQREECA

SEQ ID NO: 1248552 - protein, 9 aa, Homo Sapiens
CPEYTVWQL

SEQ ID NO: 1248553 - protein, 9 aa, Homo Sapiens
DTKSGNVTW

SEQ ID NO: 1248554 - protein, 9 aa, Homo Sapiens
NCLGDQTVQ

SEQ ID NO: 1248555 - protein, 9 aa, Homo Sapiens
EIMGGAKQI

SEQ ID NO: 1248556 - protein, 9 aa, Homo Sapiens
QLREKVHEL

SEQ ID NO: 1248557 - protein, 9 aa, Homo Sapiens
LSREHPHLA

SEQ ID NO: 1248558 - protein, 9 aa, Homo Sapiens
SRDESADSG

SEQ ID NO: 1248559 - protein, 9 aa, Homo Sapiens
GGKPNNAHY

SEQ ID NO: 1248560 - protein, 9 aa, Homo Sapiens
RSLKTNILA

SEQ ID NO: 1248561 - protein, 9 aa, Homo Sapiens
DSYDQNTLI

SEQ ID NO: 1248562 - protein, 9 aa, Homo Sapiens
TVALLQENQ

SEQ ID NO: 1248563 - protein, 9 aa, Homo Sapiens
WGWNDINCL

SEQ ID NO: 1248564 - protein, 9 aa, Homo Sapiens
NTCSSGINW

SEQ ID NO: 1248565 - protein, 9 aa, Homo Sapiens
IQEFPGSPT

SEQ ID NO: 1248566 - protein, 9 aa, Homo Sapiens
FRDMSNLFY

SEQ ID NO: 1248567 - protein, 9 aa, Homo Sapiens
FIITFHITS

SEQ ID NO: 1248568 - protein, 9 aa, Homo Sapiens
NYLRVQIAR

SEQ ID NO: 1248569 - protein, 9 aa, Homo Sapiens
PPGGDLRHP

SEQ ID NO: 1248570 - protein, 9 aa, Homo Sapiens
NAEVKLHGF

SEQ ID NO: 1248571 - protein, 9 aa, Homo Sapiens
NYFGKHFMS

SEQ ID NO: 1248572 - protein, 9 aa, Homo Sapiens
KQRKAEVNE

SEQ ID NO: 1248573 - protein, 9 aa, Homo Sapiens
SWVICFTIS

SEQ ID NO: 1248574 - protein, 9 aa, Homo Sapiens
REPPGGDLR

SEQ ID NO: 1248575 - protein, 9 aa, Homo Sapiens
PLAVDMTAL

SEQ ID NO: 1248576 - protein, 9 aa, Homo Sapiens
IWRHLMRPL

SEQ ID NO: 1248577 - protein, 9 aa, Homo Sapiens
DDVKCLSEF

SEQ ID NO: 1248578 - protein, 9 aa, Homo Sapiens
TASRRVLVW

SEQ ID NO: 1248579 - protein, 9 aa, Homo Sapiens
ATAMKLLHV

SEQ ID NO: 1248580 - protein, 9 aa, Homo Sapiens
MPARAVSTT

SEQ ID NO: 1248581 - protein, 9 aa, Homo Sapiens
ANESFYTVF

SEQ ID NO: 1248582 - protein, 9 aa, Homo Sapiens
DLLHKNHYF

SEQ ID NO: 1248583 - protein, 9 aa, Homo Sapiens
LIAAVMNTW

SEQ ID NO: 1248584 - protein, 9 aa, Homo Sapiens
IVNAENQRR

SEQ ID NO: 1248585 - protein, 9 aa, Homo Sapiens
GPPGKRGHP

SEQ ID NO: 1248586 - protein, 9 aa, Homo Sapiens
TGPRGEPQD

SEQ ID NO: 1248587 - protein, 9 aa, Homo Sapiens
ILIFMTLKN

SEQ ID NO: 1248588 - protein, 9 aa, Homo Sapiens
NTGTVYRYT

SEQ ID NO: 1248589 - protein, 9 aa, Homo Sapiens
IQPKGKQKG

SEQ ID NO: 1248590 - protein, 9 aa, Homo Sapiens
RNLVALNAD

SEQ ID NO: 1248591 - protein, 9 aa, Homo Sapiens
SVRAAFVYA

SEQ ID NO: 1248592 - protein, 9 aa, Homo Sapiens
KFTGCGGRR

SEQ ID NO: 1248593 - protein, 9 aa, Homo Sapiens
KLHLVSRNI

SEQ ID NO: 1248594 - protein, 9 aa, Homo Sapiens
NPEVTFHSL

SEQ ID NO: 1248595 - protein, 9 aa, Homo Sapiens
RSSVRQLDL

SEQ ID NO: 1248596 - protein, 9 aa, Homo Sapiens
QNGQRNAMH

SEQ ID NO: 1248597 - protein, 9 aa, Homo Sapiens
NWTTPSPHP

SEQ ID NO: 1248598 - protein, 9 aa, Homo Sapiens
IGMLTETMA

SEQ ID NO: 1248599 - protein, 9 aa, Homo Sapiens
CFDVEVSVL

SEQ ID NO: 1248600 - protein, 9 aa, Homo Sapiens
SSHYWSKNW

SEQ ID NO: 1248601 - protein, 9 aa, Homo Sapiens
HTTVLRLIK

SEQ ID NO: 1248602 - protein, 9 aa, Homo Sapiens
LELIELFLS

SEQ ID NO: 1248603 - protein, 9 aa, Homo Sapiens
MRVLPGVDP

SEQ ID NO: 1248604 - protein, 9 aa, Homo Sapiens
VALEELIRE

SEQ ID NO: 1248605 - protein, 9 aa, Homo Sapiens
KTIITKSAH

SEQ ID NO: 1248606 - protein, 9 aa, Homo Sapiens
DVPDAISES

SEQ ID NO: 1248607 - protein, 9 aa, Homo Sapiens
FTTTHNYFG

SEQ ID NO: 1248608 - protein, 9 aa, Homo Sapiens
GLGECVTEV

SEQ ID NO: 1248609 - protein, 9 aa, Homo Sapiens
NEIRVVLCE

SEQ ID NO: 1248610 - protein, 9 aa, Homo Sapiens
TFALDNATK

SEQ ID NO: 1248611 - protein, 9 aa, Homo Sapiens
SLPNTIIHG

SEQ ID NO: 1248612 - protein, 9 aa, Homo Sapiens
LKVLKIHID

SEQ ID NO: 1248613 - protein, 9 aa, Homo Sapiens
GSPFARTSL

SEQ ID NO: 1248614 - protein, 9 aa, Homo Sapiens
DLNNELREV

SEQ ID NO: 1248615 - protein, 9 aa, Homo Sapiens
PYLDHLNLS

SEQ ID NO: 1248616 - protein, 9 aa, Homo Sapiens
KSLAQPPGP

SEQ ID NO: 1248617 - protein, 9 aa, Homo Sapiens
DQLKHKEFL

SEQ ID NO: 1248618 - protein, 9 aa, Homo Sapiens
EALPHTHES

SEQ ID NO: 1248619 - protein, 9 aa, Homo Sapiens
LSELKVTEV

SEQ ID NO: 1248620 - protein, 9 aa, Homo Sapiens
TLKEISHNP

SEQ ID NO: 1248621 - protein, 9 aa, Homo Sapiens
GCCGAIKER

SEQ ID NO: 1248622 - protein, 9 aa, Homo Sapiens
TMTRNKVAE

SEQ ID NO: 1248623 - protein, 9 aa, Homo Sapiens
VASMPSSSC

SEQ ID NO: 1248624 - protein, 9 aa, Homo Sapiens
LSNCLAQIC

SEQ ID NO: 1248625 - protein, 9 aa, Homo Sapiens
RTPEENTAA

SEQ ID NO: 1248626 - protein, 9 aa, Homo Sapiens
DVDEDPQAY

SEQ ID NO: 1248627 - protein, 9 aa, Homo Sapiens
PTAECLTVV

SEQ ID NO: 1248628 - protein, 9 aa, Homo Sapiens
TLIGRRVPT

SEQ ID NO: 1248629 - protein, 9 aa, Homo Sapiens
QAYTQTHIQ

SEQ ID NO: 1248630 - protein, 9 aa, Homo Sapiens
DIIDHIFAV

SEQ ID NO: 1248631 - protein, 9 aa, Homo Sapiens
ELRIIQLLC

SEQ ID NO: 1248632 - protein, 9 aa, Homo Sapiens
EDSISRTPH

SEQ ID NO: 1248633 - protein, 9 aa, Homo Sapiens
QEDGLGDAV

SEQ ID NO: 1248634 - protein, 9 aa, Homo Sapiens
SDTTIKLNA

SEQ ID NO: 1248635 - protein, 9 aa, Homo Sapiens
VVVSGNYLE

SEQ ID NO: 1248636 - protein, 9 aa, Homo Sapiens
YPWPLNHSL

SEQ ID NO: 1248637 - protein, 9 aa, Homo Sapiens
LKYVNMDAW

SEQ ID NO: 1248638 - protein, 9 aa, Homo Sapiens
CLKQSGHGK

SEQ ID NO: 1248639 - protein, 9 aa, Homo Sapiens
DWPCKYDWD

SEQ ID NO: 1248640 - protein, 9 aa, Homo Sapiens
QCYRQCGLH

SEQ ID NO: 1248641 - protein, 9 aa, Homo Sapiens
TALATKDGT

SEQ ID NO: 1248642 - protein, 9 aa, Homo Sapiens
LCYDQCISG

SEQ ID NO: 1248643 - protein, 9 aa, Homo Sapiens
ALANSMILF

SEQ ID NO: 1248644 - protein, 9 aa, Homo Sapiens
PGSFDVMSP

SEQ ID NO: 1248645 - protein, 9 aa, Homo Sapiens
TLMSPKHKY

SEQ ID NO: 1248646 - protein, 9 aa, Homo Sapiens
QLHGKKEVY

SEQ ID NO: 1248647 - protein, 9 aa, Homo Sapiens
MDLMCAQLQ

SEQ ID NO: 1248648 - protein, 9 aa, Homo Sapiens
ICMDGYSDI

SEQ ID NO: 1248649 - protein, 9 aa, Homo Sapiens
SHGGSWSRG

SEQ ID NO: 1248650 - protein, 9 aa, Homo Sapiens
PAAVVVVTE

SEQ ID NO: 1248651 - protein, 9 aa, Homo Sapiens
NGTAQSGVL

SEQ ID NO: 1248652 - protein, 9 aa, Homo Sapiens
YNMEADGIL

SEQ ID NO: 1248653 - protein, 9 aa, Homo Sapiens
QDYTASVDS

SEQ ID NO: 1248654 - protein, 9 aa, Homo Sapiens
THAYTRECL

SEQ ID NO: 1248655 - protein, 9 aa, Homo Sapiens
GEHTWSLTE

SEQ ID NO: 1248656 - protein, 9 aa, Homo Sapiens
YIPVVKSSM

SEQ ID NO: 1248657 - protein, 9 aa, Homo Sapiens
RDHRYSRDL

SEQ ID NO: 1248658 - protein, 9 aa, Homo Sapiens
LRAASGVPP

SEQ ID NO: 1248659 - protein, 9 aa, Homo Sapiens
LPACNGSEC

SEQ ID NO: 1248660 - protein, 9 aa, Homo Sapiens
LPPPGALMW

SEQ ID NO: 1248661 - protein, 9 aa, Homo Sapiens
GVSLTSFLF

SEQ ID NO: 1248662 - protein, 9 aa, Homo Sapiens
SAALGATGI

SEQ ID NO: 1248663 - protein, 9 aa, Homo Sapiens
VVLSSRTPV

SEQ ID NO: 1248664 - protein, 9 aa, Homo Sapiens
EETCINICR

SEQ ID NO: 1248665 - protein, 9 aa, Homo Sapiens
ESGSNFTPL

SEQ ID NO: 1248666 - protein, 9 aa, Homo Sapiens
LTILLVALW

SEQ ID NO: 1248667 - protein, 9 aa, Homo Sapiens
MPSSSCVST

SEQ ID NO: 1248668 - protein, 9 aa, Homo Sapiens
YKGFVPGMF

SEQ ID NO: 1248669 - protein, 9 aa, Homo Sapiens
FNWGVCRRS

SEQ ID NO: 1248670 - protein, 9 aa, Homo Sapiens
GKTFSMSST

SEQ ID NO: 1248671 - protein, 9 aa, Homo Sapiens
TLVAVLECD

SEQ ID NO: 1248672 - protein, 9 aa, Homo Sapiens
TKHLSIGKD

SEQ ID NO: 1248673 - protein, 9 aa, Homo Sapiens
EILERSRDV

SEQ ID NO: 1248674 - protein, 9 aa, Homo Sapiens
NLYQVFVGF

SEQ ID NO: 1248675 - protein, 9 aa, Homo Sapiens
MASVKWHQR

SEQ ID NO: 1248676 - protein, 9 aa, Homo Sapiens
YFCITLGYT

SEQ ID NO: 1248677 - protein, 9 aa, Homo Sapiens
RQPSTPETA

SEQ ID NO: 1248678 - protein, 9 aa, Homo Sapiens
FGDMYTPPD

SEQ ID NO: 1248679 - protein, 9 aa, Homo Sapiens
AAGTATSQG

SEQ ID NO: 1248680 - protein, 9 aa, Homo Sapiens
LFGCMRPVW

SEQ ID NO: 1248681 - protein, 9 aa, Homo Sapiens
WKMKAEVTG

SEQ ID NO: 1248682 - protein, 9 aa, Homo Sapiens
RCGTVRRPD

SEQ ID NO: 1248683 - protein, 9 aa, Homo Sapiens
LLYKAEGVN

SEQ ID NO: 1248684 - protein, 9 aa, Homo Sapiens
QGDVEAVYP

SEQ ID NO: 1248685 - protein, 9 aa, Homo Sapiens
KLKRAAGVR

SEQ ID NO: 1248686 - protein, 9 aa, Homo Sapiens
NYDRSMLRG

SEQ ID NO: 1248687 - protein, 9 aa, Homo Sapiens
LVELLQSIK

SEQ ID NO: 1248688 - protein, 9 aa, Homo Sapiens
AAASTTRVQ

SEQ ID NO: 1248689 - protein, 9 aa, Homo Sapiens
TEETFNAAV

SEQ ID NO: 1248690 - protein, 9 aa, Homo Sapiens
AYEQAEMML

SEQ ID NO: 1248691 - protein, 9 aa, Homo Sapiens
IRLHKWAQG

SEQ ID NO: 1248692 - protein, 9 aa, Homo Sapiens
KLTDFAMSH

SEQ ID NO: 1248693 - protein, 9 aa, Homo Sapiens
GTYTLTLWN

SEQ ID NO: 1248694 - protein, 9 aa, Homo Sapiens
VHSHKKKKT

SEQ ID NO: 1248695 - protein, 9 aa, Homo Sapiens
HYETSRKTS

SEQ ID NO: 1248696 - protein, 9 aa, Homo Sapiens
TRYVGSMVA

SEQ ID NO: 1248697 - protein, 9 aa, Homo Sapiens
ARRQEPAMR

SEQ ID NO: 1248698 - protein, 9 aa, Homo Sapiens
QNHHVLGHP

SEQ ID NO: 1248699 - protein, 9 aa, Homo Sapiens
SIYKLTGVV

SEQ ID NO: 1248700 - protein, 9 aa, Homo Sapiens
LMLPPWLLL

SEQ ID NO: 1248701 - protein, 9 aa, Homo Sapiens
PNLREMWLD

SEQ ID NO: 1248702 - protein, 9 aa, Homo Sapiens
AHLQIQSPA

SEQ ID NO: 1248703 - protein, 9 aa, Homo Sapiens
GLFEETALD

SEQ ID NO: 1248704 - protein, 9 aa, Homo Sapiens
TQRAGYKAA

SEQ ID NO: 1248705 - protein, 9 aa, Homo Sapiens
IPKCPPKCI

SEQ ID NO: 1248706 - protein, 9 aa, Homo Sapiens
FASENIGLN

SEQ ID NO: 1248707 - protein, 9 aa, Homo Sapiens
FITLVITEF

SEQ ID NO: 1248708 - protein, 9 aa, Homo Sapiens
DEEVQLHVT

SEQ ID NO: 1248709 - protein, 9 aa, Homo Sapiens
DSIRIIFSY

SEQ ID NO: 1248710 - protein, 9 aa, Homo Sapiens
MPGQASLVR

SEQ ID NO: 1248711 - protein, 9 aa, Homo Sapiens
NDMDKYSVS

SEQ ID NO: 1248712 - protein, 9 aa, Homo Sapiens
EGYETHWWD

SEQ ID NO: 1248713 - protein, 9 aa, Homo Sapiens
TPWDTLKYL

SEQ ID NO: 1248714 - protein, 9 aa, Homo Sapiens
TFLKVRLVC

SEQ ID NO: 1248715 - protein, 9 aa, Homo Sapiens
EQREVGKSE

SEQ ID NO: 1248716 - protein, 9 aa, Homo Sapiens
CKLFSMVSW

SEQ ID NO: 1248717 - protein, 9 aa, Homo Sapiens
RRLDGGRHC

SEQ ID NO: 1248718 - protein, 9 aa, Homo Sapiens
TAECCMCNL

SEQ ID NO: 1248719 - protein, 9 aa, Homo Sapiens
WSLGCAMYT

SEQ ID NO: 1248720 - protein, 9 aa, Homo Sapiens
GLNYSENTP

SEQ ID NO: 1248721 - protein, 9 aa, Homo Sapiens
SAFKKPIKF

SEQ ID NO: 1248722 - protein, 9 aa, Homo Sapiens
TICKEFSLP

SEQ ID NO: 1248723 - protein, 9 aa, Homo Sapiens
IKWHKWSVL

SEQ ID NO: 1248724 - protein, 9 aa, Homo Sapiens
DLGEDRTIC

SEQ ID NO: 1248725 - protein, 9 aa, Homo Sapiens
HHMFVRDEI

SEQ ID NO: 1248726 - protein, 9 aa, Homo Sapiens
LMAAMSFLT

SEQ ID NO: 1248727 - protein, 9 aa, Homo Sapiens
ASQSRPHRT

SEQ ID NO: 1248728 - protein, 9 aa, Homo Sapiens
IISVIQKFV

SEQ ID NO: 1248729 - protein, 9 aa, Homo Sapiens
LVPGSGKVE

SEQ ID NO: 1248730 - protein, 9 aa, Homo Sapiens
KKVQSAGQI

SEQ ID NO: 1248731 - protein, 9 aa, Homo Sapiens
LDPNGTLFR

SEQ ID NO: 1248732 - protein, 9 aa, Homo Sapiens
SEEPVTNSL

SEQ ID NO: 1248733 - protein, 9 aa, Homo Sapiens
MPFLQNLCS

SEQ ID NO: 1248734 - protein, 9 aa, Homo Sapiens
ICHSNMLCW

SEQ ID NO: 1248735 - protein, 9 aa, Homo Sapiens
MVVAKHPAL

SEQ ID NO: 1248736 - protein, 9 aa, Homo Sapiens
IIAVICLWN

SEQ ID NO: 1248737 - protein, 9 aa, Homo Sapiens
LCPPGWSGH

SEQ ID NO: 1248738 - protein, 9 aa, Homo Sapiens
QLREMENLC

SEQ ID NO: 1248739 - protein, 9 aa, Homo Sapiens
KAHLTRCLI

SEQ ID NO: 1248740 - protein, 9 aa, Homo Sapiens
WSPPGPAGS

SEQ ID NO: 1248741 - protein, 9 aa, Homo Sapiens
RGYIIRRGL

SEQ ID NO: 1248742 - protein, 9 aa, Homo Sapiens
KPTDSALMP

SEQ ID NO: 1248743 - protein, 9 aa, Homo Sapiens
EPQEEATRL

SEQ ID NO: 1248744 - protein, 9 aa, Homo Sapiens
TIRIGAMAR

SEQ ID NO: 1248745 - protein, 9 aa, Homo Sapiens
FDGKHQHTN

SEQ ID NO: 1248746 - protein, 9 aa, Homo Sapiens
HGPLLTRMP

SEQ ID NO: 1248747 - protein, 9 aa, Homo Sapiens
IVLPHGQLV

SEQ ID NO: 1248748 - protein, 9 aa, Homo Sapiens
KYQEKQQKR

SEQ ID NO: 1248749 - protein, 9 aa, Homo Sapiens
DGFGLDILT

SEQ ID NO: 1248750 - protein, 9 aa, Homo Sapiens
HNGSSSGGG

SEQ ID NO: 1248751 - protein, 9 aa, Homo Sapiens
SPPQTPQHW

SEQ ID NO: 1248752 - protein, 9 aa, Homo Sapiens
DCDSEWKSS

SEQ ID NO: 1248753 - protein, 9 aa, Homo Sapiens
SPKGNRPTI

SEQ ID NO: 1248754 - protein, 9 aa, Homo Sapiens
LSTLTRKIL

SEQ ID NO: 1248755 - protein, 9 aa, Homo Sapiens
RILNNGLDM

SEQ ID NO: 1248756 - protein, 9 aa, Homo Sapiens
VWVLIHASL

SEQ ID NO: 1248757 - protein, 9 aa, Homo Sapiens
VIKVASLDC

SEQ ID NO: 1248758 - protein, 9 aa, Homo Sapiens
ETQGITSSD

SEQ ID NO: 1248759 - protein, 9 aa, Homo Sapiens
LIEHLMGGG

SEQ ID NO: 1248760 - protein, 9 aa, Homo Sapiens
WLLSWASAP

SEQ ID NO: 1248761 - protein, 9 aa, Homo Sapiens
CETLIYPNP

SEQ ID NO: 1248762 - protein, 9 aa, Homo Sapiens
GALERSEAL

SEQ ID NO: 1248763 - protein, 9 aa, Homo Sapiens
GPGPGPTTS

SEQ ID NO: 1248764 - protein, 9 aa, Homo Sapiens
CTWYLGLLQ

SEQ ID NO: 1248765 - protein, 9 aa, Homo Sapiens
RKVNSLTAQ

SEQ ID NO: 1248766 - protein, 9 aa, Homo Sapiens
IGAAFMAKV

SEQ ID NO: 1248767 - protein, 9 aa, Homo Sapiens
EDVVSDVRL

SEQ ID NO: 1248768 - protein, 9 aa, Homo Sapiens
FNLVPSQKS

SEQ ID NO: 1248769 - protein, 9 aa, Homo Sapiens
WPSTLYTTG

SEQ ID NO: 1248770 - protein, 9 aa, Homo Sapiens
TLCPPPSPS

SEQ ID NO: 1248771 - protein, 9 aa, Homo Sapiens
QGQRCNYAH

SEQ ID NO: 1248772 - protein, 9 aa, Homo Sapiens
ALAISAIAI

SEQ ID NO: 1248773 - protein, 9 aa, Homo Sapiens
QGYRFTADS

SEQ ID NO: 1248774 - protein, 9 aa, Homo Sapiens
LHFFREHAL

SEQ ID NO: 1248775 - protein, 9 aa, Homo Sapiens
LEAGVFVNV

SEQ ID NO: 1248776 - protein, 9 aa, Homo Sapiens
WRGPWMLVW

SEQ ID NO: 1248777 - protein, 9 aa, Homo Sapiens
LHGATELVA

SEQ ID NO: 1248778 - protein, 9 aa, Homo Sapiens
HVTKLIDLE

SEQ ID NO: 1248779 - protein, 9 aa, Homo Sapiens
PVSGDGAQG

SEQ ID NO: 1248780 - protein, 9 aa, Homo Sapiens
TPPSEEHVL

SEQ ID NO: 1248781 - protein, 9 aa, Homo Sapiens
VLNPRGVVH

SEQ ID NO: 1248782 - protein, 9 aa, Homo Sapiens
GEKPYKRNE

SEQ ID NO: 1248783 - protein, 9 aa, Homo Sapiens
LWITSALST

SEQ ID NO: 1248784 - protein, 9 aa, Homo Sapiens
STYSMMTRR

SEQ ID NO: 1248785 - protein, 9 aa, Homo Sapiens
LIVAVAPGA

SEQ ID NO: 1248786 - protein, 9 aa, Homo Sapiens
TQCRDMPGH

SEQ ID NO: 1248787 - protein, 9 aa, Homo Sapiens
RLWEQEGKM

SEQ ID NO: 1248788 - protein, 9 aa, Homo Sapiens
GSEEMDWLQ

SEQ ID NO: 1248789 - protein, 9 aa, Homo Sapiens
TSSPQVLNY

SEQ ID NO: 1248790 - protein, 9 aa, Homo Sapiens
KKGGKVMKI

SEQ ID NO: 1248791 - protein, 9 aa, Homo Sapiens
NQREFSMTD

SEQ ID NO: 1248792 - protein, 9 aa, Homo Sapiens
KMCIIAFVG

SEQ ID NO: 1248793 - protein, 9 aa, Homo Sapiens
TQGMNIQWM

SEQ ID NO: 1248794 - protein, 9 aa, Homo Sapiens
LICDQACRR

SEQ ID NO: 1248795 - protein, 9 aa, Homo Sapiens
DCSSDCAPG

SEQ ID NO: 1248796 - protein, 9 aa, Homo Sapiens
TTMLLHIKK

SEQ ID NO: 1248797 - protein, 9 aa, Homo Sapiens
SEDARARVG

SEQ ID NO: 1248798 - protein, 9 aa, Homo Sapiens
ELEGMGLSD

SEQ ID NO: 1248799 - protein, 9 aa, Homo Sapiens
PLHKRCQRR

SEQ ID NO: 1248800 - protein, 9 aa, Homo Sapiens
SIMTRGNVK

SEQ ID NO: 1248801 - protein, 9 aa, Homo Sapiens
YMCDVEDCE

SEQ ID NO: 1248802 - protein, 9 aa, Homo Sapiens
IESHFGYGV

SEQ ID NO: 1248803 - protein, 9 aa, Homo Sapiens
SLATKPLSW

SEQ ID NO: 1248804 - protein, 9 aa, Homo Sapiens
SMATTKAID

SEQ ID NO: 1248805 - protein, 9 aa, Homo Sapiens
VAIDIQSSL

SEQ ID NO: 1248806 - protein, 9 aa, Homo Sapiens
NCRCLRCFP

SEQ ID NO: 1248807 - protein, 9 aa, Homo Sapiens
KQEGHIWSS

SEQ ID NO: 1248808 - protein, 9 aa, Homo Sapiens
LYCDLPLGD

SEQ ID NO: 1248809 - protein, 9 aa, Homo Sapiens
IPVDSDVAV

SEQ ID NO: 1248810 - protein, 9 aa, Homo Sapiens
CVAHVFLAC

SEQ ID NO: 1248811 - protein, 9 aa, Homo Sapiens
YWISVCVFP

SEQ ID NO: 1248812 - protein, 9 aa, Homo Sapiens
TVGPSNELP

SEQ ID NO: 1248813 - protein, 9 aa, Homo Sapiens
YPVFLDKQM

SEQ ID NO: 1248814 - protein, 9 aa, Homo Sapiens
KENILLSAS

SEQ ID NO: 1248815 - protein, 9 aa, Homo Sapiens
KRRRSFSCS

SEQ ID NO: 1248816 - protein, 9 aa, Homo Sapiens
GNFPEQAHS

SEQ ID NO: 1248817 - protein, 9 aa, Homo Sapiens
CVAEGMWLP

SEQ ID NO: 1248818 - protein, 9 aa, Homo Sapiens
DISSRRNED

SEQ ID NO: 1248819 - protein, 9 aa, Homo Sapiens
KFCKLNFNG

SEQ ID NO: 1248820 - protein, 9 aa, Homo Sapiens
YPNVGLTMN

SEQ ID NO: 1248821 - protein, 9 aa, Homo Sapiens
ALPVEELCV

SEQ ID NO: 1248822 - protein, 9 aa, Homo Sapiens
ATPHFICIQ

SEQ ID NO: 1248823 - protein, 9 aa, Homo Sapiens
ALVNRMIVS

SEQ ID NO: 1248824 - protein, 9 aa, Homo Sapiens
CMQYSCSLP

SEQ ID NO: 1248825 - protein, 9 aa, Homo Sapiens
AQLKHDGKS

SEQ ID NO: 1248826 - protein, 9 aa, Homo Sapiens
EAHCDFVHH

SEQ ID NO: 1248827 - protein, 9 aa, Homo Sapiens
FQPVANAAG

SEQ ID NO: 1248828 - protein, 9 aa, Homo Sapiens
SITEMEISV

SEQ ID NO: 1248829 - protein, 9 aa, Homo Sapiens
AGYLIRNSE

SEQ ID NO: 1248830 - protein, 9 aa, Homo Sapiens
LPERNCTLP

SEQ ID NO: 1248831 - protein, 9 aa, Homo Sapiens
KKEKASMLC

SEQ ID NO: 1248832 - protein, 9 aa, Homo Sapiens
LEGADAETS

SEQ ID NO: 1248833 - protein, 9 aa, Homo Sapiens
FIQYNMEAD

SEQ ID NO: 1248834 - protein, 9 aa, Homo Sapiens
TKKQCQTLR

SEQ ID NO: 1248835 - protein, 9 aa, Homo Sapiens
VWLLAGWRG

SEQ ID NO: 1248836 - protein, 9 aa, Homo Sapiens
LPHLYMYLQ

SEQ ID NO: 1248837 - protein, 9 aa, Homo Sapiens
STEGKRCPA

SEQ ID NO: 1248838 - protein, 9 aa, Homo Sapiens
LNYSASYSE

SEQ ID NO: 1248839 - protein, 9 aa, Homo Sapiens
LKLMPIKQN

SEQ ID NO: 1248840 - protein, 9 aa, Homo Sapiens
AHKVNSLLY

SEQ ID NO: 1248841 - protein, 9 aa, Homo Sapiens
GGNLVVSNP

SEQ ID NO: 1248842 - protein, 9 aa, Homo Sapiens
GQRRMRITV

SEQ ID NO: 1248843 - protein, 9 aa, Homo Sapiens
FSMVNVDCM

SEQ ID NO: 1248844 - protein, 9 aa, Homo Sapiens
FWSRFRKLN

SEQ ID NO: 1248845 - protein, 9 aa, Homo Sapiens
RMSLGEQDQ

SEQ ID NO: 1248846 - protein, 9 aa, Homo Sapiens
STTPGHQIT

SEQ ID NO: 1248847 - protein, 9 aa, Homo Sapiens
YGPLGGPAP

SEQ ID NO: 1248848 - protein, 9 aa, Homo Sapiens
FGSHQCSGI

SEQ ID NO: 1248849 - protein, 9 aa, Homo Sapiens
LGAINNTLS

SEQ ID NO: 1248850 - protein, 9 aa, Homo Sapiens
LRHCLSLVI

SEQ ID NO: 1248851 - protein, 9 aa, Homo Sapiens
LVTQTDSCS

SEQ ID NO: 1248852 - protein, 9 aa, Homo Sapiens
ENASGKLIA

SEQ ID NO: 1248853 - protein, 9 aa, Homo Sapiens
CNIYRNIIG

SEQ ID NO: 1248854 - protein, 9 aa, Homo Sapiens
IGGVSLTSF

SEQ ID NO: 1248855 - protein, 9 aa, Homo Sapiens
HMTSISDLE

SEQ ID NO: 1248856 - protein, 9 aa, Homo Sapiens
KYEELASAI

SEQ ID NO: 1248857 - protein, 9 aa, Homo Sapiens
LYRHRLSEL

SEQ ID NO: 1248858 - protein, 9 aa, Homo Sapiens
CALGRWGYG

SEQ ID NO: 1248859 - protein, 9 aa, Homo Sapiens
YTAAVSYRL

SEQ ID NO: 1248860 - protein, 9 aa, Homo Sapiens
AIINLGVTL

SEQ ID NO: 1248861 - protein, 9 aa, Homo Sapiens
VDEDPQAYT

SEQ ID NO: 1248862 - protein, 9 aa, Homo Sapiens
FDGPKLAPW

SEQ ID NO: 1248863 - protein, 9 aa, Homo Sapiens
ANWDETLLD

SEQ ID NO: 1248864 - protein, 9 aa, Homo Sapiens
RHREYNSKY

SEQ ID NO: 1248865 - protein, 9 aa, Homo Sapiens
HNDIIFTID

SEQ ID NO: 1248866 - protein, 9 aa, Homo Sapiens
HHHHRRPQP

SEQ ID NO: 1248867 - protein, 9 aa, Homo Sapiens
ELKVLCIDQ

SEQ ID NO: 1248868 - protein, 9 aa, Homo Sapiens
TLGSSKEMM

SEQ ID NO: 1248869 - protein, 9 aa, Homo Sapiens
KVLNTQRAG

SEQ ID NO: 1248870 - protein, 9 aa, Homo Sapiens
RHIVKVDLK

SEQ ID NO: 1248871 - protein, 9 aa, Homo Sapiens
SGSITAITV

SEQ ID NO: 1248872 - protein, 9 aa, Homo Sapiens
TMSNSMINT

SEQ ID NO: 1248873 - protein, 9 aa, Homo Sapiens
NTLYRLCPH

SEQ ID NO: 1248874 - protein, 9 aa, Homo Sapiens
APWEFRPRV

SEQ ID NO: 1248875 - protein, 9 aa, Homo Sapiens
SFSENHALR

SEQ ID NO: 1248876 - protein, 9 aa, Homo Sapiens
SLHATFSII

SEQ ID NO: 1248877 - protein, 9 aa, Homo Sapiens
HPWLFTHSP

SEQ ID NO: 1248878 - protein, 9 aa, Homo Sapiens
RWKQRGRPG

SEQ ID NO: 1248879 - protein, 9 aa, Homo Sapiens
NGSHMTVRQ

SEQ ID NO: 1248880 - protein, 9 aa, Homo Sapiens
YWLIPSTIG

SEQ ID NO: 1248881 - protein, 9 aa, Homo Sapiens
RHAIDGTFV

SEQ ID NO: 1248882 - protein, 9 aa, Homo Sapiens
PANQPRTES

SEQ ID NO: 1248883 - protein, 9 aa, Homo Sapiens
QGAVWTNER

SEQ ID NO: 1248884 - protein, 9 aa, Homo Sapiens
LSVCMRHDK

SEQ ID NO: 1248885 - protein, 9 aa, Homo Sapiens
AEQRILLTG

SEQ ID NO: 1248886 - protein, 9 aa, Homo Sapiens
KEKLHCLCM

SEQ ID NO: 1248887 - protein, 9 aa, Homo Sapiens
FPPTYRYEW

SEQ ID NO: 1248888 - protein, 9 aa, Homo Sapiens
DAGDDEAMF

SEQ ID NO: 1248889 - protein, 9 aa, Homo Sapiens
EYDLKVPRG

SEQ ID NO: 1248890 - protein, 9 aa, Homo Sapiens
TAEDLSGSD

SEQ ID NO: 1248891 - protein, 9 aa, Homo Sapiens
LVFAEWLSE

SEQ ID NO: 1248892 - protein, 9 aa, Homo Sapiens
HEPTSSTFQ

SEQ ID NO: 1248893 - protein, 9 aa, Homo Sapiens
AKKNLRTME

SEQ ID NO: 1248894 - protein, 9 aa, Homo Sapiens
KTDMYLKSL

SEQ ID NO: 1248895 - protein, 9 aa, Homo Sapiens
HSDTLACLK

SEQ ID NO: 1248896 - protein, 9 aa, Homo Sapiens
FRPRVSCER

SEQ ID NO: 1248897 - protein, 9 aa, Homo Sapiens
PPPRLPLRP

SEQ ID NO: 1248898 - protein, 9 aa, Homo Sapiens
MLSLKVTEE

SEQ ID NO: 1248899 - protein, 9 aa, Homo Sapiens
MLMKTVEEK

SEQ ID NO: 1248900 - protein, 9 aa, Homo Sapiens
LRKKSITKN

SEQ ID NO: 1248901 - protein, 9 aa, Homo Sapiens
IHSVLNRSP

SEQ ID NO: 1248902 - protein, 9 aa, Homo Sapiens
CLLWTVLIL

SEQ ID NO: 1248903 - protein, 9 aa, Homo Sapiens
RERSMAPDL

SEQ ID NO: 1248904 - protein, 9 aa, Homo Sapiens
HFTVEGEVT

SEQ ID NO: 1248905 - protein, 9 aa, Homo Sapiens
HTRNDKYSS

SEQ ID NO: 1248906 - protein, 9 aa, Homo Sapiens
RRFYWTGRG

SEQ ID NO: 1248907 - protein, 9 aa, Homo Sapiens
MGIKNRNET

SEQ ID NO: 1248908 - protein, 9 aa, Homo Sapiens
ARRAGDPEG

SEQ ID NO: 1248909 - protein, 9 aa, Homo Sapiens
TTRPQRSFL

SEQ ID NO: 1248910 - protein, 9 aa, Homo Sapiens
TVHFIQQLL

SEQ ID NO: 1248911 - protein, 9 aa, Homo Sapiens
LACGSVREV

SEQ ID NO: 1248912 - protein, 9 aa, Homo Sapiens
IYATNSAEI

SEQ ID NO: 1248913 - protein, 9 aa, Homo Sapiens
STKYIVSVG

SEQ ID NO: 1248914 - protein, 9 aa, Homo Sapiens
RPFHCTQCG

SEQ ID NO: 1248915 - protein, 9 aa, Homo Sapiens
CKTHAILFK

SEQ ID NO: 1248916 - protein, 9 aa, Homo Sapiens
QHTCPEWVR

SEQ ID NO: 1248917 - protein, 9 aa, Homo Sapiens
MLYVVHCNS

SEQ ID NO: 1248918 - protein, 9 aa, Homo Sapiens
TLIWQDISL

SEQ ID NO: 1248919 - protein, 9 aa, Homo Sapiens
ISARKFLDT

SEQ ID NO: 1248920 - protein, 9 aa, Homo Sapiens
QGHVSPCTR

SEQ ID NO: 1248921 - protein, 9 aa, Homo Sapiens
QRHRISGGD

SEQ ID NO: 1248922 - protein, 9 aa, Homo Sapiens
LKDKARTLY

SEQ ID NO: 1248923 - protein, 9 aa, Homo Sapiens
HLEGEVIPS

SEQ ID NO: 1248924 - protein, 9 aa, Homo Sapiens
SGVVNVNAS

SEQ ID NO: 1248925 - protein, 9 aa, Homo Sapiens
IINRKVEML

SEQ ID NO: 1248926 - protein, 9 aa, Homo Sapiens
DYPGFFLSQ

SEQ ID NO: 1248927 - protein, 9 aa, Homo Sapiens
HLITHTGEK

SEQ ID NO: 1248928 - protein, 9 aa, Homo Sapiens
NYVKILGKK

SEQ ID NO: 1248929 - protein, 9 aa, Homo Sapiens
SFTENTDTS

SEQ ID NO: 1248930 - protein, 9 aa, Homo Sapiens
SYTVSFLLQ

SEQ ID NO: 1248931 - protein, 9 aa, Homo Sapiens
HQNRLAPPV

SEQ ID NO: 1248932 - protein, 9 aa, Homo Sapiens
MEGKIIKDH

SEQ ID NO: 1248933 - protein, 9 aa, Homo Sapiens
HAENEEEDA

SEQ ID NO: 1248934 - protein, 9 aa, Homo Sapiens
IMLDQMDHE

SEQ ID NO: 1248935 - protein, 9 aa, Homo Sapiens
PGQHTLTMP

SEQ ID NO: 1248936 - protein, 9 aa, Homo Sapiens
TMIGVILFD

SEQ ID NO: 1248937 - protein, 9 aa, Homo Sapiens
VEVGAGSSS

SEQ ID NO: 1248938 - protein, 9 aa, Homo Sapiens
TIVVYMAVK

SEQ ID NO: 1248939 - protein, 9 aa, Homo Sapiens
RRSGAPASW

SEQ ID NO: 1248940 - protein, 9 aa, Homo Sapiens
KPGGSLFTS

SEQ ID NO: 1248941 - protein, 9 aa, Homo Sapiens
VLPSEANFL

SEQ ID NO: 1248942 - protein, 9 aa, Homo Sapiens
SKKVQSAGQ

SEQ ID NO: 1248943 - protein, 9 aa, Homo Sapiens
PPPPATLIM

SEQ ID NO: 1248944 - protein, 9 aa, Homo Sapiens
NQLCIRHWT

SEQ ID NO: 1248945 - protein, 9 aa, Homo Sapiens
KTMLHKPIT

SEQ ID NO: 1248946 - protein, 9 aa, Homo Sapiens
DEAGHGDPM

SEQ ID NO: 1248947 - protein, 9 aa, Homo Sapiens
KNCTSRLDV

SEQ ID NO: 1248948 - protein, 9 aa, Homo Sapiens
QAELGLGVH

SEQ ID NO: 1248949 - protein, 9 aa, Homo Sapiens
FHVGLHSAS

SEQ ID NO: 1248950 - protein, 9 aa, Homo Sapiens
PGQVHPAPT

SEQ ID NO: 1248951 - protein, 9 aa, Homo Sapiens
SASASGCHV

SEQ ID NO: 1248952 - protein, 9 aa, Homo Sapiens
TPSTRSPLL

SEQ ID NO: 1248953 - protein, 9 aa, Homo Sapiens
PFSDTTTMK

SEQ ID NO: 1248954 - protein, 9 aa, Homo Sapiens
LKEFQACYR

SEQ ID NO: 1248955 - protein, 9 aa, Homo Sapiens
TYSMMTRRR

SEQ ID NO: 1248956 - protein, 9 aa, Homo Sapiens
MGNHASESA

SEQ ID NO: 1248957 - protein, 9 aa, Homo Sapiens
GVAPRCPRS

SEQ ID NO: 1248958 - protein, 9 aa, Homo Sapiens
ELFQHHEHL

SEQ ID NO: 1248959 - protein, 9 aa, Homo Sapiens
IFLLEKEKK

SEQ ID NO: 1248960 - protein, 9 aa, Homo Sapiens
TVWSMEHIN

SEQ ID NO: 1248961 - protein, 9 aa, Homo Sapiens
FGVNAILGV

SEQ ID NO: 1248962 - protein, 9 aa, Homo Sapiens
SKKDSCSGQ

SEQ ID NO: 1248963 - protein, 9 aa, Homo Sapiens
TLVFEGIPI

SEQ ID NO: 1248964 - protein, 9 aa, Homo Sapiens
FSKSRHDMQ

SEQ ID NO: 1248965 - protein, 9 aa, Homo Sapiens
ATLYLPLVG

SEQ ID NO: 1248966 - protein, 9 aa, Homo Sapiens
VTSFYWCLR

SEQ ID NO: 1248967 - protein, 9 aa, Homo Sapiens
QQPRWVALP

SEQ ID NO: 1248968 - protein, 9 aa, Homo Sapiens
TAPPMWPPS

SEQ ID NO: 1248969 - protein, 9 aa, Homo Sapiens
KCQASSNGC

SEQ ID NO: 1248970 - protein, 9 aa, Homo Sapiens
QLQIQEEEK

SEQ ID NO: 1248971 - protein, 9 aa, Homo Sapiens
AKLDHCRHV

SEQ ID NO: 1248972 - protein, 9 aa, Homo Sapiens
EEHYSTLRK

SEQ ID NO: 1248973 - protein, 9 aa, Homo Sapiens
WSDESEEET

SEQ ID NO: 1248974 - protein, 9 aa, Homo Sapiens
ILSFLPIKS

SEQ ID NO: 1248975 - protein, 9 aa, Homo Sapiens
REEEEEKEH

SEQ ID NO: 1248976 - protein, 9 aa, Homo Sapiens
QTKAESKPE

SEQ ID NO: 1248977 - protein, 9 aa, Homo Sapiens
NAQYSSASN

SEQ ID NO: 1248978 - protein, 9 aa, Homo Sapiens
ILSHPISIC

SEQ ID NO: 1248979 - protein, 9 aa, Homo Sapiens
HRPSFSGKL

SEQ ID NO: 1248980 - protein, 9 aa, Homo Sapiens
LFTDRKTHL

SEQ ID NO: 1248981 - protein, 9 aa, Homo Sapiens
CCMCNLRGG

SEQ ID NO: 1248982 - protein, 9 aa, Homo Sapiens
TEAATHLSA

SEQ ID NO: 1248983 - protein, 9 aa, Homo Sapiens
GEHMTPCRR

SEQ ID NO: 1248984 - protein, 9 aa, Homo Sapiens
RERLKEMLK

SEQ ID NO: 1248985 - protein, 9 aa, Homo Sapiens
EPCRELLTQ

SEQ ID NO: 1248986 - protein, 9 aa, Homo Sapiens
EDRYNVYQS

SEQ ID NO: 1248987 - protein, 9 aa, Homo Sapiens
KPMEQFILP

SEQ ID NO: 1248988 - protein, 9 aa, Homo Sapiens
TMFQNPQHG

SEQ ID NO: 1248989 - protein, 9 aa, Homo Sapiens
IIQLRAQKG

SEQ ID NO: 1248990 - protein, 9 aa, Homo Sapiens
SAISQKIFL

SEQ ID NO: 1248991 - protein, 9 aa, Homo Sapiens
MQAHLDELT

SEQ ID NO: 1248992 - protein, 9 aa, Homo Sapiens
RGEVRHFTL

SEQ ID NO: 1248993 - protein, 9 aa, Homo Sapiens
WRKGENEYA

SEQ ID NO: 1248994 - protein, 9 aa, Homo Sapiens
PWTQIPQGC

SEQ ID NO: 1248995 - protein, 9 aa, Homo Sapiens
TSFGVNVDS

SEQ ID NO: 1248996 - protein, 9 aa, Homo Sapiens
ECYDVYEIS

SEQ ID NO: 1248997 - protein, 9 aa, Homo Sapiens
TSDAPKVET

SEQ ID NO: 1248998 - protein, 9 aa, Homo Sapiens
SPEPPPALS

SEQ ID NO: 1248999 - protein, 9 aa, Homo Sapiens
SDGLSRRDT

SEQ ID NO: 1249000 - protein, 9 aa, Homo Sapiens
LHFLRTNTL

SEQ ID NO: 1249001 - protein, 9 aa, Homo Sapiens
TMKDICENF

SEQ ID NO: 1249002 - protein, 9 aa, Homo Sapiens
ITTIVQTGG

SEQ ID NO: 1249003 - protein, 9 aa, Homo Sapiens
TSTHGSGPC

SEQ ID NO: 1249004 - protein, 9 aa, Homo Sapiens
STCNPLIHV

SEQ ID NO: 1249005 - protein, 9 aa, Homo Sapiens
VWFQNRQTK

SEQ ID NO: 1249006 - protein, 9 aa, Homo Sapiens
ALGWVFIPV

SEQ ID NO: 1249007 - protein, 9 aa, Homo Sapiens
NKDYQQFWS

SEQ ID NO: 1249008 - protein, 9 aa, Homo Sapiens
TSEKLYKSE

SEQ ID NO: 1249009 - protein, 9 aa, Homo Sapiens
KNFSYDKPL

SEQ ID NO: 1249010 - protein, 9 aa, Homo Sapiens
QVPDAKKSC

SEQ ID NO: 1249011 - protein, 9 aa, Homo Sapiens
DRGEVRHFT

SEQ ID NO: 1249012 - protein, 9 aa, Homo Sapiens
KRWLTADMI

SEQ ID NO: 1249013 - protein, 9 aa, Homo Sapiens
RAEYNVIIT

SEQ ID NO: 1249014 - protein, 9 aa, Homo Sapiens
LGNGLTPDA

SEQ ID NO: 1249015 - protein, 9 aa, Homo Sapiens
CSLQYTLKQ

SEQ ID NO: 1249016 - protein, 9 aa, Homo Sapiens
RIQTRSFLK

SEQ ID NO: 1249017 - protein, 9 aa, Homo Sapiens
GYRTLQWNA

SEQ ID NO: 1249018 - protein, 9 aa, Homo Sapiens
VFSTSTLLS

SEQ ID NO: 1249019 - protein, 9 aa, Homo Sapiens
LTGHEDGTM

SEQ ID NO: 1249020 - protein, 9 aa, Homo Sapiens
LNHKSLTLW

SEQ ID NO: 1249021 - protein, 9 aa, Homo Sapiens
FFLVTTMLA

SEQ ID NO: 1249022 - protein, 9 aa, Homo Sapiens
GVHNLHSLP

SEQ ID NO: 1249023 - protein, 9 aa, Homo Sapiens
RPVSVTYQF

SEQ ID NO: 1249024 - protein, 9 aa, Homo Sapiens
TVRLLLAEA

SEQ ID NO: 1249025 - protein, 9 aa, Homo Sapiens
CSLISSDNL

SEQ ID NO: 1249026 - protein, 9 aa, Homo Sapiens
LDNSLWFPV

SEQ ID NO: 1249027 - protein, 9 aa, Homo Sapiens
GWNDINCLG

SEQ ID NO: 1249028 - protein, 9 aa, Homo Sapiens
VFLNGETQI

SEQ ID NO: 1249029 - protein, 9 aa, Homo Sapiens
PVSVVLCCL

SEQ ID NO: 1249030 - protein, 9 aa, Homo Sapiens
PGLAALAKV

SEQ ID NO: 1249031 - protein, 9 aa, Homo Sapiens
ILVSQLRAP

SEQ ID NO: 1249032 - protein, 9 aa, Homo Sapiens
HVRCSVMVE

SEQ ID NO: 1249033 - protein, 9 aa, Homo Sapiens
TPQSPSVPK

SEQ ID NO: 1249034 - protein, 9 aa, Homo Sapiens
FDSMNTFRS

SEQ ID NO: 1249035 - protein, 9 aa, Homo Sapiens
LGGVNDGCL

SEQ ID NO: 1249036 - protein, 9 aa, Homo Sapiens
NDTCLVYDS

SEQ ID NO: 1249037 - protein, 9 aa, Homo Sapiens
GPWRGPWML

SEQ ID NO: 1249038 - protein, 9 aa, Homo Sapiens
KCCECEAFM

SEQ ID NO: 1249039 - protein, 9 aa, Homo Sapiens
SPGAERKKE

SEQ ID NO: 1249040 - protein, 9 aa, Homo Sapiens
VRRFPLEAP

SEQ ID NO: 1249041 - protein, 9 aa, Homo Sapiens
NKPQKKEKL

SEQ ID NO: 1249042 - protein, 9 aa, Homo Sapiens
ERVATERRE

SEQ ID NO: 1249043 - protein, 9 aa, Homo Sapiens
ACNVGYPAL

SEQ ID NO: 1249044 - protein, 9 aa, Homo Sapiens
TREYIRSLN

SEQ ID NO: 1249045 - protein, 9 aa, Homo Sapiens
ISVAGMPAT

SEQ ID NO: 1249046 - protein, 9 aa, Homo Sapiens
GEALIHFVD

SEQ ID NO: 1249047 - protein, 9 aa, Homo Sapiens
QSIHIGEIP

SEQ ID NO: 1249048 - protein, 9 aa, Homo Sapiens
VAGIFYILV

SEQ ID NO: 1249049 - protein, 9 aa, Homo Sapiens
RQRAVLEWD

SEQ ID NO: 1249050 - protein, 9 aa, Homo Sapiens
GVCESSGRL

SEQ ID NO: 1249051 - protein, 9 aa, Homo Sapiens
IKQFHIQLN

SEQ ID NO: 1249052 - protein, 9 aa, Homo Sapiens
LVISIILVP

SEQ ID NO: 1249053 - protein, 9 aa, Homo Sapiens
PQPLPRSTC

SEQ ID NO: 1249054 - protein, 9 aa, Homo Sapiens
DTELDAYMA

SEQ ID NO: 1249055 - protein, 9 aa, Homo Sapiens
HLPWVKLPI

SEQ ID NO: 1249056 - protein, 9 aa, Homo Sapiens
MATYLAQAG

SEQ ID NO: 1249057 - protein, 9 aa, Homo Sapiens
ADSGILPEP

SEQ ID NO: 1249058 - protein, 9 aa, Homo Sapiens
LGFQTFLNL

SEQ ID NO: 1249059 - protein, 9 aa, Homo Sapiens
MFQPSVVVL

SEQ ID NO: 1249060 - protein, 9 aa, Homo Sapiens
GCVAHVFLA

SEQ ID NO: 1249061 - protein, 9 aa, Homo Sapiens
MNEIHIDPG

SEQ ID NO: 1249062 - protein, 9 aa, Homo Sapiens
TVHDSLVIF

SEQ ID NO: 1249063 - protein, 9 aa, Homo Sapiens
LKNSRKALK

SEQ ID NO: 1249064 - protein, 9 aa, Homo Sapiens
GSPGAERKK

SEQ ID NO: 1249065 - protein, 9 aa, Homo Sapiens
AMKCYLLYQ

SEQ ID NO: 1249066 - protein, 9 aa, Homo Sapiens
GEVTEMPVL

SEQ ID NO: 1249067 - protein, 9 aa, Homo Sapiens
MLQMNAKYK

SEQ ID NO: 1249068 - protein, 9 aa, Homo Sapiens
HAIDGTFVF

SEQ ID NO: 1249069 - protein, 9 aa, Homo Sapiens
KEDHPMSAM

SEQ ID NO: 1249070 - protein, 9 aa, Homo Sapiens
TIWHIIAFD

SEQ ID NO: 1249071 - protein, 9 aa, Homo Sapiens
PPKEEQKMQ

SEQ ID NO: 1249072 - protein, 9 aa, Homo Sapiens
LVDQVLVKP

SEQ ID NO: 1249073 - protein, 9 aa, Homo Sapiens
HLKATHAVK

SEQ ID NO: 1249074 - protein, 9 aa, Homo Sapiens
TNVRRHLKV

SEQ ID NO: 1249075 - protein, 9 aa, Homo Sapiens
PYNFPKEIP

SEQ ID NO: 1249076 - protein, 9 aa, Homo Sapiens
IRVRCNPQK

SEQ ID NO: 1249077 - protein, 9 aa, Homo Sapiens
VEGLENQES

SEQ ID NO: 1249078 - protein, 9 aa, Homo Sapiens
IKVFEGRTN

SEQ ID NO: 1249079 - protein, 9 aa, Homo Sapiens
DFDNDCNQG

SEQ ID NO: 1249080 - protein, 9 aa, Homo Sapiens
AHFNRTMRA

SEQ ID NO: 1249081 - protein, 9 aa, Homo Sapiens
VKHITLPKS

SEQ ID NO: 1249082 - protein, 9 aa, Homo Sapiens
ADEKISVCG

SEQ ID NO: 1249083 - protein, 9 aa, Homo Sapiens
GKKLVVAAS

SEQ ID NO: 1249084 - protein, 9 aa, Homo Sapiens
ENIMKLSGI

SEQ ID NO: 1249085 - protein, 9 aa, Homo Sapiens
IETKHPYTF

SEQ ID NO: 1249086 - protein, 9 aa, Homo Sapiens
NSRLKSFLL

SEQ ID NO: 1249087 - protein, 9 aa, Homo Sapiens
GEKLFICNE

SEQ ID NO: 1249088 - protein, 9 aa, Homo Sapiens
CMTEEVLQR

SEQ ID NO: 1249089 - protein, 9 aa, Homo Sapiens
SEATQVVAS

SEQ ID NO: 1249090 - protein, 9 aa, Homo Sapiens
TDIFLDSGF

SEQ ID NO: 1249091 - protein, 9 aa, Homo Sapiens
AGNMWDCGR

SEQ ID NO: 1249092 - protein, 9 aa, Homo Sapiens
PLMDVGEMA

SEQ ID NO: 1249093 - protein, 9 aa, Homo Sapiens
HLRDLRHTL

SEQ ID NO: 1249094 - protein, 9 aa, Homo Sapiens
YAETYHWSR

SEQ ID NO: 1249095 - protein, 9 aa, Homo Sapiens
TNDTIGDLK

SEQ ID NO: 1249096 - protein, 9 aa, Homo Sapiens
GKDLPEHAI

SEQ ID NO: 1249097 - protein, 9 aa, Homo Sapiens
IAQSLSEYN

SEQ ID NO: 1249098 - protein, 9 aa, Homo Sapiens
IECMGPLGL

SEQ ID NO: 1249099 - protein, 9 aa, Homo Sapiens
DCFPAGAQV

SEQ ID NO: 1249100 - protein, 9 aa, Homo Sapiens
IPLPDIDHV

SEQ ID NO: 1249101 - protein, 9 aa, Homo Sapiens
VVNPTTTKR

SEQ ID NO: 1249102 - protein, 9 aa, Homo Sapiens
RRNQDQRSA

SEQ ID NO: 1249103 - protein, 9 aa, Homo Sapiens
RDVRGHDTS

SEQ ID NO: 1249104 - protein, 9 aa, Homo Sapiens
AILVALVSS

SEQ ID NO: 1249105 - protein, 9 aa, Homo Sapiens
SSMACSPEI

SEQ ID NO: 1249106 - protein, 9 aa, Homo Sapiens
LSSANGNGD

SEQ ID NO: 1249107 - protein, 9 aa, Homo Sapiens
VLFLMLQTI

SEQ ID NO: 1249108 - protein, 9 aa, Homo Sapiens
PDVLPSHLH

SEQ ID NO: 1249109 - protein, 9 aa, Homo Sapiens
YPFRQGMQL

SEQ ID NO: 1249110 - protein, 9 aa, Homo Sapiens
KGEGHGRAT

SEQ ID NO: 1249111 - protein, 9 aa, Homo Sapiens
YGVATKLLE

SEQ ID NO: 1249112 - protein, 9 aa, Homo Sapiens
CLKKHTASF

SEQ ID NO: 1249113 - protein, 9 aa, Homo Sapiens
DQMKRMRAF

SEQ ID NO: 1249114 - protein, 9 aa, Homo Sapiens
NTILDVVEE

SEQ ID NO: 1249115 - protein, 9 aa, Homo Sapiens
GTVQLTSVD

SEQ ID NO: 1249116 - protein, 9 aa, Homo Sapiens
EHLITHTGE

SEQ ID NO: 1249117 - protein, 9 aa, Homo Sapiens
GYTPFANSP

SEQ ID NO: 1249118 - protein, 9 aa, Homo Sapiens
HMASLLKFA

SEQ ID NO: 1249119 - protein, 9 aa, Homo Sapiens
VVRAGAQAC

SEQ ID NO: 1249120 - protein, 9 aa, Homo Sapiens
RSRCGHSWS

SEQ ID NO: 1249121 - protein, 9 aa, Homo Sapiens
NLEDTETKD

SEQ ID NO: 1249122 - protein, 9 aa, Homo Sapiens
FLLLRRQLW

SEQ ID NO: 1249123 - protein, 9 aa, Homo Sapiens
GTMKDICEN

SEQ ID NO: 1249124 - protein, 9 aa, Homo Sapiens
WGSPFHREK

SEQ ID NO: 1249125 - protein, 9 aa, Homo Sapiens
AFQKPIPLE

SEQ ID NO: 1249126 - protein, 9 aa, Homo Sapiens
FQLFLRRYD

SEQ ID NO: 1249127 - protein, 9 aa, Homo Sapiens
RIALHIADG

SEQ ID NO: 1249128 - protein, 9 aa, Homo Sapiens
RCERFDQPI

SEQ ID NO: 1249129 - protein, 9 aa, Homo Sapiens
DLISLSINR

SEQ ID NO: 1249130 - protein, 9 aa, Homo Sapiens
FSGIVGYML

SEQ ID NO: 1249131 - protein, 9 aa, Homo Sapiens
TMKRLPRNP

SEQ ID NO: 1249132 - protein, 9 aa, Homo Sapiens
RPQPVHRFL

SEQ ID NO: 1249133 - protein, 9 aa, Homo Sapiens
DESVQHVVM

SEQ ID NO: 1249134 - protein, 9 aa, Homo Sapiens
DILRVVISL

SEQ ID NO: 1249135 - protein, 9 aa, Homo Sapiens
GTVLISCIF

SEQ ID NO: 1249136 - protein, 9 aa, Homo Sapiens
LGEVIVKRA

SEQ ID NO: 1249137 - protein, 9 aa, Homo Sapiens
NLEYSAMDC

SEQ ID NO: 1249138 - protein, 9 aa, Homo Sapiens
HDRVRLLLS

SEQ ID NO: 1249139 - protein, 9 aa, Homo Sapiens
YTVGTKPLL

SEQ ID NO: 1249140 - protein, 9 aa, Homo Sapiens
AACPFTITH

SEQ ID NO: 1249141 - protein, 9 aa, Homo Sapiens
AVSNTPLVP

SEQ ID NO: 1249142 - protein, 9 aa, Homo Sapiens
SRRLGPGGA

SEQ ID NO: 1249143 - protein, 9 aa, Homo Sapiens
YAEKYVSGK

SEQ ID NO: 1249144 - protein, 9 aa, Homo Sapiens
LALANSMIL

SEQ ID NO: 1249145 - protein, 9 aa, Homo Sapiens
PSEIFNFLY

SEQ ID NO: 1249146 - protein, 9 aa, Homo Sapiens
KHIDCHMTS

SEQ ID NO: 1249147 - protein, 9 aa, Homo Sapiens
HAERRKLWL

SEQ ID NO: 1249148 - protein, 9 aa, Homo Sapiens
VMIGPSPNP

SEQ ID NO: 1249149 - protein, 9 aa, Homo Sapiens
VFGRGEHQE

SEQ ID NO: 1249150 - protein, 9 aa, Homo Sapiens
EPDGRSHRG

SEQ ID NO: 1249151 - protein, 9 aa, Homo Sapiens
FNLMYDVTK

SEQ ID NO: 1249152 - protein, 9 aa, Homo Sapiens
DTSFFVRTK

SEQ ID NO: 1249153 - protein, 9 aa, Homo Sapiens
CIDHRCQHV

SEQ ID NO: 1249154 - protein, 9 aa, Homo Sapiens
TRNDKYSSY

SEQ ID NO: 1249155 - protein, 9 aa, Homo Sapiens
GTMADDQGC

SEQ ID NO: 1249156 - protein, 9 aa, Homo Sapiens
MSTDVSRYA

SEQ ID NO: 1249157 - protein, 9 aa, Homo Sapiens
KKERESRME

SEQ ID NO: 1249158 - protein, 9 aa, Homo Sapiens
GDTLSMFID

SEQ ID NO: 1249159 - protein, 9 aa, Homo Sapiens
GLIIQVMTT

SEQ ID NO: 1249160 - protein, 9 aa, Homo Sapiens
KPYQCGKCG

SEQ ID NO: 1249161 - protein, 9 aa, Homo Sapiens
DMNEFEMEG

SEQ ID NO: 1249162 - protein, 9 aa, Homo Sapiens
YTSPDKLKN

SEQ ID NO: 1249163 - protein, 9 aa, Homo Sapiens
WLDDFLMGM

SEQ ID NO: 1249164 - protein, 9 aa, Homo Sapiens
LGPGDRDVT

SEQ ID NO: 1249165 - protein, 9 aa, Homo Sapiens
LIMKTCFIP

SEQ ID NO: 1249166 - protein, 9 aa, Homo Sapiens
LGPMATGQR

SEQ ID NO: 1249167 - protein, 9 aa, Homo Sapiens
NANYKYHEN

SEQ ID NO: 1249168 - protein, 9 aa, Homo Sapiens
RIPCTQAEF

SEQ ID NO: 1249169 - protein, 9 aa, Homo Sapiens
LYKKKLSDS

SEQ ID NO: 1249170 - protein, 9 aa, Homo Sapiens
QTKSVVVYR

SEQ ID NO: 1249171 - protein, 9 aa, Homo Sapiens
QEHTKPIQD

SEQ ID NO: 1249172 - protein, 9 aa, Homo Sapiens
NQKKQPNAF

SEQ ID NO: 1249173 - protein, 9 aa, Homo Sapiens
QKIGECALQ

SEQ ID NO: 1249174 - protein, 9 aa, Homo Sapiens
RNQESPNTP

SEQ ID NO: 1249175 - protein, 9 aa, Homo Sapiens
TLIRFWLPF

SEQ ID NO: 1249176 - protein, 9 aa, Homo Sapiens
MGVAGSLTN

SEQ ID NO: 1249177 - protein, 9 aa, Homo Sapiens
PMSVAVLTE

SEQ ID NO: 1249178 - protein, 9 aa, Homo Sapiens
PPCRSSRTW

SEQ ID NO: 1249179 - protein, 9 aa, Homo Sapiens
QKLQEMSEK

SEQ ID NO: 1249180 - protein, 9 aa, Homo Sapiens
FESEDEGDE

SEQ ID NO: 1249181 - protein, 9 aa, Homo Sapiens
DIHKLGFTG

SEQ ID NO: 1249182 - protein, 9 aa, Homo Sapiens
RVRCNPQKT

SEQ ID NO: 1249183 - protein, 9 aa, Homo Sapiens
QHKMLPSQQ

SEQ ID NO: 1249184 - protein, 9 aa, Homo Sapiens
VRTGKAHSV

SEQ ID NO: 1249185 - protein, 9 aa, Homo Sapiens
ARSRDSDEY

SEQ ID NO: 1249186 - protein, 9 aa, Homo Sapiens
LTNHHIIHA

SEQ ID NO: 1249187 - protein, 9 aa, Homo Sapiens
QKIACILPV

SEQ ID NO: 1249188 - protein, 9 aa, Homo Sapiens
AWTPPVGMS

SEQ ID NO: 1249189 - protein, 9 aa, Homo Sapiens
VKTGVRDPT

SEQ ID NO: 1249190 - protein, 9 aa, Homo Sapiens
MRSLKELDE

SEQ ID NO: 1249191 - protein, 9 aa, Homo Sapiens
LDQLDESMR

SEQ ID NO: 1249192 - protein, 9 aa, Homo Sapiens
FLGIKYLVY

SEQ ID NO: 1249193 - protein, 9 aa, Homo Sapiens
TRKNPFECN

SEQ ID NO: 1249194 - protein, 9 aa, Homo Sapiens
LSLPTIGIK

SEQ ID NO: 1249195 - protein, 9 aa, Homo Sapiens
WTANMEWIM

SEQ ID NO: 1249196 - protein, 9 aa, Homo Sapiens
EYFNDNSIE

SEQ ID NO: 1249197 - protein, 9 aa, Homo Sapiens
ENPELSDLE

SEQ ID NO: 1249198 - protein, 9 aa, Homo Sapiens
SRHNIYVQV

SEQ ID NO: 1249199 - protein, 9 aa, Homo Sapiens
SDEEDEDFD

SEQ ID NO: 1249200 - protein, 9 aa, Homo Sapiens
QGKAGKGLG

SEQ ID NO: 1249201 - protein, 9 aa, Homo Sapiens
PGPAQASAA

SEQ ID NO: 1249202 - protein, 9 aa, Homo Sapiens
VHSPEYASL

SEQ ID NO: 1249203 - protein, 9 aa, Homo Sapiens
NHPTFPHAS

SEQ ID NO: 1249204 - protein, 9 aa, Homo Sapiens
AGRFKDMPN

SEQ ID NO: 1249205 - protein, 9 aa, Homo Sapiens
SRRRVITLP

SEQ ID NO: 1249206 - protein, 9 aa, Homo Sapiens
KPKDIATNS

SEQ ID NO: 1249207 - protein, 9 aa, Homo Sapiens
ERYTAAVSY

SEQ ID NO: 1249208 - protein, 9 aa, Homo Sapiens
YTVSLDKGE

SEQ ID NO: 1249209 - protein, 9 aa, Homo Sapiens
ALKPKKTKN

SEQ ID NO: 1249210 - protein, 9 aa, Homo Sapiens
SSYYFCITL

SEQ ID NO: 1249211 - protein, 9 aa, Homo Sapiens
VTSPFPTAI

SEQ ID NO: 1249212 - protein, 9 aa, Homo Sapiens
SYRLGIWVL

SEQ ID NO: 1249213 - protein, 9 aa, Homo Sapiens
DLETLMLFS

SEQ ID NO: 1249214 - protein, 9 aa, Homo Sapiens
ARRQWEEQQ

SEQ ID NO: 1249215 - protein, 9 aa, Homo Sapiens
AYKVDEGDG

SEQ ID NO: 1249216 - protein, 9 aa, Homo Sapiens
RTHQGHHVR

SEQ ID NO: 1249217 - protein, 9 aa, Homo Sapiens
HAISQDVNL

SEQ ID NO: 1249218 - protein, 9 aa, Homo Sapiens
ALSQSPAEV

SEQ ID NO: 1249219 - protein, 9 aa, Homo Sapiens
RRKESSRTT

SEQ ID NO: 1249220 - protein, 9 aa, Homo Sapiens
VSLPSEILG

SEQ ID NO: 1249221 - protein, 9 aa, Homo Sapiens
KNIIPMDPN

SEQ ID NO: 1249222 - protein, 9 aa, Homo Sapiens
IDSSTREII

SEQ ID NO: 1249223 - protein, 9 aa, Homo Sapiens
ELELNDFMN

SEQ ID NO: 1249224 - protein, 9 aa, Homo Sapiens
YCTNYPMSV

SEQ ID NO: 1249225 - protein, 9 aa, Homo Sapiens
DTLELFLID

SEQ ID NO: 1249226 - protein, 9 aa, Homo Sapiens
FLVLQVYIL

SEQ ID NO: 1249227 - protein, 9 aa, Homo Sapiens
TMFTNCHIY

SEQ ID NO: 1249228 - protein, 9 aa, Homo Sapiens
GLIQEAASI

SEQ ID NO: 1249229 - protein, 9 aa, Homo Sapiens
QALWVGGAE

SEQ ID NO: 1249230 - protein, 9 aa, Homo Sapiens
GDRDAILQR

SEQ ID NO: 1249231 - protein, 9 aa, Homo Sapiens
EMSKIEEKR

SEQ ID NO: 1249232 - protein, 9 aa, Homo Sapiens
LIKHQQVHT

SEQ ID NO: 1249233 - protein, 9 aa, Homo Sapiens
CSAAATTSP

SEQ ID NO: 1249234 - protein, 9 aa, Homo Sapiens
PYFELNAQF

SEQ ID NO: 1249235 - protein, 9 aa, Homo Sapiens
EAAEGEGDI

SEQ ID NO: 1249236 - protein, 9 aa, Homo Sapiens
TSVITSTSA

SEQ ID NO: 1249237 - protein, 9 aa, Homo Sapiens
SSDSERSES

SEQ ID NO: 1249238 - protein, 9 aa, Homo Sapiens
NLPVNVCWL

SEQ ID NO: 1249239 - protein, 9 aa, Homo Sapiens
YYQCVVTVE

SEQ ID NO: 1249240 - protein, 9 aa, Homo Sapiens
VSLCLVVAL

SEQ ID NO: 1249241 - protein, 9 aa, Homo Sapiens
DLYRNVMLE

SEQ ID NO: 1249242 - protein, 9 aa, Homo Sapiens
SNSTRDWRT

SEQ ID NO: 1249243 - protein, 9 aa, Homo Sapiens
KDQMKRMRA

SEQ ID NO: 1249244 - protein, 9 aa, Homo Sapiens
LQNGEKEDH

SEQ ID NO: 1249245 - protein, 9 aa, Homo Sapiens
VEVHLLESK

SEQ ID NO: 1249246 - protein, 9 aa, Homo Sapiens
VFLNVSSSI

SEQ ID NO: 1249247 - protein, 9 aa, Homo Sapiens
SWDRHRVDF

SEQ ID NO: 1249248 - protein, 9 aa, Homo Sapiens
HGHRFTMGE

SEQ ID NO: 1249249 - protein, 9 aa, Homo Sapiens
LVWSQMAVP

SEQ ID NO: 1249250 - protein, 9 aa, Homo Sapiens
EQELEGMLN

SEQ ID NO: 1249251 - protein, 9 aa, Homo Sapiens
SPSNCCCRS

SEQ ID NO: 1249252 - protein, 9 aa, Homo Sapiens
KSEKEVLLI

SEQ ID NO: 1249253 - protein, 9 aa, Homo Sapiens
QIDCHTDDL

SEQ ID NO: 1249254 - protein, 9 aa, Homo Sapiens
AKHYSWSTS

SEQ ID NO: 1249255 - protein, 9 aa, Homo Sapiens
MNLSYVFIH

SEQ ID NO: 1249256 - protein, 9 aa, Homo Sapiens
WRHRRSIVF

SEQ ID NO: 1249257 - protein, 9 aa, Homo Sapiens
GEKSYKCYQ

SEQ ID NO: 1249258 - protein, 9 aa, Homo Sapiens
ICMAAGSRC

SEQ ID NO: 1249259 - protein, 9 aa, Homo Sapiens
ENYVIFNNT

SEQ ID NO: 1249260 - protein, 9 aa, Homo Sapiens
SLSSPQVSG

SEQ ID NO: 1249261 - protein, 9 aa, Homo Sapiens
YQGHAQAVL

SEQ ID NO: 1249262 - protein, 9 aa, Homo Sapiens
YAYQGFPFL

SEQ ID NO: 1249263 - protein, 9 aa, Homo Sapiens
IITKSAHDC

SEQ ID NO: 1249264 - protein, 9 aa, Homo Sapiens
LKNIIYHFL

SEQ ID NO: 1249265 - protein, 9 aa, Homo Sapiens
RGTMRRHYE

SEQ ID NO: 1249266 - protein, 9 aa, Homo Sapiens
LSAQRESAS

SEQ ID NO: 1249267 - protein, 9 aa, Homo Sapiens
PTSASVAVT

SEQ ID NO: 1249268 - protein, 9 aa, Homo Sapiens
EPQNKCIMK

SEQ ID NO: 1249269 - protein, 9 aa, Homo Sapiens
QIHFVVDPH

SEQ ID NO: 1249270 - protein, 9 aa, Homo Sapiens
CPWQQATMA

SEQ ID NO: 1249271 - protein, 9 aa, Homo Sapiens
DWYNVSYQA

SEQ ID NO: 1249272 - protein, 9 aa, Homo Sapiens
RRVQLMWIR

SEQ ID NO: 1249273 - protein, 9 aa, Homo Sapiens
PAEGERQAA

SEQ ID NO: 1249274 - protein, 9 aa, Homo Sapiens
CYENVIGYM

SEQ ID NO: 1249275 - protein, 9 aa, Homo Sapiens
NATPSVTLF

SEQ ID NO: 1249276 - protein, 9 aa, Homo Sapiens
GPATWGSRT

SEQ ID NO: 1249277 - protein, 9 aa, Homo Sapiens
MGIRQPPGL

SEQ ID NO: 1249278 - protein, 9 aa, Homo Sapiens
IPLPLNSFP

SEQ ID NO: 1249279 - protein, 9 aa, Homo Sapiens
QKQHPVTME

SEQ ID NO: 1249280 - protein, 9 aa, Homo Sapiens
TFQLGCDAV

SEQ ID NO: 1249281 - protein, 9 aa, Homo Sapiens
HFKVTVSVA

SEQ ID NO: 1249282 - protein, 9 aa, Homo Sapiens
RDRQSEEQM

SEQ ID NO: 1249283 - protein, 9 aa, Homo Sapiens
PRRLHLQIT

SEQ ID NO: 1249284 - protein, 9 aa, Homo Sapiens
SEAGEEENT

SEQ ID NO: 1249285 - protein, 9 aa, Homo Sapiens
FLDLSVSVE

SEQ ID NO: 1249286 - protein, 9 aa, Homo Sapiens
YIRQQDLKG

SEQ ID NO: 1249287 - protein, 9 aa, Homo Sapiens
CCAFMYMCP

SEQ ID NO: 1249288 - protein, 9 aa, Homo Sapiens
KLQTISKGI

SEQ ID NO: 1249289 - protein, 9 aa, Homo Sapiens
NGLMATYLA

SEQ ID NO: 1249290 - protein, 9 aa, Homo Sapiens
ISNRRLQQT

SEQ ID NO: 1249291 - protein, 9 aa, Homo Sapiens
WTPPVGMSG

SEQ ID NO: 1249292 - protein, 9 aa, Homo Sapiens
CPRSSSTAP

SEQ ID NO: 1249293 - protein, 9 aa, Homo Sapiens
DAYTHVCIL

SEQ ID NO: 1249294 - protein, 9 aa, Homo Sapiens
KVEAGGGWE

SEQ ID NO: 1249295 - protein, 9 aa, Homo Sapiens
SDHTELGFT

SEQ ID NO: 1249296 - protein, 9 aa, Homo Sapiens
QPENTAESR

SEQ ID NO: 1249297 - protein, 9 aa, Homo Sapiens
GSHFILLEG

SEQ ID NO: 1249298 - protein, 9 aa, Homo Sapiens
NNSCSPAGQ

SEQ ID NO: 1249299 - protein, 9 aa, Homo Sapiens
ASLMATAPA

SEQ ID NO: 1249300 - protein, 9 aa, Homo Sapiens
FASKKVQSA

SEQ ID NO: 1249301 - protein, 9 aa, Homo Sapiens
SSFYSISGG

SEQ ID NO: 1249302 - protein, 9 aa, Homo Sapiens
MAHNRKDMN

SEQ ID NO: 1249303 - protein, 9 aa, Homo Sapiens
AMTEGNMGV

SEQ ID NO: 1249304 - protein, 9 aa, Homo Sapiens
TTRVMTNKK

SEQ ID NO: 1249305 - protein, 9 aa, Homo Sapiens
LVLPPNLNE

SEQ ID NO: 1249306 - protein, 9 aa, Homo Sapiens
ESQGEEEPQ

SEQ ID NO: 1249307 - protein, 9 aa, Homo Sapiens
YGSHLHGEK

SEQ ID NO: 1249308 - protein, 9 aa, Homo Sapiens
HVPLMLNML

SEQ ID NO: 1249309 - protein, 9 aa, Homo Sapiens
RGTRPPPPA

SEQ ID NO: 1249310 - protein, 9 aa, Homo Sapiens
EILQVITSN

SEQ ID NO: 1249311 - protein, 9 aa, Homo Sapiens
NLYVQLMGI

SEQ ID NO: 1249312 - protein, 9 aa, Homo Sapiens
TLESGPGGQ

SEQ ID NO: 1249313 - protein, 9 aa, Homo Sapiens
PQSPGANLT

SEQ ID NO: 1249314 - protein, 9 aa, Homo Sapiens
VRAELLVFL

SEQ ID NO: 1249315 - protein, 9 aa, Homo Sapiens
LTSIDNHPM

SEQ ID NO: 1249316 - protein, 9 aa, Homo Sapiens
RDHENIKEK

SEQ ID NO: 1249317 - protein, 9 aa, Homo Sapiens
RHATILIYH

SEQ ID NO: 1249318 - protein, 9 aa, Homo Sapiens
IFNLYHFLE

SEQ ID NO: 1249319 - protein, 9 aa, Homo Sapiens
DLNQWLTMT

SEQ ID NO: 1249320 - protein, 9 aa, Homo Sapiens
DDTCYRETC

SEQ ID NO: 1249321 - protein, 9 aa, Homo Sapiens
DANDARNDS

SEQ ID NO: 1249322 - protein, 9 aa, Homo Sapiens
EKNILTCCQ

SEQ ID NO: 1249323 - protein, 9 aa, Homo Sapiens
SPVRAELLV

SEQ ID NO: 1249324 - protein, 9 aa, Homo Sapiens
ENGVAEWQR

SEQ ID NO: 1249325 - protein, 9 aa, Homo Sapiens
KNIIYHFLT

SEQ ID NO: 1249326 - protein, 9 aa, Homo Sapiens
DSEWKSSQI

SEQ ID NO: 1249327 - protein, 9 aa, Homo Sapiens
TWNEDFLPG

SEQ ID NO: 1249328 - protein, 9 aa, Homo Sapiens
GVAAILGIT

SEQ ID NO: 1249329 - protein, 9 aa, Homo Sapiens
IQAVHKAAH

SEQ ID NO: 1249330 - protein, 9 aa, Homo Sapiens
PRCPRSAVD

SEQ ID NO: 1249331 - protein, 9 aa, Homo Sapiens
RIRVKLDDS

SEQ ID NO: 1249332 - protein, 9 aa, Homo Sapiens
HYENGAFQE

SEQ ID NO: 1249333 - protein, 9 aa, Homo Sapiens
TQADGGCFS

SEQ ID NO: 1249334 - protein, 9 aa, Homo Sapiens
THQSQIYGC

SEQ ID NO: 1249335 - protein, 9 aa, Homo Sapiens
FKDMFREVG

SEQ ID NO: 1249336 - protein, 9 aa, Homo Sapiens
KSLTCSYAK

SEQ ID NO: 1249337 - protein, 9 aa, Homo Sapiens
SRTHSPLQS

SEQ ID NO: 1249338 - protein, 9 aa, Homo Sapiens
SGRLSVMVC

SEQ ID NO: 1249339 - protein, 9 aa, Homo Sapiens
GSFLLRAAS

SEQ ID NO: 1249340 - protein, 9 aa, Homo Sapiens
PVYKPGWQD

SEQ ID NO: 1249341 - protein, 9 aa, Homo Sapiens
HSGVYPVHM

SEQ ID NO: 1249342 - protein, 9 aa, Homo Sapiens
AATFQCFGF

SEQ ID NO: 1249343 - protein, 9 aa, Homo Sapiens
RRLHLEPLV

SEQ ID NO: 1249344 - protein, 9 aa, Homo Sapiens
WFLQYNGMI

SEQ ID NO: 1249345 - protein, 9 aa, Homo Sapiens
CSFDHHCKW

SEQ ID NO: 1249346 - protein, 9 aa, Homo Sapiens
TTASGQFTV

SEQ ID NO: 1249347 - protein, 9 aa, Homo Sapiens
LWTPGPKLV

SEQ ID NO: 1249348 - protein, 9 aa, Homo Sapiens
RWCSYIAES

SEQ ID NO: 1249349 - protein, 9 aa, Homo Sapiens
PQSSGTGWW

SEQ ID NO: 1249350 - protein, 9 aa, Homo Sapiens
SPTTTMNNT

SEQ ID NO: 1249351 - protein, 9 aa, Homo Sapiens
IKLQPRQVL

SEQ ID NO: 1249352 - protein, 9 aa, Homo Sapiens
LATVFCIWK

SEQ ID NO: 1249353 - protein, 9 aa, Homo Sapiens
INKTDNNLL

SEQ ID NO: 1249354 - protein, 9 aa, Homo Sapiens
IQLHSCFQT

SEQ ID NO: 1249355 - protein, 9 aa, Homo Sapiens
GYESVSDIV

SEQ ID NO: 1249356 - protein, 9 aa, Homo Sapiens
TSEGQSKHC

SEQ ID NO: 1249357 - protein, 9 aa, Homo Sapiens
TNQGMTSSL

SEQ ID NO: 1249358 - protein, 9 aa, Homo Sapiens
PPRNLDSQT

SEQ ID NO: 1249359 - protein, 9 aa, Homo Sapiens
DKETTQAPR

SEQ ID NO: 1249360 - protein, 9 aa, Homo Sapiens
FNDSVFTML

SEQ ID NO: 1249361 - protein, 9 aa, Homo Sapiens
LQETIKFMY

SEQ ID NO: 1249362 - protein, 9 aa, Homo Sapiens
VVTADHCIS

SEQ ID NO: 1249363 - protein, 9 aa, Homo Sapiens
TRMLLANAR

SEQ ID NO: 1249364 - protein, 9 aa, Homo Sapiens
ACEVIEALL

SEQ ID NO: 1249365 - protein, 9 aa, Homo Sapiens
RLLELAGQI

SEQ ID NO: 1249366 - protein, 9 aa, Homo Sapiens
PCLPRRAPQ

SEQ ID NO: 1249367 - protein, 9 aa, Homo Sapiens
LHHAFFSPW

SEQ ID NO: 1249368 - protein, 9 aa, Homo Sapiens
AHGPREALT

SEQ ID NO: 1249369 - protein, 9 aa, Homo Sapiens
TEEGKHHPY

SEQ ID NO: 1249370 - protein, 9 aa, Homo Sapiens
PLKILAYLR

SEQ ID NO: 1249371 - protein, 9 aa, Homo Sapiens
PDFTQIDIE

SEQ ID NO: 1249372 - protein, 9 aa, Homo Sapiens
FVNKRKKCI

SEQ ID NO: 1249373 - protein, 9 aa, Homo Sapiens
IFGKQTAFL

SEQ ID NO: 1249374 - protein, 9 aa, Homo Sapiens
LVQVVDERV

SEQ ID NO: 1249375 - protein, 9 aa, Homo Sapiens
NTLIGRRVP

SEQ ID NO: 1249376 - protein, 9 aa, Homo Sapiens
SSVVLKAAA

SEQ ID NO: 1249377 - protein, 9 aa, Homo Sapiens
LLSRPDLLT

SEQ ID NO: 1249378 - protein, 9 aa, Homo Sapiens
FQCHGAADE

SEQ ID NO: 1249379 - protein, 9 aa, Homo Sapiens
HLYMYLQYP

SEQ ID NO: 1249380 - protein, 9 aa, Homo Sapiens
SRSGGVPGA

SEQ ID NO: 1249381 - protein, 9 aa, Homo Sapiens
SGAVSSAPG

SEQ ID NO: 1249382 - protein, 9 aa, Homo Sapiens
HASALCHSP

SEQ ID NO: 1249383 - protein, 9 aa, Homo Sapiens
ILASVSTPD

SEQ ID NO: 1249384 - protein, 9 aa, Homo Sapiens
ATNVRLHFL

SEQ ID NO: 1249385 - protein, 9 aa, Homo Sapiens
WWWGRKTHH

SEQ ID NO: 1249386 - protein, 9 aa, Homo Sapiens
KLWDINTHI

SEQ ID NO: 1249387 - protein, 9 aa, Homo Sapiens
IIFFTALMV

SEQ ID NO: 1249388 - protein, 9 aa, Homo Sapiens
YTVWQLTIQ

SEQ ID NO: 1249389 - protein, 9 aa, Homo Sapiens
SITSQPMGP

SEQ ID NO: 1249390 - protein, 9 aa, Homo Sapiens
KFYQLECLM

SEQ ID NO: 1249391 - protein, 9 aa, Homo Sapiens
DAPFCTRIN

SEQ ID NO: 1249392 - protein, 9 aa, Homo Sapiens
VVIRSPQPG

SEQ ID NO: 1249393 - protein, 9 aa, Homo Sapiens
EKHYECIKC

SEQ ID NO: 1249394 - protein, 9 aa, Homo Sapiens
AVQRIVRVP

SEQ ID NO: 1249395 - protein, 9 aa, Homo Sapiens
DTHGGEAFQ

SEQ ID NO: 1249396 - protein, 9 aa, Homo Sapiens
EIQHFFVTR

SEQ ID NO: 1249397 - protein, 9 aa, Homo Sapiens
QDLAKTMSK

SEQ ID NO: 1249398 - protein, 9 aa, Homo Sapiens
TMLPGQGAF

SEQ ID NO: 1249399 - protein, 9 aa, Homo Sapiens
CSITVNIAG

SEQ ID NO: 1249400 - protein, 9 aa, Homo Sapiens
QWLRVVTTK

SEQ ID NO: 1249401 - protein, 9 aa, Homo Sapiens
LEDQECHLL

SEQ ID NO: 1249402 - protein, 9 aa, Homo Sapiens
IHTGETVHV

SEQ ID NO: 1249403 - protein, 9 aa, Homo Sapiens
SLDRHMQLH

SEQ ID NO: 1249404 - protein, 9 aa, Homo Sapiens
QLKMLFLAV

SEQ ID NO: 1249405 - protein, 9 aa, Homo Sapiens
LILCTVETP

SEQ ID NO: 1249406 - protein, 9 aa, Homo Sapiens
LAQGQVLRV

SEQ ID NO: 1249407 - protein, 9 aa, Homo Sapiens
HFLKREAKL

SEQ ID NO: 1249408 - protein, 9 aa, Homo Sapiens
DILYTVAII

SEQ ID NO: 1249409 - protein, 9 aa, Homo Sapiens
LGKKKGRKT

SEQ ID NO: 1249410 - protein, 9 aa, Homo Sapiens
YQIFPPTTG

SEQ ID NO: 1249411 - protein, 9 aa, Homo Sapiens
IAAVFMSDT

SEQ ID NO: 1249412 - protein, 9 aa, Homo Sapiens
YVTIMDEND

SEQ ID NO: 1249413 - protein, 9 aa, Homo Sapiens
SFAFRLCSS

SEQ ID NO: 1249414 - protein, 9 aa, Homo Sapiens
YRHSPVFHV

SEQ ID NO: 1249415 - protein, 9 aa, Homo Sapiens
QDVQMFSEV

SEQ ID NO: 1249416 - protein, 9 aa, Homo Sapiens
QWKKVVTKW

SEQ ID NO: 1249417 - protein, 9 aa, Homo Sapiens
SELQDCEGL

SEQ ID NO: 1249418 - protein, 9 aa, Homo Sapiens
VKEVLQDLE

SEQ ID NO: 1249419 - protein, 9 aa, Homo Sapiens
RMIVSPDLP

SEQ ID NO: 1249420 - protein, 9 aa, Homo Sapiens
LNSRSTLVM

SEQ ID NO: 1249421 - protein, 9 aa, Homo Sapiens
KRSRKKRKK

SEQ ID NO: 1249422 - protein, 9 aa, Homo Sapiens
FAISAITVF

SEQ ID NO: 1249423 - protein, 9 aa, Homo Sapiens
YFAIKQEVI

SEQ ID NO: 1249424 - protein, 9 aa, Homo Sapiens
IGLIIQVMT

SEQ ID NO: 1249425 - protein, 9 aa, Homo Sapiens
YPLRPLQEG

SEQ ID NO: 1249426 - protein, 9 aa, Homo Sapiens
VLSGVRAIL

SEQ ID NO: 1249427 - protein, 9 aa, Homo Sapiens
QLADTLGYT

SEQ ID NO: 1249428 - protein, 9 aa, Homo Sapiens
AQGCVCKGV

SEQ ID NO: 1249429 - protein, 9 aa, Homo Sapiens
VQSAICLLA

SEQ ID NO: 1249430 - protein, 9 aa, Homo Sapiens
NIDSDKNVI

SEQ ID NO: 1249431 - protein, 9 aa, Homo Sapiens
RSLQHPNAL

SEQ ID NO: 1249432 - protein, 9 aa, Homo Sapiens
FSQIGPCKR

SEQ ID NO: 1249433 - protein, 9 aa, Homo Sapiens
MCGLPERNC

SEQ ID NO: 1249434 - protein, 9 aa, Homo Sapiens
PNATPSVTL

SEQ ID NO: 1249435 - protein, 9 aa, Homo Sapiens
SLPNPRHGK

SEQ ID NO: 1249436 - protein, 9 aa, Homo Sapiens
NEKEIVRLC

SEQ ID NO: 1249437 - protein, 9 aa, Homo Sapiens
NDNQWEVRI

SEQ ID NO: 1249438 - protein, 9 aa, Homo Sapiens
RRERETQSC

SEQ ID NO: 1249439 - protein, 9 aa, Homo Sapiens
RCFICRKKV

SEQ ID NO: 1249440 - protein, 9 aa, Homo Sapiens
DASVYQQAE

SEQ ID NO: 1249441 - protein, 9 aa, Homo Sapiens
ARSTGNTCS

SEQ ID NO: 1249442 - protein, 9 aa, Homo Sapiens
GELGDPRPR

SEQ ID NO: 1249443 - protein, 9 aa, Homo Sapiens
FTELNRDQV

SEQ ID NO: 1249444 - protein, 9 aa, Homo Sapiens
TETLGVSGT

SEQ ID NO: 1249445 - protein, 9 aa, Homo Sapiens
SKHGTYVMT

SEQ ID NO: 1249446 - protein, 9 aa, Homo Sapiens
DYNPIYDID

SEQ ID NO: 1249447 - protein, 9 aa, Homo Sapiens
AIPSSGMTW

SEQ ID NO: 1249448 - protein, 9 aa, Homo Sapiens
GKPDSILVP

SEQ ID NO: 1249449 - protein, 9 aa, Homo Sapiens
HEKNHTRKN

SEQ ID NO: 1249450 - protein, 9 aa, Homo Sapiens
TVKDRFQVF

SEQ ID NO: 1249451 - protein, 9 aa, Homo Sapiens
PILNFLWHG

SEQ ID NO: 1249452 - protein, 9 aa, Homo Sapiens
TEGVATALL

SEQ ID NO: 1249453 - protein, 9 aa, Homo Sapiens
VFVQIMRLI

SEQ ID NO: 1249454 - protein, 9 aa, Homo Sapiens
SNWLQSLPA

SEQ ID NO: 1249455 - protein, 9 aa, Homo Sapiens
AVCKKDKLH

SEQ ID NO: 1249456 - protein, 9 aa, Homo Sapiens
SQIEEEYAR

SEQ ID NO: 1249457 - protein, 9 aa, Homo Sapiens
TINSKMFEV

SEQ ID NO: 1249458 - protein, 9 aa, Homo Sapiens
FLLMINGQV

SEQ ID NO: 1249459 - protein, 9 aa, Homo Sapiens
LIMLRLFET

SEQ ID NO: 1249460 - protein, 9 aa, Homo Sapiens
AAGDVLNHS

SEQ ID NO: 1249461 - protein, 9 aa, Homo Sapiens
MKLELESKQ

SEQ ID NO: 1249462 - protein, 9 aa, Homo Sapiens
CMETTAQRV

SEQ ID NO: 1249463 - protein, 9 aa, Homo Sapiens
ATPGRPWPP

SEQ ID NO: 1249464 - protein, 9 aa, Homo Sapiens
TLTPASQPC

SEQ ID NO: 1249465 - protein, 9 aa, Homo Sapiens
WYVRRSSSP

SEQ ID NO: 1249466 - protein, 9 aa, Homo Sapiens
LDDDSPGDK

SEQ ID NO: 1249467 - protein, 9 aa, Homo Sapiens
NYEVQAEKN

SEQ ID NO: 1249468 - protein, 9 aa, Homo Sapiens
PTIVVARLP

SEQ ID NO: 1249469 - protein, 9 aa, Homo Sapiens
GLMVGAVST

SEQ ID NO: 1249470 - protein, 9 aa, Homo Sapiens
FTENTDTSR

SEQ ID NO: 1249471 - protein, 9 aa, Homo Sapiens
EIEAFSEPS

SEQ ID NO: 1249472 - protein, 9 aa, Homo Sapiens
SKSLPARQD

SEQ ID NO: 1249473 - protein, 9 aa, Homo Sapiens
NKVCRDQRC

SEQ ID NO: 1249474 - protein, 9 aa, Homo Sapiens
QLSLTQPQP

SEQ ID NO: 1249475 - protein, 9 aa, Homo Sapiens
RNGEALIHF

SEQ ID NO: 1249476 - protein, 9 aa, Homo Sapiens
PLPMFCAMP

SEQ ID NO: 1249477 - protein, 9 aa, Homo Sapiens
MHLRFSATY

SEQ ID NO: 1249478 - protein, 9 aa, Homo Sapiens
LMMMSLYNV

SEQ ID NO: 1249479 - protein, 9 aa, Homo Sapiens
LAAMAYDHF

SEQ ID NO: 1249480 - protein, 9 aa, Homo Sapiens
FHEVPLVQL

SEQ ID NO: 1249481 - protein, 9 aa, Homo Sapiens
GADAETSGQ

SEQ ID NO: 1249482 - protein, 9 aa, Homo Sapiens
LLEMYSKLK

SEQ ID NO: 1249483 - protein, 9 aa, Homo Sapiens
SGFGAATKV

SEQ ID NO: 1249484 - protein, 9 aa, Homo Sapiens
TPSSGAQTA

SEQ ID NO: 1249485 - protein, 9 aa, Homo Sapiens
ACYTADIRV

SEQ ID NO: 1249486 - protein, 9 aa, Homo Sapiens
PPPCGPDRC

SEQ ID NO: 1249487 - protein, 9 aa, Homo Sapiens
TKHLLGSSA

SEQ ID NO: 1249488 - protein, 9 aa, Homo Sapiens
AGDVLNHSD

SEQ ID NO: 1249489 - protein, 9 aa, Homo Sapiens
WVRMADNEV

SEQ ID NO: 1249490 - protein, 9 aa, Homo Sapiens
QSSSVLRSP

SEQ ID NO: 1249491 - protein, 9 aa, Homo Sapiens
FLARKVNSL

SEQ ID NO: 1249492 - protein, 9 aa, Homo Sapiens
SFENMANAD

SEQ ID NO: 1249493 - protein, 9 aa, Homo Sapiens
GLTHAIRLL

SEQ ID NO: 1249494 - protein, 9 aa, Homo Sapiens
HKKSYILLW

SEQ ID NO: 1249495 - protein, 9 aa, Homo Sapiens
MISVTQRGV

SEQ ID NO: 1249496 - protein, 9 aa, Homo Sapiens
TYQFGSVGQ

SEQ ID NO: 1249497 - protein, 9 aa, Homo Sapiens
QHPQQKAGL

SEQ ID NO: 1249498 - protein, 9 aa, Homo Sapiens
GVCPLGHVP

SEQ ID NO: 1249499 - protein, 9 aa, Homo Sapiens
VSAPWEFRP

SEQ ID NO: 1249500 - protein, 9 aa, Homo Sapiens
RCRISKYPT

SEQ ID NO: 1249501 - protein, 9 aa, Homo Sapiens
SDCAPGMWG

SEQ ID NO: 1249502 - protein, 9 aa, Homo Sapiens
DSMCPGYRG

SEQ ID NO: 1249503 - protein, 9 aa, Homo Sapiens
THDDCLQAV

SEQ ID NO: 1249504 - protein, 9 aa, Homo Sapiens
FFPVFVWTL

SEQ ID NO: 1249505 - protein, 9 aa, Homo Sapiens
PPLHYREPV

SEQ ID NO: 1249506 - protein, 9 aa, Homo Sapiens
RSTGWYPPT

SEQ ID NO: 1249507 - protein, 9 aa, Homo Sapiens
FLECGVQSF

SEQ ID NO: 1249508 - protein, 9 aa, Homo Sapiens
QWFCPKCVN

SEQ ID NO: 1249509 - protein, 9 aa, Homo Sapiens
ERIVSRDIT

SEQ ID NO: 1249510 - protein, 9 aa, Homo Sapiens
VISITSQPM

SEQ ID NO: 1249511 - protein, 9 aa, Homo Sapiens
HVWGADASS

SEQ ID NO: 1249512 - protein, 9 aa, Homo Sapiens
KVGTLGDRD

SEQ ID NO: 1249513 - protein, 9 aa, Homo Sapiens
LKSCGKHVE

SEQ ID NO: 1249514 - protein, 9 aa, Homo Sapiens
IYDRREYSH

SEQ ID NO: 1249515 - protein, 9 aa, Homo Sapiens
FVGDVKRCE

SEQ ID NO: 1249516 - protein, 9 aa, Homo Sapiens
LGFENVTQA

SEQ ID NO: 1249517 - protein, 9 aa, Homo Sapiens
LGDRVVITG

SEQ ID NO: 1249518 - protein, 9 aa, Homo Sapiens
EVQNFIKDK

SEQ ID NO: 1249519 - protein, 9 aa, Homo Sapiens
IIVLLLLAM

SEQ ID NO: 1249520 - protein, 9 aa, Homo Sapiens
GNKGEDQII

SEQ ID NO: 1249521 - protein, 9 aa, Homo Sapiens
KRRFATSAP

SEQ ID NO: 1249522 - protein, 9 aa, Homo Sapiens
TLCMGGCSG

SEQ ID NO: 1249523 - protein, 9 aa, Homo Sapiens
EDAPTEHVE

SEQ ID NO: 1249524 - protein, 9 aa, Homo Sapiens
DECRIIPEA

SEQ ID NO: 1249525 - protein, 9 aa, Homo Sapiens
AGPCLPRPV

SEQ ID NO: 1249526 - protein, 9 aa, Homo Sapiens
SALKNSRKA

SEQ ID NO: 1249527 - protein, 9 aa, Homo Sapiens
HLTEHLITH

SEQ ID NO: 1249528 - protein, 9 aa, Homo Sapiens
ASNPPPISK

SEQ ID NO: 1249529 - protein, 9 aa, Homo Sapiens
QAEQELDDL

SEQ ID NO: 1249530 - protein, 9 aa, Homo Sapiens
TSLYIHVDD

SEQ ID NO: 1249531 - protein, 9 aa, Homo Sapiens
EREQLKMLF

SEQ ID NO: 1249532 - protein, 9 aa, Homo Sapiens
KQADVVQVL

SEQ ID NO: 1249533 - protein, 9 aa, Homo Sapiens
DWYTMLYKP

SEQ ID NO: 1249534 - protein, 9 aa, Homo Sapiens
FAEWLSEGR

SEQ ID NO: 1249535 - protein, 9 aa, Homo Sapiens
KSERGCKKI

SEQ ID NO: 1249536 - protein, 9 aa, Homo Sapiens
EGSKHGTYV

SEQ ID NO: 1249537 - protein, 9 aa, Homo Sapiens
EKPVPRPGS

SEQ ID NO: 1249538 - protein, 9 aa, Homo Sapiens
ATDFDDKFD

SEQ ID NO: 1249539 - protein, 9 aa, Homo Sapiens
DGKDDTDGE

SEQ ID NO: 1249540 - protein, 9 aa, Homo Sapiens
SSLGEVIVK

SEQ ID NO: 1249541 - protein, 9 aa, Homo Sapiens
QEYCTWNPF

SEQ ID NO: 1249542 - protein, 9 aa, Homo Sapiens
LFREYQEEI

SEQ ID NO: 1249543 - protein, 9 aa, Homo Sapiens
PVGVREMKI

SEQ ID NO: 1249544 - protein, 9 aa, Homo Sapiens
WMGPIFPII

SEQ ID NO: 1249545 - protein, 9 aa, Homo Sapiens
GHLEHLCCD

SEQ ID NO: 1249546 - protein, 9 aa, Homo Sapiens
LLFLDTTGS

SEQ ID NO: 1249547 - protein, 9 aa, Homo Sapiens
SGLWNEDYN

SEQ ID NO: 1249548 - protein, 9 aa, Homo Sapiens
FEEAKTLSA

SEQ ID NO: 1249549 - protein, 9 aa, Homo Sapiens
PKRKLNSLM

SEQ ID NO: 1249550 - protein, 9 aa, Homo Sapiens
PALPAPGHF

SEQ ID NO: 1249551 - protein, 9 aa, Homo Sapiens
TITEGVATA

SEQ ID NO: 1249552 - protein, 9 aa, Homo Sapiens
CTSVSQHWA

SEQ ID NO: 1249553 - protein, 9 aa, Homo Sapiens
GIKHIDCHM

SEQ ID NO: 1249554 - protein, 9 aa, Homo Sapiens
KAIDAMLDL

SEQ ID NO: 1249555 - protein, 9 aa, Homo Sapiens
FDALLTYYI

SEQ ID NO: 1249556 - protein, 9 aa, Homo Sapiens
PKIHIHIDH

SEQ ID NO: 1249557 - protein, 9 aa, Homo Sapiens
ALAEHLARV

SEQ ID NO: 1249558 - protein, 9 aa, Homo Sapiens
QHGHSRRLH

SEQ ID NO: 1249559 - protein, 9 aa, Homo Sapiens
QCWVQGNAC

SEQ ID NO: 1249560 - protein, 9 aa, Homo Sapiens
NDLCYQNDD

SEQ ID NO: 1249561 - protein, 9 aa, Homo Sapiens
EIFPQCLSS

SEQ ID NO: 1249562 - protein, 9 aa, Homo Sapiens
VVDIVSWKR

SEQ ID NO: 1249563 - protein, 9 aa, Homo Sapiens
WRRCRETAV

SEQ ID NO: 1249564 - protein, 9 aa, Homo Sapiens
IKKKTKKIV

SEQ ID NO: 1249565 - protein, 9 aa, Homo Sapiens
FLLLSSVSA

SEQ ID NO: 1249566 - protein, 9 aa, Homo Sapiens
LGQSDGVIE

SEQ ID NO: 1249567 - protein, 9 aa, Homo Sapiens
LALIQVCMK

SEQ ID NO: 1249568 - protein, 9 aa, Homo Sapiens
LQQIKTAHT

SEQ ID NO: 1249569 - protein, 9 aa, Homo Sapiens
PTIYKHQKK

SEQ ID NO: 1249570 - protein, 9 aa, Homo Sapiens
DIYPYFGLF

SEQ ID NO: 1249571 - protein, 9 aa, Homo Sapiens
VLILVFGVH

SEQ ID NO: 1249572 - protein, 9 aa, Homo Sapiens
FYDTSASFS

SEQ ID NO: 1249573 - protein, 9 aa, Homo Sapiens
NEFPVIVHL

SEQ ID NO: 1249574 - protein, 9 aa, Homo Sapiens
EYASVQVPW

SEQ ID NO: 1249575 - protein, 9 aa, Homo Sapiens
SLHTQEYRA

SEQ ID NO: 1249576 - protein, 9 aa, Homo Sapiens
DEVWAIHRA

SEQ ID NO: 1249577 - protein, 9 aa, Homo Sapiens
DHMGVQQVM

SEQ ID NO: 1249578 - protein, 9 aa, Homo Sapiens
YPMSAAGRA

SEQ ID NO: 1249579 - protein, 9 aa, Homo Sapiens
ISNYQVEQS

SEQ ID NO: 1249580 - protein, 9 aa, Homo Sapiens
TKSGNVTWN

SEQ ID NO: 1249581 - protein, 9 aa, Homo Sapiens
NTVYIILRM

SEQ ID NO: 1249582 - protein, 9 aa, Homo Sapiens
RGRPGAGPE

SEQ ID NO: 1249583 - protein, 9 aa, Homo Sapiens
HRTMSLAKK

SEQ ID NO: 1249584 - protein, 9 aa, Homo Sapiens
MSKIEEKRH

SEQ ID NO: 1249585 - protein, 9 aa, Homo Sapiens
WDEPGSVIS

SEQ ID NO: 1249586 - protein, 9 aa, Homo Sapiens
NVYYGRKCI

SEQ ID NO: 1249587 - protein, 9 aa, Homo Sapiens
PQIGVINVT

SEQ ID NO: 1249588 - protein, 9 aa, Homo Sapiens
PHRLVGTTN

SEQ ID NO: 1249589 - protein, 9 aa, Homo Sapiens
QHATQKEVS

SEQ ID NO: 1249590 - protein, 9 aa, Homo Sapiens
TGISLHEKI

SEQ ID NO: 1249591 - protein, 9 aa, Homo Sapiens
TSVFEEDGC

SEQ ID NO: 1249592 - protein, 9 aa, Homo Sapiens
EKLRTARCR

SEQ ID NO: 1249593 - protein, 9 aa, Homo Sapiens
SDLIACTVT

SEQ ID NO: 1249594 - protein, 9 aa, Homo Sapiens
LNQYSAKHG

SEQ ID NO: 1249595 - protein, 9 aa, Homo Sapiens
CWSVPGSFA

SEQ ID NO: 1249596 - protein, 9 aa, Homo Sapiens
DDMALSGPV

SEQ ID NO: 1249597 - protein, 9 aa, Homo Sapiens
MFASVYIYR

SEQ ID NO: 1249598 - protein, 9 aa, Homo Sapiens
PVIKVESLP

SEQ ID NO: 1249599 - protein, 9 aa, Homo Sapiens
RVLLRFPQH

SEQ ID NO: 1249600 - protein, 9 aa, Homo Sapiens
MESFPSLAY

SEQ ID NO: 1249601 - protein, 9 aa, Homo Sapiens
EELPEQETF

SEQ ID NO: 1249602 - protein, 9 aa, Homo Sapiens
EAPEHDANS

SEQ ID NO: 1249603 - protein, 9 aa, Homo Sapiens
YSTGHLCEA

SEQ ID NO: 1249604 - protein, 9 aa, Homo Sapiens
EGDIFRSTR

SEQ ID NO: 1249605 - protein, 9 aa, Homo Sapiens
QHPVTMETT

SEQ ID NO: 1249606 - protein, 9 aa, Homo Sapiens
HVVGLVVGP

SEQ ID NO: 1249607 - protein, 9 aa, Homo Sapiens
DKIFDRIGK

SEQ ID NO: 1249608 - protein, 9 aa, Homo Sapiens
GRLSGSVRP

SEQ ID NO: 1249609 - protein, 9 aa, Homo Sapiens
ENVLMPNWL

SEQ ID NO: 1249610 - protein, 9 aa, Homo Sapiens
KSSVCIFKL

SEQ ID NO: 1249611 - protein, 9 aa, Homo Sapiens
VVSAAVKGL

SEQ ID NO: 1249612 - protein, 9 aa, Homo Sapiens
VISWGTLGL

SEQ ID NO: 1249613 - protein, 9 aa, Homo Sapiens
AKLKKVRSL

SEQ ID NO: 1249614 - protein, 9 aa, Homo Sapiens
GEWRRPPDD

SEQ ID NO: 1249615 - protein, 9 aa, Homo Sapiens
EEHVYIEMV

SEQ ID NO: 1249616 - protein, 9 aa, Homo Sapiens
NKGRIQRQL

SEQ ID NO: 1249617 - protein, 9 aa, Homo Sapiens
AGGKYDVAH

SEQ ID NO: 1249618 - protein, 9 aa, Homo Sapiens
QHIWTRFLT

SEQ ID NO: 1249619 - protein, 9 aa, Homo Sapiens
GDVETLSWI

SEQ ID NO: 1249620 - protein, 9 aa, Homo Sapiens
SVRPVSSAS

SEQ ID NO: 1249621 - protein, 9 aa, Homo Sapiens
LSVLVTPEL

SEQ ID NO: 1249622 - protein, 9 aa, Homo Sapiens
GCTWYLGLL

SEQ ID NO: 1249623 - protein, 9 aa, Homo Sapiens
DLWTVNGHP

SEQ ID NO: 1249624 - protein, 9 aa, Homo Sapiens
ESRMLKQAA

SEQ ID NO: 1249625 - protein, 9 aa, Homo Sapiens
SSWDSFLRI

SEQ ID NO: 1249626 - protein, 9 aa, Homo Sapiens
VNGVMIFLI

SEQ ID NO: 1249627 - protein, 9 aa, Homo Sapiens
VNGGKCFMV

SEQ ID NO: 1249628 - protein, 9 aa, Homo Sapiens
VASKYAIYA

SEQ ID NO: 1249629 - protein, 9 aa, Homo Sapiens
ANMIVSGSD

SEQ ID NO: 1249630 - protein, 9 aa, Homo Sapiens
GSVCYLLPD

SEQ ID NO: 1249631 - protein, 9 aa, Homo Sapiens
SIDSVIIGK

SEQ ID NO: 1249632 - protein, 9 aa, Homo Sapiens
LLGRQRQLL

SEQ ID NO: 1249633 - protein, 9 aa, Homo Sapiens
CSDAYHHLD

SEQ ID NO: 1249634 - protein, 9 aa, Homo Sapiens
YKVDEGDGD

SEQ ID NO: 1249635 - protein, 9 aa, Homo Sapiens
AVSLSRPAH

SEQ ID NO: 1249636 - protein, 9 aa, Homo Sapiens
PVKMAPNHG

SEQ ID NO: 1249637 - protein, 9 aa, Homo Sapiens
PYMTPERID

SEQ ID NO: 1249638 - protein, 9 aa, Homo Sapiens
FPLGNVQFL

SEQ ID NO: 1249639 - protein, 9 aa, Homo Sapiens
SSHLILLWL

SEQ ID NO: 1249640 - protein, 9 aa, Homo Sapiens
PSQHKMLPS

SEQ ID NO: 1249641 - protein, 9 aa, Homo Sapiens
RGLSHGGSW

SEQ ID NO: 1249642 - protein, 9 aa, Homo Sapiens
LLIMLFLLK

SEQ ID NO: 1249643 - protein, 9 aa, Homo Sapiens
ASLIGIAGS

SEQ ID NO: 1249644 - protein, 9 aa, Homo Sapiens
LGLYVYDDL

SEQ ID NO: 1249645 - protein, 9 aa, Homo Sapiens
ITEVLEQCY

SEQ ID NO: 1249646 - protein, 9 aa, Homo Sapiens
ALQKEDRPQ

SEQ ID NO: 1249647 - protein, 9 aa, Homo Sapiens
DKAPIQDIW

SEQ ID NO: 1249648 - protein, 9 aa, Homo Sapiens
LDFILMDTF

SEQ ID NO: 1249649 - protein, 9 aa, Homo Sapiens
TKSLDVLKI

SEQ ID NO: 1249650 - protein, 9 aa, Homo Sapiens
GSKATNGSA

SEQ ID NO: 1249651 - protein, 9 aa, Homo Sapiens
MSPYAYQGF

SEQ ID NO: 1249652 - protein, 9 aa, Homo Sapiens
IYSGGKKIP

SEQ ID NO: 1249653 - protein, 9 aa, Homo Sapiens
PDKKKPFVV

SEQ ID NO: 1249654 - protein, 9 aa, Homo Sapiens
EKKEGEKST

SEQ ID NO: 1249655 - protein, 9 aa, Homo Sapiens
LCSLYYTDT

SEQ ID NO: 1249656 - protein, 9 aa, Homo Sapiens
VASFGAISL

SEQ ID NO: 1249657 - protein, 9 aa, Homo Sapiens
GPELEEHYS

SEQ ID NO: 1249658 - protein, 9 aa, Homo Sapiens
SPGRKALLK

SEQ ID NO: 1249659 - protein, 9 aa, Homo Sapiens
ELTNAEKHV

SEQ ID NO: 1249660 - protein, 9 aa, Homo Sapiens
HMCLQDGGS

SEQ ID NO: 1249661 - protein, 9 aa, Homo Sapiens
IRKKPKEPR

SEQ ID NO: 1249662 - protein, 9 aa, Homo Sapiens
VLCFFKHDN

SEQ ID NO: 1249663 - protein, 9 aa, Homo Sapiens
SLDNREWEF

SEQ ID NO: 1249664 - protein, 9 aa, Homo Sapiens
NPSANYHTL

SEQ ID NO: 1249665 - protein, 9 aa, Homo Sapiens
YIQRHVNVS

SEQ ID NO: 1249666 - protein, 9 aa, Homo Sapiens
SHNPTLHHS

SEQ ID NO: 1249667 - protein, 9 aa, Homo Sapiens
ICKKDLIRR

SEQ ID NO: 1249668 - protein, 9 aa, Homo Sapiens
DATQLQCLL

SEQ ID NO: 1249669 - protein, 9 aa, Homo Sapiens
LRLKNLPSK

SEQ ID NO: 1249670 - protein, 9 aa, Homo Sapiens
TELFMFDFE

SEQ ID NO: 1249671 - protein, 9 aa, Homo Sapiens
ASFGIGPGR

SEQ ID NO: 1249672 - protein, 9 aa, Homo Sapiens
IKLWDINTH

SEQ ID NO: 1249673 - protein, 9 aa, Homo Sapiens
ATADEFIHQ

SEQ ID NO: 1249674 - protein, 9 aa, Homo Sapiens
CATLSKPKA

SEQ ID NO: 1249675 - protein, 9 aa, Homo Sapiens
FTLKATVIN

SEQ ID NO: 1249676 - protein, 9 aa, Homo Sapiens
VLDNLFEKN

SEQ ID NO: 1249677 - protein, 9 aa, Homo Sapiens
WWIGIKWVT

SEQ ID NO: 1249678 - protein, 9 aa, Homo Sapiens
FLPYTSCLY

SEQ ID NO: 1249679 - protein, 9 aa, Homo Sapiens
DLPGLWLHH

SEQ ID NO: 1249680 - protein, 9 aa, Homo Sapiens
IYLLAIYQD

SEQ ID NO: 1249681 - protein, 9 aa, Homo Sapiens
NPDESTYVD

SEQ ID NO: 1249682 - protein, 9 aa, Homo Sapiens
TGWTPLHEA

SEQ ID NO: 1249683 - protein, 9 aa, Homo Sapiens
TRWKQRGRP

SEQ ID NO: 1249684 - protein, 9 aa, Homo Sapiens
FLVVFLYMW

SEQ ID NO: 1249685 - protein, 9 aa, Homo Sapiens
DNFLMGNGR

SEQ ID NO: 1249686 - protein, 9 aa, Homo Sapiens
KWFGLWKSK

SEQ ID NO: 1249687 - protein, 9 aa, Homo Sapiens
RPLVQVVDE

SEQ ID NO: 1249688 - protein, 9 aa, Homo Sapiens
GILGHANLA

SEQ ID NO: 1249689 - protein, 9 aa, Homo Sapiens
VGVTTTQFR

SEQ ID NO: 1249690 - protein, 9 aa, Homo Sapiens
SNLDDFDPL

SEQ ID NO: 1249691 - protein, 9 aa, Homo Sapiens
PQPLTKSIS

SEQ ID NO: 1249692 - protein, 9 aa, Homo Sapiens
HTQEYRAFE

SEQ ID NO: 1249693 - protein, 9 aa, Homo Sapiens
SSLLRTIHS

SEQ ID NO: 1249694 - protein, 9 aa, Homo Sapiens
CVNMEDSYY

SEQ ID NO: 1249695 - protein, 9 aa, Homo Sapiens
FRQGYQAGQ

SEQ ID NO: 1249696 - protein, 9 aa, Homo Sapiens
FSIEGFYQL

SEQ ID NO: 1249697 - protein, 9 aa, Homo Sapiens
SFLAACRRC

SEQ ID NO: 1249698 - protein, 9 aa, Homo Sapiens
GLMALLLAL

SEQ ID NO: 1249699 - protein, 9 aa, Homo Sapiens
FPQADISIS

SEQ ID NO: 1249700 - protein, 9 aa, Homo Sapiens
LHQNRLAPP

SEQ ID NO: 1249701 - protein, 9 aa, Homo Sapiens
EDPRLLHQQ

SEQ ID NO: 1249702 - protein, 9 aa, Homo Sapiens
CDATRLESS

SEQ ID NO: 1249703 - protein, 9 aa, Homo Sapiens
TYIGMIFGG

SEQ ID NO: 1249704 - protein, 9 aa, Homo Sapiens
LAILEETQK

SEQ ID NO: 1249705 - protein, 9 aa, Homo Sapiens
HPELLAKKW

SEQ ID NO: 1249706 - protein, 9 aa, Homo Sapiens
DHRYSRDLR

SEQ ID NO: 1249707 - protein, 9 aa, Homo Sapiens
CSSASVDNT

SEQ ID NO: 1249708 - protein, 9 aa, Homo Sapiens
VILNVLLMA

SEQ ID NO: 1249709 - protein, 9 aa, Homo Sapiens
LKEDHPMSA

SEQ ID NO: 1249710 - protein, 9 aa, Homo Sapiens
DEEKIPDPL

SEQ ID NO: 1249711 - protein, 9 aa, Homo Sapiens
PGQASLVRD

SEQ ID NO: 1249712 - protein, 9 aa, Homo Sapiens
LLDNGVCIS

SEQ ID NO: 1249713 - protein, 9 aa, Homo Sapiens
HGKCLPDQQ

SEQ ID NO: 1249714 - protein, 9 aa, Homo Sapiens
DPTDVSSES

SEQ ID NO: 1249715 - protein, 9 aa, Homo Sapiens
KVNFRCAMN

SEQ ID NO: 1249716 - protein, 9 aa, Homo Sapiens
GPSLTPTPM

SEQ ID NO: 1249717 - protein, 9 aa, Homo Sapiens
DNSLKKEKS

SEQ ID NO: 1249718 - protein, 9 aa, Homo Sapiens
PPWLIGRMM

SEQ ID NO: 1249719 - protein, 9 aa, Homo Sapiens
LCNEGTRKM

SEQ ID NO: 1249720 - protein, 9 aa, Homo Sapiens
IDELENDAA

SEQ ID NO: 1249721 - protein, 9 aa, Homo Sapiens
NAQIMKEIR

SEQ ID NO: 1249722 - protein, 9 aa, Homo Sapiens
KGHRVSQEP

SEQ ID NO: 1249723 - protein, 9 aa, Homo Sapiens
KEGVRVNKV

SEQ ID NO: 1249724 - protein, 9 aa, Homo Sapiens
QLPAQGHRL

SEQ ID NO: 1249725 - protein, 9 aa, Homo Sapiens
VRGRRPALQ

SEQ ID NO: 1249726 - protein, 9 aa, Homo Sapiens
QKEKKRFSS

SEQ ID NO: 1249727 - protein, 9 aa, Homo Sapiens
KQNSHKLLP

SEQ ID NO: 1249728 - protein, 9 aa, Homo Sapiens
SSGHLEEFP

SEQ ID NO: 1249729 - protein, 9 aa, Homo Sapiens
TRVVYASAT

SEQ ID NO: 1249730 - protein, 9 aa, Homo Sapiens
TIDGFKKIS

SEQ ID NO: 1249731 - protein, 9 aa, Homo Sapiens
RIFSVSRTV

SEQ ID NO: 1249732 - protein, 9 aa, Homo Sapiens
FKGADLDPH

SEQ ID NO: 1249733 - protein, 9 aa, Homo Sapiens
VILTYHDIS

SEQ ID NO: 1249734 - protein, 9 aa, Homo Sapiens
CHAHGMRCL

SEQ ID NO: 1249735 - protein, 9 aa, Homo Sapiens
GMWLPQLHV

SEQ ID NO: 1249736 - protein, 9 aa, Homo Sapiens
TEVKEGALL

SEQ ID NO: 1249737 - protein, 9 aa, Homo Sapiens
AIVLTVKSL

SEQ ID NO: 1249738 - protein, 9 aa, Homo Sapiens
TRAEMGGRG

SEQ ID NO: 1249739 - protein, 9 aa, Homo Sapiens
LVVREIKLF

SEQ ID NO: 1249740 - protein, 9 aa, Homo Sapiens
CSSDCAPGM

SEQ ID NO: 1249741 - protein, 9 aa, Homo Sapiens
IASVKNKIE

SEQ ID NO: 1249742 - protein, 9 aa, Homo Sapiens
PMEAPAPHP

SEQ ID NO: 1249743 - protein, 9 aa, Homo Sapiens
RAVVQSSPP

SEQ ID NO: 1249744 - protein, 9 aa, Homo Sapiens
MVDIPCGPS

SEQ ID NO: 1249745 - protein, 9 aa, Homo Sapiens
YVLVTSCGP

SEQ ID NO: 1249746 - protein, 9 aa, Homo Sapiens
AWTAECCMC

SEQ ID NO: 1249747 - protein, 9 aa, Homo Sapiens
IRVMECRMA

SEQ ID NO: 1249748 - protein, 9 aa, Homo Sapiens
YHVSTHEQS

SEQ ID NO: 1249749 - protein, 9 aa, Homo Sapiens
SLYIHVDDC

SEQ ID NO: 1249750 - protein, 9 aa, Homo Sapiens
TEEYIEYLK

SEQ ID NO: 1249751 - protein, 9 aa, Homo Sapiens
EWETMKVSE

SEQ ID NO: 1249752 - protein, 9 aa, Homo Sapiens
INFGTVGET

SEQ ID NO: 1249753 - protein, 9 aa, Homo Sapiens
CVVMDVHDS

SEQ ID NO: 1249754 - protein, 9 aa, Homo Sapiens
NFEKQREEC

SEQ ID NO: 1249755 - protein, 9 aa, Homo Sapiens
VVCWASTLW

SEQ ID NO: 1249756 - protein, 9 aa, Homo Sapiens
WTALECAED

SEQ ID NO: 1249757 - protein, 9 aa, Homo Sapiens
LVETEDTSF

SEQ ID NO: 1249758 - protein, 9 aa, Homo Sapiens
TFNGFQRPA

SEQ ID NO: 1249759 - protein, 9 aa, Homo Sapiens
SKIGSETLS

SEQ ID NO: 1249760 - protein, 9 aa, Homo Sapiens
DAANNGSSK

SEQ ID NO: 1249761 - protein, 9 aa, Homo Sapiens
TGLLPGEAA

SEQ ID NO: 1249762 - protein, 9 aa, Homo Sapiens
LSLEEISRS

SEQ ID NO: 1249763 - protein, 9 aa, Homo Sapiens
TEICNLSVF

SEQ ID NO: 1249764 - protein, 9 aa, Homo Sapiens
YWSSLWPCW

SEQ ID NO: 1249765 - protein, 9 aa, Homo Sapiens
LAPFPRAAR

SEQ ID NO: 1249766 - protein, 9 aa, Homo Sapiens
SVSYTGYRD

SEQ ID NO: 1249767 - protein, 9 aa, Homo Sapiens
DYTLSCLER

SEQ ID NO: 1249768 - protein, 9 aa, Homo Sapiens
TNWTTPSPH

SEQ ID NO: 1249769 - protein, 9 aa, Homo Sapiens
LREPGPSPF

SEQ ID NO: 1249770 - protein, 9 aa, Homo Sapiens
NSLMGIFNF

SEQ ID NO: 1249771 - protein, 9 aa, Homo Sapiens
STCLLSPGA

SEQ ID NO: 1249772 - protein, 9 aa, Homo Sapiens
ALLRPPVTA

SEQ ID NO: 1249773 - protein, 9 aa, Homo Sapiens
GCPFTMTRN

SEQ ID NO: 1249774 - protein, 9 aa, Homo Sapiens
ETKEKTSQL

SEQ ID NO: 1249775 - protein, 9 aa, Homo Sapiens
LQAAIDVPV

SEQ ID NO: 1249776 - protein, 9 aa, Homo Sapiens
KKAEKQVTM

SEQ ID NO: 1249777 - protein, 9 aa, Homo Sapiens
KMKLTLAVL

SEQ ID NO: 1249778 - protein, 9 aa, Homo Sapiens
YDTLTNIDS

SEQ ID NO: 1249779 - protein, 9 aa, Homo Sapiens
CTLVFLCLY

SEQ ID NO: 1249780 - protein, 9 aa, Homo Sapiens
LFKDMPLQP

SEQ ID NO: 1249781 - protein, 9 aa, Homo Sapiens
DFITHLKFL

SEQ ID NO: 1249782 - protein, 9 aa, Homo Sapiens
DRATDFHFN

SEQ ID NO: 1249783 - protein, 9 aa, Homo Sapiens
ELVITRNHT

SEQ ID NO: 1249784 - protein, 9 aa, Homo Sapiens
LKAQAIKQG

SEQ ID NO: 1249785 - protein, 9 aa, Homo Sapiens
LSGYPMIEI

SEQ ID NO: 1249786 - protein, 9 aa, Homo Sapiens
MEGKAFLPE

SEQ ID NO: 1249787 - protein, 9 aa, Homo Sapiens
HCPQCQIVV

SEQ ID NO: 1249788 - protein, 9 aa, Homo Sapiens
EQIVVQVNN

SEQ ID NO: 1249789 - protein, 9 aa, Homo Sapiens
GNSSVNHII

SEQ ID NO: 1249790 - protein, 9 aa, Homo Sapiens
IKMKQMTTI

SEQ ID NO: 1249791 - protein, 9 aa, Homo Sapiens
WHYLVSWYD

SEQ ID NO: 1249792 - protein, 9 aa, Homo Sapiens
KSYIYVYTV

SEQ ID NO: 1249793 - protein, 9 aa, Homo Sapiens
TCGQLMNGS

SEQ ID NO: 1249794 - protein, 9 aa, Homo Sapiens
AECGKAFQH

SEQ ID NO: 1249795 - protein, 9 aa, Homo Sapiens
LESKQQVSR

SEQ ID NO: 1249796 - protein, 9 aa, Homo Sapiens
LMALADGPG

SEQ ID NO: 1249797 - protein, 9 aa, Homo Sapiens
NNGLRKNGI

SEQ ID NO: 1249798 - protein, 9 aa, Homo Sapiens
VSVPSVAER

SEQ ID NO: 1249799 - protein, 9 aa, Homo Sapiens
GQSGCQDIN

SEQ ID NO: 1249800 - protein, 9 aa, Homo Sapiens
MLDTTGMVE

SEQ ID NO: 1249801 - protein, 9 aa, Homo Sapiens
RSSTYSNNE

SEQ ID NO: 1249802 - protein, 9 aa, Homo Sapiens
TVPTWYPCG

SEQ ID NO: 1249803 - protein, 9 aa, Homo Sapiens
SAFMFTVTF

SEQ ID NO: 1249804 - protein, 9 aa, Homo Sapiens
RAYGQRGPG

SEQ ID NO: 1249805 - protein, 9 aa, Homo Sapiens
QLTNPPDHG

SEQ ID NO: 1249806 - protein, 9 aa, Homo Sapiens
HIIEATSDR

SEQ ID NO: 1249807 - protein, 9 aa, Homo Sapiens
WRPDFRESQ

SEQ ID NO: 1249808 - protein, 9 aa, Homo Sapiens
VIYYVVFTT

SEQ ID NO: 1249809 - protein, 9 aa, Homo Sapiens
PTKRHYCCA

SEQ ID NO: 1249810 - protein, 9 aa, Homo Sapiens
VTYLYLGHF

SEQ ID NO: 1249811 - protein, 9 aa, Homo Sapiens
SVMTHLSGH

SEQ ID NO: 1249812 - protein, 9 aa, Homo Sapiens
SRKKRKKNP

SEQ ID NO: 1249813 - protein, 9 aa, Homo Sapiens
EAVYEELPE

SEQ ID NO: 1249814 - protein, 9 aa, Homo Sapiens
LITCMFKQT

SEQ ID NO: 1249815 - protein, 9 aa, Homo Sapiens
LGNHYQLPI

SEQ ID NO: 1249816 - protein, 9 aa, Homo Sapiens
GKKCLDVYQ

SEQ ID NO: 1249817 - protein, 9 aa, Homo Sapiens
EALSSNMYG

SEQ ID NO: 1249818 - protein, 9 aa, Homo Sapiens
VDNGLRNPV

SEQ ID NO: 1249819 - protein, 9 aa, Homo Sapiens
GGIDTSYYK

SEQ ID NO: 1249820 - protein, 9 aa, Homo Sapiens
DPKLTMEVY

SEQ ID NO: 1249821 - protein, 9 aa, Homo Sapiens
CGLESNKNE

SEQ ID NO: 1249822 - protein, 9 aa, Homo Sapiens
ASGSVMIQR

SEQ ID NO: 1249823 - protein, 9 aa, Homo Sapiens
ICLIDVDTK

SEQ ID NO: 1249824 - protein, 9 aa, Homo Sapiens
EMELVMQEE

SEQ ID NO: 1249825 - protein, 9 aa, Homo Sapiens
RIHQRTHRG

SEQ ID NO: 1249826 - protein, 9 aa, Homo Sapiens
KDKKYYDNF

SEQ ID NO: 1249827 - protein, 9 aa, Homo Sapiens
LLIEHLMGG

SEQ ID NO: 1249828 - protein, 9 aa, Homo Sapiens
AIQPLDDDD

SEQ ID NO: 1249829 - protein, 9 aa, Homo Sapiens
LDGSVVKKV

SEQ ID NO: 1249830 - protein, 9 aa, Homo Sapiens
ILNNDAFMN

SEQ ID NO: 1249831 - protein, 9 aa, Homo Sapiens
WMLVWSQMA

SEQ ID NO: 1249832 - protein, 9 aa, Homo Sapiens
GGGATSRGV

SEQ ID NO: 1249833 - protein, 9 aa, Homo Sapiens
TWKVNFRCA

SEQ ID NO: 1249834 - protein, 9 aa, Homo Sapiens
FITKEVSTT

SEQ ID NO: 1249835 - protein, 9 aa, Homo Sapiens
EVLGWDPDN

SEQ ID NO: 1249836 - protein, 9 aa, Homo Sapiens
QLQKTHVMS

SEQ ID NO: 1249837 - protein, 9 aa, Homo Sapiens
VPDSLDNVE

SEQ ID NO: 1249838 - protein, 9 aa, Homo Sapiens
RKKEPSCKA

SEQ ID NO: 1249839 - protein, 9 aa, Homo Sapiens
ADEAPPRLQ

SEQ ID NO: 1249840 - protein, 9 aa, Homo Sapiens
AEEIYLIFL

SEQ ID NO: 1249841 - protein, 9 aa, Homo Sapiens
HGCCPYCHR

SEQ ID NO: 1249842 - protein, 9 aa, Homo Sapiens
FTLMFWREF

SEQ ID NO: 1249843 - protein, 9 aa, Homo Sapiens
HGNMENSIF

SEQ ID NO: 1249844 - protein, 9 aa, Homo Sapiens
RWEALATHT

SEQ ID NO: 1249845 - protein, 9 aa, Homo Sapiens
YFAPNFQKK

SEQ ID NO: 1249846 - protein, 9 aa, Homo Sapiens
ILNNGLDME

SEQ ID NO: 1249847 - protein, 9 aa, Homo Sapiens
TGEHTWSLT

SEQ ID NO: 1249848 - protein, 9 aa, Homo Sapiens
KLMIYLLCD

SEQ ID NO: 1249849 - protein, 9 aa, Homo Sapiens
AEFPSATLC

SEQ ID NO: 1249850 - protein, 9 aa, Homo Sapiens
SSPGEEVEG

SEQ ID NO: 1249851 - protein, 9 aa, Homo Sapiens
MVKNATVYP

SEQ ID NO: 1249852 - protein, 9 aa, Homo Sapiens
ATVMKQHQL

SEQ ID NO: 1249853 - protein, 9 aa, Homo Sapiens
LEEMKEVVG

SEQ ID NO: 1249854 - protein, 9 aa, Homo Sapiens
TALDLVRQY

SEQ ID NO: 1249855 - protein, 9 aa, Homo Sapiens
IYHFLTLPD

SEQ ID NO: 1249856 - protein, 9 aa, Homo Sapiens
GNMGVTLEA

SEQ ID NO: 1249857 - protein, 9 aa, Homo Sapiens
IDTSEPMYG

SEQ ID NO: 1249858 - protein, 9 aa, Homo Sapiens
DGTVKMIMV

SEQ ID NO: 1249859 - protein, 9 aa, Homo Sapiens
NGKYNLDFK

SEQ ID NO: 1249860 - protein, 9 aa, Homo Sapiens
EKSKESLKD

SEQ ID NO: 1249861 - protein, 9 aa, Homo Sapiens
VGTGMDGKK

SEQ ID NO: 1249862 - protein, 9 aa, Homo Sapiens
IDEIAAPQS

SEQ ID NO: 1249863 - protein, 9 aa, Homo Sapiens
TFFFLHKEF

SEQ ID NO: 1249864 - protein, 9 aa, Homo Sapiens
VETRTSSHL

SEQ ID NO: 1249865 - protein, 9 aa, Homo Sapiens
GSICHNGGN

SEQ ID NO: 1249866 - protein, 9 aa, Homo Sapiens
YCSTFQLGC

SEQ ID NO: 1249867 - protein, 9 aa, Homo Sapiens
MTTSFTDHA

SEQ ID NO: 1249868 - protein, 9 aa, Homo Sapiens
GSDSDISED

SEQ ID NO: 1249869 - protein, 9 aa, Homo Sapiens
AILLPGAPQ

SEQ ID NO: 1249870 - protein, 9 aa, Homo Sapiens
KGKLKNQIR

SEQ ID NO: 1249871 - protein, 9 aa, Homo Sapiens
TPSCQDWKK

SEQ ID NO: 1249872 - protein, 9 aa, Homo Sapiens
QNCMGKARE

SEQ ID NO: 1249873 - protein, 9 aa, Homo Sapiens
LRRMMDILE

SEQ ID NO: 1249874 - protein, 9 aa, Homo Sapiens
GSTGLVEIC

SEQ ID NO: 1249875 - protein, 9 aa, Homo Sapiens
TADISTRDS

SEQ ID NO: 1249876 - protein, 9 aa, Homo Sapiens
YLCPRSMRS

SEQ ID NO: 1249877 - protein, 9 aa, Homo Sapiens
DHRCQHVDL

SEQ ID NO: 1249878 - protein, 9 aa, Homo Sapiens
DTLNNFQEA

SEQ ID NO: 1249879 - protein, 9 aa, Homo Sapiens
EKLTVLQVQ

SEQ ID NO: 1249880 - protein, 9 aa, Homo Sapiens
RTLEPPAED

SEQ ID NO: 1249881 - protein, 9 aa, Homo Sapiens
SIMIQKGNA

SEQ ID NO: 1249882 - protein, 9 aa, Homo Sapiens
VAELPRFHE

SEQ ID NO: 1249883 - protein, 9 aa, Homo Sapiens
IRSVQQTLV

SEQ ID NO: 1249884 - protein, 9 aa, Homo Sapiens
RPGQCAGAW

SEQ ID NO: 1249885 - protein, 9 aa, Homo Sapiens
KIIVVNYPL

SEQ ID NO: 1249886 - protein, 9 aa, Homo Sapiens
QSLPNRNTK

SEQ ID NO: 1249887 - protein, 9 aa, Homo Sapiens
AFVTCSSHL

SEQ ID NO: 1249888 - protein, 9 aa, Homo Sapiens
YRWDIIAQR

SEQ ID NO: 1249889 - protein, 9 aa, Homo Sapiens
EAQAAVPAE

SEQ ID NO: 1249890 - protein, 9 aa, Homo Sapiens
RTLRALHPL

SEQ ID NO: 1249891 - protein, 9 aa, Homo Sapiens
ILEIRKEVF

SEQ ID NO: 1249892 - protein, 9 aa, Homo Sapiens
LTLSQIGRV

SEQ ID NO: 1249893 - protein, 9 aa, Homo Sapiens
WEERLQEQQ

SEQ ID NO: 1249894 - protein, 9 aa, Homo Sapiens
LGDKVVYCR

SEQ ID NO: 1249895 - protein, 9 aa, Homo Sapiens
DGYFPTVTY

SEQ ID NO: 1249896 - protein, 9 aa, Homo Sapiens
RNTIGNSQR

SEQ ID NO: 1249897 - protein, 9 aa, Homo Sapiens
VNSMSIIGS

SEQ ID NO: 1249898 - protein, 9 aa, Homo Sapiens
MAIYNVAVM

SEQ ID NO: 1249899 - protein, 9 aa, Homo Sapiens
LPYWSSLWP

SEQ ID NO: 1249900 - protein, 9 aa, Homo Sapiens
IVTLVPELG

SEQ ID NO: 1249901 - protein, 9 aa, Homo Sapiens
NWQTACDAA

SEQ ID NO: 1249902 - protein, 9 aa, Homo Sapiens
GPAKCCECE

SEQ ID NO: 1249903 - protein, 9 aa, Homo Sapiens
CGARPLTSR

SEQ ID NO: 1249904 - protein, 9 aa, Homo Sapiens
WYLQAASNN

SEQ ID NO: 1249905 - protein, 9 aa, Homo Sapiens
VGLEMVFKN

SEQ ID NO: 1249906 - protein, 9 aa, Homo Sapiens
DEPTEQHVR

SEQ ID NO: 1249907 - protein, 9 aa, Homo Sapiens
SCEDQKEDR

SEQ ID NO: 1249908 - protein, 9 aa, Homo Sapiens
CPPGWSGHL

SEQ ID NO: 1249909 - protein, 9 aa, Homo Sapiens
TKLPIGTWD

SEQ ID NO: 1249910 - protein, 9 aa, Homo Sapiens
LKVCYPERI

SEQ ID NO: 1249911 - protein, 9 aa, Homo Sapiens
TVYRYTLLL

SEQ ID NO: 1249912 - protein, 9 aa, Homo Sapiens
HVLPVPPMP

SEQ ID NO: 1249913 - protein, 9 aa, Homo Sapiens
QDPDLQRRP

SEQ ID NO: 1249914 - protein, 9 aa, Homo Sapiens
HIKPIKFED

SEQ ID NO: 1249915 - protein, 9 aa, Homo Sapiens
IKECIRLYA

SEQ ID NO: 1249916 - protein, 9 aa, Homo Sapiens
GDVLNHSDH

SEQ ID NO: 1249917 - protein, 9 aa, Homo Sapiens
MGKSEMLVD

SEQ ID NO: 1249918 - protein, 9 aa, Homo Sapiens
MATAPAASL

SEQ ID NO: 1249919 - protein, 9 aa, Homo Sapiens
PNALQCLGL

SEQ ID NO: 1249920 - protein, 9 aa, Homo Sapiens
PKQEVHRHT

SEQ ID NO: 1249921 - protein, 9 aa, Homo Sapiens
HTGMHRHTH

SEQ ID NO: 1249922 - protein, 9 aa, Homo Sapiens
LQRPAGLII

SEQ ID NO: 1249923 - protein, 9 aa, Homo Sapiens
RHGWWAGFR

SEQ ID NO: 1249924 - protein, 9 aa, Homo Sapiens
HTGEWPYKC

SEQ ID NO: 1249925 - protein, 9 aa, Homo Sapiens
LCLCRSSLK

SEQ ID NO: 1249926 - protein, 9 aa, Homo Sapiens
EKLDQLKQG

SEQ ID NO: 1249927 - protein, 9 aa, Homo Sapiens
DILEIRKEV

SEQ ID NO: 1249928 - protein, 9 aa, Homo Sapiens
VAESEALHS

SEQ ID NO: 1249929 - protein, 9 aa, Homo Sapiens
WKLERERPL

SEQ ID NO: 1249930 - protein, 9 aa, Homo Sapiens
LIIGSINAC

SEQ ID NO: 1249931 - protein, 9 aa, Homo Sapiens
MLTLACMDT

SEQ ID NO: 1249932 - protein, 9 aa, Homo Sapiens
DDEVSRILT

SEQ ID NO: 1249933 - protein, 9 aa, Homo Sapiens
VSRATPAAG

SEQ ID NO: 1249934 - protein, 9 aa, Homo Sapiens
VDFRERNKG

SEQ ID NO: 1249935 - protein, 9 aa, Homo Sapiens
TSFFVRTKN

SEQ ID NO: 1249936 - protein, 9 aa, Homo Sapiens
PGLNGRNRR

SEQ ID NO: 1249937 - protein, 9 aa, Homo Sapiens
AFFIHNCTI

SEQ ID NO: 1249938 - protein, 9 aa, Homo Sapiens
TWETILMDT

SEQ ID NO: 1249939 - protein, 9 aa, Homo Sapiens
ADVVQVLKK

SEQ ID NO: 1249940 - protein, 9 aa, Homo Sapiens
WDANVPKEA

SEQ ID NO: 1249941 - protein, 9 aa, Homo Sapiens
QQPLDILSE

SEQ ID NO: 1249942 - protein, 9 aa, Homo Sapiens
IVPHPGVQP

SEQ ID NO: 1249943 - protein, 9 aa, Homo Sapiens
FLSKDVSYL

SEQ ID NO: 1249944 - protein, 9 aa, Homo Sapiens
MHGTSISFS

SEQ ID NO: 1249945 - protein, 9 aa, Homo Sapiens
RDSYYSYMG

SEQ ID NO: 1249946 - protein, 9 aa, Homo Sapiens
NIKEKEKQS

SEQ ID NO: 1249947 - protein, 9 aa, Homo Sapiens
GAAGVNGLS

SEQ ID NO: 1249948 - protein, 9 aa, Homo Sapiens
RDESADSGL

SEQ ID NO: 1249949 - protein, 9 aa, Homo Sapiens
IQTQAPQPA

SEQ ID NO: 1249950 - protein, 9 aa, Homo Sapiens
PFLIIIIVF

SEQ ID NO: 1249951 - protein, 9 aa, Homo Sapiens
KNRPDLIDF

SEQ ID NO: 1249952 - protein, 9 aa, Homo Sapiens
DGEGGTYTD

SEQ ID NO: 1249953 - protein, 9 aa, Homo Sapiens
AARPVQDIS

SEQ ID NO: 1249954 - protein, 9 aa, Homo Sapiens
RDLVERVLY

SEQ ID NO: 1249955 - protein, 9 aa, Homo Sapiens
KKCHTAFQN

SEQ ID NO: 1249956 - protein, 9 aa, Homo Sapiens
WGDHFVYKG

SEQ ID NO: 1249957 - protein, 9 aa, Homo Sapiens
FGIWSKVYN

SEQ ID NO: 1249958 - protein, 9 aa, Homo Sapiens
GIPLKRRHV

SEQ ID NO: 1249959 - protein, 9 aa, Homo Sapiens
SYSHQQRDL

SEQ ID NO: 1249960 - protein, 9 aa, Homo Sapiens
SRSVLGTDW

SEQ ID NO: 1249961 - protein, 9 aa, Homo Sapiens
VLGTDWPKD

SEQ ID NO: 1249962 - protein, 9 aa, Homo Sapiens
HQGQNVIGL

SEQ ID NO: 1249963 - protein, 9 aa, Homo Sapiens
TDVNASEKT

SEQ ID NO: 1249964 - protein, 9 aa, Homo Sapiens
TAFLAETLL

SEQ ID NO: 1249965 - protein, 9 aa, Homo Sapiens
TFECIAPAN

SEQ ID NO: 1249966 - protein, 9 aa, Homo Sapiens
ERSGLICAR

SEQ ID NO: 1249967 - protein, 9 aa, Homo Sapiens
ECQVLLDVR

SEQ ID NO: 1249968 - protein, 9 aa, Homo Sapiens
PQKRATPLQ

SEQ ID NO: 1249969 - protein, 9 aa, Homo Sapiens
IKYQKERNE

SEQ ID NO: 1249970 - protein, 9 aa, Homo Sapiens
VSQSEGESW

SEQ ID NO: 1249971 - protein, 9 aa, Homo Sapiens
LMGDAMVMT

SEQ ID NO: 1249972 - protein, 9 aa, Homo Sapiens
AFFTSSKMV

SEQ ID NO: 1249973 - protein, 9 aa, Homo Sapiens
YPRPAFAGT

SEQ ID NO: 1249974 - protein, 9 aa, Homo Sapiens
EYQKHFLSR

SEQ ID NO: 1249975 - protein, 9 aa, Homo Sapiens
QVGIRARLR

SEQ ID NO: 1249976 - protein, 9 aa, Homo Sapiens
LVDGVTYPA

SEQ ID NO: 1249977 - protein, 9 aa, Homo Sapiens
PKSKQKKEE

SEQ ID NO: 1249978 - protein, 9 aa, Homo Sapiens
LLSRASGVA

SEQ ID NO: 1249979 - protein, 9 aa, Homo Sapiens
DSTGHWLYE

SEQ ID NO: 1249980 - protein, 9 aa, Homo Sapiens
IETRCDDTA

SEQ ID NO: 1249981 - protein, 9 aa, Homo Sapiens
ERLVRQRQL

SEQ ID NO: 1249982 - protein, 9 aa, Homo Sapiens
AWKWDYLIL

SEQ ID NO: 1249983 - protein, 9 aa, Homo Sapiens
TLPHAIMRL

SEQ ID NO: 1249984 - protein, 9 aa, Homo Sapiens
CIGSSYRAL

SEQ ID NO: 1249985 - protein, 9 aa, Homo Sapiens
VQTRVKLNY

SEQ ID NO: 1249986 - protein, 9 aa, Homo Sapiens
PVPRPGSGS

SEQ ID NO: 1249987 - protein, 9 aa, Homo Sapiens
NKLMMDKYP

SEQ ID NO: 1249988 - protein, 9 aa, Homo Sapiens
LRHLQEGDL

SEQ ID NO: 1249989 - protein, 9 aa, Homo Sapiens
KPFRHVLQP

SEQ ID NO: 1249990 - protein, 9 aa, Homo Sapiens
NRHPNTLPG

SEQ ID NO: 1249991 - protein, 9 aa, Homo Sapiens
MLVDAPPQD

SEQ ID NO: 1249992 - protein, 9 aa, Homo Sapiens
HPNPGVRYT

SEQ ID NO: 1249993 - protein, 9 aa, Homo Sapiens
GFQARLSHL

SEQ ID NO: 1249994 - protein, 9 aa, Homo Sapiens
ADIHKMLSP

SEQ ID NO: 1249995 - protein, 9 aa, Homo Sapiens
WSGTEKLLA

SEQ ID NO: 1249996 - protein, 9 aa, Homo Sapiens
LFSKELRSF

SEQ ID NO: 1249997 - protein, 9 aa, Homo Sapiens
SAHNYENNY

SEQ ID NO: 1249998 - protein, 9 aa, Homo Sapiens
QEYLAFAKR

SEQ ID NO: 1249999 - protein, 9 aa, Homo Sapiens
QRNLGMSMH

SEQ ID NO: 1250000 - protein, 9 aa, Homo Sapiens
CRYRCFTKH

SEQ ID NO: 1250001 - protein, 9 aa, Homo Sapiens
FGCPFTMTR

SEQ ID NO: 1250002 - protein, 9 aa, Homo Sapiens
ANQPRTESP

SEQ ID NO: 1250003 - protein, 9 aa, Homo Sapiens
HSDSDIFTP

SEQ ID NO: 1250004 - protein, 9 aa, Homo Sapiens
PQLHAAIRV

SEQ ID NO: 1250005 - protein, 9 aa, Homo Sapiens
NATMTLPGM

SEQ ID NO: 1250006 - protein, 9 aa, Homo Sapiens
DVDTRRTVP

SEQ ID NO: 1250007 - protein, 9 aa, Homo Sapiens
QDSMLHGAV

SEQ ID NO: 1250008 - protein, 9 aa, Homo Sapiens
IDEIVNTTF

SEQ ID NO: 1250009 - protein, 9 aa, Homo Sapiens
IKIDESSLT

SEQ ID NO: 1250010 - protein, 9 aa, Homo Sapiens
NGRNRRAKK

SEQ ID NO: 1250011 - protein, 9 aa, Homo Sapiens
GADDGVADV

SEQ ID NO: 1250012 - protein, 9 aa, Homo Sapiens
IHVCDELRE

SEQ ID NO: 1250013 - protein, 9 aa, Homo Sapiens
MAPPWVPAI

SEQ ID NO: 1250014 - protein, 9 aa, Homo Sapiens
GEPSDPYDH

SEQ ID NO: 1250015 - protein, 9 aa, Homo Sapiens
RTRCGGHKD

SEQ ID NO: 1250016 - protein, 9 aa, Homo Sapiens
STLTRKILN

SEQ ID NO: 1250017 - protein, 9 aa, Homo Sapiens
LYDYFWWEH

SEQ ID NO: 1250018 - protein, 9 aa, Homo Sapiens
GTMLKPHAP

SEQ ID NO: 1250019 - protein, 9 aa, Homo Sapiens
AAHLELHVL

SEQ ID NO: 1250020 - protein, 9 aa, Homo Sapiens
AGWTCRDEC

SEQ ID NO: 1250021 - protein, 9 aa, Homo Sapiens
HHHPYGPPG

SEQ ID NO: 1250022 - protein, 9 aa, Homo Sapiens
MLQMNDLVY

SEQ ID NO: 1250023 - protein, 9 aa, Homo Sapiens
CPRICRGIR

SEQ ID NO: 1250024 - protein, 9 aa, Homo Sapiens
SMYVEKIDV

SEQ ID NO: 1250025 - protein, 9 aa, Homo Sapiens
RLCEHCPTC

SEQ ID NO: 1250026 - protein, 9 aa, Homo Sapiens
ELWQRLEDA

SEQ ID NO: 1250027 - protein, 9 aa, Homo Sapiens
DLSPGHGVS

SEQ ID NO: 1250028 - protein, 9 aa, Homo Sapiens
RNAEYNPKQ

SEQ ID NO: 1250029 - protein, 9 aa, Homo Sapiens
RSMSTSTWA

SEQ ID NO: 1250030 - protein, 9 aa, Homo Sapiens
ELFLIAIPS

SEQ ID NO: 1250031 - protein, 9 aa, Homo Sapiens
LFLIAIPSH

SEQ ID NO: 1250032 - protein, 9 aa, Homo Sapiens
DQRCVSSSY

SEQ ID NO: 1250033 - protein, 9 aa, Homo Sapiens
HVIAWGHAF

SEQ ID NO: 1250034 - protein, 9 aa, Homo Sapiens
RVIEPSSSL

SEQ ID NO: 1250035 - protein, 9 aa, Homo Sapiens
TSASVAVTT

SEQ ID NO: 1250036 - protein, 9 aa, Homo Sapiens
TELTEELTT

SEQ ID NO: 1250037 - protein, 9 aa, Homo Sapiens
GKRGHPGFK

SEQ ID NO: 1250038 - protein, 9 aa, Homo Sapiens
IQDFIFFVM

SEQ ID NO: 1250039 - protein, 9 aa, Homo Sapiens
ASTSWHCSM

SEQ ID NO: 1250040 - protein, 9 aa, Homo Sapiens
ITGLPTDAN

SEQ ID NO: 1250041 - protein, 9 aa, Homo Sapiens
TYFDGVAVV

SEQ ID NO: 1250042 - protein, 9 aa, Homo Sapiens
TLYNQALMN

SEQ ID NO: 1250043 - protein, 9 aa, Homo Sapiens
PRAPSVWEQ

SEQ ID NO: 1250044 - protein, 9 aa, Homo Sapiens
QISHAQMLL

SEQ ID NO: 1250045 - protein, 9 aa, Homo Sapiens
IDDKNPCIF

SEQ ID NO: 1250046 - protein, 9 aa, Homo Sapiens
WIVQRRKTI

SEQ ID NO: 1250047 - protein, 9 aa, Homo Sapiens
KMRAQIPEP

SEQ ID NO: 1250048 - protein, 9 aa, Homo Sapiens
FIPDIDLIP

SEQ ID NO: 1250049 - protein, 9 aa, Homo Sapiens
LNQAADVHA

SEQ ID NO: 1250050 - protein, 9 aa, Homo Sapiens
APEVEPHLV

SEQ ID NO: 1250051 - protein, 9 aa, Homo Sapiens
LPHLFHTSY

SEQ ID NO: 1250052 - protein, 9 aa, Homo Sapiens
GRSRSTQGG

SEQ ID NO: 1250053 - protein, 9 aa, Homo Sapiens
QHVVIIHCR

SEQ ID NO: 1250054 - protein, 9 aa, Homo Sapiens
RGTDGYPGE

SEQ ID NO: 1250055 - protein, 9 aa, Homo Sapiens
AFGNSSVNH

SEQ ID NO: 1250056 - protein, 9 aa, Homo Sapiens
NLIYFVFYS

SEQ ID NO: 1250057 - protein, 9 aa, Homo Sapiens
DSSANWDET

SEQ ID NO: 1250058 - protein, 9 aa, Homo Sapiens
SVDYCQQLI

SEQ ID NO: 1250059 - protein, 9 aa, Homo Sapiens
SATFNSPGN

SEQ ID NO: 1250060 - protein, 9 aa, Homo Sapiens
LQVLDRFYW

SEQ ID NO: 1250061 - protein, 9 aa, Homo Sapiens
TMAQVDAWK

SEQ ID NO: 1250062 - protein, 9 aa, Homo Sapiens
PSSPTSSSH

SEQ ID NO: 1250063 - protein, 9 aa, Homo Sapiens
KIYFGTHTH

SEQ ID NO: 1250064 - protein, 9 aa, Homo Sapiens
LGYSQNLAK

SEQ ID NO: 1250065 - protein, 9 aa, Homo Sapiens
LGSTECVIL

SEQ ID NO: 1250066 - protein, 9 aa, Homo Sapiens
IVAVELELN

SEQ ID NO: 1250067 - protein, 9 aa, Homo Sapiens
SSCSSSPTP

SEQ ID NO: 1250068 - protein, 9 aa, Homo Sapiens
ASNQQFAGG

SEQ ID NO: 1250069 - protein, 9 aa, Homo Sapiens
TTTTLMMTT

SEQ ID NO: 1250070 - protein, 9 aa, Homo Sapiens
DMDTYMLQN

SEQ ID NO: 1250071 - protein, 9 aa, Homo Sapiens
YDEQWQPLT

SEQ ID NO: 1250072 - protein, 9 aa, Homo Sapiens
QGQHLFIES

SEQ ID NO: 1250073 - protein, 9 aa, Homo Sapiens
QASLELGEC

SEQ ID NO: 1250074 - protein, 9 aa, Homo Sapiens
IISSAIQNI

SEQ ID NO: 1250075 - protein, 9 aa, Homo Sapiens
DGQGHTTAS

SEQ ID NO: 1250076 - protein, 9 aa, Homo Sapiens
HPQHKLFQE

SEQ ID NO: 1250077 - protein, 9 aa, Homo Sapiens
MLQSTLKTL

SEQ ID NO: 1250078 - protein, 9 aa, Homo Sapiens
GRKALLKIL

SEQ ID NO: 1250079 - protein, 9 aa, Homo Sapiens
CITRKKVSL

SEQ ID NO: 1250080 - protein, 9 aa, Homo Sapiens
VMCLITAPV

SEQ ID NO: 1250081 - protein, 9 aa, Homo Sapiens
PRCRPINTT

SEQ ID NO: 1250082 - protein, 9 aa, Homo Sapiens
PRCMQYSCS

SEQ ID NO: 1250083 - protein, 9 aa, Homo Sapiens
LLKGTEAFT

SEQ ID NO: 1250084 - protein, 9 aa, Homo Sapiens
HSHRHTHTH

SEQ ID NO: 1250085 - protein, 9 aa, Homo Sapiens
PMPFNPTLP

SEQ ID NO: 1250086 - protein, 9 aa, Homo Sapiens
LAFDQNSYF

SEQ ID NO: 1250087 - protein, 9 aa, Homo Sapiens
NKESPVFAH

SEQ ID NO: 1250088 - protein, 9 aa, Homo Sapiens
LWEHNRVCD

SEQ ID NO: 1250089 - protein, 9 aa, Homo Sapiens
KKTKPVPWV

SEQ ID NO: 1250090 - protein, 9 aa, Homo Sapiens
RQNQTWNRP

SEQ ID NO: 1250091 - protein, 9 aa, Homo Sapiens
AAVRMRLEA

SEQ ID NO: 1250092 - protein, 9 aa, Homo Sapiens
YYHLLLVGI

SEQ ID NO: 1250093 - protein, 9 aa, Homo Sapiens
VSSAQDFWT

SEQ ID NO: 1250094 - protein, 9 aa, Homo Sapiens
IGVGCVDTR

SEQ ID NO: 1250095 - protein, 9 aa, Homo Sapiens
SNVGECDGT

SEQ ID NO: 1250096 - protein, 9 aa, Homo Sapiens
VGFVMYYFT

SEQ ID NO: 1250097 - protein, 9 aa, Homo Sapiens
KCKIGSLKT

SEQ ID NO: 1250098 - protein, 9 aa, Homo Sapiens
VAIGKLALL

SEQ ID NO: 1250099 - protein, 9 aa, Homo Sapiens
NKQRSHHKS

SEQ ID NO: 1250100 - protein, 9 aa, Homo Sapiens
QEEPPLVTI

SEQ ID NO: 1250101 - protein, 9 aa, Homo Sapiens
LKNAVVRAG

SEQ ID NO: 1250102 - protein, 9 aa, Homo Sapiens
SRRRMKHVW

SEQ ID NO: 1250103 - protein, 9 aa, Homo Sapiens
SEHISLTVA

SEQ ID NO: 1250104 - protein, 9 aa, Homo Sapiens
GLQGLKDKP

SEQ ID NO: 1250105 - protein, 9 aa, Homo Sapiens
GYETHWWDA

SEQ ID NO: 1250106 - protein, 9 aa, Homo Sapiens
GIQGHPDGT

SEQ ID NO: 1250107 - protein, 9 aa, Homo Sapiens
STRTLEPPA

SEQ ID NO: 1250108 - protein, 9 aa, Homo Sapiens
IERHAQVAE

SEQ ID NO: 1250109 - protein, 9 aa, Homo Sapiens
KTLSYLRES

SEQ ID NO: 1250110 - protein, 9 aa, Homo Sapiens
WQRLGKCNS

SEQ ID NO: 1250111 - protein, 9 aa, Homo Sapiens
LQQYCMVSG

SEQ ID NO: 1250112 - protein, 9 aa, Homo Sapiens
AGTGCVMTG

SEQ ID NO: 1250113 - protein, 9 aa, Homo Sapiens
VSSFMISNG

SEQ ID NO: 1250114 - protein, 9 aa, Homo Sapiens
PVFVTSCNG

SEQ ID NO: 1250115 - protein, 9 aa, Homo Sapiens
FSCPQCSRA

SEQ ID NO: 1250116 - protein, 9 aa, Homo Sapiens
NLIEYISYC

SEQ ID NO: 1250117 - protein, 9 aa, Homo Sapiens
SFDVMSPSP

SEQ ID NO: 1250118 - protein, 9 aa, Homo Sapiens
WQNNLTDAK

SEQ ID NO: 1250119 - protein, 9 aa, Homo Sapiens
CPVNKRRRN

SEQ ID NO: 1250120 - protein, 9 aa, Homo Sapiens
KEMMQFLND

SEQ ID NO: 1250121 - protein, 9 aa, Homo Sapiens
FLQVTATYA

SEQ ID NO: 1250122 - protein, 9 aa, Homo Sapiens
PQPLLQHPQ

SEQ ID NO: 1250123 - protein, 9 aa, Homo Sapiens
QVEQSQVLL

SEQ ID NO: 1250124 - protein, 9 aa, Homo Sapiens
AVMLQQHIQ

SEQ ID NO: 1250125 - protein, 9 aa, Homo Sapiens
SIRTEICNL

SEQ ID NO: 1250126 - protein, 9 aa, Homo Sapiens
MWLTQCRDM

SEQ ID NO: 1250127 - protein, 9 aa, Homo Sapiens
QGITLIWTA

SEQ ID NO: 1250128 - protein, 9 aa, Homo Sapiens
LWHWVLGLL

SEQ ID NO: 1250129 - protein, 9 aa, Homo Sapiens
SICHNGGNC

SEQ ID NO: 1250130 - protein, 9 aa, Homo Sapiens
TVMAPMLNP

SEQ ID NO: 1250131 - protein, 9 aa, Homo Sapiens
RPVRVKRRK

SEQ ID NO: 1250132 - protein, 9 aa, Homo Sapiens
PSIHRTPRS

SEQ ID NO: 1250133 - protein, 9 aa, Homo Sapiens
PPMWPPSST

SEQ ID NO: 1250134 - protein, 9 aa, Homo Sapiens
GSDPRHETP

SEQ ID NO: 1250135 - protein, 9 aa, Homo Sapiens
VVCHAPETP

SEQ ID NO: 1250136 - protein, 9 aa, Homo Sapiens
EKCLHKTHR

SEQ ID NO: 1250137 - protein, 9 aa, Homo Sapiens
WSGQMADGM

SEQ ID NO: 1250138 - protein, 9 aa, Homo Sapiens
ISKRTEYWD

SEQ ID NO: 1250139 - protein, 9 aa, Homo Sapiens
EAGWGDSGP

SEQ ID NO: 1250140 - protein, 9 aa, Homo Sapiens
SQHVRKLRV

SEQ ID NO: 1250141 - protein, 9 aa, Homo Sapiens
LRGLLDRQW

SEQ ID NO: 1250142 - protein, 9 aa, Homo Sapiens
CVWMFICII

SEQ ID NO: 1250143 - protein, 9 aa, Homo Sapiens
RADIDKNTD

SEQ ID NO: 1250144 - protein, 9 aa, Homo Sapiens
SGGDGPWGA

SEQ ID NO: 1250145 - protein, 9 aa, Homo Sapiens
ALDLVISKE

SEQ ID NO: 1250146 - protein, 9 aa, Homo Sapiens
ADAVRRSVM

SEQ ID NO: 1250147 - protein, 9 aa, Homo Sapiens
TFCESCLQN

SEQ ID NO: 1250148 - protein, 9 aa, Homo Sapiens
EECGLIQWK

SEQ ID NO: 1250149 - protein, 9 aa, Homo Sapiens
NSSLGYAIN

SEQ ID NO: 1250150 - protein, 9 aa, Homo Sapiens
ETMQPWQPL

SEQ ID NO: 1250151 - protein, 9 aa, Homo Sapiens
SVIGESYWL

SEQ ID NO: 1250152 - protein, 9 aa, Homo Sapiens
GFLRWLLEY

SEQ ID NO: 1250153 - protein, 9 aa, Homo Sapiens
KDSGQNTWL

SEQ ID NO: 1250154 - protein, 9 aa, Homo Sapiens
SSPYASKSE

SEQ ID NO: 1250155 - protein, 9 aa, Homo Sapiens
VPRDAGHLL

SEQ ID NO: 1250156 - protein, 9 aa, Homo Sapiens
DKYLKVNRF

SEQ ID NO: 1250157 - protein, 9 aa, Homo Sapiens
TLLGGRCGK

SEQ ID NO: 1250158 - protein, 9 aa, Homo Sapiens
RRLSQHQPR

SEQ ID NO: 1250159 - protein, 9 aa, Homo Sapiens
DFVLDIRMP

SEQ ID NO: 1250160 - protein, 9 aa, Homo Sapiens
AAKTVLAIC

SEQ ID NO: 1250161 - protein, 9 aa, Homo Sapiens
KLVVAASPS

SEQ ID NO: 1250162 - protein, 9 aa, Homo Sapiens
RITLSFQGR

SEQ ID NO: 1250163 - protein, 9 aa, Homo Sapiens
ISGGGGSTG

SEQ ID NO: 1250164 - protein, 9 aa, Homo Sapiens
TSITLAGNM

SEQ ID NO: 1250165 - protein, 9 aa, Homo Sapiens
KIIRAQLEF

SEQ ID NO: 1250166 - protein, 9 aa, Homo Sapiens
HCGMLREDA

SEQ ID NO: 1250167 - protein, 9 aa, Homo Sapiens
TCTTHFCAI

SEQ ID NO: 1250168 - protein, 9 aa, Homo Sapiens
HRISGGDHA

SEQ ID NO: 1250169 - protein, 9 aa, Homo Sapiens
ILPTPETVH

SEQ ID NO: 1250170 - protein, 9 aa, Homo Sapiens
LQESKSAVL

SEQ ID NO: 1250171 - protein, 9 aa, Homo Sapiens
MRNSATFKP

SEQ ID NO: 1250172 - protein, 9 aa, Homo Sapiens
LKSECHRIK

SEQ ID NO: 1250173 - protein, 9 aa, Homo Sapiens
PRKDSEHYA

SEQ ID NO: 1250174 - protein, 9 aa, Homo Sapiens
CVIRAMKKK

SEQ ID NO: 1250175 - protein, 9 aa, Homo Sapiens
TVSRAFNSL

SEQ ID NO: 1250176 - protein, 9 aa, Homo Sapiens
KKWAQEPSL

SEQ ID NO: 1250177 - protein, 9 aa, Homo Sapiens
HNTTASMGT

SEQ ID NO: 1250178 - protein, 9 aa, Homo Sapiens
TTPSPHPPP

SEQ ID NO: 1250179 - protein, 9 aa, Homo Sapiens
IYYTSFVVK

SEQ ID NO: 1250180 - protein, 9 aa, Homo Sapiens
AAIDVPVGH

SEQ ID NO: 1250181 - protein, 9 aa, Homo Sapiens
AILTGRAPG

SEQ ID NO: 1250182 - protein, 9 aa, Homo Sapiens
SSVKVWLAA

SEQ ID NO: 1250183 - protein, 9 aa, Homo Sapiens
PSATRARSK

SEQ ID NO: 1250184 - protein, 9 aa, Homo Sapiens
NIGLDQGQM

SEQ ID NO: 1250185 - protein, 9 aa, Homo Sapiens
ASVSTDLNG

SEQ ID NO: 1250186 - protein, 9 aa, Homo Sapiens
LLACSRDTL

SEQ ID NO: 1250187 - protein, 9 aa, Homo Sapiens
DRHMQLHMG

SEQ ID NO: 1250188 - protein, 9 aa, Homo Sapiens
LPGKPPFLI

SEQ ID NO: 1250189 - protein, 9 aa, Homo Sapiens
GVHQRVLHS

SEQ ID NO: 1250190 - protein, 9 aa, Homo Sapiens
GFTTLFTFI

SEQ ID NO: 1250191 - protein, 9 aa, Homo Sapiens
QAMIRSMDT

SEQ ID NO: 1250192 - protein, 9 aa, Homo Sapiens
SAYHAVEVD

SEQ ID NO: 1250193 - protein, 9 aa, Homo Sapiens
LLAKKWGSK

SEQ ID NO: 1250194 - protein, 9 aa, Homo Sapiens
NGEQLYLDP

SEQ ID NO: 1250195 - protein, 9 aa, Homo Sapiens
VTPGHFFAL

SEQ ID NO: 1250196 - protein, 9 aa, Homo Sapiens
AIDRYLCLH

SEQ ID NO: 1250197 - protein, 9 aa, Homo Sapiens
SQEPASSEV

SEQ ID NO: 1250198 - protein, 9 aa, Homo Sapiens
AGAFPMFPP

SEQ ID NO: 1250199 - protein, 9 aa, Homo Sapiens
GYGDRTSTI

SEQ ID NO: 1250200 - protein, 9 aa, Homo Sapiens
RRLHALEEQ

SEQ ID NO: 1250201 - protein, 9 aa, Homo Sapiens
SRTRQDLWE

SEQ ID NO: 1250202 - protein, 9 aa, Homo Sapiens
LWTVNGHPN

SEQ ID NO: 1250203 - protein, 9 aa, Homo Sapiens
IGCRLRKKI

SEQ ID NO: 1250204 - protein, 9 aa, Homo Sapiens
VGDATAPAG

SEQ ID NO: 1250205 - protein, 9 aa, Homo Sapiens
PPEKEARVW

SEQ ID NO: 1250206 - protein, 9 aa, Homo Sapiens
RSTLVMDWD

SEQ ID NO: 1250207 - protein, 9 aa, Homo Sapiens
KGHSTLGQG

SEQ ID NO: 1250208 - protein, 9 aa, Homo Sapiens
KVFVCAFSK

SEQ ID NO: 1250209 - protein, 9 aa, Homo Sapiens
ERDEVVKKL

SEQ ID NO: 1250210 - protein, 9 aa, Homo Sapiens
GFTENEVIQ

SEQ ID NO: 1250211 - protein, 9 aa, Homo Sapiens
FEYVRSFVT

SEQ ID NO: 1250212 - protein, 9 aa, Homo Sapiens
PPEEKDTKL

SEQ ID NO: 1250213 - protein, 9 aa, Homo Sapiens
SPIRHCSHS

SEQ ID NO: 1250214 - protein, 9 aa, Homo Sapiens
ELPWDALDL

SEQ ID NO: 1250215 - protein, 9 aa, Homo Sapiens
SDQKQHPVT

SEQ ID NO: 1250216 - protein, 9 aa, Homo Sapiens
PYLALHEDF

SEQ ID NO: 1250217 - protein, 9 aa, Homo Sapiens
NMAKLLSDL

SEQ ID NO: 1250218 - protein, 9 aa, Homo Sapiens
DPRLSRVTH

SEQ ID NO: 1250219 - protein, 9 aa, Homo Sapiens
LSMTTRIFL

SEQ ID NO: 1250220 - protein, 9 aa, Homo Sapiens
SVAVMHLRF

SEQ ID NO: 1250221 - protein, 9 aa, Homo Sapiens
MERLRVEMD

SEQ ID NO: 1250222 - protein, 9 aa, Homo Sapiens
LIWCLFFLI

SEQ ID NO: 1250223 - protein, 9 aa, Homo Sapiens
ILDVVEEEC

SEQ ID NO: 1250224 - protein, 9 aa, Homo Sapiens
LRLEHSNDP

SEQ ID NO: 1250225 - protein, 9 aa, Homo Sapiens
HWLYSLYDA

SEQ ID NO: 1250226 - protein, 9 aa, Homo Sapiens
DIDTSEPMY

SEQ ID NO: 1250227 - protein, 9 aa, Homo Sapiens
SPSQESGSQ

SEQ ID NO: 1250228 - protein, 9 aa, Homo Sapiens
SLAHRRFHS

SEQ ID NO: 1250229 - protein, 9 aa, Homo Sapiens
YSISYTLSR

SEQ ID NO: 1250230 - protein, 9 aa, Homo Sapiens
TLEPPAEDR

SEQ ID NO: 1250231 - protein, 9 aa, Homo Sapiens
LMKHKKSYI

SEQ ID NO: 1250232 - protein, 9 aa, Homo Sapiens
CKVSLVVNV

SEQ ID NO: 1250233 - protein, 9 aa, Homo Sapiens
LSNHISSMF

SEQ ID NO: 1250234 - protein, 9 aa, Homo Sapiens
QAMKLIVPR

SEQ ID NO: 1250235 - protein, 9 aa, Homo Sapiens
KLVCRAEKR

SEQ ID NO: 1250236 - protein, 9 aa, Homo Sapiens
EHLEQEHTN

SEQ ID NO: 1250237 - protein, 9 aa, Homo Sapiens
VHSDAANKS

SEQ ID NO: 1250238 - protein, 9 aa, Homo Sapiens
VSVEESAAT

SEQ ID NO: 1250239 - protein, 9 aa, Homo Sapiens
GGAGGEASN

SEQ ID NO: 1250240 - protein, 9 aa, Homo Sapiens
MENLCLESQ

SEQ ID NO: 1250241 - protein, 9 aa, Homo Sapiens
ARSEDHAVL

SEQ ID NO: 1250242 - protein, 9 aa, Homo Sapiens
LVKVLNDGG

SEQ ID NO: 1250243 - protein, 9 aa, Homo Sapiens
VCSFDHHCK

SEQ ID NO: 1250244 - protein, 9 aa, Homo Sapiens
TMVKCVKAV

SEQ ID NO: 1250245 - protein, 9 aa, Homo Sapiens
PHHMVRWVD

SEQ ID NO: 1250246 - protein, 9 aa, Homo Sapiens
EVHLLESKT

SEQ ID NO: 1250247 - protein, 9 aa, Homo Sapiens
EYTEVELKH

SEQ ID NO: 1250248 - protein, 9 aa, Homo Sapiens
NKEQQLKLM

SEQ ID NO: 1250249 - protein, 9 aa, Homo Sapiens
MPPKSVDQY

SEQ ID NO: 1250250 - protein, 9 aa, Homo Sapiens
HVADMNMCR

SEQ ID NO: 1250251 - protein, 9 aa, Homo Sapiens
VTSVAVRNA

SEQ ID NO: 1250252 - protein, 9 aa, Homo Sapiens
SANFLILMD

SEQ ID NO: 1250253 - protein, 9 aa, Homo Sapiens
ALHVVISLM

SEQ ID NO: 1250254 - protein, 9 aa, Homo Sapiens
KTLPVAQEI

SEQ ID NO: 1250255 - protein, 9 aa, Homo Sapiens
CHSDEHFRQ

SEQ ID NO: 1250256 - protein, 9 aa, Homo Sapiens
RFRENWQNN

SEQ ID NO: 1250257 - protein, 9 aa, Homo Sapiens
KPSSPVRLL

SEQ ID NO: 1250258 - protein, 9 aa, Homo Sapiens
EHKNQGTGT

SEQ ID NO: 1250259 - protein, 9 aa, Homo Sapiens
CPSGRRCRN

SEQ ID NO: 1250260 - protein, 9 aa, Homo Sapiens
RHIQLIMIF

SEQ ID NO: 1250261 - protein, 9 aa, Homo Sapiens
NLLTDDVEI

SEQ ID NO: 1250262 - protein, 9 aa, Homo Sapiens
HQTSVYLDA

SEQ ID NO: 1250263 - protein, 9 aa, Homo Sapiens
YCTSTLCHF

SEQ ID NO: 1250264 - protein, 9 aa, Homo Sapiens
CLICGNRQD

SEQ ID NO: 1250265 - protein, 9 aa, Homo Sapiens
SSSATSSPR

SEQ ID NO: 1250266 - protein, 9 aa, Homo Sapiens
SRRFDLLKT

SEQ ID NO: 1250267 - protein, 9 aa, Homo Sapiens
RRFHLNLKV

SEQ ID NO: 1250268 - protein, 9 aa, Homo Sapiens
MSGEVRFSI

SEQ ID NO: 1250269 - protein, 9 aa, Homo Sapiens
DQQHIHVYE

SEQ ID NO: 1250270 - protein, 9 aa, Homo Sapiens
CARYPKMYL

SEQ ID NO: 1250271 - protein, 9 aa, Homo Sapiens
RLSGEAYGF

SEQ ID NO: 1250272 - protein, 9 aa, Homo Sapiens
EEVLQKRLD

SEQ ID NO: 1250273 - protein, 9 aa, Homo Sapiens
PAEQRILLT

SEQ ID NO: 1250274 - protein, 9 aa, Homo Sapiens
SPRLSRVPA

SEQ ID NO: 1250275 - protein, 9 aa, Homo Sapiens
NLTMSYHSD

SEQ ID NO: 1250276 - protein, 9 aa, Homo Sapiens
KISECSQYQ

SEQ ID NO: 1250277 - protein, 9 aa, Homo Sapiens
HPPLKEGAD

SEQ ID NO: 1250278 - protein, 9 aa, Homo Sapiens
FWDYDNAFL

SEQ ID NO: 1250279 - protein, 9 aa, Homo Sapiens
QRGPRPLHR

SEQ ID NO: 1250280 - protein, 9 aa, Homo Sapiens
PPEEFGFSF

SEQ ID NO: 1250281 - protein, 9 aa, Homo Sapiens
EKHGWNWRS

SEQ ID NO: 1250282 - protein, 9 aa, Homo Sapiens
VAAVVCSQL

SEQ ID NO: 1250283 - protein, 9 aa, Homo Sapiens
SMYKRIGVS

SEQ ID NO: 1250284 - protein, 9 aa, Homo Sapiens
AMAYDHFIA

SEQ ID NO: 1250285 - protein, 9 aa, Homo Sapiens
HQMQQQNPE

SEQ ID NO: 1250286 - protein, 9 aa, Homo Sapiens
ADIDKNTDV

SEQ ID NO: 1250287 - protein, 9 aa, Homo Sapiens
KENVRTVVM

SEQ ID NO: 1250288 - protein, 9 aa, Homo Sapiens
RGMMRELLY

SEQ ID NO: 1250289 - protein, 9 aa, Homo Sapiens
MEKIHSAVG

SEQ ID NO: 1250290 - protein, 9 aa, Homo Sapiens
GMLTETMAR

SEQ ID NO: 1250291 - protein, 9 aa, Homo Sapiens
SEIQPAILQ

SEQ ID NO: 1250292 - protein, 9 aa, Homo Sapiens
RTHTILWVQ

SEQ ID NO: 1250293 - protein, 9 aa, Homo Sapiens
GHGPAETHT

SEQ ID NO: 1250294 - protein, 9 aa, Homo Sapiens
VDPRKDSEH

SEQ ID NO: 1250295 - protein, 9 aa, Homo Sapiens
APACTRWKQ

SEQ ID NO: 1250296 - protein, 9 aa, Homo Sapiens
MVHTSEKLY

SEQ ID NO: 1250297 - protein, 9 aa, Homo Sapiens
GIDEHDINF

SEQ ID NO: 1250298 - protein, 9 aa, Homo Sapiens
SYFHASITN

SEQ ID NO: 1250299 - protein, 9 aa, Homo Sapiens
IAMQINSYG

SEQ ID NO: 1250300 - protein, 9 aa, Homo Sapiens
CSVMVEAEG

SEQ ID NO: 1250301 - protein, 9 aa, Homo Sapiens
GLPTDANIF

SEQ ID NO: 1250302 - protein, 9 aa, Homo Sapiens
SAQKEGKNK

SEQ ID NO: 1250303 - protein, 9 aa, Homo Sapiens
LGGVTEVHV

SEQ ID NO: 1250304 - protein, 9 aa, Homo Sapiens
NIPQLNNVL

SEQ ID NO: 1250305 - protein, 9 aa, Homo Sapiens
PESICSDLE

SEQ ID NO: 1250306 - protein, 9 aa, Homo Sapiens
AVLEKRNYC

SEQ ID NO: 1250307 - protein, 9 aa, Homo Sapiens
LTASRTGTP

SEQ ID NO: 1250308 - protein, 9 aa, Homo Sapiens
TRMAVVMVL

SEQ ID NO: 1250309 - protein, 9 aa, Homo Sapiens
VQHLNSKFG

SEQ ID NO: 1250310 - protein, 9 aa, Homo Sapiens
DLCHQHATQ

SEQ ID NO: 1250311 - protein, 9 aa, Homo Sapiens
RRQEPAMRG

SEQ ID NO: 1250312 - protein, 9 aa, Homo Sapiens
CGKRRYCNT

SEQ ID NO: 1250313 - protein, 9 aa, Homo Sapiens
CVHVPPSVL

SEQ ID NO: 1250314 - protein, 9 aa, Homo Sapiens
ANPNITDVF

SEQ ID NO: 1250315 - protein, 9 aa, Homo Sapiens
IANCEKYGK

SEQ ID NO: 1250316 - protein, 9 aa, Homo Sapiens
QEFPGSPTF

SEQ ID NO: 1250317 - protein, 9 aa, Homo Sapiens
MCVCPFCQR

SEQ ID NO: 1250318 - protein, 9 aa, Homo Sapiens
IRTEICNLS

SEQ ID NO: 1250319 - protein, 9 aa, Homo Sapiens
HRTYLDIEH

SEQ ID NO: 1250320 - protein, 9 aa, Homo Sapiens
QTETHQGFP

SEQ ID NO: 1250321 - protein, 9 aa, Homo Sapiens
ECKHCFKKR

SEQ ID NO: 1250322 - protein, 9 aa, Homo Sapiens
IVRREWVLD

SEQ ID NO: 1250323 - protein, 9 aa, Homo Sapiens
RAEADAFMF

SEQ ID NO: 1250324 - protein, 9 aa, Homo Sapiens
HAIILDFYN

SEQ ID NO: 1250325 - protein, 9 aa, Homo Sapiens
DFANGTAQS

SEQ ID NO: 1250326 - protein, 9 aa, Homo Sapiens
IKTVQHKEV

SEQ ID NO: 1250327 - protein, 9 aa, Homo Sapiens
RESWMLHNN

SEQ ID NO: 1250328 - protein, 9 aa, Homo Sapiens
SHNETYRHI

SEQ ID NO: 1250329 - protein, 9 aa, Homo Sapiens
YYNMIAAKQ

SEQ ID NO: 1250330 - protein, 9 aa, Homo Sapiens
LGTQAEKDQ

SEQ ID NO: 1250331 - protein, 9 aa, Homo Sapiens
ITSALSTGQ

SEQ ID NO: 1250332 - protein, 9 aa, Homo Sapiens
LGISLLGVI

SEQ ID NO: 1250333 - protein, 9 aa, Homo Sapiens
RVQIARISA

SEQ ID NO: 1250334 - protein, 9 aa, Homo Sapiens
VIREGQARE

SEQ ID NO: 1250335 - protein, 9 aa, Homo Sapiens
SKQATKGKR

SEQ ID NO: 1250336 - protein, 9 aa, Homo Sapiens
LNPTFSKKF

SEQ ID NO: 1250337 - protein, 9 aa, Homo Sapiens
NMSGQPNFP

SEQ ID NO: 1250338 - protein, 9 aa, Homo Sapiens
GVPMLSIQP

SEQ ID NO: 1250339 - protein, 9 aa, Homo Sapiens
VILSGFFNT

SEQ ID NO: 1250340 - protein, 9 aa, Homo Sapiens
NQPRTESPP

SEQ ID NO: 1250341 - protein, 9 aa, Homo Sapiens
GQWHLGAAS

SEQ ID NO: 1250342 - protein, 9 aa, Homo Sapiens
INGSGQNKT

SEQ ID NO: 1250343 - protein, 9 aa, Homo Sapiens
YIDVCKPLH

SEQ ID NO: 1250344 - protein, 9 aa, Homo Sapiens
VVVDMIPGL

SEQ ID NO: 1250345 - protein, 9 aa, Homo Sapiens
ICTVSYEVR

SEQ ID NO: 1250346 - protein, 9 aa, Homo Sapiens
KVLPELIYY

SEQ ID NO: 1250347 - protein, 9 aa, Homo Sapiens
ARTECDQFS

SEQ ID NO: 1250348 - protein, 9 aa, Homo Sapiens
RPKPVTWKK

SEQ ID NO: 1250349 - protein, 9 aa, Homo Sapiens
CILGVMWSV

SEQ ID NO: 1250350 - protein, 9 aa, Homo Sapiens
LFITSVFML

SEQ ID NO: 1250351 - protein, 9 aa, Homo Sapiens
WLNSLLEEY

SEQ ID NO: 1250352 - protein, 9 aa, Homo Sapiens
NMHVIQVWF

SEQ ID NO: 1250353 - protein, 9 aa, Homo Sapiens
SDFASLTFE

SEQ ID NO: 1250354 - protein, 9 aa, Homo Sapiens
KCGYNKGYK

SEQ ID NO: 1250355 - protein, 9 aa, Homo Sapiens
VKNIKRCTY

SEQ ID NO: 1250356 - protein, 9 aa, Homo Sapiens
PAQAETEVE

SEQ ID NO: 1250357 - protein, 9 aa, Homo Sapiens
SPVFNAIFE

SEQ ID NO: 1250358 - protein, 9 aa, Homo Sapiens
GDSVASKYA

SEQ ID NO: 1250359 - protein, 9 aa, Homo Sapiens
IVTVWTLGF

SEQ ID NO: 1250360 - protein, 9 aa, Homo Sapiens
KPDPKTWKV

SEQ ID NO: 1250361 - protein, 9 aa, Homo Sapiens
SSMFREDQI

SEQ ID NO: 1250362 - protein, 9 aa, Homo Sapiens
VFTIYMGPW

SEQ ID NO: 1250363 - protein, 9 aa, Homo Sapiens
CCAYYNMIA

SEQ ID NO: 1250364 - protein, 9 aa, Homo Sapiens
SQNKQTFLV

SEQ ID NO: 1250365 - protein, 9 aa, Homo Sapiens
VVLKSIMKV

SEQ ID NO: 1250366 - protein, 9 aa, Homo Sapiens
WRTVPGHLE

SEQ ID NO: 1250367 - protein, 9 aa, Homo Sapiens
TLWKSKLLV

SEQ ID NO: 1250368 - protein, 9 aa, Homo Sapiens
HSPGMEPPF

SEQ ID NO: 1250369 - protein, 9 aa, Homo Sapiens
HLMLEELRN

SEQ ID NO: 1250370 - protein, 9 aa, Homo Sapiens
ELVWQLQLE

SEQ ID NO: 1250371 - protein, 9 aa, Homo Sapiens
FKKSKEITF

SEQ ID NO: 1250372 - protein, 9 aa, Homo Sapiens
FAQAMRMCA

SEQ ID NO: 1250373 - protein, 9 aa, Homo Sapiens
MRSLTEDKV

SEQ ID NO: 1250374 - protein, 9 aa, Homo Sapiens
LLPVLAISG

SEQ ID NO: 1250375 - protein, 9 aa, Homo Sapiens
IVDPAGEMT

SEQ ID NO: 1250376 - protein, 9 aa, Homo Sapiens
PAEATSWSC

SEQ ID NO: 1250377 - protein, 9 aa, Homo Sapiens
SSSQTPNPV

SEQ ID NO: 1250378 - protein, 9 aa, Homo Sapiens
SHVLEWLKY

SEQ ID NO: 1250379 - protein, 9 aa, Homo Sapiens
FLGMGVLFS

SEQ ID NO: 1250380 - protein, 9 aa, Homo Sapiens
HFKKGKIVL

SEQ ID NO: 1250381 - protein, 9 aa, Homo Sapiens
LDGHQQGVL

SEQ ID NO: 1250382 - protein, 9 aa, Homo Sapiens
DTTENENTK

SEQ ID NO: 1250383 - protein, 9 aa, Homo Sapiens
STCTTHFCA

SEQ ID NO: 1250384 - protein, 9 aa, Homo Sapiens
SREKAANDY

SEQ ID NO: 1250385 - protein, 9 aa, Homo Sapiens
SLKGAPDPC

SEQ ID NO: 1250386 - protein, 9 aa, Homo Sapiens
IQEIISHYE

SEQ ID NO: 1250387 - protein, 9 aa, Homo Sapiens
EPVTNSLKD

SEQ ID NO: 1250388 - protein, 9 aa, Homo Sapiens
QLENEVSMQ

SEQ ID NO: 1250389 - protein, 9 aa, Homo Sapiens
NEDGRHLRN

SEQ ID NO: 1250390 - protein, 9 aa, Homo Sapiens
AAILGITIG

SEQ ID NO: 1250391 - protein, 9 aa, Homo Sapiens
YESRCQNQD

SEQ ID NO: 1250392 - protein, 9 aa, Homo Sapiens
ENYPNVGLT

SEQ ID NO: 1250393 - protein, 9 aa, Homo Sapiens
GHYPSKCMV

SEQ ID NO: 1250394 - protein, 9 aa, Homo Sapiens
LPLQDLAFL

SEQ ID NO: 1250395 - protein, 9 aa, Homo Sapiens
EAVFIHGMH

SEQ ID NO: 1250396 - protein, 9 aa, Homo Sapiens
QHQGPVHLV

SEQ ID NO: 1250397 - protein, 9 aa, Homo Sapiens
PRKPIAHRH

SEQ ID NO: 1250398 - protein, 9 aa, Homo Sapiens
AESTVSTVG

SEQ ID NO: 1250399 - protein, 9 aa, Homo Sapiens
GPWGEPEIL

SEQ ID NO: 1250400 - protein, 9 aa, Homo Sapiens
NNPNAHGIF

SEQ ID NO: 1250401 - protein, 9 aa, Homo Sapiens
DMQMVAQPQ

SEQ ID NO: 1250402 - protein, 9 aa, Homo Sapiens
SQCTSPQLG

SEQ ID NO: 1250403 - protein, 9 aa, Homo Sapiens
RSWSSWGPL

SEQ ID NO: 1250404 - protein, 9 aa, Homo Sapiens
SLEEMKEVV

SEQ ID NO: 1250405 - protein, 9 aa, Homo Sapiens
PGKPFLYDN

SEQ ID NO: 1250406 - protein, 9 aa, Homo Sapiens
PSPPQPTLA

SEQ ID NO: 1250407 - protein, 9 aa, Homo Sapiens
HEGDAVYRV

SEQ ID NO: 1250408 - protein, 9 aa, Homo Sapiens
VQNTLLELM

SEQ ID NO: 1250409 - protein, 9 aa, Homo Sapiens
SRSHILEKK

SEQ ID NO: 1250410 - protein, 9 aa, Homo Sapiens
QNSVTDTNK

SEQ ID NO: 1250411 - protein, 9 aa, Homo Sapiens
SFLQQDRCL

SEQ ID NO: 1250412 - protein, 9 aa, Homo Sapiens
RERERYPDS

SEQ ID NO: 1250413 - protein, 9 aa, Homo Sapiens
NENFEIQQT

SEQ ID NO: 1250414 - protein, 9 aa, Homo Sapiens
CQKIACILP

SEQ ID NO: 1250415 - protein, 9 aa, Homo Sapiens
TRGPGICGS

SEQ ID NO: 1250416 - protein, 9 aa, Homo Sapiens
AVHAVLAYS

SEQ ID NO: 1250417 - protein, 9 aa, Homo Sapiens
KVSSQNRTH

SEQ ID NO: 1250418 - protein, 9 aa, Homo Sapiens
VQSMPKTCI

SEQ ID NO: 1250419 - protein, 9 aa, Homo Sapiens
HTIITDMEL

SEQ ID NO: 1250420 - protein, 9 aa, Homo Sapiens
TSQNLHNSY

SEQ ID NO: 1250421 - protein, 9 aa, Homo Sapiens
HFICIQDAM

SEQ ID NO: 1250422 - protein, 9 aa, Homo Sapiens
IDGFKKISS

SEQ ID NO: 1250423 - protein, 9 aa, Homo Sapiens
LVMLEIVTE

SEQ ID NO: 1250424 - protein, 9 aa, Homo Sapiens
ERMSSGLTD

SEQ ID NO: 1250425 - protein, 9 aa, Homo Sapiens
VKGSQLQKT

SEQ ID NO: 1250426 - protein, 9 aa, Homo Sapiens
ALGLRPTRK

SEQ ID NO: 1250427 - protein, 9 aa, Homo Sapiens
KAEKGEEKG

SEQ ID NO: 1250428 - protein, 9 aa, Homo Sapiens
RVLPGVDPN

SEQ ID NO: 1250429 - protein, 9 aa, Homo Sapiens
SFILSHWEN

SEQ ID NO: 1250430 - protein, 9 aa, Homo Sapiens
FHRCRHQSP

SEQ ID NO: 1250431 - protein, 9 aa, Homo Sapiens
DPMYGMCPL

SEQ ID NO: 1250432 - protein, 9 aa, Homo Sapiens
VVLQDASMD

SEQ ID NO: 1250433 - protein, 9 aa, Homo Sapiens
MEKTVQANK

SEQ ID NO: 1250434 - protein, 9 aa, Homo Sapiens
HGSTLSKSK

SEQ ID NO: 1250435 - protein, 9 aa, Homo Sapiens
EHRTYGAKS

SEQ ID NO: 1250436 - protein, 9 aa, Homo Sapiens
TKAESKPEE

SEQ ID NO: 1250437 - protein, 9 aa, Homo Sapiens
KRKTTMKQL

SEQ ID NO: 1250438 - protein, 9 aa, Homo Sapiens
EDNYGYDEC

SEQ ID NO: 1250439 - protein, 9 aa, Homo Sapiens
AFNSLGLLK

SEQ ID NO: 1250440 - protein, 9 aa, Homo Sapiens
TMYGNDEGH

SEQ ID NO: 1250441 - protein, 9 aa, Homo Sapiens
WGVQIANGM

SEQ ID NO: 1250442 - protein, 9 aa, Homo Sapiens
LTIVILFYS

SEQ ID NO: 1250443 - protein, 9 aa, Homo Sapiens
NEVTKLVNT

SEQ ID NO: 1250444 - protein, 9 aa, Homo Sapiens
FVQSMISNP

SEQ ID NO: 1250445 - protein, 9 aa, Homo Sapiens
MRKGIMAYS

SEQ ID NO: 1250446 - protein, 9 aa, Homo Sapiens
FILFIFKVA

SEQ ID NO: 1250447 - protein, 9 aa, Homo Sapiens
ATALDLVRQ

SEQ ID NO: 1250448 - protein, 9 aa, Homo Sapiens
TTQLAKIRP

SEQ ID NO: 1250449 - protein, 9 aa, Homo Sapiens
YRHIVKVDL

SEQ ID NO: 1250450 - protein, 9 aa, Homo Sapiens
QANTRKRDI

SEQ ID NO: 1250451 - protein, 9 aa, Homo Sapiens
DSVIMFDQS

SEQ ID NO: 1250452 - protein, 9 aa, Homo Sapiens
LKSFLLSMK

SEQ ID NO: 1250453 - protein, 9 aa, Homo Sapiens
NLSPKASHC

SEQ ID NO: 1250454 - protein, 9 aa, Homo Sapiens
EDLLFHGEA

SEQ ID NO: 1250455 - protein, 9 aa, Homo Sapiens
EAGKSTTFK

SEQ ID NO: 1250456 - protein, 9 aa, Homo Sapiens
THLPRQPST

SEQ ID NO: 1250457 - protein, 9 aa, Homo Sapiens
YYILAEPWR

SEQ ID NO: 1250458 - protein, 9 aa, Homo Sapiens
RFEEAKTLS

SEQ ID NO: 1250459 - protein, 9 aa, Homo Sapiens
YPDVLPSHL

SEQ ID NO: 1250460 - protein, 9 aa, Homo Sapiens
YDKPLNNEW

SEQ ID NO: 1250461 - protein, 9 aa, Homo Sapiens
PAATLVSAM

SEQ ID NO: 1250462 - protein, 9 aa, Homo Sapiens
LWNMTSSWP

SEQ ID NO: 1250463 - protein, 9 aa, Homo Sapiens
FMCMEACGT

SEQ ID NO: 1250464 - protein, 9 aa, Homo Sapiens
QVLKENGSM

SEQ ID NO: 1250465 - protein, 9 aa, Homo Sapiens
TKERPATDL

SEQ ID NO: 1250466 - protein, 9 aa, Homo Sapiens
QLREQWKKV

SEQ ID NO: 1250467 - protein, 9 aa, Homo Sapiens
DAVAMDFSQ

SEQ ID NO: 1250468 - protein, 9 aa, Homo Sapiens
GRRCRNGEN

SEQ ID NO: 1250469 - protein, 9 aa, Homo Sapiens
SCYNCGRGG

SEQ ID NO: 1250470 - protein, 9 aa, Homo Sapiens
SIASTDTPS

SEQ ID NO: 1250471 - protein, 9 aa, Homo Sapiens
RRRMSPSNS

SEQ ID NO: 1250472 - protein, 9 aa, Homo Sapiens
EFLGQSDGV

SEQ ID NO: 1250473 - protein, 9 aa, Homo Sapiens
IVRIPYILS

SEQ ID NO: 1250474 - protein, 9 aa, Homo Sapiens
DSGDCCTST

SEQ ID NO: 1250475 - protein, 9 aa, Homo Sapiens
VHAGKVAEE

SEQ ID NO: 1250476 - protein, 9 aa, Homo Sapiens
EKIHNGVIH

SEQ ID NO: 1250477 - protein, 9 aa, Homo Sapiens
PNHCLAPEN

SEQ ID NO: 1250478 - protein, 9 aa, Homo Sapiens
WNSKVAAVV

SEQ ID NO: 1250479 - protein, 9 aa, Homo Sapiens
LPQPLPRST

SEQ ID NO: 1250480 - protein, 9 aa, Homo Sapiens
EKERLVRQR

SEQ ID NO: 1250481 - protein, 9 aa, Homo Sapiens
EVSLHFLKR

SEQ ID NO: 1250482 - protein, 9 aa, Homo Sapiens
RLTRSKGVG

SEQ ID NO: 1250483 - protein, 9 aa, Homo Sapiens
VLVPTMFQY

SEQ ID NO: 1250484 - protein, 9 aa, Homo Sapiens
PGSCPVGTG

SEQ ID NO: 1250485 - protein, 9 aa, Homo Sapiens
ASPESLGYL

SEQ ID NO: 1250486 - protein, 9 aa, Homo Sapiens
KKSRKNEIK

SEQ ID NO: 1250487 - protein, 9 aa, Homo Sapiens
STLSHDTRR

SEQ ID NO: 1250488 - protein, 9 aa, Homo Sapiens
MVPGRPAAS

SEQ ID NO: 1250489 - protein, 9 aa, Homo Sapiens
LSIQQQEGM

SEQ ID NO: 1250490 - protein, 9 aa, Homo Sapiens
DNEFHCQEQ

SEQ ID NO: 1250491 - protein, 9 aa, Homo Sapiens
GTIQLCDMR

SEQ ID NO: 1250492 - protein, 9 aa, Homo Sapiens
LKVTEVKEG

SEQ ID NO: 1250493 - protein, 9 aa, Homo Sapiens
QLEACGMRC

SEQ ID NO: 1250494 - protein, 9 aa, Homo Sapiens
LACSCSTST

SEQ ID NO: 1250495 - protein, 9 aa, Homo Sapiens
TVLAMISVT

SEQ ID NO: 1250496 - protein, 9 aa, Homo Sapiens
WFTMVITVE

SEQ ID NO: 1250497 - protein, 9 aa, Homo Sapiens
VTELFMFDF

SEQ ID NO: 1250498 - protein, 9 aa, Homo Sapiens
SSMAVVIPE

SEQ ID NO: 1250499 - protein, 9 aa, Homo Sapiens
RSLPGAVPS

SEQ ID NO: 1250500 - protein, 9 aa, Homo Sapiens
GNDFDNDCN

SEQ ID NO: 1250501 - protein, 9 aa, Homo Sapiens
NDEKKMDIF

SEQ ID NO: 1250502 - protein, 9 aa, Homo Sapiens
LVVHLLQFQ

SEQ ID NO: 1250503 - protein, 9 aa, Homo Sapiens
YRCFTKHKN

SEQ ID NO: 1250504 - protein, 9 aa, Homo Sapiens
YIHRQCKEG

SEQ ID NO: 1250505 - protein, 9 aa, Homo Sapiens
FLRWLLEYV

SEQ ID NO: 1250506 - protein, 9 aa, Homo Sapiens
LSILVLAGN

SEQ ID NO: 1250507 - protein, 9 aa, Homo Sapiens
LTEETFNAA

SEQ ID NO: 1250508 - protein, 9 aa, Homo Sapiens
GVKFVETPR

SEQ ID NO: 1250509 - protein, 9 aa, Homo Sapiens
YAVNRRLAQ

SEQ ID NO: 1250510 - protein, 9 aa, Homo Sapiens
IKEAFELFD

SEQ ID NO: 1250511 - protein, 9 aa, Homo Sapiens
SLKEAHCLI

SEQ ID NO: 1250512 - protein, 9 aa, Homo Sapiens
AQVVQVILD

SEQ ID NO: 1250513 - protein, 9 aa, Homo Sapiens
SIIVGAGYI

SEQ ID NO: 1250514 - protein, 9 aa, Homo Sapiens
SMNIIGLEI

SEQ ID NO: 1250515 - protein, 9 aa, Homo Sapiens
CSAPFIMDT

SEQ ID NO: 1250516 - protein, 9 aa, Homo Sapiens
VSTHVLPGG

SEQ ID NO: 1250517 - protein, 9 aa, Homo Sapiens
TEACYFRVQ

SEQ ID NO: 1250518 - protein, 9 aa, Homo Sapiens
DDFCQPPDF

SEQ ID NO: 1250519 - protein, 9 aa, Homo Sapiens
QGECLNTDG

SEQ ID NO: 1250520 - protein, 9 aa, Homo Sapiens
RKHSREHKR

SEQ ID NO: 1250521 - protein, 9 aa, Homo Sapiens
NGPDADALI

SEQ ID NO: 1250522 - protein, 9 aa, Homo Sapiens
RKWPSTLYT

SEQ ID NO: 1250523 - protein, 9 aa, Homo Sapiens
TRHIWDSPA

SEQ ID NO: 1250524 - protein, 9 aa, Homo Sapiens
TDVAIQTIE

SEQ ID NO: 1250525 - protein, 9 aa, Homo Sapiens
TPIVGDQEQ

SEQ ID NO: 1250526 - protein, 9 aa, Homo Sapiens
EIWRMYAHV

SEQ ID NO: 1250527 - protein, 9 aa, Homo Sapiens
KLEILDESD

SEQ ID NO: 1250528 - protein, 9 aa, Homo Sapiens
QFFITYGIQ

SEQ ID NO: 1250529 - protein, 9 aa, Homo Sapiens
WLAPELYNG

SEQ ID NO: 1250530 - protein, 9 aa, Homo Sapiens
INRYDKVRS

SEQ ID NO: 1250531 - protein, 9 aa, Homo Sapiens
LLNGEQTEA

SEQ ID NO: 1250532 - protein, 9 aa, Homo Sapiens
RVPHSCALQ

SEQ ID NO: 1250533 - protein, 9 aa, Homo Sapiens
HCVIKNATY

SEQ ID NO: 1250534 - protein, 9 aa, Homo Sapiens
FVERGQQYF

SEQ ID NO: 1250535 - protein, 9 aa, Homo Sapiens
KQDGAIENC

SEQ ID NO: 1250536 - protein, 9 aa, Homo Sapiens
NKMMDKLKT

SEQ ID NO: 1250537 - protein, 9 aa, Homo Sapiens
CCIKHYNTG

SEQ ID NO: 1250538 - protein, 9 aa, Homo Sapiens
QYEVTWGIN

SEQ ID NO: 1250539 - protein, 9 aa, Homo Sapiens
SSLAIPDDF

SEQ ID NO: 1250540 - protein, 9 aa, Homo Sapiens
GVCISKKKT

SEQ ID NO: 1250541 - protein, 9 aa, Homo Sapiens
MGYCRTGSL

SEQ ID NO: 1250542 - protein, 9 aa, Homo Sapiens
IDDYSLCGL

SEQ ID NO: 1250543 - protein, 9 aa, Homo Sapiens
MAHLQIQSP

SEQ ID NO: 1250544 - protein, 9 aa, Homo Sapiens
LHYPSIMAG

SEQ ID NO: 1250545 - protein, 9 aa, Homo Sapiens
CMVGAGVCV

SEQ ID NO: 1250546 - protein, 9 aa, Homo Sapiens
NASGSVMIQ

SEQ ID NO: 1250547 - protein, 9 aa, Homo Sapiens
RRYIMEKTV

SEQ ID NO: 1250548 - protein, 9 aa, Homo Sapiens
MKFRNTIGN

SEQ ID NO: 1250549 - protein, 9 aa, Homo Sapiens
CIVIPGNGA

SEQ ID NO: 1250550 - protein, 9 aa, Homo Sapiens
NEMLTLAEY

SEQ ID NO: 1250551 - protein, 9 aa, Homo Sapiens
CKNVSVSIS

SEQ ID NO: 1250552 - protein, 9 aa, Homo Sapiens
KYDSVSNYQ

SEQ ID NO: 1250553 - protein, 9 aa, Homo Sapiens
HSCIGEILA

SEQ ID NO: 1250554 - protein, 9 aa, Homo Sapiens
WWFCLLWTV

SEQ ID NO: 1250555 - protein, 9 aa, Homo Sapiens
VSVALGTVE

SEQ ID NO: 1250556 - protein, 9 aa, Homo Sapiens
ENGSNGTIK

SEQ ID NO: 1250557 - protein, 9 aa, Homo Sapiens
PHGLAPFPR

SEQ ID NO: 1250558 - protein, 9 aa, Homo Sapiens
TAIQEPMLN

SEQ ID NO: 1250559 - protein, 9 aa, Homo Sapiens
QKIHTRKHY

SEQ ID NO: 1250560 - protein, 9 aa, Homo Sapiens
TGASTLVIS

SEQ ID NO: 1250561 - protein, 9 aa, Homo Sapiens
SLMGMALLA

SEQ ID NO: 1250562 - protein, 9 aa, Homo Sapiens
HQSVTPPQC

SEQ ID NO: 1250563 - protein, 9 aa, Homo Sapiens
CECEAFMVS

SEQ ID NO: 1250564 - protein, 9 aa, Homo Sapiens
ERERIWMQS

SEQ ID NO: 1250565 - protein, 9 aa, Homo Sapiens
LHLAYVTIM

SEQ ID NO: 1250566 - protein, 9 aa, Homo Sapiens
NDFSKHILN

SEQ ID NO: 1250567 - protein, 9 aa, Homo Sapiens
IIIQLRAQK

SEQ ID NO: 1250568 - protein, 9 aa, Homo Sapiens
VPARAGLDG

SEQ ID NO: 1250569 - protein, 9 aa, Homo Sapiens
KRVHQEEKH

SEQ ID NO: 1250570 - protein, 9 aa, Homo Sapiens
CEECGKAFE

SEQ ID NO: 1250571 - protein, 9 aa, Homo Sapiens
NHAEDLAPK

SEQ ID NO: 1250572 - protein, 9 aa, Homo Sapiens
TQCAGGVRT

SEQ ID NO: 1250573 - protein, 9 aa, Homo Sapiens
TKISLIKSH

SEQ ID NO: 1250574 - protein, 9 aa, Homo Sapiens
NCSVGATNM

SEQ ID NO: 1250575 - protein, 9 aa, Homo Sapiens
WVLYHNLHI

SEQ ID NO: 1250576 - protein, 9 aa, Homo Sapiens
HCEICMAAG

SEQ ID NO: 1250577 - protein, 9 aa, Homo Sapiens
PREYFIHGT

SEQ ID NO: 1250578 - protein, 9 aa, Homo Sapiens
SSRTWASPC

SEQ ID NO: 1250579 - protein, 9 aa, Homo Sapiens
LVLILVFGV

SEQ ID NO: 1250580 - protein, 9 aa, Homo Sapiens
LTGFCSWSI

SEQ ID NO: 1250581 - protein, 9 aa, Homo Sapiens
SIDPNCNVP

SEQ ID NO: 1250582 - protein, 9 aa, Homo Sapiens
TSSTRKVSL

SEQ ID NO: 1250583 - protein, 9 aa, Homo Sapiens
RLRLYYDIL

SEQ ID NO: 1250584 - protein, 9 aa, Homo Sapiens
CTGNRKTVL

SEQ ID NO: 1250585 - protein, 9 aa, Homo Sapiens
NIFRKLKVL

SEQ ID NO: 1250586 - protein, 9 aa, Homo Sapiens
GKPDFFSSM

SEQ ID NO: 1250587 - protein, 9 aa, Homo Sapiens
PAQEAPLWV

SEQ ID NO: 1250588 - protein, 9 aa, Homo Sapiens
LNLCVISID

SEQ ID NO: 1250589 - protein, 9 aa, Homo Sapiens
QDSPKCFDV

SEQ ID NO: 1250590 - protein, 9 aa, Homo Sapiens
YITMDPVQK

SEQ ID NO: 1250591 - protein, 9 aa, Homo Sapiens
SITCHRSSS

SEQ ID NO: 1250592 - protein, 9 aa, Homo Sapiens
STPSTRSPL

SEQ ID NO: 1250593 - protein, 9 aa, Homo Sapiens
DFLSVRPVS

SEQ ID NO: 1250594 - protein, 9 aa, Homo Sapiens
GPDGQTQKR

SEQ ID NO: 1250595 - protein, 9 aa, Homo Sapiens
LDVLTNVFR

SEQ ID NO: 1250596 - protein, 9 aa, Homo Sapiens
NDAELDRRI

SEQ ID NO: 1250597 - protein, 9 aa, Homo Sapiens
GTITKRTGH

SEQ ID NO: 1250598 - protein, 9 aa, Homo Sapiens
VNEILRNDL

SEQ ID NO: 1250599 - protein, 9 aa, Homo Sapiens
HVYVTIMDE

SEQ ID NO: 1250600 - protein, 9 aa, Homo Sapiens
PVRVKRRKQ

SEQ ID NO: 1250601 - protein, 9 aa, Homo Sapiens
QGHWKANCP

SEQ ID NO: 1250602 - protein, 9 aa, Homo Sapiens
KGNAKSKVH

SEQ ID NO: 1250603 - protein, 9 aa, Homo Sapiens
DSSSHFKVT

SEQ ID NO: 1250604 - protein, 9 aa, Homo Sapiens
SDIPPPSLK

SEQ ID NO: 1250605 - protein, 9 aa, Homo Sapiens
FAEVTELDN

SEQ ID NO: 1250606 - protein, 9 aa, Homo Sapiens
GQMATYFAP

SEQ ID NO: 1250607 - protein, 9 aa, Homo Sapiens
SSPAHSPSP

SEQ ID NO: 1250608 - protein, 9 aa, Homo Sapiens
PKQCCMLLK

SEQ ID NO: 1250609 - protein, 9 aa, Homo Sapiens
DEAIMAEEK

SEQ ID NO: 1250610 - protein, 9 aa, Homo Sapiens
LNHSLAYQK

SEQ ID NO: 1250611 - protein, 9 aa, Homo Sapiens
EKSYKCYQY

SEQ ID NO: 1250612 - protein, 9 aa, Homo Sapiens
LIVHEGDAV

SEQ ID NO: 1250613 - protein, 9 aa, Homo Sapiens
VCAGISYST

SEQ ID NO: 1250614 - protein, 9 aa, Homo Sapiens
GPNQLCIRH

SEQ ID NO: 1250615 - protein, 9 aa, Homo Sapiens
WHGTMTLSK

SEQ ID NO: 1250616 - protein, 9 aa, Homo Sapiens
VLYMPGFLA

SEQ ID NO: 1250617 - protein, 9 aa, Homo Sapiens
TPRLSRNKI

SEQ ID NO: 1250618 - protein, 9 aa, Homo Sapiens
RTGAWGPPA

SEQ ID NO: 1250619 - protein, 9 aa, Homo Sapiens
EVWRSRRDR

SEQ ID NO: 1250620 - protein, 9 aa, Homo Sapiens
YHVLWDDNH

SEQ ID NO: 1250621 - protein, 9 aa, Homo Sapiens
ALRVVVDRV

SEQ ID NO: 1250622 - protein, 9 aa, Homo Sapiens
DSLVKRQRT

SEQ ID NO: 1250623 - protein, 9 aa, Homo Sapiens
RCRQDDDQR

SEQ ID NO: 1250624 - protein, 9 aa, Homo Sapiens
DRRNQDQRS

SEQ ID NO: 1250625 - protein, 9 aa, Homo Sapiens
YASGRTIGI

SEQ ID NO: 1250626 - protein, 9 aa, Homo Sapiens
ENIGLNAPV

SEQ ID NO: 1250627 - protein, 9 aa, Homo Sapiens
APYWMAPEV

SEQ ID NO: 1250628 - protein, 9 aa, Homo Sapiens
RRPPHSPGM

SEQ ID NO: 1250629 - protein, 9 aa, Homo Sapiens
AVSPGCRDT

SEQ ID NO: 1250630 - protein, 9 aa, Homo Sapiens
LRLQTLEIH

SEQ ID NO: 1250631 - protein, 9 aa, Homo Sapiens
TIAGFQTHT

SEQ ID NO: 1250632 - protein, 9 aa, Homo Sapiens
DPTGTVIML

SEQ ID NO: 1250633 - protein, 9 aa, Homo Sapiens
VQEHQGKAK

SEQ ID NO: 1250634 - protein, 9 aa, Homo Sapiens
SIRKMECHD

SEQ ID NO: 1250635 - protein, 9 aa, Homo Sapiens
MKHKKSYIL

SEQ ID NO: 1250636 - protein, 9 aa, Homo Sapiens
CSEGGEVII

SEQ ID NO: 1250637 - protein, 9 aa, Homo Sapiens
VIRAMKKKG

SEQ ID NO: 1250638 - protein, 9 aa, Homo Sapiens
KGLATVIRC

SEQ ID NO: 1250639 - protein, 9 aa, Homo Sapiens
AHGDPAPPS

SEQ ID NO: 1250640 - protein, 9 aa, Homo Sapiens
EILSQLEEE

SEQ ID NO: 1250641 - protein, 9 aa, Homo Sapiens
LSKDWGWVE

SEQ ID NO: 1250642 - protein, 9 aa, Homo Sapiens
EQIQALHQY

SEQ ID NO: 1250643 - protein, 9 aa, Homo Sapiens
HTQNIMDQM

SEQ ID NO: 1250644 - protein, 9 aa, Homo Sapiens
ILRNVIKGQ

SEQ ID NO: 1250645 - protein, 9 aa, Homo Sapiens
EQSAASITI

SEQ ID NO: 1250646 - protein, 9 aa, Homo Sapiens
QRKLKYEWM

SEQ ID NO: 1250647 - protein, 9 aa, Homo Sapiens
DLEEWLKNL

SEQ ID NO: 1250648 - protein, 9 aa, Homo Sapiens
LTPPHRVSR

SEQ ID NO: 1250649 - protein, 9 aa, Homo Sapiens
MRGQILNLI

SEQ ID NO: 1250650 - protein, 9 aa, Homo Sapiens
KCLRLADME

SEQ ID NO: 1250651 - protein, 9 aa, Homo Sapiens
DESPEMAEN

SEQ ID NO: 1250652 - protein, 9 aa, Homo Sapiens
SRSAEPPSA

SEQ ID NO: 1250653 - protein, 9 aa, Homo Sapiens
HMQLHMGIT

SEQ ID NO: 1250654 - protein, 9 aa, Homo Sapiens
VGTSEFLGP

SEQ ID NO: 1250655 - protein, 9 aa, Homo Sapiens
HSGAGTLHP

SEQ ID NO: 1250656 - protein, 9 aa, Homo Sapiens
YMCNDCGKA

SEQ ID NO: 1250657 - protein, 9 aa, Homo Sapiens
WTISHAGHV

SEQ ID NO: 1250658 - protein, 9 aa, Homo Sapiens
SLPSEILGP

SEQ ID NO: 1250659 - protein, 9 aa, Homo Sapiens
NVFSPMCTS

SEQ ID NO: 1250660 - protein, 9 aa, Homo Sapiens
YFILGADPH

SEQ ID NO: 1250661 - protein, 9 aa, Homo Sapiens
WNLGGSRED

SEQ ID NO: 1250662 - protein, 9 aa, Homo Sapiens
WYEMRLLKC

SEQ ID NO: 1250663 - protein, 9 aa, Homo Sapiens
NVLPHPTPP

SEQ ID NO: 1250664 - protein, 9 aa, Homo Sapiens
MYDVTKEVP

SEQ ID NO: 1250665 - protein, 9 aa, Homo Sapiens
SFFSVNCSI

SEQ ID NO: 1250666 - protein, 9 aa, Homo Sapiens
KKVVSKSKV

SEQ ID NO: 1250667 - protein, 9 aa, Homo Sapiens
IGVSAWLNH

SEQ ID NO: 1250668 - protein, 9 aa, Homo Sapiens
IYEMSRGEH

SEQ ID NO: 1250669 - protein, 9 aa, Homo Sapiens
DEKDLGCCI

SEQ ID NO: 1250670 - protein, 9 aa, Homo Sapiens
MQSLSGECR

SEQ ID NO: 1250671 - protein, 9 aa, Homo Sapiens
ITATLEKLP

SEQ ID NO: 1250672 - protein, 9 aa, Homo Sapiens
SMQSQITRI

SEQ ID NO: 1250673 - protein, 9 aa, Homo Sapiens
VAEKLHVAA

SEQ ID NO: 1250674 - protein, 9 aa, Homo Sapiens
LVSRFAGSI

SEQ ID NO: 1250675 - protein, 9 aa, Homo Sapiens
PFRHVLQPP

SEQ ID NO: 1250676 - protein, 9 aa, Homo Sapiens
DTFKNSFVE

SEQ ID NO: 1250677 - protein, 9 aa, Homo Sapiens
CCGQASAPL

SEQ ID NO: 1250678 - protein, 9 aa, Homo Sapiens
LSIIVLLLL

SEQ ID NO: 1250679 - protein, 9 aa, Homo Sapiens
RSSWLPTLP

SEQ ID NO: 1250680 - protein, 9 aa, Homo Sapiens
PHGSITRDS

SEQ ID NO: 1250681 - protein, 9 aa, Homo Sapiens
LLGDAGMQL

SEQ ID NO: 1250682 - protein, 9 aa, Homo Sapiens
LGMLQMNDL

SEQ ID NO: 1250683 - protein, 9 aa, Homo Sapiens
DGDDNFRYF

SEQ ID NO: 1250684 - protein, 9 aa, Homo Sapiens
EDLARMELF

SEQ ID NO: 1250685 - protein, 9 aa, Homo Sapiens
ICHYFMCLL

SEQ ID NO: 1250686 - protein, 9 aa, Homo Sapiens
HHLPRLCGP

SEQ ID NO: 1250687 - protein, 9 aa, Homo Sapiens
WYPGFNCEF

SEQ ID NO: 1250688 - protein, 9 aa, Homo Sapiens
HYAQENFKS

SEQ ID NO: 1250689 - protein, 9 aa, Homo Sapiens
LKKHTASFE

SEQ ID NO: 1250690 - protein, 9 aa, Homo Sapiens
DNGLRNPVS

SEQ ID NO: 1250691 - protein, 9 aa, Homo Sapiens
QFKDTNKSC

SEQ ID NO: 1250692 - protein, 9 aa, Homo Sapiens
NTKIWFVIE

SEQ ID NO: 1250693 - protein, 9 aa, Homo Sapiens
HHLAFNQPS

SEQ ID NO: 1250694 - protein, 9 aa, Homo Sapiens
TAYELLWGW

SEQ ID NO: 1250695 - protein, 9 aa, Homo Sapiens
LLHQQSENQ

SEQ ID NO: 1250696 - protein, 9 aa, Homo Sapiens
ICLLRWMRR

SEQ ID NO: 1250697 - protein, 9 aa, Homo Sapiens
LAQSQDLSC

SEQ ID NO: 1250698 - protein, 9 aa, Homo Sapiens
FDHYYRSHN

SEQ ID NO: 1250699 - protein, 9 aa, Homo Sapiens
GADLDPHRV

SEQ ID NO: 1250700 - protein, 9 aa, Homo Sapiens
SNGAEGPTP

SEQ ID NO: 1250701 - protein, 9 aa, Homo Sapiens
IDDYTVMPE

SEQ ID NO: 1250702 - protein, 9 aa, Homo Sapiens
AQKLTTALI

SEQ ID NO: 1250703 - protein, 9 aa, Homo Sapiens
PVREQYKTD

SEQ ID NO: 1250704 - protein, 9 aa, Homo Sapiens
SECLRYEDT

SEQ ID NO: 1250705 - protein, 9 aa, Homo Sapiens
VLYGTSMQP

SEQ ID NO: 1250706 - protein, 9 aa, Homo Sapiens
HCDTNKKEE

SEQ ID NO: 1250707 - protein, 9 aa, Homo Sapiens
SGQPREIRQ

SEQ ID NO: 1250708 - protein, 9 aa, Homo Sapiens
TRIIHTALI

SEQ ID NO: 1250709 - protein, 9 aa, Homo Sapiens
WDRRRQLRA

SEQ ID NO: 1250710 - protein, 9 aa, Homo Sapiens
FVSVSFLLL

SEQ ID NO: 1250711 - protein, 9 aa, Homo Sapiens
AVGQEDGLG

SEQ ID NO: 1250712 - protein, 9 aa, Homo Sapiens
YGNLLDHLR

SEQ ID NO: 1250713 - protein, 9 aa, Homo Sapiens
VLPAGPPHH

SEQ ID NO: 1250714 - protein, 9 aa, Homo Sapiens
RYQEVAGPR

SEQ ID NO: 1250715 - protein, 9 aa, Homo Sapiens
DTMTPGELL

SEQ ID NO: 1250716 - protein, 9 aa, Homo Sapiens
KLEGPGPSL

SEQ ID NO: 1250717 - protein, 9 aa, Homo Sapiens
LSSHLALAD

SEQ ID NO: 1250718 - protein, 9 aa, Homo Sapiens
GKVRHKRHA

SEQ ID NO: 1250719 - protein, 9 aa, Homo Sapiens
RLWAILQNQ

SEQ ID NO: 1250720 - protein, 9 aa, Homo Sapiens
GPGICGSFL

SEQ ID NO: 1250721 - protein, 9 aa, Homo Sapiens
GSQEYVKVI

SEQ ID NO: 1250722 - protein, 9 aa, Homo Sapiens
HAQDYPSPN

SEQ ID NO: 1250723 - protein, 9 aa, Homo Sapiens
KVGAVFYSI

SEQ ID NO: 1250724 - protein, 9 aa, Homo Sapiens
LVTTIIAPM

SEQ ID NO: 1250725 - protein, 9 aa, Homo Sapiens
KKYDLCALL

SEQ ID NO: 1250726 - protein, 9 aa, Homo Sapiens
DNVKFRKIT

SEQ ID NO: 1250727 - protein, 9 aa, Homo Sapiens
LYPSEHRPS

SEQ ID NO: 1250728 - protein, 9 aa, Homo Sapiens
LDYHRALCT

SEQ ID NO: 1250729 - protein, 9 aa, Homo Sapiens
QCRDQFKDT

SEQ ID NO: 1250730 - protein, 9 aa, Homo Sapiens
GSCPVGTGM

SEQ ID NO: 1250731 - protein, 9 aa, Homo Sapiens
SSDGQEHFS

SEQ ID NO: 1250732 - protein, 9 aa, Homo Sapiens
RFSSLYSFS

SEQ ID NO: 1250733 - protein, 9 aa, Homo Sapiens
DAFMNQEIT

SEQ ID NO: 1250734 - protein, 9 aa, Homo Sapiens
VTRDSQKDY

SEQ ID NO: 1250735 - protein, 9 aa, Homo Sapiens
RGMRPLQRR

SEQ ID NO: 1250736 - protein, 9 aa, Homo Sapiens
TEAAINAFH

SEQ ID NO: 1250737 - protein, 9 aa, Homo Sapiens
HCVDKFDII

SEQ ID NO: 1250738 - protein, 9 aa, Homo Sapiens
TMRQQPMHQ

SEQ ID NO: 1250739 - protein, 9 aa, Homo Sapiens
LPGTCTGNR

SEQ ID NO: 1250740 - protein, 9 aa, Homo Sapiens
IHHCLNACI

SEQ ID NO: 1250741 - protein, 9 aa, Homo Sapiens
LWDINTHIT

SEQ ID NO: 1250742 - protein, 9 aa, Homo Sapiens
LAVNFCGWA

SEQ ID NO: 1250743 - protein, 9 aa, Homo Sapiens
VKGLRKGDV

SEQ ID NO: 1250744 - protein, 9 aa, Homo Sapiens
NRIGHSQSA

SEQ ID NO: 1250745 - protein, 9 aa, Homo Sapiens
GTCTGNRKT

SEQ ID NO: 1250746 - protein, 9 aa, Homo Sapiens
FLLTMDACY

SEQ ID NO: 1250747 - protein, 9 aa, Homo Sapiens
SCRREDPEE

SEQ ID NO: 1250748 - protein, 9 aa, Homo Sapiens
GKPFMSVFR

SEQ ID NO: 1250749 - protein, 9 aa, Homo Sapiens
NTLGRSAPP

SEQ ID NO: 1250750 - protein, 9 aa, Homo Sapiens
RYGRHKQYP

SEQ ID NO: 1250751 - protein, 9 aa, Homo Sapiens
NRSAHNAPS

SEQ ID NO: 1250752 - protein, 9 aa, Homo Sapiens
AASVSTDLN

SEQ ID NO: 1250753 - protein, 9 aa, Homo Sapiens
WTHPRSPFN

SEQ ID NO: 1250754 - protein, 9 aa, Homo Sapiens
PAFLAMSFN

SEQ ID NO: 1250755 - protein, 9 aa, Homo Sapiens
LLFNISVPR

SEQ ID NO: 1250756 - protein, 9 aa, Homo Sapiens
PITPETLIW

SEQ ID NO: 1250757 - protein, 9 aa, Homo Sapiens
TVYRQTINS

SEQ ID NO: 1250758 - protein, 9 aa, Homo Sapiens
DNSLWFPVG

SEQ ID NO: 1250759 - protein, 9 aa, Homo Sapiens
RSQDPKKPN

SEQ ID NO: 1250760 - protein, 9 aa, Homo Sapiens
GRKCIAKKK

SEQ ID NO: 1250761 - protein, 9 aa, Homo Sapiens
PWNTSSLVF

SEQ ID NO: 1250762 - protein, 9 aa, Homo Sapiens
TPFHLSLFQ

SEQ ID NO: 1250763 - protein, 9 aa, Homo Sapiens
PAKEWNVLK

SEQ ID NO: 1250764 - protein, 9 aa, Homo Sapiens
INTTLAVEK

SEQ ID NO: 1250765 - protein, 9 aa, Homo Sapiens
KKRDQCFQM

SEQ ID NO: 1250766 - protein, 9 aa, Homo Sapiens
TATQTEPGE

SEQ ID NO: 1250767 - protein, 9 aa, Homo Sapiens
SLETRHIHT

SEQ ID NO: 1250768 - protein, 9 aa, Homo Sapiens
EYENSFNYQ

SEQ ID NO: 1250769 - protein, 9 aa, Homo Sapiens
WSRWVSRAT

SEQ ID NO: 1250770 - protein, 9 aa, Homo Sapiens
TMQPFMLYV

SEQ ID NO: 1250771 - protein, 9 aa, Homo Sapiens
TRANVTRMC

SEQ ID NO: 1250772 - protein, 9 aa, Homo Sapiens
CMGPLGLDH

SEQ ID NO: 1250773 - protein, 9 aa, Homo Sapiens
GIYSTDYYR

SEQ ID NO: 1250774 - protein, 9 aa, Homo Sapiens
RQRQELQEI

SEQ ID NO: 1250775 - protein, 9 aa, Homo Sapiens
SDCLVCVNF

SEQ ID NO: 1250776 - protein, 9 aa, Homo Sapiens
AADELVLHS

SEQ ID NO: 1250777 - protein, 9 aa, Homo Sapiens
LNHGIYVDD

SEQ ID NO: 1250778 - protein, 9 aa, Homo Sapiens
VAERLHRNR

SEQ ID NO: 1250779 - protein, 9 aa, Homo Sapiens
GTVDCVHAR

SEQ ID NO: 1250780 - protein, 9 aa, Homo Sapiens
PPKSERGCK

SEQ ID NO: 1250781 - protein, 9 aa, Homo Sapiens
SYKCYQYGK

SEQ ID NO: 1250782 - protein, 9 aa, Homo Sapiens
HRLHSKDQM

SEQ ID NO: 1250783 - protein, 9 aa, Homo Sapiens
SLSAPPNGS

SEQ ID NO: 1250784 - protein, 9 aa, Homo Sapiens
EMVALKKYV

SEQ ID NO: 1250785 - protein, 9 aa, Homo Sapiens
IYASIKADS

SEQ ID NO: 1250786 - protein, 9 aa, Homo Sapiens
AQIPEPLRE

SEQ ID NO: 1250787 - protein, 9 aa, Homo Sapiens
DEEDEDFDE

SEQ ID NO: 1250788 - protein, 9 aa, Homo Sapiens
HGEDYAAHL

SEQ ID NO: 1250789 - protein, 9 aa, Homo Sapiens
IWLWEHNRV

SEQ ID NO: 1250790 - protein, 9 aa, Homo Sapiens
TYNSCPEGV

SEQ ID NO: 1250791 - protein, 9 aa, Homo Sapiens
HVSNLVQHQ

SEQ ID NO: 1250792 - protein, 9 aa, Homo Sapiens
KRDIALITN

SEQ ID NO: 1250793 - protein, 9 aa, Homo Sapiens
TEHLEAEIV

SEQ ID NO: 1250794 - protein, 9 aa, Homo Sapiens
FPVSVGVQS

SEQ ID NO: 1250795 - protein, 9 aa, Homo Sapiens
CSVVRLPPG

SEQ ID NO: 1250796 - protein, 9 aa, Homo Sapiens
PSGCPMYEG

SEQ ID NO: 1250797 - protein, 9 aa, Homo Sapiens
TPNATFNWN

SEQ ID NO: 1250798 - protein, 9 aa, Homo Sapiens
RYSEPLHVS

SEQ ID NO: 1250799 - protein, 9 aa, Homo Sapiens
RALILVSDI

SEQ ID NO: 1250800 - protein, 9 aa, Homo Sapiens
TPRAPSVWE

SEQ ID NO: 1250801 - protein, 9 aa, Homo Sapiens
RILYRSRHK

SEQ ID NO: 1250802 - protein, 9 aa, Homo Sapiens
YFFCATLIY

SEQ ID NO: 1250803 - protein, 9 aa, Homo Sapiens
VMDTYIKSC

SEQ ID NO: 1250804 - protein, 9 aa, Homo Sapiens
DTAAAYPPA

SEQ ID NO: 1250805 - protein, 9 aa, Homo Sapiens
HVLGHPHTS

SEQ ID NO: 1250806 - protein, 9 aa, Homo Sapiens
VQHIRPVRV

SEQ ID NO: 1250807 - protein, 9 aa, Homo Sapiens
KMKAEVTGT

SEQ ID NO: 1250808 - protein, 9 aa, Homo Sapiens
MGFHHVGHA

SEQ ID NO: 1250809 - protein, 9 aa, Homo Sapiens
EAIVAGPEG

SEQ ID NO: 1250810 - protein, 9 aa, Homo Sapiens
MKASKPIVH

SEQ ID NO: 1250811 - protein, 9 aa, Homo Sapiens
QLGTITPSA

SEQ ID NO: 1250812 - protein, 9 aa, Homo Sapiens
HEDFHASDC

SEQ ID NO: 1250813 - protein, 9 aa, Homo Sapiens
SRWPYWAGL

SEQ ID NO: 1250814 - protein, 9 aa, Homo Sapiens
QWPCFDSQR

SEQ ID NO: 1250815 - protein, 9 aa, Homo Sapiens
SHLTKDVAI

SEQ ID NO: 1250816 - protein, 9 aa, Homo Sapiens
EWMVSRSLG

SEQ ID NO: 1250817 - protein, 9 aa, Homo Sapiens
AGLRERDHL

SEQ ID NO: 1250818 - protein, 9 aa, Homo Sapiens
PSHHILPPQ

SEQ ID NO: 1250819 - protein, 9 aa, Homo Sapiens
PNMDYDIIK

SEQ ID NO: 1250820 - protein, 9 aa, Homo Sapiens
VTGLGMWGL

SEQ ID NO: 1250821 - protein, 9 aa, Homo Sapiens
TWTRLPRRS

SEQ ID NO: 1250822 - protein, 9 aa, Homo Sapiens
ESRVPGTTR

SEQ ID NO: 1250823 - protein, 9 aa, Homo Sapiens
VLHHNVWKN

SEQ ID NO: 1250824 - protein, 9 aa, Homo Sapiens
IMKEKEVKD

SEQ ID NO: 1250825 - protein, 9 aa, Homo Sapiens
LAASVSDWW

SEQ ID NO: 1250826 - protein, 9 aa, Homo Sapiens
SSMYQCVAE

SEQ ID NO: 1250827 - protein, 9 aa, Homo Sapiens
ARGVDFHHV

SEQ ID NO: 1250828 - protein, 9 aa, Homo Sapiens
VFGNASDLK

SEQ ID NO: 1250829 - protein, 9 aa, Homo Sapiens
GEGKAHEIP

SEQ ID NO: 1250830 - protein, 9 aa, Homo Sapiens
RTRACEVIE

SEQ ID NO: 1250831 - protein, 9 aa, Homo Sapiens
IKTAVRLLL

SEQ ID NO: 1250832 - protein, 9 aa, Homo Sapiens
LLKKAIDAM

SEQ ID NO: 1250833 - protein, 9 aa, Homo Sapiens
IPVAAFQGV

SEQ ID NO: 1250834 - protein, 9 aa, Homo Sapiens
ASFSENHAL

SEQ ID NO: 1250835 - protein, 9 aa, Homo Sapiens
VLIKQTGRH

SEQ ID NO: 1250836 - protein, 9 aa, Homo Sapiens
SVPRLLINQ

SEQ ID NO: 1250837 - protein, 9 aa, Homo Sapiens
QPDEEHMDM

SEQ ID NO: 1250838 - protein, 9 aa, Homo Sapiens
KLLFPVGYF

SEQ ID NO: 1250839 - protein, 9 aa, Homo Sapiens
SKDWPCKYD

SEQ ID NO: 1250840 - protein, 9 aa, Homo Sapiens
PLTSGISSS

SEQ ID NO: 1250841 - protein, 9 aa, Homo Sapiens
PGLHGGIAG

SEQ ID NO: 1250842 - protein, 9 aa, Homo Sapiens
GTVPEGSKH

SEQ ID NO: 1250843 - protein, 9 aa, Homo Sapiens
SGSSEDDEW

SEQ ID NO: 1250844 - protein, 9 aa, Homo Sapiens
KKVRSLKGH

SEQ ID NO: 1250845 - protein, 9 aa, Homo Sapiens
IHNCTITLL

SEQ ID NO: 1250846 - protein, 9 aa, Homo Sapiens
QKMSDDGVS

SEQ ID NO: 1250847 - protein, 9 aa, Homo Sapiens
GGLVFALRD

SEQ ID NO: 1250848 - protein, 9 aa, Homo Sapiens
HVRKSRPDE

SEQ ID NO: 1250849 - protein, 9 aa, Homo Sapiens
DALPILKLA

SEQ ID NO: 1250850 - protein, 9 aa, Homo Sapiens
SGESAGTIF

SEQ ID NO: 1250851 - protein, 9 aa, Homo Sapiens
TQVSGTLAR

SEQ ID NO: 1250852 - protein, 9 aa, Homo Sapiens
SYPFLVLQI

SEQ ID NO: 1250853 - protein, 9 aa, Homo Sapiens
LPRSQPLLF

SEQ ID NO: 1250854 - protein, 9 aa, Homo Sapiens
GNLRSYQQW

SEQ ID NO: 1250855 - protein, 9 aa, Homo Sapiens
QQSHTGESH

SEQ ID NO: 1250856 - protein, 9 aa, Homo Sapiens
TLLELMSLL

SEQ ID NO: 1250857 - protein, 9 aa, Homo Sapiens
APLWQGSRK

SEQ ID NO: 1250858 - protein, 9 aa, Homo Sapiens
TLACLKEST

SEQ ID NO: 1250859 - protein, 9 aa, Homo Sapiens
GPHGSITRD

SEQ ID NO: 1250860 - protein, 9 aa, Homo Sapiens
SITGKAGAT

SEQ ID NO: 1250861 - protein, 9 aa, Homo Sapiens
PVSSTSPVI

SEQ ID NO: 1250862 - protein, 9 aa, Homo Sapiens
GLVPEIIGD

SEQ ID NO: 1250863 - protein, 9 aa, Homo Sapiens
ISQHSSELN

SEQ ID NO: 1250864 - protein, 9 aa, Homo Sapiens
ILSGKLVCR

SEQ ID NO: 1250865 - protein, 9 aa, Homo Sapiens
VQHHEVQGN

SEQ ID NO: 1250866 - protein, 9 aa, Homo Sapiens
CHQDDATRP

SEQ ID NO: 1250867 - protein, 9 aa, Homo Sapiens
VRLVCSVTD

SEQ ID NO: 1250868 - protein, 9 aa, Homo Sapiens
GGCSCDYIP

SEQ ID NO: 1250869 - protein, 9 aa, Homo Sapiens
RHSNPPPYP

SEQ ID NO: 1250870 - protein, 9 aa, Homo Sapiens
RLREKIYRA

SEQ ID NO: 1250871 - protein, 9 aa, Homo Sapiens
AFDVCKGRT

SEQ ID NO: 1250872 - protein, 9 aa, Homo Sapiens
GIEDEIEDP

SEQ ID NO: 1250873 - protein, 9 aa, Homo Sapiens
EAMFSMKTS

SEQ ID NO: 1250874 - protein, 9 aa, Homo Sapiens
TELERCIVG

SEQ ID NO: 1250875 - protein, 9 aa, Homo Sapiens
IRTVRYHDG

SEQ ID NO: 1250876 - protein, 9 aa, Homo Sapiens
VPPASSVMT

SEQ ID NO: 1250877 - protein, 9 aa, Homo Sapiens
SVDTRGRHQ

SEQ ID NO: 1250878 - protein, 9 aa, Homo Sapiens
LSEYEAKVC

SEQ ID NO: 1250879 - protein, 9 aa, Homo Sapiens
TGKLCKLEK

SEQ ID NO: 1250880 - protein, 9 aa, Homo Sapiens
PKEVNCKKN

SEQ ID NO: 1250881 - protein, 9 aa, Homo Sapiens
SSTLNVLSL

SEQ ID NO: 1250882 - protein, 9 aa, Homo Sapiens
NREGVPMHK

SEQ ID NO: 1250883 - protein, 9 aa, Homo Sapiens
GGKEDNGYL

SEQ ID NO: 1250884 - protein, 9 aa, Homo Sapiens
LDGGRHCAL

SEQ ID NO: 1250885 - protein, 9 aa, Homo Sapiens
SITSVVVSR

SEQ ID NO: 1250886 - protein, 9 aa, Homo Sapiens
LKNPQLHAA

SEQ ID NO: 1250887 - protein, 9 aa, Homo Sapiens
LRMDSEPVL

SEQ ID NO: 1250888 - protein, 9 aa, Homo Sapiens
CPLLILHTE

SEQ ID NO: 1250889 - protein, 9 aa, Homo Sapiens
CKCIGSSYR

SEQ ID NO: 1250890 - protein, 9 aa, Homo Sapiens
NKSPMHHWR

SEQ ID NO: 1250891 - protein, 9 aa, Homo Sapiens
QAQETLKYT

SEQ ID NO: 1250892 - protein, 9 aa, Homo Sapiens
NTIGNSQRM

SEQ ID NO: 1250893 - protein, 9 aa, Homo Sapiens
NLRTMEQQF

SEQ ID NO: 1250894 - protein, 9 aa, Homo Sapiens
FLEKNVPLR

SEQ ID NO: 1250895 - protein, 9 aa, Homo Sapiens
TQYRIIVCS

SEQ ID NO: 1250896 - protein, 9 aa, Homo Sapiens
SRDAHQQRF

SEQ ID NO: 1250897 - protein, 9 aa, Homo Sapiens
GLKVHKYSI

SEQ ID NO: 1250898 - protein, 9 aa, Homo Sapiens
KPLKILAYL

SEQ ID NO: 1250899 - protein, 9 aa, Homo Sapiens
NNTMQQTEA

SEQ ID NO: 1250900 - protein, 9 aa, Homo Sapiens
LPLLMRVLP

SEQ ID NO: 1250901 - protein, 9 aa, Homo Sapiens
HCGKAFIRA

SEQ ID NO: 1250902 - protein, 9 aa, Homo Sapiens
TEGTIREEH

SEQ ID NO: 1250903 - protein, 9 aa, Homo Sapiens
ELKDEKWKL

SEQ ID NO: 1250904 - protein, 9 aa, Homo Sapiens
TYHSRDESA

SEQ ID NO: 1250905 - protein, 9 aa, Homo Sapiens
TFLDPFKHL

SEQ ID NO: 1250906 - protein, 9 aa, Homo Sapiens
EPGPGDSVE

SEQ ID NO: 1250907 - protein, 9 aa, Homo Sapiens
FLSPVASTD

SEQ ID NO: 1250908 - protein, 9 aa, Homo Sapiens
SEEQASVLV

SEQ ID NO: 1250909 - protein, 9 aa, Homo Sapiens
IHQKGRKKK

SEQ ID NO: 1250910 - protein, 9 aa, Homo Sapiens
KQPDEEHMD

SEQ ID NO: 1250911 - protein, 9 aa, Homo Sapiens
PLPQLLLLC

SEQ ID NO: 1250912 - protein, 9 aa, Homo Sapiens
SCRNTSVVV

SEQ ID NO: 1250913 - protein, 9 aa, Homo Sapiens
THTLGSLPD

SEQ ID NO: 1250914 - protein, 9 aa, Homo Sapiens
DLTLQPHSC

SEQ ID NO: 1250915 - protein, 9 aa, Homo Sapiens
TYLWLKQRA

SEQ ID NO: 1250916 - protein, 9 aa, Homo Sapiens
DIVGTMVFK

SEQ ID NO: 1250917 - protein, 9 aa, Homo Sapiens
LYILCKSFD

SEQ ID NO: 1250918 - protein, 9 aa, Homo Sapiens
TDFLVQMQG

SEQ ID NO: 1250919 - protein, 9 aa, Homo Sapiens
ARSRGHAPP

SEQ ID NO: 1250920 - protein, 9 aa, Homo Sapiens
HVYFPEELH

SEQ ID NO: 1250921 - protein, 9 aa, Homo Sapiens
RNVIKGQGV

SEQ ID NO: 1250922 - protein, 9 aa, Homo Sapiens
CMQGQQGAE

SEQ ID NO: 1250923 - protein, 9 aa, Homo Sapiens
YMDIITKFL

SEQ ID NO: 1250924 - protein, 9 aa, Homo Sapiens
EIERWRGMM

SEQ ID NO: 1250925 - protein, 9 aa, Homo Sapiens
ASFEKSLGN

SEQ ID NO: 1250926 - protein, 9 aa, Homo Sapiens
TIEHLEQEH

SEQ ID NO: 1250927 - protein, 9 aa, Homo Sapiens
QKDPSLLIF

SEQ ID NO: 1250928 - protein, 9 aa, Homo Sapiens
KKWTHPRSP

SEQ ID NO: 1250929 - protein, 9 aa, Homo Sapiens
MLQQGEAMH

SEQ ID NO: 1250930 - protein, 9 aa, Homo Sapiens
SPTSKYNHD

SEQ ID NO: 1250931 - protein, 9 aa, Homo Sapiens
FFCATLIYY

SEQ ID NO: 1250932 - protein, 9 aa, Homo Sapiens
NIISILYHQ

SEQ ID NO: 1250933 - protein, 9 aa, Homo Sapiens
VLPHGQLVH

SEQ ID NO: 1250934 - protein, 9 aa, Homo Sapiens
EQFEKDNEE

SEQ ID NO: 1250935 - protein, 9 aa, Homo Sapiens
AEAPAAEVS

SEQ ID NO: 1250936 - protein, 9 aa, Homo Sapiens
ENLTDEDAG

SEQ ID NO: 1250937 - protein, 9 aa, Homo Sapiens
VHFYTKIHI

SEQ ID NO: 1250938 - protein, 9 aa, Homo Sapiens
IHYENGKQQ

SEQ ID NO: 1250939 - protein, 9 aa, Homo Sapiens
VGEMAMVTA

SEQ ID NO: 1250940 - protein, 9 aa, Homo Sapiens
TCHRSSSPA

SEQ ID NO: 1250941 - protein, 9 aa, Homo Sapiens
GFALSDQRG

SEQ ID NO: 1250942 - protein, 9 aa, Homo Sapiens
LFSSFALTI

SEQ ID NO: 1250943 - protein, 9 aa, Homo Sapiens
RVSRLRTLP

SEQ ID NO: 1250944 - protein, 9 aa, Homo Sapiens
SGVCILISF

SEQ ID NO: 1250945 - protein, 9 aa, Homo Sapiens
RVATERRER

SEQ ID NO: 1250946 - protein, 9 aa, Homo Sapiens
HNPALPPGP

SEQ ID NO: 1250947 - protein, 9 aa, Homo Sapiens
IDVSMDVNP

SEQ ID NO: 1250948 - protein, 9 aa, Homo Sapiens
EQHFGVKHT

SEQ ID NO: 1250949 - protein, 9 aa, Homo Sapiens
PAVLPEHVP

SEQ ID NO: 1250950 - protein, 9 aa, Homo Sapiens
TLRHLNLEE

SEQ ID NO: 1250951 - protein, 9 aa, Homo Sapiens
LDDIEKKLT

SEQ ID NO: 1250952 - protein, 9 aa, Homo Sapiens
QAQPLNPRP

SEQ ID NO: 1250953 - protein, 9 aa, Homo Sapiens
LPEQISPGG

SEQ ID NO: 1250954 - protein, 9 aa, Homo Sapiens
LPSVYLSCR

SEQ ID NO: 1250955 - protein, 9 aa, Homo Sapiens
FHPRASNHT

SEQ ID NO: 1250956 - protein, 9 aa, Homo Sapiens
ESVRTPPNR

SEQ ID NO: 1250957 - protein, 9 aa, Homo Sapiens
VLGRGTGGT

SEQ ID NO: 1250958 - protein, 9 aa, Homo Sapiens
RVNIAYLAV

SEQ ID NO: 1250959 - protein, 9 aa, Homo Sapiens
IANNAAGND

SEQ ID NO: 1250960 - protein, 9 aa, Homo Sapiens
IIDCLGRKK

SEQ ID NO: 1250961 - protein, 9 aa, Homo Sapiens
KQSQRLPWP

SEQ ID NO: 1250962 - protein, 9 aa, Homo Sapiens
DVLIKHSVM

SEQ ID NO: 1250963 - protein, 9 aa, Homo Sapiens
NQSKIQLLQ

SEQ ID NO: 1250964 - protein, 9 aa, Homo Sapiens
QECQVLLDV

SEQ ID NO: 1250965 - protein, 9 aa, Homo Sapiens
TILDVVEEE

SEQ ID NO: 1250966 - protein, 9 aa, Homo Sapiens
SLSWPPGCF

SEQ ID NO: 1250967 - protein, 9 aa, Homo Sapiens
GQNSGNVRN

SEQ ID NO: 1250968 - protein, 9 aa, Homo Sapiens
GAVLFLQQG

SEQ ID NO: 1250969 - protein, 9 aa, Homo Sapiens
TKPQPDVDH

SEQ ID NO: 1250970 - protein, 9 aa, Homo Sapiens
PPGPPPNMI

SEQ ID NO: 1250971 - protein, 9 aa, Homo Sapiens
DYFGVKTAM

SEQ ID NO: 1250972 - protein, 9 aa, Homo Sapiens
GMGQRRMRI

SEQ ID NO: 1250973 - protein, 9 aa, Homo Sapiens
LDGQERCVL

SEQ ID NO: 1250974 - protein, 9 aa, Homo Sapiens
CTYECDEDL

SEQ ID NO: 1250975 - protein, 9 aa, Homo Sapiens
LGRWCAVHV

SEQ ID NO: 1250976 - protein, 9 aa, Homo Sapiens
PMFPPNAAA

SEQ ID NO: 1250977 - protein, 9 aa, Homo Sapiens
EVPTHFLDR

SEQ ID NO: 1250978 - protein, 9 aa, Homo Sapiens
IPLTPGSDW

SEQ ID NO: 1250979 - protein, 9 aa, Homo Sapiens
SPGTSSELQ

SEQ ID NO: 1250980 - protein, 9 aa, Homo Sapiens
PSFEDLLHT

SEQ ID NO: 1250981 - protein, 9 aa, Homo Sapiens
HQPRSDTSL

SEQ ID NO: 1250982 - protein, 9 aa, Homo Sapiens
KIPATVSEG

SEQ ID NO: 1250983 - protein, 9 aa, Homo Sapiens
DEHRTYGAK

SEQ ID NO: 1250984 - protein, 9 aa, Homo Sapiens
HETWLAPEL

SEQ ID NO: 1250985 - protein, 9 aa, Homo Sapiens
PLTTSAETS

SEQ ID NO: 1250986 - protein, 9 aa, Homo Sapiens
SRTPTLVFE

SEQ ID NO: 1250987 - protein, 9 aa, Homo Sapiens
EVGNEWIMQ

SEQ ID NO: 1250988 - protein, 9 aa, Homo Sapiens
KVRVKCNTN

SEQ ID NO: 1250989 - protein, 9 aa, Homo Sapiens
RNHTQGDLF

SEQ ID NO: 1250990 - protein, 9 aa, Homo Sapiens
IYTAFDTYY

SEQ ID NO: 1250991 - protein, 9 aa, Homo Sapiens
DPNLISVDN

SEQ ID NO: 1250992 - protein, 9 aa, Homo Sapiens
RMIGLGLLY

SEQ ID NO: 1250993 - protein, 9 aa, Homo Sapiens
RKNPFECND

SEQ ID NO: 1250994 - protein, 9 aa, Homo Sapiens
IMKNQWLLT

SEQ ID NO: 1250995 - protein, 9 aa, Homo Sapiens
PVLRTDASG

SEQ ID NO: 1250996 - protein, 9 aa, Homo Sapiens
SVSSFMYSK

SEQ ID NO: 1250997 - protein, 9 aa, Homo Sapiens
FMLCISELL

SEQ ID NO: 1250998 - protein, 9 aa, Homo Sapiens
EYSFSLISL

SEQ ID NO: 1250999 - protein, 9 aa, Homo Sapiens
PSPAPCDGA

SEQ ID NO: 1251000 - protein, 9 aa, Homo Sapiens
QKLNFTGSG

SEQ ID NO: 1251001 - protein, 9 aa, Homo Sapiens
LNDNTGWTP

SEQ ID NO: 1251002 - protein, 9 aa, Homo Sapiens
PCCLLVQRC

SEQ ID NO: 1251003 - protein, 9 aa, Homo Sapiens
NKCVCSFDH

SEQ ID NO: 1251004 - protein, 9 aa, Homo Sapiens
RNLLKPTAA

SEQ ID NO: 1251005 - protein, 9 aa, Homo Sapiens
NIPIISEDT

SEQ ID NO: 1251006 - protein, 9 aa, Homo Sapiens
RSLKGHVEQ

SEQ ID NO: 1251007 - protein, 9 aa, Homo Sapiens
SFLSYTVSF

SEQ ID NO: 1251008 - protein, 9 aa, Homo Sapiens
LEFLDLSVS

SEQ ID NO: 1251009 - protein, 9 aa, Homo Sapiens
SNVRTHEMT

SEQ ID NO: 1251010 - protein, 9 aa, Homo Sapiens
RQWTLQEAL

SEQ ID NO: 1251011 - protein, 9 aa, Homo Sapiens
AADMDYVGG

SEQ ID NO: 1251012 - protein, 9 aa, Homo Sapiens
SRTASPGRY

SEQ ID NO: 1251013 - protein, 9 aa, Homo Sapiens
WELKQVMAK

SEQ ID NO: 1251014 - protein, 9 aa, Homo Sapiens
HTDRTKAKG

SEQ ID NO: 1251015 - protein, 9 aa, Homo Sapiens
MFQNPQHGE

SEQ ID NO: 1251016 - protein, 9 aa, Homo Sapiens
QAVDQALIG

SEQ ID NO: 1251017 - protein, 9 aa, Homo Sapiens
AASQQRKIL

SEQ ID NO: 1251018 - protein, 9 aa, Homo Sapiens
ALPLDMLLF

SEQ ID NO: 1251019 - protein, 9 aa, Homo Sapiens
LPGLWLHHA

SEQ ID NO: 1251020 - protein, 9 aa, Homo Sapiens
IYVDDVNVY

SEQ ID NO: 1251021 - protein, 9 aa, Homo Sapiens
KQHLCPSQQ

SEQ ID NO: 1251022 - protein, 9 aa, Homo Sapiens
DYEYTEMGE

SEQ ID NO: 1251023 - protein, 9 aa, Homo Sapiens
RAKGWAWIR

SEQ ID NO: 1251024 - protein, 9 aa, Homo Sapiens
SRSSGAVSS

SEQ ID NO: 1251025 - protein, 9 aa, Homo Sapiens
SECGKAFSA

SEQ ID NO: 1251026 - protein, 9 aa, Homo Sapiens
WRLTDQRIS

SEQ ID NO: 1251027 - protein, 9 aa, Homo Sapiens
GYYQCVVTV

SEQ ID NO: 1251028 - protein, 9 aa, Homo Sapiens
TPGRRSGRQ

SEQ ID NO: 1251029 - protein, 9 aa, Homo Sapiens
AAGFEEHRF

SEQ ID NO: 1251030 - protein, 9 aa, Homo Sapiens
HQDDATRPS

SEQ ID NO: 1251031 - protein, 9 aa, Homo Sapiens
DEVSEKVLE

SEQ ID NO: 1251032 - protein, 9 aa, Homo Sapiens
STSPLERTR

SEQ ID NO: 1251033 - protein, 9 aa, Homo Sapiens
AVCGEIQSF

SEQ ID NO: 1251034 - protein, 9 aa, Homo Sapiens
DSGLYQDQV

SEQ ID NO: 1251035 - protein, 9 aa, Homo Sapiens
HLPSISILA

SEQ ID NO: 1251036 - protein, 9 aa, Homo Sapiens
EDYNHTHGG

SEQ ID NO: 1251037 - protein, 9 aa, Homo Sapiens
DTRFLVMAS

SEQ ID NO: 1251038 - protein, 9 aa, Homo Sapiens
WIRQQEDRK

SEQ ID NO: 1251039 - protein, 9 aa, Homo Sapiens
DSVTVDVTA

SEQ ID NO: 1251040 - protein, 9 aa, Homo Sapiens
PRVILYHEP

SEQ ID NO: 1251041 - protein, 9 aa, Homo Sapiens
EAGRKQLAR

SEQ ID NO: 1251042 - protein, 9 aa, Homo Sapiens
EQKPAVLLM

SEQ ID NO: 1251043 - protein, 9 aa, Homo Sapiens
FTEEETTQL

SEQ ID NO: 1251044 - protein, 9 aa, Homo Sapiens
VLAAQAISC

SEQ ID NO: 1251045 - protein, 9 aa, Homo Sapiens
ICSPECSCA

SEQ ID NO: 1251046 - protein, 9 aa, Homo Sapiens
FTYIPLLYW

SEQ ID NO: 1251047 - protein, 9 aa, Homo Sapiens
HGSCSSFAR

SEQ ID NO: 1251048 - protein, 9 aa, Homo Sapiens
ASQHSLPMD

SEQ ID NO: 1251049 - protein, 9 aa, Homo Sapiens
PRPFVSQTR

SEQ ID NO: 1251050 - protein, 9 aa, Homo Sapiens
HERLNEIVE

SEQ ID NO: 1251051 - protein, 9 aa, Homo Sapiens
HCRRKNQRA

SEQ ID NO: 1251052 - protein, 9 aa, Homo Sapiens
VCLLEVYNW

SEQ ID NO: 1251053 - protein, 9 aa, Homo Sapiens
GCCAFMYMC

SEQ ID NO: 1251054 - protein, 9 aa, Homo Sapiens
YKGYMKALD

SEQ ID NO: 1251055 - protein, 9 aa, Homo Sapiens
KKWGSKGKL

SEQ ID NO: 1251056 - protein, 9 aa, Homo Sapiens
GWSGHLCDI

SEQ ID NO: 1251057 - protein, 9 aa, Homo Sapiens
GRSPSTSAY

SEQ ID NO: 1251058 - protein, 9 aa, Homo Sapiens
VDKGAIKSV

SEQ ID NO: 1251059 - protein, 9 aa, Homo Sapiens
VLEILQYCF

SEQ ID NO: 1251060 - protein, 9 aa, Homo Sapiens
DIRASQVAC

SEQ ID NO: 1251061 - protein, 9 aa, Homo Sapiens
PSLLIFPPP

SEQ ID NO: 1251062 - protein, 9 aa, Homo Sapiens
GQGPHHITC

SEQ ID NO: 1251063 - protein, 9 aa, Homo Sapiens
ELPGRSIIV

SEQ ID NO: 1251064 - protein, 9 aa, Homo Sapiens
FNFKKHLNE

SEQ ID NO: 1251065 - protein, 9 aa, Homo Sapiens
TQMAYVASF

SEQ ID NO: 1251066 - protein, 9 aa, Homo Sapiens
NPELSDLER

SEQ ID NO: 1251067 - protein, 9 aa, Homo Sapiens
DAPEPGLQV

SEQ ID NO: 1251068 - protein, 9 aa, Homo Sapiens
FIKDKGVNS

SEQ ID NO: 1251069 - protein, 9 aa, Homo Sapiens
IRRKIVTMD

SEQ ID NO: 1251070 - protein, 9 aa, Homo Sapiens
KTLQDEEVW

SEQ ID NO: 1251071 - protein, 9 aa, Homo Sapiens
HKQHGKAFS

SEQ ID NO: 1251072 - protein, 9 aa, Homo Sapiens
YKKRISNHF

SEQ ID NO: 1251073 - protein, 9 aa, Homo Sapiens
DISPTERCN

SEQ ID NO: 1251074 - protein, 9 aa, Homo Sapiens
KKNGEEIHR

SEQ ID NO: 1251075 - protein, 9 aa, Homo Sapiens
PATIVSAVT

SEQ ID NO: 1251076 - protein, 9 aa, Homo Sapiens
VFIHLWALL

SEQ ID NO: 1251077 - protein, 9 aa, Homo Sapiens
VGSEQMGEQ

SEQ ID NO: 1251078 - protein, 9 aa, Homo Sapiens
RMHQAIMCW

SEQ ID NO: 1251079 - protein, 9 aa, Homo Sapiens
KEKKDSIMG

SEQ ID NO: 1251080 - protein, 9 aa, Homo Sapiens
WPCPAVPLG

SEQ ID NO: 1251081 - protein, 9 aa, Homo Sapiens
EDVKPKTLL

SEQ ID NO: 1251082 - protein, 9 aa, Homo Sapiens
GSLSDEQDM

SEQ ID NO: 1251083 - protein, 9 aa, Homo Sapiens
CSLYMSCGD

SEQ ID NO: 1251084 - protein, 9 aa, Homo Sapiens
DTLGSVHTE

SEQ ID NO: 1251085 - protein, 9 aa, Homo Sapiens
SSYQQSTSS

SEQ ID NO: 1251086 - protein, 9 aa, Homo Sapiens
IYVQVINYP

SEQ ID NO: 1251087 - protein, 9 aa, Homo Sapiens
NYTKEYNNL

SEQ ID NO: 1251088 - protein, 9 aa, Homo Sapiens
CDCVICWMN

SEQ ID NO: 1251089 - protein, 9 aa, Homo Sapiens
VSGVVQIIF

SEQ ID NO: 1251090 - protein, 9 aa, Homo Sapiens
LMRVLPGVD

SEQ ID NO: 1251091 - protein, 9 aa, Homo Sapiens
IDINDHYPV

SEQ ID NO: 1251092 - protein, 9 aa, Homo Sapiens
TLVQYIPFY

SEQ ID NO: 1251093 - protein, 9 aa, Homo Sapiens
DPRRLLHEE

SEQ ID NO: 1251094 - protein, 9 aa, Homo Sapiens
VHTEFMNPH

SEQ ID NO: 1251095 - protein, 9 aa, Homo Sapiens
MHRELREQT

SEQ ID NO: 1251096 - protein, 9 aa, Homo Sapiens
AKEKNEKGV

SEQ ID NO: 1251097 - protein, 9 aa, Homo Sapiens
QMKLPPCFP

SEQ ID NO: 1251098 - protein, 9 aa, Homo Sapiens
LLVETNEKS

SEQ ID NO: 1251099 - protein, 9 aa, Homo Sapiens
WTWEMPGAT

SEQ ID NO: 1251100 - protein, 9 aa, Homo Sapiens
RSFMDLKIK

SEQ ID NO: 1251101 - protein, 9 aa, Homo Sapiens
GEESPGRKA

SEQ ID NO: 1251102 - protein, 9 aa, Homo Sapiens
VLNDGGFHV

SEQ ID NO: 1251103 - protein, 9 aa, Homo Sapiens
GSKKEDRGK

SEQ ID NO: 1251104 - protein, 9 aa, Homo Sapiens
GYHQIGSAE

SEQ ID NO: 1251105 - protein, 9 aa, Homo Sapiens
WDPDNLADY

SEQ ID NO: 1251106 - protein, 9 aa, Homo Sapiens
PQRGPRPLH

SEQ ID NO: 1251107 - protein, 9 aa, Homo Sapiens
TAMRRIRYE

SEQ ID NO: 1251108 - protein, 9 aa, Homo Sapiens
VIPFVIEKA

SEQ ID NO: 1251109 - protein, 9 aa, Homo Sapiens
CDGAGSPGL

SEQ ID NO: 1251110 - protein, 9 aa, Homo Sapiens
NVSYQADLK

SEQ ID NO: 1251111 - protein, 9 aa, Homo Sapiens
QGHRLGNGV

SEQ ID NO: 1251112 - protein, 9 aa, Homo Sapiens
VDSLITLTF

SEQ ID NO: 1251113 - protein, 9 aa, Homo Sapiens
VVCLQPFCH

SEQ ID NO: 1251114 - protein, 9 aa, Homo Sapiens
PTTTKRFEK

SEQ ID NO: 1251115 - protein, 9 aa, Homo Sapiens
SRVQTQLCL

SEQ ID NO: 1251116 - protein, 9 aa, Homo Sapiens
DKKKEAQAA

SEQ ID NO: 1251117 - protein, 9 aa, Homo Sapiens
SSMGPGTVP

SEQ ID NO: 1251118 - protein, 9 aa, Homo Sapiens
LVYNQDEWA

SEQ ID NO: 1251119 - protein, 9 aa, Homo Sapiens
LAGQDANDL

SEQ ID NO: 1251120 - protein, 9 aa, Homo Sapiens
RVDDTRVDT

SEQ ID NO: 1251121 - protein, 9 aa, Homo Sapiens
ALCPGPGEL

SEQ ID NO: 1251122 - protein, 9 aa, Homo Sapiens
CIICAMKAL

SEQ ID NO: 1251123 - protein, 9 aa, Homo Sapiens
FGGKGQGWW

SEQ ID NO: 1251124 - protein, 9 aa, Homo Sapiens
LHQWQKKLR

SEQ ID NO: 1251125 - protein, 9 aa, Homo Sapiens
ASCKCIGSS

SEQ ID NO: 1251126 - protein, 9 aa, Homo Sapiens
ADLAFTHLN

SEQ ID NO: 1251127 - protein, 9 aa, Homo Sapiens
VIGACTCHT

SEQ ID NO: 1251128 - protein, 9 aa, Homo Sapiens
ESYWLQFDF

SEQ ID NO: 1251129 - protein, 9 aa, Homo Sapiens
RVPPTRSQT

SEQ ID NO: 1251130 - protein, 9 aa, Homo Sapiens
GLIHHYRTV

SEQ ID NO: 1251131 - protein, 9 aa, Homo Sapiens
RDSAKLFLV

SEQ ID NO: 1251132 - protein, 9 aa, Homo Sapiens
MLVDQVTGD

SEQ ID NO: 1251133 - protein, 9 aa, Homo Sapiens
HGSGPCSSC

SEQ ID NO: 1251134 - protein, 9 aa, Homo Sapiens
QSELLSFIK

SEQ ID NO: 1251135 - protein, 9 aa, Homo Sapiens
SKSAVLPVS

SEQ ID NO: 1251136 - protein, 9 aa, Homo Sapiens
SGTVNSEIW

SEQ ID NO: 1251137 - protein, 9 aa, Homo Sapiens
TERIIPFLP

SEQ ID NO: 1251138 - protein, 9 aa, Homo Sapiens
HPPPACHSF

SEQ ID NO: 1251139 - protein, 9 aa, Homo Sapiens
WLRMCPWEL

SEQ ID NO: 1251140 - protein, 9 aa, Homo Sapiens
SLRRKESSR

SEQ ID NO: 1251141 - protein, 9 aa, Homo Sapiens
YRAFYNHGL

SEQ ID NO: 1251142 - protein, 9 aa, Homo Sapiens
SRISCLYNE

SEQ ID NO: 1251143 - protein, 9 aa, Homo Sapiens
IVRLCTIGE

SEQ ID NO: 1251144 - protein, 9 aa, Homo Sapiens
CGNRQDLEE

SEQ ID NO: 1251145 - protein, 9 aa, Homo Sapiens
KAASQQRKI

SEQ ID NO: 1251146 - protein, 9 aa, Homo Sapiens
QHQRLNTGQ

SEQ ID NO: 1251147 - protein, 9 aa, Homo Sapiens
SDTELFQHH

SEQ ID NO: 1251148 - protein, 9 aa, Homo Sapiens
SETEQGIRL

SEQ ID NO: 1251149 - protein, 9 aa, Homo Sapiens
QQRTVQDKK

SEQ ID NO: 1251150 - protein, 9 aa, Homo Sapiens
ITGLCLLVM

SEQ ID NO: 1251151 - protein, 9 aa, Homo Sapiens
NHQGTLPPV

SEQ ID NO: 1251152 - protein, 9 aa, Homo Sapiens
RDLCDEEKS

SEQ ID NO: 1251153 - protein, 9 aa, Homo Sapiens
GEKRWGCVS

SEQ ID NO: 1251154 - protein, 9 aa, Homo Sapiens
NKNSQVCPL

SEQ ID NO: 1251155 - protein, 9 aa, Homo Sapiens
ATADHSLLL

SEQ ID NO: 1251156 - protein, 9 aa, Homo Sapiens
LRLYLEAFC

SEQ ID NO: 1251157 - protein, 9 aa, Homo Sapiens
VTEKTRTKE

SEQ ID NO: 1251158 - protein, 9 aa, Homo Sapiens
TGSAHFNRT

SEQ ID NO: 1251159 - protein, 9 aa, Homo Sapiens
NQELYTTHS

SEQ ID NO: 1251160 - protein, 9 aa, Homo Sapiens
GGPDSFGGP

SEQ ID NO: 1251161 - protein, 9 aa, Homo Sapiens
TLQPHSCLQ

SEQ ID NO: 1251162 - protein, 9 aa, Homo Sapiens
CPDYMDKKN

SEQ ID NO: 1251163 - protein, 9 aa, Homo Sapiens
AGQDANDLY

SEQ ID NO: 1251164 - protein, 9 aa, Homo Sapiens
KAAATSSKK

SEQ ID NO: 1251165 - protein, 9 aa, Homo Sapiens
EFGGVAPRC

SEQ ID NO: 1251166 - protein, 9 aa, Homo Sapiens
MDKETTQAP

SEQ ID NO: 1251167 - protein, 9 aa, Homo Sapiens
DAMVLLLSV

SEQ ID NO: 1251168 - protein, 9 aa, Homo Sapiens
LVVNNHRAS

SEQ ID NO: 1251169 - protein, 9 aa, Homo Sapiens
IEQMKRPLD

SEQ ID NO: 1251170 - protein, 9 aa, Homo Sapiens
FDPLSFSPT

SEQ ID NO: 1251171 - protein, 9 aa, Homo Sapiens
QLTAAGPRP

SEQ ID NO: 1251172 - protein, 9 aa, Homo Sapiens
KDEVASLRA

SEQ ID NO: 1251173 - protein, 9 aa, Homo Sapiens
DINCLGPQR

SEQ ID NO: 1251174 - protein, 9 aa, Homo Sapiens
EEETDVAIQ

SEQ ID NO: 1251175 - protein, 9 aa, Homo Sapiens
LNEYNVIDL

SEQ ID NO: 1251176 - protein, 9 aa, Homo Sapiens
QASVLVESV

SEQ ID NO: 1251177 - protein, 9 aa, Homo Sapiens
SAPPTEETT

SEQ ID NO: 1251178 - protein, 9 aa, Homo Sapiens
GPFSDTTTM

SEQ ID NO: 1251179 - protein, 9 aa, Homo Sapiens
MNLYQVFVG

SEQ ID NO: 1251180 - protein, 9 aa, Homo Sapiens
YMKALDGFV

SEQ ID NO: 1251181 - protein, 9 aa, Homo Sapiens
QELHQWQKK

SEQ ID NO: 1251182 - protein, 9 aa, Homo Sapiens
YDSDDEQEA

SEQ ID NO: 1251183 - protein, 9 aa, Homo Sapiens
ENNYHEVSV

SEQ ID NO: 1251184 - protein, 9 aa, Homo Sapiens
SYLNVHRKI

SEQ ID NO: 1251185 - protein, 9 aa, Homo Sapiens
LGRSKAGSG

SEQ ID NO: 1251186 - protein, 9 aa, Homo Sapiens
CAPGSAGPD

SEQ ID NO: 1251187 - protein, 9 aa, Homo Sapiens
QRNEIACLP

SEQ ID NO: 1251188 - protein, 9 aa, Homo Sapiens
DCAPGMWGP

SEQ ID NO: 1251189 - protein, 9 aa, Homo Sapiens
FAMSHFRSH

SEQ ID NO: 1251190 - protein, 9 aa, Homo Sapiens
ERERNHVKL

SEQ ID NO: 1251191 - protein, 9 aa, Homo Sapiens
QIKCGKRRY

SEQ ID NO: 1251192 - protein, 9 aa, Homo Sapiens
TRSRPSSTS

SEQ ID NO: 1251193 - protein, 9 aa, Homo Sapiens
VYNQDEWAW

SEQ ID NO: 1251194 - protein, 9 aa, Homo Sapiens
YDDRGQLIK

SEQ ID NO: 1251195 - protein, 9 aa, Homo Sapiens
HSMAQQENL

SEQ ID NO: 1251196 - protein, 9 aa, Homo Sapiens
EDPYFTDIF

SEQ ID NO: 1251197 - protein, 9 aa, Homo Sapiens
PECALGIGV

SEQ ID NO: 1251198 - protein, 9 aa, Homo Sapiens
CAPGGILDL

SEQ ID NO: 1251199 - protein, 9 aa, Homo Sapiens
VLLIGIIST

SEQ ID NO: 1251200 - protein, 9 aa, Homo Sapiens
RSRKLVSFT

SEQ ID NO: 1251201 - protein, 9 aa, Homo Sapiens
GHHVRISRS

SEQ ID NO: 1251202 - protein, 9 aa, Homo Sapiens
PWMHPCCTI

SEQ ID NO: 1251203 - protein, 9 aa, Homo Sapiens
KLYCDLPLG

SEQ ID NO: 1251204 - protein, 9 aa, Homo Sapiens
HKEVEFLQK

SEQ ID NO: 1251205 - protein, 9 aa, Homo Sapiens
GEKHYECIK

SEQ ID NO: 1251206 - protein, 9 aa, Homo Sapiens
IILVGTKLG

SEQ ID NO: 1251207 - protein, 9 aa, Homo Sapiens
NPDLITCLE

SEQ ID NO: 1251208 - protein, 9 aa, Homo Sapiens
GAIKSVLSG

SEQ ID NO: 1251209 - protein, 9 aa, Homo Sapiens
IKFDMEKIH

SEQ ID NO: 1251210 - protein, 9 aa, Homo Sapiens
KKETQIPLD

SEQ ID NO: 1251211 - protein, 9 aa, Homo Sapiens
LTETVYDDR

SEQ ID NO: 1251212 - protein, 9 aa, Homo Sapiens
YYSKGTPSY

SEQ ID NO: 1251213 - protein, 9 aa, Homo Sapiens
NVPEVVKDA

SEQ ID NO: 1251214 - protein, 9 aa, Homo Sapiens
VVFKGADLD

SEQ ID NO: 1251215 - protein, 9 aa, Homo Sapiens
YTLLVGKPH

SEQ ID NO: 1251216 - protein, 9 aa, Homo Sapiens
KCDICGMVC

SEQ ID NO: 1251217 - protein, 9 aa, Homo Sapiens
CYQCGKQGH

SEQ ID NO: 1251218 - protein, 9 aa, Homo Sapiens
SMNTFRSFG

SEQ ID NO: 1251219 - protein, 9 aa, Homo Sapiens
DPYLDITLD

SEQ ID NO: 1251220 - protein, 9 aa, Homo Sapiens
LVMASTCVN

SEQ ID NO: 1251221 - protein, 9 aa, Homo Sapiens
DGSHFILLE

SEQ ID NO: 1251222 - protein, 9 aa, Homo Sapiens
WLQQTTGCS

SEQ ID NO: 1251223 - protein, 9 aa, Homo Sapiens
VQLHVTATE

SEQ ID NO: 1251224 - protein, 9 aa, Homo Sapiens
SALAIVFMG

SEQ ID NO: 1251225 - protein, 9 aa, Homo Sapiens
APEEEWTRQ

SEQ ID NO: 1251226 - protein, 9 aa, Homo Sapiens
CWFGAGGPE

SEQ ID NO: 1251227 - protein, 9 aa, Homo Sapiens
TPRYIVLIA

SEQ ID NO: 1251228 - protein, 9 aa, Homo Sapiens
SNAMYKEIG

SEQ ID NO: 1251229 - protein, 9 aa, Homo Sapiens
NMTKSTSVS

SEQ ID NO: 1251230 - protein, 9 aa, Homo Sapiens
QGEWRRPPD

SEQ ID NO: 1251231 - protein, 9 aa, Homo Sapiens
RKTINFDGR

SEQ ID NO: 1251232 - protein, 9 aa, Homo Sapiens
CNNQTIFEQ

SEQ ID NO: 1251233 - protein, 9 aa, Homo Sapiens
CQSSVSVTA

SEQ ID NO: 1251234 - protein, 9 aa, Homo Sapiens
GGPEVETNV

SEQ ID NO: 1251235 - protein, 9 aa, Homo Sapiens
DKIFRKNSY

SEQ ID NO: 1251236 - protein, 9 aa, Homo Sapiens
HDPHHCGHS

SEQ ID NO: 1251237 - protein, 9 aa, Homo Sapiens
SSTAPPMWP

SEQ ID NO: 1251238 - protein, 9 aa, Homo Sapiens
TVMPGAWEE

SEQ ID NO: 1251239 - protein, 9 aa, Homo Sapiens
NQFQVEHFS

SEQ ID NO: 1251240 - protein, 9 aa, Homo Sapiens
RQLDLSHGF

SEQ ID NO: 1251241 - protein, 9 aa, Homo Sapiens
PPATRPKPN

SEQ ID NO: 1251242 - protein, 9 aa, Homo Sapiens
LQIQEEEKT

SEQ ID NO: 1251243 - protein, 9 aa, Homo Sapiens
TLLLTLLLA

SEQ ID NO: 1251244 - protein, 9 aa, Homo Sapiens
EPAQGAIGC

SEQ ID NO: 1251245 - protein, 9 aa, Homo Sapiens
HPSFLSYTV

SEQ ID NO: 1251246 - protein, 9 aa, Homo Sapiens
ERLMGYGIV

SEQ ID NO: 1251247 - protein, 9 aa, Homo Sapiens
GGQGPHHIT

SEQ ID NO: 1251248 - protein, 9 aa, Homo Sapiens
RLRDTPVGD

SEQ ID NO: 1251249 - protein, 9 aa, Homo Sapiens
VSFKYVTVG

SEQ ID NO: 1251250 - protein, 9 aa, Homo Sapiens
QDSRRETKM

SEQ ID NO: 1251251 - protein, 9 aa, Homo Sapiens
SLYIFRGQI

SEQ ID NO: 1251252 - protein, 9 aa, Homo Sapiens
VLKEIVEHV

SEQ ID NO: 1251253 - protein, 9 aa, Homo Sapiens
RLLSSVSSF

SEQ ID NO: 1251254 - protein, 9 aa, Homo Sapiens
VHKYSIVIG

SEQ ID NO: 1251255 - protein, 9 aa, Homo Sapiens
SNVVNNFFV

SEQ ID NO: 1251256 - protein, 9 aa, Homo Sapiens
TLTGVPEDH

SEQ ID NO: 1251257 - protein, 9 aa, Homo Sapiens
PELTGEDIR

SEQ ID NO: 1251258 - protein, 9 aa, Homo Sapiens
NLVVIVIYF

SEQ ID NO: 1251259 - protein, 9 aa, Homo Sapiens
TGGHMMNCP

SEQ ID NO: 1251260 - protein, 9 aa, Homo Sapiens
LEETRIAME

SEQ ID NO: 1251261 - protein, 9 aa, Homo Sapiens
TLEHPDCAF

SEQ ID NO: 1251262 - protein, 9 aa, Homo Sapiens
AQQENRYWR

SEQ ID NO: 1251263 - protein, 9 aa, Homo Sapiens
NTQRAGYKA

SEQ ID NO: 1251264 - protein, 9 aa, Homo Sapiens
PAGEMTKVQ

SEQ ID NO: 1251265 - protein, 9 aa, Homo Sapiens
NVNLQEEEG

SEQ ID NO: 1251266 - protein, 9 aa, Homo Sapiens
YPKMYLDGP

SEQ ID NO: 1251267 - protein, 9 aa, Homo Sapiens
AAEGGSRNQ

SEQ ID NO: 1251268 - protein, 9 aa, Homo Sapiens
CWTVRGSCG

SEQ ID NO: 1251269 - protein, 9 aa, Homo Sapiens
SYTSQHPDY

SEQ ID NO: 1251270 - protein, 9 aa, Homo Sapiens
STRKDIHHM

SEQ ID NO: 1251271 - protein, 9 aa, Homo Sapiens
GKHCVDKFD

SEQ ID NO: 1251272 - protein, 9 aa, Homo Sapiens
TALPDRGLD

SEQ ID NO: 1251273 - protein, 9 aa, Homo Sapiens
SGPCSSCTG

SEQ ID NO: 1251274 - protein, 9 aa, Homo Sapiens
KVFGRGEHQ

SEQ ID NO: 1251275 - protein, 9 aa, Homo Sapiens
VGTMVFKPS

SEQ ID NO: 1251276 - protein, 9 aa, Homo Sapiens
NECEIAFSQ

SEQ ID NO: 1251277 - protein, 9 aa, Homo Sapiens
PASSLRHPR

SEQ ID NO: 1251278 - protein, 9 aa, Homo Sapiens
AFTQMAYVA

SEQ ID NO: 1251279 - protein, 9 aa, Homo Sapiens
AEFKEGKNE

SEQ ID NO: 1251280 - protein, 9 aa, Homo Sapiens
GAEPHLTVG

SEQ ID NO: 1251281 - protein, 9 aa, Homo Sapiens
EFDRYSGYR

SEQ ID NO: 1251282 - protein, 9 aa, Homo Sapiens
VPGRVFGNA

SEQ ID NO: 1251283 - protein, 9 aa, Homo Sapiens
ISNAGAGDS

SEQ ID NO: 1251284 - protein, 9 aa, Homo Sapiens
PGPGLPTGF

SEQ ID NO: 1251285 - protein, 9 aa, Homo Sapiens
VTGVIIQGA

SEQ ID NO: 1251286 - protein, 9 aa, Homo Sapiens
GVVQIIFYC

SEQ ID NO: 1251287 - protein, 9 aa, Homo Sapiens
QRPSTGKAT

SEQ ID NO: 1251288 - protein, 9 aa, Homo Sapiens
GVAVVDPVT

SEQ ID NO: 1251289 - protein, 9 aa, Homo Sapiens
SSSHNWTED

SEQ ID NO: 1251290 - protein, 9 aa, Homo Sapiens
GSILKTHKQ

SEQ ID NO: 1251291 - protein, 9 aa, Homo Sapiens
DGPDGSGQY

SEQ ID NO: 1251292 - protein, 9 aa, Homo Sapiens
TAVSVLKPF

SEQ ID NO: 1251293 - protein, 9 aa, Homo Sapiens
TLHLAAEEA

SEQ ID NO: 1251294 - protein, 9 aa, Homo Sapiens
EDSSMYQCV

SEQ ID NO: 1251295 - protein, 9 aa, Homo Sapiens
KAKDAGDDE

SEQ ID NO: 1251296 - protein, 9 aa, Homo Sapiens
GPCRHAGSS

SEQ ID NO: 1251297 - protein, 9 aa, Homo Sapiens
LEEESFPEG

SEQ ID NO: 1251298 - protein, 9 aa, Homo Sapiens
RDAGHLLYP

SEQ ID NO: 1251299 - protein, 9 aa, Homo Sapiens
HFTTLGFEA

SEQ ID NO: 1251300 - protein, 9 aa, Homo Sapiens
ERAEGIPAL

SEQ ID NO: 1251301 - protein, 9 aa, Homo Sapiens
IAARALHKV

SEQ ID NO: 1251302 - protein, 9 aa, Homo Sapiens
HPRKRGRRR

SEQ ID NO: 1251303 - protein, 9 aa, Homo Sapiens
GPVSAGEDV

SEQ ID NO: 1251304 - protein, 9 aa, Homo Sapiens
MGPIFPIIR

SEQ ID NO: 1251305 - protein, 9 aa, Homo Sapiens
FCRICAVFG

SEQ ID NO: 1251306 - protein, 9 aa, Homo Sapiens
TFGMYCRET

SEQ ID NO: 1251307 - protein, 9 aa, Homo Sapiens
LYCGQGVQF

SEQ ID NO: 1251308 - protein, 9 aa, Homo Sapiens
LNGRNRRAK

SEQ ID NO: 1251309 - protein, 9 aa, Homo Sapiens
LREVTDRFK

SEQ ID NO: 1251310 - protein, 9 aa, Homo Sapiens
NIFMFITRQ

SEQ ID NO: 1251311 - protein, 9 aa, Homo Sapiens
LEDKTNVIL

SEQ ID NO: 1251312 - protein, 9 aa, Homo Sapiens
PVMSGDALG

SEQ ID NO: 1251313 - protein, 9 aa, Homo Sapiens
TLCHLLHAL

SEQ ID NO: 1251314 - protein, 9 aa, Homo Sapiens
PVAQEIFRL

SEQ ID NO: 1251315 - protein, 9 aa, Homo Sapiens
QERLMGSHV

SEQ ID NO: 1251316 - protein, 9 aa, Homo Sapiens
AAGPTADEE

SEQ ID NO: 1251317 - protein, 9 aa, Homo Sapiens
MPSRQPIPS

SEQ ID NO: 1251318 - protein, 9 aa, Homo Sapiens
VGLRNPVRV

SEQ ID NO: 1251319 - protein, 9 aa, Homo Sapiens
VSASRPSEQ

SEQ ID NO: 1251320 - protein, 9 aa, Homo Sapiens
AGGEASNPE

SEQ ID NO: 1251321 - protein, 9 aa, Homo Sapiens
HTGMLDVWY

SEQ ID NO: 1251322 - protein, 9 aa, Homo Sapiens
ILHPSRSGG

SEQ ID NO: 1251323 - protein, 9 aa, Homo Sapiens
ILQYCFEEK

SEQ ID NO: 1251324 - protein, 9 aa, Homo Sapiens
KSLEDVAID

SEQ ID NO: 1251325 - protein, 9 aa, Homo Sapiens
EKFTILQVV

SEQ ID NO: 1251326 - protein, 9 aa, Homo Sapiens
ALHIADGLR

SEQ ID NO: 1251327 - protein, 9 aa, Homo Sapiens
LKASPTLVK

SEQ ID NO: 1251328 - protein, 9 aa, Homo Sapiens
VSVVLLNFF

SEQ ID NO: 1251329 - protein, 9 aa, Homo Sapiens
VEMSEVTGY

SEQ ID NO: 1251330 - protein, 9 aa, Homo Sapiens
TVMKQHQLL

SEQ ID NO: 1251331 - protein, 9 aa, Homo Sapiens
VTAMGTEKG

SEQ ID NO: 1251332 - protein, 9 aa, Homo Sapiens
TYCFRVLSS

SEQ ID NO: 1251333 - protein, 9 aa, Homo Sapiens
DLTTGTPCL

SEQ ID NO: 1251334 - protein, 9 aa, Homo Sapiens
QPPILNHLA

SEQ ID NO: 1251335 - protein, 9 aa, Homo Sapiens
EVEKDSGHD

SEQ ID NO: 1251336 - protein, 9 aa, Homo Sapiens
TAPQENVCH

SEQ ID NO: 1251337 - protein, 9 aa, Homo Sapiens
NFDDILRVV

SEQ ID NO: 1251338 - protein, 9 aa, Homo Sapiens
EEDGCVTDH

SEQ ID NO: 1251339 - protein, 9 aa, Homo Sapiens
VTDVNASEK

SEQ ID NO: 1251340 - protein, 9 aa, Homo Sapiens
TERLREKIY

SEQ ID NO: 1251341 - protein, 9 aa, Homo Sapiens
VHWEHCCPW

SEQ ID NO: 1251342 - protein, 9 aa, Homo Sapiens
DIYGVAQHY

SEQ ID NO: 1251343 - protein, 9 aa, Homo Sapiens
VGSHNIKAA

SEQ ID NO: 1251344 - protein, 9 aa, Homo Sapiens
TQSLPLSVM

SEQ ID NO: 1251345 - protein, 9 aa, Homo Sapiens
DSGEGPSSL

SEQ ID NO: 1251346 - protein, 9 aa, Homo Sapiens
ISICLGSFE

SEQ ID NO: 1251347 - protein, 9 aa, Homo Sapiens
ALCKMVLMA

SEQ ID NO: 1251348 - protein, 9 aa, Homo Sapiens
VSSFVDKIQ

SEQ ID NO: 1251349 - protein, 9 aa, Homo Sapiens
PGKAMPTTQ

SEQ ID NO: 1251350 - protein, 9 aa, Homo Sapiens
STGKATTIP

SEQ ID NO: 1251351 - protein, 9 aa, Homo Sapiens
VNSLLYAYS

SEQ ID NO: 1251352 - protein, 9 aa, Homo Sapiens
IPYDALPDW

SEQ ID NO: 1251353 - protein, 9 aa, Homo Sapiens
ILGCTWYLG

SEQ ID NO: 1251354 - protein, 9 aa, Homo Sapiens
DAILQRLDH

SEQ ID NO: 1251355 - protein, 9 aa, Homo Sapiens
HCMSVIVSC

SEQ ID NO: 1251356 - protein, 9 aa, Homo Sapiens
QDTPSDIIV

SEQ ID NO: 1251357 - protein, 9 aa, Homo Sapiens
AQAAVPAET

SEQ ID NO: 1251358 - protein, 9 aa, Homo Sapiens
DDAPCPGYL

SEQ ID NO: 1251359 - protein, 9 aa, Homo Sapiens
SYGGESPHL

SEQ ID NO: 1251360 - protein, 9 aa, Homo Sapiens
PACTRWKQR

SEQ ID NO: 1251361 - protein, 9 aa, Homo Sapiens
IELFLSFNV

SEQ ID NO: 1251362 - protein, 9 aa, Homo Sapiens
RPHRTPWPL

SEQ ID NO: 1251363 - protein, 9 aa, Homo Sapiens
IHTGEKSYN

SEQ ID NO: 1251364 - protein, 9 aa, Homo Sapiens
RRQWEEQQQ

SEQ ID NO: 1251365 - protein, 9 aa, Homo Sapiens
SLSLKGAPD

SEQ ID NO: 1251366 - protein, 9 aa, Homo Sapiens
EALQDDLQC

SEQ ID NO: 1251367 - protein, 9 aa, Homo Sapiens
SLHLKNGPD

SEQ ID NO: 1251368 - protein, 9 aa, Homo Sapiens
RLPLAHLHR

SEQ ID NO: 1251369 - protein, 9 aa, Homo Sapiens
SLQRSPALR

SEQ ID NO: 1251370 - protein, 9 aa, Homo Sapiens
LVPPKTRRG

SEQ ID NO: 1251371 - protein, 9 aa, Homo Sapiens
RVSNTVSGL

SEQ ID NO: 1251372 - protein, 9 aa, Homo Sapiens
WYDLEHGQP

SEQ ID NO: 1251373 - protein, 9 aa, Homo Sapiens
YKDVIVLGA

SEQ ID NO: 1251374 - protein, 9 aa, Homo Sapiens
TLQKRLREP

SEQ ID NO: 1251375 - protein, 9 aa, Homo Sapiens
YKTMLHKPI

SEQ ID NO: 1251376 - protein, 9 aa, Homo Sapiens
LTTYRQLSN

SEQ ID NO: 1251377 - protein, 9 aa, Homo Sapiens
VPKEVNCKK

SEQ ID NO: 1251378 - protein, 9 aa, Homo Sapiens
PRHSPHHMV

SEQ ID NO: 1251379 - protein, 9 aa, Homo Sapiens
IRAQLEFNQ

SEQ ID NO: 1251380 - protein, 9 aa, Homo Sapiens
SQPQILLYS

SEQ ID NO: 1251381 - protein, 9 aa, Homo Sapiens
LLIYDITNY

SEQ ID NO: 1251382 - protein, 9 aa, Homo Sapiens
SPPKPPTRD

SEQ ID NO: 1251383 - protein, 9 aa, Homo Sapiens
EEHLELHKK

SEQ ID NO: 1251384 - protein, 9 aa, Homo Sapiens
EKKRKEEES

SEQ ID NO: 1251385 - protein, 9 aa, Homo Sapiens
LRLLEDAQL

SEQ ID NO: 1251386 - protein, 9 aa, Homo Sapiens
PWAMLLLWV

SEQ ID NO: 1251387 - protein, 9 aa, Homo Sapiens
NGLDMETLS

SEQ ID NO: 1251388 - protein, 9 aa, Homo Sapiens
QAILNLHGI

SEQ ID NO: 1251389 - protein, 9 aa, Homo Sapiens
RLFVTVKPY

SEQ ID NO: 1251390 - protein, 9 aa, Homo Sapiens
LALHTAACL

SEQ ID NO: 1251391 - protein, 9 aa, Homo Sapiens
EQCHWLDPD

SEQ ID NO: 1251392 - protein, 9 aa, Homo Sapiens
TELQGKFTR

SEQ ID NO: 1251393 - protein, 9 aa, Homo Sapiens
PYQDSSSHF

SEQ ID NO: 1251394 - protein, 9 aa, Homo Sapiens
RLLHEELAL

SEQ ID NO: 1251395 - protein, 9 aa, Homo Sapiens
CLGDQTVQA

SEQ ID NO: 1251396 - protein, 9 aa, Homo Sapiens
FWYEMRLLK

SEQ ID NO: 1251397 - protein, 9 aa, Homo Sapiens
KLRYKDLCT

SEQ ID NO: 1251398 - protein, 9 aa, Homo Sapiens
MERVKKYDL

SEQ ID NO: 1251399 - protein, 9 aa, Homo Sapiens
LENLQPRRL

SEQ ID NO: 1251400 - protein, 9 aa, Homo Sapiens
EGRIRAMRV

SEQ ID NO: 1251401 - protein, 9 aa, Homo Sapiens
PSIFPESKK

SEQ ID NO: 1251402 - protein, 9 aa, Homo Sapiens
TMCEPEFGN

SEQ ID NO: 1251403 - protein, 9 aa, Homo Sapiens
TVPFKYESP

SEQ ID NO: 1251404 - protein, 9 aa, Homo Sapiens
CATILDIIK

SEQ ID NO: 1251405 - protein, 9 aa, Homo Sapiens
LQNMVKTCD

SEQ ID NO: 1251406 - protein, 9 aa, Homo Sapiens
GLRDDKDTI

SEQ ID NO: 1251407 - protein, 9 aa, Homo Sapiens
NVATGVSTH

SEQ ID NO: 1251408 - protein, 9 aa, Homo Sapiens
TPIMRSLKE

SEQ ID NO: 1251409 - protein, 9 aa, Homo Sapiens
ALLRFIMPT

SEQ ID NO: 1251410 - protein, 9 aa, Homo Sapiens
DSDISEDPC

SEQ ID NO: 1251411 - protein, 9 aa, Homo Sapiens
NADIVQAKV

SEQ ID NO: 1251412 - protein, 9 aa, Homo Sapiens
IIFQLKEVV

SEQ ID NO: 1251413 - protein, 9 aa, Homo Sapiens
ALIFFTIWH

SEQ ID NO: 1251414 - protein, 9 aa, Homo Sapiens
PYRCLRGGQ

SEQ ID NO: 1251415 - protein, 9 aa, Homo Sapiens
RHWHLWKHY

SEQ ID NO: 1251416 - protein, 9 aa, Homo Sapiens
YLALHEDFH

SEQ ID NO: 1251417 - protein, 9 aa, Homo Sapiens
NLLTTDAIL

SEQ ID NO: 1251418 - protein, 9 aa, Homo Sapiens
LDIDECRII

SEQ ID NO: 1251419 - protein, 9 aa, Homo Sapiens
PLLMRVLPG

SEQ ID NO: 1251420 - protein, 9 aa, Homo Sapiens
PTGPRPLLE

SEQ ID NO: 1251421 - protein, 9 aa, Homo Sapiens
SRRYNPESE

SEQ ID NO: 1251422 - protein, 9 aa, Homo Sapiens
MYRVALESL

SEQ ID NO: 1251423 - protein, 9 aa, Homo Sapiens
MNSPTTTMN

SEQ ID NO: 1251424 - protein, 9 aa, Homo Sapiens
TCLLSPGAA

SEQ ID NO: 1251425 - protein, 9 aa, Homo Sapiens
PCMCTEEGP

SEQ ID NO: 1251426 - protein, 9 aa, Homo Sapiens
ETGEDGEEL

SEQ ID NO: 1251427 - protein, 9 aa, Homo Sapiens
MQFLKKKWY

SEQ ID NO: 1251428 - protein, 9 aa, Homo Sapiens
SSDPSAIMS

SEQ ID NO: 1251429 - protein, 9 aa, Homo Sapiens
QWLPIYLQN

SEQ ID NO: 1251430 - protein, 9 aa, Homo Sapiens
SILHTHIRQ

SEQ ID NO: 1251431 - protein, 9 aa, Homo Sapiens
KLRTARCRQ

SEQ ID NO: 1251432 - protein, 9 aa, Homo Sapiens
RPETLFLLY

SEQ ID NO: 1251433 - protein, 9 aa, Homo Sapiens
ETTHQTSVY

SEQ ID NO: 1251434 - protein, 9 aa, Homo Sapiens
WWEFPPKNC

SEQ ID NO: 1251435 - protein, 9 aa, Homo Sapiens
NEQISVMRY

SEQ ID NO: 1251436 - protein, 9 aa, Homo Sapiens
LFIGGLNFE

SEQ ID NO: 1251437 - protein, 9 aa, Homo Sapiens
VYFNLPEDD

SEQ ID NO: 1251438 - protein, 9 aa, Homo Sapiens
VVGAVSAQA

SEQ ID NO: 1251439 - protein, 9 aa, Homo Sapiens
CQKFAVMEE

SEQ ID NO: 1251440 - protein, 9 aa, Homo Sapiens
QISCVLFLL

SEQ ID NO: 1251441 - protein, 9 aa, Homo Sapiens
HHALEQLKP

SEQ ID NO: 1251442 - protein, 9 aa, Homo Sapiens
FLNDLRAEA

SEQ ID NO: 1251443 - protein, 9 aa, Homo Sapiens
RVHEQGYVP

SEQ ID NO: 1251444 - protein, 9 aa, Homo Sapiens
LTILHSTAE

SEQ ID NO: 1251445 - protein, 9 aa, Homo Sapiens
LKVHKYSIV

SEQ ID NO: 1251446 - protein, 9 aa, Homo Sapiens
QVSESLWQL

SEQ ID NO: 1251447 - protein, 9 aa, Homo Sapiens
AVAERVATE

SEQ ID NO: 1251448 - protein, 9 aa, Homo Sapiens
VMLQQHIQM

SEQ ID NO: 1251449 - protein, 9 aa, Homo Sapiens
GQMGRPHSR

SEQ ID NO: 1251450 - protein, 9 aa, Homo Sapiens
LHGFQARPE

SEQ ID NO: 1251451 - protein, 9 aa, Homo Sapiens
SSSCVSTYS

SEQ ID NO: 1251452 - protein, 9 aa, Homo Sapiens
EEIKEAFEL

SEQ ID NO: 1251453 - protein, 9 aa, Homo Sapiens
AATTSPTLL

SEQ ID NO: 1251454 - protein, 9 aa, Homo Sapiens
QLFQAEGNI

SEQ ID NO: 1251455 - protein, 9 aa, Homo Sapiens
WPDMTLVLH

SEQ ID NO: 1251456 - protein, 9 aa, Homo Sapiens
FIGWAGSSL

SEQ ID NO: 1251457 - protein, 9 aa, Homo Sapiens
VIFGISITG

SEQ ID NO: 1251458 - protein, 9 aa, Homo Sapiens
TDHPRAQCV

SEQ ID NO: 1251459 - protein, 9 aa, Homo Sapiens
APTPDATAS

SEQ ID NO: 1251460 - protein, 9 aa, Homo Sapiens
KERERHLKM

SEQ ID NO: 1251461 - protein, 9 aa, Homo Sapiens
DMDKYSVSQ

SEQ ID NO: 1251462 - protein, 9 aa, Homo Sapiens
ETQIPLDLL

SEQ ID NO: 1251463 - protein, 9 aa, Homo Sapiens
TDANIFVRV

SEQ ID NO: 1251464 - protein, 9 aa, Homo Sapiens
EHLEAEIVL

SEQ ID NO: 1251465 - protein, 9 aa, Homo Sapiens
LFIISRTYP

SEQ ID NO: 1251466 - protein, 9 aa, Homo Sapiens
ELRGGTERS

SEQ ID NO: 1251467 - protein, 9 aa, Homo Sapiens
AAPPLSKAD

SEQ ID NO: 1251468 - protein, 9 aa, Homo Sapiens
LVCQCFLRS

SEQ ID NO: 1251469 - protein, 9 aa, Homo Sapiens
RVGLEVSNN

SEQ ID NO: 1251470 - protein, 9 aa, Homo Sapiens
VLLQTMYLS

SEQ ID NO: 1251471 - protein, 9 aa, Homo Sapiens
QHDNIAKYK

SEQ ID NO: 1251472 - protein, 9 aa, Homo Sapiens
ACPSETEQG

SEQ ID NO: 1251473 - protein, 9 aa, Homo Sapiens
HVPNKSPMH

SEQ ID NO: 1251474 - protein, 9 aa, Homo Sapiens
STSFWVAEV

SEQ ID NO: 1251475 - protein, 9 aa, Homo Sapiens
KKKTRTSPT

SEQ ID NO: 1251476 - protein, 9 aa, Homo Sapiens
ITIEGPRFS

SEQ ID NO: 1251477 - protein, 9 aa, Homo Sapiens
SPATRHGWW

SEQ ID NO: 1251478 - protein, 9 aa, Homo Sapiens
ATPLGRSKA

SEQ ID NO: 1251479 - protein, 9 aa, Homo Sapiens
YSREKNPNT

SEQ ID NO: 1251480 - protein, 9 aa, Homo Sapiens
HRRSSGSRD

SEQ ID NO: 1251481 - protein, 9 aa, Homo Sapiens
CSSCCSWWK

SEQ ID NO: 1251482 - protein, 9 aa, Homo Sapiens
EHGPEPGPG

SEQ ID NO: 1251483 - protein, 9 aa, Homo Sapiens
LEGMSPICF

SEQ ID NO: 1251484 - protein, 9 aa, Homo Sapiens
AMCDDDPPT

SEQ ID NO: 1251485 - protein, 9 aa, Homo Sapiens
VDCVHARAA

SEQ ID NO: 1251486 - protein, 9 aa, Homo Sapiens
HKKKCSSAS

SEQ ID NO: 1251487 - protein, 9 aa, Homo Sapiens
VRFCKLELR

SEQ ID NO: 1251488 - protein, 9 aa, Homo Sapiens
ARSWLITAS

SEQ ID NO: 1251489 - protein, 9 aa, Homo Sapiens
DTSLTAASP

SEQ ID NO: 1251490 - protein, 9 aa, Homo Sapiens
LDEAQMVER

SEQ ID NO: 1251491 - protein, 9 aa, Homo Sapiens
RSHRRAREQ

SEQ ID NO: 1251492 - protein, 9 aa, Homo Sapiens
RDEYPQFQD

SEQ ID NO: 1251493 - protein, 9 aa, Homo Sapiens
GLYTDADMK

SEQ ID NO: 1251494 - protein, 9 aa, Homo Sapiens
NTIIHGIKF

SEQ ID NO: 1251495 - protein, 9 aa, Homo Sapiens
GSGKNSGTV

SEQ ID NO: 1251496 - protein, 9 aa, Homo Sapiens
TEPEKLHLK

SEQ ID NO: 1251497 - protein, 9 aa, Homo Sapiens
RGKHARHKG

SEQ ID NO: 1251498 - protein, 9 aa, Homo Sapiens
AGSLSGPDS

SEQ ID NO: 1251499 - protein, 9 aa, Homo Sapiens
SDPYVKACL

SEQ ID NO: 1251500 - protein, 9 aa, Homo Sapiens
GPGDRDVTY

SEQ ID NO: 1251501 - protein, 9 aa, Homo Sapiens
LETDSVSLM

SEQ ID NO: 1251502 - protein, 9 aa, Homo Sapiens
TALIYLDRS

SEQ ID NO: 1251503 - protein, 9 aa, Homo Sapiens
GSSEDDEWR

SEQ ID NO: 1251504 - protein, 9 aa, Homo Sapiens
GLPERNCTL

SEQ ID NO: 1251505 - protein, 9 aa, Homo Sapiens
PAMTGMTPL

SEQ ID NO: 1251506 - protein, 9 aa, Homo Sapiens
KKIAMTMDQ

SEQ ID NO: 1251507 - protein, 9 aa, Homo Sapiens
GPCSSCTGP

SEQ ID NO: 1251508 - protein, 9 aa, Homo Sapiens
KLNFTGSGD

SEQ ID NO: 1251509 - protein, 9 aa, Homo Sapiens
VLFLIGLVC

SEQ ID NO: 1251510 - protein, 9 aa, Homo Sapiens
PAAVGATED

SEQ ID NO: 1251511 - protein, 9 aa, Homo Sapiens
LVDVQEMEL

SEQ ID NO: 1251512 - protein, 9 aa, Homo Sapiens
YPPILSYCT

SEQ ID NO: 1251513 - protein, 9 aa, Homo Sapiens
TLSAMARGT

SEQ ID NO: 1251514 - protein, 9 aa, Homo Sapiens
STVCQGHWQ

SEQ ID NO: 1251515 - protein, 9 aa, Homo Sapiens
ALGFYLPLE

SEQ ID NO: 1251516 - protein, 9 aa, Homo Sapiens
VRHKRHALQ

SEQ ID NO: 1251517 - protein, 9 aa, Homo Sapiens
GSVPLSQGS

SEQ ID NO: 1251518 - protein, 9 aa, Homo Sapiens
TDFAMSHFR

SEQ ID NO: 1251519 - protein, 9 aa, Homo Sapiens
EELNTIQGA

SEQ ID NO: 1251520 - protein, 9 aa, Homo Sapiens
MWLPQLHVG

SEQ ID NO: 1251521 - protein, 9 aa, Homo Sapiens
VMPQLLKKF

SEQ ID NO: 1251522 - protein, 9 aa, Homo Sapiens
SGVARFSVI

SEQ ID NO: 1251523 - protein, 9 aa, Homo Sapiens
EQLGQEYGK

SEQ ID NO: 1251524 - protein, 9 aa, Homo Sapiens
HQSATQAVF

SEQ ID NO: 1251525 - protein, 9 aa, Homo Sapiens
LGSLQHPPP

SEQ ID NO: 1251526 - protein, 9 aa, Homo Sapiens
NVRTHEMTH

SEQ ID NO: 1251527 - protein, 9 aa, Homo Sapiens
NDTKSGNVT

SEQ ID NO: 1251528 - protein, 9 aa, Homo Sapiens
ESPKCQASS

SEQ ID NO: 1251529 - protein, 9 aa, Homo Sapiens
FSPPPGSGG

SEQ ID NO: 1251530 - protein, 9 aa, Homo Sapiens
PGTAIFIPS

SEQ ID NO: 1251531 - protein, 9 aa, Homo Sapiens
RSLYQVIAS

SEQ ID NO: 1251532 - protein, 9 aa, Homo Sapiens
SIEVIPFVI

SEQ ID NO: 1251533 - protein, 9 aa, Homo Sapiens
DDLAHKHVF

SEQ ID NO: 1251534 - protein, 9 aa, Homo Sapiens
EEIERWRGM

SEQ ID NO: 1251535 - protein, 9 aa, Homo Sapiens
ISTAGEADA

SEQ ID NO: 1251536 - protein, 9 aa, Homo Sapiens
RHIWDSPAF

SEQ ID NO: 1251537 - protein, 9 aa, Homo Sapiens
LLHQVFPLT

SEQ ID NO: 1251538 - protein, 9 aa, Homo Sapiens
GHPIESLSL

SEQ ID NO: 1251539 - protein, 9 aa, Homo Sapiens
KRCSFHIEN

SEQ ID NO: 1251540 - protein, 9 aa, Homo Sapiens
RRMSQGKVA

SEQ ID NO: 1251541 - protein, 9 aa, Homo Sapiens
LGDLLNLDI

SEQ ID NO: 1251542 - protein, 9 aa, Homo Sapiens
DQQLHEVYS

SEQ ID NO: 1251543 - protein, 9 aa, Homo Sapiens
LSQDHMVPG

SEQ ID NO: 1251544 - protein, 9 aa, Homo Sapiens
DLSKKTLIR

SEQ ID NO: 1251545 - protein, 9 aa, Homo Sapiens
CNVPEVVKD

SEQ ID NO: 1251546 - protein, 9 aa, Homo Sapiens
RAKKWVLRK

SEQ ID NO: 1251547 - protein, 9 aa, Homo Sapiens
ESDTMKRLP

SEQ ID NO: 1251548 - protein, 9 aa, Homo Sapiens
KLKYEWMVS

SEQ ID NO: 1251549 - protein, 9 aa, Homo Sapiens
VAVENGTVT

SEQ ID NO: 1251550 - protein, 9 aa, Homo Sapiens
AVPLGPART

SEQ ID NO: 1251551 - protein, 9 aa, Homo Sapiens
RSSSEDTLN

SEQ ID NO: 1251552 - protein, 9 aa, Homo Sapiens
GGIEDEIED

SEQ ID NO: 1251553 - protein, 9 aa, Homo Sapiens
ARGGRTMGL

SEQ ID NO: 1251554 - protein, 9 aa, Homo Sapiens
LCHLLAQPT

SEQ ID NO: 1251555 - protein, 9 aa, Homo Sapiens
QGNDIKIDE

SEQ ID NO: 1251556 - protein, 9 aa, Homo Sapiens
RTSLKSGKT

SEQ ID NO: 1251557 - protein, 9 aa, Homo Sapiens
NLHSLPGVV

SEQ ID NO: 1251558 - protein, 9 aa, Homo Sapiens
AASKRKNWQ

SEQ ID NO: 1251559 - protein, 9 aa, Homo Sapiens
WQPTRPFQS

SEQ ID NO: 1251560 - protein, 9 aa, Homo Sapiens
SVIAYGQSD

SEQ ID NO: 1251561 - protein, 9 aa, Homo Sapiens
PNYKTLFII

SEQ ID NO: 1251562 - protein, 9 aa, Homo Sapiens
KQHPVTMET

SEQ ID NO: 1251563 - protein, 9 aa, Homo Sapiens
PVPVEALKD

SEQ ID NO: 1251564 - protein, 9 aa, Homo Sapiens
QACEGRTSH

SEQ ID NO: 1251565 - protein, 9 aa, Homo Sapiens
DGATLCMGG

SEQ ID NO: 1251566 - protein, 9 aa, Homo Sapiens
LSSNMYGSF

SEQ ID NO: 1251567 - protein, 9 aa, Homo Sapiens
DSPRRLCLV

SEQ ID NO: 1251568 - protein, 9 aa, Homo Sapiens
YTDQRITSD

SEQ ID NO: 1251569 - protein, 9 aa, Homo Sapiens
AAHTHHYLC

SEQ ID NO: 1251570 - protein, 9 aa, Homo Sapiens
RRIPALSPK

SEQ ID NO: 1251571 - protein, 9 aa, Homo Sapiens
TIYTIDGFK

SEQ ID NO: 1251572 - protein, 9 aa, Homo Sapiens
KSKKDSCSG

SEQ ID NO: 1251573 - protein, 9 aa, Homo Sapiens
CLKRHVNLQ

SEQ ID NO: 1251574 - protein, 9 aa, Homo Sapiens
NRAIIVRNG

SEQ ID NO: 1251575 - protein, 9 aa, Homo Sapiens
LRGAAAVPP

SEQ ID NO: 1251576 - protein, 9 aa, Homo Sapiens
KTKDGQILH

SEQ ID NO: 1251577 - protein, 9 aa, Homo Sapiens
WPMAAHSGT

SEQ ID NO: 1251578 - protein, 9 aa, Homo Sapiens
EAQLLEAHA

SEQ ID NO: 1251579 - protein, 9 aa, Homo Sapiens
GDQNSRLAR

SEQ ID NO: 1251580 - protein, 9 aa, Homo Sapiens
EMHHTQTKF

SEQ ID NO: 1251581 - protein, 9 aa, Homo Sapiens
EWRQTPLPV

SEQ ID NO: 1251582 - protein, 9 aa, Homo Sapiens
FMISNGIER

SEQ ID NO: 1251583 - protein, 9 aa, Homo Sapiens
RTHYYQIMP

SEQ ID NO: 1251584 - protein, 9 aa, Homo Sapiens
QYGKAFTWS

SEQ ID NO: 1251585 - protein, 9 aa, Homo Sapiens
DSRVLHVLD

SEQ ID NO: 1251586 - protein, 9 aa, Homo Sapiens
HKIHTGEKS

SEQ ID NO: 1251587 - protein, 9 aa, Homo Sapiens
PSSTSFTPT

SEQ ID NO: 1251588 - protein, 9 aa, Homo Sapiens
DRVVLGTSA

SEQ ID NO: 1251589 - protein, 9 aa, Homo Sapiens
SSPNLWPDM

SEQ ID NO: 1251590 - protein, 9 aa, Homo Sapiens
VWLAAVRCL

SEQ ID NO: 1251591 - protein, 9 aa, Homo Sapiens
SLEHLHSKL

SEQ ID NO: 1251592 - protein, 9 aa, Homo Sapiens
CKYFQLDVT

SEQ ID NO: 1251593 - protein, 9 aa, Homo Sapiens
PCGQWLPIY

SEQ ID NO: 1251594 - protein, 9 aa, Homo Sapiens
IHGAVYYES

SEQ ID NO: 1251595 - protein, 9 aa, Homo Sapiens
NTHITCRLC

SEQ ID NO: 1251596 - protein, 9 aa, Homo Sapiens
SANSGCSAV

SEQ ID NO: 1251597 - protein, 9 aa, Homo Sapiens
EQLKMLFLA

SEQ ID NO: 1251598 - protein, 9 aa, Homo Sapiens
GLKVFMYPA

SEQ ID NO: 1251599 - protein, 9 aa, Homo Sapiens
HMHLIKDKK

SEQ ID NO: 1251600 - protein, 9 aa, Homo Sapiens
KKKCLRLAD

SEQ ID NO: 1251601 - protein, 9 aa, Homo Sapiens
RAHVQHFHK

SEQ ID NO: 1251602 - protein, 9 aa, Homo Sapiens
IYSKAERRS

SEQ ID NO: 1251603 - protein, 9 aa, Homo Sapiens
QFPETLLGY

SEQ ID NO: 1251604 - protein, 9 aa, Homo Sapiens
AETRRISEG

SEQ ID NO: 1251605 - protein, 9 aa, Homo Sapiens
VLESGPMRG

SEQ ID NO: 1251606 - protein, 9 aa, Homo Sapiens
EVPLVQLDP

SEQ ID NO: 1251607 - protein, 9 aa, Homo Sapiens
TSTSPKFHM

SEQ ID NO: 1251608 - protein, 9 aa, Homo Sapiens
GGQAFQKPS

SEQ ID NO: 1251609 - protein, 9 aa, Homo Sapiens
VKTCSCVGP

SEQ ID NO: 1251610 - protein, 9 aa, Homo Sapiens
PHFGLIKAW

SEQ ID NO: 1251611 - protein, 9 aa, Homo Sapiens
ELSVMDVYD

SEQ ID NO: 1251612 - protein, 9 aa, Homo Sapiens
TQHRGRGRR

SEQ ID NO: 1251613 - protein, 9 aa, Homo Sapiens
SVAERLHHP

SEQ ID NO: 1251614 - protein, 9 aa, Homo Sapiens
MLAKTFSRG

SEQ ID NO: 1251615 - protein, 9 aa, Homo Sapiens
PIKKEENTK

SEQ ID NO: 1251616 - protein, 9 aa, Homo Sapiens
KNILVNTLY

SEQ ID NO: 1251617 - protein, 9 aa, Homo Sapiens
QKTQAYHRL

SEQ ID NO: 1251618 - protein, 9 aa, Homo Sapiens
WRGMMRQRA

SEQ ID NO: 1251619 - protein, 9 aa, Homo Sapiens
RPAFAANVL

SEQ ID NO: 1251620 - protein, 9 aa, Homo Sapiens
CARLRGAAA

SEQ ID NO: 1251621 - protein, 9 aa, Homo Sapiens
DNSQLMEQL

SEQ ID NO: 1251622 - protein, 9 aa, Homo Sapiens
DVTYASKED

SEQ ID NO: 1251623 - protein, 9 aa, Homo Sapiens
AGPCGPRAH

SEQ ID NO: 1251624 - protein, 9 aa, Homo Sapiens
SAFSKGVHY

SEQ ID NO: 1251625 - protein, 9 aa, Homo Sapiens
YHMLRTRAK

SEQ ID NO: 1251626 - protein, 9 aa, Homo Sapiens
HRWLQQTTG

SEQ ID NO: 1251627 - protein, 9 aa, Homo Sapiens
GFYQLEKVL

SEQ ID NO: 1251628 - protein, 9 aa, Homo Sapiens
SELPLKEMG

SEQ ID NO: 1251629 - protein, 9 aa, Homo Sapiens
APFPAACET

SEQ ID NO: 1251630 - protein, 9 aa, Homo Sapiens
RVRGRRPAL

SEQ ID NO: 1251631 - protein, 9 aa, Homo Sapiens
DSQHQRSPS

SEQ ID NO: 1251632 - protein, 9 aa, Homo Sapiens
RKVSEFLDE

SEQ ID NO: 1251633 - protein, 9 aa, Homo Sapiens
FSTYASHLT

SEQ ID NO: 1251634 - protein, 9 aa, Homo Sapiens
TIVSATSTT

SEQ ID NO: 1251635 - protein, 9 aa, Homo Sapiens
EDEGDEFDD

SEQ ID NO: 1251636 - protein, 9 aa, Homo Sapiens
RKRNIFRKL

SEQ ID NO: 1251637 - protein, 9 aa, Homo Sapiens
EFPGSPTFA

SEQ ID NO: 1251638 - protein, 9 aa, Homo Sapiens
LSENRISSL

SEQ ID NO: 1251639 - protein, 9 aa, Homo Sapiens
VEEPRTTVD

SEQ ID NO: 1251640 - protein, 9 aa, Homo Sapiens
VWRSRRDRE

SEQ ID NO: 1251641 - protein, 9 aa, Homo Sapiens
LAALIVTSV

SEQ ID NO: 1251642 - protein, 9 aa, Homo Sapiens
PQLGTITPS

SEQ ID NO: 1251643 - protein, 9 aa, Homo Sapiens
IDTSSYQQS

SEQ ID NO: 1251644 - protein, 9 aa, Homo Sapiens
CLLRWMRRK

SEQ ID NO: 1251645 - protein, 9 aa, Homo Sapiens
QHKVTLLDF

SEQ ID NO: 1251646 - protein, 9 aa, Homo Sapiens
IPIFYRLHL

SEQ ID NO: 1251647 - protein, 9 aa, Homo Sapiens
SQRKTDLTG

SEQ ID NO: 1251648 - protein, 9 aa, Homo Sapiens
TAHAILSDS

SEQ ID NO: 1251649 - protein, 9 aa, Homo Sapiens
QEYEDEEDE

SEQ ID NO: 1251650 - protein, 9 aa, Homo Sapiens
IPQHTIQKT

SEQ ID NO: 1251651 - protein, 9 aa, Homo Sapiens
NSPFVLYLL

SEQ ID NO: 1251652 - protein, 9 aa, Homo Sapiens
SLPRCAPPP

SEQ ID NO: 1251653 - protein, 9 aa, Homo Sapiens
LAWTQGSHV

SEQ ID NO: 1251654 - protein, 9 aa, Homo Sapiens
IILEPDTSN

SEQ ID NO: 1251655 - protein, 9 aa, Homo Sapiens
EGLENQESL

SEQ ID NO: 1251656 - protein, 9 aa, Homo Sapiens
TFTPSEQVE

SEQ ID NO: 1251657 - protein, 9 aa, Homo Sapiens
HMAQRLDGA

SEQ ID NO: 1251658 - protein, 9 aa, Homo Sapiens
NGGHRIDYV

SEQ ID NO: 1251659 - protein, 9 aa, Homo Sapiens
DGSYEEAMV

SEQ ID NO: 1251660 - protein, 9 aa, Homo Sapiens
KLNQYSAKH

SEQ ID NO: 1251661 - protein, 9 aa, Homo Sapiens
SFNPEAHVF

SEQ ID NO: 1251662 - protein, 9 aa, Homo Sapiens
TSTSASSLT

SEQ ID NO: 1251663 - protein, 9 aa, Homo Sapiens
KETALIYLD

SEQ ID NO: 1251664 - protein, 9 aa, Homo Sapiens
CILILILSI

SEQ ID NO: 1251665 - protein, 9 aa, Homo Sapiens
ITNILKGQA

SEQ ID NO: 1251666 - protein, 9 aa, Homo Sapiens
TEAVAGSVP

SEQ ID NO: 1251667 - protein, 9 aa, Homo Sapiens
LENSEETST

SEQ ID NO: 1251668 - protein, 9 aa, Homo Sapiens
PDIYPYFGL

SEQ ID NO: 1251669 - protein, 9 aa, Homo Sapiens
WERSYFGSM

SEQ ID NO: 1251670 - protein, 9 aa, Homo Sapiens
QRACPATHA

SEQ ID NO: 1251671 - protein, 9 aa, Homo Sapiens
PRRHAMPCS

SEQ ID NO: 1251672 - protein, 9 aa, Homo Sapiens
TASVDFEHP

SEQ ID NO: 1251673 - protein, 9 aa, Homo Sapiens
MRLKHMDMV

SEQ ID NO: 1251674 - protein, 9 aa, Homo Sapiens
YMVMEYVHG

SEQ ID NO: 1251675 - protein, 9 aa, Homo Sapiens
INNDVNLRI

SEQ ID NO: 1251676 - protein, 9 aa, Homo Sapiens
VQSSPPTLR

SEQ ID NO: 1251677 - protein, 9 aa, Homo Sapiens
MYMCPSSSY

SEQ ID NO: 1251678 - protein, 9 aa, Homo Sapiens
RRRIPAGRR

SEQ ID NO: 1251679 - protein, 9 aa, Homo Sapiens
QHEDGEFWM

SEQ ID NO: 1251680 - protein, 9 aa, Homo Sapiens
PNVFPKTNA

SEQ ID NO: 1251681 - protein, 9 aa, Homo Sapiens
PAETHTLGS

SEQ ID NO: 1251682 - protein, 9 aa, Homo Sapiens
KGVSEKCSC

SEQ ID NO: 1251683 - protein, 9 aa, Homo Sapiens
MVMILVVDT

SEQ ID NO: 1251684 - protein, 9 aa, Homo Sapiens
FLHHPDLYL

SEQ ID NO: 1251685 - protein, 9 aa, Homo Sapiens
GKYSSLTSK

SEQ ID NO: 1251686 - protein, 9 aa, Homo Sapiens
TKMEIHRTY

SEQ ID NO: 1251687 - protein, 9 aa, Homo Sapiens
AVWRMPEFG

SEQ ID NO: 1251688 - protein, 9 aa, Homo Sapiens
RLRKKILRH

SEQ ID NO: 1251689 - protein, 9 aa, Homo Sapiens
EMPHVSVSK

SEQ ID NO: 1251690 - protein, 9 aa, Homo Sapiens
VVWKTKQTC

SEQ ID NO: 1251691 - protein, 9 aa, Homo Sapiens
EAARDEHQL

SEQ ID NO: 1251692 - protein, 9 aa, Homo Sapiens
QTRCDGKKI

SEQ ID NO: 1251693 - protein, 9 aa, Homo Sapiens
AVAAGIPNI

SEQ ID NO: 1251694 - protein, 9 aa, Homo Sapiens
HAQMLLSRL

SEQ ID NO: 1251695 - protein, 9 aa, Homo Sapiens
VSAVTTLSL

SEQ ID NO: 1251696 - protein, 9 aa, Homo Sapiens
ESWMLHNNG

SEQ ID NO: 1251697 - protein, 9 aa, Homo Sapiens
KLSYCVVFP

SEQ ID NO: 1251698 - protein, 9 aa, Homo Sapiens
QVYLEEMYW

SEQ ID NO: 1251699 - protein, 9 aa, Homo Sapiens
TTVHDSLVI

SEQ ID NO: 1251700 - protein, 9 aa, Homo Sapiens
DTLLLQVRQ

SEQ ID NO: 1251701 - protein, 9 aa, Homo Sapiens
VTELDNEVN

SEQ ID NO: 1251702 - protein, 9 aa, Homo Sapiens
RKILNVKRS

SEQ ID NO: 1251703 - protein, 9 aa, Homo Sapiens
YLPLTNVRI

SEQ ID NO: 1251704 - protein, 9 aa, Homo Sapiens
SSHFKVTVS

SEQ ID NO: 1251705 - protein, 9 aa, Homo Sapiens
TSTQGPHRH

SEQ ID NO: 1251706 - protein, 9 aa, Homo Sapiens
IRELDPLLC

SEQ ID NO: 1251707 - protein, 9 aa, Homo Sapiens
PWHEVEAPY

SEQ ID NO: 1251708 - protein, 9 aa, Homo Sapiens
YITPRYIVL

SEQ ID NO: 1251709 - protein, 9 aa, Homo Sapiens
GTVKHREFH

SEQ ID NO: 1251710 - protein, 9 aa, Homo Sapiens
RQRRRTPQP

SEQ ID NO: 1251711 - protein, 9 aa, Homo Sapiens
LKKAIDAML

SEQ ID NO: 1251712 - protein, 9 aa, Homo Sapiens
QDMPQNRLL

SEQ ID NO: 1251713 - protein, 9 aa, Homo Sapiens
EKFTASKDP

SEQ ID NO: 1251714 - protein, 9 aa, Homo Sapiens
KCSQGSAGS

SEQ ID NO: 1251715 - protein, 9 aa, Homo Sapiens
PVVKNSIMK

SEQ ID NO: 1251716 - protein, 9 aa, Homo Sapiens
YRYYPEGVH

SEQ ID NO: 1251717 - protein, 9 aa, Homo Sapiens
KHITLPKSV

SEQ ID NO: 1251718 - protein, 9 aa, Homo Sapiens
WRDLGSLQH

SEQ ID NO: 1251719 - protein, 9 aa, Homo Sapiens
AQLEEVKQA

SEQ ID NO: 1251720 - protein, 9 aa, Homo Sapiens
QAAQRAYGQ

SEQ ID NO: 1251721 - protein, 9 aa, Homo Sapiens
RMAPTLPKK

SEQ ID NO: 1251722 - protein, 9 aa, Homo Sapiens
IKENINKAQ

SEQ ID NO: 1251723 - protein, 9 aa, Homo Sapiens
RFSAKMDHP

SEQ ID NO: 1251724 - protein, 9 aa, Homo Sapiens
EQESLVAAA

SEQ ID NO: 1251725 - protein, 9 aa, Homo Sapiens
PLYVPRSKS

SEQ ID NO: 1251726 - protein, 9 aa, Homo Sapiens
SCFHPRRER

SEQ ID NO: 1251727 - protein, 9 aa, Homo Sapiens
RYSEKPMNW

SEQ ID NO: 1251728 - protein, 9 aa, Homo Sapiens
EAKAKELVW

SEQ ID NO: 1251729 - protein, 9 aa, Homo Sapiens
LKNKETFWC

SEQ ID NO: 1251730 - protein, 9 aa, Homo Sapiens
PHYPPKVVR

SEQ ID NO: 1251731 - protein, 9 aa, Homo Sapiens
RRPRYDYRR

SEQ ID NO: 1251732 - protein, 9 aa, Homo Sapiens
GDCGHAFSQ

SEQ ID NO: 1251733 - protein, 9 aa, Homo Sapiens
LVKGLREAR

SEQ ID NO: 1251734 - protein, 9 aa, Homo Sapiens
FTYGMHMIL

SEQ ID NO: 1251735 - protein, 9 aa, Homo Sapiens
LHAEIMRLF

SEQ ID NO: 1251736 - protein, 9 aa, Homo Sapiens
CMNAAPMKE

SEQ ID NO: 1251737 - protein, 9 aa, Homo Sapiens
ACGDCGHAF

SEQ ID NO: 1251738 - protein, 9 aa, Homo Sapiens
QAHMATHRA

SEQ ID NO: 1251739 - protein, 9 aa, Homo Sapiens
IIAQRASQC

SEQ ID NO: 1251740 - protein, 9 aa, Homo Sapiens
KSKMAFLTR

SEQ ID NO: 1251741 - protein, 9 aa, Homo Sapiens
LDLPSIRSQ

SEQ ID NO: 1251742 - protein, 9 aa, Homo Sapiens
NADNSHLFA

SEQ ID NO: 1251743 - protein, 9 aa, Homo Sapiens
WAMRRSYET

SEQ ID NO: 1251744 - protein, 9 aa, Homo Sapiens
WASPCSLSA

SEQ ID NO: 1251745 - protein, 9 aa, Homo Sapiens
GPHGNMENS

SEQ ID NO: 1251746 - protein, 9 aa, Homo Sapiens
HCFEGVTSI

SEQ ID NO: 1251747 - protein, 9 aa, Homo Sapiens
GLSFKECNQ

SEQ ID NO: 1251748 - protein, 9 aa, Homo Sapiens
QQSGIGHAM

SEQ ID NO: 1251749 - protein, 9 aa, Homo Sapiens
ENVTQALGR

SEQ ID NO: 1251750 - protein, 9 aa, Homo Sapiens
TRMEVPLLG

SEQ ID NO: 1251751 - protein, 9 aa, Homo Sapiens
FHPRRERSY

SEQ ID NO: 1251752 - protein, 9 aa, Homo Sapiens
VVIGHMDSG

SEQ ID NO: 1251753 - protein, 9 aa, Homo Sapiens
PKTGKWQKE

SEQ ID NO: 1251754 - protein, 9 aa, Homo Sapiens
LPLVIELSC

SEQ ID NO: 1251755 - protein, 9 aa, Homo Sapiens
VLVESVFGL

SEQ ID NO: 1251756 - protein, 9 aa, Homo Sapiens
SPRSLVKHI

SEQ ID NO: 1251757 - protein, 9 aa, Homo Sapiens
SCSGVCILI

SEQ ID NO: 1251758 - protein, 9 aa, Homo Sapiens
PDYLKAQAI

SEQ ID NO: 1251759 - protein, 9 aa, Homo Sapiens
NRRLAQQSL

SEQ ID NO: 1251760 - protein, 9 aa, Homo Sapiens
NMHINVQNG

SEQ ID NO: 1251761 - protein, 9 aa, Homo Sapiens
ELEDERKQH

SEQ ID NO: 1251762 - protein, 9 aa, Homo Sapiens
GRWGYGKPF

SEQ ID NO: 1251763 - protein, 9 aa, Homo Sapiens
NGSSKGVSA

SEQ ID NO: 1251764 - protein, 9 aa, Homo Sapiens
PSRWPYWAG

SEQ ID NO: 1251765 - protein, 9 aa, Homo Sapiens
HILQQTFFE

SEQ ID NO: 1251766 - protein, 9 aa, Homo Sapiens
EFPVIVHLP

SEQ ID NO: 1251767 - protein, 9 aa, Homo Sapiens
MLCKGRVPE

SEQ ID NO: 1251768 - protein, 9 aa, Homo Sapiens
QDFKTDLHF

SEQ ID NO: 1251769 - protein, 9 aa, Homo Sapiens
EMLLKMVAL

SEQ ID NO: 1251770 - protein, 9 aa, Homo Sapiens
SSLKWFLGK

SEQ ID NO: 1251771 - protein, 9 aa, Homo Sapiens
RMWYLLKVQ

SEQ ID NO: 1251772 - protein, 9 aa, Homo Sapiens
RTLYHLQLL

SEQ ID NO: 1251773 - protein, 9 aa, Homo Sapiens
FCYKCIHQN

SEQ ID NO: 1251774 - protein, 9 aa, Homo Sapiens
QLIAMQINS

SEQ ID NO: 1251775 - protein, 9 aa, Homo Sapiens
SGWADAKCV

SEQ ID NO: 1251776 - protein, 9 aa, Homo Sapiens
GGKVRHKRH

SEQ ID NO: 1251777 - protein, 9 aa, Homo Sapiens
GFVAKSQTA

SEQ ID NO: 1251778 - protein, 9 aa, Homo Sapiens
VNDIMLVKL

SEQ ID NO: 1251779 - protein, 9 aa, Homo Sapiens
SLGVVTKPS

SEQ ID NO: 1251780 - protein, 9 aa, Homo Sapiens
DWEEQREEW

SEQ ID NO: 1251781 - protein, 9 aa, Homo Sapiens
MADVPVTST

SEQ ID NO: 1251782 - protein, 9 aa, Homo Sapiens
VLFQGAGEA

SEQ ID NO: 1251783 - protein, 9 aa, Homo Sapiens
HQVFPLTMI

SEQ ID NO: 1251784 - protein, 9 aa, Homo Sapiens
KAAFKKANW

SEQ ID NO: 1251785 - protein, 9 aa, Homo Sapiens
TDLNGQAVY

SEQ ID NO: 1251786 - protein, 9 aa, Homo Sapiens
MHQAALLGD

SEQ ID NO: 1251787 - protein, 9 aa, Homo Sapiens
YVANAGDNR

SEQ ID NO: 1251788 - protein, 9 aa, Homo Sapiens
LHRAKRRNM

SEQ ID NO: 1251789 - protein, 9 aa, Homo Sapiens
HRSRCGHSW

SEQ ID NO: 1251790 - protein, 9 aa, Homo Sapiens
WPPSSTVWL

SEQ ID NO: 1251791 - protein, 9 aa, Homo Sapiens
GACYENVIG

SEQ ID NO: 1251792 - protein, 9 aa, Homo Sapiens
PLPEEFQVV

SEQ ID NO: 1251793 - protein, 9 aa, Homo Sapiens
PRVFYIGRE

SEQ ID NO: 1251794 - protein, 9 aa, Homo Sapiens
REFHSIDVQ

SEQ ID NO: 1251795 - protein, 9 aa, Homo Sapiens
FLCALSITD

SEQ ID NO: 1251796 - protein, 9 aa, Homo Sapiens
GSHGQEQAA

SEQ ID NO: 1251797 - protein, 9 aa, Homo Sapiens
HHISVKNHS

SEQ ID NO: 1251798 - protein, 9 aa, Homo Sapiens
GAGDKASGE

SEQ ID NO: 1251799 - protein, 9 aa, Homo Sapiens
RLPAGVGTW

SEQ ID NO: 1251800 - protein, 9 aa, Homo Sapiens
ALSIDNSQL

SEQ ID NO: 1251801 - protein, 9 aa, Homo Sapiens
ILNEEMSGL

SEQ ID NO: 1251802 - protein, 9 aa, Homo Sapiens
CYDQCISGH

SEQ ID NO: 1251803 - protein, 9 aa, Homo Sapiens
VSWPGCCSE

SEQ ID NO: 1251804 - protein, 9 aa, Homo Sapiens
RGAAAVPPL

SEQ ID NO: 1251805 - protein, 9 aa, Homo Sapiens
PYISVPPSP

SEQ ID NO: 1251806 - protein, 9 aa, Homo Sapiens
DCKGFYKRK

SEQ ID NO: 1251807 - protein, 9 aa, Homo Sapiens
ACRIPITPE

SEQ ID NO: 1251808 - protein, 9 aa, Homo Sapiens
MEDLGDKVV

SEQ ID NO: 1251809 - protein, 9 aa, Homo Sapiens
TLKHDTLKG

SEQ ID NO: 1251810 - protein, 9 aa, Homo Sapiens
RHCALGREG

SEQ ID NO: 1251811 - protein, 9 aa, Homo Sapiens
IMDENDNAP

SEQ ID NO: 1251812 - protein, 9 aa, Homo Sapiens
KSKITQAIA

SEQ ID NO: 1251813 - protein, 9 aa, Homo Sapiens
VIMLCKGRV

SEQ ID NO: 1251814 - protein, 9 aa, Homo Sapiens
HYFRNRHPG

SEQ ID NO: 1251815 - protein, 9 aa, Homo Sapiens
QLMACVRYI

SEQ ID NO: 1251816 - protein, 9 aa, Homo Sapiens
SRKNEIKFS

SEQ ID NO: 1251817 - protein, 9 aa, Homo Sapiens
APLKEELHI

SEQ ID NO: 1251818 - protein, 9 aa, Homo Sapiens
GLLGRQRQL

SEQ ID NO: 1251819 - protein, 9 aa, Homo Sapiens
VSQSLVNVF

SEQ ID NO: 1251820 - protein, 9 aa, Homo Sapiens
DAINIRDIL

SEQ ID NO: 1251821 - protein, 9 aa, Homo Sapiens
DAWKQYMRM

SEQ ID NO: 1251822 - protein, 9 aa, Homo Sapiens
SFAFGVVFS

SEQ ID NO: 1251823 - protein, 9 aa, Homo Sapiens
EVTEMPVLP

SEQ ID NO: 1251824 - protein, 9 aa, Homo Sapiens
VRGHDTSIY

SEQ ID NO: 1251825 - protein, 9 aa, Homo Sapiens
TKAAGGPCL

SEQ ID NO: 1251826 - protein, 9 aa, Homo Sapiens
PLTTHKIIH

SEQ ID NO: 1251827 - protein, 9 aa, Homo Sapiens
AILMDGFLS

SEQ ID NO: 1251828 - protein, 9 aa, Homo Sapiens
HGSTKRRKS

SEQ ID NO: 1251829 - protein, 9 aa, Homo Sapiens
SERDAPSIE

SEQ ID NO: 1251830 - protein, 9 aa, Homo Sapiens
QKRYHRSRC

SEQ ID NO: 1251831 - protein, 9 aa, Homo Sapiens
MLLAKHLQE

SEQ ID NO: 1251832 - protein, 9 aa, Homo Sapiens
YALCLQKLL

SEQ ID NO: 1251833 - protein, 9 aa, Homo Sapiens
MDTDDERSH

SEQ ID NO: 1251834 - protein, 9 aa, Homo Sapiens
CGGYLAPGP

SEQ ID NO: 1251835 - protein, 9 aa, Homo Sapiens
YFTRKEEDC

SEQ ID NO: 1251836 - protein, 9 aa, Homo Sapiens
NMCLYCGTG

SEQ ID NO: 1251837 - protein, 9 aa, Homo Sapiens
NDTPVTSKG

SEQ ID NO: 1251838 - protein, 9 aa, Homo Sapiens
GECVIDAVR

SEQ ID NO: 1251839 - protein, 9 aa, Homo Sapiens
WLGPNTVLA

SEQ ID NO: 1251840 - protein, 9 aa, Homo Sapiens
YSHQQRDLH

SEQ ID NO: 1251841 - protein, 9 aa, Homo Sapiens
SSDGKEVPF

SEQ ID NO: 1251842 - protein, 9 aa, Homo Sapiens
PGPVGPTGG

SEQ ID NO: 1251843 - protein, 9 aa, Homo Sapiens
RAAVEEKQR

SEQ ID NO: 1251844 - protein, 9 aa, Homo Sapiens
QRSASCKTG

SEQ ID NO: 1251845 - protein, 9 aa, Homo Sapiens
TCTGNRKTV

SEQ ID NO: 1251846 - protein, 9 aa, Homo Sapiens
MRRKGQQRT

SEQ ID NO: 1251847 - protein, 9 aa, Homo Sapiens
ANNGSSKGV

SEQ ID NO: 1251848 - protein, 9 aa, Homo Sapiens
APLQVTTTL

SEQ ID NO: 1251849 - protein, 9 aa, Homo Sapiens
NAATRPTDA

SEQ ID NO: 1251850 - protein, 9 aa, Homo Sapiens
AYTHVCILH

SEQ ID NO: 1251851 - protein, 9 aa, Homo Sapiens
AAPVCIVMR

SEQ ID NO: 1251852 - protein, 9 aa, Homo Sapiens
SLSSFGMAQ

SEQ ID NO: 1251853 - protein, 9 aa, Homo Sapiens
QLKSLSTCG

SEQ ID NO: 1251854 - protein, 9 aa, Homo Sapiens
PYIKMYILV

SEQ ID NO: 1251855 - protein, 9 aa, Homo Sapiens
AIDIQSSLS

SEQ ID NO: 1251856 - protein, 9 aa, Homo Sapiens
DAQMRAVIN

SEQ ID NO: 1251857 - protein, 9 aa, Homo Sapiens
GAQTARTHP

SEQ ID NO: 1251858 - protein, 9 aa, Homo Sapiens
CCGEQDRQG

SEQ ID NO: 1251859 - protein, 9 aa, Homo Sapiens
QEELGKVII

SEQ ID NO: 1251860 - protein, 9 aa, Homo Sapiens
VLAICYDAF

SEQ ID NO: 1251861 - protein, 9 aa, Homo Sapiens
SMLHTMLRV

SEQ ID NO: 1251862 - protein, 9 aa, Homo Sapiens
LVLYGTSMQ

SEQ ID NO: 1251863 - protein, 9 aa, Homo Sapiens
VNAILGVSL

SEQ ID NO: 1251864 - protein, 9 aa, Homo Sapiens
MGERLVLGK

SEQ ID NO: 1251865 - protein, 9 aa, Homo Sapiens
SRHLPEECH

SEQ ID NO: 1251866 - protein, 9 aa, Homo Sapiens
VGSLLLEWC

SEQ ID NO: 1251867 - protein, 9 aa, Homo Sapiens
PRMRQTRHY

SEQ ID NO: 1251868 - protein, 9 aa, Homo Sapiens
EETSAEEDH

SEQ ID NO: 1251869 - protein, 9 aa, Homo Sapiens
GLNGRNRRA

SEQ ID NO: 1251870 - protein, 9 aa, Homo Sapiens
IPDQCSPLS

SEQ ID NO: 1251871 - protein, 9 aa, Homo Sapiens
EEPVTNSLK

SEQ ID NO: 1251872 - protein, 9 aa, Homo Sapiens
LLVFSSKVT

SEQ ID NO: 1251873 - protein, 9 aa, Homo Sapiens
CVNQKQEPC

SEQ ID NO: 1251874 - protein, 9 aa, Homo Sapiens
NMEWIMKAQ

SEQ ID NO: 1251875 - protein, 9 aa, Homo Sapiens
VILGVVHMS

SEQ ID NO: 1251876 - protein, 9 aa, Homo Sapiens
STPAAVGAT

SEQ ID NO: 1251877 - protein, 9 aa, Homo Sapiens
ETEKLSAKG

SEQ ID NO: 1251878 - protein, 9 aa, Homo Sapiens
NRCPGRYMG

SEQ ID NO: 1251879 - protein, 9 aa, Homo Sapiens
MLLSRLHVR

SEQ ID NO: 1251880 - protein, 9 aa, Homo Sapiens
SELMPFLQN

SEQ ID NO: 1251881 - protein, 9 aa, Homo Sapiens
TQKSRVPLS

SEQ ID NO: 1251882 - protein, 9 aa, Homo Sapiens
SLWNLMGDA

SEQ ID NO: 1251883 - protein, 9 aa, Homo Sapiens
PLHYREPVL

SEQ ID NO: 1251884 - protein, 9 aa, Homo Sapiens
QSGSGPHDC

SEQ ID NO: 1251885 - protein, 9 aa, Homo Sapiens
QCSLESHLN

SEQ ID NO: 1251886 - protein, 9 aa, Homo Sapiens
TTLTRKMVL

SEQ ID NO: 1251887 - protein, 9 aa, Homo Sapiens
IGISIVSLC

SEQ ID NO: 1251888 - protein, 9 aa, Homo Sapiens
TDAEIKNGL

SEQ ID NO: 1251889 - protein, 9 aa, Homo Sapiens
YEPPQYMSV

SEQ ID NO: 1251890 - protein, 9 aa, Homo Sapiens
TLTNHHIIH

SEQ ID NO: 1251891 - protein, 9 aa, Homo Sapiens
RDGQGHGQQ

SEQ ID NO: 1251892 - protein, 9 aa, Homo Sapiens
PCLCPCWVS

SEQ ID NO: 1251893 - protein, 9 aa, Homo Sapiens
IPESVGGLE

SEQ ID NO: 1251894 - protein, 9 aa, Homo Sapiens
VVECITMSN

SEQ ID NO: 1251895 - protein, 9 aa, Homo Sapiens
CPQEPRPPK

SEQ ID NO: 1251896 - protein, 9 aa, Homo Sapiens
NLLLLHEVL

SEQ ID NO: 1251897 - protein, 9 aa, Homo Sapiens
DVVDFDVRV

SEQ ID NO: 1251898 - protein, 9 aa, Homo Sapiens
GVSGDHGES

SEQ ID NO: 1251899 - protein, 9 aa, Homo Sapiens
FDFMICISL

SEQ ID NO: 1251900 - protein, 9 aa, Homo Sapiens
VAQEIFRLS

SEQ ID NO: 1251901 - protein, 9 aa, Homo Sapiens
WVLIHASLK

SEQ ID NO: 1251902 - protein, 9 aa, Homo Sapiens
PPHGAIPPA

SEQ ID NO: 1251903 - protein, 9 aa, Homo Sapiens
VHMNQEDLA

SEQ ID NO: 1251904 - protein, 9 aa, Homo Sapiens
GHNRRHFKV

SEQ ID NO: 1251905 - protein, 9 aa, Homo Sapiens
KLDKVQIHD

SEQ ID NO: 1251906 - protein, 9 aa, Homo Sapiens
KQEHVVVRP

SEQ ID NO: 1251907 - protein, 9 aa, Homo Sapiens
LPVSATSGT

SEQ ID NO: 1251908 - protein, 9 aa, Homo Sapiens
QPSTPETAT

SEQ ID NO: 1251909 - protein, 9 aa, Homo Sapiens
VGVQSAPSS

SEQ ID NO: 1251910 - protein, 9 aa, Homo Sapiens
VGHDAKVPF

SEQ ID NO: 1251911 - protein, 9 aa, Homo Sapiens
VCILGVMWS

SEQ ID NO: 1251912 - protein, 9 aa, Homo Sapiens
YFELNAQFS

SEQ ID NO: 1251913 - protein, 9 aa, Homo Sapiens
TGLNMHVIQ

SEQ ID NO: 1251914 - protein, 9 aa, Homo Sapiens
HSVPVAQMS

SEQ ID NO: 1251915 - protein, 9 aa, Homo Sapiens
NYKCYIKNH

SEQ ID NO: 1251916 - protein, 9 aa, Homo Sapiens
KSVRDHYAR

SEQ ID NO: 1251917 - protein, 9 aa, Homo Sapiens
TLLYFVASV

SEQ ID NO: 1251918 - protein, 9 aa, Homo Sapiens
VESVSVSAR

SEQ ID NO: 1251919 - protein, 9 aa, Homo Sapiens
TVLSYMAEM

SEQ ID NO: 1251920 - protein, 9 aa, Homo Sapiens
SIICVEYSL

SEQ ID NO: 1251921 - protein, 9 aa, Homo Sapiens
IWKGPGNCH

SEQ ID NO: 1251922 - protein, 9 aa, Homo Sapiens
GFDMQMVAQ

SEQ ID NO: 1251923 - protein, 9 aa, Homo Sapiens
PFKSMYLSE

SEQ ID NO: 1251924 - protein, 9 aa, Homo Sapiens
KLKFSGSLP

SEQ ID NO: 1251925 - protein, 9 aa, Homo Sapiens
IEALPHTHE

SEQ ID NO: 1251926 - protein, 9 aa, Homo Sapiens
EEDFPTLVS

SEQ ID NO: 1251927 - protein, 9 aa, Homo Sapiens
IPKTWHSAE

SEQ ID NO: 1251928 - protein, 9 aa, Homo Sapiens
TEGSTPGTA

SEQ ID NO: 1251929 - protein, 9 aa, Homo Sapiens
GFLARKVNS

SEQ ID NO: 1251930 - protein, 9 aa, Homo Sapiens
KDAFTKTHH

SEQ ID NO: 1251931 - protein, 9 aa, Homo Sapiens
NLCVISIDR

SEQ ID NO: 1251932 - protein, 9 aa, Homo Sapiens
MISNGIERN

SEQ ID NO: 1251933 - protein, 9 aa, Homo Sapiens
EQHVRKNKM

SEQ ID NO: 1251934 - protein, 9 aa, Homo Sapiens
KLTGVHTVA

SEQ ID NO: 1251935 - protein, 9 aa, Homo Sapiens
INDGHWDIN

SEQ ID NO: 1251936 - protein, 9 aa, Homo Sapiens
SSPQPHWIT

SEQ ID NO: 1251937 - protein, 9 aa, Homo Sapiens
QSPESTMDN

SEQ ID NO: 1251938 - protein, 9 aa, Homo Sapiens
CQQICRWHT

SEQ ID NO: 1251939 - protein, 9 aa, Homo Sapiens
QHFRYPERP

SEQ ID NO: 1251940 - protein, 9 aa, Homo Sapiens
LVQPRRSAP

SEQ ID NO: 1251941 - protein, 9 aa, Homo Sapiens
EDYGHLPRE

SEQ ID NO: 1251942 - protein, 9 aa, Homo Sapiens
QRMPAFLDN

SEQ ID NO: 1251943 - protein, 9 aa, Homo Sapiens
TGENSNEVT

SEQ ID NO: 1251944 - protein, 9 aa, Homo Sapiens
LNLQVTMAV

SEQ ID NO: 1251945 - protein, 9 aa, Homo Sapiens
GAPGPDGAT

SEQ ID NO: 1251946 - protein, 9 aa, Homo Sapiens
PGVHPEVEN

SEQ ID NO: 1251947 - protein, 9 aa, Homo Sapiens
GSGITESND

SEQ ID NO: 1251948 - protein, 9 aa, Homo Sapiens
QDALETASR

SEQ ID NO: 1251949 - protein, 9 aa, Homo Sapiens
PMEQFILPE

SEQ ID NO: 1251950 - protein, 9 aa, Homo Sapiens
NLCGVSKPT

SEQ ID NO: 1251951 - protein, 9 aa, Homo Sapiens
DVASIISFD

SEQ ID NO: 1251952 - protein, 9 aa, Homo Sapiens
VLTEYVRAQ

SEQ ID NO: 1251953 - protein, 9 aa, Homo Sapiens
TNLFIYPSN

SEQ ID NO: 1251954 - protein, 9 aa, Homo Sapiens
RPIFCPVHK

SEQ ID NO: 1251955 - protein, 9 aa, Homo Sapiens
CGSFIPARY

SEQ ID NO: 1251956 - protein, 9 aa, Homo Sapiens
LVVAASPSA

SEQ ID NO: 1251957 - protein, 9 aa, Homo Sapiens
CYEEKTQKQ

SEQ ID NO: 1251958 - protein, 9 aa, Homo Sapiens
GSSALGPLG

SEQ ID NO: 1251959 - protein, 9 aa, Homo Sapiens
KKVMTCPRC

SEQ ID NO: 1251960 - protein, 9 aa, Homo Sapiens
QLEGMSPIC

SEQ ID NO: 1251961 - protein, 9 aa, Homo Sapiens
HKFCPLLCT

SEQ ID NO: 1251962 - protein, 9 aa, Homo Sapiens
ITFHITSAA

SEQ ID NO: 1251963 - protein, 9 aa, Homo Sapiens
CRLSGEMIS

SEQ ID NO: 1251964 - protein, 9 aa, Homo Sapiens
YVAHLDGRL

SEQ ID NO: 1251965 - protein, 9 aa, Homo Sapiens
LIPYVITLV

SEQ ID NO: 1251966 - protein, 9 aa, Homo Sapiens
GVQWHYLGS

SEQ ID NO: 1251967 - protein, 9 aa, Homo Sapiens
VYLEEMYWN

SEQ ID NO: 1251968 - protein, 9 aa, Homo Sapiens
TILRSLTDD

SEQ ID NO: 1251969 - protein, 9 aa, Homo Sapiens
SDESEEETE

SEQ ID NO: 1251970 - protein, 9 aa, Homo Sapiens
QTWLDPDPA

SEQ ID NO: 1251971 - protein, 9 aa, Homo Sapiens
AKMYPANFT

SEQ ID NO: 1251972 - protein, 9 aa, Homo Sapiens
EPAQHCSMI

SEQ ID NO: 1251973 - protein, 9 aa, Homo Sapiens
EYDEEPIPE

SEQ ID NO: 1251974 - protein, 9 aa, Homo Sapiens
SGQLIDKCW

SEQ ID NO: 1251975 - protein, 9 aa, Homo Sapiens
NLMYDVTKE

SEQ ID NO: 1251976 - protein, 9 aa, Homo Sapiens
GTHSSREYD

SEQ ID NO: 1251977 - protein, 9 aa, Homo Sapiens
SSSLSSLVT

SEQ ID NO: 1251978 - protein, 9 aa, Homo Sapiens
LWTWEMPGA

SEQ ID NO: 1251979 - protein, 9 aa, Homo Sapiens
SWDVAVVLK

SEQ ID NO: 1251980 - protein, 9 aa, Homo Sapiens
VETNEKSKE

SEQ ID NO: 1251981 - protein, 9 aa, Homo Sapiens
DEDTCVECE

SEQ ID NO: 1251982 - protein, 9 aa, Homo Sapiens
MMGHIKPIK

SEQ ID NO: 1251983 - protein, 9 aa, Homo Sapiens
DPYFTDIFL

SEQ ID NO: 1251984 - protein, 9 aa, Homo Sapiens
REVGKSELV

SEQ ID NO: 1251985 - protein, 9 aa, Homo Sapiens
LMATAPAAS

SEQ ID NO: 1251986 - protein, 9 aa, Homo Sapiens
QNASGSVMI

SEQ ID NO: 1251987 - protein, 9 aa, Homo Sapiens
VSLFHLTQG

SEQ ID NO: 1251988 - protein, 9 aa, Homo Sapiens
STAPAPKFS

SEQ ID NO: 1251989 - protein, 9 aa, Homo Sapiens
YLDDVNEIL

SEQ ID NO: 1251990 - protein, 9 aa, Homo Sapiens
PPLQFLPQG

SEQ ID NO: 1251991 - protein, 9 aa, Homo Sapiens
VPSSPAVLT

SEQ ID NO: 1251992 - protein, 9 aa, Homo Sapiens
KNGGKDCDS

SEQ ID NO: 1251993 - protein, 9 aa, Homo Sapiens
NFFVTEGNC

SEQ ID NO: 1251994 - protein, 9 aa, Homo Sapiens
DFVCYLGDP

SEQ ID NO: 1251995 - protein, 9 aa, Homo Sapiens
QKTHLEDMY

SEQ ID NO: 1251996 - protein, 9 aa, Homo Sapiens
ALQERAEGI

SEQ ID NO: 1251997 - protein, 9 aa, Homo Sapiens
AGPRNCICQ

SEQ ID NO: 1251998 - protein, 9 aa, Homo Sapiens
ERLFKATGP

SEQ ID NO: 1251999 - protein, 9 aa, Homo Sapiens
PRVLMKHKK

SEQ ID NO: 1252000 - protein, 9 aa, Homo Sapiens
SDWWPTVSK

SEQ ID NO: 1252001 - protein, 9 aa, Homo Sapiens
IYNQVIVVL

SEQ ID NO: 1252002 - protein, 9 aa, Homo Sapiens
WIMKRKAFQ

SEQ ID NO: 1252003 - protein, 9 aa, Homo Sapiens
VPLSKAYQG

SEQ ID NO: 1252004 - protein, 9 aa, Homo Sapiens
TEVELKHPL

SEQ ID NO: 1252005 - protein, 9 aa, Homo Sapiens
LEASLEYAK

SEQ ID NO: 1252006 - protein, 9 aa, Homo Sapiens
VSTITSIFS

SEQ ID NO: 1252007 - protein, 9 aa, Homo Sapiens
RCFAFVRDL

SEQ ID NO: 1252008 - protein, 9 aa, Homo Sapiens
EQFPGCRMC

SEQ ID NO: 1252009 - protein, 9 aa, Homo Sapiens
DLLQCSQKD

SEQ ID NO: 1252010 - protein, 9 aa, Homo Sapiens
KIYKYDRME

SEQ ID NO: 1252011 - protein, 9 aa, Homo Sapiens
MESLTLWLL

SEQ ID NO: 1252012 - protein, 9 aa, Homo Sapiens
KFSSEPPTQ

SEQ ID NO: 1252013 - protein, 9 aa, Homo Sapiens
STAPPMWPP

SEQ ID NO: 1252014 - protein, 9 aa, Homo Sapiens
HFGTGTPAP

SEQ ID NO: 1252015 - protein, 9 aa, Homo Sapiens
NLLLDQACH

SEQ ID NO: 1252016 - protein, 9 aa, Homo Sapiens
WICWRSRWQ

SEQ ID NO: 1252017 - protein, 9 aa, Homo Sapiens
LELYDCRQV

SEQ ID NO: 1252018 - protein, 9 aa, Homo Sapiens
EITMCEPEF

SEQ ID NO: 1252019 - protein, 9 aa, Homo Sapiens
QEDESCYNC

SEQ ID NO: 1252020 - protein, 9 aa, Homo Sapiens
QLKYFVLGL

SEQ ID NO: 1252021 - protein, 9 aa, Homo Sapiens
RANIRRMCR

SEQ ID NO: 1252022 - protein, 9 aa, Homo Sapiens
IQRQKVWSE

SEQ ID NO: 1252023 - protein, 9 aa, Homo Sapiens
TQGGHMNSG

SEQ ID NO: 1252024 - protein, 9 aa, Homo Sapiens
HYFLRQPQV

SEQ ID NO: 1252025 - protein, 9 aa, Homo Sapiens
SASGCHVVN

SEQ ID NO: 1252026 - protein, 9 aa, Homo Sapiens
APAPPGRPQ

SEQ ID NO: 1252027 - protein, 9 aa, Homo Sapiens
VLKIHIDFS

SEQ ID NO: 1252028 - protein, 9 aa, Homo Sapiens
VFKGADLDP

SEQ ID NO: 1252029 - protein, 9 aa, Homo Sapiens
SAAQNSKLR

SEQ ID NO: 1252030 - protein, 9 aa, Homo Sapiens
REGHSKTFD

SEQ ID NO: 1252031 - protein, 9 aa, Homo Sapiens
IYQDKDNTL

SEQ ID NO: 1252032 - protein, 9 aa, Homo Sapiens
LTRPRVFYI

SEQ ID NO: 1252033 - protein, 9 aa, Homo Sapiens
GSGFGCGYG

SEQ ID NO: 1252034 - protein, 9 aa, Homo Sapiens
CVNTDAEKI

SEQ ID NO: 1252035 - protein, 9 aa, Homo Sapiens
WHCSMAANT

SEQ ID NO: 1252036 - protein, 9 aa, Homo Sapiens
EDPKDALFR

SEQ ID NO: 1252037 - protein, 9 aa, Homo Sapiens
LPGGPWLRM

SEQ ID NO: 1252038 - protein, 9 aa, Homo Sapiens
SISAFMFTV

SEQ ID NO: 1252039 - protein, 9 aa, Homo Sapiens
QLENAITYE

SEQ ID NO: 1252040 - protein, 9 aa, Homo Sapiens
DISMNHKTC

SEQ ID NO: 1252041 - protein, 9 aa, Homo Sapiens
GVDLYHLEK

SEQ ID NO: 1252042 - protein, 9 aa, Homo Sapiens
GLGKEAEFV

SEQ ID NO: 1252043 - protein, 9 aa, Homo Sapiens
KILGDCYHC

SEQ ID NO: 1252044 - protein, 9 aa, Homo Sapiens
PHHITCIYD

SEQ ID NO: 1252045 - protein, 9 aa, Homo Sapiens
AIYFVMLLA

SEQ ID NO: 1252046 - protein, 9 aa, Homo Sapiens
FNATYQVDV

SEQ ID NO: 1252047 - protein, 9 aa, Homo Sapiens
DELEMTGID

SEQ ID NO: 1252048 - protein, 9 aa, Homo Sapiens
WMILTAGSM

SEQ ID NO: 1252049 - protein, 9 aa, Homo Sapiens
PKKKCLRLA

SEQ ID NO: 1252050 - protein, 9 aa, Homo Sapiens
SFSNCWTPL

SEQ ID NO: 1252051 - protein, 9 aa, Homo Sapiens
HLLPLWPLM

SEQ ID NO: 1252052 - protein, 9 aa, Homo Sapiens
KLKQDKKFP

SEQ ID NO: 1252053 - protein, 9 aa, Homo Sapiens
TTELSTQTI

SEQ ID NO: 1252054 - protein, 9 aa, Homo Sapiens
RACPATHAL

SEQ ID NO: 1252055 - protein, 9 aa, Homo Sapiens
FPRRFVLVG

SEQ ID NO: 1252056 - protein, 9 aa, Homo Sapiens
GLHTIALTG

SEQ ID NO: 1252057 - protein, 9 aa, Homo Sapiens
RLLPDVLLE

SEQ ID NO: 1252058 - protein, 9 aa, Homo Sapiens
LLKAPDSTS

SEQ ID NO: 1252059 - protein, 9 aa, Homo Sapiens
YCFRVLSSS

SEQ ID NO: 1252060 - protein, 9 aa, Homo Sapiens
YLEEMYWNE

SEQ ID NO: 1252061 - protein, 9 aa, Homo Sapiens
LLVSSRSIC

SEQ ID NO: 1252062 - protein, 9 aa, Homo Sapiens
AAAGILGHA

SEQ ID NO: 1252063 - protein, 9 aa, Homo Sapiens
GSQKKSVDR

SEQ ID NO: 1252064 - protein, 9 aa, Homo Sapiens
VQRVTLEGR

SEQ ID NO: 1252065 - protein, 9 aa, Homo Sapiens
IGITLSSSL

SEQ ID NO: 1252066 - protein, 9 aa, Homo Sapiens
SGTSDFTLS

SEQ ID NO: 1252067 - protein, 9 aa, Homo Sapiens
DTPSTIFIM

SEQ ID NO: 1252068 - protein, 9 aa, Homo Sapiens
LPPEFEAII

SEQ ID NO: 1252069 - protein, 9 aa, Homo Sapiens
CSIICVEYS

SEQ ID NO: 1252070 - protein, 9 aa, Homo Sapiens
NVRLSDQDV

SEQ ID NO: 1252071 - protein, 9 aa, Homo Sapiens
HPAKPKYFS

SEQ ID NO: 1252072 - protein, 9 aa, Homo Sapiens
CHPMTNNAG

SEQ ID NO: 1252073 - protein, 9 aa, Homo Sapiens
VGNEWIMQK

SEQ ID NO: 1252074 - protein, 9 aa, Homo Sapiens
QLDMEGMLH

SEQ ID NO: 1252075 - protein, 9 aa, Homo Sapiens
FSTRGFPRH

SEQ ID NO: 1252076 - protein, 9 aa, Homo Sapiens
NSGNVRNPA

SEQ ID NO: 1252077 - protein, 9 aa, Homo Sapiens
QPNRHGVYT

SEQ ID NO: 1252078 - protein, 9 aa, Homo Sapiens
DTPTIVSHK

SEQ ID NO: 1252079 - protein, 9 aa, Homo Sapiens
TVVAYYQQA

SEQ ID NO: 1252080 - protein, 9 aa, Homo Sapiens
LQTCLTHPM

SEQ ID NO: 1252081 - protein, 9 aa, Homo Sapiens
SKALWENMG

SEQ ID NO: 1252082 - protein, 9 aa, Homo Sapiens
LTLLGNGGA

SEQ ID NO: 1252083 - protein, 9 aa, Homo Sapiens
DDYRVGFGN

SEQ ID NO: 1252084 - protein, 9 aa, Homo Sapiens
HPPQAPLPM

SEQ ID NO: 1252085 - protein, 9 aa, Homo Sapiens
VAPGAHFHI

SEQ ID NO: 1252086 - protein, 9 aa, Homo Sapiens
LGTMFQNPQ

SEQ ID NO: 1252087 - protein, 9 aa, Homo Sapiens
PPPHGPPPP

SEQ ID NO: 1252088 - protein, 9 aa, Homo Sapiens
QNTIGAAFM

SEQ ID NO: 1252089 - protein, 9 aa, Homo Sapiens
RIPFDRDKY

SEQ ID NO: 1252090 - protein, 9 aa, Homo Sapiens
GHMSSAALI

SEQ ID NO: 1252091 - protein, 9 aa, Homo Sapiens
RMYTAIQEP

SEQ ID NO: 1252092 - protein, 9 aa, Homo Sapiens
KYGYALCLQ

SEQ ID NO: 1252093 - protein, 9 aa, Homo Sapiens
KSDSPTSLS

SEQ ID NO: 1252094 - protein, 9 aa, Homo Sapiens
IGGDCYIMS

SEQ ID NO: 1252095 - protein, 9 aa, Homo Sapiens
GQKCSTCSR

SEQ ID NO: 1252096 - protein, 9 aa, Homo Sapiens
HNVCLLEVY

SEQ ID NO: 1252097 - protein, 9 aa, Homo Sapiens
SESIFDMDY

SEQ ID NO: 1252098 - protein, 9 aa, Homo Sapiens
FLETTHQTS

SEQ ID NO: 1252099 - protein, 9 aa, Homo Sapiens
VNKAIDQLQ

SEQ ID NO: 1252100 - protein, 9 aa, Homo Sapiens
EGVEQAPTQ

SEQ ID NO: 1252101 - protein, 9 aa, Homo Sapiens
AMIRSMDTL

SEQ ID NO: 1252102 - protein, 9 aa, Homo Sapiens
ARCEHVQAW

SEQ ID NO: 1252103 - protein, 9 aa, Homo Sapiens
TIYHAIDHN

SEQ ID NO: 1252104 - protein, 9 aa, Homo Sapiens
VPGTPGFMT

SEQ ID NO: 1252105 - protein, 9 aa, Homo Sapiens
RCLVPEGLP

SEQ ID NO: 1252106 - protein, 9 aa, Homo Sapiens
KMVIVLDDR

SEQ ID NO: 1252107 - protein, 9 aa, Homo Sapiens
PATLRFLAL

SEQ ID NO: 1252108 - protein, 9 aa, Homo Sapiens
PANAKALKN

SEQ ID NO: 1252109 - protein, 9 aa, Homo Sapiens
QLGQEYGKN

SEQ ID NO: 1252110 - protein, 9 aa, Homo Sapiens
AGRYSFLVR

SEQ ID NO: 1252111 - protein, 9 aa, Homo Sapiens
FIPSLLIGT

SEQ ID NO: 1252112 - protein, 9 aa, Homo Sapiens
DINLLGVLE

SEQ ID NO: 1252113 - protein, 9 aa, Homo Sapiens
EQVQAYVMR

SEQ ID NO: 1252114 - protein, 9 aa, Homo Sapiens
RKLFIGGLN

SEQ ID NO: 1252115 - protein, 9 aa, Homo Sapiens
TGMHRHTHT

SEQ ID NO: 1252116 - protein, 9 aa, Homo Sapiens
AECLTVVVV

SEQ ID NO: 1252117 - protein, 9 aa, Homo Sapiens
NPFECNDCG

SEQ ID NO: 1252118 - protein, 9 aa, Homo Sapiens
VMGIDTSGT

SEQ ID NO: 1252119 - protein, 9 aa, Homo Sapiens
EPGSTCLLS

SEQ ID NO: 1252120 - protein, 9 aa, Homo Sapiens
KTNPCGSMS

SEQ ID NO: 1252121 - protein, 9 aa, Homo Sapiens
HIPLTPGSD

SEQ ID NO: 1252122 - protein, 9 aa, Homo Sapiens
DETYGYKED

SEQ ID NO: 1252123 - protein, 9 aa, Homo Sapiens
SDILTLLGL

SEQ ID NO: 1252124 - protein, 9 aa, Homo Sapiens
DTPVTSKGG

SEQ ID NO: 1252125 - protein, 9 aa, Homo Sapiens
SHTALHVAA

SEQ ID NO: 1252126 - protein, 9 aa, Homo Sapiens
RLLYVPPTC

SEQ ID NO: 1252127 - protein, 9 aa, Homo Sapiens
KYNHDNEKV

SEQ ID NO: 1252128 - protein, 9 aa, Homo Sapiens
TFVGSISTV

SEQ ID NO: 1252129 - protein, 9 aa, Homo Sapiens
GRDRQSEEQ

SEQ ID NO: 1252130 - protein, 9 aa, Homo Sapiens
QELEGMLNP

SEQ ID NO: 1252131 - protein, 9 aa, Homo Sapiens
SKESESHIL

SEQ ID NO: 1252132 - protein, 9 aa, Homo Sapiens
TILDDEPVI

SEQ ID NO: 1252133 - protein, 9 aa, Homo Sapiens
ATGYSGYIQ

SEQ ID NO: 1252134 - protein, 9 aa, Homo Sapiens
TYCFMVDSK

SEQ ID NO: 1252135 - protein, 9 aa, Homo Sapiens
PGISGQDGP

SEQ ID NO: 1252136 - protein, 9 aa, Homo Sapiens
DLEPVKTLI

SEQ ID NO: 1252137 - protein, 9 aa, Homo Sapiens
EHVHLLSLF

SEQ ID NO: 1252138 - protein, 9 aa, Homo Sapiens
ITFNGQVFQ

SEQ ID NO: 1252139 - protein, 9 aa, Homo Sapiens
ILLNIVHST

SEQ ID NO: 1252140 - protein, 9 aa, Homo Sapiens
ERCPWRIWF

SEQ ID NO: 1252141 - protein, 9 aa, Homo Sapiens
YEKRNVSNH

SEQ ID NO: 1252142 - protein, 9 aa, Homo Sapiens
AEKYDSDHT

SEQ ID NO: 1252143 - protein, 9 aa, Homo Sapiens
RSLTDDVPL

SEQ ID NO: 1252144 - protein, 9 aa, Homo Sapiens
QVAVVEDFF

SEQ ID NO: 1252145 - protein, 9 aa, Homo Sapiens
WTSLYIHVD

SEQ ID NO: 1252146 - protein, 9 aa, Homo Sapiens
KQGHWKANC

SEQ ID NO: 1252147 - protein, 9 aa, Homo Sapiens
TDSSENILP

SEQ ID NO: 1252148 - protein, 9 aa, Homo Sapiens
RGREKCHSS

SEQ ID NO: 1252149 - protein, 9 aa, Homo Sapiens
TLNLANTLQ

SEQ ID NO: 1252150 - protein, 9 aa, Homo Sapiens
EENRIDVDI

SEQ ID NO: 1252151 - protein, 9 aa, Homo Sapiens
VAHICRENA

SEQ ID NO: 1252152 - protein, 9 aa, Homo Sapiens
LIYFFVERK

SEQ ID NO: 1252153 - protein, 9 aa, Homo Sapiens
TAVNFSSIS

SEQ ID NO: 1252154 - protein, 9 aa, Homo Sapiens
KTPRLSRNK

SEQ ID NO: 1252155 - protein, 9 aa, Homo Sapiens
LGEEVSLHF

SEQ ID NO: 1252156 - protein, 9 aa, Homo Sapiens
YSATHPTVN

SEQ ID NO: 1252157 - protein, 9 aa, Homo Sapiens
IRRAQKEVA

SEQ ID NO: 1252158 - protein, 9 aa, Homo Sapiens
RQKTQAYHR

SEQ ID NO: 1252159 - protein, 9 aa, Homo Sapiens
HSSGVALSI

SEQ ID NO: 1252160 - protein, 9 aa, Homo Sapiens
YPLSCFTLF

SEQ ID NO: 1252161 - protein, 9 aa, Homo Sapiens
GIPNIQSGY

SEQ ID NO: 1252162 - protein, 9 aa, Homo Sapiens
LRDAREQWL

SEQ ID NO: 1252163 - protein, 9 aa, Homo Sapiens
KTGALWHIY

SEQ ID NO: 1252164 - protein, 9 aa, Homo Sapiens
IHGTRLPPP

SEQ ID NO: 1252165 - protein, 9 aa, Homo Sapiens
HRVTLLAQT

SEQ ID NO: 1252166 - protein, 9 aa, Homo Sapiens
VCYILMIRR

SEQ ID NO: 1252167 - protein, 9 aa, Homo Sapiens
GVTTTQFRV

SEQ ID NO: 1252168 - protein, 9 aa, Homo Sapiens
KDGNCRYCI

SEQ ID NO: 1252169 - protein, 9 aa, Homo Sapiens
NMQCQPQQG

SEQ ID NO: 1252170 - protein, 9 aa, Homo Sapiens
VSIACSSCV

SEQ ID NO: 1252171 - protein, 9 aa, Homo Sapiens
EHHHGQGAE

SEQ ID NO: 1252172 - protein, 9 aa, Homo Sapiens
GGFMSLSSQ

SEQ ID NO: 1252173 - protein, 9 aa, Homo Sapiens
MFEQHLLPA

SEQ ID NO: 1252174 - protein, 9 aa, Homo Sapiens
FILGADPHF

SEQ ID NO: 1252175 - protein, 9 aa, Homo Sapiens
VNAVGNHLN

SEQ ID NO: 1252176 - protein, 9 aa, Homo Sapiens
TTEPTSRAT

SEQ ID NO: 1252177 - protein, 9 aa, Homo Sapiens
KLLPHRHLS

SEQ ID NO: 1252178 - protein, 9 aa, Homo Sapiens
RPRGMAADM

SEQ ID NO: 1252179 - protein, 9 aa, Homo Sapiens
FRWKKLSQS

SEQ ID NO: 1252180 - protein, 9 aa, Homo Sapiens
PVCYATDGG

SEQ ID NO: 1252181 - protein, 9 aa, Homo Sapiens
VSFSLGPCG

SEQ ID NO: 1252182 - protein, 9 aa, Homo Sapiens
VTEVKEGAL

SEQ ID NO: 1252183 - protein, 9 aa, Homo Sapiens
VSAEPLTAL

SEQ ID NO: 1252184 - protein, 9 aa, Homo Sapiens
DVTNPDFKA

SEQ ID NO: 1252185 - protein, 9 aa, Homo Sapiens
DQQHPRLLI

SEQ ID NO: 1252186 - protein, 9 aa, Homo Sapiens
LSVVFKGAD

SEQ ID NO: 1252187 - protein, 9 aa, Homo Sapiens
NRDQVQKVD

SEQ ID NO: 1252188 - protein, 9 aa, Homo Sapiens
PVKTLITQC

SEQ ID NO: 1252189 - protein, 9 aa, Homo Sapiens
CHILLIQGQ

SEQ ID NO: 1252190 - protein, 9 aa, Homo Sapiens
YFLEFEGDT

SEQ ID NO: 1252191 - protein, 9 aa, Homo Sapiens
WGMLSSLKL

SEQ ID NO: 1252192 - protein, 9 aa, Homo Sapiens
LSMSTLRSA

SEQ ID NO: 1252193 - protein, 9 aa, Homo Sapiens
DSACQDVNE

SEQ ID NO: 1252194 - protein, 9 aa, Homo Sapiens
LNTQRAGYK

SEQ ID NO: 1252195 - protein, 9 aa, Homo Sapiens
TAHHPGKSN

SEQ ID NO: 1252196 - protein, 9 aa, Homo Sapiens
LYNISFTSF

SEQ ID NO: 1252197 - protein, 9 aa, Homo Sapiens
ACPATHALE

SEQ ID NO: 1252198 - protein, 9 aa, Homo Sapiens
GTSPVHGAP

SEQ ID NO: 1252199 - protein, 9 aa, Homo Sapiens
SIMAGKFCI

SEQ ID NO: 1252200 - protein, 9 aa, Homo Sapiens
QGIFPHGID

SEQ ID NO: 1252201 - protein, 9 aa, Homo Sapiens
SRWPTMLDK

SEQ ID NO: 1252202 - protein, 9 aa, Homo Sapiens
ITKEVSTTE

SEQ ID NO: 1252203 - protein, 9 aa, Homo Sapiens
MFVRDEIQC

SEQ ID NO: 1252204 - protein, 9 aa, Homo Sapiens
ISELDLEDK

SEQ ID NO: 1252205 - protein, 9 aa, Homo Sapiens
TMTLPGMHP

SEQ ID NO: 1252206 - protein, 9 aa, Homo Sapiens
SEEAHRVYG

SEQ ID NO: 1252207 - protein, 9 aa, Homo Sapiens
SMSIIGSTN

SEQ ID NO: 1252208 - protein, 9 aa, Homo Sapiens
HKLRVTNTS

SEQ ID NO: 1252209 - protein, 9 aa, Homo Sapiens
GNTTFKTDM

SEQ ID NO: 1252210 - protein, 9 aa, Homo Sapiens
WALLRFIMP

SEQ ID NO: 1252211 - protein, 9 aa, Homo Sapiens
QDSSTNIHK

SEQ ID NO: 1252212 - protein, 9 aa, Homo Sapiens
RHLMRPLCL

SEQ ID NO: 1252213 - protein, 9 aa, Homo Sapiens
SRRDTREVA

SEQ ID NO: 1252214 - protein, 9 aa, Homo Sapiens
HSPRHKPHI

SEQ ID NO: 1252215 - protein, 9 aa, Homo Sapiens
RRHREADVS

SEQ ID NO: 1252216 - protein, 9 aa, Homo Sapiens
PASQPCTPS

SEQ ID NO: 1252217 - protein, 9 aa, Homo Sapiens
HSCLQCSES

SEQ ID NO: 1252218 - protein, 9 aa, Homo Sapiens
TDTESGDAN

SEQ ID NO: 1252219 - protein, 9 aa, Homo Sapiens
PCCGATERD

SEQ ID NO: 1252220 - protein, 9 aa, Homo Sapiens
KFIIGKDST

SEQ ID NO: 1252221 - protein, 9 aa, Homo Sapiens
EDSRLAHYN

SEQ ID NO: 1252222 - protein, 9 aa, Homo Sapiens
NGEQPLSVM

SEQ ID NO: 1252223 - protein, 9 aa, Homo Sapiens
SMFLSMYLV

SEQ ID NO: 1252224 - protein, 9 aa, Homo Sapiens
DLFRNPSMC

SEQ ID NO: 1252225 - protein, 9 aa, Homo Sapiens
EKIERLNAE

SEQ ID NO: 1252226 - protein, 9 aa, Homo Sapiens
RRMTPLSAE

SEQ ID NO: 1252227 - protein, 9 aa, Homo Sapiens
DDSGEAMGL

SEQ ID NO: 1252228 - protein, 9 aa, Homo Sapiens
TDAQDCELP

SEQ ID NO: 1252229 - protein, 9 aa, Homo Sapiens
TDQRITSDD

SEQ ID NO: 1252230 - protein, 9 aa, Homo Sapiens
FAVTDVNAS

SEQ ID NO: 1252231 - protein, 9 aa, Homo Sapiens
DCVHARAAL

SEQ ID NO: 1252232 - protein, 9 aa, Homo Sapiens
STCSRLYVP

SEQ ID NO: 1252233 - protein, 9 aa, Homo Sapiens
KAGMIVRCV

SEQ ID NO: 1252234 - protein, 9 aa, Homo Sapiens
KSPTCQKMS

SEQ ID NO: 1252235 - protein, 9 aa, Homo Sapiens
WWLPYWSSL

SEQ ID NO: 1252236 - protein, 9 aa, Homo Sapiens
AKRFEITRS

SEQ ID NO: 1252237 - protein, 9 aa, Homo Sapiens
LAMLLDGRI

SEQ ID NO: 1252238 - protein, 9 aa, Homo Sapiens
QRSEHISLT

SEQ ID NO: 1252239 - protein, 9 aa, Homo Sapiens
DDDSPGDKR

SEQ ID NO: 1252240 - protein, 9 aa, Homo Sapiens
QMWSIWDPM

SEQ ID NO: 1252241 - protein, 9 aa, Homo Sapiens
RASIYGQFV

SEQ ID NO: 1252242 - protein, 9 aa, Homo Sapiens
GLICDQACR

SEQ ID NO: 1252243 - protein, 9 aa, Homo Sapiens
DRVVITGQK

SEQ ID NO: 1252244 - protein, 9 aa, Homo Sapiens
STVHYPVSS

SEQ ID NO: 1252245 - protein, 9 aa, Homo Sapiens
ILYETHHRV

SEQ ID NO: 1252246 - protein, 9 aa, Homo Sapiens
NCSKNVMFT

SEQ ID NO: 1252247 - protein, 9 aa, Homo Sapiens
KDTNKSCDA

SEQ ID NO: 1252248 - protein, 9 aa, Homo Sapiens
SKEMMFEGG

SEQ ID NO: 1252249 - protein, 9 aa, Homo Sapiens
SATRARSKH

SEQ ID NO: 1252250 - protein, 9 aa, Homo Sapiens
DDSRLIKVH

SEQ ID NO: 1252251 - protein, 9 aa, Homo Sapiens
ETLLQAGLP

SEQ ID NO: 1252252 - protein, 9 aa, Homo Sapiens
MNKQSKMYS

SEQ ID NO: 1252253 - protein, 9 aa, Homo Sapiens
LLHHPFIKN

SEQ ID NO: 1252254 - protein, 9 aa, Homo Sapiens
YKPGLVHMM

SEQ ID NO: 1252255 - protein, 9 aa, Homo Sapiens
ACGSVREVM

SEQ ID NO: 1252256 - protein, 9 aa, Homo Sapiens
PESTEEYIE

SEQ ID NO: 1252257 - protein, 9 aa, Homo Sapiens
KFKLIKGEM

SEQ ID NO: 1252258 - protein, 9 aa, Homo Sapiens
KLTMVKCNN

SEQ ID NO: 1252259 - protein, 9 aa, Homo Sapiens
YMLLAKHLQ

SEQ ID NO: 1252260 - protein, 9 aa, Homo Sapiens
DRDNLEYSA

SEQ ID NO: 1252261 - protein, 9 aa, Homo Sapiens
VFSMVNVDC

SEQ ID NO: 1252262 - protein, 9 aa, Homo Sapiens
PAVEVGAGS

SEQ ID NO: 1252263 - protein, 9 aa, Homo Sapiens
TLVISLAST

SEQ ID NO: 1252264 - protein, 9 aa, Homo Sapiens
RERNHVKLV

SEQ ID NO: 1252265 - protein, 9 aa, Homo Sapiens
EPSTKVQHC

SEQ ID NO: 1252266 - protein, 9 aa, Homo Sapiens
DQWMDKETT

SEQ ID NO: 1252267 - protein, 9 aa, Homo Sapiens
LEGALINSL

SEQ ID NO: 1252268 - protein, 9 aa, Homo Sapiens
KVFEGRTNI

SEQ ID NO: 1252269 - protein, 9 aa, Homo Sapiens
ISHCTVKLC

SEQ ID NO: 1252270 - protein, 9 aa, Homo Sapiens
IVVMVDEAH

SEQ ID NO: 1252271 - protein, 9 aa, Homo Sapiens
PCQPLTRLS

SEQ ID NO: 1252272 - protein, 9 aa, Homo Sapiens
CTVGLSIKV

SEQ ID NO: 1252273 - protein, 9 aa, Homo Sapiens
LKKLFTDRK

SEQ ID NO: 1252274 - protein, 9 aa, Homo Sapiens
LSESSVKVW

SEQ ID NO: 1252275 - protein, 9 aa, Homo Sapiens
CERRVNHMV

SEQ ID NO: 1252276 - protein, 9 aa, Homo Sapiens
SVCQRDSKI

SEQ ID NO: 1252277 - protein, 9 aa, Homo Sapiens
FQMMEGKAF

SEQ ID NO: 1252278 - protein, 9 aa, Homo Sapiens
LVMLGLCSW

SEQ ID NO: 1252279 - protein, 9 aa, Homo Sapiens
GPPASSTAP

SEQ ID NO: 1252280 - protein, 9 aa, Homo Sapiens
NGEALIHFV

SEQ ID NO: 1252281 - protein, 9 aa, Homo Sapiens
KIASISNST

SEQ ID NO: 1252282 - protein, 9 aa, Homo Sapiens
VRIGLERAD

SEQ ID NO: 1252283 - protein, 9 aa, Homo Sapiens
MSGTKGMVQ

SEQ ID NO: 1252284 - protein, 9 aa, Homo Sapiens
SPPEGFLIW

SEQ ID NO: 1252285 - protein, 9 aa, Homo Sapiens
PDHPKALKG

SEQ ID NO: 1252286 - protein, 9 aa, Homo Sapiens
TFEDLSDME

SEQ ID NO: 1252287 - protein, 9 aa, Homo Sapiens
YDGKDDTDG

SEQ ID NO: 1252288 - protein, 9 aa, Homo Sapiens
SDSPRRLCL

SEQ ID NO: 1252289 - protein, 9 aa, Homo Sapiens
IIIALSYVR

SEQ ID NO: 1252290 - protein, 9 aa, Homo Sapiens
LANEHERVV

SEQ ID NO: 1252291 - protein, 9 aa, Homo Sapiens
TPSTYVCCL

SEQ ID NO: 1252292 - protein, 9 aa, Homo Sapiens
RSTCLVNWS

SEQ ID NO: 1252293 - protein, 9 aa, Homo Sapiens
MQPFMLYVT

SEQ ID NO: 1252294 - protein, 9 aa, Homo Sapiens
LECLMQEYI

SEQ ID NO: 1252295 - protein, 9 aa, Homo Sapiens
LYNIHLQTG

SEQ ID NO: 1252296 - protein, 9 aa, Homo Sapiens
EMTTERWLV

SEQ ID NO: 1252297 - protein, 9 aa, Homo Sapiens
LEDCHIQPL

SEQ ID NO: 1252298 - protein, 9 aa, Homo Sapiens
QTCLTHPMP

SEQ ID NO: 1252299 - protein, 9 aa, Homo Sapiens
YSMMTRRRT

SEQ ID NO: 1252300 - protein, 9 aa, Homo Sapiens
STHSVTWSV

SEQ ID NO: 1252301 - protein, 9 aa, Homo Sapiens
SPSAPDDQG

SEQ ID NO: 1252302 - protein, 9 aa, Homo Sapiens
KQRRERMTF

SEQ ID NO: 1252303 - protein, 9 aa, Homo Sapiens
RCSDLVSLQ

SEQ ID NO: 1252304 - protein, 9 aa, Homo Sapiens
AVYPALPPY

SEQ ID NO: 1252305 - protein, 9 aa, Homo Sapiens
HATILIYHD

SEQ ID NO: 1252306 - protein, 9 aa, Homo Sapiens
GITESNDMH

SEQ ID NO: 1252307 - protein, 9 aa, Homo Sapiens
MCQPELESS

SEQ ID NO: 1252308 - protein, 9 aa, Homo Sapiens
AVYEAKLLA

SEQ ID NO: 1252309 - protein, 9 aa, Homo Sapiens
TICNMLHGA

SEQ ID NO: 1252310 - protein, 9 aa, Homo Sapiens
SSKPQIKCG

SEQ ID NO: 1252311 - protein, 9 aa, Homo Sapiens
MAFLCAVCG

SEQ ID NO: 1252312 - protein, 9 aa, Homo Sapiens
EFLSKDVSY

SEQ ID NO: 1252313 - protein, 9 aa, Homo Sapiens
IGTPAENKM

SEQ ID NO: 1252314 - protein, 9 aa, Homo Sapiens
NSKSHKHLS

SEQ ID NO: 1252315 - protein, 9 aa, Homo Sapiens
LRVCASITG

SEQ ID NO: 1252316 - protein, 9 aa, Homo Sapiens
DCGVCTNRL

SEQ ID NO: 1252317 - protein, 9 aa, Homo Sapiens
TEIKNILVN

SEQ ID NO: 1252318 - protein, 9 aa, Homo Sapiens
DVGRPDRGC

SEQ ID NO: 1252319 - protein, 9 aa, Homo Sapiens
IASIQSVAT

SEQ ID NO: 1252320 - protein, 9 aa, Homo Sapiens
STASVDFEH

SEQ ID NO: 1252321 - protein, 9 aa, Homo Sapiens
NAGPRYLLD

SEQ ID NO: 1252322 - protein, 9 aa, Homo Sapiens
APLPTIYKH

SEQ ID NO: 1252323 - protein, 9 aa, Homo Sapiens
VHTSEKLYK

SEQ ID NO: 1252324 - protein, 9 aa, Homo Sapiens
ASVVIRSPQ

SEQ ID NO: 1252325 - protein, 9 aa, Homo Sapiens
FQGDQEYSP

SEQ ID NO: 1252326 - protein, 9 aa, Homo Sapiens
PVIVHLPLY

SEQ ID NO: 1252327 - protein, 9 aa, Homo Sapiens
WDDAFTTFC

SEQ ID NO: 1252328 - protein, 9 aa, Homo Sapiens
HDNIAKYKG

SEQ ID NO: 1252329 - protein, 9 aa, Homo Sapiens
IFTTTHNYF

SEQ ID NO: 1252330 - protein, 9 aa, Homo Sapiens
GMVECLRNK

SEQ ID NO: 1252331 - protein, 9 aa, Homo Sapiens
FVEQAEDLK

SEQ ID NO: 1252332 - protein, 9 aa, Homo Sapiens
PDRKVWSCS

SEQ ID NO: 1252333 - protein, 9 aa, Homo Sapiens
KTHLEDMYW

SEQ ID NO: 1252334 - protein, 9 aa, Homo Sapiens
LEYSRILEK

SEQ ID NO: 1252335 - protein, 9 aa, Homo Sapiens
SVHPLNFDL

SEQ ID NO: 1252336 - protein, 9 aa, Homo Sapiens
VVTASFGIG

SEQ ID NO: 1252337 - protein, 9 aa, Homo Sapiens
GYAAMAASS

SEQ ID NO: 1252338 - protein, 9 aa, Homo Sapiens
IEPGGIGIT

SEQ ID NO: 1252339 - protein, 9 aa, Homo Sapiens
CIEKGFAPL

SEQ ID NO: 1252340 - protein, 9 aa, Homo Sapiens
TKEYNNLIL

SEQ ID NO: 1252341 - protein, 9 aa, Homo Sapiens
RVNSMSIIG

SEQ ID NO: 1252342 - protein, 9 aa, Homo Sapiens
EKEEDSSEV

SEQ ID NO: 1252343 - protein, 9 aa, Homo Sapiens
LDWHVRHYR

SEQ ID NO: 1252344 - protein, 9 aa, Homo Sapiens
LHVELNVKQ

SEQ ID NO: 1252345 - protein, 9 aa, Homo Sapiens
SSQNKQTFL

SEQ ID NO: 1252346 - protein, 9 aa, Homo Sapiens
AGEEENTFV

SEQ ID NO: 1252347 - protein, 9 aa, Homo Sapiens
TYVKLDKPG

SEQ ID NO: 1252348 - protein, 9 aa, Homo Sapiens
DVIMKGAHL

SEQ ID NO: 1252349 - protein, 9 aa, Homo Sapiens
VDQVLVKPY

SEQ ID NO: 1252350 - protein, 9 aa, Homo Sapiens
AQVPDAKKS

SEQ ID NO: 1252351 - protein, 9 aa, Homo Sapiens
NMDQNCLSR

SEQ ID NO: 1252352 - protein, 9 aa, Homo Sapiens
EFSNSKKSN

SEQ ID NO: 1252353 - protein, 9 aa, Homo Sapiens
RCQRRGRLG

SEQ ID NO: 1252354 - protein, 9 aa, Homo Sapiens
PRPCQIHIG

SEQ ID NO: 1252355 - protein, 9 aa, Homo Sapiens
RGVDVLLAH

SEQ ID NO: 1252356 - protein, 9 aa, Homo Sapiens
ATTLIQSLD

SEQ ID NO: 1252357 - protein, 9 aa, Homo Sapiens
NAMHTSQQS

SEQ ID NO: 1252358 - protein, 9 aa, Homo Sapiens
GTGTKGPGA

SEQ ID NO: 1252359 - protein, 9 aa, Homo Sapiens
VDTKFLASF

SEQ ID NO: 1252360 - protein, 9 aa, Homo Sapiens
CQEYVYPEA

SEQ ID NO: 1252361 - protein, 9 aa, Homo Sapiens
SPREPTSKV

SEQ ID NO: 1252362 - protein, 9 aa, Homo Sapiens
LSHLSVVGA

SEQ ID NO: 1252363 - protein, 9 aa, Homo Sapiens
FCNQLWHKE

SEQ ID NO: 1252364 - protein, 9 aa, Homo Sapiens
SLYENCQEV

SEQ ID NO: 1252365 - protein, 9 aa, Homo Sapiens
SGKNSGTVS

SEQ ID NO: 1252366 - protein, 9 aa, Homo Sapiens
YLSLSVNHS

SEQ ID NO: 1252367 - protein, 9 aa, Homo Sapiens
FLKLSPEST

SEQ ID NO: 1252368 - protein, 9 aa, Homo Sapiens
GDPKKTHTP

SEQ ID NO: 1252369 - protein, 9 aa, Homo Sapiens
LPPGIKVDG

SEQ ID NO: 1252370 - protein, 9 aa, Homo Sapiens
EQVTPQTGP

SEQ ID NO: 1252371 - protein, 9 aa, Homo Sapiens
ERPFICNWL

SEQ ID NO: 1252372 - protein, 9 aa, Homo Sapiens
VEQIKTNLF

SEQ ID NO: 1252373 - protein, 9 aa, Homo Sapiens
LSYCVVFPL

SEQ ID NO: 1252374 - protein, 9 aa, Homo Sapiens
KDTQTALNN

SEQ ID NO: 1252375 - protein, 9 aa, Homo Sapiens
RDVTYSCIV

SEQ ID NO: 1252376 - protein, 9 aa, Homo Sapiens
RLDGGRHCA

SEQ ID NO: 1252377 - protein, 9 aa, Homo Sapiens
PIFPIIRFC

SEQ ID NO: 1252378 - protein, 9 aa, Homo Sapiens
MVIVLDDRV

SEQ ID NO: 1252379 - protein, 9 aa, Homo Sapiens
TSLVEGEDV

SEQ ID NO: 1252380 - protein, 9 aa, Homo Sapiens
PVRRWKEFV

SEQ ID NO: 1252381 - protein, 9 aa, Homo Sapiens
KHHTLYINI

SEQ ID NO: 1252382 - protein, 9 aa, Homo Sapiens
GTIDFEESL

SEQ ID NO: 1252383 - protein, 9 aa, Homo Sapiens
MNTIDQDDE

SEQ ID NO: 1252384 - protein, 9 aa, Homo Sapiens
TMDACYGIH

SEQ ID NO: 1252385 - protein, 9 aa, Homo Sapiens
ISIEYDSDD

SEQ ID NO: 1252386 - protein, 9 aa, Homo Sapiens
FLSIMSFVD

SEQ ID NO: 1252387 - protein, 9 aa, Homo Sapiens
PWEFRPRVS

SEQ ID NO: 1252388 - protein, 9 aa, Homo Sapiens
SEGSGSSED

SEQ ID NO: 1252389 - protein, 9 aa, Homo Sapiens
SAQLDVHEK

SEQ ID NO: 1252390 - protein, 9 aa, Homo Sapiens
GLVPELVGY

SEQ ID NO: 1252391 - protein, 9 aa, Homo Sapiens
GECQSNGEG

SEQ ID NO: 1252392 - protein, 9 aa, Homo Sapiens
HMENLVAYA

SEQ ID NO: 1252393 - protein, 9 aa, Homo Sapiens
STHSISTAT

SEQ ID NO: 1252394 - protein, 9 aa, Homo Sapiens
LIFQAFSYL

SEQ ID NO: 1252395 - protein, 9 aa, Homo Sapiens
DQHLNNLMA

SEQ ID NO: 1252396 - protein, 9 aa, Homo Sapiens
FKKYQRHHT

SEQ ID NO: 1252397 - protein, 9 aa, Homo Sapiens
KTHLLRMSA

SEQ ID NO: 1252398 - protein, 9 aa, Homo Sapiens
RMEVPLLGI

SEQ ID NO: 1252399 - protein, 9 aa, Homo Sapiens
IMKRKAFQL

SEQ ID NO: 1252400 - protein, 9 aa, Homo Sapiens
SVDVLDEAE

SEQ ID NO: 1252401 - protein, 9 aa, Homo Sapiens
GISDEDSLV

SEQ ID NO: 1252402 - protein, 9 aa, Homo Sapiens
LAQLEEVKQ

SEQ ID NO: 1252403 - protein, 9 aa, Homo Sapiens
ATAAPPESP

SEQ ID NO: 1252404 - protein, 9 aa, Homo Sapiens
VNIAYLAVR

SEQ ID NO: 1252405 - protein, 9 aa, Homo Sapiens
DSAQKEGKN

SEQ ID NO: 1252406 - protein, 9 aa, Homo Sapiens
IPSSGMTWP

SEQ ID NO: 1252407 - protein, 9 aa, Homo Sapiens
EKNPNTFEC

SEQ ID NO: 1252408 - protein, 9 aa, Homo Sapiens
SALPNGLGN

SEQ ID NO: 1252409 - protein, 9 aa, Homo Sapiens
DLKKLFTDR

SEQ ID NO: 1252410 - protein, 9 aa, Homo Sapiens
VEETMQDIR

SEQ ID NO: 1252411 - protein, 9 aa, Homo Sapiens
AAAKTGDCF

SEQ ID NO: 1252412 - protein, 9 aa, Homo Sapiens
SNHSSARYA

SEQ ID NO: 1252413 - protein, 9 aa, Homo Sapiens
LKAHTVWLG

SEQ ID NO: 1252414 - protein, 9 aa, Homo Sapiens
KSCTYIRSN

SEQ ID NO: 1252415 - protein, 9 aa, Homo Sapiens
VGLLFFYHA

SEQ ID NO: 1252416 - protein, 9 aa, Homo Sapiens
LETVNCMSS

SEQ ID NO: 1252417 - protein, 9 aa, Homo Sapiens
RRVGIGHNG

SEQ ID NO: 1252418 - protein, 9 aa, Homo Sapiens
TVDVTARAG

SEQ ID NO: 1252419 - protein, 9 aa, Homo Sapiens
SWGRRPRYD

SEQ ID NO: 1252420 - protein, 9 aa, Homo Sapiens
TGMARSEDH

SEQ ID NO: 1252421 - protein, 9 aa, Homo Sapiens
LRGGTERSP

SEQ ID NO: 1252422 - protein, 9 aa, Homo Sapiens
EQLALPVLM

SEQ ID NO: 1252423 - protein, 9 aa, Homo Sapiens
PGNLVYHFC

SEQ ID NO: 1252424 - protein, 9 aa, Homo Sapiens
ENPDESTYV

SEQ ID NO: 1252425 - protein, 9 aa, Homo Sapiens
ISAPQSAGI

SEQ ID NO: 1252426 - protein, 9 aa, Homo Sapiens
RLTDQRISP

SEQ ID NO: 1252427 - protein, 9 aa, Homo Sapiens
IEKLKKTED

SEQ ID NO: 1252428 - protein, 9 aa, Homo Sapiens
RIHTGEKHY

SEQ ID NO: 1252429 - protein, 9 aa, Homo Sapiens
ALHTAACLE

SEQ ID NO: 1252430 - protein, 9 aa, Homo Sapiens
VVLCCLRSK

SEQ ID NO: 1252431 - protein, 9 aa, Homo Sapiens
EVKISSVVL

SEQ ID NO: 1252432 - protein, 9 aa, Homo Sapiens
HWFTCMFAF

SEQ ID NO: 1252433 - protein, 9 aa, Homo Sapiens
KASHCSKQR

SEQ ID NO: 1252434 - protein, 9 aa, Homo Sapiens
SAPCGAAGA

SEQ ID NO: 1252435 - protein, 9 aa, Homo Sapiens
SPSRSAACG

SEQ ID NO: 1252436 - protein, 9 aa, Homo Sapiens
LVRFCKLEL

SEQ ID NO: 1252437 - protein, 9 aa, Homo Sapiens
SANRFTKAS

SEQ ID NO: 1252438 - protein, 9 aa, Homo Sapiens
PDHRRVHTG

SEQ ID NO: 1252439 - protein, 9 aa, Homo Sapiens
FDVCKGRTK

SEQ ID NO: 1252440 - protein, 9 aa, Homo Sapiens
LVQDKCVNS

SEQ ID NO: 1252441 - protein, 9 aa, Homo Sapiens
HCRLLHQRQ

SEQ ID NO: 1252442 - protein, 9 aa, Homo Sapiens
SFHMVSLHY

SEQ ID NO: 1252443 - protein, 9 aa, Homo Sapiens
LEDSPLVAT

SEQ ID NO: 1252444 - protein, 9 aa, Homo Sapiens
SDPEVRRAT

SEQ ID NO: 1252445 - protein, 9 aa, Homo Sapiens
DLARMELFL

SEQ ID NO: 1252446 - protein, 9 aa, Homo Sapiens
QSSATLPSG

SEQ ID NO: 1252447 - protein, 9 aa, Homo Sapiens
KGKHRKPRK

SEQ ID NO: 1252448 - protein, 9 aa, Homo Sapiens
FDTSRHISV

SEQ ID NO: 1252449 - protein, 9 aa, Homo Sapiens
HAHINVSWC

SEQ ID NO: 1252450 - protein, 9 aa, Homo Sapiens
RCGGHKDSK

SEQ ID NO: 1252451 - protein, 9 aa, Homo Sapiens
HDVPSTLWK

SEQ ID NO: 1252452 - protein, 9 aa, Homo Sapiens
VPLAEPAAQ

SEQ ID NO: 1252453 - protein, 9 aa, Homo Sapiens
IVDALQTAF

SEQ ID NO: 1252454 - protein, 9 aa, Homo Sapiens
TPTPTPSWS

SEQ ID NO: 1252455 - protein, 9 aa, Homo Sapiens
PFEKPIISA

SEQ ID NO: 1252456 - protein, 9 aa, Homo Sapiens
AADINIRLI

SEQ ID NO: 1252457 - protein, 9 aa, Homo Sapiens
LVATGHLLR

SEQ ID NO: 1252458 - protein, 9 aa, Homo Sapiens
KCPPKCITP

SEQ ID NO: 1252459 - protein, 9 aa, Homo Sapiens
AGVTQDLNN

SEQ ID NO: 1252460 - protein, 9 aa, Homo Sapiens
LGKYGPTLL

SEQ ID NO: 1252461 - protein, 9 aa, Homo Sapiens
RKFQGDQEY

SEQ ID NO: 1252462 - protein, 9 aa, Homo Sapiens
SCLLPVLAI

SEQ ID NO: 1252463 - protein, 9 aa, Homo Sapiens
FRKLNWKRI

SEQ ID NO: 1252464 - protein, 9 aa, Homo Sapiens
ETLMLFSRV

SEQ ID NO: 1252465 - protein, 9 aa, Homo Sapiens
TPGAPLPWP

SEQ ID NO: 1252466 - protein, 9 aa, Homo Sapiens
KDHLGCKED

SEQ ID NO: 1252467 - protein, 9 aa, Homo Sapiens
DSYAARNGL

SEQ ID NO: 1252468 - protein, 9 aa, Homo Sapiens
IFRRLRENR

SEQ ID NO: 1252469 - protein, 9 aa, Homo Sapiens
EALVPLSKA

SEQ ID NO: 1252470 - protein, 9 aa, Homo Sapiens
ALNNFLTHC

SEQ ID NO: 1252471 - protein, 9 aa, Homo Sapiens
WFSVLFLVA

SEQ ID NO: 1252472 - protein, 9 aa, Homo Sapiens
HHIIHAGEK

SEQ ID NO: 1252473 - protein, 9 aa, Homo Sapiens
MDCQARKLA

SEQ ID NO: 1252474 - protein, 9 aa, Homo Sapiens
DLSKVPTMD

SEQ ID NO: 1252475 - protein, 9 aa, Homo Sapiens
GETYFDGVA

SEQ ID NO: 1252476 - protein, 9 aa, Homo Sapiens
GPHTFPKMK

SEQ ID NO: 1252477 - protein, 9 aa, Homo Sapiens
RKSLMIILT

SEQ ID NO: 1252478 - protein, 9 aa, Homo Sapiens
FSTTSNEDE

SEQ ID NO: 1252479 - protein, 9 aa, Homo Sapiens
GNELQRHVD

SEQ ID NO: 1252480 - protein, 9 aa, Homo Sapiens
AGFSSSQTP

SEQ ID NO: 1252481 - protein, 9 aa, Homo Sapiens
LSGTIAIKR

SEQ ID NO: 1252482 - protein, 9 aa, Homo Sapiens
SRLRLDAKI

SEQ ID NO: 1252483 - protein, 9 aa, Homo Sapiens
DAHVPIIHR

SEQ ID NO: 1252484 - protein, 9 aa, Homo Sapiens
PGRKALLKI

SEQ ID NO: 1252485 - protein, 9 aa, Homo Sapiens
PTPILIKVK

SEQ ID NO: 1252486 - protein, 9 aa, Homo Sapiens
YNCALVIFE

SEQ ID NO: 1252487 - protein, 9 aa, Homo Sapiens
LCHFLPLLE

SEQ ID NO: 1252488 - protein, 9 aa, Homo Sapiens
DENDNNPEV

SEQ ID NO: 1252489 - protein, 9 aa, Homo Sapiens
ITTPSKKKL

SEQ ID NO: 1252490 - protein, 9 aa, Homo Sapiens
AGLAEYMFD

SEQ ID NO: 1252491 - protein, 9 aa, Homo Sapiens
SSPNTYMKV

SEQ ID NO: 1252492 - protein, 9 aa, Homo Sapiens
MAYVASFLS

SEQ ID NO: 1252493 - protein, 9 aa, Homo Sapiens
PLKEELHIQ

SEQ ID NO: 1252494 - protein, 9 aa, Homo Sapiens
WYLLKVQFN

SEQ ID NO: 1252495 - protein, 9 aa, Homo Sapiens
AARLQINEF

SEQ ID NO: 1252496 - protein, 9 aa, Homo Sapiens
RHLGATILD

SEQ ID NO: 1252497 - protein, 9 aa, Homo Sapiens
GPTADEEEP

SEQ ID NO: 1252498 - protein, 9 aa, Homo Sapiens
NSHGTSSRE

SEQ ID NO: 1252499 - protein, 9 aa, Homo Sapiens
EILVTTIIA

SEQ ID NO: 1252500 - protein, 9 aa, Homo Sapiens
SGISSSITS

SEQ ID NO: 1252501 - protein, 9 aa, Homo Sapiens
PPGALMWLQ

SEQ ID NO: 1252502 - protein, 9 aa, Homo Sapiens
AGSRIVWMP

SEQ ID NO: 1252503 - protein, 9 aa, Homo Sapiens
ELWALLRFI

SEQ ID NO: 1252504 - protein, 9 aa, Homo Sapiens
DKSQSKHRA

SEQ ID NO: 1252505 - protein, 9 aa, Homo Sapiens
YVGQYDNRG

SEQ ID NO: 1252506 - protein, 9 aa, Homo Sapiens
AQAIYPHYP

SEQ ID NO: 1252507 - protein, 9 aa, Homo Sapiens
TLTGEQLLG

SEQ ID NO: 1252508 - protein, 9 aa, Homo Sapiens
VNPVFCMTE

SEQ ID NO: 1252509 - protein, 9 aa, Homo Sapiens
VENLVRVGL

SEQ ID NO: 1252510 - protein, 9 aa, Homo Sapiens
CLDIMYNEE

SEQ ID NO: 1252511 - protein, 9 aa, Homo Sapiens
YLHPRSLRS

SEQ ID NO: 1252512 - protein, 9 aa, Homo Sapiens
PGRGLRPVA

SEQ ID NO: 1252513 - protein, 9 aa, Homo Sapiens
NQEEGKNHM

SEQ ID NO: 1252514 - protein, 9 aa, Homo Sapiens
ALDLPQHKG

SEQ ID NO: 1252515 - protein, 9 aa, Homo Sapiens
KKSTRPAAG

SEQ ID NO: 1252516 - protein, 9 aa, Homo Sapiens
QPIVKKGEE

SEQ ID NO: 1252517 - protein, 9 aa, Homo Sapiens
EDLGDKVVY

SEQ ID NO: 1252518 - protein, 9 aa, Homo Sapiens
TQRYRKSWR

SEQ ID NO: 1252519 - protein, 9 aa, Homo Sapiens
LLEAHTPSV

SEQ ID NO: 1252520 - protein, 9 aa, Homo Sapiens
NKLGAINNT

SEQ ID NO: 1252521 - protein, 9 aa, Homo Sapiens
IGRVVENSD

SEQ ID NO: 1252522 - protein, 9 aa, Homo Sapiens
VLGWDPDNL

SEQ ID NO: 1252523 - protein, 9 aa, Homo Sapiens
ESLHTSERK

SEQ ID NO: 1252524 - protein, 9 aa, Homo Sapiens
KHLVKNEKG

SEQ ID NO: 1252525 - protein, 9 aa, Homo Sapiens
TAMWLSASH

SEQ ID NO: 1252526 - protein, 9 aa, Homo Sapiens
IMRLIKPMK

SEQ ID NO: 1252527 - protein, 9 aa, Homo Sapiens
MAALGLMIT

SEQ ID NO: 1252528 - protein, 9 aa, Homo Sapiens
DPFFLAELI

SEQ ID NO: 1252529 - protein, 9 aa, Homo Sapiens
MLSRHGKLC

SEQ ID NO: 1252530 - protein, 9 aa, Homo Sapiens
CEQIFCPNH

SEQ ID NO: 1252531 - protein, 9 aa, Homo Sapiens
ACLLPDKGK

SEQ ID NO: 1252532 - protein, 9 aa, Homo Sapiens
TLGIMYQSE

SEQ ID NO: 1252533 - protein, 9 aa, Homo Sapiens
PPTSPPSLC

SEQ ID NO: 1252534 - protein, 9 aa, Homo Sapiens
ITLVFEGIP

SEQ ID NO: 1252535 - protein, 9 aa, Homo Sapiens
YSSGTFYER

SEQ ID NO: 1252536 - protein, 9 aa, Homo Sapiens
SFGIGPGRR

SEQ ID NO: 1252537 - protein, 9 aa, Homo Sapiens
RVRNPTVRL

SEQ ID NO: 1252538 - protein, 9 aa, Homo Sapiens
KPYRCEEYG

SEQ ID NO: 1252539 - protein, 9 aa, Homo Sapiens
MYNVRAPTL

SEQ ID NO: 1252540 - protein, 9 aa, Homo Sapiens
NKWTTFLKV

SEQ ID NO: 1252541 - protein, 9 aa, Homo Sapiens
YLKAFLLRM

SEQ ID NO: 1252542 - protein, 9 aa, Homo Sapiens
EETPWDTLK

SEQ ID NO: 1252543 - protein, 9 aa, Homo Sapiens
NFKRAHEDI

SEQ ID NO: 1252544 - protein, 9 aa, Homo Sapiens
KSYTSQKTS

SEQ ID NO: 1252545 - protein, 9 aa, Homo Sapiens
PEEVCMAIR

SEQ ID NO: 1252546 - protein, 9 aa, Homo Sapiens
GDPEGPPWL

SEQ ID NO: 1252547 - protein, 9 aa, Homo Sapiens
QRQRLEEDK

SEQ ID NO: 1252548 - protein, 9 aa, Homo Sapiens
QYMRMSTCT

SEQ ID NO: 1252549 - protein, 9 aa, Homo Sapiens
MDKKNCSFC

SEQ ID NO: 1252550 - protein, 9 aa, Homo Sapiens
DDSLTKKLH

SEQ ID NO: 1252551 - protein, 9 aa, Homo Sapiens
TTHFALTIP

SEQ ID NO: 1252552 - protein, 9 aa, Homo Sapiens
SCGPLRIFV

SEQ ID NO: 1252553 - protein, 9 aa, Homo Sapiens
VQWTPETLT

SEQ ID NO: 1252554 - protein, 9 aa, Homo Sapiens
LRYSPTGRC

SEQ ID NO: 1252555 - protein, 9 aa, Homo Sapiens
TDSQLVVTL

SEQ ID NO: 1252556 - protein, 9 aa, Homo Sapiens
IHSITDFWK

SEQ ID NO: 1252557 - protein, 9 aa, Homo Sapiens
HQITSGPSA

SEQ ID NO: 1252558 - protein, 9 aa, Homo Sapiens
HMEFLVEPV

SEQ ID NO: 1252559 - protein, 9 aa, Homo Sapiens
VSSNVLQMF

SEQ ID NO: 1252560 - protein, 9 aa, Homo Sapiens
STYSFMPTS

SEQ ID NO: 1252561 - protein, 9 aa, Homo Sapiens
IIKLEILDE

SEQ ID NO: 1252562 - protein, 9 aa, Homo Sapiens
LVGPMNHDE

SEQ ID NO: 1252563 - protein, 9 aa, Homo Sapiens
KTINGEDVL

SEQ ID NO: 1252564 - protein, 9 aa, Homo Sapiens
VALMSSTII

SEQ ID NO: 1252565 - protein, 9 aa, Homo Sapiens
ERSESSVEG

SEQ ID NO: 1252566 - protein, 9 aa, Homo Sapiens
RLLVRVSLT

SEQ ID NO: 1252567 - protein, 9 aa, Homo Sapiens
SPKCQASSN

SEQ ID NO: 1252568 - protein, 9 aa, Homo Sapiens
LGDRVGHCV

SEQ ID NO: 1252569 - protein, 9 aa, Homo Sapiens
SQTHPLVSQ

SEQ ID NO: 1252570 - protein, 9 aa, Homo Sapiens
GDLSIFFLR

SEQ ID NO: 1252571 - protein, 9 aa, Homo Sapiens
HRCEGDPSG

SEQ ID NO: 1252572 - protein, 9 aa, Homo Sapiens
AACPQEVAS

SEQ ID NO: 1252573 - protein, 9 aa, Homo Sapiens
EHYSPVCSS

SEQ ID NO: 1252574 - protein, 9 aa, Homo Sapiens
IRAMKKKGE

SEQ ID NO: 1252575 - protein, 9 aa, Homo Sapiens
ENTKPQVKP

SEQ ID NO: 1252576 - protein, 9 aa, Homo Sapiens
CGGNLRSYQ

SEQ ID NO: 1252577 - protein, 9 aa, Homo Sapiens
SSSSLAIPD

SEQ ID NO: 1252578 - protein, 9 aa, Homo Sapiens
LKTSRWSSH

SEQ ID NO: 1252579 - protein, 9 aa, Homo Sapiens
AGLRVQIDC

SEQ ID NO: 1252580 - protein, 9 aa, Homo Sapiens
SIRIIFSYI

SEQ ID NO: 1252581 - protein, 9 aa, Homo Sapiens
SSNLERMLT

SEQ ID NO: 1252582 - protein, 9 aa, Homo Sapiens
RNRHPGASI

SEQ ID NO: 1252583 - protein, 9 aa, Homo Sapiens
ETWLAPELY

SEQ ID NO: 1252584 - protein, 9 aa, Homo Sapiens
MVQNVLQIL

SEQ ID NO: 1252585 - protein, 9 aa, Homo Sapiens
EYEEEERKE

SEQ ID NO: 1252586 - protein, 9 aa, Homo Sapiens
LSLKGAPDP

SEQ ID NO: 1252587 - protein, 9 aa, Homo Sapiens
IQGGCSAVI

SEQ ID NO: 1252588 - protein, 9 aa, Homo Sapiens
KRLKTKAVC

SEQ ID NO: 1252589 - protein, 9 aa, Homo Sapiens
ELSDLERIL

SEQ ID NO: 1252590 - protein, 9 aa, Homo Sapiens
TLHDEEANN

SEQ ID NO: 1252591 - protein, 9 aa, Homo Sapiens
EGSDPRHET

SEQ ID NO: 1252592 - protein, 9 aa, Homo Sapiens
SLRVRGQKK

SEQ ID NO: 1252593 - protein, 9 aa, Homo Sapiens
PQVLNYSAS

SEQ ID NO: 1252594 - protein, 9 aa, Homo Sapiens
ILHPQVIMV

SEQ ID NO: 1252595 - protein, 9 aa, Homo Sapiens
TPSPSHMPP

SEQ ID NO: 1252596 - protein, 9 aa, Homo Sapiens
AVSYRLLPG

SEQ ID NO: 1252597 - protein, 9 aa, Homo Sapiens
YVCYEPGHQ

SEQ ID NO: 1252598 - protein, 9 aa, Homo Sapiens
LSKYRQVAF

SEQ ID NO: 1252599 - protein, 9 aa, Homo Sapiens
LDPTAVYEA

SEQ ID NO: 1252600 - protein, 9 aa, Homo Sapiens
LDCKAGLHA

SEQ ID NO: 1252601 - protein, 9 aa, Homo Sapiens
GNITHGCSS

SEQ ID NO: 1252602 - protein, 9 aa, Homo Sapiens
KSHYFLRQP

SEQ ID NO: 1252603 - protein, 9 aa, Homo Sapiens
SNQKRELDI

SEQ ID NO: 1252604 - protein, 9 aa, Homo Sapiens
KVAKGAKPE

SEQ ID NO: 1252605 - protein, 9 aa, Homo Sapiens
RFMASWALL

SEQ ID NO: 1252606 - protein, 9 aa, Homo Sapiens
IAVSIVKSL

SEQ ID NO: 1252607 - protein, 9 aa, Homo Sapiens
LWLACSNTR

SEQ ID NO: 1252608 - protein, 9 aa, Homo Sapiens
LVSWYDLEH

SEQ ID NO: 1252609 - protein, 9 aa, Homo Sapiens
HGCHGVVAP

SEQ ID NO: 1252610 - protein, 9 aa, Homo Sapiens
YWIGVHYDE

SEQ ID NO: 1252611 - protein, 9 aa, Homo Sapiens
KNHGCAHVC

SEQ ID NO: 1252612 - protein, 9 aa, Homo Sapiens
CPGGCSCDY

SEQ ID NO: 1252613 - protein, 9 aa, Homo Sapiens
TMKIKPRLK

SEQ ID NO: 1252614 - protein, 9 aa, Homo Sapiens
MQHLPATLP

SEQ ID NO: 1252615 - protein, 9 aa, Homo Sapiens
PQHLQCLSV

SEQ ID NO: 1252616 - protein, 9 aa, Homo Sapiens
DQIFIHRDI

SEQ ID NO: 1252617 - protein, 9 aa, Homo Sapiens
PVLAISGKL

SEQ ID NO: 1252618 - protein, 9 aa, Homo Sapiens
LEGRTGINE

SEQ ID NO: 1252619 - protein, 9 aa, Homo Sapiens
IHATDVIHA

SEQ ID NO: 1252620 - protein, 9 aa, Homo Sapiens
RQELGLRIG

SEQ ID NO: 1252621 - protein, 9 aa, Homo Sapiens
QEKAQVVLT

SEQ ID NO: 1252622 - protein, 9 aa, Homo Sapiens
IDTLESRVE

SEQ ID NO: 1252623 - protein, 9 aa, Homo Sapiens
MHCPQCQIV

SEQ ID NO: 1252624 - protein, 9 aa, Homo Sapiens
TCSVRSFMD

SEQ ID NO: 1252625 - protein, 9 aa, Homo Sapiens
TFLLQDQEL

SEQ ID NO: 1252626 - protein, 9 aa, Homo Sapiens
QPAPAGAWS

SEQ ID NO: 1252627 - protein, 9 aa, Homo Sapiens
VLIHASLKL

SEQ ID NO: 1252628 - protein, 9 aa, Homo Sapiens
GQNISWDVA

SEQ ID NO: 1252629 - protein, 9 aa, Homo Sapiens
SPEPAQGAI

SEQ ID NO: 1252630 - protein, 9 aa, Homo Sapiens
DARQELGLR

SEQ ID NO: 1252631 - protein, 9 aa, Homo Sapiens
HMVVQCGNR

SEQ ID NO: 1252632 - protein, 9 aa, Homo Sapiens
EGPCVHVPP

SEQ ID NO: 1252633 - protein, 9 aa, Homo Sapiens
FIGFLSSVS

SEQ ID NO: 1252634 - protein, 9 aa, Homo Sapiens
MEELEDSVI

SEQ ID NO: 1252635 - protein, 9 aa, Homo Sapiens
VEVQMRVMG

SEQ ID NO: 1252636 - protein, 9 aa, Homo Sapiens
RLKHQPPRV

SEQ ID NO: 1252637 - protein, 9 aa, Homo Sapiens
FKTDLHFQS

SEQ ID NO: 1252638 - protein, 9 aa, Homo Sapiens
DILSRAAGT

SEQ ID NO: 1252639 - protein, 9 aa, Homo Sapiens
RSLRQFPPG

SEQ ID NO: 1252640 - protein, 9 aa, Homo Sapiens
DRMEKSVNS

SEQ ID NO: 1252641 - protein, 9 aa, Homo Sapiens
PRGVVHRRA

SEQ ID NO: 1252642 - protein, 9 aa, Homo Sapiens
FIHGTRLPP

SEQ ID NO: 1252643 - protein, 9 aa, Homo Sapiens
LDDVNEILR

SEQ ID NO: 1252644 - protein, 9 aa, Homo Sapiens
PRPRAPAQA

SEQ ID NO: 1252645 - protein, 9 aa, Homo Sapiens
FLPKTISGD

SEQ ID NO: 1252646 - protein, 9 aa, Homo Sapiens
TMPLCAVLA

SEQ ID NO: 1252647 - protein, 9 aa, Homo Sapiens
AIGGYGPVH

SEQ ID NO: 1252648 - protein, 9 aa, Homo Sapiens
ANAGDNRAI

SEQ ID NO: 1252649 - protein, 9 aa, Homo Sapiens
VNYLTKILF

SEQ ID NO: 1252650 - protein, 9 aa, Homo Sapiens
DGVIEPNKE

SEQ ID NO: 1252651 - protein, 9 aa, Homo Sapiens
MLQSYKISP

SEQ ID NO: 1252652 - protein, 9 aa, Homo Sapiens
RLCNTPLAS

SEQ ID NO: 1252653 - protein, 9 aa, Homo Sapiens
RDTREVAIE

SEQ ID NO: 1252654 - protein, 9 aa, Homo Sapiens
LQAQARQLL

SEQ ID NO: 1252655 - protein, 9 aa, Homo Sapiens
PHVDFVGEV

SEQ ID NO: 1252656 - protein, 9 aa, Homo Sapiens
ALIVTSVVG

SEQ ID NO: 1252657 - protein, 9 aa, Homo Sapiens
FLVSLTVLL

SEQ ID NO: 1252658 - protein, 9 aa, Homo Sapiens
RPRYDYRRR

SEQ ID NO: 1252659 - protein, 9 aa, Homo Sapiens
SLCSEQSNG

SEQ ID NO: 1252660 - protein, 9 aa, Homo Sapiens
NTASMSGTK

SEQ ID NO: 1252661 - protein, 9 aa, Homo Sapiens
SSFARTISM

SEQ ID NO: 1252662 - protein, 9 aa, Homo Sapiens
PNAGPRYLL

SEQ ID NO: 1252663 - protein, 9 aa, Homo Sapiens
TLPGGPWLR

SEQ ID NO: 1252664 - protein, 9 aa, Homo Sapiens
LEQLAESTV

SEQ ID NO: 1252665 - protein, 9 aa, Homo Sapiens
LSFLSDDMK

SEQ ID NO: 1252666 - protein, 9 aa, Homo Sapiens
NILISDQDV

SEQ ID NO: 1252667 - protein, 9 aa, Homo Sapiens
VLQKRLDEV

SEQ ID NO: 1252668 - protein, 9 aa, Homo Sapiens
DVQCPYIME

SEQ ID NO: 1252669 - protein, 9 aa, Homo Sapiens
NDMHFSSLG

SEQ ID NO: 1252670 - protein, 9 aa, Homo Sapiens
PEGIVGSMK

SEQ ID NO: 1252671 - protein, 9 aa, Homo Sapiens
RGGVATPGR

SEQ ID NO: 1252672 - protein, 9 aa, Homo Sapiens
APGGRPGSG

SEQ ID NO: 1252673 - protein, 9 aa, Homo Sapiens
HLDQMPSRQ

SEQ ID NO: 1252674 - protein, 9 aa, Homo Sapiens
TPGAADFKT

SEQ ID NO: 1252675 - protein, 9 aa, Homo Sapiens
GLIETKHPY

SEQ ID NO: 1252676 - protein, 9 aa, Homo Sapiens
MYPKEWHHL

SEQ ID NO: 1252677 - protein, 9 aa, Homo Sapiens
SIFPESKKR

SEQ ID NO: 1252678 - protein, 9 aa, Homo Sapiens
ISAFHGVKG

SEQ ID NO: 1252679 - protein, 9 aa, Homo Sapiens
LPSHVARRF

SEQ ID NO: 1252680 - protein, 9 aa, Homo Sapiens
PKFHMTTYS

SEQ ID NO: 1252681 - protein, 9 aa, Homo Sapiens
FCVSLAGGA

SEQ ID NO: 1252682 - protein, 9 aa, Homo Sapiens
SVLLQTMYL

SEQ ID NO: 1252683 - protein, 9 aa, Homo Sapiens
QRRPLVQVV

SEQ ID NO: 1252684 - protein, 9 aa, Homo Sapiens
YKKKLSDSF

SEQ ID NO: 1252685 - protein, 9 aa, Homo Sapiens
QGRIMSRMF

SEQ ID NO: 1252686 - protein, 9 aa, Homo Sapiens
DGTGHYMCN

SEQ ID NO: 1252687 - protein, 9 aa, Homo Sapiens
HGVNADARG

SEQ ID NO: 1252688 - protein, 9 aa, Homo Sapiens
QADEKISVC

SEQ ID NO: 1252689 - protein, 9 aa, Homo Sapiens
KMRQGEATL

SEQ ID NO: 1252690 - protein, 9 aa, Homo Sapiens
MFGEGMTCS

SEQ ID NO: 1252691 - protein, 9 aa, Homo Sapiens
AGVFVNVQQ

SEQ ID NO: 1252692 - protein, 9 aa, Homo Sapiens
TAITVTVIA

SEQ ID NO: 1252693 - protein, 9 aa, Homo Sapiens
EDPANQFLC

SEQ ID NO: 1252694 - protein, 9 aa, Homo Sapiens
HNHQPRINS

SEQ ID NO: 1252695 - protein, 9 aa, Homo Sapiens
WKKTMELTT

SEQ ID NO: 1252696 - protein, 9 aa, Homo Sapiens
VTTHFALTI

SEQ ID NO: 1252697 - protein, 9 aa, Homo Sapiens
ASLQKCPDG

SEQ ID NO: 1252698 - protein, 9 aa, Homo Sapiens
GLEPGRKCK

SEQ ID NO: 1252699 - protein, 9 aa, Homo Sapiens
WPICWGGRE

SEQ ID NO: 1252700 - protein, 9 aa, Homo Sapiens
LSLRLTGGE

SEQ ID NO: 1252701 - protein, 9 aa, Homo Sapiens
PNGTLFRLR

SEQ ID NO: 1252702 - protein, 9 aa, Homo Sapiens
KLQVCCMVE

SEQ ID NO: 1252703 - protein, 9 aa, Homo Sapiens
CALGIGVYP

SEQ ID NO: 1252704 - protein, 9 aa, Homo Sapiens
HTVPDKDGD

SEQ ID NO: 1252705 - protein, 9 aa, Homo Sapiens
ISSYTYNAA

SEQ ID NO: 1252706 - protein, 9 aa, Homo Sapiens
RTVPWNCRT

SEQ ID NO: 1252707 - protein, 9 aa, Homo Sapiens
LEVKEWMQK

SEQ ID NO: 1252708 - protein, 9 aa, Homo Sapiens
TGLVEICLM

SEQ ID NO: 1252709 - protein, 9 aa, Homo Sapiens
LYLESDEVA

SEQ ID NO: 1252710 - protein, 9 aa, Homo Sapiens
GRVFGNASD

SEQ ID NO: 1252711 - protein, 9 aa, Homo Sapiens
TPKEGVRVN

SEQ ID NO: 1252712 - protein, 9 aa, Homo Sapiens
EDRLQEYTE

SEQ ID NO: 1252713 - protein, 9 aa, Homo Sapiens
PPLAHGDRR

SEQ ID NO: 1252714 - protein, 9 aa, Homo Sapiens
PSGNGSQKK

SEQ ID NO: 1252715 - protein, 9 aa, Homo Sapiens
PDLYLESDE

SEQ ID NO: 1252716 - protein, 9 aa, Homo Sapiens
PPKPPTRDT

SEQ ID NO: 1252717 - protein, 9 aa, Homo Sapiens
PGADVGVPQ

SEQ ID NO: 1252718 - protein, 9 aa, Homo Sapiens
ISSVVLKAA

SEQ ID NO: 1252719 - protein, 9 aa, Homo Sapiens
AIDALGFYL

SEQ ID NO: 1252720 - protein, 9 aa, Homo Sapiens
VDFIISDFE

SEQ ID NO: 1252721 - protein, 9 aa, Homo Sapiens
YVDPSDMHF

SEQ ID NO: 1252722 - protein, 9 aa, Homo Sapiens
ELCVYCALL

SEQ ID NO: 1252723 - protein, 9 aa, Homo Sapiens
HRTPRSTST

SEQ ID NO: 1252724 - protein, 9 aa, Homo Sapiens
VMDSKTLPV

SEQ ID NO: 1252725 - protein, 9 aa, Homo Sapiens
NKPFRHVLQ

SEQ ID NO: 1252726 - protein, 9 aa, Homo Sapiens
ELIHTIKGN

SEQ ID NO: 1252727 - protein, 9 aa, Homo Sapiens
SSSATSGYG

SEQ ID NO: 1252728 - protein, 9 aa, Homo Sapiens
VLAPKDKKI

SEQ ID NO: 1252729 - protein, 9 aa, Homo Sapiens
ATEDKSAEH

SEQ ID NO: 1252730 - protein, 9 aa, Homo Sapiens
AKTMSKEEL

SEQ ID NO: 1252731 - protein, 9 aa, Homo Sapiens
TCLVNWSCT

SEQ ID NO: 1252732 - protein, 9 aa, Homo Sapiens
MNQTAILVC

SEQ ID NO: 1252733 - protein, 9 aa, Homo Sapiens
QRNQVKISC

SEQ ID NO: 1252734 - protein, 9 aa, Homo Sapiens
MCFDCMYGD

SEQ ID NO: 1252735 - protein, 9 aa, Homo Sapiens
ELNPIGVGC

SEQ ID NO: 1252736 - protein, 9 aa, Homo Sapiens
PIGVGCVDT

SEQ ID NO: 1252737 - protein, 9 aa, Homo Sapiens
PWELNSGDG

SEQ ID NO: 1252738 - protein, 9 aa, Homo Sapiens
EPETWTAAA

SEQ ID NO: 1252739 - protein, 9 aa, Homo Sapiens
EFSGKVMQL

SEQ ID NO: 1252740 - protein, 9 aa, Homo Sapiens
CEYLLDMIP

SEQ ID NO: 1252741 - protein, 9 aa, Homo Sapiens
CDQACRRQT

SEQ ID NO: 1252742 - protein, 9 aa, Homo Sapiens
VPEDHIKTR

SEQ ID NO: 1252743 - protein, 9 aa, Homo Sapiens
ERTAVWVLN

SEQ ID NO: 1252744 - protein, 9 aa, Homo Sapiens
PGMCVVDTG

SEQ ID NO: 1252745 - protein, 9 aa, Homo Sapiens
WDILQKTVR

SEQ ID NO: 1252746 - protein, 9 aa, Homo Sapiens
PDYGQRFQQ

SEQ ID NO: 1252747 - protein, 9 aa, Homo Sapiens
VMTKTESPR

SEQ ID NO: 1252748 - protein, 9 aa, Homo Sapiens
LTQDHSMDI

SEQ ID NO: 1252749 - protein, 9 aa, Homo Sapiens
ISKQLAVRC

SEQ ID NO: 1252750 - protein, 9 aa, Homo Sapiens
TFTWLALEN

SEQ ID NO: 1252751 - protein, 9 aa, Homo Sapiens
ISGESAGTI

SEQ ID NO: 1252752 - protein, 9 aa, Homo Sapiens
VGGDIRVIS

SEQ ID NO: 1252753 - protein, 9 aa, Homo Sapiens
KLHGFQARP

SEQ ID NO: 1252754 - protein, 9 aa, Homo Sapiens
TRKMERTEM

SEQ ID NO: 1252755 - protein, 9 aa, Homo Sapiens
ADRSMRKGI

SEQ ID NO: 1252756 - protein, 9 aa, Homo Sapiens
HRFLFNKTF

SEQ ID NO: 1252757 - protein, 9 aa, Homo Sapiens
EFWQQERSF

SEQ ID NO: 1252758 - protein, 9 aa, Homo Sapiens
KRLKLKHRD

SEQ ID NO: 1252759 - protein, 9 aa, Homo Sapiens
LIAMLEVLS

SEQ ID NO: 1252760 - protein, 9 aa, Homo Sapiens
GRSHRGGGR

SEQ ID NO: 1252761 - protein, 9 aa, Homo Sapiens
GHGLVCDLC

SEQ ID NO: 1252762 - protein, 9 aa, Homo Sapiens
SSEDTLNNF

SEQ ID NO: 1252763 - protein, 9 aa, Homo Sapiens
PTCSDAYHH

SEQ ID NO: 1252764 - protein, 9 aa, Homo Sapiens
NKSKFGVNA

SEQ ID NO: 1252765 - protein, 9 aa, Homo Sapiens
TSQDCVQNT

SEQ ID NO: 1252766 - protein, 9 aa, Homo Sapiens
KHVTIHATP

SEQ ID NO: 1252767 - protein, 9 aa, Homo Sapiens
KDPVSRTPT

SEQ ID NO: 1252768 - protein, 9 aa, Homo Sapiens
HGMAASLAI

SEQ ID NO: 1252769 - protein, 9 aa, Homo Sapiens
QVTYHNPLC

SEQ ID NO: 1252770 - protein, 9 aa, Homo Sapiens
KSMENTAPS

SEQ ID NO: 1252771 - protein, 9 aa, Homo Sapiens
KGRDHENIK

SEQ ID NO: 1252772 - protein, 9 aa, Homo Sapiens
GASDTTIKL

SEQ ID NO: 1252773 - protein, 9 aa, Homo Sapiens
DQASRTMIE

SEQ ID NO: 1252774 - protein, 9 aa, Homo Sapiens
DLLLPPAPK

SEQ ID NO: 1252775 - protein, 9 aa, Homo Sapiens
ESGPMRGAK

SEQ ID NO: 1252776 - protein, 9 aa, Homo Sapiens
IQRDTHPAI

SEQ ID NO: 1252777 - protein, 9 aa, Homo Sapiens
PWEENDPQS

SEQ ID NO: 1252778 - protein, 9 aa, Homo Sapiens
SYFTRKEED

SEQ ID NO: 1252779 - protein, 9 aa, Homo Sapiens
VKPVYKPGW

SEQ ID NO: 1252780 - protein, 9 aa, Homo Sapiens
SQHSENHTD

SEQ ID NO: 1252781 - protein, 9 aa, Homo Sapiens
QCSRAFADR

SEQ ID NO: 1252782 - protein, 9 aa, Homo Sapiens
LTSQDKEGI

SEQ ID NO: 1252783 - protein, 9 aa, Homo Sapiens
TQQLAQTDQ

SEQ ID NO: 1252784 - protein, 9 aa, Homo Sapiens
ADVELERQR

SEQ ID NO: 1252785 - protein, 9 aa, Homo Sapiens
GLEQLENAI

SEQ ID NO: 1252786 - protein, 9 aa, Homo Sapiens
YFINHMIQA

SEQ ID NO: 1252787 - protein, 9 aa, Homo Sapiens
PKCEQELEI

SEQ ID NO: 1252788 - protein, 9 aa, Homo Sapiens
WIMTLLFLD

SEQ ID NO: 1252789 - protein, 9 aa, Homo Sapiens
TDGQLHARQ

SEQ ID NO: 1252790 - protein, 9 aa, Homo Sapiens
FTSLLNNVC

SEQ ID NO: 1252791 - protein, 9 aa, Homo Sapiens
ILLADLQVN

SEQ ID NO: 1252792 - protein, 9 aa, Homo Sapiens
LTMPIYCLF

SEQ ID NO: 1252793 - protein, 9 aa, Homo Sapiens
PWGMLSSLK

SEQ ID NO: 1252794 - protein, 9 aa, Homo Sapiens
HQHEGFPPA

SEQ ID NO: 1252795 - protein, 9 aa, Homo Sapiens
LVDVSSVKQ

SEQ ID NO: 1252796 - protein, 9 aa, Homo Sapiens
STGQQLADT

SEQ ID NO: 1252797 - protein, 9 aa, Homo Sapiens
KKQASSMAV

SEQ ID NO: 1252798 - protein, 9 aa, Homo Sapiens
GITQASCQP

SEQ ID NO: 1252799 - protein, 9 aa, Homo Sapiens
LCSSSGLQV

SEQ ID NO: 1252800 - protein, 9 aa, Homo Sapiens
GQPQVIEFR

SEQ ID NO: 1252801 - protein, 9 aa, Homo Sapiens
GNLKLRKFV

SEQ ID NO: 1252802 - protein, 9 aa, Homo Sapiens
GFRITCSFP

SEQ ID NO: 1252803 - protein, 9 aa, Homo Sapiens
RCKCYGHRT

SEQ ID NO: 1252804 - protein, 9 aa, Homo Sapiens
QYPGDIGYF

SEQ ID NO: 1252805 - protein, 9 aa, Homo Sapiens
IAIGLLKRF

SEQ ID NO: 1252806 - protein, 9 aa, Homo Sapiens
HSASPKPSL

SEQ ID NO: 1252807 - protein, 9 aa, Homo Sapiens
PLLAHANFS

SEQ ID NO: 1252808 - protein, 9 aa, Homo Sapiens
NKGFPTLFT

SEQ ID NO: 1252809 - protein, 9 aa, Homo Sapiens
LQITVGAVI

SEQ ID NO: 1252810 - protein, 9 aa, Homo Sapiens
EPEETLGGQ

SEQ ID NO: 1252811 - protein, 9 aa, Homo Sapiens
MCYCIYSVG

SEQ ID NO: 1252812 - protein, 9 aa, Homo Sapiens
CRLDQQLWG

SEQ ID NO: 1252813 - protein, 9 aa, Homo Sapiens
LCPADQLCL

SEQ ID NO: 1252814 - protein, 9 aa, Homo Sapiens
FPIPAGVFT

SEQ ID NO: 1252815 - protein, 9 aa, Homo Sapiens
QRINKHINN

SEQ ID NO: 1252816 - protein, 9 aa, Homo Sapiens
LPLAHLHRE

SEQ ID NO: 1252817 - protein, 9 aa, Homo Sapiens
PPMQSAAKA

SEQ ID NO: 1252818 - protein, 9 aa, Homo Sapiens
DNAGGIHAS

SEQ ID NO: 1252819 - protein, 9 aa, Homo Sapiens
QPLQSGSGP

SEQ ID NO: 1252820 - protein, 9 aa, Homo Sapiens
IFDFMICIS

SEQ ID NO: 1252821 - protein, 9 aa, Homo Sapiens
AAHIQTSSQ

SEQ ID NO: 1252822 - protein, 9 aa, Homo Sapiens
MYFNLESSY

SEQ ID NO: 1252823 - protein, 9 aa, Homo Sapiens
KGLYVVITP

SEQ ID NO: 1252824 - protein, 9 aa, Homo Sapiens
SEVVSTITS

SEQ ID NO: 1252825 - protein, 9 aa, Homo Sapiens
RHYFYLFPN

SEQ ID NO: 1252826 - protein, 9 aa, Homo Sapiens
SSSAADLTT

SEQ ID NO: 1252827 - protein, 9 aa, Homo Sapiens
LLLATVFCI

SEQ ID NO: 1252828 - protein, 9 aa, Homo Sapiens
RRRMKHVWD

SEQ ID NO: 1252829 - protein, 9 aa, Homo Sapiens
APQENVCHL

SEQ ID NO: 1252830 - protein, 9 aa, Homo Sapiens
NSISAFMFT

SEQ ID NO: 1252831 - protein, 9 aa, Homo Sapiens
HPHLAAKYL

SEQ ID NO: 1252832 - protein, 9 aa, Homo Sapiens
GGNHGYNND

SEQ ID NO: 1252833 - protein, 9 aa, Homo Sapiens
KNCFVTRIH

SEQ ID NO: 1252834 - protein, 9 aa, Homo Sapiens
ENVVKGHRV

SEQ ID NO: 1252835 - protein, 9 aa, Homo Sapiens
HYFMCLLKD

SEQ ID NO: 1252836 - protein, 9 aa, Homo Sapiens
QQFWSSPSD

SEQ ID NO: 1252837 - protein, 9 aa, Homo Sapiens
VVAWSPSGS

SEQ ID NO: 1252838 - protein, 9 aa, Homo Sapiens
KTVQANKLL

SEQ ID NO: 1252839 - protein, 9 aa, Homo Sapiens
PPLPADLPH

SEQ ID NO: 1252840 - protein, 9 aa, Homo Sapiens
IFRHLCLEY

SEQ ID NO: 1252841 - protein, 9 aa, Homo Sapiens
AVATSSWDS

SEQ ID NO: 1252842 - protein, 9 aa, Homo Sapiens
GGWICWRSR

SEQ ID NO: 1252843 - protein, 9 aa, Homo Sapiens
LRLRETLLG

SEQ ID NO: 1252844 - protein, 9 aa, Homo Sapiens
LKEVDIMRK

SEQ ID NO: 1252845 - protein, 9 aa, Homo Sapiens
ASLVRDLQD

SEQ ID NO: 1252846 - protein, 9 aa, Homo Sapiens
TCSDAYHHL

SEQ ID NO: 1252847 - protein, 9 aa, Homo Sapiens
TIHLFLAKH

SEQ ID NO: 1252848 - protein, 9 aa, Homo Sapiens
LEMDEINHA

SEQ ID NO: 1252849 - protein, 9 aa, Homo Sapiens
DCISFMQVG

SEQ ID NO: 1252850 - protein, 9 aa, Homo Sapiens
NTPEEHMAY

SEQ ID NO: 1252851 - protein, 9 aa, Homo Sapiens
NGQRNAMHT

SEQ ID NO: 1252852 - protein, 9 aa, Homo Sapiens
QSEYSVGSD

SEQ ID NO: 1252853 - protein, 9 aa, Homo Sapiens
IGLLSSVSS

SEQ ID NO: 1252854 - protein, 9 aa, Homo Sapiens
LCHRLRHLL

SEQ ID NO: 1252855 - protein, 9 aa, Homo Sapiens
IYYLLETLP

SEQ ID NO: 1252856 - protein, 9 aa, Homo Sapiens
HRHIHTGNK

SEQ ID NO: 1252857 - protein, 9 aa, Homo Sapiens
PVGLNRVLE

SEQ ID NO: 1252858 - protein, 9 aa, Homo Sapiens
ARYFPVGNV

SEQ ID NO: 1252859 - protein, 9 aa, Homo Sapiens
TSALENLQP

SEQ ID NO: 1252860 - protein, 9 aa, Homo Sapiens
APSVWEQVT

SEQ ID NO: 1252861 - protein, 9 aa, Homo Sapiens
QLATLEGGS

SEQ ID NO: 1252862 - protein, 9 aa, Homo Sapiens
FSAHFTLGP

SEQ ID NO: 1252863 - protein, 9 aa, Homo Sapiens
TKKVIRNIV

SEQ ID NO: 1252864 - protein, 9 aa, Homo Sapiens
GEDIRSLNP

SEQ ID NO: 1252865 - protein, 9 aa, Homo Sapiens
NVQFLMDFV

SEQ ID NO: 1252866 - protein, 9 aa, Homo Sapiens
GTTSDILTL

SEQ ID NO: 1252867 - protein, 9 aa, Homo Sapiens
LHLLPQRPA

SEQ ID NO: 1252868 - protein, 9 aa, Homo Sapiens
KYHENGTGT

SEQ ID NO: 1252869 - protein, 9 aa, Homo Sapiens
ICDQACRRQ

SEQ ID NO: 1252870 - protein, 9 aa, Homo Sapiens
EIKTAVRLL

SEQ ID NO: 1252871 - protein, 9 aa, Homo Sapiens
DAVRRSVMR

SEQ ID NO: 1252872 - protein, 9 aa, Homo Sapiens
RRMYTAIQE

SEQ ID NO: 1252873 - protein, 9 aa, Homo Sapiens
HLASTLVQV

SEQ ID NO: 1252874 - protein, 9 aa, Homo Sapiens
NQIRSGMGQ

SEQ ID NO: 1252875 - protein, 9 aa, Homo Sapiens
DQTVQAPAE

SEQ ID NO: 1252876 - protein, 9 aa, Homo Sapiens
SRTRCGGHK

SEQ ID NO: 1252877 - protein, 9 aa, Homo Sapiens
HLAVDSWWL

SEQ ID NO: 1252878 - protein, 9 aa, Homo Sapiens
DFSFTPTGF

SEQ ID NO: 1252879 - protein, 9 aa, Homo Sapiens
SESVAPGAH

SEQ ID NO: 1252880 - protein, 9 aa, Homo Sapiens
HKQPVAFVV

SEQ ID NO: 1252881 - protein, 9 aa, Homo Sapiens
ATLAMVLGA

SEQ ID NO: 1252882 - protein, 9 aa, Homo Sapiens
IFLEKNVPL

SEQ ID NO: 1252883 - protein, 9 aa, Homo Sapiens
LWQLKTKEQ

SEQ ID NO: 1252884 - protein, 9 aa, Homo Sapiens
ELVKLQGEC

SEQ ID NO: 1252885 - protein, 9 aa, Homo Sapiens
YTQNIKDAK

SEQ ID NO: 1252886 - protein, 9 aa, Homo Sapiens
TQSNLRSIY

SEQ ID NO: 1252887 - protein, 9 aa, Homo Sapiens
LESIRQDGG

SEQ ID NO: 1252888 - protein, 9 aa, Homo Sapiens
TQGEPKGLH

SEQ ID NO: 1252889 - protein, 9 aa, Homo Sapiens
EMIKQFHIQ

SEQ ID NO: 1252890 - protein, 9 aa, Homo Sapiens
AAVGATEDK

SEQ ID NO: 1252891 - protein, 9 aa, Homo Sapiens
QCHWLDPDT

SEQ ID NO: 1252892 - protein, 9 aa, Homo Sapiens
KNGLLHCTQ

SEQ ID NO: 1252893 - protein, 9 aa, Homo Sapiens
RHRALSIDN

SEQ ID NO: 1252894 - protein, 9 aa, Homo Sapiens
KTNLFIYPS

SEQ ID NO: 1252895 - protein, 9 aa, Homo Sapiens
TWRLNEWHY

SEQ ID NO: 1252896 - protein, 9 aa, Homo Sapiens
LMALLLALK

SEQ ID NO: 1252897 - protein, 9 aa, Homo Sapiens
RLNPPTQQP

SEQ ID NO: 1252898 - protein, 9 aa, Homo Sapiens
GVTRHSGSQ

SEQ ID NO: 1252899 - protein, 9 aa, Homo Sapiens
TDADCFVCV

SEQ ID NO: 1252900 - protein, 9 aa, Homo Sapiens
KVFQPKRKE

SEQ ID NO: 1252901 - protein, 9 aa, Homo Sapiens
LKEAHCLIW

SEQ ID NO: 1252902 - protein, 9 aa, Homo Sapiens
EIHVWRLTD

SEQ ID NO: 1252903 - protein, 9 aa, Homo Sapiens
HLTRCLILD

SEQ ID NO: 1252904 - protein, 9 aa, Homo Sapiens
NVPVVSAAV

SEQ ID NO: 1252905 - protein, 9 aa, Homo Sapiens
RSIARCLFL

SEQ ID NO: 1252906 - protein, 9 aa, Homo Sapiens
NSTEAKSYW

SEQ ID NO: 1252907 - protein, 9 aa, Homo Sapiens
QTVDMKIGV

SEQ ID NO: 1252908 - protein, 9 aa, Homo Sapiens
HRHLSEKSH

SEQ ID NO: 1252909 - protein, 9 aa, Homo Sapiens
LFTKLTFKL

SEQ ID NO: 1252910 - protein, 9 aa, Homo Sapiens
TEPETWTAA

SEQ ID NO: 1252911 - protein, 9 aa, Homo Sapiens
HSAAAKTGD

SEQ ID NO: 1252912 - protein, 9 aa, Homo Sapiens
LDVLKIHVL

SEQ ID NO: 1252913 - protein, 9 aa, Homo Sapiens
AVVYRPCCW

SEQ ID NO: 1252914 - protein, 9 aa, Homo Sapiens
PTVIEVELQ

SEQ ID NO: 1252915 - protein, 9 aa, Homo Sapiens
EAMVHLKVA

SEQ ID NO: 1252916 - protein, 9 aa, Homo Sapiens
LIPSTIGCR

SEQ ID NO: 1252917 - protein, 9 aa, Homo Sapiens
AYKESRVVN

SEQ ID NO: 1252918 - protein, 9 aa, Homo Sapiens
AHCKGILYV

SEQ ID NO: 1252919 - protein, 9 aa, Homo Sapiens
SKQKKEEKN

SEQ ID NO: 1252920 - protein, 9 aa, Homo Sapiens
NNDNEHLAI

SEQ ID NO: 1252921 - protein, 9 aa, Homo Sapiens
RQSMKSERA

SEQ ID NO: 1252922 - protein, 9 aa, Homo Sapiens
HIFPVCSSL

SEQ ID NO: 1252923 - protein, 9 aa, Homo Sapiens
DFDHFSRHD

SEQ ID NO: 1252924 - protein, 9 aa, Homo Sapiens
HKHYMTRDA

SEQ ID NO: 1252925 - protein, 9 aa, Homo Sapiens
IIIQTVPTF

SEQ ID NO: 1252926 - protein, 9 aa, Homo Sapiens
FKRMDSAPA

SEQ ID NO: 1252927 - protein, 9 aa, Homo Sapiens
GPPSPLTLY

SEQ ID NO: 1252928 - protein, 9 aa, Homo Sapiens
RVMECRMAA

SEQ ID NO: 1252929 - protein, 9 aa, Homo Sapiens
AKCIPYMDS

SEQ ID NO: 1252930 - protein, 9 aa, Homo Sapiens
IPLDKCLAA

SEQ ID NO: 1252931 - protein, 9 aa, Homo Sapiens
PKKHGLRRR

SEQ ID NO: 1252932 - protein, 9 aa, Homo Sapiens
DCDSLVLQS

SEQ ID NO: 1252933 - protein, 9 aa, Homo Sapiens
MYEGYLQHA

SEQ ID NO: 1252934 - protein, 9 aa, Homo Sapiens
GGFLGMLQM

SEQ ID NO: 1252935 - protein, 9 aa, Homo Sapiens
SVADLAFTH

SEQ ID NO: 1252936 - protein, 9 aa, Homo Sapiens
RIHDGKEKT

SEQ ID NO: 1252937 - protein, 9 aa, Homo Sapiens
SCPTLIYSG

SEQ ID NO: 1252938 - protein, 9 aa, Homo Sapiens
QQLVAAGVL

SEQ ID NO: 1252939 - protein, 9 aa, Homo Sapiens
RDQVQKVDQ

SEQ ID NO: 1252940 - protein, 9 aa, Homo Sapiens
QHTLTMPAL

SEQ ID NO: 1252941 - protein, 9 aa, Homo Sapiens
CCKFSTPTT

SEQ ID NO: 1252942 - protein, 9 aa, Homo Sapiens
LYMVTNSQR

SEQ ID NO: 1252943 - protein, 9 aa, Homo Sapiens
TGHLWLGTL

SEQ ID NO: 1252944 - protein, 9 aa, Homo Sapiens
YSKIHSFHG

SEQ ID NO: 1252945 - protein, 9 aa, Homo Sapiens
LNLIQALRD

SEQ ID NO: 1252946 - protein, 9 aa, Homo Sapiens
ENSHCTFAI

SEQ ID NO: 1252947 - protein, 9 aa, Homo Sapiens
HWWDAPSIV

SEQ ID NO: 1252948 - protein, 9 aa, Homo Sapiens
DMHDERSKP

SEQ ID NO: 1252949 - protein, 9 aa, Homo Sapiens
LDAFLSYCP

SEQ ID NO: 1252950 - protein, 9 aa, Homo Sapiens
PEPNAREEQ

SEQ ID NO: 1252951 - protein, 9 aa, Homo Sapiens
AVGNHLNEP

SEQ ID NO: 1252952 - protein, 9 aa, Homo Sapiens
VTPYMNHSP

SEQ ID NO: 1252953 - protein, 9 aa, Homo Sapiens
IRLYAPVVN

SEQ ID NO: 1252954 - protein, 9 aa, Homo Sapiens
DLHDAAVAC

SEQ ID NO: 1252955 - protein, 9 aa, Homo Sapiens
PTWYPCGLS

SEQ ID NO: 1252956 - protein, 9 aa, Homo Sapiens
HCCRQEMYI

SEQ ID NO: 1252957 - protein, 9 aa, Homo Sapiens
EVMDTYIKS

SEQ ID NO: 1252958 - protein, 9 aa, Homo Sapiens
MDLYRLVEV

SEQ ID NO: 1252959 - protein, 9 aa, Homo Sapiens
EAIHDNIYM

SEQ ID NO: 1252960 - protein, 9 aa, Homo Sapiens
LLPALVVLA

SEQ ID NO: 1252961 - protein, 9 aa, Homo Sapiens
LERQQNQQV

SEQ ID NO: 1252962 - protein, 9 aa, Homo Sapiens
PFPKPTLWD

SEQ ID NO: 1252963 - protein, 9 aa, Homo Sapiens
CRPINTTLA

SEQ ID NO: 1252964 - protein, 9 aa, Homo Sapiens
YECCLDEVA

SEQ ID NO: 1252965 - protein, 9 aa, Homo Sapiens
HSSGLDLFA

SEQ ID NO: 1252966 - protein, 9 aa, Homo Sapiens
DGGSMAHEA

SEQ ID NO: 1252967 - protein, 9 aa, Homo Sapiens
VMKILRLLH

SEQ ID NO: 1252968 - protein, 9 aa, Homo Sapiens
KTERINDLE

SEQ ID NO: 1252969 - protein, 9 aa, Homo Sapiens
SLPSMLRDD

SEQ ID NO: 1252970 - protein, 9 aa, Homo Sapiens
MASAWPFIT

SEQ ID NO: 1252971 - protein, 9 aa, Homo Sapiens
AEHLARVGP

SEQ ID NO: 1252972 - protein, 9 aa, Homo Sapiens
SGNGSQKKS

SEQ ID NO: 1252973 - protein, 9 aa, Homo Sapiens
FYTNPIAKL

SEQ ID NO: 1252974 - protein, 9 aa, Homo Sapiens
ASSLRHPRC

SEQ ID NO: 1252975 - protein, 9 aa, Homo Sapiens
QVHPAPTPR

SEQ ID NO: 1252976 - protein, 9 aa, Homo Sapiens
AMYEICQGM

SEQ ID NO: 1252977 - protein, 9 aa, Homo Sapiens
LLGVNEAGK

SEQ ID NO: 1252978 - protein, 9 aa, Homo Sapiens
EREHREKER

SEQ ID NO: 1252979 - protein, 9 aa, Homo Sapiens
IISFDICYL

SEQ ID NO: 1252980 - protein, 9 aa, Homo Sapiens
AGPIAGLNV

SEQ ID NO: 1252981 - protein, 9 aa, Homo Sapiens
HECLKETMG

SEQ ID NO: 1252982 - protein, 9 aa, Homo Sapiens
LCPSGRRCR

SEQ ID NO: 1252983 - protein, 9 aa, Homo Sapiens
PYGPLGGPA

SEQ ID NO: 1252984 - protein, 9 aa, Homo Sapiens
QVILLSQPP

SEQ ID NO: 1252985 - protein, 9 aa, Homo Sapiens
ISLSSFPDL

SEQ ID NO: 1252986 - protein, 9 aa, Homo Sapiens
FSSYAPEQS

SEQ ID NO: 1252987 - protein, 9 aa, Homo Sapiens
AWVWDNIYS

SEQ ID NO: 1252988 - protein, 9 aa, Homo Sapiens
TAMDLYRLV

SEQ ID NO: 1252989 - protein, 9 aa, Homo Sapiens
TLIGTVLAM

SEQ ID NO: 1252990 - protein, 9 aa, Homo Sapiens
FFGSVAVMH

SEQ ID NO: 1252991 - protein, 9 aa, Homo Sapiens
LLLVFILLF

SEQ ID NO: 1252992 - protein, 9 aa, Homo Sapiens
IGTMQPFML

SEQ ID NO: 1252993 - protein, 9 aa, Homo Sapiens
PFTCAGCGK

SEQ ID NO: 1252994 - protein, 9 aa, Homo Sapiens
FLKVRLVCS

SEQ ID NO: 1252995 - protein, 9 aa, Homo Sapiens
QMGRPHSRR

SEQ ID NO: 1252996 - protein, 9 aa, Homo Sapiens
GWADAKCVL

SEQ ID NO: 1252997 - protein, 9 aa, Homo Sapiens
PTTKQLLHM

SEQ ID NO: 1252998 - protein, 9 aa, Homo Sapiens
PGHAGWLLS

SEQ ID NO: 1252999 - protein, 9 aa, Homo Sapiens
ERTFAEVTE

SEQ ID NO: 1253000 - protein, 9 aa, Homo Sapiens
DISLSLVIW

SEQ ID NO: 1253001 - protein, 9 aa, Homo Sapiens
YIARSQIFV

SEQ ID NO: 1253002 - protein, 9 aa, Homo Sapiens
QKSPKGRVV

SEQ ID NO: 1253003 - protein, 9 aa, Homo Sapiens
MLPVCSITV

SEQ ID NO: 1253004 - protein, 9 aa, Homo Sapiens
TPGEDPPVS

SEQ ID NO: 1253005 - protein, 9 aa, Homo Sapiens
NMIRGIGET

SEQ ID NO: 1253006 - protein, 9 aa, Homo Sapiens
PVLPASMIG

SEQ ID NO: 1253007 - protein, 9 aa, Homo Sapiens
CTIPSGAVK

SEQ ID NO: 1253008 - protein, 9 aa, Homo Sapiens
SGSVAPGNG

SEQ ID NO: 1253009 - protein, 9 aa, Homo Sapiens
YYKASSEMT

SEQ ID NO: 1253010 - protein, 9 aa, Homo Sapiens
KISRTQAEI

SEQ ID NO: 1253011 - protein, 9 aa, Homo Sapiens
TATADHSLL

SEQ ID NO: 1253012 - protein, 9 aa, Homo Sapiens
SGMGQRRMR

SEQ ID NO: 1253013 - protein, 9 aa, Homo Sapiens
PVGPPCRSS

SEQ ID NO: 1253014 - protein, 9 aa, Homo Sapiens
KHCRPKLPP

SEQ ID NO: 1253015 - protein, 9 aa, Homo Sapiens
ITQSKAIMG

SEQ ID NO: 1253016 - protein, 9 aa, Homo Sapiens
EGIPALVPT

SEQ ID NO: 1253017 - protein, 9 aa, Homo Sapiens
DRMNEIHID

SEQ ID NO: 1253018 - protein, 9 aa, Homo Sapiens
GSAHFNRTM

SEQ ID NO: 1253019 - protein, 9 aa, Homo Sapiens
ILLLCLPDE

SEQ ID NO: 1253020 - protein, 9 aa, Homo Sapiens
TITWKFDSP

SEQ ID NO: 1253021 - protein, 9 aa, Homo Sapiens
RAFSRRCPI

SEQ ID NO: 1253022 - protein, 9 aa, Homo Sapiens
NMGSSSSNQ

SEQ ID NO: 1253023 - protein, 9 aa, Homo Sapiens
GVVSFSLGP

SEQ ID NO: 1253024 - protein, 9 aa, Homo Sapiens
TYGCNECGK

SEQ ID NO: 1253025 - protein, 9 aa, Homo Sapiens
FRNRHPGAS

SEQ ID NO: 1253026 - protein, 9 aa, Homo Sapiens
SLTCSYAKL

SEQ ID NO: 1253027 - protein, 9 aa, Homo Sapiens
VMFALWELT

SEQ ID NO: 1253028 - protein, 9 aa, Homo Sapiens
SDQLQPQRC

SEQ ID NO: 1253029 - protein, 9 aa, Homo Sapiens
RLEFFDHNG

SEQ ID NO: 1253030 - protein, 9 aa, Homo Sapiens
NRVYIARSQ

SEQ ID NO: 1253031 - protein, 9 aa, Homo Sapiens
IEQVSQLST

SEQ ID NO: 1253032 - protein, 9 aa, Homo Sapiens
VYQQSQYLE

SEQ ID NO: 1253033 - protein, 9 aa, Homo Sapiens
PLVQLDPAE

SEQ ID NO: 1253034 - protein, 9 aa, Homo Sapiens
PVLVGLFLS

SEQ ID NO: 1253035 - protein, 9 aa, Homo Sapiens
SYECVIRAM

SEQ ID NO: 1253036 - protein, 9 aa, Homo Sapiens
KEITFQLHE

SEQ ID NO: 1253037 - protein, 9 aa, Homo Sapiens
AIYLKQVTD

SEQ ID NO: 1253038 - protein, 9 aa, Homo Sapiens
KPLKFQETE

SEQ ID NO: 1253039 - protein, 9 aa, Homo Sapiens
WDPEEMAEY

SEQ ID NO: 1253040 - protein, 9 aa, Homo Sapiens
DTVPLGTET

SEQ ID NO: 1253041 - protein, 9 aa, Homo Sapiens
RNDKYSSYN

SEQ ID NO: 1253042 - protein, 9 aa, Homo Sapiens
CCELSPGYY

SEQ ID NO: 1253043 - protein, 9 aa, Homo Sapiens
CEEFVKSMG

SEQ ID NO: 1253044 - protein, 9 aa, Homo Sapiens
RAFNSLGLL

SEQ ID NO: 1253045 - protein, 9 aa, Homo Sapiens
LYDNATDLD

SEQ ID NO: 1253046 - protein, 9 aa, Homo Sapiens
HALGFLGQF

SEQ ID NO: 1253047 - protein, 9 aa, Homo Sapiens
ETFNLKGVL

SEQ ID NO: 1253048 - protein, 9 aa, Homo Sapiens
LNPLAQSQD

SEQ ID NO: 1253049 - protein, 9 aa, Homo Sapiens
NCSLLYAQK

SEQ ID NO: 1253050 - protein, 9 aa, Homo Sapiens
QDEVTKMNL

SEQ ID NO: 1253051 - protein, 9 aa, Homo Sapiens
CFTLFENGP

SEQ ID NO: 1253052 - protein, 9 aa, Homo Sapiens
EPVKTLITQ

SEQ ID NO: 1253053 - protein, 9 aa, Homo Sapiens
NGLSFEELY

SEQ ID NO: 1253054 - protein, 9 aa, Homo Sapiens
VVGITATLF

SEQ ID NO: 1253055 - protein, 9 aa, Homo Sapiens
FGCMNAAPM

SEQ ID NO: 1253056 - protein, 9 aa, Homo Sapiens
SIISFDICY

SEQ ID NO: 1253057 - protein, 9 aa, Homo Sapiens
AASRGHRGA

SEQ ID NO: 1253058 - protein, 9 aa, Homo Sapiens
LSVTPLCGP

SEQ ID NO: 1253059 - protein, 9 aa, Homo Sapiens
SPGSDSDIS

SEQ ID NO: 1253060 - protein, 9 aa, Homo Sapiens
TTVCCYLLC

SEQ ID NO: 1253061 - protein, 9 aa, Homo Sapiens
SSVKRTHYY

SEQ ID NO: 1253062 - protein, 9 aa, Homo Sapiens
GHYLFGAGC

SEQ ID NO: 1253063 - protein, 9 aa, Homo Sapiens
VPDKDGDKD

SEQ ID NO: 1253064 - protein, 9 aa, Homo Sapiens
VSQIEEEYA

SEQ ID NO: 1253065 - protein, 9 aa, Homo Sapiens
KPSFFVLHH

SEQ ID NO: 1253066 - protein, 9 aa, Homo Sapiens
DMLHRAYSK

SEQ ID NO: 1253067 - protein, 9 aa, Homo Sapiens
PEKRANPCP

SEQ ID NO: 1253068 - protein, 9 aa, Homo Sapiens
YGPTLLCAG

SEQ ID NO: 1253069 - protein, 9 aa, Homo Sapiens
HPALCSRFA

SEQ ID NO: 1253070 - protein, 9 aa, Homo Sapiens
RGPRPLHRW

SEQ ID NO: 1253071 - protein, 9 aa, Homo Sapiens
RLWAGSRIV

SEQ ID NO: 1253072 - protein, 9 aa, Homo Sapiens
QTATSTCFD

SEQ ID NO: 1253073 - protein, 9 aa, Homo Sapiens
KKTNLARHH

SEQ ID NO: 1253074 - protein, 9 aa, Homo Sapiens
SRFHVKFTL

SEQ ID NO: 1253075 - protein, 9 aa, Homo Sapiens
RSHRGGGRS

SEQ ID NO: 1253076 - protein, 9 aa, Homo Sapiens
KKTRTSPTF

SEQ ID NO: 1253077 - protein, 9 aa, Homo Sapiens
RVKCNTNDT

SEQ ID NO: 1253078 - protein, 9 aa, Homo Sapiens
VMGLGRRGA

SEQ ID NO: 1253079 - protein, 9 aa, Homo Sapiens
YTPVDSLMF

SEQ ID NO: 1253080 - protein, 9 aa, Homo Sapiens
YSPSLRILT

SEQ ID NO: 1253081 - protein, 9 aa, Homo Sapiens
AIQLLKCLA

SEQ ID NO: 1253082 - protein, 9 aa, Homo Sapiens
ERCTFLTNL

SEQ ID NO: 1253083 - protein, 9 aa, Homo Sapiens
DPSNHQSQP

SEQ ID NO: 1253084 - protein, 9 aa, Homo Sapiens
WQLQLEAEE

SEQ ID NO: 1253085 - protein, 9 aa, Homo Sapiens
SVSNYQRVH

SEQ ID NO: 1253086 - protein, 9 aa, Homo Sapiens
FMASWALLP

SEQ ID NO: 1253087 - protein, 9 aa, Homo Sapiens
QAHRQRAVL

SEQ ID NO: 1253088 - protein, 9 aa, Homo Sapiens
QLSDHTIGV

SEQ ID NO: 1253089 - protein, 9 aa, Homo Sapiens
EPVELGKTQ

SEQ ID NO: 1253090 - protein, 9 aa, Homo Sapiens
DPNNPPSSD

SEQ ID NO: 1253091 - protein, 9 aa, Homo Sapiens
FQKLRYKDL

SEQ ID NO: 1253092 - protein, 9 aa, Homo Sapiens
LQVLVSGAS

SEQ ID NO: 1253093 - protein, 9 aa, Homo Sapiens
CRGRLDFKH

SEQ ID NO: 1253094 - protein, 9 aa, Homo Sapiens
AISHDSIFM

SEQ ID NO: 1253095 - protein, 9 aa, Homo Sapiens
PDHLTSCVW

SEQ ID NO: 1253096 - protein, 9 aa, Homo Sapiens
MNVGNQNCS

SEQ ID NO: 1253097 - protein, 9 aa, Homo Sapiens
ESGMALDEE

SEQ ID NO: 1253098 - protein, 9 aa, Homo Sapiens
VDGSVAFVP

SEQ ID NO: 1253099 - protein, 9 aa, Homo Sapiens
TSVQPILVE

SEQ ID NO: 1253100 - protein, 9 aa, Homo Sapiens
AGTGKTTLT

SEQ ID NO: 1253101 - protein, 9 aa, Homo Sapiens
DSLMFGGNI

SEQ ID NO: 1253102 - protein, 9 aa, Homo Sapiens
VHMPGDVPV

SEQ ID NO: 1253103 - protein, 9 aa, Homo Sapiens
PPGSGGDGP

SEQ ID NO: 1253104 - protein, 9 aa, Homo Sapiens
YLTLTNKFE

SEQ ID NO: 1253105 - protein, 9 aa, Homo Sapiens
VLLTHGVNA

SEQ ID NO: 1253106 - protein, 9 aa, Homo Sapiens
TDSLYMFGG

SEQ ID NO: 1253107 - protein, 9 aa, Homo Sapiens
TLHPYLTEE

SEQ ID NO: 1253108 - protein, 9 aa, Homo Sapiens
VYHPADGDM

SEQ ID NO: 1253109 - protein, 9 aa, Homo Sapiens
ASYIVVMVD

SEQ ID NO: 1253110 - protein, 9 aa, Homo Sapiens
GGNLRSYQQ

SEQ ID NO: 1253111 - protein, 9 aa, Homo Sapiens
RSIDAENSP

SEQ ID NO: 1253112 - protein, 9 aa, Homo Sapiens
SSVSSFMIS

SEQ ID NO: 1253113 - protein, 9 aa, Homo Sapiens
VRHWHLWKH

SEQ ID NO: 1253114 - protein, 9 aa, Homo Sapiens
PAGPSKVDQ

SEQ ID NO: 1253115 - protein, 9 aa, Homo Sapiens
LLQNWPSMD

SEQ ID NO: 1253116 - protein, 9 aa, Homo Sapiens
INFFTGDVF

SEQ ID NO: 1253117 - protein, 9 aa, Homo Sapiens
AQRCRISKY

SEQ ID NO: 1253118 - protein, 9 aa, Homo Sapiens
TRFGSTLHL

SEQ ID NO: 1253119 - protein, 9 aa, Homo Sapiens
RTPTLVFEH

SEQ ID NO: 1253120 - protein, 9 aa, Homo Sapiens
PVFAHVYFP

SEQ ID NO: 1253121 - protein, 9 aa, Homo Sapiens
HIHSRTHAY

SEQ ID NO: 1253122 - protein, 9 aa, Homo Sapiens
PDNSAPYGT

SEQ ID NO: 1253123 - protein, 9 aa, Homo Sapiens
CRVEMSEVT

SEQ ID NO: 1253124 - protein, 9 aa, Homo Sapiens
DNKTLKINE

SEQ ID NO: 1253125 - protein, 9 aa, Homo Sapiens
EAPEPGSTC

SEQ ID NO: 1253126 - protein, 9 aa, Homo Sapiens
VNLVCALST

SEQ ID NO: 1253127 - protein, 9 aa, Homo Sapiens
LDLGHAPMG

SEQ ID NO: 1253128 - protein, 9 aa, Homo Sapiens
RLIGQQLNG

SEQ ID NO: 1253129 - protein, 9 aa, Homo Sapiens
REVDFDAFF

SEQ ID NO: 1253130 - protein, 9 aa, Homo Sapiens
HPETSVQPI

SEQ ID NO: 1253131 - protein, 9 aa, Homo Sapiens
ASIARRAGD

SEQ ID NO: 1253132 - protein, 9 aa, Homo Sapiens
ETFAEKLSR

SEQ ID NO: 1253133 - protein, 9 aa, Homo Sapiens
VHIKFGDFD

SEQ ID NO: 1253134 - protein, 9 aa, Homo Sapiens
HILIVEGLL

SEQ ID NO: 1253135 - protein, 9 aa, Homo Sapiens
APCPGYLFE

SEQ ID NO: 1253136 - protein, 9 aa, Homo Sapiens
KIFDRIGKY

SEQ ID NO: 1253137 - protein, 9 aa, Homo Sapiens
IPKVQSNGP

SEQ ID NO: 1253138 - protein, 9 aa, Homo Sapiens
SIGRIFDGR

SEQ ID NO: 1253139 - protein, 9 aa, Homo Sapiens
SFHVTWITS

SEQ ID NO: 1253140 - protein, 9 aa, Homo Sapiens
SRSSSAADL

SEQ ID NO: 1253141 - protein, 9 aa, Homo Sapiens
DDEPETYMA

SEQ ID NO: 1253142 - protein, 9 aa, Homo Sapiens
TNMTLPATT

SEQ ID NO: 1253143 - protein, 9 aa, Homo Sapiens
EKHPDADSM

SEQ ID NO: 1253144 - protein, 9 aa, Homo Sapiens
LLEHHHGQG

SEQ ID NO: 1253145 - protein, 9 aa, Homo Sapiens
SSPGWTPRW

SEQ ID NO: 1253146 - protein, 9 aa, Homo Sapiens
KYQNKARRS

SEQ ID NO: 1253147 - protein, 9 aa, Homo Sapiens
ACEGRTSHK

SEQ ID NO: 1253148 - protein, 9 aa, Homo Sapiens
DWGWVEQLV

SEQ ID NO: 1253149 - protein, 9 aa, Homo Sapiens
KLNHKSLTL

SEQ ID NO: 1253150 - protein, 9 aa, Homo Sapiens
AFTGDILMR

SEQ ID NO: 1253151 - protein, 9 aa, Homo Sapiens
GLHEKETIY

SEQ ID NO: 1253152 - protein, 9 aa, Homo Sapiens
ANIRRMCRI

SEQ ID NO: 1253153 - protein, 9 aa, Homo Sapiens
CHSNMLCWN

SEQ ID NO: 1253154 - protein, 9 aa, Homo Sapiens
VMEKHSSGL

SEQ ID NO: 1253155 - protein, 9 aa, Homo Sapiens
GPFANIAHS

SEQ ID NO: 1253156 - protein, 9 aa, Homo Sapiens
NVLLCKEIL

SEQ ID NO: 1253157 - protein, 9 aa, Homo Sapiens
RLKHMDMVL

SEQ ID NO: 1253158 - protein, 9 aa, Homo Sapiens
ARAGVSHVL

SEQ ID NO: 1253159 - protein, 9 aa, Homo Sapiens
NKLWYKPME

SEQ ID NO: 1253160 - protein, 9 aa, Homo Sapiens
GVNAILGVS

SEQ ID NO: 1253161 - protein, 9 aa, Homo Sapiens
WVQEGMRKT

SEQ ID NO: 1253162 - protein, 9 aa, Homo Sapiens
EWNDSGPEF

SEQ ID NO: 1253163 - protein, 9 aa, Homo Sapiens
PHPLPSPGC

SEQ ID NO: 1253164 - protein, 9 aa, Homo Sapiens
KVDGLTLLK

SEQ ID NO: 1253165 - protein, 9 aa, Homo Sapiens
QRFSTRAVY

SEQ ID NO: 1253166 - protein, 9 aa, Homo Sapiens
LERAVCHDE

SEQ ID NO: 1253167 - protein, 9 aa, Homo Sapiens
HNDGYDKYT

SEQ ID NO: 1253168 - protein, 9 aa, Homo Sapiens
YLTCVERGK

SEQ ID NO: 1253169 - protein, 9 aa, Homo Sapiens
PASAGLRHN

SEQ ID NO: 1253170 - protein, 9 aa, Homo Sapiens
GKNSKSHKH

SEQ ID NO: 1253171 - protein, 9 aa, Homo Sapiens
QCEATVISE

SEQ ID NO: 1253172 - protein, 9 aa, Homo Sapiens
TLQIREQTL

SEQ ID NO: 1253173 - protein, 9 aa, Homo Sapiens
YLCLHYPPS

SEQ ID NO: 1253174 - protein, 9 aa, Homo Sapiens
TYVDEQMTM

SEQ ID NO: 1253175 - protein, 9 aa, Homo Sapiens
ASITGQSIA

SEQ ID NO: 1253176 - protein, 9 aa, Homo Sapiens
KNRRKDCRP

SEQ ID NO: 1253177 - protein, 9 aa, Homo Sapiens
VKVEAGGGW

SEQ ID NO: 1253178 - protein, 9 aa, Homo Sapiens
FVSNDSPDV

SEQ ID NO: 1253179 - protein, 9 aa, Homo Sapiens
HEIQHFFVT

SEQ ID NO: 1253180 - protein, 9 aa, Homo Sapiens
HQQVHTGER

SEQ ID NO: 1253181 - protein, 9 aa, Homo Sapiens
GLAKAKRRC

SEQ ID NO: 1253182 - protein, 9 aa, Homo Sapiens
GGKYDVAHV

SEQ ID NO: 1253183 - protein, 9 aa, Homo Sapiens
NRLVQPRRS

SEQ ID NO: 1253184 - protein, 9 aa, Homo Sapiens
IKGPAKENR

SEQ ID NO: 1253185 - protein, 9 aa, Homo Sapiens
PPWLLLGSL

SEQ ID NO: 1253186 - protein, 9 aa, Homo Sapiens
RESRMELSA

SEQ ID NO: 1253187 - protein, 9 aa, Homo Sapiens
TAFVRAQAD

SEQ ID NO: 1253188 - protein, 9 aa, Homo Sapiens
MARDLVERV

SEQ ID NO: 1253189 - protein, 9 aa, Homo Sapiens
RCVSSLSIQ

SEQ ID NO: 1253190 - protein, 9 aa, Homo Sapiens
VCQRDSKID

SEQ ID NO: 1253191 - protein, 9 aa, Homo Sapiens
LPLPEEFQV

SEQ ID NO: 1253192 - protein, 9 aa, Homo Sapiens
SETCSVRSF

SEQ ID NO: 1253193 - protein, 9 aa, Homo Sapiens
APTQYHISL

SEQ ID NO: 1253194 - protein, 9 aa, Homo Sapiens
VVNDTKSGN

SEQ ID NO: 1253195 - protein, 9 aa, Homo Sapiens
KTQCMPRKV

SEQ ID NO: 1253196 - protein, 9 aa, Homo Sapiens
LHSTAEQDC

SEQ ID NO: 1253197 - protein, 9 aa, Homo Sapiens
PRKQRRERM

SEQ ID NO: 1253198 - protein, 9 aa, Homo Sapiens
KDKLLEKGP

SEQ ID NO: 1253199 - protein, 9 aa, Homo Sapiens
QVRAKSHSE

SEQ ID NO: 1253200 - protein, 9 aa, Homo Sapiens
GKAFSAKQK

SEQ ID NO: 1253201 - protein, 9 aa, Homo Sapiens
DSEESGNFP

SEQ ID NO: 1253202 - protein, 9 aa, Homo Sapiens
HGLAPFPRA

SEQ ID NO: 1253203 - protein, 9 aa, Homo Sapiens
GVVTKSQPV

SEQ ID NO: 1253204 - protein, 9 aa, Homo Sapiens
SPFVLYLLQ

SEQ ID NO: 1253205 - protein, 9 aa, Homo Sapiens
NTAPSQDTD

SEQ ID NO: 1253206 - protein, 9 aa, Homo Sapiens
PDTLLLQVR

SEQ ID NO: 1253207 - protein, 9 aa, Homo Sapiens
TAWVLSAAE

SEQ ID NO: 1253208 - protein, 9 aa, Homo Sapiens
VEACCSILS

SEQ ID NO: 1253209 - protein, 9 aa, Homo Sapiens
EALDPDEEH

SEQ ID NO: 1253210 - protein, 9 aa, Homo Sapiens
RTTPSWCLC

SEQ ID NO: 1253211 - protein, 9 aa, Homo Sapiens
KGPHGSITR

SEQ ID NO: 1253212 - protein, 9 aa, Homo Sapiens
LEAHALEPP

SEQ ID NO: 1253213 - protein, 9 aa, Homo Sapiens
GMTENETPT

SEQ ID NO: 1253214 - protein, 9 aa, Homo Sapiens
GWRAQQQLE

SEQ ID NO: 1253215 - protein, 9 aa, Homo Sapiens
SASSQKGLQ

SEQ ID NO: 1253216 - protein, 9 aa, Homo Sapiens
TAMKSKEME

SEQ ID NO: 1253217 - protein, 9 aa, Homo Sapiens
GDNFYVIDI

SEQ ID NO: 1253218 - protein, 9 aa, Homo Sapiens
GASGAFQLK

SEQ ID NO: 1253219 - protein, 9 aa, Homo Sapiens
PHGNVLVRY

SEQ ID NO: 1253220 - protein, 9 aa, Homo Sapiens
MAHRSQKSR

SEQ ID NO: 1253221 - protein, 9 aa, Homo Sapiens
GWTPRWTTS

SEQ ID NO: 1253222 - protein, 9 aa, Homo Sapiens
VDWLPQQIR

SEQ ID NO: 1253223 - protein, 9 aa, Homo Sapiens
ARLQINEFS

SEQ ID NO: 1253224 - protein, 9 aa, Homo Sapiens
FGAISLSSL

SEQ ID NO: 1253225 - protein, 9 aa, Homo Sapiens
LKTHKQRIT

SEQ ID NO: 1253226 - protein, 9 aa, Homo Sapiens
PVERTAVWV

SEQ ID NO: 1253227 - protein, 9 aa, Homo Sapiens
GRQKYKRSI

SEQ ID NO: 1253228 - protein, 9 aa, Homo Sapiens
CPKASCLLP

SEQ ID NO: 1253229 - protein, 9 aa, Homo Sapiens
TVSERKRNI

SEQ ID NO: 1253230 - protein, 9 aa, Homo Sapiens
KNKLFPQVI

SEQ ID NO: 1253231 - protein, 9 aa, Homo Sapiens
WKGPGNCHF

SEQ ID NO: 1253232 - protein, 9 aa, Homo Sapiens
YPPTPNTVE

SEQ ID NO: 1253233 - protein, 9 aa, Homo Sapiens
PACPPRQSC

SEQ ID NO: 1253234 - protein, 9 aa, Homo Sapiens
AQTWHFLSS

SEQ ID NO: 1253235 - protein, 9 aa, Homo Sapiens
LSGVVNVNA

SEQ ID NO: 1253236 - protein, 9 aa, Homo Sapiens
TFLEGSSTL

SEQ ID NO: 1253237 - protein, 9 aa, Homo Sapiens
KEMEQFFSM

SEQ ID NO: 1253238 - protein, 9 aa, Homo Sapiens
NELTEKTGR

SEQ ID NO: 1253239 - protein, 9 aa, Homo Sapiens
CNECEIAFS

SEQ ID NO: 1253240 - protein, 9 aa, Homo Sapiens
DCRQVTRAG

SEQ ID NO: 1253241 - protein, 9 aa, Homo Sapiens
ESADQEDHI

SEQ ID NO: 1253242 - protein, 9 aa, Homo Sapiens
QHFFVTRHL

SEQ ID NO: 1253243 - protein, 9 aa, Homo Sapiens
KKNDAEPRS

SEQ ID NO: 1253244 - protein, 9 aa, Homo Sapiens
KQPWGAGAL

SEQ ID NO: 1253245 - protein, 9 aa, Homo Sapiens
LNAFRLFDD

SEQ ID NO: 1253246 - protein, 9 aa, Homo Sapiens
ITRIPEAFK

SEQ ID NO: 1253247 - protein, 9 aa, Homo Sapiens
LPPKKKCLR

SEQ ID NO: 1253248 - protein, 9 aa, Homo Sapiens
LWGECTWDC

SEQ ID NO: 1253249 - protein, 9 aa, Homo Sapiens
RAAGTEEMD

SEQ ID NO: 1253250 - protein, 9 aa, Homo Sapiens
HFFVTRHLC

SEQ ID NO: 1253251 - protein, 9 aa, Homo Sapiens
ATTSPTLLF

SEQ ID NO: 1253252 - protein, 9 aa, Homo Sapiens
LDSKGYDIA

SEQ ID NO: 1253253 - protein, 9 aa, Homo Sapiens
EEEEEKEHL

SEQ ID NO: 1253254 - protein, 9 aa, Homo Sapiens
LKKYVWIMK

SEQ ID NO: 1253255 - protein, 9 aa, Homo Sapiens
NLASNWLQS

SEQ ID NO: 1253256 - protein, 9 aa, Homo Sapiens
STPETATRR

SEQ ID NO: 1253257 - protein, 9 aa, Homo Sapiens
HAWTHRLHE

SEQ ID NO: 1253258 - protein, 9 aa, Homo Sapiens
MDGATPAIY

SEQ ID NO: 1253259 - protein, 9 aa, Homo Sapiens
HITGLCLLV

SEQ ID NO: 1253260 - protein, 9 aa, Homo Sapiens
LLGPPRPHV

SEQ ID NO: 1253261 - protein, 9 aa, Homo Sapiens
VAFIVFWVR

SEQ ID NO: 1253262 - protein, 9 aa, Homo Sapiens
SGENKKTKP

SEQ ID NO: 1253263 - protein, 9 aa, Homo Sapiens
DGLDSGADT

SEQ ID NO: 1253264 - protein, 9 aa, Homo Sapiens
DDIDRWCSI

SEQ ID NO: 1253265 - protein, 9 aa, Homo Sapiens
LLTHGVNAD

SEQ ID NO: 1253266 - protein, 9 aa, Homo Sapiens
TSQPEGEVG

SEQ ID NO: 1253267 - protein, 9 aa, Homo Sapiens
SMIVVPKGE

SEQ ID NO: 1253268 - protein, 9 aa, Homo Sapiens
KGDKKLLHF

SEQ ID NO: 1253269 - protein, 9 aa, Homo Sapiens
LRYSPISGH

SEQ ID NO: 1253270 - protein, 9 aa, Homo Sapiens
KRTLSMSTL

SEQ ID NO: 1253271 - protein, 9 aa, Homo Sapiens
SGSLSRTHS

SEQ ID NO: 1253272 - protein, 9 aa, Homo Sapiens
ICRGIRGGL

SEQ ID NO: 1253273 - protein, 9 aa, Homo Sapiens
QVAFIFHCK

SEQ ID NO: 1253274 - protein, 9 aa, Homo Sapiens
KEKEEMELL

SEQ ID NO: 1253275 - protein, 9 aa, Homo Sapiens
HTELGFTNY

SEQ ID NO: 1253276 - protein, 9 aa, Homo Sapiens
PELYPSEHR

SEQ ID NO: 1253277 - protein, 9 aa, Homo Sapiens
TDSTDTQED

SEQ ID NO: 1253278 - protein, 9 aa, Homo Sapiens
GNNLVVIVI

SEQ ID NO: 1253279 - protein, 9 aa, Homo Sapiens
DCDLQEDES

SEQ ID NO: 1253280 - protein, 9 aa, Homo Sapiens
DIIFTIDVT

SEQ ID NO: 1253281 - protein, 9 aa, Homo Sapiens
SKHILNVPQ

SEQ ID NO: 1253282 - protein, 9 aa, Homo Sapiens
GVMLVHVIR

SEQ ID NO: 1253283 - protein, 9 aa, Homo Sapiens
SAVTVVGLM

SEQ ID NO: 1253284 - protein, 9 aa, Homo Sapiens
FFILWYNDG

SEQ ID NO: 1253285 - protein, 9 aa, Homo Sapiens
LTAEDLSGS

SEQ ID NO: 1253286 - protein, 9 aa, Homo Sapiens
VSAGEDVDL

SEQ ID NO: 1253287 - protein, 9 aa, Homo Sapiens
PPCGPDRCD

SEQ ID NO: 1253288 - protein, 9 aa, Homo Sapiens
NCCCRSPPS

SEQ ID NO: 1253289 - protein, 9 aa, Homo Sapiens
ILSWDYSMQ

SEQ ID NO: 1253290 - protein, 9 aa, Homo Sapiens
EAHCLIWLL

SEQ ID NO: 1253291 - protein, 9 aa, Homo Sapiens
HEVGGYDTF

SEQ ID NO: 1253292 - protein, 9 aa, Homo Sapiens
NAPTLLATQ

SEQ ID NO: 1253293 - protein, 9 aa, Homo Sapiens
CLAEEGRTI

SEQ ID NO: 1253294 - protein, 9 aa, Homo Sapiens
ALHSYALCT

SEQ ID NO: 1253295 - protein, 9 aa, Homo Sapiens
KNHEALAKW

SEQ ID NO: 1253296 - protein, 9 aa, Homo Sapiens
LHDAGLHRV

SEQ ID NO: 1253297 - protein, 9 aa, Homo Sapiens
REERECKHH

SEQ ID NO: 1253298 - protein, 9 aa, Homo Sapiens
DTHRNTQAH

SEQ ID NO: 1253299 - protein, 9 aa, Homo Sapiens
KDIDQDNRN

SEQ ID NO: 1253300 - protein, 9 aa, Homo Sapiens
YFHKVADQL

SEQ ID NO: 1253301 - protein, 9 aa, Homo Sapiens
KENDVPTIF

SEQ ID NO: 1253302 - protein, 9 aa, Homo Sapiens
CCDVPTNGC

SEQ ID NO: 1253303 - protein, 9 aa, Homo Sapiens
KLSPDSLGS

SEQ ID NO: 1253304 - protein, 9 aa, Homo Sapiens
NQAADVHAL

SEQ ID NO: 1253305 - protein, 9 aa, Homo Sapiens
PEIINYLYE

SEQ ID NO: 1253306 - protein, 9 aa, Homo Sapiens
LHDGGRPAL

SEQ ID NO: 1253307 - protein, 9 aa, Homo Sapiens
KHDTLKGLS

SEQ ID NO: 1253308 - protein, 9 aa, Homo Sapiens
CCMLLKRMV

SEQ ID NO: 1253309 - protein, 9 aa, Homo Sapiens
DHLDAGLSV

SEQ ID NO: 1253310 - protein, 9 aa, Homo Sapiens
HVSVSRVFQ

SEQ ID NO: 1253311 - protein, 9 aa, Homo Sapiens
TYFAPNFQK

SEQ ID NO: 1253312 - protein, 9 aa, Homo Sapiens
TLHLHDAGL

SEQ ID NO: 1253313 - protein, 9 aa, Homo Sapiens
DYCKKNGEE

SEQ ID NO: 1253314 - protein, 9 aa, Homo Sapiens
PETRRVTEL

SEQ ID NO: 1253315 - protein, 9 aa, Homo Sapiens
RQDAVHAVL

SEQ ID NO: 1253316 - protein, 9 aa, Homo Sapiens
GLFSSVSAS

SEQ ID NO: 1253317 - protein, 9 aa, Homo Sapiens
CEDNAEASG

SEQ ID NO: 1253318 - protein, 9 aa, Homo Sapiens
KTCIQSQIG

SEQ ID NO: 1253319 - protein, 9 aa, Homo Sapiens
RPFICNWLF

SEQ ID NO: 1253320 - protein, 9 aa, Homo Sapiens
LDRANNLYM

SEQ ID NO: 1253321 - protein, 9 aa, Homo Sapiens
LCLEIPGSR

SEQ ID NO: 1253322 - protein, 9 aa, Homo Sapiens
HRAFLSDMI

SEQ ID NO: 1253323 - protein, 9 aa, Homo Sapiens
QKKNDAEPR

SEQ ID NO: 1253324 - protein, 9 aa, Homo Sapiens
GNEWIMQKK

SEQ ID NO: 1253325 - protein, 9 aa, Homo Sapiens
EGLNYSENT

SEQ ID NO: 1253326 - protein, 9 aa, Homo Sapiens
VHSSPPPPP

SEQ ID NO: 1253327 - protein, 9 aa, Homo Sapiens
RDTSLETAL

SEQ ID NO: 1253328 - protein, 9 aa, Homo Sapiens
DANIATSQR

SEQ ID NO: 1253329 - protein, 9 aa, Homo Sapiens
ELVMAPGFA

SEQ ID NO: 1253330 - protein, 9 aa, Homo Sapiens
VNPVGHLLM

SEQ ID NO: 1253331 - protein, 9 aa, Homo Sapiens
LQETRCANA

SEQ ID NO: 1253332 - protein, 9 aa, Homo Sapiens
LILVSQLRA

SEQ ID NO: 1253333 - protein, 9 aa, Homo Sapiens
APLIDAPHD

SEQ ID NO: 1253334 - protein, 9 aa, Homo Sapiens
NANDRNDRV

SEQ ID NO: 1253335 - protein, 9 aa, Homo Sapiens
DGWNSKVAA

SEQ ID NO: 1253336 - protein, 9 aa, Homo Sapiens
EMPGATVMP

SEQ ID NO: 1253337 - protein, 9 aa, Homo Sapiens
GVLTHDRVR

SEQ ID NO: 1253338 - protein, 9 aa, Homo Sapiens
DAAEGPFAR

SEQ ID NO: 1253339 - protein, 9 aa, Homo Sapiens
LLLTADLCS

SEQ ID NO: 1253340 - protein, 9 aa, Homo Sapiens
IGQTKSVVV

SEQ ID NO: 1253341 - protein, 9 aa, Homo Sapiens
CRAPAASQE

SEQ ID NO: 1253342 - protein, 9 aa, Homo Sapiens
RIFSTEILL

SEQ ID NO: 1253343 - protein, 9 aa, Homo Sapiens
YIEPALYRV

SEQ ID NO: 1253344 - protein, 9 aa, Homo Sapiens
CLAQICSSI

SEQ ID NO: 1253345 - protein, 9 aa, Homo Sapiens
FITLSREHP

SEQ ID NO: 1253346 - protein, 9 aa, Homo Sapiens
LGPLGVPGE

SEQ ID NO: 1253347 - protein, 9 aa, Homo Sapiens
TDSNSQSTG

SEQ ID NO: 1253348 - protein, 9 aa, Homo Sapiens
PGSAGPDCR

SEQ ID NO: 1253349 - protein, 9 aa, Homo Sapiens
TEGLMKSVD

SEQ ID NO: 1253350 - protein, 9 aa, Homo Sapiens
IFKHTAPSF

SEQ ID NO: 1253351 - protein, 9 aa, Homo Sapiens
LSRTRACEV

SEQ ID NO: 1253352 - protein, 9 aa, Homo Sapiens
GTYLRVLRD

SEQ ID NO: 1253353 - protein, 9 aa, Homo Sapiens
FIHGMHAKH

SEQ ID NO: 1253354 - protein, 9 aa, Homo Sapiens
CLCSQPRRP

SEQ ID NO: 1253355 - protein, 9 aa, Homo Sapiens
GPRPRAPAQ

SEQ ID NO: 1253356 - protein, 9 aa, Homo Sapiens
CSRSCEGGV

SEQ ID NO: 1253357 - protein, 9 aa, Homo Sapiens
CCCRSPPSS

SEQ ID NO: 1253358 - protein, 9 aa, Homo Sapiens
SSNSAFQSL

SEQ ID NO: 1253359 - protein, 9 aa, Homo Sapiens
EAVLFGINE

SEQ ID NO: 1253360 - protein, 9 aa, Homo Sapiens
MVSAEPLTA

SEQ ID NO: 1253361 - protein, 9 aa, Homo Sapiens
YVFIHLWAL

SEQ ID NO: 1253362 - protein, 9 aa, Homo Sapiens
LLYRHRLSE

SEQ ID NO: 1253363 - protein, 9 aa, Homo Sapiens
WRCQCLKDI

SEQ ID NO: 1253364 - protein, 9 aa, Homo Sapiens
KVEATKNEI

SEQ ID NO: 1253365 - protein, 9 aa, Homo Sapiens
GVQGVQVQL

SEQ ID NO: 1253366 - protein, 9 aa, Homo Sapiens
GLITLCGIL

SEQ ID NO: 1253367 - protein, 9 aa, Homo Sapiens
RVYFNLPED

SEQ ID NO: 1253368 - protein, 9 aa, Homo Sapiens
ILQQLSLEM

SEQ ID NO: 1253369 - protein, 9 aa, Homo Sapiens
PEYETAATR

SEQ ID NO: 1253370 - protein, 9 aa, Homo Sapiens
IALLQQPRS

SEQ ID NO: 1253371 - protein, 9 aa, Homo Sapiens
SCEGGVQER

SEQ ID NO: 1253372 - protein, 9 aa, Homo Sapiens
FSLLSAVFY

SEQ ID NO: 1253373 - protein, 9 aa, Homo Sapiens
TLLHSMVVA

SEQ ID NO: 1253374 - protein, 9 aa, Homo Sapiens
CMRHDKIVI

SEQ ID NO: 1253375 - protein, 9 aa, Homo Sapiens
SYALHVHKR

SEQ ID NO: 1253376 - protein, 9 aa, Homo Sapiens
QPLRVGDTE

SEQ ID NO: 1253377 - protein, 9 aa, Homo Sapiens
ATWLSFAST

SEQ ID NO: 1253378 - protein, 9 aa, Homo Sapiens
PWNGGMSML

SEQ ID NO: 1253379 - protein, 9 aa, Homo Sapiens
LKVFMYPAV

SEQ ID NO: 1253380 - protein, 9 aa, Homo Sapiens
RVHHTDHPR

SEQ ID NO: 1253381 - protein, 9 aa, Homo Sapiens
VRLNSTGAT

SEQ ID NO: 1253382 - protein, 9 aa, Homo Sapiens
SCSGQWAHI

SEQ ID NO: 1253383 - protein, 9 aa, Homo Sapiens
ALSPKPAVA

SEQ ID NO: 1253384 - protein, 9 aa, Homo Sapiens
TILRNVLWV

SEQ ID NO: 1253385 - protein, 9 aa, Homo Sapiens
VSPCTRFNQ

SEQ ID NO: 1253386 - protein, 9 aa, Homo Sapiens
LSPLEIIML

SEQ ID NO: 1253387 - protein, 9 aa, Homo Sapiens
VWSLGCAMY

SEQ ID NO: 1253388 - protein, 9 aa, Homo Sapiens
LISELQDCE

SEQ ID NO: 1253389 - protein, 9 aa, Homo Sapiens
WLIQQSKSR

SEQ ID NO: 1253390 - protein, 9 aa, Homo Sapiens
DVEAVTRLT

SEQ ID NO: 1253391 - protein, 9 aa, Homo Sapiens
CPEGVRQQV

SEQ ID NO: 1253392 - protein, 9 aa, Homo Sapiens
HLTVGLLKA

SEQ ID NO: 1253393 - protein, 9 aa, Homo Sapiens
GAETMHTLL

SEQ ID NO: 1253394 - protein, 9 aa, Homo Sapiens
TTCMFSQGS

SEQ ID NO: 1253395 - protein, 9 aa, Homo Sapiens
QPPGVGNTP

SEQ ID NO: 1253396 - protein, 9 aa, Homo Sapiens
LVLMANPIL

SEQ ID NO: 1253397 - protein, 9 aa, Homo Sapiens
LKSMTDIYM

SEQ ID NO: 1253398 - protein, 9 aa, Homo Sapiens
SKSELQVTK

SEQ ID NO: 1253399 - protein, 9 aa, Homo Sapiens
GADVPFGHP

SEQ ID NO: 1253400 - protein, 9 aa, Homo Sapiens
TVFIFWGPI

SEQ ID NO: 1253401 - protein, 9 aa, Homo Sapiens
NRRAKKVAS

SEQ ID NO: 1253402 - protein, 9 aa, Homo Sapiens
FLPEFLVLT

SEQ ID NO: 1253403 - protein, 9 aa, Homo Sapiens
DPQTKDEVA

SEQ ID NO: 1253404 - protein, 9 aa, Homo Sapiens
TYRFGHDVL

SEQ ID NO: 1253405 - protein, 9 aa, Homo Sapiens
DFAATRLFQ

SEQ ID NO: 1253406 - protein, 9 aa, Homo Sapiens
KPIKFYSVP

SEQ ID NO: 1253407 - protein, 9 aa, Homo Sapiens
MQPMMQAHL

SEQ ID NO: 1253408 - protein, 9 aa, Homo Sapiens
TFKALNDTC

SEQ ID NO: 1253409 - protein, 9 aa, Homo Sapiens
SWPDIESFS

SEQ ID NO: 1253410 - protein, 9 aa, Homo Sapiens
ICQGMHQIS

SEQ ID NO: 1253411 - protein, 9 aa, Homo Sapiens
MSGDALGWL

SEQ ID NO: 1253412 - protein, 9 aa, Homo Sapiens
LGLRIIFPL

SEQ ID NO: 1253413 - protein, 9 aa, Homo Sapiens
LCRALHSYA

SEQ ID NO: 1253414 - protein, 9 aa, Homo Sapiens
GVIYYVVFT

SEQ ID NO: 1253415 - protein, 9 aa, Homo Sapiens
VYQIHKQNK

SEQ ID NO: 1253416 - protein, 9 aa, Homo Sapiens
FNPKYGTLL

SEQ ID NO: 1253417 - protein, 9 aa, Homo Sapiens
APRPGRSAA

SEQ ID NO: 1253418 - protein, 9 aa, Homo Sapiens
FRMPGQASL

SEQ ID NO: 1253419 - protein, 9 aa, Homo Sapiens
VAKGAKPEP

SEQ ID NO: 1253420 - protein, 9 aa, Homo Sapiens
MQCHLNGVT

SEQ ID NO: 1253421 - protein, 9 aa, Homo Sapiens
SGFIPLSNF

SEQ ID NO: 1253422 - protein, 9 aa, Homo Sapiens
CTCFSHICV

SEQ ID NO: 1253423 - protein, 9 aa, Homo Sapiens
ASGFCVECV

SEQ ID NO: 1253424 - protein, 9 aa, Homo Sapiens
VKNGEKDTQ

SEQ ID NO: 1253425 - protein, 9 aa, Homo Sapiens
PLAPSPHSL

SEQ ID NO: 1253426 - protein, 9 aa, Homo Sapiens
TRRNLGSIN

SEQ ID NO: 1253427 - protein, 9 aa, Homo Sapiens
LSGTVNSEI

SEQ ID NO: 1253428 - protein, 9 aa, Homo Sapiens
NLSELDHLL

SEQ ID NO: 1253429 - protein, 9 aa, Homo Sapiens
AILFKKILL

SEQ ID NO: 1253430 - protein, 9 aa, Homo Sapiens
GSRAPAKPR

SEQ ID NO: 1253431 - protein, 9 aa, Homo Sapiens
AGEIDPVTS

SEQ ID NO: 1253432 - protein, 9 aa, Homo Sapiens
NVVNVRHDQ

SEQ ID NO: 1253433 - protein, 9 aa, Homo Sapiens
MVTATVTAN

SEQ ID NO: 1253434 - protein, 9 aa, Homo Sapiens
QQPPPRLPL

SEQ ID NO: 1253435 - protein, 9 aa, Homo Sapiens
AFCVGGDIR

SEQ ID NO: 1253436 - protein, 9 aa, Homo Sapiens
PIVPQSPAA

SEQ ID NO: 1253437 - protein, 9 aa, Homo Sapiens
SLPRVTRCY

SEQ ID NO: 1253438 - protein, 9 aa, Homo Sapiens
NPFVQSMIS

SEQ ID NO: 1253439 - protein, 9 aa, Homo Sapiens
GLLTIVVYM

SEQ ID NO: 1253440 - protein, 9 aa, Homo Sapiens
MYLKSLNPQ

SEQ ID NO: 1253441 - protein, 9 aa, Homo Sapiens
LLEAHALEP

SEQ ID NO: 1253442 - protein, 9 aa, Homo Sapiens
ELGLRIGCA

SEQ ID NO: 1253443 - protein, 9 aa, Homo Sapiens
SASVSHGAI

SEQ ID NO: 1253444 - protein, 9 aa, Homo Sapiens
AATLVSAMC

SEQ ID NO: 1253445 - protein, 9 aa, Homo Sapiens
DHSLIKPYQ

SEQ ID NO: 1253446 - protein, 9 aa, Homo Sapiens
CLKDHGSGS

SEQ ID NO: 1253447 - protein, 9 aa, Homo Sapiens
ICVIAAFTV

SEQ ID NO: 1253448 - protein, 9 aa, Homo Sapiens
AVQDLRMAR

SEQ ID NO: 1253449 - protein, 9 aa, Homo Sapiens
ALTQTVAMS

SEQ ID NO: 1253450 - protein, 9 aa, Homo Sapiens
YPGVMHISC

SEQ ID NO: 1253451 - protein, 9 aa, Homo Sapiens
HIDFSLDQP

SEQ ID NO: 1253452 - protein, 9 aa, Homo Sapiens
IMLPSQDDF

SEQ ID NO: 1253453 - protein, 9 aa, Homo Sapiens
LSTGSAEPP

SEQ ID NO: 1253454 - protein, 9 aa, Homo Sapiens
ANPGSDQIQ

SEQ ID NO: 1253455 - protein, 9 aa, Homo Sapiens
KDLAGQDAN

SEQ ID NO: 1253456 - protein, 9 aa, Homo Sapiens
GVRGCHRYL

SEQ ID NO: 1253457 - protein, 9 aa, Homo Sapiens
THVSRRIPA

SEQ ID NO: 1253458 - protein, 9 aa, Homo Sapiens
ALSVYPLNA

SEQ ID NO: 1253459 - protein, 9 aa, Homo Sapiens
SPVFAHVYF

SEQ ID NO: 1253460 - protein, 9 aa, Homo Sapiens
SIGEDTAAL

SEQ ID NO: 1253461 - protein, 9 aa, Homo Sapiens
LRMCPWELK

SEQ ID NO: 1253462 - protein, 9 aa, Homo Sapiens
QPILVECQE

SEQ ID NO: 1253463 - protein, 9 aa, Homo Sapiens
LETRHIHTL

SEQ ID NO: 1253464 - protein, 9 aa, Homo Sapiens
GNTSMWLAG

SEQ ID NO: 1253465 - protein, 9 aa, Homo Sapiens
FKVIPLDHD

SEQ ID NO: 1253466 - protein, 9 aa, Homo Sapiens
LQPLYPPIL

SEQ ID NO: 1253467 - protein, 9 aa, Homo Sapiens
PLFHIYLLA

SEQ ID NO: 1253468 - protein, 9 aa, Homo Sapiens
EDYAVFYEL

SEQ ID NO: 1253469 - protein, 9 aa, Homo Sapiens
QAPRLLSRV

SEQ ID NO: 1253470 - protein, 9 aa, Homo Sapiens
GPGTPRAPS

SEQ ID NO: 1253471 - protein, 9 aa, Homo Sapiens
SVANCLGDQ

SEQ ID NO: 1253472 - protein, 9 aa, Homo Sapiens
ISRTQAEIE

SEQ ID NO: 1253473 - protein, 9 aa, Homo Sapiens
NVRLHFLRT

SEQ ID NO: 1253474 - protein, 9 aa, Homo Sapiens
EVIPLLLEL

SEQ ID NO: 1253475 - protein, 9 aa, Homo Sapiens
QVPVRSSSI

SEQ ID NO: 1253476 - protein, 9 aa, Homo Sapiens
SIMNAIKLQ

SEQ ID NO: 1253477 - protein, 9 aa, Homo Sapiens
KIESYLHSH

SEQ ID NO: 1253478 - protein, 9 aa, Homo Sapiens
FYDQQVLYM

SEQ ID NO: 1253479 - protein, 9 aa, Homo Sapiens
VALVILFII

SEQ ID NO: 1253480 - protein, 9 aa, Homo Sapiens
QQHIQMHMG

SEQ ID NO: 1253481 - protein, 9 aa, Homo Sapiens
KSNKKISVL

SEQ ID NO: 1253482 - protein, 9 aa, Homo Sapiens
GPKLAPWVT

SEQ ID NO: 1253483 - protein, 9 aa, Homo Sapiens
EIKVKRKNL

SEQ ID NO: 1253484 - protein, 9 aa, Homo Sapiens
ASTASSSSP

SEQ ID NO: 1253485 - protein, 9 aa, Homo Sapiens
HLPEECHLS

SEQ ID NO: 1253486 - protein, 9 aa, Homo Sapiens
EEEHIYALR

SEQ ID NO: 1253487 - protein, 9 aa, Homo Sapiens
ATAPGAGDK

SEQ ID NO: 1253488 - protein, 9 aa, Homo Sapiens
HIRQTRSLS

SEQ ID NO: 1253489 - protein, 9 aa, Homo Sapiens
KCSEWMLLF

SEQ ID NO: 1253490 - protein, 9 aa, Homo Sapiens
LDLVDVSSV

SEQ ID NO: 1253491 - protein, 9 aa, Homo Sapiens
YSILIFMTL

SEQ ID NO: 1253492 - protein, 9 aa, Homo Sapiens
TQVSRQWKM

SEQ ID NO: 1253493 - protein, 9 aa, Homo Sapiens
GRTVAALSA

SEQ ID NO: 1253494 - protein, 9 aa, Homo Sapiens
SDCCIKLLS

SEQ ID NO: 1253495 - protein, 9 aa, Homo Sapiens
LQKCPDGHI

SEQ ID NO: 1253496 - protein, 9 aa, Homo Sapiens
VCHLLVMAS

SEQ ID NO: 1253497 - protein, 9 aa, Homo Sapiens
LHKNHYFEV

SEQ ID NO: 1253498 - protein, 9 aa, Homo Sapiens
MCLQDGGSP

SEQ ID NO: 1253499 - protein, 9 aa, Homo Sapiens
YDGKEPQVG

SEQ ID NO: 1253500 - protein, 9 aa, Homo Sapiens
TCPRWISRS

SEQ ID NO: 1253501 - protein, 9 aa, Homo Sapiens
ITSVFMLHI

SEQ ID NO: 1253502 - protein, 9 aa, Homo Sapiens
EVDGSVAFV

SEQ ID NO: 1253503 - protein, 9 aa, Homo Sapiens
QLCSLYYTD

SEQ ID NO: 1253504 - protein, 9 aa, Homo Sapiens
VWRLTDQRI

SEQ ID NO: 1253505 - protein, 9 aa, Homo Sapiens
GHLGTVILG

SEQ ID NO: 1253506 - protein, 9 aa, Homo Sapiens
FFSTCASHL

SEQ ID NO: 1253507 - protein, 9 aa, Homo Sapiens
SYTGYRDSA

SEQ ID NO: 1253508 - protein, 9 aa, Homo Sapiens
LEVTCVVFH

SEQ ID NO: 1253509 - protein, 9 aa, Homo Sapiens
QTIHLFLAK

SEQ ID NO: 1253510 - protein, 9 aa, Homo Sapiens
NSFQENDRL

SEQ ID NO: 1253511 - protein, 9 aa, Homo Sapiens
QKDPVLDTN

SEQ ID NO: 1253512 - protein, 9 aa, Homo Sapiens
AEPQVVVGA

SEQ ID NO: 1253513 - protein, 9 aa, Homo Sapiens
ACGETLQEF

SEQ ID NO: 1253514 - protein, 9 aa, Homo Sapiens
EEEEDDNDI

SEQ ID NO: 1253515 - protein, 9 aa, Homo Sapiens
AATFTYIPL

SEQ ID NO: 1253516 - protein, 9 aa, Homo Sapiens
MEDSYYCRC

SEQ ID NO: 1253517 - protein, 9 aa, Homo Sapiens
KEVQKYPQC

SEQ ID NO: 1253518 - protein, 9 aa, Homo Sapiens
SWESCCRTT

SEQ ID NO: 1253519 - protein, 9 aa, Homo Sapiens
TLAWSVHPL

SEQ ID NO: 1253520 - protein, 9 aa, Homo Sapiens
EVTIFILSG

SEQ ID NO: 1253521 - protein, 9 aa, Homo Sapiens
ATGSLNAGA

SEQ ID NO: 1253522 - protein, 9 aa, Homo Sapiens
LLHTGEWPF

SEQ ID NO: 1253523 - protein, 9 aa, Homo Sapiens
GPGHACMVG

SEQ ID NO: 1253524 - protein, 9 aa, Homo Sapiens
PPEFEAIIW

SEQ ID NO: 1253525 - protein, 9 aa, Homo Sapiens
NAKALKNKR

SEQ ID NO: 1253526 - protein, 9 aa, Homo Sapiens
QMTTSFTDH

SEQ ID NO: 1253527 - protein, 9 aa, Homo Sapiens
MLHTMLRVG

SEQ ID NO: 1253528 - protein, 9 aa, Homo Sapiens
ALLRPGCFD

SEQ ID NO: 1253529 - protein, 9 aa, Homo Sapiens
HLQDVSGTD

SEQ ID NO: 1253530 - protein, 9 aa, Homo Sapiens
LQIEVGPPE

SEQ ID NO: 1253531 - protein, 9 aa, Homo Sapiens
YMPKVGEVI

SEQ ID NO: 1253532 - protein, 9 aa, Homo Sapiens
SRGHRGAHR

SEQ ID NO: 1253533 - protein, 9 aa, Homo Sapiens
ADEKFLRRN

SEQ ID NO: 1253534 - protein, 9 aa, Homo Sapiens
GEKRKQDAE

SEQ ID NO: 1253535 - protein, 9 aa, Homo Sapiens
RMKEREHRE

SEQ ID NO: 1253536 - protein, 9 aa, Homo Sapiens
KVAKLVSYV

SEQ ID NO: 1253537 - protein, 9 aa, Homo Sapiens
DFLMSHPLL

SEQ ID NO: 1253538 - protein, 9 aa, Homo Sapiens
GYGMQELKA

SEQ ID NO: 1253539 - protein, 9 aa, Homo Sapiens
TLLVALKVC

SEQ ID NO: 1253540 - protein, 9 aa, Homo Sapiens
TRIVGCIWW

SEQ ID NO: 1253541 - protein, 9 aa, Homo Sapiens
GAGPHSCIG

SEQ ID NO: 1253542 - protein, 9 aa, Homo Sapiens
SYTDRILYR

SEQ ID NO: 1253543 - protein, 9 aa, Homo Sapiens
IMAEEKKQA

SEQ ID NO: 1253544 - protein, 9 aa, Homo Sapiens
ENSDGPNTA

SEQ ID NO: 1253545 - protein, 9 aa, Homo Sapiens
IQRDLPSEC

SEQ ID NO: 1253546 - protein, 9 aa, Homo Sapiens
TTCSRTAPC

SEQ ID NO: 1253547 - protein, 9 aa, Homo Sapiens
LSYTVSFLL

SEQ ID NO: 1253548 - protein, 9 aa, Homo Sapiens
MAAGQREVR

SEQ ID NO: 1253549 - protein, 9 aa, Homo Sapiens
VVMYVKNRN

SEQ ID NO: 1253550 - protein, 9 aa, Homo Sapiens
AVPAETVGH

SEQ ID NO: 1253551 - protein, 9 aa, Homo Sapiens
RHNLTTKSV

SEQ ID NO: 1253552 - protein, 9 aa, Homo Sapiens
ASSMAVVIP

SEQ ID NO: 1253553 - protein, 9 aa, Homo Sapiens
PVSVASMPS

SEQ ID NO: 1253554 - protein, 9 aa, Homo Sapiens
EEILRISLR

SEQ ID NO: 1253555 - protein, 9 aa, Homo Sapiens
PDLASYIVV

SEQ ID NO: 1253556 - protein, 9 aa, Homo Sapiens
AAGTPHHIS

SEQ ID NO: 1253557 - protein, 9 aa, Homo Sapiens
HSRTHAYTR

SEQ ID NO: 1253558 - protein, 9 aa, Homo Sapiens
ELLCWEDST

SEQ ID NO: 1253559 - protein, 9 aa, Homo Sapiens
ACILPVLMD

SEQ ID NO: 1253560 - protein, 9 aa, Homo Sapiens
IRPVRVKRR

SEQ ID NO: 1253561 - protein, 9 aa, Homo Sapiens
VKNEVLREL

SEQ ID NO: 1253562 - protein, 9 aa, Homo Sapiens
EAAPGRGLR

SEQ ID NO: 1253563 - protein, 9 aa, Homo Sapiens
LGLPLKGGL

SEQ ID NO: 1253564 - protein, 9 aa, Homo Sapiens
HTLPLPEEF

SEQ ID NO: 1253565 - protein, 9 aa, Homo Sapiens
AASADDGIL

SEQ ID NO: 1253566 - protein, 9 aa, Homo Sapiens
SYPFLVLQV

SEQ ID NO: 1253567 - protein, 9 aa, Homo Sapiens
DIRFHYGRF

SEQ ID NO: 1253568 - protein, 9 aa, Homo Sapiens
DQYVQEHIK

SEQ ID NO: 1253569 - protein, 9 aa, Homo Sapiens
VIFISYGSC

SEQ ID NO: 1253570 - protein, 9 aa, Homo Sapiens
HGPLQTDVF

SEQ ID NO: 1253571 - protein, 9 aa, Homo Sapiens
TCLLAMLLD

SEQ ID NO: 1253572 - protein, 9 aa, Homo Sapiens
SCQPLPQPL

SEQ ID NO: 1253573 - protein, 9 aa, Homo Sapiens
GDKKLLHFI

SEQ ID NO: 1253574 - protein, 9 aa, Homo Sapiens
SAAALWTWE

SEQ ID NO: 1253575 - protein, 9 aa, Homo Sapiens
PLTLPQTRC

SEQ ID NO: 1253576 - protein, 9 aa, Homo Sapiens
SDSDRLRRC

SEQ ID NO: 1253577 - protein, 9 aa, Homo Sapiens
LSSLVTQTD

SEQ ID NO: 1253578 - protein, 9 aa, Homo Sapiens
SFIGGLLHD

SEQ ID NO: 1253579 - protein, 9 aa, Homo Sapiens
PTESCEQIV

SEQ ID NO: 1253580 - protein, 9 aa, Homo Sapiens
QPGTRPPRA

SEQ ID NO: 1253581 - protein, 9 aa, Homo Sapiens
PSPEFPFQC

SEQ ID NO: 1253582 - protein, 9 aa, Homo Sapiens
PIQAEQELD

SEQ ID NO: 1253583 - protein, 9 aa, Homo Sapiens
DIRRAQKEV

SEQ ID NO: 1253584 - protein, 9 aa, Homo Sapiens
EMGKEETKQ

SEQ ID NO: 1253585 - protein, 9 aa, Homo Sapiens
WDALDLGLD

SEQ ID NO: 1253586 - protein, 9 aa, Homo Sapiens
GCSGQGAGG

SEQ ID NO: 1253587 - protein, 9 aa, Homo Sapiens
MSGQPNFPC

SEQ ID NO: 1253588 - protein, 9 aa, Homo Sapiens
YSKAERRST

SEQ ID NO: 1253589 - protein, 9 aa, Homo Sapiens
SNLQFAGMN

SEQ ID NO: 1253590 - protein, 9 aa, Homo Sapiens
GGIGHQKCK

SEQ ID NO: 1253591 - protein, 9 aa, Homo Sapiens
VGHMELRDN

SEQ ID NO: 1253592 - protein, 9 aa, Homo Sapiens
NKGKISECS

SEQ ID NO: 1253593 - protein, 9 aa, Homo Sapiens
AANVYGIPD

SEQ ID NO: 1253594 - protein, 9 aa, Homo Sapiens
WNEDFLPGA

SEQ ID NO: 1253595 - protein, 9 aa, Homo Sapiens
IKKHMAMCH

SEQ ID NO: 1253596 - protein, 9 aa, Homo Sapiens
EVRRIVDAL

SEQ ID NO: 1253597 - protein, 9 aa, Homo Sapiens
LTPPTSSRT

SEQ ID NO: 1253598 - protein, 9 aa, Homo Sapiens
ELQITDIIK

SEQ ID NO: 1253599 - protein, 9 aa, Homo Sapiens
KYDSDHTEL

SEQ ID NO: 1253600 - protein, 9 aa, Homo Sapiens
RLHLLPQRP

SEQ ID NO: 1253601 - protein, 9 aa, Homo Sapiens
PLAFRGTPG

SEQ ID NO: 1253602 - protein, 9 aa, Homo Sapiens
RDEEVHTGL

SEQ ID NO: 1253603 - protein, 9 aa, Homo Sapiens
IVGPGYDAL

SEQ ID NO: 1253604 - protein, 9 aa, Homo Sapiens
HFRQLLRGA

SEQ ID NO: 1253605 - protein, 9 aa, Homo Sapiens
VDSFHMVSL

SEQ ID NO: 1253606 - protein, 9 aa, Homo Sapiens
DACGQPVHW

SEQ ID NO: 1253607 - protein, 9 aa, Homo Sapiens
ALMVNGVMI

SEQ ID NO: 1253608 - protein, 9 aa, Homo Sapiens
DANDLYDAG

SEQ ID NO: 1253609 - protein, 9 aa, Homo Sapiens
NETELTEEL

SEQ ID NO: 1253610 - protein, 9 aa, Homo Sapiens
VGIMAVTLA

SEQ ID NO: 1253611 - protein, 9 aa, Homo Sapiens
HPALHQCLS

SEQ ID NO: 1253612 - protein, 9 aa, Homo Sapiens
PWPLNHSLA

SEQ ID NO: 1253613 - protein, 9 aa, Homo Sapiens
FPLASLALI

SEQ ID NO: 1253614 - protein, 9 aa, Homo Sapiens
EDGCVTDHF

SEQ ID NO: 1253615 - protein, 9 aa, Homo Sapiens
LLLFCMIFN

SEQ ID NO: 1253616 - protein, 9 aa, Homo Sapiens
ETVYDDRGQ

SEQ ID NO: 1253617 - protein, 9 aa, Homo Sapiens
NRLETGEDG

SEQ ID NO: 1253618 - protein, 9 aa, Homo Sapiens
PQVPKGLEN

SEQ ID NO: 1253619 - protein, 9 aa, Homo Sapiens
LYCVPMSTN

SEQ ID NO: 1253620 - protein, 9 aa, Homo Sapiens
REPWSEDRD

SEQ ID NO: 1253621 - protein, 9 aa, Homo Sapiens
AHADPSFIT

SEQ ID NO: 1253622 - protein, 9 aa, Homo Sapiens
KLELESKQQ

SEQ ID NO: 1253623 - protein, 9 aa, Homo Sapiens
YIILHIRSS

SEQ ID NO: 1253624 - protein, 9 aa, Homo Sapiens
LIRTGAWGP

SEQ ID NO: 1253625 - protein, 9 aa, Homo Sapiens
ANYHTLYRY

SEQ ID NO: 1253626 - protein, 9 aa, Homo Sapiens
GSFDVMSPS

SEQ ID NO: 1253627 - protein, 9 aa, Homo Sapiens
EGADAETSG

SEQ ID NO: 1253628 - protein, 9 aa, Homo Sapiens
CLVLSELLA

SEQ ID NO: 1253629 - protein, 9 aa, Homo Sapiens
GQSLAVNFC

SEQ ID NO: 1253630 - protein, 9 aa, Homo Sapiens
PELLKRNPR

SEQ ID NO: 1253631 - protein, 9 aa, Homo Sapiens
SMGPGTVPG

SEQ ID NO: 1253632 - protein, 9 aa, Homo Sapiens
AQAVAHICR

SEQ ID NO: 1253633 - protein, 9 aa, Homo Sapiens
AYLFAHVVD

SEQ ID NO: 1253634 - protein, 9 aa, Homo Sapiens
GPSRWPYWA

SEQ ID NO: 1253635 - protein, 9 aa, Homo Sapiens
LSIGKDIIQ

SEQ ID NO: 1253636 - protein, 9 aa, Homo Sapiens
YEYTEMGER

SEQ ID NO: 1253637 - protein, 9 aa, Homo Sapiens
LPLTNVRIA

SEQ ID NO: 1253638 - protein, 9 aa, Homo Sapiens
IEIEKGETV

SEQ ID NO: 1253639 - protein, 9 aa, Homo Sapiens
NHLRIHSIR

SEQ ID NO: 1253640 - protein, 9 aa, Homo Sapiens
ENTENKFQP

SEQ ID NO: 1253641 - protein, 9 aa, Homo Sapiens
SQRPQQASV

SEQ ID NO: 1253642 - protein, 9 aa, Homo Sapiens
GAQEEHVYI

SEQ ID NO: 1253643 - protein, 9 aa, Homo Sapiens
PEDPAPGKV

SEQ ID NO: 1253644 - protein, 9 aa, Homo Sapiens
SIAAVVLQN

SEQ ID NO: 1253645 - protein, 9 aa, Homo Sapiens
PMAKPESRM

SEQ ID NO: 1253646 - protein, 9 aa, Homo Sapiens
TNINVFSEL

SEQ ID NO: 1253647 - protein, 9 aa, Homo Sapiens
YAGRFKDMP

SEQ ID NO: 1253648 - protein, 9 aa, Homo Sapiens
PAGQSNLKS

SEQ ID NO: 1253649 - protein, 9 aa, Homo Sapiens
NPGVRYTGT

SEQ ID NO: 1253650 - protein, 9 aa, Homo Sapiens
NRTYRAMQQ

SEQ ID NO: 1253651 - protein, 9 aa, Homo Sapiens
TVNMASRME

SEQ ID NO: 1253652 - protein, 9 aa, Homo Sapiens
GGATSRGVA

SEQ ID NO: 1253653 - protein, 9 aa, Homo Sapiens
IDQDNRNTS

SEQ ID NO: 1253654 - protein, 9 aa, Homo Sapiens
GLNNSTDVQ

SEQ ID NO: 1253655 - protein, 9 aa, Homo Sapiens
TTSVITSTS

SEQ ID NO: 1253656 - protein, 9 aa, Homo Sapiens
TSPGSHFNG

SEQ ID NO: 1253657 - protein, 9 aa, Homo Sapiens
STGGQGPHH

SEQ ID NO: 1253658 - protein, 9 aa, Homo Sapiens
VSGSPFSYP

SEQ ID NO: 1253659 - protein, 9 aa, Homo Sapiens
YSLGLDTKN

SEQ ID NO: 1253660 - protein, 9 aa, Homo Sapiens
VITLPQWKA

SEQ ID NO: 1253661 - protein, 9 aa, Homo Sapiens
AAHLGYFPS

SEQ ID NO: 1253662 - protein, 9 aa, Homo Sapiens
HEQKGRCKQ

SEQ ID NO: 1253663 - protein, 9 aa, Homo Sapiens
CSTEAYMLP

SEQ ID NO: 1253664 - protein, 9 aa, Homo Sapiens
KRILEDQDE

SEQ ID NO: 1253665 - protein, 9 aa, Homo Sapiens
NLWPDMTLV

SEQ ID NO: 1253666 - protein, 9 aa, Homo Sapiens
LVSTNLTSS

SEQ ID NO: 1253667 - protein, 9 aa, Homo Sapiens
DNAFLLEAQ

SEQ ID NO: 1253668 - protein, 9 aa, Homo Sapiens
MVGMYYGAA

SEQ ID NO: 1253669 - protein, 9 aa, Homo Sapiens
SVYLDANIA

SEQ ID NO: 1253670 - protein, 9 aa, Homo Sapiens
SNGMSRRAG

SEQ ID NO: 1253671 - protein, 9 aa, Homo Sapiens
HLDAGLSVL

SEQ ID NO: 1253672 - protein, 9 aa, Homo Sapiens
YRLSGEAYG

SEQ ID NO: 1253673 - protein, 9 aa, Homo Sapiens
GNTTLSINT

SEQ ID NO: 1253674 - protein, 9 aa, Homo Sapiens
PTILQESKS

SEQ ID NO: 1253675 - protein, 9 aa, Homo Sapiens
LEAEQQLAT

SEQ ID NO: 1253676 - protein, 9 aa, Homo Sapiens
SRDPKCYVQ

SEQ ID NO: 1253677 - protein, 9 aa, Homo Sapiens
HYDTDQDGW

SEQ ID NO: 1253678 - protein, 9 aa, Homo Sapiens
LVRNPGGWR

SEQ ID NO: 1253679 - protein, 9 aa, Homo Sapiens
TTFLKVRLV

SEQ ID NO: 1253680 - protein, 9 aa, Homo Sapiens
TQAYTLTYT

SEQ ID NO: 1253681 - protein, 9 aa, Homo Sapiens
HLCLEYLPP

SEQ ID NO: 1253682 - protein, 9 aa, Homo Sapiens
QHVRKNKMA

SEQ ID NO: 1253683 - protein, 9 aa, Homo Sapiens
TILHSTAEQ

SEQ ID NO: 1253684 - protein, 9 aa, Homo Sapiens
EKMAAHMWM

SEQ ID NO: 1253685 - protein, 9 aa, Homo Sapiens
AYTGRIAQE

SEQ ID NO: 1253686 - protein, 9 aa, Homo Sapiens
VQMFSEVRN

SEQ ID NO: 1253687 - protein, 9 aa, Homo Sapiens
KCLSRKNED

SEQ ID NO: 1253688 - protein, 9 aa, Homo Sapiens
ETRVQVWFS

SEQ ID NO: 1253689 - protein, 9 aa, Homo Sapiens
SLEKYKCKV

SEQ ID NO: 1253690 - protein, 9 aa, Homo Sapiens
TPSPDSVSW

SEQ ID NO: 1253691 - protein, 9 aa, Homo Sapiens
WLTMTASEK

SEQ ID NO: 1253692 - protein, 9 aa, Homo Sapiens
KVRFLVQQN

SEQ ID NO: 1253693 - protein, 9 aa, Homo Sapiens
EHPRKRGRR

SEQ ID NO: 1253694 - protein, 9 aa, Homo Sapiens
KVMFHVILS

SEQ ID NO: 1253695 - protein, 9 aa, Homo Sapiens
SVKWHQRQN

SEQ ID NO: 1253696 - protein, 9 aa, Homo Sapiens
AHTHHYLCL

SEQ ID NO: 1253697 - protein, 9 aa, Homo Sapiens
ISKKKTKVA

SEQ ID NO: 1253698 - protein, 9 aa, Homo Sapiens
EVSRILTSK

SEQ ID NO: 1253699 - protein, 9 aa, Homo Sapiens
GVRDPTDVS

SEQ ID NO: 1253700 - protein, 9 aa, Homo Sapiens
QCINTDELC

SEQ ID NO: 1253701 - protein, 9 aa, Homo Sapiens
RVVLGTSAF

SEQ ID NO: 1253702 - protein, 9 aa, Homo Sapiens
TSKAQDVQQ

SEQ ID NO: 1253703 - protein, 9 aa, Homo Sapiens
LVRVSLTAS

SEQ ID NO: 1253704 - protein, 9 aa, Homo Sapiens
SDGLRLIAM

SEQ ID NO: 1253705 - protein, 9 aa, Homo Sapiens
APGFSFSKE

SEQ ID NO: 1253706 - protein, 9 aa, Homo Sapiens
GITCTTVAN

SEQ ID NO: 1253707 - protein, 9 aa, Homo Sapiens
SPTPSSGAQ

SEQ ID NO: 1253708 - protein, 9 aa, Homo Sapiens
TRFLVMASD

SEQ ID NO: 1253709 - protein, 9 aa, Homo Sapiens
PSVVVLQCG

SEQ ID NO: 1253710 - protein, 9 aa, Homo Sapiens
KGSGFRWKK

SEQ ID NO: 1253711 - protein, 9 aa, Homo Sapiens
HLVKSHTNI

SEQ ID NO: 1253712 - protein, 9 aa, Homo Sapiens
AKGGSNVGE

SEQ ID NO: 1253713 - protein, 9 aa, Homo Sapiens
YNQALMNMD

SEQ ID NO: 1253714 - protein, 9 aa, Homo Sapiens
MVFDGKHQH

SEQ ID NO: 1253715 - protein, 9 aa, Homo Sapiens
LYARDGLCT

SEQ ID NO: 1253716 - protein, 9 aa, Homo Sapiens
APLQLMIMQ

SEQ ID NO: 1253717 - protein, 9 aa, Homo Sapiens
EDRCVSSLS

SEQ ID NO: 1253718 - protein, 9 aa, Homo Sapiens
VGADRSYGR

SEQ ID NO: 1253719 - protein, 9 aa, Homo Sapiens
EGEKSTYSV

SEQ ID NO: 1253720 - protein, 9 aa, Homo Sapiens
QVIDINDHY

SEQ ID NO: 1253721 - protein, 9 aa, Homo Sapiens
FSYTSQHPD

SEQ ID NO: 1253722 - protein, 9 aa, Homo Sapiens
LDRHMQLHM

SEQ ID NO: 1253723 - protein, 9 aa, Homo Sapiens
KAMKCLRVP

SEQ ID NO: 1253724 - protein, 9 aa, Homo Sapiens
WVALPCSPG

SEQ ID NO: 1253725 - protein, 9 aa, Homo Sapiens
DQNSYFYRS

SEQ ID NO: 1253726 - protein, 9 aa, Homo Sapiens
RHKKALEEC

SEQ ID NO: 1253727 - protein, 9 aa, Homo Sapiens
ARAKGWAWI

SEQ ID NO: 1253728 - protein, 9 aa, Homo Sapiens
SGSGKFTVG

SEQ ID NO: 1253729 - protein, 9 aa, Homo Sapiens
DVSLSALRV

SEQ ID NO: 1253730 - protein, 9 aa, Homo Sapiens
HYEMASNPL

SEQ ID NO: 1253731 - protein, 9 aa, Homo Sapiens
GITEEPSTS

SEQ ID NO: 1253732 - protein, 9 aa, Homo Sapiens
HQCFFLSDN

SEQ ID NO: 1253733 - protein, 9 aa, Homo Sapiens
FKPFEDRVG

SEQ ID NO: 1253734 - protein, 9 aa, Homo Sapiens
GALPNLREM

SEQ ID NO: 1253735 - protein, 9 aa, Homo Sapiens
PELTNAQLH

SEQ ID NO: 1253736 - protein, 9 aa, Homo Sapiens
SFYQFVHGQ

SEQ ID NO: 1253737 - protein, 9 aa, Homo Sapiens
TACVVHLLN

SEQ ID NO: 1253738 - protein, 9 aa, Homo Sapiens
PDILNTIKR

SEQ ID NO: 1253739 - protein, 9 aa, Homo Sapiens
QSDMDECSA

SEQ ID NO: 1253740 - protein, 9 aa, Homo Sapiens
VWDANVPKE

SEQ ID NO: 1253741 - protein, 9 aa, Homo Sapiens
QGGHMNSGG

SEQ ID NO: 1253742 - protein, 9 aa, Homo Sapiens
SSSPTPSSG

SEQ ID NO: 1253743 - protein, 9 aa, Homo Sapiens
QGIRLSTSL

SEQ ID NO: 1253744 - protein, 9 aa, Homo Sapiens
PPHSPGMEP

SEQ ID NO: 1253745 - protein, 9 aa, Homo Sapiens
EPAPGLAAL

SEQ ID NO: 1253746 - protein, 9 aa, Homo Sapiens
IDSRALGFQ

SEQ ID NO: 1253747 - protein, 9 aa, Homo Sapiens
RSYVLRSTW

SEQ ID NO: 1253748 - protein, 9 aa, Homo Sapiens
TFVKNVEYV

SEQ ID NO: 1253749 - protein, 9 aa, Homo Sapiens
RGEHQERQN

SEQ ID NO: 1253750 - protein, 9 aa, Homo Sapiens
NPHLIFDVR

SEQ ID NO: 1253751 - protein, 9 aa, Homo Sapiens
ASQSMRITT

SEQ ID NO: 1253752 - protein, 9 aa, Homo Sapiens
VETGGIQTV

SEQ ID NO: 1253753 - protein, 9 aa, Homo Sapiens
AKHGEVLVN

SEQ ID NO: 1253754 - protein, 9 aa, Homo Sapiens
RGPWRGPWM

SEQ ID NO: 1253755 - protein, 9 aa, Homo Sapiens
PETQHRGRG

SEQ ID NO: 1253756 - protein, 9 aa, Homo Sapiens
GVLAIINHV

SEQ ID NO: 1253757 - protein, 9 aa, Homo Sapiens
RNPASPNEF

SEQ ID NO: 1253758 - protein, 9 aa, Homo Sapiens
PPPALSPAA

SEQ ID NO: 1253759 - protein, 9 aa, Homo Sapiens
IFHKISDVK

SEQ ID NO: 1253760 - protein, 9 aa, Homo Sapiens
NRPTILTYH

SEQ ID NO: 1253761 - protein, 9 aa, Homo Sapiens
SENHALRLL

SEQ ID NO: 1253762 - protein, 9 aa, Homo Sapiens
TEIVRSGHL

SEQ ID NO: 1253763 - protein, 9 aa, Homo Sapiens
LKFRFDASD

SEQ ID NO: 1253764 - protein, 9 aa, Homo Sapiens
AYIMSVQAE

SEQ ID NO: 1253765 - protein, 9 aa, Homo Sapiens
DALHKVSQM

SEQ ID NO: 1253766 - protein, 9 aa, Homo Sapiens
HSLETRHIH

SEQ ID NO: 1253767 - protein, 9 aa, Homo Sapiens
DYLKRYLSG

SEQ ID NO: 1253768 - protein, 9 aa, Homo Sapiens
CALQSPTSQ

SEQ ID NO: 1253769 - protein, 9 aa, Homo Sapiens
HNTGYCVCI

SEQ ID NO: 1253770 - protein, 9 aa, Homo Sapiens
VNGEQLYLD

SEQ ID NO: 1253771 - protein, 9 aa, Homo Sapiens
VKSQTIEQN

SEQ ID NO: 1253772 - protein, 9 aa, Homo Sapiens
VRVSLTASR

SEQ ID NO: 1253773 - protein, 9 aa, Homo Sapiens
LEKLVEEHT

SEQ ID NO: 1253774 - protein, 9 aa, Homo Sapiens
LTTDAILWQ

SEQ ID NO: 1253775 - protein, 9 aa, Homo Sapiens
PSDPYDHED

SEQ ID NO: 1253776 - protein, 9 aa, Homo Sapiens
ILLCNPFHH

SEQ ID NO: 1253777 - protein, 9 aa, Homo Sapiens
ISELLSAHK

SEQ ID NO: 1253778 - protein, 9 aa, Homo Sapiens
HQKKQDLTL

SEQ ID NO: 1253779 - protein, 9 aa, Homo Sapiens
FLKCNATSL

SEQ ID NO: 1253780 - protein, 9 aa, Homo Sapiens
GPILNFLWH

SEQ ID NO: 1253781 - protein, 9 aa, Homo Sapiens
MIGLGLLYL

SEQ ID NO: 1253782 - protein, 9 aa, Homo Sapiens
SGADVPFGH

SEQ ID NO: 1253783 - protein, 9 aa, Homo Sapiens
DEVDINTLQ

SEQ ID NO: 1253784 - protein, 9 aa, Homo Sapiens
PILNHLAKI

SEQ ID NO: 1253785 - protein, 9 aa, Homo Sapiens
CSLESHLNS

SEQ ID NO: 1253786 - protein, 9 aa, Homo Sapiens
SDTMKRLPR

SEQ ID NO: 1253787 - protein, 9 aa, Homo Sapiens
LLALGWVFI

SEQ ID NO: 1253788 - protein, 9 aa, Homo Sapiens
LGTKKYILN

SEQ ID NO: 1253789 - protein, 9 aa, Homo Sapiens
MALSGPVRL

SEQ ID NO: 1253790 - protein, 9 aa, Homo Sapiens
QHQPRSDTS

SEQ ID NO: 1253791 - protein, 9 aa, Homo Sapiens
QSHTGSYQC

SEQ ID NO: 1253792 - protein, 9 aa, Homo Sapiens
PNLEWLKKL

SEQ ID NO: 1253793 - protein, 9 aa, Homo Sapiens
IVVLKDAEG

SEQ ID NO: 1253794 - protein, 9 aa, Homo Sapiens
DNYGYDECA

SEQ ID NO: 1253795 - protein, 9 aa, Homo Sapiens
ALHRAKRRN

SEQ ID NO: 1253796 - protein, 9 aa, Homo Sapiens
VTTLSDDDT

SEQ ID NO: 1253797 - protein, 9 aa, Homo Sapiens
VKVTYHVTS

SEQ ID NO: 1253798 - protein, 9 aa, Homo Sapiens
ACSVGSVPG

SEQ ID NO: 1253799 - protein, 9 aa, Homo Sapiens
TAASVSTDL

SEQ ID NO: 1253800 - protein, 9 aa, Homo Sapiens
QETLKYTLE

SEQ ID NO: 1253801 - protein, 9 aa, Homo Sapiens
QTINSKMFE

SEQ ID NO: 1253802 - protein, 9 aa, Homo Sapiens
TEDELDEQG

SEQ ID NO: 1253803 - protein, 9 aa, Homo Sapiens
VCQDIPASH

SEQ ID NO: 1253804 - protein, 9 aa, Homo Sapiens
ATSVSVRTP

SEQ ID NO: 1253805 - protein, 9 aa, Homo Sapiens
RNVFQCEAH

SEQ ID NO: 1253806 - protein, 9 aa, Homo Sapiens
VSLHFLKRE

SEQ ID NO: 1253807 - protein, 9 aa, Homo Sapiens
RLSNHISSM

SEQ ID NO: 1253808 - protein, 9 aa, Homo Sapiens
SPQSSGTGW

SEQ ID NO: 1253809 - protein, 9 aa, Homo Sapiens
SGPPMQSAA

SEQ ID NO: 1253810 - protein, 9 aa, Homo Sapiens
GKREPLLSF

SEQ ID NO: 1253811 - protein, 9 aa, Homo Sapiens
VLTTLELSN

SEQ ID NO: 1253812 - protein, 9 aa, Homo Sapiens
IKQEVITPD

SEQ ID NO: 1253813 - protein, 9 aa, Homo Sapiens
LDVFLRRYT

SEQ ID NO: 1253814 - protein, 9 aa, Homo Sapiens
NEEMLSLKV

SEQ ID NO: 1253815 - protein, 9 aa, Homo Sapiens
AGHKSHEYH

SEQ ID NO: 1253816 - protein, 9 aa, Homo Sapiens
VAFHVGLHS

SEQ ID NO: 1253817 - protein, 9 aa, Homo Sapiens
MLGGVTEVH

SEQ ID NO: 1253818 - protein, 9 aa, Homo Sapiens
EGFLIWKGP

SEQ ID NO: 1253819 - protein, 9 aa, Homo Sapiens
APSGPHYPP

SEQ ID NO: 1253820 - protein, 9 aa, Homo Sapiens
RRISEGEAR

SEQ ID NO: 1253821 - protein, 9 aa, Homo Sapiens
KDIYHYITS

SEQ ID NO: 1253822 - protein, 9 aa, Homo Sapiens
ITAVLTKLR

SEQ ID NO: 1253823 - protein, 9 aa, Homo Sapiens
LVAAANCQV

SEQ ID NO: 1253824 - protein, 9 aa, Homo Sapiens
WDQDADARL

SEQ ID NO: 1253825 - protein, 9 aa, Homo Sapiens
GQVGIRARL

SEQ ID NO: 1253826 - protein, 9 aa, Homo Sapiens
IWQDLICRM

SEQ ID NO: 1253827 - protein, 9 aa, Homo Sapiens
PAELFLIAI

SEQ ID NO: 1253828 - protein, 9 aa, Homo Sapiens
WIDFVGHDA

SEQ ID NO: 1253829 - protein, 9 aa, Homo Sapiens
LQTNWTTPS

SEQ ID NO: 1253830 - protein, 9 aa, Homo Sapiens
ELICVTRAG

SEQ ID NO: 1253831 - protein, 9 aa, Homo Sapiens
SRQWKMKAE

SEQ ID NO: 1253832 - protein, 9 aa, Homo Sapiens
LDFWVQALI

SEQ ID NO: 1253833 - protein, 9 aa, Homo Sapiens
RGWKLFYNC

SEQ ID NO: 1253834 - protein, 9 aa, Homo Sapiens
LCLYCNPLA

SEQ ID NO: 1253835 - protein, 9 aa, Homo Sapiens
KNRHWHWSS

SEQ ID NO: 1253836 - protein, 9 aa, Homo Sapiens
AKREREAAA

SEQ ID NO: 1253837 - protein, 9 aa, Homo Sapiens
AKTFSEACL

SEQ ID NO: 1253838 - protein, 9 aa, Homo Sapiens
PLDPNGTLF

SEQ ID NO: 1253839 - protein, 9 aa, Homo Sapiens
SPQVLNYSA

SEQ ID NO: 1253840 - protein, 9 aa, Homo Sapiens
SLRKEHVFN

SEQ ID NO: 1253841 - protein, 9 aa, Homo Sapiens
GRKEYEEEL

SEQ ID NO: 1253842 - protein, 9 aa, Homo Sapiens
CQASSNGCA

SEQ ID NO: 1253843 - protein, 9 aa, Homo Sapiens
HMIMFLDEL

SEQ ID NO: 1253844 - protein, 9 aa, Homo Sapiens
ASQGRRPRT

SEQ ID NO: 1253845 - protein, 9 aa, Homo Sapiens
ILEDLETLM

SEQ ID NO: 1253846 - protein, 9 aa, Homo Sapiens
AALDTRFLV

SEQ ID NO: 1253847 - protein, 9 aa, Homo Sapiens
FPHGSGAGP

SEQ ID NO: 1253848 - protein, 9 aa, Homo Sapiens
AQQENEGVE

SEQ ID NO: 1253849 - protein, 9 aa, Homo Sapiens
KMSTYLVDF

SEQ ID NO: 1253850 - protein, 9 aa, Homo Sapiens
SQAHASALC

SEQ ID NO: 1253851 - protein, 9 aa, Homo Sapiens
RAQCVVLEA

SEQ ID NO: 1253852 - protein, 9 aa, Homo Sapiens
PLLKFNFNT

SEQ ID NO: 1253853 - protein, 9 aa, Homo Sapiens
PTFAALTSI

SEQ ID NO: 1253854 - protein, 9 aa, Homo Sapiens
VCATVAQFN

SEQ ID NO: 1253855 - protein, 9 aa, Homo Sapiens
GVNADARGE

SEQ ID NO: 1253856 - protein, 9 aa, Homo Sapiens
SWLTSTRPL

SEQ ID NO: 1253857 - protein, 9 aa, Homo Sapiens
SQMAVPCPP

SEQ ID NO: 1253858 - protein, 9 aa, Homo Sapiens
DAKVPFKMS

SEQ ID NO: 1253859 - protein, 9 aa, Homo Sapiens
AESRDHNQT

SEQ ID NO: 1253860 - protein, 9 aa, Homo Sapiens
TQNIKDAKD

SEQ ID NO: 1253861 - protein, 9 aa, Homo Sapiens
LPTKRHYCC

SEQ ID NO: 1253862 - protein, 9 aa, Homo Sapiens
SANLLKGLC

SEQ ID NO: 1253863 - protein, 9 aa, Homo Sapiens
NGAENEMLT

SEQ ID NO: 1253864 - protein, 9 aa, Homo Sapiens
QNEGHGGAQ

SEQ ID NO: 1253865 - protein, 9 aa, Homo Sapiens
PNQLCIRHW

SEQ ID NO: 1253866 - protein, 9 aa, Homo Sapiens
TIIEKHPAE

SEQ ID NO: 1253867 - protein, 9 aa, Homo Sapiens
KWVLRKALE

SEQ ID NO: 1253868 - protein, 9 aa, Homo Sapiens
LPGISGQDG

SEQ ID NO: 1253869 - protein, 9 aa, Homo Sapiens
GPPGVDLYH

SEQ ID NO: 1253870 - protein, 9 aa, Homo Sapiens
YWRRGTFEK

SEQ ID NO: 1253871 - protein, 9 aa, Homo Sapiens
EVLAKYSMD

SEQ ID NO: 1253872 - protein, 9 aa, Homo Sapiens
YGMHMILSL

SEQ ID NO: 1253873 - protein, 9 aa, Homo Sapiens
KWQLDKKLD

SEQ ID NO: 1253874 - protein, 9 aa, Homo Sapiens
WYPFHDIEP

SEQ ID NO: 1253875 - protein, 9 aa, Homo Sapiens
ISLNKVILY

SEQ ID NO: 1253876 - protein, 9 aa, Homo Sapiens
YLVGPGGLF

SEQ ID NO: 1253877 - protein, 9 aa, Homo Sapiens
MHHWRNSAL

SEQ ID NO: 1253878 - protein, 9 aa, Homo Sapiens
KGPGDPWSV

SEQ ID NO: 1253879 - protein, 9 aa, Homo Sapiens
SQQENTINQ

SEQ ID NO: 1253880 - protein, 9 aa, Homo Sapiens
EDGTVFDGH

SEQ ID NO: 1253881 - protein, 9 aa, Homo Sapiens
NVTQALGRA

SEQ ID NO: 1253882 - protein, 9 aa, Homo Sapiens
ERNNVITLS

SEQ ID NO: 1253883 - protein, 9 aa, Homo Sapiens
ATKSGTPFL

SEQ ID NO: 1253884 - protein, 9 aa, Homo Sapiens
ETPWDTLKY

SEQ ID NO: 1253885 - protein, 9 aa, Homo Sapiens
NGIVLDHLK

SEQ ID NO: 1253886 - protein, 9 aa, Homo Sapiens
IHSRTHAYT

SEQ ID NO: 1253887 - protein, 9 aa, Homo Sapiens
HTHTHRHTG

SEQ ID NO: 1253888 - protein, 9 aa, Homo Sapiens
IREVHVTKL

SEQ ID NO: 1253889 - protein, 9 aa, Homo Sapiens
LTVLQVQKK

SEQ ID NO: 1253890 - protein, 9 aa, Homo Sapiens
TPLHNFLEG

SEQ ID NO: 1253891 - protein, 9 aa, Homo Sapiens
STFQLGCDA

SEQ ID NO: 1253892 - protein, 9 aa, Homo Sapiens
LHNLGLGKK

SEQ ID NO: 1253893 - protein, 9 aa, Homo Sapiens
RMMQAFVTA

SEQ ID NO: 1253894 - protein, 9 aa, Homo Sapiens
TFGHMKMVL

SEQ ID NO: 1253895 - protein, 9 aa, Homo Sapiens
KCPNCSLLY

SEQ ID NO: 1253896 - protein, 9 aa, Homo Sapiens
SRTHITLGC

SEQ ID NO: 1253897 - protein, 9 aa, Homo Sapiens
IHFHEIVTK

SEQ ID NO: 1253898 - protein, 9 aa, Homo Sapiens
FRAIALLQQ

SEQ ID NO: 1253899 - protein, 9 aa, Homo Sapiens
RWPWHEVEA

SEQ ID NO: 1253900 - protein, 9 aa, Homo Sapiens
MTKTPSDHL

SEQ ID NO: 1253901 - protein, 9 aa, Homo Sapiens
LSRRLLRDI

SEQ ID NO: 1253902 - protein, 9 aa, Homo Sapiens
FKTVIKKRD

SEQ ID NO: 1253903 - protein, 9 aa, Homo Sapiens
DLDELMKND

SEQ ID NO: 1253904 - protein, 9 aa, Homo Sapiens
EDTLLTLMP

SEQ ID NO: 1253905 - protein, 9 aa, Homo Sapiens
WNGGMSMLD

SEQ ID NO: 1253906 - protein, 9 aa, Homo Sapiens
LTESYNSHW

SEQ ID NO: 1253907 - protein, 9 aa, Homo Sapiens
DGFKKISSL

SEQ ID NO: 1253908 - protein, 9 aa, Homo Sapiens
IPYLKTFLY

SEQ ID NO: 1253909 - protein, 9 aa, Homo Sapiens
ADRDSMRCG

SEQ ID NO: 1253910 - protein, 9 aa, Homo Sapiens
AGGSTGLVE

SEQ ID NO: 1253911 - protein, 9 aa, Homo Sapiens
VNAVFEWYI

SEQ ID NO: 1253912 - protein, 9 aa, Homo Sapiens
TKFLASFST

SEQ ID NO: 1253913 - protein, 9 aa, Homo Sapiens
QQGQAGMAP

SEQ ID NO: 1253914 - protein, 9 aa, Homo Sapiens
ERLHHPEIA

SEQ ID NO: 1253915 - protein, 9 aa, Homo Sapiens
IRPSHIHHR

SEQ ID NO: 1253916 - protein, 9 aa, Homo Sapiens
EGNISGCKH

SEQ ID NO: 1253917 - protein, 9 aa, Homo Sapiens
IHTLLWDLA

SEQ ID NO: 1253918 - protein, 9 aa, Homo Sapiens
FLTDPKLTM

SEQ ID NO: 1253919 - protein, 9 aa, Homo Sapiens
SKNALFETL

SEQ ID NO: 1253920 - protein, 9 aa, Homo Sapiens
ESDEVAWLK

SEQ ID NO: 1253921 - protein, 9 aa, Homo Sapiens
LSQSKEGSL

SEQ ID NO: 1253922 - protein, 9 aa, Homo Sapiens
HPDVTGQLL

SEQ ID NO: 1253923 - protein, 9 aa, Homo Sapiens
LAKCYEEKT

SEQ ID NO: 1253924 - protein, 9 aa, Homo Sapiens
VMQPVEEQA

SEQ ID NO: 1253925 - protein, 9 aa, Homo Sapiens
PGGRPGSGR

SEQ ID NO: 1253926 - protein, 9 aa, Homo Sapiens
SGKFTVGAL

SEQ ID NO: 1253927 - protein, 9 aa, Homo Sapiens
QKRELDIQI

SEQ ID NO: 1253928 - protein, 9 aa, Homo Sapiens
EEHTQAYLE

SEQ ID NO: 1253929 - protein, 9 aa, Homo Sapiens
TVNGEQLYL

SEQ ID NO: 1253930 - protein, 9 aa, Homo Sapiens
ENSMIGQKI

SEQ ID NO: 1253931 - protein, 9 aa, Homo Sapiens
ILLTGLHSV

SEQ ID NO: 1253932 - protein, 9 aa, Homo Sapiens
LLSIPWTQI

SEQ ID NO: 1253933 - protein, 9 aa, Homo Sapiens
TSMSEITTN

SEQ ID NO: 1253934 - protein, 9 aa, Homo Sapiens
SYFLLPTSD

SEQ ID NO: 1253935 - protein, 9 aa, Homo Sapiens
KAEKKLLVS

SEQ ID NO: 1253936 - protein, 9 aa, Homo Sapiens
EHTIITDME

SEQ ID NO: 1253937 - protein, 9 aa, Homo Sapiens
SILSTFLDP

SEQ ID NO: 1253938 - protein, 9 aa, Homo Sapiens
PLPPLQFLP

SEQ ID NO: 1253939 - protein, 9 aa, Homo Sapiens
VLRCIASET

SEQ ID NO: 1253940 - protein, 9 aa, Homo Sapiens
EQFISNAGA

SEQ ID NO: 1253941 - protein, 9 aa, Homo Sapiens
TIPSGAVKL

SEQ ID NO: 1253942 - protein, 9 aa, Homo Sapiens
VSPGCRDTS

SEQ ID NO: 1253943 - protein, 9 aa, Homo Sapiens
DRFHHYPHL

SEQ ID NO: 1253944 - protein, 9 aa, Homo Sapiens
ADALIVYAK

SEQ ID NO: 1253945 - protein, 9 aa, Homo Sapiens
VRNPGGWRA

SEQ ID NO: 1253946 - protein, 9 aa, Homo Sapiens
KDMNEFEME

SEQ ID NO: 1253947 - protein, 9 aa, Homo Sapiens
RIVRREWVL

SEQ ID NO: 1253948 - protein, 9 aa, Homo Sapiens
HTFCESCLQ

SEQ ID NO: 1253949 - protein, 9 aa, Homo Sapiens
HFLMDAQPW

SEQ ID NO: 1253950 - protein, 9 aa, Homo Sapiens
ANSMVFLHT

SEQ ID NO: 1253951 - protein, 9 aa, Homo Sapiens
TGMMVILNV

SEQ ID NO: 1253952 - protein, 9 aa, Homo Sapiens
SSKPDILNT

SEQ ID NO: 1253953 - protein, 9 aa, Homo Sapiens
GEGHGRATD

SEQ ID NO: 1253954 - protein, 9 aa, Homo Sapiens
AHTTMAGLT

SEQ ID NO: 1253955 - protein, 9 aa, Homo Sapiens
LEEWPELRQ

SEQ ID NO: 1253956 - protein, 9 aa, Homo Sapiens
EGVTSIIFC

SEQ ID NO: 1253957 - protein, 9 aa, Homo Sapiens
KCKPDIMLP

SEQ ID NO: 1253958 - protein, 9 aa, Homo Sapiens
HNAMVPLVR

SEQ ID NO: 1253959 - protein, 9 aa, Homo Sapiens
EDNKTLKIN

SEQ ID NO: 1253960 - protein, 9 aa, Homo Sapiens
DPTQNAWSR

SEQ ID NO: 1253961 - protein, 9 aa, Homo Sapiens
MESATRSTR

SEQ ID NO: 1253962 - protein, 9 aa, Homo Sapiens
KSFENMANA

SEQ ID NO: 1253963 - protein, 9 aa, Homo Sapiens
SPPPPVKFS

SEQ ID NO: 1253964 - protein, 9 aa, Homo Sapiens
SSQAGVQWH

SEQ ID NO: 1253965 - protein, 9 aa, Homo Sapiens
RVKKYDLCA

SEQ ID NO: 1253966 - protein, 9 aa, Homo Sapiens
MMSLYNVSI

SEQ ID NO: 1253967 - protein, 9 aa, Homo Sapiens
AVPPHGAIP

SEQ ID NO: 1253968 - protein, 9 aa, Homo Sapiens
ERETQSCPP

SEQ ID NO: 1253969 - protein, 9 aa, Homo Sapiens
LDNGGKTTI

SEQ ID NO: 1253970 - protein, 9 aa, Homo Sapiens
QTVKDRFQV

SEQ ID NO: 1253971 - protein, 9 aa, Homo Sapiens
HHAHINVSW

SEQ ID NO: 1253972 - protein, 9 aa, Homo Sapiens
KHVCVQHQG

SEQ ID NO: 1253973 - protein, 9 aa, Homo Sapiens
GPPTWPTQT

SEQ ID NO: 1253974 - protein, 9 aa, Homo Sapiens
LQVSLWKHL

SEQ ID NO: 1253975 - protein, 9 aa, Homo Sapiens
ATALYLALQ

SEQ ID NO: 1253976 - protein, 9 aa, Homo Sapiens
SFHFLFGIY

SEQ ID NO: 1253977 - protein, 9 aa, Homo Sapiens
FTDVCAAVY

SEQ ID NO: 1253978 - protein, 9 aa, Homo Sapiens
KTCLLIFFS

SEQ ID NO: 1253979 - protein, 9 aa, Homo Sapiens
EGEGTVQLT

SEQ ID NO: 1253980 - protein, 9 aa, Homo Sapiens
LVLTNLSHA

SEQ ID NO: 1253981 - protein, 9 aa, Homo Sapiens
EKKSRKNEI

SEQ ID NO: 1253982 - protein, 9 aa, Homo Sapiens
RYPNHRHRS

SEQ ID NO: 1253983 - protein, 9 aa, Homo Sapiens
LERCIVGQY

SEQ ID NO: 1253984 - protein, 9 aa, Homo Sapiens
RDYFINHMI

SEQ ID NO: 1253985 - protein, 9 aa, Homo Sapiens
QEAQNQVNI

SEQ ID NO: 1253986 - protein, 9 aa, Homo Sapiens
VLDFWVQAL

SEQ ID NO: 1253987 - protein, 9 aa, Homo Sapiens
RSSSIEQAS

SEQ ID NO: 1253988 - protein, 9 aa, Homo Sapiens
VTRIHLLDS

SEQ ID NO: 1253989 - protein, 9 aa, Homo Sapiens
LFNCGRSGN

SEQ ID NO: 1253990 - protein, 9 aa, Homo Sapiens
EKEATLVYS

SEQ ID NO: 1253991 - protein, 9 aa, Homo Sapiens
LCICALDVD

SEQ ID NO: 1253992 - protein, 9 aa, Homo Sapiens
GYLLEKKIY

SEQ ID NO: 1253993 - protein, 9 aa, Homo Sapiens
QEGMQVVVQ

SEQ ID NO: 1253994 - protein, 9 aa, Homo Sapiens
TITHRRARW

SEQ ID NO: 1253995 - protein, 9 aa, Homo Sapiens
RTQPLSFLI

SEQ ID NO: 1253996 - protein, 9 aa, Homo Sapiens
SLGKFLGKQ

SEQ ID NO: 1253997 - protein, 9 aa, Homo Sapiens
PSTLYTTGA

SEQ ID NO: 1253998 - protein, 9 aa, Homo Sapiens
SSSTAPPMW

SEQ ID NO: 1253999 - protein, 9 aa, Homo Sapiens
DDTRGKGSM

SEQ ID NO: 1254000 - protein, 9 aa, Homo Sapiens
LPPSWTMDP

SEQ ID NO: 1254001 - protein, 9 aa, Homo Sapiens
KCNSMQSEC

SEQ ID NO: 1254002 - protein, 9 aa, Homo Sapiens
TDTRGKYSD

SEQ ID NO: 1254003 - protein, 9 aa, Homo Sapiens
MFALERLTR

SEQ ID NO: 1254004 - protein, 9 aa, Homo Sapiens
QQFGAAHVW

SEQ ID NO: 1254005 - protein, 9 aa, Homo Sapiens
VDFEHPTRD

SEQ ID NO: 1254006 - protein, 9 aa, Homo Sapiens
YLEDCVEPV

SEQ ID NO: 1254007 - protein, 9 aa, Homo Sapiens
LLMVNSNYY

SEQ ID NO: 1254008 - protein, 9 aa, Homo Sapiens
KKEHTIYNM

SEQ ID NO: 1254009 - protein, 9 aa, Homo Sapiens
EEKKTARSH

SEQ ID NO: 1254010 - protein, 9 aa, Homo Sapiens
LPSAASPWS

SEQ ID NO: 1254011 - protein, 9 aa, Homo Sapiens
QYSCSLPCV

SEQ ID NO: 1254012 - protein, 9 aa, Homo Sapiens
YSRLLDVPR

SEQ ID NO: 1254013 - protein, 9 aa, Homo Sapiens
RSNPHTITG

SEQ ID NO: 1254014 - protein, 9 aa, Homo Sapiens
SDDKYPTRN

SEQ ID NO: 1254015 - protein, 9 aa, Homo Sapiens
VCCVEAQGS

SEQ ID NO: 1254016 - protein, 9 aa, Homo Sapiens
APDSTSNLA

SEQ ID NO: 1254017 - protein, 9 aa, Homo Sapiens
LESNKNEKA

SEQ ID NO: 1254018 - protein, 9 aa, Homo Sapiens
SAAALDVLT

SEQ ID NO: 1254019 - protein, 9 aa, Homo Sapiens
ESIRQDGGI

SEQ ID NO: 1254020 - protein, 9 aa, Homo Sapiens
SEKSNKKIS

SEQ ID NO: 1254021 - protein, 9 aa, Homo Sapiens
PGRKCKMHL

SEQ ID NO: 1254022 - protein, 9 aa, Homo Sapiens
RKSRRKLRR

SEQ ID NO: 1254023 - protein, 9 aa, Homo Sapiens
GPYTFTMDF

SEQ ID NO: 1254024 - protein, 9 aa, Homo Sapiens
LSPGNEENS

SEQ ID NO: 1254025 - protein, 9 aa, Homo Sapiens
GILASLQIR

SEQ ID NO: 1254026 - protein, 9 aa, Homo Sapiens
LLLVLDEDL

SEQ ID NO: 1254027 - protein, 9 aa, Homo Sapiens
TASRATKSG

SEQ ID NO: 1254028 - protein, 9 aa, Homo Sapiens
KRVLVLSVE

SEQ ID NO: 1254029 - protein, 9 aa, Homo Sapiens
GSLLTPPHR

SEQ ID NO: 1254030 - protein, 9 aa, Homo Sapiens
MRLQDPGRL

SEQ ID NO: 1254031 - protein, 9 aa, Homo Sapiens
VPVPSMDAH

SEQ ID NO: 1254032 - protein, 9 aa, Homo Sapiens
LNNELREVR

SEQ ID NO: 1254033 - protein, 9 aa, Homo Sapiens
THTTLEHPD

SEQ ID NO: 1254034 - protein, 9 aa, Homo Sapiens
HKDFGKDMA

SEQ ID NO: 1254035 - protein, 9 aa, Homo Sapiens
CCIKLLSSG

SEQ ID NO: 1254036 - protein, 9 aa, Homo Sapiens
FSPKGMTKL

SEQ ID NO: 1254037 - protein, 9 aa, Homo Sapiens
EDTKSPLYV

SEQ ID NO: 1254038 - protein, 9 aa, Homo Sapiens
WAGLPPISP

SEQ ID NO: 1254039 - protein, 9 aa, Homo Sapiens
RRTVPPLTP

SEQ ID NO: 1254040 - protein, 9 aa, Homo Sapiens
PECIPSSGI

SEQ ID NO: 1254041 - protein, 9 aa, Homo Sapiens
IVRCVIAEG

SEQ ID NO: 1254042 - protein, 9 aa, Homo Sapiens
THYYETYIR

SEQ ID NO: 1254043 - protein, 9 aa, Homo Sapiens
ALHQYCPVL

SEQ ID NO: 1254044 - protein, 9 aa, Homo Sapiens
MAKKERESR

SEQ ID NO: 1254045 - protein, 9 aa, Homo Sapiens
FNSMHHEIE

SEQ ID NO: 1254046 - protein, 9 aa, Homo Sapiens
KEAHCLIWL

SEQ ID NO: 1254047 - protein, 9 aa, Homo Sapiens
PSVPTTTTT

SEQ ID NO: 1254048 - protein, 9 aa, Homo Sapiens
GIRIKEGCA

SEQ ID NO: 1254049 - protein, 9 aa, Homo Sapiens
DDAISLRSR

SEQ ID NO: 1254050 - protein, 9 aa, Homo Sapiens
LLHKNHYFE

SEQ ID NO: 1254051 - protein, 9 aa, Homo Sapiens
PMFCAMPPE

SEQ ID NO: 1254052 - protein, 9 aa, Homo Sapiens
VWMGPIFPI

SEQ ID NO: 1254053 - protein, 9 aa, Homo Sapiens
DGVAWTPPV

SEQ ID NO: 1254054 - protein, 9 aa, Homo Sapiens
LALSKKNPG

SEQ ID NO: 1254055 - protein, 9 aa, Homo Sapiens
RMKHVWDRA

SEQ ID NO: 1254056 - protein, 9 aa, Homo Sapiens
YSNMPDSIL

SEQ ID NO: 1254057 - protein, 9 aa, Homo Sapiens
CNRPQPVHR

SEQ ID NO: 1254058 - protein, 9 aa, Homo Sapiens
PPASSTAPA

SEQ ID NO: 1254059 - protein, 9 aa, Homo Sapiens
NVEYVVRNL

SEQ ID NO: 1254060 - protein, 9 aa, Homo Sapiens
ATLKEVDIM

SEQ ID NO: 1254061 - protein, 9 aa, Homo Sapiens
TRNLGLDSY

SEQ ID NO: 1254062 - protein, 9 aa, Homo Sapiens
PPGVGNTPA

SEQ ID NO: 1254063 - protein, 9 aa, Homo Sapiens
ASTLTNHHI

SEQ ID NO: 1254064 - protein, 9 aa, Homo Sapiens
SPARSVMES

SEQ ID NO: 1254065 - protein, 9 aa, Homo Sapiens
LEHCRSLGL

SEQ ID NO: 1254066 - protein, 9 aa, Homo Sapiens
GTWWLLCQA

SEQ ID NO: 1254067 - protein, 9 aa, Homo Sapiens
LKQMLQSYK

SEQ ID NO: 1254068 - protein, 9 aa, Homo Sapiens
RPGSIHTTA

SEQ ID NO: 1254069 - protein, 9 aa, Homo Sapiens
VTKEVPMNP

SEQ ID NO: 1254070 - protein, 9 aa, Homo Sapiens
QTMKLRNYF

SEQ ID NO: 1254071 - protein, 9 aa, Homo Sapiens
TKAPQTPSA

SEQ ID NO: 1254072 - protein, 9 aa, Homo Sapiens
LGFKAGDII

SEQ ID NO: 1254073 - protein, 9 aa, Homo Sapiens
WEHNRVCDV

SEQ ID NO: 1254074 - protein, 9 aa, Homo Sapiens
STQTINFGT

SEQ ID NO: 1254075 - protein, 9 aa, Homo Sapiens
YLRVGLKGQ

SEQ ID NO: 1254076 - protein, 9 aa, Homo Sapiens
KPRGVVVDM

SEQ ID NO: 1254077 - protein, 9 aa, Homo Sapiens
EKRHREYNS

SEQ ID NO: 1254078 - protein, 9 aa, Homo Sapiens
SWIPDVFSL

SEQ ID NO: 1254079 - protein, 9 aa, Homo Sapiens
PAPKWRRRI

SEQ ID NO: 1254080 - protein, 9 aa, Homo Sapiens
VKNEINHSL

SEQ ID NO: 1254081 - protein, 9 aa, Homo Sapiens
TSQDVTLGP

SEQ ID NO: 1254082 - protein, 9 aa, Homo Sapiens
NNFTEVTIF

SEQ ID NO: 1254083 - protein, 9 aa, Homo Sapiens
KSKPKAQNP

SEQ ID NO: 1254084 - protein, 9 aa, Homo Sapiens
YPGIQAVHK

SEQ ID NO: 1254085 - protein, 9 aa, Homo Sapiens
ADIWDCDYS

SEQ ID NO: 1254086 - protein, 9 aa, Homo Sapiens
FGCMRPVWT

SEQ ID NO: 1254087 - protein, 9 aa, Homo Sapiens
EKKVSEVGR

SEQ ID NO: 1254088 - protein, 9 aa, Homo Sapiens
IFVKSWIPD

SEQ ID NO: 1254089 - protein, 9 aa, Homo Sapiens
KLHSGLMIK

SEQ ID NO: 1254090 - protein, 9 aa, Homo Sapiens
STTPSWCEE

SEQ ID NO: 1254091 - protein, 9 aa, Homo Sapiens
YELICVTRA

SEQ ID NO: 1254092 - protein, 9 aa, Homo Sapiens
YIHWQEELI

SEQ ID NO: 1254093 - protein, 9 aa, Homo Sapiens
ETRNLQTVD

SEQ ID NO: 1254094 - protein, 9 aa, Homo Sapiens
VPVAQMSNY

SEQ ID NO: 1254095 - protein, 9 aa, Homo Sapiens
EFGCPDGGD

SEQ ID NO: 1254096 - protein, 9 aa, Homo Sapiens
VCKYFQLDV

SEQ ID NO: 1254097 - protein, 9 aa, Homo Sapiens
RRGLSHGGS

SEQ ID NO: 1254098 - protein, 9 aa, Homo Sapiens
RDAIKGMQR

SEQ ID NO: 1254099 - protein, 9 aa, Homo Sapiens
FLCAATSCM

SEQ ID NO: 1254100 - protein, 9 aa, Homo Sapiens
ESVCQRDSK

SEQ ID NO: 1254101 - protein, 9 aa, Homo Sapiens
FDSEMNKLM

SEQ ID NO: 1254102 - protein, 9 aa, Homo Sapiens
KCTKSDLRL

SEQ ID NO: 1254103 - protein, 9 aa, Homo Sapiens
HVSTNLKTL

SEQ ID NO: 1254104 - protein, 9 aa, Homo Sapiens
GPRGEPQDG

SEQ ID NO: 1254105 - protein, 9 aa, Homo Sapiens
VKLREFVLV

SEQ ID NO: 1254106 - protein, 9 aa, Homo Sapiens
AIDAMLDLL

SEQ ID NO: 1254107 - protein, 9 aa, Homo Sapiens
IPGCIFVHT

SEQ ID NO: 1254108 - protein, 9 aa, Homo Sapiens
ILDRNQTHA

SEQ ID NO: 1254109 - protein, 9 aa, Homo Sapiens
LGRNMSGQP

SEQ ID NO: 1254110 - protein, 9 aa, Homo Sapiens
TWSVTLDNR

SEQ ID NO: 1254111 - protein, 9 aa, Homo Sapiens
IRNLLEQAS

SEQ ID NO: 1254112 - protein, 9 aa, Homo Sapiens
RRYTSEDNA

SEQ ID NO: 1254113 - protein, 9 aa, Homo Sapiens
PRSGNTSMW

SEQ ID NO: 1254114 - protein, 9 aa, Homo Sapiens
PESLHYKVL

SEQ ID NO: 1254115 - protein, 9 aa, Homo Sapiens
ELLAEASIL

SEQ ID NO: 1254116 - protein, 9 aa, Homo Sapiens
DRDKYLKVN

SEQ ID NO: 1254117 - protein, 9 aa, Homo Sapiens
GHSDGDSIK

SEQ ID NO: 1254118 - protein, 9 aa, Homo Sapiens
HLSALLALA

SEQ ID NO: 1254119 - protein, 9 aa, Homo Sapiens
RTISFLQCI

SEQ ID NO: 1254120 - protein, 9 aa, Homo Sapiens
AGNNDNEHL

SEQ ID NO: 1254121 - protein, 9 aa, Homo Sapiens
DITYFQAKR

SEQ ID NO: 1254122 - protein, 9 aa, Homo Sapiens
PRRPKPVTW

SEQ ID NO: 1254123 - protein, 9 aa, Homo Sapiens
QRDTHPAIH

SEQ ID NO: 1254124 - protein, 9 aa, Homo Sapiens
PRDQRVQGK

SEQ ID NO: 1254125 - protein, 9 aa, Homo Sapiens
DIVLGPIQL

SEQ ID NO: 1254126 - protein, 9 aa, Homo Sapiens
FQRSVASDY

SEQ ID NO: 1254127 - protein, 9 aa, Homo Sapiens
PSLNTVFRN

SEQ ID NO: 1254128 - protein, 9 aa, Homo Sapiens
NSGGSCLST

SEQ ID NO: 1254129 - protein, 9 aa, Homo Sapiens
TDFDDKFDD

SEQ ID NO: 1254130 - protein, 9 aa, Homo Sapiens
VVSMLHTML

SEQ ID NO: 1254131 - protein, 9 aa, Homo Sapiens
EILLSRNSE

SEQ ID NO: 1254132 - protein, 9 aa, Homo Sapiens
IAIICAYGP

SEQ ID NO: 1254133 - protein, 9 aa, Homo Sapiens
LKKNVMRVW

SEQ ID NO: 1254134 - protein, 9 aa, Homo Sapiens
KEEDIVVLA

SEQ ID NO: 1254135 - protein, 9 aa, Homo Sapiens
PLILIAPSG

SEQ ID NO: 1254136 - protein, 9 aa, Homo Sapiens
LTDVLYMVR

SEQ ID NO: 1254137 - protein, 9 aa, Homo Sapiens
QCEYLLDMI

SEQ ID NO: 1254138 - protein, 9 aa, Homo Sapiens
SRNGNVIYS

SEQ ID NO: 1254139 - protein, 9 aa, Homo Sapiens
WAILSFILL

SEQ ID NO: 1254140 - protein, 9 aa, Homo Sapiens
DTREVAIEV

SEQ ID NO: 1254141 - protein, 9 aa, Homo Sapiens
PAASLIVLK

SEQ ID NO: 1254142 - protein, 9 aa, Homo Sapiens
THTGSNIDC

SEQ ID NO: 1254143 - protein, 9 aa, Homo Sapiens
PSTKVQHCH

SEQ ID NO: 1254144 - protein, 9 aa, Homo Sapiens
LDLLVPAPP

SEQ ID NO: 1254145 - protein, 9 aa, Homo Sapiens
ENDPLRTPD

SEQ ID NO: 1254146 - protein, 9 aa, Homo Sapiens
KYSAENEED

SEQ ID NO: 1254147 - protein, 9 aa, Homo Sapiens
GTNVFSPMC

SEQ ID NO: 1254148 - protein, 9 aa, Homo Sapiens
ERDHLLAIN

SEQ ID NO: 1254149 - protein, 9 aa, Homo Sapiens
VLTLLYLAH

SEQ ID NO: 1254150 - protein, 9 aa, Homo Sapiens
KELKQMFQR

SEQ ID NO: 1254151 - protein, 9 aa, Homo Sapiens
NCSNYPAII

SEQ ID NO: 1254152 - protein, 9 aa, Homo Sapiens
HDSWEKVTG

SEQ ID NO: 1254153 - protein, 9 aa, Homo Sapiens
ESGRLSVMV

SEQ ID NO: 1254154 - protein, 9 aa, Homo Sapiens
SMEVYESPF

SEQ ID NO: 1254155 - protein, 9 aa, Homo Sapiens
VGGAESLQM

SEQ ID NO: 1254156 - protein, 9 aa, Homo Sapiens
AEQLHAAWC

SEQ ID NO: 1254157 - protein, 9 aa, Homo Sapiens
DCLIDKRQW

SEQ ID NO: 1254158 - protein, 9 aa, Homo Sapiens
DDAFTTFCG

SEQ ID NO: 1254159 - protein, 9 aa, Homo Sapiens
VPFDPLSFS

SEQ ID NO: 1254160 - protein, 9 aa, Homo Sapiens
SLQKCPDGH

SEQ ID NO: 1254161 - protein, 9 aa, Homo Sapiens
EQVSQLSTL

SEQ ID NO: 1254162 - protein, 9 aa, Homo Sapiens
CRREDPEEQ

SEQ ID NO: 1254163 - protein, 9 aa, Homo Sapiens
QHPALEPAF

SEQ ID NO: 1254164 - protein, 9 aa, Homo Sapiens
VFLLLSSVS

SEQ ID NO: 1254165 - protein, 9 aa, Homo Sapiens
GVGTWSFLT

SEQ ID NO: 1254166 - protein, 9 aa, Homo Sapiens
ADVGRAGRD

SEQ ID NO: 1254167 - protein, 9 aa, Homo Sapiens
LSACGWRSP

SEQ ID NO: 1254168 - protein, 9 aa, Homo Sapiens
TEGKLHFPE

SEQ ID NO: 1254169 - protein, 9 aa, Homo Sapiens
VIRLIGQQL

SEQ ID NO: 1254170 - protein, 9 aa, Homo Sapiens
DISTRDSVG

SEQ ID NO: 1254171 - protein, 9 aa, Homo Sapiens
AKAKELVWQ

SEQ ID NO: 1254172 - protein, 9 aa, Homo Sapiens
ASAKPIPHS

SEQ ID NO: 1254173 - protein, 9 aa, Homo Sapiens
LWSEQGIKD

SEQ ID NO: 1254174 - protein, 9 aa, Homo Sapiens
FDHFSRHDM

SEQ ID NO: 1254175 - protein, 9 aa, Homo Sapiens
EAGAKHNTS

SEQ ID NO: 1254176 - protein, 9 aa, Homo Sapiens
YIFKDMFRE

SEQ ID NO: 1254177 - protein, 9 aa, Homo Sapiens
EEARRCLRE

SEQ ID NO: 1254178 - protein, 9 aa, Homo Sapiens
FVAAVKFHV

SEQ ID NO: 1254179 - protein, 9 aa, Homo Sapiens
LQPWMGYAA

SEQ ID NO: 1254180 - protein, 9 aa, Homo Sapiens
GPSVCELVM

SEQ ID NO: 1254181 - protein, 9 aa, Homo Sapiens
NRVYTLVLG

SEQ ID NO: 1254182 - protein, 9 aa, Homo Sapiens
LIHVFFNPW

SEQ ID NO: 1254183 - protein, 9 aa, Homo Sapiens
PEGENMNVT

SEQ ID NO: 1254184 - protein, 9 aa, Homo Sapiens
AFRWGSSLI

SEQ ID NO: 1254185 - protein, 9 aa, Homo Sapiens
RSNHPPSLA

SEQ ID NO: 1254186 - protein, 9 aa, Homo Sapiens
KVPLSLRLT

SEQ ID NO: 1254187 - protein, 9 aa, Homo Sapiens
SCPLLILHT

SEQ ID NO: 1254188 - protein, 9 aa, Homo Sapiens
LTASRATKS

SEQ ID NO: 1254189 - protein, 9 aa, Homo Sapiens
SPDLQITVG

SEQ ID NO: 1254190 - protein, 9 aa, Homo Sapiens
HGLQGVPGN

SEQ ID NO: 1254191 - protein, 9 aa, Homo Sapiens
NPHPKKIRL

SEQ ID NO: 1254192 - protein, 9 aa, Homo Sapiens
LEHAIDLRV

SEQ ID NO: 1254193 - protein, 9 aa, Homo Sapiens
QMHDSFSHS

SEQ ID NO: 1254194 - protein, 9 aa, Homo Sapiens
LGPNMRGFL

SEQ ID NO: 1254195 - protein, 9 aa, Homo Sapiens
IKAKVIREG

SEQ ID NO: 1254196 - protein, 9 aa, Homo Sapiens
SQGLLGQTQ

SEQ ID NO: 1254197 - protein, 9 aa, Homo Sapiens
YSCFSSSSD

SEQ ID NO: 1254198 - protein, 9 aa, Homo Sapiens
QAKYKNTTK

SEQ ID NO: 1254199 - protein, 9 aa, Homo Sapiens
VLDTNGSLV

SEQ ID NO: 1254200 - protein, 9 aa, Homo Sapiens
SGCCNIYRN

SEQ ID NO: 1254201 - protein, 9 aa, Homo Sapiens
IFCPVHKQE

SEQ ID NO: 1254202 - protein, 9 aa, Homo Sapiens
CEGDPSGIP

SEQ ID NO: 1254203 - protein, 9 aa, Homo Sapiens
RLSRVPAQE

SEQ ID NO: 1254204 - protein, 9 aa, Homo Sapiens
QSNETYRDD

SEQ ID NO: 1254205 - protein, 9 aa, Homo Sapiens
DNVRIVTLV

SEQ ID NO: 1254206 - protein, 9 aa, Homo Sapiens
SLPEGVPQV

SEQ ID NO: 1254207 - protein, 9 aa, Homo Sapiens
PRHEYFNVS

SEQ ID NO: 1254208 - protein, 9 aa, Homo Sapiens
FMPLAKQQP

SEQ ID NO: 1254209 - protein, 9 aa, Homo Sapiens
GYTIPLDKC

SEQ ID NO: 1254210 - protein, 9 aa, Homo Sapiens
RRYVAHSVQ

SEQ ID NO: 1254211 - protein, 9 aa, Homo Sapiens
CTVENIKDP

SEQ ID NO: 1254212 - protein, 9 aa, Homo Sapiens
GLWWREGTL

SEQ ID NO: 1254213 - protein, 9 aa, Homo Sapiens
INFAYDTGT

SEQ ID NO: 1254214 - protein, 9 aa, Homo Sapiens
LSGVCESSG

SEQ ID NO: 1254215 - protein, 9 aa, Homo Sapiens
VVDRLFEIK

SEQ ID NO: 1254216 - protein, 9 aa, Homo Sapiens
GKEDNGYLL

SEQ ID NO: 1254217 - protein, 9 aa, Homo Sapiens
EHSGQPREI

SEQ ID NO: 1254218 - protein, 9 aa, Homo Sapiens
GDDAISLRS

SEQ ID NO: 1254219 - protein, 9 aa, Homo Sapiens
LLCQAEEEW

SEQ ID NO: 1254220 - protein, 9 aa, Homo Sapiens
GAGAGRIWP

SEQ ID NO: 1254221 - protein, 9 aa, Homo Sapiens
MTGAHDQAT

SEQ ID NO: 1254222 - protein, 9 aa, Homo Sapiens
NKVPEKPLH

SEQ ID NO: 1254223 - protein, 9 aa, Homo Sapiens
IWSVTNKSG

SEQ ID NO: 1254224 - protein, 9 aa, Homo Sapiens
PIPAQHAPQ

SEQ ID NO: 1254225 - protein, 9 aa, Homo Sapiens
KLIHVIHHC

SEQ ID NO: 1254226 - protein, 9 aa, Homo Sapiens
DIMRKVSGH

SEQ ID NO: 1254227 - protein, 9 aa, Homo Sapiens
QEKRLHSPA

SEQ ID NO: 1254228 - protein, 9 aa, Homo Sapiens
ADEFIHQHF

SEQ ID NO: 1254229 - protein, 9 aa, Homo Sapiens
LAWFEISEL

SEQ ID NO: 1254230 - protein, 9 aa, Homo Sapiens
FFLSIMSFV

SEQ ID NO: 1254231 - protein, 9 aa, Homo Sapiens
DSMRCGLDS

SEQ ID NO: 1254232 - protein, 9 aa, Homo Sapiens
EELCVYCAL

SEQ ID NO: 1254233 - protein, 9 aa, Homo Sapiens
QDENDNNPE

SEQ ID NO: 1254234 - protein, 9 aa, Homo Sapiens
DEVASLRAK

SEQ ID NO: 1254235 - protein, 9 aa, Homo Sapiens
TAKLTSIDN

SEQ ID NO: 1254236 - protein, 9 aa, Homo Sapiens
NHISSMFRE

SEQ ID NO: 1254237 - protein, 9 aa, Homo Sapiens
YVCAMREMN

SEQ ID NO: 1254238 - protein, 9 aa, Homo Sapiens
EATMFSNAM

SEQ ID NO: 1254239 - protein, 9 aa, Homo Sapiens
RYSISKNLP

SEQ ID NO: 1254240 - protein, 9 aa, Homo Sapiens
DLQNKLPLT

SEQ ID NO: 1254241 - protein, 9 aa, Homo Sapiens
KLDITGNGH

SEQ ID NO: 1254242 - protein, 9 aa, Homo Sapiens
QRQLLRMGG

SEQ ID NO: 1254243 - protein, 9 aa, Homo Sapiens
QGREHPSCG

SEQ ID NO: 1254244 - protein, 9 aa, Homo Sapiens
HLHLKRAPG

SEQ ID NO: 1254245 - protein, 9 aa, Homo Sapiens
QRKGISRKS

SEQ ID NO: 1254246 - protein, 9 aa, Homo Sapiens
SLASLCSEQ

SEQ ID NO: 1254247 - protein, 9 aa, Homo Sapiens
RLNIAIVWL

SEQ ID NO: 1254248 - protein, 9 aa, Homo Sapiens
QREEWKKTM

SEQ ID NO: 1254249 - protein, 9 aa, Homo Sapiens
ENTAPSQDT

SEQ ID NO: 1254250 - protein, 9 aa, Homo Sapiens
PRCLVPEGL

SEQ ID NO: 1254251 - protein, 9 aa, Homo Sapiens
AVRHGSCSS

SEQ ID NO: 1254252 - protein, 9 aa, Homo Sapiens
TKFQKLRYK

SEQ ID NO: 1254253 - protein, 9 aa, Homo Sapiens
KDGLGFITS

SEQ ID NO: 1254254 - protein, 9 aa, Homo Sapiens
NLGLDSYFL

SEQ ID NO: 1254255 - protein, 9 aa, Homo Sapiens
YLIFLKGIM

SEQ ID NO: 1254256 - protein, 9 aa, Homo Sapiens
ESCLQNYIP

SEQ ID NO: 1254257 - protein, 9 aa, Homo Sapiens
RLCLSRIQN

SEQ ID NO: 1254258 - protein, 9 aa, Homo Sapiens
KAIDTATQT

SEQ ID NO: 1254259 - protein, 9 aa, Homo Sapiens
EKTQEALNS

SEQ ID NO: 1254260 - protein, 9 aa, Homo Sapiens
PTQNAWSRS

SEQ ID NO: 1254261 - protein, 9 aa, Homo Sapiens
ATLSITCHR

SEQ ID NO: 1254262 - protein, 9 aa, Homo Sapiens
HCSKQRHKQ

SEQ ID NO: 1254263 - protein, 9 aa, Homo Sapiens
DCPIKKGPV

SEQ ID NO: 1254264 - protein, 9 aa, Homo Sapiens
SDGQEHFST

SEQ ID NO: 1254265 - protein, 9 aa, Homo Sapiens
SSSSKKQAS

SEQ ID NO: 1254266 - protein, 9 aa, Homo Sapiens
DILYPNTNY

SEQ ID NO: 1254267 - protein, 9 aa, Homo Sapiens
NDSGPEFIQ

SEQ ID NO: 1254268 - protein, 9 aa, Homo Sapiens
ATTAAATGP

SEQ ID NO: 1254269 - protein, 9 aa, Homo Sapiens
QGEAMHCPQ

SEQ ID NO: 1254270 - protein, 9 aa, Homo Sapiens
MFRLSTDSH

SEQ ID NO: 1254271 - protein, 9 aa, Homo Sapiens
EQGQQCLTT

SEQ ID NO: 1254272 - protein, 9 aa, Homo Sapiens
AVKILPIMF

SEQ ID NO: 1254273 - protein, 9 aa, Homo Sapiens
GHLCDIRSL

SEQ ID NO: 1254274 - protein, 9 aa, Homo Sapiens
KLLVTPPQG

SEQ ID NO: 1254275 - protein, 9 aa, Homo Sapiens
ERSFLDLMF

SEQ ID NO: 1254276 - protein, 9 aa, Homo Sapiens
LILQSDRNV

SEQ ID NO: 1254277 - protein, 9 aa, Homo Sapiens
RHASIQLQH

SEQ ID NO: 1254278 - protein, 9 aa, Homo Sapiens
KIHNGVIHF

SEQ ID NO: 1254279 - protein, 9 aa, Homo Sapiens
ENRCAAIKE

SEQ ID NO: 1254280 - protein, 9 aa, Homo Sapiens
DILPCLPGP

SEQ ID NO: 1254281 - protein, 9 aa, Homo Sapiens
FTNYNINQS

SEQ ID NO: 1254282 - protein, 9 aa, Homo Sapiens
SFHMSYSMA

SEQ ID NO: 1254283 - protein, 9 aa, Homo Sapiens
GELKSLSKE

SEQ ID NO: 1254284 - protein, 9 aa, Homo Sapiens
EPVFEDQCS

SEQ ID NO: 1254285 - protein, 9 aa, Homo Sapiens
CNDTTPVCT

SEQ ID NO: 1254286 - protein, 9 aa, Homo Sapiens
KRQEVPPHI

SEQ ID NO: 1254287 - protein, 9 aa, Homo Sapiens
SAIKTPQRY

SEQ ID NO: 1254288 - protein, 9 aa, Homo Sapiens
SSSPCAACV

SEQ ID NO: 1254289 - protein, 9 aa, Homo Sapiens
VALKFVTAF

SEQ ID NO: 1254290 - protein, 9 aa, Homo Sapiens
RNNVLLDLL

SEQ ID NO: 1254291 - protein, 9 aa, Homo Sapiens
VAEETERCT

SEQ ID NO: 1254292 - protein, 9 aa, Homo Sapiens
QDLLCSVKP

SEQ ID NO: 1254293 - protein, 9 aa, Homo Sapiens
HQYCPVLRP

SEQ ID NO: 1254294 - protein, 9 aa, Homo Sapiens
GVYSAPCGG

SEQ ID NO: 1254295 - protein, 9 aa, Homo Sapiens
SAKQKLIVH

SEQ ID NO: 1254296 - protein, 9 aa, Homo Sapiens
KGLSFNSSV

SEQ ID NO: 1254297 - protein, 9 aa, Homo Sapiens
VPPHIFSIS

SEQ ID NO: 1254298 - protein, 9 aa, Homo Sapiens
QRPIHPVAN

SEQ ID NO: 1254299 - protein, 9 aa, Homo Sapiens
SRPSSTSSS

SEQ ID NO: 1254300 - protein, 9 aa, Homo Sapiens
SWASAPSHQ

SEQ ID NO: 1254301 - protein, 9 aa, Homo Sapiens
QDAINIRDI

SEQ ID NO: 1254302 - protein, 9 aa, Homo Sapiens
HEMVVAKHP

SEQ ID NO: 1254303 - protein, 9 aa, Homo Sapiens
NDLELLGAT

SEQ ID NO: 1254304 - protein, 9 aa, Homo Sapiens
QYIPFYAGM

SEQ ID NO: 1254305 - protein, 9 aa, Homo Sapiens
LKGPKTDAM

SEQ ID NO: 1254306 - protein, 9 aa, Homo Sapiens
QEETRGPDG

SEQ ID NO: 1254307 - protein, 9 aa, Homo Sapiens
KLGVHISDT

SEQ ID NO: 1254308 - protein, 9 aa, Homo Sapiens
YSISKNLPI

SEQ ID NO: 1254309 - protein, 9 aa, Homo Sapiens
TAVGTMADD

SEQ ID NO: 1254310 - protein, 9 aa, Homo Sapiens
SPRRHAMPC

SEQ ID NO: 1254311 - protein, 9 aa, Homo Sapiens
SDLIISSAI

SEQ ID NO: 1254312 - protein, 9 aa, Homo Sapiens
FFIDCMTAL

SEQ ID NO: 1254313 - protein, 9 aa, Homo Sapiens
HQNCSFPLP

SEQ ID NO: 1254314 - protein, 9 aa, Homo Sapiens
ILGLRIIFP

SEQ ID NO: 1254315 - protein, 9 aa, Homo Sapiens
SAPPHHRNI

SEQ ID NO: 1254316 - protein, 9 aa, Homo Sapiens
STQHCLSVL

SEQ ID NO: 1254317 - protein, 9 aa, Homo Sapiens
HGMSQACRW

SEQ ID NO: 1254318 - protein, 9 aa, Homo Sapiens
FPVIFRKDR

SEQ ID NO: 1254319 - protein, 9 aa, Homo Sapiens
GDCTRSPGS

SEQ ID NO: 1254320 - protein, 9 aa, Homo Sapiens
EKIQLISEL

SEQ ID NO: 1254321 - protein, 9 aa, Homo Sapiens
AVCRLLENR

SEQ ID NO: 1254322 - protein, 9 aa, Homo Sapiens
RVDTDDIVE

SEQ ID NO: 1254323 - protein, 9 aa, Homo Sapiens
IEAYNHAKY

SEQ ID NO: 1254324 - protein, 9 aa, Homo Sapiens
KLPCSSLPK

SEQ ID NO: 1254325 - protein, 9 aa, Homo Sapiens
QHYLSKTSE

SEQ ID NO: 1254326 - protein, 9 aa, Homo Sapiens
HIQTSSQAK

SEQ ID NO: 1254327 - protein, 9 aa, Homo Sapiens
RCSDGKSRG

SEQ ID NO: 1254328 - protein, 9 aa, Homo Sapiens
VGTASRRVL

SEQ ID NO: 1254329 - protein, 9 aa, Homo Sapiens
VMAKHPRNT

SEQ ID NO: 1254330 - protein, 9 aa, Homo Sapiens
AIVLLTHGV

SEQ ID NO: 1254331 - protein, 9 aa, Homo Sapiens
VEELCVYCA

SEQ ID NO: 1254332 - protein, 9 aa, Homo Sapiens
KGADSGILP

SEQ ID NO: 1254333 - protein, 9 aa, Homo Sapiens
PRGMMKNHS

SEQ ID NO: 1254334 - protein, 9 aa, Homo Sapiens
GKLGPLGVP

SEQ ID NO: 1254335 - protein, 9 aa, Homo Sapiens
VLIGRQGNK

SEQ ID NO: 1254336 - protein, 9 aa, Homo Sapiens
SSIIAVICL

SEQ ID NO: 1254337 - protein, 9 aa, Homo Sapiens
QKFMDCPYN

SEQ ID NO: 1254338 - protein, 9 aa, Homo Sapiens
PRWVALPCS

SEQ ID NO: 1254339 - protein, 9 aa, Homo Sapiens
GPKGERGEQ

SEQ ID NO: 1254340 - protein, 9 aa, Homo Sapiens
ACMVGAGVC

SEQ ID NO: 1254341 - protein, 9 aa, Homo Sapiens
VHVSESFPY

SEQ ID NO: 1254342 - protein, 9 aa, Homo Sapiens
TVVFFILWY

SEQ ID NO: 1254343 - protein, 9 aa, Homo Sapiens
NAQQENEGV

SEQ ID NO: 1254344 - protein, 9 aa, Homo Sapiens
ITIEDYKIT

SEQ ID NO: 1254345 - protein, 9 aa, Homo Sapiens
QQLADTLGY

SEQ ID NO: 1254346 - protein, 9 aa, Homo Sapiens
DYYGDLAAH

SEQ ID NO: 1254347 - protein, 9 aa, Homo Sapiens
MLNPFGQVI

SEQ ID NO: 1254348 - protein, 9 aa, Homo Sapiens
LRLKRCHIS

SEQ ID NO: 1254349 - protein, 9 aa, Homo Sapiens
NFTGSGDPD

SEQ ID NO: 1254350 - protein, 9 aa, Homo Sapiens
LLCRVAVCF

SEQ ID NO: 1254351 - protein, 9 aa, Homo Sapiens
NKIHMHLIK

SEQ ID NO: 1254352 - protein, 9 aa, Homo Sapiens
EFQACYRQL

SEQ ID NO: 1254353 - protein, 9 aa, Homo Sapiens
TCRKEHETW

SEQ ID NO: 1254354 - protein, 9 aa, Homo Sapiens
QWEEQQQRQ

SEQ ID NO: 1254355 - protein, 9 aa, Homo Sapiens
PSVYLSCRR

SEQ ID NO: 1254356 - protein, 9 aa, Homo Sapiens
KNLYKKKLS

SEQ ID NO: 1254357 - protein, 9 aa, Homo Sapiens
LLDREEQRY

SEQ ID NO: 1254358 - protein, 9 aa, Homo Sapiens
KSEPWVDKK

SEQ ID NO: 1254359 - protein, 9 aa, Homo Sapiens
IVNDDINLL

SEQ ID NO: 1254360 - protein, 9 aa, Homo Sapiens
LGRSPSTSA

SEQ ID NO: 1254361 - protein, 9 aa, Homo Sapiens
ILDFEHCTC

SEQ ID NO: 1254362 - protein, 9 aa, Homo Sapiens
PPGVHGLQG

SEQ ID NO: 1254363 - protein, 9 aa, Homo Sapiens
LICWDTTSS

SEQ ID NO: 1254364 - protein, 9 aa, Homo Sapiens
PDQGNGKIL

SEQ ID NO: 1254365 - protein, 9 aa, Homo Sapiens
GQAVLGMDM

SEQ ID NO: 1254366 - protein, 9 aa, Homo Sapiens
CLRALFMKQ

SEQ ID NO: 1254367 - protein, 9 aa, Homo Sapiens
LYIPVVKSS

SEQ ID NO: 1254368 - protein, 9 aa, Homo Sapiens
ELFVNKMAA

SEQ ID NO: 1254369 - protein, 9 aa, Homo Sapiens
SCKLQDIQE

SEQ ID NO: 1254370 - protein, 9 aa, Homo Sapiens
YATNSAEIC

SEQ ID NO: 1254371 - protein, 9 aa, Homo Sapiens
PTYRYEWGS

SEQ ID NO: 1254372 - protein, 9 aa, Homo Sapiens
ARKQPWGAG

SEQ ID NO: 1254373 - protein, 9 aa, Homo Sapiens
YYFNTGTVY

SEQ ID NO: 1254374 - protein, 9 aa, Homo Sapiens
YPSDDMAVA

SEQ ID NO: 1254375 - protein, 9 aa, Homo Sapiens
WEGFTCDCY

SEQ ID NO: 1254376 - protein, 9 aa, Homo Sapiens
CMHTVPDKD

SEQ ID NO: 1254377 - protein, 9 aa, Homo Sapiens
TISPAQLDP

SEQ ID NO: 1254378 - protein, 9 aa, Homo Sapiens
DIRNFEVVL

SEQ ID NO: 1254379 - protein, 9 aa, Homo Sapiens
YIRLHKWAQ

SEQ ID NO: 1254380 - protein, 9 aa, Homo Sapiens
PTLLQRANP

SEQ ID NO: 1254381 - protein, 9 aa, Homo Sapiens
SLQITIIAN

SEQ ID NO: 1254382 - protein, 9 aa, Homo Sapiens
ARDSAQAKH

SEQ ID NO: 1254383 - protein, 9 aa, Homo Sapiens
IGIAIHGAE

SEQ ID NO: 1254384 - protein, 9 aa, Homo Sapiens
QLGVPELRD

SEQ ID NO: 1254385 - protein, 9 aa, Homo Sapiens
SLGIYNCWE

SEQ ID NO: 1254386 - protein, 9 aa, Homo Sapiens
FMHVKIFDP

SEQ ID NO: 1254387 - protein, 9 aa, Homo Sapiens
PEPGAEPHL

SEQ ID NO: 1254388 - protein, 9 aa, Homo Sapiens
GVMHISCPQ

SEQ ID NO: 1254389 - protein, 9 aa, Homo Sapiens
AHRKAAKVH

SEQ ID NO: 1254390 - protein, 9 aa, Homo Sapiens
GRKVALKKV

SEQ ID NO: 1254391 - protein, 9 aa, Homo Sapiens
PHMFWIGWG

SEQ ID NO: 1254392 - protein, 9 aa, Homo Sapiens
KGTMITIEG

SEQ ID NO: 1254393 - protein, 9 aa, Homo Sapiens
TALFSVFAY

SEQ ID NO: 1254394 - protein, 9 aa, Homo Sapiens
QHTQNIMDQ

SEQ ID NO: 1254395 - protein, 9 aa, Homo Sapiens
EAAGPTADE

SEQ ID NO: 1254396 - protein, 9 aa, Homo Sapiens
NDNEHLAIA

SEQ ID NO: 1254397 - protein, 9 aa, Homo Sapiens
YGSKGDVGP

SEQ ID NO: 1254398 - protein, 9 aa, Homo Sapiens
KHGEVLVNI

SEQ ID NO: 1254399 - protein, 9 aa, Homo Sapiens
EPKHERCPW

SEQ ID NO: 1254400 - protein, 9 aa, Homo Sapiens
AYVASFLSF

SEQ ID NO: 1254401 - protein, 9 aa, Homo Sapiens
DCDGVLQTH

SEQ ID NO: 1254402 - protein, 9 aa, Homo Sapiens
RNLDSQTFI

SEQ ID NO: 1254403 - protein, 9 aa, Homo Sapiens
LHLHNDIIF

SEQ ID NO: 1254404 - protein, 9 aa, Homo Sapiens
LKISFHRND

SEQ ID NO: 1254405 - protein, 9 aa, Homo Sapiens
FDNRLMNHF

SEQ ID NO: 1254406 - protein, 9 aa, Homo Sapiens
HSFHGQCQL

SEQ ID NO: 1254407 - protein, 9 aa, Homo Sapiens
SISELDLED

SEQ ID NO: 1254408 - protein, 9 aa, Homo Sapiens
RRMSLGEQD

SEQ ID NO: 1254409 - protein, 9 aa, Homo Sapiens
AFGLYSIFT

SEQ ID NO: 1254410 - protein, 9 aa, Homo Sapiens
FGVEFVNMF

SEQ ID NO: 1254411 - protein, 9 aa, Homo Sapiens
PQPVHRFLF

SEQ ID NO: 1254412 - protein, 9 aa, Homo Sapiens
TGINEKKIA

SEQ ID NO: 1254413 - protein, 9 aa, Homo Sapiens
MEACGTMEC

SEQ ID NO: 1254414 - protein, 9 aa, Homo Sapiens
DSQNKGKIS

SEQ ID NO: 1254415 - protein, 9 aa, Homo Sapiens
GLTFQGLDA

SEQ ID NO: 1254416 - protein, 9 aa, Homo Sapiens
LAPKRPLLP

SEQ ID NO: 1254417 - protein, 9 aa, Homo Sapiens
MTVVILKLY

SEQ ID NO: 1254418 - protein, 9 aa, Homo Sapiens
PLCGPCITS

SEQ ID NO: 1254419 - protein, 9 aa, Homo Sapiens
VTEPETWTA

SEQ ID NO: 1254420 - protein, 9 aa, Homo Sapiens
KTDIIDCLE

SEQ ID NO: 1254421 - protein, 9 aa, Homo Sapiens
MMGISHQEE

SEQ ID NO: 1254422 - protein, 9 aa, Homo Sapiens
VVEACCSIL

SEQ ID NO: 1254423 - protein, 9 aa, Homo Sapiens
TGDQTLEVL

SEQ ID NO: 1254424 - protein, 9 aa, Homo Sapiens
PDDLMASFL

SEQ ID NO: 1254425 - protein, 9 aa, Homo Sapiens
VSVVDFVQF

SEQ ID NO: 1254426 - protein, 9 aa, Homo Sapiens
KAVEDAIAC

SEQ ID NO: 1254427 - protein, 9 aa, Homo Sapiens
TVNAVQPGT

SEQ ID NO: 1254428 - protein, 9 aa, Homo Sapiens
VIPYDALPD

SEQ ID NO: 1254429 - protein, 9 aa, Homo Sapiens
SLISDNAVK

SEQ ID NO: 1254430 - protein, 9 aa, Homo Sapiens
MDLVRIGLE

SEQ ID NO: 1254431 - protein, 9 aa, Homo Sapiens
TQLLFYDTS

SEQ ID NO: 1254432 - protein, 9 aa, Homo Sapiens
NAITYEKLN

SEQ ID NO: 1254433 - protein, 9 aa, Homo Sapiens
AEPWRQEWE

SEQ ID NO: 1254434 - protein, 9 aa, Homo Sapiens
GRLGHEPVL

SEQ ID NO: 1254435 - protein, 9 aa, Homo Sapiens
LTSGISSSI

SEQ ID NO: 1254436 - protein, 9 aa, Homo Sapiens
SFITAVLTK

SEQ ID NO: 1254437 - protein, 9 aa, Homo Sapiens
TWLTLRRTG

SEQ ID NO: 1254438 - protein, 9 aa, Homo Sapiens
FDLSLTSSP

SEQ ID NO: 1254439 - protein, 9 aa, Homo Sapiens
IPAGRRSGG

SEQ ID NO: 1254440 - protein, 9 aa, Homo Sapiens
AWCDGLDWC

SEQ ID NO: 1254441 - protein, 9 aa, Homo Sapiens
NEGTRKMER

SEQ ID NO: 1254442 - protein, 9 aa, Homo Sapiens
GECGKYYIS

SEQ ID NO: 1254443 - protein, 9 aa, Homo Sapiens
IEAFNSCRY

SEQ ID NO: 1254444 - protein, 9 aa, Homo Sapiens
QAHASALCH

SEQ ID NO: 1254445 - protein, 9 aa, Homo Sapiens
CFTSSLVSD

SEQ ID NO: 1254446 - protein, 9 aa, Homo Sapiens
GAADDRVHE

SEQ ID NO: 1254447 - protein, 9 aa, Homo Sapiens
GPQPGRIRT

SEQ ID NO: 1254448 - protein, 9 aa, Homo Sapiens
KRIGVSAWL

SEQ ID NO: 1254449 - protein, 9 aa, Homo Sapiens
GIIGVSHRT

SEQ ID NO: 1254450 - protein, 9 aa, Homo Sapiens
YGNDFAATR

SEQ ID NO: 1254451 - protein, 9 aa, Homo Sapiens
LSLAHRRFH

SEQ ID NO: 1254452 - protein, 9 aa, Homo Sapiens
PTLVFEHVN

SEQ ID NO: 1254453 - protein, 9 aa, Homo Sapiens
PPKKKCLRL

SEQ ID NO: 1254454 - protein, 9 aa, Homo Sapiens
IKHYNTGKF

SEQ ID NO: 1254455 - protein, 9 aa, Homo Sapiens
SCIFFIVYL

SEQ ID NO: 1254456 - protein, 9 aa, Homo Sapiens
TYRQLSNGD

SEQ ID NO: 1254457 - protein, 9 aa, Homo Sapiens
PTLPGPGPR

SEQ ID NO: 1254458 - protein, 9 aa, Homo Sapiens
TGGDAPVFS

SEQ ID NO: 1254459 - protein, 9 aa, Homo Sapiens
ASLVNVTAG

SEQ ID NO: 1254460 - protein, 9 aa, Homo Sapiens
MLKAMFSGH

SEQ ID NO: 1254461 - protein, 9 aa, Homo Sapiens
YSVRMRQKP

SEQ ID NO: 1254462 - protein, 9 aa, Homo Sapiens
PGSGGDGPW

SEQ ID NO: 1254463 - protein, 9 aa, Homo Sapiens
HETILQKRM

SEQ ID NO: 1254464 - protein, 9 aa, Homo Sapiens
IKKEENTKH

SEQ ID NO: 1254465 - protein, 9 aa, Homo Sapiens
GRKGLFPFM

SEQ ID NO: 1254466 - protein, 9 aa, Homo Sapiens
RIVTLVPEL

SEQ ID NO: 1254467 - protein, 9 aa, Homo Sapiens
LSNDLDTQD

SEQ ID NO: 1254468 - protein, 9 aa, Homo Sapiens
YGVMCVRNV

SEQ ID NO: 1254469 - protein, 9 aa, Homo Sapiens
LKDGNCRYC

SEQ ID NO: 1254470 - protein, 9 aa, Homo Sapiens
IHKCDRVLA

SEQ ID NO: 1254471 - protein, 9 aa, Homo Sapiens
AHLDGRLAR

SEQ ID NO: 1254472 - protein, 9 aa, Homo Sapiens
EARSRGHAP

SEQ ID NO: 1254473 - protein, 9 aa, Homo Sapiens
YYSSSFTQH

SEQ ID NO: 1254474 - protein, 9 aa, Homo Sapiens
MSTLRSAKR

SEQ ID NO: 1254475 - protein, 9 aa, Homo Sapiens
GGRMDHMDR

SEQ ID NO: 1254476 - protein, 9 aa, Homo Sapiens
APAEATSWS

SEQ ID NO: 1254477 - protein, 9 aa, Homo Sapiens
ACYRQLVSG

SEQ ID NO: 1254478 - protein, 9 aa, Homo Sapiens
VTDEVLNSA

SEQ ID NO: 1254479 - protein, 9 aa, Homo Sapiens
DQRLKKKHQ

SEQ ID NO: 1254480 - protein, 9 aa, Homo Sapiens
DHPRAQCVV

SEQ ID NO: 1254481 - protein, 9 aa, Homo Sapiens
TSIRPYQCH

SEQ ID NO: 1254482 - protein, 9 aa, Homo Sapiens
AVVKRSHSF

SEQ ID NO: 1254483 - protein, 9 aa, Homo Sapiens
VQQNKMLET

SEQ ID NO: 1254484 - protein, 9 aa, Homo Sapiens
GICTNRTCL

SEQ ID NO: 1254485 - protein, 9 aa, Homo Sapiens
SRLACGAIG

SEQ ID NO: 1254486 - protein, 9 aa, Homo Sapiens
HRGTRPPPP

SEQ ID NO: 1254487 - protein, 9 aa, Homo Sapiens
LLEEYQSSL

SEQ ID NO: 1254488 - protein, 9 aa, Homo Sapiens
PPWVPAIGF

SEQ ID NO: 1254489 - protein, 9 aa, Homo Sapiens
VYDPSSIVS

SEQ ID NO: 1254490 - protein, 9 aa, Homo Sapiens
YFVLGLPNR

SEQ ID NO: 1254491 - protein, 9 aa, Homo Sapiens
LGDIIILDN

SEQ ID NO: 1254492 - protein, 9 aa, Homo Sapiens
VFTAPYDGC

SEQ ID NO: 1254493 - protein, 9 aa, Homo Sapiens
SERKRNIFR

SEQ ID NO: 1254494 - protein, 9 aa, Homo Sapiens
YASCKCIGS

SEQ ID NO: 1254495 - protein, 9 aa, Homo Sapiens
DQSKEKHVM

SEQ ID NO: 1254496 - protein, 9 aa, Homo Sapiens
DLLFQENSM

SEQ ID NO: 1254497 - protein, 9 aa, Homo Sapiens
YVAHSVQLF

SEQ ID NO: 1254498 - protein, 9 aa, Homo Sapiens
AYIFRHNQQ

SEQ ID NO: 1254499 - protein, 9 aa, Homo Sapiens
AIYNVAVMC

SEQ ID NO: 1254500 - protein, 9 aa, Homo Sapiens
PFCTRINHS

SEQ ID NO: 1254501 - protein, 9 aa, Homo Sapiens
GLMKSVDSK

SEQ ID NO: 1254502 - protein, 9 aa, Homo Sapiens
EHETWLAPE

SEQ ID NO: 1254503 - protein, 9 aa, Homo Sapiens
QNYWTEVMD

SEQ ID NO: 1254504 - protein, 9 aa, Homo Sapiens
EWNVLKKKK

SEQ ID NO: 1254505 - protein, 9 aa, Homo Sapiens
GTNEGLKER

SEQ ID NO: 1254506 - protein, 9 aa, Homo Sapiens
SLSQTEIVR

SEQ ID NO: 1254507 - protein, 9 aa, Homo Sapiens
SANSGARVP

SEQ ID NO: 1254508 - protein, 9 aa, Homo Sapiens
MEGGGSEPT

SEQ ID NO: 1254509 - protein, 9 aa, Homo Sapiens
QQDEIDIWG

SEQ ID NO: 1254510 - protein, 9 aa, Homo Sapiens
IDKCWVLGR

SEQ ID NO: 1254511 - protein, 9 aa, Homo Sapiens
DVQMFSEVR

SEQ ID NO: 1254512 - protein, 9 aa, Homo Sapiens
LAQTDQHLN

SEQ ID NO: 1254513 - protein, 9 aa, Homo Sapiens
SSSQGVSVN

SEQ ID NO: 1254514 - protein, 9 aa, Homo Sapiens
YAPAMADGS

SEQ ID NO: 1254515 - protein, 9 aa, Homo Sapiens
PDAANNGSS

SEQ ID NO: 1254516 - protein, 9 aa, Homo Sapiens
EDHSAGSVE

SEQ ID NO: 1254517 - protein, 9 aa, Homo Sapiens
EPRAHTMAQ

SEQ ID NO: 1254518 - protein, 9 aa, Homo Sapiens
QVMLDSLGR

SEQ ID NO: 1254519 - protein, 9 aa, Homo Sapiens
ATEVTWTWA

SEQ ID NO: 1254520 - protein, 9 aa, Homo Sapiens
VSNKTYDSF

SEQ ID NO: 1254521 - protein, 9 aa, Homo Sapiens
EVHRAFLSD

SEQ ID NO: 1254522 - protein, 9 aa, Homo Sapiens
KIAVSSIQR

SEQ ID NO: 1254523 - protein, 9 aa, Homo Sapiens
SAQVDVGRD

SEQ ID NO: 1254524 - protein, 9 aa, Homo Sapiens
LVAIVICDY

SEQ ID NO: 1254525 - protein, 9 aa, Homo Sapiens
SPAAGDVLN

SEQ ID NO: 1254526 - protein, 9 aa, Homo Sapiens
MKMAHTPPG

SEQ ID NO: 1254527 - protein, 9 aa, Homo Sapiens
VTRLSSLKW

SEQ ID NO: 1254528 - protein, 9 aa, Homo Sapiens
PVLTTLELS

SEQ ID NO: 1254529 - protein, 9 aa, Homo Sapiens
HWDEMLIKP

SEQ ID NO: 1254530 - protein, 9 aa, Homo Sapiens
SFFCCFHDY

SEQ ID NO: 1254531 - protein, 9 aa, Homo Sapiens
WFLLDKHHT

SEQ ID NO: 1254532 - protein, 9 aa, Homo Sapiens
QLYTSGLLA

SEQ ID NO: 1254533 - protein, 9 aa, Homo Sapiens
GCIWWFFTL

SEQ ID NO: 1254534 - protein, 9 aa, Homo Sapiens
LLLCHLLAQ

SEQ ID NO: 1254535 - protein, 9 aa, Homo Sapiens
DTDDIVEKI

SEQ ID NO: 1254536 - protein, 9 aa, Homo Sapiens
STEGLMKSV

SEQ ID NO: 1254537 - protein, 9 aa, Homo Sapiens
HKNHYFEVL

SEQ ID NO: 1254538 - protein, 9 aa, Homo Sapiens
LHHMGLFDH

SEQ ID NO: 1254539 - protein, 9 aa, Homo Sapiens
SWQGKLRLQ

SEQ ID NO: 1254540 - protein, 9 aa, Homo Sapiens
ESGPGGQTP

SEQ ID NO: 1254541 - protein, 9 aa, Homo Sapiens
YHHRRSSGS

SEQ ID NO: 1254542 - protein, 9 aa, Homo Sapiens
ETWTAAAMY

SEQ ID NO: 1254543 - protein, 9 aa, Homo Sapiens
PGQCAGAWG

SEQ ID NO: 1254544 - protein, 9 aa, Homo Sapiens
RHEGVQTFL

SEQ ID NO: 1254545 - protein, 9 aa, Homo Sapiens
SELDHLLLE

SEQ ID NO: 1254546 - protein, 9 aa, Homo Sapiens
WICCLVTSF

SEQ ID NO: 1254547 - protein, 9 aa, Homo Sapiens
PLQRPVTPA

SEQ ID NO: 1254548 - protein, 9 aa, Homo Sapiens
KFQPKRLHV

SEQ ID NO: 1254549 - protein, 9 aa, Homo Sapiens
GFTSLMGMA

SEQ ID NO: 1254550 - protein, 9 aa, Homo Sapiens
YLVDMQHFR

SEQ ID NO: 1254551 - protein, 9 aa, Homo Sapiens
EMPRASTPH

SEQ ID NO: 1254552 - protein, 9 aa, Homo Sapiens
EGAVYPFVD

SEQ ID NO: 1254553 - protein, 9 aa, Homo Sapiens
TRYILHPQV

SEQ ID NO: 1254554 - protein, 9 aa, Homo Sapiens
EDGIFLLGC

SEQ ID NO: 1254555 - protein, 9 aa, Homo Sapiens
FSRYASIKD

SEQ ID NO: 1254556 - protein, 9 aa, Homo Sapiens
DEKFLRRND

SEQ ID NO: 1254557 - protein, 9 aa, Homo Sapiens
QQTENLLKM

SEQ ID NO: 1254558 - protein, 9 aa, Homo Sapiens
TRLEAMFSM

SEQ ID NO: 1254559 - protein, 9 aa, Homo Sapiens
IYKPDFFIK

SEQ ID NO: 1254560 - protein, 9 aa, Homo Sapiens
VTAKHLSRL

SEQ ID NO: 1254561 - protein, 9 aa, Homo Sapiens
VNTELNAQI

SEQ ID NO: 1254562 - protein, 9 aa, Homo Sapiens
DTHCLRDVQ

SEQ ID NO: 1254563 - protein, 9 aa, Homo Sapiens
KRCTYDALN

SEQ ID NO: 1254564 - protein, 9 aa, Homo Sapiens
QYFGVLQRS

SEQ ID NO: 1254565 - protein, 9 aa, Homo Sapiens
CHVLAFLGM

SEQ ID NO: 1254566 - protein, 9 aa, Homo Sapiens
QYSILQTAI

SEQ ID NO: 1254567 - protein, 9 aa, Homo Sapiens
ERGCKKIKA

SEQ ID NO: 1254568 - protein, 9 aa, Homo Sapiens
IKQGDLPPS

SEQ ID NO: 1254569 - protein, 9 aa, Homo Sapiens
QSCPPSSLA

SEQ ID NO: 1254570 - protein, 9 aa, Homo Sapiens
SDEYGDKTT

SEQ ID NO: 1254571 - protein, 9 aa, Homo Sapiens
VLQSRWHSA

SEQ ID NO: 1254572 - protein, 9 aa, Homo Sapiens
GARRTVTST

SEQ ID NO: 1254573 - protein, 9 aa, Homo Sapiens
RFHYGRFQE

SEQ ID NO: 1254574 - protein, 9 aa, Homo Sapiens
HIKYFKVLI

SEQ ID NO: 1254575 - protein, 9 aa, Homo Sapiens
EHRIRIRRQ

SEQ ID NO: 1254576 - protein, 9 aa, Homo Sapiens
LTGVHTVAN

SEQ ID NO: 1254577 - protein, 9 aa, Homo Sapiens
DGRHLRNLL

SEQ ID NO: 1254578 - protein, 9 aa, Homo Sapiens
AGPHSCIGE

SEQ ID NO: 1254579 - protein, 9 aa, Homo Sapiens
IDAFSWLGH

SEQ ID NO: 1254580 - protein, 9 aa, Homo Sapiens
PSGMEHIMH

SEQ ID NO: 1254581 - protein, 9 aa, Homo Sapiens
RAHMAQRLD

SEQ ID NO: 1254582 - protein, 9 aa, Homo Sapiens
TDHAISMDL

SEQ ID NO: 1254583 - protein, 9 aa, Homo Sapiens
QVFVGFLFP

SEQ ID NO: 1254584 - protein, 9 aa, Homo Sapiens
HKPHISNKP

SEQ ID NO: 1254585 - protein, 9 aa, Homo Sapiens
NALRHEKQK

SEQ ID NO: 1254586 - protein, 9 aa, Homo Sapiens
RWLLEYVKW

SEQ ID NO: 1254587 - protein, 9 aa, Homo Sapiens
TPWPLPMCC

SEQ ID NO: 1254588 - protein, 9 aa, Homo Sapiens
ICVTGSQNE

SEQ ID NO: 1254589 - protein, 9 aa, Homo Sapiens
PGPLSGVVN

SEQ ID NO: 1254590 - protein, 9 aa, Homo Sapiens
FANSMVFLH

SEQ ID NO: 1254591 - protein, 9 aa, Homo Sapiens
DQNSRLARA

SEQ ID NO: 1254592 - protein, 9 aa, Homo Sapiens
VRKEEETDV

SEQ ID NO: 1254593 - protein, 9 aa, Homo Sapiens
WEEQREEWK

SEQ ID NO: 1254594 - protein, 9 aa, Homo Sapiens
KGRKYMDVN

SEQ ID NO: 1254595 - protein, 9 aa, Homo Sapiens
EWERSYFGS

SEQ ID NO: 1254596 - protein, 9 aa, Homo Sapiens
PRVAPQQCV

SEQ ID NO: 1254597 - protein, 9 aa, Homo Sapiens
VLTNLSHAF

SEQ ID NO: 1254598 - protein, 9 aa, Homo Sapiens
KLSQSPEQQ

SEQ ID NO: 1254599 - protein, 9 aa, Homo Sapiens
ISKSQVEDP

SEQ ID NO: 1254600 - protein, 9 aa, Homo Sapiens
KDRHMENLV

SEQ ID NO: 1254601 - protein, 9 aa, Homo Sapiens
PERKCFPGN

SEQ ID NO: 1254602 - protein, 9 aa, Homo Sapiens
HLCCELSPG

SEQ ID NO: 1254603 - protein, 9 aa, Homo Sapiens
NETYRHIVK

SEQ ID NO: 1254604 - protein, 9 aa, Homo Sapiens
IIVHIRTHT

SEQ ID NO: 1254605 - protein, 9 aa, Homo Sapiens
IQQTGPFWY

SEQ ID NO: 1254606 - protein, 9 aa, Homo Sapiens
LYVSDFKEK

SEQ ID NO: 1254607 - protein, 9 aa, Homo Sapiens
TQAFTNYNI

SEQ ID NO: 1254608 - protein, 9 aa, Homo Sapiens
GSLEEMKEV

SEQ ID NO: 1254609 - protein, 9 aa, Homo Sapiens
MLEVLSQKK

SEQ ID NO: 1254610 - protein, 9 aa, Homo Sapiens
EYGGQKCST

SEQ ID NO: 1254611 - protein, 9 aa, Homo Sapiens
SIGRLCEHC

SEQ ID NO: 1254612 - protein, 9 aa, Homo Sapiens
YLSMGGLGE

SEQ ID NO: 1254613 - protein, 9 aa, Homo Sapiens
MDSDLLRLN

SEQ ID NO: 1254614 - protein, 9 aa, Homo Sapiens
LQVFKVPTS

SEQ ID NO: 1254615 - protein, 9 aa, Homo Sapiens
EEESFPEGS

SEQ ID NO: 1254616 - protein, 9 aa, Homo Sapiens
ESKQDPVKT

SEQ ID NO: 1254617 - protein, 9 aa, Homo Sapiens
TETVYDDRG

SEQ ID NO: 1254618 - protein, 9 aa, Homo Sapiens
QHRIALHIA

SEQ ID NO: 1254619 - protein, 9 aa, Homo Sapiens
MSDTRSSDP

SEQ ID NO: 1254620 - protein, 9 aa, Homo Sapiens
MSDTELFQH

SEQ ID NO: 1254621 - protein, 9 aa, Homo Sapiens
AASVSDWWP

SEQ ID NO: 1254622 - protein, 9 aa, Homo Sapiens
ALTQDHSMD

SEQ ID NO: 1254623 - protein, 9 aa, Homo Sapiens
LQTDVFVEL

SEQ ID NO: 1254624 - protein, 9 aa, Homo Sapiens
KFNFNTYKK

SEQ ID NO: 1254625 - protein, 9 aa, Homo Sapiens
ELDENALNR

SEQ ID NO: 1254626 - protein, 9 aa, Homo Sapiens
VHVPPSVLY

SEQ ID NO: 1254627 - protein, 9 aa, Homo Sapiens
LFTLHSCNR

SEQ ID NO: 1254628 - protein, 9 aa, Homo Sapiens
RRDVLYMPG

SEQ ID NO: 1254629 - protein, 9 aa, Homo Sapiens
HVCVQHQGD

SEQ ID NO: 1254630 - protein, 9 aa, Homo Sapiens
PVLPFMLAE

SEQ ID NO: 1254631 - protein, 9 aa, Homo Sapiens
TVMEELEDS

SEQ ID NO: 1254632 - protein, 9 aa, Homo Sapiens
HVQCTGQPL

SEQ ID NO: 1254633 - protein, 9 aa, Homo Sapiens
PLACSCSTS

SEQ ID NO: 1254634 - protein, 9 aa, Homo Sapiens
SVYVAHLDG

SEQ ID NO: 1254635 - protein, 9 aa, Homo Sapiens
QKETIKDIP

SEQ ID NO: 1254636 - protein, 9 aa, Homo Sapiens
CPANGAGWP

SEQ ID NO: 1254637 - protein, 9 aa, Homo Sapiens
RGCKKIKAE

SEQ ID NO: 1254638 - protein, 9 aa, Homo Sapiens
EAFTKNIFG

SEQ ID NO: 1254639 - protein, 9 aa, Homo Sapiens
VWDVRWDAE

SEQ ID NO: 1254640 - protein, 9 aa, Homo Sapiens
HKSHEYHEC

SEQ ID NO: 1254641 - protein, 9 aa, Homo Sapiens
KHLSSSTVA

SEQ ID NO: 1254642 - protein, 9 aa, Homo Sapiens
KWDMLKRAE

SEQ ID NO: 1254643 - protein, 9 aa, Homo Sapiens
TRPRVFYIG

SEQ ID NO: 1254644 - protein, 9 aa, Homo Sapiens
IFPHGIDIL

SEQ ID NO: 1254645 - protein, 9 aa, Homo Sapiens
GLVCEIGLH

SEQ ID NO: 1254646 - protein, 9 aa, Homo Sapiens
IYALRWKEL

SEQ ID NO: 1254647 - protein, 9 aa, Homo Sapiens
DQTVLFQGA

SEQ ID NO: 1254648 - protein, 9 aa, Homo Sapiens
PAHSHFFEP

SEQ ID NO: 1254649 - protein, 9 aa, Homo Sapiens
IMGVAGSLT

SEQ ID NO: 1254650 - protein, 9 aa, Homo Sapiens
QGTSWEPAQ

SEQ ID NO: 1254651 - protein, 9 aa, Homo Sapiens
VSTLTKAKL

SEQ ID NO: 1254652 - protein, 9 aa, Homo Sapiens
KISKIEIDA

SEQ ID NO: 1254653 - protein, 9 aa, Homo Sapiens
KMNLTLDFH

SEQ ID NO: 1254654 - protein, 9 aa, Homo Sapiens
GSSLGVVTK

SEQ ID NO: 1254655 - protein, 9 aa, Homo Sapiens
EVLGGVNDG

SEQ ID NO: 1254656 - protein, 9 aa, Homo Sapiens
VKDIQWALH

SEQ ID NO: 1254657 - protein, 9 aa, Homo Sapiens
TPEEEHTGM

SEQ ID NO: 1254658 - protein, 9 aa, Homo Sapiens
GAVSAQAEA

SEQ ID NO: 1254659 - protein, 9 aa, Homo Sapiens
SRNPCCLYW

SEQ ID NO: 1254660 - protein, 9 aa, Homo Sapiens
RLPLLLPRT

SEQ ID NO: 1254661 - protein, 9 aa, Homo Sapiens
IDAIKHFLD

SEQ ID NO: 1254662 - protein, 9 aa, Homo Sapiens
QSKAIMGCI

SEQ ID NO: 1254663 - protein, 9 aa, Homo Sapiens
DQVLIKQTG

SEQ ID NO: 1254664 - protein, 9 aa, Homo Sapiens
SPWEKRLTS

SEQ ID NO: 1254665 - protein, 9 aa, Homo Sapiens
SLSNVAGIF

SEQ ID NO: 1254666 - protein, 9 aa, Homo Sapiens
LIFSARVID

SEQ ID NO: 1254667 - protein, 9 aa, Homo Sapiens
PVFHVYPLL

SEQ ID NO: 1254668 - protein, 9 aa, Homo Sapiens
SHKQPVAFV

SEQ ID NO: 1254669 - protein, 9 aa, Homo Sapiens
QPGYCTFYD

SEQ ID NO: 1254670 - protein, 9 aa, Homo Sapiens
SVMCENENG

SEQ ID NO: 1254671 - protein, 9 aa, Homo Sapiens
EVGDSLEVV

SEQ ID NO: 1254672 - protein, 9 aa, Homo Sapiens
VIATHSPEE

SEQ ID NO: 1254673 - protein, 9 aa, Homo Sapiens
LQVYILTLI

SEQ ID NO: 1254674 - protein, 9 aa, Homo Sapiens
AVVHMNQED

SEQ ID NO: 1254675 - protein, 9 aa, Homo Sapiens
DSHTALHVA

SEQ ID NO: 1254676 - protein, 9 aa, Homo Sapiens
TVVGGLGVV

SEQ ID NO: 1254677 - protein, 9 aa, Homo Sapiens
EMVFDGKHQ

SEQ ID NO: 1254678 - protein, 9 aa, Homo Sapiens
LKDFSFHFL

SEQ ID NO: 1254679 - protein, 9 aa, Homo Sapiens
CKYDWDSDD

SEQ ID NO: 1254680 - protein, 9 aa, Homo Sapiens
SRHDMQTTT

SEQ ID NO: 1254681 - protein, 9 aa, Homo Sapiens
GISLRGQGN

SEQ ID NO: 1254682 - protein, 9 aa, Homo Sapiens
KWHQRQNQT

SEQ ID NO: 1254683 - protein, 9 aa, Homo Sapiens
PPVGLNRVL

SEQ ID NO: 1254684 - protein, 9 aa, Homo Sapiens
ESSPCQTTC

SEQ ID NO: 1254685 - protein, 9 aa, Homo Sapiens
VPMLKLSYK

SEQ ID NO: 1254686 - protein, 9 aa, Homo Sapiens
NEFEMEGFF

SEQ ID NO: 1254687 - protein, 9 aa, Homo Sapiens
KSIQSKLSP

SEQ ID NO: 1254688 - protein, 9 aa, Homo Sapiens
CVCSFDHHC

SEQ ID NO: 1254689 - protein, 9 aa, Homo Sapiens
SAACPQEVA

SEQ ID NO: 1254690 - protein, 9 aa, Homo Sapiens
ACQDVNECE

SEQ ID NO: 1254691 - protein, 9 aa, Homo Sapiens
QLAQTDQHL

SEQ ID NO: 1254692 - protein, 9 aa, Homo Sapiens
SYNSHWDPP

SEQ ID NO: 1254693 - protein, 9 aa, Homo Sapiens
CLIDKRQWN

SEQ ID NO: 1254694 - protein, 9 aa, Homo Sapiens
KELGRDRQS

SEQ ID NO: 1254695 - protein, 9 aa, Homo Sapiens
KDAWVWDNI

SEQ ID NO: 1254696 - protein, 9 aa, Homo Sapiens
LITHTGEKP

SEQ ID NO: 1254697 - protein, 9 aa, Homo Sapiens
ERVIEPSSS

SEQ ID NO: 1254698 - protein, 9 aa, Homo Sapiens
PFEDRVGTI

SEQ ID NO: 1254699 - protein, 9 aa, Homo Sapiens
QHGKAFSYH

SEQ ID NO: 1254700 - protein, 9 aa, Homo Sapiens
SRTYPITTT

SEQ ID NO: 1254701 - protein, 9 aa, Homo Sapiens
HTGIHTDTH

SEQ ID NO: 1254702 - protein, 9 aa, Homo Sapiens
EDDYDTLTN

SEQ ID NO: 1254703 - protein, 9 aa, Homo Sapiens
TRNLQTVDM

SEQ ID NO: 1254704 - protein, 9 aa, Homo Sapiens
VCYTNHDLD

SEQ ID NO: 1254705 - protein, 9 aa, Homo Sapiens
PLTMIRVNS

SEQ ID NO: 1254706 - protein, 9 aa, Homo Sapiens
DCGQPNRHG

SEQ ID NO: 1254707 - protein, 9 aa, Homo Sapiens
GHTVMAPML

SEQ ID NO: 1254708 - protein, 9 aa, Homo Sapiens
NVKEAIKRL

SEQ ID NO: 1254709 - protein, 9 aa, Homo Sapiens
GISLLGVIA

SEQ ID NO: 1254710 - protein, 9 aa, Homo Sapiens
RSGGRMRGT

SEQ ID NO: 1254711 - protein, 9 aa, Homo Sapiens
TSYFIDRDS

SEQ ID NO: 1254712 - protein, 9 aa, Homo Sapiens
EDNNSTSAL

SEQ ID NO: 1254713 - protein, 9 aa, Homo Sapiens
GLMATYLAQ

SEQ ID NO: 1254714 - protein, 9 aa, Homo Sapiens
SKYKPTPIL

SEQ ID NO: 1254715 - protein, 9 aa, Homo Sapiens
PPRGGTNKD

SEQ ID NO: 1254716 - protein, 9 aa, Homo Sapiens
EKMLLERAS

SEQ ID NO: 1254717 - protein, 9 aa, Homo Sapiens
KMYLDGPFG

SEQ ID NO: 1254718 - protein, 9 aa, Homo Sapiens
FELMMHTVY

SEQ ID NO: 1254719 - protein, 9 aa, Homo Sapiens
HSNMLCWNQ

SEQ ID NO: 1254720 - protein, 9 aa, Homo Sapiens
GLVDGVTYP

SEQ ID NO: 1254721 - protein, 9 aa, Homo Sapiens
VDTNLHDYL

SEQ ID NO: 1254722 - protein, 9 aa, Homo Sapiens
MDVKDISFL

SEQ ID NO: 1254723 - protein, 9 aa, Homo Sapiens
ESSFYSISG

SEQ ID NO: 1254724 - protein, 9 aa, Homo Sapiens
QVTTTLKLI

SEQ ID NO: 1254725 - protein, 9 aa, Homo Sapiens
LFLALIQVC

SEQ ID NO: 1254726 - protein, 9 aa, Homo Sapiens
LHVANPVVN

SEQ ID NO: 1254727 - protein, 9 aa, Homo Sapiens
AKQTQTFTT

SEQ ID NO: 1254728 - protein, 9 aa, Homo Sapiens
AMFWWVSGL

SEQ ID NO: 1254729 - protein, 9 aa, Homo Sapiens
ENNKMEVLK

SEQ ID NO: 1254730 - protein, 9 aa, Homo Sapiens
QVLVDLAIM

SEQ ID NO: 1254731 - protein, 9 aa, Homo Sapiens
LEGYGIGVG

SEQ ID NO: 1254732 - protein, 9 aa, Homo Sapiens
TPHGLAPFP

SEQ ID NO: 1254733 - protein, 9 aa, Homo Sapiens
LLFLTHFTV

SEQ ID NO: 1254734 - protein, 9 aa, Homo Sapiens
LRETEATNV

SEQ ID NO: 1254735 - protein, 9 aa, Homo Sapiens
LEKELGSKH

SEQ ID NO: 1254736 - protein, 9 aa, Homo Sapiens
PCDTRLRIQ

SEQ ID NO: 1254737 - protein, 9 aa, Homo Sapiens
WQCLDTAHQ

SEQ ID NO: 1254738 - protein, 9 aa, Homo Sapiens
MLVATTVCC

SEQ ID NO: 1254739 - protein, 9 aa, Homo Sapiens
YTSSSDITE

SEQ ID NO: 1254740 - protein, 9 aa, Homo Sapiens
ILPTKRHYC

SEQ ID NO: 1254741 - protein, 9 aa, Homo Sapiens
GSETSKKHS

SEQ ID NO: 1254742 - protein, 9 aa, Homo Sapiens
GTEAFTKNI

SEQ ID NO: 1254743 - protein, 9 aa, Homo Sapiens
NIRGMMREL

SEQ ID NO: 1254744 - protein, 9 aa, Homo Sapiens
ASPTAIWRI

SEQ ID NO: 1254745 - protein, 9 aa, Homo Sapiens
AMWLSASHF

SEQ ID NO: 1254746 - protein, 9 aa, Homo Sapiens
LETLVLVGM

SEQ ID NO: 1254747 - protein, 9 aa, Homo Sapiens
CLIHNVQKD

SEQ ID NO: 1254748 - protein, 9 aa, Homo Sapiens
VTAGHHGDD

SEQ ID NO: 1254749 - protein, 9 aa, Homo Sapiens
NIAKYKGVC

SEQ ID NO: 1254750 - protein, 9 aa, Homo Sapiens
PSRCLVCGR

SEQ ID NO: 1254751 - protein, 9 aa, Homo Sapiens
NLVFIQYNM

SEQ ID NO: 1254752 - protein, 9 aa, Homo Sapiens
HGEDYKAMS

SEQ ID NO: 1254753 - protein, 9 aa, Homo Sapiens
GIVALHRAK

SEQ ID NO: 1254754 - protein, 9 aa, Homo Sapiens
GPRCLLCIC

SEQ ID NO: 1254755 - protein, 9 aa, Homo Sapiens
MLFKQQVWL

SEQ ID NO: 1254756 - protein, 9 aa, Homo Sapiens
FMTPSCSVL

SEQ ID NO: 1254757 - protein, 9 aa, Homo Sapiens
PGKDGKHSR

SEQ ID NO: 1254758 - protein, 9 aa, Homo Sapiens
ADEEHRIKM

SEQ ID NO: 1254759 - protein, 9 aa, Homo Sapiens
HMCLHRGER

SEQ ID NO: 1254760 - protein, 9 aa, Homo Sapiens
LHVKGGVSM

SEQ ID NO: 1254761 - protein, 9 aa, Homo Sapiens
TSPQLGTIT

SEQ ID NO: 1254762 - protein, 9 aa, Homo Sapiens
YTQTHIQAQ

SEQ ID NO: 1254763 - protein, 9 aa, Homo Sapiens
GRIGGGRNT

SEQ ID NO: 1254764 - protein, 9 aa, Homo Sapiens
VEEREPELY

SEQ ID NO: 1254765 - protein, 9 aa, Homo Sapiens
NGHYKTVDC

SEQ ID NO: 1254766 - protein, 9 aa, Homo Sapiens
NIFDLNNGS

SEQ ID NO: 1254767 - protein, 9 aa, Homo Sapiens
SNHPPSLAI

SEQ ID NO: 1254768 - protein, 9 aa, Homo Sapiens
GQAPQCVMA

SEQ ID NO: 1254769 - protein, 9 aa, Homo Sapiens
ISICNRDIS

SEQ ID NO: 1254770 - protein, 9 aa, Homo Sapiens
TWHFLSSRA

SEQ ID NO: 1254771 - protein, 9 aa, Homo Sapiens
QGKYPMIRN

SEQ ID NO: 1254772 - protein, 9 aa, Homo Sapiens
SRAPAKPRS

SEQ ID NO: 1254773 - protein, 9 aa, Homo Sapiens
LEQLENAIT

SEQ ID NO: 1254774 - protein, 9 aa, Homo Sapiens
RKKKGGKVM

SEQ ID NO: 1254775 - protein, 9 aa, Homo Sapiens
VPMQLRRDL

SEQ ID NO: 1254776 - protein, 9 aa, Homo Sapiens
CQVNIVGTS

SEQ ID NO: 1254777 - protein, 9 aa, Homo Sapiens
MTVTKLGCS

SEQ ID NO: 1254778 - protein, 9 aa, Homo Sapiens
FTSNEKEMM

SEQ ID NO: 1254779 - protein, 9 aa, Homo Sapiens
VPHSCALQE

SEQ ID NO: 1254780 - protein, 9 aa, Homo Sapiens
KDQRLKKKH

SEQ ID NO: 1254781 - protein, 9 aa, Homo Sapiens
GQGELIPLM

SEQ ID NO: 1254782 - protein, 9 aa, Homo Sapiens
CGHAFSQRS

SEQ ID NO: 1254783 - protein, 9 aa, Homo Sapiens
SEEMDWLQI

SEQ ID NO: 1254784 - protein, 9 aa, Homo Sapiens
RMVVSVVAL

SEQ ID NO: 1254785 - protein, 9 aa, Homo Sapiens
LEEMRKTAE

SEQ ID NO: 1254786 - protein, 9 aa, Homo Sapiens
LQENQKAQK

SEQ ID NO: 1254787 - protein, 9 aa, Homo Sapiens
AFHVGLHSA

SEQ ID NO: 1254788 - protein, 9 aa, Homo Sapiens
KPALYVSDF

SEQ ID NO: 1254789 - protein, 9 aa, Homo Sapiens
HSYGGESPH

SEQ ID NO: 1254790 - protein, 9 aa, Homo Sapiens
EHFGKYKSK

SEQ ID NO: 1254791 - protein, 9 aa, Homo Sapiens
LVRDPQVLI

SEQ ID NO: 1254792 - protein, 9 aa, Homo Sapiens
MECRMAAKL

SEQ ID NO: 1254793 - protein, 9 aa, Homo Sapiens
FHPLLINGS

SEQ ID NO: 1254794 - protein, 9 aa, Homo Sapiens
CGPKPEHRQ

SEQ ID NO: 1254795 - protein, 9 aa, Homo Sapiens
GSRTLKSAR

SEQ ID NO: 1254796 - protein, 9 aa, Homo Sapiens
LDLYVNITK

SEQ ID NO: 1254797 - protein, 9 aa, Homo Sapiens
THVDFPPRE

SEQ ID NO: 1254798 - protein, 9 aa, Homo Sapiens
QTIFLRQLV

SEQ ID NO: 1254799 - protein, 9 aa, Homo Sapiens
ICKDQCLPG

SEQ ID NO: 1254800 - protein, 9 aa, Homo Sapiens
PIKKRKKIH

SEQ ID NO: 1254801 - protein, 9 aa, Homo Sapiens
VPYHVVGLV

SEQ ID NO: 1254802 - protein, 9 aa, Homo Sapiens
CCLYASVLT

SEQ ID NO: 1254803 - protein, 9 aa, Homo Sapiens
ERHLKMWEQ

SEQ ID NO: 1254804 - protein, 9 aa, Homo Sapiens
ALERHVVQK

SEQ ID NO: 1254805 - protein, 9 aa, Homo Sapiens
CCGAIKERR

SEQ ID NO: 1254806 - protein, 9 aa, Homo Sapiens
CIAKKKTHV

SEQ ID NO: 1254807 - protein, 9 aa, Homo Sapiens
LRSVLRMAL

SEQ ID NO: 1254808 - protein, 9 aa, Homo Sapiens
FSNNGGKWL

SEQ ID NO: 1254809 - protein, 9 aa, Homo Sapiens
LNNLIVNAE

SEQ ID NO: 1254810 - protein, 9 aa, Homo Sapiens
AWEVDTCWG

SEQ ID NO: 1254811 - protein, 9 aa, Homo Sapiens
QLIVTRDSQ

SEQ ID NO: 1254812 - protein, 9 aa, Homo Sapiens
SQVCPLTTE

SEQ ID NO: 1254813 - protein, 9 aa, Homo Sapiens
YFKCKEKMS

SEQ ID NO: 1254814 - protein, 9 aa, Homo Sapiens
STAFYQVFH

SEQ ID NO: 1254815 - protein, 9 aa, Homo Sapiens
PLPPAMKCY

SEQ ID NO: 1254816 - protein, 9 aa, Homo Sapiens
LLDRQWTLQ

SEQ ID NO: 1254817 - protein, 9 aa, Homo Sapiens
TGGIQTVED

SEQ ID NO: 1254818 - protein, 9 aa, Homo Sapiens
SMQLLYFFP

SEQ ID NO: 1254819 - protein, 9 aa, Homo Sapiens
QTRYVGQYD

SEQ ID NO: 1254820 - protein, 9 aa, Homo Sapiens
KPHRDTHGG

SEQ ID NO: 1254821 - protein, 9 aa, Homo Sapiens
QEARCREEG

SEQ ID NO: 1254822 - protein, 9 aa, Homo Sapiens
PMDHQATSL

SEQ ID NO: 1254823 - protein, 9 aa, Homo Sapiens
DAMAPDVEV

SEQ ID NO: 1254824 - protein, 9 aa, Homo Sapiens
YLGLEEWPE

SEQ ID NO: 1254825 - protein, 9 aa, Homo Sapiens
QLMPPSMGT

SEQ ID NO: 1254826 - protein, 9 aa, Homo Sapiens
TNNQLGDVT

SEQ ID NO: 1254827 - protein, 9 aa, Homo Sapiens
GRKYMDVNE

SEQ ID NO: 1254828 - protein, 9 aa, Homo Sapiens
WNEGKNATL

SEQ ID NO: 1254829 - protein, 9 aa, Homo Sapiens
SGTISQPQI

SEQ ID NO: 1254830 - protein, 9 aa, Homo Sapiens
ASVLLQTMY

SEQ ID NO: 1254831 - protein, 9 aa, Homo Sapiens
MIRQNEINN

SEQ ID NO: 1254832 - protein, 9 aa, Homo Sapiens
VCYPERITI

SEQ ID NO: 1254833 - protein, 9 aa, Homo Sapiens
IGIYASIKA

SEQ ID NO: 1254834 - protein, 9 aa, Homo Sapiens
EKETQQRRM

SEQ ID NO: 1254835 - protein, 9 aa, Homo Sapiens
CPFTMTRNK

SEQ ID NO: 1254836 - protein, 9 aa, Homo Sapiens
VTPAATETG

SEQ ID NO: 1254837 - protein, 9 aa, Homo Sapiens
GSTNLIVYI

SEQ ID NO: 1254838 - protein, 9 aa, Homo Sapiens
SGILQLGGR

SEQ ID NO: 1254839 - protein, 9 aa, Homo Sapiens
VPQHLQCLS

SEQ ID NO: 1254840 - protein, 9 aa, Homo Sapiens
VPQLPRPHV

SEQ ID NO: 1254841 - protein, 9 aa, Homo Sapiens
HPYGPPGGL

SEQ ID NO: 1254842 - protein, 9 aa, Homo Sapiens
LVHLFYFFY

SEQ ID NO: 1254843 - protein, 9 aa, Homo Sapiens
QHCSMILDE

SEQ ID NO: 1254844 - protein, 9 aa, Homo Sapiens
KKHMCLHRG

SEQ ID NO: 1254845 - protein, 9 aa, Homo Sapiens
PRKEFGCPD

SEQ ID NO: 1254846 - protein, 9 aa, Homo Sapiens
TKKYTKGVI

SEQ ID NO: 1254847 - protein, 9 aa, Homo Sapiens
QATKCATIL

SEQ ID NO: 1254848 - protein, 9 aa, Homo Sapiens
EEIVVWTNL

SEQ ID NO: 1254849 - protein, 9 aa, Homo Sapiens
PKKTKNISH

SEQ ID NO: 1254850 - protein, 9 aa, Homo Sapiens
MFGELTVEP

SEQ ID NO: 1254851 - protein, 9 aa, Homo Sapiens
RGRQPHVDF

SEQ ID NO: 1254852 - protein, 9 aa, Homo Sapiens
LLAVGQEDG

SEQ ID NO: 1254853 - protein, 9 aa, Homo Sapiens
ELENSEETS

SEQ ID NO: 1254854 - protein, 9 aa, Homo Sapiens
SINALLQVE

SEQ ID NO: 1254855 - protein, 9 aa, Homo Sapiens
LVCRAEKRL

SEQ ID NO: 1254856 - protein, 9 aa, Homo Sapiens
LMKSVDSKS

SEQ ID NO: 1254857 - protein, 9 aa, Homo Sapiens
PSLAYSTPQ

SEQ ID NO: 1254858 - protein, 9 aa, Homo Sapiens
DISEACISI

SEQ ID NO: 1254859 - protein, 9 aa, Homo Sapiens
TSKLEKQLM

SEQ ID NO: 1254860 - protein, 9 aa, Homo Sapiens
KCYGHRTGD

SEQ ID NO: 1254861 - protein, 9 aa, Homo Sapiens
LKGRKYMDV

SEQ ID NO: 1254862 - protein, 9 aa, Homo Sapiens
TTTTTEEQV

SEQ ID NO: 1254863 - protein, 9 aa, Homo Sapiens
SVDNFEDCS

SEQ ID NO: 1254864 - protein, 9 aa, Homo Sapiens
WFSEEAHRV

SEQ ID NO: 1254865 - protein, 9 aa, Homo Sapiens
SEDEFVGES

SEQ ID NO: 1254866 - protein, 9 aa, Homo Sapiens
VQRRKTINF

SEQ ID NO: 1254867 - protein, 9 aa, Homo Sapiens
VLKENGSMA

SEQ ID NO: 1254868 - protein, 9 aa, Homo Sapiens
RGECVIDAV

SEQ ID NO: 1254869 - protein, 9 aa, Homo Sapiens
ENWQNNLTD

SEQ ID NO: 1254870 - protein, 9 aa, Homo Sapiens
IREDEEHPR

SEQ ID NO: 1254871 - protein, 9 aa, Homo Sapiens
VPKGLENPP

SEQ ID NO: 1254872 - protein, 9 aa, Homo Sapiens
YEQKPAVLL

SEQ ID NO: 1254873 - protein, 9 aa, Homo Sapiens
LIDNDSYPI

SEQ ID NO: 1254874 - protein, 9 aa, Homo Sapiens
GFSDYPHLQ

SEQ ID NO: 1254875 - protein, 9 aa, Homo Sapiens
ELLSILGLP

SEQ ID NO: 1254876 - protein, 9 aa, Homo Sapiens
RHRVDFDLY

SEQ ID NO: 1254877 - protein, 9 aa, Homo Sapiens
MCQLFTTEL

SEQ ID NO: 1254878 - protein, 9 aa, Homo Sapiens
DSICQQNGL

SEQ ID NO: 1254879 - protein, 9 aa, Homo Sapiens
LRRCSDGKS

SEQ ID NO: 1254880 - protein, 9 aa, Homo Sapiens
QVTKQRGIL

SEQ ID NO: 1254881 - protein, 9 aa, Homo Sapiens
VFDGHPIES

SEQ ID NO: 1254882 - protein, 9 aa, Homo Sapiens
QNENIRKEK

SEQ ID NO: 1254883 - protein, 9 aa, Homo Sapiens
CDTNKKEEM

SEQ ID NO: 1254884 - protein, 9 aa, Homo Sapiens
RGTFSRIHL

SEQ ID NO: 1254885 - protein, 9 aa, Homo Sapiens
NSFNYQSFL

SEQ ID NO: 1254886 - protein, 9 aa, Homo Sapiens
QIKPLERHV

SEQ ID NO: 1254887 - protein, 9 aa, Homo Sapiens
RRRERERYP

SEQ ID NO: 1254888 - protein, 9 aa, Homo Sapiens
KGASGAFQL

SEQ ID NO: 1254889 - protein, 9 aa, Homo Sapiens
LVSVGYGIR

SEQ ID NO: 1254890 - protein, 9 aa, Homo Sapiens
SGGLEPKGE

SEQ ID NO: 1254891 - protein, 9 aa, Homo Sapiens
FYLVETEDT

SEQ ID NO: 1254892 - protein, 9 aa, Homo Sapiens
KAPAFGCQA

SEQ ID NO: 1254893 - protein, 9 aa, Homo Sapiens
PNSTGIRDP

SEQ ID NO: 1254894 - protein, 9 aa, Homo Sapiens
WSPTRPVVF

SEQ ID NO: 1254895 - protein, 9 aa, Homo Sapiens
DLGDKVVYC

SEQ ID NO: 1254896 - protein, 9 aa, Homo Sapiens
WITSFYNHS

SEQ ID NO: 1254897 - protein, 9 aa, Homo Sapiens
PAAEVSGRG

SEQ ID NO: 1254898 - protein, 9 aa, Homo Sapiens
VAERLHHPE

SEQ ID NO: 1254899 - protein, 9 aa, Homo Sapiens
ASLGKFLGK

SEQ ID NO: 1254900 - protein, 9 aa, Homo Sapiens
PWGFPERPY

SEQ ID NO: 1254901 - protein, 9 aa, Homo Sapiens
KILKLIHPP

SEQ ID NO: 1254902 - protein, 9 aa, Homo Sapiens
SKQREDDDE

SEQ ID NO: 1254903 - protein, 9 aa, Homo Sapiens
KRERMMLMK

SEQ ID NO: 1254904 - protein, 9 aa, Homo Sapiens
GTPDHPKAL

SEQ ID NO: 1254905 - protein, 9 aa, Homo Sapiens
CLRGGQAFQ

SEQ ID NO: 1254906 - protein, 9 aa, Homo Sapiens
QTKWRKKHA

SEQ ID NO: 1254907 - protein, 9 aa, Homo Sapiens
SELEKIVKQ

SEQ ID NO: 1254908 - protein, 9 aa, Homo Sapiens
QLQVILLSQ

SEQ ID NO: 1254909 - protein, 9 aa, Homo Sapiens
RFHSTPRVL

SEQ ID NO: 1254910 - protein, 9 aa, Homo Sapiens
GRGVDVLLA

SEQ ID NO: 1254911 - protein, 9 aa, Homo Sapiens
ATRPKPNVF

SEQ ID NO: 1254912 - protein, 9 aa, Homo Sapiens
RNIVCSGKF

SEQ ID NO: 1254913 - protein, 9 aa, Homo Sapiens
LSLLAKCYE

SEQ ID NO: 1254914 - protein, 9 aa, Homo Sapiens
TFVVAYAIQ

SEQ ID NO: 1254915 - protein, 9 aa, Homo Sapiens
VADHFKKGK

SEQ ID NO: 1254916 - protein, 9 aa, Homo Sapiens
RELLYFLDS

SEQ ID NO: 1254917 - protein, 9 aa, Homo Sapiens
LIELFLSFN

SEQ ID NO: 1254918 - protein, 9 aa, Homo Sapiens
KFVKTLKWG

SEQ ID NO: 1254919 - protein, 9 aa, Homo Sapiens
EEMCKREAE

SEQ ID NO: 1254920 - protein, 9 aa, Homo Sapiens
VIMMVYITE

SEQ ID NO: 1254921 - protein, 9 aa, Homo Sapiens
TPCLCPCWV

SEQ ID NO: 1254922 - protein, 9 aa, Homo Sapiens
IFDLPLKVL

SEQ ID NO: 1254923 - protein, 9 aa, Homo Sapiens
DIYTDVREL

SEQ ID NO: 1254924 - protein, 9 aa, Homo Sapiens
TNVILMEQI

SEQ ID NO: 1254925 - protein, 9 aa, Homo Sapiens
EVETGGIQT

SEQ ID NO: 1254926 - protein, 9 aa, Homo Sapiens
RALCTCLPS

SEQ ID NO: 1254927 - protein, 9 aa, Homo Sapiens
DSLVIFGPV

SEQ ID NO: 1254928 - protein, 9 aa, Homo Sapiens
KENRCAAIK

SEQ ID NO: 1254929 - protein, 9 aa, Homo Sapiens
TATAAVEER

SEQ ID NO: 1254930 - protein, 9 aa, Homo Sapiens
WRVASTQCA

SEQ ID NO: 1254931 - protein, 9 aa, Homo Sapiens
CVNFSHWSL

SEQ ID NO: 1254932 - protein, 9 aa, Homo Sapiens
AVTFCSAGP

SEQ ID NO: 1254933 - protein, 9 aa, Homo Sapiens
CPCSSCCSW

SEQ ID NO: 1254934 - protein, 9 aa, Homo Sapiens
SASRYHHRR

SEQ ID NO: 1254935 - protein, 9 aa, Homo Sapiens
KCYQYGKNF

SEQ ID NO: 1254936 - protein, 9 aa, Homo Sapiens
SARYAILQQ

SEQ ID NO: 1254937 - protein, 9 aa, Homo Sapiens
HSPFTVSPN

SEQ ID NO: 1254938 - protein, 9 aa, Homo Sapiens
RPEPSTRTL

SEQ ID NO: 1254939 - protein, 9 aa, Homo Sapiens
LLEPCPPYP

SEQ ID NO: 1254940 - protein, 9 aa, Homo Sapiens
DLEELAVNY

SEQ ID NO: 1254941 - protein, 9 aa, Homo Sapiens
SWEDSRTHT

SEQ ID NO: 1254942 - protein, 9 aa, Homo Sapiens
QGKRWLTAD

SEQ ID NO: 1254943 - protein, 9 aa, Homo Sapiens
FVGDKDVTR

SEQ ID NO: 1254944 - protein, 9 aa, Homo Sapiens
PGSDQIQLW

SEQ ID NO: 1254945 - protein, 9 aa, Homo Sapiens
QERFRSMIP

SEQ ID NO: 1254946 - protein, 9 aa, Homo Sapiens
CEATVISEQ

SEQ ID NO: 1254947 - protein, 9 aa, Homo Sapiens
RALVRDPQV

SEQ ID NO: 1254948 - protein, 9 aa, Homo Sapiens
WLTQCRDMP

SEQ ID NO: 1254949 - protein, 9 aa, Homo Sapiens
TLASPGPEP

SEQ ID NO: 1254950 - protein, 9 aa, Homo Sapiens
NVILMEQIK

SEQ ID NO: 1254951 - protein, 9 aa, Homo Sapiens
IYNCWEFPS

SEQ ID NO: 1254952 - protein, 9 aa, Homo Sapiens
FSLLTTAIL

SEQ ID NO: 1254953 - protein, 9 aa, Homo Sapiens
RGALERSEA

SEQ ID NO: 1254954 - protein, 9 aa, Homo Sapiens
DKEDDLFVI

SEQ ID NO: 1254955 - protein, 9 aa, Homo Sapiens
AELECEEDI

SEQ ID NO: 1254956 - protein, 9 aa, Homo Sapiens
ISPKKPKIQ

SEQ ID NO: 1254957 - protein, 9 aa, Homo Sapiens
TLNGSNVAE

SEQ ID NO: 1254958 - protein, 9 aa, Homo Sapiens
KAVAFSTTS

SEQ ID NO: 1254959 - protein, 9 aa, Homo Sapiens
DQECHLLVK

SEQ ID NO: 1254960 - protein, 9 aa, Homo Sapiens
EADGMFAYI

SEQ ID NO: 1254961 - protein, 9 aa, Homo Sapiens
EDYKITYWP

SEQ ID NO: 1254962 - protein, 9 aa, Homo Sapiens
YPSTSPRSL

SEQ ID NO: 1254963 - protein, 9 aa, Homo Sapiens
CTNNQLGDV

SEQ ID NO: 1254964 - protein, 9 aa, Homo Sapiens
AGLLSILVL

SEQ ID NO: 1254965 - protein, 9 aa, Homo Sapiens
PAGNNDNEH

SEQ ID NO: 1254966 - protein, 9 aa, Homo Sapiens
TQQEGKCLQ

SEQ ID NO: 1254967 - protein, 9 aa, Homo Sapiens
RAILQNYWT

SEQ ID NO: 1254968 - protein, 9 aa, Homo Sapiens
FLRADECKT

SEQ ID NO: 1254969 - protein, 9 aa, Homo Sapiens
PQVIMVVVV

SEQ ID NO: 1254970 - protein, 9 aa, Homo Sapiens
NGSQKKSVD

SEQ ID NO: 1254971 - protein, 9 aa, Homo Sapiens
TLPMYLGEL

SEQ ID NO: 1254972 - protein, 9 aa, Homo Sapiens
PGWTPRWTT

SEQ ID NO: 1254973 - protein, 9 aa, Homo Sapiens
VDQALIGMS

SEQ ID NO: 1254974 - protein, 9 aa, Homo Sapiens
LNDVFLEAD

SEQ ID NO: 1254975 - protein, 9 aa, Homo Sapiens
LNRIALMDA

SEQ ID NO: 1254976 - protein, 9 aa, Homo Sapiens
QFISNAGAG

SEQ ID NO: 1254977 - protein, 9 aa, Homo Sapiens
KCNGRRDAR

SEQ ID NO: 1254978 - protein, 9 aa, Homo Sapiens
VSPPVLGLE

SEQ ID NO: 1254979 - protein, 9 aa, Homo Sapiens
AGSGFGCGY

SEQ ID NO: 1254980 - protein, 9 aa, Homo Sapiens
LFLVAWLGL

SEQ ID NO: 1254981 - protein, 9 aa, Homo Sapiens
IPALSPKPA

SEQ ID NO: 1254982 - protein, 9 aa, Homo Sapiens
LQVTTTLKL

SEQ ID NO: 1254983 - protein, 9 aa, Homo Sapiens
GSSGGSDGG

SEQ ID NO: 1254984 - protein, 9 aa, Homo Sapiens
LSEPYHSPS

SEQ ID NO: 1254985 - protein, 9 aa, Homo Sapiens
PSSADDNIK

SEQ ID NO: 1254986 - protein, 9 aa, Homo Sapiens
PVRDCDGVL

SEQ ID NO: 1254987 - protein, 9 aa, Homo Sapiens
WDIPSCRQQ

SEQ ID NO: 1254988 - protein, 9 aa, Homo Sapiens
PCWFGAGGP

SEQ ID NO: 1254989 - protein, 9 aa, Homo Sapiens
ISETCSVRS

SEQ ID NO: 1254990 - protein, 9 aa, Homo Sapiens
WVEQLVLYM

SEQ ID NO: 1254991 - protein, 9 aa, Homo Sapiens
CGLIQWKAG

SEQ ID NO: 1254992 - protein, 9 aa, Homo Sapiens
LTKLDLLMI

SEQ ID NO: 1254993 - protein, 9 aa, Homo Sapiens
LAFIITFHI

SEQ ID NO: 1254994 - protein, 9 aa, Homo Sapiens
PCVEDLHHQ

SEQ ID NO: 1254995 - protein, 9 aa, Homo Sapiens
PDAFVCRII

SEQ ID NO: 1254996 - protein, 9 aa, Homo Sapiens
ILLDHPKAR

SEQ ID NO: 1254997 - protein, 9 aa, Homo Sapiens
LAKAKRRCS

SEQ ID NO: 1254998 - protein, 9 aa, Homo Sapiens
DAGDQTLES

SEQ ID NO: 1254999 - protein, 9 aa, Homo Sapiens
HLNINGALY

SEQ ID NO: 1255000 - protein, 9 aa, Homo Sapiens
LANKNCPVN

SEQ ID NO: 1255001 - protein, 9 aa, Homo Sapiens
DEEEEDDND

SEQ ID NO: 1255002 - protein, 9 aa, Homo Sapiens
ESFPSLAYS

SEQ ID NO: 1255003 - protein, 9 aa, Homo Sapiens
ITPRYIVLI

SEQ ID NO: 1255004 - protein, 9 aa, Homo Sapiens
CATCKGDKK

SEQ ID NO: 1255005 - protein, 9 aa, Homo Sapiens
RLQSGSVAP

SEQ ID NO: 1255006 - protein, 9 aa, Homo Sapiens
SILHPSRSG

SEQ ID NO: 1255007 - protein, 9 aa, Homo Sapiens
AWQWGGCRD

SEQ ID NO: 1255008 - protein, 9 aa, Homo Sapiens
EEENTFVKN

SEQ ID NO: 1255009 - protein, 9 aa, Homo Sapiens
GLLGVNEAG

SEQ ID NO: 1255010 - protein, 9 aa, Homo Sapiens
PISTAGEAD

SEQ ID NO: 1255011 - protein, 9 aa, Homo Sapiens
LYEKRNVSN

SEQ ID NO: 1255012 - protein, 9 aa, Homo Sapiens
GALYKNLVS

SEQ ID NO: 1255013 - protein, 9 aa, Homo Sapiens
NYNRPPVMT

SEQ ID NO: 1255014 - protein, 9 aa, Homo Sapiens
FKQEEMAVR

SEQ ID NO: 1255015 - protein, 9 aa, Homo Sapiens
QWRMDGSVD

SEQ ID NO: 1255016 - protein, 9 aa, Homo Sapiens
TINQLEQLR

SEQ ID NO: 1255017 - protein, 9 aa, Homo Sapiens
QFWSKYKLS

SEQ ID NO: 1255018 - protein, 9 aa, Homo Sapiens
QQYCMVSGL

SEQ ID NO: 1255019 - protein, 9 aa, Homo Sapiens
HSVTWSVTL

SEQ ID NO: 1255020 - protein, 9 aa, Homo Sapiens
DTNFFLSLI

SEQ ID NO: 1255021 - protein, 9 aa, Homo Sapiens
RLHHPEIAF

SEQ ID NO: 1255022 - protein, 9 aa, Homo Sapiens
IAVAERVAT

SEQ ID NO: 1255023 - protein, 9 aa, Homo Sapiens
IAHILHGGM

SEQ ID NO: 1255024 - protein, 9 aa, Homo Sapiens
CVMSERQVT

SEQ ID NO: 1255025 - protein, 9 aa, Homo Sapiens
NLVVSNPNR

SEQ ID NO: 1255026 - protein, 9 aa, Homo Sapiens
VHGPRAAED

SEQ ID NO: 1255027 - protein, 9 aa, Homo Sapiens
WDTPTIVSH

SEQ ID NO: 1255028 - protein, 9 aa, Homo Sapiens
NVKRSQGSS

SEQ ID NO: 1255029 - protein, 9 aa, Homo Sapiens
CHRIKMQRA

SEQ ID NO: 1255030 - protein, 9 aa, Homo Sapiens
NLVTQQISK

SEQ ID NO: 1255031 - protein, 9 aa, Homo Sapiens
LPCSSLPKT

SEQ ID NO: 1255032 - protein, 9 aa, Homo Sapiens
ASLGTDSSH

SEQ ID NO: 1255033 - protein, 9 aa, Homo Sapiens
SDNLTVSSE

SEQ ID NO: 1255034 - protein, 9 aa, Homo Sapiens
SSELQNNFI

SEQ ID NO: 1255035 - protein, 9 aa, Homo Sapiens
RRPYKGDLQ

SEQ ID NO: 1255036 - protein, 9 aa, Homo Sapiens
WARPGEITD

SEQ ID NO: 1255037 - protein, 9 aa, Homo Sapiens
QIGLCFPNH

SEQ ID NO: 1255038 - protein, 9 aa, Homo Sapiens
SHGKDKECV

SEQ ID NO: 1255039 - protein, 9 aa, Homo Sapiens
FFVVVISVE

SEQ ID NO: 1255040 - protein, 9 aa, Homo Sapiens
RDEVVKKLE

SEQ ID NO: 1255041 - protein, 9 aa, Homo Sapiens
KARVTNMKA

SEQ ID NO: 1255042 - protein, 9 aa, Homo Sapiens
TYRQKQGIV

SEQ ID NO: 1255043 - protein, 9 aa, Homo Sapiens
LRIPCTQAE

SEQ ID NO: 1255044 - protein, 9 aa, Homo Sapiens
YHISLQFDF

SEQ ID NO: 1255045 - protein, 9 aa, Homo Sapiens
IKGPENEEG

SEQ ID NO: 1255046 - protein, 9 aa, Homo Sapiens
RMDQWMDKE

SEQ ID NO: 1255047 - protein, 9 aa, Homo Sapiens
LIQGRRLAD

SEQ ID NO: 1255048 - protein, 9 aa, Homo Sapiens
YRRNEHGRH

SEQ ID NO: 1255049 - protein, 9 aa, Homo Sapiens
HIGFPFSFH

SEQ ID NO: 1255050 - protein, 9 aa, Homo Sapiens
LPEGVPQVN

SEQ ID NO: 1255051 - protein, 9 aa, Homo Sapiens
DVFLRRYTS

SEQ ID NO: 1255052 - protein, 9 aa, Homo Sapiens
SHLARHQQI

SEQ ID NO: 1255053 - protein, 9 aa, Homo Sapiens
RAVLEWDVG

SEQ ID NO: 1255054 - protein, 9 aa, Homo Sapiens
AAWPGWFMC

SEQ ID NO: 1255055 - protein, 9 aa, Homo Sapiens
HCLCMCWKQ

SEQ ID NO: 1255056 - protein, 9 aa, Homo Sapiens
NHIIYGFFN

SEQ ID NO: 1255057 - protein, 9 aa, Homo Sapiens
RPAFAGTSP

SEQ ID NO: 1255058 - protein, 9 aa, Homo Sapiens
IALKMRSVV

SEQ ID NO: 1255059 - protein, 9 aa, Homo Sapiens
RPSSEKIAT

SEQ ID NO: 1255060 - protein, 9 aa, Homo Sapiens
MTANDPVVA

SEQ ID NO: 1255061 - protein, 9 aa, Homo Sapiens
LPVGSHNIK

SEQ ID NO: 1255062 - protein, 9 aa, Homo Sapiens
EQHPAAEEA

SEQ ID NO: 1255063 - protein, 9 aa, Homo Sapiens
FDQNSYFYR

SEQ ID NO: 1255064 - protein, 9 aa, Homo Sapiens
MKQLQCWSR

SEQ ID NO: 1255065 - protein, 9 aa, Homo Sapiens
HNGHELRII

SEQ ID NO: 1255066 - protein, 9 aa, Homo Sapiens
GEEAIKPCH

SEQ ID NO: 1255067 - protein, 9 aa, Homo Sapiens
GDKLSESKS

SEQ ID NO: 1255068 - protein, 9 aa, Homo Sapiens
AVMCLITAP

SEQ ID NO: 1255069 - protein, 9 aa, Homo Sapiens
NGGMSMLDT

SEQ ID NO: 1255070 - protein, 9 aa, Homo Sapiens
VLPYHDSTQ

SEQ ID NO: 1255071 - protein, 9 aa, Homo Sapiens
TLQIDFADP

SEQ ID NO: 1255072 - protein, 9 aa, Homo Sapiens
LHIHTRTHM

SEQ ID NO: 1255073 - protein, 9 aa, Homo Sapiens
LALSSMICV

SEQ ID NO: 1255074 - protein, 9 aa, Homo Sapiens
TYVDPSDMH

SEQ ID NO: 1255075 - protein, 9 aa, Homo Sapiens
RNTGTEAPY

SEQ ID NO: 1255076 - protein, 9 aa, Homo Sapiens
LRDAKLDKV

SEQ ID NO: 1255077 - protein, 9 aa, Homo Sapiens
GECDGTACG

SEQ ID NO: 1255078 - protein, 9 aa, Homo Sapiens
FENVTQALG

SEQ ID NO: 1255079 - protein, 9 aa, Homo Sapiens
HKNSINFFT

SEQ ID NO: 1255080 - protein, 9 aa, Homo Sapiens
LVCVVMDVH

SEQ ID NO: 1255081 - protein, 9 aa, Homo Sapiens
HKGGCDSKM

SEQ ID NO: 1255082 - protein, 9 aa, Homo Sapiens
WSEDDQERI

SEQ ID NO: 1255083 - protein, 9 aa, Homo Sapiens
RLQHSEWAR

SEQ ID NO: 1255084 - protein, 9 aa, Homo Sapiens
NPCCLYWCC

SEQ ID NO: 1255085 - protein, 9 aa, Homo Sapiens
EDNFNCKLT

SEQ ID NO: 1255086 - protein, 9 aa, Homo Sapiens
AFLAETLLQ

SEQ ID NO: 1255087 - protein, 9 aa, Homo Sapiens
YILHGHPGC

SEQ ID NO: 1255088 - protein, 9 aa, Homo Sapiens
SCMGFFMPY

SEQ ID NO: 1255089 - protein, 9 aa, Homo Sapiens
QKERGLDIL

SEQ ID NO: 1255090 - protein, 9 aa, Homo Sapiens
APKEASGPG

SEQ ID NO: 1255091 - protein, 9 aa, Homo Sapiens
NAAVMASDS

SEQ ID NO: 1255092 - protein, 9 aa, Homo Sapiens
AFKKANWKK

SEQ ID NO: 1255093 - protein, 9 aa, Homo Sapiens
LREPYGPLG

SEQ ID NO: 1255094 - protein, 9 aa, Homo Sapiens
GLTLLKCGE

SEQ ID NO: 1255095 - protein, 9 aa, Homo Sapiens
SADYIHLTF

SEQ ID NO: 1255096 - protein, 9 aa, Homo Sapiens
KMMDKLKTH

SEQ ID NO: 1255097 - protein, 9 aa, Homo Sapiens
QERIIPCLA

SEQ ID NO: 1255098 - protein, 9 aa, Homo Sapiens
DLSGSDSDE

SEQ ID NO: 1255099 - protein, 9 aa, Homo Sapiens
ISNNAEQSA

SEQ ID NO: 1255100 - protein, 9 aa, Homo Sapiens
HMFWIGWGP

SEQ ID NO: 1255101 - protein, 9 aa, Homo Sapiens
NTTTLAEFG

SEQ ID NO: 1255102 - protein, 9 aa, Homo Sapiens
NDVAGEIDP

SEQ ID NO: 1255103 - protein, 9 aa, Homo Sapiens
PQQASVVIR

SEQ ID NO: 1255104 - protein, 9 aa, Homo Sapiens
CEDQKEDRA

SEQ ID NO: 1255105 - protein, 9 aa, Homo Sapiens
PLLSFLQQD

SEQ ID NO: 1255106 - protein, 9 aa, Homo Sapiens
TMESDIYTD

SEQ ID NO: 1255107 - protein, 9 aa, Homo Sapiens
NTGDAIDQM

SEQ ID NO: 1255108 - protein, 9 aa, Homo Sapiens
FGRLGHEPV

SEQ ID NO: 1255109 - protein, 9 aa, Homo Sapiens
GQSARAIMT

SEQ ID NO: 1255110 - protein, 9 aa, Homo Sapiens
IRKWGKLPG

SEQ ID NO: 1255111 - protein, 9 aa, Homo Sapiens
FPLAMHYLD

SEQ ID NO: 1255112 - protein, 9 aa, Homo Sapiens
ALSLEEISR

SEQ ID NO: 1255113 - protein, 9 aa, Homo Sapiens
KRGLQDGST

SEQ ID NO: 1255114 - protein, 9 aa, Homo Sapiens
KHYECIKCG

SEQ ID NO: 1255115 - protein, 9 aa, Homo Sapiens
PIPTCLASW

SEQ ID NO: 1255116 - protein, 9 aa, Homo Sapiens
FYRNGKYNL

SEQ ID NO: 1255117 - protein, 9 aa, Homo Sapiens
VARYFPVGN

SEQ ID NO: 1255118 - protein, 9 aa, Homo Sapiens
SPGMMRHLN

SEQ ID NO: 1255119 - protein, 9 aa, Homo Sapiens
ITALATKDG

SEQ ID NO: 1255120 - protein, 9 aa, Homo Sapiens
LLIFVKSWI

SEQ ID NO: 1255121 - protein, 9 aa, Homo Sapiens
VNFCGWASL

SEQ ID NO: 1255122 - protein, 9 aa, Homo Sapiens
GVCFGDGSL

SEQ ID NO: 1255123 - protein, 9 aa, Homo Sapiens
NKEVKAVMS

SEQ ID NO: 1255124 - protein, 9 aa, Homo Sapiens
AFKMSIFSP

SEQ ID NO: 1255125 - protein, 9 aa, Homo Sapiens
DECYHSDFN

SEQ ID NO: 1255126 - protein, 9 aa, Homo Sapiens
NHPAILNGR

SEQ ID NO: 1255127 - protein, 9 aa, Homo Sapiens
THLLVSQLR

SEQ ID NO: 1255128 - protein, 9 aa, Homo Sapiens
LLLALLNEH

SEQ ID NO: 1255129 - protein, 9 aa, Homo Sapiens
LTFIKCAYV

SEQ ID NO: 1255130 - protein, 9 aa, Homo Sapiens
EEPPLSPPN

SEQ ID NO: 1255131 - protein, 9 aa, Homo Sapiens
QREQVLLNA

SEQ ID NO: 1255132 - protein, 9 aa, Homo Sapiens
EHCEVDAHS

SEQ ID NO: 1255133 - protein, 9 aa, Homo Sapiens
IRAKKWVLR

SEQ ID NO: 1255134 - protein, 9 aa, Homo Sapiens
ISHVMQYGN

SEQ ID NO: 1255135 - protein, 9 aa, Homo Sapiens
VMTGLFTLC

SEQ ID NO: 1255136 - protein, 9 aa, Homo Sapiens
LDLRCQTHI

SEQ ID NO: 1255137 - protein, 9 aa, Homo Sapiens
WPFRCVDCG

SEQ ID NO: 1255138 - protein, 9 aa, Homo Sapiens
HSSCQPACC

SEQ ID NO: 1255139 - protein, 9 aa, Homo Sapiens
YKGTVDCVH

SEQ ID NO: 1255140 - protein, 9 aa, Homo Sapiens
IKHRGHARE

SEQ ID NO: 1255141 - protein, 9 aa, Homo Sapiens
LAQPPGPPA

SEQ ID NO: 1255142 - protein, 9 aa, Homo Sapiens
YGSGEVPMP

SEQ ID NO: 1255143 - protein, 9 aa, Homo Sapiens
SGHMEVLTD

SEQ ID NO: 1255144 - protein, 9 aa, Homo Sapiens
ENGSHLPAI

SEQ ID NO: 1255145 - protein, 9 aa, Homo Sapiens
SPLTSGISS

SEQ ID NO: 1255146 - protein, 9 aa, Homo Sapiens
SYCWVIGNQ

SEQ ID NO: 1255147 - protein, 9 aa, Homo Sapiens
NSCEIYGRR

SEQ ID NO: 1255148 - protein, 9 aa, Homo Sapiens
ANGITCTTV

SEQ ID NO: 1255149 - protein, 9 aa, Homo Sapiens
FDDILRVVI

SEQ ID NO: 1255150 - protein, 9 aa, Homo Sapiens
PPCCRWEAL

SEQ ID NO: 1255151 - protein, 9 aa, Homo Sapiens
KNMTKSTSV

SEQ ID NO: 1255152 - protein, 9 aa, Homo Sapiens
PPSLCHRLK

SEQ ID NO: 1255153 - protein, 9 aa, Homo Sapiens
IFMTLKNSK

SEQ ID NO: 1255154 - protein, 9 aa, Homo Sapiens
YAAHLELHV

SEQ ID NO: 1255155 - protein, 9 aa, Homo Sapiens
PHMLTTNLF

SEQ ID NO: 1255156 - protein, 9 aa, Homo Sapiens
LAGLLSRGN

SEQ ID NO: 1255157 - protein, 9 aa, Homo Sapiens
LHQASEDMK

SEQ ID NO: 1255158 - protein, 9 aa, Homo Sapiens
TNVKTVFFP

SEQ ID NO: 1255159 - protein, 9 aa, Homo Sapiens
VQWAILMDG

SEQ ID NO: 1255160 - protein, 9 aa, Homo Sapiens
SYSTLPMYL

SEQ ID NO: 1255161 - protein, 9 aa, Homo Sapiens
RDDPSGVIL

SEQ ID NO: 1255162 - protein, 9 aa, Homo Sapiens
IQDETMQPW

SEQ ID NO: 1255163 - protein, 9 aa, Homo Sapiens
SRQENDAEL

SEQ ID NO: 1255164 - protein, 9 aa, Homo Sapiens
AKTTRNVNS

SEQ ID NO: 1255165 - protein, 9 aa, Homo Sapiens
MKVMIPLLQ

SEQ ID NO: 1255166 - protein, 9 aa, Homo Sapiens
AMISVTQRG

SEQ ID NO: 1255167 - protein, 9 aa, Homo Sapiens
DSVLEIFKQ

SEQ ID NO: 1255168 - protein, 9 aa, Homo Sapiens
LYTSTAMIR

SEQ ID NO: 1255169 - protein, 9 aa, Homo Sapiens
PGFTSLMGM

SEQ ID NO: 1255170 - protein, 9 aa, Homo Sapiens
VASFEKSLG

SEQ ID NO: 1255171 - protein, 9 aa, Homo Sapiens
VDAVAMDFS

SEQ ID NO: 1255172 - protein, 9 aa, Homo Sapiens
LLRTSQEPA

SEQ ID NO: 1255173 - protein, 9 aa, Homo Sapiens
AEYQTTSPV

SEQ ID NO: 1255174 - protein, 9 aa, Homo Sapiens
ATLIWCLFF

SEQ ID NO: 1255175 - protein, 9 aa, Homo Sapiens
LGVVTPESF

SEQ ID NO: 1255176 - protein, 9 aa, Homo Sapiens
GKLFKLNHK

SEQ ID NO: 1255177 - protein, 9 aa, Homo Sapiens
YYASLKKDQ

SEQ ID NO: 1255178 - protein, 9 aa, Homo Sapiens
KGETVQEEL

SEQ ID NO: 1255179 - protein, 9 aa, Homo Sapiens
ISCIFVLYT

SEQ ID NO: 1255180 - protein, 9 aa, Homo Sapiens
LSSQQQATV

SEQ ID NO: 1255181 - protein, 9 aa, Homo Sapiens
LTDIQETHR

SEQ ID NO: 1255182 - protein, 9 aa, Homo Sapiens
HRHTGIHTD

SEQ ID NO: 1255183 - protein, 9 aa, Homo Sapiens
GIERNKGFP

SEQ ID NO: 1255184 - protein, 9 aa, Homo Sapiens
AQANTRKRD

SEQ ID NO: 1255185 - protein, 9 aa, Homo Sapiens
TLVSAMCTA

SEQ ID NO: 1255186 - protein, 9 aa, Homo Sapiens
TSPIRHCSH

SEQ ID NO: 1255187 - protein, 9 aa, Homo Sapiens
YRGEGTHDE

SEQ ID NO: 1255188 - protein, 9 aa, Homo Sapiens
NANMNLEIL

SEQ ID NO: 1255189 - protein, 9 aa, Homo Sapiens
IRHLQDVSG

SEQ ID NO: 1255190 - protein, 9 aa, Homo Sapiens
WGNYGKSYL

SEQ ID NO: 1255191 - protein, 9 aa, Homo Sapiens
KIDDYTVMP

SEQ ID NO: 1255192 - protein, 9 aa, Homo Sapiens
LFLGVTIGL

SEQ ID NO: 1255193 - protein, 9 aa, Homo Sapiens
APPHHRNIP

SEQ ID NO: 1255194 - protein, 9 aa, Homo Sapiens
RGTPSYSPY

SEQ ID NO: 1255195 - protein, 9 aa, Homo Sapiens
EESLVKWLA

SEQ ID NO: 1255196 - protein, 9 aa, Homo Sapiens
NGEKDTQTA

SEQ ID NO: 1255197 - protein, 9 aa, Homo Sapiens
QAGPWNTSS

SEQ ID NO: 1255198 - protein, 9 aa, Homo Sapiens
AVLFLQQGS

SEQ ID NO: 1255199 - protein, 9 aa, Homo Sapiens
FHVYPLLNC

SEQ ID NO: 1255200 - protein, 9 aa, Homo Sapiens
TKIQRDTHP

SEQ ID NO: 1255201 - protein, 9 aa, Homo Sapiens
RILSGKLVC

SEQ ID NO: 1255202 - protein, 9 aa, Homo Sapiens
ITLSITGKA

SEQ ID NO: 1255203 - protein, 9 aa, Homo Sapiens
QLQSVVGIG

SEQ ID NO: 1255204 - protein, 9 aa, Homo Sapiens
YHNLHIMIQ

SEQ ID NO: 1255205 - protein, 9 aa, Homo Sapiens
ESPQSGSES

SEQ ID NO: 1255206 - protein, 9 aa, Homo Sapiens
VHYPVSSNA

SEQ ID NO: 1255207 - protein, 9 aa, Homo Sapiens
SRHAIDGTF

SEQ ID NO: 1255208 - protein, 9 aa, Homo Sapiens
LENNKTMNW

SEQ ID NO: 1255209 - protein, 9 aa, Homo Sapiens
RVEMSEVTG

SEQ ID NO: 1255210 - protein, 9 aa, Homo Sapiens
DAKCVLEAH

SEQ ID NO: 1255211 - protein, 9 aa, Homo Sapiens
QKAMKCLRV

SEQ ID NO: 1255212 - protein, 9 aa, Homo Sapiens
GWTEEGRTV

SEQ ID NO: 1255213 - protein, 9 aa, Homo Sapiens
KPAKSKLAV

SEQ ID NO: 1255214 - protein, 9 aa, Homo Sapiens
VFVTSCNGY

SEQ ID NO: 1255215 - protein, 9 aa, Homo Sapiens
TVNYTLFES

SEQ ID NO: 1255216 - protein, 9 aa, Homo Sapiens
SADSRIYTE

SEQ ID NO: 1255217 - protein, 9 aa, Homo Sapiens
ISRLPLESV

SEQ ID NO: 1255218 - protein, 9 aa, Homo Sapiens
DRDFGVNGH

SEQ ID NO: 1255219 - protein, 9 aa, Homo Sapiens
EIYNQVIVV

SEQ ID NO: 1255220 - protein, 9 aa, Homo Sapiens
EVTAMGTEK

SEQ ID NO: 1255221 - protein, 9 aa, Homo Sapiens
DLIMLRLFE

SEQ ID NO: 1255222 - protein, 9 aa, Homo Sapiens
NILMLKGKS

SEQ ID NO: 1255223 - protein, 9 aa, Homo Sapiens
WIGIKWVTG

SEQ ID NO: 1255224 - protein, 9 aa, Homo Sapiens
LKLIHPPLK

SEQ ID NO: 1255225 - protein, 9 aa, Homo Sapiens
YTGVTDSTD

SEQ ID NO: 1255226 - protein, 9 aa, Homo Sapiens
TEVLEQCYR

SEQ ID NO: 1255227 - protein, 9 aa, Homo Sapiens
NTEDLLLSE

SEQ ID NO: 1255228 - protein, 9 aa, Homo Sapiens
PKHSASPKP

SEQ ID NO: 1255229 - protein, 9 aa, Homo Sapiens
EGDTHCLRD

SEQ ID NO: 1255230 - protein, 9 aa, Homo Sapiens
KVLKIHIDF

SEQ ID NO: 1255231 - protein, 9 aa, Homo Sapiens
TDNISSCMD

SEQ ID NO: 1255232 - protein, 9 aa, Homo Sapiens
LTVVCWAST

SEQ ID NO: 1255233 - protein, 9 aa, Homo Sapiens
KGEFLGQSD

SEQ ID NO: 1255234 - protein, 9 aa, Homo Sapiens
EVDATRGQV

SEQ ID NO: 1255235 - protein, 9 aa, Homo Sapiens
QTENLLKMR

SEQ ID NO: 1255236 - protein, 9 aa, Homo Sapiens
ETLLHSMVV

SEQ ID NO: 1255237 - protein, 9 aa, Homo Sapiens
GGVSLTSFL

SEQ ID NO: 1255238 - protein, 9 aa, Homo Sapiens
VKAINQQMG

SEQ ID NO: 1255239 - protein, 9 aa, Homo Sapiens
MPEFGDFAR

SEQ ID NO: 1255240 - protein, 9 aa, Homo Sapiens
LQDLAFLSP

SEQ ID NO: 1255241 - protein, 9 aa, Homo Sapiens
GHRLGNGVQ

SEQ ID NO: 1255242 - protein, 9 aa, Homo Sapiens
NDVKRLKHG

SEQ ID NO: 1255243 - protein, 9 aa, Homo Sapiens
LILSWDYSM

SEQ ID NO: 1255244 - protein, 9 aa, Homo Sapiens
FSRCFHHCN

SEQ ID NO: 1255245 - protein, 9 aa, Homo Sapiens
DQYSDDFCQ

SEQ ID NO: 1255246 - protein, 9 aa, Homo Sapiens
SSCPTLIYS

SEQ ID NO: 1255247 - protein, 9 aa, Homo Sapiens
SSGENKKTK

SEQ ID NO: 1255248 - protein, 9 aa, Homo Sapiens
LFDHQMVIC

SEQ ID NO: 1255249 - protein, 9 aa, Homo Sapiens
VDVMVIGWL

SEQ ID NO: 1255250 - protein, 9 aa, Homo Sapiens
EACISIVHM

SEQ ID NO: 1255251 - protein, 9 aa, Homo Sapiens
LGNGGAAKQ

SEQ ID NO: 1255252 - protein, 9 aa, Homo Sapiens
IYYLYEKRN

SEQ ID NO: 1255253 - protein, 9 aa, Homo Sapiens
HAEHVHTTV

SEQ ID NO: 1255254 - protein, 9 aa, Homo Sapiens
TAGSLSGPD

SEQ ID NO: 1255255 - protein, 9 aa, Homo Sapiens
CFSHICVIG

SEQ ID NO: 1255256 - protein, 9 aa, Homo Sapiens
NRVMAILCN

SEQ ID NO: 1255257 - protein, 9 aa, Homo Sapiens
LPDDQVITI

SEQ ID NO: 1255258 - protein, 9 aa, Homo Sapiens
YFPSSLGEV

SEQ ID NO: 1255259 - protein, 9 aa, Homo Sapiens
YDHVDEVMC

SEQ ID NO: 1255260 - protein, 9 aa, Homo Sapiens
FIPEGENMN

SEQ ID NO: 1255261 - protein, 9 aa, Homo Sapiens
IKHIDCHMT

SEQ ID NO: 1255262 - protein, 9 aa, Homo Sapiens
FSEEQLHQG

SEQ ID NO: 1255263 - protein, 9 aa, Homo Sapiens
KKRLRHRAP

SEQ ID NO: 1255264 - protein, 9 aa, Homo Sapiens
LLYQEGTKM

SEQ ID NO: 1255265 - protein, 9 aa, Homo Sapiens
PTFLRVALR

SEQ ID NO: 1255266 - protein, 9 aa, Homo Sapiens
SGARVPPTR

SEQ ID NO: 1255267 - protein, 9 aa, Homo Sapiens
ARAVREGMC

SEQ ID NO: 1255268 - protein, 9 aa, Homo Sapiens
HATTLIQSL

SEQ ID NO: 1255269 - protein, 9 aa, Homo Sapiens
FRPRTGKAV

SEQ ID NO: 1255270 - protein, 9 aa, Homo Sapiens
KISFKRKST

SEQ ID NO: 1255271 - protein, 9 aa, Homo Sapiens
NTGYCVCIL

SEQ ID NO: 1255272 - protein, 9 aa, Homo Sapiens
PSVNGRRMA

SEQ ID NO: 1255273 - protein, 9 aa, Homo Sapiens
AYDQRYSGS

SEQ ID NO: 1255274 - protein, 9 aa, Homo Sapiens
APPMWPPSS

SEQ ID NO: 1255275 - protein, 9 aa, Homo Sapiens
WNTQDENMR

SEQ ID NO: 1255276 - protein, 9 aa, Homo Sapiens
ECAEDKEAL

SEQ ID NO: 1255277 - protein, 9 aa, Homo Sapiens
DTVQLNVKY

SEQ ID NO: 1255278 - protein, 9 aa, Homo Sapiens
IGILQLAFL

SEQ ID NO: 1255279 - protein, 9 aa, Homo Sapiens
MRGSPGPLT

SEQ ID NO: 1255280 - protein, 9 aa, Homo Sapiens
GPARTGLLP

SEQ ID NO: 1255281 - protein, 9 aa, Homo Sapiens
PSGSRAPAK

SEQ ID NO: 1255282 - protein, 9 aa, Homo Sapiens
LLYAYSGLL

SEQ ID NO: 1255283 - protein, 9 aa, Homo Sapiens
IVLTVKSLP

SEQ ID NO: 1255284 - protein, 9 aa, Homo Sapiens
REPLVGTSE

SEQ ID NO: 1255285 - protein, 9 aa, Homo Sapiens
SVSVVLLNF

SEQ ID NO: 1255286 - protein, 9 aa, Homo Sapiens
QDDVKCLSE

SEQ ID NO: 1255287 - protein, 9 aa, Homo Sapiens
HMTPCRRRA

SEQ ID NO: 1255288 - protein, 9 aa, Homo Sapiens
HFGVWAEMV

SEQ ID NO: 1255289 - protein, 9 aa, Homo Sapiens
NILLNIVHS

SEQ ID NO: 1255290 - protein, 9 aa, Homo Sapiens
FLSSVSSFV

SEQ ID NO: 1255291 - protein, 9 aa, Homo Sapiens
RQGYQAGQT

SEQ ID NO: 1255292 - protein, 9 aa, Homo Sapiens
NPVFCMTEE

SEQ ID NO: 1255293 - protein, 9 aa, Homo Sapiens
LGVPSHHIL

SEQ ID NO: 1255294 - protein, 9 aa, Homo Sapiens
TNPSKISGS

SEQ ID NO: 1255295 - protein, 9 aa, Homo Sapiens
MLDSLGRPT

SEQ ID NO: 1255296 - protein, 9 aa, Homo Sapiens
RHMVVQCGN

SEQ ID NO: 1255297 - protein, 9 aa, Homo Sapiens
DWAANVYGI

SEQ ID NO: 1255298 - protein, 9 aa, Homo Sapiens
VQLQHLGTP

SEQ ID NO: 1255299 - protein, 9 aa, Homo Sapiens
TARTVQILG

SEQ ID NO: 1255300 - protein, 9 aa, Homo Sapiens
FEEEPEETL

SEQ ID NO: 1255301 - protein, 9 aa, Homo Sapiens
WPHTGPTNY

SEQ ID NO: 1255302 - protein, 9 aa, Homo Sapiens
CPISRTYTR

SEQ ID NO: 1255303 - protein, 9 aa, Homo Sapiens
YRLRMHLGL

SEQ ID NO: 1255304 - protein, 9 aa, Homo Sapiens
GRYYNEAGI

SEQ ID NO: 1255305 - protein, 9 aa, Homo Sapiens
LKCLATVAP

SEQ ID NO: 1255306 - protein, 9 aa, Homo Sapiens
LRILTIGTR

SEQ ID NO: 1255307 - protein, 9 aa, Homo Sapiens
NPPTFETFT

SEQ ID NO: 1255308 - protein, 9 aa, Homo Sapiens
WLACSNTRI

SEQ ID NO: 1255309 - protein, 9 aa, Homo Sapiens
SVGSVPGIT

SEQ ID NO: 1255310 - protein, 9 aa, Homo Sapiens
HCAFSIPNN

SEQ ID NO: 1255311 - protein, 9 aa, Homo Sapiens
TTMLNPLIY

SEQ ID NO: 1255312 - protein, 9 aa, Homo Sapiens
RVQFLGFSW

SEQ ID NO: 1255313 - protein, 9 aa, Homo Sapiens
RSRTSLMDC

SEQ ID NO: 1255314 - protein, 9 aa, Homo Sapiens
ATDSLYMFG

SEQ ID NO: 1255315 - protein, 9 aa, Homo Sapiens
ITPLSLAKK

SEQ ID NO: 1255316 - protein, 9 aa, Homo Sapiens
RLFPLASLA

SEQ ID NO: 1255317 - protein, 9 aa, Homo Sapiens
SNWRKGENE

SEQ ID NO: 1255318 - protein, 9 aa, Homo Sapiens
VLGLYVYDD

SEQ ID NO: 1255319 - protein, 9 aa, Homo Sapiens
LCYQISCVL

SEQ ID NO: 1255320 - protein, 9 aa, Homo Sapiens
TRLHPQKRA

SEQ ID NO: 1255321 - protein, 9 aa, Homo Sapiens
AMPCSRPRS

SEQ ID NO: 1255322 - protein, 9 aa, Homo Sapiens
PVISAFVGD

SEQ ID NO: 1255323 - protein, 9 aa, Homo Sapiens
RWLENKPII

SEQ ID NO: 1255324 - protein, 9 aa, Homo Sapiens
IISILYHQL

SEQ ID NO: 1255325 - protein, 9 aa, Homo Sapiens
IELSCMDTY

SEQ ID NO: 1255326 - protein, 9 aa, Homo Sapiens
QQKLLIKMK

SEQ ID NO: 1255327 - protein, 9 aa, Homo Sapiens
KDYKPTRML

SEQ ID NO: 1255328 - protein, 9 aa, Homo Sapiens
LSIMSFVDI

SEQ ID NO: 1255329 - protein, 9 aa, Homo Sapiens
TLAGIKTLT

SEQ ID NO: 1255330 - protein, 9 aa, Homo Sapiens
HRYSRDLRD

SEQ ID NO: 1255331 - protein, 9 aa, Homo Sapiens
GVSGSGKFT

SEQ ID NO: 1255332 - protein, 9 aa, Homo Sapiens
REKPVYYAL

SEQ ID NO: 1255333 - protein, 9 aa, Homo Sapiens
EKCGYNKGY

SEQ ID NO: 1255334 - protein, 9 aa, Homo Sapiens
TPSIHRTPR

SEQ ID NO: 1255335 - protein, 9 aa, Homo Sapiens
YGTGGHMMN

SEQ ID NO: 1255336 - protein, 9 aa, Homo Sapiens
PVAQLCLGE

SEQ ID NO: 1255337 - protein, 9 aa, Homo Sapiens
KPVNEYACR

SEQ ID NO: 1255338 - protein, 9 aa, Homo Sapiens
LWPDQQLHI

SEQ ID NO: 1255339 - protein, 9 aa, Homo Sapiens
KETFWCERV

SEQ ID NO: 1255340 - protein, 9 aa, Homo Sapiens
INFSYFHAS

SEQ ID NO: 1255341 - protein, 9 aa, Homo Sapiens
FAFVRDLCD

SEQ ID NO: 1255342 - protein, 9 aa, Homo Sapiens
KAFTDMSNL

SEQ ID NO: 1255343 - protein, 9 aa, Homo Sapiens
RSLVKHICA

SEQ ID NO: 1255344 - protein, 9 aa, Homo Sapiens
MLLHIKKTI

SEQ ID NO: 1255345 - protein, 9 aa, Homo Sapiens
GLGSTECVI

SEQ ID NO: 1255346 - protein, 9 aa, Homo Sapiens
RHYCCALIA

SEQ ID NO: 1255347 - protein, 9 aa, Homo Sapiens
STPRSQWRC

SEQ ID NO: 1255348 - protein, 9 aa, Homo Sapiens
AKKWGSKGK

SEQ ID NO: 1255349 - protein, 9 aa, Homo Sapiens
IKLKTPRLS

SEQ ID NO: 1255350 - protein, 9 aa, Homo Sapiens
YVSKIKQKL

SEQ ID NO: 1255351 - protein, 9 aa, Homo Sapiens
MEQDKIVSV

SEQ ID NO: 1255352 - protein, 9 aa, Homo Sapiens
VALERRKIS

SEQ ID NO: 1255353 - protein, 9 aa, Homo Sapiens
CIFVHTSGF

SEQ ID NO: 1255354 - protein, 9 aa, Homo Sapiens
VLIKHSVMV

SEQ ID NO: 1255355 - protein, 9 aa, Homo Sapiens
WCLCSQPRR

SEQ ID NO: 1255356 - protein, 9 aa, Homo Sapiens
VINLVQDSL

SEQ ID NO: 1255357 - protein, 9 aa, Homo Sapiens
RKQPWGAGA

SEQ ID NO: 1255358 - protein, 9 aa, Homo Sapiens
IITPSEAKV

SEQ ID NO: 1255359 - protein, 9 aa, Homo Sapiens
EEECTNEPS

SEQ ID NO: 1255360 - protein, 9 aa, Homo Sapiens
FVAFPVSNI

SEQ ID NO: 1255361 - protein, 9 aa, Homo Sapiens
QRYSISKNL

SEQ ID NO: 1255362 - protein, 9 aa, Homo Sapiens
LTFLKRPEL

SEQ ID NO: 1255363 - protein, 9 aa, Homo Sapiens
VHMNSVERY

SEQ ID NO: 1255364 - protein, 9 aa, Homo Sapiens
EDLSDMEGG

SEQ ID NO: 1255365 - protein, 9 aa, Homo Sapiens
ALLFGDDDS

SEQ ID NO: 1255366 - protein, 9 aa, Homo Sapiens
GPGPRLQQM

SEQ ID NO: 1255367 - protein, 9 aa, Homo Sapiens
KSEPRRIKY

SEQ ID NO: 1255368 - protein, 9 aa, Homo Sapiens
DAKKSCTYI

SEQ ID NO: 1255369 - protein, 9 aa, Homo Sapiens
DVIVLGADT

SEQ ID NO: 1255370 - protein, 9 aa, Homo Sapiens
VPSTLWKSK

SEQ ID NO: 1255371 - protein, 9 aa, Homo Sapiens
EEEMSDGSQ

SEQ ID NO: 1255372 - protein, 9 aa, Homo Sapiens
IYKNILSEI

SEQ ID NO: 1255373 - protein, 9 aa, Homo Sapiens
APQCVMAFD

SEQ ID NO: 1255374 - protein, 9 aa, Homo Sapiens
PNNKCIYFL

SEQ ID NO: 1255375 - protein, 9 aa, Homo Sapiens
TVTSTRKRP

SEQ ID NO: 1255376 - protein, 9 aa, Homo Sapiens
EVARTTAGW

SEQ ID NO: 1255377 - protein, 9 aa, Homo Sapiens
GHWSLTRPR

SEQ ID NO: 1255378 - protein, 9 aa, Homo Sapiens
FLPIEDNCG

SEQ ID NO: 1255379 - protein, 9 aa, Homo Sapiens
GKWWGEEVA

SEQ ID NO: 1255380 - protein, 9 aa, Homo Sapiens
LRRKESSRT

SEQ ID NO: 1255381 - protein, 9 aa, Homo Sapiens
SELEPISLS

SEQ ID NO: 1255382 - protein, 9 aa, Homo Sapiens
SSDHPISAP

SEQ ID NO: 1255383 - protein, 9 aa, Homo Sapiens
TMNRTNINV

SEQ ID NO: 1255384 - protein, 9 aa, Homo Sapiens
EHEEKIMKL

SEQ ID NO: 1255385 - protein, 9 aa, Homo Sapiens
PDSLDNVEV

SEQ ID NO: 1255386 - protein, 9 aa, Homo Sapiens
YIGDNTTVN

SEQ ID NO: 1255387 - protein, 9 aa, Homo Sapiens
PPVKVRTKA

SEQ ID NO: 1255388 - protein, 9 aa, Homo Sapiens
VVYKDVIVL

SEQ ID NO: 1255389 - protein, 9 aa, Homo Sapiens
MAAHSGTRC

SEQ ID NO: 1255390 - protein, 9 aa, Homo Sapiens
ACHSFCRRR

SEQ ID NO: 1255391 - protein, 9 aa, Homo Sapiens
SITSFDGVQ

SEQ ID NO: 1255392 - protein, 9 aa, Homo Sapiens
FFPRPTSLT

SEQ ID NO: 1255393 - protein, 9 aa, Homo Sapiens
DDMKSEEIT

SEQ ID NO: 1255394 - protein, 9 aa, Homo Sapiens
NVYYPTPKV

SEQ ID NO: 1255395 - protein, 9 aa, Homo Sapiens
RWWRRRICA

SEQ ID NO: 1255396 - protein, 9 aa, Homo Sapiens
PWLHACMIR

SEQ ID NO: 1255397 - protein, 9 aa, Homo Sapiens
TCAIRNEVT

SEQ ID NO: 1255398 - protein, 9 aa, Homo Sapiens
LVISVCYIL

SEQ ID NO: 1255399 - protein, 9 aa, Homo Sapiens
LHPLRALSR

SEQ ID NO: 1255400 - protein, 9 aa, Homo Sapiens
YGNSDYKRT

SEQ ID NO: 1255401 - protein, 9 aa, Homo Sapiens
ELIFSARVI

SEQ ID NO: 1255402 - protein, 9 aa, Homo Sapiens
HCSMAANTF

SEQ ID NO: 1255403 - protein, 9 aa, Homo Sapiens
CKYACHKKY

SEQ ID NO: 1255404 - protein, 9 aa, Homo Sapiens
KQEESLKRC

SEQ ID NO: 1255405 - protein, 9 aa, Homo Sapiens
HMGVQQVMA

SEQ ID NO: 1255406 - protein, 9 aa, Homo Sapiens
DNTKPNPVT

SEQ ID NO: 1255407 - protein, 9 aa, Homo Sapiens
SWSSWGPLA

SEQ ID NO: 1255408 - protein, 9 aa, Homo Sapiens
VMAMFKLLN

SEQ ID NO: 1255409 - protein, 9 aa, Homo Sapiens
DNPSIFPES

SEQ ID NO: 1255410 - protein, 9 aa, Homo Sapiens
PSGMVIFNL

SEQ ID NO: 1255411 - protein, 9 aa, Homo Sapiens
AEWLSEGRN

SEQ ID NO: 1255412 - protein, 9 aa, Homo Sapiens
EQLHAAWCD

SEQ ID NO: 1255413 - protein, 9 aa, Homo Sapiens
ESKKGLNQR

SEQ ID NO: 1255414 - protein, 9 aa, Homo Sapiens
ASLALIYWV

SEQ ID NO: 1255415 - protein, 9 aa, Homo Sapiens
LYISLNKVI

SEQ ID NO: 1255416 - protein, 9 aa, Homo Sapiens
VSTYDGLAL

SEQ ID NO: 1255417 - protein, 9 aa, Homo Sapiens
ALKILLDHP

SEQ ID NO: 1255418 - protein, 9 aa, Homo Sapiens
TPGERGPTG

SEQ ID NO: 1255419 - protein, 9 aa, Homo Sapiens
LYPNTNYEV

SEQ ID NO: 1255420 - protein, 9 aa, Homo Sapiens
IEALEWHVI

SEQ ID NO: 1255421 - protein, 9 aa, Homo Sapiens
GKHQHTNVC

SEQ ID NO: 1255422 - protein, 9 aa, Homo Sapiens
LDNDKNCYS

SEQ ID NO: 1255423 - protein, 9 aa, Homo Sapiens
LSHPCANGI

SEQ ID NO: 1255424 - protein, 9 aa, Homo Sapiens
GGGWGWGNM

SEQ ID NO: 1255425 - protein, 9 aa, Homo Sapiens
VRTVVMTVT

SEQ ID NO: 1255426 - protein, 9 aa, Homo Sapiens
FPPLEKVHY

SEQ ID NO: 1255427 - protein, 9 aa, Homo Sapiens
KIQQNICVI

SEQ ID NO: 1255428 - protein, 9 aa, Homo Sapiens
VREQYKTDA

SEQ ID NO: 1255429 - protein, 9 aa, Homo Sapiens
ETQSCPPSS

SEQ ID NO: 1255430 - protein, 9 aa, Homo Sapiens
VYLKAFLLR

SEQ ID NO: 1255431 - protein, 9 aa, Homo Sapiens
KWWGEEVAV

SEQ ID NO: 1255432 - protein, 9 aa, Homo Sapiens
NRCAAIKES

SEQ ID NO: 1255433 - protein, 9 aa, Homo Sapiens
EIVRLCTIG

SEQ ID NO: 1255434 - protein, 9 aa, Homo Sapiens
LLLEDRYNV

SEQ ID NO: 1255435 - protein, 9 aa, Homo Sapiens
QQLQSGEKY

SEQ ID NO: 1255436 - protein, 9 aa, Homo Sapiens
DAGMQLLCE

SEQ ID NO: 1255437 - protein, 9 aa, Homo Sapiens
PEKLHLKEE

SEQ ID NO: 1255438 - protein, 9 aa, Homo Sapiens
WVMILKLPF

SEQ ID NO: 1255439 - protein, 9 aa, Homo Sapiens
IKDKALNAL

SEQ ID NO: 1255440 - protein, 9 aa, Homo Sapiens
SSEQVLKFC

SEQ ID NO: 1255441 - protein, 9 aa, Homo Sapiens
TDSALMPHI

SEQ ID NO: 1255442 - protein, 9 aa, Homo Sapiens
GNLRSRKLV

SEQ ID NO: 1255443 - protein, 9 aa, Homo Sapiens
TIAIKRYFS

SEQ ID NO: 1255444 - protein, 9 aa, Homo Sapiens
NPALNEFQK

SEQ ID NO: 1255445 - protein, 9 aa, Homo Sapiens
EWLSEGRNA

SEQ ID NO: 1255446 - protein, 9 aa, Homo Sapiens
VIDIGTFDI

SEQ ID NO: 1255447 - protein, 9 aa, Homo Sapiens
SMSTKKIQK

SEQ ID NO: 1255448 - protein, 9 aa, Homo Sapiens
LELNVEKTE

SEQ ID NO: 1255449 - protein, 9 aa, Homo Sapiens
LQPGTRPPR

SEQ ID NO: 1255450 - protein, 9 aa, Homo Sapiens
KGLVTVITG

SEQ ID NO: 1255451 - protein, 9 aa, Homo Sapiens
VIKTRYHIV

SEQ ID NO: 1255452 - protein, 9 aa, Homo Sapiens
GGLGYGYVG

SEQ ID NO: 1255453 - protein, 9 aa, Homo Sapiens
TPGRPWPPS

SEQ ID NO: 1255454 - protein, 9 aa, Homo Sapiens
TEAAAGTGC

SEQ ID NO: 1255455 - protein, 9 aa, Homo Sapiens
TNLFIAQSI

SEQ ID NO: 1255456 - protein, 9 aa, Homo Sapiens
ERSHFSLNL

SEQ ID NO: 1255457 - protein, 9 aa, Homo Sapiens
ILEDEKPEY

SEQ ID NO: 1255458 - protein, 9 aa, Homo Sapiens
SLIKKRFVA

SEQ ID NO: 1255459 - protein, 9 aa, Homo Sapiens
YDSHTALHV

SEQ ID NO: 1255460 - protein, 9 aa, Homo Sapiens
SAHLLYFLF

SEQ ID NO: 1255461 - protein, 9 aa, Homo Sapiens
FDGHPIESL

SEQ ID NO: 1255462 - protein, 9 aa, Homo Sapiens
YLNVHRKIH

SEQ ID NO: 1255463 - protein, 9 aa, Homo Sapiens
WVQDESPEM

SEQ ID NO: 1255464 - protein, 9 aa, Homo Sapiens
DPDPANAPC

SEQ ID NO: 1255465 - protein, 9 aa, Homo Sapiens
VNEILSQLE

SEQ ID NO: 1255466 - protein, 9 aa, Homo Sapiens
RISRNGNVI

SEQ ID NO: 1255467 - protein, 9 aa, Homo Sapiens
NCDINIIVT

SEQ ID NO: 1255468 - protein, 9 aa, Homo Sapiens
TQKVFQLQI

SEQ ID NO: 1255469 - protein, 9 aa, Homo Sapiens
QSYRLVLYE

SEQ ID NO: 1255470 - protein, 9 aa, Homo Sapiens
LFRNPSMCK

SEQ ID NO: 1255471 - protein, 9 aa, Homo Sapiens
LPIGTWDQV

SEQ ID NO: 1255472 - protein, 9 aa, Homo Sapiens
IDWNEGKNA

SEQ ID NO: 1255473 - protein, 9 aa, Homo Sapiens
SKTSESSAQ

SEQ ID NO: 1255474 - protein, 9 aa, Homo Sapiens
FPVFVWTLR

SEQ ID NO: 1255475 - protein, 9 aa, Homo Sapiens
GLGGRIVRR

SEQ ID NO: 1255476 - protein, 9 aa, Homo Sapiens
RKKYMDAET

SEQ ID NO: 1255477 - protein, 9 aa, Homo Sapiens
QDLAFLSPV

SEQ ID NO: 1255478 - protein, 9 aa, Homo Sapiens
QAISCFAYQ

SEQ ID NO: 1255479 - protein, 9 aa, Homo Sapiens
VLLAFIITF

SEQ ID NO: 1255480 - protein, 9 aa, Homo Sapiens
QCDVCDKIF

SEQ ID NO: 1255481 - protein, 9 aa, Homo Sapiens
HPKARNEVR

SEQ ID NO: 1255482 - protein, 9 aa, Homo Sapiens
KSLSKEDLG

SEQ ID NO: 1255483 - protein, 9 aa, Homo Sapiens
NNYTINNKR

SEQ ID NO: 1255484 - protein, 9 aa, Homo Sapiens
AALIFFTIW

SEQ ID NO: 1255485 - protein, 9 aa, Homo Sapiens
RSMIPSYIR

SEQ ID NO: 1255486 - protein, 9 aa, Homo Sapiens
GMTWPPLFF

SEQ ID NO: 1255487 - protein, 9 aa, Homo Sapiens
SALGDLTGD

SEQ ID NO: 1255488 - protein, 9 aa, Homo Sapiens
RSIQTQNKA

SEQ ID NO: 1255489 - protein, 9 aa, Homo Sapiens
LKQVVRKPL

SEQ ID NO: 1255490 - protein, 9 aa, Homo Sapiens
AVSSAPGGG

SEQ ID NO: 1255491 - protein, 9 aa, Homo Sapiens
YNMLITCID

SEQ ID NO: 1255492 - protein, 9 aa, Homo Sapiens
WELLKEKAP

SEQ ID NO: 1255493 - protein, 9 aa, Homo Sapiens
HRTLLEGSD

SEQ ID NO: 1255494 - protein, 9 aa, Homo Sapiens
AVSEVSNGM

SEQ ID NO: 1255495 - protein, 9 aa, Homo Sapiens
NSTGATASL

SEQ ID NO: 1255496 - protein, 9 aa, Homo Sapiens
RICAVFGGI

SEQ ID NO: 1255497 - protein, 9 aa, Homo Sapiens
RTNINVFSE

SEQ ID NO: 1255498 - protein, 9 aa, Homo Sapiens
LTPHFSAGK

SEQ ID NO: 1255499 - protein, 9 aa, Homo Sapiens
ANVVMFEQH

SEQ ID NO: 1255500 - protein, 9 aa, Homo Sapiens
PRQSCGGGG

SEQ ID NO: 1255501 - protein, 9 aa, Homo Sapiens
KTAGARRSK

SEQ ID NO: 1255502 - protein, 9 aa, Homo Sapiens
ASQVACWTV

SEQ ID NO: 1255503 - protein, 9 aa, Homo Sapiens
FTTSSHIIV

SEQ ID NO: 1255504 - protein, 9 aa, Homo Sapiens
MNVAFIYYK

SEQ ID NO: 1255505 - protein, 9 aa, Homo Sapiens
MTLKNSKTG

SEQ ID NO: 1255506 - protein, 9 aa, Homo Sapiens
LKQLSNLCH

SEQ ID NO: 1255507 - protein, 9 aa, Homo Sapiens
GFVEQAEDL

SEQ ID NO: 1255508 - protein, 9 aa, Homo Sapiens
PLRSVLRMA

SEQ ID NO: 1255509 - protein, 9 aa, Homo Sapiens
LSCHFRGRS

SEQ ID NO: 1255510 - protein, 9 aa, Homo Sapiens
ECKEKFTAS

SEQ ID NO: 1255511 - protein, 9 aa, Homo Sapiens
VWSKTHRFL

SEQ ID NO: 1255512 - protein, 9 aa, Homo Sapiens
WLPTLPATQ

SEQ ID NO: 1255513 - protein, 9 aa, Homo Sapiens
PAQLCHRLR

SEQ ID NO: 1255514 - protein, 9 aa, Homo Sapiens
LGNLKLRKF

SEQ ID NO: 1255515 - protein, 9 aa, Homo Sapiens
PPQIGKKQS

SEQ ID NO: 1255516 - protein, 9 aa, Homo Sapiens
ICRVDFSFP

SEQ ID NO: 1255517 - protein, 9 aa, Homo Sapiens
VIDINDHYP

SEQ ID NO: 1255518 - protein, 9 aa, Homo Sapiens
LHDAHEFSN

SEQ ID NO: 1255519 - protein, 9 aa, Homo Sapiens
SEADGLDSG

SEQ ID NO: 1255520 - protein, 9 aa, Homo Sapiens
VGVIATLLF

SEQ ID NO: 1255521 - protein, 9 aa, Homo Sapiens
QQEGKCLQA

SEQ ID NO: 1255522 - protein, 9 aa, Homo Sapiens
ESHFKLREC

SEQ ID NO: 1255523 - protein, 9 aa, Homo Sapiens
LLIFPPPLP

SEQ ID NO: 1255524 - protein, 9 aa, Homo Sapiens
FHDSWEKVT

SEQ ID NO: 1255525 - protein, 9 aa, Homo Sapiens
LLLYTVMRC

SEQ ID NO: 1255526 - protein, 9 aa, Homo Sapiens
RLSVMVCDV

SEQ ID NO: 1255527 - protein, 9 aa, Homo Sapiens
HSEIKFVLK

SEQ ID NO: 1255528 - protein, 9 aa, Homo Sapiens
FQCEAHRIL

SEQ ID NO: 1255529 - protein, 9 aa, Homo Sapiens
ILLFNISVP

SEQ ID NO: 1255530 - protein, 9 aa, Homo Sapiens
FCKTHAILF

SEQ ID NO: 1255531 - protein, 9 aa, Homo Sapiens
DSYFSFEMS

SEQ ID NO: 1255532 - protein, 9 aa, Homo Sapiens
KDALAHQVP

SEQ ID NO: 1255533 - protein, 9 aa, Homo Sapiens
TISDPYVCI

SEQ ID NO: 1255534 - protein, 9 aa, Homo Sapiens
VKSWIPDVF

SEQ ID NO: 1255535 - protein, 9 aa, Homo Sapiens
IAIHGAERI

SEQ ID NO: 1255536 - protein, 9 aa, Homo Sapiens
YVAFHDPHH

SEQ ID NO: 1255537 - protein, 9 aa, Homo Sapiens
RTSHKAARL

SEQ ID NO: 1255538 - protein, 9 aa, Homo Sapiens
YITKGGNIG

SEQ ID NO: 1255539 - protein, 9 aa, Homo Sapiens
LQITDIIKI

SEQ ID NO: 1255540 - protein, 9 aa, Homo Sapiens
RDMSNLFYT

SEQ ID NO: 1255541 - protein, 9 aa, Homo Sapiens
LTPKRKLNS

SEQ ID NO: 1255542 - protein, 9 aa, Homo Sapiens
TDYSCNTRF

SEQ ID NO: 1255543 - protein, 9 aa, Homo Sapiens
RGCTQDLVL

SEQ ID NO: 1255544 - protein, 9 aa, Homo Sapiens
TGQEPAQHC

SEQ ID NO: 1255545 - protein, 9 aa, Homo Sapiens
TSNRCTSDL

SEQ ID NO: 1255546 - protein, 9 aa, Homo Sapiens
EAGYYRLSG

SEQ ID NO: 1255547 - protein, 9 aa, Homo Sapiens
KSHAGENSL

SEQ ID NO: 1255548 - protein, 9 aa, Homo Sapiens
RVHIKFGDF

SEQ ID NO: 1255549 - protein, 9 aa, Homo Sapiens
LWHGKLVLD

SEQ ID NO: 1255550 - protein, 9 aa, Homo Sapiens
AALKEQLSE

SEQ ID NO: 1255551 - protein, 9 aa, Homo Sapiens
ECDTLGIRE

SEQ ID NO: 1255552 - protein, 9 aa, Homo Sapiens
SNVAEGHKA

SEQ ID NO: 1255553 - protein, 9 aa, Homo Sapiens
SPKGRVVSA

SEQ ID NO: 1255554 - protein, 9 aa, Homo Sapiens
LRVSDPSPN

SEQ ID NO: 1255555 - protein, 9 aa, Homo Sapiens
TIEDYKITY

SEQ ID NO: 1255556 - protein, 9 aa, Homo Sapiens
VRTPPNRTI

SEQ ID NO: 1255557 - protein, 9 aa, Homo Sapiens
TFVQSESHL

SEQ ID NO: 1255558 - protein, 9 aa, Homo Sapiens
DLKDQLKHK

SEQ ID NO: 1255559 - protein, 9 aa, Homo Sapiens
RHRVIATHS

SEQ ID NO: 1255560 - protein, 9 aa, Homo Sapiens
ESHFGYGVA

SEQ ID NO: 1255561 - protein, 9 aa, Homo Sapiens
TRHSGSQDE

SEQ ID NO: 1255562 - protein, 9 aa, Homo Sapiens
REKCHSSPG

SEQ ID NO: 1255563 - protein, 9 aa, Homo Sapiens
AMRRSYETI

SEQ ID NO: 1255564 - protein, 9 aa, Homo Sapiens
RSMRSLTED

SEQ ID NO: 1255565 - protein, 9 aa, Homo Sapiens
VNGLNALHV

SEQ ID NO: 1255566 - protein, 9 aa, Homo Sapiens
YMPPSTILQ

SEQ ID NO: 1255567 - protein, 9 aa, Homo Sapiens
CPRCMQYSC

SEQ ID NO: 1255568 - protein, 9 aa, Homo Sapiens
EGPFVHIAN

SEQ ID NO: 1255569 - protein, 9 aa, Homo Sapiens
RPVQDISLP

SEQ ID NO: 1255570 - protein, 9 aa, Homo Sapiens
MFVGHATTL

SEQ ID NO: 1255571 - protein, 9 aa, Homo Sapiens
MVPLVRKIF

SEQ ID NO: 1255572 - protein, 9 aa, Homo Sapiens
YVRSLRMDS

SEQ ID NO: 1255573 - protein, 9 aa, Homo Sapiens
QSWLCIICA

SEQ ID NO: 1255574 - protein, 9 aa, Homo Sapiens
KSRPYFELN

SEQ ID NO: 1255575 - protein, 9 aa, Homo Sapiens
PLDPHENGS

SEQ ID NO: 1255576 - protein, 9 aa, Homo Sapiens
ALGLMITCM

SEQ ID NO: 1255577 - protein, 9 aa, Homo Sapiens
DTVLSTLYI

SEQ ID NO: 1255578 - protein, 9 aa, Homo Sapiens
VLKFCKLNF

SEQ ID NO: 1255579 - protein, 9 aa, Homo Sapiens
DRSVNDLHQ

SEQ ID NO: 1255580 - protein, 9 aa, Homo Sapiens
VHIRQTRSL

SEQ ID NO: 1255581 - protein, 9 aa, Homo Sapiens
EKDNEETGF

SEQ ID NO: 1255582 - protein, 9 aa, Homo Sapiens
RQDLWEERS

SEQ ID NO: 1255583 - protein, 9 aa, Homo Sapiens
SMVCDPHGP

SEQ ID NO: 1255584 - protein, 9 aa, Homo Sapiens
GPPHGSSFG

SEQ ID NO: 1255585 - protein, 9 aa, Homo Sapiens
VDVATDGDC

SEQ ID NO: 1255586 - protein, 9 aa, Homo Sapiens
GRSRGCGRG

SEQ ID NO: 1255587 - protein, 9 aa, Homo Sapiens
ELSFLSDDM

SEQ ID NO: 1255588 - protein, 9 aa, Homo Sapiens
SQESGSQED

SEQ ID NO: 1255589 - protein, 9 aa, Homo Sapiens
MCYHMPVKN

SEQ ID NO: 1255590 - protein, 9 aa, Homo Sapiens
AKKPEPNAR

SEQ ID NO: 1255591 - protein, 9 aa, Homo Sapiens
KGLAVVTQS

SEQ ID NO: 1255592 - protein, 9 aa, Homo Sapiens
FDSHQMNDS

SEQ ID NO: 1255593 - protein, 9 aa, Homo Sapiens
EDDEQCLSE

SEQ ID NO: 1255594 - protein, 9 aa, Homo Sapiens
GNLVMLGLC

SEQ ID NO: 1255595 - protein, 9 aa, Homo Sapiens
EQPLSVMVS

SEQ ID NO: 1255596 - protein, 9 aa, Homo Sapiens
SHLHGMSSK

SEQ ID NO: 1255597 - protein, 9 aa, Homo Sapiens
RAGPRPRVP

SEQ ID NO: 1255598 - protein, 9 aa, Homo Sapiens
FLTIMHIQI

SEQ ID NO: 1255599 - protein, 9 aa, Homo Sapiens
AADSAQKEG

SEQ ID NO: 1255600 - protein, 9 aa, Homo Sapiens
RNEHGRHRK

SEQ ID NO: 1255601 - protein, 9 aa, Homo Sapiens
GSVRPQELV

SEQ ID NO: 1255602 - protein, 9 aa, Homo Sapiens
AVGLSLWVC

SEQ ID NO: 1255603 - protein, 9 aa, Homo Sapiens
DNLTVSSEE

SEQ ID NO: 1255604 - protein, 9 aa, Homo Sapiens
LNRTYRAMQ

SEQ ID NO: 1255605 - protein, 9 aa, Homo Sapiens
RMNEIHIDP

SEQ ID NO: 1255606 - protein, 9 aa, Homo Sapiens
RGSNALHVV

SEQ ID NO: 1255607 - protein, 9 aa, Homo Sapiens
KVTLQNLFT

SEQ ID NO: 1255608 - protein, 9 aa, Homo Sapiens
YDTSAKKWK

SEQ ID NO: 1255609 - protein, 9 aa, Homo Sapiens
IPTGEDGPS

SEQ ID NO: 1255610 - protein, 9 aa, Homo Sapiens
YPANFTWKM

SEQ ID NO: 1255611 - protein, 9 aa, Homo Sapiens
TDEVLNSAM

SEQ ID NO: 1255612 - protein, 9 aa, Homo Sapiens
LRVIQGDEV

SEQ ID NO: 1255613 - protein, 9 aa, Homo Sapiens
TPEVIQVYI

SEQ ID NO: 1255614 - protein, 9 aa, Homo Sapiens
ETVIDKSKS

SEQ ID NO: 1255615 - protein, 9 aa, Homo Sapiens
NNKMEVLKK

SEQ ID NO: 1255616 - protein, 9 aa, Homo Sapiens
NAVVRAGAQ

SEQ ID NO: 1255617 - protein, 9 aa, Homo Sapiens
SVITSTSAP

SEQ ID NO: 1255618 - protein, 9 aa, Homo Sapiens
HRNIPNGLH

SEQ ID NO: 1255619 - protein, 9 aa, Homo Sapiens
QELCADLKV

SEQ ID NO: 1255620 - protein, 9 aa, Homo Sapiens
NEEKAVITE

SEQ ID NO: 1255621 - protein, 9 aa, Homo Sapiens
EENDPQSGL

SEQ ID NO: 1255622 - protein, 9 aa, Homo Sapiens
SNKVCRDQR

SEQ ID NO: 1255623 - protein, 9 aa, Homo Sapiens
GTPAENKMN

SEQ ID NO: 1255624 - protein, 9 aa, Homo Sapiens
QLIVMQPIP

SEQ ID NO: 1255625 - protein, 9 aa, Homo Sapiens
QESLVAAAQ

SEQ ID NO: 1255626 - protein, 9 aa, Homo Sapiens
RHKPHISNK

SEQ ID NO: 1255627 - protein, 9 aa, Homo Sapiens
NPKDTTSIH

SEQ ID NO: 1255628 - protein, 9 aa, Homo Sapiens
QLCHRLRHL

SEQ ID NO: 1255629 - protein, 9 aa, Homo Sapiens
TVELCDHVH

SEQ ID NO: 1255630 - protein, 9 aa, Homo Sapiens
KQLARHEWA

SEQ ID NO: 1255631 - protein, 9 aa, Homo Sapiens
APLEEMRKT

SEQ ID NO: 1255632 - protein, 9 aa, Homo Sapiens
TEDKSAEHK

SEQ ID NO: 1255633 - protein, 9 aa, Homo Sapiens
CIGIRGCTL

SEQ ID NO: 1255634 - protein, 9 aa, Homo Sapiens
KKPIKFYSV

SEQ ID NO: 1255635 - protein, 9 aa, Homo Sapiens
KPKKNRCFI

SEQ ID NO: 1255636 - protein, 9 aa, Homo Sapiens
FIKILWNIL

SEQ ID NO: 1255637 - protein, 9 aa, Homo Sapiens
YRLSILTLQ

SEQ ID NO: 1255638 - protein, 9 aa, Homo Sapiens
LTMEVYFGP

SEQ ID NO: 1255639 - protein, 9 aa, Homo Sapiens
SMSFTTSKF

SEQ ID NO: 1255640 - protein, 9 aa, Homo Sapiens
CPQEVASTA

SEQ ID NO: 1255641 - protein, 9 aa, Homo Sapiens
YIRSLNMVP

SEQ ID NO: 1255642 - protein, 9 aa, Homo Sapiens
AIFEHEMEE

SEQ ID NO: 1255643 - protein, 9 aa, Homo Sapiens
CNDNQWEVR

SEQ ID NO: 1255644 - protein, 9 aa, Homo Sapiens
PLSVRLQDN

SEQ ID NO: 1255645 - protein, 9 aa, Homo Sapiens
CCECEAFMV

SEQ ID NO: 1255646 - protein, 9 aa, Homo Sapiens
GAGWPCPAV

SEQ ID NO: 1255647 - protein, 9 aa, Homo Sapiens
VIMVVVVPA

SEQ ID NO: 1255648 - protein, 9 aa, Homo Sapiens
ILNLHGIAK

SEQ ID NO: 1255649 - protein, 9 aa, Homo Sapiens
SKHPQHKLF

SEQ ID NO: 1255650 - protein, 9 aa, Homo Sapiens
HKQYPISLV

SEQ ID NO: 1255651 - protein, 9 aa, Homo Sapiens
DCEHCLLEL

SEQ ID NO: 1255652 - protein, 9 aa, Homo Sapiens
DEFMVQAPP

SEQ ID NO: 1255653 - protein, 9 aa, Homo Sapiens
LGPLVPRLA

SEQ ID NO: 1255654 - protein, 9 aa, Homo Sapiens
PETLLGYPE

SEQ ID NO: 1255655 - protein, 9 aa, Homo Sapiens
KPSKGKDGV

SEQ ID NO: 1255656 - protein, 9 aa, Homo Sapiens
ENRIWELTS

SEQ ID NO: 1255657 - protein, 9 aa, Homo Sapiens
AAKHSKASL

SEQ ID NO: 1255658 - protein, 9 aa, Homo Sapiens
EWAWNDVPC

SEQ ID NO: 1255659 - protein, 9 aa, Homo Sapiens
MATGQRPSA

SEQ ID NO: 1255660 - protein, 9 aa, Homo Sapiens
QPELLKRNP

SEQ ID NO: 1255661 - protein, 9 aa, Homo Sapiens
AARNANMNL

SEQ ID NO: 1255662 - protein, 9 aa, Homo Sapiens
RYHHRRSSG

SEQ ID NO: 1255663 - protein, 9 aa, Homo Sapiens
KRLAPEYET

SEQ ID NO: 1255664 - protein, 9 aa, Homo Sapiens
PPIMRIIID

SEQ ID NO: 1255665 - protein, 9 aa, Homo Sapiens
LVSRNIYHS

SEQ ID NO: 1255666 - protein, 9 aa, Homo Sapiens
GVQTFLLQD

SEQ ID NO: 1255667 - protein, 9 aa, Homo Sapiens
DFSFHFLFG

SEQ ID NO: 1255668 - protein, 9 aa, Homo Sapiens
PQAHGDPAP

SEQ ID NO: 1255669 - protein, 9 aa, Homo Sapiens
DHDAALMQD

SEQ ID NO: 1255670 - protein, 9 aa, Homo Sapiens
EKPEYISDT

SEQ ID NO: 1255671 - protein, 9 aa, Homo Sapiens
GYWIGVHYD

SEQ ID NO: 1255672 - protein, 9 aa, Homo Sapiens
TRQHEDGEF

SEQ ID NO: 1255673 - protein, 9 aa, Homo Sapiens
RPAGHEWRY

SEQ ID NO: 1255674 - protein, 9 aa, Homo Sapiens
SPMWDNPGS

SEQ ID NO: 1255675 - protein, 9 aa, Homo Sapiens
YILVSCGED

SEQ ID NO: 1255676 - protein, 9 aa, Homo Sapiens
STAGRKDHL

SEQ ID NO: 1255677 - protein, 9 aa, Homo Sapiens
YLHSNCLDQ

SEQ ID NO: 1255678 - protein, 9 aa, Homo Sapiens
LQSCWHLLR

SEQ ID NO: 1255679 - protein, 9 aa, Homo Sapiens
DHSIRIQRD

SEQ ID NO: 1255680 - protein, 9 aa, Homo Sapiens
FIYHDQVPD

SEQ ID NO: 1255681 - protein, 9 aa, Homo Sapiens
PKALKLLVM

SEQ ID NO: 1255682 - protein, 9 aa, Homo Sapiens
MDILEIRKE

SEQ ID NO: 1255683 - protein, 9 aa, Homo Sapiens
VREVMLWER

SEQ ID NO: 1255684 - protein, 9 aa, Homo Sapiens
FKCHLYNRC

SEQ ID NO: 1255685 - protein, 9 aa, Homo Sapiens
RVSITPGTI

SEQ ID NO: 1255686 - protein, 9 aa, Homo Sapiens
FLHPGFCCL

SEQ ID NO: 1255687 - protein, 9 aa, Homo Sapiens
QMKSMYMSE

SEQ ID NO: 1255688 - protein, 9 aa, Homo Sapiens
FVDTADRLT

SEQ ID NO: 1255689 - protein, 9 aa, Homo Sapiens
SITSEHHNQ

SEQ ID NO: 1255690 - protein, 9 aa, Homo Sapiens
RCRPINTTL

SEQ ID NO: 1255691 - protein, 9 aa, Homo Sapiens
MNVAAAVWV

SEQ ID NO: 1255692 - protein, 9 aa, Homo Sapiens
TGTPAPAFW

SEQ ID NO: 1255693 - protein, 9 aa, Homo Sapiens
CISFMQVGC

SEQ ID NO: 1255694 - protein, 9 aa, Homo Sapiens
EAPPAKECT

SEQ ID NO: 1255695 - protein, 9 aa, Homo Sapiens
VSAELLLLT

SEQ ID NO: 1255696 - protein, 9 aa, Homo Sapiens
HPNENNSSD

SEQ ID NO: 1255697 - protein, 9 aa, Homo Sapiens
TRKMVLDWA

SEQ ID NO: 1255698 - protein, 9 aa, Homo Sapiens
QIRLCILPG

SEQ ID NO: 1255699 - protein, 9 aa, Homo Sapiens
EQGDIEDDQ

SEQ ID NO: 1255700 - protein, 9 aa, Homo Sapiens
ADYIHLTFL

SEQ ID NO: 1255701 - protein, 9 aa, Homo Sapiens
AGDDAISLR

SEQ ID NO: 1255702 - protein, 9 aa, Homo Sapiens
QTLREDRMT

SEQ ID NO: 1255703 - protein, 9 aa, Homo Sapiens
SLTADYGFP

SEQ ID NO: 1255704 - protein, 9 aa, Homo Sapiens
NCMGKARER

SEQ ID NO: 1255705 - protein, 9 aa, Homo Sapiens
RCGKHFGTT

SEQ ID NO: 1255706 - protein, 9 aa, Homo Sapiens
DCTRSPGSL

SEQ ID NO: 1255707 - protein, 9 aa, Homo Sapiens
AFRALLLNK

SEQ ID NO: 1255708 - protein, 9 aa, Homo Sapiens
NKNEKAALK

SEQ ID NO: 1255709 - protein, 9 aa, Homo Sapiens
TGEKTYGCN

SEQ ID NO: 1255710 - protein, 9 aa, Homo Sapiens
PGICGSFLL

SEQ ID NO: 1255711 - protein, 9 aa, Homo Sapiens
LAGLLQLTA

SEQ ID NO: 1255712 - protein, 9 aa, Homo Sapiens
TSQIKQMLS

SEQ ID NO: 1255713 - protein, 9 aa, Homo Sapiens
GERGLWWRE

SEQ ID NO: 1255714 - protein, 9 aa, Homo Sapiens
HWLYLSENA

SEQ ID NO: 1255715 - protein, 9 aa, Homo Sapiens
RHRHIHTGN

SEQ ID NO: 1255716 - protein, 9 aa, Homo Sapiens
EAMHCPQCQ

SEQ ID NO: 1255717 - protein, 9 aa, Homo Sapiens
RPPDDDFRR

SEQ ID NO: 1255718 - protein, 9 aa, Homo Sapiens
SKPSIKQTC

SEQ ID NO: 1255719 - protein, 9 aa, Homo Sapiens
TESWPPAPL

SEQ ID NO: 1255720 - protein, 9 aa, Homo Sapiens
QTDPLALCH

SEQ ID NO: 1255721 - protein, 9 aa, Homo Sapiens
SLRNAVNFA

SEQ ID NO: 1255722 - protein, 9 aa, Homo Sapiens
PCFPVKLDI

SEQ ID NO: 1255723 - protein, 9 aa, Homo Sapiens
ASIQSVATF

SEQ ID NO: 1255724 - protein, 9 aa, Homo Sapiens
GVKIGFFQG

SEQ ID NO: 1255725 - protein, 9 aa, Homo Sapiens
DEDMKVMEE

SEQ ID NO: 1255726 - protein, 9 aa, Homo Sapiens
VMSCSTEAY

SEQ ID NO: 1255727 - protein, 9 aa, Homo Sapiens
VQRTMMKAL

SEQ ID NO: 1255728 - protein, 9 aa, Homo Sapiens
APPEAPLTP

SEQ ID NO: 1255729 - protein, 9 aa, Homo Sapiens
MTDIYMLNL

SEQ ID NO: 1255730 - protein, 9 aa, Homo Sapiens
RIPLPLNSF

SEQ ID NO: 1255731 - protein, 9 aa, Homo Sapiens
RRRLPYPLL

SEQ ID NO: 1255732 - protein, 9 aa, Homo Sapiens
GYENSGTGF

SEQ ID NO: 1255733 - protein, 9 aa, Homo Sapiens
ATKLYRTTI

SEQ ID NO: 1255734 - protein, 9 aa, Homo Sapiens
YQVFVGFLF

SEQ ID NO: 1255735 - protein, 9 aa, Homo Sapiens
KDYDSHTAL

SEQ ID NO: 1255736 - protein, 9 aa, Homo Sapiens
CTQKTAVPK

SEQ ID NO: 1255737 - protein, 9 aa, Homo Sapiens
SYSGIPLNI

SEQ ID NO: 1255738 - protein, 9 aa, Homo Sapiens
LHNDSSILD

SEQ ID NO: 1255739 - protein, 9 aa, Homo Sapiens
LKFQETETD

SEQ ID NO: 1255740 - protein, 9 aa, Homo Sapiens
NFCAEGHKC

SEQ ID NO: 1255741 - protein, 9 aa, Homo Sapiens
LAVVGITAT

SEQ ID NO: 1255742 - protein, 9 aa, Homo Sapiens
ICLAQLGVP

SEQ ID NO: 1255743 - protein, 9 aa, Homo Sapiens
AATTPSTTA

SEQ ID NO: 1255744 - protein, 9 aa, Homo Sapiens
HTFGNAPGF

SEQ ID NO: 1255745 - protein, 9 aa, Homo Sapiens
FCDFLPVLC

SEQ ID NO: 1255746 - protein, 9 aa, Homo Sapiens
SRRKLRRKR

SEQ ID NO: 1255747 - protein, 9 aa, Homo Sapiens
QISQPLPSQ

SEQ ID NO: 1255748 - protein, 9 aa, Homo Sapiens
MKRPLDTQQ

SEQ ID NO: 1255749 - protein, 9 aa, Homo Sapiens
QIQEEEKTL

SEQ ID NO: 1255750 - protein, 9 aa, Homo Sapiens
RAISCRNTS

SEQ ID NO: 1255751 - protein, 9 aa, Homo Sapiens
RRNGEALIH

SEQ ID NO: 1255752 - protein, 9 aa, Homo Sapiens
KKKAYPSEK

SEQ ID NO: 1255753 - protein, 9 aa, Homo Sapiens
DEAESTVST

SEQ ID NO: 1255754 - protein, 9 aa, Homo Sapiens
HQQVRAKSH

SEQ ID NO: 1255755 - protein, 9 aa, Homo Sapiens
FHHYPHLEQ

SEQ ID NO: 1255756 - protein, 9 aa, Homo Sapiens
PEILVWRPE

SEQ ID NO: 1255757 - protein, 9 aa, Homo Sapiens
SVKFDVQSN

SEQ ID NO: 1255758 - protein, 9 aa, Homo Sapiens
PFVSQTRGI

SEQ ID NO: 1255759 - protein, 9 aa, Homo Sapiens
SPQPHWITS

SEQ ID NO: 1255760 - protein, 9 aa, Homo Sapiens
PQDFLSVRP

SEQ ID NO: 1255761 - protein, 9 aa, Homo Sapiens
VKISKAHDK

SEQ ID NO: 1255762 - protein, 9 aa, Homo Sapiens
QLIMIFCST

SEQ ID NO: 1255763 - protein, 9 aa, Homo Sapiens
DTEKRVILN

SEQ ID NO: 1255764 - protein, 9 aa, Homo Sapiens
LCGPATWGS

SEQ ID NO: 1255765 - protein, 9 aa, Homo Sapiens
PSEHRPSFS

SEQ ID NO: 1255766 - protein, 9 aa, Homo Sapiens
WSMEHINRY

SEQ ID NO: 1255767 - protein, 9 aa, Homo Sapiens
TWSLYYLFS

SEQ ID NO: 1255768 - protein, 9 aa, Homo Sapiens
SLSSFLIFF

SEQ ID NO: 1255769 - protein, 9 aa, Homo Sapiens
DELCSERKQ

SEQ ID NO: 1255770 - protein, 9 aa, Homo Sapiens
QEPASSEVV

SEQ ID NO: 1255771 - protein, 9 aa, Homo Sapiens
SFGAISLSS

SEQ ID NO: 1255772 - protein, 9 aa, Homo Sapiens
LEAEPQVVV

SEQ ID NO: 1255773 - protein, 9 aa, Homo Sapiens
GKTCKDSAT

SEQ ID NO: 1255774 - protein, 9 aa, Homo Sapiens
NKGTCLNDV

SEQ ID NO: 1255775 - protein, 9 aa, Homo Sapiens
KEDVTYASK

SEQ ID NO: 1255776 - protein, 9 aa, Homo Sapiens
CFRVLSSSW

SEQ ID NO: 1255777 - protein, 9 aa, Homo Sapiens
VSAVDGLIF

SEQ ID NO: 1255778 - protein, 9 aa, Homo Sapiens
KTQLEQMYQ

SEQ ID NO: 1255779 - protein, 9 aa, Homo Sapiens
SSTHNAMVP

SEQ ID NO: 1255780 - protein, 9 aa, Homo Sapiens
GATLCMGGC

SEQ ID NO: 1255781 - protein, 9 aa, Homo Sapiens
RGSAGHWIS

SEQ ID NO: 1255782 - protein, 9 aa, Homo Sapiens
RSPLLSRRT

SEQ ID NO: 1255783 - protein, 9 aa, Homo Sapiens
HSVQLFILY

SEQ ID NO: 1255784 - protein, 9 aa, Homo Sapiens
EKVKCYIIE

SEQ ID NO: 1255785 - protein, 9 aa, Homo Sapiens
TVKKVLPEL

SEQ ID NO: 1255786 - protein, 9 aa, Homo Sapiens
CSTFQLGCD

SEQ ID NO: 1255787 - protein, 9 aa, Homo Sapiens
ANVQPILNV

SEQ ID NO: 1255788 - protein, 9 aa, Homo Sapiens
PVLPQEENT

SEQ ID NO: 1255789 - protein, 9 aa, Homo Sapiens
PPFLIQLHS

SEQ ID NO: 1255790 - protein, 9 aa, Homo Sapiens
ALFLGMGVL

SEQ ID NO: 1255791 - protein, 9 aa, Homo Sapiens
GHSHWVNTM

SEQ ID NO: 1255792 - protein, 9 aa, Homo Sapiens
HGGSWSRGW

SEQ ID NO: 1255793 - protein, 9 aa, Homo Sapiens
VIPMVHIIN

SEQ ID NO: 1255794 - protein, 9 aa, Homo Sapiens
PFPRAARPI

SEQ ID NO: 1255795 - protein, 9 aa, Homo Sapiens
ECTAPTPAA

SEQ ID NO: 1255796 - protein, 9 aa, Homo Sapiens
KFQGDQEYS

SEQ ID NO: 1255797 - protein, 9 aa, Homo Sapiens
RGRLFTFDS

SEQ ID NO: 1255798 - protein, 9 aa, Homo Sapiens
PKMWRSIMI

SEQ ID NO: 1255799 - protein, 9 aa, Homo Sapiens
LTAQPTKVR

SEQ ID NO: 1255800 - protein, 9 aa, Homo Sapiens
QPHKYILVS

SEQ ID NO: 1255801 - protein, 9 aa, Homo Sapiens
MELPPLKLM

SEQ ID NO: 1255802 - protein, 9 aa, Homo Sapiens
DNGGKTTIL

SEQ ID NO: 1255803 - protein, 9 aa, Homo Sapiens
IFCARSSWL

SEQ ID NO: 1255804 - protein, 9 aa, Homo Sapiens
LRCTNNQLG

SEQ ID NO: 1255805 - protein, 9 aa, Homo Sapiens
DLESIISTL

SEQ ID NO: 1255806 - protein, 9 aa, Homo Sapiens
QTVPTFMPL

SEQ ID NO: 1255807 - protein, 9 aa, Homo Sapiens
RIKTDFLVQ

SEQ ID NO: 1255808 - protein, 9 aa, Homo Sapiens
VVVAMNAFK

SEQ ID NO: 1255809 - protein, 9 aa, Homo Sapiens
MGEQVTNGR

SEQ ID NO: 1255810 - protein, 9 aa, Homo Sapiens
REEWKKTME

SEQ ID NO: 1255811 - protein, 9 aa, Homo Sapiens
LKFSGSLPI

SEQ ID NO: 1255812 - protein, 9 aa, Homo Sapiens
EKGPPLAPS

SEQ ID NO: 1255813 - protein, 9 aa, Homo Sapiens
FKGYLGYQA

SEQ ID NO: 1255814 - protein, 9 aa, Homo Sapiens
IHTDTDTHS

SEQ ID NO: 1255815 - protein, 9 aa, Homo Sapiens
STRQEMTVI

SEQ ID NO: 1255816 - protein, 9 aa, Homo Sapiens
LSRPSGSRA

SEQ ID NO: 1255817 - protein, 9 aa, Homo Sapiens
EHLAGCTFQ

SEQ ID NO: 1255818 - protein, 9 aa, Homo Sapiens
RKNGSNRHE

SEQ ID NO: 1255819 - protein, 9 aa, Homo Sapiens
SSGRQQRGT

SEQ ID NO: 1255820 - protein, 9 aa, Homo Sapiens
RHEMTHSEE

SEQ ID NO: 1255821 - protein, 9 aa, Homo Sapiens
SIRQDGGIG

SEQ ID NO: 1255822 - protein, 9 aa, Homo Sapiens
RMYAHVYGN

SEQ ID NO: 1255823 - protein, 9 aa, Homo Sapiens
AIGCWLGCL

SEQ ID NO: 1255824 - protein, 9 aa, Homo Sapiens
WLQGEKQQV

SEQ ID NO: 1255825 - protein, 9 aa, Homo Sapiens
TPSPPQPTL

SEQ ID NO: 1255826 - protein, 9 aa, Homo Sapiens
EGVNCRYRC

SEQ ID NO: 1255827 - protein, 9 aa, Homo Sapiens
DCASPSRPT

SEQ ID NO: 1255828 - protein, 9 aa, Homo Sapiens
GQVLEGNNL

SEQ ID NO: 1255829 - protein, 9 aa, Homo Sapiens
CLGHGNLTD

SEQ ID NO: 1255830 - protein, 9 aa, Homo Sapiens
AGDPEGPPW

SEQ ID NO: 1255831 - protein, 9 aa, Homo Sapiens
TETGTQWWK

SEQ ID NO: 1255832 - protein, 9 aa, Homo Sapiens
GHSHRGAGV

SEQ ID NO: 1255833 - protein, 9 aa, Homo Sapiens
PCPAVPLGP

SEQ ID NO: 1255834 - protein, 9 aa, Homo Sapiens
MPTLLAQPE

SEQ ID NO: 1255835 - protein, 9 aa, Homo Sapiens
FAFRLCSSS

SEQ ID NO: 1255836 - protein, 9 aa, Homo Sapiens
AGHHGDDLK

SEQ ID NO: 1255837 - protein, 9 aa, Homo Sapiens
VPEKPLHEV

SEQ ID NO: 1255838 - protein, 9 aa, Homo Sapiens
ACLVMITYG

SEQ ID NO: 1255839 - protein, 9 aa, Homo Sapiens
SHIDALYES

SEQ ID NO: 1255840 - protein, 9 aa, Homo Sapiens
FCVEHNTFG

SEQ ID NO: 1255841 - protein, 9 aa, Homo Sapiens
LLDHPKARN

SEQ ID NO: 1255842 - protein, 9 aa, Homo Sapiens
LIPYYSNMV

SEQ ID NO: 1255843 - protein, 9 aa, Homo Sapiens
QGEHSGQPR

SEQ ID NO: 1255844 - protein, 9 aa, Homo Sapiens
FCQNPAPLW

SEQ ID NO: 1255845 - protein, 9 aa, Homo Sapiens
GAENEMLTL

SEQ ID NO: 1255846 - protein, 9 aa, Homo Sapiens
RTPSYTDRI

SEQ ID NO: 1255847 - protein, 9 aa, Homo Sapiens
ASMDAQPAE

SEQ ID NO: 1255848 - protein, 9 aa, Homo Sapiens
MYGMCPLKG

SEQ ID NO: 1255849 - protein, 9 aa, Homo Sapiens
RHALQDMAR

SEQ ID NO: 1255850 - protein, 9 aa, Homo Sapiens
VSLTASRAT

SEQ ID NO: 1255851 - protein, 9 aa, Homo Sapiens
LKKKKSINP

SEQ ID NO: 1255852 - protein, 9 aa, Homo Sapiens
TSGKQTGIE

SEQ ID NO: 1255853 - protein, 9 aa, Homo Sapiens
EGAVLGLYV

SEQ ID NO: 1255854 - protein, 9 aa, Homo Sapiens
ASNSKATFQ

SEQ ID NO: 1255855 - protein, 9 aa, Homo Sapiens
SISMTPFGG

SEQ ID NO: 1255856 - protein, 9 aa, Homo Sapiens
RIGVSAWLN

SEQ ID NO: 1255857 - protein, 9 aa, Homo Sapiens
FLPCHFHRL

SEQ ID NO: 1255858 - protein, 9 aa, Homo Sapiens
IYAGLKSAG

SEQ ID NO: 1255859 - protein, 9 aa, Homo Sapiens
SGSQPHLDT

SEQ ID NO: 1255860 - protein, 9 aa, Homo Sapiens
THHMYYLKI

SEQ ID NO: 1255861 - protein, 9 aa, Homo Sapiens
QLEKRHREY

SEQ ID NO: 1255862 - protein, 9 aa, Homo Sapiens
DLDALPLDM

SEQ ID NO: 1255863 - protein, 9 aa, Homo Sapiens
AKYKAEEVE

SEQ ID NO: 1255864 - protein, 9 aa, Homo Sapiens
EWQCLDTAH

SEQ ID NO: 1255865 - protein, 9 aa, Homo Sapiens
SVYHPADGD

SEQ ID NO: 1255866 - protein, 9 aa, Homo Sapiens
IDNTYYSAD

SEQ ID NO: 1255867 - protein, 9 aa, Homo Sapiens
AHPAQGLAG

SEQ ID NO: 1255868 - protein, 9 aa, Homo Sapiens
VQEVEKEPG

SEQ ID NO: 1255869 - protein, 9 aa, Homo Sapiens
YWSEDDQER

SEQ ID NO: 1255870 - protein, 9 aa, Homo Sapiens
WKLSESGTI

SEQ ID NO: 1255871 - protein, 9 aa, Homo Sapiens
IPGPEKMLD

SEQ ID NO: 1255872 - protein, 9 aa, Homo Sapiens
SNHFQGLSH

SEQ ID NO: 1255873 - protein, 9 aa, Homo Sapiens
KRMPQELFE

SEQ ID NO: 1255874 - protein, 9 aa, Homo Sapiens
YCFGEDLAR

SEQ ID NO: 1255875 - protein, 9 aa, Homo Sapiens
ETYMAAVKK

SEQ ID NO: 1255876 - protein, 9 aa, Homo Sapiens
FRKVLIYQK

SEQ ID NO: 1255877 - protein, 9 aa, Homo Sapiens
TPQRYKEDG

SEQ ID NO: 1255878 - protein, 9 aa, Homo Sapiens
APEVVNRIG

SEQ ID NO: 1255879 - protein, 9 aa, Homo Sapiens
TSQPMGPRI

SEQ ID NO: 1255880 - protein, 9 aa, Homo Sapiens
TQDVQMFSE

SEQ ID NO: 1255881 - protein, 9 aa, Homo Sapiens
PLLLVVGCV

SEQ ID NO: 1255882 - protein, 9 aa, Homo Sapiens
MLPSSSAGA

SEQ ID NO: 1255883 - protein, 9 aa, Homo Sapiens
TVHYLDETE

SEQ ID NO: 1255884 - protein, 9 aa, Homo Sapiens
CGTMECFPT

SEQ ID NO: 1255885 - protein, 9 aa, Homo Sapiens
YGYDECAVL

SEQ ID NO: 1255886 - protein, 9 aa, Homo Sapiens
SLIPKTWHS

SEQ ID NO: 1255887 - protein, 9 aa, Homo Sapiens
DEVMVQMLL

SEQ ID NO: 1255888 - protein, 9 aa, Homo Sapiens
PDPANAPCR

SEQ ID NO: 1255889 - protein, 9 aa, Homo Sapiens
EVPGRVFGN

SEQ ID NO: 1255890 - protein, 9 aa, Homo Sapiens
GPAQASAAV

SEQ ID NO: 1255891 - protein, 9 aa, Homo Sapiens
AWMTLSVSE

SEQ ID NO: 1255892 - protein, 9 aa, Homo Sapiens
VGAVFYSII

SEQ ID NO: 1255893 - protein, 9 aa, Homo Sapiens
GMLNGGHRI

SEQ ID NO: 1255894 - protein, 9 aa, Homo Sapiens
MRPLCLVTS

SEQ ID NO: 1255895 - protein, 9 aa, Homo Sapiens
CYDAFGEDS

SEQ ID NO: 1255896 - protein, 9 aa, Homo Sapiens
NVVSKLHGC

SEQ ID NO: 1255897 - protein, 9 aa, Homo Sapiens
CHAPETPES

SEQ ID NO: 1255898 - protein, 9 aa, Homo Sapiens
PANAPCRCS

SEQ ID NO: 1255899 - protein, 9 aa, Homo Sapiens
SETNQHIWT

SEQ ID NO: 1255900 - protein, 9 aa, Homo Sapiens
AKPKVHNHQ

SEQ ID NO: 1255901 - protein, 9 aa, Homo Sapiens
AINNLNPTF

SEQ ID NO: 1255902 - protein, 9 aa, Homo Sapiens
VEQAPTQNE

SEQ ID NO: 1255903 - protein, 9 aa, Homo Sapiens
VAVDAISIS

SEQ ID NO: 1255904 - protein, 9 aa, Homo Sapiens
STSTHGSGP

SEQ ID NO: 1255905 - protein, 9 aa, Homo Sapiens
LKENDVPTI

SEQ ID NO: 1255906 - protein, 9 aa, Homo Sapiens
STRCCWCSL

SEQ ID NO: 1255907 - protein, 9 aa, Homo Sapiens
YTSFHNNVY

SEQ ID NO: 1255908 - protein, 9 aa, Homo Sapiens
EYTAMKSKE

SEQ ID NO: 1255909 - protein, 9 aa, Homo Sapiens
GKEKTGALW

SEQ ID NO: 1255910 - protein, 9 aa, Homo Sapiens
TSNDPPTST

SEQ ID NO: 1255911 - protein, 9 aa, Homo Sapiens
HFEKEQQQL

SEQ ID NO: 1255912 - protein, 9 aa, Homo Sapiens
CSKDWPCKY

SEQ ID NO: 1255913 - protein, 9 aa, Homo Sapiens
VLQETIKFM

SEQ ID NO: 1255914 - protein, 9 aa, Homo Sapiens
LNELASLDQ

SEQ ID NO: 1255915 - protein, 9 aa, Homo Sapiens
YFCRHEMTH

SEQ ID NO: 1255916 - protein, 9 aa, Homo Sapiens
PLHTAGGGG

SEQ ID NO: 1255917 - protein, 9 aa, Homo Sapiens
KVILVWEKA

SEQ ID NO: 1255918 - protein, 9 aa, Homo Sapiens
DLGSVTDSL

SEQ ID NO: 1255919 - protein, 9 aa, Homo Sapiens
IKECFTSSL

SEQ ID NO: 1255920 - protein, 9 aa, Homo Sapiens
EASIYKNIL

SEQ ID NO: 1255921 - protein, 9 aa, Homo Sapiens
GRPDRGCLG

SEQ ID NO: 1255922 - protein, 9 aa, Homo Sapiens
IKAKLPVWA

SEQ ID NO: 1255923 - protein, 9 aa, Homo Sapiens
APGRGLRPV

SEQ ID NO: 1255924 - protein, 9 aa, Homo Sapiens
NGSVRLWHA

SEQ ID NO: 1255925 - protein, 9 aa, Homo Sapiens
RLILELGFS

SEQ ID NO: 1255926 - protein, 9 aa, Homo Sapiens
HQAIMCWAS

SEQ ID NO: 1255927 - protein, 9 aa, Homo Sapiens
NEAVEKGIS

SEQ ID NO: 1255928 - protein, 9 aa, Homo Sapiens
NVTGHADLK

SEQ ID NO: 1255929 - protein, 9 aa, Homo Sapiens
QAEGIPKIY

SEQ ID NO: 1255930 - protein, 9 aa, Homo Sapiens
ERQLTALPS

SEQ ID NO: 1255931 - protein, 9 aa, Homo Sapiens
IFQRRNTGQ

SEQ ID NO: 1255932 - protein, 9 aa, Homo Sapiens
QTTGCSQRR

SEQ ID NO: 1255933 - protein, 9 aa, Homo Sapiens
LSSTSPLER

SEQ ID NO: 1255934 - protein, 9 aa, Homo Sapiens
HLKFLDKAR

SEQ ID NO: 1255935 - protein, 9 aa, Homo Sapiens
LRASIYGQF

SEQ ID NO: 1255936 - protein, 9 aa, Homo Sapiens
DMYTPPDIT

SEQ ID NO: 1255937 - protein, 9 aa, Homo Sapiens
QSGEMVIHG

SEQ ID NO: 1255938 - protein, 9 aa, Homo Sapiens
STTLDAQST

SEQ ID NO: 1255939 - protein, 9 aa, Homo Sapiens
DCYMTSYSG

SEQ ID NO: 1255940 - protein, 9 aa, Homo Sapiens
SVCGRLQQA

SEQ ID NO: 1255941 - protein, 9 aa, Homo Sapiens
FGEDLARME

SEQ ID NO: 1255942 - protein, 9 aa, Homo Sapiens
GREVLGGVN

SEQ ID NO: 1255943 - protein, 9 aa, Homo Sapiens
IFFTALMVN

SEQ ID NO: 1255944 - protein, 9 aa, Homo Sapiens
GDIIILDNL

SEQ ID NO: 1255945 - protein, 9 aa, Homo Sapiens
NQDQRSASR

SEQ ID NO: 1255946 - protein, 9 aa, Homo Sapiens
ALMASVPPV

SEQ ID NO: 1255947 - protein, 9 aa, Homo Sapiens
GSYATVYNG

SEQ ID NO: 1255948 - protein, 9 aa, Homo Sapiens
NEKEMMQFL

SEQ ID NO: 1255949 - protein, 9 aa, Homo Sapiens
GPLQTDVFV

SEQ ID NO: 1255950 - protein, 9 aa, Homo Sapiens
RVFGNASDL

SEQ ID NO: 1255951 - protein, 9 aa, Homo Sapiens
QLKAVDVVL

SEQ ID NO: 1255952 - protein, 9 aa, Homo Sapiens
SSPPAGEGM

SEQ ID NO: 1255953 - protein, 9 aa, Homo Sapiens
CIPSSGILV

SEQ ID NO: 1255954 - protein, 9 aa, Homo Sapiens
PPTGTNMHG

SEQ ID NO: 1255955 - protein, 9 aa, Homo Sapiens
HMTTADDMP

SEQ ID NO: 1255956 - protein, 9 aa, Homo Sapiens
TGILSLSNI

SEQ ID NO: 1255957 - protein, 9 aa, Homo Sapiens
QKEDRAMSQ

SEQ ID NO: 1255958 - protein, 9 aa, Homo Sapiens
LQCSLESHL

SEQ ID NO: 1255959 - protein, 9 aa, Homo Sapiens
YWTDRGCEW

SEQ ID NO: 1255960 - protein, 9 aa, Homo Sapiens
QVDKGAIKS

SEQ ID NO: 1255961 - protein, 9 aa, Homo Sapiens
CLTFTSGIL

SEQ ID NO: 1255962 - protein, 9 aa, Homo Sapiens
LVCKAGEQQ

SEQ ID NO: 1255963 - protein, 9 aa, Homo Sapiens
SEGTTGNGL

SEQ ID NO: 1255964 - protein, 9 aa, Homo Sapiens
DMHFRSLCT

SEQ ID NO: 1255965 - protein, 9 aa, Homo Sapiens
IRPFYKTML

SEQ ID NO: 1255966 - protein, 9 aa, Homo Sapiens
TCSRACSCG

SEQ ID NO: 1255967 - protein, 9 aa, Homo Sapiens
TYVSTYLKM

SEQ ID NO: 1255968 - protein, 9 aa, Homo Sapiens
LHNTTASMG

SEQ ID NO: 1255969 - protein, 9 aa, Homo Sapiens
RARQGCLRA

SEQ ID NO: 1255970 - protein, 9 aa, Homo Sapiens
NQEEHLLAD

SEQ ID NO: 1255971 - protein, 9 aa, Homo Sapiens
PCFKSDHGH

SEQ ID NO: 1255972 - protein, 9 aa, Homo Sapiens
DTWQTATFR

SEQ ID NO: 1255973 - protein, 9 aa, Homo Sapiens
HLEDMYWMA

SEQ ID NO: 1255974 - protein, 9 aa, Homo Sapiens
REFNLMYDV

SEQ ID NO: 1255975 - protein, 9 aa, Homo Sapiens
THKRIYTGE

SEQ ID NO: 1255976 - protein, 9 aa, Homo Sapiens
YFNLTMSYH

SEQ ID NO: 1255977 - protein, 9 aa, Homo Sapiens
ARLSHLHGM

SEQ ID NO: 1255978 - protein, 9 aa, Homo Sapiens
GPFWYEMRL

SEQ ID NO: 1255979 - protein, 9 aa, Homo Sapiens
QYDVVADCS

SEQ ID NO: 1255980 - protein, 9 aa, Homo Sapiens
DKNTDVLVA

SEQ ID NO: 1255981 - protein, 9 aa, Homo Sapiens
ETEKERLVR

SEQ ID NO: 1255982 - protein, 9 aa, Homo Sapiens
GNGEIGRDR

SEQ ID NO: 1255983 - protein, 9 aa, Homo Sapiens
KYLETLKQG

SEQ ID NO: 1255984 - protein, 9 aa, Homo Sapiens
KDQLKHKEF

SEQ ID NO: 1255985 - protein, 9 aa, Homo Sapiens
HMSSAALIH

SEQ ID NO: 1255986 - protein, 9 aa, Homo Sapiens
EKNEKGVLK

SEQ ID NO: 1255987 - protein, 9 aa, Homo Sapiens
DLPQHKGVA

SEQ ID NO: 1255988 - protein, 9 aa, Homo Sapiens
LQGGEETQC

SEQ ID NO: 1255989 - protein, 9 aa, Homo Sapiens
PEKKVSEVG

SEQ ID NO: 1255990 - protein, 9 aa, Homo Sapiens
HCPLDLRPP

SEQ ID NO: 1255991 - protein, 9 aa, Homo Sapiens
LISCIFVLY

SEQ ID NO: 1255992 - protein, 9 aa, Homo Sapiens
PNSRVEIVT

SEQ ID NO: 1255993 - protein, 9 aa, Homo Sapiens
DRKTGVKLS

SEQ ID NO: 1255994 - protein, 9 aa, Homo Sapiens
LENLLTDDV

SEQ ID NO: 1255995 - protein, 9 aa, Homo Sapiens
YGRTSEFLL

SEQ ID NO: 1255996 - protein, 9 aa, Homo Sapiens
VMLGLCSWT

SEQ ID NO: 1255997 - protein, 9 aa, Homo Sapiens
MAAMSFLTI

SEQ ID NO: 1255998 - protein, 9 aa, Homo Sapiens
IMQNLEFIE

SEQ ID NO: 1255999 - protein, 9 aa, Homo Sapiens
PQHVKNQGT

SEQ ID NO: 1256000 - protein, 9 aa, Homo Sapiens
IELEYSRIL

SEQ ID NO: 1256001 - protein, 9 aa, Homo Sapiens
TAQEQNENI

SEQ ID NO: 1256002 - protein, 9 aa, Homo Sapiens
DVVSDVRLM

SEQ ID NO: 1256003 - protein, 9 aa, Homo Sapiens
DGQTQKRSF

SEQ ID NO: 1256004 - protein, 9 aa, Homo Sapiens
IESMELNKI

SEQ ID NO: 1256005 - protein, 9 aa, Homo Sapiens
KRPRHVILD

SEQ ID NO: 1256006 - protein, 9 aa, Homo Sapiens
KVYKVKYPI

SEQ ID NO: 1256007 - protein, 9 aa, Homo Sapiens
NLPRGSRTH

SEQ ID NO: 1256008 - protein, 9 aa, Homo Sapiens
DHYARSPKE

SEQ ID NO: 1256009 - protein, 9 aa, Homo Sapiens
DLQFWLGDM

SEQ ID NO: 1256010 - protein, 9 aa, Homo Sapiens
GCGPAEQRI

SEQ ID NO: 1256011 - protein, 9 aa, Homo Sapiens
SLGYLTSTS

SEQ ID NO: 1256012 - protein, 9 aa, Homo Sapiens
ISSPTCSKD

SEQ ID NO: 1256013 - protein, 9 aa, Homo Sapiens
GHLHQNRLA

SEQ ID NO: 1256014 - protein, 9 aa, Homo Sapiens
GHYMCNACG

SEQ ID NO: 1256015 - protein, 9 aa, Homo Sapiens
GAVFYSIIT

SEQ ID NO: 1256016 - protein, 9 aa, Homo Sapiens
EPSDPYDHE

SEQ ID NO: 1256017 - protein, 9 aa, Homo Sapiens
KEWMQKKRR

SEQ ID NO: 1256018 - protein, 9 aa, Homo Sapiens
GKATCSDSS

SEQ ID NO: 1256019 - protein, 9 aa, Homo Sapiens
VWSQMAVPC

SEQ ID NO: 1256020 - protein, 9 aa, Homo Sapiens
RGFCATLSK

SEQ ID NO: 1256021 - protein, 9 aa, Homo Sapiens
PTLGAALPP

SEQ ID NO: 1256022 - protein, 9 aa, Homo Sapiens
PGAAVGSVC

SEQ ID NO: 1256023 - protein, 9 aa, Homo Sapiens
MKLLHVLAS

SEQ ID NO: 1256024 - protein, 9 aa, Homo Sapiens
GHARESEMC

SEQ ID NO: 1256025 - protein, 9 aa, Homo Sapiens
TVMDGLHGS

SEQ ID NO: 1256026 - protein, 9 aa, Homo Sapiens
DKNHEALAK

SEQ ID NO: 1256027 - protein, 9 aa, Homo Sapiens
KEEESKKGL

SEQ ID NO: 1256028 - protein, 9 aa, Homo Sapiens
KLTTALIVL

SEQ ID NO: 1256029 - protein, 9 aa, Homo Sapiens
NLLKMRSFP

SEQ ID NO: 1256030 - protein, 9 aa, Homo Sapiens
GKCIHCILL

SEQ ID NO: 1256031 - protein, 9 aa, Homo Sapiens
ANKSILTSA

SEQ ID NO: 1256032 - protein, 9 aa, Homo Sapiens
QTAILLPGA

SEQ ID NO: 1256033 - protein, 9 aa, Homo Sapiens
LTNVFREEL

SEQ ID NO: 1256034 - protein, 9 aa, Homo Sapiens
YRSMSTSTW

SEQ ID NO: 1256035 - protein, 9 aa, Homo Sapiens
LAPCLPSYP

SEQ ID NO: 1256036 - protein, 9 aa, Homo Sapiens
AIKDQLHKY

SEQ ID NO: 1256037 - protein, 9 aa, Homo Sapiens
HRHTHTHRY

SEQ ID NO: 1256038 - protein, 9 aa, Homo Sapiens
NAVGNHLNE

SEQ ID NO: 1256039 - protein, 9 aa, Homo Sapiens
EQKMSDDGV

SEQ ID NO: 1256040 - protein, 9 aa, Homo Sapiens
MRAAGRHLC

SEQ ID NO: 1256041 - protein, 9 aa, Homo Sapiens
WCSYIAESD

SEQ ID NO: 1256042 - protein, 9 aa, Homo Sapiens
LSALREAQI

SEQ ID NO: 1256043 - protein, 9 aa, Homo Sapiens
AGAAGASVA

SEQ ID NO: 1256044 - protein, 9 aa, Homo Sapiens
DCNLVRYNI

SEQ ID NO: 1256045 - protein, 9 aa, Homo Sapiens
DAMTQDTQN

SEQ ID NO: 1256046 - protein, 9 aa, Homo Sapiens
KESQLTCDS

SEQ ID NO: 1256047 - protein, 9 aa, Homo Sapiens
QSRKAIDTA

SEQ ID NO: 1256048 - protein, 9 aa, Homo Sapiens
TEKLSAKGD

SEQ ID NO: 1256049 - protein, 9 aa, Homo Sapiens
SKKNRNNDV

SEQ ID NO: 1256050 - protein, 9 aa, Homo Sapiens
MRKTAEDLE

SEQ ID NO: 1256051 - protein, 9 aa, Homo Sapiens
NNPPAHESI

SEQ ID NO: 1256052 - protein, 9 aa, Homo Sapiens
LYINIISIL

SEQ ID NO: 1256053 - protein, 9 aa, Homo Sapiens
GSLPIRVLS

SEQ ID NO: 1256054 - protein, 9 aa, Homo Sapiens
TVHCMANLC

SEQ ID NO: 1256055 - protein, 9 aa, Homo Sapiens
TAVRHGSCS

SEQ ID NO: 1256056 - protein, 9 aa, Homo Sapiens
RSSPAYYTS

SEQ ID NO: 1256057 - protein, 9 aa, Homo Sapiens
CCRWEALAT

SEQ ID NO: 1256058 - protein, 9 aa, Homo Sapiens
NMSDTGWVN

SEQ ID NO: 1256059 - protein, 9 aa, Homo Sapiens
DTFEDLSDM

SEQ ID NO: 1256060 - protein, 9 aa, Homo Sapiens
FTGDILMRM

SEQ ID NO: 1256061 - protein, 9 aa, Homo Sapiens
AAPGFSFSK

SEQ ID NO: 1256062 - protein, 9 aa, Homo Sapiens
IITFHITSA

SEQ ID NO: 1256063 - protein, 9 aa, Homo Sapiens
EIAKKVQEL

SEQ ID NO: 1256064 - protein, 9 aa, Homo Sapiens
EQCYRPLEP

SEQ ID NO: 1256065 - protein, 9 aa, Homo Sapiens
AYFVMTCQE

SEQ ID NO: 1256066 - protein, 9 aa, Homo Sapiens
KNEKGVLKR

SEQ ID NO: 1256067 - protein, 9 aa, Homo Sapiens
DKVVYCRCW

SEQ ID NO: 1256068 - protein, 9 aa, Homo Sapiens
SSHLLMVGM

SEQ ID NO: 1256069 - protein, 9 aa, Homo Sapiens
AREQRWQLQ

SEQ ID NO: 1256070 - protein, 9 aa, Homo Sapiens
DAHSGRCAN

SEQ ID NO: 1256071 - protein, 9 aa, Homo Sapiens
LCALVFKVL

SEQ ID NO: 1256072 - protein, 9 aa, Homo Sapiens
QMSKALFRK

SEQ ID NO: 1256073 - protein, 9 aa, Homo Sapiens
NPSNFLLDR

SEQ ID NO: 1256074 - protein, 9 aa, Homo Sapiens
EVFAHALHF

SEQ ID NO: 1256075 - protein, 9 aa, Homo Sapiens
YDSICQQNG

SEQ ID NO: 1256076 - protein, 9 aa, Homo Sapiens
CTAPTPAAA

SEQ ID NO: 1256077 - protein, 9 aa, Homo Sapiens
YHHHFPQAL

SEQ ID NO: 1256078 - protein, 9 aa, Homo Sapiens
GSTCLLSPG

SEQ ID NO: 1256079 - protein, 9 aa, Homo Sapiens
AEEAEQHQG

SEQ ID NO: 1256080 - protein, 9 aa, Homo Sapiens
LIPVREQYK

SEQ ID NO: 1256081 - protein, 9 aa, Homo Sapiens
TSLVLIWIF

SEQ ID NO: 1256082 - protein, 9 aa, Homo Sapiens
ACPPRQSCG

SEQ ID NO: 1256083 - protein, 9 aa, Homo Sapiens
QRCSLEGEL

SEQ ID NO: 1256084 - protein, 9 aa, Homo Sapiens
IFTNIEAAL

SEQ ID NO: 1256085 - protein, 9 aa, Homo Sapiens
YEMSRGEHD

SEQ ID NO: 1256086 - protein, 9 aa, Homo Sapiens
AINQQMGAF

SEQ ID NO: 1256087 - protein, 9 aa, Homo Sapiens
HARQILHPE

SEQ ID NO: 1256088 - protein, 9 aa, Homo Sapiens
DSATELLLL

SEQ ID NO: 1256089 - protein, 9 aa, Homo Sapiens
QYHISLQFD

SEQ ID NO: 1256090 - protein, 9 aa, Homo Sapiens
GPGTLPGSS

SEQ ID NO: 1256091 - protein, 9 aa, Homo Sapiens
RPPRAHVQH

SEQ ID NO: 1256092 - protein, 9 aa, Homo Sapiens
LLAMLLDGR

SEQ ID NO: 1256093 - protein, 9 aa, Homo Sapiens
KKGEEGGRM

SEQ ID NO: 1256094 - protein, 9 aa, Homo Sapiens
LAEEGRTIY

SEQ ID NO: 1256095 - protein, 9 aa, Homo Sapiens
QMHMGGQIP

SEQ ID NO: 1256096 - protein, 9 aa, Homo Sapiens
SLKRCSFHI

SEQ ID NO: 1256097 - protein, 9 aa, Homo Sapiens
TSFYNHSWK

SEQ ID NO: 1256098 - protein, 9 aa, Homo Sapiens
LVKHQGQHL

SEQ ID NO: 1256099 - protein, 9 aa, Homo Sapiens
PTEHVERFF

SEQ ID NO: 1256100 - protein, 9 aa, Homo Sapiens
GEVTSMSEI

SEQ ID NO: 1256101 - protein, 9 aa, Homo Sapiens
PHHRNIPNG

SEQ ID NO: 1256102 - protein, 9 aa, Homo Sapiens
TLCEDMGQF

SEQ ID NO: 1256103 - protein, 9 aa, Homo Sapiens
FEGVTSIIF

SEQ ID NO: 1256104 - protein, 9 aa, Homo Sapiens
HLTQGEPKG

SEQ ID NO: 1256105 - protein, 9 aa, Homo Sapiens
TTKCFAKRL

SEQ ID NO: 1256106 - protein, 9 aa, Homo Sapiens
ARCREEGLS

SEQ ID NO: 1256107 - protein, 9 aa, Homo Sapiens
HTAPSFTKN

SEQ ID NO: 1256108 - protein, 9 aa, Homo Sapiens
CGRSGNSPM

SEQ ID NO: 1256109 - protein, 9 aa, Homo Sapiens
FPSATLCST

SEQ ID NO: 1256110 - protein, 9 aa, Homo Sapiens
ISLALHLQP

SEQ ID NO: 1256111 - protein, 9 aa, Homo Sapiens
LASCASVAI

SEQ ID NO: 1256112 - protein, 9 aa, Homo Sapiens
SGNLRSRKL

SEQ ID NO: 1256113 - protein, 9 aa, Homo Sapiens
EQPLFQPMD

SEQ ID NO: 1256114 - protein, 9 aa, Homo Sapiens
VLEKFTILQ

SEQ ID NO: 1256115 - protein, 9 aa, Homo Sapiens
EEEVETLLK

SEQ ID NO: 1256116 - protein, 9 aa, Homo Sapiens
FPVFVTSCN

SEQ ID NO: 1256117 - protein, 9 aa, Homo Sapiens
FFDHNGSSS

SEQ ID NO: 1256118 - protein, 9 aa, Homo Sapiens
TTFCGGLAA

SEQ ID NO: 1256119 - protein, 9 aa, Homo Sapiens
LVRVGLRNP

SEQ ID NO: 1256120 - protein, 9 aa, Homo Sapiens
IPYILSQTE

SEQ ID NO: 1256121 - protein, 9 aa, Homo Sapiens
PKALKPKKT

SEQ ID NO: 1256122 - protein, 9 aa, Homo Sapiens
LYSEDSTPA

SEQ ID NO: 1256123 - protein, 9 aa, Homo Sapiens
SSPTPSSGA

SEQ ID NO: 1256124 - protein, 9 aa, Homo Sapiens
LVFGYTQRQ

SEQ ID NO: 1256125 - protein, 9 aa, Homo Sapiens
YNSCPEGVR

SEQ ID NO: 1256126 - protein, 9 aa, Homo Sapiens
SCWVRQAAF

SEQ ID NO: 1256127 - protein, 9 aa, Homo Sapiens
RTQSLQPVV

SEQ ID NO: 1256128 - protein, 9 aa, Homo Sapiens
EDWFTTETL

SEQ ID NO: 1256129 - protein, 9 aa, Homo Sapiens
LLSSVSAEL

SEQ ID NO: 1256130 - protein, 9 aa, Homo Sapiens
KSSQIGSCG

SEQ ID NO: 1256131 - protein, 9 aa, Homo Sapiens
SDISRELEE

SEQ ID NO: 1256132 - protein, 9 aa, Homo Sapiens
GRNMSGQPN

SEQ ID NO: 1256133 - protein, 9 aa, Homo Sapiens
LRQREGQQF

SEQ ID NO: 1256134 - protein, 9 aa, Homo Sapiens
WEMKEDQGE

SEQ ID NO: 1256135 - protein, 9 aa, Homo Sapiens
FSVFPVFVT

SEQ ID NO: 1256136 - protein, 9 aa, Homo Sapiens
LKNQIRSGM

SEQ ID NO: 1256137 - protein, 9 aa, Homo Sapiens
GVTEVHVPT

SEQ ID NO: 1256138 - protein, 9 aa, Homo Sapiens
ATAPAASLE

SEQ ID NO: 1256139 - protein, 9 aa, Homo Sapiens
DTHKQHGKA

SEQ ID NO: 1256140 - protein, 9 aa, Homo Sapiens
VSVSISHNS

SEQ ID NO: 1256141 - protein, 9 aa, Homo Sapiens
LVFINSFGG

SEQ ID NO: 1256142 - protein, 9 aa, Homo Sapiens
SCLDIMYNE

SEQ ID NO: 1256143 - protein, 9 aa, Homo Sapiens
EELGKVIIQ

SEQ ID NO: 1256144 - protein, 9 aa, Homo Sapiens
WFTCMFAFF

SEQ ID NO: 1256145 - protein, 9 aa, Homo Sapiens
VDELLEILG

SEQ ID NO: 1256146 - protein, 9 aa, Homo Sapiens
QLPRPHVLP

SEQ ID NO: 1256147 - protein, 9 aa, Homo Sapiens
DGQLHARQI

SEQ ID NO: 1256148 - protein, 9 aa, Homo Sapiens
VGIVDQVVT

SEQ ID NO: 1256149 - protein, 9 aa, Homo Sapiens
FAVLGTMVM

SEQ ID NO: 1256150 - protein, 9 aa, Homo Sapiens
VLTKHLLGS

SEQ ID NO: 1256151 - protein, 9 aa, Homo Sapiens
LHSGLMIKK

SEQ ID NO: 1256152 - protein, 9 aa, Homo Sapiens
SGKLKKSFD

SEQ ID NO: 1256153 - protein, 9 aa, Homo Sapiens
LFLFSVLFV

SEQ ID NO: 1256154 - protein, 9 aa, Homo Sapiens
GAPGGPGHL

SEQ ID NO: 1256155 - protein, 9 aa, Homo Sapiens
YYATQNCMG

SEQ ID NO: 1256156 - protein, 9 aa, Homo Sapiens
TTIRVRCNP

SEQ ID NO: 1256157 - protein, 9 aa, Homo Sapiens
YMTANDPVV

SEQ ID NO: 1256158 - protein, 9 aa, Homo Sapiens
EAWNERVVN

SEQ ID NO: 1256159 - protein, 9 aa, Homo Sapiens
VLGTSAFSK

SEQ ID NO: 1256160 - protein, 9 aa, Homo Sapiens
VHQFKMQLL

SEQ ID NO: 1256161 - protein, 9 aa, Homo Sapiens
FPNKHIRFN

SEQ ID NO: 1256162 - protein, 9 aa, Homo Sapiens
GSQVIIIVG

SEQ ID NO: 1256163 - protein, 9 aa, Homo Sapiens
HGSDALNIQ

SEQ ID NO: 1256164 - protein, 9 aa, Homo Sapiens
LMQQALQGM

SEQ ID NO: 1256165 - protein, 9 aa, Homo Sapiens
HMLRTRAKS

SEQ ID NO: 1256166 - protein, 9 aa, Homo Sapiens
GQQMDPNRA

SEQ ID NO: 1256167 - protein, 9 aa, Homo Sapiens
PSGMEHQQT

SEQ ID NO: 1256168 - protein, 9 aa, Homo Sapiens
ECLANVSWA

SEQ ID NO: 1256169 - protein, 9 aa, Homo Sapiens
YIKSLSAPG

SEQ ID NO: 1256170 - protein, 9 aa, Homo Sapiens
GSWMATEAG

SEQ ID NO: 1256171 - protein, 9 aa, Homo Sapiens
MNAFKTDTE

SEQ ID NO: 1256172 - protein, 9 aa, Homo Sapiens
ESVSVVLLN

SEQ ID NO: 1256173 - protein, 9 aa, Homo Sapiens
ASEYTSYQR

SEQ ID NO: 1256174 - protein, 9 aa, Homo Sapiens
YERWTGHEV

SEQ ID NO: 1256175 - protein, 9 aa, Homo Sapiens
KEHETWLAP

SEQ ID NO: 1256176 - protein, 9 aa, Homo Sapiens
DKARTLYTI

SEQ ID NO: 1256177 - protein, 9 aa, Homo Sapiens
LWTAHIFPV

SEQ ID NO: 1256178 - protein, 9 aa, Homo Sapiens
ASPSTHSIS

SEQ ID NO: 1256179 - protein, 9 aa, Homo Sapiens
GDLTSRLSS

SEQ ID NO: 1256180 - protein, 9 aa, Homo Sapiens
YPDSFSMRR

SEQ ID NO: 1256181 - protein, 9 aa, Homo Sapiens
CSLERDPSN

SEQ ID NO: 1256182 - protein, 9 aa, Homo Sapiens
VGTETVIDK

SEQ ID NO: 1256183 - protein, 9 aa, Homo Sapiens
ISFTSFPIL

SEQ ID NO: 1256184 - protein, 9 aa, Homo Sapiens
LRFLSSHLA

SEQ ID NO: 1256185 - protein, 9 aa, Homo Sapiens
RTHSFGHFP

SEQ ID NO: 1256186 - protein, 9 aa, Homo Sapiens
GSDPSIKSF

SEQ ID NO: 1256187 - protein, 9 aa, Homo Sapiens
SSLGLARTS

SEQ ID NO: 1256188 - protein, 9 aa, Homo Sapiens
ANIKAKLPV

SEQ ID NO: 1256189 - protein, 9 aa, Homo Sapiens
MVCDVLKAV

SEQ ID NO: 1256190 - protein, 9 aa, Homo Sapiens
GTGVVHAAL

SEQ ID NO: 1256191 - protein, 9 aa, Homo Sapiens
MDIMLICTT

SEQ ID NO: 1256192 - protein, 9 aa, Homo Sapiens
GMTCSSCHR

SEQ ID NO: 1256193 - protein, 9 aa, Homo Sapiens
SMGTCLIAK

SEQ ID NO: 1256194 - protein, 9 aa, Homo Sapiens
SRGREKCHS

SEQ ID NO: 1256195 - protein, 9 aa, Homo Sapiens
EEVFPLAMH

SEQ ID NO: 1256196 - protein, 9 aa, Homo Sapiens
FEIQQTGPF

SEQ ID NO: 1256197 - protein, 9 aa, Homo Sapiens
PDQDLFLLN

SEQ ID NO: 1256198 - protein, 9 aa, Homo Sapiens
VIVQVFEGT

SEQ ID NO: 1256199 - protein, 9 aa, Homo Sapiens
TLRNLHCYP

SEQ ID NO: 1256200 - protein, 9 aa, Homo Sapiens
SNISKRTEY

SEQ ID NO: 1256201 - protein, 9 aa, Homo Sapiens
PLAHGDRRG

SEQ ID NO: 1256202 - protein, 9 aa, Homo Sapiens
IGRIFDGRE

SEQ ID NO: 1256203 - protein, 9 aa, Homo Sapiens
KVMGGLKNS

SEQ ID NO: 1256204 - protein, 9 aa, Homo Sapiens
HRYLCYLAE

SEQ ID NO: 1256205 - protein, 9 aa, Homo Sapiens
KLSLRFETR

SEQ ID NO: 1256206 - protein, 9 aa, Homo Sapiens
NIAYLAVRR

SEQ ID NO: 1256207 - protein, 9 aa, Homo Sapiens
STLYISLNK

SEQ ID NO: 1256208 - protein, 9 aa, Homo Sapiens
IKEKEKQSD

SEQ ID NO: 1256209 - protein, 9 aa, Homo Sapiens
PVGPVQVGK

SEQ ID NO: 1256210 - protein, 9 aa, Homo Sapiens
LSQWMWCLF

SEQ ID NO: 1256211 - protein, 9 aa, Homo Sapiens
GLARAHAGL

SEQ ID NO: 1256212 - protein, 9 aa, Homo Sapiens
CCLVTSFYW

SEQ ID NO: 1256213 - protein, 9 aa, Homo Sapiens
PQTLSHLKC

SEQ ID NO: 1256214 - protein, 9 aa, Homo Sapiens
ELLAKKWGS

SEQ ID NO: 1256215 - protein, 9 aa, Homo Sapiens
DERSHFSLN

SEQ ID NO: 1256216 - protein, 9 aa, Homo Sapiens
VKSLVQKLH

SEQ ID NO: 1256217 - protein, 9 aa, Homo Sapiens
ACWARGGCL

SEQ ID NO: 1256218 - protein, 9 aa, Homo Sapiens
YTGTTRVAY

SEQ ID NO: 1256219 - protein, 9 aa, Homo Sapiens
MAYIWDYFI

SEQ ID NO: 1256220 - protein, 9 aa, Homo Sapiens
YQTEQYNEE

SEQ ID NO: 1256221 - protein, 9 aa, Homo Sapiens
GLTICGHNY

SEQ ID NO: 1256222 - protein, 9 aa, Homo Sapiens
RLMGYGIVC

SEQ ID NO: 1256223 - protein, 9 aa, Homo Sapiens
IVIDSDNEE

SEQ ID NO: 1256224 - protein, 9 aa, Homo Sapiens
DERCYLDLT

SEQ ID NO: 1256225 - protein, 9 aa, Homo Sapiens
VNTVCHSKI

SEQ ID NO: 1256226 - protein, 9 aa, Homo Sapiens
IDSKPSARH

SEQ ID NO: 1256227 - protein, 9 aa, Homo Sapiens
PPQLQAPMA

SEQ ID NO: 1256228 - protein, 9 aa, Homo Sapiens
YECNECEIA

SEQ ID NO: 1256229 - protein, 9 aa, Homo Sapiens
TMKRLDSKV

SEQ ID NO: 1256230 - protein, 9 aa, Homo Sapiens
CKEKMSQQK

SEQ ID NO: 1256231 - protein, 9 aa, Homo Sapiens
CFLQVTATY

SEQ ID NO: 1256232 - protein, 9 aa, Homo Sapiens
HHRRSHQGE

SEQ ID NO: 1256233 - protein, 9 aa, Homo Sapiens
LWLFLFQIQ

SEQ ID NO: 1256234 - protein, 9 aa, Homo Sapiens
TRALRRLQS

SEQ ID NO: 1256235 - protein, 9 aa, Homo Sapiens
LQQSVLWNC

SEQ ID NO: 1256236 - protein, 9 aa, Homo Sapiens
DMYWMASNY

SEQ ID NO: 1256237 - protein, 9 aa, Homo Sapiens
LDEFLKKFE

SEQ ID NO: 1256238 - protein, 9 aa, Homo Sapiens
MLSSTSPLE

SEQ ID NO: 1256239 - protein, 9 aa, Homo Sapiens
PVELGYQVT

SEQ ID NO: 1256240 - protein, 9 aa, Homo Sapiens
YALGDLFQS

SEQ ID NO: 1256241 - protein, 9 aa, Homo Sapiens
CSSPVLTKH

SEQ ID NO: 1256242 - protein, 9 aa, Homo Sapiens
LAAKYGYAL

SEQ ID NO: 1256243 - protein, 9 aa, Homo Sapiens
ECNRPQPVH

SEQ ID NO: 1256244 - protein, 9 aa, Homo Sapiens
VETLLKSKD

SEQ ID NO: 1256245 - protein, 9 aa, Homo Sapiens
QVSRQWKMK

SEQ ID NO: 1256246 - protein, 9 aa, Homo Sapiens
LWNEDYNPY

SEQ ID NO: 1256247 - protein, 9 aa, Homo Sapiens
LEEMCKREA

SEQ ID NO: 1256248 - protein, 9 aa, Homo Sapiens
LDDSLLDLS

SEQ ID NO: 1256249 - protein, 9 aa, Homo Sapiens
SFRKVLIYQ

SEQ ID NO: 1256250 - protein, 9 aa, Homo Sapiens
LADIEQSTS

SEQ ID NO: 1256251 - protein, 9 aa, Homo Sapiens
QRSVASDYM

SEQ ID NO: 1256252 - protein, 9 aa, Homo Sapiens
STREIIIRN

SEQ ID NO: 1256253 - protein, 9 aa, Homo Sapiens
PGIFSVGLH

SEQ ID NO: 1256254 - protein, 9 aa, Homo Sapiens
TITSREIKT

SEQ ID NO: 1256255 - protein, 9 aa, Homo Sapiens
RTGKAVSTP

SEQ ID NO: 1256256 - protein, 9 aa, Homo Sapiens
VDVQEMELV

SEQ ID NO: 1256257 - protein, 9 aa, Homo Sapiens
PLNIYYVRN

SEQ ID NO: 1256258 - protein, 9 aa, Homo Sapiens
HDTLKGLSS

SEQ ID NO: 1256259 - protein, 9 aa, Homo Sapiens
TDLTGLPEG

SEQ ID NO: 1256260 - protein, 9 aa, Homo Sapiens
SIIEHMPPK

SEQ ID NO: 1256261 - protein, 9 aa, Homo Sapiens
SKVGPYPWW

SEQ ID NO: 1256262 - protein, 9 aa, Homo Sapiens
VLQRTLSVL

SEQ ID NO: 1256263 - protein, 9 aa, Homo Sapiens
AVNLHPQLA

SEQ ID NO: 1256264 - protein, 9 aa, Homo Sapiens
LISPNINRR

SEQ ID NO: 1256265 - protein, 9 aa, Homo Sapiens
AQKEVAGFL

SEQ ID NO: 1256266 - protein, 9 aa, Homo Sapiens
GFHMLFYTM

SEQ ID NO: 1256267 - protein, 9 aa, Homo Sapiens
LEGSAEIPT

SEQ ID NO: 1256268 - protein, 9 aa, Homo Sapiens
LGFLRWLLE

SEQ ID NO: 1256269 - protein, 9 aa, Homo Sapiens
QQTGPFWYE

SEQ ID NO: 1256270 - protein, 9 aa, Homo Sapiens
PTRTAHFGS

SEQ ID NO: 1256271 - protein, 9 aa, Homo Sapiens
GSTRLEAMF

SEQ ID NO: 1256272 - protein, 9 aa, Homo Sapiens
TPQPLTSAR

SEQ ID NO: 1256273 - protein, 9 aa, Homo Sapiens
GFFQSFSDA

SEQ ID NO: 1256274 - protein, 9 aa, Homo Sapiens
KMLDQSPTV

SEQ ID NO: 1256275 - protein, 9 aa, Homo Sapiens
PVVIFKYIE

SEQ ID NO: 1256276 - protein, 9 aa, Homo Sapiens
IAQLKQKLQ

SEQ ID NO: 1256277 - protein, 9 aa, Homo Sapiens
EGGNGMDSD

SEQ ID NO: 1256278 - protein, 9 aa, Homo Sapiens
CDLAVCKKI

SEQ ID NO: 1256279 - protein, 9 aa, Homo Sapiens
QMRVMGLGR

SEQ ID NO: 1256280 - protein, 9 aa, Homo Sapiens
SEQLGQEYG

SEQ ID NO: 1256281 - protein, 9 aa, Homo Sapiens
EGKNATLKT

SEQ ID NO: 1256282 - protein, 9 aa, Homo Sapiens
DGCRLSGEM

SEQ ID NO: 1256283 - protein, 9 aa, Homo Sapiens
IKVVAVDGD

SEQ ID NO: 1256284 - protein, 9 aa, Homo Sapiens
FSDNLAKTH

SEQ ID NO: 1256285 - protein, 9 aa, Homo Sapiens
HYTTPEDVV

SEQ ID NO: 1256286 - protein, 9 aa, Homo Sapiens
ATLLFCLLV

SEQ ID NO: 1256287 - protein, 9 aa, Homo Sapiens
YKCIHQNLE

SEQ ID NO: 1256288 - protein, 9 aa, Homo Sapiens
ASPGATLTG

SEQ ID NO: 1256289 - protein, 9 aa, Homo Sapiens
IGINAELSL

SEQ ID NO: 1256290 - protein, 9 aa, Homo Sapiens
ELVLFEEKN

SEQ ID NO: 1256291 - protein, 9 aa, Homo Sapiens
SGNVRNPAS

SEQ ID NO: 1256292 - protein, 9 aa, Homo Sapiens
EFLSLLAKC

SEQ ID NO: 1256293 - protein, 9 aa, Homo Sapiens
TLYLPLVGI

SEQ ID NO: 1256294 - protein, 9 aa, Homo Sapiens
HSATAEYSR

SEQ ID NO: 1256295 - protein, 9 aa, Homo Sapiens
KQEEMAVRD

SEQ ID NO: 1256296 - protein, 9 aa, Homo Sapiens
AKYKLKSYL

SEQ ID NO: 1256297 - protein, 9 aa, Homo Sapiens
PRPRGNQGD

SEQ ID NO: 1256298 - protein, 9 aa, Homo Sapiens
KFVTAFFKW

SEQ ID NO: 1256299 - protein, 9 aa, Homo Sapiens
GKQEGANLL

SEQ ID NO: 1256300 - protein, 9 aa, Homo Sapiens
LQLFQAEGN

SEQ ID NO: 1256301 - protein, 9 aa, Homo Sapiens
QPQILLYSS

SEQ ID NO: 1256302 - protein, 9 aa, Homo Sapiens
LYLEAFCLP

SEQ ID NO: 1256303 - protein, 9 aa, Homo Sapiens
YNTGPGTLP

SEQ ID NO: 1256304 - protein, 9 aa, Homo Sapiens
SPNINRRNE

SEQ ID NO: 1256305 - protein, 9 aa, Homo Sapiens
ILNFLWHGK

SEQ ID NO: 1256306 - protein, 9 aa, Homo Sapiens
VHLTASRTG

SEQ ID NO: 1256307 - protein, 9 aa, Homo Sapiens
PPHMAIQQH

SEQ ID NO: 1256308 - protein, 9 aa, Homo Sapiens
FLSNMSFVN

SEQ ID NO: 1256309 - protein, 9 aa, Homo Sapiens
LKEQLSELE

SEQ ID NO: 1256310 - protein, 9 aa, Homo Sapiens
RMPEFGDFA

SEQ ID NO: 1256311 - protein, 9 aa, Homo Sapiens
PFFTTSPES

SEQ ID NO: 1256312 - protein, 9 aa, Homo Sapiens
REIIIRNIQ

SEQ ID NO: 1256313 - protein, 9 aa, Homo Sapiens
SADATINFA

SEQ ID NO: 1256314 - protein, 9 aa, Homo Sapiens
DVTVKTAMI

SEQ ID NO: 1256315 - protein, 9 aa, Homo Sapiens
EHFNGVDEL

SEQ ID NO: 1256316 - protein, 9 aa, Homo Sapiens
GIVSTSSHL

SEQ ID NO: 1256317 - protein, 9 aa, Homo Sapiens
HAGLELLTS

SEQ ID NO: 1256318 - protein, 9 aa, Homo Sapiens
AHASALCHS

SEQ ID NO: 1256319 - protein, 9 aa, Homo Sapiens
ARALHKVFL

SEQ ID NO: 1256320 - protein, 9 aa, Homo Sapiens
RGARVSLPS

SEQ ID NO: 1256321 - protein, 9 aa, Homo Sapiens
CSKQRHKQS

SEQ ID NO: 1256322 - protein, 9 aa, Homo Sapiens
EAEAIHILT

SEQ ID NO: 1256323 - protein, 9 aa, Homo Sapiens
LSQICLNTE

SEQ ID NO: 1256324 - protein, 9 aa, Homo Sapiens
DNQTRYVGQ

SEQ ID NO: 1256325 - protein, 9 aa, Homo Sapiens
ADGADGRQH

SEQ ID NO: 1256326 - protein, 9 aa, Homo Sapiens
DAFQKPIPL

SEQ ID NO: 1256327 - protein, 9 aa, Homo Sapiens
SLSINRYDK

SEQ ID NO: 1256328 - protein, 9 aa, Homo Sapiens
TIFLYVRTG

SEQ ID NO: 1256329 - protein, 9 aa, Homo Sapiens
QEEDFPTLV

SEQ ID NO: 1256330 - protein, 9 aa, Homo Sapiens
TGYTLGFMS

SEQ ID NO: 1256331 - protein, 9 aa, Homo Sapiens
TTCGQMTSY

SEQ ID NO: 1256332 - protein, 9 aa, Homo Sapiens
HSSLGKLFK

SEQ ID NO: 1256333 - protein, 9 aa, Homo Sapiens
SDTRSSDPP

SEQ ID NO: 1256334 - protein, 9 aa, Homo Sapiens
TSVTYLYLG

SEQ ID NO: 1256335 - protein, 9 aa, Homo Sapiens
QAHTGIHTD

SEQ ID NO: 1256336 - protein, 9 aa, Homo Sapiens
LGDLTGDNS

SEQ ID NO: 1256337 - protein, 9 aa, Homo Sapiens
IYTQQKKEQ

SEQ ID NO: 1256338 - protein, 9 aa, Homo Sapiens
TCKGDKKLL

SEQ ID NO: 1256339 - protein, 9 aa, Homo Sapiens
ALLLACSRD

SEQ ID NO: 1256340 - protein, 9 aa, Homo Sapiens
IMGQAYAFA

SEQ ID NO: 1256341 - protein, 9 aa, Homo Sapiens
SPASAGLRH

SEQ ID NO: 1256342 - protein, 9 aa, Homo Sapiens
QCFFLSDNQ

SEQ ID NO: 1256343 - protein, 9 aa, Homo Sapiens
KLIAAVMNT

SEQ ID NO: 1256344 - protein, 9 aa, Homo Sapiens
AIILFSRSL

SEQ ID NO: 1256345 - protein, 9 aa, Homo Sapiens
DGELKMLQD

SEQ ID NO: 1256346 - protein, 9 aa, Homo Sapiens
QLSSARAEN

SEQ ID NO: 1256347 - protein, 9 aa, Homo Sapiens
DLDVTVKTA

SEQ ID NO: 1256348 - protein, 9 aa, Homo Sapiens
QQQQIDPNN

SEQ ID NO: 1256349 - protein, 9 aa, Homo Sapiens
NVGECDGTA

SEQ ID NO: 1256350 - protein, 9 aa, Homo Sapiens
IIGFVISGR

SEQ ID NO: 1256351 - protein, 9 aa, Homo Sapiens
EDAQVGTII

SEQ ID NO: 1256352 - protein, 9 aa, Homo Sapiens
HTAACLEEA

SEQ ID NO: 1256353 - protein, 9 aa, Homo Sapiens
KYNVMLVRL

SEQ ID NO: 1256354 - protein, 9 aa, Homo Sapiens
GICWYQCCP

SEQ ID NO: 1256355 - protein, 9 aa, Homo Sapiens
TFYEVDCDA

SEQ ID NO: 1256356 - protein, 9 aa, Homo Sapiens
INIRLIRQV

SEQ ID NO: 1256357 - protein, 9 aa, Homo Sapiens
FPERPYLAD

SEQ ID NO: 1256358 - protein, 9 aa, Homo Sapiens
PQVKLCRAV

SEQ ID NO: 1256359 - protein, 9 aa, Homo Sapiens
EEVSLHFLK

SEQ ID NO: 1256360 - protein, 9 aa, Homo Sapiens
WTMDPQEMV

SEQ ID NO: 1256361 - protein, 9 aa, Homo Sapiens
PEVEPHLVY

SEQ ID NO: 1256362 - protein, 9 aa, Homo Sapiens
REIQRELLS

SEQ ID NO: 1256363 - protein, 9 aa, Homo Sapiens
VNGHPNENN

SEQ ID NO: 1256364 - protein, 9 aa, Homo Sapiens
EGLFGCMRP

SEQ ID NO: 1256365 - protein, 9 aa, Homo Sapiens
PKIATWRWS

SEQ ID NO: 1256366 - protein, 9 aa, Homo Sapiens
CPCDTRLRI

SEQ ID NO: 1256367 - protein, 9 aa, Homo Sapiens
YIRTGYRPA

SEQ ID NO: 1256368 - protein, 9 aa, Homo Sapiens
SALVEHETV

SEQ ID NO: 1256369 - protein, 9 aa, Homo Sapiens
WRMDGSVDF

SEQ ID NO: 1256370 - protein, 9 aa, Homo Sapiens
CEYMPNAIP

SEQ ID NO: 1256371 - protein, 9 aa, Homo Sapiens
ECAVLCLPC

SEQ ID NO: 1256372 - protein, 9 aa, Homo Sapiens
SKARIGGHI

SEQ ID NO: 1256373 - protein, 9 aa, Homo Sapiens
YSASKVFVC

SEQ ID NO: 1256374 - protein, 9 aa, Homo Sapiens
EMDELKPWI

SEQ ID NO: 1256375 - protein, 9 aa, Homo Sapiens
LQNCILFVN

SEQ ID NO: 1256376 - protein, 9 aa, Homo Sapiens
EFLVLTQKT

SEQ ID NO: 1256377 - protein, 9 aa, Homo Sapiens
MSPGTQLTN

SEQ ID NO: 1256378 - protein, 9 aa, Homo Sapiens
GALCKMVLM

SEQ ID NO: 1256379 - protein, 9 aa, Homo Sapiens
VGLTMNYCR

SEQ ID NO: 1256380 - protein, 9 aa, Homo Sapiens
GLWMEYATH

SEQ ID NO: 1256381 - protein, 9 aa, Homo Sapiens
ALQSISELD

SEQ ID NO: 1256382 - protein, 9 aa, Homo Sapiens
ARTGLLPGE

SEQ ID NO: 1256383 - protein, 9 aa, Homo Sapiens
GSLLGVLQY

SEQ ID NO: 1256384 - protein, 9 aa, Homo Sapiens
RFDASDKPL

SEQ ID NO: 1256385 - protein, 9 aa, Homo Sapiens
PSKAMFWWV

SEQ ID NO: 1256386 - protein, 9 aa, Homo Sapiens
NCALVIFEM

SEQ ID NO: 1256387 - protein, 9 aa, Homo Sapiens
GITFCNQLW

SEQ ID NO: 1256388 - protein, 9 aa, Homo Sapiens
LSSATATVS

SEQ ID NO: 1256389 - protein, 9 aa, Homo Sapiens
VVQVILDGL

SEQ ID NO: 1256390 - protein, 9 aa, Homo Sapiens
IQEEEKTLQ

SEQ ID NO: 1256391 - protein, 9 aa, Homo Sapiens
PTLSWSPPG

SEQ ID NO: 1256392 - protein, 9 aa, Homo Sapiens
VCGSDPSIK

SEQ ID NO: 1256393 - protein, 9 aa, Homo Sapiens
HLSALVNRM

SEQ ID NO: 1256394 - protein, 9 aa, Homo Sapiens
CSSCTGPSC

SEQ ID NO: 1256395 - protein, 9 aa, Homo Sapiens
APDSRDARW

SEQ ID NO: 1256396 - protein, 9 aa, Homo Sapiens
EDFLPGAIP

SEQ ID NO: 1256397 - protein, 9 aa, Homo Sapiens
GSLSGPDSS

SEQ ID NO: 1256398 - protein, 9 aa, Homo Sapiens
CNGKGNEPS

SEQ ID NO: 1256399 - protein, 9 aa, Homo Sapiens
YKSHRPCVT

SEQ ID NO: 1256400 - protein, 9 aa, Homo Sapiens
IEKSLYQEN

SEQ ID NO: 1256401 - protein, 9 aa, Homo Sapiens
IDTATQTEP

SEQ ID NO: 1256402 - protein, 9 aa, Homo Sapiens
FKKVSEEKE

SEQ ID NO: 1256403 - protein, 9 aa, Homo Sapiens
QQENTINQL

SEQ ID NO: 1256404 - protein, 9 aa, Homo Sapiens
FIPIFYRLH

SEQ ID NO: 1256405 - protein, 9 aa, Homo Sapiens
LAFLSLQCT

SEQ ID NO: 1256406 - protein, 9 aa, Homo Sapiens
ATVYNGISR

SEQ ID NO: 1256407 - protein, 9 aa, Homo Sapiens
GAVSSAPGG

SEQ ID NO: 1256408 - protein, 9 aa, Homo Sapiens
ESYIEKSLY

SEQ ID NO: 1256409 - protein, 9 aa, Homo Sapiens
VSVAMVQAL

SEQ ID NO: 1256410 - protein, 9 aa, Homo Sapiens
WHKWSVLKS

SEQ ID NO: 1256411 - protein, 9 aa, Homo Sapiens
AMSHFRSHL

SEQ ID NO: 1256412 - protein, 9 aa, Homo Sapiens
IPNIQSGYE

SEQ ID NO: 1256413 - protein, 9 aa, Homo Sapiens
VTYIEHPDV

SEQ ID NO: 1256414 - protein, 9 aa, Homo Sapiens
DVAINFTQE

SEQ ID NO: 1256415 - protein, 9 aa, Homo Sapiens
KSVVVYRLV

SEQ ID NO: 1256416 - protein, 9 aa, Homo Sapiens
PQPPVKVRT

SEQ ID NO: 1256417 - protein, 9 aa, Homo Sapiens
ELTYTYSTS

SEQ ID NO: 1256418 - protein, 9 aa, Homo Sapiens
LVQKLHPPN

SEQ ID NO: 1256419 - protein, 9 aa, Homo Sapiens
PESRMLKQA

SEQ ID NO: 1256420 - protein, 9 aa, Homo Sapiens
DFYYGWAVF

SEQ ID NO: 1256421 - protein, 9 aa, Homo Sapiens
LYLALQYSE

SEQ ID NO: 1256422 - protein, 9 aa, Homo Sapiens
VKRQRTHDQ

SEQ ID NO: 1256423 - protein, 9 aa, Homo Sapiens
KPYERSECR

SEQ ID NO: 1256424 - protein, 9 aa, Homo Sapiens
AYYILHGHP

SEQ ID NO: 1256425 - protein, 9 aa, Homo Sapiens
NVMDVKDIS

SEQ ID NO: 1256426 - protein, 9 aa, Homo Sapiens
FTVHNPEMC

SEQ ID NO: 1256427 - protein, 9 aa, Homo Sapiens
SKHRASNEK

SEQ ID NO: 1256428 - protein, 9 aa, Homo Sapiens
KVASLDCED

SEQ ID NO: 1256429 - protein, 9 aa, Homo Sapiens
LTNTLIGRR

SEQ ID NO: 1256430 - protein, 9 aa, Homo Sapiens
RRKLRRKRR

SEQ ID NO: 1256431 - protein, 9 aa, Homo Sapiens
QSSSDGQEH

SEQ ID NO: 1256432 - protein, 9 aa, Homo Sapiens
LLSEKKAIS

SEQ ID NO: 1256433 - protein, 9 aa, Homo Sapiens
LPKCNGKGT

SEQ ID NO: 1256434 - protein, 9 aa, Homo Sapiens
LLFQENSMI

SEQ ID NO: 1256435 - protein, 9 aa, Homo Sapiens
YINSLTILD

SEQ ID NO: 1256436 - protein, 9 aa, Homo Sapiens
SNPPPYPSR

SEQ ID NO: 1256437 - protein, 9 aa, Homo Sapiens
WSKLESGHF

SEQ ID NO: 1256438 - protein, 9 aa, Homo Sapiens
HFVDSEQRD

SEQ ID NO: 1256439 - protein, 9 aa, Homo Sapiens
TGTYTLTLW

SEQ ID NO: 1256440 - protein, 9 aa, Homo Sapiens
TNEKSKESL

SEQ ID NO: 1256441 - protein, 9 aa, Homo Sapiens
GRSCSQEEC

SEQ ID NO: 1256442 - protein, 9 aa, Homo Sapiens
EFPSATLCS

SEQ ID NO: 1256443 - protein, 9 aa, Homo Sapiens
SAVSPSSVR

SEQ ID NO: 1256444 - protein, 9 aa, Homo Sapiens
HAPWEENDP

SEQ ID NO: 1256445 - protein, 9 aa, Homo Sapiens
TADLCSVQD

SEQ ID NO: 1256446 - protein, 9 aa, Homo Sapiens
NVCCESEVF

SEQ ID NO: 1256447 - protein, 9 aa, Homo Sapiens
LWNLGGSRE

SEQ ID NO: 1256448 - protein, 9 aa, Homo Sapiens
GINGHFELN

SEQ ID NO: 1256449 - protein, 9 aa, Homo Sapiens
AGIPNIQSG

SEQ ID NO: 1256450 - protein, 9 aa, Homo Sapiens
IVSLLTESN

SEQ ID NO: 1256451 - protein, 9 aa, Homo Sapiens
SPGSHFNGL

SEQ ID NO: 1256452 - protein, 9 aa, Homo Sapiens
VTGRQEDVA

SEQ ID NO: 1256453 - protein, 9 aa, Homo Sapiens
EEVLAKYSM

SEQ ID NO: 1256454 - protein, 9 aa, Homo Sapiens
TSQYFGVLQ

SEQ ID NO: 1256455 - protein, 9 aa, Homo Sapiens
AINNTLSNQ

SEQ ID NO: 1256456 - protein, 9 aa, Homo Sapiens
DQVVTEEQV

SEQ ID NO: 1256457 - protein, 9 aa, Homo Sapiens
PVHSACHGP

SEQ ID NO: 1256458 - protein, 9 aa, Homo Sapiens
IFRKDREFI

SEQ ID NO: 1256459 - protein, 9 aa, Homo Sapiens
EDIDTSEPM

SEQ ID NO: 1256460 - protein, 9 aa, Homo Sapiens
TQWWKTNTH

SEQ ID NO: 1256461 - protein, 9 aa, Homo Sapiens
AKVSPPVLG

SEQ ID NO: 1256462 - protein, 9 aa, Homo Sapiens
PSLSSFGMA

SEQ ID NO: 1256463 - protein, 9 aa, Homo Sapiens
CYILMIRRL

SEQ ID NO: 1256464 - protein, 9 aa, Homo Sapiens
VFQWRMDGS

SEQ ID NO: 1256465 - protein, 9 aa, Homo Sapiens
LLAVFSSRG

SEQ ID NO: 1256466 - protein, 9 aa, Homo Sapiens
CLVTLMQKN

SEQ ID NO: 1256467 - protein, 9 aa, Homo Sapiens
LKNLPSKVL

SEQ ID NO: 1256468 - protein, 9 aa, Homo Sapiens
LDENDNAPT

SEQ ID NO: 1256469 - protein, 9 aa, Homo Sapiens
GQTDASVYQ

SEQ ID NO: 1256470 - protein, 9 aa, Homo Sapiens
NAVNFAVLK

SEQ ID NO: 1256471 - protein, 9 aa, Homo Sapiens
PAHIFIPIF

SEQ ID NO: 1256472 - protein, 9 aa, Homo Sapiens
GKRGSDYDT

SEQ ID NO: 1256473 - protein, 9 aa, Homo Sapiens
GTRGPGICG

SEQ ID NO: 1256474 - protein, 9 aa, Homo Sapiens
GNRIGGKMK

SEQ ID NO: 1256475 - protein, 9 aa, Homo Sapiens
QFCQNPAPL

SEQ ID NO: 1256476 - protein, 9 aa, Homo Sapiens
GYWDIRGLT

SEQ ID NO: 1256477 - protein, 9 aa, Homo Sapiens
ISQDECLRY

SEQ ID NO: 1256478 - protein, 9 aa, Homo Sapiens
DFQTAQLLT

SEQ ID NO: 1256479 - protein, 9 aa, Homo Sapiens
NLNDNTGWT

SEQ ID NO: 1256480 - protein, 9 aa, Homo Sapiens
KTAMIGACF

SEQ ID NO: 1256481 - protein, 9 aa, Homo Sapiens
FTSQANVVG

SEQ ID NO: 1256482 - protein, 9 aa, Homo Sapiens
SMPIFFELF

SEQ ID NO: 1256483 - protein, 9 aa, Homo Sapiens
QLRRVLEMS

SEQ ID NO: 1256484 - protein, 9 aa, Homo Sapiens
TPLTPTPTP

SEQ ID NO: 1256485 - protein, 9 aa, Homo Sapiens
SGPGGQTPE

SEQ ID NO: 1256486 - protein, 9 aa, Homo Sapiens
LKSHGKDKE

SEQ ID NO: 1256487 - protein, 9 aa, Homo Sapiens
IMTLLFLDT

SEQ ID NO: 1256488 - protein, 9 aa, Homo Sapiens
VQEHIKPPV

SEQ ID NO: 1256489 - protein, 9 aa, Homo Sapiens
DAISLRSRL

SEQ ID NO: 1256490 - protein, 9 aa, Homo Sapiens
RLHPQKRAT

SEQ ID NO: 1256491 - protein, 9 aa, Homo Sapiens
LQLLNRWDK

SEQ ID NO: 1256492 - protein, 9 aa, Homo Sapiens
AKLIPQTPE

SEQ ID NO: 1256493 - protein, 9 aa, Homo Sapiens
IIVVNYPLW

SEQ ID NO: 1256494 - protein, 9 aa, Homo Sapiens
DIIHCGKCY

SEQ ID NO: 1256495 - protein, 9 aa, Homo Sapiens
IPLKRRHVS

SEQ ID NO: 1256496 - protein, 9 aa, Homo Sapiens
GAKDLHWLY

SEQ ID NO: 1256497 - protein, 9 aa, Homo Sapiens
VGAPGVQGY

SEQ ID NO: 1256498 - protein, 9 aa, Homo Sapiens
ARNLIYFVF

SEQ ID NO: 1256499 - protein, 9 aa, Homo Sapiens
KYVWIMKRK

SEQ ID NO: 1256500 - protein, 9 aa, Homo Sapiens
LLCLDMSDT

SEQ ID NO: 1256501 - protein, 9 aa, Homo Sapiens
RTGKPTDSA

SEQ ID NO: 1256502 - protein, 9 aa, Homo Sapiens
YLDIEHITG

SEQ ID NO: 1256503 - protein, 9 aa, Homo Sapiens
QLKLMQQAL

SEQ ID NO: 1256504 - protein, 9 aa, Homo Sapiens
GVLCADTCQ

SEQ ID NO: 1256505 - protein, 9 aa, Homo Sapiens
QQELLIGML

SEQ ID NO: 1256506 - protein, 9 aa, Homo Sapiens
ACLPQTISN

SEQ ID NO: 1256507 - protein, 9 aa, Homo Sapiens
CNGKGTEPG

SEQ ID NO: 1256508 - protein, 9 aa, Homo Sapiens
LVPSFSFHA

SEQ ID NO: 1256509 - protein, 9 aa, Homo Sapiens
MRVMGLGRR

SEQ ID NO: 1256510 - protein, 9 aa, Homo Sapiens
TLVLELLTF

SEQ ID NO: 1256511 - protein, 9 aa, Homo Sapiens
EYALKQEIA

SEQ ID NO: 1256512 - protein, 9 aa, Homo Sapiens
AHASRPLPT

SEQ ID NO: 1256513 - protein, 9 aa, Homo Sapiens
RHVEVSCAH

SEQ ID NO: 1256514 - protein, 9 aa, Homo Sapiens
DPDEEHRIR

SEQ ID NO: 1256515 - protein, 9 aa, Homo Sapiens
MSRRSQHLT

SEQ ID NO: 1256516 - protein, 9 aa, Homo Sapiens
VFAENNNLS

SEQ ID NO: 1256517 - protein, 9 aa, Homo Sapiens
TDSLCHMMP

SEQ ID NO: 1256518 - protein, 9 aa, Homo Sapiens
NHNEEYDEE

SEQ ID NO: 1256519 - protein, 9 aa, Homo Sapiens
INKHINNDV

SEQ ID NO: 1256520 - protein, 9 aa, Homo Sapiens
QPVANAAGA

SEQ ID NO: 1256521 - protein, 9 aa, Homo Sapiens
FRPTGGAVL

SEQ ID NO: 1256522 - protein, 9 aa, Homo Sapiens
SPLYVPRSK

SEQ ID NO: 1256523 - protein, 9 aa, Homo Sapiens
QISKSQVED

SEQ ID NO: 1256524 - protein, 9 aa, Homo Sapiens
LRITLSFQG

SEQ ID NO: 1256525 - protein, 9 aa, Homo Sapiens
PPPRAPPAR

SEQ ID NO: 1256526 - protein, 9 aa, Homo Sapiens
FVHHALEQL

SEQ ID NO: 1256527 - protein, 9 aa, Homo Sapiens
TSDASFLTQ

SEQ ID NO: 1256528 - protein, 9 aa, Homo Sapiens
ERLMGSHVA

SEQ ID NO: 1256529 - protein, 9 aa, Homo Sapiens
KYTISGESA

SEQ ID NO: 1256530 - protein, 9 aa, Homo Sapiens
STCSRACSC

SEQ ID NO: 1256531 - protein, 9 aa, Homo Sapiens
GGSWSRGWG

SEQ ID NO: 1256532 - protein, 9 aa, Homo Sapiens
LYHNLHIMI

SEQ ID NO: 1256533 - protein, 9 aa, Homo Sapiens
KILKILEGG

SEQ ID NO: 1256534 - protein, 9 aa, Homo Sapiens
YTIPLDKCL

SEQ ID NO: 1256535 - protein, 9 aa, Homo Sapiens
SKVPHLHST

SEQ ID NO: 1256536 - protein, 9 aa, Homo Sapiens
LLNRWDKLD

SEQ ID NO: 1256537 - protein, 9 aa, Homo Sapiens
MSLHPWLFT

SEQ ID NO: 1256538 - protein, 9 aa, Homo Sapiens
FSFMVFFFT

SEQ ID NO: 1256539 - protein, 9 aa, Homo Sapiens
LISDLECRC

SEQ ID NO: 1256540 - protein, 9 aa, Homo Sapiens
LVEQSQKRG

SEQ ID NO: 1256541 - protein, 9 aa, Homo Sapiens
SDQREQVLQ

SEQ ID NO: 1256542 - protein, 9 aa, Homo Sapiens
LIGMLTETM

SEQ ID NO: 1256543 - protein, 9 aa, Homo Sapiens
DSHGSTLSK

SEQ ID NO: 1256544 - protein, 9 aa, Homo Sapiens
TQCPAMVQT

SEQ ID NO: 1256545 - protein, 9 aa, Homo Sapiens
ASVKWHQRQ

SEQ ID NO: 1256546 - protein, 9 aa, Homo Sapiens
VMHLRFSAT

SEQ ID NO: 1256547 - protein, 9 aa, Homo Sapiens
FKDTNKSCD

SEQ ID NO: 1256548 - protein, 9 aa, Homo Sapiens
NVRRHLKVI

SEQ ID NO: 1256549 - protein, 9 aa, Homo Sapiens
RTLASMVLS

SEQ ID NO: 1256550 - protein, 9 aa, Homo Sapiens
HPLVSQAQA

SEQ ID NO: 1256551 - protein, 9 aa, Homo Sapiens
PKCDVTQSQ

SEQ ID NO: 1256552 - protein, 9 aa, Homo Sapiens
ILPCLPGPY

SEQ ID NO: 1256553 - protein, 9 aa, Homo Sapiens
TSCVWPDVR

SEQ ID NO: 1256554 - protein, 9 aa, Homo Sapiens
SSLVFNQSP

SEQ ID NO: 1256555 - protein, 9 aa, Homo Sapiens
LLRQRGILR

SEQ ID NO: 1256556 - protein, 9 aa, Homo Sapiens
RELLSILGL

SEQ ID NO: 1256557 - protein, 9 aa, Homo Sapiens
SAGLRVQID

SEQ ID NO: 1256558 - protein, 9 aa, Homo Sapiens
GNLLLDQAC

SEQ ID NO: 1256559 - protein, 9 aa, Homo Sapiens
PMPTLLAQP

SEQ ID NO: 1256560 - protein, 9 aa, Homo Sapiens
GHLPWVKLP

SEQ ID NO: 1256561 - protein, 9 aa, Homo Sapiens
PEPPPALSP

SEQ ID NO: 1256562 - protein, 9 aa, Homo Sapiens
ELQGAVWTN

SEQ ID NO: 1256563 - protein, 9 aa, Homo Sapiens
TSSTMRLQD

SEQ ID NO: 1256564 - protein, 9 aa, Homo Sapiens
GTDFLQLMP

SEQ ID NO: 1256565 - protein, 9 aa, Homo Sapiens
TMEVYFGPC

SEQ ID NO: 1256566 - protein, 9 aa, Homo Sapiens
LEEYQSSLH

SEQ ID NO: 1256567 - protein, 9 aa, Homo Sapiens
KFHVLTERI

SEQ ID NO: 1256568 - protein, 9 aa, Homo Sapiens
GNVLVRYSS

SEQ ID NO: 1256569 - protein, 9 aa, Homo Sapiens
QVFKVPTSI

SEQ ID NO: 1256570 - protein, 9 aa, Homo Sapiens
PPDFEIHIA

SEQ ID NO: 1256571 - protein, 9 aa, Homo Sapiens
LCKLKFRFD

SEQ ID NO: 1256572 - protein, 9 aa, Homo Sapiens
ICSDLESSD

SEQ ID NO: 1256573 - protein, 9 aa, Homo Sapiens
NRVQFLGFS

SEQ ID NO: 1256574 - protein, 9 aa, Homo Sapiens
HLLHRYCVF

SEQ ID NO: 1256575 - protein, 9 aa, Homo Sapiens
PCEQLLILV

SEQ ID NO: 1256576 - protein, 9 aa, Homo Sapiens
AAQNSKLRL

SEQ ID NO: 1256577 - protein, 9 aa, Homo Sapiens
ELPEQETFY

SEQ ID NO: 1256578 - protein, 9 aa, Homo Sapiens
WITKIEVPK

SEQ ID NO: 1256579 - protein, 9 aa, Homo Sapiens
LHEHKTVYR

SEQ ID NO: 1256580 - protein, 9 aa, Homo Sapiens
DTPDEPQKS

SEQ ID NO: 1256581 - protein, 9 aa, Homo Sapiens
KDAAEGPFA

SEQ ID NO: 1256582 - protein, 9 aa, Homo Sapiens
VTMLLRYSH

SEQ ID NO: 1256583 - protein, 9 aa, Homo Sapiens
SLSLPWRPN

SEQ ID NO: 1256584 - protein, 9 aa, Homo Sapiens
LAIIRHLRD

SEQ ID NO: 1256585 - protein, 9 aa, Homo Sapiens
RCMNVVHDK

SEQ ID NO: 1256586 - protein, 9 aa, Homo Sapiens
QEAPRSKWH

SEQ ID NO: 1256587 - protein, 9 aa, Homo Sapiens
MSSPGEEVE

SEQ ID NO: 1256588 - protein, 9 aa, Homo Sapiens
MGLQIHFVV

SEQ ID NO: 1256589 - protein, 9 aa, Homo Sapiens
KVDLSLPTI

SEQ ID NO: 1256590 - protein, 9 aa, Homo Sapiens
GLFIQGNDI

SEQ ID NO: 1256591 - protein, 9 aa, Homo Sapiens
ATTPSTTAV

SEQ ID NO: 1256592 - protein, 9 aa, Homo Sapiens
YSKHLRFPD

SEQ ID NO: 1256593 - protein, 9 aa, Homo Sapiens
HPTSDGEGM

SEQ ID NO: 1256594 - protein, 9 aa, Homo Sapiens
LVLGSVKYV

SEQ ID NO: 1256595 - protein, 9 aa, Homo Sapiens
LSGPDSSED

SEQ ID NO: 1256596 - protein, 9 aa, Homo Sapiens
DAQDCELPS

SEQ ID NO: 1256597 - protein, 9 aa, Homo Sapiens
TLISDIETV

SEQ ID NO: 1256598 - protein, 9 aa, Homo Sapiens
NRLAPPVHP

SEQ ID NO: 1256599 - protein, 9 aa, Homo Sapiens
LTVNGEQLY

SEQ ID NO: 1256600 - protein, 9 aa, Homo Sapiens
WEWKEQGSK

SEQ ID NO: 1256601 - protein, 9 aa, Homo Sapiens
INRKVEMLF

SEQ ID NO: 1256602 - protein, 9 aa, Homo Sapiens
PHLFHTSYW

SEQ ID NO: 1256603 - protein, 9 aa, Homo Sapiens
FCCGDPKKT

SEQ ID NO: 1256604 - protein, 9 aa, Homo Sapiens
PWMRPHTPG

SEQ ID NO: 1256605 - protein, 9 aa, Homo Sapiens
EVEGGVRCR

SEQ ID NO: 1256606 - protein, 9 aa, Homo Sapiens
SYILLWKRT

SEQ ID NO: 1256607 - protein, 9 aa, Homo Sapiens
ELTGEDIRS

SEQ ID NO: 1256608 - protein, 9 aa, Homo Sapiens
PPVQQTQFT

SEQ ID NO: 1256609 - protein, 9 aa, Homo Sapiens
EHLQHQDWA

SEQ ID NO: 1256610 - protein, 9 aa, Homo Sapiens
GDTTEHIHT

SEQ ID NO: 1256611 - protein, 9 aa, Homo Sapiens
HETVAEAAV

SEQ ID NO: 1256612 - protein, 9 aa, Homo Sapiens
SDVLRIQNI

SEQ ID NO: 1256613 - protein, 9 aa, Homo Sapiens
SVCELVMAP

SEQ ID NO: 1256614 - protein, 9 aa, Homo Sapiens
SPDKKKPFV

SEQ ID NO: 1256615 - protein, 9 aa, Homo Sapiens
AQKFGYKLM

SEQ ID NO: 1256616 - protein, 9 aa, Homo Sapiens
PAPIRRHSS

SEQ ID NO: 1256617 - protein, 9 aa, Homo Sapiens
ICIILTALI

SEQ ID NO: 1256618 - protein, 9 aa, Homo Sapiens
CFSLVIPFD

SEQ ID NO: 1256619 - protein, 9 aa, Homo Sapiens
KPENVLIGR

SEQ ID NO: 1256620 - protein, 9 aa, Homo Sapiens
TAKEEFLTD

SEQ ID NO: 1256621 - protein, 9 aa, Homo Sapiens
EFIQMSNFN

SEQ ID NO: 1256622 - protein, 9 aa, Homo Sapiens
KPPVKRQEL

SEQ ID NO: 1256623 - protein, 9 aa, Homo Sapiens
KKRKKNPRK

SEQ ID NO: 1256624 - protein, 9 aa, Homo Sapiens
RSDNTLHLA

SEQ ID NO: 1256625 - protein, 9 aa, Homo Sapiens
QLALANSMI

SEQ ID NO: 1256626 - protein, 9 aa, Homo Sapiens
PTPSSGAQT

SEQ ID NO: 1256627 - protein, 9 aa, Homo Sapiens
PVMTLAIPI

SEQ ID NO: 1256628 - protein, 9 aa, Homo Sapiens
GITAYELLW

SEQ ID NO: 1256629 - protein, 9 aa, Homo Sapiens
FMYPAVGTI

SEQ ID NO: 1256630 - protein, 9 aa, Homo Sapiens
DSSWVQDES

SEQ ID NO: 1256631 - protein, 9 aa, Homo Sapiens
DDPSMSEIT

SEQ ID NO: 1256632 - protein, 9 aa, Homo Sapiens
SKGTDFLQL

SEQ ID NO: 1256633 - protein, 9 aa, Homo Sapiens
LLEFLQRSS

SEQ ID NO: 1256634 - protein, 9 aa, Homo Sapiens
IPYINGKFK

SEQ ID NO: 1256635 - protein, 9 aa, Homo Sapiens
SVKRTHYYE

SEQ ID NO: 1256636 - protein, 9 aa, Homo Sapiens
THVNDIMLV

SEQ ID NO: 1256637 - protein, 9 aa, Homo Sapiens
FSTPTTPSA

SEQ ID NO: 1256638 - protein, 9 aa, Homo Sapiens
KEAVTGNRI

SEQ ID NO: 1256639 - protein, 9 aa, Homo Sapiens
DLKVKVRQW

SEQ ID NO: 1256640 - protein, 9 aa, Homo Sapiens
ENDAELDRR

SEQ ID NO: 1256641 - protein, 9 aa, Homo Sapiens
AVNFCGWAS

SEQ ID NO: 1256642 - protein, 9 aa, Homo Sapiens
TLVYSNSSS

SEQ ID NO: 1256643 - protein, 9 aa, Homo Sapiens
SRLLPDVLL

SEQ ID NO: 1256644 - protein, 9 aa, Homo Sapiens
TSESSAQPS

SEQ ID NO: 1256645 - protein, 9 aa, Homo Sapiens
GLHTQTMSC

SEQ ID NO: 1256646 - protein, 9 aa, Homo Sapiens
LALLNEHQV

SEQ ID NO: 1256647 - protein, 9 aa, Homo Sapiens
QSSYLIRHK

SEQ ID NO: 1256648 - protein, 9 aa, Homo Sapiens
DQLQDETNH

SEQ ID NO: 1256649 - protein, 9 aa, Homo Sapiens
VVTALKKCP

SEQ ID NO: 1256650 - protein, 9 aa, Homo Sapiens
FNLKKDDVC

SEQ ID NO: 1256651 - protein, 9 aa, Homo Sapiens
NEKNTASIN

SEQ ID NO: 1256652 - protein, 9 aa, Homo Sapiens
PARAGLDGR

SEQ ID NO: 1256653 - protein, 9 aa, Homo Sapiens
ECEMADEEH

SEQ ID NO: 1256654 - protein, 9 aa, Homo Sapiens
LTGRAPGCT

SEQ ID NO: 1256655 - protein, 9 aa, Homo Sapiens
IIPDSPITA

SEQ ID NO: 1256656 - protein, 9 aa, Homo Sapiens
GQQVLTVHA

SEQ ID NO: 1256657 - protein, 9 aa, Homo Sapiens
DPLRTPDAL

SEQ ID NO: 1256658 - protein, 9 aa, Homo Sapiens
TNEGLKERK

SEQ ID NO: 1256659 - protein, 9 aa, Homo Sapiens
IMKVMIPLL

SEQ ID NO: 1256660 - protein, 9 aa, Homo Sapiens
IRIQRDLPS

SEQ ID NO: 1256661 - protein, 9 aa, Homo Sapiens
TALPSSADD

SEQ ID NO: 1256662 - protein, 9 aa, Homo Sapiens
ATNGSAAKL

SEQ ID NO: 1256663 - protein, 9 aa, Homo Sapiens
THTHRYTHR

SEQ ID NO: 1256664 - protein, 9 aa, Homo Sapiens
GRAGPRPRV

SEQ ID NO: 1256665 - protein, 9 aa, Homo Sapiens
KPKKTKNIS

SEQ ID NO: 1256666 - protein, 9 aa, Homo Sapiens
EATRLPTSV

SEQ ID NO: 1256667 - protein, 9 aa, Homo Sapiens
VNVTWDGKY

SEQ ID NO: 1256668 - protein, 9 aa, Homo Sapiens
KDAQVVQVI

SEQ ID NO: 1256669 - protein, 9 aa, Homo Sapiens
LPPDAQDIT

SEQ ID NO: 1256670 - protein, 9 aa, Homo Sapiens
ESEEGQEYE

SEQ ID NO: 1256671 - protein, 9 aa, Homo Sapiens
EHDLIEDLK

SEQ ID NO: 1256672 - protein, 9 aa, Homo Sapiens
RMGSGIECM

SEQ ID NO: 1256673 - protein, 9 aa, Homo Sapiens
PSPTPSPPQ

SEQ ID NO: 1256674 - protein, 9 aa, Homo Sapiens
SDIDGIITK

SEQ ID NO: 1256675 - protein, 9 aa, Homo Sapiens
LHPDVTGQL

SEQ ID NO: 1256676 - protein, 9 aa, Homo Sapiens
RRYLRVGLK

SEQ ID NO: 1256677 - protein, 9 aa, Homo Sapiens
ERCFMCQAC

SEQ ID NO: 1256678 - protein, 9 aa, Homo Sapiens
YLVDFIISD

SEQ ID NO: 1256679 - protein, 9 aa, Homo Sapiens
SMSSTLIRH

SEQ ID NO: 1256680 - protein, 9 aa, Homo Sapiens
VLAFLGMAR

SEQ ID NO: 1256681 - protein, 9 aa, Homo Sapiens
PDGQTQKRS

SEQ ID NO: 1256682 - protein, 9 aa, Homo Sapiens
GPRAPSGPH

SEQ ID NO: 1256683 - protein, 9 aa, Homo Sapiens
NECGKVFGV

SEQ ID NO: 1256684 - protein, 9 aa, Homo Sapiens
GYYIEASIA

SEQ ID NO: 1256685 - protein, 9 aa, Homo Sapiens
IIYRRYSKF

SEQ ID NO: 1256686 - protein, 9 aa, Homo Sapiens
PLYIPHPSS

SEQ ID NO: 1256687 - protein, 9 aa, Homo Sapiens
GPRREDIVG

SEQ ID NO: 1256688 - protein, 9 aa, Homo Sapiens
RQKLQLKAV

SEQ ID NO: 1256689 - protein, 9 aa, Homo Sapiens
KLEIKVKRK

SEQ ID NO: 1256690 - protein, 9 aa, Homo Sapiens
FLWIFLGLM

SEQ ID NO: 1256691 - protein, 9 aa, Homo Sapiens
PPPYPSRPS

SEQ ID NO: 1256692 - protein, 9 aa, Homo Sapiens
SGLICARLR

SEQ ID NO: 1256693 - protein, 9 aa, Homo Sapiens
DDDEDPDLI

SEQ ID NO: 1256694 - protein, 9 aa, Homo Sapiens
QAQARQLLA

SEQ ID NO: 1256695 - protein, 9 aa, Homo Sapiens
LTDMWIGRL

SEQ ID NO: 1256696 - protein, 9 aa, Homo Sapiens
PFITTFFTS

SEQ ID NO: 1256697 - protein, 9 aa, Homo Sapiens
TGPRGRRAL

SEQ ID NO: 1256698 - protein, 9 aa, Homo Sapiens
MLPEPGFPD

SEQ ID NO: 1256699 - protein, 9 aa, Homo Sapiens
ELIMYRKSG

SEQ ID NO: 1256700 - protein, 9 aa, Homo Sapiens
KPREVFGFE

SEQ ID NO: 1256701 - protein, 9 aa, Homo Sapiens
VHQRVLHSA

SEQ ID NO: 1256702 - protein, 9 aa, Homo Sapiens
VKLDAAGLH

SEQ ID NO: 1256703 - protein, 9 aa, Homo Sapiens
VPLFSTVCQ

SEQ ID NO: 1256704 - protein, 9 aa, Homo Sapiens
DNFNLGRAS

SEQ ID NO: 1256705 - protein, 9 aa, Homo Sapiens
RQQNQQVEK

SEQ ID NO: 1256706 - protein, 9 aa, Homo Sapiens
DHEQDREIS

SEQ ID NO: 1256707 - protein, 9 aa, Homo Sapiens
IICAYGPII

SEQ ID NO: 1256708 - protein, 9 aa, Homo Sapiens
PPRLCTVGL

SEQ ID NO: 1256709 - protein, 9 aa, Homo Sapiens
NDGIYVRPR

SEQ ID NO: 1256710 - protein, 9 aa, Homo Sapiens
DGSWTFAHR

SEQ ID NO: 1256711 - protein, 9 aa, Homo Sapiens
MDHMDRCFD

SEQ ID NO: 1256712 - protein, 9 aa, Homo Sapiens
ILEVSYIKV

SEQ ID NO: 1256713 - protein, 9 aa, Homo Sapiens
SKRPQAMAS

SEQ ID NO: 1256714 - protein, 9 aa, Homo Sapiens
ETVNCMSSQ

SEQ ID NO: 1256715 - protein, 9 aa, Homo Sapiens
LADRQCEYL

SEQ ID NO: 1256716 - protein, 9 aa, Homo Sapiens
FHRNDPMER

SEQ ID NO: 1256717 - protein, 9 aa, Homo Sapiens
GLRKGHSTL

SEQ ID NO: 1256718 - protein, 9 aa, Homo Sapiens
FDHNGSSSG

SEQ ID NO: 1256719 - protein, 9 aa, Homo Sapiens
CGTPDHPKA

SEQ ID NO: 1256720 - protein, 9 aa, Homo Sapiens
SQRLPWPCC

SEQ ID NO: 1256721 - protein, 9 aa, Homo Sapiens
SLQHPNALQ

SEQ ID NO: 1256722 - protein, 9 aa, Homo Sapiens
LLSKCPWNE

SEQ ID NO: 1256723 - protein, 9 aa, Homo Sapiens
SDASFTENT

SEQ ID NO: 1256724 - protein, 9 aa, Homo Sapiens
RGNVKYANM

SEQ ID NO: 1256725 - protein, 9 aa, Homo Sapiens
LFPAYPIYG

SEQ ID NO: 1256726 - protein, 9 aa, Homo Sapiens
VAKLVSYVS

SEQ ID NO: 1256727 - protein, 9 aa, Homo Sapiens
NSHWDPPEE

SEQ ID NO: 1256728 - protein, 9 aa, Homo Sapiens
ANPCPSSSN

SEQ ID NO: 1256729 - protein, 9 aa, Homo Sapiens
ARLRTAGII

SEQ ID NO: 1256730 - protein, 9 aa, Homo Sapiens
RVMGLGRRG

SEQ ID NO: 1256731 - protein, 9 aa, Homo Sapiens
TWRNSMSTK

SEQ ID NO: 1256732 - protein, 9 aa, Homo Sapiens
SSETRGECV

SEQ ID NO: 1256733 - protein, 9 aa, Homo Sapiens
SMFIDAPYE

SEQ ID NO: 1256734 - protein, 9 aa, Homo Sapiens
DSSCKTPDV

SEQ ID NO: 1256735 - protein, 9 aa, Homo Sapiens
IHTGEKHYE

SEQ ID NO: 1256736 - protein, 9 aa, Homo Sapiens
ADVSLSALR

SEQ ID NO: 1256737 - protein, 9 aa, Homo Sapiens
DKSPEEVCM

SEQ ID NO: 1256738 - protein, 9 aa, Homo Sapiens
GMHRHTHTQ

SEQ ID NO: 1256739 - protein, 9 aa, Homo Sapiens
SYFTSNALS

SEQ ID NO: 1256740 - protein, 9 aa, Homo Sapiens
LRCGHVYVR

SEQ ID NO: 1256741 - protein, 9 aa, Homo Sapiens
NRTLETVNC

SEQ ID NO: 1256742 - protein, 9 aa, Homo Sapiens
EQQRTVQDK

SEQ ID NO: 1256743 - protein, 9 aa, Homo Sapiens
GIWVLVTAA

SEQ ID NO: 1256744 - protein, 9 aa, Homo Sapiens
KSAFKKPIK

SEQ ID NO: 1256745 - protein, 9 aa, Homo Sapiens
LRTGLYKSH

SEQ ID NO: 1256746 - protein, 9 aa, Homo Sapiens
KEFGCPDGG

SEQ ID NO: 1256747 - protein, 9 aa, Homo Sapiens
QYFKRTGTG

SEQ ID NO: 1256748 - protein, 9 aa, Homo Sapiens
NMHGMKAAK

SEQ ID NO: 1256749 - protein, 9 aa, Homo Sapiens
GVGTPNLIS

SEQ ID NO: 1256750 - protein, 9 aa, Homo Sapiens
NFPEQAHSS

SEQ ID NO: 1256751 - protein, 9 aa, Homo Sapiens
ERSIHLFIN

SEQ ID NO: 1256752 - protein, 9 aa, Homo Sapiens
QVLMDRGDT

SEQ ID NO: 1256753 - protein, 9 aa, Homo Sapiens
PPQYMSVNQ

SEQ ID NO: 1256754 - protein, 9 aa, Homo Sapiens
VSSTSPVIK

SEQ ID NO: 1256755 - protein, 9 aa, Homo Sapiens
MNIQWMHVP

SEQ ID NO: 1256756 - protein, 9 aa, Homo Sapiens
SPGTPQSPH

SEQ ID NO: 1256757 - protein, 9 aa, Homo Sapiens
KQHALAAAA

SEQ ID NO: 1256758 - protein, 9 aa, Homo Sapiens
TEAYMLPVS

SEQ ID NO: 1256759 - protein, 9 aa, Homo Sapiens
CSNSEGYLF

SEQ ID NO: 1256760 - protein, 9 aa, Homo Sapiens
DYNGHHRIQ

SEQ ID NO: 1256761 - protein, 9 aa, Homo Sapiens
SYVKLREFV

SEQ ID NO: 1256762 - protein, 9 aa, Homo Sapiens
YLGSRTQTS

SEQ ID NO: 1256763 - protein, 9 aa, Homo Sapiens
HLLDSNVIE

SEQ ID NO: 1256764 - protein, 9 aa, Homo Sapiens
FPYPGFNMS

SEQ ID NO: 1256765 - protein, 9 aa, Homo Sapiens
SGAFQLKKS

SEQ ID NO: 1256766 - protein, 9 aa, Homo Sapiens
GSVADLAFT

SEQ ID NO: 1256767 - protein, 9 aa, Homo Sapiens
SDTCSRDTY

SEQ ID NO: 1256768 - protein, 9 aa, Homo Sapiens
VPGMFGTSH

SEQ ID NO: 1256769 - protein, 9 aa, Homo Sapiens
LKFLEHFDI

SEQ ID NO: 1256770 - protein, 9 aa, Homo Sapiens
PPLAPAQLC

SEQ ID NO: 1256771 - protein, 9 aa, Homo Sapiens
CLDCDMESI

SEQ ID NO: 1256772 - protein, 9 aa, Homo Sapiens
MAADMGMGG

SEQ ID NO: 1256773 - protein, 9 aa, Homo Sapiens
FQSWSGTEK

SEQ ID NO: 1256774 - protein, 9 aa, Homo Sapiens
RANLKKHMC

SEQ ID NO: 1256775 - protein, 9 aa, Homo Sapiens
CNTPLASRE

SEQ ID NO: 1256776 - protein, 9 aa, Homo Sapiens
GLPLQDLAF

SEQ ID NO: 1256777 - protein, 9 aa, Homo Sapiens
SSDKGDCHI

SEQ ID NO: 1256778 - protein, 9 aa, Homo Sapiens
SAGPRNCIC

SEQ ID NO: 1256779 - protein, 9 aa, Homo Sapiens
SLQRCYSKS

SEQ ID NO: 1256780 - protein, 9 aa, Homo Sapiens
YALINFSYF

SEQ ID NO: 1256781 - protein, 9 aa, Homo Sapiens
VALATKACA

SEQ ID NO: 1256782 - protein, 9 aa, Homo Sapiens
NGTVTDRQI

SEQ ID NO: 1256783 - protein, 9 aa, Homo Sapiens
LPSAQIRCP

SEQ ID NO: 1256784 - protein, 9 aa, Homo Sapiens
RAREVGWMV

SEQ ID NO: 1256785 - protein, 9 aa, Homo Sapiens
KMSIFSPMK

SEQ ID NO: 1256786 - protein, 9 aa, Homo Sapiens
LQQLEQFEK

SEQ ID NO: 1256787 - protein, 9 aa, Homo Sapiens
SRTVMELKM

SEQ ID NO: 1256788 - protein, 9 aa, Homo Sapiens
IHVKTLEKM

SEQ ID NO: 1256789 - protein, 9 aa, Homo Sapiens
AWRPLEGVL

SEQ ID NO: 1256790 - protein, 9 aa, Homo Sapiens
SFFMVKGAV

SEQ ID NO: 1256791 - protein, 9 aa, Homo Sapiens
QVGKEQHPA

SEQ ID NO: 1256792 - protein, 9 aa, Homo Sapiens
KQGDLPPSW

SEQ ID NO: 1256793 - protein, 9 aa, Homo Sapiens
AARALHKVF

SEQ ID NO: 1256794 - protein, 9 aa, Homo Sapiens
LSLSQWMWC

SEQ ID NO: 1256795 - protein, 9 aa, Homo Sapiens
WEADASRSL

SEQ ID NO: 1256796 - protein, 9 aa, Homo Sapiens
KCIQEIIEQ

SEQ ID NO: 1256797 - protein, 9 aa, Homo Sapiens
ASVRAAFVY

SEQ ID NO: 1256798 - protein, 9 aa, Homo Sapiens
FFFFVSCHT

SEQ ID NO: 1256799 - protein, 9 aa, Homo Sapiens
ATRARSKHW

SEQ ID NO: 1256800 - protein, 9 aa, Homo Sapiens
FMNNGFFLK

SEQ ID NO: 1256801 - protein, 9 aa, Homo Sapiens
FTSVTYLYL

SEQ ID NO: 1256802 - protein, 9 aa, Homo Sapiens
TSVYLDANI

SEQ ID NO: 1256803 - protein, 9 aa, Homo Sapiens
NPESESITF

SEQ ID NO: 1256804 - protein, 9 aa, Homo Sapiens
GLGVHQRVL

SEQ ID NO: 1256805 - protein, 9 aa, Homo Sapiens
LILPVLLLK

SEQ ID NO: 1256806 - protein, 9 aa, Homo Sapiens
GDKCSQGSA

SEQ ID NO: 1256807 - protein, 9 aa, Homo Sapiens
LLLYQEGTK

SEQ ID NO: 1256808 - protein, 9 aa, Homo Sapiens
ELNPKDTTS

SEQ ID NO: 1256809 - protein, 9 aa, Homo Sapiens
DMIAKQSLQ

SEQ ID NO: 1256810 - protein, 9 aa, Homo Sapiens
LGCLAGPVV

SEQ ID NO: 1256811 - protein, 9 aa, Homo Sapiens
ATPLQFAFY

SEQ ID NO: 1256812 - protein, 9 aa, Homo Sapiens
DIALITNHP

SEQ ID NO: 1256813 - protein, 9 aa, Homo Sapiens
CWEYCAIKT

SEQ ID NO: 1256814 - protein, 9 aa, Homo Sapiens
PQSRRRMKH

SEQ ID NO: 1256815 - protein, 9 aa, Homo Sapiens
AGLSAAQSS

SEQ ID NO: 1256816 - protein, 9 aa, Homo Sapiens
IGCFALLWC

SEQ ID NO: 1256817 - protein, 9 aa, Homo Sapiens
EVRPQVSLT

SEQ ID NO: 1256818 - protein, 9 aa, Homo Sapiens
ILSFILLEG

SEQ ID NO: 1256819 - protein, 9 aa, Homo Sapiens
SVASDYMPA

SEQ ID NO: 1256820 - protein, 9 aa, Homo Sapiens
KQDKKNGAA

SEQ ID NO: 1256821 - protein, 9 aa, Homo Sapiens
TRLPTSVPQ

SEQ ID NO: 1256822 - protein, 9 aa, Homo Sapiens
LLKKPALYV

SEQ ID NO: 1256823 - protein, 9 aa, Homo Sapiens
KIPDPLDVI

SEQ ID NO: 1256824 - protein, 9 aa, Homo Sapiens
SLYASGRTI

SEQ ID NO: 1256825 - protein, 9 aa, Homo Sapiens
ISVDPIAGK

SEQ ID NO: 1256826 - protein, 9 aa, Homo Sapiens
SNSLYWYGG

SEQ ID NO: 1256827 - protein, 9 aa, Homo Sapiens
PKSERGCKK

SEQ ID NO: 1256828 - protein, 9 aa, Homo Sapiens
YGVIIVGNL

SEQ ID NO: 1256829 - protein, 9 aa, Homo Sapiens
IIVGASVGT

SEQ ID NO: 1256830 - protein, 9 aa, Homo Sapiens
WQTACDAAT

SEQ ID NO: 1256831 - protein, 9 aa, Homo Sapiens
EVFGFEQAV

SEQ ID NO: 1256832 - protein, 9 aa, Homo Sapiens
HVSGPDGQT

SEQ ID NO: 1256833 - protein, 9 aa, Homo Sapiens
KEWESQCKI

SEQ ID NO: 1256834 - protein, 9 aa, Homo Sapiens
ACLIFLCVV

SEQ ID NO: 1256835 - protein, 9 aa, Homo Sapiens
GIVGYMLLL

SEQ ID NO: 1256836 - protein, 9 aa, Homo Sapiens
MRKTVQVTE

SEQ ID NO: 1256837 - protein, 9 aa, Homo Sapiens
AIGPWIQVK

SEQ ID NO: 1256838 - protein, 9 aa, Homo Sapiens
SYLPDHRRV

SEQ ID NO: 1256839 - protein, 9 aa, Homo Sapiens
SELGNHYLY

SEQ ID NO: 1256840 - protein, 9 aa, Homo Sapiens
MLSSLKLQS

SEQ ID NO: 1256841 - protein, 9 aa, Homo Sapiens
GITLMSPKH

SEQ ID NO: 1256842 - protein, 9 aa, Homo Sapiens
SHLRVLRCT

SEQ ID NO: 1256843 - protein, 9 aa, Homo Sapiens
RLAELEGRQ

SEQ ID NO: 1256844 - protein, 9 aa, Homo Sapiens
QKEYEENSW

SEQ ID NO: 1256845 - protein, 9 aa, Homo Sapiens
WKKLSQSPE

SEQ ID NO: 1256846 - protein, 9 aa, Homo Sapiens
WSLALSSMI

SEQ ID NO: 1256847 - protein, 9 aa, Homo Sapiens
AIMMMDESV

SEQ ID NO: 1256848 - protein, 9 aa, Homo Sapiens
GGLPAQCLA

SEQ ID NO: 1256849 - protein, 9 aa, Homo Sapiens
CTSDLERSI

SEQ ID NO: 1256850 - protein, 9 aa, Homo Sapiens
HHAFFSPWT

SEQ ID NO: 1256851 - protein, 9 aa, Homo Sapiens
ADDTAHHPG

SEQ ID NO: 1256852 - protein, 9 aa, Homo Sapiens
TRAWSMVGR

SEQ ID NO: 1256853 - protein, 9 aa, Homo Sapiens
QVWHEEHCG

SEQ ID NO: 1256854 - protein, 9 aa, Homo Sapiens
ADAETSGQD

SEQ ID NO: 1256855 - protein, 9 aa, Homo Sapiens
KLKEKVKPA

SEQ ID NO: 1256856 - protein, 9 aa, Homo Sapiens
RGWGRGLVG

SEQ ID NO: 1256857 - protein, 9 aa, Homo Sapiens
SPPVQQTQF

SEQ ID NO: 1256858 - protein, 9 aa, Homo Sapiens
RKVALKKVL

SEQ ID NO: 1256859 - protein, 9 aa, Homo Sapiens
NALQCLGLC

SEQ ID NO: 1256860 - protein, 9 aa, Homo Sapiens
PQCTFFFLH

SEQ ID NO: 1256861 - protein, 9 aa, Homo Sapiens
PRRKQTGHR

SEQ ID NO: 1256862 - protein, 9 aa, Homo Sapiens
EGGPPTETN

SEQ ID NO: 1256863 - protein, 9 aa, Homo Sapiens
PERERIWMQ

SEQ ID NO: 1256864 - protein, 9 aa, Homo Sapiens
PGQQKREAQ

SEQ ID NO: 1256865 - protein, 9 aa, Homo Sapiens
DYDNAFLLE

SEQ ID NO: 1256866 - protein, 9 aa, Homo Sapiens
AKTYCFMVD

SEQ ID NO: 1256867 - protein, 9 aa, Homo Sapiens
VGVKGTYRL

SEQ ID NO: 1256868 - protein, 9 aa, Homo Sapiens
WGDSGPHTF

SEQ ID NO: 1256869 - protein, 9 aa, Homo Sapiens
IMGNHASES

SEQ ID NO: 1256870 - protein, 9 aa, Homo Sapiens
FGCGYGGGL

SEQ ID NO: 1256871 - protein, 9 aa, Homo Sapiens
ALQLAYYIL

SEQ ID NO: 1256872 - protein, 9 aa, Homo Sapiens
TLVNVIDWV

SEQ ID NO: 1256873 - protein, 9 aa, Homo Sapiens
TGRLTQARG

SEQ ID NO: 1256874 - protein, 9 aa, Homo Sapiens
PSWRKIMSD

SEQ ID NO: 1256875 - protein, 9 aa, Homo Sapiens
SLSFPQHSM

SEQ ID NO: 1256876 - protein, 9 aa, Homo Sapiens
TWLAPELYN

SEQ ID NO: 1256877 - protein, 9 aa, Homo Sapiens
TPDAMLDKT

SEQ ID NO: 1256878 - protein, 9 aa, Homo Sapiens
LQPVLFSMF

SEQ ID NO: 1256879 - protein, 9 aa, Homo Sapiens
RFRSIIDDT

SEQ ID NO: 1256880 - protein, 9 aa, Homo Sapiens
MPFNPTLPP

SEQ ID NO: 1256881 - protein, 9 aa, Homo Sapiens
ETILGLTGV

SEQ ID NO: 1256882 - protein, 9 aa, Homo Sapiens
LGESASPAT

SEQ ID NO: 1256883 - protein, 9 aa, Homo Sapiens
RGHYPSKCM

SEQ ID NO: 1256884 - protein, 9 aa, Homo Sapiens
INQFGPPMI

SEQ ID NO: 1256885 - protein, 9 aa, Homo Sapiens
CSKMTLIQP

SEQ ID NO: 1256886 - protein, 9 aa, Homo Sapiens
LFLLLPISA

SEQ ID NO: 1256887 - protein, 9 aa, Homo Sapiens
FNLMPGDVE

SEQ ID NO: 1256888 - protein, 9 aa, Homo Sapiens
CDYFGVKTA

SEQ ID NO: 1256889 - protein, 9 aa, Homo Sapiens
SHLNVNIKS

SEQ ID NO: 1256890 - protein, 9 aa, Homo Sapiens
GGDLTSRLS

SEQ ID NO: 1256891 - protein, 9 aa, Homo Sapiens
ARTISMQAI

SEQ ID NO: 1256892 - protein, 9 aa, Homo Sapiens
LSEHPDIHK

SEQ ID NO: 1256893 - protein, 9 aa, Homo Sapiens
CPREWDSAT

SEQ ID NO: 1256894 - protein, 9 aa, Homo Sapiens
GSHPLSYKW

SEQ ID NO: 1256895 - protein, 9 aa, Homo Sapiens
FDTGPQGGI

SEQ ID NO: 1256896 - protein, 9 aa, Homo Sapiens
PLGTETSIL

SEQ ID NO: 1256897 - protein, 9 aa, Homo Sapiens
NGSVGDATA

SEQ ID NO: 1256898 - protein, 9 aa, Homo Sapiens
VSDGSEVVV

SEQ ID NO: 1256899 - protein, 9 aa, Homo Sapiens
KYTKGVIPS

SEQ ID NO: 1256900 - protein, 9 aa, Homo Sapiens
VQMRVMGLG

SEQ ID NO: 1256901 - protein, 9 aa, Homo Sapiens
MNIIGLEIP

SEQ ID NO: 1256902 - protein, 9 aa, Homo Sapiens
SLLHPHPQF

SEQ ID NO: 1256903 - protein, 9 aa, Homo Sapiens
VNSLTAQPT

SEQ ID NO: 1256904 - protein, 9 aa, Homo Sapiens
RIELLFFVL

SEQ ID NO: 1256905 - protein, 9 aa, Homo Sapiens
HSDVGLLEG

SEQ ID NO: 1256906 - protein, 9 aa, Homo Sapiens
IVPRKTRLY

SEQ ID NO: 1256907 - protein, 9 aa, Homo Sapiens
AILKMKGNF

SEQ ID NO: 1256908 - protein, 9 aa, Homo Sapiens
PLRTPDALP

SEQ ID NO: 1256909 - protein, 9 aa, Homo Sapiens
EAVWRMPEF

SEQ ID NO: 1256910 - protein, 9 aa, Homo Sapiens
LQDIQEIIS

SEQ ID NO: 1256911 - protein, 9 aa, Homo Sapiens
ERQLHVGGP

SEQ ID NO: 1256912 - protein, 9 aa, Homo Sapiens
DYEEFVCGC

SEQ ID NO: 1256913 - protein, 9 aa, Homo Sapiens
KYKEDAHLL

SEQ ID NO: 1256914 - protein, 9 aa, Homo Sapiens
ASPEPCTIP

SEQ ID NO: 1256915 - protein, 9 aa, Homo Sapiens
ALPPWPVEG

SEQ ID NO: 1256916 - protein, 9 aa, Homo Sapiens
QAAAHTHHY

SEQ ID NO: 1256917 - protein, 9 aa, Homo Sapiens
YKLSGCRFS

SEQ ID NO: 1256918 - protein, 9 aa, Homo Sapiens
SSISMTPFG

SEQ ID NO: 1256919 - protein, 9 aa, Homo Sapiens
DFQLKKAQN

SEQ ID NO: 1256920 - protein, 9 aa, Homo Sapiens
TCMLKGSSA

SEQ ID NO: 1256921 - protein, 9 aa, Homo Sapiens
TSPSWAAAS

SEQ ID NO: 1256922 - protein, 9 aa, Homo Sapiens
SEETHRKVV

SEQ ID NO: 1256923 - protein, 9 aa, Homo Sapiens
TYRLMAHYL

SEQ ID NO: 1256924 - protein, 9 aa, Homo Sapiens
SKDLQAQAV

SEQ ID NO: 1256925 - protein, 9 aa, Homo Sapiens
TAEDLEIAT

SEQ ID NO: 1256926 - protein, 9 aa, Homo Sapiens
ILCRIRASF

SEQ ID NO: 1256927 - protein, 9 aa, Homo Sapiens
ETVEDWETE

SEQ ID NO: 1256928 - protein, 9 aa, Homo Sapiens
TLFENGPCL

SEQ ID NO: 1256929 - protein, 9 aa, Homo Sapiens
GTEAPYYLA

SEQ ID NO: 1256930 - protein, 9 aa, Homo Sapiens
YRHRLSELR

SEQ ID NO: 1256931 - protein, 9 aa, Homo Sapiens
FLIQLHSCF

SEQ ID NO: 1256932 - protein, 9 aa, Homo Sapiens
VIPGLNNST

SEQ ID NO: 1256933 - protein, 9 aa, Homo Sapiens
GCVCKGVSE

SEQ ID NO: 1256934 - protein, 9 aa, Homo Sapiens
LDHSVKGKH

SEQ ID NO: 1256935 - protein, 9 aa, Homo Sapiens
LTIDMGDLE

SEQ ID NO: 1256936 - protein, 9 aa, Homo Sapiens
CHDQVLIKQ

SEQ ID NO: 1256937 - protein, 9 aa, Homo Sapiens
VNQPLVGEE

SEQ ID NO: 1256938 - protein, 9 aa, Homo Sapiens
RRFATSAPP

SEQ ID NO: 1256939 - protein, 9 aa, Homo Sapiens
QTLEVLQYL

SEQ ID NO: 1256940 - protein, 9 aa, Homo Sapiens
KQEKDFSLK

SEQ ID NO: 1256941 - protein, 9 aa, Homo Sapiens
AEQSAASIT

SEQ ID NO: 1256942 - protein, 9 aa, Homo Sapiens
NTCGRSWRI

SEQ ID NO: 1256943 - protein, 9 aa, Homo Sapiens
GRIRAMRVA

SEQ ID NO: 1256944 - protein, 9 aa, Homo Sapiens
PNDENIMGL

SEQ ID NO: 1256945 - protein, 9 aa, Homo Sapiens
ITSVVVSRL

SEQ ID NO: 1256946 - protein, 9 aa, Homo Sapiens
ASGTSSTMR

SEQ ID NO: 1256947 - protein, 9 aa, Homo Sapiens
QGRLAARNA

SEQ ID NO: 1256948 - protein, 9 aa, Homo Sapiens
IPYVITLVF

SEQ ID NO: 1256949 - protein, 9 aa, Homo Sapiens
TINFAYDTG

SEQ ID NO: 1256950 - protein, 9 aa, Homo Sapiens
EKSYVCEHE

SEQ ID NO: 1256951 - protein, 9 aa, Homo Sapiens
TTSAEKEAT

SEQ ID NO: 1256952 - protein, 9 aa, Homo Sapiens
YQKVKLFRA

SEQ ID NO: 1256953 - protein, 9 aa, Homo Sapiens
PPVPGSASL

SEQ ID NO: 1256954 - protein, 9 aa, Homo Sapiens
TAVWVLIHA

SEQ ID NO: 1256955 - protein, 9 aa, Homo Sapiens
WRDYKRLWA

SEQ ID NO: 1256956 - protein, 9 aa, Homo Sapiens
ISVTQRGVP

SEQ ID NO: 1256957 - protein, 9 aa, Homo Sapiens
SSSMVFPGG

SEQ ID NO: 1256958 - protein, 9 aa, Homo Sapiens
GTEGQPQVI

SEQ ID NO: 1256959 - protein, 9 aa, Homo Sapiens
HTGETVHVC

SEQ ID NO: 1256960 - protein, 9 aa, Homo Sapiens
TDTHRNTQA

SEQ ID NO: 1256961 - protein, 9 aa, Homo Sapiens
ESLLLALLN

SEQ ID NO: 1256962 - protein, 9 aa, Homo Sapiens
KRIIFHKIS

SEQ ID NO: 1256963 - protein, 9 aa, Homo Sapiens
MHLIKDKKA

SEQ ID NO: 1256964 - protein, 9 aa, Homo Sapiens
RGAHRSPSA

SEQ ID NO: 1256965 - protein, 9 aa, Homo Sapiens
EGGHTQDLP

SEQ ID NO: 1256966 - protein, 9 aa, Homo Sapiens
DQLQPQRCS

SEQ ID NO: 1256967 - protein, 9 aa, Homo Sapiens
VQDESPEMA

SEQ ID NO: 1256968 - protein, 9 aa, Homo Sapiens
STLWYLSIT

SEQ ID NO: 1256969 - protein, 9 aa, Homo Sapiens
ISEYSNMPD

SEQ ID NO: 1256970 - protein, 9 aa, Homo Sapiens
AHNRKDMND

SEQ ID NO: 1256971 - protein, 9 aa, Homo Sapiens
ENSGTGFWT

SEQ ID NO: 1256972 - protein, 9 aa, Homo Sapiens
MSVLYVWAH

SEQ ID NO: 1256973 - protein, 9 aa, Homo Sapiens
GYELREPYG

SEQ ID NO: 1256974 - protein, 9 aa, Homo Sapiens
CPYFHSLEV

SEQ ID NO: 1256975 - protein, 9 aa, Homo Sapiens
DLYHLEKLS

SEQ ID NO: 1256976 - protein, 9 aa, Homo Sapiens
RTTITTIVQ

SEQ ID NO: 1256977 - protein, 9 aa, Homo Sapiens
CLLNQELLT

SEQ ID NO: 1256978 - protein, 9 aa, Homo Sapiens
LADGNSNTA

SEQ ID NO: 1256979 - protein, 9 aa, Homo Sapiens
GTMFQNPQH

SEQ ID NO: 1256980 - protein, 9 aa, Homo Sapiens
LGRGTGGTF

SEQ ID NO: 1256981 - protein, 9 aa, Homo Sapiens
KAMFSGHME

SEQ ID NO: 1256982 - protein, 9 aa, Homo Sapiens
PTPGAADFK

SEQ ID NO: 1256983 - protein, 9 aa, Homo Sapiens
RRYPRTTDG

SEQ ID NO: 1256984 - protein, 9 aa, Homo Sapiens
ASGIGIISF

SEQ ID NO: 1256985 - protein, 9 aa, Homo Sapiens
DLLCSVKPF

SEQ ID NO: 1256986 - protein, 9 aa, Homo Sapiens
IPPEIFQES

SEQ ID NO: 1256987 - protein, 9 aa, Homo Sapiens
SICNRDISP

SEQ ID NO: 1256988 - protein, 9 aa, Homo Sapiens
PTRPVVFLV

SEQ ID NO: 1256989 - protein, 9 aa, Homo Sapiens
GPSCERRVN

SEQ ID NO: 1256990 - protein, 9 aa, Homo Sapiens
LQSGEKYLT

SEQ ID NO: 1256991 - protein, 9 aa, Homo Sapiens
PKTWKVNFR

SEQ ID NO: 1256992 - protein, 9 aa, Homo Sapiens
RMCPWTAWS

SEQ ID NO: 1256993 - protein, 9 aa, Homo Sapiens
VVIIPHPYI

SEQ ID NO: 1256994 - protein, 9 aa, Homo Sapiens
FHKVADQLL

SEQ ID NO: 1256995 - protein, 9 aa, Homo Sapiens
AQMSNYQEY

SEQ ID NO: 1256996 - protein, 9 aa, Homo Sapiens
TGPQFCQNP

SEQ ID NO: 1256997 - protein, 9 aa, Homo Sapiens
VHQRMMSQQ

SEQ ID NO: 1256998 - protein, 9 aa, Homo Sapiens
RLGHLAREC

SEQ ID NO: 1256999 - protein, 9 aa, Homo Sapiens
SCTLVMECV

SEQ ID NO: 1257000 - protein, 9 aa, Homo Sapiens
QDFLVDIAE

SEQ ID NO: 1257001 - protein, 9 aa, Homo Sapiens
LAIYQDKDN

SEQ ID NO: 1257002 - protein, 9 aa, Homo Sapiens
YHDQVPDLK

SEQ ID NO: 1257003 - protein, 9 aa, Homo Sapiens
GMSMHVERS

SEQ ID NO: 1257004 - protein, 9 aa, Homo Sapiens
SHQALGLRP

SEQ ID NO: 1257005 - protein, 9 aa, Homo Sapiens
SYNLLEFLQ

SEQ ID NO: 1257006 - protein, 9 aa, Homo Sapiens
DPPLVRVNR

SEQ ID NO: 1257007 - protein, 9 aa, Homo Sapiens
PTFETFTSA

SEQ ID NO: 1257008 - protein, 9 aa, Homo Sapiens
TWRWSRKIG

SEQ ID NO: 1257009 - protein, 9 aa, Homo Sapiens
GIFGNNLVV

SEQ ID NO: 1257010 - protein, 9 aa, Homo Sapiens
ILCGLAVGI

SEQ ID NO: 1257011 - protein, 9 aa, Homo Sapiens
PVLPVSPAA

SEQ ID NO: 1257012 - protein, 9 aa, Homo Sapiens
DLHHQAKLN

SEQ ID NO: 1257013 - protein, 9 aa, Homo Sapiens
VGDVKRCEE

SEQ ID NO: 1257014 - protein, 9 aa, Homo Sapiens
LPNHHHPYG

SEQ ID NO: 1257015 - protein, 9 aa, Homo Sapiens
QLLHHPFIK

SEQ ID NO: 1257016 - protein, 9 aa, Homo Sapiens
SSTTTCSRT

SEQ ID NO: 1257017 - protein, 9 aa, Homo Sapiens
KFLEDCHIQ

SEQ ID NO: 1257018 - protein, 9 aa, Homo Sapiens
LYIFRGQIN

SEQ ID NO: 1257019 - protein, 9 aa, Homo Sapiens
FNKKTNLAR

SEQ ID NO: 1257020 - protein, 9 aa, Homo Sapiens
LYSIFTEHK

SEQ ID NO: 1257021 - protein, 9 aa, Homo Sapiens
LGYPGIQAV

SEQ ID NO: 1257022 - protein, 9 aa, Homo Sapiens
VSAMCTAVW

SEQ ID NO: 1257023 - protein, 9 aa, Homo Sapiens
KANKDLGED

SEQ ID NO: 1257024 - protein, 9 aa, Homo Sapiens
EVRRATVHC

SEQ ID NO: 1257025 - protein, 9 aa, Homo Sapiens
RDWAVFHEE

SEQ ID NO: 1257026 - protein, 9 aa, Homo Sapiens
TGETVHVCN

SEQ ID NO: 1257027 - protein, 9 aa, Homo Sapiens
TPEEHMAYI

SEQ ID NO: 1257028 - protein, 9 aa, Homo Sapiens
QLGLAKGRG

SEQ ID NO: 1257029 - protein, 9 aa, Homo Sapiens
DTWKFMDMM

SEQ ID NO: 1257030 - protein, 9 aa, Homo Sapiens
EVTELDNEV

SEQ ID NO: 1257031 - protein, 9 aa, Homo Sapiens
AWHEGQGTV

SEQ ID NO: 1257032 - protein, 9 aa, Homo Sapiens
GSLPAFIKL

SEQ ID NO: 1257033 - protein, 9 aa, Homo Sapiens
GSGRAGWCV

SEQ ID NO: 1257034 - protein, 9 aa, Homo Sapiens
GPVLPQEEN

SEQ ID NO: 1257035 - protein, 9 aa, Homo Sapiens
IGSAEYCTD

SEQ ID NO: 1257036 - protein, 9 aa, Homo Sapiens
YLRSRNLLM

SEQ ID NO: 1257037 - protein, 9 aa, Homo Sapiens
ILLVLSGVR

SEQ ID NO: 1257038 - protein, 9 aa, Homo Sapiens
TGISSKAMC

SEQ ID NO: 1257039 - protein, 9 aa, Homo Sapiens
LLPTQDEKT

SEQ ID NO: 1257040 - protein, 9 aa, Homo Sapiens
AKQKLIVHQ

SEQ ID NO: 1257041 - protein, 9 aa, Homo Sapiens
EDSTGHWLY

SEQ ID NO: 1257042 - protein, 9 aa, Homo Sapiens
DSELLWDIL

SEQ ID NO: 1257043 - protein, 9 aa, Homo Sapiens
VRILQGLVD

SEQ ID NO: 1257044 - protein, 9 aa, Homo Sapiens
ACNKCVCSF

SEQ ID NO: 1257045 - protein, 9 aa, Homo Sapiens
SLSSSESQA

SEQ ID NO: 1257046 - protein, 9 aa, Homo Sapiens
ERTPSCQDW

SEQ ID NO: 1257047 - protein, 9 aa, Homo Sapiens
LASSRGIVS

SEQ ID NO: 1257048 - protein, 9 aa, Homo Sapiens
PLLSTPTRV

SEQ ID NO: 1257049 - protein, 9 aa, Homo Sapiens
SVFGVIYYV

SEQ ID NO: 1257050 - protein, 9 aa, Homo Sapiens
GAPGPVCYA

SEQ ID NO: 1257051 - protein, 9 aa, Homo Sapiens
IALVTFVAL

SEQ ID NO: 1257052 - protein, 9 aa, Homo Sapiens
LELFRWPWH

SEQ ID NO: 1257053 - protein, 9 aa, Homo Sapiens
RVGPYTFTM

SEQ ID NO: 1257054 - protein, 9 aa, Homo Sapiens
DTKLLVLNS

SEQ ID NO: 1257055 - protein, 9 aa, Homo Sapiens
PPGWSGHLC

SEQ ID NO: 1257056 - protein, 9 aa, Homo Sapiens
LIIVHATSN

SEQ ID NO: 1257057 - protein, 9 aa, Homo Sapiens
GALERGTGL

SEQ ID NO: 1257058 - protein, 9 aa, Homo Sapiens
DSPLILQSD

SEQ ID NO: 1257059 - protein, 9 aa, Homo Sapiens
EENEHMRLE

SEQ ID NO: 1257060 - protein, 9 aa, Homo Sapiens
KTKNISHDT

SEQ ID NO: 1257061 - protein, 9 aa, Homo Sapiens
PAPMEGKII

SEQ ID NO: 1257062 - protein, 9 aa, Homo Sapiens
SDYMPALPR

SEQ ID NO: 1257063 - protein, 9 aa, Homo Sapiens
HSTLGQGLS

SEQ ID NO: 1257064 - protein, 9 aa, Homo Sapiens
EPRKEFGCP

SEQ ID NO: 1257065 - protein, 9 aa, Homo Sapiens
MDENDNAPM

SEQ ID NO: 1257066 - protein, 9 aa, Homo Sapiens
PVCIVMRQS

SEQ ID NO: 1257067 - protein, 9 aa, Homo Sapiens
EAFPGRRAP

SEQ ID NO: 1257068 - protein, 9 aa, Homo Sapiens
LITSLAVTD

SEQ ID NO: 1257069 - protein, 9 aa, Homo Sapiens
YTTPEDVVS

SEQ ID NO: 1257070 - protein, 9 aa, Homo Sapiens
FIIGKDSTH

SEQ ID NO: 1257071 - protein, 9 aa, Homo Sapiens
GQWLPIYLQ

SEQ ID NO: 1257072 - protein, 9 aa, Homo Sapiens
RMNFLHHPD

SEQ ID NO: 1257073 - protein, 9 aa, Homo Sapiens
VRYNIINAL

SEQ ID NO: 1257074 - protein, 9 aa, Homo Sapiens
GALYRLSIL

SEQ ID NO: 1257075 - protein, 9 aa, Homo Sapiens
EHLAPAWML

SEQ ID NO: 1257076 - protein, 9 aa, Homo Sapiens
DGLKRTTYV

SEQ ID NO: 1257077 - protein, 9 aa, Homo Sapiens
PPASSCSSS

SEQ ID NO: 1257078 - protein, 9 aa, Homo Sapiens
PLKGCLLHT

SEQ ID NO: 1257079 - protein, 9 aa, Homo Sapiens
EPGRKCKMH

SEQ ID NO: 1257080 - protein, 9 aa, Homo Sapiens
SGSESKKEI

SEQ ID NO: 1257081 - protein, 9 aa, Homo Sapiens
LVMQEEIFG

SEQ ID NO: 1257082 - protein, 9 aa, Homo Sapiens
PPPLHYREP

SEQ ID NO: 1257083 - protein, 9 aa, Homo Sapiens
PPVELGYQV

SEQ ID NO: 1257084 - protein, 9 aa, Homo Sapiens
LYQTEQYNE

SEQ ID NO: 1257085 - protein, 9 aa, Homo Sapiens
MYHQPSAPT

SEQ ID NO: 1257086 - protein, 9 aa, Homo Sapiens
MGQFIKHLN

SEQ ID NO: 1257087 - protein, 9 aa, Homo Sapiens
QKVLCAEFK

SEQ ID NO: 1257088 - protein, 9 aa, Homo Sapiens
EHCRSLGLL

SEQ ID NO: 1257089 - protein, 9 aa, Homo Sapiens
EQKMQSRMD

SEQ ID NO: 1257090 - protein, 9 aa, Homo Sapiens
LFLIDNDSY

SEQ ID NO: 1257091 - protein, 9 aa, Homo Sapiens
ATDVIHAVW

SEQ ID NO: 1257092 - protein, 9 aa, Homo Sapiens
GTKVIVQVF

SEQ ID NO: 1257093 - protein, 9 aa, Homo Sapiens
HGLSRKYIH

SEQ ID NO: 1257094 - protein, 9 aa, Homo Sapiens
LILHTEDDP

SEQ ID NO: 1257095 - protein, 9 aa, Homo Sapiens
RCAAIKESK

SEQ ID NO: 1257096 - protein, 9 aa, Homo Sapiens
GKPTDSALM

SEQ ID NO: 1257097 - protein, 9 aa, Homo Sapiens
EYQIFPPTT

SEQ ID NO: 1257098 - protein, 9 aa, Homo Sapiens
SHFEGLITI

SEQ ID NO: 1257099 - protein, 9 aa, Homo Sapiens
LTLEGIHQF

SEQ ID NO: 1257100 - protein, 9 aa, Homo Sapiens
IYKHQKKQD

SEQ ID NO: 1257101 - protein, 9 aa, Homo Sapiens
FVQFECGEG

SEQ ID NO: 1257102 - protein, 9 aa, Homo Sapiens
YDLKVPRGM

SEQ ID NO: 1257103 - protein, 9 aa, Homo Sapiens
LESLRGEGH

SEQ ID NO: 1257104 - protein, 9 aa, Homo Sapiens
DRAISCRNT

SEQ ID NO: 1257105 - protein, 9 aa, Homo Sapiens
AGPGQDRHM

SEQ ID NO: 1257106 - protein, 9 aa, Homo Sapiens
YPSQFNPTY

SEQ ID NO: 1257107 - protein, 9 aa, Homo Sapiens
PLISIASTD

SEQ ID NO: 1257108 - protein, 9 aa, Homo Sapiens
QLSNLCHFC

SEQ ID NO: 1257109 - protein, 9 aa, Homo Sapiens
RAHTMAQVD

SEQ ID NO: 1257110 - protein, 9 aa, Homo Sapiens
AFSLLSAVF

SEQ ID NO: 1257111 - protein, 9 aa, Homo Sapiens
LVTSCKTPF

SEQ ID NO: 1257112 - protein, 9 aa, Homo Sapiens
SQILTSYIF

SEQ ID NO: 1257113 - protein, 9 aa, Homo Sapiens
SCVQNNIPQ

SEQ ID NO: 1257114 - protein, 9 aa, Homo Sapiens
RTEASAKPI

SEQ ID NO: 1257115 - protein, 9 aa, Homo Sapiens
GSDGGSMMG

SEQ ID NO: 1257116 - protein, 9 aa, Homo Sapiens
YSVRPGGSG

SEQ ID NO: 1257117 - protein, 9 aa, Homo Sapiens
EQYIAIQYK

SEQ ID NO: 1257118 - protein, 9 aa, Homo Sapiens
QVVLTASIN

SEQ ID NO: 1257119 - protein, 9 aa, Homo Sapiens
TKVYKVKYP

SEQ ID NO: 1257120 - protein, 9 aa, Homo Sapiens
EGLSHISNM

SEQ ID NO: 1257121 - protein, 9 aa, Homo Sapiens
TGWWRSQEV

SEQ ID NO: 1257122 - protein, 9 aa, Homo Sapiens
VTSTRKRPY

SEQ ID NO: 1257123 - protein, 9 aa, Homo Sapiens
GKGNEPSTK

SEQ ID NO: 1257124 - protein, 9 aa, Homo Sapiens
IGGYGPVHM

SEQ ID NO: 1257125 - protein, 9 aa, Homo Sapiens
QCVVTVESL

SEQ ID NO: 1257126 - protein, 9 aa, Homo Sapiens
QLHENQKKQ

SEQ ID NO: 1257127 - protein, 9 aa, Homo Sapiens
YHRALCTCL

SEQ ID NO: 1257128 - protein, 9 aa, Homo Sapiens
NFKKHLNEH

SEQ ID NO: 1257129 - protein, 9 aa, Homo Sapiens
NLQFAGMNI

SEQ ID NO: 1257130 - protein, 9 aa, Homo Sapiens
TTTHNYFGL

SEQ ID NO: 1257131 - protein, 9 aa, Homo Sapiens
EPLLAHANF

SEQ ID NO: 1257132 - protein, 9 aa, Homo Sapiens
EDGTMYGND

SEQ ID NO: 1257133 - protein, 9 aa, Homo Sapiens
ASQGRSWNT

SEQ ID NO: 1257134 - protein, 9 aa, Homo Sapiens
DDKGSMSLS

SEQ ID NO: 1257135 - protein, 9 aa, Homo Sapiens
LEWHVIQAV

SEQ ID NO: 1257136 - protein, 9 aa, Homo Sapiens
LVKRQRTHD

SEQ ID NO: 1257137 - protein, 9 aa, Homo Sapiens
YVELKANNE

SEQ ID NO: 1257138 - protein, 9 aa, Homo Sapiens
TICGHNYLL

SEQ ID NO: 1257139 - protein, 9 aa, Homo Sapiens
HPCCTIKIT

SEQ ID NO: 1257140 - protein, 9 aa, Homo Sapiens
IHNGHGSAS

SEQ ID NO: 1257141 - protein, 9 aa, Homo Sapiens
VKGTYRLVN

SEQ ID NO: 1257142 - protein, 9 aa, Homo Sapiens
CKTPFLVDQ

SEQ ID NO: 1257143 - protein, 9 aa, Homo Sapiens
RCGHVYVRR

SEQ ID NO: 1257144 - protein, 9 aa, Homo Sapiens
NNYHEVSVF

SEQ ID NO: 1257145 - protein, 9 aa, Homo Sapiens
HLAQELAWC

SEQ ID NO: 1257146 - protein, 9 aa, Homo Sapiens
EQPGPMGPP

SEQ ID NO: 1257147 - protein, 9 aa, Homo Sapiens
ESAMSFIHH

SEQ ID NO: 1257148 - protein, 9 aa, Homo Sapiens
TFIWMLHCI

SEQ ID NO: 1257149 - protein, 9 aa, Homo Sapiens
NRLDKPKFG

SEQ ID NO: 1257150 - protein, 9 aa, Homo Sapiens
GQSHYVPSS

SEQ ID NO: 1257151 - protein, 9 aa, Homo Sapiens
IMDYCKKNG

SEQ ID NO: 1257152 - protein, 9 aa, Homo Sapiens
LGSRTLKSA

SEQ ID NO: 1257153 - protein, 9 aa, Homo Sapiens
GMIFGGDYI

SEQ ID NO: 1257154 - protein, 9 aa, Homo Sapiens
LMTAMWLSA

SEQ ID NO: 1257155 - protein, 9 aa, Homo Sapiens
QKIFYMLNT

SEQ ID NO: 1257156 - protein, 9 aa, Homo Sapiens
DCPHVFAKP

SEQ ID NO: 1257157 - protein, 9 aa, Homo Sapiens
HHHRRPQPA

SEQ ID NO: 1257158 - protein, 9 aa, Homo Sapiens
TMTKIQVHL

SEQ ID NO: 1257159 - protein, 9 aa, Homo Sapiens
RKQHALAAA

SEQ ID NO: 1257160 - protein, 9 aa, Homo Sapiens
MEVLKKTCK

SEQ ID NO: 1257161 - protein, 9 aa, Homo Sapiens
LRRQLWAIL

SEQ ID NO: 1257162 - protein, 9 aa, Homo Sapiens
YGHLPREGA

SEQ ID NO: 1257163 - protein, 9 aa, Homo Sapiens
SACRNILDR

SEQ ID NO: 1257164 - protein, 9 aa, Homo Sapiens
AYTLISPNI

SEQ ID NO: 1257165 - protein, 9 aa, Homo Sapiens
TLEGRTGIN

SEQ ID NO: 1257166 - protein, 9 aa, Homo Sapiens
EEADGELTA

SEQ ID NO: 1257167 - protein, 9 aa, Homo Sapiens
MLDTGSFAG

SEQ ID NO: 1257168 - protein, 9 aa, Homo Sapiens
ISPVEISEW

SEQ ID NO: 1257169 - protein, 9 aa, Homo Sapiens
PTFIWMLHC

SEQ ID NO: 1257170 - protein, 9 aa, Homo Sapiens
VIQGDEVDI

SEQ ID NO: 1257171 - protein, 9 aa, Homo Sapiens
AKTVLAICY

SEQ ID NO: 1257172 - protein, 9 aa, Homo Sapiens
HMEVLTDKE

SEQ ID NO: 1257173 - protein, 9 aa, Homo Sapiens
IASLSQTEI

SEQ ID NO: 1257174 - protein, 9 aa, Homo Sapiens
TGYRDSAHQ

SEQ ID NO: 1257175 - protein, 9 aa, Homo Sapiens
VDVIAKALV

SEQ ID NO: 1257176 - protein, 9 aa, Homo Sapiens
LPKKLKGKL

SEQ ID NO: 1257177 - protein, 9 aa, Homo Sapiens
HEEGKIIRA

SEQ ID NO: 1257178 - protein, 9 aa, Homo Sapiens
DAKKNLRTM

SEQ ID NO: 1257179 - protein, 9 aa, Homo Sapiens
CLESQQLIE

SEQ ID NO: 1257180 - protein, 9 aa, Homo Sapiens
DDLMASFLG

SEQ ID NO: 1257181 - protein, 9 aa, Homo Sapiens
LAQQENRYW

SEQ ID NO: 1257182 - protein, 9 aa, Homo Sapiens
AGHFEPLRG

SEQ ID NO: 1257183 - protein, 9 aa, Homo Sapiens
LFLNEEMLS

SEQ ID NO: 1257184 - protein, 9 aa, Homo Sapiens
LEDRCVSSL

SEQ ID NO: 1257185 - protein, 9 aa, Homo Sapiens
YEGYGQTEM

SEQ ID NO: 1257186 - protein, 9 aa, Homo Sapiens
VTFKPFDGE

SEQ ID NO: 1257187 - protein, 9 aa, Homo Sapiens
EELQEYLAF

SEQ ID NO: 1257188 - protein, 9 aa, Homo Sapiens
TKTTCMFSQ

SEQ ID NO: 1257189 - protein, 9 aa, Homo Sapiens
VWDCNTGKY

SEQ ID NO: 1257190 - protein, 9 aa, Homo Sapiens
SGHPRIELL

SEQ ID NO: 1257191 - protein, 9 aa, Homo Sapiens
VLLERRLTL

SEQ ID NO: 1257192 - protein, 9 aa, Homo Sapiens
SSSSQAHAS

SEQ ID NO: 1257193 - protein, 9 aa, Homo Sapiens
DGAVQDLRM

SEQ ID NO: 1257194 - protein, 9 aa, Homo Sapiens
LAPENSDGP

SEQ ID NO: 1257195 - protein, 9 aa, Homo Sapiens
IAQELSFRR

SEQ ID NO: 1257196 - protein, 9 aa, Homo Sapiens
LQSRKAIDT

SEQ ID NO: 1257197 - protein, 9 aa, Homo Sapiens
KQVPKCDVT

SEQ ID NO: 1257198 - protein, 9 aa, Homo Sapiens
NFRPTGGAV

SEQ ID NO: 1257199 - protein, 9 aa, Homo Sapiens
QTQFTVISP

SEQ ID NO: 1257200 - protein, 9 aa, Homo Sapiens
VGCVSCFVG

SEQ ID NO: 1257201 - protein, 9 aa, Homo Sapiens
LWRRFRSVR

SEQ ID NO: 1257202 - protein, 9 aa, Homo Sapiens
DNLDEFLKK

SEQ ID NO: 1257203 - protein, 9 aa, Homo Sapiens
KRQSQEVET

SEQ ID NO: 1257204 - protein, 9 aa, Homo Sapiens
IQEARKTLF

SEQ ID NO: 1257205 - protein, 9 aa, Homo Sapiens
PPSSKRHKT

SEQ ID NO: 1257206 - protein, 9 aa, Homo Sapiens
PKYIFDLPL

SEQ ID NO: 1257207 - protein, 9 aa, Homo Sapiens
GMALDEETR

SEQ ID NO: 1257208 - protein, 9 aa, Homo Sapiens
GSGKVEEDS

SEQ ID NO: 1257209 - protein, 9 aa, Homo Sapiens
NTLQPGCTN

SEQ ID NO: 1257210 - protein, 9 aa, Homo Sapiens
TIKENINKA

SEQ ID NO: 1257211 - protein, 9 aa, Homo Sapiens
DNLAKTHLG

SEQ ID NO: 1257212 - protein, 9 aa, Homo Sapiens
MEIHGAVYY

SEQ ID NO: 1257213 - protein, 9 aa, Homo Sapiens
CFMVDSKEE

SEQ ID NO: 1257214 - protein, 9 aa, Homo Sapiens
CNSGQFLDA

SEQ ID NO: 1257215 - protein, 9 aa, Homo Sapiens
INNKRNGVA

SEQ ID NO: 1257216 - protein, 9 aa, Homo Sapiens
LVICRGWLT

SEQ ID NO: 1257217 - protein, 9 aa, Homo Sapiens
ERLQEQQRT

SEQ ID NO: 1257218 - protein, 9 aa, Homo Sapiens
ALTLAEHLA

SEQ ID NO: 1257219 - protein, 9 aa, Homo Sapiens
IQNASGSVM

SEQ ID NO: 1257220 - protein, 9 aa, Homo Sapiens
VEAVYPALP

SEQ ID NO: 1257221 - protein, 9 aa, Homo Sapiens
LSQHQPRSD

SEQ ID NO: 1257222 - protein, 9 aa, Homo Sapiens
YFTNRQRMN

SEQ ID NO: 1257223 - protein, 9 aa, Homo Sapiens
PASSVMTHL

SEQ ID NO: 1257224 - protein, 9 aa, Homo Sapiens
TGFDDMEGS

SEQ ID NO: 1257225 - protein, 9 aa, Homo Sapiens
GMHLASTLV

SEQ ID NO: 1257226 - protein, 9 aa, Homo Sapiens
QALGCRTTY

SEQ ID NO: 1257227 - protein, 9 aa, Homo Sapiens
MDSKTLPVA

SEQ ID NO: 1257228 - protein, 9 aa, Homo Sapiens
LAHSKMFPI

SEQ ID NO: 1257229 - protein, 9 aa, Homo Sapiens
KNGPDSIMN

SEQ ID NO: 1257230 - protein, 9 aa, Homo Sapiens
PATVSEGKK

SEQ ID NO: 1257231 - protein, 9 aa, Homo Sapiens
PAASPSTHS

SEQ ID NO: 1257232 - protein, 9 aa, Homo Sapiens
DGLIFQAFS

SEQ ID NO: 1257233 - protein, 9 aa, Homo Sapiens
DDYDTLTNI

SEQ ID NO: 1257234 - protein, 9 aa, Homo Sapiens
SVLFVISEV

SEQ ID NO: 1257235 - protein, 9 aa, Homo Sapiens
KIGDWQHTQ

SEQ ID NO: 1257236 - protein, 9 aa, Homo Sapiens
SSMRSWSSW

SEQ ID NO: 1257237 - protein, 9 aa, Homo Sapiens
VYRQTINSK

SEQ ID NO: 1257238 - protein, 9 aa, Homo Sapiens
QDREGTGRM

SEQ ID NO: 1257239 - protein, 9 aa, Homo Sapiens
CYGHRTGDK

SEQ ID NO: 1257240 - protein, 9 aa, Homo Sapiens
TYTSDSEGS

SEQ ID NO: 1257241 - protein, 9 aa, Homo Sapiens
RLIKLLFPV

SEQ ID NO: 1257242 - protein, 9 aa, Homo Sapiens
EIGRDRIVT

SEQ ID NO: 1257243 - protein, 9 aa, Homo Sapiens
PYQHQLLEP

SEQ ID NO: 1257244 - protein, 9 aa, Homo Sapiens
RILDPSIKG

SEQ ID NO: 1257245 - protein, 9 aa, Homo Sapiens
KHSSGLDLF

SEQ ID NO: 1257246 - protein, 9 aa, Homo Sapiens
VTQQISKSQ

SEQ ID NO: 1257247 - protein, 9 aa, Homo Sapiens
CYNPAAVVV

SEQ ID NO: 1257248 - protein, 9 aa, Homo Sapiens
VCPPPPLSS

SEQ ID NO: 1257249 - protein, 9 aa, Homo Sapiens
ADVLIKHSV

SEQ ID NO: 1257250 - protein, 9 aa, Homo Sapiens
QVVQEGTRC

SEQ ID NO: 1257251 - protein, 9 aa, Homo Sapiens
VQSEEEMSD

SEQ ID NO: 1257252 - protein, 9 aa, Homo Sapiens
QGPPGLHGP

SEQ ID NO: 1257253 - protein, 9 aa, Homo Sapiens
SQRGGILAS

SEQ ID NO: 1257254 - protein, 9 aa, Homo Sapiens
QTNIQTLDC

SEQ ID NO: 1257255 - protein, 9 aa, Homo Sapiens
QEGLSHISN

SEQ ID NO: 1257256 - protein, 9 aa, Homo Sapiens
NRQDLEEPT

SEQ ID NO: 1257257 - protein, 9 aa, Homo Sapiens
TMLDTGSFA

SEQ ID NO: 1257258 - protein, 9 aa, Homo Sapiens
RGDDCSSDC

SEQ ID NO: 1257259 - protein, 9 aa, Homo Sapiens
QILNLSSDV

SEQ ID NO: 1257260 - protein, 9 aa, Homo Sapiens
MEKIRNVFQ

SEQ ID NO: 1257261 - protein, 9 aa, Homo Sapiens
IDHRCQHVD

SEQ ID NO: 1257262 - protein, 9 aa, Homo Sapiens
GYLQHAAQE

SEQ ID NO: 1257263 - protein, 9 aa, Homo Sapiens
CLIDVDTKF

SEQ ID NO: 1257264 - protein, 9 aa, Homo Sapiens
GYFPTVTYT

SEQ ID NO: 1257265 - protein, 9 aa, Homo Sapiens
AFPVSNINS

SEQ ID NO: 1257266 - protein, 9 aa, Homo Sapiens
RGEKRKQDA

SEQ ID NO: 1257267 - protein, 9 aa, Homo Sapiens
ISHAGHVLA

SEQ ID NO: 1257268 - protein, 9 aa, Homo Sapiens
TSLSAPPNG

SEQ ID NO: 1257269 - protein, 9 aa, Homo Sapiens
YTADIRVIE

SEQ ID NO: 1257270 - protein, 9 aa, Homo Sapiens
ESPLLTQKT

SEQ ID NO: 1257271 - protein, 9 aa, Homo Sapiens
ARKRREECL

SEQ ID NO: 1257272 - protein, 9 aa, Homo Sapiens
ENIKEKEKQ

SEQ ID NO: 1257273 - protein, 9 aa, Homo Sapiens
HTSEKLYKS

SEQ ID NO: 1257274 - protein, 9 aa, Homo Sapiens
VAHLPWKVF

SEQ ID NO: 1257275 - protein, 9 aa, Homo Sapiens
CFLTLDHYP

SEQ ID NO: 1257276 - protein, 9 aa, Homo Sapiens
RKGISRKSP

SEQ ID NO: 1257277 - protein, 9 aa, Homo Sapiens
GAIPLAHPV

SEQ ID NO: 1257278 - protein, 9 aa, Homo Sapiens
PGLMASAWP

SEQ ID NO: 1257279 - protein, 9 aa, Homo Sapiens
RYMCDVEDC

SEQ ID NO: 1257280 - protein, 9 aa, Homo Sapiens
VDLSYCSLE

SEQ ID NO: 1257281 - protein, 9 aa, Homo Sapiens
CDLPLWTLE

SEQ ID NO: 1257282 - protein, 9 aa, Homo Sapiens
KVAAVVCSQ

SEQ ID NO: 1257283 - protein, 9 aa, Homo Sapiens
AMVKAGGSH

SEQ ID NO: 1257284 - protein, 9 aa, Homo Sapiens
TEAKVAWHE

SEQ ID NO: 1257285 - protein, 9 aa, Homo Sapiens
QLSKDWGWV

SEQ ID NO: 1257286 - protein, 9 aa, Homo Sapiens
IDSGTSDFT

SEQ ID NO: 1257287 - protein, 9 aa, Homo Sapiens
LGPELWALQ

SEQ ID NO: 1257288 - protein, 9 aa, Homo Sapiens
TVVMTVTLS

SEQ ID NO: 1257289 - protein, 9 aa, Homo Sapiens
FPQSSLTMG

SEQ ID NO: 1257290 - protein, 9 aa, Homo Sapiens
GDIVNIGDV

SEQ ID NO: 1257291 - protein, 9 aa, Homo Sapiens
ASSSQGVSV

SEQ ID NO: 1257292 - protein, 9 aa, Homo Sapiens
LINGSGQNK

SEQ ID NO: 1257293 - protein, 9 aa, Homo Sapiens
DRLVQRFST

SEQ ID NO: 1257294 - protein, 9 aa, Homo Sapiens
KIENLRFAH

SEQ ID NO: 1257295 - protein, 9 aa, Homo Sapiens
MAPKVAKGA

SEQ ID NO: 1257296 - protein, 9 aa, Homo Sapiens
SAVCFMEEL

SEQ ID NO: 1257297 - protein, 9 aa, Homo Sapiens
PYTFTMDFC

SEQ ID NO: 1257298 - protein, 9 aa, Homo Sapiens
SSNLWKQNS

SEQ ID NO: 1257299 - protein, 9 aa, Homo Sapiens
LSSPNTYMK

SEQ ID NO: 1257300 - protein, 9 aa, Homo Sapiens
LFEKNHCDC

SEQ ID NO: 1257301 - protein, 9 aa, Homo Sapiens
TYPITTTFI

SEQ ID NO: 1257302 - protein, 9 aa, Homo Sapiens
ADPHFGLIK

SEQ ID NO: 1257303 - protein, 9 aa, Homo Sapiens
SISLDSGFS

SEQ ID NO: 1257304 - protein, 9 aa, Homo Sapiens
IVASVVTSD

SEQ ID NO: 1257305 - protein, 9 aa, Homo Sapiens
GPSPIPTCL

SEQ ID NO: 1257306 - protein, 9 aa, Homo Sapiens
CDKSTCTKM

SEQ ID NO: 1257307 - protein, 9 aa, Homo Sapiens
PCITSPSRQ

SEQ ID NO: 1257308 - protein, 9 aa, Homo Sapiens
NKNVRFIGE

SEQ ID NO: 1257309 - protein, 9 aa, Homo Sapiens
IRPSCHGVM

SEQ ID NO: 1257310 - protein, 9 aa, Homo Sapiens
PGTSSELQN

SEQ ID NO: 1257311 - protein, 9 aa, Homo Sapiens
PSGLKIQMG

SEQ ID NO: 1257312 - protein, 9 aa, Homo Sapiens
ATTAMDLYR

SEQ ID NO: 1257313 - protein, 9 aa, Homo Sapiens
PGRLSANSG

SEQ ID NO: 1257314 - protein, 9 aa, Homo Sapiens
VRNHIMHLD

SEQ ID NO: 1257315 - protein, 9 aa, Homo Sapiens
HEVQGNESD

SEQ ID NO: 1257316 - protein, 9 aa, Homo Sapiens
WSFCFSPLW

SEQ ID NO: 1257317 - protein, 9 aa, Homo Sapiens
TLEGGSRVD

SEQ ID NO: 1257318 - protein, 9 aa, Homo Sapiens
VNFAVLKLN

SEQ ID NO: 1257319 - protein, 9 aa, Homo Sapiens
CSRDTLPAS

SEQ ID NO: 1257320 - protein, 9 aa, Homo Sapiens
RSLYIDLGT

SEQ ID NO: 1257321 - protein, 9 aa, Homo Sapiens
SCCLPGQVH

SEQ ID NO: 1257322 - protein, 9 aa, Homo Sapiens
LLTQKTQTQ

SEQ ID NO: 1257323 - protein, 9 aa, Homo Sapiens
VFSATLAYV

SEQ ID NO: 1257324 - protein, 9 aa, Homo Sapiens
TSDTPIMRS

SEQ ID NO: 1257325 - protein, 9 aa, Homo Sapiens
RVALRSVAV

SEQ ID NO: 1257326 - protein, 9 aa, Homo Sapiens
PQRMFDAEK

SEQ ID NO: 1257327 - protein, 9 aa, Homo Sapiens
LTPGEDPPV

SEQ ID NO: 1257328 - protein, 9 aa, Homo Sapiens
MGDCIGWLD

SEQ ID NO: 1257329 - protein, 9 aa, Homo Sapiens
NSISNQPND

SEQ ID NO: 1257330 - protein, 9 aa, Homo Sapiens
SASLFHRRR

SEQ ID NO: 1257331 - protein, 9 aa, Homo Sapiens
STPHPLTVT

SEQ ID NO: 1257332 - protein, 9 aa, Homo Sapiens
ELRLEEAIG

SEQ ID NO: 1257333 - protein, 9 aa, Homo Sapiens
ISFLTPMAV

SEQ ID NO: 1257334 - protein, 9 aa, Homo Sapiens
VSYFMCMEA

SEQ ID NO: 1257335 - protein, 9 aa, Homo Sapiens
SVRMRQKPS

SEQ ID NO: 1257336 - protein, 9 aa, Homo Sapiens
GDIGYFAIY

SEQ ID NO: 1257337 - protein, 9 aa, Homo Sapiens
QLQSGEKYL

SEQ ID NO: 1257338 - protein, 9 aa, Homo Sapiens
NNVIKSLTC

SEQ ID NO: 1257339 - protein, 9 aa, Homo Sapiens
TDMSNLNKH

SEQ ID NO: 1257340 - protein, 9 aa, Homo Sapiens
SLIKGPLSK

SEQ ID NO: 1257341 - protein, 9 aa, Homo Sapiens
IESYLHSHF

SEQ ID NO: 1257342 - protein, 9 aa, Homo Sapiens
VGTAEAVIP

SEQ ID NO: 1257343 - protein, 9 aa, Homo Sapiens
PSANYHTLY

SEQ ID NO: 1257344 - protein, 9 aa, Homo Sapiens
GAQGVLLIY

SEQ ID NO: 1257345 - protein, 9 aa, Homo Sapiens
RWQDIYKQF

SEQ ID NO: 1257346 - protein, 9 aa, Homo Sapiens
LDSPRYTIP

SEQ ID NO: 1257347 - protein, 9 aa, Homo Sapiens
HFTLGPLVP

SEQ ID NO: 1257348 - protein, 9 aa, Homo Sapiens
CTTAEFPSA

SEQ ID NO: 1257349 - protein, 9 aa, Homo Sapiens
GTFVFVDQR

SEQ ID NO: 1257350 - protein, 9 aa, Homo Sapiens
PEVKVKIAT

SEQ ID NO: 1257351 - protein, 9 aa, Homo Sapiens
AECLQPKAA

SEQ ID NO: 1257352 - protein, 9 aa, Homo Sapiens
PETKEKTSQ

SEQ ID NO: 1257353 - protein, 9 aa, Homo Sapiens
IALISFGVT

SEQ ID NO: 1257354 - protein, 9 aa, Homo Sapiens
EMRDGPQGD

SEQ ID NO: 1257355 - protein, 9 aa, Homo Sapiens
MRRRERERY

SEQ ID NO: 1257356 - protein, 9 aa, Homo Sapiens
SGFCVECVE

SEQ ID NO: 1257357 - protein, 9 aa, Homo Sapiens
ALLQEIKEC

SEQ ID NO: 1257358 - protein, 9 aa, Homo Sapiens
GVASFETNF

SEQ ID NO: 1257359 - protein, 9 aa, Homo Sapiens
QQHRFNGSD

SEQ ID NO: 1257360 - protein, 9 aa, Homo Sapiens
QYSDDFCQP

SEQ ID NO: 1257361 - protein, 9 aa, Homo Sapiens
RHTHTHRYT

SEQ ID NO: 1257362 - protein, 9 aa, Homo Sapiens
DLLTSVCET

SEQ ID NO: 1257363 - protein, 9 aa, Homo Sapiens
PAGRSSGRQ

SEQ ID NO: 1257364 - protein, 9 aa, Homo Sapiens
IPEPLREEG

SEQ ID NO: 1257365 - protein, 9 aa, Homo Sapiens
LKTLKEISH

SEQ ID NO: 1257366 - protein, 9 aa, Homo Sapiens
RLTGLGRED

SEQ ID NO: 1257367 - protein, 9 aa, Homo Sapiens
IAHTTWWDL

SEQ ID NO: 1257368 - protein, 9 aa, Homo Sapiens
GVGAETMHT

SEQ ID NO: 1257369 - protein, 9 aa, Homo Sapiens
MYPAVGTIS

SEQ ID NO: 1257370 - protein, 9 aa, Homo Sapiens
PMEYANHMA

SEQ ID NO: 1257371 - protein, 9 aa, Homo Sapiens
RDPSNHQSQ

SEQ ID NO: 1257372 - protein, 9 aa, Homo Sapiens
NSSVNEMHV

SEQ ID NO: 1257373 - protein, 9 aa, Homo Sapiens
YISDQVAFI

SEQ ID NO: 1257374 - protein, 9 aa, Homo Sapiens
PGCRMCPWT

SEQ ID NO: 1257375 - protein, 9 aa, Homo Sapiens
WGEGGRRPY

SEQ ID NO: 1257376 - protein, 9 aa, Homo Sapiens
YHWFTCMFA

SEQ ID NO: 1257377 - protein, 9 aa, Homo Sapiens
TTSVDLPPE

SEQ ID NO: 1257378 - protein, 9 aa, Homo Sapiens
DGSYMCLAL

SEQ ID NO: 1257379 - protein, 9 aa, Homo Sapiens
SHLIRHRHI

SEQ ID NO: 1257380 - protein, 9 aa, Homo Sapiens
SHLHLKRAP

SEQ ID NO: 1257381 - protein, 9 aa, Homo Sapiens
LTFITTMLN

SEQ ID NO: 1257382 - protein, 9 aa, Homo Sapiens
NTQAHTGIH

SEQ ID NO: 1257383 - protein, 9 aa, Homo Sapiens
DSKTLPVAQ

SEQ ID NO: 1257384 - protein, 9 aa, Homo Sapiens
YASLVRETQ

SEQ ID NO: 1257385 - protein, 9 aa, Homo Sapiens
GSPSRSAAC

SEQ ID NO: 1257386 - protein, 9 aa, Homo Sapiens
VKRFRGLGD

SEQ ID NO: 1257387 - protein, 9 aa, Homo Sapiens
SFTPTSLLY

SEQ ID NO: 1257388 - protein, 9 aa, Homo Sapiens
TECVILAVM

SEQ ID NO: 1257389 - protein, 9 aa, Homo Sapiens
NIPNGLHDP

SEQ ID NO: 1257390 - protein, 9 aa, Homo Sapiens
SGMEHIMHM

SEQ ID NO: 1257391 - protein, 9 aa, Homo Sapiens
PGRAVPIKV

SEQ ID NO: 1257392 - protein, 9 aa, Homo Sapiens
NYLHNDAHV

SEQ ID NO: 1257393 - protein, 9 aa, Homo Sapiens
KLSGCRFSR

SEQ ID NO: 1257394 - protein, 9 aa, Homo Sapiens
IHVQCTGQP

SEQ ID NO: 1257395 - protein, 9 aa, Homo Sapiens
RQKNDGIYV

SEQ ID NO: 1257396 - protein, 9 aa, Homo Sapiens
FGLLGVNEA

SEQ ID NO: 1257397 - protein, 9 aa, Homo Sapiens
GVLQRMLPT

SEQ ID NO: 1257398 - protein, 9 aa, Homo Sapiens
SIIAVICLW

SEQ ID NO: 1257399 - protein, 9 aa, Homo Sapiens
VDFHHVSAV

SEQ ID NO: 1257400 - protein, 9 aa, Homo Sapiens
FFRVDHIMM

SEQ ID NO: 1257401 - protein, 9 aa, Homo Sapiens
TAEFPSATL

SEQ ID NO: 1257402 - protein, 9 aa, Homo Sapiens
LTGTPVQNT

SEQ ID NO: 1257403 - protein, 9 aa, Homo Sapiens
GRKQLARHE

SEQ ID NO: 1257404 - protein, 9 aa, Homo Sapiens
SLLYAYSGL

SEQ ID NO: 1257405 - protein, 9 aa, Homo Sapiens
MQEDPPLMV

SEQ ID NO: 1257406 - protein, 9 aa, Homo Sapiens
NQVKISCSN

SEQ ID NO: 1257407 - protein, 9 aa, Homo Sapiens
NFLILMDMA

SEQ ID NO: 1257408 - protein, 9 aa, Homo Sapiens
ITSDDLHND

SEQ ID NO: 1257409 - protein, 9 aa, Homo Sapiens
IAKYKGVCY

SEQ ID NO: 1257410 - protein, 9 aa, Homo Sapiens
CEDPSFNMD

SEQ ID NO: 1257411 - protein, 9 aa, Homo Sapiens
ELNAQFSQI

SEQ ID NO: 1257412 - protein, 9 aa, Homo Sapiens
KVIQASLDI

SEQ ID NO: 1257413 - protein, 9 aa, Homo Sapiens
RWGYGKPFE

SEQ ID NO: 1257414 - protein, 9 aa, Homo Sapiens
QPHSCLQCS

SEQ ID NO: 1257415 - protein, 9 aa, Homo Sapiens
DGTMRIGEP

SEQ ID NO: 1257416 - protein, 9 aa, Homo Sapiens
QAAEPTHTQ

SEQ ID NO: 1257417 - protein, 9 aa, Homo Sapiens
VSLTSYTSY

SEQ ID NO: 1257418 - protein, 9 aa, Homo Sapiens
FRNDILPCL

SEQ ID NO: 1257419 - protein, 9 aa, Homo Sapiens
ASSTAPAPK

SEQ ID NO: 1257420 - protein, 9 aa, Homo Sapiens
FYLETQDGK

SEQ ID NO: 1257421 - protein, 9 aa, Homo Sapiens
CKLEKIRQD

SEQ ID NO: 1257422 - protein, 9 aa, Homo Sapiens
WPLNHSLAY

SEQ ID NO: 1257423 - protein, 9 aa, Homo Sapiens
AHYLVGTPY

SEQ ID NO: 1257424 - protein, 9 aa, Homo Sapiens
FVNVMNKMH

SEQ ID NO: 1257425 - protein, 9 aa, Homo Sapiens
MPSSMGPGT

SEQ ID NO: 1257426 - protein, 9 aa, Homo Sapiens
QIMIFPEGI

SEQ ID NO: 1257427 - protein, 9 aa, Homo Sapiens
LLPPYLSSY

SEQ ID NO: 1257428 - protein, 9 aa, Homo Sapiens
IQPPRRLVA

SEQ ID NO: 1257429 - protein, 9 aa, Homo Sapiens
RRASATINM

SEQ ID NO: 1257430 - protein, 9 aa, Homo Sapiens
FDSVIHLCC

SEQ ID NO: 1257431 - protein, 9 aa, Homo Sapiens
FSFHLPVLR

SEQ ID NO: 1257432 - protein, 9 aa, Homo Sapiens
GELGGGWIC

SEQ ID NO: 1257433 - protein, 9 aa, Homo Sapiens
TCHALSRLR

SEQ ID NO: 1257434 - protein, 9 aa, Homo Sapiens
SRASGVARF

SEQ ID NO: 1257435 - protein, 9 aa, Homo Sapiens
YKAMSRDEK

SEQ ID NO: 1257436 - protein, 9 aa, Homo Sapiens
LRALHPLRA

SEQ ID NO: 1257437 - protein, 9 aa, Homo Sapiens
STHEPTSST

SEQ ID NO: 1257438 - protein, 9 aa, Homo Sapiens
GAYIFRHNQ

SEQ ID NO: 1257439 - protein, 9 aa, Homo Sapiens
TTTEEQVSE

SEQ ID NO: 1257440 - protein, 9 aa, Homo Sapiens
LCVCCAECL

SEQ ID NO: 1257441 - protein, 9 aa, Homo Sapiens
DQMPSRQPI

SEQ ID NO: 1257442 - protein, 9 aa, Homo Sapiens
LPSEANFLG

SEQ ID NO: 1257443 - protein, 9 aa, Homo Sapiens
EEINRAGMG

SEQ ID NO: 1257444 - protein, 9 aa, Homo Sapiens
QEHFGKYKS

SEQ ID NO: 1257445 - protein, 9 aa, Homo Sapiens
LIVMQPIPA

SEQ ID NO: 1257446 - protein, 9 aa, Homo Sapiens
SASLEVTAM

SEQ ID NO: 1257447 - protein, 9 aa, Homo Sapiens
TIVQTGGGW

SEQ ID NO: 1257448 - protein, 9 aa, Homo Sapiens
TPHHISVKN

SEQ ID NO: 1257449 - protein, 9 aa, Homo Sapiens
RISQHSSEL

SEQ ID NO: 1257450 - protein, 9 aa, Homo Sapiens
AFVRDLCDE

SEQ ID NO: 1257451 - protein, 9 aa, Homo Sapiens
TSFCLAPKR

SEQ ID NO: 1257452 - protein, 9 aa, Homo Sapiens
SIKNKISIT

SEQ ID NO: 1257453 - protein, 9 aa, Homo Sapiens
GIFFRCERF

SEQ ID NO: 1257454 - protein, 9 aa, Homo Sapiens
ACSNTRIIH

SEQ ID NO: 1257455 - protein, 9 aa, Homo Sapiens
QGSHVWGAD

SEQ ID NO: 1257456 - protein, 9 aa, Homo Sapiens
SEHKLSHGS

SEQ ID NO: 1257457 - protein, 9 aa, Homo Sapiens
DQGLQGLKD

SEQ ID NO: 1257458 - protein, 9 aa, Homo Sapiens
GARVSLPSE

SEQ ID NO: 1257459 - protein, 9 aa, Homo Sapiens
EHTQAYLEE

SEQ ID NO: 1257460 - protein, 9 aa, Homo Sapiens
NQRAGAPCI

SEQ ID NO: 1257461 - protein, 9 aa, Homo Sapiens
ALLTYYIAF

SEQ ID NO: 1257462 - protein, 9 aa, Homo Sapiens
SPLEIIMLN

SEQ ID NO: 1257463 - protein, 9 aa, Homo Sapiens
LKQVLFLQL

SEQ ID NO: 1257464 - protein, 9 aa, Homo Sapiens
TLQSQPKES

SEQ ID NO: 1257465 - protein, 9 aa, Homo Sapiens
VIQASLDIG

SEQ ID NO: 1257466 - protein, 9 aa, Homo Sapiens
SSAGDDAIS

SEQ ID NO: 1257467 - protein, 9 aa, Homo Sapiens
GPVHLVQQC

SEQ ID NO: 1257468 - protein, 9 aa, Homo Sapiens
ETILQKRMN

SEQ ID NO: 1257469 - protein, 9 aa, Homo Sapiens
CPACRIPIT

SEQ ID NO: 1257470 - protein, 9 aa, Homo Sapiens
LPHSSGLAL

SEQ ID NO: 1257471 - protein, 9 aa, Homo Sapiens
YQMQSEEVR

SEQ ID NO: 1257472 - protein, 9 aa, Homo Sapiens
CTPYELRMI

SEQ ID NO: 1257473 - protein, 9 aa, Homo Sapiens
VEKHLLGEH

SEQ ID NO: 1257474 - protein, 9 aa, Homo Sapiens
AQPYHMLRT

SEQ ID NO: 1257475 - protein, 9 aa, Homo Sapiens
KLNVDVKKE

SEQ ID NO: 1257476 - protein, 9 aa, Homo Sapiens
PTEKTAGAR

SEQ ID NO: 1257477 - protein, 9 aa, Homo Sapiens
GSTCGCRWS

SEQ ID NO: 1257478 - protein, 9 aa, Homo Sapiens
GLEPEDNNS

SEQ ID NO: 1257479 - protein, 9 aa, Homo Sapiens
VHNPEMCQL

SEQ ID NO: 1257480 - protein, 9 aa, Homo Sapiens
KFKILDEVV

SEQ ID NO: 1257481 - protein, 9 aa, Homo Sapiens
ASTPHPLTV

SEQ ID NO: 1257482 - protein, 9 aa, Homo Sapiens
SRRTSQNLH

SEQ ID NO: 1257483 - protein, 9 aa, Homo Sapiens
GAILKVEDF

SEQ ID NO: 1257484 - protein, 9 aa, Homo Sapiens
DGQGHGQQG

SEQ ID NO: 1257485 - protein, 9 aa, Homo Sapiens
PSVDGDDNF

SEQ ID NO: 1257486 - protein, 9 aa, Homo Sapiens
ASTHRHPSA

SEQ ID NO: 1257487 - protein, 9 aa, Homo Sapiens
LPDEDAFWA

SEQ ID NO: 1257488 - protein, 9 aa, Homo Sapiens
EDHIKTRKV

SEQ ID NO: 1257489 - protein, 9 aa, Homo Sapiens
ALDAFLSYC

SEQ ID NO: 1257490 - protein, 9 aa, Homo Sapiens
TALHGESDL

SEQ ID NO: 1257491 - protein, 9 aa, Homo Sapiens
TTTMKIIVE

SEQ ID NO: 1257492 - protein, 9 aa, Homo Sapiens
CLDMSDTRS

SEQ ID NO: 1257493 - protein, 9 aa, Homo Sapiens
NSKATFQLE

SEQ ID NO: 1257494 - protein, 9 aa, Homo Sapiens
LEIKPSFFV

SEQ ID NO: 1257495 - protein, 9 aa, Homo Sapiens
QRRMSLGEQ

SEQ ID NO: 1257496 - protein, 9 aa, Homo Sapiens
PWRTVPGHL

SEQ ID NO: 1257497 - protein, 9 aa, Homo Sapiens
EWTGGDAPV

SEQ ID NO: 1257498 - protein, 9 aa, Homo Sapiens
GEGDIFRST

SEQ ID NO: 1257499 - protein, 9 aa, Homo Sapiens
SIVNWYIHL

SEQ ID NO: 1257500 - protein, 9 aa, Homo Sapiens
DVRGPEAPD

SEQ ID NO: 1257501 - protein, 9 aa, Homo Sapiens
DVIRLIGQQ

SEQ ID NO: 1257502 - protein, 9 aa, Homo Sapiens
VKLCQTTGL

SEQ ID NO: 1257503 - protein, 9 aa, Homo Sapiens
HLLAINGVS

SEQ ID NO: 1257504 - protein, 9 aa, Homo Sapiens
KEILHFHKG

SEQ ID NO: 1257505 - protein, 9 aa, Homo Sapiens
TIAVGLSLW

SEQ ID NO: 1257506 - protein, 9 aa, Homo Sapiens
ATEGLQTLC

SEQ ID NO: 1257507 - protein, 9 aa, Homo Sapiens
SEGPCVHVP

SEQ ID NO: 1257508 - protein, 9 aa, Homo Sapiens
TDSVSLMRV

SEQ ID NO: 1257509 - protein, 9 aa, Homo Sapiens
LALGPMATG

SEQ ID NO: 1257510 - protein, 9 aa, Homo Sapiens
ANNAAGNDT

SEQ ID NO: 1257511 - protein, 9 aa, Homo Sapiens
RDEYIKWLE

SEQ ID NO: 1257512 - protein, 9 aa, Homo Sapiens
LNSGGGATS

SEQ ID NO: 1257513 - protein, 9 aa, Homo Sapiens
GIEQVKHIT

SEQ ID NO: 1257514 - protein, 9 aa, Homo Sapiens
YVTMTLELG

SEQ ID NO: 1257515 - protein, 9 aa, Homo Sapiens
SNTTTLAEF

SEQ ID NO: 1257516 - protein, 9 aa, Homo Sapiens
HSFCRRRRL

SEQ ID NO: 1257517 - protein, 9 aa, Homo Sapiens
DMTIDFDRI

SEQ ID NO: 1257518 - protein, 9 aa, Homo Sapiens
NLAKNASLG

SEQ ID NO: 1257519 - protein, 9 aa, Homo Sapiens
LKNIFMFIT

SEQ ID NO: 1257520 - protein, 9 aa, Homo Sapiens
SDNEEEDDD

SEQ ID NO: 1257521 - protein, 9 aa, Homo Sapiens
CGEGSLQEI

SEQ ID NO: 1257522 - protein, 9 aa, Homo Sapiens
YFVMTCQEY

SEQ ID NO: 1257523 - protein, 9 aa, Homo Sapiens
GQNWTSLYI

SEQ ID NO: 1257524 - protein, 9 aa, Homo Sapiens
GHGNLTDIS

SEQ ID NO: 1257525 - protein, 9 aa, Homo Sapiens
TQSCPPSSL

SEQ ID NO: 1257526 - protein, 9 aa, Homo Sapiens
GCGGHRGGR

SEQ ID NO: 1257527 - protein, 9 aa, Homo Sapiens
SHLLHIDQN

SEQ ID NO: 1257528 - protein, 9 aa, Homo Sapiens
EDILHFNIF

SEQ ID NO: 1257529 - protein, 9 aa, Homo Sapiens
HPATKLSPD

SEQ ID NO: 1257530 - protein, 9 aa, Homo Sapiens
VHVPLMLNM

SEQ ID NO: 1257531 - protein, 9 aa, Homo Sapiens
GARRRQAED

SEQ ID NO: 1257532 - protein, 9 aa, Homo Sapiens
NNATTRVMT

SEQ ID NO: 1257533 - protein, 9 aa, Homo Sapiens
VMHRMIGLG

SEQ ID NO: 1257534 - protein, 9 aa, Homo Sapiens
LMDAQPWSE

SEQ ID NO: 1257535 - protein, 9 aa, Homo Sapiens
LIPNLTMKE

SEQ ID NO: 1257536 - protein, 9 aa, Homo Sapiens
FSKHPQHKL

SEQ ID NO: 1257537 - protein, 9 aa, Homo Sapiens
QAKLNQHRE

SEQ ID NO: 1257538 - protein, 9 aa, Homo Sapiens
KSTLDAFGK

SEQ ID NO: 1257539 - protein, 9 aa, Homo Sapiens
KIWLSVKEP

SEQ ID NO: 1257540 - protein, 9 aa, Homo Sapiens
RQTRPRRLS

SEQ ID NO: 1257541 - protein, 9 aa, Homo Sapiens
VYVRRGPGP

SEQ ID NO: 1257542 - protein, 9 aa, Homo Sapiens
SEEETEKEL

SEQ ID NO: 1257543 - protein, 9 aa, Homo Sapiens
EFLDLSVSV

SEQ ID NO: 1257544 - protein, 9 aa, Homo Sapiens
QILTTTDVR

SEQ ID NO: 1257545 - protein, 9 aa, Homo Sapiens
ILYIILHIR

SEQ ID NO: 1257546 - protein, 9 aa, Homo Sapiens
PNMRGFLYA

SEQ ID NO: 1257547 - protein, 9 aa, Homo Sapiens
TGENVYKCD

SEQ ID NO: 1257548 - protein, 9 aa, Homo Sapiens
APSPMLPAQ

SEQ ID NO: 1257549 - protein, 9 aa, Homo Sapiens
KPFKYEFCD

SEQ ID NO: 1257550 - protein, 9 aa, Homo Sapiens
DTALTAANG

SEQ ID NO: 1257551 - protein, 9 aa, Homo Sapiens
FWETHPLGC

SEQ ID NO: 1257552 - protein, 9 aa, Homo Sapiens
ISFLECGVQ

SEQ ID NO: 1257553 - protein, 9 aa, Homo Sapiens
RSEADKLTL

SEQ ID NO: 1257554 - protein, 9 aa, Homo Sapiens
NYYNFPLAL

SEQ ID NO: 1257555 - protein, 9 aa, Homo Sapiens
SDLITFLYL

SEQ ID NO: 1257556 - protein, 9 aa, Homo Sapiens
VLSRPSLNK

SEQ ID NO: 1257557 - protein, 9 aa, Homo Sapiens
SATLAYVNS

SEQ ID NO: 1257558 - protein, 9 aa, Homo Sapiens
ALWTWEMPG

SEQ ID NO: 1257559 - protein, 9 aa, Homo Sapiens
TRKDIHHMF

SEQ ID NO: 1257560 - protein, 9 aa, Homo Sapiens
KRLWAGSRI

SEQ ID NO: 1257561 - protein, 9 aa, Homo Sapiens
NVVSYAEVR

SEQ ID NO: 1257562 - protein, 9 aa, Homo Sapiens
LREMENLCL

SEQ ID NO: 1257563 - protein, 9 aa, Homo Sapiens
FQTAYLSMG

SEQ ID NO: 1257564 - protein, 9 aa, Homo Sapiens
YQSVLSMTT

SEQ ID NO: 1257565 - protein, 9 aa, Homo Sapiens
DKERPFHCT

SEQ ID NO: 1257566 - protein, 9 aa, Homo Sapiens
AQEQNENIP

SEQ ID NO: 1257567 - protein, 9 aa, Homo Sapiens
TCWGHYNNV

SEQ ID NO: 1257568 - protein, 9 aa, Homo Sapiens
AKSQTAPQE

SEQ ID NO: 1257569 - protein, 9 aa, Homo Sapiens
RNHLRDVPD

SEQ ID NO: 1257570 - protein, 9 aa, Homo Sapiens
VGHCVIKNA

SEQ ID NO: 1257571 - protein, 9 aa, Homo Sapiens
SRPYFELNA

SEQ ID NO: 1257572 - protein, 9 aa, Homo Sapiens
AVCFLAVGL

SEQ ID NO: 1257573 - protein, 9 aa, Homo Sapiens
YHFLSPYIS

SEQ ID NO: 1257574 - protein, 9 aa, Homo Sapiens
MTLIWRHLM

SEQ ID NO: 1257575 - protein, 9 aa, Homo Sapiens
LSSHVVDRL

SEQ ID NO: 1257576 - protein, 9 aa, Homo Sapiens
ISPGPTSPS

SEQ ID NO: 1257577 - protein, 9 aa, Homo Sapiens
TINVFDHNK

SEQ ID NO: 1257578 - protein, 9 aa, Homo Sapiens
NHITGLCLL

SEQ ID NO: 1257579 - protein, 9 aa, Homo Sapiens
NTAHAILSD

SEQ ID NO: 1257580 - protein, 9 aa, Homo Sapiens
HDDAHAEMH

SEQ ID NO: 1257581 - protein, 9 aa, Homo Sapiens
KTLTQRYRK

SEQ ID NO: 1257582 - protein, 9 aa, Homo Sapiens
VKVRTKAAG

SEQ ID NO: 1257583 - protein, 9 aa, Homo Sapiens
QALRYLHSN

SEQ ID NO: 1257584 - protein, 9 aa, Homo Sapiens
PDTVHEACD

SEQ ID NO: 1257585 - protein, 9 aa, Homo Sapiens
GPAATTPST

SEQ ID NO: 1257586 - protein, 9 aa, Homo Sapiens
EMAEYCNGA

SEQ ID NO: 1257587 - protein, 9 aa, Homo Sapiens
HGGEAFQSG

SEQ ID NO: 1257588 - protein, 9 aa, Homo Sapiens
VDGVTYPAC

SEQ ID NO: 1257589 - protein, 9 aa, Homo Sapiens
QQTLVSTNL

SEQ ID NO: 1257590 - protein, 9 aa, Homo Sapiens
ALCHLVDLF

SEQ ID NO: 1257591 - protein, 9 aa, Homo Sapiens
SAGDDAISL

SEQ ID NO: 1257592 - protein, 9 aa, Homo Sapiens
QLGSQLIAM

SEQ ID NO: 1257593 - protein, 9 aa, Homo Sapiens
SLDRSNSLY

SEQ ID NO: 1257594 - protein, 9 aa, Homo Sapiens
MRGFLYAGL

SEQ ID NO: 1257595 - protein, 9 aa, Homo Sapiens
KQREECAAL

SEQ ID NO: 1257596 - protein, 9 aa, Homo Sapiens
SSFLIFFIP

SEQ ID NO: 1257597 - protein, 9 aa, Homo Sapiens
ATCSSAVRK

SEQ ID NO: 1257598 - protein, 9 aa, Homo Sapiens
FYFFYDVID

SEQ ID NO: 1257599 - protein, 9 aa, Homo Sapiens
DCMYGDIFG

SEQ ID NO: 1257600 - protein, 9 aa, Homo Sapiens
PTSSSHNWT

SEQ ID NO: 1257601 - protein, 9 aa, Homo Sapiens
MIVSGSDIM

SEQ ID NO: 1257602 - protein, 9 aa, Homo Sapiens
SARPSSIEV

SEQ ID NO: 1257603 - protein, 9 aa, Homo Sapiens
TLVLILVFG

SEQ ID NO: 1257604 - protein, 9 aa, Homo Sapiens
TTAKSICRM

SEQ ID NO: 1257605 - protein, 9 aa, Homo Sapiens
IHNGVIHFD

SEQ ID NO: 1257606 - protein, 9 aa, Homo Sapiens
GEKSYNCKV

SEQ ID NO: 1257607 - protein, 9 aa, Homo Sapiens
GNMGHESEI

SEQ ID NO: 1257608 - protein, 9 aa, Homo Sapiens
TCTKMVVYP

SEQ ID NO: 1257609 - protein, 9 aa, Homo Sapiens
SFMEPWASA

SEQ ID NO: 1257610 - protein, 9 aa, Homo Sapiens
DGKHSRCPP

SEQ ID NO: 1257611 - protein, 9 aa, Homo Sapiens
QSARAIMTQ

SEQ ID NO: 1257612 - protein, 9 aa, Homo Sapiens
SVCEIWMNQ

SEQ ID NO: 1257613 - protein, 9 aa, Homo Sapiens
CVLRLQFAS

SEQ ID NO: 1257614 - protein, 9 aa, Homo Sapiens
NGSSSGGGR

SEQ ID NO: 1257615 - protein, 9 aa, Homo Sapiens
QETGLNMHV

SEQ ID NO: 1257616 - protein, 9 aa, Homo Sapiens
IQAGQQFAH

SEQ ID NO: 1257617 - protein, 9 aa, Homo Sapiens
QQQIDPNNP

SEQ ID NO: 1257618 - protein, 9 aa, Homo Sapiens
VPHLLRLFV

SEQ ID NO: 1257619 - protein, 9 aa, Homo Sapiens
DADGECQFN

SEQ ID NO: 1257620 - protein, 9 aa, Homo Sapiens
STLCHFLPL

SEQ ID NO: 1257621 - protein, 9 aa, Homo Sapiens
ESLKPSTSL

SEQ ID NO: 1257622 - protein, 9 aa, Homo Sapiens
HDSTQVGDL

SEQ ID NO: 1257623 - protein, 9 aa, Homo Sapiens
ETRAWSMVG

SEQ ID NO: 1257624 - protein, 9 aa, Homo Sapiens
MFLDGGGIT

SEQ ID NO: 1257625 - protein, 9 aa, Homo Sapiens
RRFDLLKTG

SEQ ID NO: 1257626 - protein, 9 aa, Homo Sapiens
PVSWSSINP

SEQ ID NO: 1257627 - protein, 9 aa, Homo Sapiens
ICLEENNQF

SEQ ID NO: 1257628 - protein, 9 aa, Homo Sapiens
ENIRKKYPD

SEQ ID NO: 1257629 - protein, 9 aa, Homo Sapiens
LAWNRVYIA

SEQ ID NO: 1257630 - protein, 9 aa, Homo Sapiens
DMVTPEAKN

SEQ ID NO: 1257631 - protein, 9 aa, Homo Sapiens
PGRLFVTVK

SEQ ID NO: 1257632 - protein, 9 aa, Homo Sapiens
CALVIFEMT

SEQ ID NO: 1257633 - protein, 9 aa, Homo Sapiens
VNYVRSLRM

SEQ ID NO: 1257634 - protein, 9 aa, Homo Sapiens
NPGLNGRNR

SEQ ID NO: 1257635 - protein, 9 aa, Homo Sapiens
NCSILPCLA

SEQ ID NO: 1257636 - protein, 9 aa, Homo Sapiens
NIYFLIQKI

SEQ ID NO: 1257637 - protein, 9 aa, Homo Sapiens
THGSGPCSS

SEQ ID NO: 1257638 - protein, 9 aa, Homo Sapiens
ISRWNWLQA

SEQ ID NO: 1257639 - protein, 9 aa, Homo Sapiens
CIHFTVEGE

SEQ ID NO: 1257640 - protein, 9 aa, Homo Sapiens
ISILDQILQ

SEQ ID NO: 1257641 - protein, 9 aa, Homo Sapiens
SGSGRFGLC

SEQ ID NO: 1257642 - protein, 9 aa, Homo Sapiens
ALERGTGLG

SEQ ID NO: 1257643 - protein, 9 aa, Homo Sapiens
HGLSKAMST

SEQ ID NO: 1257644 - protein, 9 aa, Homo Sapiens
TERTALAGA

SEQ ID NO: 1257645 - protein, 9 aa, Homo Sapiens
VKSVTKSTT

SEQ ID NO: 1257646 - protein, 9 aa, Homo Sapiens
RHAMPCSRP

SEQ ID NO: 1257647 - protein, 9 aa, Homo Sapiens
TTTTTLMMT

SEQ ID NO: 1257648 - protein, 9 aa, Homo Sapiens
QDETMQPWQ

SEQ ID NO: 1257649 - protein, 9 aa, Homo Sapiens
LLPAWMTLS

SEQ ID NO: 1257650 - protein, 9 aa, Homo Sapiens
SHDSMCPGY

SEQ ID NO: 1257651 - protein, 9 aa, Homo Sapiens
LFLAMLYVV

SEQ ID NO: 1257652 - protein, 9 aa, Homo Sapiens
GRRALWPSS

SEQ ID NO: 1257653 - protein, 9 aa, Homo Sapiens
RFIQSCPTI

SEQ ID NO: 1257654 - protein, 9 aa, Homo Sapiens
PFTMTRNKV

SEQ ID NO: 1257655 - protein, 9 aa, Homo Sapiens
THEPPRPEL

SEQ ID NO: 1257656 - protein, 9 aa, Homo Sapiens
TGLTVIGVF

SEQ ID NO: 1257657 - protein, 9 aa, Homo Sapiens
FHSLQKQVG

SEQ ID NO: 1257658 - protein, 9 aa, Homo Sapiens
GPMRGAKEP

SEQ ID NO: 1257659 - protein, 9 aa, Homo Sapiens
LKKVGDLIL

SEQ ID NO: 1257660 - protein, 9 aa, Homo Sapiens
NAILDFEHC

SEQ ID NO: 1257661 - protein, 9 aa, Homo Sapiens
KATEHLEAE

SEQ ID NO: 1257662 - protein, 9 aa, Homo Sapiens
QHQDWAAIM

SEQ ID NO: 1257663 - protein, 9 aa, Homo Sapiens
QGLVDGVTY

SEQ ID NO: 1257664 - protein, 9 aa, Homo Sapiens
AGFQTHTTP

SEQ ID NO: 1257665 - protein, 9 aa, Homo Sapiens
AEGHKCGEN

SEQ ID NO: 1257666 - protein, 9 aa, Homo Sapiens
TGDNMFFYQ

SEQ ID NO: 1257667 - protein, 9 aa, Homo Sapiens
GTAICNYCK

SEQ ID NO: 1257668 - protein, 9 aa, Homo Sapiens
VTMTLELGG

SEQ ID NO: 1257669 - protein, 9 aa, Homo Sapiens
VLLFLWRRF

SEQ ID NO: 1257670 - protein, 9 aa, Homo Sapiens
PDCPDYMDK

SEQ ID NO: 1257671 - protein, 9 aa, Homo Sapiens
TSSLVFNQS

SEQ ID NO: 1257672 - protein, 9 aa, Homo Sapiens
GPVAEAKSP

SEQ ID NO: 1257673 - protein, 9 aa, Homo Sapiens
THQGHHVRI

SEQ ID NO: 1257674 - protein, 9 aa, Homo Sapiens
VKNVVLDCL

SEQ ID NO: 1257675 - protein, 9 aa, Homo Sapiens
QSREEKQEH

SEQ ID NO: 1257676 - protein, 9 aa, Homo Sapiens
CCFHDYNVE

SEQ ID NO: 1257677 - protein, 9 aa, Homo Sapiens
DGSHEGTVH

SEQ ID NO: 1257678 - protein, 9 aa, Homo Sapiens
IFSYIFCLF

SEQ ID NO: 1257679 - protein, 9 aa, Homo Sapiens
GLENPPGPW

SEQ ID NO: 1257680 - protein, 9 aa, Homo Sapiens
DLVERVLYS

SEQ ID NO: 1257681 - protein, 9 aa, Homo Sapiens
HSSSSQAHA

SEQ ID NO: 1257682 - protein, 9 aa, Homo Sapiens
YELPDDQVI

SEQ ID NO: 1257683 - protein, 9 aa, Homo Sapiens
LDHLLLELN

SEQ ID NO: 1257684 - protein, 9 aa, Homo Sapiens
GTHTHKQIA

SEQ ID NO: 1257685 - protein, 9 aa, Homo Sapiens
LWCLARDPA

SEQ ID NO: 1257686 - protein, 9 aa, Homo Sapiens
HLNEPLKYS

SEQ ID NO: 1257687 - protein, 9 aa, Homo Sapiens
LPERSDSEL

SEQ ID NO: 1257688 - protein, 9 aa, Homo Sapiens
YSFLVRNPG

SEQ ID NO: 1257689 - protein, 9 aa, Homo Sapiens
SEMAQAEGI

SEQ ID NO: 1257690 - protein, 9 aa, Homo Sapiens
PSSMGPGTV

SEQ ID NO: 1257691 - protein, 9 aa, Homo Sapiens
VDYEEFVCG

SEQ ID NO: 1257692 - protein, 9 aa, Homo Sapiens
TQPFFTTSP

SEQ ID NO: 1257693 - protein, 9 aa, Homo Sapiens
NAAPMKEAN

SEQ ID NO: 1257694 - protein, 9 aa, Homo Sapiens
LRNRSAHNA

SEQ ID NO: 1257695 - protein, 9 aa, Homo Sapiens
SSTRSRPSS

SEQ ID NO: 1257696 - protein, 9 aa, Homo Sapiens
HRRPQPATY

SEQ ID NO: 1257697 - protein, 9 aa, Homo Sapiens
CCVEAQGSL

SEQ ID NO: 1257698 - protein, 9 aa, Homo Sapiens
TNKVPEKPL

SEQ ID NO: 1257699 - protein, 9 aa, Homo Sapiens
DSSENILPQ

SEQ ID NO: 1257700 - protein, 9 aa, Homo Sapiens
QSLAVNFCG

SEQ ID NO: 1257701 - protein, 9 aa, Homo Sapiens
ATHYIAPTV

SEQ ID NO: 1257702 - protein, 9 aa, Homo Sapiens
CGKAFGLYS

SEQ ID NO: 1257703 - protein, 9 aa, Homo Sapiens
SMRIFSTEI

SEQ ID NO: 1257704 - protein, 9 aa, Homo Sapiens
AEADAFMFE

SEQ ID NO: 1257705 - protein, 9 aa, Homo Sapiens
PVKRQELTE

SEQ ID NO: 1257706 - protein, 9 aa, Homo Sapiens
PPSSVLDSA

SEQ ID NO: 1257707 - protein, 9 aa, Homo Sapiens
WGHRFELVL

SEQ ID NO: 1257708 - protein, 9 aa, Homo Sapiens
ANKDLGEDR

SEQ ID NO: 1257709 - protein, 9 aa, Homo Sapiens
WQKECIYYA

SEQ ID NO: 1257710 - protein, 9 aa, Homo Sapiens
RDFITALPD

SEQ ID NO: 1257711 - protein, 9 aa, Homo Sapiens
VFQPKRKEY

SEQ ID NO: 1257712 - protein, 9 aa, Homo Sapiens
VIYYTSFVV

SEQ ID NO: 1257713 - protein, 9 aa, Homo Sapiens
TSAEEDHAE

SEQ ID NO: 1257714 - protein, 9 aa, Homo Sapiens
VANGFITLV

SEQ ID NO: 1257715 - protein, 9 aa, Homo Sapiens
TTPSKKKLK

SEQ ID NO: 1257716 - protein, 9 aa, Homo Sapiens
LEVTAMGTE

SEQ ID NO: 1257717 - protein, 9 aa, Homo Sapiens
FPDHLGCAG

SEQ ID NO: 1257718 - protein, 9 aa, Homo Sapiens
AELFLIAIP

SEQ ID NO: 1257719 - protein, 9 aa, Homo Sapiens
GAVLGLYVY

SEQ ID NO: 1257720 - protein, 9 aa, Homo Sapiens
DCLLMIWSV

SEQ ID NO: 1257721 - protein, 9 aa, Homo Sapiens
ITEEPSTSS

SEQ ID NO: 1257722 - protein, 9 aa, Homo Sapiens
WTRQGWQRY

SEQ ID NO: 1257723 - protein, 9 aa, Homo Sapiens
IARDTRHLG

SEQ ID NO: 1257724 - protein, 9 aa, Homo Sapiens
HLLLVGIDE

SEQ ID NO: 1257725 - protein, 9 aa, Homo Sapiens
PSSAAVLPP

SEQ ID NO: 1257726 - protein, 9 aa, Homo Sapiens
HMYYLKISQ

SEQ ID NO: 1257727 - protein, 9 aa, Homo Sapiens
LLSAVMMLH

SEQ ID NO: 1257728 - protein, 9 aa, Homo Sapiens
IISFMQSDM

SEQ ID NO: 1257729 - protein, 9 aa, Homo Sapiens
PSKSKSSSY

SEQ ID NO: 1257730 - protein, 9 aa, Homo Sapiens
LLAAVVALL

SEQ ID NO: 1257731 - protein, 9 aa, Homo Sapiens
LPRPHVLPV

SEQ ID NO: 1257732 - protein, 9 aa, Homo Sapiens
TKALSDLIS

SEQ ID NO: 1257733 - protein, 9 aa, Homo Sapiens
SMEHINRYI

SEQ ID NO: 1257734 - protein, 9 aa, Homo Sapiens
ALSITDILY

SEQ ID NO: 1257735 - protein, 9 aa, Homo Sapiens
ESEARIILE

SEQ ID NO: 1257736 - protein, 9 aa, Homo Sapiens
GFGILGYSQ

SEQ ID NO: 1257737 - protein, 9 aa, Homo Sapiens
YCLKTTAKC

SEQ ID NO: 1257738 - protein, 9 aa, Homo Sapiens
HPALPLPPD

SEQ ID NO: 1257739 - protein, 9 aa, Homo Sapiens
ISMQLLYFF

SEQ ID NO: 1257740 - protein, 9 aa, Homo Sapiens
PRCLLCICA

SEQ ID NO: 1257741 - protein, 9 aa, Homo Sapiens
VLKQVVRKP

SEQ ID NO: 1257742 - protein, 9 aa, Homo Sapiens
DVVEACCSI

SEQ ID NO: 1257743 - protein, 9 aa, Homo Sapiens
PESMEVHRA

SEQ ID NO: 1257744 - protein, 9 aa, Homo Sapiens
LKDYKPTRM

SEQ ID NO: 1257745 - protein, 9 aa, Homo Sapiens
STLHNLGLG

SEQ ID NO: 1257746 - protein, 9 aa, Homo Sapiens
TISMQAILT

SEQ ID NO: 1257747 - protein, 9 aa, Homo Sapiens
DQRRAALDG

SEQ ID NO: 1257748 - protein, 9 aa, Homo Sapiens
NQHVSVSRV

SEQ ID NO: 1257749 - protein, 9 aa, Homo Sapiens
SGYGAPSTD

SEQ ID NO: 1257750 - protein, 9 aa, Homo Sapiens
STASSSSPA

SEQ ID NO: 1257751 - protein, 9 aa, Homo Sapiens
STWADSQEK

SEQ ID NO: 1257752 - protein, 9 aa, Homo Sapiens
HYRILDDKG

SEQ ID NO: 1257753 - protein, 9 aa, Homo Sapiens
TKGVIPSSL

SEQ ID NO: 1257754 - protein, 9 aa, Homo Sapiens
SPHGSTKRR

SEQ ID NO: 1257755 - protein, 9 aa, Homo Sapiens
DQREQVLQG

SEQ ID NO: 1257756 - protein, 9 aa, Homo Sapiens
GSYGDHHHP

SEQ ID NO: 1257757 - protein, 9 aa, Homo Sapiens
CYRQLVSGS

SEQ ID NO: 1257758 - protein, 9 aa, Homo Sapiens
APGAHFHIE

SEQ ID NO: 1257759 - protein, 9 aa, Homo Sapiens
IDKSEMPHV

SEQ ID NO: 1257760 - protein, 9 aa, Homo Sapiens
KCLSSANGN

SEQ ID NO: 1257761 - protein, 9 aa, Homo Sapiens
LPTEKTAGA

SEQ ID NO: 1257762 - protein, 9 aa, Homo Sapiens
SLSEYNRQY

SEQ ID NO: 1257763 - protein, 9 aa, Homo Sapiens
YHWSRSHED

SEQ ID NO: 1257764 - protein, 9 aa, Homo Sapiens
AVGATEDKS

SEQ ID NO: 1257765 - protein, 9 aa, Homo Sapiens
SGDALGWLG

SEQ ID NO: 1257766 - protein, 9 aa, Homo Sapiens
FAGAFPMFP

SEQ ID NO: 1257767 - protein, 9 aa, Homo Sapiens
IIEDQYKNS

SEQ ID NO: 1257768 - protein, 9 aa, Homo Sapiens
PNRISSSLQ

SEQ ID NO: 1257769 - protein, 9 aa, Homo Sapiens
LSHPISICL

SEQ ID NO: 1257770 - protein, 9 aa, Homo Sapiens
LTACMQGQQ

SEQ ID NO: 1257771 - protein, 9 aa, Homo Sapiens
QIQALHQYC

SEQ ID NO: 1257772 - protein, 9 aa, Homo Sapiens
PWSEDRDLG

SEQ ID NO: 1257773 - protein, 9 aa, Homo Sapiens
QDLVLPDSR

SEQ ID NO: 1257774 - protein, 9 aa, Homo Sapiens
IEAPEHDAN

SEQ ID NO: 1257775 - protein, 9 aa, Homo Sapiens
FFCCFHDYN

SEQ ID NO: 1257776 - protein, 9 aa, Homo Sapiens
KEDDLFVIA

SEQ ID NO: 1257777 - protein, 9 aa, Homo Sapiens
PSAESVVQC

SEQ ID NO: 1257778 - protein, 9 aa, Homo Sapiens
SHCTVKLCQ

SEQ ID NO: 1257779 - protein, 9 aa, Homo Sapiens
LEEHYSTLR

SEQ ID NO: 1257780 - protein, 9 aa, Homo Sapiens
SEPYHSPSN

SEQ ID NO: 1257781 - protein, 9 aa, Homo Sapiens
AKSPTCQKM

SEQ ID NO: 1257782 - protein, 9 aa, Homo Sapiens
LGIEQVKHI

SEQ ID NO: 1257783 - protein, 9 aa, Homo Sapiens
PVELGKTQF

SEQ ID NO: 1257784 - protein, 9 aa, Homo Sapiens
LHVYIVGND

SEQ ID NO: 1257785 - protein, 9 aa, Homo Sapiens
INGYKRVLV

SEQ ID NO: 1257786 - protein, 9 aa, Homo Sapiens
VMYVKNRNP

SEQ ID NO: 1257787 - protein, 9 aa, Homo Sapiens
KPHSTGDVF

SEQ ID NO: 1257788 - protein, 9 aa, Homo Sapiens
LLKPQTPNY

SEQ ID NO: 1257789 - protein, 9 aa, Homo Sapiens
YEGYLQHAA

SEQ ID NO: 1257790 - protein, 9 aa, Homo Sapiens
GGCWQRLAE

SEQ ID NO: 1257791 - protein, 9 aa, Homo Sapiens
TQLEQMYQW

SEQ ID NO: 1257792 - protein, 9 aa, Homo Sapiens
VSRHAIDGT

SEQ ID NO: 1257793 - protein, 9 aa, Homo Sapiens
YSVTTLSDD

SEQ ID NO: 1257794 - protein, 9 aa, Homo Sapiens
NPVGQKKCK

SEQ ID NO: 1257795 - protein, 9 aa, Homo Sapiens
LILLWLLGS

SEQ ID NO: 1257796 - protein, 9 aa, Homo Sapiens
LRGGGSPSR

SEQ ID NO: 1257797 - protein, 9 aa, Homo Sapiens
QVTDTVLIN

SEQ ID NO: 1257798 - protein, 9 aa, Homo Sapiens
SISNSTRDW

SEQ ID NO: 1257799 - protein, 9 aa, Homo Sapiens
TETKDLLVA

SEQ ID NO: 1257800 - protein, 9 aa, Homo Sapiens
HLELHVLVM

SEQ ID NO: 1257801 - protein, 9 aa, Homo Sapiens
QVPQCKLFS

SEQ ID NO: 1257802 - protein, 9 aa, Homo Sapiens
CGVCTNRLD

SEQ ID NO: 1257803 - protein, 9 aa, Homo Sapiens
LSAPQIGVI

SEQ ID NO: 1257804 - protein, 9 aa, Homo Sapiens
CPSLRGPAA

SEQ ID NO: 1257805 - protein, 9 aa, Homo Sapiens
LKMKNMDDN

SEQ ID NO: 1257806 - protein, 9 aa, Homo Sapiens
YDVYEISYG

SEQ ID NO: 1257807 - protein, 9 aa, Homo Sapiens
VSDWWPTVS

SEQ ID NO: 1257808 - protein, 9 aa, Homo Sapiens
IIDHIFAVE

SEQ ID NO: 1257809 - protein, 9 aa, Homo Sapiens
ASTPRAPDS

SEQ ID NO: 1257810 - protein, 9 aa, Homo Sapiens
GHESEIQPA

SEQ ID NO: 1257811 - protein, 9 aa, Homo Sapiens
TAPQSRKAG

SEQ ID NO: 1257812 - protein, 9 aa, Homo Sapiens
FCIWKSHPS

SEQ ID NO: 1257813 - protein, 9 aa, Homo Sapiens
FQGAKDLHW

SEQ ID NO: 1257814 - protein, 9 aa, Homo Sapiens
TECDQFSQE

SEQ ID NO: 1257815 - protein, 9 aa, Homo Sapiens
VLQVQKKSL

SEQ ID NO: 1257816 - protein, 9 aa, Homo Sapiens
RYRCFTKHK

SEQ ID NO: 1257817 - protein, 9 aa, Homo Sapiens
ECFTSSLVS

SEQ ID NO: 1257818 - protein, 9 aa, Homo Sapiens
LFLSFNVYV

SEQ ID NO: 1257819 - protein, 9 aa, Homo Sapiens
ARIILEPDT

SEQ ID NO: 1257820 - protein, 9 aa, Homo Sapiens
PGPGGGRGG

SEQ ID NO: 1257821 - protein, 9 aa, Homo Sapiens
DGSFHCVCQ

SEQ ID NO: 1257822 - protein, 9 aa, Homo Sapiens
ELYPSEHRP

SEQ ID NO: 1257823 - protein, 9 aa, Homo Sapiens
ALIHKNRPD

SEQ ID NO: 1257824 - protein, 9 aa, Homo Sapiens
PVHPVAELP

SEQ ID NO: 1257825 - protein, 9 aa, Homo Sapiens
KSTYSVFNP

SEQ ID NO: 1257826 - protein, 9 aa, Homo Sapiens
AEIMRLFPQ

SEQ ID NO: 1257827 - protein, 9 aa, Homo Sapiens
EDASFEKVA

SEQ ID NO: 1257828 - protein, 9 aa, Homo Sapiens
NKTDNNLLD

SEQ ID NO: 1257829 - protein, 9 aa, Homo Sapiens
GTPHHISVK

SEQ ID NO: 1257830 - protein, 9 aa, Homo Sapiens
IIWDAQDLF

SEQ ID NO: 1257831 - protein, 9 aa, Homo Sapiens
TWNKRSGMQ

SEQ ID NO: 1257832 - protein, 9 aa, Homo Sapiens
AILTVHHKI

SEQ ID NO: 1257833 - protein, 9 aa, Homo Sapiens
LVLEGQVTQ

SEQ ID NO: 1257834 - protein, 9 aa, Homo Sapiens
RDACKIIIA

SEQ ID NO: 1257835 - protein, 9 aa, Homo Sapiens
LAPSTMKIE

SEQ ID NO: 1257836 - protein, 9 aa, Homo Sapiens
NNKTVLERR

SEQ ID NO: 1257837 - protein, 9 aa, Homo Sapiens
SDSEPETQH

SEQ ID NO: 1257838 - protein, 9 aa, Homo Sapiens
SVRQLDLSH

SEQ ID NO: 1257839 - protein, 9 aa, Homo Sapiens
LGSLLEHHH

SEQ ID NO: 1257840 - protein, 9 aa, Homo Sapiens
CQLLQRFKV

SEQ ID NO: 1257841 - protein, 9 aa, Homo Sapiens
RIYTMKIKP

SEQ ID NO: 1257842 - protein, 9 aa, Homo Sapiens
SRRFSSLYS

SEQ ID NO: 1257843 - protein, 9 aa, Homo Sapiens
NVLAARYMC

SEQ ID NO: 1257844 - protein, 9 aa, Homo Sapiens
GLVCFRPKG

SEQ ID NO: 1257845 - protein, 9 aa, Homo Sapiens
HAPETPESY

SEQ ID NO: 1257846 - protein, 9 aa, Homo Sapiens
TQETDSFQV

SEQ ID NO: 1257847 - protein, 9 aa, Homo Sapiens
SRFWAKMCY

SEQ ID NO: 1257848 - protein, 9 aa, Homo Sapiens
ILFCDLAVC

SEQ ID NO: 1257849 - protein, 9 aa, Homo Sapiens
VGASGQRPI

SEQ ID NO: 1257850 - protein, 9 aa, Homo Sapiens
DAQGPRPGS

SEQ ID NO: 1257851 - protein, 9 aa, Homo Sapiens
HKVSAITIV

SEQ ID NO: 1257852 - protein, 9 aa, Homo Sapiens
DWVKSQTIE

SEQ ID NO: 1257853 - protein, 9 aa, Homo Sapiens
QLNSIAAVV

SEQ ID NO: 1257854 - protein, 9 aa, Homo Sapiens
KADSTFSGF

SEQ ID NO: 1257855 - protein, 9 aa, Homo Sapiens
CTLPPPPYP

SEQ ID NO: 1257856 - protein, 9 aa, Homo Sapiens
EGSKIGSET

SEQ ID NO: 1257857 - protein, 9 aa, Homo Sapiens
TPSAATFQC

SEQ ID NO: 1257858 - protein, 9 aa, Homo Sapiens
ILMDGFLSQ

SEQ ID NO: 1257859 - protein, 9 aa, Homo Sapiens
VFIRGVGPD

SEQ ID NO: 1257860 - protein, 9 aa, Homo Sapiens
KKQPNAFGE

SEQ ID NO: 1257861 - protein, 9 aa, Homo Sapiens
AWLKMLCVN

SEQ ID NO: 1257862 - protein, 9 aa, Homo Sapiens
LSVANCLGD

SEQ ID NO: 1257863 - protein, 9 aa, Homo Sapiens
AFCTCFSHI

SEQ ID NO: 1257864 - protein, 9 aa, Homo Sapiens
FDVMSPSPD

SEQ ID NO: 1257865 - protein, 9 aa, Homo Sapiens
LTMTASEKT

SEQ ID NO: 1257866 - protein, 9 aa, Homo Sapiens
LNPPTQQPI

SEQ ID NO: 1257867 - protein, 9 aa, Homo Sapiens
ARAQPQTKA

SEQ ID NO: 1257868 - protein, 9 aa, Homo Sapiens
LTHFTVLTA

SEQ ID NO: 1257869 - protein, 9 aa, Homo Sapiens
SLEIFEWFL

SEQ ID NO: 1257870 - protein, 9 aa, Homo Sapiens
CWRCKCYGH

SEQ ID NO: 1257871 - protein, 9 aa, Homo Sapiens
AVNMIFAVV

SEQ ID NO: 1257872 - protein, 9 aa, Homo Sapiens
MTCQEYVYP

SEQ ID NO: 1257873 - protein, 9 aa, Homo Sapiens
VPYLRNRSA

SEQ ID NO: 1257874 - protein, 9 aa, Homo Sapiens
AWPFITTFF

SEQ ID NO: 1257875 - protein, 9 aa, Homo Sapiens
DIVQAKVEM

SEQ ID NO: 1257876 - protein, 9 aa, Homo Sapiens
LQEGKMQYL

SEQ ID NO: 1257877 - protein, 9 aa, Homo Sapiens
CISLIKEEQ

SEQ ID NO: 1257878 - protein, 9 aa, Homo Sapiens
DDLQCYRQC

SEQ ID NO: 1257879 - protein, 9 aa, Homo Sapiens
RNKEEPKAQ

SEQ ID NO: 1257880 - protein, 9 aa, Homo Sapiens
IMGSPKPAT

SEQ ID NO: 1257881 - protein, 9 aa, Homo Sapiens
ICTGPVAQL

SEQ ID NO: 1257882 - protein, 9 aa, Homo Sapiens
TPNKPQKKE

SEQ ID NO: 1257883 - protein, 9 aa, Homo Sapiens
TGKYLETLK

SEQ ID NO: 1257884 - protein, 9 aa, Homo Sapiens
PKLTDFAMS

SEQ ID NO: 1257885 - protein, 9 aa, Homo Sapiens
DPYSTGHLC

SEQ ID NO: 1257886 - protein, 9 aa, Homo Sapiens
RHHAHINVS

SEQ ID NO: 1257887 - protein, 9 aa, Homo Sapiens
PPSNHHQQP

SEQ ID NO: 1257888 - protein, 9 aa, Homo Sapiens
GVCVTAHAL

SEQ ID NO: 1257889 - protein, 9 aa, Homo Sapiens
HGTDCWTYR

SEQ ID NO: 1257890 - protein, 9 aa, Homo Sapiens
PYLTTYRQL

SEQ ID NO: 1257891 - protein, 9 aa, Homo Sapiens
LTTNLFIAQ

SEQ ID NO: 1257892 - protein, 9 aa, Homo Sapiens
EDDVHRLFE

SEQ ID NO: 1257893 - protein, 9 aa, Homo Sapiens
RLCTIGELL

SEQ ID NO: 1257894 - protein, 9 aa, Homo Sapiens
DLPLVIELS

SEQ ID NO: 1257895 - protein, 9 aa, Homo Sapiens
DEERIKNLY

SEQ ID NO: 1257896 - protein, 9 aa, Homo Sapiens
GKPKTIAGF

SEQ ID NO: 1257897 - protein, 9 aa, Homo Sapiens
VLWVHSNQL

SEQ ID NO: 1257898 - protein, 9 aa, Homo Sapiens
QTFITIGDR

SEQ ID NO: 1257899 - protein, 9 aa, Homo Sapiens
SPEECGLIQ

SEQ ID NO: 1257900 - protein, 9 aa, Homo Sapiens
TIVVARLPY

SEQ ID NO: 1257901 - protein, 9 aa, Homo Sapiens
LVGVLLLVF

SEQ ID NO: 1257902 - protein, 9 aa, Homo Sapiens
QKRFLKYAE

SEQ ID NO: 1257903 - protein, 9 aa, Homo Sapiens
ACQTLCNGS

SEQ ID NO: 1257904 - protein, 9 aa, Homo Sapiens
RAENTTVVW

SEQ ID NO: 1257905 - protein, 9 aa, Homo Sapiens
EQKAKMEKF

SEQ ID NO: 1257906 - protein, 9 aa, Homo Sapiens
AKPKYFSAF

SEQ ID NO: 1257907 - protein, 9 aa, Homo Sapiens
ISSSLTPPT

SEQ ID NO: 1257908 - protein, 9 aa, Homo Sapiens
ACGTPDHPK

SEQ ID NO: 1257909 - protein, 9 aa, Homo Sapiens
ERMQDLKST

SEQ ID NO: 1257910 - protein, 9 aa, Homo Sapiens
MITCMYTGK

SEQ ID NO: 1257911 - protein, 9 aa, Homo Sapiens
WNEDYNPYQ

SEQ ID NO: 1257912 - protein, 9 aa, Homo Sapiens
QGIRTVRYH

SEQ ID NO: 1257913 - protein, 9 aa, Homo Sapiens
ATATAATSP

SEQ ID NO: 1257914 - protein, 9 aa, Homo Sapiens
SEVAAERSP

SEQ ID NO: 1257915 - protein, 9 aa, Homo Sapiens
LCRIRASFS

SEQ ID NO: 1257916 - protein, 9 aa, Homo Sapiens
PPAHPRPPA

SEQ ID NO: 1257917 - protein, 9 aa, Homo Sapiens
ILVTTIIAP

SEQ ID NO: 1257918 - protein, 9 aa, Homo Sapiens
SKNTKLLST

SEQ ID NO: 1257919 - protein, 9 aa, Homo Sapiens
EVLAKHEAF

SEQ ID NO: 1257920 - protein, 9 aa, Homo Sapiens
LISMVNHMV

SEQ ID NO: 1257921 - protein, 9 aa, Homo Sapiens
SHFILLEGS

SEQ ID NO: 1257922 - protein, 9 aa, Homo Sapiens
GVGSEAYSK

SEQ ID NO: 1257923 - protein, 9 aa, Homo Sapiens
GHRCEGDPS

SEQ ID NO: 1257924 - protein, 9 aa, Homo Sapiens
FSQRSSDIF

SEQ ID NO: 1257925 - protein, 9 aa, Homo Sapiens
PKESQLTCD

SEQ ID NO: 1257926 - protein, 9 aa, Homo Sapiens
TKKYILNEE

SEQ ID NO: 1257927 - protein, 9 aa, Homo Sapiens
VYFLAFDQN

SEQ ID NO: 1257928 - protein, 9 aa, Homo Sapiens
IGLRGLTNL

SEQ ID NO: 1257929 - protein, 9 aa, Homo Sapiens
RRGWKNFYA

SEQ ID NO: 1257930 - protein, 9 aa, Homo Sapiens
ARYDSICQQ

SEQ ID NO: 1257931 - protein, 9 aa, Homo Sapiens
SSSQAHASA

SEQ ID NO: 1257932 - protein, 9 aa, Homo Sapiens
AILQGTLLF

SEQ ID NO: 1257933 - protein, 9 aa, Homo Sapiens
ISHIKYFKV

SEQ ID NO: 1257934 - protein, 9 aa, Homo Sapiens
MENTAPSQD

SEQ ID NO: 1257935 - protein, 9 aa, Homo Sapiens
TSLTAASPP

SEQ ID NO: 1257936 - protein, 9 aa, Homo Sapiens
FLIWKGPGN

SEQ ID NO: 1257937 - protein, 9 aa, Homo Sapiens
GSASLFHRR

SEQ ID NO: 1257938 - protein, 9 aa, Homo Sapiens
FLGQSDGVI

SEQ ID NO: 1257939 - protein, 9 aa, Homo Sapiens
DALPDWLKD

SEQ ID NO: 1257940 - protein, 9 aa, Homo Sapiens
VCVNFSHWS

SEQ ID NO: 1257941 - protein, 9 aa, Homo Sapiens
FFIFVLFFG

SEQ ID NO: 1257942 - protein, 9 aa, Homo Sapiens
LFGKNFRIY

SEQ ID NO: 1257943 - protein, 9 aa, Homo Sapiens
SEACISIVH

SEQ ID NO: 1257944 - protein, 9 aa, Homo Sapiens
AFSEPSVFQ

SEQ ID NO: 1257945 - protein, 9 aa, Homo Sapiens
IHHRKFDAK

SEQ ID NO: 1257946 - protein, 9 aa, Homo Sapiens
REKHHMLKI

SEQ ID NO: 1257947 - protein, 9 aa, Homo Sapiens
AMSFNSLVN

SEQ ID NO: 1257948 - protein, 9 aa, Homo Sapiens
TSPFPTAIP

SEQ ID NO: 1257949 - protein, 9 aa, Homo Sapiens
LKRKCEMAF

SEQ ID NO: 1257950 - protein, 9 aa, Homo Sapiens
DDSIRIIFS

SEQ ID NO: 1257951 - protein, 9 aa, Homo Sapiens
ELPTPWLCR

SEQ ID NO: 1257952 - protein, 9 aa, Homo Sapiens
VEIVTAMRR

SEQ ID NO: 1257953 - protein, 9 aa, Homo Sapiens
QEDHIKPTV

SEQ ID NO: 1257954 - protein, 9 aa, Homo Sapiens
QCSPLSCNE

SEQ ID NO: 1257955 - protein, 9 aa, Homo Sapiens
LKYIKAKVI

SEQ ID NO: 1257956 - protein, 9 aa, Homo Sapiens
NLHIMIQYL

SEQ ID NO: 1257957 - protein, 9 aa, Homo Sapiens
SMRKGIMAY

SEQ ID NO: 1257958 - protein, 9 aa, Homo Sapiens
HSSELNTIV

SEQ ID NO: 1257959 - protein, 9 aa, Homo Sapiens
LYLLFTGAA

SEQ ID NO: 1257960 - protein, 9 aa, Homo Sapiens
RAAFVYALG

SEQ ID NO: 1257961 - protein, 9 aa, Homo Sapiens
NLTECKNVS

SEQ ID NO: 1257962 - protein, 9 aa, Homo Sapiens
EGMSPICFI

SEQ ID NO: 1257963 - protein, 9 aa, Homo Sapiens
GMSPYAYQG

SEQ ID NO: 1257964 - protein, 9 aa, Homo Sapiens
MPLVGDLSI

SEQ ID NO: 1257965 - protein, 9 aa, Homo Sapiens
KQKEEWRRS

SEQ ID NO: 1257966 - protein, 9 aa, Homo Sapiens
GHSRRLHLE

SEQ ID NO: 1257967 - protein, 9 aa, Homo Sapiens
IITKSDALG

SEQ ID NO: 1257968 - protein, 9 aa, Homo Sapiens
TQSHTGSYQ

SEQ ID NO: 1257969 - protein, 9 aa, Homo Sapiens
PTGTWKPGT

SEQ ID NO: 1257970 - protein, 9 aa, Homo Sapiens
FIMLDQMDH

SEQ ID NO: 1257971 - protein, 9 aa, Homo Sapiens
RCCLVNKWS

SEQ ID NO: 1257972 - protein, 9 aa, Homo Sapiens
PSVAKTEIA

SEQ ID NO: 1257973 - protein, 9 aa, Homo Sapiens
KMYPANFTW

SEQ ID NO: 1257974 - protein, 9 aa, Homo Sapiens
ASMSGTKGM

SEQ ID NO: 1257975 - protein, 9 aa, Homo Sapiens
SVSIMGTRG

SEQ ID NO: 1257976 - protein, 9 aa, Homo Sapiens
AYSFSRWCS

SEQ ID NO: 1257977 - protein, 9 aa, Homo Sapiens
EAQKLLYCD

SEQ ID NO: 1257978 - protein, 9 aa, Homo Sapiens
RRAGDPEGP

SEQ ID NO: 1257979 - protein, 9 aa, Homo Sapiens
LFPFMHVKI

SEQ ID NO: 1257980 - protein, 9 aa, Homo Sapiens
YPGLELPLM

SEQ ID NO: 1257981 - protein, 9 aa, Homo Sapiens
GGLEPGRKC

SEQ ID NO: 1257982 - protein, 9 aa, Homo Sapiens
EEHMAYIWD

SEQ ID NO: 1257983 - protein, 9 aa, Homo Sapiens
WCDGMSHCP

SEQ ID NO: 1257984 - protein, 9 aa, Homo Sapiens
IVDLLQCSQ

SEQ ID NO: 1257985 - protein, 9 aa, Homo Sapiens
ETEESLVKW

SEQ ID NO: 1257986 - protein, 9 aa, Homo Sapiens
ATVLAYAME

SEQ ID NO: 1257987 - protein, 9 aa, Homo Sapiens
FMYMCPSSS

SEQ ID NO: 1257988 - protein, 9 aa, Homo Sapiens
TQYMKYMYP

SEQ ID NO: 1257989 - protein, 9 aa, Homo Sapiens
LACGAIGIA

SEQ ID NO: 1257990 - protein, 9 aa, Homo Sapiens
ASLQPTLSV

SEQ ID NO: 1257991 - protein, 9 aa, Homo Sapiens
ECGKAFQHC

SEQ ID NO: 1257992 - protein, 9 aa, Homo Sapiens
RVLYSMECA

SEQ ID NO: 1257993 - protein, 9 aa, Homo Sapiens
VRKQFANVQ

SEQ ID NO: 1257994 - protein, 9 aa, Homo Sapiens
ATALLLLKL

SEQ ID NO: 1257995 - protein, 9 aa, Homo Sapiens
AVDNTTAKE

SEQ ID NO: 1257996 - protein, 9 aa, Homo Sapiens
RIWMQSPVD

SEQ ID NO: 1257997 - protein, 9 aa, Homo Sapiens
MSPLNFCGP

SEQ ID NO: 1257998 - protein, 9 aa, Homo Sapiens
DRDAILQRL

SEQ ID NO: 1257999 - protein, 9 aa, Homo Sapiens
ERWTGHEVK

SEQ ID NO: 1258000 - protein, 9 aa, Homo Sapiens
AGWGDSGPH

SEQ ID NO: 1258001 - protein, 9 aa, Homo Sapiens
IKQCLKDHG

SEQ ID NO: 1258002 - protein, 9 aa, Homo Sapiens
EHWDEMLIK

SEQ ID NO: 1258003 - protein, 9 aa, Homo Sapiens
NVASSSHSR

SEQ ID NO: 1258004 - protein, 9 aa, Homo Sapiens
GKNSGTVSS

SEQ ID NO: 1258005 - protein, 9 aa, Homo Sapiens
LVDIAEPVC

SEQ ID NO: 1258006 - protein, 9 aa, Homo Sapiens
LYEMICGHA

SEQ ID NO: 1258007 - protein, 9 aa, Homo Sapiens
DAETSGQDE

SEQ ID NO: 1258008 - protein, 9 aa, Homo Sapiens
REGVTRMSM

SEQ ID NO: 1258009 - protein, 9 aa, Homo Sapiens
TGDNEKAKA

SEQ ID NO: 1258010 - protein, 9 aa, Homo Sapiens
LTIMHIQIK

SEQ ID NO: 1258011 - protein, 9 aa, Homo Sapiens
IQCETLIYP

SEQ ID NO: 1258012 - protein, 9 aa, Homo Sapiens
LAVGQEDGL

SEQ ID NO: 1258013 - protein, 9 aa, Homo Sapiens
AEPAESSMP

SEQ ID NO: 1258014 - protein, 9 aa, Homo Sapiens
GHFRHGAAS

SEQ ID NO: 1258015 - protein, 9 aa, Homo Sapiens
THTILWVQA

SEQ ID NO: 1258016 - protein, 9 aa, Homo Sapiens
AGEADASSV

SEQ ID NO: 1258017 - protein, 9 aa, Homo Sapiens
CHLLVKVID

SEQ ID NO: 1258018 - protein, 9 aa, Homo Sapiens
PPPGYESVS

SEQ ID NO: 1258019 - protein, 9 aa, Homo Sapiens
CYTLDPHTC

SEQ ID NO: 1258020 - protein, 9 aa, Homo Sapiens
SFHHIDSVY

SEQ ID NO: 1258021 - protein, 9 aa, Homo Sapiens
LEQFEKDNE

SEQ ID NO: 1258022 - protein, 9 aa, Homo Sapiens
DHTELGFTN

SEQ ID NO: 1258023 - protein, 9 aa, Homo Sapiens
ELQGKFTRV

SEQ ID NO: 1258024 - protein, 9 aa, Homo Sapiens
KLQDEDYQV

SEQ ID NO: 1258025 - protein, 9 aa, Homo Sapiens
PSSVLDSAL

SEQ ID NO: 1258026 - protein, 9 aa, Homo Sapiens
QHPEIVGSG

SEQ ID NO: 1258027 - protein, 9 aa, Homo Sapiens
FGEGMTCSS

SEQ ID NO: 1258028 - protein, 9 aa, Homo Sapiens
RIKYLMEDI

SEQ ID NO: 1258029 - protein, 9 aa, Homo Sapiens
CKLELRLPS

SEQ ID NO: 1258030 - protein, 9 aa, Homo Sapiens
TGEWPFRCV

SEQ ID NO: 1258031 - protein, 9 aa, Homo Sapiens
GTVTDRQIL

SEQ ID NO: 1258032 - protein, 9 aa, Homo Sapiens
GSPKGNRPT

SEQ ID NO: 1258033 - protein, 9 aa, Homo Sapiens
VRRATVHCM

SEQ ID NO: 1258034 - protein, 9 aa, Homo Sapiens
ERRREGHSK

SEQ ID NO: 1258035 - protein, 9 aa, Homo Sapiens
LSLQCTGSG

SEQ ID NO: 1258036 - protein, 9 aa, Homo Sapiens
VCASITGQS

SEQ ID NO: 1258037 - protein, 9 aa, Homo Sapiens
RLSFDLSLT

SEQ ID NO: 1258038 - protein, 9 aa, Homo Sapiens
LEVRAPAAN

SEQ ID NO: 1258039 - protein, 9 aa, Homo Sapiens
RRPKPVTWK

SEQ ID NO: 1258040 - protein, 9 aa, Homo Sapiens
WYQQPRWVA

SEQ ID NO: 1258041 - protein, 9 aa, Homo Sapiens
GPGDPWSVS

SEQ ID NO: 1258042 - protein, 9 aa, Homo Sapiens
GKTAELTYT

SEQ ID NO: 1258043 - protein, 9 aa, Homo Sapiens
RDITLLDLI

SEQ ID NO: 1258044 - protein, 9 aa, Homo Sapiens
NILEISLIK

SEQ ID NO: 1258045 - protein, 9 aa, Homo Sapiens
ELWALQSPE

SEQ ID NO: 1258046 - protein, 9 aa, Homo Sapiens
GDCYIMSGS

SEQ ID NO: 1258047 - protein, 9 aa, Homo Sapiens
ASRYHHRRS

SEQ ID NO: 1258048 - protein, 9 aa, Homo Sapiens
HCPPLLPLP

SEQ ID NO: 1258049 - protein, 9 aa, Homo Sapiens
KGYECSDMS

SEQ ID NO: 1258050 - protein, 9 aa, Homo Sapiens
KNGAGEALG

SEQ ID NO: 1258051 - protein, 9 aa, Homo Sapiens
VDTDGNDTI

SEQ ID NO: 1258052 - protein, 9 aa, Homo Sapiens
NRAHSNYRD

SEQ ID NO: 1258053 - protein, 9 aa, Homo Sapiens
TIGIVMDSG

SEQ ID NO: 1258054 - protein, 9 aa, Homo Sapiens
SEYSVGSDE

SEQ ID NO: 1258055 - protein, 9 aa, Homo Sapiens
EVKENYVIF

SEQ ID NO: 1258056 - protein, 9 aa, Homo Sapiens
NAEASGFCV

SEQ ID NO: 1258057 - protein, 9 aa, Homo Sapiens
PLAQRKGIS

SEQ ID NO: 1258058 - protein, 9 aa, Homo Sapiens
CPRERLKEM

SEQ ID NO: 1258059 - protein, 9 aa, Homo Sapiens
PSPATRHGW

SEQ ID NO: 1258060 - protein, 9 aa, Homo Sapiens
VTDRFKLPP

SEQ ID NO: 1258061 - protein, 9 aa, Homo Sapiens
GNLTDISQP

SEQ ID NO: 1258062 - protein, 9 aa, Homo Sapiens
TTGMVECLR

SEQ ID NO: 1258063 - protein, 9 aa, Homo Sapiens
ISQPQILLY

SEQ ID NO: 1258064 - protein, 9 aa, Homo Sapiens
PNALYFSTG

SEQ ID NO: 1258065 - protein, 9 aa, Homo Sapiens
TADRLTSLA

SEQ ID NO: 1258066 - protein, 9 aa, Homo Sapiens
HHPFKHDIF

SEQ ID NO: 1258067 - protein, 9 aa, Homo Sapiens
NCNQHYGWH

SEQ ID NO: 1258068 - protein, 9 aa, Homo Sapiens
QEVETGGIQ

SEQ ID NO: 1258069 - protein, 9 aa, Homo Sapiens
LEQECLTFT

SEQ ID NO: 1258070 - protein, 9 aa, Homo Sapiens
FEPYQASQH

SEQ ID NO: 1258071 - protein, 9 aa, Homo Sapiens
NYIARDTRH

SEQ ID NO: 1258072 - protein, 9 aa, Homo Sapiens
GVKCTKSDL

SEQ ID NO: 1258073 - protein, 9 aa, Homo Sapiens
VVKHPSAES

SEQ ID NO: 1258074 - protein, 9 aa, Homo Sapiens
DQDDRDLYD

SEQ ID NO: 1258075 - protein, 9 aa, Homo Sapiens
DCMEEKNQV

SEQ ID NO: 1258076 - protein, 9 aa, Homo Sapiens
MDSEPVLVH

SEQ ID NO: 1258077 - protein, 9 aa, Homo Sapiens
LIGQQLNGL

SEQ ID NO: 1258078 - protein, 9 aa, Homo Sapiens
FALSEPYHS

SEQ ID NO: 1258079 - protein, 9 aa, Homo Sapiens
LCSVQDGEP

SEQ ID NO: 1258080 - protein, 9 aa, Homo Sapiens
MSRRAGCVW

SEQ ID NO: 1258081 - protein, 9 aa, Homo Sapiens
SYINIFMTD

SEQ ID NO: 1258082 - protein, 9 aa, Homo Sapiens
STLVMDWDS

SEQ ID NO: 1258083 - protein, 9 aa, Homo Sapiens
PVVKSSMPE

SEQ ID NO: 1258084 - protein, 9 aa, Homo Sapiens
EILRISLRE

SEQ ID NO: 1258085 - protein, 9 aa, Homo Sapiens
EAQVDVLTQ

SEQ ID NO: 1258086 - protein, 9 aa, Homo Sapiens
HSGQPREIR

SEQ ID NO: 1258087 - protein, 9 aa, Homo Sapiens
KTNGAENEM

SEQ ID NO: 1258088 - protein, 9 aa, Homo Sapiens
APRRGCGGH

SEQ ID NO: 1258089 - protein, 9 aa, Homo Sapiens
HSLPMDCLV

SEQ ID NO: 1258090 - protein, 9 aa, Homo Sapiens
QNPAPLWQG

SEQ ID NO: 1258091 - protein, 9 aa, Homo Sapiens
ALISFGVTL

SEQ ID NO: 1258092 - protein, 9 aa, Homo Sapiens
AGPSKVDQL

SEQ ID NO: 1258093 - protein, 9 aa, Homo Sapiens
RMGVCICFY

SEQ ID NO: 1258094 - protein, 9 aa, Homo Sapiens
RLAPPVHPV

SEQ ID NO: 1258095 - protein, 9 aa, Homo Sapiens
STKDSSANW

SEQ ID NO: 1258096 - protein, 9 aa, Homo Sapiens
AYESAESDT

SEQ ID NO: 1258097 - protein, 9 aa, Homo Sapiens
LISLSSSES

SEQ ID NO: 1258098 - protein, 9 aa, Homo Sapiens
IQLIVMQPI

SEQ ID NO: 1258099 - protein, 9 aa, Homo Sapiens
PAPYQHQLL

SEQ ID NO: 1258100 - protein, 9 aa, Homo Sapiens
VFHLQNPKA

SEQ ID NO: 1258101 - protein, 9 aa, Homo Sapiens
GCCIKHYNT

SEQ ID NO: 1258102 - protein, 9 aa, Homo Sapiens
DKGAIKSVL

SEQ ID NO: 1258103 - protein, 9 aa, Homo Sapiens
PLSFADEKF

SEQ ID NO: 1258104 - protein, 9 aa, Homo Sapiens
NQSKATPQS

SEQ ID NO: 1258105 - protein, 9 aa, Homo Sapiens
GGRGGPDRI

SEQ ID NO: 1258106 - protein, 9 aa, Homo Sapiens
NEAHYPDIY

SEQ ID NO: 1258107 - protein, 9 aa, Homo Sapiens
YRECVEFLR

SEQ ID NO: 1258108 - protein, 9 aa, Homo Sapiens
VALSYINIF

SEQ ID NO: 1258109 - protein, 9 aa, Homo Sapiens
ADLPHSSGL

SEQ ID NO: 1258110 - protein, 9 aa, Homo Sapiens
HEEKIMKLS

SEQ ID NO: 1258111 - protein, 9 aa, Homo Sapiens
YTRECLGTH

SEQ ID NO: 1258112 - protein, 9 aa, Homo Sapiens
TDPLALCHL

SEQ ID NO: 1258113 - protein, 9 aa, Homo Sapiens
YTLDNSLWF

SEQ ID NO: 1258114 - protein, 9 aa, Homo Sapiens
ENVLIGRQG

SEQ ID NO: 1258115 - protein, 9 aa, Homo Sapiens
SFSTRGFPR

SEQ ID NO: 1258116 - protein, 9 aa, Homo Sapiens
LEREKHHML

SEQ ID NO: 1258117 - protein, 9 aa, Homo Sapiens
VLKATVPFK

SEQ ID NO: 1258118 - protein, 9 aa, Homo Sapiens
MFPIPAGVF

SEQ ID NO: 1258119 - protein, 9 aa, Homo Sapiens
KKEENTKHF

SEQ ID NO: 1258120 - protein, 9 aa, Homo Sapiens
PGHLEHLCC

SEQ ID NO: 1258121 - protein, 9 aa, Homo Sapiens
SAMHQLAGL

SEQ ID NO: 1258122 - protein, 9 aa, Homo Sapiens
IEVELQFSK

SEQ ID NO: 1258123 - protein, 9 aa, Homo Sapiens
AAIKGPENE

SEQ ID NO: 1258124 - protein, 9 aa, Homo Sapiens
GQLKAAMRR

SEQ ID NO: 1258125 - protein, 9 aa, Homo Sapiens
RRLKHQPPR

SEQ ID NO: 1258126 - protein, 9 aa, Homo Sapiens
IRQSALCPG

SEQ ID NO: 1258127 - protein, 9 aa, Homo Sapiens
QHSLPMDCL

SEQ ID NO: 1258128 - protein, 9 aa, Homo Sapiens
GPTGGPGFP

SEQ ID NO: 1258129 - protein, 9 aa, Homo Sapiens
TENLGAANG

SEQ ID NO: 1258130 - protein, 9 aa, Homo Sapiens
PTAIWRIGS

SEQ ID NO: 1258131 - protein, 9 aa, Homo Sapiens
AATTAAATG

SEQ ID NO: 1258132 - protein, 9 aa, Homo Sapiens
QPPPRLPLR

SEQ ID NO: 1258133 - protein, 9 aa, Homo Sapiens
IKTLTQRYR

SEQ ID NO: 1258134 - protein, 9 aa, Homo Sapiens
GEVWRGKWW

SEQ ID NO: 1258135 - protein, 9 aa, Homo Sapiens
TFSQRSSDI

SEQ ID NO: 1258136 - protein, 9 aa, Homo Sapiens
LHACMIRLF

SEQ ID NO: 1258137 - protein, 9 aa, Homo Sapiens
EQLQNNGLR

SEQ ID NO: 1258138 - protein, 9 aa, Homo Sapiens
CSCDYIPGS

SEQ ID NO: 1258139 - protein, 9 aa, Homo Sapiens
KRKEEESKK

SEQ ID NO: 1258140 - protein, 9 aa, Homo Sapiens
ILAVMAYDH

SEQ ID NO: 1258141 - protein, 9 aa, Homo Sapiens
YGNVGDVTC

SEQ ID NO: 1258142 - protein, 9 aa, Homo Sapiens
EELYMAHNR

SEQ ID NO: 1258143 - protein, 9 aa, Homo Sapiens
QGCVCKGVS

SEQ ID NO: 1258144 - protein, 9 aa, Homo Sapiens
IAERARQGC

SEQ ID NO: 1258145 - protein, 9 aa, Homo Sapiens
LPHKTHRGL

SEQ ID NO: 1258146 - protein, 9 aa, Homo Sapiens
VVREIKLFS

SEQ ID NO: 1258147 - protein, 9 aa, Homo Sapiens
GAHFHIESA

SEQ ID NO: 1258148 - protein, 9 aa, Homo Sapiens
VLLDLLRSS

SEQ ID NO: 1258149 - protein, 9 aa, Homo Sapiens
KTVGQCMET

SEQ ID NO: 1258150 - protein, 9 aa, Homo Sapiens
ETDVAIQTI

SEQ ID NO: 1258151 - protein, 9 aa, Homo Sapiens
AVFYLLWTP

SEQ ID NO: 1258152 - protein, 9 aa, Homo Sapiens
LFDKDGDET

SEQ ID NO: 1258153 - protein, 9 aa, Homo Sapiens
TICHYFMCL

SEQ ID NO: 1258154 - protein, 9 aa, Homo Sapiens
HMDRCFDVL

SEQ ID NO: 1258155 - protein, 9 aa, Homo Sapiens
ALRARWSTS

SEQ ID NO: 1258156 - protein, 9 aa, Homo Sapiens
GILLSPNYS

SEQ ID NO: 1258157 - protein, 9 aa, Homo Sapiens
GISSSITSS

SEQ ID NO: 1258158 - protein, 9 aa, Homo Sapiens
NHSLSIFHT

SEQ ID NO: 1258159 - protein, 9 aa, Homo Sapiens
IMYRKSGLP

SEQ ID NO: 1258160 - protein, 9 aa, Homo Sapiens
YPHLQKVLF

SEQ ID NO: 1258161 - protein, 9 aa, Homo Sapiens
SVRTPEENT

SEQ ID NO: 1258162 - protein, 9 aa, Homo Sapiens
KEAITNYVK

SEQ ID NO: 1258163 - protein, 9 aa, Homo Sapiens
EEIYLIFLK

SEQ ID NO: 1258164 - protein, 9 aa, Homo Sapiens
VRQLDLSHG

SEQ ID NO: 1258165 - protein, 9 aa, Homo Sapiens
GGSPSRSAA

SEQ ID NO: 1258166 - protein, 9 aa, Homo Sapiens
FRVHITLHD

SEQ ID NO: 1258167 - protein, 9 aa, Homo Sapiens
CQDSMLHGA

SEQ ID NO: 1258168 - protein, 9 aa, Homo Sapiens
LHAKRQPLL

SEQ ID NO: 1258169 - protein, 9 aa, Homo Sapiens
KWDYLILRP

SEQ ID NO: 1258170 - protein, 9 aa, Homo Sapiens
CCMQMVSSN

SEQ ID NO: 1258171 - protein, 9 aa, Homo Sapiens
RHVSLRVLS

SEQ ID NO: 1258172 - protein, 9 aa, Homo Sapiens
VFGMLLGDI

SEQ ID NO: 1258173 - protein, 9 aa, Homo Sapiens
ILHQPKKYM

SEQ ID NO: 1258174 - protein, 9 aa, Homo Sapiens
SSLTPPTSS

SEQ ID NO: 1258175 - protein, 9 aa, Homo Sapiens
ASFEKVAAE

SEQ ID NO: 1258176 - protein, 9 aa, Homo Sapiens
QDDNINTPF

SEQ ID NO: 1258177 - protein, 9 aa, Homo Sapiens
PMVHIINRK

SEQ ID NO: 1258178 - protein, 9 aa, Homo Sapiens
SSGPGNVLH

SEQ ID NO: 1258179 - protein, 9 aa, Homo Sapiens
LGFDVDICP

SEQ ID NO: 1258180 - protein, 9 aa, Homo Sapiens
EHYSTLRKI

SEQ ID NO: 1258181 - protein, 9 aa, Homo Sapiens
QALSYFTRK

SEQ ID NO: 1258182 - protein, 9 aa, Homo Sapiens
VHELQARRF

SEQ ID NO: 1258183 - protein, 9 aa, Homo Sapiens
SQPPRGGTN

SEQ ID NO: 1258184 - protein, 9 aa, Homo Sapiens
SRTSAGISS

SEQ ID NO: 1258185 - protein, 9 aa, Homo Sapiens
SWGGPRKAD

SEQ ID NO: 1258186 - protein, 9 aa, Homo Sapiens
GLRERDHLL

SEQ ID NO: 1258187 - protein, 9 aa, Homo Sapiens
ASGVARFSV

SEQ ID NO: 1258188 - protein, 9 aa, Homo Sapiens
QLPLRGSAG

SEQ ID NO: 1258189 - protein, 9 aa, Homo Sapiens
LVPELGRSH

SEQ ID NO: 1258190 - protein, 9 aa, Homo Sapiens
LDRNGSWYP

SEQ ID NO: 1258191 - protein, 9 aa, Homo Sapiens
EGEHMTPCR

SEQ ID NO: 1258192 - protein, 9 aa, Homo Sapiens
ILPAAEYQT

SEQ ID NO: 1258193 - protein, 9 aa, Homo Sapiens
GIPGTSIPG

SEQ ID NO: 1258194 - protein, 9 aa, Homo Sapiens
ANSGCSAVS

SEQ ID NO: 1258195 - protein, 9 aa, Homo Sapiens
VKAAQGLQE

SEQ ID NO: 1258196 - protein, 9 aa, Homo Sapiens
EETMSRFCE

SEQ ID NO: 1258197 - protein, 9 aa, Homo Sapiens
LKQIRLCIL

SEQ ID NO: 1258198 - protein, 9 aa, Homo Sapiens
GLEGSGGRL

SEQ ID NO: 1258199 - protein, 9 aa, Homo Sapiens
APLPTITNW

SEQ ID NO: 1258200 - protein, 9 aa, Homo Sapiens
YKSKMAFLT

SEQ ID NO: 1258201 - protein, 9 aa, Homo Sapiens
MIVIFISYG

SEQ ID NO: 1258202 - protein, 9 aa, Homo Sapiens
QVKEVKKSI

SEQ ID NO: 1258203 - protein, 9 aa, Homo Sapiens
KTDNNLLDQ

SEQ ID NO: 1258204 - protein, 9 aa, Homo Sapiens
LDGSCVLVH

SEQ ID NO: 1258205 - protein, 9 aa, Homo Sapiens
DNLAFLKKI

SEQ ID NO: 1258206 - protein, 9 aa, Homo Sapiens
IKLFSKELR

SEQ ID NO: 1258207 - protein, 9 aa, Homo Sapiens
HVMSCSTEA

SEQ ID NO: 1258208 - protein, 9 aa, Homo Sapiens
GRDGQGHGQ

SEQ ID NO: 1258209 - protein, 9 aa, Homo Sapiens
RLLINQDLV

SEQ ID NO: 1258210 - protein, 9 aa, Homo Sapiens
LCRSSLKAY

SEQ ID NO: 1258211 - protein, 9 aa, Homo Sapiens
ATYFAPNFQ

SEQ ID NO: 1258212 - protein, 9 aa, Homo Sapiens
VEGGIWAVY

SEQ ID NO: 1258213 - protein, 9 aa, Homo Sapiens
TVNSEIWNA

SEQ ID NO: 1258214 - protein, 9 aa, Homo Sapiens
CCDDMALSG

SEQ ID NO: 1258215 - protein, 9 aa, Homo Sapiens
FYWNDGLDQ

SEQ ID NO: 1258216 - protein, 9 aa, Homo Sapiens
WCGWRRLLC

SEQ ID NO: 1258217 - protein, 9 aa, Homo Sapiens
EYARESADQ

SEQ ID NO: 1258218 - protein, 9 aa, Homo Sapiens
LDSDELEMT

SEQ ID NO: 1258219 - protein, 9 aa, Homo Sapiens
NINSPTKIL

SEQ ID NO: 1258220 - protein, 9 aa, Homo Sapiens
PSQGHVTFD

SEQ ID NO: 1258221 - protein, 9 aa, Homo Sapiens
KKNCSFCQD

SEQ ID NO: 1258222 - protein, 9 aa, Homo Sapiens
TLRLRESAE

SEQ ID NO: 1258223 - protein, 9 aa, Homo Sapiens
EVDIMRKVS

SEQ ID NO: 1258224 - protein, 9 aa, Homo Sapiens
LSALSLEEI

SEQ ID NO: 1258225 - protein, 9 aa, Homo Sapiens
GPPASQGRR

SEQ ID NO: 1258226 - protein, 9 aa, Homo Sapiens
SKLYQAYTP

SEQ ID NO: 1258227 - protein, 9 aa, Homo Sapiens
LVNALRDDP

SEQ ID NO: 1258228 - protein, 9 aa, Homo Sapiens
GCRHYVVAR

SEQ ID NO: 1258229 - protein, 9 aa, Homo Sapiens
TVPGIFCAR

SEQ ID NO: 1258230 - protein, 9 aa, Homo Sapiens
IAFAHNSTR

SEQ ID NO: 1258231 - protein, 9 aa, Homo Sapiens
PSHIHHRKF

SEQ ID NO: 1258232 - protein, 9 aa, Homo Sapiens
GVWLLEPPR

SEQ ID NO: 1258233 - protein, 9 aa, Homo Sapiens
MTLIYITLY

SEQ ID NO: 1258234 - protein, 9 aa, Homo Sapiens
RTLLLSLMA

SEQ ID NO: 1258235 - protein, 9 aa, Homo Sapiens
HATDVIHAV

SEQ ID NO: 1258236 - protein, 9 aa, Homo Sapiens
CVLMTKSAD

SEQ ID NO: 1258237 - protein, 9 aa, Homo Sapiens
ETSTESWEL

SEQ ID NO: 1258238 - protein, 9 aa, Homo Sapiens
ATVSRAFNS

SEQ ID NO: 1258239 - protein, 9 aa, Homo Sapiens
QTSECLRYE

SEQ ID NO: 1258240 - protein, 9 aa, Homo Sapiens
PLSERHAPP

SEQ ID NO: 1258241 - protein, 9 aa, Homo Sapiens
INSFGGKGQ

SEQ ID NO: 1258242 - protein, 9 aa, Homo Sapiens
TLTRICTVS

SEQ ID NO: 1258243 - protein, 9 aa, Homo Sapiens
EDYLHLETL

SEQ ID NO: 1258244 - protein, 9 aa, Homo Sapiens
YQVEQSQVL

SEQ ID NO: 1258245 - protein, 9 aa, Homo Sapiens
KGRGVDVLL

SEQ ID NO: 1258246 - protein, 9 aa, Homo Sapiens
ASTTSVITS

SEQ ID NO: 1258247 - protein, 9 aa, Homo Sapiens
DDEWRSDRK

SEQ ID NO: 1258248 - protein, 9 aa, Homo Sapiens
KEQLSELEK

SEQ ID NO: 1258249 - protein, 9 aa, Homo Sapiens
VEEVCSFFH

SEQ ID NO: 1258250 - protein, 9 aa, Homo Sapiens
LYLETAARS

SEQ ID NO: 1258251 - protein, 9 aa, Homo Sapiens
QLAESTVQE

SEQ ID NO: 1258252 - protein, 9 aa, Homo Sapiens
GLAACGTCV

SEQ ID NO: 1258253 - protein, 9 aa, Homo Sapiens
STTGSVSSL

SEQ ID NO: 1258254 - protein, 9 aa, Homo Sapiens
QARTRAGLV

SEQ ID NO: 1258255 - protein, 9 aa, Homo Sapiens
KLMMVPELT

SEQ ID NO: 1258256 - protein, 9 aa, Homo Sapiens
VKNSIMKNQ

SEQ ID NO: 1258257 - protein, 9 aa, Homo Sapiens
LKRCHISSS

SEQ ID NO: 1258258 - protein, 9 aa, Homo Sapiens
SLVKRQRTH

SEQ ID NO: 1258259 - protein, 9 aa, Homo Sapiens
HNYLLTAEW

SEQ ID NO: 1258260 - protein, 9 aa, Homo Sapiens
QPQPPVKVR

SEQ ID NO: 1258261 - protein, 9 aa, Homo Sapiens
SPWSRTLAS

SEQ ID NO: 1258262 - protein, 9 aa, Homo Sapiens
NLGNWQKEC

SEQ ID NO: 1258263 - protein, 9 aa, Homo Sapiens
HRAYLDGSG

SEQ ID NO: 1258264 - protein, 9 aa, Homo Sapiens
STLSVLVTP

SEQ ID NO: 1258265 - protein, 9 aa, Homo Sapiens
GAGSGFGCG

SEQ ID NO: 1258266 - protein, 9 aa, Homo Sapiens
GAADSAPCD

SEQ ID NO: 1258267 - protein, 9 aa, Homo Sapiens
RDAKNIIPM

SEQ ID NO: 1258268 - protein, 9 aa, Homo Sapiens
LTDEDAGTY

SEQ ID NO: 1258269 - protein, 9 aa, Homo Sapiens
LYTDADMKS

SEQ ID NO: 1258270 - protein, 9 aa, Homo Sapiens
MGGLGERVL

SEQ ID NO: 1258271 - protein, 9 aa, Homo Sapiens
QRVLHSAMH

SEQ ID NO: 1258272 - protein, 9 aa, Homo Sapiens
QCSHPNVVI

SEQ ID NO: 1258273 - protein, 9 aa, Homo Sapiens
QGPHHITCI

SEQ ID NO: 1258274 - protein, 9 aa, Homo Sapiens
FVVVISVEV

SEQ ID NO: 1258275 - protein, 9 aa, Homo Sapiens
DDQERIIPC

SEQ ID NO: 1258276 - protein, 9 aa, Homo Sapiens
FSCEDQKED

SEQ ID NO: 1258277 - protein, 9 aa, Homo Sapiens
HIDCHMTSI

SEQ ID NO: 1258278 - protein, 9 aa, Homo Sapiens
HSILIELLD

SEQ ID NO: 1258279 - protein, 9 aa, Homo Sapiens
GEWPFRCVD

SEQ ID NO: 1258280 - protein, 9 aa, Homo Sapiens
KRNPEARLN

SEQ ID NO: 1258281 - protein, 9 aa, Homo Sapiens
FLDGGGITE

SEQ ID NO: 1258282 - protein, 9 aa, Homo Sapiens
SHICVIGLF

SEQ ID NO: 1258283 - protein, 9 aa, Homo Sapiens
DLLNLDIGP

SEQ ID NO: 1258284 - protein, 9 aa, Homo Sapiens
RPVSPRRMT

SEQ ID NO: 1258285 - protein, 9 aa, Homo Sapiens
CLKDQPKSH

SEQ ID NO: 1258286 - protein, 9 aa, Homo Sapiens
PGVKISKAH

SEQ ID NO: 1258287 - protein, 9 aa, Homo Sapiens
WDLGSVTDS

SEQ ID NO: 1258288 - protein, 9 aa, Homo Sapiens
LSLLLQGYR

SEQ ID NO: 1258289 - protein, 9 aa, Homo Sapiens
SLCHMMPFY

SEQ ID NO: 1258290 - protein, 9 aa, Homo Sapiens
VRSGHEEVL

SEQ ID NO: 1258291 - protein, 9 aa, Homo Sapiens
ILIKVKVKN

SEQ ID NO: 1258292 - protein, 9 aa, Homo Sapiens
HPDYGQRFQ

SEQ ID NO: 1258293 - protein, 9 aa, Homo Sapiens
ALRAHMAQR

SEQ ID NO: 1258294 - protein, 9 aa, Homo Sapiens
AARRIKTDF

SEQ ID NO: 1258295 - protein, 9 aa, Homo Sapiens
YSSYHTLDE

SEQ ID NO: 1258296 - protein, 9 aa, Homo Sapiens
RYPVPGYCV

SEQ ID NO: 1258297 - protein, 9 aa, Homo Sapiens
YDVMDAVPV

SEQ ID NO: 1258298 - protein, 9 aa, Homo Sapiens
PSSVRGSAA

SEQ ID NO: 1258299 - protein, 9 aa, Homo Sapiens
NKHLRGGGS

SEQ ID NO: 1258300 - protein, 9 aa, Homo Sapiens
PIQHHPSEV

SEQ ID NO: 1258301 - protein, 9 aa, Homo Sapiens
EEAHRVYGD

SEQ ID NO: 1258302 - protein, 9 aa, Homo Sapiens
TVYNGISRI

SEQ ID NO: 1258303 - protein, 9 aa, Homo Sapiens
EIHRRYVAH

SEQ ID NO: 1258304 - protein, 9 aa, Homo Sapiens
KVFSPQTHT

SEQ ID NO: 1258305 - protein, 9 aa, Homo Sapiens
QENDFSKHI

SEQ ID NO: 1258306 - protein, 9 aa, Homo Sapiens
TIFILSGFA

SEQ ID NO: 1258307 - protein, 9 aa, Homo Sapiens
PELLAKKWG

SEQ ID NO: 1258308 - protein, 9 aa, Homo Sapiens
EGPELEEHY

SEQ ID NO: 1258309 - protein, 9 aa, Homo Sapiens
YTLKQHPAL

SEQ ID NO: 1258310 - protein, 9 aa, Homo Sapiens
KIRLQNNQC

SEQ ID NO: 1258311 - protein, 9 aa, Homo Sapiens
MLQTAGCFV

SEQ ID NO: 1258312 - protein, 9 aa, Homo Sapiens
NFTSVYEEL

SEQ ID NO: 1258313 - protein, 9 aa, Homo Sapiens
DCLDGTCLA

SEQ ID NO: 1258314 - protein, 9 aa, Homo Sapiens
GEDGPSCSS

SEQ ID NO: 1258315 - protein, 9 aa, Homo Sapiens
VEWRGAMGI

SEQ ID NO: 1258316 - protein, 9 aa, Homo Sapiens
TGHSFHMSY

SEQ ID NO: 1258317 - protein, 9 aa, Homo Sapiens
TWARPGEIT

SEQ ID NO: 1258318 - protein, 9 aa, Homo Sapiens
TRNVNSSRF

SEQ ID NO: 1258319 - protein, 9 aa, Homo Sapiens
LDVRRSLRQ

SEQ ID NO: 1258320 - protein, 9 aa, Homo Sapiens
TGGLMALLL

SEQ ID NO: 1258321 - protein, 9 aa, Homo Sapiens
AYDFHDSWE

SEQ ID NO: 1258322 - protein, 9 aa, Homo Sapiens
MITYGVSAF

SEQ ID NO: 1258323 - protein, 9 aa, Homo Sapiens
DRGCLGFQV

SEQ ID NO: 1258324 - protein, 9 aa, Homo Sapiens
EKIDDYTVM

SEQ ID NO: 1258325 - protein, 9 aa, Homo Sapiens
SKPVNEYAC

SEQ ID NO: 1258326 - protein, 9 aa, Homo Sapiens
RKIYEPPQY

SEQ ID NO: 1258327 - protein, 9 aa, Homo Sapiens
ADAFMFEGH

SEQ ID NO: 1258328 - protein, 9 aa, Homo Sapiens
FTKLTFKLT

SEQ ID NO: 1258329 - protein, 9 aa, Homo Sapiens
QFLHEHKTV

SEQ ID NO: 1258330 - protein, 9 aa, Homo Sapiens
HDSTSVDSE

SEQ ID NO: 1258331 - protein, 9 aa, Homo Sapiens
IVFDSEMNK

SEQ ID NO: 1258332 - protein, 9 aa, Homo Sapiens
QGEPKGLHQ

SEQ ID NO: 1258333 - protein, 9 aa, Homo Sapiens
QVGTIIALI

SEQ ID NO: 1258334 - protein, 9 aa, Homo Sapiens
WASVNRGMF

SEQ ID NO: 1258335 - protein, 9 aa, Homo Sapiens
QLFLRRYDE

SEQ ID NO: 1258336 - protein, 9 aa, Homo Sapiens
GLTEIPSHL

SEQ ID NO: 1258337 - protein, 9 aa, Homo Sapiens
SGSDIMRSE

SEQ ID NO: 1258338 - protein, 9 aa, Homo Sapiens
MMKQLQQQH

SEQ ID NO: 1258339 - protein, 9 aa, Homo Sapiens
EYVQHIQQP

SEQ ID NO: 1258340 - protein, 9 aa, Homo Sapiens
PVLSVCMRH

SEQ ID NO: 1258341 - protein, 9 aa, Homo Sapiens
VVLTEYVRA

SEQ ID NO: 1258342 - protein, 9 aa, Homo Sapiens
FSKELRSFL

SEQ ID NO: 1258343 - protein, 9 aa, Homo Sapiens
YRGSTRLEA

SEQ ID NO: 1258344 - protein, 9 aa, Homo Sapiens
MLNGHYKTV

SEQ ID NO: 1258345 - protein, 9 aa, Homo Sapiens
NQDLNIISQ

SEQ ID NO: 1258346 - protein, 9 aa, Homo Sapiens
TQIVANYEL

SEQ ID NO: 1258347 - protein, 9 aa, Homo Sapiens
NKTYLDVGS

SEQ ID NO: 1258348 - protein, 9 aa, Homo Sapiens
VQVTEKTRT

SEQ ID NO: 1258349 - protein, 9 aa, Homo Sapiens
KKIGQWPCF

SEQ ID NO: 1258350 - protein, 9 aa, Homo Sapiens
KEDTWKFMD

SEQ ID NO: 1258351 - protein, 9 aa, Homo Sapiens
YILLWKRTL

SEQ ID NO: 1258352 - protein, 9 aa, Homo Sapiens
DTKILILIM

SEQ ID NO: 1258353 - protein, 9 aa, Homo Sapiens
GPEAPDGRA

SEQ ID NO: 1258354 - protein, 9 aa, Homo Sapiens
KTRNQGIRT

SEQ ID NO: 1258355 - protein, 9 aa, Homo Sapiens
DIDHVPEEE

SEQ ID NO: 1258356 - protein, 9 aa, Homo Sapiens
TLRRPASMG

SEQ ID NO: 1258357 - protein, 9 aa, Homo Sapiens
TWLALENMT

SEQ ID NO: 1258358 - protein, 9 aa, Homo Sapiens
LDWLSQQLV

SEQ ID NO: 1258359 - protein, 9 aa, Homo Sapiens
FLTLLGNGG

SEQ ID NO: 1258360 - protein, 9 aa, Homo Sapiens
GKFTVGALL

SEQ ID NO: 1258361 - protein, 9 aa, Homo Sapiens
DTLESRVES

SEQ ID NO: 1258362 - protein, 9 aa, Homo Sapiens
GLFPAYPIY

SEQ ID NO: 1258363 - protein, 9 aa, Homo Sapiens
TEASAKPIP

SEQ ID NO: 1258364 - protein, 9 aa, Homo Sapiens
IHIHIDHID

SEQ ID NO: 1258365 - protein, 9 aa, Homo Sapiens
AVVGPVAEA

SEQ ID NO: 1258366 - protein, 9 aa, Homo Sapiens
MRRFDDQNL

SEQ ID NO: 1258367 - protein, 9 aa, Homo Sapiens
PSPPKPPTR

SEQ ID NO: 1258368 - protein, 9 aa, Homo Sapiens
INYLYETTL

SEQ ID NO: 1258369 - protein, 9 aa, Homo Sapiens
VTIMGKLRG

SEQ ID NO: 1258370 - protein, 9 aa, Homo Sapiens
HHKVSAITI

SEQ ID NO: 1258371 - protein, 9 aa, Homo Sapiens
AIDLRVEVQ

SEQ ID NO: 1258372 - protein, 9 aa, Homo Sapiens
PAWCPCSSC

SEQ ID NO: 1258373 - protein, 9 aa, Homo Sapiens
SCSADIWDC

SEQ ID NO: 1258374 - protein, 9 aa, Homo Sapiens
SAPCCWRLW

SEQ ID NO: 1258375 - protein, 9 aa, Homo Sapiens
KQHPALEPA

SEQ ID NO: 1258376 - protein, 9 aa, Homo Sapiens
KILGTAICN

SEQ ID NO: 1258377 - protein, 9 aa, Homo Sapiens
IQQMEQKNY

SEQ ID NO: 1258378 - protein, 9 aa, Homo Sapiens
YSVGSDEED

SEQ ID NO: 1258379 - protein, 9 aa, Homo Sapiens
LHSEIKFVL

SEQ ID NO: 1258380 - protein, 9 aa, Homo Sapiens
SGGPEVETN

SEQ ID NO: 1258381 - protein, 9 aa, Homo Sapiens
ADILSRAAG

SEQ ID NO: 1258382 - protein, 9 aa, Homo Sapiens
TRTLQRKWT

SEQ ID NO: 1258383 - protein, 9 aa, Homo Sapiens
THPCMRRYI

SEQ ID NO: 1258384 - protein, 9 aa, Homo Sapiens
MLTQADEKI

SEQ ID NO: 1258385 - protein, 9 aa, Homo Sapiens
LTLVRLIKE

SEQ ID NO: 1258386 - protein, 9 aa, Homo Sapiens
LLSPPLPPA

SEQ ID NO: 1258387 - protein, 9 aa, Homo Sapiens
SMSGTKGMV

SEQ ID NO: 1258388 - protein, 9 aa, Homo Sapiens
YSYPMSAAG

SEQ ID NO: 1258389 - protein, 9 aa, Homo Sapiens
NLLHFSVLM

SEQ ID NO: 1258390 - protein, 9 aa, Homo Sapiens
LKLMAHYGR

SEQ ID NO: 1258391 - protein, 9 aa, Homo Sapiens
PEKQNENIR

SEQ ID NO: 1258392 - protein, 9 aa, Homo Sapiens
AEQHQGPVH

SEQ ID NO: 1258393 - protein, 9 aa, Homo Sapiens
HPNVVIYYT

SEQ ID NO: 1258394 - protein, 9 aa, Homo Sapiens
KAFSAKQKL

SEQ ID NO: 1258395 - protein, 9 aa, Homo Sapiens
PPAQAMKLI

SEQ ID NO: 1258396 - protein, 9 aa, Homo Sapiens
KAQIEKCIQ

SEQ ID NO: 1258397 - protein, 9 aa, Homo Sapiens
SQKFFFDRS

SEQ ID NO: 1258398 - protein, 9 aa, Homo Sapiens
EKQKWDADE

SEQ ID NO: 1258399 - protein, 9 aa, Homo Sapiens
PEFPFQCDP

SEQ ID NO: 1258400 - protein, 9 aa, Homo Sapiens
KAFSTCTTH

SEQ ID NO: 1258401 - protein, 9 aa, Homo Sapiens
TTHFCAIVL

SEQ ID NO: 1258402 - protein, 9 aa, Homo Sapiens
ASAGLRHNP

SEQ ID NO: 1258403 - protein, 9 aa, Homo Sapiens
YVGLLFFYH

SEQ ID NO: 1258404 - protein, 9 aa, Homo Sapiens
LAYVNSLVL

SEQ ID NO: 1258405 - protein, 9 aa, Homo Sapiens
VLSRTRACE

SEQ ID NO: 1258406 - protein, 9 aa, Homo Sapiens
GSASNTQGC

SEQ ID NO: 1258407 - protein, 9 aa, Homo Sapiens
HLLVSQLRA

SEQ ID NO: 1258408 - protein, 9 aa, Homo Sapiens
MLPAQFKQR

SEQ ID NO: 1258409 - protein, 9 aa, Homo Sapiens
EFGFSFSFS

SEQ ID NO: 1258410 - protein, 9 aa, Homo Sapiens
TSREKAAND

SEQ ID NO: 1258411 - protein, 9 aa, Homo Sapiens
NTRDPDTRH

SEQ ID NO: 1258412 - protein, 9 aa, Homo Sapiens
MMLHHMGLF

SEQ ID NO: 1258413 - protein, 9 aa, Homo Sapiens
GPPCRSSRT

SEQ ID NO: 1258414 - protein, 9 aa, Homo Sapiens
WEVLRKMGL

SEQ ID NO: 1258415 - protein, 9 aa, Homo Sapiens
LNAICTGPV

SEQ ID NO: 1258416 - protein, 9 aa, Homo Sapiens
APEKEEDSS

SEQ ID NO: 1258417 - protein, 9 aa, Homo Sapiens
KMAAHMWMV

SEQ ID NO: 1258418 - protein, 9 aa, Homo Sapiens
TERIREMQS

SEQ ID NO: 1258419 - protein, 9 aa, Homo Sapiens
NKKISVLSF

SEQ ID NO: 1258420 - protein, 9 aa, Homo Sapiens
STDSHFPYD

SEQ ID NO: 1258421 - protein, 9 aa, Homo Sapiens
LLEPPRTDP

SEQ ID NO: 1258422 - protein, 9 aa, Homo Sapiens
VSMQPHKYI

SEQ ID NO: 1258423 - protein, 9 aa, Homo Sapiens
EDMYWMASN

SEQ ID NO: 1258424 - protein, 9 aa, Homo Sapiens
HVCQYNAVV

SEQ ID NO: 1258425 - protein, 9 aa, Homo Sapiens
QVLVSGASM

SEQ ID NO: 1258426 - protein, 9 aa, Homo Sapiens
TEARTECDQ

SEQ ID NO: 1258427 - protein, 9 aa, Homo Sapiens
VNITKQDIM

SEQ ID NO: 1258428 - protein, 9 aa, Homo Sapiens
QHWQLKYPK

SEQ ID NO: 1258429 - protein, 9 aa, Homo Sapiens
APFPRAARP

SEQ ID NO: 1258430 - protein, 9 aa, Homo Sapiens
NNFSPKGMT

SEQ ID NO: 1258431 - protein, 9 aa, Homo Sapiens
IFCSTFLSL

SEQ ID NO: 1258432 - protein, 9 aa, Homo Sapiens
TNRQRMNKE

SEQ ID NO: 1258433 - protein, 9 aa, Homo Sapiens
ISQTKQKLN

SEQ ID NO: 1258434 - protein, 9 aa, Homo Sapiens
GSMAHEADD

SEQ ID NO: 1258435 - protein, 9 aa, Homo Sapiens
AMLNDGSSD

SEQ ID NO: 1258436 - protein, 9 aa, Homo Sapiens
YDNCRCLRC

SEQ ID NO: 1258437 - protein, 9 aa, Homo Sapiens
GPNTVLAFK

SEQ ID NO: 1258438 - protein, 9 aa, Homo Sapiens
MNISLTIST

SEQ ID NO: 1258439 - protein, 9 aa, Homo Sapiens
VMQCHLNGV

SEQ ID NO: 1258440 - protein, 9 aa, Homo Sapiens
EPSTRTLEP

SEQ ID NO: 1258441 - protein, 9 aa, Homo Sapiens
VYMAVKELN

SEQ ID NO: 1258442 - protein, 9 aa, Homo Sapiens
VRFRENWQN

SEQ ID NO: 1258443 - protein, 9 aa, Homo Sapiens
QERFEEAKT

SEQ ID NO: 1258444 - protein, 9 aa, Homo Sapiens
KLLEKGPSP

SEQ ID NO: 1258445 - protein, 9 aa, Homo Sapiens
QSEEEMSDG

SEQ ID NO: 1258446 - protein, 9 aa, Homo Sapiens
NCSFPLPGV

SEQ ID NO: 1258447 - protein, 9 aa, Homo Sapiens
TMVEKSEPW

SEQ ID NO: 1258448 - protein, 9 aa, Homo Sapiens
GIVAARRCK

SEQ ID NO: 1258449 - protein, 9 aa, Homo Sapiens
AHAGLPCLA

SEQ ID NO: 1258450 - protein, 9 aa, Homo Sapiens
NDRIQPPRR

SEQ ID NO: 1258451 - protein, 9 aa, Homo Sapiens
ILLERHMLI

SEQ ID NO: 1258452 - protein, 9 aa, Homo Sapiens
FPCINSLVA

SEQ ID NO: 1258453 - protein, 9 aa, Homo Sapiens
KREKGPNDT

SEQ ID NO: 1258454 - protein, 9 aa, Homo Sapiens
VWQRGTPSY

SEQ ID NO: 1258455 - protein, 9 aa, Homo Sapiens
FERIASEDS

SEQ ID NO: 1258456 - protein, 9 aa, Homo Sapiens
GPQGPPGLH

SEQ ID NO: 1258457 - protein, 9 aa, Homo Sapiens
RADGTMRIG

SEQ ID NO: 1258458 - protein, 9 aa, Homo Sapiens
IQNRNIQID

SEQ ID NO: 1258459 - protein, 9 aa, Homo Sapiens
LQPKTKGEI

SEQ ID NO: 1258460 - protein, 9 aa, Homo Sapiens
VPMSTNQAQ

SEQ ID NO: 1258461 - protein, 9 aa, Homo Sapiens
TCGCRWSGP

SEQ ID NO: 1258462 - protein, 9 aa, Homo Sapiens
QPPRGGTNK

SEQ ID NO: 1258463 - protein, 9 aa, Homo Sapiens
HQLHGKKEV

SEQ ID NO: 1258464 - protein, 9 aa, Homo Sapiens
HLLAQPTLP

SEQ ID NO: 1258465 - protein, 9 aa, Homo Sapiens
DKDTTENEN

SEQ ID NO: 1258466 - protein, 9 aa, Homo Sapiens
SQRRPLVQV

SEQ ID NO: 1258467 - protein, 9 aa, Homo Sapiens
IVVPKGEDQ

SEQ ID NO: 1258468 - protein, 9 aa, Homo Sapiens
PLEIIMLNT

SEQ ID NO: 1258469 - protein, 9 aa, Homo Sapiens
CKILAMKAI

SEQ ID NO: 1258470 - protein, 9 aa, Homo Sapiens
SSVFGVIYY

SEQ ID NO: 1258471 - protein, 9 aa, Homo Sapiens
ARRCLREFQ

SEQ ID NO: 1258472 - protein, 9 aa, Homo Sapiens
QALIGMSDL

SEQ ID NO: 1258473 - protein, 9 aa, Homo Sapiens
GEQGIPGDR

SEQ ID NO: 1258474 - protein, 9 aa, Homo Sapiens
EEEDDNDIH

SEQ ID NO: 1258475 - protein, 9 aa, Homo Sapiens
LIFVKSWIP

SEQ ID NO: 1258476 - protein, 9 aa, Homo Sapiens
NSMILFFKG

SEQ ID NO: 1258477 - protein, 9 aa, Homo Sapiens
LSPLHVKGG

SEQ ID NO: 1258478 - protein, 9 aa, Homo Sapiens
VSIVKSLEH

SEQ ID NO: 1258479 - protein, 9 aa, Homo Sapiens
VEDLHHQAK

SEQ ID NO: 1258480 - protein, 9 aa, Homo Sapiens
NGSMASDPL

SEQ ID NO: 1258481 - protein, 9 aa, Homo Sapiens
KKRQEVPPH

SEQ ID NO: 1258482 - protein, 9 aa, Homo Sapiens
YRLVEGQVK

SEQ ID NO: 1258483 - protein, 9 aa, Homo Sapiens
TPTIVSHKE

SEQ ID NO: 1258484 - protein, 9 aa, Homo Sapiens
AQKGRYVGA

SEQ ID NO: 1258485 - protein, 9 aa, Homo Sapiens
LFIQGNDIK

SEQ ID NO: 1258486 - protein, 9 aa, Homo Sapiens
IQAQTGTHR

SEQ ID NO: 1258487 - protein, 9 aa, Homo Sapiens
RNHVKLVNL

SEQ ID NO: 1258488 - protein, 9 aa, Homo Sapiens
KNATVYPGL

SEQ ID NO: 1258489 - protein, 9 aa, Homo Sapiens
VAGGKYDVA

SEQ ID NO: 1258490 - protein, 9 aa, Homo Sapiens
AAVEQIKTN

SEQ ID NO: 1258491 - protein, 9 aa, Homo Sapiens
TNDGEIWRM

SEQ ID NO: 1258492 - protein, 9 aa, Homo Sapiens
GWLQDVTVQ

SEQ ID NO: 1258493 - protein, 9 aa, Homo Sapiens
SVAIGKLAL

SEQ ID NO: 1258494 - protein, 9 aa, Homo Sapiens
VVVISVEVF

SEQ ID NO: 1258495 - protein, 9 aa, Homo Sapiens
EADKCGLTP

SEQ ID NO: 1258496 - protein, 9 aa, Homo Sapiens
IIITFIIIA

SEQ ID NO: 1258497 - protein, 9 aa, Homo Sapiens
AWIDFVGHD

SEQ ID NO: 1258498 - protein, 9 aa, Homo Sapiens
PEELQEYLA

SEQ ID NO: 1258499 - protein, 9 aa, Homo Sapiens
AVGSVCYLL

SEQ ID NO: 1258500 - protein, 9 aa, Homo Sapiens
EKDQRLKKK

SEQ ID NO: 1258501 - protein, 9 aa, Homo Sapiens
EEHRFRNFF

SEQ ID NO: 1258502 - protein, 9 aa, Homo Sapiens
KSNLIRHQI

SEQ ID NO: 1258503 - protein, 9 aa, Homo Sapiens
KRCNKKIAM

SEQ ID NO: 1258504 - protein, 9 aa, Homo Sapiens
WSIWDPMSV

SEQ ID NO: 1258505 - protein, 9 aa, Homo Sapiens
EYSLGPFVE

SEQ ID NO: 1258506 - protein, 9 aa, Homo Sapiens
QGNACISCI

SEQ ID NO: 1258507 - protein, 9 aa, Homo Sapiens
HVSHLNVNI

SEQ ID NO: 1258508 - protein, 9 aa, Homo Sapiens
HRLLVRVSL

SEQ ID NO: 1258509 - protein, 9 aa, Homo Sapiens
EKDNSDYIE

SEQ ID NO: 1258510 - protein, 9 aa, Homo Sapiens
SHRESEEVL

SEQ ID NO: 1258511 - protein, 9 aa, Homo Sapiens
VFMKFSVQV

SEQ ID NO: 1258512 - protein, 9 aa, Homo Sapiens
LPSVSYFMC

SEQ ID NO: 1258513 - protein, 9 aa, Homo Sapiens
KGRVVSAIQ

SEQ ID NO: 1258514 - protein, 9 aa, Homo Sapiens
KRNSSDNAI

SEQ ID NO: 1258515 - protein, 9 aa, Homo Sapiens
KYKRSIDAE

SEQ ID NO: 1258516 - protein, 9 aa, Homo Sapiens
RSTSTTPAC

SEQ ID NO: 1258517 - protein, 9 aa, Homo Sapiens
TALMVNGVM

SEQ ID NO: 1258518 - protein, 9 aa, Homo Sapiens
RPASSLRHP

SEQ ID NO: 1258519 - protein, 9 aa, Homo Sapiens
PYERSECRK

SEQ ID NO: 1258520 - protein, 9 aa, Homo Sapiens
WEDSTGHWL

SEQ ID NO: 1258521 - protein, 9 aa, Homo Sapiens
GWLDDFLMG

SEQ ID NO: 1258522 - protein, 9 aa, Homo Sapiens
IEATSDRIK

SEQ ID NO: 1258523 - protein, 9 aa, Homo Sapiens
GKVMKILRL

SEQ ID NO: 1258524 - protein, 9 aa, Homo Sapiens
EPSAPSPML

SEQ ID NO: 1258525 - protein, 9 aa, Homo Sapiens
HHTLYINII

SEQ ID NO: 1258526 - protein, 9 aa, Homo Sapiens
HGNSGHLLV

SEQ ID NO: 1258527 - protein, 9 aa, Homo Sapiens
NHAFPDTDL

SEQ ID NO: 1258528 - protein, 9 aa, Homo Sapiens
FAGTSPVHG

SEQ ID NO: 1258529 - protein, 9 aa, Homo Sapiens
QKRATPLQF

SEQ ID NO: 1258530 - protein, 9 aa, Homo Sapiens
GDPKLKEKV

SEQ ID NO: 1258531 - protein, 9 aa, Homo Sapiens
ALVRDPQVL

SEQ ID NO: 1258532 - protein, 9 aa, Homo Sapiens
AHVSTNLKT

SEQ ID NO: 1258533 - protein, 9 aa, Homo Sapiens
DTGDIVNIG

SEQ ID NO: 1258534 - protein, 9 aa, Homo Sapiens
ELECEEDII

SEQ ID NO: 1258535 - protein, 9 aa, Homo Sapiens
KTKEDYGHL

SEQ ID NO: 1258536 - protein, 9 aa, Homo Sapiens
SSDRIKVCV

SEQ ID NO: 1258537 - protein, 9 aa, Homo Sapiens
QMSNYQEYL

SEQ ID NO: 1258538 - protein, 9 aa, Homo Sapiens
ASAPCGAAG

SEQ ID NO: 1258539 - protein, 9 aa, Homo Sapiens
SREDHHLPR

SEQ ID NO: 1258540 - protein, 9 aa, Homo Sapiens
TEDDPVVPF

SEQ ID NO: 1258541 - protein, 9 aa, Homo Sapiens
DIEHTMEEE

SEQ ID NO: 1258542 - protein, 9 aa, Homo Sapiens
KTLHKKNFL

SEQ ID NO: 1258543 - protein, 9 aa, Homo Sapiens
EDPEEQSPS

SEQ ID NO: 1258544 - protein, 9 aa, Homo Sapiens
ELGYQVTAE

SEQ ID NO: 1258545 - protein, 9 aa, Homo Sapiens
STEAYMLPV

SEQ ID NO: 1258546 - protein, 9 aa, Homo Sapiens
NRISSSLQL

SEQ ID NO: 1258547 - protein, 9 aa, Homo Sapiens
LGPTGAKVA

SEQ ID NO: 1258548 - protein, 9 aa, Homo Sapiens
ASVDFEHPT

SEQ ID NO: 1258549 - protein, 9 aa, Homo Sapiens
LLVMASTCV

SEQ ID NO: 1258550 - protein, 9 aa, Homo Sapiens
TREEIVVWT

SEQ ID NO: 1258551 - protein, 9 aa, Homo Sapiens
QLAPAVRSS

SEQ ID NO: 1258552 - protein, 9 aa, Homo Sapiens
SYEEAMVHL

SEQ ID NO: 1258553 - protein, 9 aa, Homo Sapiens
NEILEIAMD

SEQ ID NO: 1258554 - protein, 9 aa, Homo Sapiens
RSQHPHTTS

SEQ ID NO: 1258555 - protein, 9 aa, Homo Sapiens
ISAPFKERP

SEQ ID NO: 1258556 - protein, 9 aa, Homo Sapiens
PDFEIHIAM

SEQ ID NO: 1258557 - protein, 9 aa, Homo Sapiens
RANRVMAIL

SEQ ID NO: 1258558 - protein, 9 aa, Homo Sapiens
GLSGYPMIE

SEQ ID NO: 1258559 - protein, 9 aa, Homo Sapiens
TAFPEVSFL

SEQ ID NO: 1258560 - protein, 9 aa, Homo Sapiens
EFEAIIWDA

SEQ ID NO: 1258561 - protein, 9 aa, Homo Sapiens
EQLLILVSQ

SEQ ID NO: 1258562 - protein, 9 aa, Homo Sapiens
MDQNCLSRC

SEQ ID NO: 1258563 - protein, 9 aa, Homo Sapiens
MSEITSETQ

SEQ ID NO: 1258564 - protein, 9 aa, Homo Sapiens
VLLMAVEIN

SEQ ID NO: 1258565 - protein, 9 aa, Homo Sapiens
ADISLNKFK

SEQ ID NO: 1258566 - protein, 9 aa, Homo Sapiens
AVTTPGLLL

SEQ ID NO: 1258567 - protein, 9 aa, Homo Sapiens
RAASGVPPP

SEQ ID NO: 1258568 - protein, 9 aa, Homo Sapiens
LEGPGPSLG

SEQ ID NO: 1258569 - protein, 9 aa, Homo Sapiens
EAKKKAYPS

SEQ ID NO: 1258570 - protein, 9 aa, Homo Sapiens
VSADSRIYT

SEQ ID NO: 1258571 - protein, 9 aa, Homo Sapiens
PETRKCKAK

SEQ ID NO: 1258572 - protein, 9 aa, Homo Sapiens
KPKAQNPAR

SEQ ID NO: 1258573 - protein, 9 aa, Homo Sapiens
ALMDAYLLY

SEQ ID NO: 1258574 - protein, 9 aa, Homo Sapiens
EASVLAAEP

SEQ ID NO: 1258575 - protein, 9 aa, Homo Sapiens
QRRYLRVGL

SEQ ID NO: 1258576 - protein, 9 aa, Homo Sapiens
FNLKQKVMF

SEQ ID NO: 1258577 - protein, 9 aa, Homo Sapiens
HEKLSQICL

SEQ ID NO: 1258578 - protein, 9 aa, Homo Sapiens
RVARPFSGN

SEQ ID NO: 1258579 - protein, 9 aa, Homo Sapiens
IQPLNFSST

SEQ ID NO: 1258580 - protein, 9 aa, Homo Sapiens
VKNKLFPQV

SEQ ID NO: 1258581 - protein, 9 aa, Homo Sapiens
KGLREARTI

SEQ ID NO: 1258582 - protein, 9 aa, Homo Sapiens
LHWPLSRTH

SEQ ID NO: 1258583 - protein, 9 aa, Homo Sapiens
QMTSYPLTL

SEQ ID NO: 1258584 - protein, 9 aa, Homo Sapiens
LRNAVNFAV

SEQ ID NO: 1258585 - protein, 9 aa, Homo Sapiens
AHSNYRDGM

SEQ ID NO: 1258586 - protein, 9 aa, Homo Sapiens
AGLLTIVVY

SEQ ID NO: 1258587 - protein, 9 aa, Homo Sapiens
HREKVKCYI

SEQ ID NO: 1258588 - protein, 9 aa, Homo Sapiens
APSGPSSSV

SEQ ID NO: 1258589 - protein, 9 aa, Homo Sapiens
EWCGWQSIF

SEQ ID NO: 1258590 - protein, 9 aa, Homo Sapiens
DGIQPMWDD

SEQ ID NO: 1258591 - protein, 9 aa, Homo Sapiens
KVSVFKCPN

SEQ ID NO: 1258592 - protein, 9 aa, Homo Sapiens
HSIGTNEGL

SEQ ID NO: 1258593 - protein, 9 aa, Homo Sapiens
QPRQVLCDK

SEQ ID NO: 1258594 - protein, 9 aa, Homo Sapiens
EIQRKNNNG

SEQ ID NO: 1258595 - protein, 9 aa, Homo Sapiens
WMDKETTQA

SEQ ID NO: 1258596 - protein, 9 aa, Homo Sapiens
CLMVCYRTD

SEQ ID NO: 1258597 - protein, 9 aa, Homo Sapiens
ALQCLGLCV

SEQ ID NO: 1258598 - protein, 9 aa, Homo Sapiens
VLVLWPLYQ

SEQ ID NO: 1258599 - protein, 9 aa, Homo Sapiens
TLAGNMWDC

SEQ ID NO: 1258600 - protein, 9 aa, Homo Sapiens
NAHYFIGFL

SEQ ID NO: 1258601 - protein, 9 aa, Homo Sapiens
LYYDILEDR

SEQ ID NO: 1258602 - protein, 9 aa, Homo Sapiens
FGNAPGFYI

SEQ ID NO: 1258603 - protein, 9 aa, Homo Sapiens
WAVFGGQVA

SEQ ID NO: 1258604 - protein, 9 aa, Homo Sapiens
KYMYPYECE

SEQ ID NO: 1258605 - protein, 9 aa, Homo Sapiens
QESVLKMCQ

SEQ ID NO: 1258606 - protein, 9 aa, Homo Sapiens
PAPRPGQHT

SEQ ID NO: 1258607 - protein, 9 aa, Homo Sapiens
IGYFAIYFL

SEQ ID NO: 1258608 - protein, 9 aa, Homo Sapiens
QSKIQLLQS

SEQ ID NO: 1258609 - protein, 9 aa, Homo Sapiens
PAPISPKKP

SEQ ID NO: 1258610 - protein, 9 aa, Homo Sapiens
YEVDCDAID

SEQ ID NO: 1258611 - protein, 9 aa, Homo Sapiens
TGHRRHREE

SEQ ID NO: 1258612 - protein, 9 aa, Homo Sapiens
LHKVFLSIK

SEQ ID NO: 1258613 - protein, 9 aa, Homo Sapiens
HVFLTVTEV

SEQ ID NO: 1258614 - protein, 9 aa, Homo Sapiens
KVRRFPLEA

SEQ ID NO: 1258615 - protein, 9 aa, Homo Sapiens
TLEKMLLER

SEQ ID NO: 1258616 - protein, 9 aa, Homo Sapiens
RLQQMWLTQ

SEQ ID NO: 1258617 - protein, 9 aa, Homo Sapiens
ARVDRSREP

SEQ ID NO: 1258618 - protein, 9 aa, Homo Sapiens
VRGIFVLEE

SEQ ID NO: 1258619 - protein, 9 aa, Homo Sapiens
NDEEKMILS

SEQ ID NO: 1258620 - protein, 9 aa, Homo Sapiens
APGFYISTP

SEQ ID NO: 1258621 - protein, 9 aa, Homo Sapiens
HRGYIIRRG

SEQ ID NO: 1258622 - protein, 9 aa, Homo Sapiens
SSYTYNAAQ

SEQ ID NO: 1258623 - protein, 9 aa, Homo Sapiens
RRNEDLDRW

SEQ ID NO: 1258624 - protein, 9 aa, Homo Sapiens
DCDAIDGGR

SEQ ID NO: 1258625 - protein, 9 aa, Homo Sapiens
MRQKTQAYH

SEQ ID NO: 1258626 - protein, 9 aa, Homo Sapiens
HKPKVSSIS

SEQ ID NO: 1258627 - protein, 9 aa, Homo Sapiens
LSSEGGIDE

SEQ ID NO: 1258628 - protein, 9 aa, Homo Sapiens
SSSFLTMLK

SEQ ID NO: 1258629 - protein, 9 aa, Homo Sapiens
HPKPASTPV

SEQ ID NO: 1258630 - protein, 9 aa, Homo Sapiens
QSIHTGENP

SEQ ID NO: 1258631 - protein, 9 aa, Homo Sapiens
RMRQKPSDR

SEQ ID NO: 1258632 - protein, 9 aa, Homo Sapiens
GRRGWKNFY

SEQ ID NO: 1258633 - protein, 9 aa, Homo Sapiens
EPFKSMYLS

SEQ ID NO: 1258634 - protein, 9 aa, Homo Sapiens
CTIHNGHGS

SEQ ID NO: 1258635 - protein, 9 aa, Homo Sapiens
PFSNPNGCI

SEQ ID NO: 1258636 - protein, 9 aa, Homo Sapiens
IISDPATCA

SEQ ID NO: 1258637 - protein, 9 aa, Homo Sapiens
CNTVRGIFV

SEQ ID NO: 1258638 - protein, 9 aa, Homo Sapiens
VVMNSAQSS

SEQ ID NO: 1258639 - protein, 9 aa, Homo Sapiens
KQLMKLEQQ

SEQ ID NO: 1258640 - protein, 9 aa, Homo Sapiens
EEDIIPDSP

SEQ ID NO: 1258641 - protein, 9 aa, Homo Sapiens
DVQSAICLL

SEQ ID NO: 1258642 - protein, 9 aa, Homo Sapiens
EVVSILLCN

SEQ ID NO: 1258643 - protein, 9 aa, Homo Sapiens
IQWALHSYK

SEQ ID NO: 1258644 - protein, 9 aa, Homo Sapiens
KAVDNTTAK

SEQ ID NO: 1258645 - protein, 9 aa, Homo Sapiens
HTPGRRSGR

SEQ ID NO: 1258646 - protein, 9 aa, Homo Sapiens
SQAGVQWHY

SEQ ID NO: 1258647 - protein, 9 aa, Homo Sapiens
DPVLTTLEL

SEQ ID NO: 1258648 - protein, 9 aa, Homo Sapiens
LTRAQQPYK

SEQ ID NO: 1258649 - protein, 9 aa, Homo Sapiens
VEMCFDCMY

SEQ ID NO: 1258650 - protein, 9 aa, Homo Sapiens
ERSSSEDTL

SEQ ID NO: 1258651 - protein, 9 aa, Homo Sapiens
LQGDMPTAT

SEQ ID NO: 1258652 - protein, 9 aa, Homo Sapiens
WIIAMTYER

SEQ ID NO: 1258653 - protein, 9 aa, Homo Sapiens
IDGTAIAKC

SEQ ID NO: 1258654 - protein, 9 aa, Homo Sapiens
CMVEEVWLA

SEQ ID NO: 1258655 - protein, 9 aa, Homo Sapiens
LVAGIPLLV

SEQ ID NO: 1258656 - protein, 9 aa, Homo Sapiens
HTAVKNFMA

SEQ ID NO: 1258657 - protein, 9 aa, Homo Sapiens
SLHFLQNTE

SEQ ID NO: 1258658 - protein, 9 aa, Homo Sapiens
SSLQITIIA

SEQ ID NO: 1258659 - protein, 9 aa, Homo Sapiens
LVCTCPSME

SEQ ID NO: 1258660 - protein, 9 aa, Homo Sapiens
HEKQMILTE

SEQ ID NO: 1258661 - protein, 9 aa, Homo Sapiens
QVHMALQLC

SEQ ID NO: 1258662 - protein, 9 aa, Homo Sapiens
SATCSSAVR

SEQ ID NO: 1258663 - protein, 9 aa, Homo Sapiens
AEGYRWDII

SEQ ID NO: 1258664 - protein, 9 aa, Homo Sapiens
YTSLQFSKK

SEQ ID NO: 1258665 - protein, 9 aa, Homo Sapiens
KIRQERDEV

SEQ ID NO: 1258666 - protein, 9 aa, Homo Sapiens
EVYLTLTNK

SEQ ID NO: 1258667 - protein, 9 aa, Homo Sapiens
DAISISIIG

SEQ ID NO: 1258668 - protein, 9 aa, Homo Sapiens
AQAPLHPQP

SEQ ID NO: 1258669 - protein, 9 aa, Homo Sapiens
KIQRDTHPA

SEQ ID NO: 1258670 - protein, 9 aa, Homo Sapiens
LMGIVSNSL

SEQ ID NO: 1258671 - protein, 9 aa, Homo Sapiens
GPEEAAGPT

SEQ ID NO: 1258672 - protein, 9 aa, Homo Sapiens
SFGVNVDSL

SEQ ID NO: 1258673 - protein, 9 aa, Homo Sapiens
ILFIFKVAQ

SEQ ID NO: 1258674 - protein, 9 aa, Homo Sapiens
NRKDMNDTL

SEQ ID NO: 1258675 - protein, 9 aa, Homo Sapiens
SVTQRGVPA

SEQ ID NO: 1258676 - protein, 9 aa, Homo Sapiens
DHENIKEKE

SEQ ID NO: 1258677 - protein, 9 aa, Homo Sapiens
REQYKTDAK

SEQ ID NO: 1258678 - protein, 9 aa, Homo Sapiens
LMPPLPSEG

SEQ ID NO: 1258679 - protein, 9 aa, Homo Sapiens
LALPVLMNA

SEQ ID NO: 1258680 - protein, 9 aa, Homo Sapiens
SDDGVSGDH

SEQ ID NO: 1258681 - protein, 9 aa, Homo Sapiens
LLIGISIVS

SEQ ID NO: 1258682 - protein, 9 aa, Homo Sapiens
GIRKKKDLK

SEQ ID NO: 1258683 - protein, 9 aa, Homo Sapiens
GMDAAGKTT

SEQ ID NO: 1258684 - protein, 9 aa, Homo Sapiens
VPTMFQYGR

SEQ ID NO: 1258685 - protein, 9 aa, Homo Sapiens
VMIPLLQIG

SEQ ID NO: 1258686 - protein, 9 aa, Homo Sapiens
PKDDEFYQH

SEQ ID NO: 1258687 - protein, 9 aa, Homo Sapiens
LSWASAPSH

SEQ ID NO: 1258688 - protein, 9 aa, Homo Sapiens
SGGATALPL

SEQ ID NO: 1258689 - protein, 9 aa, Homo Sapiens
AMKAIRNNR

SEQ ID NO: 1258690 - protein, 9 aa, Homo Sapiens
YKGQMKDIY

SEQ ID NO: 1258691 - protein, 9 aa, Homo Sapiens
EHDANSASV

SEQ ID NO: 1258692 - protein, 9 aa, Homo Sapiens
SGDLRENMT

SEQ ID NO: 1258693 - protein, 9 aa, Homo Sapiens
VPGEDGRPG

SEQ ID NO: 1258694 - protein, 9 aa, Homo Sapiens
IMPFINGDV

SEQ ID NO: 1258695 - protein, 9 aa, Homo Sapiens
ERRHCSPSE

SEQ ID NO: 1258696 - protein, 9 aa, Homo Sapiens
DLYRLVEVQ

SEQ ID NO: 1258697 - protein, 9 aa, Homo Sapiens
KDPLTNKVP

SEQ ID NO: 1258698 - protein, 9 aa, Homo Sapiens
PRGRLFTFD

SEQ ID NO: 1258699 - protein, 9 aa, Homo Sapiens
QSLPLSVMC

SEQ ID NO: 1258700 - protein, 9 aa, Homo Sapiens
ALKVCYPER

SEQ ID NO: 1258701 - protein, 9 aa, Homo Sapiens
CDCVAEGMW

SEQ ID NO: 1258702 - protein, 9 aa, Homo Sapiens
EVSKSLWFI

SEQ ID NO: 1258703 - protein, 9 aa, Homo Sapiens
VRTHEMTHT

SEQ ID NO: 1258704 - protein, 9 aa, Homo Sapiens
LAAEDVTNE

SEQ ID NO: 1258705 - protein, 9 aa, Homo Sapiens
KGRCKVFST

SEQ ID NO: 1258706 - protein, 9 aa, Homo Sapiens
SKRQALMPI

SEQ ID NO: 1258707 - protein, 9 aa, Homo Sapiens
ETHRQPMPD

SEQ ID NO: 1258708 - protein, 9 aa, Homo Sapiens
SPVLTKHLL

SEQ ID NO: 1258709 - protein, 9 aa, Homo Sapiens
AESSMPPVT

SEQ ID NO: 1258710 - protein, 9 aa, Homo Sapiens
YEAGELKWE

SEQ ID NO: 1258711 - protein, 9 aa, Homo Sapiens
QINEFSGKV

SEQ ID NO: 1258712 - protein, 9 aa, Homo Sapiens
RHLKMWEQK

SEQ ID NO: 1258713 - protein, 9 aa, Homo Sapiens
AVPDTVHEA

SEQ ID NO: 1258714 - protein, 9 aa, Homo Sapiens
EFIHQHFTE

SEQ ID NO: 1258715 - protein, 9 aa, Homo Sapiens
MAQEFDIYR

SEQ ID NO: 1258716 - protein, 9 aa, Homo Sapiens
PYECKQYGK

SEQ ID NO: 1258717 - protein, 9 aa, Homo Sapiens
CHTLPLPEE

SEQ ID NO: 1258718 - protein, 9 aa, Homo Sapiens
RLSDQDVGR

SEQ ID NO: 1258719 - protein, 9 aa, Homo Sapiens
AITFRMPSR

SEQ ID NO: 1258720 - protein, 9 aa, Homo Sapiens
WPPTVTIWM

SEQ ID NO: 1258721 - protein, 9 aa, Homo Sapiens
LYIILHIRS

SEQ ID NO: 1258722 - protein, 9 aa, Homo Sapiens
TANPMEYAN

SEQ ID NO: 1258723 - protein, 9 aa, Homo Sapiens
NPVHYPGPA

SEQ ID NO: 1258724 - protein, 9 aa, Homo Sapiens
FSLNQAADV

SEQ ID NO: 1258725 - protein, 9 aa, Homo Sapiens
YEPGHQALG

SEQ ID NO: 1258726 - protein, 9 aa, Homo Sapiens
IEAQELLKN

SEQ ID NO: 1258727 - protein, 9 aa, Homo Sapiens
CGQASAPLS

SEQ ID NO: 1258728 - protein, 9 aa, Homo Sapiens
NQKAQKTPY

SEQ ID NO: 1258729 - protein, 9 aa, Homo Sapiens
IVSRRTSQN

SEQ ID NO: 1258730 - protein, 9 aa, Homo Sapiens
TSLLITATL

SEQ ID NO: 1258731 - protein, 9 aa, Homo Sapiens
VINVTDADS

SEQ ID NO: 1258732 - protein, 9 aa, Homo Sapiens
QGFNVRLSD

SEQ ID NO: 1258733 - protein, 9 aa, Homo Sapiens
VTGHADLKH

SEQ ID NO: 1258734 - protein, 9 aa, Homo Sapiens
QGKRPLHSS

SEQ ID NO: 1258735 - protein, 9 aa, Homo Sapiens
ELLKQMLQS

SEQ ID NO: 1258736 - protein, 9 aa, Homo Sapiens
ESHLLHIDQ

SEQ ID NO: 1258737 - protein, 9 aa, Homo Sapiens
MSQACRWQK

SEQ ID NO: 1258738 - protein, 9 aa, Homo Sapiens
ERHQDLLCS

SEQ ID NO: 1258739 - protein, 9 aa, Homo Sapiens
SAHTILPEA

SEQ ID NO: 1258740 - protein, 9 aa, Homo Sapiens
DEAMTEGNM

SEQ ID NO: 1258741 - protein, 9 aa, Homo Sapiens
DVLEASLEY

SEQ ID NO: 1258742 - protein, 9 aa, Homo Sapiens
LVGMGPAAG

SEQ ID NO: 1258743 - protein, 9 aa, Homo Sapiens
NPGAALDFC

SEQ ID NO: 1258744 - protein, 9 aa, Homo Sapiens
AGALRAVVQ

SEQ ID NO: 1258745 - protein, 9 aa, Homo Sapiens
SGLALCGIV

SEQ ID NO: 1258746 - protein, 9 aa, Homo Sapiens
LNHPFIQDL

SEQ ID NO: 1258747 - protein, 9 aa, Homo Sapiens
RALISKFPE

SEQ ID NO: 1258748 - protein, 9 aa, Homo Sapiens
HLKDGNCRY

SEQ ID NO: 1258749 - protein, 9 aa, Homo Sapiens
EGGEVIITS

SEQ ID NO: 1258750 - protein, 9 aa, Homo Sapiens
RDDLNVCCE

SEQ ID NO: 1258751 - protein, 9 aa, Homo Sapiens
GQGHTTASC

SEQ ID NO: 1258752 - protein, 9 aa, Homo Sapiens
GCLRALFMK

SEQ ID NO: 1258753 - protein, 9 aa, Homo Sapiens
WWAPACTRW

SEQ ID NO: 1258754 - protein, 9 aa, Homo Sapiens
RESVPSYTI

SEQ ID NO: 1258755 - protein, 9 aa, Homo Sapiens
SKAIMGCIA

SEQ ID NO: 1258756 - protein, 9 aa, Homo Sapiens
PLLSRRTLP

SEQ ID NO: 1258757 - protein, 9 aa, Homo Sapiens
QPPRVLMKH

SEQ ID NO: 1258758 - protein, 9 aa, Homo Sapiens
HKNRRKDCR

SEQ ID NO: 1258759 - protein, 9 aa, Homo Sapiens
VRLSDQDVG

SEQ ID NO: 1258760 - protein, 9 aa, Homo Sapiens
EIRLNMLLR

SEQ ID NO: 1258761 - protein, 9 aa, Homo Sapiens
AKELVWQLQ

SEQ ID NO: 1258762 - protein, 9 aa, Homo Sapiens
LLPALCLHL

SEQ ID NO: 1258763 - protein, 9 aa, Homo Sapiens
SDTSLTAAS

SEQ ID NO: 1258764 - protein, 9 aa, Homo Sapiens
PGALEKENQ

SEQ ID NO: 1258765 - protein, 9 aa, Homo Sapiens
QVLEGNNLV

SEQ ID NO: 1258766 - protein, 9 aa, Homo Sapiens
DGPQGDIEV

SEQ ID NO: 1258767 - protein, 9 aa, Homo Sapiens
STPTRVCPR

SEQ ID NO: 1258768 - protein, 9 aa, Homo Sapiens
FLLIKEWAA

SEQ ID NO: 1258769 - protein, 9 aa, Homo Sapiens
SVNRHRHMF

SEQ ID NO: 1258770 - protein, 9 aa, Homo Sapiens
SGRIVGTKP

SEQ ID NO: 1258771 - protein, 9 aa, Homo Sapiens
AVATGAASA

SEQ ID NO: 1258772 - protein, 9 aa, Homo Sapiens
KLKVLMMMS

SEQ ID NO: 1258773 - protein, 9 aa, Homo Sapiens
QFAGMNISL

SEQ ID NO: 1258774 - protein, 9 aa, Homo Sapiens
FPPSLLCEI

SEQ ID NO: 1258775 - protein, 9 aa, Homo Sapiens
EAHPQVVMY

SEQ ID NO: 1258776 - protein, 9 aa, Homo Sapiens
HTKPIQDVQ

SEQ ID NO: 1258777 - protein, 9 aa, Homo Sapiens
VDLAIMGQA

SEQ ID NO: 1258778 - protein, 9 aa, Homo Sapiens
ETHPLGCVK

SEQ ID NO: 1258779 - protein, 9 aa, Homo Sapiens
ENQGLPLYI

SEQ ID NO: 1258780 - protein, 9 aa, Homo Sapiens
DTATQTEPG

SEQ ID NO: 1258781 - protein, 9 aa, Homo Sapiens
WISRLSACG

SEQ ID NO: 1258782 - protein, 9 aa, Homo Sapiens
RNEFTDQLP

SEQ ID NO: 1258783 - protein, 9 aa, Homo Sapiens
PSTAFYQVF

SEQ ID NO: 1258784 - protein, 9 aa, Homo Sapiens
TDGVAWTPP

SEQ ID NO: 1258785 - protein, 9 aa, Homo Sapiens
LVTRGRQPH

SEQ ID NO: 1258786 - protein, 9 aa, Homo Sapiens
TAAAFKLSP

SEQ ID NO: 1258787 - protein, 9 aa, Homo Sapiens
GTVPGMPNS

SEQ ID NO: 1258788 - protein, 9 aa, Homo Sapiens
RYSPTGRCW

SEQ ID NO: 1258789 - protein, 9 aa, Homo Sapiens
VMPLLTFEV

SEQ ID NO: 1258790 - protein, 9 aa, Homo Sapiens
RFRKSEGIF

SEQ ID NO: 1258791 - protein, 9 aa, Homo Sapiens
SSPAHNGMM

SEQ ID NO: 1258792 - protein, 9 aa, Homo Sapiens
MGYAAMAAS

SEQ ID NO: 1258793 - protein, 9 aa, Homo Sapiens
AYYTSSSDI

SEQ ID NO: 1258794 - protein, 9 aa, Homo Sapiens
LKIKPPLAP

SEQ ID NO: 1258795 - protein, 9 aa, Homo Sapiens
IHPSLLMEN

SEQ ID NO: 1258796 - protein, 9 aa, Homo Sapiens
STQCAGGVR

SEQ ID NO: 1258797 - protein, 9 aa, Homo Sapiens
NDTIGDLKK

SEQ ID NO: 1258798 - protein, 9 aa, Homo Sapiens
IPEATNRHV

SEQ ID NO: 1258799 - protein, 9 aa, Homo Sapiens
FEEHRFRNF

SEQ ID NO: 1258800 - protein, 9 aa, Homo Sapiens
EIAQTWHFL

SEQ ID NO: 1258801 - protein, 9 aa, Homo Sapiens
ELLPLIPVR

SEQ ID NO: 1258802 - protein, 9 aa, Homo Sapiens
GHTQDLPGV

SEQ ID NO: 1258803 - protein, 9 aa, Homo Sapiens
TRTHMGEKP

SEQ ID NO: 1258804 - protein, 9 aa, Homo Sapiens
LRKLDHILP

SEQ ID NO: 1258805 - protein, 9 aa, Homo Sapiens
PSSCFHPRR

SEQ ID NO: 1258806 - protein, 9 aa, Homo Sapiens
GLLLFIYNK

SEQ ID NO: 1258807 - protein, 9 aa, Homo Sapiens
FLKIKPPLA

SEQ ID NO: 1258808 - protein, 9 aa, Homo Sapiens
PTCTYECDE

SEQ ID NO: 1258809 - protein, 9 aa, Homo Sapiens
AGMQLLCEG

SEQ ID NO: 1258810 - protein, 9 aa, Homo Sapiens
FCLPGEAPV

SEQ ID NO: 1258811 - protein, 9 aa, Homo Sapiens
VVAESEALH

SEQ ID NO: 1258812 - protein, 9 aa, Homo Sapiens
TKNISHDTF

SEQ ID NO: 1258813 - protein, 9 aa, Homo Sapiens
LVFSSKVTL

SEQ ID NO: 1258814 - protein, 9 aa, Homo Sapiens
VLMMMSLYN

SEQ ID NO: 1258815 - protein, 9 aa, Homo Sapiens
KYQRHHTGE

SEQ ID NO: 1258816 - protein, 9 aa, Homo Sapiens
WVLLDEAQK

SEQ ID NO: 1258817 - protein, 9 aa, Homo Sapiens
LLWALTTEC

SEQ ID NO: 1258818 - protein, 9 aa, Homo Sapiens
RNGVNDVSG

SEQ ID NO: 1258819 - protein, 9 aa, Homo Sapiens
PTPHGLAPF

SEQ ID NO: 1258820 - protein, 9 aa, Homo Sapiens
MKSERADRS

SEQ ID NO: 1258821 - protein, 9 aa, Homo Sapiens
HFPSMQQLV

SEQ ID NO: 1258822 - protein, 9 aa, Homo Sapiens
DVLRVVHIL

SEQ ID NO: 1258823 - protein, 9 aa, Homo Sapiens
LITQCTATE

SEQ ID NO: 1258824 - protein, 9 aa, Homo Sapiens
NNFTKLITV

SEQ ID NO: 1258825 - protein, 9 aa, Homo Sapiens
IFFAMEMLL

SEQ ID NO: 1258826 - protein, 9 aa, Homo Sapiens
ASGRTIGIV

SEQ ID NO: 1258827 - protein, 9 aa, Homo Sapiens
GFFIHCRRK

SEQ ID NO: 1258828 - protein, 9 aa, Homo Sapiens
QRVSLEQLC

SEQ ID NO: 1258829 - protein, 9 aa, Homo Sapiens
SYQADLKNQ

SEQ ID NO: 1258830 - protein, 9 aa, Homo Sapiens
SPNLWPDMT

SEQ ID NO: 1258831 - protein, 9 aa, Homo Sapiens
FLCLYCNPL

SEQ ID NO: 1258832 - protein, 9 aa, Homo Sapiens
TIGTRSGAI

SEQ ID NO: 1258833 - protein, 9 aa, Homo Sapiens
SEALLLQCP

SEQ ID NO: 1258834 - protein, 9 aa, Homo Sapiens
LRNLLKPTA

SEQ ID NO: 1258835 - protein, 9 aa, Homo Sapiens
LIQLHSCFQ

SEQ ID NO: 1258836 - protein, 9 aa, Homo Sapiens
SVGWLQIRA

SEQ ID NO: 1258837 - protein, 9 aa, Homo Sapiens
EGVPMHKGE

SEQ ID NO: 1258838 - protein, 9 aa, Homo Sapiens
TSILLFLFS

SEQ ID NO: 1258839 - protein, 9 aa, Homo Sapiens
SSLGYAINK

SEQ ID NO: 1258840 - protein, 9 aa, Homo Sapiens
DPAPPSGSA

SEQ ID NO: 1258841 - protein, 9 aa, Homo Sapiens
TTEALHRVA

SEQ ID NO: 1258842 - protein, 9 aa, Homo Sapiens
LGEYKFGPI

SEQ ID NO: 1258843 - protein, 9 aa, Homo Sapiens
QDLFLLNGS

SEQ ID NO: 1258844 - protein, 9 aa, Homo Sapiens
AHFHIESAQ

SEQ ID NO: 1258845 - protein, 9 aa, Homo Sapiens
YLETLKQGV

SEQ ID NO: 1258846 - protein, 9 aa, Homo Sapiens
TDQYVQEHI

SEQ ID NO: 1258847 - protein, 9 aa, Homo Sapiens
EQKNYNKEF

SEQ ID NO: 1258848 - protein, 9 aa, Homo Sapiens
CSCSTSTHG

SEQ ID NO: 1258849 - protein, 9 aa, Homo Sapiens
GIDGTAIAK

SEQ ID NO: 1258850 - protein, 9 aa, Homo Sapiens
EEDLTLQPH

SEQ ID NO: 1258851 - protein, 9 aa, Homo Sapiens
KTWKVNFRC

SEQ ID NO: 1258852 - protein, 9 aa, Homo Sapiens
QMPSRQPIP

SEQ ID NO: 1258853 - protein, 9 aa, Homo Sapiens
FSNCWTPLT

SEQ ID NO: 1258854 - protein, 9 aa, Homo Sapiens
LWALLRFIM

SEQ ID NO: 1258855 - protein, 9 aa, Homo Sapiens
SYGDHHHPS

SEQ ID NO: 1258856 - protein, 9 aa, Homo Sapiens
LLWKRTLIP

SEQ ID NO: 1258857 - protein, 9 aa, Homo Sapiens
RLKDFSFHF

SEQ ID NO: 1258858 - protein, 9 aa, Homo Sapiens
GVPGEDGRP

SEQ ID NO: 1258859 - protein, 9 aa, Homo Sapiens
LLNGPSSAA

SEQ ID NO: 1258860 - protein, 9 aa, Homo Sapiens
RGSPHLLCK

SEQ ID NO: 1258861 - protein, 9 aa, Homo Sapiens
NPVGHLLMT

SEQ ID NO: 1258862 - protein, 9 aa, Homo Sapiens
GAERKKEKA

SEQ ID NO: 1258863 - protein, 9 aa, Homo Sapiens
DTCVECEDP

SEQ ID NO: 1258864 - protein, 9 aa, Homo Sapiens
LSRASGVAR

SEQ ID NO: 1258865 - protein, 9 aa, Homo Sapiens
YIFQNVMVM

SEQ ID NO: 1258866 - protein, 9 aa, Homo Sapiens
IREMQSFFG

SEQ ID NO: 1258867 - protein, 9 aa, Homo Sapiens
IGESYWLQF

SEQ ID NO: 1258868 - protein, 9 aa, Homo Sapiens
WFTTETLGV

SEQ ID NO: 1258869 - protein, 9 aa, Homo Sapiens
AIMGQAYAF

SEQ ID NO: 1258870 - protein, 9 aa, Homo Sapiens
ILGHANLAG

SEQ ID NO: 1258871 - protein, 9 aa, Homo Sapiens
RLKELATPK

SEQ ID NO: 1258872 - protein, 9 aa, Homo Sapiens
PGFGEQINN

SEQ ID NO: 1258873 - protein, 9 aa, Homo Sapiens
SIRIQRDLP

SEQ ID NO: 1258874 - protein, 9 aa, Homo Sapiens
TPPALPPVP

SEQ ID NO: 1258875 - protein, 9 aa, Homo Sapiens
RRYSIISST

SEQ ID NO: 1258876 - protein, 9 aa, Homo Sapiens
CENPKSREV

SEQ ID NO: 1258877 - protein, 9 aa, Homo Sapiens
LADSVLEIF

SEQ ID NO: 1258878 - protein, 9 aa, Homo Sapiens
LSFDLSLTS

SEQ ID NO: 1258879 - protein, 9 aa, Homo Sapiens
LILIAPSGP

SEQ ID NO: 1258880 - protein, 9 aa, Homo Sapiens
SLQHLDGHQ

SEQ ID NO: 1258881 - protein, 9 aa, Homo Sapiens
CMLKGSSAQ

SEQ ID NO: 1258882 - protein, 9 aa, Homo Sapiens
HENIKEKEK

SEQ ID NO: 1258883 - protein, 9 aa, Homo Sapiens
KSSRKSMNS

SEQ ID NO: 1258884 - protein, 9 aa, Homo Sapiens
HPSSWESCC

SEQ ID NO: 1258885 - protein, 9 aa, Homo Sapiens
EETERCTFL

SEQ ID NO: 1258886 - protein, 9 aa, Homo Sapiens
EDQTWKRSR

SEQ ID NO: 1258887 - protein, 9 aa, Homo Sapiens
KRILDPSIK

SEQ ID NO: 1258888 - protein, 9 aa, Homo Sapiens
EQPEQTVLL

SEQ ID NO: 1258889 - protein, 9 aa, Homo Sapiens
EEPSAPSPM

SEQ ID NO: 1258890 - protein, 9 aa, Homo Sapiens
VCKAGEQQE

SEQ ID NO: 1258891 - protein, 9 aa, Homo Sapiens
VVFWFLQYN

SEQ ID NO: 1258892 - protein, 9 aa, Homo Sapiens
LCKRSVPMA

SEQ ID NO: 1258893 - protein, 9 aa, Homo Sapiens
LPVNVCWLL

SEQ ID NO: 1258894 - protein, 9 aa, Homo Sapiens
SGYPMIEIV

SEQ ID NO: 1258895 - protein, 9 aa, Homo Sapiens
QIRSGMGQR

SEQ ID NO: 1258896 - protein, 9 aa, Homo Sapiens
YLTSTSEQA

SEQ ID NO: 1258897 - protein, 9 aa, Homo Sapiens
EMLHNFPKV

SEQ ID NO: 1258898 - protein, 9 aa, Homo Sapiens
MEVLKTWLT

SEQ ID NO: 1258899 - protein, 9 aa, Homo Sapiens
HKNQGTGTK

SEQ ID NO: 1258900 - protein, 9 aa, Homo Sapiens
VLCAEFKMK

SEQ ID NO: 1258901 - protein, 9 aa, Homo Sapiens
TKFETVYQI

SEQ ID NO: 1258902 - protein, 9 aa, Homo Sapiens
TWTLTQSPH

SEQ ID NO: 1258903 - protein, 9 aa, Homo Sapiens
IETVKAGHH

SEQ ID NO: 1258904 - protein, 9 aa, Homo Sapiens
PAKQTQTFT

SEQ ID NO: 1258905 - protein, 9 aa, Homo Sapiens
FFAMEMLLK

SEQ ID NO: 1258906 - protein, 9 aa, Homo Sapiens
PFYKTMLHK

SEQ ID NO: 1258907 - protein, 9 aa, Homo Sapiens
LHGSHISMS

SEQ ID NO: 1258908 - protein, 9 aa, Homo Sapiens
DNDYFTYIT

SEQ ID NO: 1258909 - protein, 9 aa, Homo Sapiens
SLMDIMLIC

SEQ ID NO: 1258910 - protein, 9 aa, Homo Sapiens
LEGNSCEIY

SEQ ID NO: 1258911 - protein, 9 aa, Homo Sapiens
NMGQKENLW

SEQ ID NO: 1258912 - protein, 9 aa, Homo Sapiens
NQVIKDKND

SEQ ID NO: 1258913 - protein, 9 aa, Homo Sapiens
AYTRECLGT

SEQ ID NO: 1258914 - protein, 9 aa, Homo Sapiens
NTREKSYDC

SEQ ID NO: 1258915 - protein, 9 aa, Homo Sapiens
MGHESEIQP

SEQ ID NO: 1258916 - protein, 9 aa, Homo Sapiens
NHMVENSSP

SEQ ID NO: 1258917 - protein, 9 aa, Homo Sapiens
KMKQEVGEQ

SEQ ID NO: 1258918 - protein, 9 aa, Homo Sapiens
NDRLFIVME

SEQ ID NO: 1258919 - protein, 9 aa, Homo Sapiens
VLEKRNYCS

SEQ ID NO: 1258920 - protein, 9 aa, Homo Sapiens
AGDERMLVD

SEQ ID NO: 1258921 - protein, 9 aa, Homo Sapiens
VDQVVTEEQ

SEQ ID NO: 1258922 - protein, 9 aa, Homo Sapiens
EQPLTLTKN

SEQ ID NO: 1258923 - protein, 9 aa, Homo Sapiens
NPLFTPVPA

SEQ ID NO: 1258924 - protein, 9 aa, Homo Sapiens
LAEKRILDP

SEQ ID NO: 1258925 - protein, 9 aa, Homo Sapiens
LIVSQGPSP

SEQ ID NO: 1258926 - protein, 9 aa, Homo Sapiens
WDLFYKLAE

SEQ ID NO: 1258927 - protein, 9 aa, Homo Sapiens
GIEALPHTH

SEQ ID NO: 1258928 - protein, 9 aa, Homo Sapiens
HLEKLSSSR

SEQ ID NO: 1258929 - protein, 9 aa, Homo Sapiens
FVAQMLVEN

SEQ ID NO: 1258930 - protein, 9 aa, Homo Sapiens
PKLKEKVKP

SEQ ID NO: 1258931 - protein, 9 aa, Homo Sapiens
QVIEFRTNA

SEQ ID NO: 1258932 - protein, 9 aa, Homo Sapiens
LSDHTIGVL

SEQ ID NO: 1258933 - protein, 9 aa, Homo Sapiens
LTKEDYAVF

SEQ ID NO: 1258934 - protein, 9 aa, Homo Sapiens
NVKQVFECL

SEQ ID NO: 1258935 - protein, 9 aa, Homo Sapiens
VSHAFLPRI

SEQ ID NO: 1258936 - protein, 9 aa, Homo Sapiens
PAHSSAFHH

SEQ ID NO: 1258937 - protein, 9 aa, Homo Sapiens
PSHQRQKAA

SEQ ID NO: 1258938 - protein, 9 aa, Homo Sapiens
LTPCPREWD

SEQ ID NO: 1258939 - protein, 9 aa, Homo Sapiens
GTSQDVTLG

SEQ ID NO: 1258940 - protein, 9 aa, Homo Sapiens
DAGLSVLSQ

SEQ ID NO: 1258941 - protein, 9 aa, Homo Sapiens
ANKCMVEYE

SEQ ID NO: 1258942 - protein, 9 aa, Homo Sapiens
FHKISDVKK

SEQ ID NO: 1258943 - protein, 9 aa, Homo Sapiens
CMCQDSMLH

SEQ ID NO: 1258944 - protein, 9 aa, Homo Sapiens
ETEPGKPFM

SEQ ID NO: 1258945 - protein, 9 aa, Homo Sapiens
DLANVTVAS

SEQ ID NO: 1258946 - protein, 9 aa, Homo Sapiens
RLNSTGATA

SEQ ID NO: 1258947 - protein, 9 aa, Homo Sapiens
QSGSESKKE

SEQ ID NO: 1258948 - protein, 9 aa, Homo Sapiens
WAMLLLWVP

SEQ ID NO: 1258949 - protein, 9 aa, Homo Sapiens
LVTLMQKNW

SEQ ID NO: 1258950 - protein, 9 aa, Homo Sapiens
KYKPGLVHM

SEQ ID NO: 1258951 - protein, 9 aa, Homo Sapiens
LIPQTPESA

SEQ ID NO: 1258952 - protein, 9 aa, Homo Sapiens
AFLKKISFK

SEQ ID NO: 1258953 - protein, 9 aa, Homo Sapiens
MRCGLDSEG

SEQ ID NO: 1258954 - protein, 9 aa, Homo Sapiens
WVHFYTKIH

SEQ ID NO: 1258955 - protein, 9 aa, Homo Sapiens
SSQGKRWLT

SEQ ID NO: 1258956 - protein, 9 aa, Homo Sapiens
VNMSFLYIL

SEQ ID NO: 1258957 - protein, 9 aa, Homo Sapiens
LLMGLMFAS

SEQ ID NO: 1258958 - protein, 9 aa, Homo Sapiens
LHAAIRVLP

SEQ ID NO: 1258959 - protein, 9 aa, Homo Sapiens
FFSVNCSIL

SEQ ID NO: 1258960 - protein, 9 aa, Homo Sapiens
GGKDCDSLV

SEQ ID NO: 1258961 - protein, 9 aa, Homo Sapiens
LKANNEGVE

SEQ ID NO: 1258962 - protein, 9 aa, Homo Sapiens
IIFQRRNTG

SEQ ID NO: 1258963 - protein, 9 aa, Homo Sapiens
GVREMKIWL

SEQ ID NO: 1258964 - protein, 9 aa, Homo Sapiens
YINDNDITA

SEQ ID NO: 1258965 - protein, 9 aa, Homo Sapiens
SGKQTGIEV

SEQ ID NO: 1258966 - protein, 9 aa, Homo Sapiens
PMSLSAGAI

SEQ ID NO: 1258967 - protein, 9 aa, Homo Sapiens
SNHHQQPPH

SEQ ID NO: 1258968 - protein, 9 aa, Homo Sapiens
SKPQIKCGK

SEQ ID NO: 1258969 - protein, 9 aa, Homo Sapiens
AFRMNVAPA

SEQ ID NO: 1258970 - protein, 9 aa, Homo Sapiens
DVVQVLKKL

SEQ ID NO: 1258971 - protein, 9 aa, Homo Sapiens
PGPTTSPGS

SEQ ID NO: 1258972 - protein, 9 aa, Homo Sapiens
KAKELVWQL

SEQ ID NO: 1258973 - protein, 9 aa, Homo Sapiens
SLAKEMIAL

SEQ ID NO: 1258974 - protein, 9 aa, Homo Sapiens
FPAYPIYGY

SEQ ID NO: 1258975 - protein, 9 aa, Homo Sapiens
HFRLRLLED

SEQ ID NO: 1258976 - protein, 9 aa, Homo Sapiens
ENKTYLDVG

SEQ ID NO: 1258977 - protein, 9 aa, Homo Sapiens
SELPFPSHM

SEQ ID NO: 1258978 - protein, 9 aa, Homo Sapiens
ASPAPRSPA

SEQ ID NO: 1258979 - protein, 9 aa, Homo Sapiens
KENQKKTLI

SEQ ID NO: 1258980 - protein, 9 aa, Homo Sapiens
TALTAANGK

SEQ ID NO: 1258981 - protein, 9 aa, Homo Sapiens
TAASKRKNW

SEQ ID NO: 1258982 - protein, 9 aa, Homo Sapiens
LSQPNATPS

SEQ ID NO: 1258983 - protein, 9 aa, Homo Sapiens
CKHHLKHGP

SEQ ID NO: 1258984 - protein, 9 aa, Homo Sapiens
IYDITNYQS

SEQ ID NO: 1258985 - protein, 9 aa, Homo Sapiens
QKTHVMSVL

SEQ ID NO: 1258986 - protein, 9 aa, Homo Sapiens
WTIDNTYYS

SEQ ID NO: 1258987 - protein, 9 aa, Homo Sapiens
PARTGLLPG

SEQ ID NO: 1258988 - protein, 9 aa, Homo Sapiens
FVSSWGCNV

SEQ ID NO: 1258989 - protein, 9 aa, Homo Sapiens
GPKTDAMAP

SEQ ID NO: 1258990 - protein, 9 aa, Homo Sapiens
WRNSMSTKK

SEQ ID NO: 1258991 - protein, 9 aa, Homo Sapiens
MQLRRDLIF

SEQ ID NO: 1258992 - protein, 9 aa, Homo Sapiens
FTSLMGMAL

SEQ ID NO: 1258993 - protein, 9 aa, Homo Sapiens
EETTYGRSL

SEQ ID NO: 1258994 - protein, 9 aa, Homo Sapiens
HTLQHDEIK

SEQ ID NO: 1258995 - protein, 9 aa, Homo Sapiens
VPGALELVW

SEQ ID NO: 1258996 - protein, 9 aa, Homo Sapiens
TGSFDNNKT

SEQ ID NO: 1258997 - protein, 9 aa, Homo Sapiens
QNKCIMKEP

SEQ ID NO: 1258998 - protein, 9 aa, Homo Sapiens
QNFSKSRHD

SEQ ID NO: 1258999 - protein, 9 aa, Homo Sapiens
LPRIPKVQS

SEQ ID NO: 1259000 - protein, 9 aa, Homo Sapiens
CHGVMGVYG

SEQ ID NO: 1259001 - protein, 9 aa, Homo Sapiens
PFQCDPSYR

SEQ ID NO: 1259002 - protein, 9 aa, Homo Sapiens
VEPSLSSFG

SEQ ID NO: 1259003 - protein, 9 aa, Homo Sapiens
HSLREACET

SEQ ID NO: 1259004 - protein, 9 aa, Homo Sapiens
SHILIVEGL

SEQ ID NO: 1259005 - protein, 9 aa, Homo Sapiens
DCTQFSDRD

SEQ ID NO: 1259006 - protein, 9 aa, Homo Sapiens
PCPTPGAAD

SEQ ID NO: 1259007 - protein, 9 aa, Homo Sapiens
SSSPAHNGM

SEQ ID NO: 1259008 - protein, 9 aa, Homo Sapiens
HTQDLPGVK

SEQ ID NO: 1259009 - protein, 9 aa, Homo Sapiens
KEDAYEYKS

SEQ ID NO: 1259010 - protein, 9 aa, Homo Sapiens
PEMAASPSS

SEQ ID NO: 1259011 - protein, 9 aa, Homo Sapiens
RFVMQAKTF

SEQ ID NO: 1259012 - protein, 9 aa, Homo Sapiens
LWIFLGLME

SEQ ID NO: 1259013 - protein, 9 aa, Homo Sapiens
RKWGKLPGP

SEQ ID NO: 1259014 - protein, 9 aa, Homo Sapiens
HWEHCCPWI

SEQ ID NO: 1259015 - protein, 9 aa, Homo Sapiens
PGYCTFYDE

SEQ ID NO: 1259016 - protein, 9 aa, Homo Sapiens
QKRSFRTSV

SEQ ID NO: 1259017 - protein, 9 aa, Homo Sapiens
QNCSVGATN

SEQ ID NO: 1259018 - protein, 9 aa, Homo Sapiens
AEIEDWFTT

SEQ ID NO: 1259019 - protein, 9 aa, Homo Sapiens
LENPPGPWG

SEQ ID NO: 1259020 - protein, 9 aa, Homo Sapiens
ASALAQNMW

SEQ ID NO: 1259021 - protein, 9 aa, Homo Sapiens
YITKAYEML

SEQ ID NO: 1259022 - protein, 9 aa, Homo Sapiens
VTEMPVLPF

SEQ ID NO: 1259023 - protein, 9 aa, Homo Sapiens
WMKVTVESS

SEQ ID NO: 1259024 - protein, 9 aa, Homo Sapiens
RRCMLLLFF

SEQ ID NO: 1259025 - protein, 9 aa, Homo Sapiens
RLDTYLARF

SEQ ID NO: 1259026 - protein, 9 aa, Homo Sapiens
GHAFFLEGV

SEQ ID NO: 1259027 - protein, 9 aa, Homo Sapiens
KNSQVCPLT

SEQ ID NO: 1259028 - protein, 9 aa, Homo Sapiens
GVKISKAHD

SEQ ID NO: 1259029 - protein, 9 aa, Homo Sapiens
KDDFSFSRY

SEQ ID NO: 1259030 - protein, 9 aa, Homo Sapiens
NVTVASHLT

SEQ ID NO: 1259031 - protein, 9 aa, Homo Sapiens
VPATCFLRQ

SEQ ID NO: 1259032 - protein, 9 aa, Homo Sapiens
KDTLQRTDP

SEQ ID NO: 1259033 - protein, 9 aa, Homo Sapiens
KRCKMITEQ

SEQ ID NO: 1259034 - protein, 9 aa, Homo Sapiens
YGSLPAFIK

SEQ ID NO: 1259035 - protein, 9 aa, Homo Sapiens
SLLLEWCGW

SEQ ID NO: 1259036 - protein, 9 aa, Homo Sapiens
LLQQSVLWN

SEQ ID NO: 1259037 - protein, 9 aa, Homo Sapiens
GMVKKESIN

SEQ ID NO: 1259038 - protein, 9 aa, Homo Sapiens
DTFSHLQNL

SEQ ID NO: 1259039 - protein, 9 aa, Homo Sapiens
WETPSHLAV

SEQ ID NO: 1259040 - protein, 9 aa, Homo Sapiens
KATAYIMSV

SEQ ID NO: 1259041 - protein, 9 aa, Homo Sapiens
QLSTLVDAQ

SEQ ID NO: 1259042 - protein, 9 aa, Homo Sapiens
MQYFKRTGT

SEQ ID NO: 1259043 - protein, 9 aa, Homo Sapiens
WTPSPSHMP

SEQ ID NO: 1259044 - protein, 9 aa, Homo Sapiens
APFCTRINH

SEQ ID NO: 1259045 - protein, 9 aa, Homo Sapiens
PGPPASQGR

SEQ ID NO: 1259046 - protein, 9 aa, Homo Sapiens
LLKSECHRI

SEQ ID NO: 1259047 - protein, 9 aa, Homo Sapiens
PPVDGLGAP

SEQ ID NO: 1259048 - protein, 9 aa, Homo Sapiens
TLNYLRDGA

SEQ ID NO: 1259049 - protein, 9 aa, Homo Sapiens
SREEVNENF

SEQ ID NO: 1259050 - protein, 9 aa, Homo Sapiens
KLSGIQHDQ

SEQ ID NO: 1259051 - protein, 9 aa, Homo Sapiens
YRLEELEKM

SEQ ID NO: 1259052 - protein, 9 aa, Homo Sapiens
PALVPRCLV

SEQ ID NO: 1259053 - protein, 9 aa, Homo Sapiens
GWTVFQWRM

SEQ ID NO: 1259054 - protein, 9 aa, Homo Sapiens
MVAQPQGLE

SEQ ID NO: 1259055 - protein, 9 aa, Homo Sapiens
PRRLCLVLS

SEQ ID NO: 1259056 - protein, 9 aa, Homo Sapiens
DSMLHGAVS

SEQ ID NO: 1259057 - protein, 9 aa, Homo Sapiens
YFQQLEDKT

SEQ ID NO: 1259058 - protein, 9 aa, Homo Sapiens
RIFTSVLKR

SEQ ID NO: 1259059 - protein, 9 aa, Homo Sapiens
YMNSVTRNL

SEQ ID NO: 1259060 - protein, 9 aa, Homo Sapiens
ILGITIGLL

SEQ ID NO: 1259061 - protein, 9 aa, Homo Sapiens
EAANLLIPT

SEQ ID NO: 1259062 - protein, 9 aa, Homo Sapiens
CTRFNQGHS

SEQ ID NO: 1259063 - protein, 9 aa, Homo Sapiens
EYVHGGEMF

SEQ ID NO: 1259064 - protein, 9 aa, Homo Sapiens
IFKADKEAK

SEQ ID NO: 1259065 - protein, 9 aa, Homo Sapiens
RPDRQPDFT

SEQ ID NO: 1259066 - protein, 9 aa, Homo Sapiens
KGENEYANV

SEQ ID NO: 1259067 - protein, 9 aa, Homo Sapiens
VAMDFSQAL

SEQ ID NO: 1259068 - protein, 9 aa, Homo Sapiens
PDGRYMHSW

SEQ ID NO: 1259069 - protein, 9 aa, Homo Sapiens
SVAKSMKSL

SEQ ID NO: 1259070 - protein, 9 aa, Homo Sapiens
LAVISLNIT

SEQ ID NO: 1259071 - protein, 9 aa, Homo Sapiens
TGRSYTIGI

SEQ ID NO: 1259072 - protein, 9 aa, Homo Sapiens
GKDGKHSRC

SEQ ID NO: 1259073 - protein, 9 aa, Homo Sapiens
TSPVIKVES

SEQ ID NO: 1259074 - protein, 9 aa, Homo Sapiens
VHQAILNLH

SEQ ID NO: 1259075 - protein, 9 aa, Homo Sapiens
DKEKKRKEE

SEQ ID NO: 1259076 - protein, 9 aa, Homo Sapiens
NLSYVFIHL

SEQ ID NO: 1259077 - protein, 9 aa, Homo Sapiens
QSPNCNQHY

SEQ ID NO: 1259078 - protein, 9 aa, Homo Sapiens
SPLLPAWMT

SEQ ID NO: 1259079 - protein, 9 aa, Homo Sapiens
RHMLIHTSI

SEQ ID NO: 1259080 - protein, 9 aa, Homo Sapiens
HNGGNCVEK

SEQ ID NO: 1259081 - protein, 9 aa, Homo Sapiens
ISKQATKGK

SEQ ID NO: 1259082 - protein, 9 aa, Homo Sapiens
EFLPKTISG

SEQ ID NO: 1259083 - protein, 9 aa, Homo Sapiens
VILIMSVII

SEQ ID NO: 1259084 - protein, 9 aa, Homo Sapiens
PVIMQESHT

SEQ ID NO: 1259085 - protein, 9 aa, Homo Sapiens
RLSACGWRS

SEQ ID NO: 1259086 - protein, 9 aa, Homo Sapiens
MGIDTSGTF

SEQ ID NO: 1259087 - protein, 9 aa, Homo Sapiens
SVSASRPSE

SEQ ID NO: 1259088 - protein, 9 aa, Homo Sapiens
VVFVGIKYV

SEQ ID NO: 1259089 - protein, 9 aa, Homo Sapiens
TDTKFQKLR

SEQ ID NO: 1259090 - protein, 9 aa, Homo Sapiens
ATIVSAVTT

SEQ ID NO: 1259091 - protein, 9 aa, Homo Sapiens
LTGSHAYER

SEQ ID NO: 1259092 - protein, 9 aa, Homo Sapiens
IVGLDNGGK

SEQ ID NO: 1259093 - protein, 9 aa, Homo Sapiens
EKNHCDCNV

SEQ ID NO: 1259094 - protein, 9 aa, Homo Sapiens
LGMSMHVER

SEQ ID NO: 1259095 - protein, 9 aa, Homo Sapiens
DMGRKCSKA

SEQ ID NO: 1259096 - protein, 9 aa, Homo Sapiens
SLETALNAK

SEQ ID NO: 1259097 - protein, 9 aa, Homo Sapiens
KLHLKEEDG

SEQ ID NO: 1259098 - protein, 9 aa, Homo Sapiens
HAGWLLSWA

SEQ ID NO: 1259099 - protein, 9 aa, Homo Sapiens
CSSSGLQVL

SEQ ID NO: 1259100 - protein, 9 aa, Homo Sapiens
CARSSWLPT

SEQ ID NO: 1259101 - protein, 9 aa, Homo Sapiens
WRAQQQLEN

SEQ ID NO: 1259102 - protein, 9 aa, Homo Sapiens
GSEAIPGGN

SEQ ID NO: 1259103 - protein, 9 aa, Homo Sapiens
MTTTLSSSV

SEQ ID NO: 1259104 - protein, 9 aa, Homo Sapiens
KNFRPTGGA

SEQ ID NO: 1259105 - protein, 9 aa, Homo Sapiens
RKKNPRKRL

SEQ ID NO: 1259106 - protein, 9 aa, Homo Sapiens
PRTQEVIPL

SEQ ID NO: 1259107 - protein, 9 aa, Homo Sapiens
PKDALAHQV

SEQ ID NO: 1259108 - protein, 9 aa, Homo Sapiens
KQFAAVIMR

SEQ ID NO: 1259109 - protein, 9 aa, Homo Sapiens
PLSPPNEEV

SEQ ID NO: 1259110 - protein, 9 aa, Homo Sapiens
KCVLEAHGL

SEQ ID NO: 1259111 - protein, 9 aa, Homo Sapiens
AFALMASVP

SEQ ID NO: 1259112 - protein, 9 aa, Homo Sapiens
MAYDFHDSW

SEQ ID NO: 1259113 - protein, 9 aa, Homo Sapiens
GRAVPIKVM

SEQ ID NO: 1259114 - protein, 9 aa, Homo Sapiens
RQTMHNYSG

SEQ ID NO: 1259115 - protein, 9 aa, Homo Sapiens
VEKMAAHMW

SEQ ID NO: 1259116 - protein, 9 aa, Homo Sapiens
PHTPGRRSG

SEQ ID NO: 1259117 - protein, 9 aa, Homo Sapiens
GDVTCGQLM

SEQ ID NO: 1259118 - protein, 9 aa, Homo Sapiens
SESSVKVWL

SEQ ID NO: 1259119 - protein, 9 aa, Homo Sapiens
VFIHGMHAK

SEQ ID NO: 1259120 - protein, 9 aa, Homo Sapiens
VRPVSSASS

SEQ ID NO: 1259121 - protein, 9 aa, Homo Sapiens
CDALPILKL

SEQ ID NO: 1259122 - protein, 9 aa, Homo Sapiens
TRVCPRPLL

SEQ ID NO: 1259123 - protein, 9 aa, Homo Sapiens
EGETYFDGV

SEQ ID NO: 1259124 - protein, 9 aa, Homo Sapiens
EEVKQASIQ

SEQ ID NO: 1259125 - protein, 9 aa, Homo Sapiens
HPPSLAITP

SEQ ID NO: 1259126 - protein, 9 aa, Homo Sapiens
LQTTVGVDG

SEQ ID NO: 1259127 - protein, 9 aa, Homo Sapiens
DLWEERSWS

SEQ ID NO: 1259128 - protein, 9 aa, Homo Sapiens
HECVNMEDS

SEQ ID NO: 1259129 - protein, 9 aa, Homo Sapiens
LAFFGLVPE

SEQ ID NO: 1259130 - protein, 9 aa, Homo Sapiens
CRGKRVRQN

SEQ ID NO: 1259131 - protein, 9 aa, Homo Sapiens
DCLGRKKTM

SEQ ID NO: 1259132 - protein, 9 aa, Homo Sapiens
NIIPMDPNG

SEQ ID NO: 1259133 - protein, 9 aa, Homo Sapiens
TESENGSPE

SEQ ID NO: 1259134 - protein, 9 aa, Homo Sapiens
PQTHTVDLY

SEQ ID NO: 1259135 - protein, 9 aa, Homo Sapiens
DQRVQGKDI

SEQ ID NO: 1259136 - protein, 9 aa, Homo Sapiens
KMTVSERKR

SEQ ID NO: 1259137 - protein, 9 aa, Homo Sapiens
SSSHFYVVM

SEQ ID NO: 1259138 - protein, 9 aa, Homo Sapiens
GLHEEAERK

SEQ ID NO: 1259139 - protein, 9 aa, Homo Sapiens
RFCVSLAGG

SEQ ID NO: 1259140 - protein, 9 aa, Homo Sapiens
NRCFICRKK

SEQ ID NO: 1259141 - protein, 9 aa, Homo Sapiens
SWWSSHVLE

SEQ ID NO: 1259142 - protein, 9 aa, Homo Sapiens
SVKSYKSYD

SEQ ID NO: 1259143 - protein, 9 aa, Homo Sapiens
FCKLNFNGE

SEQ ID NO: 1259144 - protein, 9 aa, Homo Sapiens
GHAHRKAAK

SEQ ID NO: 1259145 - protein, 9 aa, Homo Sapiens
MLKGSSAQD

SEQ ID NO: 1259146 - protein, 9 aa, Homo Sapiens
QIKQMLSDL

SEQ ID NO: 1259147 - protein, 9 aa, Homo Sapiens
STIGCRLRK

SEQ ID NO: 1259148 - protein, 9 aa, Homo Sapiens
LPSPGPVLP

SEQ ID NO: 1259149 - protein, 9 aa, Homo Sapiens
TIPYHPKPA

SEQ ID NO: 1259150 - protein, 9 aa, Homo Sapiens
KLVSYVSKI

SEQ ID NO: 1259151 - protein, 9 aa, Homo Sapiens
CVHDSTMHS

SEQ ID NO: 1259152 - protein, 9 aa, Homo Sapiens
LRKGHSTLG

SEQ ID NO: 1259153 - protein, 9 aa, Homo Sapiens
EEKHKVEEK

SEQ ID NO: 1259154 - protein, 9 aa, Homo Sapiens
AQGEGQTEA

SEQ ID NO: 1259155 - protein, 9 aa, Homo Sapiens
QGQIQTQAP

SEQ ID NO: 1259156 - protein, 9 aa, Homo Sapiens
SLLLIFTSV

SEQ ID NO: 1259157 - protein, 9 aa, Homo Sapiens
QCTKMYELS

SEQ ID NO: 1259158 - protein, 9 aa, Homo Sapiens
VALAASVSD

SEQ ID NO: 1259159 - protein, 9 aa, Homo Sapiens
EPWVDKKGS

SEQ ID NO: 1259160 - protein, 9 aa, Homo Sapiens
KTKGEIANC

SEQ ID NO: 1259161 - protein, 9 aa, Homo Sapiens
GALPSPDVP

SEQ ID NO: 1259162 - protein, 9 aa, Homo Sapiens
SRMELSALQ

SEQ ID NO: 1259163 - protein, 9 aa, Homo Sapiens
LLLNKRRTE

SEQ ID NO: 1259164 - protein, 9 aa, Homo Sapiens
GTSAFSKGV

SEQ ID NO: 1259165 - protein, 9 aa, Homo Sapiens
SALENLQPR

SEQ ID NO: 1259166 - protein, 9 aa, Homo Sapiens
YIIAARALH

SEQ ID NO: 1259167 - protein, 9 aa, Homo Sapiens
ESSMNIIGL

SEQ ID NO: 1259168 - protein, 9 aa, Homo Sapiens
NVTSVAVRN

SEQ ID NO: 1259169 - protein, 9 aa, Homo Sapiens
QRRLPKPAS

SEQ ID NO: 1259170 - protein, 9 aa, Homo Sapiens
TYIPLLYWI

SEQ ID NO: 1259171 - protein, 9 aa, Homo Sapiens
VGVGSEAYS

SEQ ID NO: 1259172 - protein, 9 aa, Homo Sapiens
TSLSLSQWM

SEQ ID NO: 1259173 - protein, 9 aa, Homo Sapiens
VFDDNYDRS

SEQ ID NO: 1259174 - protein, 9 aa, Homo Sapiens
CCMVEEVWL

SEQ ID NO: 1259175 - protein, 9 aa, Homo Sapiens
RSESSVEGP

SEQ ID NO: 1259176 - protein, 9 aa, Homo Sapiens
SMGPQYVTT

SEQ ID NO: 1259177 - protein, 9 aa, Homo Sapiens
RAHEDISRL

SEQ ID NO: 1259178 - protein, 9 aa, Homo Sapiens
GHAGLELLT

SEQ ID NO: 1259179 - protein, 9 aa, Homo Sapiens
SAQKLTTAL

SEQ ID NO: 1259180 - protein, 9 aa, Homo Sapiens
VRSLKGHVE

SEQ ID NO: 1259181 - protein, 9 aa, Homo Sapiens
DLLKRYTKE

SEQ ID NO: 1259182 - protein, 9 aa, Homo Sapiens
LVLRKLDHI

SEQ ID NO: 1259183 - protein, 9 aa, Homo Sapiens
WLRTDCFHC

SEQ ID NO: 1259184 - protein, 9 aa, Homo Sapiens
KKGADSGIL

SEQ ID NO: 1259185 - protein, 9 aa, Homo Sapiens
EILHSSLGK

SEQ ID NO: 1259186 - protein, 9 aa, Homo Sapiens
SLCTKLSLI

SEQ ID NO: 1259187 - protein, 9 aa, Homo Sapiens
HGLICDQAC

SEQ ID NO: 1259188 - protein, 9 aa, Homo Sapiens
MAGLPGLYH

SEQ ID NO: 1259189 - protein, 9 aa, Homo Sapiens
QVHTGERHH

SEQ ID NO: 1259190 - protein, 9 aa, Homo Sapiens
DDCLLMIWS

SEQ ID NO: 1259191 - protein, 9 aa, Homo Sapiens
QPTKVRRFP

SEQ ID NO: 1259192 - protein, 9 aa, Homo Sapiens
EGIPETKEK

SEQ ID NO: 1259193 - protein, 9 aa, Homo Sapiens
VFWFLQYNG

SEQ ID NO: 1259194 - protein, 9 aa, Homo Sapiens
CGPRAHPAQ

SEQ ID NO: 1259195 - protein, 9 aa, Homo Sapiens
VAYSFSNCW

SEQ ID NO: 1259196 - protein, 9 aa, Homo Sapiens
MCSKVRGRS

SEQ ID NO: 1259197 - protein, 9 aa, Homo Sapiens
GVSVALGTV

SEQ ID NO: 1259198 - protein, 9 aa, Homo Sapiens
TLVTMVTAT

SEQ ID NO: 1259199 - protein, 9 aa, Homo Sapiens
PTVRLLLAE

SEQ ID NO: 1259200 - protein, 9 aa, Homo Sapiens
RWTTSTDQR

SEQ ID NO: 1259201 - protein, 9 aa, Homo Sapiens
DKNPIVVGG

SEQ ID NO: 1259202 - protein, 9 aa, Homo Sapiens
FRENWQNNL

SEQ ID NO: 1259203 - protein, 9 aa, Homo Sapiens
NHHVLGHPH

SEQ ID NO: 1259204 - protein, 9 aa, Homo Sapiens
DNIYMPRKY

SEQ ID NO: 1259205 - protein, 9 aa, Homo Sapiens
NLKQFYKGK

SEQ ID NO: 1259206 - protein, 9 aa, Homo Sapiens
VIAHILHGG

SEQ ID NO: 1259207 - protein, 9 aa, Homo Sapiens
WQLTIQYQE

SEQ ID NO: 1259208 - protein, 9 aa, Homo Sapiens
EETTQLAKI

SEQ ID NO: 1259209 - protein, 9 aa, Homo Sapiens
VDVVAELAR

SEQ ID NO: 1259210 - protein, 9 aa, Homo Sapiens
ADQEDHIKP

SEQ ID NO: 1259211 - protein, 9 aa, Homo Sapiens
SSHGLSKAM

SEQ ID NO: 1259212 - protein, 9 aa, Homo Sapiens
QESLQLQVA

SEQ ID NO: 1259213 - protein, 9 aa, Homo Sapiens
DRANNLYME

SEQ ID NO: 1259214 - protein, 9 aa, Homo Sapiens
RKKCHTAFQ

SEQ ID NO: 1259215 - protein, 9 aa, Homo Sapiens
NHCDCNVDW

SEQ ID NO: 1259216 - protein, 9 aa, Homo Sapiens
VNFRCAMNS

SEQ ID NO: 1259217 - protein, 9 aa, Homo Sapiens
TESRVPGTT

SEQ ID NO: 1259218 - protein, 9 aa, Homo Sapiens
SAITIVSAT

SEQ ID NO: 1259219 - protein, 9 aa, Homo Sapiens
SAPWKPIWL

SEQ ID NO: 1259220 - protein, 9 aa, Homo Sapiens
ASQTMVKCV

SEQ ID NO: 1259221 - protein, 9 aa, Homo Sapiens
SDGVIEPNK

SEQ ID NO: 1259222 - protein, 9 aa, Homo Sapiens
TDLSKLEVY

SEQ ID NO: 1259223 - protein, 9 aa, Homo Sapiens
DPKCYVQDL

SEQ ID NO: 1259224 - protein, 9 aa, Homo Sapiens
ASMPSSSCV

SEQ ID NO: 1259225 - protein, 9 aa, Homo Sapiens
RTVMELKMH

SEQ ID NO: 1259226 - protein, 9 aa, Homo Sapiens
ACLASLSII

SEQ ID NO: 1259227 - protein, 9 aa, Homo Sapiens
QQFAHQMQQ

SEQ ID NO: 1259228 - protein, 9 aa, Homo Sapiens
DVKRLKHGY

SEQ ID NO: 1259229 - protein, 9 aa, Homo Sapiens
AVKEKQKWD

SEQ ID NO: 1259230 - protein, 9 aa, Homo Sapiens
GVTRMSMDL

SEQ ID NO: 1259231 - protein, 9 aa, Homo Sapiens
VVGIFGNNL

SEQ ID NO: 1259232 - protein, 9 aa, Homo Sapiens
KNQVVCHDY

SEQ ID NO: 1259233 - protein, 9 aa, Homo Sapiens
VLVRHNRCL

SEQ ID NO: 1259234 - protein, 9 aa, Homo Sapiens
HFETSCLKE

SEQ ID NO: 1259235 - protein, 9 aa, Homo Sapiens
MVILNVLLM

SEQ ID NO: 1259236 - protein, 9 aa, Homo Sapiens
MNKEYSISN

SEQ ID NO: 1259237 - protein, 9 aa, Homo Sapiens
EGGYHQIGS

SEQ ID NO: 1259238 - protein, 9 aa, Homo Sapiens
ENTINQLEQ

SEQ ID NO: 1259239 - protein, 9 aa, Homo Sapiens
EYPLSCFTL

SEQ ID NO: 1259240 - protein, 9 aa, Homo Sapiens
PSLQPPTLG

SEQ ID NO: 1259241 - protein, 9 aa, Homo Sapiens
KVLMMMSLY

SEQ ID NO: 1259242 - protein, 9 aa, Homo Sapiens
QYTLKQHPA

SEQ ID NO: 1259243 - protein, 9 aa, Homo Sapiens
EQEHSNAFM

SEQ ID NO: 1259244 - protein, 9 aa, Homo Sapiens
VWPPRLNTS

SEQ ID NO: 1259245 - protein, 9 aa, Homo Sapiens
DEGYYQCVV

SEQ ID NO: 1259246 - protein, 9 aa, Homo Sapiens
GCLLHTYVL

SEQ ID NO: 1259247 - protein, 9 aa, Homo Sapiens
LERKINKMM

SEQ ID NO: 1259248 - protein, 9 aa, Homo Sapiens
IVKRSDGFN

SEQ ID NO: 1259249 - protein, 9 aa, Homo Sapiens
LTLWPDQQL

SEQ ID NO: 1259250 - protein, 9 aa, Homo Sapiens
GPPLKKMKQ

SEQ ID NO: 1259251 - protein, 9 aa, Homo Sapiens
KMGERVHIK

SEQ ID NO: 1259252 - protein, 9 aa, Homo Sapiens
NISLTISTA

SEQ ID NO: 1259253 - protein, 9 aa, Homo Sapiens
LTDNMLQST

SEQ ID NO: 1259254 - protein, 9 aa, Homo Sapiens
TCFFTFKNF

SEQ ID NO: 1259255 - protein, 9 aa, Homo Sapiens
GGIWAVYER

SEQ ID NO: 1259256 - protein, 9 aa, Homo Sapiens
DCLVCVNFS

SEQ ID NO: 1259257 - protein, 9 aa, Homo Sapiens
NLGMWVQEG

SEQ ID NO: 1259258 - protein, 9 aa, Homo Sapiens
AGESGTRDP

SEQ ID NO: 1259259 - protein, 9 aa, Homo Sapiens
DDLVDTNLH

SEQ ID NO: 1259260 - protein, 9 aa, Homo Sapiens
MSDTGWVNA

SEQ ID NO: 1259261 - protein, 9 aa, Homo Sapiens
DALKSLKMQ

SEQ ID NO: 1259262 - protein, 9 aa, Homo Sapiens
IHLFLAKHG

SEQ ID NO: 1259263 - protein, 9 aa, Homo Sapiens
ATSCMGFFM

SEQ ID NO: 1259264 - protein, 9 aa, Homo Sapiens
LQNNGLRKN

SEQ ID NO: 1259265 - protein, 9 aa, Homo Sapiens
AHLYDMLHR

SEQ ID NO: 1259266 - protein, 9 aa, Homo Sapiens
GLWHGMFVN

SEQ ID NO: 1259267 - protein, 9 aa, Homo Sapiens
KLTACMQGQ

SEQ ID NO: 1259268 - protein, 9 aa, Homo Sapiens
TLHQLATSY

SEQ ID NO: 1259269 - protein, 9 aa, Homo Sapiens
CQCFLRSGP

SEQ ID NO: 1259270 - protein, 9 aa, Homo Sapiens
ATDLSTTEA

SEQ ID NO: 1259271 - protein, 9 aa, Homo Sapiens
LISFGVTLL

SEQ ID NO: 1259272 - protein, 9 aa, Homo Sapiens
GTVLGESAS

SEQ ID NO: 1259273 - protein, 9 aa, Homo Sapiens
FKYVTVGFT

SEQ ID NO: 1259274 - protein, 9 aa, Homo Sapiens
GELKWETDE

SEQ ID NO: 1259275 - protein, 9 aa, Homo Sapiens
LKWVQYTSG

SEQ ID NO: 1259276 - protein, 9 aa, Homo Sapiens
HQRMMSQQK

SEQ ID NO: 1259277 - protein, 9 aa, Homo Sapiens
RIFYVHAYI

SEQ ID NO: 1259278 - protein, 9 aa, Homo Sapiens
MLAAREDRL

SEQ ID NO: 1259279 - protein, 9 aa, Homo Sapiens
VAVTTPGLL

SEQ ID NO: 1259280 - protein, 9 aa, Homo Sapiens
MNLEILLGV

SEQ ID NO: 1259281 - protein, 9 aa, Homo Sapiens
VLLRLVDED

SEQ ID NO: 1259282 - protein, 9 aa, Homo Sapiens
DLREGAHYL

SEQ ID NO: 1259283 - protein, 9 aa, Homo Sapiens
AVLDFWVQA

SEQ ID NO: 1259284 - protein, 9 aa, Homo Sapiens
CYPQLCLQG

SEQ ID NO: 1259285 - protein, 9 aa, Homo Sapiens
DVTKEVPMN

SEQ ID NO: 1259286 - protein, 9 aa, Homo Sapiens
RIRTVGIVG

SEQ ID NO: 1259287 - protein, 9 aa, Homo Sapiens
CSGVCILIS

SEQ ID NO: 1259288 - protein, 9 aa, Homo Sapiens
QVGLESAID

SEQ ID NO: 1259289 - protein, 9 aa, Homo Sapiens
RICSSAHLL

SEQ ID NO: 1259290 - protein, 9 aa, Homo Sapiens
QHLTRYSQG

SEQ ID NO: 1259291 - protein, 9 aa, Homo Sapiens
AQPTLPGPG

SEQ ID NO: 1259292 - protein, 9 aa, Homo Sapiens
EKKKLRYVF

SEQ ID NO: 1259293 - protein, 9 aa, Homo Sapiens
NIVFDSEMN

SEQ ID NO: 1259294 - protein, 9 aa, Homo Sapiens
FSPSTKYIV

SEQ ID NO: 1259295 - protein, 9 aa, Homo Sapiens
PRRFVLVGD

SEQ ID NO: 1259296 - protein, 9 aa, Homo Sapiens
ITNHSDRPP

SEQ ID NO: 1259297 - protein, 9 aa, Homo Sapiens
VWEETMSRF

SEQ ID NO: 1259298 - protein, 9 aa, Homo Sapiens
LKSARSSVP

SEQ ID NO: 1259299 - protein, 9 aa, Homo Sapiens
WVKSQTIEQ

SEQ ID NO: 1259300 - protein, 9 aa, Homo Sapiens
CEIQEHTKP

SEQ ID NO: 1259301 - protein, 9 aa, Homo Sapiens
ISKLKTSID

SEQ ID NO: 1259302 - protein, 9 aa, Homo Sapiens
KRHKTISID

SEQ ID NO: 1259303 - protein, 9 aa, Homo Sapiens
NVPPSNHHQ

SEQ ID NO: 1259304 - protein, 9 aa, Homo Sapiens
YGTLLKAVK

SEQ ID NO: 1259305 - protein, 9 aa, Homo Sapiens
PSTIGCRLR

SEQ ID NO: 1259306 - protein, 9 aa, Homo Sapiens
QREWRIFQL

SEQ ID NO: 1259307 - protein, 9 aa, Homo Sapiens
ETLIWQDIS

SEQ ID NO: 1259308 - protein, 9 aa, Homo Sapiens
LVKDIQWAL

SEQ ID NO: 1259309 - protein, 9 aa, Homo Sapiens
QGFPTKVTF

SEQ ID NO: 1259310 - protein, 9 aa, Homo Sapiens
SSMESFPSL

SEQ ID NO: 1259311 - protein, 9 aa, Homo Sapiens
LMPIKQNVC

SEQ ID NO: 1259312 - protein, 9 aa, Homo Sapiens
PFARTSLKS

SEQ ID NO: 1259313 - protein, 9 aa, Homo Sapiens
IELLFFVLI

SEQ ID NO: 1259314 - protein, 9 aa, Homo Sapiens
LLRPGCFDR

SEQ ID NO: 1259315 - protein, 9 aa, Homo Sapiens
SHHKSKDRY

SEQ ID NO: 1259316 - protein, 9 aa, Homo Sapiens
CHRGTRPPP

SEQ ID NO: 1259317 - protein, 9 aa, Homo Sapiens
PSRDKVVAV

SEQ ID NO: 1259318 - protein, 9 aa, Homo Sapiens
EETALDAFL

SEQ ID NO: 1259319 - protein, 9 aa, Homo Sapiens
LDPFKHLSP

SEQ ID NO: 1259320 - protein, 9 aa, Homo Sapiens
LSASVSHGA

SEQ ID NO: 1259321 - protein, 9 aa, Homo Sapiens
RNDPFLHPG

SEQ ID NO: 1259322 - protein, 9 aa, Homo Sapiens
KGKRKKKGG

SEQ ID NO: 1259323 - protein, 9 aa, Homo Sapiens
KTLIGTVLA

SEQ ID NO: 1259324 - protein, 9 aa, Homo Sapiens
EVSNGMSRR

SEQ ID NO: 1259325 - protein, 9 aa, Homo Sapiens
RMAREKGSQ

SEQ ID NO: 1259326 - protein, 9 aa, Homo Sapiens
LNNADIVQA

SEQ ID NO: 1259327 - protein, 9 aa, Homo Sapiens
FVVWLLAGW

SEQ ID NO: 1259328 - protein, 9 aa, Homo Sapiens
PSFSAPCCW

SEQ ID NO: 1259329 - protein, 9 aa, Homo Sapiens
SVSHGAIPV

SEQ ID NO: 1259330 - protein, 9 aa, Homo Sapiens
PGPGDSVEA

SEQ ID NO: 1259331 - protein, 9 aa, Homo Sapiens
KKTKKIVYQ

SEQ ID NO: 1259332 - protein, 9 aa, Homo Sapiens
LAGFITPLS

SEQ ID NO: 1259333 - protein, 9 aa, Homo Sapiens
KPTLWDEPG

SEQ ID NO: 1259334 - protein, 9 aa, Homo Sapiens
SCAASCVLM

SEQ ID NO: 1259335 - protein, 9 aa, Homo Sapiens
TFRPNPALN

SEQ ID NO: 1259336 - protein, 9 aa, Homo Sapiens
GVATALLLL

SEQ ID NO: 1259337 - protein, 9 aa, Homo Sapiens
FMEPLPMFC

SEQ ID NO: 1259338 - protein, 9 aa, Homo Sapiens
DDNDIHITA

SEQ ID NO: 1259339 - protein, 9 aa, Homo Sapiens
LGGIGVLNK

SEQ ID NO: 1259340 - protein, 9 aa, Homo Sapiens
NVHIMSCNK

SEQ ID NO: 1259341 - protein, 9 aa, Homo Sapiens
LPRLCGPTL

SEQ ID NO: 1259342 - protein, 9 aa, Homo Sapiens
HEVLAKHEA

SEQ ID NO: 1259343 - protein, 9 aa, Homo Sapiens
LPLLLPRTP

SEQ ID NO: 1259344 - protein, 9 aa, Homo Sapiens
RQRFMASWA

SEQ ID NO: 1259345 - protein, 9 aa, Homo Sapiens
IFILSGFAN

SEQ ID NO: 1259346 - protein, 9 aa, Homo Sapiens
LNSAMQAFL

SEQ ID NO: 1259347 - protein, 9 aa, Homo Sapiens
YSYSQKVSQ

SEQ ID NO: 1259348 - protein, 9 aa, Homo Sapiens
TSMQPYSPT

SEQ ID NO: 1259349 - protein, 9 aa, Homo Sapiens
TSASGTSST

SEQ ID NO: 1259350 - protein, 9 aa, Homo Sapiens
LYDHVDEVM

SEQ ID NO: 1259351 - protein, 9 aa, Homo Sapiens
LKEELHIQG

SEQ ID NO: 1259352 - protein, 9 aa, Homo Sapiens
GHPSSFSPH

SEQ ID NO: 1259353 - protein, 9 aa, Homo Sapiens
LYQAYTPNF

SEQ ID NO: 1259354 - protein, 9 aa, Homo Sapiens
MFSEVRNDL

SEQ ID NO: 1259355 - protein, 9 aa, Homo Sapiens
HHHFPQALT

SEQ ID NO: 1259356 - protein, 9 aa, Homo Sapiens
LKENGSMAS

SEQ ID NO: 1259357 - protein, 9 aa, Homo Sapiens
TAELTYTYS

SEQ ID NO: 1259358 - protein, 9 aa, Homo Sapiens
HHPESMGLT

SEQ ID NO: 1259359 - protein, 9 aa, Homo Sapiens
TGAHLRLRL

SEQ ID NO: 1259360 - protein, 9 aa, Homo Sapiens
VEDWETERK

SEQ ID NO: 1259361 - protein, 9 aa, Homo Sapiens
MTIQAQPQI

SEQ ID NO: 1259362 - protein, 9 aa, Homo Sapiens
IPLMNIEGE

SEQ ID NO: 1259363 - protein, 9 aa, Homo Sapiens
GLFPFMHVK

SEQ ID NO: 1259364 - protein, 9 aa, Homo Sapiens
HIEAILDKF

SEQ ID NO: 1259365 - protein, 9 aa, Homo Sapiens
KSTTTTRSL

SEQ ID NO: 1259366 - protein, 9 aa, Homo Sapiens
DVKVTADTV

SEQ ID NO: 1259367 - protein, 9 aa, Homo Sapiens
TFLTIMHIQ

SEQ ID NO: 1259368 - protein, 9 aa, Homo Sapiens
TLDCPIKKG

SEQ ID NO: 1259369 - protein, 9 aa, Homo Sapiens
SPGMTTTLS

SEQ ID NO: 1259370 - protein, 9 aa, Homo Sapiens
FVKTLKWGL

SEQ ID NO: 1259371 - protein, 9 aa, Homo Sapiens
WSLGNDTPV

SEQ ID NO: 1259372 - protein, 9 aa, Homo Sapiens
SRPGSIHTT

SEQ ID NO: 1259373 - protein, 9 aa, Homo Sapiens
FSTMKMAHT

SEQ ID NO: 1259374 - protein, 9 aa, Homo Sapiens
GPFSQIVAI

SEQ ID NO: 1259375 - protein, 9 aa, Homo Sapiens
VVIFGISIT

SEQ ID NO: 1259376 - protein, 9 aa, Homo Sapiens
HYRSHNPTL

SEQ ID NO: 1259377 - protein, 9 aa, Homo Sapiens
EALNSDGWL

SEQ ID NO: 1259378 - protein, 9 aa, Homo Sapiens
YIHLKLGAI

SEQ ID NO: 1259379 - protein, 9 aa, Homo Sapiens
HPLPLPPPV

SEQ ID NO: 1259380 - protein, 9 aa, Homo Sapiens
SQWSLGNDT

SEQ ID NO: 1259381 - protein, 9 aa, Homo Sapiens
WMNQNAGFP

SEQ ID NO: 1259382 - protein, 9 aa, Homo Sapiens
ARQILHPEA

SEQ ID NO: 1259383 - protein, 9 aa, Homo Sapiens
NSLLKEGHR

SEQ ID NO: 1259384 - protein, 9 aa, Homo Sapiens
ATRLPTSVP

SEQ ID NO: 1259385 - protein, 9 aa, Homo Sapiens
TERSPGRCA

SEQ ID NO: 1259386 - protein, 9 aa, Homo Sapiens
AKLKRAAGV

SEQ ID NO: 1259387 - protein, 9 aa, Homo Sapiens
LKRPRHVIL

SEQ ID NO: 1259388 - protein, 9 aa, Homo Sapiens
ITASLGTDS

SEQ ID NO: 1259389 - protein, 9 aa, Homo Sapiens
DGMSHCPGG

SEQ ID NO: 1259390 - protein, 9 aa, Homo Sapiens
SKEGIVALH

SEQ ID NO: 1259391 - protein, 9 aa, Homo Sapiens
TVHFRLTRD

SEQ ID NO: 1259392 - protein, 9 aa, Homo Sapiens
VLFLPTDTK

SEQ ID NO: 1259393 - protein, 9 aa, Homo Sapiens
ERSQGLHEE

SEQ ID NO: 1259394 - protein, 9 aa, Homo Sapiens
LHDRIFSYT

SEQ ID NO: 1259395 - protein, 9 aa, Homo Sapiens
QKKDEDMKV

SEQ ID NO: 1259396 - protein, 9 aa, Homo Sapiens
RNANMNLEI

SEQ ID NO: 1259397 - protein, 9 aa, Homo Sapiens
EILHFHKGG

SEQ ID NO: 1259398 - protein, 9 aa, Homo Sapiens
GILYVTMTL

SEQ ID NO: 1259399 - protein, 9 aa, Homo Sapiens
GTIREEHEY

SEQ ID NO: 1259400 - protein, 9 aa, Homo Sapiens
AIKQEVITP

SEQ ID NO: 1259401 - protein, 9 aa, Homo Sapiens
SSLRHPRCG

SEQ ID NO: 1259402 - protein, 9 aa, Homo Sapiens
VPLGPARTG

SEQ ID NO: 1259403 - protein, 9 aa, Homo Sapiens
YSISGGGGS

SEQ ID NO: 1259404 - protein, 9 aa, Homo Sapiens
QETLNSHGT

SEQ ID NO: 1259405 - protein, 9 aa, Homo Sapiens
GAAACPLDQ

SEQ ID NO: 1259406 - protein, 9 aa, Homo Sapiens
SDETKAPQT

SEQ ID NO: 1259407 - protein, 9 aa, Homo Sapiens
PQCVMAFDV

SEQ ID NO: 1259408 - protein, 9 aa, Homo Sapiens
KNLKNNVMQ

SEQ ID NO: 1259409 - protein, 9 aa, Homo Sapiens
TCAVIKVAS

SEQ ID NO: 1259410 - protein, 9 aa, Homo Sapiens
KGAILKVED

SEQ ID NO: 1259411 - protein, 9 aa, Homo Sapiens
KFNFTCLEA

SEQ ID NO: 1259412 - protein, 9 aa, Homo Sapiens
DCNDNQWEV

SEQ ID NO: 1259413 - protein, 9 aa, Homo Sapiens
FCNYDSGDC

SEQ ID NO: 1259414 - protein, 9 aa, Homo Sapiens
FLDLMFGEG

SEQ ID NO: 1259415 - protein, 9 aa, Homo Sapiens
YEVTWGINQ

SEQ ID NO: 1259416 - protein, 9 aa, Homo Sapiens
LKVLCFFKH

SEQ ID NO: 1259417 - protein, 9 aa, Homo Sapiens
TCQCINTDE

SEQ ID NO: 1259418 - protein, 9 aa, Homo Sapiens
KMQSRMDQW

SEQ ID NO: 1259419 - protein, 9 aa, Homo Sapiens
AIDTATQTE

SEQ ID NO: 1259420 - protein, 9 aa, Homo Sapiens
ILWYRVDFQ

SEQ ID NO: 1259421 - protein, 9 aa, Homo Sapiens
GADHHEVIS

SEQ ID NO: 1259422 - protein, 9 aa, Homo Sapiens
KEEGSSGNS

SEQ ID NO: 1259423 - protein, 9 aa, Homo Sapiens
PAAAAATTA

SEQ ID NO: 1259424 - protein, 9 aa, Homo Sapiens
TTTDVRKIM

SEQ ID NO: 1259425 - protein, 9 aa, Homo Sapiens
SQKSVACNV

SEQ ID NO: 1259426 - protein, 9 aa, Homo Sapiens
PQEVASTAS

SEQ ID NO: 1259427 - protein, 9 aa, Homo Sapiens
PTHFLDRDE

SEQ ID NO: 1259428 - protein, 9 aa, Homo Sapiens
ALTLVRLIK

SEQ ID NO: 1259429 - protein, 9 aa, Homo Sapiens
RRGAPRPGR

SEQ ID NO: 1259430 - protein, 9 aa, Homo Sapiens
KLNQHREKK

SEQ ID NO: 1259431 - protein, 9 aa, Homo Sapiens
EDSWTALEC

SEQ ID NO: 1259432 - protein, 9 aa, Homo Sapiens
PELVGYCCL

SEQ ID NO: 1259433 - protein, 9 aa, Homo Sapiens
AHSTEAIRA

SEQ ID NO: 1259434 - protein, 9 aa, Homo Sapiens
HTTTTTGVL

SEQ ID NO: 1259435 - protein, 9 aa, Homo Sapiens
QLLGQALFT

SEQ ID NO: 1259436 - protein, 9 aa, Homo Sapiens
LDGTVKMIM

SEQ ID NO: 1259437 - protein, 9 aa, Homo Sapiens
TNGPDADAL

SEQ ID NO: 1259438 - protein, 9 aa, Homo Sapiens
LTNPPDHGD

SEQ ID NO: 1259439 - protein, 9 aa, Homo Sapiens
ATNSAEICQ

SEQ ID NO: 1259440 - protein, 9 aa, Homo Sapiens
LTHCLLVSS

SEQ ID NO: 1259441 - protein, 9 aa, Homo Sapiens
STAGEADAS

SEQ ID NO: 1259442 - protein, 9 aa, Homo Sapiens
NWGHLVAFF

SEQ ID NO: 1259443 - protein, 9 aa, Homo Sapiens
VSLEWLMPN

SEQ ID NO: 1259444 - protein, 9 aa, Homo Sapiens
AQPPGVGNT

SEQ ID NO: 1259445 - protein, 9 aa, Homo Sapiens
FCTRKDPRQ

SEQ ID NO: 1259446 - protein, 9 aa, Homo Sapiens
GKAFSQSSP

SEQ ID NO: 1259447 - protein, 9 aa, Homo Sapiens
VTGLTQSNL

SEQ ID NO: 1259448 - protein, 9 aa, Homo Sapiens
RLQQAAVLG

SEQ ID NO: 1259449 - protein, 9 aa, Homo Sapiens
GSTLSKSKH

SEQ ID NO: 1259450 - protein, 9 aa, Homo Sapiens
CKFIENSAA

SEQ ID NO: 1259451 - protein, 9 aa, Homo Sapiens
ETMPLESQT

SEQ ID NO: 1259452 - protein, 9 aa, Homo Sapiens
NLISDPSCW

SEQ ID NO: 1259453 - protein, 9 aa, Homo Sapiens
IKSKEELHH

SEQ ID NO: 1259454 - protein, 9 aa, Homo Sapiens
WYKPMEQFI

SEQ ID NO: 1259455 - protein, 9 aa, Homo Sapiens
KYVGKDGYN

SEQ ID NO: 1259456 - protein, 9 aa, Homo Sapiens
CSCVGPDNV

SEQ ID NO: 1259457 - protein, 9 aa, Homo Sapiens
INVQNGKWD

SEQ ID NO: 1259458 - protein, 9 aa, Homo Sapiens
MALLLALKV

SEQ ID NO: 1259459 - protein, 9 aa, Homo Sapiens
CWASDTMYL

SEQ ID NO: 1259460 - protein, 9 aa, Homo Sapiens
RLGRCSVSD

SEQ ID NO: 1259461 - protein, 9 aa, Homo Sapiens
LQDYMLTLH

SEQ ID NO: 1259462 - protein, 9 aa, Homo Sapiens
CTFYDECGK

SEQ ID NO: 1259463 - protein, 9 aa, Homo Sapiens
HDERSKPVN

SEQ ID NO: 1259464 - protein, 9 aa, Homo Sapiens
KSVACNVGY

SEQ ID NO: 1259465 - protein, 9 aa, Homo Sapiens
LSRLGDVAH

SEQ ID NO: 1259466 - protein, 9 aa, Homo Sapiens
VDDTRVDTD

SEQ ID NO: 1259467 - protein, 9 aa, Homo Sapiens
LFVRKQFAN

SEQ ID NO: 1259468 - protein, 9 aa, Homo Sapiens
IKAALYVGD

SEQ ID NO: 1259469 - protein, 9 aa, Homo Sapiens
NGFRNYNTS

SEQ ID NO: 1259470 - protein, 9 aa, Homo Sapiens
IHTRTHMGE

SEQ ID NO: 1259471 - protein, 9 aa, Homo Sapiens
EAKLKKVRS

SEQ ID NO: 1259472 - protein, 9 aa, Homo Sapiens
ASNHTFCWE

SEQ ID NO: 1259473 - protein, 9 aa, Homo Sapiens
CHDEPSALA

SEQ ID NO: 1259474 - protein, 9 aa, Homo Sapiens
ANVLRERQL

SEQ ID NO: 1259475 - protein, 9 aa, Homo Sapiens
APGHFRHGA

SEQ ID NO: 1259476 - protein, 9 aa, Homo Sapiens
KPIPHSDEY

SEQ ID NO: 1259477 - protein, 9 aa, Homo Sapiens
YMGRAVRMQ

SEQ ID NO: 1259478 - protein, 9 aa, Homo Sapiens
FRGQINTEV

SEQ ID NO: 1259479 - protein, 9 aa, Homo Sapiens
LHEVYSHTV

SEQ ID NO: 1259480 - protein, 9 aa, Homo Sapiens
SLGRHASCY

SEQ ID NO: 1259481 - protein, 9 aa, Homo Sapiens
YDVAHVVSE

SEQ ID NO: 1259482 - protein, 9 aa, Homo Sapiens
RHLSQDHMV

SEQ ID NO: 1259483 - protein, 9 aa, Homo Sapiens
ASCLLPPVG

SEQ ID NO: 1259484 - protein, 9 aa, Homo Sapiens
VCFNMGHIT

SEQ ID NO: 1259485 - protein, 9 aa, Homo Sapiens
STNIHKLRV

SEQ ID NO: 1259486 - protein, 9 aa, Homo Sapiens
GVKVHSGRG

SEQ ID NO: 1259487 - protein, 9 aa, Homo Sapiens
GFIHHNCAP

SEQ ID NO: 1259488 - protein, 9 aa, Homo Sapiens
YRESLQRCY

SEQ ID NO: 1259489 - protein, 9 aa, Homo Sapiens
IHHLCITRK

SEQ ID NO: 1259490 - protein, 9 aa, Homo Sapiens
NHHQQPPHN

SEQ ID NO: 1259491 - protein, 9 aa, Homo Sapiens
LLGDLIQDA

SEQ ID NO: 1259492 - protein, 9 aa, Homo Sapiens
VGTLGDRDA

SEQ ID NO: 1259493 - protein, 9 aa, Homo Sapiens
RSPALRARW

SEQ ID NO: 1259494 - protein, 9 aa, Homo Sapiens
LSVTMLLRY

SEQ ID NO: 1259495 - protein, 9 aa, Homo Sapiens
RSSVCEIWM

SEQ ID NO: 1259496 - protein, 9 aa, Homo Sapiens
SILIELLDT

SEQ ID NO: 1259497 - protein, 9 aa, Homo Sapiens
IITWSLYYL

SEQ ID NO: 1259498 - protein, 9 aa, Homo Sapiens
NLLGDAGMQ

SEQ ID NO: 1259499 - protein, 9 aa, Homo Sapiens
AAKDPSATP

SEQ ID NO: 1259500 - protein, 9 aa, Homo Sapiens
GLYSIFTEH

SEQ ID NO: 1259501 - protein, 9 aa, Homo Sapiens
GCLPLLPAL

SEQ ID NO: 1259502 - protein, 9 aa, Homo Sapiens
IFEMRKKPP

SEQ ID NO: 1259503 - protein, 9 aa, Homo Sapiens
NKEQDQRPI

SEQ ID NO: 1259504 - protein, 9 aa, Homo Sapiens
QHYFCDALP

SEQ ID NO: 1259505 - protein, 9 aa, Homo Sapiens
EKTLQDEEV

SEQ ID NO: 1259506 - protein, 9 aa, Homo Sapiens
CNGSECRSF

SEQ ID NO: 1259507 - protein, 9 aa, Homo Sapiens
NFIKDKGVN

SEQ ID NO: 1259508 - protein, 9 aa, Homo Sapiens
WDMLKRAET

SEQ ID NO: 1259509 - protein, 9 aa, Homo Sapiens
QSRPHRTPW

SEQ ID NO: 1259510 - protein, 9 aa, Homo Sapiens
CDPSYRSVQ

SEQ ID NO: 1259511 - protein, 9 aa, Homo Sapiens
RLRNMLSHL

SEQ ID NO: 1259512 - protein, 9 aa, Homo Sapiens
EATFDTLQL

SEQ ID NO: 1259513 - protein, 9 aa, Homo Sapiens
SNGTIKVEK

SEQ ID NO: 1259514 - protein, 9 aa, Homo Sapiens
KCNKETVVM

SEQ ID NO: 1259515 - protein, 9 aa, Homo Sapiens
PAGRRSGGR

SEQ ID NO: 1259516 - protein, 9 aa, Homo Sapiens
ARAENTTVV

SEQ ID NO: 1259517 - protein, 9 aa, Homo Sapiens
LKWLDMFSD

SEQ ID NO: 1259518 - protein, 9 aa, Homo Sapiens
RVHQEEKHK

SEQ ID NO: 1259519 - protein, 9 aa, Homo Sapiens
WVTWMILTA

SEQ ID NO: 1259520 - protein, 9 aa, Homo Sapiens
LKVRLVCSV

SEQ ID NO: 1259521 - protein, 9 aa, Homo Sapiens
RMALGEGAE

SEQ ID NO: 1259522 - protein, 9 aa, Homo Sapiens
SATATVSAV

SEQ ID NO: 1259523 - protein, 9 aa, Homo Sapiens
ANRVPFDPL

SEQ ID NO: 1259524 - protein, 9 aa, Homo Sapiens
LCSEQSNGS

SEQ ID NO: 1259525 - protein, 9 aa, Homo Sapiens
GQEYGKNLA

SEQ ID NO: 1259526 - protein, 9 aa, Homo Sapiens
HCTQCGRSY

SEQ ID NO: 1259527 - protein, 9 aa, Homo Sapiens
PRFPKCEQE

SEQ ID NO: 1259528 - protein, 9 aa, Homo Sapiens
HLPLYAAIK

SEQ ID NO: 1259529 - protein, 9 aa, Homo Sapiens
PVQNTLLEL

SEQ ID NO: 1259530 - protein, 9 aa, Homo Sapiens
EMSRGEHDL

SEQ ID NO: 1259531 - protein, 9 aa, Homo Sapiens
CLLCICALD

SEQ ID NO: 1259532 - protein, 9 aa, Homo Sapiens
SLVLQSKNC

SEQ ID NO: 1259533 - protein, 9 aa, Homo Sapiens
LCFLRADEC

SEQ ID NO: 1259534 - protein, 9 aa, Homo Sapiens
GWKNFYAVL

SEQ ID NO: 1259535 - protein, 9 aa, Homo Sapiens
LNNVCAYDP

SEQ ID NO: 1259536 - protein, 9 aa, Homo Sapiens
FILYIILHI

SEQ ID NO: 1259537 - protein, 9 aa, Homo Sapiens
VFPPSDQLQ

SEQ ID NO: 1259538 - protein, 9 aa, Homo Sapiens
KVFLLRHPP

SEQ ID NO: 1259539 - protein, 9 aa, Homo Sapiens
NEYNVIDLP

SEQ ID NO: 1259540 - protein, 9 aa, Homo Sapiens
SGRVHNMEL

SEQ ID NO: 1259541 - protein, 9 aa, Homo Sapiens
GETDEATHY

SEQ ID NO: 1259542 - protein, 9 aa, Homo Sapiens
VSQHSENHT

SEQ ID NO: 1259543 - protein, 9 aa, Homo Sapiens
LAISFCGFV

SEQ ID NO: 1259544 - protein, 9 aa, Homo Sapiens
YTDQYVQEH

SEQ ID NO: 1259545 - protein, 9 aa, Homo Sapiens
VECITMSNS

SEQ ID NO: 1259546 - protein, 9 aa, Homo Sapiens
AFHLAIYTV

SEQ ID NO: 1259547 - protein, 9 aa, Homo Sapiens
SARICRNWR

SEQ ID NO: 1259548 - protein, 9 aa, Homo Sapiens
TNLEETRIA

SEQ ID NO: 1259549 - protein, 9 aa, Homo Sapiens
LEEVPSPVW

SEQ ID NO: 1259550 - protein, 9 aa, Homo Sapiens
APNHGLHLS

SEQ ID NO: 1259551 - protein, 9 aa, Homo Sapiens
IQVCSLERD

SEQ ID NO: 1259552 - protein, 9 aa, Homo Sapiens
KERPATDLS

SEQ ID NO: 1259553 - protein, 9 aa, Homo Sapiens
EKAVAFSTT

SEQ ID NO: 1259554 - protein, 9 aa, Homo Sapiens
DTKSPLYVP

SEQ ID NO: 1259555 - protein, 9 aa, Homo Sapiens
GVASQHSLP

SEQ ID NO: 1259556 - protein, 9 aa, Homo Sapiens
PGDIGYFAI

SEQ ID NO: 1259557 - protein, 9 aa, Homo Sapiens
ACKRRRMSP

SEQ ID NO: 1259558 - protein, 9 aa, Homo Sapiens
NRSVAPGFQ

SEQ ID NO: 1259559 - protein, 9 aa, Homo Sapiens
SSDRFHSFD

SEQ ID NO: 1259560 - protein, 9 aa, Homo Sapiens
IEKGETVQE

SEQ ID NO: 1259561 - protein, 9 aa, Homo Sapiens
SPPMLLKES

SEQ ID NO: 1259562 - protein, 9 aa, Homo Sapiens
CSTEAADPS

SEQ ID NO: 1259563 - protein, 9 aa, Homo Sapiens
EQRKISQEN

SEQ ID NO: 1259564 - protein, 9 aa, Homo Sapiens
MVHIINRKV

SEQ ID NO: 1259565 - protein, 9 aa, Homo Sapiens
SSADDNIKT

SEQ ID NO: 1259566 - protein, 9 aa, Homo Sapiens
QCMETTAQR

SEQ ID NO: 1259567 - protein, 9 aa, Homo Sapiens
EIDAFSWLG

SEQ ID NO: 1259568 - protein, 9 aa, Homo Sapiens
KNQGTGTKG

SEQ ID NO: 1259569 - protein, 9 aa, Homo Sapiens
AAHMWMVHI

SEQ ID NO: 1259570 - protein, 9 aa, Homo Sapiens
ELYCMVVPE

SEQ ID NO: 1259571 - protein, 9 aa, Homo Sapiens
HIFCKFCMM

SEQ ID NO: 1259572 - protein, 9 aa, Homo Sapiens
YPMIRNQRS

SEQ ID NO: 1259573 - protein, 9 aa, Homo Sapiens
GPDGATGDR

SEQ ID NO: 1259574 - protein, 9 aa, Homo Sapiens
VGQCMETTA

SEQ ID NO: 1259575 - protein, 9 aa, Homo Sapiens
RVTSLRYSP

SEQ ID NO: 1259576 - protein, 9 aa, Homo Sapiens
QPDVDHQKS

SEQ ID NO: 1259577 - protein, 9 aa, Homo Sapiens
VFFTLHIYH

SEQ ID NO: 1259578 - protein, 9 aa, Homo Sapiens
EVEPFKSMY

SEQ ID NO: 1259579 - protein, 9 aa, Homo Sapiens
ITKNVQQAR

SEQ ID NO: 1259580 - protein, 9 aa, Homo Sapiens
LDEVVAQEP

SEQ ID NO: 1259581 - protein, 9 aa, Homo Sapiens
TLLGNGGAA

SEQ ID NO: 1259582 - protein, 9 aa, Homo Sapiens
DSAQKNIYR

SEQ ID NO: 1259583 - protein, 9 aa, Homo Sapiens
SSRDDPSMS

SEQ ID NO: 1259584 - protein, 9 aa, Homo Sapiens
IWEELSVMD

SEQ ID NO: 1259585 - protein, 9 aa, Homo Sapiens
PLRALAEHL

SEQ ID NO: 1259586 - protein, 9 aa, Homo Sapiens
EVGGYDTFM

SEQ ID NO: 1259587 - protein, 9 aa, Homo Sapiens
QIYAVPWHG

SEQ ID NO: 1259588 - protein, 9 aa, Homo Sapiens
VNVFLCMNN

SEQ ID NO: 1259589 - protein, 9 aa, Homo Sapiens
HPMTNNAGR

SEQ ID NO: 1259590 - protein, 9 aa, Homo Sapiens
NAWLRQKND

SEQ ID NO: 1259591 - protein, 9 aa, Homo Sapiens
WGNLVMLGL

SEQ ID NO: 1259592 - protein, 9 aa, Homo Sapiens
SYMPPSTIL

SEQ ID NO: 1259593 - protein, 9 aa, Homo Sapiens
FVTSCNGYF

SEQ ID NO: 1259594 - protein, 9 aa, Homo Sapiens
QIDNNKSIG

SEQ ID NO: 1259595 - protein, 9 aa, Homo Sapiens
APAVEVGAG

SEQ ID NO: 1259596 - protein, 9 aa, Homo Sapiens
HWFGLVSRT

SEQ ID NO: 1259597 - protein, 9 aa, Homo Sapiens
MRHIPLTPG

SEQ ID NO: 1259598 - protein, 9 aa, Homo Sapiens
PQKKEKLHC

SEQ ID NO: 1259599 - protein, 9 aa, Homo Sapiens
SAFHHSVKA

SEQ ID NO: 1259600 - protein, 9 aa, Homo Sapiens
LESQELMRL

SEQ ID NO: 1259601 - protein, 9 aa, Homo Sapiens
DWSGCTLQK

SEQ ID NO: 1259602 - protein, 9 aa, Homo Sapiens
TSDSDSSTY

SEQ ID NO: 1259603 - protein, 9 aa, Homo Sapiens
IAMCDDDPP

SEQ ID NO: 1259604 - protein, 9 aa, Homo Sapiens
GGPCLPRRA

SEQ ID NO: 1259605 - protein, 9 aa, Homo Sapiens
KCNATSLQH

SEQ ID NO: 1259606 - protein, 9 aa, Homo Sapiens
SRHIFNQNN

SEQ ID NO: 1259607 - protein, 9 aa, Homo Sapiens
GFLIWKGPG

SEQ ID NO: 1259608 - protein, 9 aa, Homo Sapiens
TGASDSELM

SEQ ID NO: 1259609 - protein, 9 aa, Homo Sapiens
ANLDGQERC

SEQ ID NO: 1259610 - protein, 9 aa, Homo Sapiens
YGWTANMEW

SEQ ID NO: 1259611 - protein, 9 aa, Homo Sapiens
IDALGFYLP

SEQ ID NO: 1259612 - protein, 9 aa, Homo Sapiens
KQIRCNTQG

SEQ ID NO: 1259613 - protein, 9 aa, Homo Sapiens
INQVALEVW

SEQ ID NO: 1259614 - protein, 9 aa, Homo Sapiens
ENTFVKNVE

SEQ ID NO: 1259615 - protein, 9 aa, Homo Sapiens
KKSEAVWRM

SEQ ID NO: 1259616 - protein, 9 aa, Homo Sapiens
THIVFTDQV

SEQ ID NO: 1259617 - protein, 9 aa, Homo Sapiens
MDPNRAFIC

SEQ ID NO: 1259618 - protein, 9 aa, Homo Sapiens
CLDIDECRI

SEQ ID NO: 1259619 - protein, 9 aa, Homo Sapiens
LHLDQMPSR

SEQ ID NO: 1259620 - protein, 9 aa, Homo Sapiens
ASVVTSDKR

SEQ ID NO: 1259621 - protein, 9 aa, Homo Sapiens
NPGALEKEN

SEQ ID NO: 1259622 - protein, 9 aa, Homo Sapiens
SPSVAKTEI

SEQ ID NO: 1259623 - protein, 9 aa, Homo Sapiens
REMANAKET

SEQ ID NO: 1259624 - protein, 9 aa, Homo Sapiens
PQPWSLQSC

SEQ ID NO: 1259625 - protein, 9 aa, Homo Sapiens
VNKKKDKKH

SEQ ID NO: 1259626 - protein, 9 aa, Homo Sapiens
IPTARCCLY

SEQ ID NO: 1259627 - protein, 9 aa, Homo Sapiens
LIDAPHDDA

SEQ ID NO: 1259628 - protein, 9 aa, Homo Sapiens
IVIARALLK

SEQ ID NO: 1259629 - protein, 9 aa, Homo Sapiens
DIWGNTVNM

SEQ ID NO: 1259630 - protein, 9 aa, Homo Sapiens
VMTLAIPIA

SEQ ID NO: 1259631 - protein, 9 aa, Homo Sapiens
YRIIVCSTQ

SEQ ID NO: 1259632 - protein, 9 aa, Homo Sapiens
EAQAQHLAQ

SEQ ID NO: 1259633 - protein, 9 aa, Homo Sapiens
FLRFFAPTI

SEQ ID NO: 1259634 - protein, 9 aa, Homo Sapiens
ERVWGLGLP

SEQ ID NO: 1259635 - protein, 9 aa, Homo Sapiens
DNSHLFALR

SEQ ID NO: 1259636 - protein, 9 aa, Homo Sapiens
KSMGNLNLP

SEQ ID NO: 1259637 - protein, 9 aa, Homo Sapiens
DKMQYFKRT

SEQ ID NO: 1259638 - protein, 9 aa, Homo Sapiens
SAVDTDGND

SEQ ID NO: 1259639 - protein, 9 aa, Homo Sapiens
PPTLRCSAA

SEQ ID NO: 1259640 - protein, 9 aa, Homo Sapiens
APPRKPEPL

SEQ ID NO: 1259641 - protein, 9 aa, Homo Sapiens
SVTWSVTLD

SEQ ID NO: 1259642 - protein, 9 aa, Homo Sapiens
IPDPLDVID

SEQ ID NO: 1259643 - protein, 9 aa, Homo Sapiens
PDSVSWPGC

SEQ ID NO: 1259644 - protein, 9 aa, Homo Sapiens
RSKAGSGSV

SEQ ID NO: 1259645 - protein, 9 aa, Homo Sapiens
LPAFLAMSF

SEQ ID NO: 1259646 - protein, 9 aa, Homo Sapiens
MICGHAPFE

SEQ ID NO: 1259647 - protein, 9 aa, Homo Sapiens
AVENGTVTD

SEQ ID NO: 1259648 - protein, 9 aa, Homo Sapiens
VQGNACISC

SEQ ID NO: 1259649 - protein, 9 aa, Homo Sapiens
SSCHRPFHL

SEQ ID NO: 1259650 - protein, 9 aa, Homo Sapiens
WLFGYDEQW

SEQ ID NO: 1259651 - protein, 9 aa, Homo Sapiens
GARVKQGKY

SEQ ID NO: 1259652 - protein, 9 aa, Homo Sapiens
MQGPRTRPQ

SEQ ID NO: 1259653 - protein, 9 aa, Homo Sapiens
GPPLAPSPH

SEQ ID NO: 1259654 - protein, 9 aa, Homo Sapiens
KKEYQIFPP

SEQ ID NO: 1259655 - protein, 9 aa, Homo Sapiens
KTAASKRKN

SEQ ID NO: 1259656 - protein, 9 aa, Homo Sapiens
FFLSQCQRD

SEQ ID NO: 1259657 - protein, 9 aa, Homo Sapiens
CRWEALATH

SEQ ID NO: 1259658 - protein, 9 aa, Homo Sapiens
YCNPLASLL

SEQ ID NO: 1259659 - protein, 9 aa, Homo Sapiens
QEHIEAILD

SEQ ID NO: 1259660 - protein, 9 aa, Homo Sapiens
EESPGRKAL

SEQ ID NO: 1259661 - protein, 9 aa, Homo Sapiens
LPSMLRDDA

SEQ ID NO: 1259662 - protein, 9 aa, Homo Sapiens
LRTQCPAMV

SEQ ID NO: 1259663 - protein, 9 aa, Homo Sapiens
DKLEHKTKS

SEQ ID NO: 1259664 - protein, 9 aa, Homo Sapiens
TVHYPVSSN

SEQ ID NO: 1259665 - protein, 9 aa, Homo Sapiens
GSRIVWMPR

SEQ ID NO: 1259666 - protein, 9 aa, Homo Sapiens
KVFMYPAVG

SEQ ID NO: 1259667 - protein, 9 aa, Homo Sapiens
LLGVLQRML

SEQ ID NO: 1259668 - protein, 9 aa, Homo Sapiens
ANGTAQSGV

SEQ ID NO: 1259669 - protein, 9 aa, Homo Sapiens
NPLYCESVH

SEQ ID NO: 1259670 - protein, 9 aa, Homo Sapiens
SLSGPDSSE

SEQ ID NO: 1259671 - protein, 9 aa, Homo Sapiens
AVRRVAQVQ

SEQ ID NO: 1259672 - protein, 9 aa, Homo Sapiens
SQELMRLFG

SEQ ID NO: 1259673 - protein, 9 aa, Homo Sapiens
TYHVTSSVT

SEQ ID NO: 1259674 - protein, 9 aa, Homo Sapiens
EESKKGLNQ

SEQ ID NO: 1259675 - protein, 9 aa, Homo Sapiens
AGRRSGGRM

SEQ ID NO: 1259676 - protein, 9 aa, Homo Sapiens
MVLRNLSMD

SEQ ID NO: 1259677 - protein, 9 aa, Homo Sapiens
AQLDVHEKT

SEQ ID NO: 1259678 - protein, 9 aa, Homo Sapiens
PSVAERLHH

SEQ ID NO: 1259679 - protein, 9 aa, Homo Sapiens
DGNEQISVM

SEQ ID NO: 1259680 - protein, 9 aa, Homo Sapiens
PGSIHTTAF

SEQ ID NO: 1259681 - protein, 9 aa, Homo Sapiens
TKNVQQARS

SEQ ID NO: 1259682 - protein, 9 aa, Homo Sapiens
MNLQTATST

SEQ ID NO: 1259683 - protein, 9 aa, Homo Sapiens
CLPLLEMYS

SEQ ID NO: 1259684 - protein, 9 aa, Homo Sapiens
LQTNMAKLL

SEQ ID NO: 1259685 - protein, 9 aa, Homo Sapiens
PSNPDPDGR

SEQ ID NO: 1259686 - protein, 9 aa, Homo Sapiens
NCDVCGSDP

SEQ ID NO: 1259687 - protein, 9 aa, Homo Sapiens
QCCAYYNMI

SEQ ID NO: 1259688 - protein, 9 aa, Homo Sapiens
LDDLRDCIA

SEQ ID NO: 1259689 - protein, 9 aa, Homo Sapiens
DKAQIEKCI

SEQ ID NO: 1259690 - protein, 9 aa, Homo Sapiens
ESDLELDKE

SEQ ID NO: 1259691 - protein, 9 aa, Homo Sapiens
KVLCFFKHD

SEQ ID NO: 1259692 - protein, 9 aa, Homo Sapiens
LSDQTVLFQ

SEQ ID NO: 1259693 - protein, 9 aa, Homo Sapiens
IIDDTWWFG

SEQ ID NO: 1259694 - protein, 9 aa, Homo Sapiens
NAIGPWIQV

SEQ ID NO: 1259695 - protein, 9 aa, Homo Sapiens
PQPKCWQQD

SEQ ID NO: 1259696 - protein, 9 aa, Homo Sapiens
PPDAQDITS

SEQ ID NO: 1259697 - protein, 9 aa, Homo Sapiens
PGPEKMLDQ

SEQ ID NO: 1259698 - protein, 9 aa, Homo Sapiens
LLRAASGVP

SEQ ID NO: 1259699 - protein, 9 aa, Homo Sapiens
LQCLSVVFK

SEQ ID NO: 1259700 - protein, 9 aa, Homo Sapiens
KLHVAALVA

SEQ ID NO: 1259701 - protein, 9 aa, Homo Sapiens
PTPGSCPVG

SEQ ID NO: 1259702 - protein, 9 aa, Homo Sapiens
ALVEQSQKR

SEQ ID NO: 1259703 - protein, 9 aa, Homo Sapiens
KFVGFIVVF

SEQ ID NO: 1259704 - protein, 9 aa, Homo Sapiens
LKASIKGVP

SEQ ID NO: 1259705 - protein, 9 aa, Homo Sapiens
IGCWLGCLA

SEQ ID NO: 1259706 - protein, 9 aa, Homo Sapiens
ETEATNVIL

SEQ ID NO: 1259707 - protein, 9 aa, Homo Sapiens
GSREDHHLP

SEQ ID NO: 1259708 - protein, 9 aa, Homo Sapiens
LLRWMRRKG

SEQ ID NO: 1259709 - protein, 9 aa, Homo Sapiens
SHLTIVILF

SEQ ID NO: 1259710 - protein, 9 aa, Homo Sapiens
IITVTDLGT

SEQ ID NO: 1259711 - protein, 9 aa, Homo Sapiens
YQLKGRKYM

SEQ ID NO: 1259712 - protein, 9 aa, Homo Sapiens
KRTHYYQIM

SEQ ID NO: 1259713 - protein, 9 aa, Homo Sapiens
TLASMVLSL

SEQ ID NO: 1259714 - protein, 9 aa, Homo Sapiens
SQVMTHLHM

SEQ ID NO: 1259715 - protein, 9 aa, Homo Sapiens
LGLARTSAG

SEQ ID NO: 1259716 - protein, 9 aa, Homo Sapiens
LISDQDVCK

SEQ ID NO: 1259717 - protein, 9 aa, Homo Sapiens
PEPLREEGI

SEQ ID NO: 1259718 - protein, 9 aa, Homo Sapiens
GSKHGTYVM

SEQ ID NO: 1259719 - protein, 9 aa, Homo Sapiens
ENIILDSVG

SEQ ID NO: 1259720 - protein, 9 aa, Homo Sapiens
LCFLVPTFL

SEQ ID NO: 1259721 - protein, 9 aa, Homo Sapiens
NEAMARVQR

SEQ ID NO: 1259722 - protein, 9 aa, Homo Sapiens
QSEGSDSAI

SEQ ID NO: 1259723 - protein, 9 aa, Homo Sapiens
LTGHSFHMS

SEQ ID NO: 1259724 - protein, 9 aa, Homo Sapiens
RGPAKCCEC

SEQ ID NO: 1259725 - protein, 9 aa, Homo Sapiens
AASQEATAP

SEQ ID NO: 1259726 - protein, 9 aa, Homo Sapiens
RKTGRKVAL

SEQ ID NO: 1259727 - protein, 9 aa, Homo Sapiens
FSQAKRNNI

SEQ ID NO: 1259728 - protein, 9 aa, Homo Sapiens
NIEAFNSCR

SEQ ID NO: 1259729 - protein, 9 aa, Homo Sapiens
AGGVRTREL

SEQ ID NO: 1259730 - protein, 9 aa, Homo Sapiens
NWRKGENEY

SEQ ID NO: 1259731 - protein, 9 aa, Homo Sapiens
RHMEFLVEP

SEQ ID NO: 1259732 - protein, 9 aa, Homo Sapiens
DIMYNEEMN

SEQ ID NO: 1259733 - protein, 9 aa, Homo Sapiens
CPKGLGFSI

SEQ ID NO: 1259734 - protein, 9 aa, Homo Sapiens
HCVVNDTKS

SEQ ID NO: 1259735 - protein, 9 aa, Homo Sapiens
DSSMACSPE

SEQ ID NO: 1259736 - protein, 9 aa, Homo Sapiens
TLVSTNLTS

SEQ ID NO: 1259737 - protein, 9 aa, Homo Sapiens
MGHLITGAT

SEQ ID NO: 1259738 - protein, 9 aa, Homo Sapiens
TGTNMHGMK

SEQ ID NO: 1259739 - protein, 9 aa, Homo Sapiens
RYVGAALGR

SEQ ID NO: 1259740 - protein, 9 aa, Homo Sapiens
EQAKAKDAG

SEQ ID NO: 1259741 - protein, 9 aa, Homo Sapiens
HRTSEPHGN

SEQ ID NO: 1259742 - protein, 9 aa, Homo Sapiens
QLWHLWLDD

SEQ ID NO: 1259743 - protein, 9 aa, Homo Sapiens
NKKKLGQST

SEQ ID NO: 1259744 - protein, 9 aa, Homo Sapiens
LKHGYLEAT

SEQ ID NO: 1259745 - protein, 9 aa, Homo Sapiens
PLKEGADHH

SEQ ID NO: 1259746 - protein, 9 aa, Homo Sapiens
IIKESNILE

SEQ ID NO: 1259747 - protein, 9 aa, Homo Sapiens
CRQVTRAGI

SEQ ID NO: 1259748 - protein, 9 aa, Homo Sapiens
AVYLPNCDC

SEQ ID NO: 1259749 - protein, 9 aa, Homo Sapiens
KNYKCYIKN

SEQ ID NO: 1259750 - protein, 9 aa, Homo Sapiens
GNIEHLVIT

SEQ ID NO: 1259751 - protein, 9 aa, Homo Sapiens
SGCPMYEGK

SEQ ID NO: 1259752 - protein, 9 aa, Homo Sapiens
HFLTLPDSL

SEQ ID NO: 1259753 - protein, 9 aa, Homo Sapiens
PKKLKGKLK

SEQ ID NO: 1259754 - protein, 9 aa, Homo Sapiens
VLDHLKATH

SEQ ID NO: 1259755 - protein, 9 aa, Homo Sapiens
LPHGNVLVR

SEQ ID NO: 1259756 - protein, 9 aa, Homo Sapiens
PTPVVQFHP

SEQ ID NO: 1259757 - protein, 9 aa, Homo Sapiens
TIPAKQTQT

SEQ ID NO: 1259758 - protein, 9 aa, Homo Sapiens
TAPAPKFSP

SEQ ID NO: 1259759 - protein, 9 aa, Homo Sapiens
NENIRKEKN

SEQ ID NO: 1259760 - protein, 9 aa, Homo Sapiens
SSKKVVVSP

SEQ ID NO: 1259761 - protein, 9 aa, Homo Sapiens
RKISQENVK

SEQ ID NO: 1259762 - protein, 9 aa, Homo Sapiens
IYMLNLAIS

SEQ ID NO: 1259763 - protein, 9 aa, Homo Sapiens
KCTSVSQHW

SEQ ID NO: 1259764 - protein, 9 aa, Homo Sapiens
HENKTYLDV

SEQ ID NO: 1259765 - protein, 9 aa, Homo Sapiens
QLHVGGPVP

SEQ ID NO: 1259766 - protein, 9 aa, Homo Sapiens
EADVQAISG

SEQ ID NO: 1259767 - protein, 9 aa, Homo Sapiens
GPEMAASPS

SEQ ID NO: 1259768 - protein, 9 aa, Homo Sapiens
KTDLHFQSS

SEQ ID NO: 1259769 - protein, 9 aa, Homo Sapiens
VNCKKNDET

SEQ ID NO: 1259770 - protein, 9 aa, Homo Sapiens
ADASRSLEF

SEQ ID NO: 1259771 - protein, 9 aa, Homo Sapiens
DCVAEGMWL

SEQ ID NO: 1259772 - protein, 9 aa, Homo Sapiens
YYGYEEYYD

SEQ ID NO: 1259773 - protein, 9 aa, Homo Sapiens
LRRMYTAIQ

SEQ ID NO: 1259774 - protein, 9 aa, Homo Sapiens
PFLYDNATD

SEQ ID NO: 1259775 - protein, 9 aa, Homo Sapiens
QVRVPYHVV

SEQ ID NO: 1259776 - protein, 9 aa, Homo Sapiens
VWEQVTPQT

SEQ ID NO: 1259777 - protein, 9 aa, Homo Sapiens
GLIKVFRSL

SEQ ID NO: 1259778 - protein, 9 aa, Homo Sapiens
DIDATQLQC

SEQ ID NO: 1259779 - protein, 9 aa, Homo Sapiens
GHHPFKHDI

SEQ ID NO: 1259780 - protein, 9 aa, Homo Sapiens
STGDQTLEV

SEQ ID NO: 1259781 - protein, 9 aa, Homo Sapiens
RVRTSFFGK

SEQ ID NO: 1259782 - protein, 9 aa, Homo Sapiens
SIEPGGIGI

SEQ ID NO: 1259783 - protein, 9 aa, Homo Sapiens
QPQPLLQHP

SEQ ID NO: 1259784 - protein, 9 aa, Homo Sapiens
HRVSQEPWN

SEQ ID NO: 1259785 - protein, 9 aa, Homo Sapiens
KLDLYTTEQ

SEQ ID NO: 1259786 - protein, 9 aa, Homo Sapiens
EVVQRFLCL

SEQ ID NO: 1259787 - protein, 9 aa, Homo Sapiens
TAPAASLEV

SEQ ID NO: 1259788 - protein, 9 aa, Homo Sapiens
KNILSEIGK

SEQ ID NO: 1259789 - protein, 9 aa, Homo Sapiens
NTKHFPKGM

SEQ ID NO: 1259790 - protein, 9 aa, Homo Sapiens
GDQQLHEVY

SEQ ID NO: 1259791 - protein, 9 aa, Homo Sapiens
KKVTHILKS

SEQ ID NO: 1259792 - protein, 9 aa, Homo Sapiens
HPKKIRLQE

SEQ ID NO: 1259793 - protein, 9 aa, Homo Sapiens
LWEVLRKMG

SEQ ID NO: 1259794 - protein, 9 aa, Homo Sapiens
RRMADVPVT

SEQ ID NO: 1259795 - protein, 9 aa, Homo Sapiens
TVIEVELQF

SEQ ID NO: 1259796 - protein, 9 aa, Homo Sapiens
MRLFGIPYI

SEQ ID NO: 1259797 - protein, 9 aa, Homo Sapiens
HVANPVVNA

SEQ ID NO: 1259798 - protein, 9 aa, Homo Sapiens
GRMMQAFVT

SEQ ID NO: 1259799 - protein, 9 aa, Homo Sapiens
APMTEGTHC

SEQ ID NO: 1259800 - protein, 9 aa, Homo Sapiens
IRQTRSLSV

SEQ ID NO: 1259801 - protein, 9 aa, Homo Sapiens
IPTCRDVGP

SEQ ID NO: 1259802 - protein, 9 aa, Homo Sapiens
EAIVKRSDG

SEQ ID NO: 1259803 - protein, 9 aa, Homo Sapiens
AGAEAVRGA

SEQ ID NO: 1259804 - protein, 9 aa, Homo Sapiens
PQSKNALFE

SEQ ID NO: 1259805 - protein, 9 aa, Homo Sapiens
NRHMKSHTE

SEQ ID NO: 1259806 - protein, 9 aa, Homo Sapiens
ICGSFLLRA

SEQ ID NO: 1259807 - protein, 9 aa, Homo Sapiens
RDVMPQLLK

SEQ ID NO: 1259808 - protein, 9 aa, Homo Sapiens
QQTRMLLAN

SEQ ID NO: 1259809 - protein, 9 aa, Homo Sapiens
RGFTAMNRI

SEQ ID NO: 1259810 - protein, 9 aa, Homo Sapiens
CEEDMLDGH

SEQ ID NO: 1259811 - protein, 9 aa, Homo Sapiens
CQCLKDISL

SEQ ID NO: 1259812 - protein, 9 aa, Homo Sapiens
ELRERVTQD

SEQ ID NO: 1259813 - protein, 9 aa, Homo Sapiens
NQGISLLLH

SEQ ID NO: 1259814 - protein, 9 aa, Homo Sapiens
MFDAEKIRS

SEQ ID NO: 1259815 - protein, 9 aa, Homo Sapiens
ISDAPVTGT

SEQ ID NO: 1259816 - protein, 9 aa, Homo Sapiens
AEQDCLALE

SEQ ID NO: 1259817 - protein, 9 aa, Homo Sapiens
GKKKKYIKA

SEQ ID NO: 1259818 - protein, 9 aa, Homo Sapiens
DLDDSVSSS

SEQ ID NO: 1259819 - protein, 9 aa, Homo Sapiens
SLLIGTAWG

SEQ ID NO: 1259820 - protein, 9 aa, Homo Sapiens
VIAKDSQKK

SEQ ID NO: 1259821 - protein, 9 aa, Homo Sapiens
SPKELGRDR

SEQ ID NO: 1259822 - protein, 9 aa, Homo Sapiens
LAGNSTSPW

SEQ ID NO: 1259823 - protein, 9 aa, Homo Sapiens
CLQPKAAEG

SEQ ID NO: 1259824 - protein, 9 aa, Homo Sapiens
KCNSGQFLD

SEQ ID NO: 1259825 - protein, 9 aa, Homo Sapiens
CILFVNSRI

SEQ ID NO: 1259826 - protein, 9 aa, Homo Sapiens
EEYYDDYYG

SEQ ID NO: 1259827 - protein, 9 aa, Homo Sapiens
RYTKLSYCV

SEQ ID NO: 1259828 - protein, 9 aa, Homo Sapiens
GFDQDMVNK

SEQ ID NO: 1259829 - protein, 9 aa, Homo Sapiens
QEVHRHTNA

SEQ ID NO: 1259830 - protein, 9 aa, Homo Sapiens
SSTLNLANT

SEQ ID NO: 1259831 - protein, 9 aa, Homo Sapiens
EMLSLKVTE

SEQ ID NO: 1259832 - protein, 9 aa, Homo Sapiens
LQGECVRGL

SEQ ID NO: 1259833 - protein, 9 aa, Homo Sapiens
TAAGPRPRA

SEQ ID NO: 1259834 - protein, 9 aa, Homo Sapiens
AHPQVVMYV

SEQ ID NO: 1259835 - protein, 9 aa, Homo Sapiens
EGPGPSLGY

SEQ ID NO: 1259836 - protein, 9 aa, Homo Sapiens
VSVVALFVL

SEQ ID NO: 1259837 - protein, 9 aa, Homo Sapiens
RLIRPEYVW

SEQ ID NO: 1259838 - protein, 9 aa, Homo Sapiens
EWRRCRETA

SEQ ID NO: 1259839 - protein, 9 aa, Homo Sapiens
FFFWDYDNA

SEQ ID NO: 1259840 - protein, 9 aa, Homo Sapiens
PEPPPAHPR

SEQ ID NO: 1259841 - protein, 9 aa, Homo Sapiens
DYKRLWAGS

SEQ ID NO: 1259842 - protein, 9 aa, Homo Sapiens
QTQSRTASP

SEQ ID NO: 1259843 - protein, 9 aa, Homo Sapiens
QPKSHYFLR

SEQ ID NO: 1259844 - protein, 9 aa, Homo Sapiens
FTTAHNTLG

SEQ ID NO: 1259845 - protein, 9 aa, Homo Sapiens
KRKKEPSCK

SEQ ID NO: 1259846 - protein, 9 aa, Homo Sapiens
VWSCSSGNK

SEQ ID NO: 1259847 - protein, 9 aa, Homo Sapiens
MKTCFIPNR

SEQ ID NO: 1259848 - protein, 9 aa, Homo Sapiens
VAWLGLNVF

SEQ ID NO: 1259849 - protein, 9 aa, Homo Sapiens
QSVMNSPTT

SEQ ID NO: 1259850 - protein, 9 aa, Homo Sapiens
DSQTFITIG

SEQ ID NO: 1259851 - protein, 9 aa, Homo Sapiens
LADLLLSVF

SEQ ID NO: 1259852 - protein, 9 aa, Homo Sapiens
GYVCYEPGH

SEQ ID NO: 1259853 - protein, 9 aa, Homo Sapiens
VTSCKTPFL

SEQ ID NO: 1259854 - protein, 9 aa, Homo Sapiens
TYMSVDDLR

SEQ ID NO: 1259855 - protein, 9 aa, Homo Sapiens
DIIKIQKEK

SEQ ID NO: 1259856 - protein, 9 aa, Homo Sapiens
VIELSCMDT

SEQ ID NO: 1259857 - protein, 9 aa, Homo Sapiens
DILKALVRY

SEQ ID NO: 1259858 - protein, 9 aa, Homo Sapiens
GMYCRETCN

SEQ ID NO: 1259859 - protein, 9 aa, Homo Sapiens
EREMSKGLK

SEQ ID NO: 1259860 - protein, 9 aa, Homo Sapiens
PDSVDIERM

SEQ ID NO: 1259861 - protein, 9 aa, Homo Sapiens
PDRCDNTAG

SEQ ID NO: 1259862 - protein, 9 aa, Homo Sapiens
WRPNTYYKV

SEQ ID NO: 1259863 - protein, 9 aa, Homo Sapiens
LEGGNGMDS

SEQ ID NO: 1259864 - protein, 9 aa, Homo Sapiens
QESGSQEDA

SEQ ID NO: 1259865 - protein, 9 aa, Homo Sapiens
AALWTWEMP

SEQ ID NO: 1259866 - protein, 9 aa, Homo Sapiens
PHTAVKNFM

SEQ ID NO: 1259867 - protein, 9 aa, Homo Sapiens
YNAAQAGES

SEQ ID NO: 1259868 - protein, 9 aa, Homo Sapiens
TSPRSLVKH

SEQ ID NO: 1259869 - protein, 9 aa, Homo Sapiens
EPEGGFNKW

SEQ ID NO: 1259870 - protein, 9 aa, Homo Sapiens
ATHALEEHQ

SEQ ID NO: 1259871 - protein, 9 aa, Homo Sapiens
LPPWPVEGS

SEQ ID NO: 1259872 - protein, 9 aa, Homo Sapiens
SYVFIHLWA

SEQ ID NO: 1259873 - protein, 9 aa, Homo Sapiens
CPMYEGKMK

SEQ ID NO: 1259874 - protein, 9 aa, Homo Sapiens
KASNSKATF

SEQ ID NO: 1259875 - protein, 9 aa, Homo Sapiens
CLPDEDAFW

SEQ ID NO: 1259876 - protein, 9 aa, Homo Sapiens
SRYLSKGVE

SEQ ID NO: 1259877 - protein, 9 aa, Homo Sapiens
LGLEQPLTL

SEQ ID NO: 1259878 - protein, 9 aa, Homo Sapiens
VTVLCDIKQ

SEQ ID NO: 1259879 - protein, 9 aa, Homo Sapiens
LALQGDMPT

SEQ ID NO: 1259880 - protein, 9 aa, Homo Sapiens
LVGFVICVP

SEQ ID NO: 1259881 - protein, 9 aa, Homo Sapiens
TKKLHHLGN

SEQ ID NO: 1259882 - protein, 9 aa, Homo Sapiens
EMMLKEMQK

SEQ ID NO: 1259883 - protein, 9 aa, Homo Sapiens
DNFYVIDIG

SEQ ID NO: 1259884 - protein, 9 aa, Homo Sapiens
QTLEIHFHE

SEQ ID NO: 1259885 - protein, 9 aa, Homo Sapiens
RKLNMCLYC

SEQ ID NO: 1259886 - protein, 9 aa, Homo Sapiens
TVQVTEKTR

SEQ ID NO: 1259887 - protein, 9 aa, Homo Sapiens
SLGSLLEHH

SEQ ID NO: 1259888 - protein, 9 aa, Homo Sapiens
PEATNRHVW

SEQ ID NO: 1259889 - protein, 9 aa, Homo Sapiens
NWNFLPMWM

SEQ ID NO: 1259890 - protein, 9 aa, Homo Sapiens
IEYISYCWV

SEQ ID NO: 1259891 - protein, 9 aa, Homo Sapiens
LMDRGDTCH

SEQ ID NO: 1259892 - protein, 9 aa, Homo Sapiens
CHSFCRRRR

SEQ ID NO: 1259893 - protein, 9 aa, Homo Sapiens
PRSDTSLTA

SEQ ID NO: 1259894 - protein, 9 aa, Homo Sapiens
LKKSLEDVA

SEQ ID NO: 1259895 - protein, 9 aa, Homo Sapiens
LFQAEGNIS

SEQ ID NO: 1259896 - protein, 9 aa, Homo Sapiens
GHLCEAPSP

SEQ ID NO: 1259897 - protein, 9 aa, Homo Sapiens
YTDRILYRS

SEQ ID NO: 1259898 - protein, 9 aa, Homo Sapiens
QGRQTQSRT

SEQ ID NO: 1259899 - protein, 9 aa, Homo Sapiens
HWRDHTGEN

SEQ ID NO: 1259900 - protein, 9 aa, Homo Sapiens
QMVAQPQGL

SEQ ID NO: 1259901 - protein, 9 aa, Homo Sapiens
DLHFQSSAV

SEQ ID NO: 1259902 - protein, 9 aa, Homo Sapiens
TDIQETHRQ

SEQ ID NO: 1259903 - protein, 9 aa, Homo Sapiens
VRPVCLPAH

SEQ ID NO: 1259904 - protein, 9 aa, Homo Sapiens
ITRNHTQGD

SEQ ID NO: 1259905 - protein, 9 aa, Homo Sapiens
SLEHAIDLR

SEQ ID NO: 1259906 - protein, 9 aa, Homo Sapiens
SAGLRHNPA

SEQ ID NO: 1259907 - protein, 9 aa, Homo Sapiens
PSINALLQV

SEQ ID NO: 1259908 - protein, 9 aa, Homo Sapiens
VGSEAYSKK

SEQ ID NO: 1259909 - protein, 9 aa, Homo Sapiens
NEKIERLNA

SEQ ID NO: 1259910 - protein, 9 aa, Homo Sapiens
NNSTSALED

SEQ ID NO: 1259911 - protein, 9 aa, Homo Sapiens
IATIVTVMC

SEQ ID NO: 1259912 - protein, 9 aa, Homo Sapiens
IFHTKDFQD

SEQ ID NO: 1259913 - protein, 9 aa, Homo Sapiens
HQHFGRPRW

SEQ ID NO: 1259914 - protein, 9 aa, Homo Sapiens
HPHPQFAPP

SEQ ID NO: 1259915 - protein, 9 aa, Homo Sapiens
FHHIDSVYV

SEQ ID NO: 1259916 - protein, 9 aa, Homo Sapiens
VGRAGPRPR

SEQ ID NO: 1259917 - protein, 9 aa, Homo Sapiens
HISLQFDFF

SEQ ID NO: 1259918 - protein, 9 aa, Homo Sapiens
FDETELQGK

SEQ ID NO: 1259919 - protein, 9 aa, Homo Sapiens
MERSKTCGD

SEQ ID NO: 1259920 - protein, 9 aa, Homo Sapiens
AIKGPENEE

SEQ ID NO: 1259921 - protein, 9 aa, Homo Sapiens
HLHNDIIFT

SEQ ID NO: 1259922 - protein, 9 aa, Homo Sapiens
GYIQGMSDL

SEQ ID NO: 1259923 - protein, 9 aa, Homo Sapiens
GALRAHMAQ

SEQ ID NO: 1259924 - protein, 9 aa, Homo Sapiens
YILCKSFDI

SEQ ID NO: 1259925 - protein, 9 aa, Homo Sapiens
DTCAPGGIL

SEQ ID NO: 1259926 - protein, 9 aa, Homo Sapiens
QKTLTLLNP

SEQ ID NO: 1259927 - protein, 9 aa, Homo Sapiens
EWKNDKRSA

SEQ ID NO: 1259928 - protein, 9 aa, Homo Sapiens
PTTVFVQIM

SEQ ID NO: 1259929 - protein, 9 aa, Homo Sapiens
FFSMFGELT

SEQ ID NO: 1259930 - protein, 9 aa, Homo Sapiens
KYPMIRNQR

SEQ ID NO: 1259931 - protein, 9 aa, Homo Sapiens
QFWSSPSDP

SEQ ID NO: 1259932 - protein, 9 aa, Homo Sapiens
FLTKEDYAV

SEQ ID NO: 1259933 - protein, 9 aa, Homo Sapiens
TVHFKCRHP

SEQ ID NO: 1259934 - protein, 9 aa, Homo Sapiens
DRFYWNDGL

SEQ ID NO: 1259935 - protein, 9 aa, Homo Sapiens
QPYHMLRTR

SEQ ID NO: 1259936 - protein, 9 aa, Homo Sapiens
GRVVSAIQD

SEQ ID NO: 1259937 - protein, 9 aa, Homo Sapiens
PIGEFRSNV

SEQ ID NO: 1259938 - protein, 9 aa, Homo Sapiens
VCLSVTIFS

SEQ ID NO: 1259939 - protein, 9 aa, Homo Sapiens
LVTSCGPLR

SEQ ID NO: 1259940 - protein, 9 aa, Homo Sapiens
QTFLDDDSP

SEQ ID NO: 1259941 - protein, 9 aa, Homo Sapiens
DELVDPLTT

SEQ ID NO: 1259942 - protein, 9 aa, Homo Sapiens
ESEKKNPGA

SEQ ID NO: 1259943 - protein, 9 aa, Homo Sapiens
KEVKENYVI

SEQ ID NO: 1259944 - protein, 9 aa, Homo Sapiens
RNPWSCIFF

SEQ ID NO: 1259945 - protein, 9 aa, Homo Sapiens
YDGCYLITA

SEQ ID NO: 1259946 - protein, 9 aa, Homo Sapiens
FYYNVIITW

SEQ ID NO: 1259947 - protein, 9 aa, Homo Sapiens
LCQQWGCCG

SEQ ID NO: 1259948 - protein, 9 aa, Homo Sapiens
VENGTVTDR

SEQ ID NO: 1259949 - protein, 9 aa, Homo Sapiens
LTKKLHHLG

SEQ ID NO: 1259950 - protein, 9 aa, Homo Sapiens
GPNAWRPLE

SEQ ID NO: 1259951 - protein, 9 aa, Homo Sapiens
FPNHLPQLM

SEQ ID NO: 1259952 - protein, 9 aa, Homo Sapiens
SIWALILGI

SEQ ID NO: 1259953 - protein, 9 aa, Homo Sapiens
DPGNRGTDG

SEQ ID NO: 1259954 - protein, 9 aa, Homo Sapiens
KDSSANWDE

SEQ ID NO: 1259955 - protein, 9 aa, Homo Sapiens
FYVTALFSV

SEQ ID NO: 1259956 - protein, 9 aa, Homo Sapiens
VVHVTVFDL

SEQ ID NO: 1259957 - protein, 9 aa, Homo Sapiens
DDKNPCIFF

SEQ ID NO: 1259958 - protein, 9 aa, Homo Sapiens
KGTVDCVHA

SEQ ID NO: 1259959 - protein, 9 aa, Homo Sapiens
TKNEISAPF

SEQ ID NO: 1259960 - protein, 9 aa, Homo Sapiens
GVVHMSFGV

SEQ ID NO: 1259961 - protein, 9 aa, Homo Sapiens
SPPASSCSS

SEQ ID NO: 1259962 - protein, 9 aa, Homo Sapiens
IDQYVDYLV

SEQ ID NO: 1259963 - protein, 9 aa, Homo Sapiens
PKASHCSKQ

SEQ ID NO: 1259964 - protein, 9 aa, Homo Sapiens
LVEFEFHTT

SEQ ID NO: 1259965 - protein, 9 aa, Homo Sapiens
VPGRHVEVS

SEQ ID NO: 1259966 - protein, 9 aa, Homo Sapiens
LQHWPVLQK

SEQ ID NO: 1259967 - protein, 9 aa, Homo Sapiens
FPLAVDMTA

SEQ ID NO: 1259968 - protein, 9 aa, Homo Sapiens
LQGYDKGVE

SEQ ID NO: 1259969 - protein, 9 aa, Homo Sapiens
IGPCKRCKM

SEQ ID NO: 1259970 - protein, 9 aa, Homo Sapiens
ACVVHLLND

SEQ ID NO: 1259971 - protein, 9 aa, Homo Sapiens
LQAKYKNTT

SEQ ID NO: 1259972 - protein, 9 aa, Homo Sapiens
DAGEQREVG

SEQ ID NO: 1259973 - protein, 9 aa, Homo Sapiens
SQKLGRWCA

SEQ ID NO: 1259974 - protein, 9 aa, Homo Sapiens
HMSYSMAIL

SEQ ID NO: 1259975 - protein, 9 aa, Homo Sapiens
TQGITSSDF

SEQ ID NO: 1259976 - protein, 9 aa, Homo Sapiens
GGGLPYLDH

SEQ ID NO: 1259977 - protein, 9 aa, Homo Sapiens
HQPPRVLMK

SEQ ID NO: 1259978 - protein, 9 aa, Homo Sapiens
ISRILLSSM

SEQ ID NO: 1259979 - protein, 9 aa, Homo Sapiens
AIDHNSPFF

SEQ ID NO: 1259980 - protein, 9 aa, Homo Sapiens
DSLGIYNCW

SEQ ID NO: 1259981 - protein, 9 aa, Homo Sapiens
NYTPKVIEC

SEQ ID NO: 1259982 - protein, 9 aa, Homo Sapiens
IMHPRFCVS

SEQ ID NO: 1259983 - protein, 9 aa, Homo Sapiens
AHLTRCLIL

SEQ ID NO: 1259984 - protein, 9 aa, Homo Sapiens
QYNAVVGAG

SEQ ID NO: 1259985 - protein, 9 aa, Homo Sapiens
VVYYDDRFI

SEQ ID NO: 1259986 - protein, 9 aa, Homo Sapiens
KSNCGVDCS

SEQ ID NO: 1259987 - protein, 9 aa, Homo Sapiens
CQKRIDTYV

SEQ ID NO: 1259988 - protein, 9 aa, Homo Sapiens
YTEMGERLV

SEQ ID NO: 1259989 - protein, 9 aa, Homo Sapiens
GMEHQQTGL

SEQ ID NO: 1259990 - protein, 9 aa, Homo Sapiens
SQLTCDSAQ

SEQ ID NO: 1259991 - protein, 9 aa, Homo Sapiens
INVFQEDSV

SEQ ID NO: 1259992 - protein, 9 aa, Homo Sapiens
CIMNSFVND

SEQ ID NO: 1259993 - protein, 9 aa, Homo Sapiens
FWYSLTNDI

SEQ ID NO: 1259994 - protein, 9 aa, Homo Sapiens
QADVHAAVT

SEQ ID NO: 1259995 - protein, 9 aa, Homo Sapiens
SGCDETLFG

SEQ ID NO: 1259996 - protein, 9 aa, Homo Sapiens
KALDGFVKL

SEQ ID NO: 1259997 - protein, 9 aa, Homo Sapiens
KHIRRLDTY

SEQ ID NO: 1259998 - protein, 9 aa, Homo Sapiens
YMCLALEAE

SEQ ID NO: 1259999 - protein, 9 aa, Homo Sapiens
ECYHSDFNR

SEQ ID NO: 1260000 - protein, 9 aa, Homo Sapiens
TVEAYTREA

SEQ ID NO: 1260001 - protein, 9 aa, Homo Sapiens
RPAEEELKM

SEQ ID NO: 1260002 - protein, 9 aa, Homo Sapiens
RHPVRVPDQ

SEQ ID NO: 1260003 - protein, 9 aa, Homo Sapiens
LLPPCCRWE

SEQ ID NO: 1260004 - protein, 9 aa, Homo Sapiens
DAIGTTPFS

SEQ ID NO: 1260005 - protein, 9 aa, Homo Sapiens
SDDIEHTME

SEQ ID NO: 1260006 - protein, 9 aa, Homo Sapiens
FPDAANNGS

SEQ ID NO: 1260007 - protein, 9 aa, Homo Sapiens
QPNATPSVT

SEQ ID NO: 1260008 - protein, 9 aa, Homo Sapiens
KLGPLGVPG

SEQ ID NO: 1260009 - protein, 9 aa, Homo Sapiens
IIVGAGYIA

SEQ ID NO: 1260010 - protein, 9 aa, Homo Sapiens
KPIPRPTNK

SEQ ID NO: 1260011 - protein, 9 aa, Homo Sapiens
AADMGMGGF

SEQ ID NO: 1260012 - protein, 9 aa, Homo Sapiens
GGSRNQEEG

SEQ ID NO: 1260013 - protein, 9 aa, Homo Sapiens
DSIHFAVDR

SEQ ID NO: 1260014 - protein, 9 aa, Homo Sapiens
DSMYVEKID

SEQ ID NO: 1260015 - protein, 9 aa, Homo Sapiens
QQIKTAHTT

SEQ ID NO: 1260016 - protein, 9 aa, Homo Sapiens
PRGRRGWKN

SEQ ID NO: 1260017 - protein, 9 aa, Homo Sapiens
DVRVQKIGN

SEQ ID NO: 1260018 - protein, 9 aa, Homo Sapiens
QEVMKLVCA

SEQ ID NO: 1260019 - protein, 9 aa, Homo Sapiens
KSVAEKNKD

SEQ ID NO: 1260020 - protein, 9 aa, Homo Sapiens
TVASSSLTP

SEQ ID NO: 1260021 - protein, 9 aa, Homo Sapiens
GSSMSTIGN

SEQ ID NO: 1260022 - protein, 9 aa, Homo Sapiens
CVVFHYRSA

SEQ ID NO: 1260023 - protein, 9 aa, Homo Sapiens
EWLKNLRRD

SEQ ID NO: 1260024 - protein, 9 aa, Homo Sapiens
KATNVRLHF

SEQ ID NO: 1260025 - protein, 9 aa, Homo Sapiens
QHPNALQCL

SEQ ID NO: 1260026 - protein, 9 aa, Homo Sapiens
NHDEDTCVE

SEQ ID NO: 1260027 - protein, 9 aa, Homo Sapiens
EVSLTLSPH

SEQ ID NO: 1260028 - protein, 9 aa, Homo Sapiens
TPKLEHLDH

SEQ ID NO: 1260029 - protein, 9 aa, Homo Sapiens
SKYAIYAVQ

SEQ ID NO: 1260030 - protein, 9 aa, Homo Sapiens
TKQLLHMCL

SEQ ID NO: 1260031 - protein, 9 aa, Homo Sapiens
KRDQCFQMM

SEQ ID NO: 1260032 - protein, 9 aa, Homo Sapiens
TLLCAGWWE

SEQ ID NO: 1260033 - protein, 9 aa, Homo Sapiens
EDPQTKDEV

SEQ ID NO: 1260034 - protein, 9 aa, Homo Sapiens
DFVHHALEQ

SEQ ID NO: 1260035 - protein, 9 aa, Homo Sapiens
GGQKCSTCS

SEQ ID NO: 1260036 - protein, 9 aa, Homo Sapiens
STGLVEICL

SEQ ID NO: 1260037 - protein, 9 aa, Homo Sapiens
KSTPIVGDQ

SEQ ID NO: 1260038 - protein, 9 aa, Homo Sapiens
QRITSDDLH

SEQ ID NO: 1260039 - protein, 9 aa, Homo Sapiens
PADPEMATL

SEQ ID NO: 1260040 - protein, 9 aa, Homo Sapiens
CEICVLMLL

SEQ ID NO: 1260041 - protein, 9 aa, Homo Sapiens
ESNILEISL

SEQ ID NO: 1260042 - protein, 9 aa, Homo Sapiens
CGTCVFTNP

SEQ ID NO: 1260043 - protein, 9 aa, Homo Sapiens
KDQLEEIKE

SEQ ID NO: 1260044 - protein, 9 aa, Homo Sapiens
AGQTDASVY

SEQ ID NO: 1260045 - protein, 9 aa, Homo Sapiens
VSKSISMAG

SEQ ID NO: 1260046 - protein, 9 aa, Homo Sapiens
TGDIVNIGD

SEQ ID NO: 1260047 - protein, 9 aa, Homo Sapiens
YGVRGCHRY

SEQ ID NO: 1260048 - protein, 9 aa, Homo Sapiens
KVKPADDGR

SEQ ID NO: 1260049 - protein, 9 aa, Homo Sapiens
DTFTPSEQV

SEQ ID NO: 1260050 - protein, 9 aa, Homo Sapiens
SKHKRHTSS

SEQ ID NO: 1260051 - protein, 9 aa, Homo Sapiens
ENSEETSTE

SEQ ID NO: 1260052 - protein, 9 aa, Homo Sapiens
DEEHMDMVV

SEQ ID NO: 1260053 - protein, 9 aa, Homo Sapiens
LPKRWDLLT

SEQ ID NO: 1260054 - protein, 9 aa, Homo Sapiens
VMVCDVLKA

SEQ ID NO: 1260055 - protein, 9 aa, Homo Sapiens
VNYFGKHFM

SEQ ID NO: 1260056 - protein, 9 aa, Homo Sapiens
SEQGIKDSF

SEQ ID NO: 1260057 - protein, 9 aa, Homo Sapiens
DNFEDCSLC

SEQ ID NO: 1260058 - protein, 9 aa, Homo Sapiens
KSRRKLRRK

SEQ ID NO: 1260059 - protein, 9 aa, Homo Sapiens
HSLAYQKQW

SEQ ID NO: 1260060 - protein, 9 aa, Homo Sapiens
GPPGPVGPT

SEQ ID NO: 1260061 - protein, 9 aa, Homo Sapiens
ATVLVLWPL

SEQ ID NO: 1260062 - protein, 9 aa, Homo Sapiens
DYMLTLHTK

SEQ ID NO: 1260063 - protein, 9 aa, Homo Sapiens
DLIQDAPNY

SEQ ID NO: 1260064 - protein, 9 aa, Homo Sapiens
LHCRTYYVL

SEQ ID NO: 1260065 - protein, 9 aa, Homo Sapiens
KDPSPVSSE

SEQ ID NO: 1260066 - protein, 9 aa, Homo Sapiens
LALWLCCAT

SEQ ID NO: 1260067 - protein, 9 aa, Homo Sapiens
LRHPRCGVP

SEQ ID NO: 1260068 - protein, 9 aa, Homo Sapiens
QLAYYILHG

SEQ ID NO: 1260069 - protein, 9 aa, Homo Sapiens
VLYHNLHIM

SEQ ID NO: 1260070 - protein, 9 aa, Homo Sapiens
QVNISASEK

SEQ ID NO: 1260071 - protein, 9 aa, Homo Sapiens
HVLKEMVVF

SEQ ID NO: 1260072 - protein, 9 aa, Homo Sapiens
GLGQTKKLI

SEQ ID NO: 1260073 - protein, 9 aa, Homo Sapiens
AKHPRNTPS

SEQ ID NO: 1260074 - protein, 9 aa, Homo Sapiens
NTTIPAKQT

SEQ ID NO: 1260075 - protein, 9 aa, Homo Sapiens
SGKLVCRAE

SEQ ID NO: 1260076 - protein, 9 aa, Homo Sapiens
DMIDYEKGA

SEQ ID NO: 1260077 - protein, 9 aa, Homo Sapiens
SYWLQFDFQ

SEQ ID NO: 1260078 - protein, 9 aa, Homo Sapiens
NPDPDGRYY

SEQ ID NO: 1260079 - protein, 9 aa, Homo Sapiens
IDFASLRIH

SEQ ID NO: 1260080 - protein, 9 aa, Homo Sapiens
HGPEPGPGD

SEQ ID NO: 1260081 - protein, 9 aa, Homo Sapiens
PIYEGYTLP

SEQ ID NO: 1260082 - protein, 9 aa, Homo Sapiens
AIVKRSDGF

SEQ ID NO: 1260083 - protein, 9 aa, Homo Sapiens
LLNDNRLTR

SEQ ID NO: 1260084 - protein, 9 aa, Homo Sapiens
SEGTLEGAD

SEQ ID NO: 1260085 - protein, 9 aa, Homo Sapiens
RKEHETWLA

SEQ ID NO: 1260086 - protein, 9 aa, Homo Sapiens
YLPTKIAAV

SEQ ID NO: 1260087 - protein, 9 aa, Homo Sapiens
FFFVSCHTQ

SEQ ID NO: 1260088 - protein, 9 aa, Homo Sapiens
VDLKKLFTD

SEQ ID NO: 1260089 - protein, 9 aa, Homo Sapiens
YGYSPCVKK

SEQ ID NO: 1260090 - protein, 9 aa, Homo Sapiens
IKTNLFIYP

SEQ ID NO: 1260091 - protein, 9 aa, Homo Sapiens
GPPTETNSL

SEQ ID NO: 1260092 - protein, 9 aa, Homo Sapiens
SWCLVQGFG

SEQ ID NO: 1260093 - protein, 9 aa, Homo Sapiens
KKNRNNDVT

SEQ ID NO: 1260094 - protein, 9 aa, Homo Sapiens
ACGMRCKSL

SEQ ID NO: 1260095 - protein, 9 aa, Homo Sapiens
EVMQPVEEQ

SEQ ID NO: 1260096 - protein, 9 aa, Homo Sapiens
KRRDVLYMP

SEQ ID NO: 1260097 - protein, 9 aa, Homo Sapiens
QTEMVLICG

SEQ ID NO: 1260098 - protein, 9 aa, Homo Sapiens
MQKEEKKTA

SEQ ID NO: 1260099 - protein, 9 aa, Homo Sapiens
GQGVQFLEA

SEQ ID NO: 1260100 - protein, 9 aa, Homo Sapiens
GYRDSAHQP

SEQ ID NO: 1260101 - protein, 9 aa, Homo Sapiens
ALLLFSLHR

SEQ ID NO: 1260102 - protein, 9 aa, Homo Sapiens
TDFLQLMPA

SEQ ID NO: 1260103 - protein, 9 aa, Homo Sapiens
LQHSEWARQ

SEQ ID NO: 1260104 - protein, 9 aa, Homo Sapiens
HQSIHIGEI

SEQ ID NO: 1260105 - protein, 9 aa, Homo Sapiens
KTLFPREAP

SEQ ID NO: 1260106 - protein, 9 aa, Homo Sapiens
SHVSKMALA

SEQ ID NO: 1260107 - protein, 9 aa, Homo Sapiens
GRLFTFDSE

SEQ ID NO: 1260108 - protein, 9 aa, Homo Sapiens
STFLDPFKH

SEQ ID NO: 1260109 - protein, 9 aa, Homo Sapiens
VHFKCRHPT

SEQ ID NO: 1260110 - protein, 9 aa, Homo Sapiens
TVMFRIHVE

SEQ ID NO: 1260111 - protein, 9 aa, Homo Sapiens
PCKYTGSLQ

SEQ ID NO: 1260112 - protein, 9 aa, Homo Sapiens
LLMRDLEGG

SEQ ID NO: 1260113 - protein, 9 aa, Homo Sapiens
EVKKSIQSK

SEQ ID NO: 1260114 - protein, 9 aa, Homo Sapiens
TPGFGEQIN

SEQ ID NO: 1260115 - protein, 9 aa, Homo Sapiens
QWLSAGQTD

SEQ ID NO: 1260116 - protein, 9 aa, Homo Sapiens
VTVQYPIML

SEQ ID NO: 1260117 - protein, 9 aa, Homo Sapiens
DDSRDEIQE

SEQ ID NO: 1260118 - protein, 9 aa, Homo Sapiens
HLTAFLAET

SEQ ID NO: 1260119 - protein, 9 aa, Homo Sapiens
DDEQCLSEW

SEQ ID NO: 1260120 - protein, 9 aa, Homo Sapiens
ISKQLPWVR

SEQ ID NO: 1260121 - protein, 9 aa, Homo Sapiens
QGKEHVHLL

SEQ ID NO: 1260122 - protein, 9 aa, Homo Sapiens
SLVRDLQDS

SEQ ID NO: 1260123 - protein, 9 aa, Homo Sapiens
KLELTNAEK

SEQ ID NO: 1260124 - protein, 9 aa, Homo Sapiens
QPEQTVLLM

SEQ ID NO: 1260125 - protein, 9 aa, Homo Sapiens
SSTTDAQPG

SEQ ID NO: 1260126 - protein, 9 aa, Homo Sapiens
MTVAEKLHV

SEQ ID NO: 1260127 - protein, 9 aa, Homo Sapiens
HVYSGAVNL

SEQ ID NO: 1260128 - protein, 9 aa, Homo Sapiens
QDVIMKGAH

SEQ ID NO: 1260129 - protein, 9 aa, Homo Sapiens
PVDCLDGTC

SEQ ID NO: 1260130 - protein, 9 aa, Homo Sapiens
LHPRSLRSP

SEQ ID NO: 1260131 - protein, 9 aa, Homo Sapiens
SAMCTAVWS

SEQ ID NO: 1260132 - protein, 9 aa, Homo Sapiens
FPTRTAHFG

SEQ ID NO: 1260133 - protein, 9 aa, Homo Sapiens
KGVGAETMH

SEQ ID NO: 1260134 - protein, 9 aa, Homo Sapiens
NYNTGILFL

SEQ ID NO: 1260135 - protein, 9 aa, Homo Sapiens
YTSGTPSSS

SEQ ID NO: 1260136 - protein, 9 aa, Homo Sapiens
DTIGQVGRL

SEQ ID NO: 1260137 - protein, 9 aa, Homo Sapiens
EQTVLLMGG

SEQ ID NO: 1260138 - protein, 9 aa, Homo Sapiens
ESTEEYIEY

SEQ ID NO: 1260139 - protein, 9 aa, Homo Sapiens
VSGEVMHGS

SEQ ID NO: 1260140 - protein, 9 aa, Homo Sapiens
FEGLKVHKY

SEQ ID NO: 1260141 - protein, 9 aa, Homo Sapiens
RRAPQGVNP

SEQ ID NO: 1260142 - protein, 9 aa, Homo Sapiens
KEFKAELIM

SEQ ID NO: 1260143 - protein, 9 aa, Homo Sapiens
PQKPIPRPT

SEQ ID NO: 1260144 - protein, 9 aa, Homo Sapiens
KQKSNCGVD

SEQ ID NO: 1260145 - protein, 9 aa, Homo Sapiens
KKLRYVFKK

SEQ ID NO: 1260146 - protein, 9 aa, Homo Sapiens
SLIVLKNVP

SEQ ID NO: 1260147 - protein, 9 aa, Homo Sapiens
YRFGYGFNE

SEQ ID NO: 1260148 - protein, 9 aa, Homo Sapiens
ISECSQYQQ

SEQ ID NO: 1260149 - protein, 9 aa, Homo Sapiens
VKTGSKNYG

SEQ ID NO: 1260150 - protein, 9 aa, Homo Sapiens
MHMILSLKT

SEQ ID NO: 1260151 - protein, 9 aa, Homo Sapiens
LESKLYQAY

SEQ ID NO: 1260152 - protein, 9 aa, Homo Sapiens
KQEYCTWNP

SEQ ID NO: 1260153 - protein, 9 aa, Homo Sapiens
DYFINHMIQ

SEQ ID NO: 1260154 - protein, 9 aa, Homo Sapiens
KNPGALEKE

SEQ ID NO: 1260155 - protein, 9 aa, Homo Sapiens
RHRSRINTD

SEQ ID NO: 1260156 - protein, 9 aa, Homo Sapiens
QRELPSAQI

SEQ ID NO: 1260157 - protein, 9 aa, Homo Sapiens
FQELLCLCR

SEQ ID NO: 1260158 - protein, 9 aa, Homo Sapiens
VKAEFRVFH

SEQ ID NO: 1260159 - protein, 9 aa, Homo Sapiens
YMLNPCNTK

SEQ ID NO: 1260160 - protein, 9 aa, Homo Sapiens
VVVVFAALL

SEQ ID NO: 1260161 - protein, 9 aa, Homo Sapiens
ATRFGSTLH

SEQ ID NO: 1260162 - protein, 9 aa, Homo Sapiens
PGHLHQNRL

SEQ ID NO: 1260163 - protein, 9 aa, Homo Sapiens
RDTANHLRI

SEQ ID NO: 1260164 - protein, 9 aa, Homo Sapiens
HLGPELWAL

SEQ ID NO: 1260165 - protein, 9 aa, Homo Sapiens
LINFMLRNE

SEQ ID NO: 1260166 - protein, 9 aa, Homo Sapiens
DYYGYEEYY

SEQ ID NO: 1260167 - protein, 9 aa, Homo Sapiens
RNGKYNLDF

SEQ ID NO: 1260168 - protein, 9 aa, Homo Sapiens
CPTGTKSLD

SEQ ID NO: 1260169 - protein, 9 aa, Homo Sapiens
AIFLVLVSA

SEQ ID NO: 1260170 - protein, 9 aa, Homo Sapiens
SVCETLVSM

SEQ ID NO: 1260171 - protein, 9 aa, Homo Sapiens
KQASLQVDW

SEQ ID NO: 1260172 - protein, 9 aa, Homo Sapiens
PSRQQGCIS

SEQ ID NO: 1260173 - protein, 9 aa, Homo Sapiens
LSPAQVIVV

SEQ ID NO: 1260174 - protein, 9 aa, Homo Sapiens
LVNRMIVSP

SEQ ID NO: 1260175 - protein, 9 aa, Homo Sapiens
AKEWNVLKK

SEQ ID NO: 1260176 - protein, 9 aa, Homo Sapiens
GVCGDRATD

SEQ ID NO: 1260177 - protein, 9 aa, Homo Sapiens
IPCAAVRAV

SEQ ID NO: 1260178 - protein, 9 aa, Homo Sapiens
TQEHKTAVS

SEQ ID NO: 1260179 - protein, 9 aa, Homo Sapiens
ETPSHLAVL

SEQ ID NO: 1260180 - protein, 9 aa, Homo Sapiens
STYLKMTPH

SEQ ID NO: 1260181 - protein, 9 aa, Homo Sapiens
VKRRFATSA

SEQ ID NO: 1260182 - protein, 9 aa, Homo Sapiens
ENNKTMNWA

SEQ ID NO: 1260183 - protein, 9 aa, Homo Sapiens
RSGLKRSSG

SEQ ID NO: 1260184 - protein, 9 aa, Homo Sapiens
RDIQKQVWE

SEQ ID NO: 1260185 - protein, 9 aa, Homo Sapiens
VMGACYENV

SEQ ID NO: 1260186 - protein, 9 aa, Homo Sapiens
RCRNGENTD

SEQ ID NO: 1260187 - protein, 9 aa, Homo Sapiens
LKRNPRSWL

SEQ ID NO: 1260188 - protein, 9 aa, Homo Sapiens
QYCTNYPMS

SEQ ID NO: 1260189 - protein, 9 aa, Homo Sapiens
FLRQLYTSG

SEQ ID NO: 1260190 - protein, 9 aa, Homo Sapiens
NDNTGWTPL

SEQ ID NO: 1260191 - protein, 9 aa, Homo Sapiens
LGYQALSEM

SEQ ID NO: 1260192 - protein, 9 aa, Homo Sapiens
VPTMDLTVG

SEQ ID NO: 1260193 - protein, 9 aa, Homo Sapiens
QPNDENIMG

SEQ ID NO: 1260194 - protein, 9 aa, Homo Sapiens
ISSMFREDQ

SEQ ID NO: 1260195 - protein, 9 aa, Homo Sapiens
RDHNQTAGR

SEQ ID NO: 1260196 - protein, 9 aa, Homo Sapiens
DSITSVVVS

SEQ ID NO: 1260197 - protein, 9 aa, Homo Sapiens
RSRPSRQLL

SEQ ID NO: 1260198 - protein, 9 aa, Homo Sapiens
SVEQACPQH

SEQ ID NO: 1260199 - protein, 9 aa, Homo Sapiens
CMFAFFRNH

SEQ ID NO: 1260200 - protein, 9 aa, Homo Sapiens
MEQYECSLE

SEQ ID NO: 1260201 - protein, 9 aa, Homo Sapiens
MSPVERTAV

SEQ ID NO: 1260202 - protein, 9 aa, Homo Sapiens
LFSVLFVIS

SEQ ID NO: 1260203 - protein, 9 aa, Homo Sapiens
FWNRATLSI

SEQ ID NO: 1260204 - protein, 9 aa, Homo Sapiens
SIRHLQDVS

SEQ ID NO: 1260205 - protein, 9 aa, Homo Sapiens
FHCTQCGRS

SEQ ID NO: 1260206 - protein, 9 aa, Homo Sapiens
CRHAGSSAL

SEQ ID NO: 1260207 - protein, 9 aa, Homo Sapiens
CLDVEYNNG

SEQ ID NO: 1260208 - protein, 9 aa, Homo Sapiens
SLASTQAQS

SEQ ID NO: 1260209 - protein, 9 aa, Homo Sapiens
MNHSPFTVS

SEQ ID NO: 1260210 - protein, 9 aa, Homo Sapiens
YVVECITMS

SEQ ID NO: 1260211 - protein, 9 aa, Homo Sapiens
AYVTIMGKL

SEQ ID NO: 1260212 - protein, 9 aa, Homo Sapiens
ALRLEHSND

SEQ ID NO: 1260213 - protein, 9 aa, Homo Sapiens
GEEEPQERN

SEQ ID NO: 1260214 - protein, 9 aa, Homo Sapiens
TYHGSQKQP

SEQ ID NO: 1260215 - protein, 9 aa, Homo Sapiens
GHAPMGPYA

SEQ ID NO: 1260216 - protein, 9 aa, Homo Sapiens
SSWQDVIMK

SEQ ID NO: 1260217 - protein, 9 aa, Homo Sapiens
QLITRGKGV

SEQ ID NO: 1260218 - protein, 9 aa, Homo Sapiens
LDEWRKKCH

SEQ ID NO: 1260219 - protein, 9 aa, Homo Sapiens
WIQVKVEEV

SEQ ID NO: 1260220 - protein, 9 aa, Homo Sapiens
NYVALHILQ

SEQ ID NO: 1260221 - protein, 9 aa, Homo Sapiens
SSLTLSSAL

SEQ ID NO: 1260222 - protein, 9 aa, Homo Sapiens
HRTYQEYES

SEQ ID NO: 1260223 - protein, 9 aa, Homo Sapiens
ANDLYDAGE

SEQ ID NO: 1260224 - protein, 9 aa, Homo Sapiens
KPNKKQQEP

SEQ ID NO: 1260225 - protein, 9 aa, Homo Sapiens
LCYQNDDSV

SEQ ID NO: 1260226 - protein, 9 aa, Homo Sapiens
ATYRLMAHY

SEQ ID NO: 1260227 - protein, 9 aa, Homo Sapiens
LSASHFTTL

SEQ ID NO: 1260228 - protein, 9 aa, Homo Sapiens
GADIHKMLS

SEQ ID NO: 1260229 - protein, 9 aa, Homo Sapiens
ANCVNIPMI

SEQ ID NO: 1260230 - protein, 9 aa, Homo Sapiens
NGGNLVVSN

SEQ ID NO: 1260231 - protein, 9 aa, Homo Sapiens
QASLDIGDF

SEQ ID NO: 1260232 - protein, 9 aa, Homo Sapiens
KLFKLNHKS

SEQ ID NO: 1260233 - protein, 9 aa, Homo Sapiens
GGCSGQGAG

SEQ ID NO: 1260234 - protein, 9 aa, Homo Sapiens
GQLIVNDDI

SEQ ID NO: 1260235 - protein, 9 aa, Homo Sapiens
TESEKRYVQ

SEQ ID NO: 1260236 - protein, 9 aa, Homo Sapiens
YQRVHTGKR

SEQ ID NO: 1260237 - protein, 9 aa, Homo Sapiens
HHVLGHPHT

SEQ ID NO: 1260238 - protein, 9 aa, Homo Sapiens
CFAFVRDLC

SEQ ID NO: 1260239 - protein, 9 aa, Homo Sapiens
QCGVQGVQV

SEQ ID NO: 1260240 - protein, 9 aa, Homo Sapiens
PSSALKLVA

SEQ ID NO: 1260241 - protein, 9 aa, Homo Sapiens
NVDCMSWLV

SEQ ID NO: 1260242 - protein, 9 aa, Homo Sapiens
EECAALEKL

SEQ ID NO: 1260243 - protein, 9 aa, Homo Sapiens
DGDIEKSRH

SEQ ID NO: 1260244 - protein, 9 aa, Homo Sapiens
KEILFYDQI

SEQ ID NO: 1260245 - protein, 9 aa, Homo Sapiens
EVVLSSRTP

SEQ ID NO: 1260246 - protein, 9 aa, Homo Sapiens
DGLSRRDTR

SEQ ID NO: 1260247 - protein, 9 aa, Homo Sapiens
NVMFTRYIL

SEQ ID NO: 1260248 - protein, 9 aa, Homo Sapiens
CTGSGGPGN

SEQ ID NO: 1260249 - protein, 9 aa, Homo Sapiens
KDVSYLISN

SEQ ID NO: 1260250 - protein, 9 aa, Homo Sapiens
SAPGGRPGS

SEQ ID NO: 1260251 - protein, 9 aa, Homo Sapiens
PTVGSSLSE

SEQ ID NO: 1260252 - protein, 9 aa, Homo Sapiens
KRELHQHEG

SEQ ID NO: 1260253 - protein, 9 aa, Homo Sapiens
PSNCCCRSP

SEQ ID NO: 1260254 - protein, 9 aa, Homo Sapiens
WLRVVTTKI

SEQ ID NO: 1260255 - protein, 9 aa, Homo Sapiens
TTPSTTAVR

SEQ ID NO: 1260256 - protein, 9 aa, Homo Sapiens
QLVTTEPTS

SEQ ID NO: 1260257 - protein, 9 aa, Homo Sapiens
LDDHNDVVT

SEQ ID NO: 1260258 - protein, 9 aa, Homo Sapiens
WQKTLTLLN

SEQ ID NO: 1260259 - protein, 9 aa, Homo Sapiens
DNSAPYGTR

SEQ ID NO: 1260260 - protein, 9 aa, Homo Sapiens
AYVPPMATA

SEQ ID NO: 1260261 - protein, 9 aa, Homo Sapiens
HWDGGSLLG

SEQ ID NO: 1260262 - protein, 9 aa, Homo Sapiens
FFVLHHNVW

SEQ ID NO: 1260263 - protein, 9 aa, Homo Sapiens
CQRRGRLGL

SEQ ID NO: 1260264 - protein, 9 aa, Homo Sapiens
VIKVVAVDG

SEQ ID NO: 1260265 - protein, 9 aa, Homo Sapiens
AFLNLLVST

SEQ ID NO: 1260266 - protein, 9 aa, Homo Sapiens
SSDGLMYFS

SEQ ID NO: 1260267 - protein, 9 aa, Homo Sapiens
GHMMNCPKI

SEQ ID NO: 1260268 - protein, 9 aa, Homo Sapiens
LGSVTDSLC

SEQ ID NO: 1260269 - protein, 9 aa, Homo Sapiens
SATEEAEET

SEQ ID NO: 1260270 - protein, 9 aa, Homo Sapiens
GCETLCEDM

SEQ ID NO: 1260271 - protein, 9 aa, Homo Sapiens
SCVGPDNVP

SEQ ID NO: 1260272 - protein, 9 aa, Homo Sapiens
YSLHTQEYR

SEQ ID NO: 1260273 - protein, 9 aa, Homo Sapiens
YENCQEVLK

SEQ ID NO: 1260274 - protein, 9 aa, Homo Sapiens
CATAMKLLH

SEQ ID NO: 1260275 - protein, 9 aa, Homo Sapiens
NKISITTIG

SEQ ID NO: 1260276 - protein, 9 aa, Homo Sapiens
PRRAPQGVN

SEQ ID NO: 1260277 - protein, 9 aa, Homo Sapiens
AGHGDPMPE

SEQ ID NO: 1260278 - protein, 9 aa, Homo Sapiens
MHHEIEGTG

SEQ ID NO: 1260279 - protein, 9 aa, Homo Sapiens
SSSESQAMC

SEQ ID NO: 1260280 - protein, 9 aa, Homo Sapiens
ETGGIQTVE

SEQ ID NO: 1260281 - protein, 9 aa, Homo Sapiens
SLKWFLGKT

SEQ ID NO: 1260282 - protein, 9 aa, Homo Sapiens
KDQPKSHYF

SEQ ID NO: 1260283 - protein, 9 aa, Homo Sapiens
GTCLAIDPL

SEQ ID NO: 1260284 - protein, 9 aa, Homo Sapiens
EKLARDLNA

SEQ ID NO: 1260285 - protein, 9 aa, Homo Sapiens
FHHLAFNQP

SEQ ID NO: 1260286 - protein, 9 aa, Homo Sapiens
GTVIMLCKG

SEQ ID NO: 1260287 - protein, 9 aa, Homo Sapiens
TPMPPMLMP

SEQ ID NO: 1260288 - protein, 9 aa, Homo Sapiens
VTPVEGSKI

SEQ ID NO: 1260289 - protein, 9 aa, Homo Sapiens
DAEGSKATN

SEQ ID NO: 1260290 - protein, 9 aa, Homo Sapiens
QCSTEAADP

SEQ ID NO: 1260291 - protein, 9 aa, Homo Sapiens
RDQRCVSSS

SEQ ID NO: 1260292 - protein, 9 aa, Homo Sapiens
MQELKAGSR

SEQ ID NO: 1260293 - protein, 9 aa, Homo Sapiens
GGGPGPAQA

SEQ ID NO: 1260294 - protein, 9 aa, Homo Sapiens
ISYSTLPMY

SEQ ID NO: 1260295 - protein, 9 aa, Homo Sapiens
IVAGPEGKG

SEQ ID NO: 1260296 - protein, 9 aa, Homo Sapiens
VALLLGVVS

SEQ ID NO: 1260297 - protein, 9 aa, Homo Sapiens
HQDFANMTG

SEQ ID NO: 1260298 - protein, 9 aa, Homo Sapiens
PPIPLMETV

SEQ ID NO: 1260299 - protein, 9 aa, Homo Sapiens
QYGNVPVVS

SEQ ID NO: 1260300 - protein, 9 aa, Homo Sapiens
TFQAVLDGF

SEQ ID NO: 1260301 - protein, 9 aa, Homo Sapiens
YPNHPDVLV

SEQ ID NO: 1260302 - protein, 9 aa, Homo Sapiens
DDYDEDSQK

SEQ ID NO: 1260303 - protein, 9 aa, Homo Sapiens
LPIEDNCGD

SEQ ID NO: 1260304 - protein, 9 aa, Homo Sapiens
FRIKLYFMY

SEQ ID NO: 1260305 - protein, 9 aa, Homo Sapiens
KMNRENRIW

SEQ ID NO: 1260306 - protein, 9 aa, Homo Sapiens
PAAPTFSGI

SEQ ID NO: 1260307 - protein, 9 aa, Homo Sapiens
SSTCVKEQD

SEQ ID NO: 1260308 - protein, 9 aa, Homo Sapiens
EFVLVKLCQ

SEQ ID NO: 1260309 - protein, 9 aa, Homo Sapiens
LTRKILNVK

SEQ ID NO: 1260310 - protein, 9 aa, Homo Sapiens
KFSTPTTPS

SEQ ID NO: 1260311 - protein, 9 aa, Homo Sapiens
VLPSHLFLY

SEQ ID NO: 1260312 - protein, 9 aa, Homo Sapiens
KEVSLTLSP

SEQ ID NO: 1260313 - protein, 9 aa, Homo Sapiens
TVTYTQCTD

SEQ ID NO: 1260314 - protein, 9 aa, Homo Sapiens
IKMTVSERK

SEQ ID NO: 1260315 - protein, 9 aa, Homo Sapiens
SQIVAICSA

SEQ ID NO: 1260316 - protein, 9 aa, Homo Sapiens
RYNNRTYHI

SEQ ID NO: 1260317 - protein, 9 aa, Homo Sapiens
PAYYTSSSD

SEQ ID NO: 1260318 - protein, 9 aa, Homo Sapiens
KSIFKESLY

SEQ ID NO: 1260319 - protein, 9 aa, Homo Sapiens
EWGSRDTYA

SEQ ID NO: 1260320 - protein, 9 aa, Homo Sapiens
GESPHLSPC

SEQ ID NO: 1260321 - protein, 9 aa, Homo Sapiens
KLLKENDVP

SEQ ID NO: 1260322 - protein, 9 aa, Homo Sapiens
KAVGESVQD

SEQ ID NO: 1260323 - protein, 9 aa, Homo Sapiens
ESSVKVWLA

SEQ ID NO: 1260324 - protein, 9 aa, Homo Sapiens
MWADEEEEV

SEQ ID NO: 1260325 - protein, 9 aa, Homo Sapiens
NFSHAISQD

SEQ ID NO: 1260326 - protein, 9 aa, Homo Sapiens
ARVIDGKEA

SEQ ID NO: 1260327 - protein, 9 aa, Homo Sapiens
VFSPMCTSR

SEQ ID NO: 1260328 - protein, 9 aa, Homo Sapiens
GMLAGFITP

SEQ ID NO: 1260329 - protein, 9 aa, Homo Sapiens
TTGTLHIMD

SEQ ID NO: 1260330 - protein, 9 aa, Homo Sapiens
TIQDWSLKS

SEQ ID NO: 1260331 - protein, 9 aa, Homo Sapiens
KEKKRKEEE

SEQ ID NO: 1260332 - protein, 9 aa, Homo Sapiens
QLVPGSGKV

SEQ ID NO: 1260333 - protein, 9 aa, Homo Sapiens
ITVKKLKSV

SEQ ID NO: 1260334 - protein, 9 aa, Homo Sapiens
TMKIEIIAP

SEQ ID NO: 1260335 - protein, 9 aa, Homo Sapiens
PVCLPAHSH

SEQ ID NO: 1260336 - protein, 9 aa, Homo Sapiens
TGKVTDINP

SEQ ID NO: 1260337 - protein, 9 aa, Homo Sapiens
KHAPTKSAP

SEQ ID NO: 1260338 - protein, 9 aa, Homo Sapiens
DGHKLITVS

SEQ ID NO: 1260339 - protein, 9 aa, Homo Sapiens
GVWGNLVML

SEQ ID NO: 1260340 - protein, 9 aa, Homo Sapiens
GASQSRPHR

SEQ ID NO: 1260341 - protein, 9 aa, Homo Sapiens
MHQLAGLLQ

SEQ ID NO: 1260342 - protein, 9 aa, Homo Sapiens
RIQVIASDL

SEQ ID NO: 1260343 - protein, 9 aa, Homo Sapiens
KTYPGVMHI

SEQ ID NO: 1260344 - protein, 9 aa, Homo Sapiens
SRQPSCKNV

SEQ ID NO: 1260345 - protein, 9 aa, Homo Sapiens
NNWSTKISL

SEQ ID NO: 1260346 - protein, 9 aa, Homo Sapiens
GVTVHEATP

SEQ ID NO: 1260347 - protein, 9 aa, Homo Sapiens
WKPAWTDRI

SEQ ID NO: 1260348 - protein, 9 aa, Homo Sapiens
TTMKIIVED

SEQ ID NO: 1260349 - protein, 9 aa, Homo Sapiens
LRGKHARHK

SEQ ID NO: 1260350 - protein, 9 aa, Homo Sapiens
KNLPFSVES

SEQ ID NO: 1260351 - protein, 9 aa, Homo Sapiens
RDSMRCGLD

SEQ ID NO: 1260352 - protein, 9 aa, Homo Sapiens
VASLELSEV

SEQ ID NO: 1260353 - protein, 9 aa, Homo Sapiens
RGWKNFYAV

SEQ ID NO: 1260354 - protein, 9 aa, Homo Sapiens
PTARCCLYA

SEQ ID NO: 1260355 - protein, 9 aa, Homo Sapiens
LADKFIYYQ

SEQ ID NO: 1260356 - protein, 9 aa, Homo Sapiens
VHSACHGPL

SEQ ID NO: 1260357 - protein, 9 aa, Homo Sapiens
MGIDNLYVQ

SEQ ID NO: 1260358 - protein, 9 aa, Homo Sapiens
VSSIPSNSN

SEQ ID NO: 1260359 - protein, 9 aa, Homo Sapiens
ITAPEMLIY

SEQ ID NO: 1260360 - protein, 9 aa, Homo Sapiens
WGRRPRYDY

SEQ ID NO: 1260361 - protein, 9 aa, Homo Sapiens
RSTAATSSP

SEQ ID NO: 1260362 - protein, 9 aa, Homo Sapiens
HCVSGLPVS

SEQ ID NO: 1260363 - protein, 9 aa, Homo Sapiens
NAKTTRNVN

SEQ ID NO: 1260364 - protein, 9 aa, Homo Sapiens
GCDSSCGSR

SEQ ID NO: 1260365 - protein, 9 aa, Homo Sapiens
VYEELPEQE

SEQ ID NO: 1260366 - protein, 9 aa, Homo Sapiens
WICMEFCGE

SEQ ID NO: 1260367 - protein, 9 aa, Homo Sapiens
MIALVIQVA

SEQ ID NO: 1260368 - protein, 9 aa, Homo Sapiens
TRTLQTNMA

SEQ ID NO: 1260369 - protein, 9 aa, Homo Sapiens
SIKDHRKSL

SEQ ID NO: 1260370 - protein, 9 aa, Homo Sapiens
VSAQAEANT

SEQ ID NO: 1260371 - protein, 9 aa, Homo Sapiens
KDIATNSKA

SEQ ID NO: 1260372 - protein, 9 aa, Homo Sapiens
IGLHCRTYY

SEQ ID NO: 1260373 - protein, 9 aa, Homo Sapiens
NSIFVVCAN

SEQ ID NO: 1260374 - protein, 9 aa, Homo Sapiens
HSLSIFHTK

SEQ ID NO: 1260375 - protein, 9 aa, Homo Sapiens
FGYDEQWQP

SEQ ID NO: 1260376 - protein, 9 aa, Homo Sapiens
LAMISVTQR

SEQ ID NO: 1260377 - protein, 9 aa, Homo Sapiens
YKRNECGKT

SEQ ID NO: 1260378 - protein, 9 aa, Homo Sapiens
AGWLQLLNR

SEQ ID NO: 1260379 - protein, 9 aa, Homo Sapiens
RSGMGQRRM

SEQ ID NO: 1260380 - protein, 9 aa, Homo Sapiens
AGDKASGEG

SEQ ID NO: 1260381 - protein, 9 aa, Homo Sapiens
GPSRAHCPA

SEQ ID NO: 1260382 - protein, 9 aa, Homo Sapiens
GEDRTICEA

SEQ ID NO: 1260383 - protein, 9 aa, Homo Sapiens
LRCIASETH

SEQ ID NO: 1260384 - protein, 9 aa, Homo Sapiens
NKDPSPVSS

SEQ ID NO: 1260385 - protein, 9 aa, Homo Sapiens
RLAAEDVTN

SEQ ID NO: 1260386 - protein, 9 aa, Homo Sapiens
PSPPVQQTQ

SEQ ID NO: 1260387 - protein, 9 aa, Homo Sapiens
PELQPVLVG

SEQ ID NO: 1260388 - protein, 9 aa, Homo Sapiens
NASESEEDH

SEQ ID NO: 1260389 - protein, 9 aa, Homo Sapiens
TELNAQIMK

SEQ ID NO: 1260390 - protein, 9 aa, Homo Sapiens
GVIEEFWQQ

SEQ ID NO: 1260391 - protein, 9 aa, Homo Sapiens
KDKECVLEA

SEQ ID NO: 1260392 - protein, 9 aa, Homo Sapiens
WGPPLAHGD

SEQ ID NO: 1260393 - protein, 9 aa, Homo Sapiens
QVDWVKSQT

SEQ ID NO: 1260394 - protein, 9 aa, Homo Sapiens
CVTGSQNEG

SEQ ID NO: 1260395 - protein, 9 aa, Homo Sapiens
ALRHEKQKL

SEQ ID NO: 1260396 - protein, 9 aa, Homo Sapiens
HQEVMKLVC

SEQ ID NO: 1260397 - protein, 9 aa, Homo Sapiens
YFATEGLQT

SEQ ID NO: 1260398 - protein, 9 aa, Homo Sapiens
KVWFFSADG

SEQ ID NO: 1260399 - protein, 9 aa, Homo Sapiens
NVMLVRLNS

SEQ ID NO: 1260400 - protein, 9 aa, Homo Sapiens
IAYLAVRRH

SEQ ID NO: 1260401 - protein, 9 aa, Homo Sapiens
AAEEAEQHQ

SEQ ID NO: 1260402 - protein, 9 aa, Homo Sapiens
LSILTLQPS

SEQ ID NO: 1260403 - protein, 9 aa, Homo Sapiens
GKHFMSFHW

SEQ ID NO: 1260404 - protein, 9 aa, Homo Sapiens
FEKPIISAP

SEQ ID NO: 1260405 - protein, 9 aa, Homo Sapiens
ELKHPLSLP

SEQ ID NO: 1260406 - protein, 9 aa, Homo Sapiens
SFILLEGYG

SEQ ID NO: 1260407 - protein, 9 aa, Homo Sapiens
NKLPKKLKG

SEQ ID NO: 1260408 - protein, 9 aa, Homo Sapiens
CSHPNVVIY

SEQ ID NO: 1260409 - protein, 9 aa, Homo Sapiens
CSLEGELQR

SEQ ID NO: 1260410 - protein, 9 aa, Homo Sapiens
KKMNYENSH

SEQ ID NO: 1260411 - protein, 9 aa, Homo Sapiens
HYIAPTVLT

SEQ ID NO: 1260412 - protein, 9 aa, Homo Sapiens
YNAVVGAGY

SEQ ID NO: 1260413 - protein, 9 aa, Homo Sapiens
KCWQQDMST

SEQ ID NO: 1260414 - protein, 9 aa, Homo Sapiens
VLVNFMKDA

SEQ ID NO: 1260415 - protein, 9 aa, Homo Sapiens
DLVPLEVTC

SEQ ID NO: 1260416 - protein, 9 aa, Homo Sapiens
MKSVDSKSG

SEQ ID NO: 1260417 - protein, 9 aa, Homo Sapiens
MVKGAVLFL

SEQ ID NO: 1260418 - protein, 9 aa, Homo Sapiens
QPSCKNVCF

SEQ ID NO: 1260419 - protein, 9 aa, Homo Sapiens
MLFIFTYGM

SEQ ID NO: 1260420 - protein, 9 aa, Homo Sapiens
FLAVMAAVG

SEQ ID NO: 1260421 - protein, 9 aa, Homo Sapiens
ERPVQHHEV

SEQ ID NO: 1260422 - protein, 9 aa, Homo Sapiens
VTRMVVSVV

SEQ ID NO: 1260423 - protein, 9 aa, Homo Sapiens
YRSHNDGYD

SEQ ID NO: 1260424 - protein, 9 aa, Homo Sapiens
REAQILAFT

SEQ ID NO: 1260425 - protein, 9 aa, Homo Sapiens
AEHVHTTVL

SEQ ID NO: 1260426 - protein, 9 aa, Homo Sapiens
INDNPSIFP

SEQ ID NO: 1260427 - protein, 9 aa, Homo Sapiens
DQNQSKIQL

SEQ ID NO: 1260428 - protein, 9 aa, Homo Sapiens
QEESLKRCS

SEQ ID NO: 1260429 - protein, 9 aa, Homo Sapiens
ENILLSASG

SEQ ID NO: 1260430 - protein, 9 aa, Homo Sapiens
PDEQLTPEI

SEQ ID NO: 1260431 - protein, 9 aa, Homo Sapiens
ISVTMIGVI

SEQ ID NO: 1260432 - protein, 9 aa, Homo Sapiens
ALGVSITFN

SEQ ID NO: 1260433 - protein, 9 aa, Homo Sapiens
EIEDWFTTE

SEQ ID NO: 1260434 - protein, 9 aa, Homo Sapiens
VEAPEVEPH

SEQ ID NO: 1260435 - protein, 9 aa, Homo Sapiens
PYHMLRTRA

SEQ ID NO: 1260436 - protein, 9 aa, Homo Sapiens
VYPALPPYS

SEQ ID NO: 1260437 - protein, 9 aa, Homo Sapiens
SQEDARKSL

SEQ ID NO: 1260438 - protein, 9 aa, Homo Sapiens
IHSLDVVGK

SEQ ID NO: 1260439 - protein, 9 aa, Homo Sapiens
PPAPPKLIM

SEQ ID NO: 1260440 - protein, 9 aa, Homo Sapiens
EDYAAHLEL

SEQ ID NO: 1260441 - protein, 9 aa, Homo Sapiens
GSPPPPVKF

SEQ ID NO: 1260442 - protein, 9 aa, Homo Sapiens
RCTYDALNV

SEQ ID NO: 1260443 - protein, 9 aa, Homo Sapiens
GIIYRSTCL

SEQ ID NO: 1260444 - protein, 9 aa, Homo Sapiens
KYLQASGIR

SEQ ID NO: 1260445 - protein, 9 aa, Homo Sapiens
LPGSRHKHA

SEQ ID NO: 1260446 - protein, 9 aa, Homo Sapiens
ATKKYMQAG

SEQ ID NO: 1260447 - protein, 9 aa, Homo Sapiens
IFTDAQDPD

SEQ ID NO: 1260448 - protein, 9 aa, Homo Sapiens
MGSASNQQF

SEQ ID NO: 1260449 - protein, 9 aa, Homo Sapiens
AQRASNKNV

SEQ ID NO: 1260450 - protein, 9 aa, Homo Sapiens
KHHPYKMNL

SEQ ID NO: 1260451 - protein, 9 aa, Homo Sapiens
TSQGFFQSF

SEQ ID NO: 1260452 - protein, 9 aa, Homo Sapiens
GAAGAREAG

SEQ ID NO: 1260453 - protein, 9 aa, Homo Sapiens
PALCSRFAQ

SEQ ID NO: 1260454 - protein, 9 aa, Homo Sapiens
EVIQIFCDT

SEQ ID NO: 1260455 - protein, 9 aa, Homo Sapiens
HYPPKVVRL

SEQ ID NO: 1260456 - protein, 9 aa, Homo Sapiens
LHYREPVLE

SEQ ID NO: 1260457 - protein, 9 aa, Homo Sapiens
KYHMVRCIT

SEQ ID NO: 1260458 - protein, 9 aa, Homo Sapiens
ENEQHFGVK

SEQ ID NO: 1260459 - protein, 9 aa, Homo Sapiens
SVTPLCGPC

SEQ ID NO: 1260460 - protein, 9 aa, Homo Sapiens
SLDIGDFTL

SEQ ID NO: 1260461 - protein, 9 aa, Homo Sapiens
YKRLWAGSR

SEQ ID NO: 1260462 - protein, 9 aa, Homo Sapiens
SQASKDLFH

SEQ ID NO: 1260463 - protein, 9 aa, Homo Sapiens
PISAPQSAG

SEQ ID NO: 1260464 - protein, 9 aa, Homo Sapiens
DFNHITGKG

SEQ ID NO: 1260465 - protein, 9 aa, Homo Sapiens
KASGVKCTK

SEQ ID NO: 1260466 - protein, 9 aa, Homo Sapiens
VVIYYTSFV

SEQ ID NO: 1260467 - protein, 9 aa, Homo Sapiens
TFINGSAPA

SEQ ID NO: 1260468 - protein, 9 aa, Homo Sapiens
KTHTKPQPD

SEQ ID NO: 1260469 - protein, 9 aa, Homo Sapiens
MIEIVYFAL

SEQ ID NO: 1260470 - protein, 9 aa, Homo Sapiens
KSLEHLHSK

SEQ ID NO: 1260471 - protein, 9 aa, Homo Sapiens
QQISKSQVE

SEQ ID NO: 1260472 - protein, 9 aa, Homo Sapiens
LGRWGYGKP

SEQ ID NO: 1260473 - protein, 9 aa, Homo Sapiens
IVSATSTTA

SEQ ID NO: 1260474 - protein, 9 aa, Homo Sapiens
LEGSDLESI

SEQ ID NO: 1260475 - protein, 9 aa, Homo Sapiens
SAARKWPST

SEQ ID NO: 1260476 - protein, 9 aa, Homo Sapiens
SMVNHMVEN

SEQ ID NO: 1260477 - protein, 9 aa, Homo Sapiens
RKMSQGHCT

SEQ ID NO: 1260478 - protein, 9 aa, Homo Sapiens
HSHWVNTMA

SEQ ID NO: 1260479 - protein, 9 aa, Homo Sapiens
TYITKAYEM

SEQ ID NO: 1260480 - protein, 9 aa, Homo Sapiens
KLKNQIRSG

SEQ ID NO: 1260481 - protein, 9 aa, Homo Sapiens
AGVGTWSFL

SEQ ID NO: 1260482 - protein, 9 aa, Homo Sapiens
KAQAIKQGD

SEQ ID NO: 1260483 - protein, 9 aa, Homo Sapiens
TWDCGGGLQ

SEQ ID NO: 1260484 - protein, 9 aa, Homo Sapiens
TYINIKPAR

SEQ ID NO: 1260485 - protein, 9 aa, Homo Sapiens
QRTVQDKKK

SEQ ID NO: 1260486 - protein, 9 aa, Homo Sapiens
SLEVARTTA

SEQ ID NO: 1260487 - protein, 9 aa, Homo Sapiens
SLSNISKRT

SEQ ID NO: 1260488 - protein, 9 aa, Homo Sapiens
DLAKADEGR

SEQ ID NO: 1260489 - protein, 9 aa, Homo Sapiens
SSRWPTMLD

SEQ ID NO: 1260490 - protein, 9 aa, Homo Sapiens
LPKFSIEGF

SEQ ID NO: 1260491 - protein, 9 aa, Homo Sapiens
GPDLEVQED

SEQ ID NO: 1260492 - protein, 9 aa, Homo Sapiens
LLVALKVCY

SEQ ID NO: 1260493 - protein, 9 aa, Homo Sapiens
SSVCIFKLT

SEQ ID NO: 1260494 - protein, 9 aa, Homo Sapiens
WFIGLSEDV

SEQ ID NO: 1260495 - protein, 9 aa, Homo Sapiens
NLVPSQKSL

SEQ ID NO: 1260496 - protein, 9 aa, Homo Sapiens
PYLADQDRP

SEQ ID NO: 1260497 - protein, 9 aa, Homo Sapiens
EPGAEPHLT

SEQ ID NO: 1260498 - protein, 9 aa, Homo Sapiens
NDNAPTLLA

SEQ ID NO: 1260499 - protein, 9 aa, Homo Sapiens
CTLWTWMTC

SEQ ID NO: 1260500 - protein, 9 aa, Homo Sapiens
HSGPDQQMD

SEQ ID NO: 1260501 - protein, 9 aa, Homo Sapiens
LARAHAGLP

SEQ ID NO: 1260502 - protein, 9 aa, Homo Sapiens
TNSLKDGIV

SEQ ID NO: 1260503 - protein, 9 aa, Homo Sapiens
APTILTPKL

SEQ ID NO: 1260504 - protein, 9 aa, Homo Sapiens
QKLDLYTTE

SEQ ID NO: 1260505 - protein, 9 aa, Homo Sapiens
LHSHFIGEG

SEQ ID NO: 1260506 - protein, 9 aa, Homo Sapiens
VTWTWARPG

SEQ ID NO: 1260507 - protein, 9 aa, Homo Sapiens
VASVVTSDK

SEQ ID NO: 1260508 - protein, 9 aa, Homo Sapiens
VYVTIMDEN

SEQ ID NO: 1260509 - protein, 9 aa, Homo Sapiens
GANLLCGGG

SEQ ID NO: 1260510 - protein, 9 aa, Homo Sapiens
RVTLEGRPG

SEQ ID NO: 1260511 - protein, 9 aa, Homo Sapiens
QYFNIVTLQ

SEQ ID NO: 1260512 - protein, 9 aa, Homo Sapiens
ETVVNLENR

SEQ ID NO: 1260513 - protein, 9 aa, Homo Sapiens
LNTCMLKGS

SEQ ID NO: 1260514 - protein, 9 aa, Homo Sapiens
RLQVLVSGA

SEQ ID NO: 1260515 - protein, 9 aa, Homo Sapiens
LASYIVVMV

SEQ ID NO: 1260516 - protein, 9 aa, Homo Sapiens
LKVLCIDQL

SEQ ID NO: 1260517 - protein, 9 aa, Homo Sapiens
STTDAQPGN

SEQ ID NO: 1260518 - protein, 9 aa, Homo Sapiens
LRRLQSGSV

SEQ ID NO: 1260519 - protein, 9 aa, Homo Sapiens
GKTIAVGLS

SEQ ID NO: 1260520 - protein, 9 aa, Homo Sapiens
EMLKEIKPR

SEQ ID NO: 1260521 - protein, 9 aa, Homo Sapiens
VETNVKTVF

SEQ ID NO: 1260522 - protein, 9 aa, Homo Sapiens
TFVDLEETG

SEQ ID NO: 1260523 - protein, 9 aa, Homo Sapiens
ACPRSSSTA

SEQ ID NO: 1260524 - protein, 9 aa, Homo Sapiens
VGPPASQGI

SEQ ID NO: 1260525 - protein, 9 aa, Homo Sapiens
EDLLLSETL

SEQ ID NO: 1260526 - protein, 9 aa, Homo Sapiens
WDVQSTQDS

SEQ ID NO: 1260527 - protein, 9 aa, Homo Sapiens
GASYGTGGH

SEQ ID NO: 1260528 - protein, 9 aa, Homo Sapiens
ENNNLSKLQ

SEQ ID NO: 1260529 - protein, 9 aa, Homo Sapiens
LMATVLNVY

SEQ ID NO: 1260530 - protein, 9 aa, Homo Sapiens
TRKRDISLS

SEQ ID NO: 1260531 - protein, 9 aa, Homo Sapiens
VSGVYDGKI

SEQ ID NO: 1260532 - protein, 9 aa, Homo Sapiens
CSKGGCGSC

SEQ ID NO: 1260533 - protein, 9 aa, Homo Sapiens
HLLCKAPQD

SEQ ID NO: 1260534 - protein, 9 aa, Homo Sapiens
WQQERSFLD

SEQ ID NO: 1260535 - protein, 9 aa, Homo Sapiens
TVHNPEMCQ

SEQ ID NO: 1260536 - protein, 9 aa, Homo Sapiens
LPILKLACA

SEQ ID NO: 1260537 - protein, 9 aa, Homo Sapiens
VFGQVCALS

SEQ ID NO: 1260538 - protein, 9 aa, Homo Sapiens
ILCQLTVSN

SEQ ID NO: 1260539 - protein, 9 aa, Homo Sapiens
YQHQLLEPC

SEQ ID NO: 1260540 - protein, 9 aa, Homo Sapiens
VSCHTQFSI

SEQ ID NO: 1260541 - protein, 9 aa, Homo Sapiens
KTISGDMRG

SEQ ID NO: 1260542 - protein, 9 aa, Homo Sapiens
CQADPTCSD

SEQ ID NO: 1260543 - protein, 9 aa, Homo Sapiens
EDARKSLAQ

SEQ ID NO: 1260544 - protein, 9 aa, Homo Sapiens
ASDWGSPFH

SEQ ID NO: 1260545 - protein, 9 aa, Homo Sapiens
LHLQITRTL

SEQ ID NO: 1260546 - protein, 9 aa, Homo Sapiens
VAYAIQKLF

SEQ ID NO: 1260547 - protein, 9 aa, Homo Sapiens
RTQYMKYMY

SEQ ID NO: 1260548 - protein, 9 aa, Homo Sapiens
NHGYFLIVT

SEQ ID NO: 1260549 - protein, 9 aa, Homo Sapiens
RQTLREDRM

SEQ ID NO: 1260550 - protein, 9 aa, Homo Sapiens
ALSGHLGTV

SEQ ID NO: 1260551 - protein, 9 aa, Homo Sapiens
AQLKQKLQE

SEQ ID NO: 1260552 - protein, 9 aa, Homo Sapiens
GSHLPAIPR

SEQ ID NO: 1260553 - protein, 9 aa, Homo Sapiens
TLLKIELVL

SEQ ID NO: 1260554 - protein, 9 aa, Homo Sapiens
IYIQRHVNV

SEQ ID NO: 1260555 - protein, 9 aa, Homo Sapiens
STAEQDCLA

SEQ ID NO: 1260556 - protein, 9 aa, Homo Sapiens
CWSRRFHLN

SEQ ID NO: 1260557 - protein, 9 aa, Homo Sapiens
DVVAELARK

SEQ ID NO: 1260558 - protein, 9 aa, Homo Sapiens
GHPLDIQIL

SEQ ID NO: 1260559 - protein, 9 aa, Homo Sapiens
PDVLNDHGV

SEQ ID NO: 1260560 - protein, 9 aa, Homo Sapiens
VSFHHLAFN

SEQ ID NO: 1260561 - protein, 9 aa, Homo Sapiens
LSSIKTRCE

SEQ ID NO: 1260562 - protein, 9 aa, Homo Sapiens
SFCFSPLWL

SEQ ID NO: 1260563 - protein, 9 aa, Homo Sapiens
STMKMAHTP

SEQ ID NO: 1260564 - protein, 9 aa, Homo Sapiens
ESSQLAELP

SEQ ID NO: 1260565 - protein, 9 aa, Homo Sapiens
LHARQILHP

SEQ ID NO: 1260566 - protein, 9 aa, Homo Sapiens
GVPMHKGEH

SEQ ID NO: 1260567 - protein, 9 aa, Homo Sapiens
PSSPSTTPS

SEQ ID NO: 1260568 - protein, 9 aa, Homo Sapiens
TLSFQGRPV

SEQ ID NO: 1260569 - protein, 9 aa, Homo Sapiens
CMCTEEGPL

SEQ ID NO: 1260570 - protein, 9 aa, Homo Sapiens
AHCLQVQNV

SEQ ID NO: 1260571 - protein, 9 aa, Homo Sapiens
KYNLDFKSP

SEQ ID NO: 1260572 - protein, 9 aa, Homo Sapiens
LLGLSGYPM

SEQ ID NO: 1260573 - protein, 9 aa, Homo Sapiens
QQEGMQVVV

SEQ ID NO: 1260574 - protein, 9 aa, Homo Sapiens
KTVMGIDTS

SEQ ID NO: 1260575 - protein, 9 aa, Homo Sapiens
TTAWVLSAA

SEQ ID NO: 1260576 - protein, 9 aa, Homo Sapiens
LLEVYNWVK

SEQ ID NO: 1260577 - protein, 9 aa, Homo Sapiens
VEVKNVKSE

SEQ ID NO: 1260578 - protein, 9 aa, Homo Sapiens
TIHPSLLME

SEQ ID NO: 1260579 - protein, 9 aa, Homo Sapiens
YEEAMVHLK

SEQ ID NO: 1260580 - protein, 9 aa, Homo Sapiens
LCRETEKLS

SEQ ID NO: 1260581 - protein, 9 aa, Homo Sapiens
NWKKISING

SEQ ID NO: 1260582 - protein, 9 aa, Homo Sapiens
LTKEKEEME

SEQ ID NO: 1260583 - protein, 9 aa, Homo Sapiens
DEVSRILTS

SEQ ID NO: 1260584 - protein, 9 aa, Homo Sapiens
PSDLDLLVP

SEQ ID NO: 1260585 - protein, 9 aa, Homo Sapiens
KKSYILLWK

SEQ ID NO: 1260586 - protein, 9 aa, Homo Sapiens
VDAAPPVGL

SEQ ID NO: 1260587 - protein, 9 aa, Homo Sapiens
SRTEPSMAT

SEQ ID NO: 1260588 - protein, 9 aa, Homo Sapiens
KTKVFQPKR

SEQ ID NO: 1260589 - protein, 9 aa, Homo Sapiens
KHVWDRAVE

SEQ ID NO: 1260590 - protein, 9 aa, Homo Sapiens
TIAKHNQVE

SEQ ID NO: 1260591 - protein, 9 aa, Homo Sapiens
AFTTFCGGL

SEQ ID NO: 1260592 - protein, 9 aa, Homo Sapiens
LPVAQEIFR

SEQ ID NO: 1260593 - protein, 9 aa, Homo Sapiens
TGEKHCKCT

SEQ ID NO: 1260594 - protein, 9 aa, Homo Sapiens
QCTGQPLPQ

SEQ ID NO: 1260595 - protein, 9 aa, Homo Sapiens
MLNPCNTKI

SEQ ID NO: 1260596 - protein, 9 aa, Homo Sapiens
PLTPREQTW

SEQ ID NO: 1260597 - protein, 9 aa, Homo Sapiens
TDVSSESDS

SEQ ID NO: 1260598 - protein, 9 aa, Homo Sapiens
FDNTRDPDT

SEQ ID NO: 1260599 - protein, 9 aa, Homo Sapiens
EEEPVELRG

SEQ ID NO: 1260600 - protein, 9 aa, Homo Sapiens
ARYAILQQL

SEQ ID NO: 1260601 - protein, 9 aa, Homo Sapiens
PFKYEFCDV

SEQ ID NO: 1260602 - protein, 9 aa, Homo Sapiens
HEPVLVQLV

SEQ ID NO: 1260603 - protein, 9 aa, Homo Sapiens
GSSFSVKRK

SEQ ID NO: 1260604 - protein, 9 aa, Homo Sapiens
PQGDIEVLG

SEQ ID NO: 1260605 - protein, 9 aa, Homo Sapiens
FSSFALTIL

SEQ ID NO: 1260606 - protein, 9 aa, Homo Sapiens
AQIRCPKGS

SEQ ID NO: 1260607 - protein, 9 aa, Homo Sapiens
PDKDGDKDE

SEQ ID NO: 1260608 - protein, 9 aa, Homo Sapiens
YCRKFDIAI

SEQ ID NO: 1260609 - protein, 9 aa, Homo Sapiens
KTTNLEETR

SEQ ID NO: 1260610 - protein, 9 aa, Homo Sapiens
PKLPCSSLP

SEQ ID NO: 1260611 - protein, 9 aa, Homo Sapiens
HYGRLADPA

SEQ ID NO: 1260612 - protein, 9 aa, Homo Sapiens
YSNWRKGEN

SEQ ID NO: 1260613 - protein, 9 aa, Homo Sapiens
AGWLQDVTV

SEQ ID NO: 1260614 - protein, 9 aa, Homo Sapiens
TSPSEETWI

SEQ ID NO: 1260615 - protein, 9 aa, Homo Sapiens
QVDFRERNK

SEQ ID NO: 1260616 - protein, 9 aa, Homo Sapiens
TQQPMKSPG

SEQ ID NO: 1260617 - protein, 9 aa, Homo Sapiens
FLVRNPGGW

SEQ ID NO: 1260618 - protein, 9 aa, Homo Sapiens
QMDHEQDRE

SEQ ID NO: 1260619 - protein, 9 aa, Homo Sapiens
LYVWAHLNR

SEQ ID NO: 1260620 - protein, 9 aa, Homo Sapiens
RCRQQQQLL

SEQ ID NO: 1260621 - protein, 9 aa, Homo Sapiens
ETLVLVGMG

SEQ ID NO: 1260622 - protein, 9 aa, Homo Sapiens
IGFTLMFWR

SEQ ID NO: 1260623 - protein, 9 aa, Homo Sapiens
THSPEEIRG

SEQ ID NO: 1260624 - protein, 9 aa, Homo Sapiens
NDDINLLGV

SEQ ID NO: 1260625 - protein, 9 aa, Homo Sapiens
VFAHALHFF

SEQ ID NO: 1260626 - protein, 9 aa, Homo Sapiens
IPCGPSCER

SEQ ID NO: 1260627 - protein, 9 aa, Homo Sapiens
ALYCGQGVQ

SEQ ID NO: 1260628 - protein, 9 aa, Homo Sapiens
PGIKVDGLT

SEQ ID NO: 1260629 - protein, 9 aa, Homo Sapiens
AKDLHWLYL

SEQ ID NO: 1260630 - protein, 9 aa, Homo Sapiens
MNERGRDQC

SEQ ID NO: 1260631 - protein, 9 aa, Homo Sapiens
QRYHSLILT

SEQ ID NO: 1260632 - protein, 9 aa, Homo Sapiens
NHGMSLTIH

SEQ ID NO: 1260633 - protein, 9 aa, Homo Sapiens
TCSSGINWI

SEQ ID NO: 1260634 - protein, 9 aa, Homo Sapiens
DAMYQEGLG

SEQ ID NO: 1260635 - protein, 9 aa, Homo Sapiens
HVLFQSSLM

SEQ ID NO: 1260636 - protein, 9 aa, Homo Sapiens
SGGQKQRIV

SEQ ID NO: 1260637 - protein, 9 aa, Homo Sapiens
YMAHNRKDM

SEQ ID NO: 1260638 - protein, 9 aa, Homo Sapiens
IYVLVTSCG

SEQ ID NO: 1260639 - protein, 9 aa, Homo Sapiens
KTCATCKGD

SEQ ID NO: 1260640 - protein, 9 aa, Homo Sapiens
EVIQVYIGS

SEQ ID NO: 1260641 - protein, 9 aa, Homo Sapiens
FKFDMDELN

SEQ ID NO: 1260642 - protein, 9 aa, Homo Sapiens
YINIKPARK

SEQ ID NO: 1260643 - protein, 9 aa, Homo Sapiens
PPTRDTPHA

SEQ ID NO: 1260644 - protein, 9 aa, Homo Sapiens
TVLMTSLPF

SEQ ID NO: 1260645 - protein, 9 aa, Homo Sapiens
AAEDVTNEK

SEQ ID NO: 1260646 - protein, 9 aa, Homo Sapiens
KQIERVYFE

SEQ ID NO: 1260647 - protein, 9 aa, Homo Sapiens
GRGNQARYV

SEQ ID NO: 1260648 - protein, 9 aa, Homo Sapiens
SRGKSRWRK

SEQ ID NO: 1260649 - protein, 9 aa, Homo Sapiens
IVQRRKTIN

SEQ ID NO: 1260650 - protein, 9 aa, Homo Sapiens
TGTHRHIHS

SEQ ID NO: 1260651 - protein, 9 aa, Homo Sapiens
ADSTFSGFL

SEQ ID NO: 1260652 - protein, 9 aa, Homo Sapiens
ESVSDHCHH

SEQ ID NO: 1260653 - protein, 9 aa, Homo Sapiens
KLYSLHTQE

SEQ ID NO: 1260654 - protein, 9 aa, Homo Sapiens
IGEIPYECE

SEQ ID NO: 1260655 - protein, 9 aa, Homo Sapiens
LPTPVVQFH

SEQ ID NO: 1260656 - protein, 9 aa, Homo Sapiens
TGSGKNSGT

SEQ ID NO: 1260657 - protein, 9 aa, Homo Sapiens
PVTPAATET

SEQ ID NO: 1260658 - protein, 9 aa, Homo Sapiens
LTLPQTRCD

SEQ ID NO: 1260659 - protein, 9 aa, Homo Sapiens
YILHPQVIM

SEQ ID NO: 1260660 - protein, 9 aa, Homo Sapiens
KDLEMRVIR

SEQ ID NO: 1260661 - protein, 9 aa, Homo Sapiens
PVVQFHPLL

SEQ ID NO: 1260662 - protein, 9 aa, Homo Sapiens
QKMQSRMDQ

SEQ ID NO: 1260663 - protein, 9 aa, Homo Sapiens
HSLDVVGKI

SEQ ID NO: 1260664 - protein, 9 aa, Homo Sapiens
ARPFSGNLR

SEQ ID NO: 1260665 - protein, 9 aa, Homo Sapiens
EEDHSAGSV

SEQ ID NO: 1260666 - protein, 9 aa, Homo Sapiens
TDTHSHRHT

SEQ ID NO: 1260667 - protein, 9 aa, Homo Sapiens
SQGHHPESM

SEQ ID NO: 1260668 - protein, 9 aa, Homo Sapiens
NSYFKCKEK

SEQ ID NO: 1260669 - protein, 9 aa, Homo Sapiens
SLADIENHN

SEQ ID NO: 1260670 - protein, 9 aa, Homo Sapiens
GADSGILPE

SEQ ID NO: 1260671 - protein, 9 aa, Homo Sapiens
NGHELRIIQ

SEQ ID NO: 1260672 - protein, 9 aa, Homo Sapiens
TNGHPHCMS

SEQ ID NO: 1260673 - protein, 9 aa, Homo Sapiens
KNPFECNDC

SEQ ID NO: 1260674 - protein, 9 aa, Homo Sapiens
VKAMGTLQI

SEQ ID NO: 1260675 - protein, 9 aa, Homo Sapiens
QRLTDIFRH

SEQ ID NO: 1260676 - protein, 9 aa, Homo Sapiens
DKDSGQNTW

SEQ ID NO: 1260677 - protein, 9 aa, Homo Sapiens
EGVRQQVFT

SEQ ID NO: 1260678 - protein, 9 aa, Homo Sapiens
KPVISAFVG

SEQ ID NO: 1260679 - protein, 9 aa, Homo Sapiens
KCLDVYQPE

SEQ ID NO: 1260680 - protein, 9 aa, Homo Sapiens
DYKFPIEYA

SEQ ID NO: 1260681 - protein, 9 aa, Homo Sapiens
HEATDSLYM

SEQ ID NO: 1260682 - protein, 9 aa, Homo Sapiens
NEEEDDDEN

SEQ ID NO: 1260683 - protein, 9 aa, Homo Sapiens
YSPRPTYSC

SEQ ID NO: 1260684 - protein, 9 aa, Homo Sapiens
ELRHKPQCG

SEQ ID NO: 1260685 - protein, 9 aa, Homo Sapiens
PASSEVVSY

SEQ ID NO: 1260686 - protein, 9 aa, Homo Sapiens
SVVLCCLRS

SEQ ID NO: 1260687 - protein, 9 aa, Homo Sapiens
TMLASALGV

SEQ ID NO: 1260688 - protein, 9 aa, Homo Sapiens
EVGRREPVE

SEQ ID NO: 1260689 - protein, 9 aa, Homo Sapiens
LPPRFVMQA

SEQ ID NO: 1260690 - protein, 9 aa, Homo Sapiens
MLIKPKELV

SEQ ID NO: 1260691 - protein, 9 aa, Homo Sapiens
DSTDTQEDQ

SEQ ID NO: 1260692 - protein, 9 aa, Homo Sapiens
SEMLVDVAT

SEQ ID NO: 1260693 - protein, 9 aa, Homo Sapiens
SCKTPFLVD

SEQ ID NO: 1260694 - protein, 9 aa, Homo Sapiens
ECRIIPEAC

SEQ ID NO: 1260695 - protein, 9 aa, Homo Sapiens
HMDMVLPEV

SEQ ID NO: 1260696 - protein, 9 aa, Homo Sapiens
VLRKLDHIL

SEQ ID NO: 1260697 - protein, 9 aa, Homo Sapiens
KCGKAFGLY

SEQ ID NO: 1260698 - protein, 9 aa, Homo Sapiens
EAVSLPDEG

SEQ ID NO: 1260699 - protein, 9 aa, Homo Sapiens
MDTALTAAN

SEQ ID NO: 1260700 - protein, 9 aa, Homo Sapiens
CCATVATSV

SEQ ID NO: 1260701 - protein, 9 aa, Homo Sapiens
DLEHGQPPI

SEQ ID NO: 1260702 - protein, 9 aa, Homo Sapiens
GIDTSGTFN

SEQ ID NO: 1260703 - protein, 9 aa, Homo Sapiens
GDMYTPPDI

SEQ ID NO: 1260704 - protein, 9 aa, Homo Sapiens
FEMEGFFAL

SEQ ID NO: 1260705 - protein, 9 aa, Homo Sapiens
RAALDGFLA

SEQ ID NO: 1260706 - protein, 9 aa, Homo Sapiens
AVPVRRWKE

SEQ ID NO: 1260707 - protein, 9 aa, Homo Sapiens
SVSVTAAAE

SEQ ID NO: 1260708 - protein, 9 aa, Homo Sapiens
ASSCSSSPT

SEQ ID NO: 1260709 - protein, 9 aa, Homo Sapiens
EHPSCGSTC

SEQ ID NO: 1260710 - protein, 9 aa, Homo Sapiens
ECCIRGATA

SEQ ID NO: 1260711 - protein, 9 aa, Homo Sapiens
EEREMSKGL

SEQ ID NO: 1260712 - protein, 9 aa, Homo Sapiens
TCPCDTRLR

SEQ ID NO: 1260713 - protein, 9 aa, Homo Sapiens
VFAMCMTGA

SEQ ID NO: 1260714 - protein, 9 aa, Homo Sapiens
GKGKKKQHL

SEQ ID NO: 1260715 - protein, 9 aa, Homo Sapiens
AGGLPAQCL

SEQ ID NO: 1260716 - protein, 9 aa, Homo Sapiens
PPAPKWRRR

SEQ ID NO: 1260717 - protein, 9 aa, Homo Sapiens
LLLMKQALD

SEQ ID NO: 1260718 - protein, 9 aa, Homo Sapiens
IQVRSIQQT

SEQ ID NO: 1260719 - protein, 9 aa, Homo Sapiens
KLDHCRHVS

SEQ ID NO: 1260720 - protein, 9 aa, Homo Sapiens
KDNQTRYVG

SEQ ID NO: 1260721 - protein, 9 aa, Homo Sapiens
HVTNQGMTS

SEQ ID NO: 1260722 - protein, 9 aa, Homo Sapiens
WSSMRRTAF

SEQ ID NO: 1260723 - protein, 9 aa, Homo Sapiens
DYNHTHGGK

SEQ ID NO: 1260724 - protein, 9 aa, Homo Sapiens
KTLFIIFSH

SEQ ID NO: 1260725 - protein, 9 aa, Homo Sapiens
YSGGKKIPL

SEQ ID NO: 1260726 - protein, 9 aa, Homo Sapiens
RYNVYQSEA

SEQ ID NO: 1260727 - protein, 9 aa, Homo Sapiens
TCAGCGKNF

SEQ ID NO: 1260728 - protein, 9 aa, Homo Sapiens
PWWDIPSCR

SEQ ID NO: 1260729 - protein, 9 aa, Homo Sapiens
SGIGIISFM

SEQ ID NO: 1260730 - protein, 9 aa, Homo Sapiens
EGNSCEIYG

SEQ ID NO: 1260731 - protein, 9 aa, Homo Sapiens
VLGDCTRSP

SEQ ID NO: 1260732 - protein, 9 aa, Homo Sapiens
LIWKGPGNC

SEQ ID NO: 1260733 - protein, 9 aa, Homo Sapiens
KGYLFMYNR

SEQ ID NO: 1260734 - protein, 9 aa, Homo Sapiens
LGQELLRIT

SEQ ID NO: 1260735 - protein, 9 aa, Homo Sapiens
PGDRDVTYS

SEQ ID NO: 1260736 - protein, 9 aa, Homo Sapiens
VFITMANVF

SEQ ID NO: 1260737 - protein, 9 aa, Homo Sapiens
ANIFVRVKA

SEQ ID NO: 1260738 - protein, 9 aa, Homo Sapiens
DFKKPVLPV

SEQ ID NO: 1260739 - protein, 9 aa, Homo Sapiens
FWEDNFNCK

SEQ ID NO: 1260740 - protein, 9 aa, Homo Sapiens
NKCIYFLIK

SEQ ID NO: 1260741 - protein, 9 aa, Homo Sapiens
GSPEECGLI

SEQ ID NO: 1260742 - protein, 9 aa, Homo Sapiens
GGTYTDGEG

SEQ ID NO: 1260743 - protein, 9 aa, Homo Sapiens
MAKEGGASI

SEQ ID NO: 1260744 - protein, 9 aa, Homo Sapiens
YNNRGNECS

SEQ ID NO: 1260745 - protein, 9 aa, Homo Sapiens
SLGSTPYIS

SEQ ID NO: 1260746 - protein, 9 aa, Homo Sapiens
GAAVGSVCY

SEQ ID NO: 1260747 - protein, 9 aa, Homo Sapiens
PASNTERMQ

SEQ ID NO: 1260748 - protein, 9 aa, Homo Sapiens
HYFHKVADQ

SEQ ID NO: 1260749 - protein, 9 aa, Homo Sapiens
QGQQCLTTH

SEQ ID NO: 1260750 - protein, 9 aa, Homo Sapiens
LDKEGVIEP

SEQ ID NO: 1260751 - protein, 9 aa, Homo Sapiens
KGSMSLSPP

SEQ ID NO: 1260752 - protein, 9 aa, Homo Sapiens
CLRLADMEH

SEQ ID NO: 1260753 - protein, 9 aa, Homo Sapiens
RHCLSLVII

SEQ ID NO: 1260754 - protein, 9 aa, Homo Sapiens
VCDDGWDLH

SEQ ID NO: 1260755 - protein, 9 aa, Homo Sapiens
TSSKKVVVS

SEQ ID NO: 1260756 - protein, 9 aa, Homo Sapiens
CATVATSVE

SEQ ID NO: 1260757 - protein, 9 aa, Homo Sapiens
RMSQPLQCL

SEQ ID NO: 1260758 - protein, 9 aa, Homo Sapiens
KEKNEKGVL

SEQ ID NO: 1260759 - protein, 9 aa, Homo Sapiens
LAYYILHGH

SEQ ID NO: 1260760 - protein, 9 aa, Homo Sapiens
EDAGEQREV

SEQ ID NO: 1260761 - protein, 9 aa, Homo Sapiens
QLDLYVNIT

SEQ ID NO: 1260762 - protein, 9 aa, Homo Sapiens
VDGQEEKYT

SEQ ID NO: 1260763 - protein, 9 aa, Homo Sapiens
AAQAISCFA

SEQ ID NO: 1260764 - protein, 9 aa, Homo Sapiens
TLAYVNSLV

SEQ ID NO: 1260765 - protein, 9 aa, Homo Sapiens
GSGIECMGP

SEQ ID NO: 1260766 - protein, 9 aa, Homo Sapiens
ERCPQEPRP

SEQ ID NO: 1260767 - protein, 9 aa, Homo Sapiens
QKVIVHHAM

SEQ ID NO: 1260768 - protein, 9 aa, Homo Sapiens
SNTRIIHTA

SEQ ID NO: 1260769 - protein, 9 aa, Homo Sapiens
KSNTGDAID

SEQ ID NO: 1260770 - protein, 9 aa, Homo Sapiens
PFHPPPLHY

SEQ ID NO: 1260771 - protein, 9 aa, Homo Sapiens
HHKSKDRYC

SEQ ID NO: 1260772 - protein, 9 aa, Homo Sapiens
HLEAEIVLH

SEQ ID NO: 1260773 - protein, 9 aa, Homo Sapiens
GQEHFSTSG

SEQ ID NO: 1260774 - protein, 9 aa, Homo Sapiens
FLLNGSSLE

SEQ ID NO: 1260775 - protein, 9 aa, Homo Sapiens
GDAEYVYYK

SEQ ID NO: 1260776 - protein, 9 aa, Homo Sapiens
FYTDQYVQE

SEQ ID NO: 1260777 - protein, 9 aa, Homo Sapiens
IISLECSES

SEQ ID NO: 1260778 - protein, 9 aa, Homo Sapiens
QNGEKEDHF

SEQ ID NO: 1260779 - protein, 9 aa, Homo Sapiens
SDHTIGVLF

SEQ ID NO: 1260780 - protein, 9 aa, Homo Sapiens
GRHKQYPIS

SEQ ID NO: 1260781 - protein, 9 aa, Homo Sapiens
FHPVAAAAA

SEQ ID NO: 1260782 - protein, 9 aa, Homo Sapiens
PMPLSGRLV

SEQ ID NO: 1260783 - protein, 9 aa, Homo Sapiens
QSEGESWPD

SEQ ID NO: 1260784 - protein, 9 aa, Homo Sapiens
RSLGYPGIQ

SEQ ID NO: 1260785 - protein, 9 aa, Homo Sapiens
LLSYPSDDM

SEQ ID NO: 1260786 - protein, 9 aa, Homo Sapiens
MNPGEVTSM

SEQ ID NO: 1260787 - protein, 9 aa, Homo Sapiens
EFAPDSRHI

SEQ ID NO: 1260788 - protein, 9 aa, Homo Sapiens
GVHINIAIV

SEQ ID NO: 1260789 - protein, 9 aa, Homo Sapiens
DLVWSKVGP

SEQ ID NO: 1260790 - protein, 9 aa, Homo Sapiens
IQMWSIWDP

SEQ ID NO: 1260791 - protein, 9 aa, Homo Sapiens
GCGYGGGLG

SEQ ID NO: 1260792 - protein, 9 aa, Homo Sapiens
RVFRELKVL

SEQ ID NO: 1260793 - protein, 9 aa, Homo Sapiens
AAFHLAIYT

SEQ ID NO: 1260794 - protein, 9 aa, Homo Sapiens
TERINDLEL

SEQ ID NO: 1260795 - protein, 9 aa, Homo Sapiens
HRTLKNFEL

SEQ ID NO: 1260796 - protein, 9 aa, Homo Sapiens
LTSWPHWLY

SEQ ID NO: 1260797 - protein, 9 aa, Homo Sapiens
PLPVFAYTH

SEQ ID NO: 1260798 - protein, 9 aa, Homo Sapiens
LDPTGTVIM

SEQ ID NO: 1260799 - protein, 9 aa, Homo Sapiens
DTKFLASFS

SEQ ID NO: 1260800 - protein, 9 aa, Homo Sapiens
LDLSEGEED

SEQ ID NO: 1260801 - protein, 9 aa, Homo Sapiens
FTDIFLDSG

SEQ ID NO: 1260802 - protein, 9 aa, Homo Sapiens
SISMRAQDR

SEQ ID NO: 1260803 - protein, 9 aa, Homo Sapiens
MWHIYVSLE

SEQ ID NO: 1260804 - protein, 9 aa, Homo Sapiens
SSPRSPAGV

SEQ ID NO: 1260805 - protein, 9 aa, Homo Sapiens
VLNDHGVFL

SEQ ID NO: 1260806 - protein, 9 aa, Homo Sapiens
CFRPKGSNK

SEQ ID NO: 1260807 - protein, 9 aa, Homo Sapiens
YAIKMTVSE

SEQ ID NO: 1260808 - protein, 9 aa, Homo Sapiens
KPFSCPQCS

SEQ ID NO: 1260809 - protein, 9 aa, Homo Sapiens
GTLFLSLSR

SEQ ID NO: 1260810 - protein, 9 aa, Homo Sapiens
KILRHGIGL

SEQ ID NO: 1260811 - protein, 9 aa, Homo Sapiens
QSRWHSAPY

SEQ ID NO: 1260812 - protein, 9 aa, Homo Sapiens
DDTKLLVLN

SEQ ID NO: 1260813 - protein, 9 aa, Homo Sapiens
VLQDNIFDL

SEQ ID NO: 1260814 - protein, 9 aa, Homo Sapiens
QHALAAAAK

SEQ ID NO: 1260815 - protein, 9 aa, Homo Sapiens
MNADCSSGP

SEQ ID NO: 1260816 - protein, 9 aa, Homo Sapiens
RLRETLLGG

SEQ ID NO: 1260817 - protein, 9 aa, Homo Sapiens
MMQAFVTAT

SEQ ID NO: 1260818 - protein, 9 aa, Homo Sapiens
IPTSLAVGF

SEQ ID NO: 1260819 - protein, 9 aa, Homo Sapiens
IKHSVMVDA

SEQ ID NO: 1260820 - protein, 9 aa, Homo Sapiens
CQNPAPLWQ

SEQ ID NO: 1260821 - protein, 9 aa, Homo Sapiens
QQVLYMVTN

SEQ ID NO: 1260822 - protein, 9 aa, Homo Sapiens
HYSTLRKIV

SEQ ID NO: 1260823 - protein, 9 aa, Homo Sapiens
FLNRLVPTG

SEQ ID NO: 1260824 - protein, 9 aa, Homo Sapiens
DLERILARH

SEQ ID NO: 1260825 - protein, 9 aa, Homo Sapiens
RPDIYPYFG

SEQ ID NO: 1260826 - protein, 9 aa, Homo Sapiens
SLDLTLTHP

SEQ ID NO: 1260827 - protein, 9 aa, Homo Sapiens
FDGVAVVDP

SEQ ID NO: 1260828 - protein, 9 aa, Homo Sapiens
TSQHPDYGQ

SEQ ID NO: 1260829 - protein, 9 aa, Homo Sapiens
RRLGRCSVS

SEQ ID NO: 1260830 - protein, 9 aa, Homo Sapiens
KKHFVYQKV

SEQ ID NO: 1260831 - protein, 9 aa, Homo Sapiens
EFSNNGGKW

SEQ ID NO: 1260832 - protein, 9 aa, Homo Sapiens
KADGLSKDT

SEQ ID NO: 1260833 - protein, 9 aa, Homo Sapiens
IENFIQKQE

SEQ ID NO: 1260834 - protein, 9 aa, Homo Sapiens
MPYSAPNVP

SEQ ID NO: 1260835 - protein, 9 aa, Homo Sapiens
NKHHMIMFL

SEQ ID NO: 1260836 - protein, 9 aa, Homo Sapiens
MTERIREMQ

SEQ ID NO: 1260837 - protein, 9 aa, Homo Sapiens
DYKSGPPMQ

SEQ ID NO: 1260838 - protein, 9 aa, Homo Sapiens
EKKDSIMGL

SEQ ID NO: 1260839 - protein, 9 aa, Homo Sapiens
AAFPSKAMF

SEQ ID NO: 1260840 - protein, 9 aa, Homo Sapiens
AHFTLGPLV

SEQ ID NO: 1260841 - protein, 9 aa, Homo Sapiens
DVLYMVRFK

SEQ ID NO: 1260842 - protein, 9 aa, Homo Sapiens
IGNMMSIYS

SEQ ID NO: 1260843 - protein, 9 aa, Homo Sapiens
RELDIQISK

SEQ ID NO: 1260844 - protein, 9 aa, Homo Sapiens
DVSGPVFDF

SEQ ID NO: 1260845 - protein, 9 aa, Homo Sapiens
DRVSTLTKA

SEQ ID NO: 1260846 - protein, 9 aa, Homo Sapiens
TTQAPRLLS

SEQ ID NO: 1260847 - protein, 9 aa, Homo Sapiens
RKAAKVHLE

SEQ ID NO: 1260848 - protein, 9 aa, Homo Sapiens
ALPRPQLQS

SEQ ID NO: 1260849 - protein, 9 aa, Homo Sapiens
YSCNTRFHF

SEQ ID NO: 1260850 - protein, 9 aa, Homo Sapiens
WKPDSARVH

SEQ ID NO: 1260851 - protein, 9 aa, Homo Sapiens
GVPVGIMAV

SEQ ID NO: 1260852 - protein, 9 aa, Homo Sapiens
TLVDAQLDY

SEQ ID NO: 1260853 - protein, 9 aa, Homo Sapiens
LLEPDMIIR

SEQ ID NO: 1260854 - protein, 9 aa, Homo Sapiens
CCLPFFQDR

SEQ ID NO: 1260855 - protein, 9 aa, Homo Sapiens
QYVKDVQFA

SEQ ID NO: 1260856 - protein, 9 aa, Homo Sapiens
ITSQDCVQN

SEQ ID NO: 1260857 - protein, 9 aa, Homo Sapiens
FIISRTYPI

SEQ ID NO: 1260858 - protein, 9 aa, Homo Sapiens
IRSLNPELE

SEQ ID NO: 1260859 - protein, 9 aa, Homo Sapiens
EKGAILKVE

SEQ ID NO: 1260860 - protein, 9 aa, Homo Sapiens
EEKDNSDYI

SEQ ID NO: 1260861 - protein, 9 aa, Homo Sapiens
PLPVHSACH

SEQ ID NO: 1260862 - protein, 9 aa, Homo Sapiens
TTTTTTEEQ

SEQ ID NO: 1260863 - protein, 9 aa, Homo Sapiens
DEKISVCGR

SEQ ID NO: 1260864 - protein, 9 aa, Homo Sapiens
PTVNYFGKH

SEQ ID NO: 1260865 - protein, 9 aa, Homo Sapiens
EEVDATRGQ

SEQ ID NO: 1260866 - protein, 9 aa, Homo Sapiens
RISCLYNEK

SEQ ID NO: 1260867 - protein, 9 aa, Homo Sapiens
IHNITASDS

SEQ ID NO: 1260868 - protein, 9 aa, Homo Sapiens
FDSHDSMCP

SEQ ID NO: 1260869 - protein, 9 aa, Homo Sapiens
KREMDELKP

SEQ ID NO: 1260870 - protein, 9 aa, Homo Sapiens
GRLNMHINV

SEQ ID NO: 1260871 - protein, 9 aa, Homo Sapiens
GPLLYRHRL

SEQ ID NO: 1260872 - protein, 9 aa, Homo Sapiens
LSTLYISLN

SEQ ID NO: 1260873 - protein, 9 aa, Homo Sapiens
KADLEVQVQ

SEQ ID NO: 1260874 - protein, 9 aa, Homo Sapiens
VDNFEDCSL

SEQ ID NO: 1260875 - protein, 9 aa, Homo Sapiens
SKKKLKLAP

SEQ ID NO: 1260876 - protein, 9 aa, Homo Sapiens
RSHYAKCIP

SEQ ID NO: 1260877 - protein, 9 aa, Homo Sapiens
RLSHLHGMS

SEQ ID NO: 1260878 - protein, 9 aa, Homo Sapiens
NQKKENEIR

SEQ ID NO: 1260879 - protein, 9 aa, Homo Sapiens
VKLFKLPCL

SEQ ID NO: 1260880 - protein, 9 aa, Homo Sapiens
LVGDVIRQS

SEQ ID NO: 1260881 - protein, 9 aa, Homo Sapiens
GDLAAHLGY

SEQ ID NO: 1260882 - protein, 9 aa, Homo Sapiens
ISSAWTDSN

SEQ ID NO: 1260883 - protein, 9 aa, Homo Sapiens
CRPPCPFAP

SEQ ID NO: 1260884 - protein, 9 aa, Homo Sapiens
LPTDANIFV

SEQ ID NO: 1260885 - protein, 9 aa, Homo Sapiens
WVSRATPAA

SEQ ID NO: 1260886 - protein, 9 aa, Homo Sapiens
KESSMNIIG

SEQ ID NO: 1260887 - protein, 9 aa, Homo Sapiens
VDAISISII

SEQ ID NO: 1260888 - protein, 9 aa, Homo Sapiens
RPRHVILDP

SEQ ID NO: 1260889 - protein, 9 aa, Homo Sapiens
SPGPVLPQE

SEQ ID NO: 1260890 - protein, 9 aa, Homo Sapiens
KEKKRFSSH

SEQ ID NO: 1260891 - protein, 9 aa, Homo Sapiens
SGTGFWTGL

SEQ ID NO: 1260892 - protein, 9 aa, Homo Sapiens
EMTVIVNSM

SEQ ID NO: 1260893 - protein, 9 aa, Homo Sapiens
TSSQAKVLL

SEQ ID NO: 1260894 - protein, 9 aa, Homo Sapiens
HKEKKSRKN

SEQ ID NO: 1260895 - protein, 9 aa, Homo Sapiens
EDDTNFFLS

SEQ ID NO: 1260896 - protein, 9 aa, Homo Sapiens
HRKVCENPK

SEQ ID NO: 1260897 - protein, 9 aa, Homo Sapiens
DAIYKDLTA

SEQ ID NO: 1260898 - protein, 9 aa, Homo Sapiens
WHKPKVSSI

SEQ ID NO: 1260899 - protein, 9 aa, Homo Sapiens
QSDTEANER

SEQ ID NO: 1260900 - protein, 9 aa, Homo Sapiens
DNQEDSVIM

SEQ ID NO: 1260901 - protein, 9 aa, Homo Sapiens
GQGAMFRLS

SEQ ID NO: 1260902 - protein, 9 aa, Homo Sapiens
EGNHLLGGS

SEQ ID NO: 1260903 - protein, 9 aa, Homo Sapiens
ALSPAADAP

SEQ ID NO: 1260904 - protein, 9 aa, Homo Sapiens
LNAENTGPT

SEQ ID NO: 1260905 - protein, 9 aa, Homo Sapiens
MLYKPSPDY

SEQ ID NO: 1260906 - protein, 9 aa, Homo Sapiens
RECDRQKEQ

SEQ ID NO: 1260907 - protein, 9 aa, Homo Sapiens
TVCHSKIRS

SEQ ID NO: 1260908 - protein, 9 aa, Homo Sapiens
KTYCFMVDS

SEQ ID NO: 1260909 - protein, 9 aa, Homo Sapiens
DFEHPTRDG

SEQ ID NO: 1260910 - protein, 9 aa, Homo Sapiens
SMASDPLCL

SEQ ID NO: 1260911 - protein, 9 aa, Homo Sapiens
PRSIGRLCE

SEQ ID NO: 1260912 - protein, 9 aa, Homo Sapiens
PFLHPGFCC

SEQ ID NO: 1260913 - protein, 9 aa, Homo Sapiens
LRHKPQCGE

SEQ ID NO: 1260914 - protein, 9 aa, Homo Sapiens
AARKWPSTL

SEQ ID NO: 1260915 - protein, 9 aa, Homo Sapiens
ETYECCLDE

SEQ ID NO: 1260916 - protein, 9 aa, Homo Sapiens
SLCKLKFRF

SEQ ID NO: 1260917 - protein, 9 aa, Homo Sapiens
LASPGTSSE

SEQ ID NO: 1260918 - protein, 9 aa, Homo Sapiens
MHLASTLVQ

SEQ ID NO: 1260919 - protein, 9 aa, Homo Sapiens
ERMLVDAPP

SEQ ID NO: 1260920 - protein, 9 aa, Homo Sapiens
VLAEPNRIP

SEQ ID NO: 1260921 - protein, 9 aa, Homo Sapiens
KCWEMKSVY

SEQ ID NO: 1260922 - protein, 9 aa, Homo Sapiens
PTPTPSWSC

SEQ ID NO: 1260923 - protein, 9 aa, Homo Sapiens
LSHAAVQRI

SEQ ID NO: 1260924 - protein, 9 aa, Homo Sapiens
CMATWRKNR

SEQ ID NO: 1260925 - protein, 9 aa, Homo Sapiens
TTWWDLFYK

SEQ ID NO: 1260926 - protein, 9 aa, Homo Sapiens
LPAWMTLSV

SEQ ID NO: 1260927 - protein, 9 aa, Homo Sapiens
KDGDETITT

SEQ ID NO: 1260928 - protein, 9 aa, Homo Sapiens
KKIESYLHS

SEQ ID NO: 1260929 - protein, 9 aa, Homo Sapiens
FKRTHYYQI

SEQ ID NO: 1260930 - protein, 9 aa, Homo Sapiens
AAATTSPTL

SEQ ID NO: 1260931 - protein, 9 aa, Homo Sapiens
LRVKAADQD

SEQ ID NO: 1260932 - protein, 9 aa, Homo Sapiens
IIFHKISDV

SEQ ID NO: 1260933 - protein, 9 aa, Homo Sapiens
PGSTCLLSP

SEQ ID NO: 1260934 - protein, 9 aa, Homo Sapiens
YVLKLLLNK

SEQ ID NO: 1260935 - protein, 9 aa, Homo Sapiens
ICVPLVIVI

SEQ ID NO: 1260936 - protein, 9 aa, Homo Sapiens
SCTYIRSNL

SEQ ID NO: 1260937 - protein, 9 aa, Homo Sapiens
GRASPAPRS

SEQ ID NO: 1260938 - protein, 9 aa, Homo Sapiens
IKFVLKVDS

SEQ ID NO: 1260939 - protein, 9 aa, Homo Sapiens
PEYASLVRE

SEQ ID NO: 1260940 - protein, 9 aa, Homo Sapiens
AKLLAYNQH

SEQ ID NO: 1260941 - protein, 9 aa, Homo Sapiens
QGARAQPQT

SEQ ID NO: 1260942 - protein, 9 aa, Homo Sapiens
DEEHRIRIR

SEQ ID NO: 1260943 - protein, 9 aa, Homo Sapiens
HLGTPITVR

SEQ ID NO: 1260944 - protein, 9 aa, Homo Sapiens
MHTVPDKDG

SEQ ID NO: 1260945 - protein, 9 aa, Homo Sapiens
SGQEETRGP

SEQ ID NO: 1260946 - protein, 9 aa, Homo Sapiens
GCCGEQDRQ

SEQ ID NO: 1260947 - protein, 9 aa, Homo Sapiens
KWGKLPGPT

SEQ ID NO: 1260948 - protein, 9 aa, Homo Sapiens
GSHCTPPSP

SEQ ID NO: 1260949 - protein, 9 aa, Homo Sapiens
DNQLIGTMQ

SEQ ID NO: 1260950 - protein, 9 aa, Homo Sapiens
CLYGPIAFK

SEQ ID NO: 1260951 - protein, 9 aa, Homo Sapiens
DTDGNDTIN

SEQ ID NO: 1260952 - protein, 9 aa, Homo Sapiens
AIDGTFVFV

SEQ ID NO: 1260953 - protein, 9 aa, Homo Sapiens
QIPEPLREE

SEQ ID NO: 1260954 - protein, 9 aa, Homo Sapiens
GSKDINKNK

SEQ ID NO: 1260955 - protein, 9 aa, Homo Sapiens
MFIECLDCD

SEQ ID NO: 1260956 - protein, 9 aa, Homo Sapiens
LPYNFPKEI

SEQ ID NO: 1260957 - protein, 9 aa, Homo Sapiens
FLYLLGHDI

SEQ ID NO: 1260958 - protein, 9 aa, Homo Sapiens
QGSRKKGME

SEQ ID NO: 1260959 - protein, 9 aa, Homo Sapiens
ELAEAIKCR

SEQ ID NO: 1260960 - protein, 9 aa, Homo Sapiens
PQGVLVRHN

SEQ ID NO: 1260961 - protein, 9 aa, Homo Sapiens
SSSVISQRT

SEQ ID NO: 1260962 - protein, 9 aa, Homo Sapiens
GWWEFPPKN

SEQ ID NO: 1260963 - protein, 9 aa, Homo Sapiens
FCESCLQNY

SEQ ID NO: 1260964 - protein, 9 aa, Homo Sapiens
HTGSNIDCE

SEQ ID NO: 1260965 - protein, 9 aa, Homo Sapiens
SGEVMHGSS

SEQ ID NO: 1260966 - protein, 9 aa, Homo Sapiens
LRGFDQDMV

SEQ ID NO: 1260967 - protein, 9 aa, Homo Sapiens
TPDALPEEK

SEQ ID NO: 1260968 - protein, 9 aa, Homo Sapiens
KHRGHARES

SEQ ID NO: 1260969 - protein, 9 aa, Homo Sapiens
EVPMPQMCS

SEQ ID NO: 1260970 - protein, 9 aa, Homo Sapiens
ELIPLMNIE

SEQ ID NO: 1260971 - protein, 9 aa, Homo Sapiens
ELYTTHSLI

SEQ ID NO: 1260972 - protein, 9 aa, Homo Sapiens
SAAVLNPRG

SEQ ID NO: 1260973 - protein, 9 aa, Homo Sapiens
YQNKARRSR

SEQ ID NO: 1260974 - protein, 9 aa, Homo Sapiens
DKCWVLGRD

SEQ ID NO: 1260975 - protein, 9 aa, Homo Sapiens
HVHIQSQIT

SEQ ID NO: 1260976 - protein, 9 aa, Homo Sapiens
RKTDLTGLP

SEQ ID NO: 1260977 - protein, 9 aa, Homo Sapiens
ERSPSPSTQ

SEQ ID NO: 1260978 - protein, 9 aa, Homo Sapiens
IVLYILCKS

SEQ ID NO: 1260979 - protein, 9 aa, Homo Sapiens
EYEETPWDT

SEQ ID NO: 1260980 - protein, 9 aa, Homo Sapiens
LSYLDQCHR

SEQ ID NO: 1260981 - protein, 9 aa, Homo Sapiens
TPRSLIPPI

SEQ ID NO: 1260982 - protein, 9 aa, Homo Sapiens
HHCLNACIQ

SEQ ID NO: 1260983 - protein, 9 aa, Homo Sapiens
PGLELFRWP

SEQ ID NO: 1260984 - protein, 9 aa, Homo Sapiens
TEHLITHTG

SEQ ID NO: 1260985 - protein, 9 aa, Homo Sapiens
PTEPPMNKH

SEQ ID NO: 1260986 - protein, 9 aa, Homo Sapiens
CRTTPSWCL

SEQ ID NO: 1260987 - protein, 9 aa, Homo Sapiens
GIHASKDAN

SEQ ID NO: 1260988 - protein, 9 aa, Homo Sapiens
KPLFHIYLL

SEQ ID NO: 1260989 - protein, 9 aa, Homo Sapiens
LPTPVLTIV

SEQ ID NO: 1260990 - protein, 9 aa, Homo Sapiens
TVSLTSYTS

SEQ ID NO: 1260991 - protein, 9 aa, Homo Sapiens
AKENRCAAI

SEQ ID NO: 1260992 - protein, 9 aa, Homo Sapiens
RHMENLVAY

SEQ ID NO: 1260993 - protein, 9 aa, Homo Sapiens
RIIPEACRG

SEQ ID NO: 1260994 - protein, 9 aa, Homo Sapiens
SIQSVATFP

SEQ ID NO: 1260995 - protein, 9 aa, Homo Sapiens
QIPWDKNHE

SEQ ID NO: 1260996 - protein, 9 aa, Homo Sapiens
LFFWDQLCS

SEQ ID NO: 1260997 - protein, 9 aa, Homo Sapiens
FQEKRLHSP

SEQ ID NO: 1260998 - protein, 9 aa, Homo Sapiens
MCLLKDKGL

SEQ ID NO: 1260999 - protein, 9 aa, Homo Sapiens
IVGILIAHY

SEQ ID NO: 1261000 - protein, 9 aa, Homo Sapiens
GKIIRAQLE

SEQ ID NO: 1261001 - protein, 9 aa, Homo Sapiens
AQIEKCIQE

SEQ ID NO: 1261002 - protein, 9 aa, Homo Sapiens
ISCSNSEGY

SEQ ID NO: 1261003 - protein, 9 aa, Homo Sapiens
SMYMSEAGE

SEQ ID NO: 1261004 - protein, 9 aa, Homo Sapiens
MNAAPMKEA

SEQ ID NO: 1261005 - protein, 9 aa, Homo Sapiens
SFGVVLGVF

SEQ ID NO: 1261006 - protein, 9 aa, Homo Sapiens
ICLGPLFFP

SEQ ID NO: 1261007 - protein, 9 aa, Homo Sapiens
SPTRPVVFL

SEQ ID NO: 1261008 - protein, 9 aa, Homo Sapiens
SLWQLKTKE

SEQ ID NO: 1261009 - protein, 9 aa, Homo Sapiens
YHAIYFVML

SEQ ID NO: 1261010 - protein, 9 aa, Homo Sapiens
TTLGQMATY

SEQ ID NO: 1261011 - protein, 9 aa, Homo Sapiens
PLVATGHLL

SEQ ID NO: 1261012 - protein, 9 aa, Homo Sapiens
LLQTFLDDD

SEQ ID NO: 1261013 - protein, 9 aa, Homo Sapiens
IENNFTKLI

SEQ ID NO: 1261014 - protein, 9 aa, Homo Sapiens
HVARAHKQD

SEQ ID NO: 1261015 - protein, 9 aa, Homo Sapiens
CGSTCGCRW

SEQ ID NO: 1261016 - protein, 9 aa, Homo Sapiens
GMLLGDIII

SEQ ID NO: 1261017 - protein, 9 aa, Homo Sapiens
PCSSCCSWW

SEQ ID NO: 1261018 - protein, 9 aa, Homo Sapiens
ALAIVFMGA

SEQ ID NO: 1261019 - protein, 9 aa, Homo Sapiens
FSSSWQDVI

SEQ ID NO: 1261020 - protein, 9 aa, Homo Sapiens
WAPPSATRA

SEQ ID NO: 1261021 - protein, 9 aa, Homo Sapiens
RERRREGHS

SEQ ID NO: 1261022 - protein, 9 aa, Homo Sapiens
TSSHLILLW

SEQ ID NO: 1261023 - protein, 9 aa, Homo Sapiens
CAEGHKCGE

SEQ ID NO: 1261024 - protein, 9 aa, Homo Sapiens
YCCALIALE

SEQ ID NO: 1261025 - protein, 9 aa, Homo Sapiens
YSGIPLNIT

SEQ ID NO: 1261026 - protein, 9 aa, Homo Sapiens
GLGGVGMHL

SEQ ID NO: 1261027 - protein, 9 aa, Homo Sapiens
TVYPGLELP

SEQ ID NO: 1261028 - protein, 9 aa, Homo Sapiens
VVDTKILIL

SEQ ID NO: 1261029 - protein, 9 aa, Homo Sapiens
WAIFPVWSP

SEQ ID NO: 1261030 - protein, 9 aa, Homo Sapiens
GNVLVIITV

SEQ ID NO: 1261031 - protein, 9 aa, Homo Sapiens
VPELRDSRD

SEQ ID NO: 1261032 - protein, 9 aa, Homo Sapiens
SHDKHVFTV

SEQ ID NO: 1261033 - protein, 9 aa, Homo Sapiens
NMGVTLEAS

SEQ ID NO: 1261034 - protein, 9 aa, Homo Sapiens
TIWMCRHPR

SEQ ID NO: 1261035 - protein, 9 aa, Homo Sapiens
VAAAVWVVV

SEQ ID NO: 1261036 - protein, 9 aa, Homo Sapiens
CGPATWGSR

SEQ ID NO: 1261037 - protein, 9 aa, Homo Sapiens
YIPLLYWIN

SEQ ID NO: 1261038 - protein, 9 aa, Homo Sapiens
RQPHVDFVG

SEQ ID NO: 1261039 - protein, 9 aa, Homo Sapiens
LVEHLKFIP

SEQ ID NO: 1261040 - protein, 9 aa, Homo Sapiens
EKCQGAKTV

SEQ ID NO: 1261041 - protein, 9 aa, Homo Sapiens
FGLVKLFKL

SEQ ID NO: 1261042 - protein, 9 aa, Homo Sapiens
SSPYTSVYE

SEQ ID NO: 1261043 - protein, 9 aa, Homo Sapiens
ISHAQMLLS

SEQ ID NO: 1261044 - protein, 9 aa, Homo Sapiens
KWITKIEVP

SEQ ID NO: 1261045 - protein, 9 aa, Homo Sapiens
DQDLFLLNG

SEQ ID NO: 1261046 - protein, 9 aa, Homo Sapiens
EMKATYINI

SEQ ID NO: 1261047 - protein, 9 aa, Homo Sapiens
TGYDLRADV

SEQ ID NO: 1261048 - protein, 9 aa, Homo Sapiens
QKQRIVIAR

SEQ ID NO: 1261049 - protein, 9 aa, Homo Sapiens
LEDEKPEYI

SEQ ID NO: 1261050 - protein, 9 aa, Homo Sapiens
LSLTSSPNL

SEQ ID NO: 1261051 - protein, 9 aa, Homo Sapiens
QYRVCQEIL

SEQ ID NO: 1261052 - protein, 9 aa, Homo Sapiens
GFYLPLESG

SEQ ID NO: 1261053 - protein, 9 aa, Homo Sapiens
SDTDGCRLS

SEQ ID NO: 1261054 - protein, 9 aa, Homo Sapiens
EEERKEDKE

SEQ ID NO: 1261055 - protein, 9 aa, Homo Sapiens
GVLLLVFIL

SEQ ID NO: 1261056 - protein, 9 aa, Homo Sapiens
VVFFILWYN

SEQ ID NO: 1261057 - protein, 9 aa, Homo Sapiens
AVGSPFART

SEQ ID NO: 1261058 - protein, 9 aa, Homo Sapiens
RCFHHCNPG

SEQ ID NO: 1261059 - protein, 9 aa, Homo Sapiens
AMFKLLNTH

SEQ ID NO: 1261060 - protein, 9 aa, Homo Sapiens
YTCEECDKA

SEQ ID NO: 1261061 - protein, 9 aa, Homo Sapiens
NVLEILQYC

SEQ ID NO: 1261062 - protein, 9 aa, Homo Sapiens
ESEDEGDEF

SEQ ID NO: 1261063 - protein, 9 aa, Homo Sapiens
IDMHFRSLC

SEQ ID NO: 1261064 - protein, 9 aa, Homo Sapiens
GLLLRFLAV

SEQ ID NO: 1261065 - protein, 9 aa, Homo Sapiens
WNRITTASS

SEQ ID NO: 1261066 - protein, 9 aa, Homo Sapiens
FRALHQASE

SEQ ID NO: 1261067 - protein, 9 aa, Homo Sapiens
HGAETRRIS

SEQ ID NO: 1261068 - protein, 9 aa, Homo Sapiens
TWEMPGATV

SEQ ID NO: 1261069 - protein, 9 aa, Homo Sapiens
VCFMEELGE

SEQ ID NO: 1261070 - protein, 9 aa, Homo Sapiens
QPCSSVDTR

SEQ ID NO: 1261071 - protein, 9 aa, Homo Sapiens
WNFLPMWMR

SEQ ID NO: 1261072 - protein, 9 aa, Homo Sapiens
FITAVLTKL

SEQ ID NO: 1261073 - protein, 9 aa, Homo Sapiens
ISKFPELLF

SEQ ID NO: 1261074 - protein, 9 aa, Homo Sapiens
KLESGHFPS

SEQ ID NO: 1261075 - protein, 9 aa, Homo Sapiens
WAENGGRPP

SEQ ID NO: 1261076 - protein, 9 aa, Homo Sapiens
LRQRFMASW

SEQ ID NO: 1261077 - protein, 9 aa, Homo Sapiens
ACRRCMATW

SEQ ID NO: 1261078 - protein, 9 aa, Homo Sapiens
TWLPVSDDT

SEQ ID NO: 1261079 - protein, 9 aa, Homo Sapiens
NLVNMSFLY

SEQ ID NO: 1261080 - protein, 9 aa, Homo Sapiens
SAWTDSNSQ

SEQ ID NO: 1261081 - protein, 9 aa, Homo Sapiens
TTITTIVQT

SEQ ID NO: 1261082 - protein, 9 aa, Homo Sapiens
IKGEMKELL

SEQ ID NO: 1261083 - protein, 9 aa, Homo Sapiens
AETHTLGSL

SEQ ID NO: 1261084 - protein, 9 aa, Homo Sapiens
CKMSLLFDH

SEQ ID NO: 1261085 - protein, 9 aa, Homo Sapiens
VNFSSISMT

SEQ ID NO: 1261086 - protein, 9 aa, Homo Sapiens
SEYPLSCFT

SEQ ID NO: 1261087 - protein, 9 aa, Homo Sapiens
TTNQPVKMA

SEQ ID NO: 1261088 - protein, 9 aa, Homo Sapiens
QQLSLEMPE

SEQ ID NO: 1261089 - protein, 9 aa, Homo Sapiens
VISVEVFLP

SEQ ID NO: 1261090 - protein, 9 aa, Homo Sapiens
STKISLIKS

SEQ ID NO: 1261091 - protein, 9 aa, Homo Sapiens
EMKEVVGLK

SEQ ID NO: 1261092 - protein, 9 aa, Homo Sapiens
DMGQFIKHL

SEQ ID NO: 1261093 - protein, 9 aa, Homo Sapiens
GRSRSRPPA

SEQ ID NO: 1261094 - protein, 9 aa, Homo Sapiens
NPPKQEVHR

SEQ ID NO: 1261095 - protein, 9 aa, Homo Sapiens
MCAARLTDP

SEQ ID NO: 1261096 - protein, 9 aa, Homo Sapiens
KTRPKQEKD

SEQ ID NO: 1261097 - protein, 9 aa, Homo Sapiens
TRLYQSVLS

SEQ ID NO: 1261098 - protein, 9 aa, Homo Sapiens
RYDGLGWRV

SEQ ID NO: 1261099 - protein, 9 aa, Homo Sapiens
VHLPLYAAI

SEQ ID NO: 1261100 - protein, 9 aa, Homo Sapiens
WLCIICAMK

SEQ ID NO: 1261101 - protein, 9 aa, Homo Sapiens
TLAVLPTLR

SEQ ID NO: 1261102 - protein, 9 aa, Homo Sapiens
VKRFQKKLY

SEQ ID NO: 1261103 - protein, 9 aa, Homo Sapiens
LHKMDSFTQ

SEQ ID NO: 1261104 - protein, 9 aa, Homo Sapiens
KFDIAIRLQ

SEQ ID NO: 1261105 - protein, 9 aa, Homo Sapiens
VQEGTRCYR

SEQ ID NO: 1261106 - protein, 9 aa, Homo Sapiens
YFDGVAVVD

SEQ ID NO: 1261107 - protein, 9 aa, Homo Sapiens
SSNQKRELD

SEQ ID NO: 1261108 - protein, 9 aa, Homo Sapiens
EHLMGGGRR

SEQ ID NO: 1261109 - protein, 9 aa, Homo Sapiens
EHTGMLDVW

SEQ ID NO: 1261110 - protein, 9 aa, Homo Sapiens
TGPRPLLEF

SEQ ID NO: 1261111 - protein, 9 aa, Homo Sapiens
GGSLLGVLQ

SEQ ID NO: 1261112 - protein, 9 aa, Homo Sapiens
LLSMTVTKL

SEQ ID NO: 1261113 - protein, 9 aa, Homo Sapiens
RDLNAVKYV

SEQ ID NO: 1261114 - protein, 9 aa, Homo Sapiens
REVHLCCEL

SEQ ID NO: 1261115 - protein, 9 aa, Homo Sapiens
REMDELKPW

SEQ ID NO: 1261116 - protein, 9 aa, Homo Sapiens
MKYSKPSIK

SEQ ID NO: 1261117 - protein, 9 aa, Homo Sapiens
ARGCTQDLV

SEQ ID NO: 1261118 - protein, 9 aa, Homo Sapiens
AFTTSSHII

SEQ ID NO: 1261119 - protein, 9 aa, Homo Sapiens
VGQKCSEWM

SEQ ID NO: 1261120 - protein, 9 aa, Homo Sapiens
RHQNCSFPL

SEQ ID NO: 1261121 - protein, 9 aa, Homo Sapiens
PKASCLLPP

SEQ ID NO: 1261122 - protein, 9 aa, Homo Sapiens
KEQDQRPIH

SEQ ID NO: 1261123 - protein, 9 aa, Homo Sapiens
LDVEYNNGP

SEQ ID NO: 1261124 - protein, 9 aa, Homo Sapiens
EPNVLNECL

SEQ ID NO: 1261125 - protein, 9 aa, Homo Sapiens
EKKALLFHT

SEQ ID NO: 1261126 - protein, 9 aa, Homo Sapiens
DHPKARNEV

SEQ ID NO: 1261127 - protein, 9 aa, Homo Sapiens
ISQENVKAA

SEQ ID NO: 1261128 - protein, 9 aa, Homo Sapiens
DSSMYQCVA

SEQ ID NO: 1261129 - protein, 9 aa, Homo Sapiens
NDKSPEEVC

SEQ ID NO: 1261130 - protein, 9 aa, Homo Sapiens
AQVDFRERN

SEQ ID NO: 1261131 - protein, 9 aa, Homo Sapiens
IKEVRIMHW

SEQ ID NO: 1261132 - protein, 9 aa, Homo Sapiens
LQHPNALQC

SEQ ID NO: 1261133 - protein, 9 aa, Homo Sapiens
VFLVVFLYM

SEQ ID NO: 1261134 - protein, 9 aa, Homo Sapiens
EMRVIRWFD

SEQ ID NO: 1261135 - protein, 9 aa, Homo Sapiens
HYRMEKSGK

SEQ ID NO: 1261136 - protein, 9 aa, Homo Sapiens
KMLPSQQRE

SEQ ID NO: 1261137 - protein, 9 aa, Homo Sapiens
NPNCRLCNT

SEQ ID NO: 1261138 - protein, 9 aa, Homo Sapiens
KQVMAKHPR

SEQ ID NO: 1261139 - protein, 9 aa, Homo Sapiens
KLTKIENLR

SEQ ID NO: 1261140 - protein, 9 aa, Homo Sapiens
RPLHRWLQQ

SEQ ID NO: 1261141 - protein, 9 aa, Homo Sapiens
RPYLADQDR

SEQ ID NO: 1261142 - protein, 9 aa, Homo Sapiens
CEWVKFAKP

SEQ ID NO: 1261143 - protein, 9 aa, Homo Sapiens
MGACYENVI

SEQ ID NO: 1261144 - protein, 9 aa, Homo Sapiens
HIAMCDDDP

SEQ ID NO: 1261145 - protein, 9 aa, Homo Sapiens
FVCSFMEPW

SEQ ID NO: 1261146 - protein, 9 aa, Homo Sapiens
SNPHTITGP

SEQ ID NO: 1261147 - protein, 9 aa, Homo Sapiens
EGPLTVITI

SEQ ID NO: 1261148 - protein, 9 aa, Homo Sapiens
CSCGHPWVA

SEQ ID NO: 1261149 - protein, 9 aa, Homo Sapiens
QIVANYELI

SEQ ID NO: 1261150 - protein, 9 aa, Homo Sapiens
EARLNPPTQ

SEQ ID NO: 1261151 - protein, 9 aa, Homo Sapiens
VELQFSKDF

SEQ ID NO: 1261152 - protein, 9 aa, Homo Sapiens
IETKNKNVR

SEQ ID NO: 1261153 - protein, 9 aa, Homo Sapiens
TFMPLAKQQ

SEQ ID NO: 1261154 - protein, 9 aa, Homo Sapiens
KQRPKANSA

SEQ ID NO: 1261155 - protein, 9 aa, Homo Sapiens
FFAPTILTP

SEQ ID NO: 1261156 - protein, 9 aa, Homo Sapiens
CDDMALSGP

SEQ ID NO: 1261157 - protein, 9 aa, Homo Sapiens
NDSPDVLND

SEQ ID NO: 1261158 - protein, 9 aa, Homo Sapiens
VDYCQQLIV

SEQ ID NO: 1261159 - protein, 9 aa, Homo Sapiens
GHRAFLSYV

SEQ ID NO: 1261160 - protein, 9 aa, Homo Sapiens
PLAEPAAQP

SEQ ID NO: 1261161 - protein, 9 aa, Homo Sapiens
EEHIYALRW

SEQ ID NO: 1261162 - protein, 9 aa, Homo Sapiens
QTWTRLPRR

SEQ ID NO: 1261163 - protein, 9 aa, Homo Sapiens
RSTRAEMGG

SEQ ID NO: 1261164 - protein, 9 aa, Homo Sapiens
SGILVSLTS

SEQ ID NO: 1261165 - protein, 9 aa, Homo Sapiens
QVPKGLENP

SEQ ID NO: 1261166 - protein, 9 aa, Homo Sapiens
QVAPSRRLK

SEQ ID NO: 1261167 - protein, 9 aa, Homo Sapiens
LFDNTRDPD

SEQ ID NO: 1261168 - protein, 9 aa, Homo Sapiens
SDPELLKQM

SEQ ID NO: 1261169 - protein, 9 aa, Homo Sapiens
IFHVNPVGH

SEQ ID NO: 1261170 - protein, 9 aa, Homo Sapiens
EVMVQMLLD

SEQ ID NO: 1261171 - protein, 9 aa, Homo Sapiens
ARGTSPIRH

SEQ ID NO: 1261172 - protein, 9 aa, Homo Sapiens
TRNKVAEHL

SEQ ID NO: 1261173 - protein, 9 aa, Homo Sapiens
LTGLPEGAP

SEQ ID NO: 1261174 - protein, 9 aa, Homo Sapiens
DGGRHCALG

SEQ ID NO: 1261175 - protein, 9 aa, Homo Sapiens
KLQLKAVDV

SEQ ID NO: 1261176 - protein, 9 aa, Homo Sapiens
TGIRIKEGC

SEQ ID NO: 1261177 - protein, 9 aa, Homo Sapiens
THEPTSSTF

SEQ ID NO: 1261178 - protein, 9 aa, Homo Sapiens
VAMVQALEE

SEQ ID NO: 1261179 - protein, 9 aa, Homo Sapiens
APMEGKIIK

SEQ ID NO: 1261180 - protein, 9 aa, Homo Sapiens
FARGCTQDL

SEQ ID NO: 1261181 - protein, 9 aa, Homo Sapiens
LKNPHLIFD

SEQ ID NO: 1261182 - protein, 9 aa, Homo Sapiens
IKVASLDCE

SEQ ID NO: 1261183 - protein, 9 aa, Homo Sapiens
TYTDGEGYT

SEQ ID NO: 1261184 - protein, 9 aa, Homo Sapiens
ALMWLQEPQ

SEQ ID NO: 1261185 - protein, 9 aa, Homo Sapiens
QSHHGHPGS

SEQ ID NO: 1261186 - protein, 9 aa, Homo Sapiens
LNASLGSWM

SEQ ID NO: 1261187 - protein, 9 aa, Homo Sapiens
GTGGHMMNC

SEQ ID NO: 1261188 - protein, 9 aa, Homo Sapiens
DSHKQPVAF

SEQ ID NO: 1261189 - protein, 9 aa, Homo Sapiens
ECREKNVER

SEQ ID NO: 1261190 - protein, 9 aa, Homo Sapiens
RQWNRCQYC

SEQ ID NO: 1261191 - protein, 9 aa, Homo Sapiens
GVAEWQRSL

SEQ ID NO: 1261192 - protein, 9 aa, Homo Sapiens
DKHHTPPMI

SEQ ID NO: 1261193 - protein, 9 aa, Homo Sapiens
PEAPLTPRE

SEQ ID NO: 1261194 - protein, 9 aa, Homo Sapiens
TAHNTLGRS

SEQ ID NO: 1261195 - protein, 9 aa, Homo Sapiens
LRSRRFSSL

SEQ ID NO: 1261196 - protein, 9 aa, Homo Sapiens
VKVWLAAVR

SEQ ID NO: 1261197 - protein, 9 aa, Homo Sapiens
CKQTSECLR

SEQ ID NO: 1261198 - protein, 9 aa, Homo Sapiens
NASEYTSYQ

SEQ ID NO: 1261199 - protein, 9 aa, Homo Sapiens
PGYESVSDI

SEQ ID NO: 1261200 - protein, 9 aa, Homo Sapiens
HIVLKLMPI

SEQ ID NO: 1261201 - protein, 9 aa, Homo Sapiens
QDPVKTEMG

SEQ ID NO: 1261202 - protein, 9 aa, Homo Sapiens
STTAAFVAA

SEQ ID NO: 1261203 - protein, 9 aa, Homo Sapiens
HDCHEFGNI

SEQ ID NO: 1261204 - protein, 9 aa, Homo Sapiens
EEAEQHQGP

SEQ ID NO: 1261205 - protein, 9 aa, Homo Sapiens
LLVLDEDLA

SEQ ID NO: 1261206 - protein, 9 aa, Homo Sapiens
KNVRFIGEL

SEQ ID NO: 1261207 - protein, 9 aa, Homo Sapiens
VRPWLPPRR

SEQ ID NO: 1261208 - protein, 9 aa, Homo Sapiens
SLSPPHPVL

SEQ ID NO: 1261209 - protein, 9 aa, Homo Sapiens
TVIQIIHIP

SEQ ID NO: 1261210 - protein, 9 aa, Homo Sapiens
RNLRQQSGI

SEQ ID NO: 1261211 - protein, 9 aa, Homo Sapiens
SGTIDFEES

SEQ ID NO: 1261212 - protein, 9 aa, Homo Sapiens
KPDILNTIK

SEQ ID NO: 1261213 - protein, 9 aa, Homo Sapiens
GAANGQILE

SEQ ID NO: 1261214 - protein, 9 aa, Homo Sapiens
SLQPFCTVC

SEQ ID NO: 1261215 - protein, 9 aa, Homo Sapiens
GGIAGRSAD

SEQ ID NO: 1261216 - protein, 9 aa, Homo Sapiens
RFHVKFTLE

SEQ ID NO: 1261217 - protein, 9 aa, Homo Sapiens
DPHTCWEYC

SEQ ID NO: 1261218 - protein, 9 aa, Homo Sapiens
YGDQSMHRE

SEQ ID NO: 1261219 - protein, 9 aa, Homo Sapiens
CSKTCCLGM

SEQ ID NO: 1261220 - protein, 9 aa, Homo Sapiens
SSQPPRGGT

SEQ ID NO: 1261221 - protein, 9 aa, Homo Sapiens
DLEDKLEKI

SEQ ID NO: 1261222 - protein, 9 aa, Homo Sapiens
YMAHLQIQS

SEQ ID NO: 1261223 - protein, 9 aa, Homo Sapiens
QAALLGDLI

SEQ ID NO: 1261224 - protein, 9 aa, Homo Sapiens
QVNGEQHHW

SEQ ID NO: 1261225 - protein, 9 aa, Homo Sapiens
DVQSMPKTC

SEQ ID NO: 1261226 - protein, 9 aa, Homo Sapiens
NLPSKVLDD

SEQ ID NO: 1261227 - protein, 9 aa, Homo Sapiens
SKYTVNAFE

SEQ ID NO: 1261228 - protein, 9 aa, Homo Sapiens
YCNGAGLVN

SEQ ID NO: 1261229 - protein, 9 aa, Homo Sapiens
VIARALLKN

SEQ ID NO: 1261230 - protein, 9 aa, Homo Sapiens
HTGIHTDTD

SEQ ID NO: 1261231 - protein, 9 aa, Homo Sapiens
WTSQYFGVL

SEQ ID NO: 1261232 - protein, 9 aa, Homo Sapiens
SQALSAHTI

SEQ ID NO: 1261233 - protein, 9 aa, Homo Sapiens
AKSVRDHYA

SEQ ID NO: 1261234 - protein, 9 aa, Homo Sapiens
SLTRAQQPY

SEQ ID NO: 1261235 - protein, 9 aa, Homo Sapiens
SPCTRFNQG

SEQ ID NO: 1261236 - protein, 9 aa, Homo Sapiens
IEQSTSIRL

SEQ ID NO: 1261237 - protein, 9 aa, Homo Sapiens
SNPNRNWDT

SEQ ID NO: 1261238 - protein, 9 aa, Homo Sapiens
HQGHHVRIS

SEQ ID NO: 1261239 - protein, 9 aa, Homo Sapiens
HDFSFTPTG

SEQ ID NO: 1261240 - protein, 9 aa, Homo Sapiens
KEVLLIGII

SEQ ID NO: 1261241 - protein, 9 aa, Homo Sapiens
SHNWQTACD

SEQ ID NO: 1261242 - protein, 9 aa, Homo Sapiens
PCAACVDRI

SEQ ID NO: 1261243 - protein, 9 aa, Homo Sapiens
ALKLLVMED

SEQ ID NO: 1261244 - protein, 9 aa, Homo Sapiens
TLKWGLYIA

SEQ ID NO: 1261245 - protein, 9 aa, Homo Sapiens
WTVRGSCGW

SEQ ID NO: 1261246 - protein, 9 aa, Homo Sapiens
EDIVVLAEE

SEQ ID NO: 1261247 - protein, 9 aa, Homo Sapiens
SHECAWGCC

SEQ ID NO: 1261248 - protein, 9 aa, Homo Sapiens
MFEGGPRPW

SEQ ID NO: 1261249 - protein, 9 aa, Homo Sapiens
WADAKCVLE

SEQ ID NO: 1261250 - protein, 9 aa, Homo Sapiens
TEHFNGVDE

SEQ ID NO: 1261251 - protein, 9 aa, Homo Sapiens
CKYTGSLQY

SEQ ID NO: 1261252 - protein, 9 aa, Homo Sapiens
RSGMQVSQD

SEQ ID NO: 1261253 - protein, 9 aa, Homo Sapiens
NKKGWLPLH

SEQ ID NO: 1261254 - protein, 9 aa, Homo Sapiens
IQEHTKPIQ

SEQ ID NO: 1261255 - protein, 9 aa, Homo Sapiens
SKLSLEDSS

SEQ ID NO: 1261256 - protein, 9 aa, Homo Sapiens
KAENRQERE

SEQ ID NO: 1261257 - protein, 9 aa, Homo Sapiens
KCGDAEYVY

SEQ ID NO: 1261258 - protein, 9 aa, Homo Sapiens
IARRQEPAM

SEQ ID NO: 1261259 - protein, 9 aa, Homo Sapiens
MCQVTSTDH

SEQ ID NO: 1261260 - protein, 9 aa, Homo Sapiens
IADQGQLMG

SEQ ID NO: 1261261 - protein, 9 aa, Homo Sapiens
KNIYRDVML

SEQ ID NO: 1261262 - protein, 9 aa, Homo Sapiens
ARVWEATVL

SEQ ID NO: 1261263 - protein, 9 aa, Homo Sapiens
ACISIVHMY

SEQ ID NO: 1261264 - protein, 9 aa, Homo Sapiens
MAVVMVLAF

SEQ ID NO: 1261265 - protein, 9 aa, Homo Sapiens
HEHKTVYRD

SEQ ID NO: 1261266 - protein, 9 aa, Homo Sapiens
GFKDSLIVP

SEQ ID NO: 1261267 - protein, 9 aa, Homo Sapiens
VMSPSPDSE

SEQ ID NO: 1261268 - protein, 9 aa, Homo Sapiens
RDGSLHATF

SEQ ID NO: 1261269 - protein, 9 aa, Homo Sapiens
IICVEYSLM

SEQ ID NO: 1261270 - protein, 9 aa, Homo Sapiens
PMTKTWTLT

SEQ ID NO: 1261271 - protein, 9 aa, Homo Sapiens
HLMGGGRRD

SEQ ID NO: 1261272 - protein, 9 aa, Homo Sapiens
GWICWRSRW

SEQ ID NO: 1261273 - protein, 9 aa, Homo Sapiens
HISLTVAYG

SEQ ID NO: 1261274 - protein, 9 aa, Homo Sapiens
IGLSIVGKR

SEQ ID NO: 1261275 - protein, 9 aa, Homo Sapiens
LGNVQFLMD

SEQ ID NO: 1261276 - protein, 9 aa, Homo Sapiens
SAGHWISRL

SEQ ID NO: 1261277 - protein, 9 aa, Homo Sapiens
AGGTNLGAP

SEQ ID NO: 1261278 - protein, 9 aa, Homo Sapiens
EEHLLADLM

SEQ ID NO: 1261279 - protein, 9 aa, Homo Sapiens
RFLKYAEKY

SEQ ID NO: 1261280 - protein, 9 aa, Homo Sapiens
GFMTLRNPR

SEQ ID NO: 1261281 - protein, 9 aa, Homo Sapiens
KTVLFLPTD

SEQ ID NO: 1261282 - protein, 9 aa, Homo Sapiens
ESLWQLKTK

SEQ ID NO: 1261283 - protein, 9 aa, Homo Sapiens
GRPGRPRWR

SEQ ID NO: 1261284 - protein, 9 aa, Homo Sapiens
APTGIGGPY

SEQ ID NO: 1261285 - protein, 9 aa, Homo Sapiens
WYKKCLTRL

SEQ ID NO: 1261286 - protein, 9 aa, Homo Sapiens
PTAVGTMAD

SEQ ID NO: 1261287 - protein, 9 aa, Homo Sapiens
PTGIGVYSA

SEQ ID NO: 1261288 - protein, 9 aa, Homo Sapiens
YFNMYGGNP

SEQ ID NO: 1261289 - protein, 9 aa, Homo Sapiens
LKWHPDKNM

SEQ ID NO: 1261290 - protein, 9 aa, Homo Sapiens
RTTTAKSIC

SEQ ID NO: 1261291 - protein, 9 aa, Homo Sapiens
LPSSPAHSP

SEQ ID NO: 1261292 - protein, 9 aa, Homo Sapiens
GYGEANDYS

SEQ ID NO: 1261293 - protein, 9 aa, Homo Sapiens
SSVVISDCK

SEQ ID NO: 1261294 - protein, 9 aa, Homo Sapiens
EMQPMMQAH

SEQ ID NO: 1261295 - protein, 9 aa, Homo Sapiens
RYCIKDCTS

SEQ ID NO: 1261296 - protein, 9 aa, Homo Sapiens
PRAEEEAVS

SEQ ID NO: 1261297 - protein, 9 aa, Homo Sapiens
TLGYTVHDK

SEQ ID NO: 1261298 - protein, 9 aa, Homo Sapiens
VPGYCVPHT

SEQ ID NO: 1261299 - protein, 9 aa, Homo Sapiens
HDLIHEAFS

SEQ ID NO: 1261300 - protein, 9 aa, Homo Sapiens
YFRVQFLVV

SEQ ID NO: 1261301 - protein, 9 aa, Homo Sapiens
SIVSLCLVV

SEQ ID NO: 1261302 - protein, 9 aa, Homo Sapiens
KAFQHCSSL

SEQ ID NO: 1261303 - protein, 9 aa, Homo Sapiens
IQTLDCPIK

SEQ ID NO: 1261304 - protein, 9 aa, Homo Sapiens
GESHFKLRE

SEQ ID NO: 1261305 - protein, 9 aa, Homo Sapiens
ATSYFIDRD

SEQ ID NO: 1261306 - protein, 9 aa, Homo Sapiens
ENKKSQILT

SEQ ID NO: 1261307 - protein, 9 aa, Homo Sapiens
GTPRAPSVW

SEQ ID NO: 1261308 - protein, 9 aa, Homo Sapiens
NLFYTPNSS

SEQ ID NO: 1261309 - protein, 9 aa, Homo Sapiens
VVHMNQEDL

SEQ ID NO: 1261310 - protein, 9 aa, Homo Sapiens
TASSSSPAS

SEQ ID NO: 1261311 - protein, 9 aa, Homo Sapiens
VLLNEYNVI

SEQ ID NO: 1261312 - protein, 9 aa, Homo Sapiens
QWSPTRPVV

SEQ ID NO: 1261313 - protein, 9 aa, Homo Sapiens
EKPDTHKQH

SEQ ID NO: 1261314 - protein, 9 aa, Homo Sapiens
DTFEDLENP

SEQ ID NO: 1261315 - protein, 9 aa, Homo Sapiens
LCYQDAHGP

SEQ ID NO: 1261316 - protein, 9 aa, Homo Sapiens
NMNKQSKMY

SEQ ID NO: 1261317 - protein, 9 aa, Homo Sapiens
IWELTSNFN

SEQ ID NO: 1261318 - protein, 9 aa, Homo Sapiens
LERSEALLL

SEQ ID NO: 1261319 - protein, 9 aa, Homo Sapiens
NPFALSPLH

SEQ ID NO: 1261320 - protein, 9 aa, Homo Sapiens
EDEDEDEQE

SEQ ID NO: 1261321 - protein, 9 aa, Homo Sapiens
AHVFLACSF

SEQ ID NO: 1261322 - protein, 9 aa, Homo Sapiens
VAFSPSTKY

SEQ ID NO: 1261323 - protein, 9 aa, Homo Sapiens
LLHDGGRPA

SEQ ID NO: 1261324 - protein, 9 aa, Homo Sapiens
LRKRIIFHK

SEQ ID NO: 1261325 - protein, 9 aa, Homo Sapiens
QDAYSHLKN

SEQ ID NO: 1261326 - protein, 9 aa, Homo Sapiens
QVAGITGMH

SEQ ID NO: 1261327 - protein, 9 aa, Homo Sapiens
CGKHFGTTL

SEQ ID NO: 1261328 - protein, 9 aa, Homo Sapiens
TLTFQDQRY

SEQ ID NO: 1261329 - protein, 9 aa, Homo Sapiens
QAPNAQECV

SEQ ID NO: 1261330 - protein, 9 aa, Homo Sapiens
HSIRIQRDL

SEQ ID NO: 1261331 - protein, 9 aa, Homo Sapiens
VISAFVGDK

SEQ ID NO: 1261332 - protein, 9 aa, Homo Sapiens
LLSFLQQDR

SEQ ID NO: 1261333 - protein, 9 aa, Homo Sapiens
KYTPGDAPD

SEQ ID NO: 1261334 - protein, 9 aa, Homo Sapiens
REHPSCGST

SEQ ID NO: 1261335 - protein, 9 aa, Homo Sapiens
LMVGMDAAG

SEQ ID NO: 1261336 - protein, 9 aa, Homo Sapiens
LHAAWCDGL

SEQ ID NO: 1261337 - protein, 9 aa, Homo Sapiens
PLLDKNKCL

SEQ ID NO: 1261338 - protein, 9 aa, Homo Sapiens
QTDFFRKWD

SEQ ID NO: 1261339 - protein, 9 aa, Homo Sapiens
RQSKYTVNA

SEQ ID NO: 1261340 - protein, 9 aa, Homo Sapiens
IPALGVSIT

SEQ ID NO: 1261341 - protein, 9 aa, Homo Sapiens
GSVAGKALS

SEQ ID NO: 1261342 - protein, 9 aa, Homo Sapiens
RELGGRAFE

SEQ ID NO: 1261343 - protein, 9 aa, Homo Sapiens
PSSPGWTPR

SEQ ID NO: 1261344 - protein, 9 aa, Homo Sapiens
TTDVRKIMN

SEQ ID NO: 1261345 - protein, 9 aa, Homo Sapiens
GYSYECVIR

SEQ ID NO: 1261346 - protein, 9 aa, Homo Sapiens
FDFDHFSRH

SEQ ID NO: 1261347 - protein, 9 aa, Homo Sapiens
DPAALKDRH

SEQ ID NO: 1261348 - protein, 9 aa, Homo Sapiens
IISNAMYKE

SEQ ID NO: 1261349 - protein, 9 aa, Homo Sapiens
KHPLSLPSW

SEQ ID NO: 1261350 - protein, 9 aa, Homo Sapiens
KGMTKLCSA

SEQ ID NO: 1261351 - protein, 9 aa, Homo Sapiens
FREYQEEIK

SEQ ID NO: 1261352 - protein, 9 aa, Homo Sapiens
GVIIVGNLK

SEQ ID NO: 1261353 - protein, 9 aa, Homo Sapiens
PASLKEAHC

SEQ ID NO: 1261354 - protein, 9 aa, Homo Sapiens
TVIKKRDQC

SEQ ID NO: 1261355 - protein, 9 aa, Homo Sapiens
SVGYGIRKL

SEQ ID NO: 1261356 - protein, 9 aa, Homo Sapiens
AGSVGGNAG

SEQ ID NO: 1261357 - protein, 9 aa, Homo Sapiens
SQVACWTVD

SEQ ID NO: 1261358 - protein, 9 aa, Homo Sapiens
KNDKRSAFG

SEQ ID NO: 1261359 - protein, 9 aa, Homo Sapiens
VTVWTLGFA

SEQ ID NO: 1261360 - protein, 9 aa, Homo Sapiens
KPLLDKNKC

SEQ ID NO: 1261361 - protein, 9 aa, Homo Sapiens
ITDPCLQRT

SEQ ID NO: 1261362 - protein, 9 aa, Homo Sapiens
GPLFFPRRF

SEQ ID NO: 1261363 - protein, 9 aa, Homo Sapiens
FATEGLQTL

SEQ ID NO: 1261364 - protein, 9 aa, Homo Sapiens
KSITKNVQQ

SEQ ID NO: 1261365 - protein, 9 aa, Homo Sapiens
KFTPQDAYS

SEQ ID NO: 1261366 - protein, 9 aa, Homo Sapiens
GHFPSMQQL

SEQ ID NO: 1261367 - protein, 9 aa, Homo Sapiens
AAATTAAAT

SEQ ID NO: 1261368 - protein, 9 aa, Homo Sapiens
CRRCMATWR

SEQ ID NO: 1261369 - protein, 9 aa, Homo Sapiens
YTSDSEGSC

SEQ ID NO: 1261370 - protein, 9 aa, Homo Sapiens
LKIQQNICV

SEQ ID NO: 1261371 - protein, 9 aa, Homo Sapiens
NLVYFSEKL

SEQ ID NO: 1261372 - protein, 9 aa, Homo Sapiens
DIKEVRIMH

SEQ ID NO: 1261373 - protein, 9 aa, Homo Sapiens
GVNGHVTCS

SEQ ID NO: 1261374 - protein, 9 aa, Homo Sapiens
PARGTSPIR

SEQ ID NO: 1261375 - protein, 9 aa, Homo Sapiens
ATFKPFEDR

SEQ ID NO: 1261376 - protein, 9 aa, Homo Sapiens
KLQEMSEKM

SEQ ID NO: 1261377 - protein, 9 aa, Homo Sapiens
MSGSRDATL

SEQ ID NO: 1261378 - protein, 9 aa, Homo Sapiens
SGEVPMPQM

SEQ ID NO: 1261379 - protein, 9 aa, Homo Sapiens
ICCLVTSFY

SEQ ID NO: 1261380 - protein, 9 aa, Homo Sapiens
VPAFHSLQK

SEQ ID NO: 1261381 - protein, 9 aa, Homo Sapiens
TGRMRVVGW

SEQ ID NO: 1261382 - protein, 9 aa, Homo Sapiens
PHTFPKMKS

SEQ ID NO: 1261383 - protein, 9 aa, Homo Sapiens
KILWNILKP

SEQ ID NO: 1261384 - protein, 9 aa, Homo Sapiens
VLQNTSQIK

SEQ ID NO: 1261385 - protein, 9 aa, Homo Sapiens
VALNADKFS

SEQ ID NO: 1261386 - protein, 9 aa, Homo Sapiens
LSVSRAIGN

SEQ ID NO: 1261387 - protein, 9 aa, Homo Sapiens
SGSVMIQRV

SEQ ID NO: 1261388 - protein, 9 aa, Homo Sapiens
IMPYRLGPG

SEQ ID NO: 1261389 - protein, 9 aa, Homo Sapiens
FTSNALSLK

SEQ ID NO: 1261390 - protein, 9 aa, Homo Sapiens
QATVMKQHQ

SEQ ID NO: 1261391 - protein, 9 aa, Homo Sapiens
DLSKLEVYL

SEQ ID NO: 1261392 - protein, 9 aa, Homo Sapiens
HAHRKAAKV

SEQ ID NO: 1261393 - protein, 9 aa, Homo Sapiens
SHTGEKTYG

SEQ ID NO: 1261394 - protein, 9 aa, Homo Sapiens
CYLDLTRLR

SEQ ID NO: 1261395 - protein, 9 aa, Homo Sapiens
PWIQVKVEE

SEQ ID NO: 1261396 - protein, 9 aa, Homo Sapiens
SVVVLQCGS

SEQ ID NO: 1261397 - protein, 9 aa, Homo Sapiens
PRPLHRWLQ

SEQ ID NO: 1261398 - protein, 9 aa, Homo Sapiens
QKSSLSPPH

SEQ ID NO: 1261399 - protein, 9 aa, Homo Sapiens
TRMCQVTST

SEQ ID NO: 1261400 - protein, 9 aa, Homo Sapiens
DRREYSHFE

SEQ ID NO: 1261401 - protein, 9 aa, Homo Sapiens
LCYLERADA

SEQ ID NO: 1261402 - protein, 9 aa, Homo Sapiens
VDPLKAIQW

SEQ ID NO: 1261403 - protein, 9 aa, Homo Sapiens
WWAFENPHT

SEQ ID NO: 1261404 - protein, 9 aa, Homo Sapiens
SAICLLANM

SEQ ID NO: 1261405 - protein, 9 aa, Homo Sapiens
ITVHYLDET

SEQ ID NO: 1261406 - protein, 9 aa, Homo Sapiens
DDWIIAMTY

SEQ ID NO: 1261407 - protein, 9 aa, Homo Sapiens
IRSPQPGFL

SEQ ID NO: 1261408 - protein, 9 aa, Homo Sapiens
LRQFPPGMP

SEQ ID NO: 1261409 - protein, 9 aa, Homo Sapiens
LLNNVCAYD

SEQ ID NO: 1261410 - protein, 9 aa, Homo Sapiens
KSSSKRQAL

SEQ ID NO: 1261411 - protein, 9 aa, Homo Sapiens
EIHGAVYYE

SEQ ID NO: 1261412 - protein, 9 aa, Homo Sapiens
MRSHTGEKT

SEQ ID NO: 1261413 - protein, 9 aa, Homo Sapiens
MSDGSQDTE

SEQ ID NO: 1261414 - protein, 9 aa, Homo Sapiens
DVKRCEELE

SEQ ID NO: 1261415 - protein, 9 aa, Homo Sapiens
QLQCWSRRF

SEQ ID NO: 1261416 - protein, 9 aa, Homo Sapiens
PLSLRLTGG

SEQ ID NO: 1261417 - protein, 9 aa, Homo Sapiens
RRYDEFMVQ

SEQ ID NO: 1261418 - protein, 9 aa, Homo Sapiens
PWSCIFFIV

SEQ ID NO: 1261419 - protein, 9 aa, Homo Sapiens
RSKWHWQVS

SEQ ID NO: 1261420 - protein, 9 aa, Homo Sapiens
SPVERTAVW

SEQ ID NO: 1261421 - protein, 9 aa, Homo Sapiens
VEKDSGHDS

SEQ ID NO: 1261422 - protein, 9 aa, Homo Sapiens
LNPRGVVHR

SEQ ID NO: 1261423 - protein, 9 aa, Homo Sapiens
LPMAYLIYR

SEQ ID NO: 1261424 - protein, 9 aa, Homo Sapiens
IIVGYILLA

SEQ ID NO: 1261425 - protein, 9 aa, Homo Sapiens
MQAFVTATC

SEQ ID NO: 1261426 - protein, 9 aa, Homo Sapiens
KHTLQHDEI

SEQ ID NO: 1261427 - protein, 9 aa, Homo Sapiens
LLRFLAVMA

SEQ ID NO: 1261428 - protein, 9 aa, Homo Sapiens
QCPYIMEEA

SEQ ID NO: 1261429 - protein, 9 aa, Homo Sapiens
FRAHSEPED

SEQ ID NO: 1261430 - protein, 9 aa, Homo Sapiens
HCMVHTSEK

SEQ ID NO: 1261431 - protein, 9 aa, Homo Sapiens
TFVVFLVFI

SEQ ID NO: 1261432 - protein, 9 aa, Homo Sapiens
KVKCYIIEH

SEQ ID NO: 1261433 - protein, 9 aa, Homo Sapiens
THQLLAMTL

SEQ ID NO: 1261434 - protein, 9 aa, Homo Sapiens
HPTRDGLGS

SEQ ID NO: 1261435 - protein, 9 aa, Homo Sapiens
MAKPESRML

SEQ ID NO: 1261436 - protein, 9 aa, Homo Sapiens
TLGRSAPPS

SEQ ID NO: 1261437 - protein, 9 aa, Homo Sapiens
LPSPKHSAS

SEQ ID NO: 1261438 - protein, 9 aa, Homo Sapiens
PPAHESILP

SEQ ID NO: 1261439 - protein, 9 aa, Homo Sapiens
SQLTLVNLV

SEQ ID NO: 1261440 - protein, 9 aa, Homo Sapiens
NSRQPSCKN

SEQ ID NO: 1261441 - protein, 9 aa, Homo Sapiens
TPILIKVKV

SEQ ID NO: 1261442 - protein, 9 aa, Homo Sapiens
RQLLRMGGG

SEQ ID NO: 1261443 - protein, 9 aa, Homo Sapiens
VALTRLAYA

SEQ ID NO: 1261444 - protein, 9 aa, Homo Sapiens
CNTRFHFTH

SEQ ID NO: 1261445 - protein, 9 aa, Homo Sapiens
QVVTEEQVQ

SEQ ID NO: 1261446 - protein, 9 aa, Homo Sapiens
KRHRKVCEN

SEQ ID NO: 1261447 - protein, 9 aa, Homo Sapiens
HCDFVHHAL

SEQ ID NO: 1261448 - protein, 9 aa, Homo Sapiens
AFMFTVTFA

SEQ ID NO: 1261449 - protein, 9 aa, Homo Sapiens
FDMDYASWG

SEQ ID NO: 1261450 - protein, 9 aa, Homo Sapiens
STRIVGCIW

SEQ ID NO: 1261451 - protein, 9 aa, Homo Sapiens
QNKNKKKLG

SEQ ID NO: 1261452 - protein, 9 aa, Homo Sapiens
PAHSPSPAV

SEQ ID NO: 1261453 - protein, 9 aa, Homo Sapiens
CELIQGWDI

SEQ ID NO: 1261454 - protein, 9 aa, Homo Sapiens
ESDEAIVAG

SEQ ID NO: 1261455 - protein, 9 aa, Homo Sapiens
KRLEKEYTA

SEQ ID NO: 1261456 - protein, 9 aa, Homo Sapiens
GGMRSRGRG

SEQ ID NO: 1261457 - protein, 9 aa, Homo Sapiens
RKLLPHRHL

SEQ ID NO: 1261458 - protein, 9 aa, Homo Sapiens
NMKQSGEMV

SEQ ID NO: 1261459 - protein, 9 aa, Homo Sapiens
ELPRFHEVP

SEQ ID NO: 1261460 - protein, 9 aa, Homo Sapiens
LGYPEKRTQ

SEQ ID NO: 1261461 - protein, 9 aa, Homo Sapiens
YIVLIAESC

SEQ ID NO: 1261462 - protein, 9 aa, Homo Sapiens
PANGAGWPC

SEQ ID NO: 1261463 - protein, 9 aa, Homo Sapiens
ELFGDMYTP

SEQ ID NO: 1261464 - protein, 9 aa, Homo Sapiens
GIQRNHTVC

SEQ ID NO: 1261465 - protein, 9 aa, Homo Sapiens
DGDETITTK

SEQ ID NO: 1261466 - protein, 9 aa, Homo Sapiens
ISPLKSIVA

SEQ ID NO: 1261467 - protein, 9 aa, Homo Sapiens
SKKYSYMTI

SEQ ID NO: 1261468 - protein, 9 aa, Homo Sapiens
VSSQNRTHS

SEQ ID NO: 1261469 - protein, 9 aa, Homo Sapiens
SEDGHKLIT

SEQ ID NO: 1261470 - protein, 9 aa, Homo Sapiens
TTAMDLYRL

SEQ ID NO: 1261471 - protein, 9 aa, Homo Sapiens
MKLVCADMK

SEQ ID NO: 1261472 - protein, 9 aa, Homo Sapiens
LCPRSMRSL

SEQ ID NO: 1261473 - protein, 9 aa, Homo Sapiens
QLSLQESGM

SEQ ID NO: 1261474 - protein, 9 aa, Homo Sapiens
LPGAIPLAH

SEQ ID NO: 1261475 - protein, 9 aa, Homo Sapiens
SEKELKVLC

SEQ ID NO: 1261476 - protein, 9 aa, Homo Sapiens
CHTAFQNQG

SEQ ID NO: 1261477 - protein, 9 aa, Homo Sapiens
QIIHIPKNK

SEQ ID NO: 1261478 - protein, 9 aa, Homo Sapiens
PFSRRFDLL

SEQ ID NO: 1261479 - protein, 9 aa, Homo Sapiens
SEPLHVSIS

SEQ ID NO: 1261480 - protein, 9 aa, Homo Sapiens
VVCTCLVTL

SEQ ID NO: 1261481 - protein, 9 aa, Homo Sapiens
KNYNKEFLH

SEQ ID NO: 1261482 - protein, 9 aa, Homo Sapiens
DALGFYLPL

SEQ ID NO: 1261483 - protein, 9 aa, Homo Sapiens
PMWPPSSTV

SEQ ID NO: 1261484 - protein, 9 aa, Homo Sapiens
KENNKMEVL

SEQ ID NO: 1261485 - protein, 9 aa, Homo Sapiens
QITDIIKIQ

SEQ ID NO: 1261486 - protein, 9 aa, Homo Sapiens
EPGIFSVGL

SEQ ID NO: 1261487 - protein, 9 aa, Homo Sapiens
TVPDKDGDK

SEQ ID NO: 1261488 - protein, 9 aa, Homo Sapiens
SRHKHAPTK

SEQ ID NO: 1261489 - protein, 9 aa, Homo Sapiens
SRGRSRSTQ

SEQ ID NO: 1261490 - protein, 9 aa, Homo Sapiens
VSYIKVVHV

SEQ ID NO: 1261491 - protein, 9 aa, Homo Sapiens
DDFSFSRYA

SEQ ID NO: 1261492 - protein, 9 aa, Homo Sapiens
RAFYPNQDG

SEQ ID NO: 1261493 - protein, 9 aa, Homo Sapiens
WKLFYNCAL

SEQ ID NO: 1261494 - protein, 9 aa, Homo Sapiens
LTVIGVFLN

SEQ ID NO: 1261495 - protein, 9 aa, Homo Sapiens
VSGLDYRRL

SEQ ID NO: 1261496 - protein, 9 aa, Homo Sapiens
GSFAFGVVF

SEQ ID NO: 1261497 - protein, 9 aa, Homo Sapiens
SLWTAHIFP

SEQ ID NO: 1261498 - protein, 9 aa, Homo Sapiens
GTVYRYTLL

SEQ ID NO: 1261499 - protein, 9 aa, Homo Sapiens
ADSDESYIE

SEQ ID NO: 1261500 - protein, 9 aa, Homo Sapiens
LDDQHWHSI

SEQ ID NO: 1261501 - protein, 9 aa, Homo Sapiens
WLQDVTVQY

SEQ ID NO: 1261502 - protein, 9 aa, Homo Sapiens
HQSAIVLGN

SEQ ID NO: 1261503 - protein, 9 aa, Homo Sapiens
VAKSMKSLY

SEQ ID NO: 1261504 - protein, 9 aa, Homo Sapiens
VFYSFSELL

SEQ ID NO: 1261505 - protein, 9 aa, Homo Sapiens
LICLAQLGV

SEQ ID NO: 1261506 - protein, 9 aa, Homo Sapiens
TRIDKIRMY

SEQ ID NO: 1261507 - protein, 9 aa, Homo Sapiens
SLHWDGGSL

SEQ ID NO: 1261508 - protein, 9 aa, Homo Sapiens
MKMVLLWAS

SEQ ID NO: 1261509 - protein, 9 aa, Homo Sapiens
GPTGAKVAL

SEQ ID NO: 1261510 - protein, 9 aa, Homo Sapiens
YAFILYIIL

SEQ ID NO: 1261511 - protein, 9 aa, Homo Sapiens
MRDLEGGHG

SEQ ID NO: 1261512 - protein, 9 aa, Homo Sapiens
AVAKWITKI

SEQ ID NO: 1261513 - protein, 9 aa, Homo Sapiens
FFLAELIYI

SEQ ID NO: 1261514 - protein, 9 aa, Homo Sapiens
HLEQEHTNR

SEQ ID NO: 1261515 - protein, 9 aa, Homo Sapiens
KKMKQEVGE

SEQ ID NO: 1261516 - protein, 9 aa, Homo Sapiens
RNHIMHLDE

SEQ ID NO: 1261517 - protein, 9 aa, Homo Sapiens
VMECVDGGE

SEQ ID NO: 1261518 - protein, 9 aa, Homo Sapiens
RVVSAIQDI

SEQ ID NO: 1261519 - protein, 9 aa, Homo Sapiens
IPCESNNKK

SEQ ID NO: 1261520 - protein, 9 aa, Homo Sapiens
CKRAKIPGK

SEQ ID NO: 1261521 - protein, 9 aa, Homo Sapiens
WRRRIPAGR

SEQ ID NO: 1261522 - protein, 9 aa, Homo Sapiens
LLIGMLTET

SEQ ID NO: 1261523 - protein, 9 aa, Homo Sapiens
PTLLKKPAL

SEQ ID NO: 1261524 - protein, 9 aa, Homo Sapiens
HISRKFTEW

SEQ ID NO: 1261525 - protein, 9 aa, Homo Sapiens
YPCGLSQDG

SEQ ID NO: 1261526 - protein, 9 aa, Homo Sapiens
QFIHTNWAG

SEQ ID NO: 1261527 - protein, 9 aa, Homo Sapiens
ISQHFRKVS

SEQ ID NO: 1261528 - protein, 9 aa, Homo Sapiens
CIKLLSSGF

SEQ ID NO: 1261529 - protein, 9 aa, Homo Sapiens
KEKLRDRDY

SEQ ID NO: 1261530 - protein, 9 aa, Homo Sapiens
MLLFSWQGK

SEQ ID NO: 1261531 - protein, 9 aa, Homo Sapiens
LQLCLPLLE

SEQ ID NO: 1261532 - protein, 9 aa, Homo Sapiens
LKQKLQDED

SEQ ID NO: 1261533 - protein, 9 aa, Homo Sapiens
SRACSCGHP

SEQ ID NO: 1261534 - protein, 9 aa, Homo Sapiens
VLYSMECAF

SEQ ID NO: 1261535 - protein, 9 aa, Homo Sapiens
WTWMTCTSL

SEQ ID NO: 1261536 - protein, 9 aa, Homo Sapiens
TASINIHAG

SEQ ID NO: 1261537 - protein, 9 aa, Homo Sapiens
DEEPPRVIL

SEQ ID NO: 1261538 - protein, 9 aa, Homo Sapiens
IKYLMEDIS

SEQ ID NO: 1261539 - protein, 9 aa, Homo Sapiens
GLSRRDTRE

SEQ ID NO: 1261540 - protein, 9 aa, Homo Sapiens
SELVSIDSK

SEQ ID NO: 1261541 - protein, 9 aa, Homo Sapiens
LGLLMRDLE

SEQ ID NO: 1261542 - protein, 9 aa, Homo Sapiens
TFRRKIPES

SEQ ID NO: 1261543 - protein, 9 aa, Homo Sapiens
ASSSSPASV

SEQ ID NO: 1261544 - protein, 9 aa, Homo Sapiens
ATKNEISAP

SEQ ID NO: 1261545 - protein, 9 aa, Homo Sapiens
KYEFCDVRC

SEQ ID NO: 1261546 - protein, 9 aa, Homo Sapiens
KQEVEVKNV

SEQ ID NO: 1261547 - protein, 9 aa, Homo Sapiens
TEAGYYRLS

SEQ ID NO: 1261548 - protein, 9 aa, Homo Sapiens
LLGCRHYVV

SEQ ID NO: 1261549 - protein, 9 aa, Homo Sapiens
SPVGVREMK

SEQ ID NO: 1261550 - protein, 9 aa, Homo Sapiens
GAVAKWITK

SEQ ID NO: 1261551 - protein, 9 aa, Homo Sapiens
ILDGLSNIL

SEQ ID NO: 1261552 - protein, 9 aa, Homo Sapiens
VAAERSPSP

SEQ ID NO: 1261553 - protein, 9 aa, Homo Sapiens
NGIIQGFRV

SEQ ID NO: 1261554 - protein, 9 aa, Homo Sapiens
ITYFQAKRE

SEQ ID NO: 1261555 - protein, 9 aa, Homo Sapiens
IIHCRGGKG

SEQ ID NO: 1261556 - protein, 9 aa, Homo Sapiens
CAWGCCGSF

SEQ ID NO: 1261557 - protein, 9 aa, Homo Sapiens
NAGWLQDVT

SEQ ID NO: 1261558 - protein, 9 aa, Homo Sapiens
CYVQDLLRS

SEQ ID NO: 1261559 - protein, 9 aa, Homo Sapiens
VSESFPYPG

SEQ ID NO: 1261560 - protein, 9 aa, Homo Sapiens
GSSQNHHVL

SEQ ID NO: 1261561 - protein, 9 aa, Homo Sapiens
PPDFHPHPG

SEQ ID NO: 1261562 - protein, 9 aa, Homo Sapiens
KNNVMQLPL

SEQ ID NO: 1261563 - protein, 9 aa, Homo Sapiens
AQHVSPELL

SEQ ID NO: 1261564 - protein, 9 aa, Homo Sapiens
VSGLWDFMI

SEQ ID NO: 1261565 - protein, 9 aa, Homo Sapiens
KLSLEDSSM

SEQ ID NO: 1261566 - protein, 9 aa, Homo Sapiens
PPGIKVDGL

SEQ ID NO: 1261567 - protein, 9 aa, Homo Sapiens
LDWMFWYSL

SEQ ID NO: 1261568 - protein, 9 aa, Homo Sapiens
GIPAPEEEW

SEQ ID NO: 1261569 - protein, 9 aa, Homo Sapiens
LINFSYFHA

SEQ ID NO: 1261570 - protein, 9 aa, Homo Sapiens
IYAVPWHGT

SEQ ID NO: 1261571 - protein, 9 aa, Homo Sapiens
VVVLKATVP

SEQ ID NO: 1261572 - protein, 9 aa, Homo Sapiens
LDHILPSNY

SEQ ID NO: 1261573 - protein, 9 aa, Homo Sapiens
KMLQDEVTK

SEQ ID NO: 1261574 - protein, 9 aa, Homo Sapiens
RINKHINND

SEQ ID NO: 1261575 - protein, 9 aa, Homo Sapiens
SPALRARWS

SEQ ID NO: 1261576 - protein, 9 aa, Homo Sapiens
IVDPLKAIQ

SEQ ID NO: 1261577 - protein, 9 aa, Homo Sapiens
HMQLYEAWK

SEQ ID NO: 1261578 - protein, 9 aa, Homo Sapiens
AYQGFPFLP

SEQ ID NO: 1261579 - protein, 9 aa, Homo Sapiens
AEVTELDNE

SEQ ID NO: 1261580 - protein, 9 aa, Homo Sapiens
DAPITSLHD

SEQ ID NO: 1261581 - protein, 9 aa, Homo Sapiens
SSHMIVIFI

SEQ ID NO: 1261582 - protein, 9 aa, Homo Sapiens
DVIEEIIKL

SEQ ID NO: 1261583 - protein, 9 aa, Homo Sapiens
HITLPKSVV

SEQ ID NO: 1261584 - protein, 9 aa, Homo Sapiens
FCATLSKPK

SEQ ID NO: 1261585 - protein, 9 aa, Homo Sapiens
KPWNGGMSM

SEQ ID NO: 1261586 - protein, 9 aa, Homo Sapiens
SCEDNAEAS

SEQ ID NO: 1261587 - protein, 9 aa, Homo Sapiens
VKKLKSVQE

SEQ ID NO: 1261588 - protein, 9 aa, Homo Sapiens
DEVVAQEPL

SEQ ID NO: 1261589 - protein, 9 aa, Homo Sapiens
ISSCMDNFN

SEQ ID NO: 1261590 - protein, 9 aa, Homo Sapiens
YQEAKYKLK

SEQ ID NO: 1261591 - protein, 9 aa, Homo Sapiens
AVAHICREN

SEQ ID NO: 1261592 - protein, 9 aa, Homo Sapiens
MAHEADDAP

SEQ ID NO: 1261593 - protein, 9 aa, Homo Sapiens
SSMMSVKFD

SEQ ID NO: 1261594 - protein, 9 aa, Homo Sapiens
GFKGYECSD

SEQ ID NO: 1261595 - protein, 9 aa, Homo Sapiens
ASFGAISLS

SEQ ID NO: 1261596 - protein, 9 aa, Homo Sapiens
IQSVATFPD

SEQ ID NO: 1261597 - protein, 9 aa, Homo Sapiens
HILPSNYGQ

SEQ ID NO: 1261598 - protein, 9 aa, Homo Sapiens
GCDAVLQLF

SEQ ID NO: 1261599 - protein, 9 aa, Homo Sapiens
FIIIALSYV

SEQ ID NO: 1261600 - protein, 9 aa, Homo Sapiens
HINVSWCFV

SEQ ID NO: 1261601 - protein, 9 aa, Homo Sapiens
GDLTMDTAL

SEQ ID NO: 1261602 - protein, 9 aa, Homo Sapiens
LLRDISERG

SEQ ID NO: 1261603 - protein, 9 aa, Homo Sapiens
DVRELVSLK

SEQ ID NO: 1261604 - protein, 9 aa, Homo Sapiens
HKTISIDEN

SEQ ID NO: 1261605 - protein, 9 aa, Homo Sapiens
ILTYHDISM

SEQ ID NO: 1261606 - protein, 9 aa, Homo Sapiens
PHENKTYLD

SEQ ID NO: 1261607 - protein, 9 aa, Homo Sapiens
AHFGSALVP

SEQ ID NO: 1261608 - protein, 9 aa, Homo Sapiens
LLQNKVGAV

SEQ ID NO: 1261609 - protein, 9 aa, Homo Sapiens
VFNAIFEHE

SEQ ID NO: 1261610 - protein, 9 aa, Homo Sapiens
DKVSVSIMG

SEQ ID NO: 1261611 - protein, 9 aa, Homo Sapiens
EYEEELEAQ

SEQ ID NO: 1261612 - protein, 9 aa, Homo Sapiens
KTYGCNECG

SEQ ID NO: 1261613 - protein, 9 aa, Homo Sapiens
VIMQESHTE

SEQ ID NO: 1261614 - protein, 9 aa, Homo Sapiens
IKGVPGFGW

SEQ ID NO: 1261615 - protein, 9 aa, Homo Sapiens
VKPADDGRK

SEQ ID NO: 1261616 - protein, 9 aa, Homo Sapiens
ACSCHQCPS

SEQ ID NO: 1261617 - protein, 9 aa, Homo Sapiens
KTTAAHYLV

SEQ ID NO: 1261618 - protein, 9 aa, Homo Sapiens
TMSSAWPPT

SEQ ID NO: 1261619 - protein, 9 aa, Homo Sapiens
KAFGLYSIF

SEQ ID NO: 1261620 - protein, 9 aa, Homo Sapiens
AVCKYFQLD

SEQ ID NO: 1261621 - protein, 9 aa, Homo Sapiens
HYFIGFLGD

SEQ ID NO: 1261622 - protein, 9 aa, Homo Sapiens
FPTLLTFIG

SEQ ID NO: 1261623 - protein, 9 aa, Homo Sapiens
RGEGHGLVC

SEQ ID NO: 1261624 - protein, 9 aa, Homo Sapiens
QPTLLQRAN

SEQ ID NO: 1261625 - protein, 9 aa, Homo Sapiens
PRRMTPLSA

SEQ ID NO: 1261626 - protein, 9 aa, Homo Sapiens
GLSELKVTE

SEQ ID NO: 1261627 - protein, 9 aa, Homo Sapiens
KAKLIPTCR

SEQ ID NO: 1261628 - protein, 9 aa, Homo Sapiens
GERLMGYGI

SEQ ID NO: 1261629 - protein, 9 aa, Homo Sapiens
MSHFRSHLE

SEQ ID NO: 1261630 - protein, 9 aa, Homo Sapiens
QHIQQPLDI

SEQ ID NO: 1261631 - protein, 9 aa, Homo Sapiens
DYRLPRVET

SEQ ID NO: 1261632 - protein, 9 aa, Homo Sapiens
SPGPTSPSL

SEQ ID NO: 1261633 - protein, 9 aa, Homo Sapiens
MQEDEEESW

SEQ ID NO: 1261634 - protein, 9 aa, Homo Sapiens
HQSSSVLRS

SEQ ID NO: 1261635 - protein, 9 aa, Homo Sapiens
FLSFNVYVG

SEQ ID NO: 1261636 - protein, 9 aa, Homo Sapiens
YAIQKLFAP

SEQ ID NO: 1261637 - protein, 9 aa, Homo Sapiens
MRIGEPTSN

SEQ ID NO: 1261638 - protein, 9 aa, Homo Sapiens
MFREVGLLE

SEQ ID NO: 1261639 - protein, 9 aa, Homo Sapiens
DAKNIIPMD

SEQ ID NO: 1261640 - protein, 9 aa, Homo Sapiens
INFTQEEWK

SEQ ID NO: 1261641 - protein, 9 aa, Homo Sapiens
QCLSVVFKG

SEQ ID NO: 1261642 - protein, 9 aa, Homo Sapiens
MEPLPMFCA

SEQ ID NO: 1261643 - protein, 9 aa, Homo Sapiens
RKKAFVTCS

SEQ ID NO: 1261644 - protein, 9 aa, Homo Sapiens
LMLLPLPPP

SEQ ID NO: 1261645 - protein, 9 aa, Homo Sapiens
IGIISFMQS

SEQ ID NO: 1261646 - protein, 9 aa, Homo Sapiens
EETAETFDV

SEQ ID NO: 1261647 - protein, 9 aa, Homo Sapiens
IPRVARPFS

SEQ ID NO: 1261648 - protein, 9 aa, Homo Sapiens
KAQVVLTEY

SEQ ID NO: 1261649 - protein, 9 aa, Homo Sapiens
ALDRYIDVC

SEQ ID NO: 1261650 - protein, 9 aa, Homo Sapiens
GASPEPCTI

SEQ ID NO: 1261651 - protein, 9 aa, Homo Sapiens
RRSIARCLF

SEQ ID NO: 1261652 - protein, 9 aa, Homo Sapiens
VSQRPQQAS

SEQ ID NO: 1261653 - protein, 9 aa, Homo Sapiens
WSSLLRTIH

SEQ ID NO: 1261654 - protein, 9 aa, Homo Sapiens
KLELRLPSV

SEQ ID NO: 1261655 - protein, 9 aa, Homo Sapiens
DIGYFAIYF

SEQ ID NO: 1261656 - protein, 9 aa, Homo Sapiens
EDEATYTSD

SEQ ID NO: 1261657 - protein, 9 aa, Homo Sapiens
NRHPGASIQ

SEQ ID NO: 1261658 - protein, 9 aa, Homo Sapiens
PRPASSLRH

SEQ ID NO: 1261659 - protein, 9 aa, Homo Sapiens
KAMCIMNSF

SEQ ID NO: 1261660 - protein, 9 aa, Homo Sapiens
TIGKEDNKT

SEQ ID NO: 1261661 - protein, 9 aa, Homo Sapiens
EGLRHLQEG

SEQ ID NO: 1261662 - protein, 9 aa, Homo Sapiens
ELRQREGQQ

SEQ ID NO: 1261663 - protein, 9 aa, Homo Sapiens
LFQENSMIG

SEQ ID NO: 1261664 - protein, 9 aa, Homo Sapiens
EHFLGFLRW

SEQ ID NO: 1261665 - protein, 9 aa, Homo Sapiens
FRGSILKTH

SEQ ID NO: 1261666 - protein, 9 aa, Homo Sapiens
IYHYRMEKS

SEQ ID NO: 1261667 - protein, 9 aa, Homo Sapiens
RNSSLGYAI

SEQ ID NO: 1261668 - protein, 9 aa, Homo Sapiens
SEGDFYYGW

SEQ ID NO: 1261669 - protein, 9 aa, Homo Sapiens
NGLDQKAGS

SEQ ID NO: 1261670 - protein, 9 aa, Homo Sapiens
AHCLIWLLE

SEQ ID NO: 1261671 - protein, 9 aa, Homo Sapiens
LRTAGIICL

SEQ ID NO: 1261672 - protein, 9 aa, Homo Sapiens
MRERHFHPV

SEQ ID NO: 1261673 - protein, 9 aa, Homo Sapiens
GTNHEEIFP

SEQ ID NO: 1261674 - protein, 9 aa, Homo Sapiens
PSESKQKEY

SEQ ID NO: 1261675 - protein, 9 aa, Homo Sapiens
CVGGDIRVI

SEQ ID NO: 1261676 - protein, 9 aa, Homo Sapiens
GPRPLHRWL

SEQ ID NO: 1261677 - protein, 9 aa, Homo Sapiens
QEIKECFTS

SEQ ID NO: 1261678 - protein, 9 aa, Homo Sapiens
SVKQEVQNF

SEQ ID NO: 1261679 - protein, 9 aa, Homo Sapiens
ILLTSDAPK

SEQ ID NO: 1261680 - protein, 9 aa, Homo Sapiens
NHALRLLQE

SEQ ID NO: 1261681 - protein, 9 aa, Homo Sapiens
LCLSEVDNG

SEQ ID NO: 1261682 - protein, 9 aa, Homo Sapiens
MCGPAEPQQ

SEQ ID NO: 1261683 - protein, 9 aa, Homo Sapiens
IFERIASED

SEQ ID NO: 1261684 - protein, 9 aa, Homo Sapiens
KKAVDNTTA

SEQ ID NO: 1261685 - protein, 9 aa, Homo Sapiens
YLKQVTDTV

SEQ ID NO: 1261686 - protein, 9 aa, Homo Sapiens
VMKFRNTIG

SEQ ID NO: 1261687 - protein, 9 aa, Homo Sapiens
SCGRGNQAR

SEQ ID NO: 1261688 - protein, 9 aa, Homo Sapiens
CHQHATQKE

SEQ ID NO: 1261689 - protein, 9 aa, Homo Sapiens
PCGAAGARE

SEQ ID NO: 1261690 - protein, 9 aa, Homo Sapiens
TPVPAMTGM

SEQ ID NO: 1261691 - protein, 9 aa, Homo Sapiens
AVKAAQGLQ

SEQ ID NO: 1261692 - protein, 9 aa, Homo Sapiens
LQSSVNRHR

SEQ ID NO: 1261693 - protein, 9 aa, Homo Sapiens
HPDKNMDNA

SEQ ID NO: 1261694 - protein, 9 aa, Homo Sapiens
FHHVGHAGL

SEQ ID NO: 1261695 - protein, 9 aa, Homo Sapiens
YDRIKFIIG

SEQ ID NO: 1261696 - protein, 9 aa, Homo Sapiens
HQLLAMTLR

SEQ ID NO: 1261697 - protein, 9 aa, Homo Sapiens
RPLQEGKMQ

SEQ ID NO: 1261698 - protein, 9 aa, Homo Sapiens
TSFWLMLTS

SEQ ID NO: 1261699 - protein, 9 aa, Homo Sapiens
QQLRKRDVR

SEQ ID NO: 1261700 - protein, 9 aa, Homo Sapiens
MKQEVLPAA

SEQ ID NO: 1261701 - protein, 9 aa, Homo Sapiens
CKGRGVDVL

SEQ ID NO: 1261702 - protein, 9 aa, Homo Sapiens
SRDRRNQDQ

SEQ ID NO: 1261703 - protein, 9 aa, Homo Sapiens
FADEKFLRR

SEQ ID NO: 1261704 - protein, 9 aa, Homo Sapiens
DHIQEAMRV

SEQ ID NO: 1261705 - protein, 9 aa, Homo Sapiens
GRERRDRRP

SEQ ID NO: 1261706 - protein, 9 aa, Homo Sapiens
CRVHDLEIE

SEQ ID NO: 1261707 - protein, 9 aa, Homo Sapiens
KYAEKYVSG

SEQ ID NO: 1261708 - protein, 9 aa, Homo Sapiens
WHPDKNMDN

SEQ ID NO: 1261709 - protein, 9 aa, Homo Sapiens
EDSQKFFFD

SEQ ID NO: 1261710 - protein, 9 aa, Homo Sapiens
PLTKSISLD

SEQ ID NO: 1261711 - protein, 9 aa, Homo Sapiens
FIDKVRFLV

SEQ ID NO: 1261712 - protein, 9 aa, Homo Sapiens
DVAIQTIEE

SEQ ID NO: 1261713 - protein, 9 aa, Homo Sapiens
EVHQAILNL

SEQ ID NO: 1261714 - protein, 9 aa, Homo Sapiens
MYPANFTWK

SEQ ID NO: 1261715 - protein, 9 aa, Homo Sapiens
TPACCKFST

SEQ ID NO: 1261716 - protein, 9 aa, Homo Sapiens
PGCTGTLVP

SEQ ID NO: 1261717 - protein, 9 aa, Homo Sapiens
FTWLALENM

SEQ ID NO: 1261718 - protein, 9 aa, Homo Sapiens
GDLLNLDIG

SEQ ID NO: 1261719 - protein, 9 aa, Homo Sapiens
NSSDNAIDN

SEQ ID NO: 1261720 - protein, 9 aa, Homo Sapiens
YITSTFARC

SEQ ID NO: 1261721 - protein, 9 aa, Homo Sapiens
NSYPHFLES

SEQ ID NO: 1261722 - protein, 9 aa, Homo Sapiens
PKCPPKCIT

SEQ ID NO: 1261723 - protein, 9 aa, Homo Sapiens
THHYLCLDK

SEQ ID NO: 1261724 - protein, 9 aa, Homo Sapiens
ISRKFTEWC

SEQ ID NO: 1261725 - protein, 9 aa, Homo Sapiens
LASNWLQSL

SEQ ID NO: 1261726 - protein, 9 aa, Homo Sapiens
GKRPLHSSG

SEQ ID NO: 1261727 - protein, 9 aa, Homo Sapiens
HTGSNHSSA

SEQ ID NO: 1261728 - protein, 9 aa, Homo Sapiens
SSGTESWPP

SEQ ID NO: 1261729 - protein, 9 aa, Homo Sapiens
VQALEEVRK

SEQ ID NO: 1261730 - protein, 9 aa, Homo Sapiens
PLSWAPPSA

SEQ ID NO: 1261731 - protein, 9 aa, Homo Sapiens
PLPTITNWE

SEQ ID NO: 1261732 - protein, 9 aa, Homo Sapiens
TVIRCRQDD

SEQ ID NO: 1261733 - protein, 9 aa, Homo Sapiens
DSDLLRLNQ

SEQ ID NO: 1261734 - protein, 9 aa, Homo Sapiens
ENIIFLKCS

SEQ ID NO: 1261735 - protein, 9 aa, Homo Sapiens
SGGRMRGTK

SEQ ID NO: 1261736 - protein, 9 aa, Homo Sapiens
KGVGTPNLI

SEQ ID NO: 1261737 - protein, 9 aa, Homo Sapiens
LRGLTNLGN

SEQ ID NO: 1261738 - protein, 9 aa, Homo Sapiens
SMISNPDLM

SEQ ID NO: 1261739 - protein, 9 aa, Homo Sapiens
MSIGLLCYA

SEQ ID NO: 1261740 - protein, 9 aa, Homo Sapiens
PGDKPLPVP

SEQ ID NO: 1261741 - protein, 9 aa, Homo Sapiens
LGHGNLTDI

SEQ ID NO: 1261742 - protein, 9 aa, Homo Sapiens
MLVGWYPFH

SEQ ID NO: 1261743 - protein, 9 aa, Homo Sapiens
SQNHHVLGH

SEQ ID NO: 1261744 - protein, 9 aa, Homo Sapiens
VPPPVDIKP

SEQ ID NO: 1261745 - protein, 9 aa, Homo Sapiens
PPTFEDTVV

SEQ ID NO: 1261746 - protein, 9 aa, Homo Sapiens
PGNTILHMD

SEQ ID NO: 1261747 - protein, 9 aa, Homo Sapiens
HQLHQRRTQ

SEQ ID NO: 1261748 - protein, 9 aa, Homo Sapiens
HPAERHMIS

SEQ ID NO: 1261749 - protein, 9 aa, Homo Sapiens
KILAMKAIR

SEQ ID NO: 1261750 - protein, 9 aa, Homo Sapiens
MCVDPSSPR

SEQ ID NO: 1261751 - protein, 9 aa, Homo Sapiens
IGVHYDEPL

SEQ ID NO: 1261752 - protein, 9 aa, Homo Sapiens
VNAAIGSVF

SEQ ID NO: 1261753 - protein, 9 aa, Homo Sapiens
TRKHSREHK

SEQ ID NO: 1261754 - protein, 9 aa, Homo Sapiens
EESVFAVTD

SEQ ID NO: 1261755 - protein, 9 aa, Homo Sapiens
LTSDAPKVE

SEQ ID NO: 1261756 - protein, 9 aa, Homo Sapiens
HPRPPALSL

SEQ ID NO: 1261757 - protein, 9 aa, Homo Sapiens
IQPMWDDSR

SEQ ID NO: 1261758 - protein, 9 aa, Homo Sapiens
YGKDKAPIQ

SEQ ID NO: 1261759 - protein, 9 aa, Homo Sapiens
AISFCGFVV

SEQ ID NO: 1261760 - protein, 9 aa, Homo Sapiens
DSHDSMCPG

SEQ ID NO: 1261761 - protein, 9 aa, Homo Sapiens
CLVCGRLSV

SEQ ID NO: 1261762 - protein, 9 aa, Homo Sapiens
QRRERMTFT

SEQ ID NO: 1261763 - protein, 9 aa, Homo Sapiens
KLDKPGEGT

SEQ ID NO: 1261764 - protein, 9 aa, Homo Sapiens
LLKLLNTCM

SEQ ID NO: 1261765 - protein, 9 aa, Homo Sapiens
HFSTSGFRA

SEQ ID NO: 1261766 - protein, 9 aa, Homo Sapiens
ELNVKQGAE

SEQ ID NO: 1261767 - protein, 9 aa, Homo Sapiens
PATLIMASL

SEQ ID NO: 1261768 - protein, 9 aa, Homo Sapiens
ILYQTEQYN

SEQ ID NO: 1261769 - protein, 9 aa, Homo Sapiens
LYDGKDDTD

SEQ ID NO: 1261770 - protein, 9 aa, Homo Sapiens
LYQTIFLRQ

SEQ ID NO: 1261771 - protein, 9 aa, Homo Sapiens
TSIRLTESL

SEQ ID NO: 1261772 - protein, 9 aa, Homo Sapiens
DRWSWDRHR

SEQ ID NO: 1261773 - protein, 9 aa, Homo Sapiens
HAYERFTGN

SEQ ID NO: 1261774 - protein, 9 aa, Homo Sapiens
MVGAVSTYD

SEQ ID NO: 1261775 - protein, 9 aa, Homo Sapiens
HGSQKQPKC

SEQ ID NO: 1261776 - protein, 9 aa, Homo Sapiens
LLKQMLQSY

SEQ ID NO: 1261777 - protein, 9 aa, Homo Sapiens
DNRTLYHLQ

SEQ ID NO: 1261778 - protein, 9 aa, Homo Sapiens
DRQTQVGLE

SEQ ID NO: 1261779 - protein, 9 aa, Homo Sapiens
LTDPKLTME

SEQ ID NO: 1261780 - protein, 9 aa, Homo Sapiens
QVLTVHAGK

SEQ ID NO: 1261781 - protein, 9 aa, Homo Sapiens
WRDGRKTCS

SEQ ID NO: 1261782 - protein, 9 aa, Homo Sapiens
LSAPPHHRN

SEQ ID NO: 1261783 - protein, 9 aa, Homo Sapiens
FLMSHPLLM

SEQ ID NO: 1261784 - protein, 9 aa, Homo Sapiens
GKLVRFCKL

SEQ ID NO: 1261785 - protein, 9 aa, Homo Sapiens
RCPQEPRPP

SEQ ID NO: 1261786 - protein, 9 aa, Homo Sapiens
DYLGLEEWP

SEQ ID NO: 1261787 - protein, 9 aa, Homo Sapiens
GVTEDYLHL

SEQ ID NO: 1261788 - protein, 9 aa, Homo Sapiens
VEDVCEEEI

SEQ ID NO: 1261789 - protein, 9 aa, Homo Sapiens
VNHAEDLAP

SEQ ID NO: 1261790 - protein, 9 aa, Homo Sapiens
LTKTVEEPR

SEQ ID NO: 1261791 - protein, 9 aa, Homo Sapiens
GHAVEWLCE

SEQ ID NO: 1261792 - protein, 9 aa, Homo Sapiens
DMALDRYID

SEQ ID NO: 1261793 - protein, 9 aa, Homo Sapiens
DVGAQEEHV

SEQ ID NO: 1261794 - protein, 9 aa, Homo Sapiens
QMTTILEIK

SEQ ID NO: 1261795 - protein, 9 aa, Homo Sapiens
VVTKIRPVM

SEQ ID NO: 1261796 - protein, 9 aa, Homo Sapiens
DEPQEEATR

SEQ ID NO: 1261797 - protein, 9 aa, Homo Sapiens
GHFYECCIR

SEQ ID NO: 1261798 - protein, 9 aa, Homo Sapiens
TPSAPVPLA

SEQ ID NO: 1261799 - protein, 9 aa, Homo Sapiens
IYHDQVPDL

SEQ ID NO: 1261800 - protein, 9 aa, Homo Sapiens
PCKECGPKP

SEQ ID NO: 1261801 - protein, 9 aa, Homo Sapiens
SRDITRGYE

SEQ ID NO: 1261802 - protein, 9 aa, Homo Sapiens
IVTLQLFYL

SEQ ID NO: 1261803 - protein, 9 aa, Homo Sapiens
SEADWLQFW

SEQ ID NO: 1261804 - protein, 9 aa, Homo Sapiens
NSMSIIGST

SEQ ID NO: 1261805 - protein, 9 aa, Homo Sapiens
VALNTLSIT

SEQ ID NO: 1261806 - protein, 9 aa, Homo Sapiens
KCYVQDLLR

SEQ ID NO: 1261807 - protein, 9 aa, Homo Sapiens
HLTKDVAIQ

SEQ ID NO: 1261808 - protein, 9 aa, Homo Sapiens
RQKAMKCLR

SEQ ID NO: 1261809 - protein, 9 aa, Homo Sapiens
SMLRDDAIG

SEQ ID NO: 1261810 - protein, 9 aa, Homo Sapiens
QGSSPPTVV

SEQ ID NO: 1261811 - protein, 9 aa, Homo Sapiens
SVAFTSTEH

SEQ ID NO: 1261812 - protein, 9 aa, Homo Sapiens
PAVRSSGFP

SEQ ID NO: 1261813 - protein, 9 aa, Homo Sapiens
VTIPVVIFK

SEQ ID NO: 1261814 - protein, 9 aa, Homo Sapiens
PGTPRAPSV

SEQ ID NO: 1261815 - protein, 9 aa, Homo Sapiens
KHLLGEHLT

SEQ ID NO: 1261816 - protein, 9 aa, Homo Sapiens
PVKGTMETM

SEQ ID NO: 1261817 - protein, 9 aa, Homo Sapiens
YRLVNVFLG

SEQ ID NO: 1261818 - protein, 9 aa, Homo Sapiens
PLDFEIFDL

SEQ ID NO: 1261819 - protein, 9 aa, Homo Sapiens
ATETGTQWW

SEQ ID NO: 1261820 - protein, 9 aa, Homo Sapiens
RSRGRGGPG

SEQ ID NO: 1261821 - protein, 9 aa, Homo Sapiens
PFVVSGPYI

SEQ ID NO: 1261822 - protein, 9 aa, Homo Sapiens
LELLPPCCR

SEQ ID NO: 1261823 - protein, 9 aa, Homo Sapiens
QYRIIVCST

SEQ ID NO: 1261824 - protein, 9 aa, Homo Sapiens
KSFNHVSNL

SEQ ID NO: 1261825 - protein, 9 aa, Homo Sapiens
QRYKEDGSS

SEQ ID NO: 1261826 - protein, 9 aa, Homo Sapiens
SDPRHETPP

SEQ ID NO: 1261827 - protein, 9 aa, Homo Sapiens
LGQMATYFA

SEQ ID NO: 1261828 - protein, 9 aa, Homo Sapiens
EEMKEVVGL

SEQ ID NO: 1261829 - protein, 9 aa, Homo Sapiens
KEYTAMKSK

SEQ ID NO: 1261830 - protein, 9 aa, Homo Sapiens
KLEKTLLVL

SEQ ID NO: 1261831 - protein, 9 aa, Homo Sapiens
VEKKYTPGD

SEQ ID NO: 1261832 - protein, 9 aa, Homo Sapiens
KVSTHSVTW

SEQ ID NO: 1261833 - protein, 9 aa, Homo Sapiens
DFESEDEGD

SEQ ID NO: 1261834 - protein, 9 aa, Homo Sapiens
QCSGILQLG

SEQ ID NO: 1261835 - protein, 9 aa, Homo Sapiens
TGWYPPTPN

SEQ ID NO: 1261836 - protein, 9 aa, Homo Sapiens
CCLNVGLIR

SEQ ID NO: 1261837 - protein, 9 aa, Homo Sapiens
LLASTEPFP

SEQ ID NO: 1261838 - protein, 9 aa, Homo Sapiens
GESAGTIFL

SEQ ID NO: 1261839 - protein, 9 aa, Homo Sapiens
PYLDITLDI

SEQ ID NO: 1261840 - protein, 9 aa, Homo Sapiens
LMVNGVMIF

SEQ ID NO: 1261841 - protein, 9 aa, Homo Sapiens
RDQGRHPVR

SEQ ID NO: 1261842 - protein, 9 aa, Homo Sapiens
VKSEGDEDY

SEQ ID NO: 1261843 - protein, 9 aa, Homo Sapiens
PHRQTRPRR

SEQ ID NO: 1261844 - protein, 9 aa, Homo Sapiens
AQPVTEDWS

SEQ ID NO: 1261845 - protein, 9 aa, Homo Sapiens
GMQRFAGLP

SEQ ID NO: 1261846 - protein, 9 aa, Homo Sapiens
HVTFDDIAV

SEQ ID NO: 1261847 - protein, 9 aa, Homo Sapiens
LDHYPMSKQ

SEQ ID NO: 1261848 - protein, 9 aa, Homo Sapiens
SESKKEINI

SEQ ID NO: 1261849 - protein, 9 aa, Homo Sapiens
THTQIDQQH

SEQ ID NO: 1261850 - protein, 9 aa, Homo Sapiens
PSNGAEGPT

SEQ ID NO: 1261851 - protein, 9 aa, Homo Sapiens
LIVGTASRR

SEQ ID NO: 1261852 - protein, 9 aa, Homo Sapiens
SIKGVPGFG

SEQ ID NO: 1261853 - protein, 9 aa, Homo Sapiens
AMCIMNSFV

SEQ ID NO: 1261854 - protein, 9 aa, Homo Sapiens
YHTLDEIYS

SEQ ID NO: 1261855 - protein, 9 aa, Homo Sapiens
VFRNLASED

SEQ ID NO: 1261856 - protein, 9 aa, Homo Sapiens
MAHTPPGHH

SEQ ID NO: 1261857 - protein, 9 aa, Homo Sapiens
KNPHLIFDV

SEQ ID NO: 1261858 - protein, 9 aa, Homo Sapiens
TALETCKAH

SEQ ID NO: 1261859 - protein, 9 aa, Homo Sapiens
IRRELEELS

SEQ ID NO: 1261860 - protein, 9 aa, Homo Sapiens
TAPAASLMA

SEQ ID NO: 1261861 - protein, 9 aa, Homo Sapiens
CRICAVFGG

SEQ ID NO: 1261862 - protein, 9 aa, Homo Sapiens
SLCHRLKPS

SEQ ID NO: 1261863 - protein, 9 aa, Homo Sapiens
PMAYLIYRL

SEQ ID NO: 1261864 - protein, 9 aa, Homo Sapiens
TSRGRQLRH

SEQ ID NO: 1261865 - protein, 9 aa, Homo Sapiens
MLCWNQTHP

SEQ ID NO: 1261866 - protein, 9 aa, Homo Sapiens
TPWLCRAPA

SEQ ID NO: 1261867 - protein, 9 aa, Homo Sapiens
KVSPYEFFA

SEQ ID NO: 1261868 - protein, 9 aa, Homo Sapiens
RPCQPLTRL

SEQ ID NO: 1261869 - protein, 9 aa, Homo Sapiens
PSHLFLYNK

SEQ ID NO: 1261870 - protein, 9 aa, Homo Sapiens
RDTHPAIHD

SEQ ID NO: 1261871 - protein, 9 aa, Homo Sapiens
CNLVRYNII

SEQ ID NO: 1261872 - protein, 9 aa, Homo Sapiens
DDEDSDNLE

SEQ ID NO: 1261873 - protein, 9 aa, Homo Sapiens
TMIEKLKKT

SEQ ID NO: 1261874 - protein, 9 aa, Homo Sapiens
VPSFSFHAA

SEQ ID NO: 1261875 - protein, 9 aa, Homo Sapiens
RVFVYCTFL

SEQ ID NO: 1261876 - protein, 9 aa, Homo Sapiens
DVIVIDSDN

SEQ ID NO: 1261877 - protein, 9 aa, Homo Sapiens
NLVKSTLDA

SEQ ID NO: 1261878 - protein, 9 aa, Homo Sapiens
DEWRKKCHT

SEQ ID NO: 1261879 - protein, 9 aa, Homo Sapiens
PQCGEASWA

SEQ ID NO: 1261880 - protein, 9 aa, Homo Sapiens
QPPYQQPLQ

SEQ ID NO: 1261881 - protein, 9 aa, Homo Sapiens
SLSHHSDHK

SEQ ID NO: 1261882 - protein, 9 aa, Homo Sapiens
SNEDCAKQI

SEQ ID NO: 1261883 - protein, 9 aa, Homo Sapiens
NEILSQLEE

SEQ ID NO: 1261884 - protein, 9 aa, Homo Sapiens
SVRDHYARS

SEQ ID NO: 1261885 - protein, 9 aa, Homo Sapiens
VNQKQEPCP

SEQ ID NO: 1261886 - protein, 9 aa, Homo Sapiens
DGSGQYTHK

SEQ ID NO: 1261887 - protein, 9 aa, Homo Sapiens
QCVVCLQPF

SEQ ID NO: 1261888 - protein, 9 aa, Homo Sapiens
IDFSLDQPK

SEQ ID NO: 1261889 - protein, 9 aa, Homo Sapiens
PALSLRSLQ

SEQ ID NO: 1261890 - protein, 9 aa, Homo Sapiens
FVYALGDLF

SEQ ID NO: 1261891 - protein, 9 aa, Homo Sapiens
TQVVASLAE

SEQ ID NO: 1261892 - protein, 9 aa, Homo Sapiens
LQVDWLPQQ

SEQ ID NO: 1261893 - protein, 9 aa, Homo Sapiens
TSSMDPGGM

SEQ ID NO: 1261894 - protein, 9 aa, Homo Sapiens
TMAVLLVQL

SEQ ID NO: 1261895 - protein, 9 aa, Homo Sapiens
NHPGASIVL

SEQ ID NO: 1261896 - protein, 9 aa, Homo Sapiens
SSLVVHLLQ

SEQ ID NO: 1261897 - protein, 9 aa, Homo Sapiens
NQPPILNHL

SEQ ID NO: 1261898 - protein, 9 aa, Homo Sapiens
HLWLPVNLT

SEQ ID NO: 1261899 - protein, 9 aa, Homo Sapiens
VNWYIHLKL

SEQ ID NO: 1261900 - protein, 9 aa, Homo Sapiens
VCVNTDAEK

SEQ ID NO: 1261901 - protein, 9 aa, Homo Sapiens
CTPPALPPV

SEQ ID NO: 1261902 - protein, 9 aa, Homo Sapiens
SGCTSKGLI

SEQ ID NO: 1261903 - protein, 9 aa, Homo Sapiens
CSVASFGAI

SEQ ID NO: 1261904 - protein, 9 aa, Homo Sapiens
IEYASNKLP

SEQ ID NO: 1261905 - protein, 9 aa, Homo Sapiens
AQDFLVDIA

SEQ ID NO: 1261906 - protein, 9 aa, Homo Sapiens
TRKILNVKR

SEQ ID NO: 1261907 - protein, 9 aa, Homo Sapiens
DSANGSVGD

SEQ ID NO: 1261908 - protein, 9 aa, Homo Sapiens
SSGMEYFNM

SEQ ID NO: 1261909 - protein, 9 aa, Homo Sapiens
ALFTLHSCN

SEQ ID NO: 1261910 - protein, 9 aa, Homo Sapiens
ARCGGNLLH

SEQ ID NO: 1261911 - protein, 9 aa, Homo Sapiens
NACISCITK

SEQ ID NO: 1261912 - protein, 9 aa, Homo Sapiens
AHSHFFEPG

SEQ ID NO: 1261913 - protein, 9 aa, Homo Sapiens
SHMPPTTTE

SEQ ID NO: 1261914 - protein, 9 aa, Homo Sapiens
DQKQHPVTM

SEQ ID NO: 1261915 - protein, 9 aa, Homo Sapiens
GQVCALSIE

SEQ ID NO: 1261916 - protein, 9 aa, Homo Sapiens
TESYNSHWD

SEQ ID NO: 1261917 - protein, 9 aa, Homo Sapiens
SNVYYPTPK

SEQ ID NO: 1261918 - protein, 9 aa, Homo Sapiens
KKYQRHHTG

SEQ ID NO: 1261919 - protein, 9 aa, Homo Sapiens
ERKCFPGNQ

SEQ ID NO: 1261920 - protein, 9 aa, Homo Sapiens
TSPQPKCWQ

SEQ ID NO: 1261921 - protein, 9 aa, Homo Sapiens
PPALSPAAD

SEQ ID NO: 1261922 - protein, 9 aa, Homo Sapiens
CMYGDIFGN

SEQ ID NO: 1261923 - protein, 9 aa, Homo Sapiens
ASCEICVLM

SEQ ID NO: 1261924 - protein, 9 aa, Homo Sapiens
TGPGTLPGS

SEQ ID NO: 1261925 - protein, 9 aa, Homo Sapiens
SEAMGFFCL

SEQ ID NO: 1261926 - protein, 9 aa, Homo Sapiens
LQCYRQCGL

SEQ ID NO: 1261927 - protein, 9 aa, Homo Sapiens
TFLRVALRS

SEQ ID NO: 1261928 - protein, 9 aa, Homo Sapiens
AERFYYQAM

SEQ ID NO: 1261929 - protein, 9 aa, Homo Sapiens
SQKVSQASK

SEQ ID NO: 1261930 - protein, 9 aa, Homo Sapiens
STTCGQMTS

SEQ ID NO: 1261931 - protein, 9 aa, Homo Sapiens
MNVMVQNVL

SEQ ID NO: 1261932 - protein, 9 aa, Homo Sapiens
GEKHCKCTE

SEQ ID NO: 1261933 - protein, 9 aa, Homo Sapiens
CVFPASKEG

SEQ ID NO: 1261934 - protein, 9 aa, Homo Sapiens
KATCSDSSG

SEQ ID NO: 1261935 - protein, 9 aa, Homo Sapiens
ACGWRSPQR

SEQ ID NO: 1261936 - protein, 9 aa, Homo Sapiens
CHNGGNCVE

SEQ ID NO: 1261937 - protein, 9 aa, Homo Sapiens
TWYLGLLQV

SEQ ID NO: 1261938 - protein, 9 aa, Homo Sapiens
VTVKPYQPQ

SEQ ID NO: 1261939 - protein, 9 aa, Homo Sapiens
SVPTTTTTT

SEQ ID NO: 1261940 - protein, 9 aa, Homo Sapiens
RQLRRVLEM

SEQ ID NO: 1261941 - protein, 9 aa, Homo Sapiens
GTLPACNGS

SEQ ID NO: 1261942 - protein, 9 aa, Homo Sapiens
SLAAAWDGS

SEQ ID NO: 1261943 - protein, 9 aa, Homo Sapiens
LFEETALDA

SEQ ID NO: 1261944 - protein, 9 aa, Homo Sapiens
EQDMPQNRL

SEQ ID NO: 1261945 - protein, 9 aa, Homo Sapiens
MKVNFDILE

SEQ ID NO: 1261946 - protein, 9 aa, Homo Sapiens
ADKFIYYQV

SEQ ID NO: 1261947 - protein, 9 aa, Homo Sapiens
DRDDHSFGR

SEQ ID NO: 1261948 - protein, 9 aa, Homo Sapiens
LDPHENGSN

SEQ ID NO: 1261949 - protein, 9 aa, Homo Sapiens
GSISLALHL

SEQ ID NO: 1261950 - protein, 9 aa, Homo Sapiens
KAHRDWAVF

SEQ ID NO: 1261951 - protein, 9 aa, Homo Sapiens
AQAMKLIVP

SEQ ID NO: 1261952 - protein, 9 aa, Homo Sapiens
EDRCPLNIY

SEQ ID NO: 1261953 - protein, 9 aa, Homo Sapiens
THRNTQAHT

SEQ ID NO: 1261954 - protein, 9 aa, Homo Sapiens
YHTDLEELN

SEQ ID NO: 1261955 - protein, 9 aa, Homo Sapiens
LRVQIDCHT

SEQ ID NO: 1261956 - protein, 9 aa, Homo Sapiens
EESPHGSTK

SEQ ID NO: 1261957 - protein, 9 aa, Homo Sapiens
SPSLPEQIS

SEQ ID NO: 1261958 - protein, 9 aa, Homo Sapiens
GDEFDDWED

SEQ ID NO: 1261959 - protein, 9 aa, Homo Sapiens
GPDMVLTPD

SEQ ID NO: 1261960 - protein, 9 aa, Homo Sapiens
LKENQKKTL

SEQ ID NO: 1261961 - protein, 9 aa, Homo Sapiens
LNAQIMKEI

SEQ ID NO: 1261962 - protein, 9 aa, Homo Sapiens
ILEGGNGMD

SEQ ID NO: 1261963 - protein, 9 aa, Homo Sapiens
QLKGRKYMD

SEQ ID NO: 1261964 - protein, 9 aa, Homo Sapiens
LDCLYGPIA

SEQ ID NO: 1261965 - protein, 9 aa, Homo Sapiens
AGLTTHLLV

SEQ ID NO: 1261966 - protein, 9 aa, Homo Sapiens
GSVHTEFMN

SEQ ID NO: 1261967 - protein, 9 aa, Homo Sapiens
LGVHQRVLH

SEQ ID NO: 1261968 - protein, 9 aa, Homo Sapiens
GQQVTLRYS

SEQ ID NO: 1261969 - protein, 9 aa, Homo Sapiens
TKDAGPIAG

SEQ ID NO: 1261970 - protein, 9 aa, Homo Sapiens
IEIDAFSWL

SEQ ID NO: 1261971 - protein, 9 aa, Homo Sapiens
EDGRVSENI

SEQ ID NO: 1261972 - protein, 9 aa, Homo Sapiens
LMITVHELN

SEQ ID NO: 1261973 - protein, 9 aa, Homo Sapiens
LFPLASLAL

SEQ ID NO: 1261974 - protein, 9 aa, Homo Sapiens
QPMDHQATS

SEQ ID NO: 1261975 - protein, 9 aa, Homo Sapiens
VSSDDKYPT

SEQ ID NO: 1261976 - protein, 9 aa, Homo Sapiens
FGAAGVNGL

SEQ ID NO: 1261977 - protein, 9 aa, Homo Sapiens
IKDHRKSLM

SEQ ID NO: 1261978 - protein, 9 aa, Homo Sapiens
SGPHTFPKM

SEQ ID NO: 1261979 - protein, 9 aa, Homo Sapiens
QEGKCLQAK

SEQ ID NO: 1261980 - protein, 9 aa, Homo Sapiens
PENYPNVGL

SEQ ID NO: 1261981 - protein, 9 aa, Homo Sapiens
ETHQGFPTK

SEQ ID NO: 1261982 - protein, 9 aa, Homo Sapiens
ATNRHVWEL

SEQ ID NO: 1261983 - protein, 9 aa, Homo Sapiens
TLYRHNLTG

SEQ ID NO: 1261984 - protein, 9 aa, Homo Sapiens
KSFLSSYAL

SEQ ID NO: 1261985 - protein, 9 aa, Homo Sapiens
STAMIRPDP

SEQ ID NO: 1261986 - protein, 9 aa, Homo Sapiens
RAYNSDGLA

SEQ ID NO: 1261987 - protein, 9 aa, Homo Sapiens
YPRTTDGKE

SEQ ID NO: 1261988 - protein, 9 aa, Homo Sapiens
FTQCLLFIT

SEQ ID NO: 1261989 - protein, 9 aa, Homo Sapiens
QRETYECCL

SEQ ID NO: 1261990 - protein, 9 aa, Homo Sapiens
FVFSMVNVD

SEQ ID NO: 1261991 - protein, 9 aa, Homo Sapiens
DAANKSILT

SEQ ID NO: 1261992 - protein, 9 aa, Homo Sapiens
TLTVAVGVC

SEQ ID NO: 1261993 - protein, 9 aa, Homo Sapiens
GPTTSPGSH

SEQ ID NO: 1261994 - protein, 9 aa, Homo Sapiens
HREFHALIK

SEQ ID NO: 1261995 - protein, 9 aa, Homo Sapiens
GEDYKAMSR

SEQ ID NO: 1261996 - protein, 9 aa, Homo Sapiens
RHPRCGVPD

SEQ ID NO: 1261997 - protein, 9 aa, Homo Sapiens
DSKYDVRVQ

SEQ ID NO: 1261998 - protein, 9 aa, Homo Sapiens
TWYPCGLSQ

SEQ ID NO: 1261999 - protein, 9 aa, Homo Sapiens
LKLVKVLND

SEQ ID NO: 1262000 - protein, 9 aa, Homo Sapiens
SKLFKDLGM

SEQ ID NO: 1262001 - protein, 9 aa, Homo Sapiens
DLKIKLAMK

SEQ ID NO: 1262002 - protein, 9 aa, Homo Sapiens
EECSKPREV

SEQ ID NO: 1262003 - protein, 9 aa, Homo Sapiens
KNFRIYKAP

SEQ ID NO: 1262004 - protein, 9 aa, Homo Sapiens
GFGLDILTK

SEQ ID NO: 1262005 - protein, 9 aa, Homo Sapiens
PPRAPPARG

SEQ ID NO: 1262006 - protein, 9 aa, Homo Sapiens
CGCHLGVFP

SEQ ID NO: 1262007 - protein, 9 aa, Homo Sapiens
EVKEVLQDL

SEQ ID NO: 1262008 - protein, 9 aa, Homo Sapiens
RNPTVRLLL

SEQ ID NO: 1262009 - protein, 9 aa, Homo Sapiens
LSFRQTMWW

SEQ ID NO: 1262010 - protein, 9 aa, Homo Sapiens
PQQHNFTHH

SEQ ID NO: 1262011 - protein, 9 aa, Homo Sapiens
IHFAVDRRV

SEQ ID NO: 1262012 - protein, 9 aa, Homo Sapiens
MLNYKDIMK

SEQ ID NO: 1262013 - protein, 9 aa, Homo Sapiens
ERDCASPSR

SEQ ID NO: 1262014 - protein, 9 aa, Homo Sapiens
DLAGQDAND

SEQ ID NO: 1262015 - protein, 9 aa, Homo Sapiens
ADADLEEWL

SEQ ID NO: 1262016 - protein, 9 aa, Homo Sapiens
LPEEFQVVK

SEQ ID NO: 1262017 - protein, 9 aa, Homo Sapiens
VNPTTTKRF

SEQ ID NO: 1262018 - protein, 9 aa, Homo Sapiens
NSPSLQPPT

SEQ ID NO: 1262019 - protein, 9 aa, Homo Sapiens
DTLELTCEA

SEQ ID NO: 1262020 - protein, 9 aa, Homo Sapiens
YFFLSIMSF

SEQ ID NO: 1262021 - protein, 9 aa, Homo Sapiens
SCSNSEGYL

SEQ ID NO: 1262022 - protein, 9 aa, Homo Sapiens
GISRKSPLA

SEQ ID NO: 1262023 - protein, 9 aa, Homo Sapiens
CNAGWLQDV

SEQ ID NO: 1262024 - protein, 9 aa, Homo Sapiens
RKKDKEKKR

SEQ ID NO: 1262025 - protein, 9 aa, Homo Sapiens
LKMLQDEVT

SEQ ID NO: 1262026 - protein, 9 aa, Homo Sapiens
DSPMQEDPP

SEQ ID NO: 1262027 - protein, 9 aa, Homo Sapiens
KAEELKADL

SEQ ID NO: 1262028 - protein, 9 aa, Homo Sapiens
DSGILPEPV

SEQ ID NO: 1262029 - protein, 9 aa, Homo Sapiens
SICLGSFET

SEQ ID NO: 1262030 - protein, 9 aa, Homo Sapiens
LLFPVGYFV

SEQ ID NO: 1262031 - protein, 9 aa, Homo Sapiens
EILNAFRLF

SEQ ID NO: 1262032 - protein, 9 aa, Homo Sapiens
GSMGPQYVT

SEQ ID NO: 1262033 - protein, 9 aa, Homo Sapiens
YSAENEEDK

SEQ ID NO: 1262034 - protein, 9 aa, Homo Sapiens
CGKSFNHVS

SEQ ID NO: 1262035 - protein, 9 aa, Homo Sapiens
EAVTGNRIG

SEQ ID NO: 1262036 - protein, 9 aa, Homo Sapiens
SCGWWAPAC

SEQ ID NO: 1262037 - protein, 9 aa, Homo Sapiens
ELNAQIMKE

SEQ ID NO: 1262038 - protein, 9 aa, Homo Sapiens
VKTLITQCT

SEQ ID NO: 1262039 - protein, 9 aa, Homo Sapiens
GYVSQVAEH

SEQ ID NO: 1262040 - protein, 9 aa, Homo Sapiens
SGMQVSQDF

SEQ ID NO: 1262041 - protein, 9 aa, Homo Sapiens
VVLAQGSGL

SEQ ID NO: 1262042 - protein, 9 aa, Homo Sapiens
GIFYILVGG

SEQ ID NO: 1262043 - protein, 9 aa, Homo Sapiens
FDTLQLWLI

SEQ ID NO: 1262044 - protein, 9 aa, Homo Sapiens
VGRREPVEL

SEQ ID NO: 1262045 - protein, 9 aa, Homo Sapiens
QREFSMTDF

SEQ ID NO: 1262046 - protein, 9 aa, Homo Sapiens
YLYEKRNVS

SEQ ID NO: 1262047 - protein, 9 aa, Homo Sapiens
TELIQALVL

SEQ ID NO: 1262048 - protein, 9 aa, Homo Sapiens
ISDQVAFIF

SEQ ID NO: 1262049 - protein, 9 aa, Homo Sapiens
TVHPPPSTC

SEQ ID NO: 1262050 - protein, 9 aa, Homo Sapiens
SFEGLVQLW

SEQ ID NO: 1262051 - protein, 9 aa, Homo Sapiens
STVTATTTT

SEQ ID NO: 1262052 - protein, 9 aa, Homo Sapiens
PMTEGTHCC

SEQ ID NO: 1262053 - protein, 9 aa, Homo Sapiens
SAVDGLIFQ

SEQ ID NO: 1262054 - protein, 9 aa, Homo Sapiens
NFTKLITVN

SEQ ID NO: 1262055 - protein, 9 aa, Homo Sapiens
QIEEEYARE

SEQ ID NO: 1262056 - protein, 9 aa, Homo Sapiens
LVQGFGSTQ

SEQ ID NO: 1262057 - protein, 9 aa, Homo Sapiens
EDSLVKRQR

SEQ ID NO: 1262058 - protein, 9 aa, Homo Sapiens
TTSPTLLFS

SEQ ID NO: 1262059 - protein, 9 aa, Homo Sapiens
EIYGRRYHQ

SEQ ID NO: 1262060 - protein, 9 aa, Homo Sapiens
FWASYHISS

SEQ ID NO: 1262061 - protein, 9 aa, Homo Sapiens
SALKFQRTQ

SEQ ID NO: 1262062 - protein, 9 aa, Homo Sapiens
AKLDKVQIH

SEQ ID NO: 1262063 - protein, 9 aa, Homo Sapiens
DVREEVMLS

SEQ ID NO: 1262064 - protein, 9 aa, Homo Sapiens
LNSLLEEYQ

SEQ ID NO: 1262065 - protein, 9 aa, Homo Sapiens
EAGELKWET

SEQ ID NO: 1262066 - protein, 9 aa, Homo Sapiens
MPRMRQLQS

SEQ ID NO: 1262067 - protein, 9 aa, Homo Sapiens
DPVLDTNGS

SEQ ID NO: 1262068 - protein, 9 aa, Homo Sapiens
QVETRTSSH

SEQ ID NO: 1262069 - protein, 9 aa, Homo Sapiens
AGSLLTPPH

SEQ ID NO: 1262070 - protein, 9 aa, Homo Sapiens
TAKSICRML

SEQ ID NO: 1262071 - protein, 9 aa, Homo Sapiens
GGKRVVYYD

SEQ ID NO: 1262072 - protein, 9 aa, Homo Sapiens
RPASPTAIW

SEQ ID NO: 1262073 - protein, 9 aa, Homo Sapiens
GTAPTDSWL

SEQ ID NO: 1262074 - protein, 9 aa, Homo Sapiens
KALQQTRML

SEQ ID NO: 1262075 - protein, 9 aa, Homo Sapiens
PMFCHSDEH

SEQ ID NO: 1262076 - protein, 9 aa, Homo Sapiens
RHPGASIQE

SEQ ID NO: 1262077 - protein, 9 aa, Homo Sapiens
SELQNNFIE

SEQ ID NO: 1262078 - protein, 9 aa, Homo Sapiens
LPAAAAATT

SEQ ID NO: 1262079 - protein, 9 aa, Homo Sapiens
TMLYKPSPD

SEQ ID NO: 1262080 - protein, 9 aa, Homo Sapiens
QEKDFSLKT

SEQ ID NO: 1262081 - protein, 9 aa, Homo Sapiens
YTIYITTAS

SEQ ID NO: 1262082 - protein, 9 aa, Homo Sapiens
THPFEEGKK

SEQ ID NO: 1262083 - protein, 9 aa, Homo Sapiens
LSRKYIHWQ

SEQ ID NO: 1262084 - protein, 9 aa, Homo Sapiens
QKEEKKTAR

SEQ ID NO: 1262085 - protein, 9 aa, Homo Sapiens
GHRYVNMTL

SEQ ID NO: 1262086 - protein, 9 aa, Homo Sapiens
LGISSEIEQ

SEQ ID NO: 1262087 - protein, 9 aa, Homo Sapiens
GADHMASLL

SEQ ID NO: 1262088 - protein, 9 aa, Homo Sapiens
PHGSGAGPF

SEQ ID NO: 1262089 - protein, 9 aa, Homo Sapiens
KLYPHRVAC

SEQ ID NO: 1262090 - protein, 9 aa, Homo Sapiens
VFCLPWEIP

SEQ ID NO: 1262091 - protein, 9 aa, Homo Sapiens
PGRPRWRDY

SEQ ID NO: 1262092 - protein, 9 aa, Homo Sapiens
EKALVEAAV

SEQ ID NO: 1262093 - protein, 9 aa, Homo Sapiens
VFLRRYTSE

SEQ ID NO: 1262094 - protein, 9 aa, Homo Sapiens
DDCSSDCAP

SEQ ID NO: 1262095 - protein, 9 aa, Homo Sapiens
LASARGPLC

SEQ ID NO: 1262096 - protein, 9 aa, Homo Sapiens
SFPSTAQLN

SEQ ID NO: 1262097 - protein, 9 aa, Homo Sapiens
KTPFLVDQS

SEQ ID NO: 1262098 - protein, 9 aa, Homo Sapiens
HSPGVHPEV

SEQ ID NO: 1262099 - protein, 9 aa, Homo Sapiens
RQEWDLTKS

SEQ ID NO: 1262100 - protein, 9 aa, Homo Sapiens
NGSNRHEIS

SEQ ID NO: 1262101 - protein, 9 aa, Homo Sapiens
NIARKSLPR

SEQ ID NO: 1262102 - protein, 9 aa, Homo Sapiens
EGDSVASKY

SEQ ID NO: 1262103 - protein, 9 aa, Homo Sapiens
EVETLLKSK

SEQ ID NO: 1262104 - protein, 9 aa, Homo Sapiens
DQDREGTGR

SEQ ID NO: 1262105 - protein, 9 aa, Homo Sapiens
GFDMGGMST

SEQ ID NO: 1262106 - protein, 9 aa, Homo Sapiens
YLYNFSYIN

SEQ ID NO: 1262107 - protein, 9 aa, Homo Sapiens
NGCHSGEIF

SEQ ID NO: 1262108 - protein, 9 aa, Homo Sapiens
LELLTSNDP

SEQ ID NO: 1262109 - protein, 9 aa, Homo Sapiens
GSHAYERFT

SEQ ID NO: 1262110 - protein, 9 aa, Homo Sapiens
HSAQAFPQA

SEQ ID NO: 1262111 - protein, 9 aa, Homo Sapiens
PKMYRVALE

SEQ ID NO: 1262112 - protein, 9 aa, Homo Sapiens
YEVIGKSKP

SEQ ID NO: 1262113 - protein, 9 aa, Homo Sapiens
INPWERKSY

SEQ ID NO: 1262114 - protein, 9 aa, Homo Sapiens
HPRFCVSLA

SEQ ID NO: 1262115 - protein, 9 aa, Homo Sapiens
RQFTSQANV

SEQ ID NO: 1262116 - protein, 9 aa, Homo Sapiens
LLTPPHRVS

SEQ ID NO: 1262117 - protein, 9 aa, Homo Sapiens
KQMLQSYKI

SEQ ID NO: 1262118 - protein, 9 aa, Homo Sapiens
SLHIHTRTH

SEQ ID NO: 1262119 - protein, 9 aa, Homo Sapiens
EPHLTVGLL

SEQ ID NO: 1262120 - protein, 9 aa, Homo Sapiens
KGEGDMTKA

SEQ ID NO: 1262121 - protein, 9 aa, Homo Sapiens
TQHCLSVLF

SEQ ID NO: 1262122 - protein, 9 aa, Homo Sapiens
AVFIHGMHA

SEQ ID NO: 1262123 - protein, 9 aa, Homo Sapiens
GPFTDVCAA

SEQ ID NO: 1262124 - protein, 9 aa, Homo Sapiens
QNKYKEDAH

SEQ ID NO: 1262125 - protein, 9 aa, Homo Sapiens
EVMFALWEL

SEQ ID NO: 1262126 - protein, 9 aa, Homo Sapiens
VHHALEQLK

SEQ ID NO: 1262127 - protein, 9 aa, Homo Sapiens
CRDMPGHAG

SEQ ID NO: 1262128 - protein, 9 aa, Homo Sapiens
ELGLGVHQR

SEQ ID NO: 1262129 - protein, 9 aa, Homo Sapiens
PRVARPFSG

SEQ ID NO: 1262130 - protein, 9 aa, Homo Sapiens
GPGDSVEAC

SEQ ID NO: 1262131 - protein, 9 aa, Homo Sapiens
LISIASTDT

SEQ ID NO: 1262132 - protein, 9 aa, Homo Sapiens
EWHVIQAVN

SEQ ID NO: 1262133 - protein, 9 aa, Homo Sapiens
PEDLCARTQ

SEQ ID NO: 1262134 - protein, 9 aa, Homo Sapiens
KIVYQQSQY

SEQ ID NO: 1262135 - protein, 9 aa, Homo Sapiens
LIRKWGKLP

SEQ ID NO: 1262136 - protein, 9 aa, Homo Sapiens
STSPQPKCW

SEQ ID NO: 1262137 - protein, 9 aa, Homo Sapiens
LGHLARECD

SEQ ID NO: 1262138 - protein, 9 aa, Homo Sapiens
YNGHHRIQV

SEQ ID NO: 1262139 - protein, 9 aa, Homo Sapiens
MGAGTLTNL

SEQ ID NO: 1262140 - protein, 9 aa, Homo Sapiens
LQVITSNMP

SEQ ID NO: 1262141 - protein, 9 aa, Homo Sapiens
YNNGPDGCA

SEQ ID NO: 1262142 - protein, 9 aa, Homo Sapiens
CRDVEQYVL

SEQ ID NO: 1262143 - protein, 9 aa, Homo Sapiens
MILTEFELL

SEQ ID NO: 1262144 - protein, 9 aa, Homo Sapiens
FTDVDLHVY

SEQ ID NO: 1262145 - protein, 9 aa, Homo Sapiens
NFLGSGTGF

SEQ ID NO: 1262146 - protein, 9 aa, Homo Sapiens
YEIKNEADM

SEQ ID NO: 1262147 - protein, 9 aa, Homo Sapiens
YLQASGIRA

SEQ ID NO: 1262148 - protein, 9 aa, Homo Sapiens
VILDGLSNI

SEQ ID NO: 1262149 - protein, 9 aa, Homo Sapiens
ESLESVSVV

SEQ ID NO: 1262150 - protein, 9 aa, Homo Sapiens
DLLVEFEFH

SEQ ID NO: 1262151 - protein, 9 aa, Homo Sapiens
EKRKIPCES

SEQ ID NO: 1262152 - protein, 9 aa, Homo Sapiens
VLDDEDSDN

SEQ ID NO: 1262153 - protein, 9 aa, Homo Sapiens
SFGILNGLC

SEQ ID NO: 1262154 - protein, 9 aa, Homo Sapiens
MSNLFYTPN

SEQ ID NO: 1262155 - protein, 9 aa, Homo Sapiens
NLDFNHITG

SEQ ID NO: 1262156 - protein, 9 aa, Homo Sapiens
PDFRESQEQ

SEQ ID NO: 1262157 - protein, 9 aa, Homo Sapiens
YEVWLGTMF

SEQ ID NO: 1262158 - protein, 9 aa, Homo Sapiens
TCMFSQGSD

SEQ ID NO: 1262159 - protein, 9 aa, Homo Sapiens
ATHLSAYVS

SEQ ID NO: 1262160 - protein, 9 aa, Homo Sapiens
YEVLVFAEW

SEQ ID NO: 1262161 - protein, 9 aa, Homo Sapiens
HFFREHALQ

SEQ ID NO: 1262162 - protein, 9 aa, Homo Sapiens
HLRIHSIRA

SEQ ID NO: 1262163 - protein, 9 aa, Homo Sapiens
WTACVVHLL

SEQ ID NO: 1262164 - protein, 9 aa, Homo Sapiens
SNYITMDPV

SEQ ID NO: 1262165 - protein, 9 aa, Homo Sapiens
HAGPCLPRP

SEQ ID NO: 1262166 - protein, 9 aa, Homo Sapiens
VIAGIVDQP

SEQ ID NO: 1262167 - protein, 9 aa, Homo Sapiens
SHLHGEKGK

SEQ ID NO: 1262168 - protein, 9 aa, Homo Sapiens
HLELHKKYK

SEQ ID NO: 1262169 - protein, 9 aa, Homo Sapiens
EPTEQHVRK

SEQ ID NO: 1262170 - protein, 9 aa, Homo Sapiens
EYIRSLNMV

SEQ ID NO: 1262171 - protein, 9 aa, Homo Sapiens
TAQQELDEK

SEQ ID NO: 1262172 - protein, 9 aa, Homo Sapiens
YMAVKELND

SEQ ID NO: 1262173 - protein, 9 aa, Homo Sapiens
QKQEPCPAQ

SEQ ID NO: 1262174 - protein, 9 aa, Homo Sapiens
HIICSPLHL

SEQ ID NO: 1262175 - protein, 9 aa, Homo Sapiens
YRQLSNGDH

SEQ ID NO: 1262176 - protein, 9 aa, Homo Sapiens
MDMAFDRYV

SEQ ID NO: 1262177 - protein, 9 aa, Homo Sapiens
GGVGMHLAS

SEQ ID NO: 1262178 - protein, 9 aa, Homo Sapiens
IATSQRDLI

SEQ ID NO: 1262179 - protein, 9 aa, Homo Sapiens
NENQDLNII

SEQ ID NO: 1262180 - protein, 9 aa, Homo Sapiens
TMYLSFITL

SEQ ID NO: 1262181 - protein, 9 aa, Homo Sapiens
PALPLPPDF

SEQ ID NO: 1262182 - protein, 9 aa, Homo Sapiens
DTRRTVPPL

SEQ ID NO: 1262183 - protein, 9 aa, Homo Sapiens
TVHEACDRL

SEQ ID NO: 1262184 - protein, 9 aa, Homo Sapiens
ATSSWDSFL

SEQ ID NO: 1262185 - protein, 9 aa, Homo Sapiens
QLVFFSLLT

SEQ ID NO: 1262186 - protein, 9 aa, Homo Sapiens
NIMKLSGIQ

SEQ ID NO: 1262187 - protein, 9 aa, Homo Sapiens
PCRVTDSQL

SEQ ID NO: 1262188 - protein, 9 aa, Homo Sapiens
SVESKWSLL

SEQ ID NO: 1262189 - protein, 9 aa, Homo Sapiens
TDMELPPLK

SEQ ID NO: 1262190 - protein, 9 aa, Homo Sapiens
SQGSSPPTV

SEQ ID NO: 1262191 - protein, 9 aa, Homo Sapiens
VQLWHLWLD

SEQ ID NO: 1262192 - protein, 9 aa, Homo Sapiens
CTCTLKGKK

SEQ ID NO: 1262193 - protein, 9 aa, Homo Sapiens
LELFVNKMA

SEQ ID NO: 1262194 - protein, 9 aa, Homo Sapiens
EEWRRSLKE

SEQ ID NO: 1262195 - protein, 9 aa, Homo Sapiens
EEHRIRIRR

SEQ ID NO: 1262196 - protein, 9 aa, Homo Sapiens
DKDGDETIT

SEQ ID NO: 1262197 - protein, 9 aa, Homo Sapiens
PQAGPWNTS

SEQ ID NO: 1262198 - protein, 9 aa, Homo Sapiens
KLPIGTWDQ

SEQ ID NO: 1262199 - protein, 9 aa, Homo Sapiens
NPTVRLLLA

SEQ ID NO: 1262200 - protein, 9 aa, Homo Sapiens
YAMEQYECS

SEQ ID NO: 1262201 - protein, 9 aa, Homo Sapiens
EIHYENGKQ

SEQ ID NO: 1262202 - protein, 9 aa, Homo Sapiens
GNGMDSDME

SEQ ID NO: 1262203 - protein, 9 aa, Homo Sapiens
GRLTGLGRE

SEQ ID NO: 1262204 - protein, 9 aa, Homo Sapiens
LPLYIPHPS

SEQ ID NO: 1262205 - protein, 9 aa, Homo Sapiens
AFLAMSFNS

SEQ ID NO: 1262206 - protein, 9 aa, Homo Sapiens
TYRHIVKVD

SEQ ID NO: 1262207 - protein, 9 aa, Homo Sapiens
DKIQTETHQ

SEQ ID NO: 1262208 - protein, 9 aa, Homo Sapiens
RTCQCINTD

SEQ ID NO: 1262209 - protein, 9 aa, Homo Sapiens
DINDCPHVF

SEQ ID NO: 1262210 - protein, 9 aa, Homo Sapiens
YTSQKTSGT

SEQ ID NO: 1262211 - protein, 9 aa, Homo Sapiens
EGSPGAERK

SEQ ID NO: 1262212 - protein, 9 aa, Homo Sapiens
SLKMEASYC

SEQ ID NO: 1262213 - protein, 9 aa, Homo Sapiens
LSTSILLFL

SEQ ID NO: 1262214 - protein, 9 aa, Homo Sapiens
IGPLQGEHS

SEQ ID NO: 1262215 - protein, 9 aa, Homo Sapiens
FLSYTVSFL

SEQ ID NO: 1262216 - protein, 9 aa, Homo Sapiens
MFTVTFAWC

SEQ ID NO: 1262217 - protein, 9 aa, Homo Sapiens
INLMDELTL

SEQ ID NO: 1262218 - protein, 9 aa, Homo Sapiens
NPAIRDTKP

SEQ ID NO: 1262219 - protein, 9 aa, Homo Sapiens
VATTTSLVT

SEQ ID NO: 1262220 - protein, 9 aa, Homo Sapiens
LGQTQKVFQ

SEQ ID NO: 1262221 - protein, 9 aa, Homo Sapiens
WTAHAIILD

SEQ ID NO: 1262222 - protein, 9 aa, Homo Sapiens
GVIIQGAKR

SEQ ID NO: 1262223 - protein, 9 aa, Homo Sapiens
IPAKQTQTF

SEQ ID NO: 1262224 - protein, 9 aa, Homo Sapiens
SLMGIFNFT

SEQ ID NO: 1262225 - protein, 9 aa, Homo Sapiens
VEHETVAEA

SEQ ID NO: 1262226 - protein, 9 aa, Homo Sapiens
GQWPCFDSQ

SEQ ID NO: 1262227 - protein, 9 aa, Homo Sapiens
QGAKDLHWL

SEQ ID NO: 1262228 - protein, 9 aa, Homo Sapiens
LSELEKIVK

SEQ ID NO: 1262229 - protein, 9 aa, Homo Sapiens
AENESPKCQ

SEQ ID NO: 1262230 - protein, 9 aa, Homo Sapiens
FMCLLKDKG

SEQ ID NO: 1262231 - protein, 9 aa, Homo Sapiens
LINSLIQLN

SEQ ID NO: 1262232 - protein, 9 aa, Homo Sapiens
QRYRKSWRC

SEQ ID NO: 1262233 - protein, 9 aa, Homo Sapiens
VPDAISESQ

SEQ ID NO: 1262234 - protein, 9 aa, Homo Sapiens
KPFLYDNAT

SEQ ID NO: 1262235 - protein, 9 aa, Homo Sapiens
GELRLRETL

SEQ ID NO: 1262236 - protein, 9 aa, Homo Sapiens
FFSKDQFPE

SEQ ID NO: 1262237 - protein, 9 aa, Homo Sapiens
CMTALGLAY

SEQ ID NO: 1262238 - protein, 9 aa, Homo Sapiens
SHTGESHFK

SEQ ID NO: 1262239 - protein, 9 aa, Homo Sapiens
MSIIGSTNL

SEQ ID NO: 1262240 - protein, 9 aa, Homo Sapiens
PGFYISTPT

SEQ ID NO: 1262241 - protein, 9 aa, Homo Sapiens
QVYIGSFWS

SEQ ID NO: 1262242 - protein, 9 aa, Homo Sapiens
SWGCNVSRK

SEQ ID NO: 1262243 - protein, 9 aa, Homo Sapiens
MCTAKFGSK

SEQ ID NO: 1262244 - protein, 9 aa, Homo Sapiens
ISTQHCLSV

SEQ ID NO: 1262245 - protein, 9 aa, Homo Sapiens
LCQTTGLME

SEQ ID NO: 1262246 - protein, 9 aa, Homo Sapiens
QPSSPSQES

SEQ ID NO: 1262247 - protein, 9 aa, Homo Sapiens
TLCNGSNCF

SEQ ID NO: 1262248 - protein, 9 aa, Homo Sapiens
ANAPCRCSA

SEQ ID NO: 1262249 - protein, 9 aa, Homo Sapiens
SSCKTPDVS

SEQ ID NO: 1262250 - protein, 9 aa, Homo Sapiens
TCTLWTWMT

SEQ ID NO: 1262251 - protein, 9 aa, Homo Sapiens
MHPPTLNQI

SEQ ID NO: 1262252 - protein, 9 aa, Homo Sapiens
DSSCGSRGS

SEQ ID NO: 1262253 - protein, 9 aa, Homo Sapiens
GLLCYAALS

SEQ ID NO: 1262254 - protein, 9 aa, Homo Sapiens
SCNSPQPWS

SEQ ID NO: 1262255 - protein, 9 aa, Homo Sapiens
VVWLLAGWR

SEQ ID NO: 1262256 - protein, 9 aa, Homo Sapiens
KHPAERHMI

SEQ ID NO: 1262257 - protein, 9 aa, Homo Sapiens
ERKLDRANN

SEQ ID NO: 1262258 - protein, 9 aa, Homo Sapiens
TPQDAYSHL

SEQ ID NO: 1262259 - protein, 9 aa, Homo Sapiens
RRPYAPINV

SEQ ID NO: 1262260 - protein, 9 aa, Homo Sapiens
LRVRGQKKC

SEQ ID NO: 1262261 - protein, 9 aa, Homo Sapiens
LFITLVITE

SEQ ID NO: 1262262 - protein, 9 aa, Homo Sapiens
LFEASNWHG

SEQ ID NO: 1262263 - protein, 9 aa, Homo Sapiens
ANGLMATYL

SEQ ID NO: 1262264 - protein, 9 aa, Homo Sapiens
PHRTPWPLP

SEQ ID NO: 1262265 - protein, 9 aa, Homo Sapiens
CNPLIHVFF

SEQ ID NO: 1262266 - protein, 9 aa, Homo Sapiens
RVSLTASRA

SEQ ID NO: 1262267 - protein, 9 aa, Homo Sapiens
QLLKCLATV

SEQ ID NO: 1262268 - protein, 9 aa, Homo Sapiens
KLTSALFNT

SEQ ID NO: 1262269 - protein, 9 aa, Homo Sapiens
QPDFTQIDI

SEQ ID NO: 1262270 - protein, 9 aa, Homo Sapiens
TGDCFPAGA

SEQ ID NO: 1262271 - protein, 9 aa, Homo Sapiens
KISITTIGN

SEQ ID NO: 1262272 - protein, 9 aa, Homo Sapiens
GPKRDHATL

SEQ ID NO: 1262273 - protein, 9 aa, Homo Sapiens
KDTTTSMRI

SEQ ID NO: 1262274 - protein, 9 aa, Homo Sapiens
CRHQSPDCC

SEQ ID NO: 1262275 - protein, 9 aa, Homo Sapiens
ILSTFLDPF

SEQ ID NO: 1262276 - protein, 9 aa, Homo Sapiens
KKSKEEGTR

SEQ ID NO: 1262277 - protein, 9 aa, Homo Sapiens
VLSSPNLWP

SEQ ID NO: 1262278 - protein, 9 aa, Homo Sapiens
NEQHLEGEF

SEQ ID NO: 1262279 - protein, 9 aa, Homo Sapiens
YTVSFLLQE

SEQ ID NO: 1262280 - protein, 9 aa, Homo Sapiens
GFVICVPES

SEQ ID NO: 1262281 - protein, 9 aa, Homo Sapiens
ELRQWVRMA

SEQ ID NO: 1262282 - protein, 9 aa, Homo Sapiens
THPTVNYFG

SEQ ID NO: 1262283 - protein, 9 aa, Homo Sapiens
PKTEKSFGE

SEQ ID NO: 1262284 - protein, 9 aa, Homo Sapiens
YINIISILY

SEQ ID NO: 1262285 - protein, 9 aa, Homo Sapiens
AAERSPSPS

SEQ ID NO: 1262286 - protein, 9 aa, Homo Sapiens
SGTIMTDLE

SEQ ID NO: 1262287 - protein, 9 aa, Homo Sapiens
PGSFVSKVY

SEQ ID NO: 1262288 - protein, 9 aa, Homo Sapiens
ERVLYSMEC

SEQ ID NO: 1262289 - protein, 9 aa, Homo Sapiens
PMGEWTACV

SEQ ID NO: 1262290 - protein, 9 aa, Homo Sapiens
WDKNHEALA

SEQ ID NO: 1262291 - protein, 9 aa, Homo Sapiens
KKYVWIMKR

SEQ ID NO: 1262292 - protein, 9 aa, Homo Sapiens
LEENNQFQV

SEQ ID NO: 1262293 - protein, 9 aa, Homo Sapiens
VACLIFLCV

SEQ ID NO: 1262294 - protein, 9 aa, Homo Sapiens
RWNESPGAP

SEQ ID NO: 1262295 - protein, 9 aa, Homo Sapiens
KVKQRIEYA

SEQ ID NO: 1262296 - protein, 9 aa, Homo Sapiens
YLQAAIDVP

SEQ ID NO: 1262297 - protein, 9 aa, Homo Sapiens
GLEIPDQNI

SEQ ID NO: 1262298 - protein, 9 aa, Homo Sapiens
RVSGLHGSD

SEQ ID NO: 1262299 - protein, 9 aa, Homo Sapiens
DAALMQDYT

SEQ ID NO: 1262300 - protein, 9 aa, Homo Sapiens
AYELLWGWR

SEQ ID NO: 1262301 - protein, 9 aa, Homo Sapiens
FHSIDVQVE

SEQ ID NO: 1262302 - protein, 9 aa, Homo Sapiens
RMADVPVTS

SEQ ID NO: 1262303 - protein, 9 aa, Homo Sapiens
FFDTSRHIS

SEQ ID NO: 1262304 - protein, 9 aa, Homo Sapiens
GMHPPTLNQ

SEQ ID NO: 1262305 - protein, 9 aa, Homo Sapiens
LAQRKGISR

SEQ ID NO: 1262306 - protein, 9 aa, Homo Sapiens
IDKRQWNRC

SEQ ID NO: 1262307 - protein, 9 aa, Homo Sapiens
VSTHSVTWS

SEQ ID NO: 1262308 - protein, 9 aa, Homo Sapiens
LCNPFHHSL

SEQ ID NO: 1262309 - protein, 9 aa, Homo Sapiens
SCMDTYEME

SEQ ID NO: 1262310 - protein, 9 aa, Homo Sapiens
GAELVITRN

SEQ ID NO: 1262311 - protein, 9 aa, Homo Sapiens
SKKVVVSPT

SEQ ID NO: 1262312 - protein, 9 aa, Homo Sapiens
ALSEPYHSP

SEQ ID NO: 1262313 - protein, 9 aa, Homo Sapiens
VQIMRLIKP

SEQ ID NO: 1262314 - protein, 9 aa, Homo Sapiens
QEPSLVKIS

SEQ ID NO: 1262315 - protein, 9 aa, Homo Sapiens
SLLHDRIFS

SEQ ID NO: 1262316 - protein, 9 aa, Homo Sapiens
ECKNADPIL

SEQ ID NO: 1262317 - protein, 9 aa, Homo Sapiens
PLGVPGEDG

SEQ ID NO: 1262318 - protein, 9 aa, Homo Sapiens
QNWNFLPMW

SEQ ID NO: 1262319 - protein, 9 aa, Homo Sapiens
AALDECYHS

SEQ ID NO: 1262320 - protein, 9 aa, Homo Sapiens
EEKYTDVEE

SEQ ID NO: 1262321 - protein, 9 aa, Homo Sapiens
MTEGTHCCR

SEQ ID NO: 1262322 - protein, 9 aa, Homo Sapiens
RQKTLHKKN

SEQ ID NO: 1262323 - protein, 9 aa, Homo Sapiens
IAPLPTITN

SEQ ID NO: 1262324 - protein, 9 aa, Homo Sapiens
ELESEARII

SEQ ID NO: 1262325 - protein, 9 aa, Homo Sapiens
SEKIATIAE

SEQ ID NO: 1262326 - protein, 9 aa, Homo Sapiens
REEHEYEEE

SEQ ID NO: 1262327 - protein, 9 aa, Homo Sapiens
ATTGRNFDD

SEQ ID NO: 1262328 - protein, 9 aa, Homo Sapiens
NYENSHSHE

SEQ ID NO: 1262329 - protein, 9 aa, Homo Sapiens
MGEWTACVV

SEQ ID NO: 1262330 - protein, 9 aa, Homo Sapiens
LEKMLLERA

SEQ ID NO: 1262331 - protein, 9 aa, Homo Sapiens
NVTNVRRHL

SEQ ID NO: 1262332 - protein, 9 aa, Homo Sapiens
KMAPNHGLH

SEQ ID NO: 1262333 - protein, 9 aa, Homo Sapiens
KWGSKGKLE

SEQ ID NO: 1262334 - protein, 9 aa, Homo Sapiens
PAASLEVRA

SEQ ID NO: 1262335 - protein, 9 aa, Homo Sapiens
GSGKFTVGA

SEQ ID NO: 1262336 - protein, 9 aa, Homo Sapiens
QGHHVRISR

SEQ ID NO: 1262337 - protein, 9 aa, Homo Sapiens
YEWMVSRSL

SEQ ID NO: 1262338 - protein, 9 aa, Homo Sapiens
PLPPPVTYQ

SEQ ID NO: 1262339 - protein, 9 aa, Homo Sapiens
SSGTGWWRS

SEQ ID NO: 1262340 - protein, 9 aa, Homo Sapiens
AIQYKEAID

SEQ ID NO: 1262341 - protein, 9 aa, Homo Sapiens
LALYLLFTG

SEQ ID NO: 1262342 - protein, 9 aa, Homo Sapiens
VLKLMPIKQ

SEQ ID NO: 1262343 - protein, 9 aa, Homo Sapiens
QKLKLHQSA

SEQ ID NO: 1262344 - protein, 9 aa, Homo Sapiens
LLALLNEHQ

SEQ ID NO: 1262345 - protein, 9 aa, Homo Sapiens
QPLMELLFR

SEQ ID NO: 1262346 - protein, 9 aa, Homo Sapiens
KLRRMMDIL

SEQ ID NO: 1262347 - protein, 9 aa, Homo Sapiens
GSVREVMLW

SEQ ID NO: 1262348 - protein, 9 aa, Homo Sapiens
DAEALVDQV

SEQ ID NO: 1262349 - protein, 9 aa, Homo Sapiens
NLDFKSPDD

SEQ ID NO: 1262350 - protein, 9 aa, Homo Sapiens
DNLEYSAMD

SEQ ID NO: 1262351 - protein, 9 aa, Homo Sapiens
LGQVLEGNN

SEQ ID NO: 1262352 - protein, 9 aa, Homo Sapiens
KVKVRQWRA

SEQ ID NO: 1262353 - protein, 9 aa, Homo Sapiens
VSIMGTRGE

SEQ ID NO: 1262354 - protein, 9 aa, Homo Sapiens
GDMTKALGT

SEQ ID NO: 1262355 - protein, 9 aa, Homo Sapiens
STYVCCLNV

SEQ ID NO: 1262356 - protein, 9 aa, Homo Sapiens
RVIATHSPE

SEQ ID NO: 1262357 - protein, 9 aa, Homo Sapiens
CMDGYSDIV

SEQ ID NO: 1262358 - protein, 9 aa, Homo Sapiens
QNLEDNNRC

SEQ ID NO: 1262359 - protein, 9 aa, Homo Sapiens
CGKATCSDS

SEQ ID NO: 1262360 - protein, 9 aa, Homo Sapiens
CKFYQLECL

SEQ ID NO: 1262361 - protein, 9 aa, Homo Sapiens
HPEPAPGLA

SEQ ID NO: 1262362 - protein, 9 aa, Homo Sapiens
AAGVQCGVQ

SEQ ID NO: 1262363 - protein, 9 aa, Homo Sapiens
FSVSRTVME

SEQ ID NO: 1262364 - protein, 9 aa, Homo Sapiens
IINVHIMSC

SEQ ID NO: 1262365 - protein, 9 aa, Homo Sapiens
EAVEKGISE

SEQ ID NO: 1262366 - protein, 9 aa, Homo Sapiens
ERPYMCNDC

SEQ ID NO: 1262367 - protein, 9 aa, Homo Sapiens
LIIQVMTTE

SEQ ID NO: 1262368 - protein, 9 aa, Homo Sapiens
PIFYRLHLT

SEQ ID NO: 1262369 - protein, 9 aa, Homo Sapiens
EKIVLPHGQ

SEQ ID NO: 1262370 - protein, 9 aa, Homo Sapiens
RIWELTSNF

SEQ ID NO: 1262371 - protein, 9 aa, Homo Sapiens
MQWFCPKCV

SEQ ID NO: 1262372 - protein, 9 aa, Homo Sapiens
RLGPEADVG

SEQ ID NO: 1262373 - protein, 9 aa, Homo Sapiens
RLITLYPTM

SEQ ID NO: 1262374 - protein, 9 aa, Homo Sapiens
QLMKLEQQS

SEQ ID NO: 1262375 - protein, 9 aa, Homo Sapiens
KIAVSIVKS

SEQ ID NO: 1262376 - protein, 9 aa, Homo Sapiens
RKKMKLTLA

SEQ ID NO: 1262377 - protein, 9 aa, Homo Sapiens
SYAFILYII

SEQ ID NO: 1262378 - protein, 9 aa, Homo Sapiens
EKAPAFGCQ

SEQ ID NO: 1262379 - protein, 9 aa, Homo Sapiens
SFQVKRPGD

SEQ ID NO: 1262380 - protein, 9 aa, Homo Sapiens
ISLQWNRIY

SEQ ID NO: 1262381 - protein, 9 aa, Homo Sapiens
WHGKLVLDK

SEQ ID NO: 1262382 - protein, 9 aa, Homo Sapiens
FPPSGMGYC

SEQ ID NO: 1262383 - protein, 9 aa, Homo Sapiens
VKKSSVMCE

SEQ ID NO: 1262384 - protein, 9 aa, Homo Sapiens
EHFRQLLRG

SEQ ID NO: 1262385 - protein, 9 aa, Homo Sapiens
MRRSYETIA

SEQ ID NO: 1262386 - protein, 9 aa, Homo Sapiens
DFFSSMQKV

SEQ ID NO: 1262387 - protein, 9 aa, Homo Sapiens
PVVQNLGMW

SEQ ID NO: 1262388 - protein, 9 aa, Homo Sapiens
EDAHLLNDA

SEQ ID NO: 1262389 - protein, 9 aa, Homo Sapiens
MQLMAAMSF

SEQ ID NO: 1262390 - protein, 9 aa, Homo Sapiens
RTSYPPFRF

SEQ ID NO: 1262391 - protein, 9 aa, Homo Sapiens
TRMLNIPFP

SEQ ID NO: 1262392 - protein, 9 aa, Homo Sapiens
GPGELRLRE

SEQ ID NO: 1262393 - protein, 9 aa, Homo Sapiens
PDSRHIFNQ

SEQ ID NO: 1262394 - protein, 9 aa, Homo Sapiens
AEDLKAKGV

SEQ ID NO: 1262395 - protein, 9 aa, Homo Sapiens
NHDNEKVQL

SEQ ID NO: 1262396 - protein, 9 aa, Homo Sapiens
RLRTLPGGP

SEQ ID NO: 1262397 - protein, 9 aa, Homo Sapiens
TIYITTASG

SEQ ID NO: 1262398 - protein, 9 aa, Homo Sapiens
VSKMALAYA

SEQ ID NO: 1262399 - protein, 9 aa, Homo Sapiens
TTTGGLTSV

SEQ ID NO: 1262400 - protein, 9 aa, Homo Sapiens
KFDDEEPLP

SEQ ID NO: 1262401 - protein, 9 aa, Homo Sapiens
SKGHKIRLI

SEQ ID NO: 1262402 - protein, 9 aa, Homo Sapiens
QREGQQFGA

SEQ ID NO: 1262403 - protein, 9 aa, Homo Sapiens
TVRYYSKGT

SEQ ID NO: 1262404 - protein, 9 aa, Homo Sapiens
GVVTPESFT

SEQ ID NO: 1262405 - protein, 9 aa, Homo Sapiens
DFFKRTHYY

SEQ ID NO: 1262406 - protein, 9 aa, Homo Sapiens
FTKNIFGRY

SEQ ID NO: 1262407 - protein, 9 aa, Homo Sapiens
LIFLVQYLC

SEQ ID NO: 1262408 - protein, 9 aa, Homo Sapiens
RIVWMPRMR

SEQ ID NO: 1262409 - protein, 9 aa, Homo Sapiens
FFVLLGITQ

SEQ ID NO: 1262410 - protein, 9 aa, Homo Sapiens
APADPEMAT

SEQ ID NO: 1262411 - protein, 9 aa, Homo Sapiens
ELKWETDEA

SEQ ID NO: 1262412 - protein, 9 aa, Homo Sapiens
QIKTDVNKA

SEQ ID NO: 1262413 - protein, 9 aa, Homo Sapiens
HVFRPDIYP

SEQ ID NO: 1262414 - protein, 9 aa, Homo Sapiens
SAVMMLHHM

SEQ ID NO: 1262415 - protein, 9 aa, Homo Sapiens
LTTMLLHIK

SEQ ID NO: 1262416 - protein, 9 aa, Homo Sapiens
LTWVRDHHP

SEQ ID NO: 1262417 - protein, 9 aa, Homo Sapiens
INIISILYH

SEQ ID NO: 1262418 - protein, 9 aa, Homo Sapiens
QEDARKSLA

SEQ ID NO: 1262419 - protein, 9 aa, Homo Sapiens
ALLLNKRRT

SEQ ID NO: 1262420 - protein, 9 aa, Homo Sapiens
PGGPGHLHQ

SEQ ID NO: 1262421 - protein, 9 aa, Homo Sapiens
LLQGYDKGV

SEQ ID NO: 1262422 - protein, 9 aa, Homo Sapiens
QAMPSDLII

SEQ ID NO: 1262423 - protein, 9 aa, Homo Sapiens
IRQDGGIGK

SEQ ID NO: 1262424 - protein, 9 aa, Homo Sapiens
FKLPCLKRG

SEQ ID NO: 1262425 - protein, 9 aa, Homo Sapiens
ELVGYCCLE

SEQ ID NO: 1262426 - protein, 9 aa, Homo Sapiens
NLEAPLMLS

SEQ ID NO: 1262427 - protein, 9 aa, Homo Sapiens
CDPEIQELH

SEQ ID NO: 1262428 - protein, 9 aa, Homo Sapiens
RLQEYTEQR

SEQ ID NO: 1262429 - protein, 9 aa, Homo Sapiens
RGARCQDRV

SEQ ID NO: 1262430 - protein, 9 aa, Homo Sapiens
KGYMKALDG

SEQ ID NO: 1262431 - protein, 9 aa, Homo Sapiens
TQWQRHYFY

SEQ ID NO: 1262432 - protein, 9 aa, Homo Sapiens
CEVIEALLR

SEQ ID NO: 1262433 - protein, 9 aa, Homo Sapiens
YFDGPKLAP

SEQ ID NO: 1262434 - protein, 9 aa, Homo Sapiens
YLVSWYDLE

SEQ ID NO: 1262435 - protein, 9 aa, Homo Sapiens
CVEDLHHQA

SEQ ID NO: 1262436 - protein, 9 aa, Homo Sapiens
YQAYTPNFL

SEQ ID NO: 1262437 - protein, 9 aa, Homo Sapiens
CSNTPEEHM

SEQ ID NO: 1262438 - protein, 9 aa, Homo Sapiens
SFLSSYALH

SEQ ID NO: 1262439 - protein, 9 aa, Homo Sapiens
SQLQAQGQI

SEQ ID NO: 1262440 - protein, 9 aa, Homo Sapiens
SALFNTASG

SEQ ID NO: 1262441 - protein, 9 aa, Homo Sapiens
FANIAHSNS

SEQ ID NO: 1262442 - protein, 9 aa, Homo Sapiens
YSLVMGACY

SEQ ID NO: 1262443 - protein, 9 aa, Homo Sapiens
CQTTCYRPR

SEQ ID NO: 1262444 - protein, 9 aa, Homo Sapiens
LKAFLLRMR

SEQ ID NO: 1262445 - protein, 9 aa, Homo Sapiens
TLYHLQLLV

SEQ ID NO: 1262446 - protein, 9 aa, Homo Sapiens
TGTEAPYYL

SEQ ID NO: 1262447 - protein, 9 aa, Homo Sapiens
VLTHDRVRL

SEQ ID NO: 1262448 - protein, 9 aa, Homo Sapiens
LLNNADIVQ

SEQ ID NO: 1262449 - protein, 9 aa, Homo Sapiens
GYDKGVEIY

SEQ ID NO: 1262450 - protein, 9 aa, Homo Sapiens
EIYIKSLSA

SEQ ID NO: 1262451 - protein, 9 aa, Homo Sapiens
TRCYRHNRL

SEQ ID NO: 1262452 - protein, 9 aa, Homo Sapiens
TEPPMNKHL

SEQ ID NO: 1262453 - protein, 9 aa, Homo Sapiens
KTFQIDDYS

SEQ ID NO: 1262454 - protein, 9 aa, Homo Sapiens
AKRNNIVKK

SEQ ID NO: 1262455 - protein, 9 aa, Homo Sapiens
LSHLHGMSS

SEQ ID NO: 1262456 - protein, 9 aa, Homo Sapiens
LMGAGTLTN

SEQ ID NO: 1262457 - protein, 9 aa, Homo Sapiens
QHVSPELLT

SEQ ID NO: 1262458 - protein, 9 aa, Homo Sapiens
CTQDLVLPD

SEQ ID NO: 1262459 - protein, 9 aa, Homo Sapiens
FSLPNTIIH

SEQ ID NO: 1262460 - protein, 9 aa, Homo Sapiens
PKGLENPPG

SEQ ID NO: 1262461 - protein, 9 aa, Homo Sapiens
GIQAVHKAA

SEQ ID NO: 1262462 - protein, 9 aa, Homo Sapiens
NYQRVHTGK

SEQ ID NO: 1262463 - protein, 9 aa, Homo Sapiens
RELKVLCFF

SEQ ID NO: 1262464 - protein, 9 aa, Homo Sapiens
YYPEGVHKE

SEQ ID NO: 1262465 - protein, 9 aa, Homo Sapiens
EIMRLFPQA

SEQ ID NO: 1262466 - protein, 9 aa, Homo Sapiens
SQGKVASLG

SEQ ID NO: 1262467 - protein, 9 aa, Homo Sapiens
TGVVMHYGN

SEQ ID NO: 1262468 - protein, 9 aa, Homo Sapiens
AQPQTKAES

SEQ ID NO: 1262469 - protein, 9 aa, Homo Sapiens
YCGIGINAE

SEQ ID NO: 1262470 - protein, 9 aa, Homo Sapiens
HHSIRCMNV

SEQ ID NO: 1262471 - protein, 9 aa, Homo Sapiens
IHYETSRKT

SEQ ID NO: 1262472 - protein, 9 aa, Homo Sapiens
QEQYIAIQY

SEQ ID NO: 1262473 - protein, 9 aa, Homo Sapiens
GKEDWEMKE

SEQ ID NO: 1262474 - protein, 9 aa, Homo Sapiens
QIGVINVTD

SEQ ID NO: 1262475 - protein, 9 aa, Homo Sapiens
GSGEVPMPQ

SEQ ID NO: 1262476 - protein, 9 aa, Homo Sapiens
RLDRYHHHF

SEQ ID NO: 1262477 - protein, 9 aa, Homo Sapiens
TVKYSKIHS

SEQ ID NO: 1262478 - protein, 9 aa, Homo Sapiens
RAGAPCIQE

SEQ ID NO: 1262479 - protein, 9 aa, Homo Sapiens
MEYVHGGEM

SEQ ID NO: 1262480 - protein, 9 aa, Homo Sapiens
QEVVQRFLC

SEQ ID NO: 1262481 - protein, 9 aa, Homo Sapiens
VLGHAHRKA

SEQ ID NO: 1262482 - protein, 9 aa, Homo Sapiens
KGTPRLQTT

SEQ ID NO: 1262483 - protein, 9 aa, Homo Sapiens
KEEDSSEVG

SEQ ID NO: 1262484 - protein, 9 aa, Homo Sapiens
QASSYSHQQ

SEQ ID NO: 1262485 - protein, 9 aa, Homo Sapiens
SKMALAYAL

SEQ ID NO: 1262486 - protein, 9 aa, Homo Sapiens
AQARQLLAV

SEQ ID NO: 1262487 - protein, 9 aa, Homo Sapiens
TPSNGAEGP

SEQ ID NO: 1262488 - protein, 9 aa, Homo Sapiens
RTVPPLTPR

SEQ ID NO: 1262489 - protein, 9 aa, Homo Sapiens
EAIPGGNLF

SEQ ID NO: 1262490 - protein, 9 aa, Homo Sapiens
IIGKCLKQS

SEQ ID NO: 1262491 - protein, 9 aa, Homo Sapiens
ASASLVNVT

SEQ ID NO: 1262492 - protein, 9 aa, Homo Sapiens
GHNYLLTAE

SEQ ID NO: 1262493 - protein, 9 aa, Homo Sapiens
NRDISPTER

SEQ ID NO: 1262494 - protein, 9 aa, Homo Sapiens
GSTQDHVLS

SEQ ID NO: 1262495 - protein, 9 aa, Homo Sapiens
TSIAPKQRP

SEQ ID NO: 1262496 - protein, 9 aa, Homo Sapiens
CPWTAWSEC

SEQ ID NO: 1262497 - protein, 9 aa, Homo Sapiens
EKHQQVRAK

SEQ ID NO: 1262498 - protein, 9 aa, Homo Sapiens
IVALMSSTI

SEQ ID NO: 1262499 - protein, 9 aa, Homo Sapiens
NGYGSHLHG

SEQ ID NO: 1262500 - protein, 9 aa, Homo Sapiens
PQVLILDEA

SEQ ID NO: 1262501 - protein, 9 aa, Homo Sapiens
CFPVKLDIP

SEQ ID NO: 1262502 - protein, 9 aa, Homo Sapiens
ELPFPSHML

SEQ ID NO: 1262503 - protein, 9 aa, Homo Sapiens
SCEEFVKSM

SEQ ID NO: 1262504 - protein, 9 aa, Homo Sapiens
LHGKIYDAL

SEQ ID NO: 1262505 - protein, 9 aa, Homo Sapiens
LYCNPLASL

SEQ ID NO: 1262506 - protein, 9 aa, Homo Sapiens
RRLRENRRH

SEQ ID NO: 1262507 - protein, 9 aa, Homo Sapiens
ALGPMATGQ

SEQ ID NO: 1262508 - protein, 9 aa, Homo Sapiens
YASVQVPWK

SEQ ID NO: 1262509 - protein, 9 aa, Homo Sapiens
LMSQLTCKQ

SEQ ID NO: 1262510 - protein, 9 aa, Homo Sapiens
ELGFKAGDI

SEQ ID NO: 1262511 - protein, 9 aa, Homo Sapiens
LRHADNLRT

SEQ ID NO: 1262512 - protein, 9 aa, Homo Sapiens
DMFREVGLL

SEQ ID NO: 1262513 - protein, 9 aa, Homo Sapiens
EKTRTKEKY

SEQ ID NO: 1262514 - protein, 9 aa, Homo Sapiens
HKIRLIVEL

SEQ ID NO: 1262515 - protein, 9 aa, Homo Sapiens
KTHLGDSEN

SEQ ID NO: 1262516 - protein, 9 aa, Homo Sapiens
TFEDLENPP

SEQ ID NO: 1262517 - protein, 9 aa, Homo Sapiens
VGPTTIHVQ

SEQ ID NO: 1262518 - protein, 9 aa, Homo Sapiens
REQRWQLQK

SEQ ID NO: 1262519 - protein, 9 aa, Homo Sapiens
SNMPDSILS

SEQ ID NO: 1262520 - protein, 9 aa, Homo Sapiens
VKLQGECVR

SEQ ID NO: 1262521 - protein, 9 aa, Homo Sapiens
VVLKAAAHH

SEQ ID NO: 1262522 - protein, 9 aa, Homo Sapiens
TPRWTTSTD

SEQ ID NO: 1262523 - protein, 9 aa, Homo Sapiens
MSAAYLPED

SEQ ID NO: 1262524 - protein, 9 aa, Homo Sapiens
TEKTGRLQQ

SEQ ID NO: 1262525 - protein, 9 aa, Homo Sapiens
GLAVPDTVH

SEQ ID NO: 1262526 - protein, 9 aa, Homo Sapiens
IFGGDYIFT

SEQ ID NO: 1262527 - protein, 9 aa, Homo Sapiens
WYITKGGNI

SEQ ID NO: 1262528 - protein, 9 aa, Homo Sapiens
QVDSITNIL

SEQ ID NO: 1262529 - protein, 9 aa, Homo Sapiens
SPSPSTQLS

SEQ ID NO: 1262530 - protein, 9 aa, Homo Sapiens
HLLVMASTC

SEQ ID NO: 1262531 - protein, 9 aa, Homo Sapiens
PTSLVATTT

SEQ ID NO: 1262532 - protein, 9 aa, Homo Sapiens
DCQARKLAN

SEQ ID NO: 1262533 - protein, 9 aa, Homo Sapiens
TGIHTDTHR

SEQ ID NO: 1262534 - protein, 9 aa, Homo Sapiens
HLCHYFDGP

SEQ ID NO: 1262535 - protein, 9 aa, Homo Sapiens
LSEHPRLPL

SEQ ID NO: 1262536 - protein, 9 aa, Homo Sapiens
LHLKNGPDS

SEQ ID NO: 1262537 - protein, 9 aa, Homo Sapiens
NESFYTVFT

SEQ ID NO: 1262538 - protein, 9 aa, Homo Sapiens
CTKMYELSW

SEQ ID NO: 1262539 - protein, 9 aa, Homo Sapiens
GSPAAGDVL

SEQ ID NO: 1262540 - protein, 9 aa, Homo Sapiens
GTMVFKPSD

SEQ ID NO: 1262541 - protein, 9 aa, Homo Sapiens
VGKPVFVME

SEQ ID NO: 1262542 - protein, 9 aa, Homo Sapiens
GLIEAPEHD

SEQ ID NO: 1262543 - protein, 9 aa, Homo Sapiens
DRDLYDAGV

SEQ ID NO: 1262544 - protein, 9 aa, Homo Sapiens
GSKHSLHRK

SEQ ID NO: 1262545 - protein, 9 aa, Homo Sapiens
MLEAVRHVG

SEQ ID NO: 1262546 - protein, 9 aa, Homo Sapiens
EPNKKGWLP

SEQ ID NO: 1262547 - protein, 9 aa, Homo Sapiens
SGRAAELLV

SEQ ID NO: 1262548 - protein, 9 aa, Homo Sapiens
LCALRELWQ

SEQ ID NO: 1262549 - protein, 9 aa, Homo Sapiens
GLPTGFDDM

SEQ ID NO: 1262550 - protein, 9 aa, Homo Sapiens
TGIGGPYMF

SEQ ID NO: 1262551 - protein, 9 aa, Homo Sapiens
LELQADISL

SEQ ID NO: 1262552 - protein, 9 aa, Homo Sapiens
VSLTSFLFP

SEQ ID NO: 1262553 - protein, 9 aa, Homo Sapiens
EIINYLYET

SEQ ID NO: 1262554 - protein, 9 aa, Homo Sapiens
STWTMLLSA

SEQ ID NO: 1262555 - protein, 9 aa, Homo Sapiens
HLGEALVPL

SEQ ID NO: 1262556 - protein, 9 aa, Homo Sapiens
EQRSAQVDV

SEQ ID NO: 1262557 - protein, 9 aa, Homo Sapiens
MGYVEAKSW

SEQ ID NO: 1262558 - protein, 9 aa, Homo Sapiens
VFCPLKADS

SEQ ID NO: 1262559 - protein, 9 aa, Homo Sapiens
VCADMKANS

SEQ ID NO: 1262560 - protein, 9 aa, Homo Sapiens
RFPQHVKNQ

SEQ ID NO: 1262561 - protein, 9 aa, Homo Sapiens
LDHCRHVSL

SEQ ID NO: 1262562 - protein, 9 aa, Homo Sapiens
MNFLHHPDL

SEQ ID NO: 1262563 - protein, 9 aa, Homo Sapiens
NFKLTMVKC

SEQ ID NO: 1262564 - protein, 9 aa, Homo Sapiens
DYLLSKLSS

SEQ ID NO: 1262565 - protein, 9 aa, Homo Sapiens
LHYPPSYKA

SEQ ID NO: 1262566 - protein, 9 aa, Homo Sapiens
GVHISDTCS

SEQ ID NO: 1262567 - protein, 9 aa, Homo Sapiens
QRMNKEYSI

SEQ ID NO: 1262568 - protein, 9 aa, Homo Sapiens
LVKQKEEWR

SEQ ID NO: 1262569 - protein, 9 aa, Homo Sapiens
TVGHFSQAR

SEQ ID NO: 1262570 - protein, 9 aa, Homo Sapiens
VKPENVLIG

SEQ ID NO: 1262571 - protein, 9 aa, Homo Sapiens
KAEGVNIRD

SEQ ID NO: 1262572 - protein, 9 aa, Homo Sapiens
NTVCHSKIR

SEQ ID NO: 1262573 - protein, 9 aa, Homo Sapiens
VWEKATGRY

SEQ ID NO: 1262574 - protein, 9 aa, Homo Sapiens
LQEWYKKCL

SEQ ID NO: 1262575 - protein, 9 aa, Homo Sapiens
QREVGKSEL

SEQ ID NO: 1262576 - protein, 9 aa, Homo Sapiens
LTQRYRKSW

SEQ ID NO: 1262577 - protein, 9 aa, Homo Sapiens
SQVNPEGPI

SEQ ID NO: 1262578 - protein, 9 aa, Homo Sapiens
AISLQWNRI

SEQ ID NO: 1262579 - protein, 9 aa, Homo Sapiens
ERRSTAATS

SEQ ID NO: 1262580 - protein, 9 aa, Homo Sapiens
LTQTVAMSP

SEQ ID NO: 1262581 - protein, 9 aa, Homo Sapiens
FLTPKRKLN

SEQ ID NO: 1262582 - protein, 9 aa, Homo Sapiens
QKCIEVRVV

SEQ ID NO: 1262583 - protein, 9 aa, Homo Sapiens
SSCTGPSCA

SEQ ID NO: 1262584 - protein, 9 aa, Homo Sapiens
TDKNSLLDM

SEQ ID NO: 1262585 - protein, 9 aa, Homo Sapiens
AYTLTYTGT

SEQ ID NO: 1262586 - protein, 9 aa, Homo Sapiens
EEWERCPQE

SEQ ID NO: 1262587 - protein, 9 aa, Homo Sapiens
AKLTKIENL

SEQ ID NO: 1262588 - protein, 9 aa, Homo Sapiens
MDAAGKTTI

SEQ ID NO: 1262589 - protein, 9 aa, Homo Sapiens
QINTEVMEV

SEQ ID NO: 1262590 - protein, 9 aa, Homo Sapiens
RLSTGRASP

SEQ ID NO: 1262591 - protein, 9 aa, Homo Sapiens
DIPASHSDV

SEQ ID NO: 1262592 - protein, 9 aa, Homo Sapiens
MFGTSHGAL

SEQ ID NO: 1262593 - protein, 9 aa, Homo Sapiens
LRDRDYDRK

SEQ ID NO: 1262594 - protein, 9 aa, Homo Sapiens
THRLHERKQ

SEQ ID NO: 1262595 - protein, 9 aa, Homo Sapiens
NEPYRLVEG

SEQ ID NO: 1262596 - protein, 9 aa, Homo Sapiens
NNFGYIVTF

SEQ ID NO: 1262597 - protein, 9 aa, Homo Sapiens
NIFTKRDIA

SEQ ID NO: 1262598 - protein, 9 aa, Homo Sapiens
RNGSFHIRR

SEQ ID NO: 1262599 - protein, 9 aa, Homo Sapiens
HITCIYDPL

SEQ ID NO: 1262600 - protein, 9 aa, Homo Sapiens
MDQASRTMI

SEQ ID NO: 1262601 - protein, 9 aa, Homo Sapiens
FNPEAHVFM

SEQ ID NO: 1262602 - protein, 9 aa, Homo Sapiens
DELEAVCKY

SEQ ID NO: 1262603 - protein, 9 aa, Homo Sapiens
LKVRKKMKL

SEQ ID NO: 1262604 - protein, 9 aa, Homo Sapiens
HLLADLMQN

SEQ ID NO: 1262605 - protein, 9 aa, Homo Sapiens
IHASKDANQ

SEQ ID NO: 1262606 - protein, 9 aa, Homo Sapiens
DHGHRFTMG

SEQ ID NO: 1262607 - protein, 9 aa, Homo Sapiens
EEPRTTVDS

SEQ ID NO: 1262608 - protein, 9 aa, Homo Sapiens
EECCMLPYY

SEQ ID NO: 1262609 - protein, 9 aa, Homo Sapiens
RDTPDYLKA

SEQ ID NO: 1262610 - protein, 9 aa, Homo Sapiens
RESADQEDH

SEQ ID NO: 1262611 - protein, 9 aa, Homo Sapiens
ASRLLADDA

SEQ ID NO: 1262612 - protein, 9 aa, Homo Sapiens
FWQQERSFL

SEQ ID NO: 1262613 - protein, 9 aa, Homo Sapiens
KLFICNECG

SEQ ID NO: 1262614 - protein, 9 aa, Homo Sapiens
VLQGEPVPL

SEQ ID NO: 1262615 - protein, 9 aa, Homo Sapiens
KGREEILRI

SEQ ID NO: 1262616 - protein, 9 aa, Homo Sapiens
DILTKLKDV

SEQ ID NO: 1262617 - protein, 9 aa, Homo Sapiens
FMTLLYFVA

SEQ ID NO: 1262618 - protein, 9 aa, Homo Sapiens
GLLDRQWTL

SEQ ID NO: 1262619 - protein, 9 aa, Homo Sapiens
LKQVMAKHP

SEQ ID NO: 1262620 - protein, 9 aa, Homo Sapiens
VLFSLPNTI

SEQ ID NO: 1262621 - protein, 9 aa, Homo Sapiens
ASPGSDSDI

SEQ ID NO: 1262622 - protein, 9 aa, Homo Sapiens
LCALSITDI

SEQ ID NO: 1262623 - protein, 9 aa, Homo Sapiens
ALPHLFHTS

SEQ ID NO: 1262624 - protein, 9 aa, Homo Sapiens
RLRDAREQW

SEQ ID NO: 1262625 - protein, 9 aa, Homo Sapiens
PDADSMYVE

SEQ ID NO: 1262626 - protein, 9 aa, Homo Sapiens
EPPMNKHLS

SEQ ID NO: 1262627 - protein, 9 aa, Homo Sapiens
EKLQLVEWL

SEQ ID NO: 1262628 - protein, 9 aa, Homo Sapiens
KKYILNEEM

SEQ ID NO: 1262629 - protein, 9 aa, Homo Sapiens
SANAHLVAS

SEQ ID NO: 1262630 - protein, 9 aa, Homo Sapiens
GRRAPLQLP

SEQ ID NO: 1262631 - protein, 9 aa, Homo Sapiens
LEKGPSPIP

SEQ ID NO: 1262632 - protein, 9 aa, Homo Sapiens
RILEDQDEN

SEQ ID NO: 1262633 - protein, 9 aa, Homo Sapiens
RIQVRSIQQ

SEQ ID NO: 1262634 - protein, 9 aa, Homo Sapiens
GTNMTLPAT

SEQ ID NO: 1262635 - protein, 9 aa, Homo Sapiens
MERVGLEVS

SEQ ID NO: 1262636 - protein, 9 aa, Homo Sapiens
PEIFQESSQ

SEQ ID NO: 1262637 - protein, 9 aa, Homo Sapiens
GTAWGRLFG

SEQ ID NO: 1262638 - protein, 9 aa, Homo Sapiens
GFKKISSLD

SEQ ID NO: 1262639 - protein, 9 aa, Homo Sapiens
AEMHDDAKK

SEQ ID NO: 1262640 - protein, 9 aa, Homo Sapiens
TVCQGHWQI

SEQ ID NO: 1262641 - protein, 9 aa, Homo Sapiens
RLAHLYDML

SEQ ID NO: 1262642 - protein, 9 aa, Homo Sapiens
RQPSVDGDD

SEQ ID NO: 1262643 - protein, 9 aa, Homo Sapiens
LPVFAYTHI

SEQ ID NO: 1262644 - protein, 9 aa, Homo Sapiens
AGSVPLSQG

SEQ ID NO: 1262645 - protein, 9 aa, Homo Sapiens
GDIRNFEVV

SEQ ID NO: 1262646 - protein, 9 aa, Homo Sapiens
YEPENPEVK

SEQ ID NO: 1262647 - protein, 9 aa, Homo Sapiens
FCHFWRDGR

SEQ ID NO: 1262648 - protein, 9 aa, Homo Sapiens
LVTFSDEHR

SEQ ID NO: 1262649 - protein, 9 aa, Homo Sapiens
KAFSQSSPL

SEQ ID NO: 1262650 - protein, 9 aa, Homo Sapiens
KEREHREKE

SEQ ID NO: 1262651 - protein, 9 aa, Homo Sapiens
TTASCLTNC

SEQ ID NO: 1262652 - protein, 9 aa, Homo Sapiens
APAGAWSFQ

SEQ ID NO: 1262653 - protein, 9 aa, Homo Sapiens
QEAASIQEA

SEQ ID NO: 1262654 - protein, 9 aa, Homo Sapiens
KIEVNNATT

SEQ ID NO: 1262655 - protein, 9 aa, Homo Sapiens
SALSTNKIA

SEQ ID NO: 1262656 - protein, 9 aa, Homo Sapiens
TMALLDQNP

SEQ ID NO: 1262657 - protein, 9 aa, Homo Sapiens
SEEEMSDGS

SEQ ID NO: 1262658 - protein, 9 aa, Homo Sapiens
ESLVAAAQR

SEQ ID NO: 1262659 - protein, 9 aa, Homo Sapiens
LLIFFSKDQ

SEQ ID NO: 1262660 - protein, 9 aa, Homo Sapiens
PDRGCLGFQ

SEQ ID NO: 1262661 - protein, 9 aa, Homo Sapiens
QRTDPPLVR

SEQ ID NO: 1262662 - protein, 9 aa, Homo Sapiens
ELSTQTINF

SEQ ID NO: 1262663 - protein, 9 aa, Homo Sapiens
AFQELLCLC

SEQ ID NO: 1262664 - protein, 9 aa, Homo Sapiens
VKGKHRKPR

SEQ ID NO: 1262665 - protein, 9 aa, Homo Sapiens
KPGKGIGLS

SEQ ID NO: 1262666 - protein, 9 aa, Homo Sapiens
VDALKGLVD

SEQ ID NO: 1262667 - protein, 9 aa, Homo Sapiens
HFQGLSHRG

SEQ ID NO: 1262668 - protein, 9 aa, Homo Sapiens
VRCSVMVEA

SEQ ID NO: 1262669 - protein, 9 aa, Homo Sapiens
KIGGVSLTS

SEQ ID NO: 1262670 - protein, 9 aa, Homo Sapiens
EKIRLQNNQ

SEQ ID NO: 1262671 - protein, 9 aa, Homo Sapiens
ITIVMPLLT

SEQ ID NO: 1262672 - protein, 9 aa, Homo Sapiens
HLRFSATYS

SEQ ID NO: 1262673 - protein, 9 aa, Homo Sapiens
CYDVYEISY

SEQ ID NO: 1262674 - protein, 9 aa, Homo Sapiens
DCGHAFSQR

SEQ ID NO: 1262675 - protein, 9 aa, Homo Sapiens
GAEHICQAI

SEQ ID NO: 1262676 - protein, 9 aa, Homo Sapiens
PEEEHTGML

SEQ ID NO: 1262677 - protein, 9 aa, Homo Sapiens
IRADIDKNT

SEQ ID NO: 1262678 - protein, 9 aa, Homo Sapiens
SWVQDESPE

SEQ ID NO: 1262679 - protein, 9 aa, Homo Sapiens
SASVAVTTP

SEQ ID NO: 1262680 - protein, 9 aa, Homo Sapiens
EHWTLKAIL

SEQ ID NO: 1262681 - protein, 9 aa, Homo Sapiens
VDAHSGRCA

SEQ ID NO: 1262682 - protein, 9 aa, Homo Sapiens
LASPGATLT

SEQ ID NO: 1262683 - protein, 9 aa, Homo Sapiens
EEAIKPCHP

SEQ ID NO: 1262684 - protein, 9 aa, Homo Sapiens
PYGTRYVGS

SEQ ID NO: 1262685 - protein, 9 aa, Homo Sapiens
MGGAKQIER

SEQ ID NO: 1262686 - protein, 9 aa, Homo Sapiens
RFATSAPPQ

SEQ ID NO: 1262687 - protein, 9 aa, Homo Sapiens
IFDRIGKYE

SEQ ID NO: 1262688 - protein, 9 aa, Homo Sapiens
KRFRKSEGI

SEQ ID NO: 1262689 - protein, 9 aa, Homo Sapiens
YSGAVNLST

SEQ ID NO: 1262690 - protein, 9 aa, Homo Sapiens
VHHTDHPRA

SEQ ID NO: 1262691 - protein, 9 aa, Homo Sapiens
TSDRIKQEN

SEQ ID NO: 1262692 - protein, 9 aa, Homo Sapiens
NSKTVGQCM

SEQ ID NO: 1262693 - protein, 9 aa, Homo Sapiens
WRRHREADV

SEQ ID NO: 1262694 - protein, 9 aa, Homo Sapiens
AMARVQRAV

SEQ ID NO: 1262695 - protein, 9 aa, Homo Sapiens
NLSSHVVDR

SEQ ID NO: 1262696 - protein, 9 aa, Homo Sapiens
TGNRIGGKM

SEQ ID NO: 1262697 - protein, 9 aa, Homo Sapiens
VVRKPLEAV

SEQ ID NO: 1262698 - protein, 9 aa, Homo Sapiens
RKISRTQAE

SEQ ID NO: 1262699 - protein, 9 aa, Homo Sapiens
DPAPGKVGT

SEQ ID NO: 1262700 - protein, 9 aa, Homo Sapiens
PYLRNRSAH

SEQ ID NO: 1262701 - protein, 9 aa, Homo Sapiens
LEKNVPLRV

SEQ ID NO: 1262702 - protein, 9 aa, Homo Sapiens
EDHAVLLGC

SEQ ID NO: 1262703 - protein, 9 aa, Homo Sapiens
VVSGLRSVH

SEQ ID NO: 1262704 - protein, 9 aa, Homo Sapiens
VNTMGSYIC

SEQ ID NO: 1262705 - protein, 9 aa, Homo Sapiens
ALKNKRRRM

SEQ ID NO: 1262706 - protein, 9 aa, Homo Sapiens
RPGSGRAGW

SEQ ID NO: 1262707 - protein, 9 aa, Homo Sapiens
DFTQIDIEM

SEQ ID NO: 1262708 - protein, 9 aa, Homo Sapiens
YFTVDIVHV

SEQ ID NO: 1262709 - protein, 9 aa, Homo Sapiens
HISCPQEMA

SEQ ID NO: 1262710 - protein, 9 aa, Homo Sapiens
RPGQHTLTM

SEQ ID NO: 1262711 - protein, 9 aa, Homo Sapiens
PNHHHPYGP

SEQ ID NO: 1262712 - protein, 9 aa, Homo Sapiens
ALSYFTRKE

SEQ ID NO: 1262713 - protein, 9 aa, Homo Sapiens
DGFLAALQA

SEQ ID NO: 1262714 - protein, 9 aa, Homo Sapiens
EVLQDLEEL

SEQ ID NO: 1262715 - protein, 9 aa, Homo Sapiens
PVCSSDGLM

SEQ ID NO: 1262716 - protein, 9 aa, Homo Sapiens
QAQEHFGKY

SEQ ID NO: 1262717 - protein, 9 aa, Homo Sapiens
VQLDPAEMR

SEQ ID NO: 1262718 - protein, 9 aa, Homo Sapiens
PVSNINSPT

SEQ ID NO: 1262719 - protein, 9 aa, Homo Sapiens
ILIELLDTQ

SEQ ID NO: 1262720 - protein, 9 aa, Homo Sapiens
KTQEALNSD

SEQ ID NO: 1262721 - protein, 9 aa, Homo Sapiens
MYVCIANNA

SEQ ID NO: 1262722 - protein, 9 aa, Homo Sapiens
PSCERRVNH

SEQ ID NO: 1262723 - protein, 9 aa, Homo Sapiens
VAQVQRLEA

SEQ ID NO: 1262724 - protein, 9 aa, Homo Sapiens
RSMRKGIMA

SEQ ID NO: 1262725 - protein, 9 aa, Homo Sapiens
DLSELEGMG

SEQ ID NO: 1262726 - protein, 9 aa, Homo Sapiens
YASNKLPCN

SEQ ID NO: 1262727 - protein, 9 aa, Homo Sapiens
VSNINSPTK

SEQ ID NO: 1262728 - protein, 9 aa, Homo Sapiens
SFLGGGIDT

SEQ ID NO: 1262729 - protein, 9 aa, Homo Sapiens
ETRAAGKCP

SEQ ID NO: 1262730 - protein, 9 aa, Homo Sapiens
EDEYQRVRE

SEQ ID NO: 1262731 - protein, 9 aa, Homo Sapiens
VLCADTCQC

SEQ ID NO: 1262732 - protein, 9 aa, Homo Sapiens
HRRRGLSHG

SEQ ID NO: 1262733 - protein, 9 aa, Homo Sapiens
ALKEQLSEL

SEQ ID NO: 1262734 - protein, 9 aa, Homo Sapiens
VHDLEIEGR

SEQ ID NO: 1262735 - protein, 9 aa, Homo Sapiens
SFDGVQESE

SEQ ID NO: 1262736 - protein, 9 aa, Homo Sapiens
GDCSARQAE

SEQ ID NO: 1262737 - protein, 9 aa, Homo Sapiens
PLFTPVPAM

SEQ ID NO: 1262738 - protein, 9 aa, Homo Sapiens
TDFFRKWDD

SEQ ID NO: 1262739 - protein, 9 aa, Homo Sapiens
EEEEEDSCM

SEQ ID NO: 1262740 - protein, 9 aa, Homo Sapiens
LDGRIRLRR

SEQ ID NO: 1262741 - protein, 9 aa, Homo Sapiens
EPISLSSFP

SEQ ID NO: 1262742 - protein, 9 aa, Homo Sapiens
ITGKGASGA

SEQ ID NO: 1262743 - protein, 9 aa, Homo Sapiens
VMLSTYFET

SEQ ID NO: 1262744 - protein, 9 aa, Homo Sapiens
FTPLKVGGI

SEQ ID NO: 1262745 - protein, 9 aa, Homo Sapiens
KCKMSLLFD

SEQ ID NO: 1262746 - protein, 9 aa, Homo Sapiens
RACEVIEAL

SEQ ID NO: 1262747 - protein, 9 aa, Homo Sapiens
KPQVKLCRA

SEQ ID NO: 1262748 - protein, 9 aa, Homo Sapiens
CQDIPASHS

SEQ ID NO: 1262749 - protein, 9 aa, Homo Sapiens
SWRERVDRL

SEQ ID NO: 1262750 - protein, 9 aa, Homo Sapiens
QVWEWKEQG

SEQ ID NO: 1262751 - protein, 9 aa, Homo Sapiens
SSLIHHYQI

SEQ ID NO: 1262752 - protein, 9 aa, Homo Sapiens
SASNQQFAG

SEQ ID NO: 1262753 - protein, 9 aa, Homo Sapiens
KIHTRKHYE

SEQ ID NO: 1262754 - protein, 9 aa, Homo Sapiens
SHLALADVV

SEQ ID NO: 1262755 - protein, 9 aa, Homo Sapiens
GPPASQGIG

SEQ ID NO: 1262756 - protein, 9 aa, Homo Sapiens
ILEDQDENP

SEQ ID NO: 1262757 - protein, 9 aa, Homo Sapiens
ALFIGWAGS

SEQ ID NO: 1262758 - protein, 9 aa, Homo Sapiens
QINQVALEV

SEQ ID NO: 1262759 - protein, 9 aa, Homo Sapiens
DGNSNTALH

SEQ ID NO: 1262760 - protein, 9 aa, Homo Sapiens
THGLSHLRC

SEQ ID NO: 1262761 - protein, 9 aa, Homo Sapiens
SGYISLLLH

SEQ ID NO: 1262762 - protein, 9 aa, Homo Sapiens
YHVNFSHAI

SEQ ID NO: 1262763 - protein, 9 aa, Homo Sapiens
EIREDEEHP

SEQ ID NO: 1262764 - protein, 9 aa, Homo Sapiens
HLVTQQPMK

SEQ ID NO: 1262765 - protein, 9 aa, Homo Sapiens
RGHRGAHRS

SEQ ID NO: 1262766 - protein, 9 aa, Homo Sapiens
TKEAITNYV

SEQ ID NO: 1262767 - protein, 9 aa, Homo Sapiens
HMRERHFHP

SEQ ID NO: 1262768 - protein, 9 aa, Homo Sapiens
SGNIVPRHV

SEQ ID NO: 1262769 - protein, 9 aa, Homo Sapiens
AMLYVVHCN

SEQ ID NO: 1262770 - protein, 9 aa, Homo Sapiens
QYENISILD

SEQ ID NO: 1262771 - protein, 9 aa, Homo Sapiens
SPGQLKAAM

SEQ ID NO: 1262772 - protein, 9 aa, Homo Sapiens
YGDRTSTIC

SEQ ID NO: 1262773 - protein, 9 aa, Homo Sapiens
DDTFSHLQN

SEQ ID NO: 1262774 - protein, 9 aa, Homo Sapiens
AMRVLEYLF

SEQ ID NO: 1262775 - protein, 9 aa, Homo Sapiens
EDDSGEAMG

SEQ ID NO: 1262776 - protein, 9 aa, Homo Sapiens
ALYDGKDDT

SEQ ID NO: 1262777 - protein, 9 aa, Homo Sapiens
VIDVFHKYT

SEQ ID NO: 1262778 - protein, 9 aa, Homo Sapiens
GGGRGGPDR

SEQ ID NO: 1262779 - protein, 9 aa, Homo Sapiens
EGKNELQVS

SEQ ID NO: 1262780 - protein, 9 aa, Homo Sapiens
YASLKKDQK

SEQ ID NO: 1262781 - protein, 9 aa, Homo Sapiens
QSECREKNV

SEQ ID NO: 1262782 - protein, 9 aa, Homo Sapiens
CKQESSESH

SEQ ID NO: 1262783 - protein, 9 aa, Homo Sapiens
LTMSYHSDS

SEQ ID NO: 1262784 - protein, 9 aa, Homo Sapiens
GHLEGEVIP

SEQ ID NO: 1262785 - protein, 9 aa, Homo Sapiens
ENILPQQKL

SEQ ID NO: 1262786 - protein, 9 aa, Homo Sapiens
REHPHLAAK

SEQ ID NO: 1262787 - protein, 9 aa, Homo Sapiens
FRTGKPTDS

SEQ ID NO: 1262788 - protein, 9 aa, Homo Sapiens
CFHHCNPGI

SEQ ID NO: 1262789 - protein, 9 aa, Homo Sapiens
EGVPQVNGE

SEQ ID NO: 1262790 - protein, 9 aa, Homo Sapiens
VSLSALRVS

SEQ ID NO: 1262791 - protein, 9 aa, Homo Sapiens
WQKEAFPGR

SEQ ID NO: 1262792 - protein, 9 aa, Homo Sapiens
TVHAGKVAE

SEQ ID NO: 1262793 - protein, 9 aa, Homo Sapiens
KEIYNQVIV

SEQ ID NO: 1262794 - protein, 9 aa, Homo Sapiens
LAAERERNQ

SEQ ID NO: 1262795 - protein, 9 aa, Homo Sapiens
REMKIWLSV

SEQ ID NO: 1262796 - protein, 9 aa, Homo Sapiens
DLEKELGSK

SEQ ID NO: 1262797 - protein, 9 aa, Homo Sapiens
FLIQKIFYM

SEQ ID NO: 1262798 - protein, 9 aa, Homo Sapiens
SLVEGEDVH

SEQ ID NO: 1262799 - protein, 9 aa, Homo Sapiens
LQGEHSGQP

SEQ ID NO: 1262800 - protein, 9 aa, Homo Sapiens
CTWNPFRSK

SEQ ID NO: 1262801 - protein, 9 aa, Homo Sapiens
TRECLGTHT

SEQ ID NO: 1262802 - protein, 9 aa, Homo Sapiens
LPYTSCLYI

SEQ ID NO: 1262803 - protein, 9 aa, Homo Sapiens
QVLIKHEIQ

SEQ ID NO: 1262804 - protein, 9 aa, Homo Sapiens
SSVSSFMYS

SEQ ID NO: 1262805 - protein, 9 aa, Homo Sapiens
HLQSSVVIS

SEQ ID NO: 1262806 - protein, 9 aa, Homo Sapiens
EDLGGCWQR

SEQ ID NO: 1262807 - protein, 9 aa, Homo Sapiens
RVILYHEPR

SEQ ID NO: 1262808 - protein, 9 aa, Homo Sapiens
ATIARKSVL

SEQ ID NO: 1262809 - protein, 9 aa, Homo Sapiens
EAPPRLQVL

SEQ ID NO: 1262810 - protein, 9 aa, Homo Sapiens
NNIRGMMRE

SEQ ID NO: 1262811 - protein, 9 aa, Homo Sapiens
AFFLKVTTL

SEQ ID NO: 1262812 - protein, 9 aa, Homo Sapiens
VKSHTNISH

SEQ ID NO: 1262813 - protein, 9 aa, Homo Sapiens
TRNHTQGDL

SEQ ID NO: 1262814 - protein, 9 aa, Homo Sapiens
FRKSEGIFD

SEQ ID NO: 1262815 - protein, 9 aa, Homo Sapiens
ILMIRRLRG

SEQ ID NO: 1262816 - protein, 9 aa, Homo Sapiens
VKENYVIFN

SEQ ID NO: 1262817 - protein, 9 aa, Homo Sapiens
AENEEEDAV

SEQ ID NO: 1262818 - protein, 9 aa, Homo Sapiens
MMKLLNQKK

SEQ ID NO: 1262819 - protein, 9 aa, Homo Sapiens
KSFDTGPQG

SEQ ID NO: 1262820 - protein, 9 aa, Homo Sapiens
EKRYVQPQA

SEQ ID NO: 1262821 - protein, 9 aa, Homo Sapiens
GELYFWVKE

SEQ ID NO: 1262822 - protein, 9 aa, Homo Sapiens
GQALFTLHS

SEQ ID NO: 1262823 - protein, 9 aa, Homo Sapiens
DSSFSFMVF

SEQ ID NO: 1262824 - protein, 9 aa, Homo Sapiens
SCRYDRPQD

SEQ ID NO: 1262825 - protein, 9 aa, Homo Sapiens
KPVAIAPIP

SEQ ID NO: 1262826 - protein, 9 aa, Homo Sapiens
LCMCWKQMM

SEQ ID NO: 1262827 - protein, 9 aa, Homo Sapiens
MRSKGVRVP

SEQ ID NO: 1262828 - protein, 9 aa, Homo Sapiens
VRRHLKVIQ

SEQ ID NO: 1262829 - protein, 9 aa, Homo Sapiens
VAAVKFHVL

SEQ ID NO: 1262830 - protein, 9 aa, Homo Sapiens
GYLGYQALS

SEQ ID NO: 1262831 - protein, 9 aa, Homo Sapiens
RMEKNILTC

SEQ ID NO: 1262832 - protein, 9 aa, Homo Sapiens
YNVSYQADL

SEQ ID NO: 1262833 - protein, 9 aa, Homo Sapiens
ALELVWQHR

SEQ ID NO: 1262834 - protein, 9 aa, Homo Sapiens
GKDLTKRSI

SEQ ID NO: 1262835 - protein, 9 aa, Homo Sapiens
PEERRALRH

SEQ ID NO: 1262836 - protein, 9 aa, Homo Sapiens
ESGHFPSMQ

SEQ ID NO: 1262837 - protein, 9 aa, Homo Sapiens
ESADSGLSM

SEQ ID NO: 1262838 - protein, 9 aa, Homo Sapiens
HALSDDGVS

SEQ ID NO: 1262839 - protein, 9 aa, Homo Sapiens
DGVADVLAR

SEQ ID NO: 1262840 - protein, 9 aa, Homo Sapiens
GPPPNMISN

SEQ ID NO: 1262841 - protein, 9 aa, Homo Sapiens
RKEFGCPDG

SEQ ID NO: 1262842 - protein, 9 aa, Homo Sapiens
THLKFLDKA

SEQ ID NO: 1262843 - protein, 9 aa, Homo Sapiens
DTAKQTEDN

SEQ ID NO: 1262844 - protein, 9 aa, Homo Sapiens
IHRDIIHCG

SEQ ID NO: 1262845 - protein, 9 aa, Homo Sapiens
FLSLQCTGS

SEQ ID NO: 1262846 - protein, 9 aa, Homo Sapiens
KISLIKSHN

SEQ ID NO: 1262847 - protein, 9 aa, Homo Sapiens
AEKQRSDIS

SEQ ID NO: 1262848 - protein, 9 aa, Homo Sapiens
QFLKKKWYL

SEQ ID NO: 1262849 - protein, 9 aa, Homo Sapiens
TVLGESASP

SEQ ID NO: 1262850 - protein, 9 aa, Homo Sapiens
MTPCRRRAG

SEQ ID NO: 1262851 - protein, 9 aa, Homo Sapiens
DWPKDLVKC

SEQ ID NO: 1262852 - protein, 9 aa, Homo Sapiens
HLIHNYNLI

SEQ ID NO: 1262853 - protein, 9 aa, Homo Sapiens
PPRQSCGGG

SEQ ID NO: 1262854 - protein, 9 aa, Homo Sapiens
NPIVVGGTN

SEQ ID NO: 1262855 - protein, 9 aa, Homo Sapiens
VSVNPEPLH

SEQ ID NO: 1262856 - protein, 9 aa, Homo Sapiens
WKQNSHKLL

SEQ ID NO: 1262857 - protein, 9 aa, Homo Sapiens
APDQGNGKI

SEQ ID NO: 1262858 - protein, 9 aa, Homo Sapiens
RKGDLLRRT

SEQ ID NO: 1262859 - protein, 9 aa, Homo Sapiens
DFHASDCGE

SEQ ID NO: 1262860 - protein, 9 aa, Homo Sapiens
SMEDDTNFF

SEQ ID NO: 1262861 - protein, 9 aa, Homo Sapiens
EAASIQEAA

SEQ ID NO: 1262862 - protein, 9 aa, Homo Sapiens
LPPDFHPHP

SEQ ID NO: 1262863 - protein, 9 aa, Homo Sapiens
YENNYHEVS

SEQ ID NO: 1262864 - protein, 9 aa, Homo Sapiens
LSRQNNYTI

SEQ ID NO: 1262865 - protein, 9 aa, Homo Sapiens
VGEFLWQVS

SEQ ID NO: 1262866 - protein, 9 aa, Homo Sapiens
QCYRPLEPT

SEQ ID NO: 1262867 - protein, 9 aa, Homo Sapiens
GVTSIIFCV

SEQ ID NO: 1262868 - protein, 9 aa, Homo Sapiens
LYNNNTMQQ

SEQ ID NO: 1262869 - protein, 9 aa, Homo Sapiens
GLLSILVLA

SEQ ID NO: 1262870 - protein, 9 aa, Homo Sapiens
PAPAFWNRA

SEQ ID NO: 1262871 - protein, 9 aa, Homo Sapiens
AITNYVKEF

SEQ ID NO: 1262872 - protein, 9 aa, Homo Sapiens
LSSSVISQR

SEQ ID NO: 1262873 - protein, 9 aa, Homo Sapiens
PSSHFVPKH

SEQ ID NO: 1262874 - protein, 9 aa, Homo Sapiens
KGTIQLCDM

SEQ ID NO: 1262875 - protein, 9 aa, Homo Sapiens
QVPNDEEKM

SEQ ID NO: 1262876 - protein, 9 aa, Homo Sapiens
GGPRGGMRS

SEQ ID NO: 1262877 - protein, 9 aa, Homo Sapiens
PEYGAARPV

SEQ ID NO: 1262878 - protein, 9 aa, Homo Sapiens
NTYCFRVLS

SEQ ID NO: 1262879 - protein, 9 aa, Homo Sapiens
CHQCPSGSR

SEQ ID NO: 1262880 - protein, 9 aa, Homo Sapiens
DQLPDCSES

SEQ ID NO: 1262881 - protein, 9 aa, Homo Sapiens
QRDYANGFG

SEQ ID NO: 1262882 - protein, 9 aa, Homo Sapiens
NDLKKGLQR

SEQ ID NO: 1262883 - protein, 9 aa, Homo Sapiens
GHDAKVPFK

SEQ ID NO: 1262884 - protein, 9 aa, Homo Sapiens
GRRFYWTGR

SEQ ID NO: 1262885 - protein, 9 aa, Homo Sapiens
YHKHCAFSI

SEQ ID NO: 1262886 - protein, 9 aa, Homo Sapiens
TQQISKSQV

SEQ ID NO: 1262887 - protein, 9 aa, Homo Sapiens
LLESIRQDG

SEQ ID NO: 1262888 - protein, 9 aa, Homo Sapiens
EPLLSFLQQ

SEQ ID NO: 1262889 - protein, 9 aa, Homo Sapiens
LLLCLPDED

SEQ ID NO: 1262890 - protein, 9 aa, Homo Sapiens
RPAHASRPL

SEQ ID NO: 1262891 - protein, 9 aa, Homo Sapiens
YRLMAHYLK

SEQ ID NO: 1262892 - protein, 9 aa, Homo Sapiens
PHMAIQQHS

SEQ ID NO: 1262893 - protein, 9 aa, Homo Sapiens
PSRAHCPAN

SEQ ID NO: 1262894 - protein, 9 aa, Homo Sapiens
LSCRRWKRL

SEQ ID NO: 1262895 - protein, 9 aa, Homo Sapiens
IWDPMSVWT

SEQ ID NO: 1262896 - protein, 9 aa, Homo Sapiens
HHRRPQPAT

SEQ ID NO: 1262897 - protein, 9 aa, Homo Sapiens
TMDSLEDTK

SEQ ID NO: 1262898 - protein, 9 aa, Homo Sapiens
TPLCGPCIT

SEQ ID NO: 1262899 - protein, 9 aa, Homo Sapiens
GSPTFAALT

SEQ ID NO: 1262900 - protein, 9 aa, Homo Sapiens
ITLSFQGRP

SEQ ID NO: 1262901 - protein, 9 aa, Homo Sapiens
IGLERADTA

SEQ ID NO: 1262902 - protein, 9 aa, Homo Sapiens
DNSPFVLYL

SEQ ID NO: 1262903 - protein, 9 aa, Homo Sapiens
ERGETFRPN

SEQ ID NO: 1262904 - protein, 9 aa, Homo Sapiens
TVPGHLEHL

SEQ ID NO: 1262905 - protein, 9 aa, Homo Sapiens
TKPLLYSQL

SEQ ID NO: 1262906 - protein, 9 aa, Homo Sapiens
TKGNGDCAL

SEQ ID NO: 1262907 - protein, 9 aa, Homo Sapiens
NMISNRRLQ

SEQ ID NO: 1262908 - protein, 9 aa, Homo Sapiens
NYVIFNNTS

SEQ ID NO: 1262909 - protein, 9 aa, Homo Sapiens
FLELNVEKT

SEQ ID NO: 1262910 - protein, 9 aa, Homo Sapiens
DVRFERAEQ

SEQ ID NO: 1262911 - protein, 9 aa, Homo Sapiens
AALDGFLAA

SEQ ID NO: 1262912 - protein, 9 aa, Homo Sapiens
PPVPQCLPS

SEQ ID NO: 1262913 - protein, 9 aa, Homo Sapiens
WENYNTGIL

SEQ ID NO: 1262914 - protein, 9 aa, Homo Sapiens
SQKRSGECQ

SEQ ID NO: 1262915 - protein, 9 aa, Homo Sapiens
NVSSSIQAQ

SEQ ID NO: 1262916 - protein, 9 aa, Homo Sapiens
SCRRWKRLV

SEQ ID NO: 1262917 - protein, 9 aa, Homo Sapiens
CTKLKVLMM

SEQ ID NO: 1262918 - protein, 9 aa, Homo Sapiens
TAPIMNGQG

SEQ ID NO: 1262919 - protein, 9 aa, Homo Sapiens
VRYNFMNNG

SEQ ID NO: 1262920 - protein, 9 aa, Homo Sapiens
HYDEPLGKN

SEQ ID NO: 1262921 - protein, 9 aa, Homo Sapiens
RQWEEQQQR

SEQ ID NO: 1262922 - protein, 9 aa, Homo Sapiens
LERRKISRT

SEQ ID NO: 1262923 - protein, 9 aa, Homo Sapiens
DRNDRVIRV

SEQ ID NO: 1262924 - protein, 9 aa, Homo Sapiens
MSGRIVGTK

SEQ ID NO: 1262925 - protein, 9 aa, Homo Sapiens
KESNILEIS

SEQ ID NO: 1262926 - protein, 9 aa, Homo Sapiens
AGVQCGVQG

SEQ ID NO: 1262927 - protein, 9 aa, Homo Sapiens
NYELICVTR

SEQ ID NO: 1262928 - protein, 9 aa, Homo Sapiens
SFHHLAFNQ

SEQ ID NO: 1262929 - protein, 9 aa, Homo Sapiens
KTARSHRRA

SEQ ID NO: 1262930 - protein, 9 aa, Homo Sapiens
PAQRKLLPH

SEQ ID NO: 1262931 - protein, 9 aa, Homo Sapiens
RERPVCCVE

SEQ ID NO: 1262932 - protein, 9 aa, Homo Sapiens
TTVFVQIMR

SEQ ID NO: 1262933 - protein, 9 aa, Homo Sapiens
VGDLSIFFL

SEQ ID NO: 1262934 - protein, 9 aa, Homo Sapiens
RVDFNEFIL

SEQ ID NO: 1262935 - protein, 9 aa, Homo Sapiens
YGAPSTDKE

SEQ ID NO: 1262936 - protein, 9 aa, Homo Sapiens
PLSCNEDGY

SEQ ID NO: 1262937 - protein, 9 aa, Homo Sapiens
CWTAHAIIL

SEQ ID NO: 1262938 - protein, 9 aa, Homo Sapiens
RIMSRMFAD

SEQ ID NO: 1262939 - protein, 9 aa, Homo Sapiens
ITKKYTKGV

SEQ ID NO: 1262940 - protein, 9 aa, Homo Sapiens
VAMMGLTGS

SEQ ID NO: 1262941 - protein, 9 aa, Homo Sapiens
VKQRIEYAN

SEQ ID NO: 1262942 - protein, 9 aa, Homo Sapiens
EVCRDRGEL

SEQ ID NO: 1262943 - protein, 9 aa, Homo Sapiens
CATDSLGIY

SEQ ID NO: 1262944 - protein, 9 aa, Homo Sapiens
IKGTVKVEA

SEQ ID NO: 1262945 - protein, 9 aa, Homo Sapiens
VREMKIWLS

SEQ ID NO: 1262946 - protein, 9 aa, Homo Sapiens
CVPHTDKRR

SEQ ID NO: 1262947 - protein, 9 aa, Homo Sapiens
MKIEIIAPP

SEQ ID NO: 1262948 - protein, 9 aa, Homo Sapiens
KTDFLVQMQ

SEQ ID NO: 1262949 - protein, 9 aa, Homo Sapiens
GGRMRGTKS

SEQ ID NO: 1262950 - protein, 9 aa, Homo Sapiens
KCCDVPTNG

SEQ ID NO: 1262951 - protein, 9 aa, Homo Sapiens
GPGPTTSPG

SEQ ID NO: 1262952 - protein, 9 aa, Homo Sapiens
AGHVLAPKD

SEQ ID NO: 1262953 - protein, 9 aa, Homo Sapiens
HTTVRCMHL

SEQ ID NO: 1262954 - protein, 9 aa, Homo Sapiens
MQMVSSNVL

SEQ ID NO: 1262955 - protein, 9 aa, Homo Sapiens
INHMIQAIP

SEQ ID NO: 1262956 - protein, 9 aa, Homo Sapiens
MTSYPLTLV

SEQ ID NO: 1262957 - protein, 9 aa, Homo Sapiens
WKKVVTKWK

SEQ ID NO: 1262958 - protein, 9 aa, Homo Sapiens
PRHKPHISN

SEQ ID NO: 1262959 - protein, 9 aa, Homo Sapiens
GSQRGGILA

SEQ ID NO: 1262960 - protein, 9 aa, Homo Sapiens
QSGVCFGDG

SEQ ID NO: 1262961 - protein, 9 aa, Homo Sapiens
AGTMLKPHA

SEQ ID NO: 1262962 - protein, 9 aa, Homo Sapiens
LCADLKVKV

SEQ ID NO: 1262963 - protein, 9 aa, Homo Sapiens
DYYILAEPW

SEQ ID NO: 1262964 - protein, 9 aa, Homo Sapiens
IDNSATCSS

SEQ ID NO: 1262965 - protein, 9 aa, Homo Sapiens
NRHRHMFVK

SEQ ID NO: 1262966 - protein, 9 aa, Homo Sapiens
PQCSRAFAD

SEQ ID NO: 1262967 - protein, 9 aa, Homo Sapiens
PQDFELNPI

SEQ ID NO: 1262968 - protein, 9 aa, Homo Sapiens
EEEDELVDP

SEQ ID NO: 1262969 - protein, 9 aa, Homo Sapiens
NTKSSVCIF

SEQ ID NO: 1262970 - protein, 9 aa, Homo Sapiens
CGDCGHAFS

SEQ ID NO: 1262971 - protein, 9 aa, Homo Sapiens
ATSTCFDAA

SEQ ID NO: 1262972 - protein, 9 aa, Homo Sapiens
VSAVVGPVA

SEQ ID NO: 1262973 - protein, 9 aa, Homo Sapiens
PGIFCARSS

SEQ ID NO: 1262974 - protein, 9 aa, Homo Sapiens
TRCLILDIS

SEQ ID NO: 1262975 - protein, 9 aa, Homo Sapiens
VILLFYVTA

SEQ ID NO: 1262976 - protein, 9 aa, Homo Sapiens
TGPTNYRLR

SEQ ID NO: 1262977 - protein, 9 aa, Homo Sapiens
ASILSQKLG

SEQ ID NO: 1262978 - protein, 9 aa, Homo Sapiens
LLQHTQNTH

SEQ ID NO: 1262979 - protein, 9 aa, Homo Sapiens
WPTQTWTRL

SEQ ID NO: 1262980 - protein, 9 aa, Homo Sapiens
SRGCGRGHR

SEQ ID NO: 1262981 - protein, 9 aa, Homo Sapiens
LVMGACYEN

SEQ ID NO: 1262982 - protein, 9 aa, Homo Sapiens
VGVLLLVFI

SEQ ID NO: 1262983 - protein, 9 aa, Homo Sapiens
WEHKSMENT

SEQ ID NO: 1262984 - protein, 9 aa, Homo Sapiens
LPRVQMDHE

SEQ ID NO: 1262985 - protein, 9 aa, Homo Sapiens
VCVFRPETV

SEQ ID NO: 1262986 - protein, 9 aa, Homo Sapiens
PKCDKIFDR

SEQ ID NO: 1262987 - protein, 9 aa, Homo Sapiens
VVWVPTEAL

SEQ ID NO: 1262988 - protein, 9 aa, Homo Sapiens
VLIYPDRAW

SEQ ID NO: 1262989 - protein, 9 aa, Homo Sapiens
EATSWSCQP

SEQ ID NO: 1262990 - protein, 9 aa, Homo Sapiens
GCRDNLKYS

SEQ ID NO: 1262991 - protein, 9 aa, Homo Sapiens
HVLDQFQVM

SEQ ID NO: 1262992 - protein, 9 aa, Homo Sapiens
RKAHRDWAV

SEQ ID NO: 1262993 - protein, 9 aa, Homo Sapiens
LLLGGCLAC

SEQ ID NO: 1262994 - protein, 9 aa, Homo Sapiens
NGEDVLFAM

SEQ ID NO: 1262995 - protein, 9 aa, Homo Sapiens
GQKKCDIGP

SEQ ID NO: 1262996 - protein, 9 aa, Homo Sapiens
GRTIYLRPA

SEQ ID NO: 1262997 - protein, 9 aa, Homo Sapiens
FKAELIMYR

SEQ ID NO: 1262998 - protein, 9 aa, Homo Sapiens
VLCCLRSKE

SEQ ID NO: 1262999 - protein, 9 aa, Homo Sapiens
RISGGDHAP

SEQ ID NO: 1263000 - protein, 9 aa, Homo Sapiens
APPKLIMLP

SEQ ID NO: 1263001 - protein, 9 aa, Homo Sapiens
YCVPHTDKR

SEQ ID NO: 1263002 - protein, 9 aa, Homo Sapiens
CHMTSISDL

SEQ ID NO: 1263003 - protein, 9 aa, Homo Sapiens
GLESNKNEK

SEQ ID NO: 1263004 - protein, 9 aa, Homo Sapiens
FITMANVFL

SEQ ID NO: 1263005 - protein, 9 aa, Homo Sapiens
CLHPHFTHI

SEQ ID NO: 1263006 - protein, 9 aa, Homo Sapiens
MFGRCQKVP

SEQ ID NO: 1263007 - protein, 9 aa, Homo Sapiens
ALDNGLTRT

SEQ ID NO: 1263008 - protein, 9 aa, Homo Sapiens
SEDRDLGFP

SEQ ID NO: 1263009 - protein, 9 aa, Homo Sapiens
PLLTQKTQT

SEQ ID NO: 1263010 - protein, 9 aa, Homo Sapiens
NATYQVDVF

SEQ ID NO: 1263011 - protein, 9 aa, Homo Sapiens
KQRIEYANL

SEQ ID NO: 1263012 - protein, 9 aa, Homo Sapiens
LLWDILQKT

SEQ ID NO: 1263013 - protein, 9 aa, Homo Sapiens
YQCVVTVES

SEQ ID NO: 1263014 - protein, 9 aa, Homo Sapiens
VTVESLGTI

SEQ ID NO: 1263015 - protein, 9 aa, Homo Sapiens
QGDIEDDQA

SEQ ID NO: 1263016 - protein, 9 aa, Homo Sapiens
KQTGHRRHR

SEQ ID NO: 1263017 - protein, 9 aa, Homo Sapiens
HLVSRNIYH

SEQ ID NO: 1263018 - protein, 9 aa, Homo Sapiens
ERPTVKAAE

SEQ ID NO: 1263019 - protein, 9 aa, Homo Sapiens
AAAHTHHYL

SEQ ID NO: 1263020 - protein, 9 aa, Homo Sapiens
VLMNADCSS

SEQ ID NO: 1263021 - protein, 9 aa, Homo Sapiens
SLIIGSINA

SEQ ID NO: 1263022 - protein, 9 aa, Homo Sapiens
REQLVPGSG

SEQ ID NO: 1263023 - protein, 9 aa, Homo Sapiens
LIKPKELVK

SEQ ID NO: 1263024 - protein, 9 aa, Homo Sapiens
LHRVAVQHF

SEQ ID NO: 1263025 - protein, 9 aa, Homo Sapiens
LNYLAECLQ

SEQ ID NO: 1263026 - protein, 9 aa, Homo Sapiens
QRGTPSYSP

SEQ ID NO: 1263027 - protein, 9 aa, Homo Sapiens
SSWVQDESP

SEQ ID NO: 1263028 - protein, 9 aa, Homo Sapiens
CQGHWQIVD

SEQ ID NO: 1263029 - protein, 9 aa, Homo Sapiens
SLENTKPQV

SEQ ID NO: 1263030 - protein, 9 aa, Homo Sapiens
EDTSFFVRT

SEQ ID NO: 1263031 - protein, 9 aa, Homo Sapiens
ESSAGDDAI

SEQ ID NO: 1263032 - protein, 9 aa, Homo Sapiens
RNGSWYPGF

SEQ ID NO: 1263033 - protein, 9 aa, Homo Sapiens
ICHNGGNCV

SEQ ID NO: 1263034 - protein, 9 aa, Homo Sapiens
EQYECSLEQ

SEQ ID NO: 1263035 - protein, 9 aa, Homo Sapiens
VTASFGIGP

SEQ ID NO: 1263036 - protein, 9 aa, Homo Sapiens
EVLGHAHRK

SEQ ID NO: 1263037 - protein, 9 aa, Homo Sapiens
SQPNATPSV

SEQ ID NO: 1263038 - protein, 9 aa, Homo Sapiens
TVGSSLSEA

SEQ ID NO: 1263039 - protein, 9 aa, Homo Sapiens
SPYISPKES

SEQ ID NO: 1263040 - protein, 9 aa, Homo Sapiens
KLIKGEMKE

SEQ ID NO: 1263041 - protein, 9 aa, Homo Sapiens
MTTADDMPH

SEQ ID NO: 1263042 - protein, 9 aa, Homo Sapiens
YTIDGFKKI

SEQ ID NO: 1263043 - protein, 9 aa, Homo Sapiens
QITMLNGHY

SEQ ID NO: 1263044 - protein, 9 aa, Homo Sapiens
GCYLITATL

SEQ ID NO: 1263045 - protein, 9 aa, Homo Sapiens
SYNCKVCGK

SEQ ID NO: 1263046 - protein, 9 aa, Homo Sapiens
CEQELEISE

SEQ ID NO: 1263047 - protein, 9 aa, Homo Sapiens
CYIMSGSRD

SEQ ID NO: 1263048 - protein, 9 aa, Homo Sapiens
NQYSAKHGE

SEQ ID NO: 1263049 - protein, 9 aa, Homo Sapiens
KDTHFNFAI

SEQ ID NO: 1263050 - protein, 9 aa, Homo Sapiens
LQCIMQTYL

SEQ ID NO: 1263051 - protein, 9 aa, Homo Sapiens
RGSCGWWAP

SEQ ID NO: 1263052 - protein, 9 aa, Homo Sapiens
AGVKVWYLE

SEQ ID NO: 1263053 - protein, 9 aa, Homo Sapiens
EHSLSAPGN

SEQ ID NO: 1263054 - protein, 9 aa, Homo Sapiens
DAIACKRAK

SEQ ID NO: 1263055 - protein, 9 aa, Homo Sapiens
YALGKYGPT

SEQ ID NO: 1263056 - protein, 9 aa, Homo Sapiens
WRHVADMNM

SEQ ID NO: 1263057 - protein, 9 aa, Homo Sapiens
MFQNVTEEK

SEQ ID NO: 1263058 - protein, 9 aa, Homo Sapiens
IFLGLMEKE

SEQ ID NO: 1263059 - protein, 9 aa, Homo Sapiens
DYGVASQHS

SEQ ID NO: 1263060 - protein, 9 aa, Homo Sapiens
GDAPVGTQA

SEQ ID NO: 1263061 - protein, 9 aa, Homo Sapiens
KVKIATLYL

SEQ ID NO: 1263062 - protein, 9 aa, Homo Sapiens
LRSYQQWVH

SEQ ID NO: 1263063 - protein, 9 aa, Homo Sapiens
RIQRDLPSE

SEQ ID NO: 1263064 - protein, 9 aa, Homo Sapiens
AQDLWSEQG

SEQ ID NO: 1263065 - protein, 9 aa, Homo Sapiens
LICLLRWMR

SEQ ID NO: 1263066 - protein, 9 aa, Homo Sapiens
IIGLEIPDQ

SEQ ID NO: 1263067 - protein, 9 aa, Homo Sapiens
MGTLQIDFA

SEQ ID NO: 1263068 - protein, 9 aa, Homo Sapiens
MSLKSNAVL

SEQ ID NO: 1263069 - protein, 9 aa, Homo Sapiens
SMSLSPPLN

SEQ ID NO: 1263070 - protein, 9 aa, Homo Sapiens
THTKPQPDV

SEQ ID NO: 1263071 - protein, 9 aa, Homo Sapiens
VMLDSLGRP

SEQ ID NO: 1263072 - protein, 9 aa, Homo Sapiens
NTVFRNLAS

SEQ ID NO: 1263073 - protein, 9 aa, Homo Sapiens
VMLVRLNSK

SEQ ID NO: 1263074 - protein, 9 aa, Homo Sapiens
GTVSGQNCC

SEQ ID NO: 1263075 - protein, 9 aa, Homo Sapiens
IGSTNLIVY

SEQ ID NO: 1263076 - protein, 9 aa, Homo Sapiens
GKTCLLIFF

SEQ ID NO: 1263077 - protein, 9 aa, Homo Sapiens
DVTESENGS

SEQ ID NO: 1263078 - protein, 9 aa, Homo Sapiens
ECLKETMGW

SEQ ID NO: 1263079 - protein, 9 aa, Homo Sapiens
TFFDTFNVP

SEQ ID NO: 1263080 - protein, 9 aa, Homo Sapiens
FCTCFSHIC

SEQ ID NO: 1263081 - protein, 9 aa, Homo Sapiens
VLDGFDALL

SEQ ID NO: 1263082 - protein, 9 aa, Homo Sapiens
TGEKLFICN

SEQ ID NO: 1263083 - protein, 9 aa, Homo Sapiens
ELKLYDSNL

SEQ ID NO: 1263084 - protein, 9 aa, Homo Sapiens
LPPPVTYQV

SEQ ID NO: 1263085 - protein, 9 aa, Homo Sapiens
EYSHFEKEQ

SEQ ID NO: 1263086 - protein, 9 aa, Homo Sapiens
LVMECVDGG

SEQ ID NO: 1263087 - protein, 9 aa, Homo Sapiens
RGAALLRTM

SEQ ID NO: 1263088 - protein, 9 aa, Homo Sapiens
IHQNLEDNN

SEQ ID NO: 1263089 - protein, 9 aa, Homo Sapiens
RGSRMSQPL

SEQ ID NO: 1263090 - protein, 9 aa, Homo Sapiens
YLPVGSHNI

SEQ ID NO: 1263091 - protein, 9 aa, Homo Sapiens
QNICVIAAF

SEQ ID NO: 1263092 - protein, 9 aa, Homo Sapiens
LLRNLMVQA

SEQ ID NO: 1263093 - protein, 9 aa, Homo Sapiens
SSKEMMFEG

SEQ ID NO: 1263094 - protein, 9 aa, Homo Sapiens
INRTLETVN

SEQ ID NO: 1263095 - protein, 9 aa, Homo Sapiens
HRAGGLPAQ

SEQ ID NO: 1263096 - protein, 9 aa, Homo Sapiens
YVGKDGYNY

SEQ ID NO: 1263097 - protein, 9 aa, Homo Sapiens
YLTKILFGA

SEQ ID NO: 1263098 - protein, 9 aa, Homo Sapiens
STRDWRTIT

SEQ ID NO: 1263099 - protein, 9 aa, Homo Sapiens
GTPRDQRVQ

SEQ ID NO: 1263100 - protein, 9 aa, Homo Sapiens
QPLTRLSTG

SEQ ID NO: 1263101 - protein, 9 aa, Homo Sapiens
GCNLDCKAG

SEQ ID NO: 1263102 - protein, 9 aa, Homo Sapiens
IFKRAFYPN

SEQ ID NO: 1263103 - protein, 9 aa, Homo Sapiens
IYYFVFDHA

SEQ ID NO: 1263104 - protein, 9 aa, Homo Sapiens
DIQGSGKTA

SEQ ID NO: 1263105 - protein, 9 aa, Homo Sapiens
PLIMRGLAG

SEQ ID NO: 1263106 - protein, 9 aa, Homo Sapiens
SSLGVVTKP

SEQ ID NO: 1263107 - protein, 9 aa, Homo Sapiens
QTGHRRHRE

SEQ ID NO: 1263108 - protein, 9 aa, Homo Sapiens
PGPHRLVGT

SEQ ID NO: 1263109 - protein, 9 aa, Homo Sapiens
RHTSSSDDF

SEQ ID NO: 1263110 - protein, 9 aa, Homo Sapiens
QLKRSEADK

SEQ ID NO: 1263111 - protein, 9 aa, Homo Sapiens
KVKTGSKNY

SEQ ID NO: 1263112 - protein, 9 aa, Homo Sapiens
SQPLLFIIS

SEQ ID NO: 1263113 - protein, 9 aa, Homo Sapiens
GKSYLVALY

SEQ ID NO: 1263114 - protein, 9 aa, Homo Sapiens
NSMSTKKIQ

SEQ ID NO: 1263115 - protein, 9 aa, Homo Sapiens
DHVLSQESS

SEQ ID NO: 1263116 - protein, 9 aa, Homo Sapiens
AHQMQQQNP

SEQ ID NO: 1263117 - protein, 9 aa, Homo Sapiens
DSLVLQSKN

SEQ ID NO: 1263118 - protein, 9 aa, Homo Sapiens
SREHPHLAA

SEQ ID NO: 1263119 - protein, 9 aa, Homo Sapiens
KWWGLQSKI

SEQ ID NO: 1263120 - protein, 9 aa, Homo Sapiens
FKSIHSITD

SEQ ID NO: 1263121 - protein, 9 aa, Homo Sapiens
WRSRWQGPC

SEQ ID NO: 1263122 - protein, 9 aa, Homo Sapiens
ITFIIIALS

SEQ ID NO: 1263123 - protein, 9 aa, Homo Sapiens
PNTVLAFKR

SEQ ID NO: 1263124 - protein, 9 aa, Homo Sapiens
EQQVGQSKH

SEQ ID NO: 1263125 - protein, 9 aa, Homo Sapiens
GIRGCTLSS

SEQ ID NO: 1263126 - protein, 9 aa, Homo Sapiens
DPVSLAAAW

SEQ ID NO: 1263127 - protein, 9 aa, Homo Sapiens
LYCNTGDVC

SEQ ID NO: 1263128 - protein, 9 aa, Homo Sapiens
QHFVLRFRA

SEQ ID NO: 1263129 - protein, 9 aa, Homo Sapiens
QLHEVYSHT

SEQ ID NO: 1263130 - protein, 9 aa, Homo Sapiens
TTQRTLASP

SEQ ID NO: 1263131 - protein, 9 aa, Homo Sapiens
LHLLGATAF

SEQ ID NO: 1263132 - protein, 9 aa, Homo Sapiens
GKRWLTADM

SEQ ID NO: 1263133 - protein, 9 aa, Homo Sapiens
AQAQHLAQE

SEQ ID NO: 1263134 - protein, 9 aa, Homo Sapiens
VTWGINQFG

SEQ ID NO: 1263135 - protein, 9 aa, Homo Sapiens
IEDQNQSKI

SEQ ID NO: 1263136 - protein, 9 aa, Homo Sapiens
KALVTSEAK

SEQ ID NO: 1263137 - protein, 9 aa, Homo Sapiens
SQSKEGSLD

SEQ ID NO: 1263138 - protein, 9 aa, Homo Sapiens
KYKPRFVHI

SEQ ID NO: 1263139 - protein, 9 aa, Homo Sapiens
PGYWIGVHY

SEQ ID NO: 1263140 - protein, 9 aa, Homo Sapiens
STEAKSYWD

SEQ ID NO: 1263141 - protein, 9 aa, Homo Sapiens
YTSTAMIRP

SEQ ID NO: 1263142 - protein, 9 aa, Homo Sapiens
IRCDCVICW

SEQ ID NO: 1263143 - protein, 9 aa, Homo Sapiens
LHHRRSHQG

SEQ ID NO: 1263144 - protein, 9 aa, Homo Sapiens
ERLQHSEWA

SEQ ID NO: 1263145 - protein, 9 aa, Homo Sapiens
SHTGEKSYV

SEQ ID NO: 1263146 - protein, 9 aa, Homo Sapiens
MTFTRAQLD

SEQ ID NO: 1263147 - protein, 9 aa, Homo Sapiens
LSSVLASLI

SEQ ID NO: 1263148 - protein, 9 aa, Homo Sapiens
WQLQKQERP

SEQ ID NO: 1263149 - protein, 9 aa, Homo Sapiens
RLLAPCLPS

SEQ ID NO: 1263150 - protein, 9 aa, Homo Sapiens
GKILKACVR

SEQ ID NO: 1263151 - protein, 9 aa, Homo Sapiens
AADSEPESD

SEQ ID NO: 1263152 - protein, 9 aa, Homo Sapiens
VLKMCQPEL

SEQ ID NO: 1263153 - protein, 9 aa, Homo Sapiens
CHFWRDGRK

SEQ ID NO: 1263154 - protein, 9 aa, Homo Sapiens
ILEFLDLSV

SEQ ID NO: 1263155 - protein, 9 aa, Homo Sapiens
TGESHFKLR

SEQ ID NO: 1263156 - protein, 9 aa, Homo Sapiens
RYSGSEGSM

SEQ ID NO: 1263157 - protein, 9 aa, Homo Sapiens
IGIVCSPTP

SEQ ID NO: 1263158 - protein, 9 aa, Homo Sapiens
LFLLAGPDM

SEQ ID NO: 1263159 - protein, 9 aa, Homo Sapiens
NLREMWLDR

SEQ ID NO: 1263160 - protein, 9 aa, Homo Sapiens
GLGMWGLPP

SEQ ID NO: 1263161 - protein, 9 aa, Homo Sapiens
KSLWFIGLS

SEQ ID NO: 1263162 - protein, 9 aa, Homo Sapiens
RGRSRSTQG

SEQ ID NO: 1263163 - protein, 9 aa, Homo Sapiens
KATYINIKP

SEQ ID NO: 1263164 - protein, 9 aa, Homo Sapiens
SLTNTLIGR

SEQ ID NO: 1263165 - protein, 9 aa, Homo Sapiens
DGGRPALLA

SEQ ID NO: 1263166 - protein, 9 aa, Homo Sapiens
CWYQCCPHS

SEQ ID NO: 1263167 - protein, 9 aa, Homo Sapiens
RLRNSSLGY

SEQ ID NO: 1263168 - protein, 9 aa, Homo Sapiens
DHLKATHAV

SEQ ID NO: 1263169 - protein, 9 aa, Homo Sapiens
NIQIDNNKS

SEQ ID NO: 1263170 - protein, 9 aa, Homo Sapiens
RCQNQDRIN

SEQ ID NO: 1263171 - protein, 9 aa, Homo Sapiens
NHDLDQFLE

SEQ ID NO: 1263172 - protein, 9 aa, Homo Sapiens
KKKPFVVSG

SEQ ID NO: 1263173 - protein, 9 aa, Homo Sapiens
CENFQDLMQ

SEQ ID NO: 1263174 - protein, 9 aa, Homo Sapiens
GCIFVHTSG

SEQ ID NO: 1263175 - protein, 9 aa, Homo Sapiens
APAPTPDAT

SEQ ID NO: 1263176 - protein, 9 aa, Homo Sapiens
SLQPPTLGA

SEQ ID NO: 1263177 - protein, 9 aa, Homo Sapiens
GAALLRTMG

SEQ ID NO: 1263178 - protein, 9 aa, Homo Sapiens
TVVVLKATV

SEQ ID NO: 1263179 - protein, 9 aa, Homo Sapiens
ELLIGMLTE

SEQ ID NO: 1263180 - protein, 9 aa, Homo Sapiens
QHLFIESRA

SEQ ID NO: 1263181 - protein, 9 aa, Homo Sapiens
KIKLWDINT

SEQ ID NO: 1263182 - protein, 9 aa, Homo Sapiens
QEKQQKREA

SEQ ID NO: 1263183 - protein, 9 aa, Homo Sapiens
VPRHEQITR

SEQ ID NO: 1263184 - protein, 9 aa, Homo Sapiens
GARIPPTSR

SEQ ID NO: 1263185 - protein, 9 aa, Homo Sapiens
TILTPKLFD

SEQ ID NO: 1263186 - protein, 9 aa, Homo Sapiens
FIQSCPTIR

SEQ ID NO: 1263187 - protein, 9 aa, Homo Sapiens
VVDMIPGLP

SEQ ID NO: 1263188 - protein, 9 aa, Homo Sapiens
LEDAQLQDL

SEQ ID NO: 1263189 - protein, 9 aa, Homo Sapiens
VKLGVHISD

SEQ ID NO: 1263190 - protein, 9 aa, Homo Sapiens
TRDWRTITY

SEQ ID NO: 1263191 - protein, 9 aa, Homo Sapiens
CEVDAHSGR

SEQ ID NO: 1263192 - protein, 9 aa, Homo Sapiens
PAPGLTKCV

SEQ ID NO: 1263193 - protein, 9 aa, Homo Sapiens
ILELGFSKV

SEQ ID NO: 1263194 - protein, 9 aa, Homo Sapiens
ENQYTLDNS

SEQ ID NO: 1263195 - protein, 9 aa, Homo Sapiens
VGGKRVVYY

SEQ ID NO: 1263196 - protein, 9 aa, Homo Sapiens
RDISPTERC

SEQ ID NO: 1263197 - protein, 9 aa, Homo Sapiens
STPDSVTIL

SEQ ID NO: 1263198 - protein, 9 aa, Homo Sapiens
EDWSAQPVT

SEQ ID NO: 1263199 - protein, 9 aa, Homo Sapiens
SADIWDCDY

SEQ ID NO: 1263200 - protein, 9 aa, Homo Sapiens
HIQPLIPLY

SEQ ID NO: 1263201 - protein, 9 aa, Homo Sapiens
YCGKTFSMS

SEQ ID NO: 1263202 - protein, 9 aa, Homo Sapiens
TRPPRARVS

SEQ ID NO: 1263203 - protein, 9 aa, Homo Sapiens
EDPKSKQKK

SEQ ID NO: 1263204 - protein, 9 aa, Homo Sapiens
LFIGWAGSS

SEQ ID NO: 1263205 - protein, 9 aa, Homo Sapiens
SAILKRDVD

SEQ ID NO: 1263206 - protein, 9 aa, Homo Sapiens
TKRTGHYLF

SEQ ID NO: 1263207 - protein, 9 aa, Homo Sapiens
QKLAQLEEV

SEQ ID NO: 1263208 - protein, 9 aa, Homo Sapiens
FVGFIVVFC

SEQ ID NO: 1263209 - protein, 9 aa, Homo Sapiens
VSHVLNRLT

SEQ ID NO: 1263210 - protein, 9 aa, Homo Sapiens
RGDEVMVQM

SEQ ID NO: 1263211 - protein, 9 aa, Homo Sapiens
PFKCHLYNR

SEQ ID NO: 1263212 - protein, 9 aa, Homo Sapiens
SESGTIMTD

SEQ ID NO: 1263213 - protein, 9 aa, Homo Sapiens
GERVHIKFG

SEQ ID NO: 1263214 - protein, 9 aa, Homo Sapiens
PQVVVGAPG

SEQ ID NO: 1263215 - protein, 9 aa, Homo Sapiens
FTSVYEELV

SEQ ID NO: 1263216 - protein, 9 aa, Homo Sapiens
ISTVHYPVS

SEQ ID NO: 1263217 - protein, 9 aa, Homo Sapiens
DYMDKKNCS

SEQ ID NO: 1263218 - protein, 9 aa, Homo Sapiens
GGKGQGWWE

SEQ ID NO: 1263219 - protein, 9 aa, Homo Sapiens
KNSINFFTG

SEQ ID NO: 1263220 - protein, 9 aa, Homo Sapiens
ARHRKTGRK

SEQ ID NO: 1263221 - protein, 9 aa, Homo Sapiens
HLVASFEKS

SEQ ID NO: 1263222 - protein, 9 aa, Homo Sapiens
PPHGSSFGN

SEQ ID NO: 1263223 - protein, 9 aa, Homo Sapiens
GTELQVIVR

SEQ ID NO: 1263224 - protein, 9 aa, Homo Sapiens
LSSSESQAM

SEQ ID NO: 1263225 - protein, 9 aa, Homo Sapiens
SKCNKETVV

SEQ ID NO: 1263226 - protein, 9 aa, Homo Sapiens
MRVIRWFDY

SEQ ID NO: 1263227 - protein, 9 aa, Homo Sapiens
REQVLQGEP

SEQ ID NO: 1263228 - protein, 9 aa, Homo Sapiens
TDFHFNAMT

SEQ ID NO: 1263229 - protein, 9 aa, Homo Sapiens
ATVIRCRQD

SEQ ID NO: 1263230 - protein, 9 aa, Homo Sapiens
DTELFQHHE

SEQ ID NO: 1263231 - protein, 9 aa, Homo Sapiens
VTDTKNVQF

SEQ ID NO: 1263232 - protein, 9 aa, Homo Sapiens
LLPAAAAAT

SEQ ID NO: 1263233 - protein, 9 aa, Homo Sapiens
RLDSKVNII

SEQ ID NO: 1263234 - protein, 9 aa, Homo Sapiens
YNCILTNFR

SEQ ID NO: 1263235 - protein, 9 aa, Homo Sapiens
RITVKKLKS

SEQ ID NO: 1263236 - protein, 9 aa, Homo Sapiens
LQQGEAMHC

SEQ ID NO: 1263237 - protein, 9 aa, Homo Sapiens
ICDGCNGPA

SEQ ID NO: 1263238 - protein, 9 aa, Homo Sapiens
TATVSAVIA

SEQ ID NO: 1263239 - protein, 9 aa, Homo Sapiens
MKETKCQQI

SEQ ID NO: 1263240 - protein, 9 aa, Homo Sapiens
SDFVLDIRM

SEQ ID NO: 1263241 - protein, 9 aa, Homo Sapiens
FHASDCGEE

SEQ ID NO: 1263242 - protein, 9 aa, Homo Sapiens
SDCYNPAAV

SEQ ID NO: 1263243 - protein, 9 aa, Homo Sapiens
SSTLLHHRR

SEQ ID NO: 1263244 - protein, 9 aa, Homo Sapiens
KKHLNEHMK

SEQ ID NO: 1263245 - protein, 9 aa, Homo Sapiens
EQHLEGEFC

SEQ ID NO: 1263246 - protein, 9 aa, Homo Sapiens
WHYGGLTGL

SEQ ID NO: 1263247 - protein, 9 aa, Homo Sapiens
PRAPAQAHM

SEQ ID NO: 1263248 - protein, 9 aa, Homo Sapiens
VSQLSTLVD

SEQ ID NO: 1263249 - protein, 9 aa, Homo Sapiens
AMAALGLMI

SEQ ID NO: 1263250 - protein, 9 aa, Homo Sapiens
QHFRKVSEF

SEQ ID NO: 1263251 - protein, 9 aa, Homo Sapiens
PLGFGKLYP

SEQ ID NO: 1263252 - protein, 9 aa, Homo Sapiens
PAPEEEWTR

SEQ ID NO: 1263253 - protein, 9 aa, Homo Sapiens
MLPSQQREI

SEQ ID NO: 1263254 - protein, 9 aa, Homo Sapiens
VCRRSLDSL

SEQ ID NO: 1263255 - protein, 9 aa, Homo Sapiens
TIIAPMMLW

SEQ ID NO: 1263256 - protein, 9 aa, Homo Sapiens
QPQVIEFRT

SEQ ID NO: 1263257 - protein, 9 aa, Homo Sapiens
TREKSYDCK

SEQ ID NO: 1263258 - protein, 9 aa, Homo Sapiens
KLLQKCIEV

SEQ ID NO: 1263259 - protein, 9 aa, Homo Sapiens
HPGKSNLKL

SEQ ID NO: 1263260 - protein, 9 aa, Homo Sapiens
VCQYNAVVG

SEQ ID NO: 1263261 - protein, 9 aa, Homo Sapiens
CRDQFKDTN

SEQ ID NO: 1263262 - protein, 9 aa, Homo Sapiens
TSTPEELKL

SEQ ID NO: 1263263 - protein, 9 aa, Homo Sapiens
SKAFGQSSV

SEQ ID NO: 1263264 - protein, 9 aa, Homo Sapiens
CMGGCSGQG

SEQ ID NO: 1263265 - protein, 9 aa, Homo Sapiens
TTLYRHNLT

SEQ ID NO: 1263266 - protein, 9 aa, Homo Sapiens
ESASIHDMN

SEQ ID NO: 1263267 - protein, 9 aa, Homo Sapiens
EHRISQHSS

SEQ ID NO: 1263268 - protein, 9 aa, Homo Sapiens
ITKKWGDHF

SEQ ID NO: 1263269 - protein, 9 aa, Homo Sapiens
YCGQGVQFL

SEQ ID NO: 1263270 - protein, 9 aa, Homo Sapiens
HAWTAECCM

SEQ ID NO: 1263271 - protein, 9 aa, Homo Sapiens
SIQEAASVP

SEQ ID NO: 1263272 - protein, 9 aa, Homo Sapiens
NDGEIWRMY

SEQ ID NO: 1263273 - protein, 9 aa, Homo Sapiens
TLKSARSSV

SEQ ID NO: 1263274 - protein, 9 aa, Homo Sapiens
FVNIPCAAV

SEQ ID NO: 1263275 - protein, 9 aa, Homo Sapiens
WFQNRQTKW

SEQ ID NO: 1263276 - protein, 9 aa, Homo Sapiens
TERVIEPSS

SEQ ID NO: 1263277 - protein, 9 aa, Homo Sapiens
LHQYCPVLR

SEQ ID NO: 1263278 - protein, 9 aa, Homo Sapiens
RTFSKQPST

SEQ ID NO: 1263279 - protein, 9 aa, Homo Sapiens
YQSRNYYNF

SEQ ID NO: 1263280 - protein, 9 aa, Homo Sapiens
SGRTVSLFH

SEQ ID NO: 1263281 - protein, 9 aa, Homo Sapiens
MLLWIGASL

SEQ ID NO: 1263282 - protein, 9 aa, Homo Sapiens
YQRHHTGEK

SEQ ID NO: 1263283 - protein, 9 aa, Homo Sapiens
PSFFVLHHN

SEQ ID NO: 1263284 - protein, 9 aa, Homo Sapiens
YSSSSTSSS

SEQ ID NO: 1263285 - protein, 9 aa, Homo Sapiens
RDSAIRKHL

SEQ ID NO: 1263286 - protein, 9 aa, Homo Sapiens
ERDEERIKN

SEQ ID NO: 1263287 - protein, 9 aa, Homo Sapiens
ADLLRRSDR

SEQ ID NO: 1263288 - protein, 9 aa, Homo Sapiens
VISYFGCMN

SEQ ID NO: 1263289 - protein, 9 aa, Homo Sapiens
QEFGGVAPR

SEQ ID NO: 1263290 - protein, 9 aa, Homo Sapiens
GSDSAILLK

SEQ ID NO: 1263291 - protein, 9 aa, Homo Sapiens
SVAGKALSN

SEQ ID NO: 1263292 - protein, 9 aa, Homo Sapiens
IKSFENMAN

SEQ ID NO: 1263293 - protein, 9 aa, Homo Sapiens
AKRRQKCEW

SEQ ID NO: 1263294 - protein, 9 aa, Homo Sapiens
SRDDPSMSE

SEQ ID NO: 1263295 - protein, 9 aa, Homo Sapiens
RPQKPIRCG

SEQ ID NO: 1263296 - protein, 9 aa, Homo Sapiens
RGKKRQEVP

SEQ ID NO: 1263297 - protein, 9 aa, Homo Sapiens
MVKTCDSEE

SEQ ID NO: 1263298 - protein, 9 aa, Homo Sapiens
TIGVLFNNG

SEQ ID NO: 1263299 - protein, 9 aa, Homo Sapiens
GQKKCKMSL

SEQ ID NO: 1263300 - protein, 9 aa, Homo Sapiens
RRQKCEWVK

SEQ ID NO: 1263301 - protein, 9 aa, Homo Sapiens
GPLTVITIP

SEQ ID NO: 1263302 - protein, 9 aa, Homo Sapiens
SSIQREYLD

SEQ ID NO: 1263303 - protein, 9 aa, Homo Sapiens
SNMDQNCLS

SEQ ID NO: 1263304 - protein, 9 aa, Homo Sapiens
HLNGAYKVD

SEQ ID NO: 1263305 - protein, 9 aa, Homo Sapiens
YNEAMARVQ

SEQ ID NO: 1263306 - protein, 9 aa, Homo Sapiens
IARCLFLGD

SEQ ID NO: 1263307 - protein, 9 aa, Homo Sapiens
SIYLLAIYQ

SEQ ID NO: 1263308 - protein, 9 aa, Homo Sapiens
CPCMCTEEG

SEQ ID NO: 1263309 - protein, 9 aa, Homo Sapiens
DGKLEAQNR

SEQ ID NO: 1263310 - protein, 9 aa, Homo Sapiens
WIGWGPWER

SEQ ID NO: 1263311 - protein, 9 aa, Homo Sapiens
ESASPATHY

SEQ ID NO: 1263312 - protein, 9 aa, Homo Sapiens
VELKANNEG

SEQ ID NO: 1263313 - protein, 9 aa, Homo Sapiens
HKRCEEVDA

SEQ ID NO: 1263314 - protein, 9 aa, Homo Sapiens
AQGQVLRVS

SEQ ID NO: 1263315 - protein, 9 aa, Homo Sapiens
NLEMNVMVQ

SEQ ID NO: 1263316 - protein, 9 aa, Homo Sapiens
QKPIEPCRE

SEQ ID NO: 1263317 - protein, 9 aa, Homo Sapiens
STGNTCSSG

SEQ ID NO: 1263318 - protein, 9 aa, Homo Sapiens
VKTCIQSQI

SEQ ID NO: 1263319 - protein, 9 aa, Homo Sapiens
RTIHSVLNR

SEQ ID NO: 1263320 - protein, 9 aa, Homo Sapiens
DACMCQDSM

SEQ ID NO: 1263321 - protein, 9 aa, Homo Sapiens
INVINMDNF

SEQ ID NO: 1263322 - protein, 9 aa, Homo Sapiens
ITSEHHNQP

SEQ ID NO: 1263323 - protein, 9 aa, Homo Sapiens
QLALPVLMN

SEQ ID NO: 1263324 - protein, 9 aa, Homo Sapiens
SLAVNFCGW

SEQ ID NO: 1263325 - protein, 9 aa, Homo Sapiens
NTLHLASER

SEQ ID NO: 1263326 - protein, 9 aa, Homo Sapiens
VIFFIGIAI

SEQ ID NO: 1263327 - protein, 9 aa, Homo Sapiens
TQEALNSDG

SEQ ID NO: 1263328 - protein, 9 aa, Homo Sapiens
AHYLMQAAG

SEQ ID NO: 1263329 - protein, 9 aa, Homo Sapiens
EQQLATLEG

SEQ ID NO: 1263330 - protein, 9 aa, Homo Sapiens
FTQMAYVAS

SEQ ID NO: 1263331 - protein, 9 aa, Homo Sapiens
IRTHTGSNH

SEQ ID NO: 1263332 - protein, 9 aa, Homo Sapiens
YQIHKQNKI

SEQ ID NO: 1263333 - protein, 9 aa, Homo Sapiens
TAHQNLYRN

SEQ ID NO: 1263334 - protein, 9 aa, Homo Sapiens
SMFREDQIY

SEQ ID NO: 1263335 - protein, 9 aa, Homo Sapiens
TQTWTRLPR

SEQ ID NO: 1263336 - protein, 9 aa, Homo Sapiens
MSFTSHIDA

SEQ ID NO: 1263337 - protein, 9 aa, Homo Sapiens
CVSLAGGAW

SEQ ID NO: 1263338 - protein, 9 aa, Homo Sapiens
GLSIGLQSL

SEQ ID NO: 1263339 - protein, 9 aa, Homo Sapiens
SLQWNRIYS

SEQ ID NO: 1263340 - protein, 9 aa, Homo Sapiens
LCCLRSKEE

SEQ ID NO: 1263341 - protein, 9 aa, Homo Sapiens
RWQLQKQER

SEQ ID NO: 1263342 - protein, 9 aa, Homo Sapiens
FRWGSSLII

SEQ ID NO: 1263343 - protein, 9 aa, Homo Sapiens
GRHASCYIK

SEQ ID NO: 1263344 - protein, 9 aa, Homo Sapiens
GMQLLCEGL

SEQ ID NO: 1263345 - protein, 9 aa, Homo Sapiens
ECRKFQGDQ

SEQ ID NO: 1263346 - protein, 9 aa, Homo Sapiens
MLYTMLVGW

SEQ ID NO: 1263347 - protein, 9 aa, Homo Sapiens
TIPRNLLTT

SEQ ID NO: 1263348 - protein, 9 aa, Homo Sapiens
YRLVLYEKS

SEQ ID NO: 1263349 - protein, 9 aa, Homo Sapiens
VNMWRKNLQ

SEQ ID NO: 1263350 - protein, 9 aa, Homo Sapiens
EARTECDQF

SEQ ID NO: 1263351 - protein, 9 aa, Homo Sapiens
NSLYIPKAL

SEQ ID NO: 1263352 - protein, 9 aa, Homo Sapiens
TPNYNHHTR

SEQ ID NO: 1263353 - protein, 9 aa, Homo Sapiens
MKCLRVPPL

SEQ ID NO: 1263354 - protein, 9 aa, Homo Sapiens
LIKALFAME

SEQ ID NO: 1263355 - protein, 9 aa, Homo Sapiens
GDEVGSEQM

SEQ ID NO: 1263356 - protein, 9 aa, Homo Sapiens
GSSSTRSRP

SEQ ID NO: 1263357 - protein, 9 aa, Homo Sapiens
HAALGGAGV

SEQ ID NO: 1263358 - protein, 9 aa, Homo Sapiens
GIKYLVYML

SEQ ID NO: 1263359 - protein, 9 aa, Homo Sapiens
LLCFLVLTN

SEQ ID NO: 1263360 - protein, 9 aa, Homo Sapiens
VEFLQKLLP

SEQ ID NO: 1263361 - protein, 9 aa, Homo Sapiens
EDPSFNMDA

SEQ ID NO: 1263362 - protein, 9 aa, Homo Sapiens
VPPSNHHQQ

SEQ ID NO: 1263363 - protein, 9 aa, Homo Sapiens
WISRSAEPP

SEQ ID NO: 1263364 - protein, 9 aa, Homo Sapiens
TIPPRMTPK

SEQ ID NO: 1263365 - protein, 9 aa, Homo Sapiens
KATTIPPSQ

SEQ ID NO: 1263366 - protein, 9 aa, Homo Sapiens
LTTSVDLPP

SEQ ID NO: 1263367 - protein, 9 aa, Homo Sapiens
QLDSAQKNI

SEQ ID NO: 1263368 - protein, 9 aa, Homo Sapiens
NDHYPVFLD

SEQ ID NO: 1263369 - protein, 9 aa, Homo Sapiens
TMRFWDASG

SEQ ID NO: 1263370 - protein, 9 aa, Homo Sapiens
DVGFRAIAL

SEQ ID NO: 1263371 - protein, 9 aa, Homo Sapiens
DGYSDIVQN

SEQ ID NO: 1263372 - protein, 9 aa, Homo Sapiens
ITATLFVVI

SEQ ID NO: 1263373 - protein, 9 aa, Homo Sapiens
IRPVMILTE

SEQ ID NO: 1263374 - protein, 9 aa, Homo Sapiens
PRMRQLQSS

SEQ ID NO: 1263375 - protein, 9 aa, Homo Sapiens
TRRVTELFM

SEQ ID NO: 1263376 - protein, 9 aa, Homo Sapiens
KIHIHIDHI

SEQ ID NO: 1263377 - protein, 9 aa, Homo Sapiens
SQHLTRYSQ

SEQ ID NO: 1263378 - protein, 9 aa, Homo Sapiens
SSISPVEIS

SEQ ID NO: 1263379 - protein, 9 aa, Homo Sapiens
VIALFYGTT

SEQ ID NO: 1263380 - protein, 9 aa, Homo Sapiens
RLGTVMHRM

SEQ ID NO: 1263381 - protein, 9 aa, Homo Sapiens
DQQMDFQRE

SEQ ID NO: 1263382 - protein, 9 aa, Homo Sapiens
GHRFELVLF

SEQ ID NO: 1263383 - protein, 9 aa, Homo Sapiens
TLGNMNNNS

SEQ ID NO: 1263384 - protein, 9 aa, Homo Sapiens
TFSHLQNLT

SEQ ID NO: 1263385 - protein, 9 aa, Homo Sapiens
NPPSSDVLR

SEQ ID NO: 1263386 - protein, 9 aa, Homo Sapiens
EGSLQEIYH

SEQ ID NO: 1263387 - protein, 9 aa, Homo Sapiens
NGEEIHRKQ

SEQ ID NO: 1263388 - protein, 9 aa, Homo Sapiens
VLAGNSTSP

SEQ ID NO: 1263389 - protein, 9 aa, Homo Sapiens
DTLSMFIDA

SEQ ID NO: 1263390 - protein, 9 aa, Homo Sapiens
ISKSAGTML

SEQ ID NO: 1263391 - protein, 9 aa, Homo Sapiens
GTGCVMTGR

SEQ ID NO: 1263392 - protein, 9 aa, Homo Sapiens
GFLRQLYTS

SEQ ID NO: 1263393 - protein, 9 aa, Homo Sapiens
RRFSVSTLH

SEQ ID NO: 1263394 - protein, 9 aa, Homo Sapiens
QEVQNFIKD

SEQ ID NO: 1263395 - protein, 9 aa, Homo Sapiens
PPRTQEVIP

SEQ ID NO: 1263396 - protein, 9 aa, Homo Sapiens
LAASAYHAV

SEQ ID NO: 1263397 - protein, 9 aa, Homo Sapiens
ETLRSNHPP

SEQ ID NO: 1263398 - protein, 9 aa, Homo Sapiens
LPPAPKWRR

SEQ ID NO: 1263399 - protein, 9 aa, Homo Sapiens
IIGVSHRTQ

SEQ ID NO: 1263400 - protein, 9 aa, Homo Sapiens
FILRNVIKG

SEQ ID NO: 1263401 - protein, 9 aa, Homo Sapiens
MKILRLLHQ

SEQ ID NO: 1263402 - protein, 9 aa, Homo Sapiens
EKSNKKISV

SEQ ID NO: 1263403 - protein, 9 aa, Homo Sapiens
RGPPASSTA

SEQ ID NO: 1263404 - protein, 9 aa, Homo Sapiens
RGCLGFQVW

SEQ ID NO: 1263405 - protein, 9 aa, Homo Sapiens
LEKEYTAMK

SEQ ID NO: 1263406 - protein, 9 aa, Homo Sapiens
KYLTCVERG

SEQ ID NO: 1263407 - protein, 9 aa, Homo Sapiens
NFSCFIYNV

SEQ ID NO: 1263408 - protein, 9 aa, Homo Sapiens
NIFVRVKAV

SEQ ID NO: 1263409 - protein, 9 aa, Homo Sapiens
NIRDDERLL

SEQ ID NO: 1263410 - protein, 9 aa, Homo Sapiens
QPVHRFLFL

SEQ ID NO: 1263411 - protein, 9 aa, Homo Sapiens
MTPHKSQAD

SEQ ID NO: 1263412 - protein, 9 aa, Homo Sapiens
CGLPERNCT

SEQ ID NO: 1263413 - protein, 9 aa, Homo Sapiens
DELPSNKTV

SEQ ID NO: 1263414 - protein, 9 aa, Homo Sapiens
GECVRGLKQ

SEQ ID NO: 1263415 - protein, 9 aa, Homo Sapiens
KWQKEAFPG

SEQ ID NO: 1263416 - protein, 9 aa, Homo Sapiens
HVIVNQPLV

SEQ ID NO: 1263417 - protein, 9 aa, Homo Sapiens
SFCKTHAIL

SEQ ID NO: 1263418 - protein, 9 aa, Homo Sapiens
EHQETAYEY

SEQ ID NO: 1263419 - protein, 9 aa, Homo Sapiens
TLGDRDAIL

SEQ ID NO: 1263420 - protein, 9 aa, Homo Sapiens
PAQETLNSH

SEQ ID NO: 1263421 - protein, 9 aa, Homo Sapiens
CRRNLVALN

SEQ ID NO: 1263422 - protein, 9 aa, Homo Sapiens
ESLVMMVRQ

SEQ ID NO: 1263423 - protein, 9 aa, Homo Sapiens
VDAPPQDPS

SEQ ID NO: 1263424 - protein, 9 aa, Homo Sapiens
SKDFSDYGA

SEQ ID NO: 1263425 - protein, 9 aa, Homo Sapiens
NLEETRIAM

SEQ ID NO: 1263426 - protein, 9 aa, Homo Sapiens
VVQNLGMWV

SEQ ID NO: 1263427 - protein, 9 aa, Homo Sapiens
SHAFLPRIP

SEQ ID NO: 1263428 - protein, 9 aa, Homo Sapiens
VNLNDNTGW

SEQ ID NO: 1263429 - protein, 9 aa, Homo Sapiens
ECLVDAAGG

SEQ ID NO: 1263430 - protein, 9 aa, Homo Sapiens
NRTMRALAK

SEQ ID NO: 1263431 - protein, 9 aa, Homo Sapiens
DMALSGPVR

SEQ ID NO: 1263432 - protein, 9 aa, Homo Sapiens
HDGDFEVPG

SEQ ID NO: 1263433 - protein, 9 aa, Homo Sapiens
FVIWAVTFC

SEQ ID NO: 1263434 - protein, 9 aa, Homo Sapiens
SAKLFLVDR

SEQ ID NO: 1263435 - protein, 9 aa, Homo Sapiens
LHFHKGGGY

SEQ ID NO: 1263436 - protein, 9 aa, Homo Sapiens
LGECELPAA

SEQ ID NO: 1263437 - protein, 9 aa, Homo Sapiens
DKKKRLKLK

SEQ ID NO: 1263438 - protein, 9 aa, Homo Sapiens
TTYGRSLKV

SEQ ID NO: 1263439 - protein, 9 aa, Homo Sapiens
VTSIIFCVE

SEQ ID NO: 1263440 - protein, 9 aa, Homo Sapiens
CLHTFCESC

SEQ ID NO: 1263441 - protein, 9 aa, Homo Sapiens
KDAIVLTVK

SEQ ID NO: 1263442 - protein, 9 aa, Homo Sapiens
HLHSIGTNE

SEQ ID NO: 1263443 - protein, 9 aa, Homo Sapiens
AFCLPGEAP

SEQ ID NO: 1263444 - protein, 9 aa, Homo Sapiens
IESSTFQFC

SEQ ID NO: 1263445 - protein, 9 aa, Homo Sapiens
HIPIFRTSA

SEQ ID NO: 1263446 - protein, 9 aa, Homo Sapiens
PQGDVEAVY

SEQ ID NO: 1263447 - protein, 9 aa, Homo Sapiens
IVSAVTTLS

SEQ ID NO: 1263448 - protein, 9 aa, Homo Sapiens
ISGRVHNME

SEQ ID NO: 1263449 - protein, 9 aa, Homo Sapiens
FSKHILNVP

SEQ ID NO: 1263450 - protein, 9 aa, Homo Sapiens
HPISAPQSA

SEQ ID NO: 1263451 - protein, 9 aa, Homo Sapiens
LEDSSMYQC

SEQ ID NO: 1263452 - protein, 9 aa, Homo Sapiens
HTTASCLTN

SEQ ID NO: 1263453 - protein, 9 aa, Homo Sapiens
CNTKIWFVI

SEQ ID NO: 1263454 - protein, 9 aa, Homo Sapiens
WLSSPNTYM

SEQ ID NO: 1263455 - protein, 9 aa, Homo Sapiens
KNTVYIILR

SEQ ID NO: 1263456 - protein, 9 aa, Homo Sapiens
LILATSAIP

SEQ ID NO: 1263457 - protein, 9 aa, Homo Sapiens
VVSKLHGCL

SEQ ID NO: 1263458 - protein, 9 aa, Homo Sapiens
GIPTGEDGP

SEQ ID NO: 1263459 - protein, 9 aa, Homo Sapiens
NGVIEEFWQ

SEQ ID NO: 1263460 - protein, 9 aa, Homo Sapiens
FDHQMVICK

SEQ ID NO: 1263461 - protein, 9 aa, Homo Sapiens
LVPTMFQYG

SEQ ID NO: 1263462 - protein, 9 aa, Homo Sapiens
AISAITVFI

SEQ ID NO: 1263463 - protein, 9 aa, Homo Sapiens
HGTTGSGHY

SEQ ID NO: 1263464 - protein, 9 aa, Homo Sapiens
STVWLSRPS

SEQ ID NO: 1263465 - protein, 9 aa, Homo Sapiens
IHNKILTGA

SEQ ID NO: 1263466 - protein, 9 aa, Homo Sapiens
SPAPRSPAS

SEQ ID NO: 1263467 - protein, 9 aa, Homo Sapiens
LTQCRDMPG

SEQ ID NO: 1263468 - protein, 9 aa, Homo Sapiens
RIVSRDITR

SEQ ID NO: 1263469 - protein, 9 aa, Homo Sapiens
IPFFYMTAN

SEQ ID NO: 1263470 - protein, 9 aa, Homo Sapiens
SRPVRDCDG

SEQ ID NO: 1263471 - protein, 9 aa, Homo Sapiens
RSAQVDVGR

SEQ ID NO: 1263472 - protein, 9 aa, Homo Sapiens
LLTEACYFR

SEQ ID NO: 1263473 - protein, 9 aa, Homo Sapiens
PLTSLLITA

SEQ ID NO: 1263474 - protein, 9 aa, Homo Sapiens
VVWSKTHRF

SEQ ID NO: 1263475 - protein, 9 aa, Homo Sapiens
EAAVRMRLE

SEQ ID NO: 1263476 - protein, 9 aa, Homo Sapiens
ADVHALRTI

SEQ ID NO: 1263477 - protein, 9 aa, Homo Sapiens
SGTLARTVT

SEQ ID NO: 1263478 - protein, 9 aa, Homo Sapiens
AIKCEYMPN

SEQ ID NO: 1263479 - protein, 9 aa, Homo Sapiens
ISVCYILMI

SEQ ID NO: 1263480 - protein, 9 aa, Homo Sapiens
DKAYFITKE

SEQ ID NO: 1263481 - protein, 9 aa, Homo Sapiens
LSRIQNRRW

SEQ ID NO: 1263482 - protein, 9 aa, Homo Sapiens
GMAQKRIHA

SEQ ID NO: 1263483 - protein, 9 aa, Homo Sapiens
PKREHLSLA

SEQ ID NO: 1263484 - protein, 9 aa, Homo Sapiens
GGPEMAASP

SEQ ID NO: 1263485 - protein, 9 aa, Homo Sapiens
QDVPVPPPV

SEQ ID NO: 1263486 - protein, 9 aa, Homo Sapiens
NELQVSLFQ

SEQ ID NO: 1263487 - protein, 9 aa, Homo Sapiens
ASRTMIENF

SEQ ID NO: 1263488 - protein, 9 aa, Homo Sapiens
QSESHLAAR

SEQ ID NO: 1263489 - protein, 9 aa, Homo Sapiens
IGRCSDLVS

SEQ ID NO: 1263490 - protein, 9 aa, Homo Sapiens
RPSGSRAPA

SEQ ID NO: 1263491 - protein, 9 aa, Homo Sapiens
AWKKLSPGN

SEQ ID NO: 1263492 - protein, 9 aa, Homo Sapiens
GERPVQHHE

SEQ ID NO: 1263493 - protein, 9 aa, Homo Sapiens
LRHLNLEEE

SEQ ID NO: 1263494 - protein, 9 aa, Homo Sapiens
DIDECRIIP

SEQ ID NO: 1263495 - protein, 9 aa, Homo Sapiens
PSSWESCCR

SEQ ID NO: 1263496 - protein, 9 aa, Homo Sapiens
PSCKNVCFD

SEQ ID NO: 1263497 - protein, 9 aa, Homo Sapiens
PIMRSLKEL

SEQ ID NO: 1263498 - protein, 9 aa, Homo Sapiens
KVSMSKNTK

SEQ ID NO: 1263499 - protein, 9 aa, Homo Sapiens
TLMQKNWRH

SEQ ID NO: 1263500 - protein, 9 aa, Homo Sapiens
MLAGFITPL

SEQ ID NO: 1263501 - protein, 9 aa, Homo Sapiens
NTVSGLWDF

SEQ ID NO: 1263502 - protein, 9 aa, Homo Sapiens
DQYSISYTL

SEQ ID NO: 1263503 - protein, 9 aa, Homo Sapiens
PWMGYAAMA

SEQ ID NO: 1263504 - protein, 9 aa, Homo Sapiens
LLTPCPREW

SEQ ID NO: 1263505 - protein, 9 aa, Homo Sapiens
KSKKKKECQ

SEQ ID NO: 1263506 - protein, 9 aa, Homo Sapiens
RHWHWSSGS

SEQ ID NO: 1263507 - protein, 9 aa, Homo Sapiens
NSLTILDDE

SEQ ID NO: 1263508 - protein, 9 aa, Homo Sapiens
IVHATSNGQ

SEQ ID NO: 1263509 - protein, 9 aa, Homo Sapiens
MFGGNILHS

SEQ ID NO: 1263510 - protein, 9 aa, Homo Sapiens
CLNDVGGNL

SEQ ID NO: 1263511 - protein, 9 aa, Homo Sapiens
NNPPSSDVL

SEQ ID NO: 1263512 - protein, 9 aa, Homo Sapiens
RKTVQVTEK

SEQ ID NO: 1263513 - protein, 9 aa, Homo Sapiens
GRTMGLLVK

SEQ ID NO: 1263514 - protein, 9 aa, Homo Sapiens
AGTKVIVQV

SEQ ID NO: 1263515 - protein, 9 aa, Homo Sapiens
SWDRRRQLR

SEQ ID NO: 1263516 - protein, 9 aa, Homo Sapiens
TLQEFNGNL

SEQ ID NO: 1263517 - protein, 9 aa, Homo Sapiens
LKFNFNTYK

SEQ ID NO: 1263518 - protein, 9 aa, Homo Sapiens
SVWEQVTPQ

SEQ ID NO: 1263519 - protein, 9 aa, Homo Sapiens
AWAIPVPQI

SEQ ID NO: 1263520 - protein, 9 aa, Homo Sapiens
IQYKEAIDL

SEQ ID NO: 1263521 - protein, 9 aa, Homo Sapiens
GALRAVVQS

SEQ ID NO: 1263522 - protein, 9 aa, Homo Sapiens
TNIQTLDCP

SEQ ID NO: 1263523 - protein, 9 aa, Homo Sapiens
KVTRNLRQQ

SEQ ID NO: 1263524 - protein, 9 aa, Homo Sapiens
KRKCEMAFQ

SEQ ID NO: 1263525 - protein, 9 aa, Homo Sapiens
TGKVVCVFR

SEQ ID NO: 1263526 - protein, 9 aa, Homo Sapiens
PTLVKRKKR

SEQ ID NO: 1263527 - protein, 9 aa, Homo Sapiens
TDPKLTMEV

SEQ ID NO: 1263528 - protein, 9 aa, Homo Sapiens
QWQPLTVEH

SEQ ID NO: 1263529 - protein, 9 aa, Homo Sapiens
LLDKSINHQ

SEQ ID NO: 1263530 - protein, 9 aa, Homo Sapiens
ECQQCFSSL

SEQ ID NO: 1263531 - protein, 9 aa, Homo Sapiens
GKAFGLYSI

SEQ ID NO: 1263532 - protein, 9 aa, Homo Sapiens
KCGCRMVHM

SEQ ID NO: 1263533 - protein, 9 aa, Homo Sapiens
KKIESHFGY

SEQ ID NO: 1263534 - protein, 9 aa, Homo Sapiens
LRTLPGGPW

SEQ ID NO: 1263535 - protein, 9 aa, Homo Sapiens
VTRGRQPHV

SEQ ID NO: 1263536 - protein, 9 aa, Homo Sapiens
RHVDEFLLD

SEQ ID NO: 1263537 - protein, 9 aa, Homo Sapiens
GAAEKHVTI

SEQ ID NO: 1263538 - protein, 9 aa, Homo Sapiens
VKIECHSLD

SEQ ID NO: 1263539 - protein, 9 aa, Homo Sapiens
NHSPFTVSP

SEQ ID NO: 1263540 - protein, 9 aa, Homo Sapiens
GPDRCDNTA

SEQ ID NO: 1263541 - protein, 9 aa, Homo Sapiens
RDAILQRLD

SEQ ID NO: 1263542 - protein, 9 aa, Homo Sapiens
GDCMEKQMH

SEQ ID NO: 1263543 - protein, 9 aa, Homo Sapiens
VHHKIHTGE

SEQ ID NO: 1263544 - protein, 9 aa, Homo Sapiens
SKPDILNTI

SEQ ID NO: 1263545 - protein, 9 aa, Homo Sapiens
LATGKLCKL

SEQ ID NO: 1263546 - protein, 9 aa, Homo Sapiens
PVANAAGAE

SEQ ID NO: 1263547 - protein, 9 aa, Homo Sapiens
FVFASMRIL

SEQ ID NO: 1263548 - protein, 9 aa, Homo Sapiens
WLSEGRNAP

SEQ ID NO: 1263549 - protein, 9 aa, Homo Sapiens
PEMCQLFTT

SEQ ID NO: 1263550 - protein, 9 aa, Homo Sapiens
EIPVPGNLG

SEQ ID NO: 1263551 - protein, 9 aa, Homo Sapiens
NDSKGGEKE

SEQ ID NO: 1263552 - protein, 9 aa, Homo Sapiens
FVYQKVKLF

SEQ ID NO: 1263553 - protein, 9 aa, Homo Sapiens
LRYLLDVHL

SEQ ID NO: 1263554 - protein, 9 aa, Homo Sapiens
EESLKRCSF

SEQ ID NO: 1263555 - protein, 9 aa, Homo Sapiens
LFPVGYFVS

SEQ ID NO: 1263556 - protein, 9 aa, Homo Sapiens
LEIKVKRKN

SEQ ID NO: 1263557 - protein, 9 aa, Homo Sapiens
STTGKVIKC

SEQ ID NO: 1263558 - protein, 9 aa, Homo Sapiens
AVEVGAGSS

SEQ ID NO: 1263559 - protein, 9 aa, Homo Sapiens
SVTYQFGSV

SEQ ID NO: 1263560 - protein, 9 aa, Homo Sapiens
ELDEQGSAV

SEQ ID NO: 1263561 - protein, 9 aa, Homo Sapiens
QARIISDPA

SEQ ID NO: 1263562 - protein, 9 aa, Homo Sapiens
LQQNVTEVF

SEQ ID NO: 1263563 - protein, 9 aa, Homo Sapiens
VNRRLAQQS

SEQ ID NO: 1263564 - protein, 9 aa, Homo Sapiens
LVISWGTLG

SEQ ID NO: 1263565 - protein, 9 aa, Homo Sapiens
RYLLDDSVM

SEQ ID NO: 1263566 - protein, 9 aa, Homo Sapiens
MYQSELLSF

SEQ ID NO: 1263567 - protein, 9 aa, Homo Sapiens
CVVCHAPET

SEQ ID NO: 1263568 - protein, 9 aa, Homo Sapiens
TAHIFPVCS

SEQ ID NO: 1263569 - protein, 9 aa, Homo Sapiens
RNETELTEE

SEQ ID NO: 1263570 - protein, 9 aa, Homo Sapiens
VPRAEEEAV

SEQ ID NO: 1263571 - protein, 9 aa, Homo Sapiens
FLSSVSPSM

SEQ ID NO: 1263572 - protein, 9 aa, Homo Sapiens
HFSQARTRA

SEQ ID NO: 1263573 - protein, 9 aa, Homo Sapiens
PCPREWDSA

SEQ ID NO: 1263574 - protein, 9 aa, Homo Sapiens
GGSHQDCHE

SEQ ID NO: 1263575 - protein, 9 aa, Homo Sapiens
NISKQLPWV

SEQ ID NO: 1263576 - protein, 9 aa, Homo Sapiens
MYQWAQVKP

SEQ ID NO: 1263577 - protein, 9 aa, Homo Sapiens
VCESSGRLY

SEQ ID NO: 1263578 - protein, 9 aa, Homo Sapiens
KFDMEKIHS

SEQ ID NO: 1263579 - protein, 9 aa, Homo Sapiens
ALGSPPFRL

SEQ ID NO: 1263580 - protein, 9 aa, Homo Sapiens
LSEVDNGLR

SEQ ID NO: 1263581 - protein, 9 aa, Homo Sapiens
TGRKHQGRI

SEQ ID NO: 1263582 - protein, 9 aa, Homo Sapiens
TSPLERTRY

SEQ ID NO: 1263583 - protein, 9 aa, Homo Sapiens
IPQSVASAG

SEQ ID NO: 1263584 - protein, 9 aa, Homo Sapiens
SLCVSRGTF

SEQ ID NO: 1263585 - protein, 9 aa, Homo Sapiens
LMGLDAMVL

SEQ ID NO: 1263586 - protein, 9 aa, Homo Sapiens
IGVDHVRCS

SEQ ID NO: 1263587 - protein, 9 aa, Homo Sapiens
QCGKATCSD

SEQ ID NO: 1263588 - protein, 9 aa, Homo Sapiens
PPSLLHPHP

SEQ ID NO: 1263589 - protein, 9 aa, Homo Sapiens
FQKTRNGSF

SEQ ID NO: 1263590 - protein, 9 aa, Homo Sapiens
GAATKVMCI

SEQ ID NO: 1263591 - protein, 9 aa, Homo Sapiens
AGTPHHISV

SEQ ID NO: 1263592 - protein, 9 aa, Homo Sapiens
LLPSVSYFM

SEQ ID NO: 1263593 - protein, 9 aa, Homo Sapiens
DIATPKGSS

SEQ ID NO: 1263594 - protein, 9 aa, Homo Sapiens
NDCPHVFAK

SEQ ID NO: 1263595 - protein, 9 aa, Homo Sapiens
IHLLDSNVI

SEQ ID NO: 1263596 - protein, 9 aa, Homo Sapiens
FMKLHSGLM

SEQ ID NO: 1263597 - protein, 9 aa, Homo Sapiens
EPGGIGITL

SEQ ID NO: 1263598 - protein, 9 aa, Homo Sapiens
SGHLCDIRS

SEQ ID NO: 1263599 - protein, 9 aa, Homo Sapiens
FGKYDSHGS

SEQ ID NO: 1263600 - protein, 9 aa, Homo Sapiens
PCVHVPPSV

SEQ ID NO: 1263601 - protein, 9 aa, Homo Sapiens
GLLPGWGQW

SEQ ID NO: 1263602 - protein, 9 aa, Homo Sapiens
IHIAMCDDD

SEQ ID NO: 1263603 - protein, 9 aa, Homo Sapiens
TYVCCLNVG

SEQ ID NO: 1263604 - protein, 9 aa, Homo Sapiens
ITASDSGKY

SEQ ID NO: 1263605 - protein, 9 aa, Homo Sapiens
STKPWNGGM

SEQ ID NO: 1263606 - protein, 9 aa, Homo Sapiens
DEMEDEEEE

SEQ ID NO: 1263607 - protein, 9 aa, Homo Sapiens
LLRVVHVAG

SEQ ID NO: 1263608 - protein, 9 aa, Homo Sapiens
GEDVLFAMS

SEQ ID NO: 1263609 - protein, 9 aa, Homo Sapiens
FSETLRRPA

SEQ ID NO: 1263610 - protein, 9 aa, Homo Sapiens
FLYHVSTHE

SEQ ID NO: 1263611 - protein, 9 aa, Homo Sapiens
AMIRQNEIN

SEQ ID NO: 1263612 - protein, 9 aa, Homo Sapiens
DYIHLTFLK

SEQ ID NO: 1263613 - protein, 9 aa, Homo Sapiens
ELHQWQKKL

SEQ ID NO: 1263614 - protein, 9 aa, Homo Sapiens
HSTLSHDTR

SEQ ID NO: 1263615 - protein, 9 aa, Homo Sapiens
EERLQEQQR

SEQ ID NO: 1263616 - protein, 9 aa, Homo Sapiens
HDEDTCVEC

SEQ ID NO: 1263617 - protein, 9 aa, Homo Sapiens
KRANPCPSS

SEQ ID NO: 1263618 - protein, 9 aa, Homo Sapiens
QDASMDAQP

SEQ ID NO: 1263619 - protein, 9 aa, Homo Sapiens
PLPFDSMNT

SEQ ID NO: 1263620 - protein, 9 aa, Homo Sapiens
ANVPAGGQT

SEQ ID NO: 1263621 - protein, 9 aa, Homo Sapiens
CVMTGRTGH

SEQ ID NO: 1263622 - protein, 9 aa, Homo Sapiens
MGMGGFSQG

SEQ ID NO: 1263623 - protein, 9 aa, Homo Sapiens
PPAGYVSQV

SEQ ID NO: 1263624 - protein, 9 aa, Homo Sapiens
PESLGYLTS

SEQ ID NO: 1263625 - protein, 9 aa, Homo Sapiens
YEETPWDTL

SEQ ID NO: 1263626 - protein, 9 aa, Homo Sapiens
SFQNYTPKV

SEQ ID NO: 1263627 - protein, 9 aa, Homo Sapiens
SQPFRLENL

SEQ ID NO: 1263628 - protein, 9 aa, Homo Sapiens
GIKTLTQRY

SEQ ID NO: 1263629 - protein, 9 aa, Homo Sapiens
ALGLEGSGG

SEQ ID NO: 1263630 - protein, 9 aa, Homo Sapiens
PTFEDTVVA

SEQ ID NO: 1263631 - protein, 9 aa, Homo Sapiens
ETFEFVVVS

SEQ ID NO: 1263632 - protein, 9 aa, Homo Sapiens
EKEYTAMKS

SEQ ID NO: 1263633 - protein, 9 aa, Homo Sapiens
EPCQSSVSV

SEQ ID NO: 1263634 - protein, 9 aa, Homo Sapiens
GYCTFYDEC

SEQ ID NO: 1263635 - protein, 9 aa, Homo Sapiens
MRLNITIFF

SEQ ID NO: 1263636 - protein, 9 aa, Homo Sapiens
LENLTDEDA

SEQ ID NO: 1263637 - protein, 9 aa, Homo Sapiens
FHCDICDTS

SEQ ID NO: 1263638 - protein, 9 aa, Homo Sapiens
HGKDKECVL

SEQ ID NO: 1263639 - protein, 9 aa, Homo Sapiens
DGGWLTDGS

SEQ ID NO: 1263640 - protein, 9 aa, Homo Sapiens
DHFSRHDMI

SEQ ID NO: 1263641 - protein, 9 aa, Homo Sapiens
HTNISHVMQ

SEQ ID NO: 1263642 - protein, 9 aa, Homo Sapiens
GKPHFETSC

SEQ ID NO: 1263643 - protein, 9 aa, Homo Sapiens
SKDINKNKN

SEQ ID NO: 1263644 - protein, 9 aa, Homo Sapiens
PNAREEQPT

SEQ ID NO: 1263645 - protein, 9 aa, Homo Sapiens
PLIPVREQY

SEQ ID NO: 1263646 - protein, 9 aa, Homo Sapiens
PGAADFKTI

SEQ ID NO: 1263647 - protein, 9 aa, Homo Sapiens
INLVYFSEK

SEQ ID NO: 1263648 - protein, 9 aa, Homo Sapiens
RLRLVPPKT

SEQ ID NO: 1263649 - protein, 9 aa, Homo Sapiens
LDKWQVLHS

SEQ ID NO: 1263650 - protein, 9 aa, Homo Sapiens
CKGDMGGTR

SEQ ID NO: 1263651 - protein, 9 aa, Homo Sapiens
HIRRLDTYL

SEQ ID NO: 1263652 - protein, 9 aa, Homo Sapiens
GMTLKSVME

SEQ ID NO: 1263653 - protein, 9 aa, Homo Sapiens
DSAILLKVK

SEQ ID NO: 1263654 - protein, 9 aa, Homo Sapiens
YDRMEKSVN

SEQ ID NO: 1263655 - protein, 9 aa, Homo Sapiens
GLRERPVCC

SEQ ID NO: 1263656 - protein, 9 aa, Homo Sapiens
TCSSCHRPF

SEQ ID NO: 1263657 - protein, 9 aa, Homo Sapiens
IALFYGTTI

SEQ ID NO: 1263658 - protein, 9 aa, Homo Sapiens
LSSARAENT

SEQ ID NO: 1263659 - protein, 9 aa, Homo Sapiens
RTVAALSAD

SEQ ID NO: 1263660 - protein, 9 aa, Homo Sapiens
PVTAFVRAQ

SEQ ID NO: 1263661 - protein, 9 aa, Homo Sapiens
TVSGQNCCE

SEQ ID NO: 1263662 - protein, 9 aa, Homo Sapiens
ISQIGNDMG

SEQ ID NO: 1263663 - protein, 9 aa, Homo Sapiens
WAQEPSLVK

SEQ ID NO: 1263664 - protein, 9 aa, Homo Sapiens
KKGRCKVFS

SEQ ID NO: 1263665 - protein, 9 aa, Homo Sapiens
QEGLGGQRD

SEQ ID NO: 1263666 - protein, 9 aa, Homo Sapiens
ETRKCKAKS

SEQ ID NO: 1263667 - protein, 9 aa, Homo Sapiens
EPVVWVPTE

SEQ ID NO: 1263668 - protein, 9 aa, Homo Sapiens
DAVHAVLAY

SEQ ID NO: 1263669 - protein, 9 aa, Homo Sapiens
LPGTLAKST

SEQ ID NO: 1263670 - protein, 9 aa, Homo Sapiens
NPKQFAAVI

SEQ ID NO: 1263671 - protein, 9 aa, Homo Sapiens
LQSVVGIGV

SEQ ID NO: 1263672 - protein, 9 aa, Homo Sapiens
KEISQDECL

SEQ ID NO: 1263673 - protein, 9 aa, Homo Sapiens
GAGHVSSTY

SEQ ID NO: 1263674 - protein, 9 aa, Homo Sapiens
INIVVIGHM

SEQ ID NO: 1263675 - protein, 9 aa, Homo Sapiens
NYSQVAMMG

SEQ ID NO: 1263676 - protein, 9 aa, Homo Sapiens
EANTYESHI

SEQ ID NO: 1263677 - protein, 9 aa, Homo Sapiens
PDLQITVGA

SEQ ID NO: 1263678 - protein, 9 aa, Homo Sapiens
SKEEGTRRY

SEQ ID NO: 1263679 - protein, 9 aa, Homo Sapiens
THNAMVPLV

SEQ ID NO: 1263680 - protein, 9 aa, Homo Sapiens
KIQLLQSLQ

SEQ ID NO: 1263681 - protein, 9 aa, Homo Sapiens
PTSPPSLCH

SEQ ID NO: 1263682 - protein, 9 aa, Homo Sapiens
PSCKAKNIL

SEQ ID NO: 1263683 - protein, 9 aa, Homo Sapiens
LKQDLAKTM

SEQ ID NO: 1263684 - protein, 9 aa, Homo Sapiens
TTILEIKPS

SEQ ID NO: 1263685 - protein, 9 aa, Homo Sapiens
KLKGKLKNQ

SEQ ID NO: 1263686 - protein, 9 aa, Homo Sapiens
KCMVEKILV

SEQ ID NO: 1263687 - protein, 9 aa, Homo Sapiens
LCQRYYHRC

SEQ ID NO: 1263688 - protein, 9 aa, Homo Sapiens
GTEKVDDDV

SEQ ID NO: 1263689 - protein, 9 aa, Homo Sapiens
RGSTRLEAM

SEQ ID NO: 1263690 - protein, 9 aa, Homo Sapiens
RDSAHQPEM

SEQ ID NO: 1263691 - protein, 9 aa, Homo Sapiens
QENDRLFIV

SEQ ID NO: 1263692 - protein, 9 aa, Homo Sapiens
VIIIVGPGY

SEQ ID NO: 1263693 - protein, 9 aa, Homo Sapiens
SKRKNWQPL

SEQ ID NO: 1263694 - protein, 9 aa, Homo Sapiens
SYKASCEIC

SEQ ID NO: 1263695 - protein, 9 aa, Homo Sapiens
MVKKESIND

SEQ ID NO: 1263696 - protein, 9 aa, Homo Sapiens
SCAQHQRLN

SEQ ID NO: 1263697 - protein, 9 aa, Homo Sapiens
IDVDILRMK

SEQ ID NO: 1263698 - protein, 9 aa, Homo Sapiens
RWPYWAGLP

SEQ ID NO: 1263699 - protein, 9 aa, Homo Sapiens
IATLYLPLV

SEQ ID NO: 1263700 - protein, 9 aa, Homo Sapiens
INMITPSYF

SEQ ID NO: 1263701 - protein, 9 aa, Homo Sapiens
VQSYGPPHG

SEQ ID NO: 1263702 - protein, 9 aa, Homo Sapiens
LSMGGLGER

SEQ ID NO: 1263703 - protein, 9 aa, Homo Sapiens
QCPACRIPI

SEQ ID NO: 1263704 - protein, 9 aa, Homo Sapiens
EPTHTQVYI

SEQ ID NO: 1263705 - protein, 9 aa, Homo Sapiens
ISDNAVKIL

SEQ ID NO: 1263706 - protein, 9 aa, Homo Sapiens
LLVLSYIDL

SEQ ID NO: 1263707 - protein, 9 aa, Homo Sapiens
RSGECQSNG

SEQ ID NO: 1263708 - protein, 9 aa, Homo Sapiens
GFEGQSHYV

SEQ ID NO: 1263709 - protein, 9 aa, Homo Sapiens
DIRVIEECH

SEQ ID NO: 1263710 - protein, 9 aa, Homo Sapiens
LEKFGLHTI

SEQ ID NO: 1263711 - protein, 9 aa, Homo Sapiens
VLAISGKLC

SEQ ID NO: 1263712 - protein, 9 aa, Homo Sapiens
TFTYIPLLY

SEQ ID NO: 1263713 - protein, 9 aa, Homo Sapiens
HQCSGILQL

SEQ ID NO: 1263714 - protein, 9 aa, Homo Sapiens
AENKKSQIL

SEQ ID NO: 1263715 - protein, 9 aa, Homo Sapiens
PKHERCPWR

SEQ ID NO: 1263716 - protein, 9 aa, Homo Sapiens
YEDEEDEED

SEQ ID NO: 1263717 - protein, 9 aa, Homo Sapiens
YFVFYSFSE

SEQ ID NO: 1263718 - protein, 9 aa, Homo Sapiens
HRSQKSRSE

SEQ ID NO: 1263719 - protein, 9 aa, Homo Sapiens
TDVLYMVRF

SEQ ID NO: 1263720 - protein, 9 aa, Homo Sapiens
LKALVRYGA

SEQ ID NO: 1263721 - protein, 9 aa, Homo Sapiens
NLFLAMLYV

SEQ ID NO: 1263722 - protein, 9 aa, Homo Sapiens
ENDPQSGLY

SEQ ID NO: 1263723 - protein, 9 aa, Homo Sapiens
TVLFLPTDT

SEQ ID NO: 1263724 - protein, 9 aa, Homo Sapiens
FSGHMEVLT

SEQ ID NO: 1263725 - protein, 9 aa, Homo Sapiens
YYFLGIKYL

SEQ ID NO: 1263726 - protein, 9 aa, Homo Sapiens
SNHTFCWEQ

SEQ ID NO: 1263727 - protein, 9 aa, Homo Sapiens
LKETMGWVT

SEQ ID NO: 1263728 - protein, 9 aa, Homo Sapiens
NQRETYECC

SEQ ID NO: 1263729 - protein, 9 aa, Homo Sapiens
SCSSSPTPS

SEQ ID NO: 1263730 - protein, 9 aa, Homo Sapiens
VKLDDSRLI

SEQ ID NO: 1263731 - protein, 9 aa, Homo Sapiens
NLLLYQEGT

SEQ ID NO: 1263732 - protein, 9 aa, Homo Sapiens
MLTAQDMFY

SEQ ID NO: 1263733 - protein, 9 aa, Homo Sapiens
DGGSFLMFK

SEQ ID NO: 1263734 - protein, 9 aa, Homo Sapiens
LLVFLTHAL

SEQ ID NO: 1263735 - protein, 9 aa, Homo Sapiens
RHYDTDQDG

SEQ ID NO: 1263736 - protein, 9 aa, Homo Sapiens
AACPLDQAL

SEQ ID NO: 1263737 - protein, 9 aa, Homo Sapiens
NEFSGKVMQ

SEQ ID NO: 1263738 - protein, 9 aa, Homo Sapiens
TKSAHDCHE

SEQ ID NO: 1263739 - protein, 9 aa, Homo Sapiens
DRCARYPKM

SEQ ID NO: 1263740 - protein, 9 aa, Homo Sapiens
RRAPLQLPL

SEQ ID NO: 1263741 - protein, 9 aa, Homo Sapiens
AFNYLSVSK

SEQ ID NO: 1263742 - protein, 9 aa, Homo Sapiens
SAVLIYPDR

SEQ ID NO: 1263743 - protein, 9 aa, Homo Sapiens
AYFFTELNR

SEQ ID NO: 1263744 - protein, 9 aa, Homo Sapiens
QSVATFPDP

SEQ ID NO: 1263745 - protein, 9 aa, Homo Sapiens
CPSSSNEHA

SEQ ID NO: 1263746 - protein, 9 aa, Homo Sapiens
GNGKILKAC

SEQ ID NO: 1263747 - protein, 9 aa, Homo Sapiens
MSISSALAI

SEQ ID NO: 1263748 - protein, 9 aa, Homo Sapiens
HNDDTKLLV

SEQ ID NO: 1263749 - protein, 9 aa, Homo Sapiens
VVGFCLLIM

SEQ ID NO: 1263750 - protein, 9 aa, Homo Sapiens
NSAEICQYV

SEQ ID NO: 1263751 - protein, 9 aa, Homo Sapiens
LSAVCFMEE

SEQ ID NO: 1263752 - protein, 9 aa, Homo Sapiens
LKATVINYL

SEQ ID NO: 1263753 - protein, 9 aa, Homo Sapiens
LRAYNSDGL

SEQ ID NO: 1263754 - protein, 9 aa, Homo Sapiens
FFCKHLGCT

SEQ ID NO: 1263755 - protein, 9 aa, Homo Sapiens
HPRNTPSGP

SEQ ID NO: 1263756 - protein, 9 aa, Homo Sapiens
VGPGGLFPA

SEQ ID NO: 1263757 - protein, 9 aa, Homo Sapiens
RDHATLKLF

SEQ ID NO: 1263758 - protein, 9 aa, Homo Sapiens
LGDFEAVWD

SEQ ID NO: 1263759 - protein, 9 aa, Homo Sapiens
KQVWEWKEQ

SEQ ID NO: 1263760 - protein, 9 aa, Homo Sapiens
DDIEHTMEE

SEQ ID NO: 1263761 - protein, 9 aa, Homo Sapiens
YTTHSLIKG

SEQ ID NO: 1263762 - protein, 9 aa, Homo Sapiens
TQASEATQV

SEQ ID NO: 1263763 - protein, 9 aa, Homo Sapiens
GEITMCEPE

SEQ ID NO: 1263764 - protein, 9 aa, Homo Sapiens
HSPEYASLV

SEQ ID NO: 1263765 - protein, 9 aa, Homo Sapiens
HQALGGDDF

SEQ ID NO: 1263766 - protein, 9 aa, Homo Sapiens
IHHMFVRDE

SEQ ID NO: 1263767 - protein, 9 aa, Homo Sapiens
TRIFEMRKK

SEQ ID NO: 1263768 - protein, 9 aa, Homo Sapiens
GTDVNMFNT

SEQ ID NO: 1263769 - protein, 9 aa, Homo Sapiens
ELNVEKTEK

SEQ ID NO: 1263770 - protein, 9 aa, Homo Sapiens
ALQATIARK

SEQ ID NO: 1263771 - protein, 9 aa, Homo Sapiens
AWFEISELE

SEQ ID NO: 1263772 - protein, 9 aa, Homo Sapiens
SMQHLPATL

SEQ ID NO: 1263773 - protein, 9 aa, Homo Sapiens
LSWSFRNIY

SEQ ID NO: 1263774 - protein, 9 aa, Homo Sapiens
FGIPVVVAM

SEQ ID NO: 1263775 - protein, 9 aa, Homo Sapiens
TQEVIPLLL

SEQ ID NO: 1263776 - protein, 9 aa, Homo Sapiens
AVCFMEELG

SEQ ID NO: 1263777 - protein, 9 aa, Homo Sapiens
NNKTMNWAE

SEQ ID NO: 1263778 - protein, 9 aa, Homo Sapiens
SFEDLLHTI

SEQ ID NO: 1263779 - protein, 9 aa, Homo Sapiens
MSFLGGGID

SEQ ID NO: 1263780 - protein, 9 aa, Homo Sapiens
QSPHRQTRP

SEQ ID NO: 1263781 - protein, 9 aa, Homo Sapiens
MLNDGSSDM

SEQ ID NO: 1263782 - protein, 9 aa, Homo Sapiens
VLTIVPHPG

SEQ ID NO: 1263783 - protein, 9 aa, Homo Sapiens
QSSPPTLRC

SEQ ID NO: 1263784 - protein, 9 aa, Homo Sapiens
MGFFCLMVA

SEQ ID NO: 1263785 - protein, 9 aa, Homo Sapiens
HTQVYIRTP

SEQ ID NO: 1263786 - protein, 9 aa, Homo Sapiens
RPYFELNAQ

SEQ ID NO: 1263787 - protein, 9 aa, Homo Sapiens
RSPSAPDDQ

SEQ ID NO: 1263788 - protein, 9 aa, Homo Sapiens
MCFLRRSGA

SEQ ID NO: 1263789 - protein, 9 aa, Homo Sapiens
DKNDSVDAQ

SEQ ID NO: 1263790 - protein, 9 aa, Homo Sapiens
NYKDIMKEK

SEQ ID NO: 1263791 - protein, 9 aa, Homo Sapiens
LSSDVRYKM

SEQ ID NO: 1263792 - protein, 9 aa, Homo Sapiens
PDADALIVY

SEQ ID NO: 1263793 - protein, 9 aa, Homo Sapiens
ASTLVISLA

SEQ ID NO: 1263794 - protein, 9 aa, Homo Sapiens
RDYKRLWAG

SEQ ID NO: 1263795 - protein, 9 aa, Homo Sapiens
AEPGYLVIK

SEQ ID NO: 1263796 - protein, 9 aa, Homo Sapiens
VVVVTELGP

SEQ ID NO: 1263797 - protein, 9 aa, Homo Sapiens
IQPLDDDDV

SEQ ID NO: 1263798 - protein, 9 aa, Homo Sapiens
IFPPPLPAL

SEQ ID NO: 1263799 - protein, 9 aa, Homo Sapiens
THSPFRAHS

SEQ ID NO: 1263800 - protein, 9 aa, Homo Sapiens
PAKKPEPNA

SEQ ID NO: 1263801 - protein, 9 aa, Homo Sapiens
LTPASQPCT

SEQ ID NO: 1263802 - protein, 9 aa, Homo Sapiens
LRKGDVMIA

SEQ ID NO: 1263803 - protein, 9 aa, Homo Sapiens
ADSAPCDWF

SEQ ID NO: 1263804 - protein, 9 aa, Homo Sapiens
HIHVYENGG

SEQ ID NO: 1263805 - protein, 9 aa, Homo Sapiens
SVDARQELG

SEQ ID NO: 1263806 - protein, 9 aa, Homo Sapiens
SQVSESLWQ

SEQ ID NO: 1263807 - protein, 9 aa, Homo Sapiens
ALGMFNSSL

SEQ ID NO: 1263808 - protein, 9 aa, Homo Sapiens
DFVQFECGE

SEQ ID NO: 1263809 - protein, 9 aa, Homo Sapiens
EELASAILK

SEQ ID NO: 1263810 - protein, 9 aa, Homo Sapiens
FTFTTQQTT

SEQ ID NO: 1263811 - protein, 9 aa, Homo Sapiens
EMEGFFALH

SEQ ID NO: 1263812 - protein, 9 aa, Homo Sapiens
VLHYIIISV

SEQ ID NO: 1263813 - protein, 9 aa, Homo Sapiens
CGHNYLLTA

SEQ ID NO: 1263814 - protein, 9 aa, Homo Sapiens
LPALPAPGH

SEQ ID NO: 1263815 - protein, 9 aa, Homo Sapiens
VNIKSSSRY

SEQ ID NO: 1263816 - protein, 9 aa, Homo Sapiens
CPKCVNKKK

SEQ ID NO: 1263817 - protein, 9 aa, Homo Sapiens
HMLTTNLFI

SEQ ID NO: 1263818 - protein, 9 aa, Homo Sapiens
PEDKSQSKH

SEQ ID NO: 1263819 - protein, 9 aa, Homo Sapiens
LFLTQPGAG

SEQ ID NO: 1263820 - protein, 9 aa, Homo Sapiens
PIEKIVTDI

SEQ ID NO: 1263821 - protein, 9 aa, Homo Sapiens
EVLQKRLDE

SEQ ID NO: 1263822 - protein, 9 aa, Homo Sapiens
HRMPRNPWE

SEQ ID NO: 1263823 - protein, 9 aa, Homo Sapiens
LQINEFSGK

SEQ ID NO: 1263824 - protein, 9 aa, Homo Sapiens
GSEGSMQTL

SEQ ID NO: 1263825 - protein, 9 aa, Homo Sapiens
VTAGVHHHT

SEQ ID NO: 1263826 - protein, 9 aa, Homo Sapiens
GLWNEDYNP

SEQ ID NO: 1263827 - protein, 9 aa, Homo Sapiens
TVMHRMIGL

SEQ ID NO: 1263828 - protein, 9 aa, Homo Sapiens
DNIFDLNNG

SEQ ID NO: 1263829 - protein, 9 aa, Homo Sapiens
GLVIMAKEG

SEQ ID NO: 1263830 - protein, 9 aa, Homo Sapiens
IFVIIVSIS

SEQ ID NO: 1263831 - protein, 9 aa, Homo Sapiens
ADKKKRLKL

SEQ ID NO: 1263832 - protein, 9 aa, Homo Sapiens
RNERERNHV

SEQ ID NO: 1263833 - protein, 9 aa, Homo Sapiens
YPAQETLNS

SEQ ID NO: 1263834 - protein, 9 aa, Homo Sapiens
CSSVDTRGR

SEQ ID NO: 1263835 - protein, 9 aa, Homo Sapiens
EALHSLREA

SEQ ID NO: 1263836 - protein, 9 aa, Homo Sapiens
YLSCRRWKR

SEQ ID NO: 1263837 - protein, 9 aa, Homo Sapiens
LPPEKEARV

SEQ ID NO: 1263838 - protein, 9 aa, Homo Sapiens
AEDNYGYDE

SEQ ID NO: 1263839 - protein, 9 aa, Homo Sapiens
ILEIKPSFF

SEQ ID NO: 1263840 - protein, 9 aa, Homo Sapiens
VHAALGGAG

SEQ ID NO: 1263841 - protein, 9 aa, Homo Sapiens
AQPPGPPAS

SEQ ID NO: 1263842 - protein, 9 aa, Homo Sapiens
WGEEVAVKI

SEQ ID NO: 1263843 - protein, 9 aa, Homo Sapiens
ERKRNIFRK

SEQ ID NO: 1263844 - protein, 9 aa, Homo Sapiens
LLHPHPQFA

SEQ ID NO: 1263845 - protein, 9 aa, Homo Sapiens
NLHLDQMPS

SEQ ID NO: 1263846 - protein, 9 aa, Homo Sapiens
LGVVHMSFG

SEQ ID NO: 1263847 - protein, 9 aa, Homo Sapiens
PLMNIEGEL

SEQ ID NO: 1263848 - protein, 9 aa, Homo Sapiens
LGRRSKRPQ

SEQ ID NO: 1263849 - protein, 9 aa, Homo Sapiens
IFLFVDKTF

SEQ ID NO: 1263850 - protein, 9 aa, Homo Sapiens
QSSPLTTHK

SEQ ID NO: 1263851 - protein, 9 aa, Homo Sapiens
PLFTSLLNN

SEQ ID NO: 1263852 - protein, 9 aa, Homo Sapiens
VLPHSTKAR

SEQ ID NO: 1263853 - protein, 9 aa, Homo Sapiens
EVFTKVYKV

SEQ ID NO: 1263854 - protein, 9 aa, Homo Sapiens
WEQEHSNAF

SEQ ID NO: 1263855 - protein, 9 aa, Homo Sapiens
QEVASTASR

SEQ ID NO: 1263856 - protein, 9 aa, Homo Sapiens
LGTDWPKDL

SEQ ID NO: 1263857 - protein, 9 aa, Homo Sapiens
ADSGRYQLH

SEQ ID NO: 1263858 - protein, 9 aa, Homo Sapiens
WHPVSREWT

SEQ ID NO: 1263859 - protein, 9 aa, Homo Sapiens
MQDYTASVD

SEQ ID NO: 1263860 - protein, 9 aa, Homo Sapiens
KIDGEDGIF

SEQ ID NO: 1263861 - protein, 9 aa, Homo Sapiens
FYPWTIDNT

SEQ ID NO: 1263862 - protein, 9 aa, Homo Sapiens
TKMVVYPWQ

SEQ ID NO: 1263863 - protein, 9 aa, Homo Sapiens
QELDEKPAS

SEQ ID NO: 1263864 - protein, 9 aa, Homo Sapiens
PFSGNLRMP

SEQ ID NO: 1263865 - protein, 9 aa, Homo Sapiens
DESAMSFIH

SEQ ID NO: 1263866 - protein, 9 aa, Homo Sapiens
QSQRLPWPC

SEQ ID NO: 1263867 - protein, 9 aa, Homo Sapiens
VLLFGTCAI

SEQ ID NO: 1263868 - protein, 9 aa, Homo Sapiens
LPAGPPHHR

SEQ ID NO: 1263869 - protein, 9 aa, Homo Sapiens
ERTVIQIIH

SEQ ID NO: 1263870 - protein, 9 aa, Homo Sapiens
NDIHITARI

SEQ ID NO: 1263871 - protein, 9 aa, Homo Sapiens
QKDAWVWDN

SEQ ID NO: 1263872 - protein, 9 aa, Homo Sapiens
GEESLQSCI

SEQ ID NO: 1263873 - protein, 9 aa, Homo Sapiens
RQGREHPSC

SEQ ID NO: 1263874 - protein, 9 aa, Homo Sapiens
NDFMNVLPE

SEQ ID NO: 1263875 - protein, 9 aa, Homo Sapiens
LRHPPQAPL

SEQ ID NO: 1263876 - protein, 9 aa, Homo Sapiens
RAGPRPGGG

SEQ ID NO: 1263877 - protein, 9 aa, Homo Sapiens
RKITDPCLQ

SEQ ID NO: 1263878 - protein, 9 aa, Homo Sapiens
AASPSTHSI

SEQ ID NO: 1263879 - protein, 9 aa, Homo Sapiens
DLEIGSHHL

SEQ ID NO: 1263880 - protein, 9 aa, Homo Sapiens
EECLVDAAG

SEQ ID NO: 1263881 - protein, 9 aa, Homo Sapiens
FYYSSSFTQ

SEQ ID NO: 1263882 - protein, 9 aa, Homo Sapiens
CRLEQGQQC

SEQ ID NO: 1263883 - protein, 9 aa, Homo Sapiens
PMMQAHLDE

SEQ ID NO: 1263884 - protein, 9 aa, Homo Sapiens
LYGTSMQPY

SEQ ID NO: 1263885 - protein, 9 aa, Homo Sapiens
WLPRSGNTS

SEQ ID NO: 1263886 - protein, 9 aa, Homo Sapiens
HLAYVTIMG

SEQ ID NO: 1263887 - protein, 9 aa, Homo Sapiens
MLLKESYKT

SEQ ID NO: 1263888 - protein, 9 aa, Homo Sapiens
LFSCNSPQP

SEQ ID NO: 1263889 - protein, 9 aa, Homo Sapiens
AAPQWCGWR

SEQ ID NO: 1263890 - protein, 9 aa, Homo Sapiens
LGHFYECCI

SEQ ID NO: 1263891 - protein, 9 aa, Homo Sapiens
PKYFSAFIN

SEQ ID NO: 1263892 - protein, 9 aa, Homo Sapiens
ETTQAPRLL

SEQ ID NO: 1263893 - protein, 9 aa, Homo Sapiens
SSQGVSVNP

SEQ ID NO: 1263894 - protein, 9 aa, Homo Sapiens
PKSHYFLRQ

SEQ ID NO: 1263895 - protein, 9 aa, Homo Sapiens
TCVRHWHLW

SEQ ID NO: 1263896 - protein, 9 aa, Homo Sapiens
YNKGYKGLD

SEQ ID NO: 1263897 - protein, 9 aa, Homo Sapiens
IFRKLKVLQ

SEQ ID NO: 1263898 - protein, 9 aa, Homo Sapiens
KNHCDCNVD

SEQ ID NO: 1263899 - protein, 9 aa, Homo Sapiens
KKDSIMGLQ

SEQ ID NO: 1263900 - protein, 9 aa, Homo Sapiens
IQTQNKASR

SEQ ID NO: 1263901 - protein, 9 aa, Homo Sapiens
NCTSRLDVH

SEQ ID NO: 1263902 - protein, 9 aa, Homo Sapiens
QVDVFCLPW

SEQ ID NO: 1263903 - protein, 9 aa, Homo Sapiens
KRMNFLHHP

SEQ ID NO: 1263904 - protein, 9 aa, Homo Sapiens
MSCSTEAYM

SEQ ID NO: 1263905 - protein, 9 aa, Homo Sapiens
GPHSCIGEI

SEQ ID NO: 1263906 - protein, 9 aa, Homo Sapiens
HLQAKIKAV

SEQ ID NO: 1263907 - protein, 9 aa, Homo Sapiens
EDHHLPRLC

SEQ ID NO: 1263908 - protein, 9 aa, Homo Sapiens
GRCDSIHFA

SEQ ID NO: 1263909 - protein, 9 aa, Homo Sapiens
PGPRHWSSL

SEQ ID NO: 1263910 - protein, 9 aa, Homo Sapiens
EAAPVCIVM

SEQ ID NO: 1263911 - protein, 9 aa, Homo Sapiens
DVPCTNGHS

SEQ ID NO: 1263912 - protein, 9 aa, Homo Sapiens
SVQVTTIQD

SEQ ID NO: 1263913 - protein, 9 aa, Homo Sapiens
HGFLGQVWC

SEQ ID NO: 1263914 - protein, 9 aa, Homo Sapiens
RIHVEFQLS

SEQ ID NO: 1263915 - protein, 9 aa, Homo Sapiens
RHMQLHMGI

SEQ ID NO: 1263916 - protein, 9 aa, Homo Sapiens
HWSSLSLRV

SEQ ID NO: 1263917 - protein, 9 aa, Homo Sapiens
SQGFFQSFS

SEQ ID NO: 1263918 - protein, 9 aa, Homo Sapiens
HFSHTIRCT

SEQ ID NO: 1263919 - protein, 9 aa, Homo Sapiens
VVVSYVVAD

SEQ ID NO: 1263920 - protein, 9 aa, Homo Sapiens
RGSPGGPGF

SEQ ID NO: 1263921 - protein, 9 aa, Homo Sapiens
PTWPTQTWT

SEQ ID NO: 1263922 - protein, 9 aa, Homo Sapiens
DSVDIERMS

SEQ ID NO: 1263923 - protein, 9 aa, Homo Sapiens
SENHTDETL

SEQ ID NO: 1263924 - protein, 9 aa, Homo Sapiens
STGRASPAP

SEQ ID NO: 1263925 - protein, 9 aa, Homo Sapiens
AAVGKPDFF

SEQ ID NO: 1263926 - protein, 9 aa, Homo Sapiens
LTLTRICTV

SEQ ID NO: 1263927 - protein, 9 aa, Homo Sapiens
EFLHQGQLE

SEQ ID NO: 1263928 - protein, 9 aa, Homo Sapiens
PAISPKSSL

SEQ ID NO: 1263929 - protein, 9 aa, Homo Sapiens
SFSAPCCWR

SEQ ID NO: 1263930 - protein, 9 aa, Homo Sapiens
NYITMDPVQ

SEQ ID NO: 1263931 - protein, 9 aa, Homo Sapiens
TVAALSADA

SEQ ID NO: 1263932 - protein, 9 aa, Homo Sapiens
PEYTVWQLT

SEQ ID NO: 1263933 - protein, 9 aa, Homo Sapiens
SDQDVCKIS

SEQ ID NO: 1263934 - protein, 9 aa, Homo Sapiens
RKWDDYRVG

SEQ ID NO: 1263935 - protein, 9 aa, Homo Sapiens
TFVLFLNDL

SEQ ID NO: 1263936 - protein, 9 aa, Homo Sapiens
WEQVTPQTG

SEQ ID NO: 1263937 - protein, 9 aa, Homo Sapiens
GSYQCHSWE

SEQ ID NO: 1263938 - protein, 9 aa, Homo Sapiens
PLQDSPKCF

SEQ ID NO: 1263939 - protein, 9 aa, Homo Sapiens
IEKHQQVRA

SEQ ID NO: 1263940 - protein, 9 aa, Homo Sapiens
RECGKSFPS

SEQ ID NO: 1263941 - protein, 9 aa, Homo Sapiens
CGKTCLLIF

SEQ ID NO: 1263942 - protein, 9 aa, Homo Sapiens
YENSHSHEE

SEQ ID NO: 1263943 - protein, 9 aa, Homo Sapiens
KKENEIRVV

SEQ ID NO: 1263944 - protein, 9 aa, Homo Sapiens
INVTDADSV

SEQ ID NO: 1263945 - protein, 9 aa, Homo Sapiens
GKDEDAKKN

SEQ ID NO: 1263946 - protein, 9 aa, Homo Sapiens
VKDSYAARN

SEQ ID NO: 1263947 - protein, 9 aa, Homo Sapiens
SSAQDFWTF

SEQ ID NO: 1263948 - protein, 9 aa, Homo Sapiens
NDCNQGNQV

SEQ ID NO: 1263949 - protein, 9 aa, Homo Sapiens
RNTTIPAKQ

SEQ ID NO: 1263950 - protein, 9 aa, Homo Sapiens
YRILDDKGG

SEQ ID NO: 1263951 - protein, 9 aa, Homo Sapiens
KAKNDVVKI

SEQ ID NO: 1263952 - protein, 9 aa, Homo Sapiens
AGYRLEELE

SEQ ID NO: 1263953 - protein, 9 aa, Homo Sapiens
ELGNHYQLP

SEQ ID NO: 1263954 - protein, 9 aa, Homo Sapiens
YINIFMTDA

SEQ ID NO: 1263955 - protein, 9 aa, Homo Sapiens
QEALNSDGW

SEQ ID NO: 1263956 - protein, 9 aa, Homo Sapiens
ADMKSDNVK

SEQ ID NO: 1263957 - protein, 9 aa, Homo Sapiens
FAVETYSVR

SEQ ID NO: 1263958 - protein, 9 aa, Homo Sapiens
INIIVTQNG

SEQ ID NO: 1263959 - protein, 9 aa, Homo Sapiens
TITTIVQTG

SEQ ID NO: 1263960 - protein, 9 aa, Homo Sapiens
DVLKIHVLE

SEQ ID NO: 1263961 - protein, 9 aa, Homo Sapiens
NMQSLSGEC

SEQ ID NO: 1263962 - protein, 9 aa, Homo Sapiens
ACCDDMALS

SEQ ID NO: 1263963 - protein, 9 aa, Homo Sapiens
AFTKTHHAY

SEQ ID NO: 1263964 - protein, 9 aa, Homo Sapiens
EAQMVERPT

SEQ ID NO: 1263965 - protein, 9 aa, Homo Sapiens
NSPQPWSLQ

SEQ ID NO: 1263966 - protein, 9 aa, Homo Sapiens
ITSTSAPVR

SEQ ID NO: 1263967 - protein, 9 aa, Homo Sapiens
PNVLPHPTP

SEQ ID NO: 1263968 - protein, 9 aa, Homo Sapiens
QCLALRVVV

SEQ ID NO: 1263969 - protein, 9 aa, Homo Sapiens
ILYVTEPET

SEQ ID NO: 1263970 - protein, 9 aa, Homo Sapiens
ESEEDHSAG

SEQ ID NO: 1263971 - protein, 9 aa, Homo Sapiens
PKCKKEYQI

SEQ ID NO: 1263972 - protein, 9 aa, Homo Sapiens
TQCLLFITL

SEQ ID NO: 1263973 - protein, 9 aa, Homo Sapiens
DNDCNQGNQ

SEQ ID NO: 1263974 - protein, 9 aa, Homo Sapiens
PAIYYVMSG

SEQ ID NO: 1263975 - protein, 9 aa, Homo Sapiens
AFYVVECIT

SEQ ID NO: 1263976 - protein, 9 aa, Homo Sapiens
PDAMLDKTC

SEQ ID NO: 1263977 - protein, 9 aa, Homo Sapiens
DKECVLEAE

SEQ ID NO: 1263978 - protein, 9 aa, Homo Sapiens
VKRSHSFSK

SEQ ID NO: 1263979 - protein, 9 aa, Homo Sapiens
RDSDEYGDK

SEQ ID NO: 1263980 - protein, 9 aa, Homo Sapiens
RISRISCLY

SEQ ID NO: 1263981 - protein, 9 aa, Homo Sapiens
EQAEMMLKE

SEQ ID NO: 1263982 - protein, 9 aa, Homo Sapiens
DCMTALGLA

SEQ ID NO: 1263983 - protein, 9 aa, Homo Sapiens
VMDAVPVRR

SEQ ID NO: 1263984 - protein, 9 aa, Homo Sapiens
GADPRRLLH

SEQ ID NO: 1263985 - protein, 9 aa, Homo Sapiens
PGRIRTVGI

SEQ ID NO: 1263986 - protein, 9 aa, Homo Sapiens
TNAEVKLHG

SEQ ID NO: 1263987 - protein, 9 aa, Homo Sapiens
SVFPVFVTS

SEQ ID NO: 1263988 - protein, 9 aa, Homo Sapiens
KKEVKKRSR

SEQ ID NO: 1263989 - protein, 9 aa, Homo Sapiens
GGKVMKILR

SEQ ID NO: 1263990 - protein, 9 aa, Homo Sapiens
LLWITSALS

SEQ ID NO: 1263991 - protein, 9 aa, Homo Sapiens
HPLDIQILH

SEQ ID NO: 1263992 - protein, 9 aa, Homo Sapiens
VIFVIWAVT

SEQ ID NO: 1263993 - protein, 9 aa, Homo Sapiens
RQLLRQRGI

SEQ ID NO: 1263994 - protein, 9 aa, Homo Sapiens
LGSTQDHVL

SEQ ID NO: 1263995 - protein, 9 aa, Homo Sapiens
RKFVGDVKR

SEQ ID NO: 1263996 - protein, 9 aa, Homo Sapiens
MHLSALLAL

SEQ ID NO: 1263997 - protein, 9 aa, Homo Sapiens
PTRKVAVQP

SEQ ID NO: 1263998 - protein, 9 aa, Homo Sapiens
LYDCRQVTR

SEQ ID NO: 1263999 - protein, 9 aa, Homo Sapiens
VTAKLTSID

SEQ ID NO: 1264000 - protein, 9 aa, Homo Sapiens
TVLLMGGAS

SEQ ID NO: 1264001 - protein, 9 aa, Homo Sapiens
CGCRMVHMP

SEQ ID NO: 1264002 - protein, 9 aa, Homo Sapiens
LTLEGRTGI

SEQ ID NO: 1264003 - protein, 9 aa, Homo Sapiens
KEHLMLEEL

SEQ ID NO: 1264004 - protein, 9 aa, Homo Sapiens
EATSDRIKQ

SEQ ID NO: 1264005 - protein, 9 aa, Homo Sapiens
QIYAGLKSA

SEQ ID NO: 1264006 - protein, 9 aa, Homo Sapiens
QLEEECTNE

SEQ ID NO: 1264007 - protein, 9 aa, Homo Sapiens
FSSKVTLQN

SEQ ID NO: 1264008 - protein, 9 aa, Homo Sapiens
VNALKNPHL

SEQ ID NO: 1264009 - protein, 9 aa, Homo Sapiens
TFITLSREH

SEQ ID NO: 1264010 - protein, 9 aa, Homo Sapiens
EEPEGGFNK

SEQ ID NO: 1264011 - protein, 9 aa, Homo Sapiens
LQLVEWLQG

SEQ ID NO: 1264012 - protein, 9 aa, Homo Sapiens
CIANNAAGN

SEQ ID NO: 1264013 - protein, 9 aa, Homo Sapiens
KVTYHVTSS

SEQ ID NO: 1264014 - protein, 9 aa, Homo Sapiens
VLKTWLTLR

SEQ ID NO: 1264015 - protein, 9 aa, Homo Sapiens
SITNILKGQ

SEQ ID NO: 1264016 - protein, 9 aa, Homo Sapiens
QQVRAKSHS

SEQ ID NO: 1264017 - protein, 9 aa, Homo Sapiens
LKTLNEQHL

SEQ ID NO: 1264018 - protein, 9 aa, Homo Sapiens
NVGRQGIFP

SEQ ID NO: 1264019 - protein, 9 aa, Homo Sapiens
TTHQTSVYL

SEQ ID NO: 1264020 - protein, 9 aa, Homo Sapiens
YVYDDLKQK

SEQ ID NO: 1264021 - protein, 9 aa, Homo Sapiens
NEANYLRVQ

SEQ ID NO: 1264022 - protein, 9 aa, Homo Sapiens
QPQSKFNFT

SEQ ID NO: 1264023 - protein, 9 aa, Homo Sapiens
GRRYLHVAN

SEQ ID NO: 1264024 - protein, 9 aa, Homo Sapiens
AEGMWLPQL

SEQ ID NO: 1264025 - protein, 9 aa, Homo Sapiens
IKLDDSDIP

SEQ ID NO: 1264026 - protein, 9 aa, Homo Sapiens
LPNNKCIYF

SEQ ID NO: 1264027 - protein, 9 aa, Homo Sapiens
CDSLNSVTL

SEQ ID NO: 1264028 - protein, 9 aa, Homo Sapiens
ILRISLREL

SEQ ID NO: 1264029 - protein, 9 aa, Homo Sapiens
KGTVKVEAG

SEQ ID NO: 1264030 - protein, 9 aa, Homo Sapiens
MPRASTPHP

SEQ ID NO: 1264031 - protein, 9 aa, Homo Sapiens
MYGGNPVSC

SEQ ID NO: 1264032 - protein, 9 aa, Homo Sapiens
AAGTEEMDI

SEQ ID NO: 1264033 - protein, 9 aa, Homo Sapiens
APTLLATQA

SEQ ID NO: 1264034 - protein, 9 aa, Homo Sapiens
RSPVFNAIF

SEQ ID NO: 1264035 - protein, 9 aa, Homo Sapiens
SMLHGAVSL

SEQ ID NO: 1264036 - protein, 9 aa, Homo Sapiens
LALIYWVSV

SEQ ID NO: 1264037 - protein, 9 aa, Homo Sapiens
EIDAIYKDL

SEQ ID NO: 1264038 - protein, 9 aa, Homo Sapiens
FLPERKCFP

SEQ ID NO: 1264039 - protein, 9 aa, Homo Sapiens
QALDFQLKK

SEQ ID NO: 1264040 - protein, 9 aa, Homo Sapiens
LNAAYGVEN

SEQ ID NO: 1264041 - protein, 9 aa, Homo Sapiens
GDDDEDTER

SEQ ID NO: 1264042 - protein, 9 aa, Homo Sapiens
SPPTLRCSA

SEQ ID NO: 1264043 - protein, 9 aa, Homo Sapiens
QKKHFNSLY

SEQ ID NO: 1264044 - protein, 9 aa, Homo Sapiens
KYIKAKVIR

SEQ ID NO: 1264045 - protein, 9 aa, Homo Sapiens
EDFKGYLGY

SEQ ID NO: 1264046 - protein, 9 aa, Homo Sapiens
KIFYMLNTL

SEQ ID NO: 1264047 - protein, 9 aa, Homo Sapiens
VDYKSGPPM

SEQ ID NO: 1264048 - protein, 9 aa, Homo Sapiens
SGLAACGTC

SEQ ID NO: 1264049 - protein, 9 aa, Homo Sapiens
NHCLAPENS

SEQ ID NO: 1264050 - protein, 9 aa, Homo Sapiens
PNCRLCNTP

SEQ ID NO: 1264051 - protein, 9 aa, Homo Sapiens
RPEVAAAEE

SEQ ID NO: 1264052 - protein, 9 aa, Homo Sapiens
QSHTGESHF

SEQ ID NO: 1264053 - protein, 9 aa, Homo Sapiens
QAGKPKTIA

SEQ ID NO: 1264054 - protein, 9 aa, Homo Sapiens
GTPYAGRFK

SEQ ID NO: 1264055 - protein, 9 aa, Homo Sapiens
LYHGLICDQ

SEQ ID NO: 1264056 - protein, 9 aa, Homo Sapiens
VNHIIYGFF

SEQ ID NO: 1264057 - protein, 9 aa, Homo Sapiens
LERHMLIHV

SEQ ID NO: 1264058 - protein, 9 aa, Homo Sapiens
FLCLKRHVN

SEQ ID NO: 1264059 - protein, 9 aa, Homo Sapiens
FSVLVCPPP

SEQ ID NO: 1264060 - protein, 9 aa, Homo Sapiens
GVNDVSGPV

SEQ ID NO: 1264061 - protein, 9 aa, Homo Sapiens
VIWAVTFCS

SEQ ID NO: 1264062 - protein, 9 aa, Homo Sapiens
ISGLITLCG

SEQ ID NO: 1264063 - protein, 9 aa, Homo Sapiens
AIGIGGFGK

SEQ ID NO: 1264064 - protein, 9 aa, Homo Sapiens
FAYTHIVFT

SEQ ID NO: 1264065 - protein, 9 aa, Homo Sapiens
RPNTYYKVA

SEQ ID NO: 1264066 - protein, 9 aa, Homo Sapiens
NLSHAAVQR

SEQ ID NO: 1264067 - protein, 9 aa, Homo Sapiens
CALVFKVLH

SEQ ID NO: 1264068 - protein, 9 aa, Homo Sapiens
YAQDFLVDI

SEQ ID NO: 1264069 - protein, 9 aa, Homo Sapiens
LIQQFLTLW

SEQ ID NO: 1264070 - protein, 9 aa, Homo Sapiens
QKTRNGSFH

SEQ ID NO: 1264071 - protein, 9 aa, Homo Sapiens
KGTEAFTKN

SEQ ID NO: 1264072 - protein, 9 aa, Homo Sapiens
LQLAYYILH

SEQ ID NO: 1264073 - protein, 9 aa, Homo Sapiens
YEGLDWLSQ

SEQ ID NO: 1264074 - protein, 9 aa, Homo Sapiens
PHGPPPPPG

SEQ ID NO: 1264075 - protein, 9 aa, Homo Sapiens
HLELLPPCC

SEQ ID NO: 1264076 - protein, 9 aa, Homo Sapiens
ASKLVSVGY

SEQ ID NO: 1264077 - protein, 9 aa, Homo Sapiens
NLSMDPTFA

SEQ ID NO: 1264078 - protein, 9 aa, Homo Sapiens
PRPEVAAAE

SEQ ID NO: 1264079 - protein, 9 aa, Homo Sapiens
VWQLTIQYQ

SEQ ID NO: 1264080 - protein, 9 aa, Homo Sapiens
LHGSDALNI

SEQ ID NO: 1264081 - protein, 9 aa, Homo Sapiens
QGKNHKMCI

SEQ ID NO: 1264082 - protein, 9 aa, Homo Sapiens
ISCPQEMAA

SEQ ID NO: 1264083 - protein, 9 aa, Homo Sapiens
PSRSAACGG

SEQ ID NO: 1264084 - protein, 9 aa, Homo Sapiens
LMMVPELTC

SEQ ID NO: 1264085 - protein, 9 aa, Homo Sapiens
QIQAAEPTH

SEQ ID NO: 1264086 - protein, 9 aa, Homo Sapiens
LGVLQRMLP

SEQ ID NO: 1264087 - protein, 9 aa, Homo Sapiens
MDAIRFLLC

SEQ ID NO: 1264088 - protein, 9 aa, Homo Sapiens
LVIHNDDTK

SEQ ID NO: 1264089 - protein, 9 aa, Homo Sapiens
GSGGPINPD

SEQ ID NO: 1264090 - protein, 9 aa, Homo Sapiens
SFIKILWNI

SEQ ID NO: 1264091 - protein, 9 aa, Homo Sapiens
TCRDVGPVP

SEQ ID NO: 1264092 - protein, 9 aa, Homo Sapiens
FHSFDALLA

SEQ ID NO: 1264093 - protein, 9 aa, Homo Sapiens
CMVEYEEAQ

SEQ ID NO: 1264094 - protein, 9 aa, Homo Sapiens
HRIRIRRQE

SEQ ID NO: 1264095 - protein, 9 aa, Homo Sapiens
LTLTHPPAS

SEQ ID NO: 1264096 - protein, 9 aa, Homo Sapiens
KSGNVTWNS

SEQ ID NO: 1264097 - protein, 9 aa, Homo Sapiens
ATMLPAQEA

SEQ ID NO: 1264098 - protein, 9 aa, Homo Sapiens
HMWPMARGL

SEQ ID NO: 1264099 - protein, 9 aa, Homo Sapiens
MVEKSEPWV

SEQ ID NO: 1264100 - protein, 9 aa, Homo Sapiens
TVQEELLKG

SEQ ID NO: 1264101 - protein, 9 aa, Homo Sapiens
PTSDGEGMQ

SEQ ID NO: 1264102 - protein, 9 aa, Homo Sapiens
ASRAEGLSL

SEQ ID NO: 1264103 - protein, 9 aa, Homo Sapiens
DQSSDGSWA

SEQ ID NO: 1264104 - protein, 9 aa, Homo Sapiens
SKLRLSFST

SEQ ID NO: 1264105 - protein, 9 aa, Homo Sapiens
NTTLSINTV

SEQ ID NO: 1264106 - protein, 9 aa, Homo Sapiens
CWWLPYWSS

SEQ ID NO: 1264107 - protein, 9 aa, Homo Sapiens
QGVLVRHNR

SEQ ID NO: 1264108 - protein, 9 aa, Homo Sapiens
SRDKVVAVF

SEQ ID NO: 1264109 - protein, 9 aa, Homo Sapiens
EKLVEEHTQ

SEQ ID NO: 1264110 - protein, 9 aa, Homo Sapiens
LPADLPHSS

SEQ ID NO: 1264111 - protein, 9 aa, Homo Sapiens
MVSLHYGIM

SEQ ID NO: 1264112 - protein, 9 aa, Homo Sapiens
SESHILIVE

SEQ ID NO: 1264113 - protein, 9 aa, Homo Sapiens
MDSQNKGKI

SEQ ID NO: 1264114 - protein, 9 aa, Homo Sapiens
LHTIDELVE

SEQ ID NO: 1264115 - protein, 9 aa, Homo Sapiens
TQSPHRQTR

SEQ ID NO: 1264116 - protein, 9 aa, Homo Sapiens
PPGPVGPTG

SEQ ID NO: 1264117 - protein, 9 aa, Homo Sapiens
LLLVFSSKV

SEQ ID NO: 1264118 - protein, 9 aa, Homo Sapiens
CTNGPPCTS

SEQ ID NO: 1264119 - protein, 9 aa, Homo Sapiens
GRQPHVDFV

SEQ ID NO: 1264120 - protein, 9 aa, Homo Sapiens
QAILTGRAP

SEQ ID NO: 1264121 - protein, 9 aa, Homo Sapiens
ILPAVLGIT

SEQ ID NO: 1264122 - protein, 9 aa, Homo Sapiens
GLGGQRDLV

SEQ ID NO: 1264123 - protein, 9 aa, Homo Sapiens
MEYFNMYGG

SEQ ID NO: 1264124 - protein, 9 aa, Homo Sapiens
TTGGLTSVI

SEQ ID NO: 1264125 - protein, 9 aa, Homo Sapiens
FVLSPGADH

SEQ ID NO: 1264126 - protein, 9 aa, Homo Sapiens
SDGSQDTEN

SEQ ID NO: 1264127 - protein, 9 aa, Homo Sapiens
TLSLLHDRI

SEQ ID NO: 1264128 - protein, 9 aa, Homo Sapiens
SFSRDPKCY

SEQ ID NO: 1264129 - protein, 9 aa, Homo Sapiens
NGVAEWQRS

SEQ ID NO: 1264130 - protein, 9 aa, Homo Sapiens
APPVGLNRV

SEQ ID NO: 1264131 - protein, 9 aa, Homo Sapiens
EEVETLLKS

SEQ ID NO: 1264132 - protein, 9 aa, Homo Sapiens
LDDSRLIKV

SEQ ID NO: 1264133 - protein, 9 aa, Homo Sapiens
YYIQRFQYA

SEQ ID NO: 1264134 - protein, 9 aa, Homo Sapiens
LAEHLARVG

SEQ ID NO: 1264135 - protein, 9 aa, Homo Sapiens
LTPDAARDL

SEQ ID NO: 1264136 - protein, 9 aa, Homo Sapiens
LVLVGMGPA

SEQ ID NO: 1264137 - protein, 9 aa, Homo Sapiens
TLSREHPHL

SEQ ID NO: 1264138 - protein, 9 aa, Homo Sapiens
VIAQSLSEY

SEQ ID NO: 1264139 - protein, 9 aa, Homo Sapiens
IGMTPTVIT

SEQ ID NO: 1264140 - protein, 9 aa, Homo Sapiens
YRCTIHNGH

SEQ ID NO: 1264141 - protein, 9 aa, Homo Sapiens
YLLKESSGL

SEQ ID NO: 1264142 - protein, 9 aa, Homo Sapiens
TPGHQITSG

SEQ ID NO: 1264143 - protein, 9 aa, Homo Sapiens
ITKCNGRRD

SEQ ID NO: 1264144 - protein, 9 aa, Homo Sapiens
RRDRRPGPS

SEQ ID NO: 1264145 - protein, 9 aa, Homo Sapiens
EFSGLSHIS

SEQ ID NO: 1264146 - protein, 9 aa, Homo Sapiens
APEYETAAT

SEQ ID NO: 1264147 - protein, 9 aa, Homo Sapiens
ILEVTVYTF

SEQ ID NO: 1264148 - protein, 9 aa, Homo Sapiens
LEPLLPRSQ

SEQ ID NO: 1264149 - protein, 9 aa, Homo Sapiens
GDKVVYCRC

SEQ ID NO: 1264150 - protein, 9 aa, Homo Sapiens
CTKSDLRLI

SEQ ID NO: 1264151 - protein, 9 aa, Homo Sapiens
TWIIKESNI

SEQ ID NO: 1264152 - protein, 9 aa, Homo Sapiens
VTLEKCGYN

SEQ ID NO: 1264153 - protein, 9 aa, Homo Sapiens
RIIPCLALV

SEQ ID NO: 1264154 - protein, 9 aa, Homo Sapiens
IRNVFQCEA

SEQ ID NO: 1264155 - protein, 9 aa, Homo Sapiens
RHQQIHTGR

SEQ ID NO: 1264156 - protein, 9 aa, Homo Sapiens
YTLTYTGTH

SEQ ID NO: 1264157 - protein, 9 aa, Homo Sapiens
SESHLAARE

SEQ ID NO: 1264158 - protein, 9 aa, Homo Sapiens
PKRKEYEMK

SEQ ID NO: 1264159 - protein, 9 aa, Homo Sapiens
KDTTSIHLM

SEQ ID NO: 1264160 - protein, 9 aa, Homo Sapiens
SRIKVFEGR

SEQ ID NO: 1264161 - protein, 9 aa, Homo Sapiens
RRTVTSTRK

SEQ ID NO: 1264162 - protein, 9 aa, Homo Sapiens
TTQETDSFQ

SEQ ID NO: 1264163 - protein, 9 aa, Homo Sapiens
EAEQQLATL

SEQ ID NO: 1264164 - protein, 9 aa, Homo Sapiens
LNFLWHGKL

SEQ ID NO: 1264165 - protein, 9 aa, Homo Sapiens
SNDCNDNQW

SEQ ID NO: 1264166 - protein, 9 aa, Homo Sapiens
QDQRSASRD

SEQ ID NO: 1264167 - protein, 9 aa, Homo Sapiens
TLELQKLNT

SEQ ID NO: 1264168 - protein, 9 aa, Homo Sapiens
AMKCLRVPP

SEQ ID NO: 1264169 - protein, 9 aa, Homo Sapiens
LALKDVAIV

SEQ ID NO: 1264170 - protein, 9 aa, Homo Sapiens
DLDGMFIEC

SEQ ID NO: 1264171 - protein, 9 aa, Homo Sapiens
CHKSGGREY

SEQ ID NO: 1264172 - protein, 9 aa, Homo Sapiens
KPENIILDS

SEQ ID NO: 1264173 - protein, 9 aa, Homo Sapiens
IIRHLRDVR

SEQ ID NO: 1264174 - protein, 9 aa, Homo Sapiens
QTQVGLESA

SEQ ID NO: 1264175 - protein, 9 aa, Homo Sapiens
VHEQGYVPD

SEQ ID NO: 1264176 - protein, 9 aa, Homo Sapiens
LTSREKAAN

SEQ ID NO: 1264177 - protein, 9 aa, Homo Sapiens
RNPSMCKRI

SEQ ID NO: 1264178 - protein, 9 aa, Homo Sapiens
VASTASRLV

SEQ ID NO: 1264179 - protein, 9 aa, Homo Sapiens
YWVHFYTKI

SEQ ID NO: 1264180 - protein, 9 aa, Homo Sapiens
SPSHMPPTT

SEQ ID NO: 1264181 - protein, 9 aa, Homo Sapiens
QQVGQSKHL

SEQ ID NO: 1264182 - protein, 9 aa, Homo Sapiens
LCRMDPTWH

SEQ ID NO: 1264183 - protein, 9 aa, Homo Sapiens
IDAMLDLLK

SEQ ID NO: 1264184 - protein, 9 aa, Homo Sapiens
GCRDVEQYV

SEQ ID NO: 1264185 - protein, 9 aa, Homo Sapiens
HAYAVMKNF

SEQ ID NO: 1264186 - protein, 9 aa, Homo Sapiens
QWHLGAASR

SEQ ID NO: 1264187 - protein, 9 aa, Homo Sapiens
VFECLVDVI

SEQ ID NO: 1264188 - protein, 9 aa, Homo Sapiens
RNAMHTSQQ

SEQ ID NO: 1264189 - protein, 9 aa, Homo Sapiens
IPSSGILVS

SEQ ID NO: 1264190 - protein, 9 aa, Homo Sapiens
EMRLLKCMV

SEQ ID NO: 1264191 - protein, 9 aa, Homo Sapiens
TLSMFIDAP

SEQ ID NO: 1264192 - protein, 9 aa, Homo Sapiens
GSSLIIHKR

SEQ ID NO: 1264193 - protein, 9 aa, Homo Sapiens
LTKNYVALH

SEQ ID NO: 1264194 - protein, 9 aa, Homo Sapiens
IYRAFYNHG

SEQ ID NO: 1264195 - protein, 9 aa, Homo Sapiens
AIDGGRASQ

SEQ ID NO: 1264196 - protein, 9 aa, Homo Sapiens
CSQKRSGEC

SEQ ID NO: 1264197 - protein, 9 aa, Homo Sapiens
DLPLGDFEA

SEQ ID NO: 1264198 - protein, 9 aa, Homo Sapiens
SMACSPEIS

SEQ ID NO: 1264199 - protein, 9 aa, Homo Sapiens
AELVITRNH

SEQ ID NO: 1264200 - protein, 9 aa, Homo Sapiens
WKNFYAVLK

SEQ ID NO: 1264201 - protein, 9 aa, Homo Sapiens
SRDEIQESS

SEQ ID NO: 1264202 - protein, 9 aa, Homo Sapiens
KINKMMDKL

SEQ ID NO: 1264203 - protein, 9 aa, Homo Sapiens
PIEDFITHL

SEQ ID NO: 1264204 - protein, 9 aa, Homo Sapiens
TLLTFIGLL

SEQ ID NO: 1264205 - protein, 9 aa, Homo Sapiens
GNACISCIT

SEQ ID NO: 1264206 - protein, 9 aa, Homo Sapiens
NNKLLKEND

SEQ ID NO: 1264207 - protein, 9 aa, Homo Sapiens
GGRRPYKGD

SEQ ID NO: 1264208 - protein, 9 aa, Homo Sapiens
WRVWRFAPG

SEQ ID NO: 1264209 - protein, 9 aa, Homo Sapiens
NVGLTMNYC

SEQ ID NO: 1264210 - protein, 9 aa, Homo Sapiens
IKPKELVKR

SEQ ID NO: 1264211 - protein, 9 aa, Homo Sapiens
EDSGLYQDQ

SEQ ID NO: 1264212 - protein, 9 aa, Homo Sapiens
SSGNKHLSR

SEQ ID NO: 1264213 - protein, 9 aa, Homo Sapiens
THLSALVNR

SEQ ID NO: 1264214 - protein, 9 aa, Homo Sapiens
STQDHVLSQ

SEQ ID NO: 1264215 - protein, 9 aa, Homo Sapiens
FPEGICTNR

SEQ ID NO: 1264216 - protein, 9 aa, Homo Sapiens
LLAISFCGF

SEQ ID NO: 1264217 - protein, 9 aa, Homo Sapiens
CYHCVSGLP

SEQ ID NO: 1264218 - protein, 9 aa, Homo Sapiens
DEEHLELHK

SEQ ID NO: 1264219 - protein, 9 aa, Homo Sapiens
KLHIQEEIA

SEQ ID NO: 1264220 - protein, 9 aa, Homo Sapiens
TINFGTVGE

SEQ ID NO: 1264221 - protein, 9 aa, Homo Sapiens
QNVLEILQY

SEQ ID NO: 1264222 - protein, 9 aa, Homo Sapiens
PELPTPWLC

SEQ ID NO: 1264223 - protein, 9 aa, Homo Sapiens
FGNDINNVL

SEQ ID NO: 1264224 - protein, 9 aa, Homo Sapiens
QPWMGYAAM

SEQ ID NO: 1264225 - protein, 9 aa, Homo Sapiens
TEQYNEETF

SEQ ID NO: 1264226 - protein, 9 aa, Homo Sapiens
KHCVDKFDI

SEQ ID NO: 1264227 - protein, 9 aa, Homo Sapiens
NVDVKKEVD

SEQ ID NO: 1264228 - protein, 9 aa, Homo Sapiens
CGCRKQKSN

SEQ ID NO: 1264229 - protein, 9 aa, Homo Sapiens
HRHTHTHRH

SEQ ID NO: 1264230 - protein, 9 aa, Homo Sapiens
MGQRRAGNV

SEQ ID NO: 1264231 - protein, 9 aa, Homo Sapiens
KWETDEAQF

SEQ ID NO: 1264232 - protein, 9 aa, Homo Sapiens
VSEFLDEAL

SEQ ID NO: 1264233 - protein, 9 aa, Homo Sapiens
QCGNRPYKC

SEQ ID NO: 1264234 - protein, 9 aa, Homo Sapiens
PHVFAKPLY

SEQ ID NO: 1264235 - protein, 9 aa, Homo Sapiens
SLRQVAVVE

SEQ ID NO: 1264236 - protein, 9 aa, Homo Sapiens
VGFEPFYHL

SEQ ID NO: 1264237 - protein, 9 aa, Homo Sapiens
QAFTNYNIN

SEQ ID NO: 1264238 - protein, 9 aa, Homo Sapiens
TAGIICLET

SEQ ID NO: 1264239 - protein, 9 aa, Homo Sapiens
NEINHSLSA

SEQ ID NO: 1264240 - protein, 9 aa, Homo Sapiens
IHREKVKCY

SEQ ID NO: 1264241 - protein, 9 aa, Homo Sapiens
AKALKNKRR

SEQ ID NO: 1264242 - protein, 9 aa, Homo Sapiens
LFIHFGVWA

SEQ ID NO: 1264243 - protein, 9 aa, Homo Sapiens
QHFGVKHTT

SEQ ID NO: 1264244 - protein, 9 aa, Homo Sapiens
MIGVILFDF

SEQ ID NO: 1264245 - protein, 9 aa, Homo Sapiens
KATNGSAAK

SEQ ID NO: 1264246 - protein, 9 aa, Homo Sapiens
VTFPFRPIH

SEQ ID NO: 1264247 - protein, 9 aa, Homo Sapiens
PSKISGSVA

SEQ ID NO: 1264248 - protein, 9 aa, Homo Sapiens
LSLSVNHSS

SEQ ID NO: 1264249 - protein, 9 aa, Homo Sapiens
VCPLTTEKK

SEQ ID NO: 1264250 - protein, 9 aa, Homo Sapiens
FYTVFTPPV

SEQ ID NO: 1264251 - protein, 9 aa, Homo Sapiens
NPESAASSL

SEQ ID NO: 1264252 - protein, 9 aa, Homo Sapiens
QQHPRLLIV

SEQ ID NO: 1264253 - protein, 9 aa, Homo Sapiens
SYDQNTLIS

SEQ ID NO: 1264254 - protein, 9 aa, Homo Sapiens
IPMSTSLLG

SEQ ID NO: 1264255 - protein, 9 aa, Homo Sapiens
VNVCWLLCG

SEQ ID NO: 1264256 - protein, 9 aa, Homo Sapiens
NGTRLEPLL

SEQ ID NO: 1264257 - protein, 9 aa, Homo Sapiens
TIWQDLICR

SEQ ID NO: 1264258 - protein, 9 aa, Homo Sapiens
DVKPVYKPG

SEQ ID NO: 1264259 - protein, 9 aa, Homo Sapiens
YLLQNGSAP

SEQ ID NO: 1264260 - protein, 9 aa, Homo Sapiens
AITIVSATS

SEQ ID NO: 1264261 - protein, 9 aa, Homo Sapiens
LSRHDEIEY

SEQ ID NO: 1264262 - protein, 9 aa, Homo Sapiens
PERPYLADQ

SEQ ID NO: 1264263 - protein, 9 aa, Homo Sapiens
HLTASRTGT

SEQ ID NO: 1264264 - protein, 9 aa, Homo Sapiens
PILREDAPT

SEQ ID NO: 1264265 - protein, 9 aa, Homo Sapiens
QWLIQQSKS

SEQ ID NO: 1264266 - protein, 9 aa, Homo Sapiens
PVGQKKCKM

SEQ ID NO: 1264267 - protein, 9 aa, Homo Sapiens
VANAGDNRA

SEQ ID NO: 1264268 - protein, 9 aa, Homo Sapiens
STITSIFSL

SEQ ID NO: 1264269 - protein, 9 aa, Homo Sapiens
KDYPFHIKY

SEQ ID NO: 1264270 - protein, 9 aa, Homo Sapiens
SPSVFLLMI

SEQ ID NO: 1264271 - protein, 9 aa, Homo Sapiens
THLSAYVSY

SEQ ID NO: 1264272 - protein, 9 aa, Homo Sapiens
RGPLCKRSV

SEQ ID NO: 1264273 - protein, 9 aa, Homo Sapiens
YLETQDGKL

SEQ ID NO: 1264274 - protein, 9 aa, Homo Sapiens
ENLLKYVNM

SEQ ID NO: 1264275 - protein, 9 aa, Homo Sapiens
KEDAHLLND

SEQ ID NO: 1264276 - protein, 9 aa, Homo Sapiens
QTIEHLEQE

SEQ ID NO: 1264277 - protein, 9 aa, Homo Sapiens
HCFQHVVTV

SEQ ID NO: 1264278 - protein, 9 aa, Homo Sapiens
HHYRTVHQY

SEQ ID NO: 1264279 - protein, 9 aa, Homo Sapiens
NFTHHLLAA

SEQ ID NO: 1264280 - protein, 9 aa, Homo Sapiens
IFLRQLVIY

SEQ ID NO: 1264281 - protein, 9 aa, Homo Sapiens
SRGIYSTDY

SEQ ID NO: 1264282 - protein, 9 aa, Homo Sapiens
LNGAYKVDE

SEQ ID NO: 1264283 - protein, 9 aa, Homo Sapiens
NKRSGMQVS

SEQ ID NO: 1264284 - protein, 9 aa, Homo Sapiens
LITATLEKL

SEQ ID NO: 1264285 - protein, 9 aa, Homo Sapiens
TILQKRMNF

SEQ ID NO: 1264286 - protein, 9 aa, Homo Sapiens
DFIAKVSPP

SEQ ID NO: 1264287 - protein, 9 aa, Homo Sapiens
GRFGLCLDG

SEQ ID NO: 1264288 - protein, 9 aa, Homo Sapiens
MGHIKPIKF

SEQ ID NO: 1264289 - protein, 9 aa, Homo Sapiens
GFLKTPLGG

SEQ ID NO: 1264290 - protein, 9 aa, Homo Sapiens
TFGNMQMAS

SEQ ID NO: 1264291 - protein, 9 aa, Homo Sapiens
HSFHMSYSM

SEQ ID NO: 1264292 - protein, 9 aa, Homo Sapiens
AIPDDFGGR

SEQ ID NO: 1264293 - protein, 9 aa, Homo Sapiens
EMLATGAHD

SEQ ID NO: 1264294 - protein, 9 aa, Homo Sapiens
FTKVYKVKY

SEQ ID NO: 1264295 - protein, 9 aa, Homo Sapiens
ADFVSFFPV

SEQ ID NO: 1264296 - protein, 9 aa, Homo Sapiens
DMPLVGDLS

SEQ ID NO: 1264297 - protein, 9 aa, Homo Sapiens
TRRISEGEA

SEQ ID NO: 1264298 - protein, 9 aa, Homo Sapiens
VQWSDLITF

SEQ ID NO: 1264299 - protein, 9 aa, Homo Sapiens
GPIAGLNVM

SEQ ID NO: 1264300 - protein, 9 aa, Homo Sapiens
TDMYLKSLN

SEQ ID NO: 1264301 - protein, 9 aa, Homo Sapiens
WVNALKNPH

SEQ ID NO: 1264302 - protein, 9 aa, Homo Sapiens
DPRSIGRLC

SEQ ID NO: 1264303 - protein, 9 aa, Homo Sapiens
YVKLDKPGE

SEQ ID NO: 1264304 - protein, 9 aa, Homo Sapiens
GPVAQLCLG

SEQ ID NO: 1264305 - protein, 9 aa, Homo Sapiens
YKTLERQMQ

SEQ ID NO: 1264306 - protein, 9 aa, Homo Sapiens
QRKTDLTGL

SEQ ID NO: 1264307 - protein, 9 aa, Homo Sapiens
PSGTRGPGI

SEQ ID NO: 1264308 - protein, 9 aa, Homo Sapiens
LKLHIQEEI

SEQ ID NO: 1264309 - protein, 9 aa, Homo Sapiens
TPFLVDQSQ

SEQ ID NO: 1264310 - protein, 9 aa, Homo Sapiens
LSKEELISE

SEQ ID NO: 1264311 - protein, 9 aa, Homo Sapiens
YKDIMKEKE

SEQ ID NO: 1264312 - protein, 9 aa, Homo Sapiens
FVLKVDSPD

SEQ ID NO: 1264313 - protein, 9 aa, Homo Sapiens
IRSQVVRKA

SEQ ID NO: 1264314 - protein, 9 aa, Homo Sapiens
EGTPRDQRV

SEQ ID NO: 1264315 - protein, 9 aa, Homo Sapiens
SISEYSNMP

SEQ ID NO: 1264316 - protein, 9 aa, Homo Sapiens
EGVNIRDDE

SEQ ID NO: 1264317 - protein, 9 aa, Homo Sapiens
LVWPPRLNT

SEQ ID NO: 1264318 - protein, 9 aa, Homo Sapiens
KLNSRSTLV

SEQ ID NO: 1264319 - protein, 9 aa, Homo Sapiens
ESESHILIV

SEQ ID NO: 1264320 - protein, 9 aa, Homo Sapiens
ELCALRELW

SEQ ID NO: 1264321 - protein, 9 aa, Homo Sapiens
MKNEGSYGD

SEQ ID NO: 1264322 - protein, 9 aa, Homo Sapiens
EIQQTGPFW

SEQ ID NO: 1264323 - protein, 9 aa, Homo Sapiens
EKHKVEEKR

SEQ ID NO: 1264324 - protein, 9 aa, Homo Sapiens
LWSPGGRQL

SEQ ID NO: 1264325 - protein, 9 aa, Homo Sapiens
GEQREVGKS

SEQ ID NO: 1264326 - protein, 9 aa, Homo Sapiens
ILTVHHKIH

SEQ ID NO: 1264327 - protein, 9 aa, Homo Sapiens
KSHKHLSKK

SEQ ID NO: 1264328 - protein, 9 aa, Homo Sapiens
PQPGRIRTV

SEQ ID NO: 1264329 - protein, 9 aa, Homo Sapiens
PALYVSDFK

SEQ ID NO: 1264330 - protein, 9 aa, Homo Sapiens
SWPPAPLPA

SEQ ID NO: 1264331 - protein, 9 aa, Homo Sapiens
GIFAPLQSI

SEQ ID NO: 1264332 - protein, 9 aa, Homo Sapiens
FFAICGPQM

SEQ ID NO: 1264333 - protein, 9 aa, Homo Sapiens
SRKYIHWQE

SEQ ID NO: 1264334 - protein, 9 aa, Homo Sapiens
QSSVCEIWM

SEQ ID NO: 1264335 - protein, 9 aa, Homo Sapiens
ELASAILKR

SEQ ID NO: 1264336 - protein, 9 aa, Homo Sapiens
IAVLIPKDH

SEQ ID NO: 1264337 - protein, 9 aa, Homo Sapiens
FNSCRYDRP

SEQ ID NO: 1264338 - protein, 9 aa, Homo Sapiens
DEQDMPQNR

SEQ ID NO: 1264339 - protein, 9 aa, Homo Sapiens
EPAESSMPP

SEQ ID NO: 1264340 - protein, 9 aa, Homo Sapiens
GPREYFIHG

SEQ ID NO: 1264341 - protein, 9 aa, Homo Sapiens
TEMGERLVL

SEQ ID NO: 1264342 - protein, 9 aa, Homo Sapiens
CAATSCMGF

SEQ ID NO: 1264343 - protein, 9 aa, Homo Sapiens
AKQDVHCIH

SEQ ID NO: 1264344 - protein, 9 aa, Homo Sapiens
SKPKAQNPA

SEQ ID NO: 1264345 - protein, 9 aa, Homo Sapiens
SLHYKVLIF

SEQ ID NO: 1264346 - protein, 9 aa, Homo Sapiens
MDCGQPNRH

SEQ ID NO: 1264347 - protein, 9 aa, Homo Sapiens
AHMWMVHID

SEQ ID NO: 1264348 - protein, 9 aa, Homo Sapiens
HRIDYVLQE

SEQ ID NO: 1264349 - protein, 9 aa, Homo Sapiens
EGHALGFLG

SEQ ID NO: 1264350 - protein, 9 aa, Homo Sapiens
CEIRLTQKA

SEQ ID NO: 1264351 - protein, 9 aa, Homo Sapiens
RDTMTPGEL

SEQ ID NO: 1264352 - protein, 9 aa, Homo Sapiens
GSKGDVGPA

SEQ ID NO: 1264353 - protein, 9 aa, Homo Sapiens
DIFRSTRYL

SEQ ID NO: 1264354 - protein, 9 aa, Homo Sapiens
LIVNAENQR

SEQ ID NO: 1264355 - protein, 9 aa, Homo Sapiens
NTTVSVHPL

SEQ ID NO: 1264356 - protein, 9 aa, Homo Sapiens
TRPVVFLVQ

SEQ ID NO: 1264357 - protein, 9 aa, Homo Sapiens
YFSFEMSLT

SEQ ID NO: 1264358 - protein, 9 aa, Homo Sapiens
CVRGDEVMV

SEQ ID NO: 1264359 - protein, 9 aa, Homo Sapiens
QPPGPPASQ

SEQ ID NO: 1264360 - protein, 9 aa, Homo Sapiens
FYDRIKFII

SEQ ID NO: 1264361 - protein, 9 aa, Homo Sapiens
QARAGVSHV

SEQ ID NO: 1264362 - protein, 9 aa, Homo Sapiens
AVLWEVLRK

SEQ ID NO: 1264363 - protein, 9 aa, Homo Sapiens
SAAHIQTSS

SEQ ID NO: 1264364 - protein, 9 aa, Homo Sapiens
PPPSPSVAK

SEQ ID NO: 1264365 - protein, 9 aa, Homo Sapiens
AKEMIALKM

SEQ ID NO: 1264366 - protein, 9 aa, Homo Sapiens
AEWQRSLFV

SEQ ID NO: 1264367 - protein, 9 aa, Homo Sapiens
EMWGMYEGQ

SEQ ID NO: 1264368 - protein, 9 aa, Homo Sapiens
ITWQRLGKC

SEQ ID NO: 1264369 - protein, 9 aa, Homo Sapiens
VSFLLLRRQ

SEQ ID NO: 1264370 - protein, 9 aa, Homo Sapiens
VCTFFDTFN

SEQ ID NO: 1264371 - protein, 9 aa, Homo Sapiens
EEHPPPPAG

SEQ ID NO: 1264372 - protein, 9 aa, Homo Sapiens
QQQEGMQVV

SEQ ID NO: 1264373 - protein, 9 aa, Homo Sapiens
LVRLIKESG

SEQ ID NO: 1264374 - protein, 9 aa, Homo Sapiens
WSRGWGRGL

SEQ ID NO: 1264375 - protein, 9 aa, Homo Sapiens
NPTLPPGRF

SEQ ID NO: 1264376 - protein, 9 aa, Homo Sapiens
VSGRGEDSG

SEQ ID NO: 1264377 - protein, 9 aa, Homo Sapiens
GGGIGHQKC

SEQ ID NO: 1264378 - protein, 9 aa, Homo Sapiens
LRFTLTKLS

SEQ ID NO: 1264379 - protein, 9 aa, Homo Sapiens
SLHRMPRNP

SEQ ID NO: 1264380 - protein, 9 aa, Homo Sapiens
EGIPLKRRH

SEQ ID NO: 1264381 - protein, 9 aa, Homo Sapiens
AGIICLETF

SEQ ID NO: 1264382 - protein, 9 aa, Homo Sapiens
KQTFLVEFL

SEQ ID NO: 1264383 - protein, 9 aa, Homo Sapiens
ENESPKCQA

SEQ ID NO: 1264384 - protein, 9 aa, Homo Sapiens
QGPWRPLHT

SEQ ID NO: 1264385 - protein, 9 aa, Homo Sapiens
LTGRLTQAR

SEQ ID NO: 1264386 - protein, 9 aa, Homo Sapiens
READVSLSA

SEQ ID NO: 1264387 - protein, 9 aa, Homo Sapiens
FIVFWVRSK

SEQ ID NO: 1264388 - protein, 9 aa, Homo Sapiens
INVNAIKAE

SEQ ID NO: 1264389 - protein, 9 aa, Homo Sapiens
RGPWMLVWS

SEQ ID NO: 1264390 - protein, 9 aa, Homo Sapiens
ARCSLEDIV

SEQ ID NO: 1264391 - protein, 9 aa, Homo Sapiens
GVGYCKRQV

SEQ ID NO: 1264392 - protein, 9 aa, Homo Sapiens
EKEFLFNMC

SEQ ID NO: 1264393 - protein, 9 aa, Homo Sapiens
RSDENEQHF

SEQ ID NO: 1264394 - protein, 9 aa, Homo Sapiens
SISNQPNDE

SEQ ID NO: 1264395 - protein, 9 aa, Homo Sapiens
ENIHYGREN

SEQ ID NO: 1264396 - protein, 9 aa, Homo Sapiens
SFARTISMQ

SEQ ID NO: 1264397 - protein, 9 aa, Homo Sapiens
AGVLAGEPL

SEQ ID NO: 1264398 - protein, 9 aa, Homo Sapiens
LYPPILSYC

SEQ ID NO: 1264399 - protein, 9 aa, Homo Sapiens
QTSKDDLDL

SEQ ID NO: 1264400 - protein, 9 aa, Homo Sapiens
FVVFLVVYM

SEQ ID NO: 1264401 - protein, 9 aa, Homo Sapiens
DDDAPCPGY

SEQ ID NO: 1264402 - protein, 9 aa, Homo Sapiens
PDRPTGIGV

SEQ ID NO: 1264403 - protein, 9 aa, Homo Sapiens
CDFVHHALE

SEQ ID NO: 1264404 - protein, 9 aa, Homo Sapiens
YHLATKKYM

SEQ ID NO: 1264405 - protein, 9 aa, Homo Sapiens
YQDSSSHFK

SEQ ID NO: 1264406 - protein, 9 aa, Homo Sapiens
ACTVTTKDG

SEQ ID NO: 1264407 - protein, 9 aa, Homo Sapiens
VYLPNCDCK

SEQ ID NO: 1264408 - protein, 9 aa, Homo Sapiens
GVNEAGKST

SEQ ID NO: 1264409 - protein, 9 aa, Homo Sapiens
PPKQEVHRH

SEQ ID NO: 1264410 - protein, 9 aa, Homo Sapiens
DMGDLEMLS

SEQ ID NO: 1264411 - protein, 9 aa, Homo Sapiens
PAPALVPRC

SEQ ID NO: 1264412 - protein, 9 aa, Homo Sapiens
VQFLEAQII

SEQ ID NO: 1264413 - protein, 9 aa, Homo Sapiens
WNLMGDAMV

SEQ ID NO: 1264414 - protein, 9 aa, Homo Sapiens
NMVPSIPYL

SEQ ID NO: 1264415 - protein, 9 aa, Homo Sapiens
SPPPLPADL

SEQ ID NO: 1264416 - protein, 9 aa, Homo Sapiens
TAAMCVCPF

SEQ ID NO: 1264417 - protein, 9 aa, Homo Sapiens
PDTLGDGMM

SEQ ID NO: 1264418 - protein, 9 aa, Homo Sapiens
LEGQVTQSS

SEQ ID NO: 1264419 - protein, 9 aa, Homo Sapiens
EWTACVVHL

SEQ ID NO: 1264420 - protein, 9 aa, Homo Sapiens
EDSSEVGPI

SEQ ID NO: 1264421 - protein, 9 aa, Homo Sapiens
TKEKEEMEL

SEQ ID NO: 1264422 - protein, 9 aa, Homo Sapiens
GGGGGGGGI

SEQ ID NO: 1264423 - protein, 9 aa, Homo Sapiens
SKQQVSRPA

SEQ ID NO: 1264424 - protein, 9 aa, Homo Sapiens
LPRVETHSS

SEQ ID NO: 1264425 - protein, 9 aa, Homo Sapiens
ESKSAVLPV

SEQ ID NO: 1264426 - protein, 9 aa, Homo Sapiens
FLQIYKVWF

SEQ ID NO: 1264427 - protein, 9 aa, Homo Sapiens
YLHNDAHVP

SEQ ID NO: 1264428 - protein, 9 aa, Homo Sapiens
WEHLWLPVN

SEQ ID NO: 1264429 - protein, 9 aa, Homo Sapiens
MKQMTTILE

SEQ ID NO: 1264430 - protein, 9 aa, Homo Sapiens
FVVAYAIQK

SEQ ID NO: 1264431 - protein, 9 aa, Homo Sapiens
NGKTCKDSA

SEQ ID NO: 1264432 - protein, 9 aa, Homo Sapiens
VLIRKWGKL

SEQ ID NO: 1264433 - protein, 9 aa, Homo Sapiens
WTQNHRTMS

SEQ ID NO: 1264434 - protein, 9 aa, Homo Sapiens
SLVMMVRQM

SEQ ID NO: 1264435 - protein, 9 aa, Homo Sapiens
AHLNRDMIV

SEQ ID NO: 1264436 - protein, 9 aa, Homo Sapiens
NVPKDSVIP

SEQ ID NO: 1264437 - protein, 9 aa, Homo Sapiens
CRETEKLSA

SEQ ID NO: 1264438 - protein, 9 aa, Homo Sapiens
SNLEQLAES

SEQ ID NO: 1264439 - protein, 9 aa, Homo Sapiens
DFLPGAIPL

SEQ ID NO: 1264440 - protein, 9 aa, Homo Sapiens
YYNVIITWS

SEQ ID NO: 1264441 - protein, 9 aa, Homo Sapiens
AFQEALDPV

SEQ ID NO: 1264442 - protein, 9 aa, Homo Sapiens
KAKLKRAAG

SEQ ID NO: 1264443 - protein, 9 aa, Homo Sapiens
PNCNVPEVV

SEQ ID NO: 1264444 - protein, 9 aa, Homo Sapiens
GNMMSIYSE

SEQ ID NO: 1264445 - protein, 9 aa, Homo Sapiens
TYLKMTPHK

SEQ ID NO: 1264446 - protein, 9 aa, Homo Sapiens
ATVFCIWKS

SEQ ID NO: 1264447 - protein, 9 aa, Homo Sapiens
DRYHAIYFV

SEQ ID NO: 1264448 - protein, 9 aa, Homo Sapiens
PNTYYKVAS

SEQ ID NO: 1264449 - protein, 9 aa, Homo Sapiens
EGPTPRSGT

SEQ ID NO: 1264450 - protein, 9 aa, Homo Sapiens
SFNFKKHLN

SEQ ID NO: 1264451 - protein, 9 aa, Homo Sapiens
FGNVCVNTD

SEQ ID NO: 1264452 - protein, 9 aa, Homo Sapiens
LDDVLYECS

SEQ ID NO: 1264453 - protein, 9 aa, Homo Sapiens
DSRALGFQT

SEQ ID NO: 1264454 - protein, 9 aa, Homo Sapiens
KLMPIKQNV

SEQ ID NO: 1264455 - protein, 9 aa, Homo Sapiens
NLPRVCHVL

SEQ ID NO: 1264456 - protein, 9 aa, Homo Sapiens
FVAEETERC

SEQ ID NO: 1264457 - protein, 9 aa, Homo Sapiens
DVLRIQNIL

SEQ ID NO: 1264458 - protein, 9 aa, Homo Sapiens
SLEYAKVEA

SEQ ID NO: 1264459 - protein, 9 aa, Homo Sapiens
KYKSKEFQL

SEQ ID NO: 1264460 - protein, 9 aa, Homo Sapiens
SVFTMLPGQ

SEQ ID NO: 1264461 - protein, 9 aa, Homo Sapiens
CSRTAPCTT

SEQ ID NO: 1264462 - protein, 9 aa, Homo Sapiens
WTTSTDQRP

SEQ ID NO: 1264463 - protein, 9 aa, Homo Sapiens
NSGGGATSR

SEQ ID NO: 1264464 - protein, 9 aa, Homo Sapiens
MFQRLDCIY

SEQ ID NO: 1264465 - protein, 9 aa, Homo Sapiens
MANVFLILH

SEQ ID NO: 1264466 - protein, 9 aa, Homo Sapiens
QQPYKSLVQ

SEQ ID NO: 1264467 - protein, 9 aa, Homo Sapiens
NEKSKESLK

SEQ ID NO: 1264468 - protein, 9 aa, Homo Sapiens
NLIVNAENQ

SEQ ID NO: 1264469 - protein, 9 aa, Homo Sapiens
HDPKIESST

SEQ ID NO: 1264470 - protein, 9 aa, Homo Sapiens
YLPDHRRVH

SEQ ID NO: 1264471 - protein, 9 aa, Homo Sapiens
CSDLESSDA

SEQ ID NO: 1264472 - protein, 9 aa, Homo Sapiens
AKVIREGQA

SEQ ID NO: 1264473 - protein, 9 aa, Homo Sapiens
VCVFPASKE

SEQ ID NO: 1264474 - protein, 9 aa, Homo Sapiens
QATMALLDQ

SEQ ID NO: 1264475 - protein, 9 aa, Homo Sapiens
LAEASILRQ

SEQ ID NO: 1264476 - protein, 9 aa, Homo Sapiens
LMNAISPLK

SEQ ID NO: 1264477 - protein, 9 aa, Homo Sapiens
LPNLREMWL

SEQ ID NO: 1264478 - protein, 9 aa, Homo Sapiens
SSDNAIDNP

SEQ ID NO: 1264479 - protein, 9 aa, Homo Sapiens
LQWLIQQSK

SEQ ID NO: 1264480 - protein, 9 aa, Homo Sapiens
SIQAQPLNP

SEQ ID NO: 1264481 - protein, 9 aa, Homo Sapiens
KVQIHDVVL

SEQ ID NO: 1264482 - protein, 9 aa, Homo Sapiens
DKYSSYNNV

SEQ ID NO: 1264483 - protein, 9 aa, Homo Sapiens
NFSKHPQHK

SEQ ID NO: 1264484 - protein, 9 aa, Homo Sapiens
RGIVSFVCE

SEQ ID NO: 1264485 - protein, 9 aa, Homo Sapiens
ECMGPLGLD

SEQ ID NO: 1264486 - protein, 9 aa, Homo Sapiens
ENSGAAEKH

SEQ ID NO: 1264487 - protein, 9 aa, Homo Sapiens
RIREMQSFF

SEQ ID NO: 1264488 - protein, 9 aa, Homo Sapiens
IHVFRPDIY

SEQ ID NO: 1264489 - protein, 9 aa, Homo Sapiens
SLNGTNMTL

SEQ ID NO: 1264490 - protein, 9 aa, Homo Sapiens
SKDTSRCSE

SEQ ID NO: 1264491 - protein, 9 aa, Homo Sapiens
FQVFLNGET

SEQ ID NO: 1264492 - protein, 9 aa, Homo Sapiens
SSAVLIYPD

SEQ ID NO: 1264493 - protein, 9 aa, Homo Sapiens
PSPGPPSPL

SEQ ID NO: 1264494 - protein, 9 aa, Homo Sapiens
YSFRMCQVN

SEQ ID NO: 1264495 - protein, 9 aa, Homo Sapiens
NCESVSDHC

SEQ ID NO: 1264496 - protein, 9 aa, Homo Sapiens
DECAVLCLP

SEQ ID NO: 1264497 - protein, 9 aa, Homo Sapiens
HLHPQHCRL

SEQ ID NO: 1264498 - protein, 9 aa, Homo Sapiens
NVVFFPCCL

SEQ ID NO: 1264499 - protein, 9 aa, Homo Sapiens
TKKKHFVYQ

SEQ ID NO: 1264500 - protein, 9 aa, Homo Sapiens
KGLFPFMHV

SEQ ID NO: 1264501 - protein, 9 aa, Homo Sapiens
PYRCEEYGK

SEQ ID NO: 1264502 - protein, 9 aa, Homo Sapiens
SGAGTLHPY

SEQ ID NO: 1264503 - protein, 9 aa, Homo Sapiens
DKEMVRVQG

SEQ ID NO: 1264504 - protein, 9 aa, Homo Sapiens
TNIDSDKNV

SEQ ID NO: 1264505 - protein, 9 aa, Homo Sapiens
EATNRHVWE

SEQ ID NO: 1264506 - protein, 9 aa, Homo Sapiens
MLFLAVLNF

SEQ ID NO: 1264507 - protein, 9 aa, Homo Sapiens
DHQPRFPKC

SEQ ID NO: 1264508 - protein, 9 aa, Homo Sapiens
TQGFMGLFL

SEQ ID NO: 1264509 - protein, 9 aa, Homo Sapiens
VKQASIQHI

SEQ ID NO: 1264510 - protein, 9 aa, Homo Sapiens
QAVRYQGHA

SEQ ID NO: 1264511 - protein, 9 aa, Homo Sapiens
HALHFFREH

SEQ ID NO: 1264512 - protein, 9 aa, Homo Sapiens
HLVLGDCTR

SEQ ID NO: 1264513 - protein, 9 aa, Homo Sapiens
YAAMAASSV

SEQ ID NO: 1264514 - protein, 9 aa, Homo Sapiens
QLVFCQDQI

SEQ ID NO: 1264515 - protein, 9 aa, Homo Sapiens
ASSYSHQQR

SEQ ID NO: 1264516 - protein, 9 aa, Homo Sapiens
SGNSGRNPQ

SEQ ID NO: 1264517 - protein, 9 aa, Homo Sapiens
HPRIELLFF

SEQ ID NO: 1264518 - protein, 9 aa, Homo Sapiens
LHSSLGKLF

SEQ ID NO: 1264519 - protein, 9 aa, Homo Sapiens
LQNWNFLPM

SEQ ID NO: 1264520 - protein, 9 aa, Homo Sapiens
NNIPQLNNV

SEQ ID NO: 1264521 - protein, 9 aa, Homo Sapiens
LQRHVDEFL

SEQ ID NO: 1264522 - protein, 9 aa, Homo Sapiens
HSRGLVIMA

SEQ ID NO: 1264523 - protein, 9 aa, Homo Sapiens
KGLYTDADM

SEQ ID NO: 1264524 - protein, 9 aa, Homo Sapiens
IHFGVWAEM

SEQ ID NO: 1264525 - protein, 9 aa, Homo Sapiens
KTHVMSVLH

SEQ ID NO: 1264526 - protein, 9 aa, Homo Sapiens
VGFCLLIML

SEQ ID NO: 1264527 - protein, 9 aa, Homo Sapiens
GIQPHLDMK

SEQ ID NO: 1264528 - protein, 9 aa, Homo Sapiens
INDLELLGA

SEQ ID NO: 1264529 - protein, 9 aa, Homo Sapiens
CWEDSTGHW

SEQ ID NO: 1264530 - protein, 9 aa, Homo Sapiens
TFKPFEDRV

SEQ ID NO: 1264531 - protein, 9 aa, Homo Sapiens
DQLLPLAYN

SEQ ID NO: 1264532 - protein, 9 aa, Homo Sapiens
PINPAMALE

SEQ ID NO: 1264533 - protein, 9 aa, Homo Sapiens
CWVLGRDYS

SEQ ID NO: 1264534 - protein, 9 aa, Homo Sapiens
MARVQRAVQ

SEQ ID NO: 1264535 - protein, 9 aa, Homo Sapiens
YAKVEAHQL

SEQ ID NO: 1264536 - protein, 9 aa, Homo Sapiens
GNDTPVTSK

SEQ ID NO: 1264537 - protein, 9 aa, Homo Sapiens
VAQLPAQGH

SEQ ID NO: 1264538 - protein, 9 aa, Homo Sapiens
LTNFRVMNI

SEQ ID NO: 1264539 - protein, 9 aa, Homo Sapiens
EQMKRPLDT

SEQ ID NO: 1264540 - protein, 9 aa, Homo Sapiens
CAALEKLQS

SEQ ID NO: 1264541 - protein, 9 aa, Homo Sapiens
RKGYMSKRS

SEQ ID NO: 1264542 - protein, 9 aa, Homo Sapiens
YKCRECGKS

SEQ ID NO: 1264543 - protein, 9 aa, Homo Sapiens
DCLEQELLC

SEQ ID NO: 1264544 - protein, 9 aa, Homo Sapiens
KQQSEDDVH

SEQ ID NO: 1264545 - protein, 9 aa, Homo Sapiens
EVNCKKNDE

SEQ ID NO: 1264546 - protein, 9 aa, Homo Sapiens
ILISDQDVC

SEQ ID NO: 1264547 - protein, 9 aa, Homo Sapiens
VSQVAEHIR

SEQ ID NO: 1264548 - protein, 9 aa, Homo Sapiens
SFLPYTSCL

SEQ ID NO: 1264549 - protein, 9 aa, Homo Sapiens
SGPRCLLCI

SEQ ID NO: 1264550 - protein, 9 aa, Homo Sapiens
NAVPIVPQS

SEQ ID NO: 1264551 - protein, 9 aa, Homo Sapiens
EGYRWDIIA

SEQ ID NO: 1264552 - protein, 9 aa, Homo Sapiens
IKTRCEGLC

SEQ ID NO: 1264553 - protein, 9 aa, Homo Sapiens
ELADLPKRL

SEQ ID NO: 1264554 - protein, 9 aa, Homo Sapiens
PYHPKPAST

SEQ ID NO: 1264555 - protein, 9 aa, Homo Sapiens
KCFPGNQHP

SEQ ID NO: 1264556 - protein, 9 aa, Homo Sapiens
AASPWSRTL

SEQ ID NO: 1264557 - protein, 9 aa, Homo Sapiens
SSASRYHHR

SEQ ID NO: 1264558 - protein, 9 aa, Homo Sapiens
ARPIHNLGS

SEQ ID NO: 1264559 - protein, 9 aa, Homo Sapiens
PDVTESENG

SEQ ID NO: 1264560 - protein, 9 aa, Homo Sapiens
SLKSNAVLS

SEQ ID NO: 1264561 - protein, 9 aa, Homo Sapiens
RNLVLAAGD

SEQ ID NO: 1264562 - protein, 9 aa, Homo Sapiens
LKDHGSGSV

SEQ ID NO: 1264563 - protein, 9 aa, Homo Sapiens
FYKGKKKLM

SEQ ID NO: 1264564 - protein, 9 aa, Homo Sapiens
LAKEMIALK

SEQ ID NO: 1264565 - protein, 9 aa, Homo Sapiens
WPLYEAAPG

SEQ ID NO: 1264566 - protein, 9 aa, Homo Sapiens
REQWKKVVT

SEQ ID NO: 1264567 - protein, 9 aa, Homo Sapiens
IKNLYKKKL

SEQ ID NO: 1264568 - protein, 9 aa, Homo Sapiens
RPVRDCDGV

SEQ ID NO: 1264569 - protein, 9 aa, Homo Sapiens
TLNVLSLNG

SEQ ID NO: 1264570 - protein, 9 aa, Homo Sapiens
PSGMRAAGR

SEQ ID NO: 1264571 - protein, 8 aa, Homo Sapiens
QAACWYVL

SEQ ID NO: 1264572 - protein, 9 aa, Homo Sapiens
FDHTFGNAP

SEQ ID NO: 1264573 - protein, 9 aa, Homo Sapiens
AMCIVGHLP

SEQ ID NO: 1264574 - protein, 9 aa, Homo Sapiens
DLTDNMLQS

SEQ ID NO: 1264575 - protein, 9 aa, Homo Sapiens
KIPCESNNK

SEQ ID NO: 1264576 - protein, 9 aa, Homo Sapiens
PKCFDVEVS

SEQ ID NO: 1264577 - protein, 9 aa, Homo Sapiens
CLTRERRLE

SEQ ID NO: 1264578 - protein, 9 aa, Homo Sapiens
PRYIVLIAE

SEQ ID NO: 1264579 - protein, 9 aa, Homo Sapiens
LKTRQVCSL

SEQ ID NO: 1264580 - protein, 9 aa, Homo Sapiens
KVAAEARSL

SEQ ID NO: 1264581 - protein, 9 aa, Homo Sapiens
ENCDINIIV

SEQ ID NO: 1264582 - protein, 9 aa, Homo Sapiens
DSNSQSTGA

SEQ ID NO: 1264583 - protein, 9 aa, Homo Sapiens
PMQLRRDLI

SEQ ID NO: 1264584 - protein, 9 aa, Homo Sapiens
FTSFRWWRR

SEQ ID NO: 1264585 - protein, 9 aa, Homo Sapiens
PKAEELKAD

SEQ ID NO: 1264586 - protein, 9 aa, Homo Sapiens
ATAPAASLM

SEQ ID NO: 1264587 - protein, 9 aa, Homo Sapiens
HFGSALVPT

SEQ ID NO: 1264588 - protein, 9 aa, Homo Sapiens
EIYTQQKKE

SEQ ID NO: 1264589 - protein, 9 aa, Homo Sapiens
DPSDMHFIF

SEQ ID NO: 1264590 - protein, 9 aa, Homo Sapiens
AKRQPLLWN

SEQ ID NO: 1264591 - protein, 9 aa, Homo Sapiens
ECYDELGNH

SEQ ID NO: 1264592 - protein, 9 aa, Homo Sapiens
HPYIKMYIL

SEQ ID NO: 1264593 - protein, 9 aa, Homo Sapiens
YDLREDDLD

SEQ ID NO: 1264594 - protein, 9 aa, Homo Sapiens
SEDEQGDIE

SEQ ID NO: 1264595 - protein, 9 aa, Homo Sapiens
EEAEEGHAL

SEQ ID NO: 1264596 - protein, 9 aa, Homo Sapiens
TLLLSLMAT

SEQ ID NO: 1264597 - protein, 9 aa, Homo Sapiens
CQTHISLPQ

SEQ ID NO: 1264598 - protein, 9 aa, Homo Sapiens
YTVNAFEVF

SEQ ID NO: 1264599 - protein, 9 aa, Homo Sapiens
VCPLGHVPL

SEQ ID NO: 1264600 - protein, 9 aa, Homo Sapiens
TTLELSNEL

SEQ ID NO: 1264601 - protein, 9 aa, Homo Sapiens
RPKGSNKVN

SEQ ID NO: 1264602 - protein, 9 aa, Homo Sapiens
HQPSSPSQE

SEQ ID NO: 1264603 - protein, 9 aa, Homo Sapiens
GWAGSSLCI

SEQ ID NO: 1264604 - protein, 9 aa, Homo Sapiens
TAILVCCLI

SEQ ID NO: 1264605 - protein, 9 aa, Homo Sapiens
GAADFKTIC

SEQ ID NO: 1264606 - protein, 9 aa, Homo Sapiens
MEMLLKMVA

SEQ ID NO: 1264607 - protein, 9 aa, Homo Sapiens
TCINICRVD

SEQ ID NO: 1264608 - protein, 9 aa, Homo Sapiens
GKSNTGDAI

SEQ ID NO: 1264609 - protein, 9 aa, Homo Sapiens
HKPYLLSPV

SEQ ID NO: 1264610 - protein, 9 aa, Homo Sapiens
VHMALQLCP

SEQ ID NO: 1264611 - protein, 9 aa, Homo Sapiens
ARGMRPLQR

SEQ ID NO: 1264612 - protein, 9 aa, Homo Sapiens
ECLLILDYH

SEQ ID NO: 1264613 - protein, 9 aa, Homo Sapiens
RAGSEVISW

SEQ ID NO: 1264614 - protein, 9 aa, Homo Sapiens
AVEKGISEQ

SEQ ID NO: 1264615 - protein, 9 aa, Homo Sapiens
RRDTREVAI

SEQ ID NO: 1264616 - protein, 9 aa, Homo Sapiens
GTGHYMCNA

SEQ ID NO: 1264617 - protein, 9 aa, Homo Sapiens
SGDFKKPVL

SEQ ID NO: 1264618 - protein, 9 aa, Homo Sapiens
LWTLESLLS

SEQ ID NO: 1264619 - protein, 9 aa, Homo Sapiens
AAASPSWPR

SEQ ID NO: 1264620 - protein, 9 aa, Homo Sapiens
VWLSRPSGS

SEQ ID NO: 1264621 - protein, 9 aa, Homo Sapiens
EFRPRVSCE

SEQ ID NO: 1264622 - protein, 9 aa, Homo Sapiens
GFSFSKEQR

SEQ ID NO: 1264623 - protein, 9 aa, Homo Sapiens
KELVWQLQL

SEQ ID NO: 1264624 - protein, 9 aa, Homo Sapiens
LRIHNITAS

SEQ ID NO: 1264625 - protein, 9 aa, Homo Sapiens
YFCDALPIL

SEQ ID NO: 1264626 - protein, 9 aa, Homo Sapiens
NVLQMFLPQ

SEQ ID NO: 1264627 - protein, 9 aa, Homo Sapiens
SPLEKCLSS

SEQ ID NO: 1264628 - protein, 9 aa, Homo Sapiens
ELNLASNWL

SEQ ID NO: 1264629 - protein, 9 aa, Homo Sapiens
PRYDYRRRS

SEQ ID NO: 1264630 - protein, 9 aa, Homo Sapiens
GQVISLDLH

SEQ ID NO: 1264631 - protein, 9 aa, Homo Sapiens
YMHSWLEPT

SEQ ID NO: 1264632 - protein, 9 aa, Homo Sapiens
TTAVRHGSC

SEQ ID NO: 1264633 - protein, 9 aa, Homo Sapiens
SKVAAVVCS

SEQ ID NO: 1264634 - protein, 9 aa, Homo Sapiens
YENGKQQYS

SEQ ID NO: 1264635 - protein, 9 aa, Homo Sapiens
SHQCSGILQ

SEQ ID NO: 1264636 - protein, 9 aa, Homo Sapiens
TLDNSLWFP

SEQ ID NO: 1264637 - protein, 9 aa, Homo Sapiens
RVNKVMVAE

SEQ ID NO: 1264638 - protein, 9 aa, Homo Sapiens
KTKKKHFVY

SEQ ID NO: 1264639 - protein, 9 aa, Homo Sapiens
SDAANKSIL

SEQ ID NO: 1264640 - protein, 9 aa, Homo Sapiens
PSSEGASQS

SEQ ID NO: 1264641 - protein, 9 aa, Homo Sapiens
EEKSEDQGL

SEQ ID NO: 1264642 - protein, 9 aa, Homo Sapiens
LEDMYWMAS

SEQ ID NO: 1264643 - protein, 9 aa, Homo Sapiens
QTLESGPGG

SEQ ID NO: 1264644 - protein, 9 aa, Homo Sapiens
EIFTKPLKF

SEQ ID NO: 1264645 - protein, 9 aa, Homo Sapiens
QELRLEEAI

SEQ ID NO: 1264646 - protein, 9 aa, Homo Sapiens
LVRSSTYSN

SEQ ID NO: 1264647 - protein, 9 aa, Homo Sapiens
WTPETLTAF

SEQ ID NO: 1264648 - protein, 9 aa, Homo Sapiens
KPSQPAAKD

SEQ ID NO: 1264649 - protein, 9 aa, Homo Sapiens
DVIRQSLPN

SEQ ID NO: 1264650 - protein, 9 aa, Homo Sapiens
RKDSPLILQ

SEQ ID NO: 1264651 - protein, 9 aa, Homo Sapiens
GLVTVITGG

SEQ ID NO: 1264652 - protein, 9 aa, Homo Sapiens
CDAIDGGRA

SEQ ID NO: 1264653 - protein, 9 aa, Homo Sapiens
LDYHNLNLE

SEQ ID NO: 1264654 - protein, 9 aa, Homo Sapiens
IGTNEGLKE

SEQ ID NO: 1264655 - protein, 9 aa, Homo Sapiens
PRLQQMWLT

SEQ ID NO: 1264656 - protein, 9 aa, Homo Sapiens
CELPAACLK

SEQ ID NO: 1264657 - protein, 9 aa, Homo Sapiens
TQDTQNALR

SEQ ID NO: 1264658 - protein, 9 aa, Homo Sapiens
HSSPPPPPP

SEQ ID NO: 1264659 - protein, 9 aa, Homo Sapiens
DSESSVSED

SEQ ID NO: 1264660 - protein, 9 aa, Homo Sapiens
DTRGRHQKK

SEQ ID NO: 1264661 - protein, 9 aa, Homo Sapiens
SQIIYRRYS

SEQ ID NO: 1264662 - protein, 9 aa, Homo Sapiens
IELVLIDFG

SEQ ID NO: 1264663 - protein, 9 aa, Homo Sapiens
QLDINTEDL

SEQ ID NO: 1264664 - protein, 9 aa, Homo Sapiens
FSQIVAICS

SEQ ID NO: 1264665 - protein, 9 aa, Homo Sapiens
PAATETGTQ

SEQ ID NO: 1264666 - protein, 9 aa, Homo Sapiens
GCVLIRKWG

SEQ ID NO: 1264667 - protein, 9 aa, Homo Sapiens
GPVCYATDG

SEQ ID NO: 1264668 - protein, 9 aa, Homo Sapiens
TLFKDMPLQ

SEQ ID NO: 1264669 - protein, 9 aa, Homo Sapiens
DGHVMSCST

SEQ ID NO: 1264670 - protein, 9 aa, Homo Sapiens
YVPDHGRDQ

SEQ ID NO: 1264671 - protein, 9 aa, Homo Sapiens
IFMTLLYFV

SEQ ID NO: 1264672 - protein, 9 aa, Homo Sapiens
NCDCKGFYK

SEQ ID NO: 1264673 - protein, 9 aa, Homo Sapiens
SKIENFIQK

SEQ ID NO: 1264674 - protein, 9 aa, Homo Sapiens
MKDICENFQ

SEQ ID NO: 1264675 - protein, 9 aa, Homo Sapiens
WGCGLESNK

SEQ ID NO: 1264676 - protein, 9 aa, Homo Sapiens
PEHYSPVCS

SEQ ID NO: 1264677 - protein, 9 aa, Homo Sapiens
PAKENRCAA

SEQ ID NO: 1264678 - protein, 9 aa, Homo Sapiens
LFMYNRVQF

SEQ ID NO: 1264679 - protein, 9 aa, Homo Sapiens
DEEIERWRG

SEQ ID NO: 1264680 - protein, 9 aa, Homo Sapiens
PAAEEAEQH

SEQ ID NO: 1264681 - protein, 9 aa, Homo Sapiens
RQIVAGGST

SEQ ID NO: 1264682 - protein, 9 aa, Homo Sapiens
SITLAGNMW

SEQ ID NO: 1264683 - protein, 9 aa, Homo Sapiens
PRWTTSTDQ

SEQ ID NO: 1264684 - protein, 9 aa, Homo Sapiens
VTVVGLMMG

SEQ ID NO: 1264685 - protein, 9 aa, Homo Sapiens
LLITATLEK

SEQ ID NO: 1264686 - protein, 9 aa, Homo Sapiens
VKRSQGSSP

SEQ ID NO: 1264687 - protein, 9 aa, Homo Sapiens
LKMCQPELE

SEQ ID NO: 1264688 - protein, 9 aa, Homo Sapiens
APLRHADNL

SEQ ID NO: 1264689 - protein, 9 aa, Homo Sapiens
SLMATAPAA

SEQ ID NO: 1264690 - protein, 9 aa, Homo Sapiens
FLYVPVKRS

SEQ ID NO: 1264691 - protein, 9 aa, Homo Sapiens
LTNAQLHAQ

SEQ ID NO: 1264692 - protein, 9 aa, Homo Sapiens
LYATVLVLW

SEQ ID NO: 1264693 - protein, 9 aa, Homo Sapiens
VLPSHLHPE

SEQ ID NO: 1264694 - protein, 9 aa, Homo Sapiens
QNNQCYNWT

SEQ ID NO: 1264695 - protein, 9 aa, Homo Sapiens
TFNPKYGTL

SEQ ID NO: 1264696 - protein, 9 aa, Homo Sapiens
SAIKCEYMP

SEQ ID NO: 1264697 - protein, 9 aa, Homo Sapiens
EVGKSELVE

SEQ ID NO: 1264698 - protein, 9 aa, Homo Sapiens
GLSRKYIHW

SEQ ID NO: 1264699 - protein, 9 aa, Homo Sapiens
VFFILWYND

SEQ ID NO: 1264700 - protein, 9 aa, Homo Sapiens
LSAQKLTTA

SEQ ID NO: 1264701 - protein, 9 aa, Homo Sapiens
LQEIRRELE

SEQ ID NO: 1264702 - protein, 9 aa, Homo Sapiens
QHHEHLPSI

SEQ ID NO: 1264703 - protein, 9 aa, Homo Sapiens
HATQKEVSL

SEQ ID NO: 1264704 - protein, 9 aa, Homo Sapiens
GKVGTAEAV

SEQ ID NO: 1264705 - protein, 9 aa, Homo Sapiens
STYSNNESK

SEQ ID NO: 1264706 - protein, 9 aa, Homo Sapiens
RQATKDAGP

SEQ ID NO: 1264707 - protein, 9 aa, Homo Sapiens
REEDRCPLN

SEQ ID NO: 1264708 - protein, 9 aa, Homo Sapiens
PVPGNLGTA

SEQ ID NO: 1264709 - protein, 9 aa, Homo Sapiens
FLRVALRSV

SEQ ID NO: 1264710 - protein, 9 aa, Homo Sapiens
LWEQEGKMR

SEQ ID NO: 1264711 - protein, 9 aa, Homo Sapiens
CKEEQRPRS

SEQ ID NO: 1264712 - protein, 9 aa, Homo Sapiens
EERGTPYAG

SEQ ID NO: 1264713 - protein, 9 aa, Homo Sapiens
PRAPPEAPL

SEQ ID NO: 1264714 - protein, 9 aa, Homo Sapiens
VLMKHKKSY

SEQ ID NO: 1264715 - protein, 9 aa, Homo Sapiens
RSQWRCQCL

SEQ ID NO: 1264716 - protein, 9 aa, Homo Sapiens
KIERLNAEL

SEQ ID NO: 1264717 - protein, 9 aa, Homo Sapiens
LDANIATSQ

SEQ ID NO: 1264718 - protein, 9 aa, Homo Sapiens
YFMCLLKDK

SEQ ID NO: 1264719 - protein, 9 aa, Homo Sapiens
TAVVYRPCC

SEQ ID NO: 1264720 - protein, 9 aa, Homo Sapiens
VLGIETRCD

SEQ ID NO: 1264721 - protein, 9 aa, Homo Sapiens
FRNSFVLNI

SEQ ID NO: 1264722 - protein, 9 aa, Homo Sapiens
MELNKIYYL

SEQ ID NO: 1264723 - protein, 9 aa, Homo Sapiens
PEGEVGVRV

SEQ ID NO: 1264724 - protein, 9 aa, Homo Sapiens
WAIHRAYLD

SEQ ID NO: 1264725 - protein, 9 aa, Homo Sapiens
GQEEKYTDV

SEQ ID NO: 1264726 - protein, 9 aa, Homo Sapiens
GGIGGGGFH

SEQ ID NO: 1264727 - protein, 9 aa, Homo Sapiens
GVHGLQGVP

SEQ ID NO: 1264728 - protein, 9 aa, Homo Sapiens
MCDVEDCEA

SEQ ID NO: 1264729 - protein, 9 aa, Homo Sapiens
GRTGRKHQG

SEQ ID NO: 1264730 - protein, 9 aa, Homo Sapiens
QHYANLFIH

SEQ ID NO: 1264731 - protein, 9 aa, Homo Sapiens
KYMDIITKF

SEQ ID NO: 1264732 - protein, 9 aa, Homo Sapiens
LQAQTRCHR

SEQ ID NO: 1264733 - protein, 9 aa, Homo Sapiens
PTGFDDMEG

SEQ ID NO: 1264734 - protein, 9 aa, Homo Sapiens
GSITAITVT

SEQ ID NO: 1264735 - protein, 9 aa, Homo Sapiens
PPEHRELCL

SEQ ID NO: 1264736 - protein, 9 aa, Homo Sapiens
ELLKRNPRS

SEQ ID NO: 1264737 - protein, 9 aa, Homo Sapiens
EHETVAEAA

SEQ ID NO: 1264738 - protein, 9 aa, Homo Sapiens
LLLEIYTQQ

SEQ ID NO: 1264739 - protein, 9 aa, Homo Sapiens
GFTSFRWWR

SEQ ID NO: 1264740 - protein, 9 aa, Homo Sapiens
ELTEARTEC

SEQ ID NO: 1264741 - protein, 9 aa, Homo Sapiens
VWMFICIIL

SEQ ID NO: 1264742 - protein, 9 aa, Homo Sapiens
TASLGAGGG

SEQ ID NO: 1264743 - protein, 9 aa, Homo Sapiens
GSYICHCPP

SEQ ID NO: 1264744 - protein, 9 aa, Homo Sapiens
EISAPFKER

SEQ ID NO: 1264745 - protein, 9 aa, Homo Sapiens
AVSLPDEGF

SEQ ID NO: 1264746 - protein, 9 aa, Homo Sapiens
EGQPQVIEF

SEQ ID NO: 1264747 - protein, 9 aa, Homo Sapiens
NVSWAARVN

SEQ ID NO: 1264748 - protein, 9 aa, Homo Sapiens
HDEPSALAR

SEQ ID NO: 1264749 - protein, 9 aa, Homo Sapiens
NHFSSDELQ

SEQ ID NO: 1264750 - protein, 9 aa, Homo Sapiens
ENRISSLVK

SEQ ID NO: 1264751 - protein, 9 aa, Homo Sapiens
LDAELQAKI

SEQ ID NO: 1264752 - protein, 9 aa, Homo Sapiens
PCAAVRAVI

SEQ ID NO: 1264753 - protein, 9 aa, Homo Sapiens
ALNADKFSG

SEQ ID NO: 1264754 - protein, 9 aa, Homo Sapiens
FMCGPAEPQ

SEQ ID NO: 1264755 - protein, 9 aa, Homo Sapiens
SSLLNQQDE

SEQ ID NO: 1264756 - protein, 9 aa, Homo Sapiens
HPGTGKVEI

SEQ ID NO: 1264757 - protein, 9 aa, Homo Sapiens
QLTLVNLVC

SEQ ID NO: 1264758 - protein, 9 aa, Homo Sapiens
VQLSSARAE

SEQ ID NO: 1264759 - protein, 9 aa, Homo Sapiens
KTDIIDHIF

SEQ ID NO: 1264760 - protein, 9 aa, Homo Sapiens
EFFDHNGSS

SEQ ID NO: 1264761 - protein, 9 aa, Homo Sapiens
RGMFLCDEC

SEQ ID NO: 1264762 - protein, 9 aa, Homo Sapiens
TVSGLWDFM

SEQ ID NO: 1264763 - protein, 9 aa, Homo Sapiens
CISKKKTKV

SEQ ID NO: 1264764 - protein, 9 aa, Homo Sapiens
TLAGYFNLV

SEQ ID NO: 1264765 - protein, 9 aa, Homo Sapiens
LYRHNLTGI

SEQ ID NO: 1264766 - protein, 9 aa, Homo Sapiens
GRKTHHISP

SEQ ID NO: 1264767 - protein, 9 aa, Homo Sapiens
GHKIRLIVE

SEQ ID NO: 1264768 - protein, 9 aa, Homo Sapiens
KVIPLDHDN

SEQ ID NO: 1264769 - protein, 9 aa, Homo Sapiens
KEQEQYIAI

SEQ ID NO: 1264770 - protein, 9 aa, Homo Sapiens
WRSPQRSAS

SEQ ID NO: 1264771 - protein, 9 aa, Homo Sapiens
EKYTDVEEG

SEQ ID NO: 1264772 - protein, 9 aa, Homo Sapiens
WQPLTVEHM

SEQ ID NO: 1264773 - protein, 9 aa, Homo Sapiens
SREAGAKHN

SEQ ID NO: 1264774 - protein, 9 aa, Homo Sapiens
EFNLMYDVT

SEQ ID NO: 1264775 - protein, 9 aa, Homo Sapiens
LLPQRPAFA

SEQ ID NO: 1264776 - protein, 9 aa, Homo Sapiens
MHNYSGLID

SEQ ID NO: 1264777 - protein, 9 aa, Homo Sapiens
SSLCIIGGV

SEQ ID NO: 1264778 - protein, 9 aa, Homo Sapiens
YEECKDLIN

SEQ ID NO: 1264779 - protein, 9 aa, Homo Sapiens
EGQEYEDEE

SEQ ID NO: 1264780 - protein, 9 aa, Homo Sapiens
FQKLQQLHL

SEQ ID NO: 1264781 - protein, 9 aa, Homo Sapiens
HLHASRTQI

SEQ ID NO: 1264782 - protein, 9 aa, Homo Sapiens
ECGARPLTS

SEQ ID NO: 1264783 - protein, 9 aa, Homo Sapiens
GAVPATCFL

SEQ ID NO: 1264784 - protein, 9 aa, Homo Sapiens
VLSTLSVLV

SEQ ID NO: 1264785 - protein, 9 aa, Homo Sapiens
QAQHLAQEL

SEQ ID NO: 1264786 - protein, 9 aa, Homo Sapiens
LIALVTFVA

SEQ ID NO: 1264787 - protein, 9 aa, Homo Sapiens
LARKVNSLT

SEQ ID NO: 1264788 - protein, 9 aa, Homo Sapiens
ILVGTKLGL

SEQ ID NO: 1264789 - protein, 9 aa, Homo Sapiens
EIKLFKCPK

SEQ ID NO: 1264790 - protein, 9 aa, Homo Sapiens
SGLLPALVV

SEQ ID NO: 1264791 - protein, 9 aa, Homo Sapiens
ETFKALNDT

SEQ ID NO: 1264792 - protein, 9 aa, Homo Sapiens
ELIYIIRQK

SEQ ID NO: 1264793 - protein, 9 aa, Homo Sapiens
CAFLEYRRQ

SEQ ID NO: 1264794 - protein, 9 aa, Homo Sapiens
REQVLLNAR

SEQ ID NO: 1264795 - protein, 9 aa, Homo Sapiens
WGEKIVALM

SEQ ID NO: 1264796 - protein, 9 aa, Homo Sapiens
DQELQITDI

SEQ ID NO: 1264797 - protein, 9 aa, Homo Sapiens
SPVSVVLCC

SEQ ID NO: 1264798 - protein, 9 aa, Homo Sapiens
ICFIAFQVR

SEQ ID NO: 1264799 - protein, 9 aa, Homo Sapiens
VEGSKIGSE

SEQ ID NO: 1264800 - protein, 9 aa, Homo Sapiens
NFLWHGKLV

SEQ ID NO: 1264801 - protein, 9 aa, Homo Sapiens
IDVTAKLTS

SEQ ID NO: 1264802 - protein, 9 aa, Homo Sapiens
LFYERMNTI

SEQ ID NO: 1264803 - protein, 9 aa, Homo Sapiens
RYNCILTNF

SEQ ID NO: 1264804 - protein, 9 aa, Homo Sapiens
ITSKLLHQN

SEQ ID NO: 1264805 - protein, 9 aa, Homo Sapiens
ECNECEIAF

SEQ ID NO: 1264806 - protein, 9 aa, Homo Sapiens
IDYEKGAIL

SEQ ID NO: 1264807 - protein, 9 aa, Homo Sapiens
AALPRPQLQ

SEQ ID NO: 1264808 - protein, 9 aa, Homo Sapiens
PELLKQMLQ

SEQ ID NO: 1264809 - protein, 9 aa, Homo Sapiens
FCNAGIIRT

SEQ ID NO: 1264810 - protein, 9 aa, Homo Sapiens
MEEKNQVVC

SEQ ID NO: 1264811 - protein, 9 aa, Homo Sapiens
TMLHKPITL

SEQ ID NO: 1264812 - protein, 9 aa, Homo Sapiens
PYPWWPCMV

SEQ ID NO: 1264813 - protein, 9 aa, Homo Sapiens
CITSLLPQD

SEQ ID NO: 1264814 - protein, 9 aa, Homo Sapiens
VNLFDTTEV

SEQ ID NO: 1264815 - protein, 9 aa, Homo Sapiens
KQNENIRKE

SEQ ID NO: 1264816 - protein, 9 aa, Homo Sapiens
WRHLMRPLC

SEQ ID NO: 1264817 - protein, 9 aa, Homo Sapiens
RRVTELFMF

SEQ ID NO: 1264818 - protein, 9 aa, Homo Sapiens
NIVSRRPSE

SEQ ID NO: 1264819 - protein, 9 aa, Homo Sapiens
EENIYAAVK

SEQ ID NO: 1264820 - protein, 9 aa, Homo Sapiens
GWFTMVITV

SEQ ID NO: 1264821 - protein, 9 aa, Homo Sapiens
VLSSATATV

SEQ ID NO: 1264822 - protein, 9 aa, Homo Sapiens
CNMLHGATE

SEQ ID NO: 1264823 - protein, 9 aa, Homo Sapiens
VGFFIFVLF

SEQ ID NO: 1264824 - protein, 9 aa, Homo Sapiens
CLDGTCLAI

SEQ ID NO: 1264825 - protein, 9 aa, Homo Sapiens
NYGYDECAV

SEQ ID NO: 1264826 - protein, 9 aa, Homo Sapiens
KSALNRIQV

SEQ ID NO: 1264827 - protein, 9 aa, Homo Sapiens
CWDQDADAR

SEQ ID NO: 1264828 - protein, 9 aa, Homo Sapiens
RCSVMVEAE

SEQ ID NO: 1264829 - protein, 9 aa, Homo Sapiens
RCSLEDIVI

SEQ ID NO: 1264830 - protein, 9 aa, Homo Sapiens
GTQASAAPT

SEQ ID NO: 1264831 - protein, 9 aa, Homo Sapiens
DDRGQLIKS

SEQ ID NO: 1264832 - protein, 9 aa, Homo Sapiens
VMKEKCKFG

SEQ ID NO: 1264833 - protein, 9 aa, Homo Sapiens
TIFIMNRHP

SEQ ID NO: 1264834 - protein, 9 aa, Homo Sapiens
IEKGFAPLN

SEQ ID NO: 1264835 - protein, 9 aa, Homo Sapiens
DGLHGSHIS

SEQ ID NO: 1264836 - protein, 9 aa, Homo Sapiens
ISKGIFAPL

SEQ ID NO: 1264837 - protein, 9 aa, Homo Sapiens
RTTTTVGVT

SEQ ID NO: 1264838 - protein, 9 aa, Homo Sapiens
TLNKCTSVS

SEQ ID NO: 1264839 - protein, 9 aa, Homo Sapiens
GYSDIVQNG

SEQ ID NO: 1264840 - protein, 9 aa, Homo Sapiens
SGTIAIKRY

SEQ ID NO: 1264841 - protein, 9 aa, Homo Sapiens
MVLLLILPV

SEQ ID NO: 1264842 - protein, 9 aa, Homo Sapiens
CLPRPVSLG

SEQ ID NO: 1264843 - protein, 9 aa, Homo Sapiens
WGLLPGWGQ

SEQ ID NO: 1264844 - protein, 9 aa, Homo Sapiens
VPDQEPTHT

SEQ ID NO: 1264845 - protein, 9 aa, Homo Sapiens
KEWAAHPLL

SEQ ID NO: 1264846 - protein, 9 aa, Homo Sapiens
RHTQAYTQT

SEQ ID NO: 1264847 - protein, 9 aa, Homo Sapiens
LTPGSDWRD

SEQ ID NO: 1264848 - protein, 9 aa, Homo Sapiens
QLQCLLNQE

SEQ ID NO: 1264849 - protein, 9 aa, Homo Sapiens
NLKALSKQP

SEQ ID NO: 1264850 - protein, 9 aa, Homo Sapiens
SNALHVVIS

SEQ ID NO: 1264851 - protein, 9 aa, Homo Sapiens
DSGPHTFPK

SEQ ID NO: 1264852 - protein, 9 aa, Homo Sapiens
HPPASEGSC

SEQ ID NO: 1264853 - protein, 9 aa, Homo Sapiens
EDHAEVQSP

SEQ ID NO: 1264854 - protein, 9 aa, Homo Sapiens
DSEMNKLMM

SEQ ID NO: 1264855 - protein, 9 aa, Homo Sapiens
DVNEILRND

SEQ ID NO: 1264856 - protein, 9 aa, Homo Sapiens
LYQVIHKMH

SEQ ID NO: 1264857 - protein, 9 aa, Homo Sapiens
MTRNKVAEH

SEQ ID NO: 1264858 - protein, 9 aa, Homo Sapiens
LSNISKRTE

SEQ ID NO: 1264859 - protein, 9 aa, Homo Sapiens
PNTTVSVHP

SEQ ID NO: 1264860 - protein, 9 aa, Homo Sapiens
TGKATTIPP

SEQ ID NO: 1264861 - protein, 9 aa, Homo Sapiens
FEDLLHTID

SEQ ID NO: 1264862 - protein, 9 aa, Homo Sapiens
CWGHYNNVS

SEQ ID NO: 1264863 - protein, 9 aa, Homo Sapiens
YTGRIAQEL

SEQ ID NO: 1264864 - protein, 9 aa, Homo Sapiens
NGSVFQTGP

SEQ ID NO: 1264865 - protein, 9 aa, Homo Sapiens
GPFGIPGTS

SEQ ID NO: 1264866 - protein, 9 aa, Homo Sapiens
SVCYLLPDA

SEQ ID NO: 1264867 - protein, 9 aa, Homo Sapiens
GVIATLLFC

SEQ ID NO: 1264868 - protein, 9 aa, Homo Sapiens
PPHRVSRLR

SEQ ID NO: 1264869 - protein, 9 aa, Homo Sapiens
FANSPSDTP

SEQ ID NO: 1264870 - protein, 9 aa, Homo Sapiens
QGIPVTEDF

SEQ ID NO: 1264871 - protein, 9 aa, Homo Sapiens
AMSPKLMIY

SEQ ID NO: 1264872 - protein, 9 aa, Homo Sapiens
KLKTPRLSR

SEQ ID NO: 1264873 - protein, 9 aa, Homo Sapiens
GSKVMGGLK

SEQ ID NO: 1264874 - protein, 9 aa, Homo Sapiens
KALLKILKL

SEQ ID NO: 1264875 - protein, 9 aa, Homo Sapiens
TFNWNTFLQ

SEQ ID NO: 1264876 - protein, 9 aa, Homo Sapiens
AFCNYDSGD

SEQ ID NO: 1264877 - protein, 9 aa, Homo Sapiens
NVAAAVWVV

SEQ ID NO: 1264878 - protein, 9 aa, Homo Sapiens
PDLEVKEWM

SEQ ID NO: 1264879 - protein, 9 aa, Homo Sapiens
NVFVHKKKC

SEQ ID NO: 1264880 - protein, 9 aa, Homo Sapiens
LVVDGLRVR

SEQ ID NO: 1264881 - protein, 9 aa, Homo Sapiens
KIVSVFYTV

SEQ ID NO: 1264882 - protein, 9 aa, Homo Sapiens
TPHPLTVTA

SEQ ID NO: 1264883 - protein, 9 aa, Homo Sapiens
GFKFDMDEL

SEQ ID NO: 1264884 - protein, 9 aa, Homo Sapiens
VRSSGFPNP

SEQ ID NO: 1264885 - protein, 9 aa, Homo Sapiens
ALSAHTILP

SEQ ID NO: 1264886 - protein, 9 aa, Homo Sapiens
IGFLSSVSP

SEQ ID NO: 1264887 - protein, 9 aa, Homo Sapiens
LKWETDEAQ

SEQ ID NO: 1264888 - protein, 9 aa, Homo Sapiens
TSPTLLFSC

SEQ ID NO: 1264889 - protein, 9 aa, Homo Sapiens
DEDSQKFFF

SEQ ID NO: 1264890 - protein, 9 aa, Homo Sapiens
KYFCRHEMT

SEQ ID NO: 1264891 - protein, 9 aa, Homo Sapiens
IQEAMRVLE

SEQ ID NO: 1264892 - protein, 9 aa, Homo Sapiens
NMREFILWC

SEQ ID NO: 1264893 - protein, 9 aa, Homo Sapiens
VVCYTNHDL

SEQ ID NO: 1264894 - protein, 9 aa, Homo Sapiens
GNFIIHISH

SEQ ID NO: 1264895 - protein, 9 aa, Homo Sapiens
IGLVCVTQA

SEQ ID NO: 1264896 - protein, 9 aa, Homo Sapiens
KKRFSSHDI

SEQ ID NO: 1264897 - protein, 9 aa, Homo Sapiens
AVLLMEKLE

SEQ ID NO: 1264898 - protein, 9 aa, Homo Sapiens
NISILDQIL

SEQ ID NO: 1264899 - protein, 9 aa, Homo Sapiens
ISLNKFKQT

SEQ ID NO: 1264900 - protein, 9 aa, Homo Sapiens
VNSIEFDSE

SEQ ID NO: 1264901 - protein, 9 aa, Homo Sapiens
MQAGNKLKA

SEQ ID NO: 1264902 - protein, 9 aa, Homo Sapiens
GSYTSFHNN

SEQ ID NO: 1264903 - protein, 9 aa, Homo Sapiens
SEETSAEED

SEQ ID NO: 1264904 - protein, 9 aa, Homo Sapiens
LTGVVMHYG

SEQ ID NO: 1264905 - protein, 9 aa, Homo Sapiens
CRVVFDDNY

SEQ ID NO: 1264906 - protein, 9 aa, Homo Sapiens
KCKKEYQIF

SEQ ID NO: 1264907 - protein, 9 aa, Homo Sapiens
DETKAPQTP

SEQ ID NO: 1264908 - protein, 9 aa, Homo Sapiens
VWEADASRS

SEQ ID NO: 1264909 - protein, 9 aa, Homo Sapiens
YGQTEMVLI

SEQ ID NO: 1264910 - protein, 9 aa, Homo Sapiens
AVGGHSHRG

SEQ ID NO: 1264911 - protein, 9 aa, Homo Sapiens
SLTLHQRFH

SEQ ID NO: 1264912 - protein, 9 aa, Homo Sapiens
YRSTCLVNW

SEQ ID NO: 1264913 - protein, 9 aa, Homo Sapiens
NSGARVPPT

SEQ ID NO: 1264914 - protein, 9 aa, Homo Sapiens
QERRQEVLI

SEQ ID NO: 1264915 - protein, 9 aa, Homo Sapiens
ENDVPTIFL

SEQ ID NO: 1264916 - protein, 9 aa, Homo Sapiens
HGVVWDSKK

SEQ ID NO: 1264917 - protein, 9 aa, Homo Sapiens
LLTPPQIGK

SEQ ID NO: 1264918 - protein, 9 aa, Homo Sapiens
DDGVADVLA

SEQ ID NO: 1264919 - protein, 9 aa, Homo Sapiens
NDSVDAQNI

SEQ ID NO: 1264920 - protein, 9 aa, Homo Sapiens
EQLSELEKI

SEQ ID NO: 1264921 - protein, 9 aa, Homo Sapiens
WVVTADHCI

SEQ ID NO: 1264922 - protein, 9 aa, Homo Sapiens
TKLKDVKSS

SEQ ID NO: 1264923 - protein, 9 aa, Homo Sapiens
QISPGGAGS

SEQ ID NO: 1264924 - protein, 9 aa, Homo Sapiens
DMSNLFYTP

SEQ ID NO: 1264925 - protein, 9 aa, Homo Sapiens
KLHHLGNDE

SEQ ID NO: 1264926 - protein, 9 aa, Homo Sapiens
ITALPDRGL

SEQ ID NO: 1264927 - protein, 9 aa, Homo Sapiens
PVLMALADG

SEQ ID NO: 1264928 - protein, 9 aa, Homo Sapiens
KLPKKLKGK

SEQ ID NO: 1264929 - protein, 9 aa, Homo Sapiens
HHFQKVIPH

SEQ ID NO: 1264930 - protein, 9 aa, Homo Sapiens
LPNKIHMHL

SEQ ID NO: 1264931 - protein, 9 aa, Homo Sapiens
IIVHATSNG

SEQ ID NO: 1264932 - protein, 9 aa, Homo Sapiens
LRERQLHVG

SEQ ID NO: 1264933 - protein, 9 aa, Homo Sapiens
QVYLKAFLL

SEQ ID NO: 1264934 - protein, 9 aa, Homo Sapiens
VLAKYSMDH

SEQ ID NO: 1264935 - protein, 9 aa, Homo Sapiens
QGLQGLKDK

SEQ ID NO: 1264936 - protein, 9 aa, Homo Sapiens
GATLTGEQL

SEQ ID NO: 1264937 - protein, 9 aa, Homo Sapiens
RLAKNLNKQ

SEQ ID NO: 1264938 - protein, 9 aa, Homo Sapiens
MDNIFDFMI

SEQ ID NO: 1264939 - protein, 9 aa, Homo Sapiens
LSIQPKGKQ

SEQ ID NO: 1264940 - protein, 9 aa, Homo Sapiens
CNICHILLI

SEQ ID NO: 1264941 - protein, 9 aa, Homo Sapiens
MKLHSGLMI

SEQ ID NO: 1264942 - protein, 9 aa, Homo Sapiens
RDNLKYSSK

SEQ ID NO: 1264943 - protein, 9 aa, Homo Sapiens
TIAPEKEED

SEQ ID NO: 1264944 - protein, 9 aa, Homo Sapiens
PPVMTLAIP

SEQ ID NO: 1264945 - protein, 9 aa, Homo Sapiens
MGGKEDNGY

SEQ ID NO: 1264946 - protein, 9 aa, Homo Sapiens
RRHLSQDHM

SEQ ID NO: 1264947 - protein, 9 aa, Homo Sapiens
DLLFHGEAS

SEQ ID NO: 1264948 - protein, 9 aa, Homo Sapiens
VTVRDAKNI

SEQ ID NO: 1264949 - protein, 9 aa, Homo Sapiens
RPMEAPAPH

SEQ ID NO: 1264950 - protein, 9 aa, Homo Sapiens
LFYDQILCD

SEQ ID NO: 1264951 - protein, 9 aa, Homo Sapiens
AVTIIITFI

SEQ ID NO: 1264952 - protein, 9 aa, Homo Sapiens
FTLHSCNRT

SEQ ID NO: 1264953 - protein, 9 aa, Homo Sapiens
TGFTENEVI

SEQ ID NO: 1264954 - protein, 9 aa, Homo Sapiens
EEWRRCRET

SEQ ID NO: 1264955 - protein, 9 aa, Homo Sapiens
KRLTGGDWF

SEQ ID NO: 1264956 - protein, 9 aa, Homo Sapiens
NTDASASAP

SEQ ID NO: 1264957 - protein, 9 aa, Homo Sapiens
NITHGCSSE

SEQ ID NO: 1264958 - protein, 9 aa, Homo Sapiens
QPQSKNALF

SEQ ID NO: 1264959 - protein, 9 aa, Homo Sapiens
ILPVLLLKE

SEQ ID NO: 1264960 - protein, 9 aa, Homo Sapiens
IFWVGRKGD

SEQ ID NO: 1264961 - protein, 9 aa, Homo Sapiens
IDLRVEVQK

SEQ ID NO: 1264962 - protein, 9 aa, Homo Sapiens
KILAYLRLG

SEQ ID NO: 1264963 - protein, 9 aa, Homo Sapiens
DTVVAYYQQ

SEQ ID NO: 1264964 - protein, 9 aa, Homo Sapiens
EEEIPEESD

SEQ ID NO: 1264965 - protein, 9 aa, Homo Sapiens
REPGPSPFS

SEQ ID NO: 1264966 - protein, 9 aa, Homo Sapiens
HQSFMTPSC

SEQ ID NO: 1264967 - protein, 9 aa, Homo Sapiens
SLYMSCGDC

SEQ ID NO: 1264968 - protein, 9 aa, Homo Sapiens
VRSNPHTIT

SEQ ID NO: 1264969 - protein, 9 aa, Homo Sapiens
EREQKLKLH

SEQ ID NO: 1264970 - protein, 9 aa, Homo Sapiens
HLRNLLKPT

SEQ ID NO: 1264971 - protein, 9 aa, Homo Sapiens
TYKFNFSKI

SEQ ID NO: 1264972 - protein, 9 aa, Homo Sapiens
AGTSPVHGA

SEQ ID NO: 1264973 - protein, 9 aa, Homo Sapiens
HKYMDIITK

SEQ ID NO: 1264974 - protein, 9 aa, Homo Sapiens
DKRSAFGVS

SEQ ID NO: 1264975 - protein, 9 aa, Homo Sapiens
VKTLRTQCP

SEQ ID NO: 1264976 - protein, 9 aa, Homo Sapiens
KSKEITFQL

SEQ ID NO: 1264977 - protein, 9 aa, Homo Sapiens
IIAARALHK

SEQ ID NO: 1264978 - protein, 9 aa, Homo Sapiens
KDLHWLYLS

SEQ ID NO: 1264979 - protein, 9 aa, Homo Sapiens
ISSDNLTVS

SEQ ID NO: 1264980 - protein, 9 aa, Homo Sapiens
YAGLKSAGR

SEQ ID NO: 1264981 - protein, 9 aa, Homo Sapiens
KFNFSKIIV

SEQ ID NO: 1264982 - protein, 9 aa, Homo Sapiens
KAQEFLPKT

SEQ ID NO: 1264983 - protein, 9 aa, Homo Sapiens
QITIIANAT

SEQ ID NO: 1264984 - protein, 9 aa, Homo Sapiens
CTGQPLPQS

SEQ ID NO: 1264985 - protein, 9 aa, Homo Sapiens
VGKEQHPAA

SEQ ID NO: 1264986 - protein, 9 aa, Homo Sapiens
AEVDVIAKA

SEQ ID NO: 1264987 - protein, 9 aa, Homo Sapiens
TSFYWCLRK

SEQ ID NO: 1264988 - protein, 9 aa, Homo Sapiens
KYAQDFLVD

SEQ ID NO: 1264989 - protein, 9 aa, Homo Sapiens
CQSDMDECS

SEQ ID NO: 1264990 - protein, 9 aa, Homo Sapiens
GGWLTDGSV

SEQ ID NO: 1264991 - protein, 9 aa, Homo Sapiens
SSWGCNVSR

SEQ ID NO: 1264992 - protein, 9 aa, Homo Sapiens
AVMHLRFSA

SEQ ID NO: 1264993 - protein, 9 aa, Homo Sapiens
PAKSKLAVS

SEQ ID NO: 1264994 - protein, 9 aa, Homo Sapiens
WRQLRRVLE

SEQ ID NO: 1264995 - protein, 9 aa, Homo Sapiens
EVMNPHPKK

SEQ ID NO: 1264996 - protein, 9 aa, Homo Sapiens
EDEEEEELE

SEQ ID NO: 1264997 - protein, 9 aa, Homo Sapiens
PCSLSAPAE

SEQ ID NO: 1264998 - protein, 9 aa, Homo Sapiens
LDKKLDCGC

SEQ ID NO: 1264999 - protein, 9 aa, Homo Sapiens
LRWLLEYVK

SEQ ID NO: 1265000 - protein, 9 aa, Homo Sapiens
TKPWNGGMS

SEQ ID NO: 1265001 - protein, 9 aa, Homo Sapiens
QMYQWAQVK

SEQ ID NO: 1265002 - protein, 9 aa, Homo Sapiens
DPTIENNFT

SEQ ID NO: 1265003 - protein, 9 aa, Homo Sapiens
TSASASLEV

SEQ ID NO: 1265004 - protein, 9 aa, Homo Sapiens
HLEEFPVLN

SEQ ID NO: 1265005 - protein, 9 aa, Homo Sapiens
LVLFEEKNQ

SEQ ID NO: 1265006 - protein, 9 aa, Homo Sapiens
IQTSSQAKV

SEQ ID NO: 1265007 - protein, 9 aa, Homo Sapiens
MAREKGSQI

SEQ ID NO: 1265008 - protein, 9 aa, Homo Sapiens
LKKALVTSE

SEQ ID NO: 1265009 - protein, 9 aa, Homo Sapiens
GRTGINEKK

SEQ ID NO: 1265010 - protein, 9 aa, Homo Sapiens
YYIEASIAG

SEQ ID NO: 1265011 - protein, 9 aa, Homo Sapiens
CAMKALQKR

SEQ ID NO: 1265012 - protein, 9 aa, Homo Sapiens
DPETRRVTE

SEQ ID NO: 1265013 - protein, 9 aa, Homo Sapiens
LGSSKEMMF

SEQ ID NO: 1265014 - protein, 9 aa, Homo Sapiens
SCIDDKNPC

SEQ ID NO: 1265015 - protein, 9 aa, Homo Sapiens
PFSFHLPVL

SEQ ID NO: 1265016 - protein, 9 aa, Homo Sapiens
KAQPLRVGD

SEQ ID NO: 1265017 - protein, 9 aa, Homo Sapiens
KSYVKLREF

SEQ ID NO: 1265018 - protein, 9 aa, Homo Sapiens
RMCQVTSTD

SEQ ID NO: 1265019 - protein, 9 aa, Homo Sapiens
SVTMLLRYS

SEQ ID NO: 1265020 - protein, 9 aa, Homo Sapiens
QVKLCRAVS

SEQ ID NO: 1265021 - protein, 9 aa, Homo Sapiens
GTLCPGGRP

SEQ ID NO: 1265022 - protein, 9 aa, Homo Sapiens
FTTFCGGLA

SEQ ID NO: 1265023 - protein, 9 aa, Homo Sapiens
YVFKKGDLY

SEQ ID NO: 1265024 - protein, 9 aa, Homo Sapiens
VIYIINVHI

SEQ ID NO: 1265025 - protein, 9 aa, Homo Sapiens
ADPTCSDAY

SEQ ID NO: 1265026 - protein, 9 aa, Homo Sapiens
HNLTTKSVC

SEQ ID NO: 1265027 - protein, 9 aa, Homo Sapiens
CPATHALEE

SEQ ID NO: 1265028 - protein, 9 aa, Homo Sapiens
DSILVPAVT

SEQ ID NO: 1265029 - protein, 9 aa, Homo Sapiens
VIREIQSAA

SEQ ID NO: 1265030 - protein, 9 aa, Homo Sapiens
SHCTPPSPY

SEQ ID NO: 1265031 - protein, 9 aa, Homo Sapiens
RMQHQSQKC

SEQ ID NO: 1265032 - protein, 9 aa, Homo Sapiens
FRVMLLAWK

SEQ ID NO: 1265033 - protein, 9 aa, Homo Sapiens
NKEFLHQGQ

SEQ ID NO: 1265034 - protein, 9 aa, Homo Sapiens
NGSGQNKTQ

SEQ ID NO: 1265035 - protein, 9 aa, Homo Sapiens
FLSRDYLAT

SEQ ID NO: 1265036 - protein, 9 aa, Homo Sapiens
CLLELQYFI

SEQ ID NO: 1265037 - protein, 9 aa, Homo Sapiens
VSGELGGGW

SEQ ID NO: 1265038 - protein, 9 aa, Homo Sapiens
DCIGWLDDF

SEQ ID NO: 1265039 - protein, 9 aa, Homo Sapiens
AIHTFVQSE

SEQ ID NO: 1265040 - protein, 9 aa, Homo Sapiens
KATQSVLIS

SEQ ID NO: 1265041 - protein, 9 aa, Homo Sapiens
MAAKLLAKY

SEQ ID NO: 1265042 - protein, 9 aa, Homo Sapiens
LNQWLTMTA

SEQ ID NO: 1265043 - protein, 9 aa, Homo Sapiens
FSARVIDGK

SEQ ID NO: 1265044 - protein, 9 aa, Homo Sapiens
EDVTYASKE

SEQ ID NO: 1265045 - protein, 9 aa, Homo Sapiens
YEINLMDEL

SEQ ID NO: 1265046 - protein, 9 aa, Homo Sapiens
TDGNDTINA

SEQ ID NO: 1265047 - protein, 9 aa, Homo Sapiens
LYKGFVPGM

SEQ ID NO: 1265048 - protein, 9 aa, Homo Sapiens
TVPERERIW

SEQ ID NO: 1265049 - protein, 9 aa, Homo Sapiens
KCRECGKSF

SEQ ID NO: 1265050 - protein, 9 aa, Homo Sapiens
EEQESLVAA

SEQ ID NO: 1265051 - protein, 9 aa, Homo Sapiens
PCDWFGDFS

SEQ ID NO: 1265052 - protein, 9 aa, Homo Sapiens
PQVSDGSEV

SEQ ID NO: 1265053 - protein, 9 aa, Homo Sapiens
ACHGPLLTR

SEQ ID NO: 1265054 - protein, 9 aa, Homo Sapiens
AADSAPCDW

SEQ ID NO: 1265055 - protein, 9 aa, Homo Sapiens
QYAVNRRLA

SEQ ID NO: 1265056 - protein, 9 aa, Homo Sapiens
AGASVAARK

SEQ ID NO: 1265057 - protein, 9 aa, Homo Sapiens
YNQDEWAWN

SEQ ID NO: 1265058 - protein, 9 aa, Homo Sapiens
TCDSEESGN

SEQ ID NO: 1265059 - protein, 9 aa, Homo Sapiens
HGEVLVNIK

SEQ ID NO: 1265060 - protein, 9 aa, Homo Sapiens
PQYMSVNQA

SEQ ID NO: 1265061 - protein, 9 aa, Homo Sapiens
ASISNSTRD

SEQ ID NO: 1265062 - protein, 9 aa, Homo Sapiens
VTRMSMDLK

SEQ ID NO: 1265063 - protein, 9 aa, Homo Sapiens
QWINVFQED

SEQ ID NO: 1265064 - protein, 9 aa, Homo Sapiens
TPETATRRP

SEQ ID NO: 1265065 - protein, 9 aa, Homo Sapiens
TATLFVVIT

SEQ ID NO: 1265066 - protein, 9 aa, Homo Sapiens
LFYVTALFS

SEQ ID NO: 1265067 - protein, 9 aa, Homo Sapiens
ASVSHGAIP

SEQ ID NO: 1265068 - protein, 9 aa, Homo Sapiens
TARSHRRAR

SEQ ID NO: 1265069 - protein, 9 aa, Homo Sapiens
LSNLCHFCD

SEQ ID NO: 1265070 - protein, 9 aa, Homo Sapiens
CRSLGYPGI

SEQ ID NO: 1265071 - protein, 9 aa, Homo Sapiens
EAAVRIGIV

SEQ ID NO: 1265072 - protein, 9 aa, Homo Sapiens
VVVLQCGSD

SEQ ID NO: 1265073 - protein, 9 aa, Homo Sapiens
VCYATDGGC

SEQ ID NO: 1265074 - protein, 9 aa, Homo Sapiens
DSVSNYQRV

SEQ ID NO: 1265075 - protein, 9 aa, Homo Sapiens
SINVVAWSP

SEQ ID NO: 1265076 - protein, 9 aa, Homo Sapiens
HILKKEHTI

SEQ ID NO: 1265077 - protein, 9 aa, Homo Sapiens
ATVSEGKKQ

SEQ ID NO: 1265078 - protein, 9 aa, Homo Sapiens
SVVVYRLVT

SEQ ID NO: 1265079 - protein, 9 aa, Homo Sapiens
LQPRQVLCD

SEQ ID NO: 1265080 - protein, 9 aa, Homo Sapiens
WLLLGSLPS

SEQ ID NO: 1265081 - protein, 9 aa, Homo Sapiens
PPILNHLAK

SEQ ID NO: 1265082 - protein, 9 aa, Homo Sapiens
LGTVMHRMI

SEQ ID NO: 1265083 - protein, 9 aa, Homo Sapiens
LTTTDVRKI

SEQ ID NO: 1265084 - protein, 9 aa, Homo Sapiens
LIHHYQIHT

SEQ ID NO: 1265085 - protein, 9 aa, Homo Sapiens
CTGPSCARS

SEQ ID NO: 1265086 - protein, 9 aa, Homo Sapiens
QLATSYFID

SEQ ID NO: 1265087 - protein, 9 aa, Homo Sapiens
CPWRIWFLD

SEQ ID NO: 1265088 - protein, 9 aa, Homo Sapiens
LIYDITNYQ

SEQ ID NO: 1265089 - protein, 9 aa, Homo Sapiens
GSGPFTDVC

SEQ ID NO: 1265090 - protein, 9 aa, Homo Sapiens
EVRFSIHLP

SEQ ID NO: 1265091 - protein, 9 aa, Homo Sapiens
MHFRSLCTK

SEQ ID NO: 1265092 - protein, 9 aa, Homo Sapiens
NASLGKFLG

SEQ ID NO: 1265093 - protein, 9 aa, Homo Sapiens
GYGIRYEFV

SEQ ID NO: 1265094 - protein, 9 aa, Homo Sapiens
LIQGWDITV

SEQ ID NO: 1265095 - protein, 9 aa, Homo Sapiens
MATHRAGGL

SEQ ID NO: 1265096 - protein, 9 aa, Homo Sapiens
QDADVELER

SEQ ID NO: 1265097 - protein, 9 aa, Homo Sapiens
TKLDLLMIH

SEQ ID NO: 1265098 - protein, 9 aa, Homo Sapiens
VFIPVYIAA

SEQ ID NO: 1265099 - protein, 9 aa, Homo Sapiens
TVFFPSASG

SEQ ID NO: 1265100 - protein, 9 aa, Homo Sapiens
VMEERYKMY

SEQ ID NO: 1265101 - protein, 9 aa, Homo Sapiens
LASASLVNV

SEQ ID NO: 1265102 - protein, 9 aa, Homo Sapiens
SDLLRLNQL

SEQ ID NO: 1265103 - protein, 9 aa, Homo Sapiens
PKKTHTPCV

SEQ ID NO: 1265104 - protein, 9 aa, Homo Sapiens
IIHNYSAAL

SEQ ID NO: 1265105 - protein, 9 aa, Homo Sapiens
HTGESHFKL

SEQ ID NO: 1265106 - protein, 9 aa, Homo Sapiens
AIYTVTGQS

SEQ ID NO: 1265107 - protein, 9 aa, Homo Sapiens
DEAIVAGPE

SEQ ID NO: 1265108 - protein, 9 aa, Homo Sapiens
STGSGKNSG

SEQ ID NO: 1265109 - protein, 9 aa, Homo Sapiens
LLCKEILHS

SEQ ID NO: 1265110 - protein, 9 aa, Homo Sapiens
LESGPGGQT

SEQ ID NO: 1265111 - protein, 9 aa, Homo Sapiens
FCMTEEVLQ

SEQ ID NO: 1265112 - protein, 9 aa, Homo Sapiens
RSGGVPGAI

SEQ ID NO: 1265113 - protein, 9 aa, Homo Sapiens
SLRMDSEPV

SEQ ID NO: 1265114 - protein, 9 aa, Homo Sapiens
NNGFFLKVT

SEQ ID NO: 1265115 - protein, 9 aa, Homo Sapiens
ADPQSRDAH

SEQ ID NO: 1265116 - protein, 9 aa, Homo Sapiens
EEWFECKNA

SEQ ID NO: 1265117 - protein, 9 aa, Homo Sapiens
DMKVMEERY

SEQ ID NO: 1265118 - protein, 9 aa, Homo Sapiens
HRHRSRINT

SEQ ID NO: 1265119 - protein, 9 aa, Homo Sapiens
EKNHTRKNP

SEQ ID NO: 1265120 - protein, 9 aa, Homo Sapiens
NLLIEPCKY

SEQ ID NO: 1265121 - protein, 9 aa, Homo Sapiens
PLYPPILSY

SEQ ID NO: 1265122 - protein, 9 aa, Homo Sapiens
GSFDNNKTV

SEQ ID NO: 1265123 - protein, 9 aa, Homo Sapiens
LRSYLPDHR

SEQ ID NO: 1265124 - protein, 9 aa, Homo Sapiens
AKLVSYVSK

SEQ ID NO: 1265125 - protein, 9 aa, Homo Sapiens
ILLDLTDNM

SEQ ID NO: 1265126 - protein, 9 aa, Homo Sapiens
LQNKLPLTR

SEQ ID NO: 1265127 - protein, 9 aa, Homo Sapiens
YPGFFLSQC

SEQ ID NO: 1265128 - protein, 9 aa, Homo Sapiens
MDGYSDIVQ

SEQ ID NO: 1265129 - protein, 9 aa, Homo Sapiens
QAEGAVYPF

SEQ ID NO: 1265130 - protein, 9 aa, Homo Sapiens
IDAIYKDLT

SEQ ID NO: 1265131 - protein, 9 aa, Homo Sapiens
YSKKLMDLL

SEQ ID NO: 1265132 - protein, 9 aa, Homo Sapiens
IKLTGVHTV

SEQ ID NO: 1265133 - protein, 9 aa, Homo Sapiens
TVACASYKP

SEQ ID NO: 1265134 - protein, 9 aa, Homo Sapiens
FIPNRVIGL

SEQ ID NO: 1265135 - protein, 9 aa, Homo Sapiens
DNAVKILPI

SEQ ID NO: 1265136 - protein, 9 aa, Homo Sapiens
LRLSFSTKP

SEQ ID NO: 1265137 - protein, 9 aa, Homo Sapiens
MAASPSSSA

SEQ ID NO: 1265138 - protein, 9 aa, Homo Sapiens
KLRRKRRRK

SEQ ID NO: 1265139 - protein, 9 aa, Homo Sapiens
PLKRKCEMA

SEQ ID NO: 1265140 - protein, 9 aa, Homo Sapiens
PIAFRMNVA

SEQ ID NO: 1265141 - protein, 9 aa, Homo Sapiens
RMGRTGRKH

SEQ ID NO: 1265142 - protein, 9 aa, Homo Sapiens
VDIAEPVCR

SEQ ID NO: 1265143 - protein, 9 aa, Homo Sapiens
PVPFDQGSP

SEQ ID NO: 1265144 - protein, 9 aa, Homo Sapiens
QENSDETKA

SEQ ID NO: 1265145 - protein, 9 aa, Homo Sapiens
PREVFGFEQ

SEQ ID NO: 1265146 - protein, 9 aa, Homo Sapiens
WTGDNMFFY

SEQ ID NO: 1265147 - protein, 9 aa, Homo Sapiens
VPELPTPWL

SEQ ID NO: 1265148 - protein, 9 aa, Homo Sapiens
REALKLHIQ

SEQ ID NO: 1265149 - protein, 9 aa, Homo Sapiens
CGMRCKSLL

SEQ ID NO: 1265150 - protein, 9 aa, Homo Sapiens
EMRILMVGM

SEQ ID NO: 1265151 - protein, 9 aa, Homo Sapiens
QAPMAHLSE

SEQ ID NO: 1265152 - protein, 9 aa, Homo Sapiens
GGRHCALGR

SEQ ID NO: 1265153 - protein, 9 aa, Homo Sapiens
NDRNDRVIR

SEQ ID NO: 1265154 - protein, 9 aa, Homo Sapiens
SISVAGMPA

SEQ ID NO: 1265155 - protein, 9 aa, Homo Sapiens
TLIPGSSNQ

SEQ ID NO: 1265156 - protein, 9 aa, Homo Sapiens
MACSPEISH

SEQ ID NO: 1265157 - protein, 9 aa, Homo Sapiens
HAGKVAEET

SEQ ID NO: 1265158 - protein, 9 aa, Homo Sapiens
YYRGHMSSA

SEQ ID NO: 1265159 - protein, 9 aa, Homo Sapiens
RPQAKAVVR

SEQ ID NO: 1265160 - protein, 9 aa, Homo Sapiens
SSSIQAQPL

SEQ ID NO: 1265161 - protein, 9 aa, Homo Sapiens
EWDYYPDRS

SEQ ID NO: 1265162 - protein, 9 aa, Homo Sapiens
RGLVIMAKE

SEQ ID NO: 1265163 - protein, 9 aa, Homo Sapiens
MGALGLEGS

SEQ ID NO: 1265164 - protein, 9 aa, Homo Sapiens
FMFNANISY

SEQ ID NO: 1265165 - protein, 9 aa, Homo Sapiens
SYLDQCHRD

SEQ ID NO: 1265166 - protein, 9 aa, Homo Sapiens
SAASPWSRT

SEQ ID NO: 1265167 - protein, 9 aa, Homo Sapiens
YTHIVFTDQ

SEQ ID NO: 1265168 - protein, 9 aa, Homo Sapiens
GVVTKPSQV

SEQ ID NO: 1265169 - protein, 9 aa, Homo Sapiens
GQSNLKSNI

SEQ ID NO: 1265170 - protein, 9 aa, Homo Sapiens
DAKKQFKKV

SEQ ID NO: 1265171 - protein, 9 aa, Homo Sapiens
NLRQQSGIG

SEQ ID NO: 1265172 - protein, 9 aa, Homo Sapiens
PDPDGRYYN

SEQ ID NO: 1265173 - protein, 9 aa, Homo Sapiens
AFHSLQKQV

SEQ ID NO: 1265174 - protein, 9 aa, Homo Sapiens
ARGTDVPEI

SEQ ID NO: 1265175 - protein, 9 aa, Homo Sapiens
IPMIRQQEL

SEQ ID NO: 1265176 - protein, 9 aa, Homo Sapiens
HPESMGLTL

SEQ ID NO: 1265177 - protein, 9 aa, Homo Sapiens
SNRHEISTY

SEQ ID NO: 1265178 - protein, 9 aa, Homo Sapiens
GNSEHLKRD

SEQ ID NO: 1265179 - protein, 9 aa, Homo Sapiens
GQEYEDEED

SEQ ID NO: 1265180 - protein, 9 aa, Homo Sapiens
DIFLDSGFQ

SEQ ID NO: 1265181 - protein, 9 aa, Homo Sapiens
VNPLLPPPM

SEQ ID NO: 1265182 - protein, 9 aa, Homo Sapiens
DQIQLWQFL

SEQ ID NO: 1265183 - protein, 9 aa, Homo Sapiens
KLTETRVQV

SEQ ID NO: 1265184 - protein, 9 aa, Homo Sapiens
FVISEVRSK

SEQ ID NO: 1265185 - protein, 9 aa, Homo Sapiens
YMKYMYPYE

SEQ ID NO: 1265186 - protein, 9 aa, Homo Sapiens
CVSLDDVLY

SEQ ID NO: 1265187 - protein, 9 aa, Homo Sapiens
SLPARSGLK

SEQ ID NO: 1265188 - protein, 9 aa, Homo Sapiens
HTGEKLFIC

SEQ ID NO: 1265189 - protein, 9 aa, Homo Sapiens
VLQVYILTL

SEQ ID NO: 1265190 - protein, 9 aa, Homo Sapiens
EVWAIHRAY

SEQ ID NO: 1265191 - protein, 9 aa, Homo Sapiens
GVVSIACSS

SEQ ID NO: 1265192 - protein, 9 aa, Homo Sapiens
YQDKDNTLR

SEQ ID NO: 1265193 - protein, 9 aa, Homo Sapiens
QMAYVASFL

SEQ ID NO: 1265194 - protein, 9 aa, Homo Sapiens
PETVHFRLT

SEQ ID NO: 1265195 - protein, 9 aa, Homo Sapiens
DLLRVVHVA

SEQ ID NO: 1265196 - protein, 9 aa, Homo Sapiens
CHRIGQTKS

SEQ ID NO: 1265197 - protein, 9 aa, Homo Sapiens
VDNQLIGTM

SEQ ID NO: 1265198 - protein, 9 aa, Homo Sapiens
LSSSGRLAK

SEQ ID NO: 1265199 - protein, 9 aa, Homo Sapiens
VLVGTHDAI

SEQ ID NO: 1265200 - protein, 9 aa, Homo Sapiens
AMQFLKKKW

SEQ ID NO: 1265201 - protein, 9 aa, Homo Sapiens
EEEEKEHLA

SEQ ID NO: 1265202 - protein, 9 aa, Homo Sapiens
RQRKSRRKL

SEQ ID NO: 1265203 - protein, 9 aa, Homo Sapiens
APDSRHIFN

SEQ ID NO: 1265204 - protein, 9 aa, Homo Sapiens
SLKPSTSLT

SEQ ID NO: 1265205 - protein, 9 aa, Homo Sapiens
FVTVKPYQP

SEQ ID NO: 1265206 - protein, 9 aa, Homo Sapiens
KVCRDQRCV

SEQ ID NO: 1265207 - protein, 9 aa, Homo Sapiens
VDIQRRYLR

SEQ ID NO: 1265208 - protein, 9 aa, Homo Sapiens
HLIRHRHIH

SEQ ID NO: 1265209 - protein, 9 aa, Homo Sapiens
VQTQLCLRI

SEQ ID NO: 1265210 - protein, 9 aa, Homo Sapiens
THNVVSYAE

SEQ ID NO: 1265211 - protein, 9 aa, Homo Sapiens
RRTQSLQPV

SEQ ID NO: 1265212 - protein, 9 aa, Homo Sapiens
SMGSKAISH

SEQ ID NO: 1265213 - protein, 9 aa, Homo Sapiens
SCSQEECIE

SEQ ID NO: 1265214 - protein, 9 aa, Homo Sapiens
STTTGVSII

SEQ ID NO: 1265215 - protein, 9 aa, Homo Sapiens
GSRHKHAPT

SEQ ID NO: 1265216 - protein, 9 aa, Homo Sapiens
IFNGSLGLS

SEQ ID NO: 1265217 - protein, 9 aa, Homo Sapiens
SRRNEDLDR

SEQ ID NO: 1265218 - protein, 9 aa, Homo Sapiens
HSAESRDHN

SEQ ID NO: 1265219 - protein, 9 aa, Homo Sapiens
ATLVYSNSS

SEQ ID NO: 1265220 - protein, 9 aa, Homo Sapiens
GIETRCDDT

SEQ ID NO: 1265221 - protein, 9 aa, Homo Sapiens
PPLLNNADI

SEQ ID NO: 1265222 - protein, 9 aa, Homo Sapiens
LIAPSGPSS

SEQ ID NO: 1265223 - protein, 9 aa, Homo Sapiens
ISNAETFAE

SEQ ID NO: 1265224 - protein, 9 aa, Homo Sapiens
ETFPVEADL

SEQ ID NO: 1265225 - protein, 9 aa, Homo Sapiens
SSKPQAHGD

SEQ ID NO: 1265226 - protein, 9 aa, Homo Sapiens
TALYLALQY

SEQ ID NO: 1265227 - protein, 9 aa, Homo Sapiens
PGSFAFGVV

SEQ ID NO: 1265228 - protein, 9 aa, Homo Sapiens
SEKTIWQDL

SEQ ID NO: 1265229 - protein, 9 aa, Homo Sapiens
KEAGYLIRN

SEQ ID NO: 1265230 - protein, 9 aa, Homo Sapiens
VTAMRRIRY

SEQ ID NO: 1265231 - protein, 9 aa, Homo Sapiens
EKDTKLALI

SEQ ID NO: 1265232 - protein, 9 aa, Homo Sapiens
NFLLSGTVN

SEQ ID NO: 1265233 - protein, 9 aa, Homo Sapiens
EHGHQSHSS

SEQ ID NO: 1265234 - protein, 9 aa, Homo Sapiens
NVPLLHGAS

SEQ ID NO: 1265235 - protein, 9 aa, Homo Sapiens
KDSYAARNG

SEQ ID NO: 1265236 - protein, 9 aa, Homo Sapiens
LWDFMIYLK

SEQ ID NO: 1265237 - protein, 9 aa, Homo Sapiens
RNLIYFVFY

SEQ ID NO: 1265238 - protein, 9 aa, Homo Sapiens
AGPSRWPYW

SEQ ID NO: 1265239 - protein, 9 aa, Homo Sapiens
ITCTTVANQ

SEQ ID NO: 1265240 - protein, 9 aa, Homo Sapiens
WLSRPSGSR

SEQ ID NO: 1265241 - protein, 9 aa, Homo Sapiens
QYCFEEKSL

SEQ ID NO: 1265242 - protein, 9 aa, Homo Sapiens
CKAHDGDFE

SEQ ID NO: 1265243 - protein, 9 aa, Homo Sapiens
DPNCNVPEV

SEQ ID NO: 1265244 - protein, 9 aa, Homo Sapiens
RFELVLFEE

SEQ ID NO: 1265245 - protein, 9 aa, Homo Sapiens
EFLPCHFHR

SEQ ID NO: 1265246 - protein, 9 aa, Homo Sapiens
NLNPTFSKK

SEQ ID NO: 1265247 - protein, 9 aa, Homo Sapiens
ISELQDCEG

SEQ ID NO: 1265248 - protein, 9 aa, Homo Sapiens
SPLVLKQVV

SEQ ID NO: 1265249 - protein, 9 aa, Homo Sapiens
AKTGDCFPA

SEQ ID NO: 1265250 - protein, 9 aa, Homo Sapiens
HLVDLFRSH

SEQ ID NO: 1265251 - protein, 9 aa, Homo Sapiens
KHRASNEKE

SEQ ID NO: 1265252 - protein, 9 aa, Homo Sapiens
CVNIPMIRQ

SEQ ID NO: 1265253 - protein, 9 aa, Homo Sapiens
FLKCSVPPT

SEQ ID NO: 1265254 - protein, 9 aa, Homo Sapiens
VIVSGTEGK

SEQ ID NO: 1265255 - protein, 9 aa, Homo Sapiens
GKSEMLVDV

SEQ ID NO: 1265256 - protein, 9 aa, Homo Sapiens
RECKHHLKH

SEQ ID NO: 1265257 - protein, 9 aa, Homo Sapiens
DGHPIESLS

SEQ ID NO: 1265258 - protein, 9 aa, Homo Sapiens
IQKLFAPVR

SEQ ID NO: 1265259 - protein, 9 aa, Homo Sapiens
GHEDGTMRF

SEQ ID NO: 1265260 - protein, 9 aa, Homo Sapiens
SHLSVVGAL

SEQ ID NO: 1265261 - protein, 9 aa, Homo Sapiens
FQCDPSYRS

SEQ ID NO: 1265262 - protein, 9 aa, Homo Sapiens
APLNQTECL

SEQ ID NO: 1265263 - protein, 9 aa, Homo Sapiens
EGGQSSTTD

SEQ ID NO: 1265264 - protein, 9 aa, Homo Sapiens
YGDLAAHLG

SEQ ID NO: 1265265 - protein, 9 aa, Homo Sapiens
RDTLPASLP

SEQ ID NO: 1265266 - protein, 9 aa, Homo Sapiens
TAIAKCLGE

SEQ ID NO: 1265267 - protein, 9 aa, Homo Sapiens
VTMIGVILF

SEQ ID NO: 1265268 - protein, 9 aa, Homo Sapiens
SAIMPFING

SEQ ID NO: 1265269 - protein, 9 aa, Homo Sapiens
LVWQHRVFV

SEQ ID NO: 1265270 - protein, 9 aa, Homo Sapiens
LTDIFRHYD

SEQ ID NO: 1265271 - protein, 9 aa, Homo Sapiens
VPQIKPLER

SEQ ID NO: 1265272 - protein, 9 aa, Homo Sapiens
FGTGTPAPA

SEQ ID NO: 1265273 - protein, 9 aa, Homo Sapiens
GTQAEKDQR

SEQ ID NO: 1265274 - protein, 9 aa, Homo Sapiens
QLHAAWCDG

SEQ ID NO: 1265275 - protein, 9 aa, Homo Sapiens
YHFDLGYIQ

SEQ ID NO: 1265276 - protein, 9 aa, Homo Sapiens
LVTSFYWCL

SEQ ID NO: 1265277 - protein, 9 aa, Homo Sapiens
TGLGELLRS

SEQ ID NO: 1265278 - protein, 9 aa, Homo Sapiens
HIKPTVIEV

SEQ ID NO: 1265279 - protein, 9 aa, Homo Sapiens
RYDYRRRSP

SEQ ID NO: 1265280 - protein, 9 aa, Homo Sapiens
SPKGMTKLC

SEQ ID NO: 1265281 - protein, 9 aa, Homo Sapiens
QQVWLRQKL

SEQ ID NO: 1265282 - protein, 9 aa, Homo Sapiens
GMSLTIHNK

SEQ ID NO: 1265283 - protein, 9 aa, Homo Sapiens
ANYELICVT

SEQ ID NO: 1265284 - protein, 9 aa, Homo Sapiens
DSTSNLARK

SEQ ID NO: 1265285 - protein, 9 aa, Homo Sapiens
GKLCKLEKI

SEQ ID NO: 1265286 - protein, 9 aa, Homo Sapiens
FGAGPHSCI

SEQ ID NO: 1265287 - protein, 9 aa, Homo Sapiens
HGQEQAAEG

SEQ ID NO: 1265288 - protein, 9 aa, Homo Sapiens
IRSSSLIHH

SEQ ID NO: 1265289 - protein, 9 aa, Homo Sapiens
EDPNLISVD

SEQ ID NO: 1265290 - protein, 9 aa, Homo Sapiens
LKRDHSLIK

SEQ ID NO: 1265291 - protein, 9 aa, Homo Sapiens
LNWGVQIAN

SEQ ID NO: 1265292 - protein, 9 aa, Homo Sapiens
SNGEQPLSV

SEQ ID NO: 1265293 - protein, 9 aa, Homo Sapiens
TGKNFVAQM

SEQ ID NO: 1265294 - protein, 9 aa, Homo Sapiens
DALPLDMLL

SEQ ID NO: 1265295 - protein, 9 aa, Homo Sapiens
LEIRKEVFE

SEQ ID NO: 1265296 - protein, 9 aa, Homo Sapiens
SVNHSSNKR

SEQ ID NO: 1265297 - protein, 9 aa, Homo Sapiens
TQVILMYIF

SEQ ID NO: 1265298 - protein, 9 aa, Homo Sapiens
QGVQFLEAQ

SEQ ID NO: 1265299 - protein, 9 aa, Homo Sapiens
HLRLRLDGS

SEQ ID NO: 1265300 - protein, 9 aa, Homo Sapiens
KIHSFHGQC

SEQ ID NO: 1265301 - protein, 9 aa, Homo Sapiens
LEPISLSSF

SEQ ID NO: 1265302 - protein, 9 aa, Homo Sapiens
PNGLGNTGP

SEQ ID NO: 1265303 - protein, 9 aa, Homo Sapiens
KRIDTYVDE

SEQ ID NO: 1265304 - protein, 9 aa, Homo Sapiens
NPEGPIQHH

SEQ ID NO: 1265305 - protein, 9 aa, Homo Sapiens
PRAPPARGT

SEQ ID NO: 1265306 - protein, 9 aa, Homo Sapiens
DFHPHPGPN

SEQ ID NO: 1265307 - protein, 9 aa, Homo Sapiens
TGHEDGTMR

SEQ ID NO: 1265308 - protein, 9 aa, Homo Sapiens
SARRADSPP

SEQ ID NO: 1265309 - protein, 9 aa, Homo Sapiens
MFREDQIYR

SEQ ID NO: 1265310 - protein, 9 aa, Homo Sapiens
EDPLLLPCT

SEQ ID NO: 1265311 - protein, 9 aa, Homo Sapiens
LPLKEMGKE

SEQ ID NO: 1265312 - protein, 9 aa, Homo Sapiens
SVRLQDNVP

SEQ ID NO: 1265313 - protein, 9 aa, Homo Sapiens
DRGAGHVSS

SEQ ID NO: 1265314 - protein, 9 aa, Homo Sapiens
TTKKAVDNT

SEQ ID NO: 1265315 - protein, 9 aa, Homo Sapiens
WQDIYKQFD

SEQ ID NO: 1265316 - protein, 9 aa, Homo Sapiens
TGSLNAGAF

SEQ ID NO: 1265317 - protein, 9 aa, Homo Sapiens
PATHALEEH

SEQ ID NO: 1265318 - protein, 9 aa, Homo Sapiens
PSHLAVLQH

SEQ ID NO: 1265319 - protein, 9 aa, Homo Sapiens
SRAEYNVII

SEQ ID NO: 1265320 - protein, 9 aa, Homo Sapiens
GTLHPYLTE

SEQ ID NO: 1265321 - protein, 9 aa, Homo Sapiens
PCTPSPLDG

SEQ ID NO: 1265322 - protein, 9 aa, Homo Sapiens
YRPIYEFHG

SEQ ID NO: 1265323 - protein, 9 aa, Homo Sapiens
IKSEPLPKS

SEQ ID NO: 1265324 - protein, 9 aa, Homo Sapiens
PNMISNRRL

SEQ ID NO: 1265325 - protein, 9 aa, Homo Sapiens
FPGSPTFAA

SEQ ID NO: 1265326 - protein, 9 aa, Homo Sapiens
FTNCHIYNK

SEQ ID NO: 1265327 - protein, 9 aa, Homo Sapiens
PPLGFGKLY

SEQ ID NO: 1265328 - protein, 9 aa, Homo Sapiens
YSMDHGVDS

SEQ ID NO: 1265329 - protein, 9 aa, Homo Sapiens
EDDEWRSDR

SEQ ID NO: 1265330 - protein, 9 aa, Homo Sapiens
ISILAMPLL

SEQ ID NO: 1265331 - protein, 9 aa, Homo Sapiens
ITPETLIWQ

SEQ ID NO: 1265332 - protein, 9 aa, Homo Sapiens
PGPRLQQMW

SEQ ID NO: 1265333 - protein, 9 aa, Homo Sapiens
DCYIMSGSR

SEQ ID NO: 1265334 - protein, 9 aa, Homo Sapiens
NKHVFFLTP

SEQ ID NO: 1265335 - protein, 9 aa, Homo Sapiens
IVTDIDELG

SEQ ID NO: 1265336 - protein, 9 aa, Homo Sapiens
DGAEKRKTT

SEQ ID NO: 1265337 - protein, 9 aa, Homo Sapiens
ALARYDSIC

SEQ ID NO: 1265338 - protein, 9 aa, Homo Sapiens
QVDVKPVYK

SEQ ID NO: 1265339 - protein, 9 aa, Homo Sapiens
NDTINAQEL

SEQ ID NO: 1265340 - protein, 9 aa, Homo Sapiens
QEEVLAKYS

SEQ ID NO: 1265341 - protein, 9 aa, Homo Sapiens
HPLLQDAIR

SEQ ID NO: 1265342 - protein, 9 aa, Homo Sapiens
FMYFNLESS

SEQ ID NO: 1265343 - protein, 9 aa, Homo Sapiens
NDPQSGLYN

SEQ ID NO: 1265344 - protein, 9 aa, Homo Sapiens
CRGIRGGLE

SEQ ID NO: 1265345 - protein, 9 aa, Homo Sapiens
GIRRPPSGM

SEQ ID NO: 1265346 - protein, 9 aa, Homo Sapiens
NNFLTHCLL

SEQ ID NO: 1265347 - protein, 9 aa, Homo Sapiens
LRDEEVHTG

SEQ ID NO: 1265348 - protein, 9 aa, Homo Sapiens
EFFAHDPVN

SEQ ID NO: 1265349 - protein, 9 aa, Homo Sapiens
TMDTALTAA

SEQ ID NO: 1265350 - protein, 9 aa, Homo Sapiens
REGDTLELT

SEQ ID NO: 1265351 - protein, 9 aa, Homo Sapiens
LTSNDPPTS

SEQ ID NO: 1265352 - protein, 9 aa, Homo Sapiens
PGGILDLEK

SEQ ID NO: 1265353 - protein, 9 aa, Homo Sapiens
HQTRTHQGH

SEQ ID NO: 1265354 - protein, 9 aa, Homo Sapiens
ICLICGNRQ

SEQ ID NO: 1265355 - protein, 9 aa, Homo Sapiens
ELTGRLTQA

SEQ ID NO: 1265356 - protein, 9 aa, Homo Sapiens
DAGCRPYMT

SEQ ID NO: 1265357 - protein, 9 aa, Homo Sapiens
KGWLPLHEA

SEQ ID NO: 1265358 - protein, 9 aa, Homo Sapiens
GPVSVASMP

SEQ ID NO: 1265359 - protein, 9 aa, Homo Sapiens
LNFTGSGDP

SEQ ID NO: 1265360 - protein, 9 aa, Homo Sapiens
GWDPDNLAD

SEQ ID NO: 1265361 - protein, 9 aa, Homo Sapiens
QEALDPVPF

SEQ ID NO: 1265362 - protein, 9 aa, Homo Sapiens
IDRYLCLHY

SEQ ID NO: 1265363 - protein, 9 aa, Homo Sapiens
TPETVHFRL

SEQ ID NO: 1265364 - protein, 9 aa, Homo Sapiens
MEWIMKAQA

SEQ ID NO: 1265365 - protein, 9 aa, Homo Sapiens
KTAVSVLKP

SEQ ID NO: 1265366 - protein, 9 aa, Homo Sapiens
LSSYALHVH

SEQ ID NO: 1265367 - protein, 9 aa, Homo Sapiens
HLSRQDAAG

SEQ ID NO: 1265368 - protein, 9 aa, Homo Sapiens
VAPSRRLKL

SEQ ID NO: 1265369 - protein, 9 aa, Homo Sapiens
TKNFRPTGG

SEQ ID NO: 1265370 - protein, 9 aa, Homo Sapiens
SLYIPKALQ

SEQ ID NO: 1265371 - protein, 9 aa, Homo Sapiens
GPPKSERGC

SEQ ID NO: 1265372 - protein, 9 aa, Homo Sapiens
ALKFQRTQQ

SEQ ID NO: 1265373 - protein, 9 aa, Homo Sapiens
WGASKLVSV

SEQ ID NO: 1265374 - protein, 9 aa, Homo Sapiens
KRPAQVKLL

SEQ ID NO: 1265375 - protein, 9 aa, Homo Sapiens
ASLNEEEGI

SEQ ID NO: 1265376 - protein, 9 aa, Homo Sapiens
QSGGATALP

SEQ ID NO: 1265377 - protein, 9 aa, Homo Sapiens
LAECLQPKA

SEQ ID NO: 1265378 - protein, 9 aa, Homo Sapiens
LFTTQPFFT

SEQ ID NO: 1265379 - protein, 9 aa, Homo Sapiens
ADVHAAVTA

SEQ ID NO: 1265380 - protein, 9 aa, Homo Sapiens
DGVTYPACH

SEQ ID NO: 1265381 - protein, 9 aa, Homo Sapiens
AQKETIKDI

SEQ ID NO: 1265382 - protein, 9 aa, Homo Sapiens
RTALAGAGA

SEQ ID NO: 1265383 - protein, 9 aa, Homo Sapiens
YQCHSWEEM

SEQ ID NO: 1265384 - protein, 9 aa, Homo Sapiens
QPLLWNMTS

SEQ ID NO: 1265385 - protein, 9 aa, Homo Sapiens
LCPTVLMTS

SEQ ID NO: 1265386 - protein, 9 aa, Homo Sapiens
SQGLHEEAE

SEQ ID NO: 1265387 - protein, 9 aa, Homo Sapiens
EVELQFSKD

SEQ ID NO: 1265388 - protein, 9 aa, Homo Sapiens
AEQEQMWKI

SEQ ID NO: 1265389 - protein, 9 aa, Homo Sapiens
VCYLLPDAS

SEQ ID NO: 1265390 - protein, 9 aa, Homo Sapiens
MSQPLQCLR

SEQ ID NO: 1265391 - protein, 9 aa, Homo Sapiens
FQGGPNWGH

SEQ ID NO: 1265392 - protein, 9 aa, Homo Sapiens
LLSEAKAKD

SEQ ID NO: 1265393 - protein, 9 aa, Homo Sapiens
ESKQREDDD

SEQ ID NO: 1265394 - protein, 9 aa, Homo Sapiens
NYLAECLQP

SEQ ID NO: 1265395 - protein, 9 aa, Homo Sapiens
KPFEDRVGT

SEQ ID NO: 1265396 - protein, 9 aa, Homo Sapiens
VVCVFRPET

SEQ ID NO: 1265397 - protein, 9 aa, Homo Sapiens
PTAVYEAKL

SEQ ID NO: 1265398 - protein, 9 aa, Homo Sapiens
PGPSPFSSK

SEQ ID NO: 1265399 - protein, 9 aa, Homo Sapiens
TWGSRTSAG

SEQ ID NO: 1265400 - protein, 9 aa, Homo Sapiens
VEHEKQMIL

SEQ ID NO: 1265401 - protein, 9 aa, Homo Sapiens
EEDELVDPL

SEQ ID NO: 1265402 - protein, 9 aa, Homo Sapiens
IVVQVNNGD

SEQ ID NO: 1265403 - protein, 9 aa, Homo Sapiens
EVDAAPPVG

SEQ ID NO: 1265404 - protein, 9 aa, Homo Sapiens
IHTNWAGHG

SEQ ID NO: 1265405 - protein, 9 aa, Homo Sapiens
EQEKEEDIV

SEQ ID NO: 1265406 - protein, 9 aa, Homo Sapiens
EQKAARRQW

SEQ ID NO: 1265407 - protein, 9 aa, Homo Sapiens
VLPQEENTG

SEQ ID NO: 1265408 - protein, 9 aa, Homo Sapiens
DSVGHIPES

SEQ ID NO: 1265409 - protein, 9 aa, Homo Sapiens
VANESFYTV

SEQ ID NO: 1265410 - protein, 9 aa, Homo Sapiens
TNAEKHVHN

SEQ ID NO: 1265411 - protein, 9 aa, Homo Sapiens
PRGYPPILY

SEQ ID NO: 1265412 - protein, 9 aa, Homo Sapiens
YTLISPNIN

SEQ ID NO: 1265413 - protein, 9 aa, Homo Sapiens
KECIYYADV

SEQ ID NO: 1265414 - protein, 9 aa, Homo Sapiens
VCKGDMGGT

SEQ ID NO: 1265415 - protein, 9 aa, Homo Sapiens
WAGHGGTVS

SEQ ID NO: 1265416 - protein, 9 aa, Homo Sapiens
RYHAIYFVM

SEQ ID NO: 1265417 - protein, 9 aa, Homo Sapiens
VSENIVCLI

SEQ ID NO: 1265418 - protein, 9 aa, Homo Sapiens
LQFGRVGPY

SEQ ID NO: 1265419 - protein, 9 aa, Homo Sapiens
TNVRIARTF

SEQ ID NO: 1265420 - protein, 9 aa, Homo Sapiens
KVIIQGKNQ

SEQ ID NO: 1265421 - protein, 9 aa, Homo Sapiens
MTKIQVHLT

SEQ ID NO: 1265422 - protein, 9 aa, Homo Sapiens
IPLLLELQK

SEQ ID NO: 1265423 - protein, 9 aa, Homo Sapiens
WRVIPYDAL

SEQ ID NO: 1265424 - protein, 9 aa, Homo Sapiens
AWICCLVTS

SEQ ID NO: 1265425 - protein, 9 aa, Homo Sapiens
LDTYLARFE

SEQ ID NO: 1265426 - protein, 9 aa, Homo Sapiens
YSYLLKESS

SEQ ID NO: 1265427 - protein, 9 aa, Homo Sapiens
GEDLARMEL

SEQ ID NO: 1265428 - protein, 9 aa, Homo Sapiens
KIVVVMAKE

SEQ ID NO: 1265429 - protein, 9 aa, Homo Sapiens
DTANSSEIK

SEQ ID NO: 1265430 - protein, 9 aa, Homo Sapiens
KRSEENSSN

SEQ ID NO: 1265431 - protein, 9 aa, Homo Sapiens
NDNRLTRAT

SEQ ID NO: 1265432 - protein, 9 aa, Homo Sapiens
REDLPTIVI

SEQ ID NO: 1265433 - protein, 9 aa, Homo Sapiens
DLEVKEWMQ

SEQ ID NO: 1265434 - protein, 9 aa, Homo Sapiens
KECGKSFNH

SEQ ID NO: 1265435 - protein, 9 aa, Homo Sapiens
GTRPPRARV

SEQ ID NO: 1265436 - protein, 9 aa, Homo Sapiens
LVFALRDWR

SEQ ID NO: 1265437 - protein, 9 aa, Homo Sapiens
FVLGLPNRD

SEQ ID NO: 1265438 - protein, 9 aa, Homo Sapiens
LVCFRPKGS

SEQ ID NO: 1265439 - protein, 9 aa, Homo Sapiens
QHMDNIFDF

SEQ ID NO: 1265440 - protein, 9 aa, Homo Sapiens
TMIENFNAK

SEQ ID NO: 1265441 - protein, 9 aa, Homo Sapiens
PCGPRAHPA

SEQ ID NO: 1265442 - protein, 9 aa, Homo Sapiens
PSSGMTWPP

SEQ ID NO: 1265443 - protein, 9 aa, Homo Sapiens
QKEVSLTLS

SEQ ID NO: 1265444 - protein, 9 aa, Homo Sapiens
KQPVAFVVT

SEQ ID NO: 1265445 - protein, 9 aa, Homo Sapiens
SLIRNLLEQ

SEQ ID NO: 1265446 - protein, 9 aa, Homo Sapiens
FLEDCHIQP

SEQ ID NO: 1265447 - protein, 9 aa, Homo Sapiens
DPRHETPPG

SEQ ID NO: 1265448 - protein, 9 aa, Homo Sapiens
AHYIYTPLP

SEQ ID NO: 1265449 - protein, 9 aa, Homo Sapiens
LKLHQSATQ

SEQ ID NO: 1265450 - protein, 9 aa, Homo Sapiens
RVHDLEIEG

SEQ ID NO: 1265451 - protein, 9 aa, Homo Sapiens
GTSVKIECH

SEQ ID NO: 1265452 - protein, 9 aa, Homo Sapiens
EAHALEPPS

SEQ ID NO: 1265453 - protein, 9 aa, Homo Sapiens
VPPPTDSAC

SEQ ID NO: 1265454 - protein, 9 aa, Homo Sapiens
GDNYLWSPG

SEQ ID NO: 1265455 - protein, 9 aa, Homo Sapiens
SPLLTQKTQ

SEQ ID NO: 1265456 - protein, 9 aa, Homo Sapiens
QALHQYCPV

SEQ ID NO: 1265457 - protein, 9 aa, Homo Sapiens
IVLPTEKTA

SEQ ID NO: 1265458 - protein, 9 aa, Homo Sapiens
IREIQSAAF

SEQ ID NO: 1265459 - protein, 9 aa, Homo Sapiens
MDESVQHVV

SEQ ID NO: 1265460 - protein, 9 aa, Homo Sapiens
TTIVQTGGG

SEQ ID NO: 1265461 - protein, 9 aa, Homo Sapiens
YLSFTEEGY

SEQ ID NO: 1265462 - protein, 9 aa, Homo Sapiens
KPGTLECGD

SEQ ID NO: 1265463 - protein, 9 aa, Homo Sapiens
WMGPIPPAM

SEQ ID NO: 1265464 - protein, 9 aa, Homo Sapiens
HPGFKGSEG

SEQ ID NO: 1265465 - protein, 9 aa, Homo Sapiens
RSDISRELE

SEQ ID NO: 1265466 - protein, 9 aa, Homo Sapiens
GYVGFGGWG

SEQ ID NO: 1265467 - protein, 9 aa, Homo Sapiens
FNEVQKASA

SEQ ID NO: 1265468 - protein, 9 aa, Homo Sapiens
PCGALERGT

SEQ ID NO: 1265469 - protein, 9 aa, Homo Sapiens
CDLQEDESC

SEQ ID NO: 1265470 - protein, 9 aa, Homo Sapiens
LIKSKEELH

SEQ ID NO: 1265471 - protein, 9 aa, Homo Sapiens
VFMGNMIRG

SEQ ID NO: 1265472 - protein, 9 aa, Homo Sapiens
ILEHCRSLG

SEQ ID NO: 1265473 - protein, 9 aa, Homo Sapiens
AGLHRVRPP

SEQ ID NO: 1265474 - protein, 9 aa, Homo Sapiens
TDGSVRFPI

SEQ ID NO: 1265475 - protein, 9 aa, Homo Sapiens
IIHGIKFHY

SEQ ID NO: 1265476 - protein, 9 aa, Homo Sapiens
IFPQDVPVP

SEQ ID NO: 1265477 - protein, 9 aa, Homo Sapiens
SVSRTVMEL

SEQ ID NO: 1265478 - protein, 9 aa, Homo Sapiens
WIGASLCFL

SEQ ID NO: 1265479 - protein, 9 aa, Homo Sapiens
PMVDAVAMD

SEQ ID NO: 1265480 - protein, 9 aa, Homo Sapiens
PAPCDGAGS

SEQ ID NO: 1265481 - protein, 9 aa, Homo Sapiens
WAANVYGIP

SEQ ID NO: 1265482 - protein, 9 aa, Homo Sapiens
SITGQSIAN

SEQ ID NO: 1265483 - protein, 9 aa, Homo Sapiens
PEAHVFMPI

SEQ ID NO: 1265484 - protein, 9 aa, Homo Sapiens
CHGPLLTRM

SEQ ID NO: 1265485 - protein, 9 aa, Homo Sapiens
ASSRGIVSF

SEQ ID NO: 1265486 - protein, 9 aa, Homo Sapiens
AFNEKASIM

SEQ ID NO: 1265487 - protein, 9 aa, Homo Sapiens
TFDTLQLWL

SEQ ID NO: 1265488 - protein, 9 aa, Homo Sapiens
KHLSKKSQS

SEQ ID NO: 1265489 - protein, 9 aa, Homo Sapiens
ICRKKVGLT

SEQ ID NO: 1265490 - protein, 9 aa, Homo Sapiens
EQVTYHNPL

SEQ ID NO: 1265491 - protein, 9 aa, Homo Sapiens
CMEKQMHDS

SEQ ID NO: 1265492 - protein, 9 aa, Homo Sapiens
QAEDDEQCL

SEQ ID NO: 1265493 - protein, 9 aa, Homo Sapiens
MLLFLNPDA

SEQ ID NO: 1265494 - protein, 9 aa, Homo Sapiens
TTRDVQKVL

SEQ ID NO: 1265495 - protein, 9 aa, Homo Sapiens
KAFLPERKC

SEQ ID NO: 1265496 - protein, 9 aa, Homo Sapiens
SYYSYMGHF

SEQ ID NO: 1265497 - protein, 9 aa, Homo Sapiens
SPNSTGIRD

SEQ ID NO: 1265498 - protein, 9 aa, Homo Sapiens
DAGLHRVRP

SEQ ID NO: 1265499 - protein, 9 aa, Homo Sapiens
TLGFEAPGS

SEQ ID NO: 1265500 - protein, 9 aa, Homo Sapiens
YSLTRAQQP

SEQ ID NO: 1265501 - protein, 9 aa, Homo Sapiens
GMQLEVVDK

SEQ ID NO: 1265502 - protein, 9 aa, Homo Sapiens
YNSHWDPPE

SEQ ID NO: 1265503 - protein, 9 aa, Homo Sapiens
DRLTSLARD

SEQ ID NO: 1265504 - protein, 9 aa, Homo Sapiens
RKLLEAHTP

SEQ ID NO: 1265505 - protein, 9 aa, Homo Sapiens
TSDFIPVAC

SEQ ID NO: 1265506 - protein, 9 aa, Homo Sapiens
QFHPLLPDP

SEQ ID NO: 1265507 - protein, 9 aa, Homo Sapiens
YGYVGFGGW

SEQ ID NO: 1265508 - protein, 9 aa, Homo Sapiens
LIHHLCITR

SEQ ID NO: 1265509 - protein, 9 aa, Homo Sapiens
DENTGLIKV

SEQ ID NO: 1265510 - protein, 9 aa, Homo Sapiens
KHILDIFRR

SEQ ID NO: 1265511 - protein, 9 aa, Homo Sapiens
IGKLALLGA

SEQ ID NO: 1265512 - protein, 9 aa, Homo Sapiens
HALEEQGAT

SEQ ID NO: 1265513 - protein, 9 aa, Homo Sapiens
ERKEWESQC

SEQ ID NO: 1265514 - protein, 9 aa, Homo Sapiens
KSTRPAAGV

SEQ ID NO: 1265515 - protein, 9 aa, Homo Sapiens
GWFMCGPAE

SEQ ID NO: 1265516 - protein, 9 aa, Homo Sapiens
ELKQMFQRL

SEQ ID NO: 1265517 - protein, 9 aa, Homo Sapiens
SVSADSRIY

SEQ ID NO: 1265518 - protein, 9 aa, Homo Sapiens
INKDVTHPC

SEQ ID NO: 1265519 - protein, 9 aa, Homo Sapiens
VGNTPAQQP

SEQ ID NO: 1265520 - protein, 9 aa, Homo Sapiens
KQFHIQLNE

SEQ ID NO: 1265521 - protein, 9 aa, Homo Sapiens
GFPTLSWSP

SEQ ID NO: 1265522 - protein, 9 aa, Homo Sapiens
RIHKCDRVL

SEQ ID NO: 1265523 - protein, 9 aa, Homo Sapiens
HSNAFMVNG

SEQ ID NO: 1265524 - protein, 9 aa, Homo Sapiens
HLLGEHLTA

SEQ ID NO: 1265525 - protein, 9 aa, Homo Sapiens
LISDNAVKI

SEQ ID NO: 1265526 - protein, 9 aa, Homo Sapiens
AQARCALGR

SEQ ID NO: 1265527 - protein, 9 aa, Homo Sapiens
HTGEKPYER

SEQ ID NO: 1265528 - protein, 9 aa, Homo Sapiens
RQVCSLDNR

SEQ ID NO: 1265529 - protein, 9 aa, Homo Sapiens
GLLIGISIV

SEQ ID NO: 1265530 - protein, 9 aa, Homo Sapiens
RALGFQTFL

SEQ ID NO: 1265531 - protein, 9 aa, Homo Sapiens
EMCKREAED

SEQ ID NO: 1265532 - protein, 9 aa, Homo Sapiens
GDLQVLDRF

SEQ ID NO: 1265533 - protein, 9 aa, Homo Sapiens
PHGNMENSI

SEQ ID NO: 1265534 - protein, 9 aa, Homo Sapiens
GRQTQSRTA

SEQ ID NO: 1265535 - protein, 9 aa, Homo Sapiens
EGPVSAGED

SEQ ID NO: 1265536 - protein, 9 aa, Homo Sapiens
TLSHLKCTV

SEQ ID NO: 1265537 - protein, 9 aa, Homo Sapiens
LHKKYKERK

SEQ ID NO: 1265538 - protein, 9 aa, Homo Sapiens
PPSDQLQPQ

SEQ ID NO: 1265539 - protein, 9 aa, Homo Sapiens
VVLLNFFPY

SEQ ID NO: 1265540 - protein, 9 aa, Homo Sapiens
FRRKIPESV

SEQ ID NO: 1265541 - protein, 9 aa, Homo Sapiens
GQIQTQAPQ

SEQ ID NO: 1265542 - protein, 9 aa, Homo Sapiens
LLVLMANPI

SEQ ID NO: 1265543 - protein, 9 aa, Homo Sapiens
PLCSSISPG

SEQ ID NO: 1265544 - protein, 9 aa, Homo Sapiens
KTFCVNGGK

SEQ ID NO: 1265545 - protein, 9 aa, Homo Sapiens
QDNIFDLNN

SEQ ID NO: 1265546 - protein, 9 aa, Homo Sapiens
YCGYSVSET

SEQ ID NO: 1265547 - protein, 9 aa, Homo Sapiens
TAGARRSKA

SEQ ID NO: 1265548 - protein, 9 aa, Homo Sapiens
CFFTFKNFF

SEQ ID NO: 1265549 - protein, 9 aa, Homo Sapiens
MKGKDGYWT

SEQ ID NO: 1265550 - protein, 9 aa, Homo Sapiens
TLLVPLLVT

SEQ ID NO: 1265551 - protein, 9 aa, Homo Sapiens
ACSCSGVCI

SEQ ID NO: 1265552 - protein, 9 aa, Homo Sapiens
PTTQETDSF

SEQ ID NO: 1265553 - protein, 9 aa, Homo Sapiens
KTGVKLSGG

SEQ ID NO: 1265554 - protein, 9 aa, Homo Sapiens
LSYHQHFGR

SEQ ID NO: 1265555 - protein, 9 aa, Homo Sapiens
QTISKGIFA

SEQ ID NO: 1265556 - protein, 9 aa, Homo Sapiens
DRHRVDFDL

SEQ ID NO: 1265557 - protein, 9 aa, Homo Sapiens
PYCHRCKDD

SEQ ID NO: 1265558 - protein, 9 aa, Homo Sapiens
GHACMVGAG

SEQ ID NO: 1265559 - protein, 9 aa, Homo Sapiens
FELVLFEEK

SEQ ID NO: 1265560 - protein, 9 aa, Homo Sapiens
SMKPQSLQL

SEQ ID NO: 1265561 - protein, 9 aa, Homo Sapiens
MTAYDQRYS

SEQ ID NO: 1265562 - protein, 9 aa, Homo Sapiens
TLSKPKAIR

SEQ ID NO: 1265563 - protein, 9 aa, Homo Sapiens
SIHLFINSL

SEQ ID NO: 1265564 - protein, 9 aa, Homo Sapiens
DASRSLEFR

SEQ ID NO: 1265565 - protein, 9 aa, Homo Sapiens
PRKRLRKKH

SEQ ID NO: 1265566 - protein, 9 aa, Homo Sapiens
LAEPNRIPS

SEQ ID NO: 1265567 - protein, 9 aa, Homo Sapiens
VCALSIEES

SEQ ID NO: 1265568 - protein, 9 aa, Homo Sapiens
FGVKHTTLH

SEQ ID NO: 1265569 - protein, 9 aa, Homo Sapiens
LREGAHYLM

SEQ ID NO: 1265570 - protein, 9 aa, Homo Sapiens
STEHAHIVA

SEQ ID NO: 1265571 - protein, 9 aa, Homo Sapiens
VSTVSHTDA

SEQ ID NO: 1265572 - protein, 9 aa, Homo Sapiens
GVTQDLNNE

SEQ ID NO: 1265573 - protein, 9 aa, Homo Sapiens
DSLLDLSEG

SEQ ID NO: 1265574 - protein, 9 aa, Homo Sapiens
PLVIELSCM

SEQ ID NO: 1265575 - protein, 9 aa, Homo Sapiens
PFVQSMISN

SEQ ID NO: 1265576 - protein, 9 aa, Homo Sapiens
RNETKHLSI

SEQ ID NO: 1265577 - protein, 9 aa, Homo Sapiens
EPRGGGVRP

SEQ ID NO: 1265578 - protein, 9 aa, Homo Sapiens
FRKWDDYRV

SEQ ID NO: 1265579 - protein, 9 aa, Homo Sapiens
SLVTQTDSC

SEQ ID NO: 1265580 - protein, 9 aa, Homo Sapiens
YILMDRGDI

SEQ ID NO: 1265581 - protein, 9 aa, Homo Sapiens
TIAENIHYG

SEQ ID NO: 1265582 - protein, 9 aa, Homo Sapiens
SEDEGDEFD

SEQ ID NO: 1265583 - protein, 9 aa, Homo Sapiens
GDAPVFSTS

SEQ ID NO: 1265584 - protein, 9 aa, Homo Sapiens
EDTQYMTMR

SEQ ID NO: 1265585 - protein, 9 aa, Homo Sapiens
CPPKCITPR

SEQ ID NO: 1265586 - protein, 9 aa, Homo Sapiens
SNWIQEERH

SEQ ID NO: 1265587 - protein, 9 aa, Homo Sapiens
DHYPMSKQT

SEQ ID NO: 1265588 - protein, 9 aa, Homo Sapiens
PICLVLVSY

SEQ ID NO: 1265589 - protein, 9 aa, Homo Sapiens
PQDAYSHLK

SEQ ID NO: 1265590 - protein, 9 aa, Homo Sapiens
TVTTKDGGM

SEQ ID NO: 1265591 - protein, 9 aa, Homo Sapiens
NLRSIYTPS

SEQ ID NO: 1265592 - protein, 9 aa, Homo Sapiens
FQGSVSFKY

SEQ ID NO: 1265593 - protein, 9 aa, Homo Sapiens
DPKNVRMAI

SEQ ID NO: 1265594 - protein, 9 aa, Homo Sapiens
TRENPFECS

SEQ ID NO: 1265595 - protein, 9 aa, Homo Sapiens
ATYADSGPF

SEQ ID NO: 1265596 - protein, 9 aa, Homo Sapiens
MTSLPFCGP

SEQ ID NO: 1265597 - protein, 9 aa, Homo Sapiens
RIASEDSRL

SEQ ID NO: 1265598 - protein, 9 aa, Homo Sapiens
SMDTLRIQY

SEQ ID NO: 1265599 - protein, 9 aa, Homo Sapiens
QTSVYLDAN

SEQ ID NO: 1265600 - protein, 9 aa, Homo Sapiens
EPPPCGPDR

SEQ ID NO: 1265601 - protein, 9 aa, Homo Sapiens
LLVPLLVTL

SEQ ID NO: 1265602 - protein, 9 aa, Homo Sapiens
LLKILKLIH

SEQ ID NO: 1265603 - protein, 9 aa, Homo Sapiens
KKKKSINPW

SEQ ID NO: 1265604 - protein, 9 aa, Homo Sapiens
FPEIINYLY

SEQ ID NO: 1265605 - protein, 9 aa, Homo Sapiens
GPVFTIYMG

SEQ ID NO: 1265606 - protein, 9 aa, Homo Sapiens
LCHKSGGRE

SEQ ID NO: 1265607 - protein, 9 aa, Homo Sapiens
HGEDYNHTH

SEQ ID NO: 1265608 - protein, 9 aa, Homo Sapiens
ITMLNGHYK

SEQ ID NO: 1265609 - protein, 9 aa, Homo Sapiens
ARQRRRTPQ

SEQ ID NO: 1265610 - protein, 9 aa, Homo Sapiens
THEKLSQIC

SEQ ID NO: 1265611 - protein, 9 aa, Homo Sapiens
LEWCGWQSI

SEQ ID NO: 1265612 - protein, 9 aa, Homo Sapiens
LEEISRSLR

SEQ ID NO: 1265613 - protein, 9 aa, Homo Sapiens
PKGLGQTKK

SEQ ID NO: 1265614 - protein, 9 aa, Homo Sapiens
TSGTKSSRK

SEQ ID NO: 1265615 - protein, 9 aa, Homo Sapiens
PVLCLACTD

SEQ ID NO: 1265616 - protein, 9 aa, Homo Sapiens
RKVWSCSSG

SEQ ID NO: 1265617 - protein, 9 aa, Homo Sapiens
MCMTGAHDQ

SEQ ID NO: 1265618 - protein, 9 aa, Homo Sapiens
VRTWRLNEW

SEQ ID NO: 1265619 - protein, 9 aa, Homo Sapiens
PESDVFEIT

SEQ ID NO: 1265620 - protein, 9 aa, Homo Sapiens
KCEWVKFAK

SEQ ID NO: 1265621 - protein, 9 aa, Homo Sapiens
ITTASSPST

SEQ ID NO: 1265622 - protein, 9 aa, Homo Sapiens
GGQKQRIVI

SEQ ID NO: 1265623 - protein, 9 aa, Homo Sapiens
MRLEATDVK

SEQ ID NO: 1265624 - protein, 9 aa, Homo Sapiens
GYRFTADSW

SEQ ID NO: 1265625 - protein, 9 aa, Homo Sapiens
KFCPLLCTM

SEQ ID NO: 1265626 - protein, 9 aa, Homo Sapiens
SVSFKYVTV

SEQ ID NO: 1265627 - protein, 9 aa, Homo Sapiens
RPTDAQDCE

SEQ ID NO: 1265628 - protein, 9 aa, Homo Sapiens
LQHVVIIHC

SEQ ID NO: 1265629 - protein, 9 aa, Homo Sapiens
VTPQTGPQF

SEQ ID NO: 1265630 - protein, 9 aa, Homo Sapiens
SPSPPVQQT

SEQ ID NO: 1265631 - protein, 9 aa, Homo Sapiens
DDHNDVVTL

SEQ ID NO: 1265632 - protein, 9 aa, Homo Sapiens
EVWNDMDKY

SEQ ID NO: 1265633 - protein, 9 aa, Homo Sapiens
TSIVKDSYA

SEQ ID NO: 1265634 - protein, 9 aa, Homo Sapiens
MALDRYIDV

SEQ ID NO: 1265635 - protein, 9 aa, Homo Sapiens
GEHCEVDAH

SEQ ID NO: 1265636 - protein, 9 aa, Homo Sapiens
TEHLAPAWM

SEQ ID NO: 1265637 - protein, 9 aa, Homo Sapiens
GVSEKCSCC

SEQ ID NO: 1265638 - protein, 9 aa, Homo Sapiens
CNKCVCSFD

SEQ ID NO: 1265639 - protein, 9 aa, Homo Sapiens
DDTWWFGTV

SEQ ID NO: 1265640 - protein, 9 aa, Homo Sapiens
IQTRSFLKW

SEQ ID NO: 1265641 - protein, 9 aa, Homo Sapiens
EYLMKRENQ

SEQ ID NO: 1265642 - protein, 9 aa, Homo Sapiens
QHQSQKCKS

SEQ ID NO: 1265643 - protein, 9 aa, Homo Sapiens
PDVGAQEEH

SEQ ID NO: 1265644 - protein, 9 aa, Homo Sapiens
ITLSREHPH

SEQ ID NO: 1265645 - protein, 9 aa, Homo Sapiens
VDARQELGL

SEQ ID NO: 1265646 - protein, 9 aa, Homo Sapiens
SGAGKTMIS

SEQ ID NO: 1265647 - protein, 9 aa, Homo Sapiens
PQPLLGALV

SEQ ID NO: 1265648 - protein, 9 aa, Homo Sapiens
SRVEIVTAM

SEQ ID NO: 1265649 - protein, 9 aa, Homo Sapiens
VSNGMSRRA

SEQ ID NO: 1265650 - protein, 9 aa, Homo Sapiens
PGPSGDVGA

SEQ ID NO: 1265651 - protein, 9 aa, Homo Sapiens
DSILAEKMV

SEQ ID NO: 1265652 - protein, 9 aa, Homo Sapiens
TQTINFGTV

SEQ ID NO: 1265653 - protein, 9 aa, Homo Sapiens
VKIATLYLP

SEQ ID NO: 1265654 - protein, 9 aa, Homo Sapiens
RIGEPTSNE

SEQ ID NO: 1265655 - protein, 9 aa, Homo Sapiens
EEAAGPTAD

SEQ ID NO: 1265656 - protein, 9 aa, Homo Sapiens
PAMRGSPGP

SEQ ID NO: 1265657 - protein, 9 aa, Homo Sapiens
TQAHTGIHT

SEQ ID NO: 1265658 - protein, 9 aa, Homo Sapiens
NVITLSITG

SEQ ID NO: 1265659 - protein, 9 aa, Homo Sapiens
SNPDPDGRY

SEQ ID NO: 1265660 - protein, 9 aa, Homo Sapiens
RPPVMTLAI

SEQ ID NO: 1265661 - protein, 9 aa, Homo Sapiens
ATINMITPS

SEQ ID NO: 1265662 - protein, 9 aa, Homo Sapiens
KSARICRNW

SEQ ID NO: 1265663 - protein, 9 aa, Homo Sapiens
GAISLSSLY

SEQ ID NO: 1265664 - protein, 9 aa, Homo Sapiens
DPMHPELVS

SEQ ID NO: 1265665 - protein, 9 aa, Homo Sapiens
ASNTQGCQV

SEQ ID NO: 1265666 - protein, 9 aa, Homo Sapiens
YLDITLDIQ

SEQ ID NO: 1265667 - protein, 9 aa, Homo Sapiens
SEFYVELKA

SEQ ID NO: 1265668 - protein, 9 aa, Homo Sapiens
VVGAPGGPG

SEQ ID NO: 1265669 - protein, 9 aa, Homo Sapiens
DDVLLVFWD

SEQ ID NO: 1265670 - protein, 9 aa, Homo Sapiens
AHRPTEQEL

SEQ ID NO: 1265671 - protein, 9 aa, Homo Sapiens
SYTAPIMNG

SEQ ID NO: 1265672 - protein, 9 aa, Homo Sapiens
ISYCWVIGN

SEQ ID NO: 1265673 - protein, 9 aa, Homo Sapiens
SRSRDRRNQ

SEQ ID NO: 1265674 - protein, 9 aa, Homo Sapiens
GFPTLLTFI

SEQ ID NO: 1265675 - protein, 9 aa, Homo Sapiens
SPLSCNEDG

SEQ ID NO: 1265676 - protein, 9 aa, Homo Sapiens
SSKRHKTIS

SEQ ID NO: 1265677 - protein, 9 aa, Homo Sapiens
STQNPDLEP

SEQ ID NO: 1265678 - protein, 9 aa, Homo Sapiens
RHRAPPRKP

SEQ ID NO: 1265679 - protein, 9 aa, Homo Sapiens
LTVHAGKVA

SEQ ID NO: 1265680 - protein, 9 aa, Homo Sapiens
LAFLSPVAS

SEQ ID NO: 1265681 - protein, 9 aa, Homo Sapiens
VVSVGWLQI

SEQ ID NO: 1265682 - protein, 9 aa, Homo Sapiens
FKMFCTRKD

SEQ ID NO: 1265683 - protein, 9 aa, Homo Sapiens
KLYFMYFNL

SEQ ID NO: 1265684 - protein, 9 aa, Homo Sapiens
SSHFYVVMW

SEQ ID NO: 1265685 - protein, 9 aa, Homo Sapiens
IFTKRDIAL

SEQ ID NO: 1265686 - protein, 9 aa, Homo Sapiens
DLVRQYDVV

SEQ ID NO: 1265687 - protein, 9 aa, Homo Sapiens
MCLTRERRL

SEQ ID NO: 1265688 - protein, 9 aa, Homo Sapiens
KTLRTQCPA

SEQ ID NO: 1265689 - protein, 9 aa, Homo Sapiens
VFEGRTNIE

SEQ ID NO: 1265690 - protein, 9 aa, Homo Sapiens
AIICAYGPI

SEQ ID NO: 1265691 - protein, 9 aa, Homo Sapiens
SSNMYGSFW

SEQ ID NO: 1265692 - protein, 9 aa, Homo Sapiens
RHLCLEYLP

SEQ ID NO: 1265693 - protein, 9 aa, Homo Sapiens
PPLVKVTYH

SEQ ID NO: 1265694 - protein, 9 aa, Homo Sapiens
RVSLPSEIL

SEQ ID NO: 1265695 - protein, 9 aa, Homo Sapiens
IEEAGKFMD

SEQ ID NO: 1265696 - protein, 9 aa, Homo Sapiens
LANVTVASH

SEQ ID NO: 1265697 - protein, 9 aa, Homo Sapiens
CMRRYIKNP

SEQ ID NO: 1265698 - protein, 9 aa, Homo Sapiens
SLADRQCEY

SEQ ID NO: 1265699 - protein, 9 aa, Homo Sapiens
NSDYKRTVA

SEQ ID NO: 1265700 - protein, 9 aa, Homo Sapiens
MSTTGKVIK

SEQ ID NO: 1265701 - protein, 9 aa, Homo Sapiens
SYFGCMNAA

SEQ ID NO: 1265702 - protein, 9 aa, Homo Sapiens
KHLSIGKDI

SEQ ID NO: 1265703 - protein, 9 aa, Homo Sapiens
AILNLHGIA

SEQ ID NO: 1265704 - protein, 9 aa, Homo Sapiens
FSVIMMVYI

SEQ ID NO: 1265705 - protein, 9 aa, Homo Sapiens
TMLQTAGCF

SEQ ID NO: 1265706 - protein, 9 aa, Homo Sapiens
YVPRSKSEM

SEQ ID NO: 1265707 - protein, 9 aa, Homo Sapiens
IYNVAVMCL

SEQ ID NO: 1265708 - protein, 9 aa, Homo Sapiens
KTLVVFWFL

SEQ ID NO: 1265709 - protein, 9 aa, Homo Sapiens
SLLMENGPG

SEQ ID NO: 1265710 - protein, 9 aa, Homo Sapiens
PSYTIKVSF

SEQ ID NO: 1265711 - protein, 9 aa, Homo Sapiens
YGYKEDKPC

SEQ ID NO: 1265712 - protein, 9 aa, Homo Sapiens
DRYIDVCKP

SEQ ID NO: 1265713 - protein, 9 aa, Homo Sapiens
SGVNLFDTT

SEQ ID NO: 1265714 - protein, 9 aa, Homo Sapiens
TSVDLPPEF

SEQ ID NO: 1265715 - protein, 9 aa, Homo Sapiens
KDGKHSRCP

SEQ ID NO: 1265716 - protein, 9 aa, Homo Sapiens
NIHKLRVTN

SEQ ID NO: 1265717 - protein, 9 aa, Homo Sapiens
RGHRRRGLS

SEQ ID NO: 1265718 - protein, 9 aa, Homo Sapiens
RVQFLVVTA

SEQ ID NO: 1265719 - protein, 9 aa, Homo Sapiens
HYIRGAAPT

SEQ ID NO: 1265720 - protein, 9 aa, Homo Sapiens
HSPEEIRGG

SEQ ID NO: 1265721 - protein, 9 aa, Homo Sapiens
LGDGMMERR

SEQ ID NO: 1265722 - protein, 9 aa, Homo Sapiens
PRTFSKQPS

SEQ ID NO: 1265723 - protein, 9 aa, Homo Sapiens
ELYDCRQVT

SEQ ID NO: 1265724 - protein, 9 aa, Homo Sapiens
TRHLGATIL

SEQ ID NO: 1265725 - protein, 9 aa, Homo Sapiens
SHLAVLQHL

SEQ ID NO: 1265726 - protein, 9 aa, Homo Sapiens
TPKKHGLRR

SEQ ID NO: 1265727 - protein, 9 aa, Homo Sapiens
WLWKLMIIV

SEQ ID NO: 1265728 - protein, 9 aa, Homo Sapiens
FGRGEHQER

SEQ ID NO: 1265729 - protein, 9 aa, Homo Sapiens
FKEINTAHA

SEQ ID NO: 1265730 - protein, 9 aa, Homo Sapiens
RECVEFLRP

SEQ ID NO: 1265731 - protein, 9 aa, Homo Sapiens
VSTLHNLGL

SEQ ID NO: 1265732 - protein, 9 aa, Homo Sapiens
GGSMAHEAD

SEQ ID NO: 1265733 - protein, 9 aa, Homo Sapiens
RRALWPSSV

SEQ ID NO: 1265734 - protein, 9 aa, Homo Sapiens
GPSPGSHGQ

SEQ ID NO: 1265735 - protein, 9 aa, Homo Sapiens
RELLLEDRY

SEQ ID NO: 1265736 - protein, 9 aa, Homo Sapiens
HRDKLCLMV

SEQ ID NO: 1265737 - protein, 9 aa, Homo Sapiens
LQRMLPTRP

SEQ ID NO: 1265738 - protein, 9 aa, Homo Sapiens
HTVWSMEHI

SEQ ID NO: 1265739 - protein, 9 aa, Homo Sapiens
QRLKKKHQL

SEQ ID NO: 1265740 - protein, 9 aa, Homo Sapiens
GNVANGFIT

SEQ ID NO: 1265741 - protein, 9 aa, Homo Sapiens
KNGEKDTQT

SEQ ID NO: 1265742 - protein, 9 aa, Homo Sapiens
LAPAWMLLS

SEQ ID NO: 1265743 - protein, 9 aa, Homo Sapiens
LGPELSPPQ

SEQ ID NO: 1265744 - protein, 9 aa, Homo Sapiens
RIKELSSID

SEQ ID NO: 1265745 - protein, 9 aa, Homo Sapiens
LLHVLRGRL

SEQ ID NO: 1265746 - protein, 9 aa, Homo Sapiens
AEEGPVSAG

SEQ ID NO: 1265747 - protein, 9 aa, Homo Sapiens
ANEHERVVK

SEQ ID NO: 1265748 - protein, 9 aa, Homo Sapiens
PTEETTYGR

SEQ ID NO: 1265749 - protein, 9 aa, Homo Sapiens
EPGHQALGG

SEQ ID NO: 1265750 - protein, 9 aa, Homo Sapiens
MQLGKRHNL

SEQ ID NO: 1265751 - protein, 9 aa, Homo Sapiens
FTKPLKFQE

SEQ ID NO: 1265752 - protein, 9 aa, Homo Sapiens
ITLPKSVVD

SEQ ID NO: 1265753 - protein, 9 aa, Homo Sapiens
ENVLLASTE

SEQ ID NO: 1265754 - protein, 9 aa, Homo Sapiens
INFSVIDQY

SEQ ID NO: 1265755 - protein, 9 aa, Homo Sapiens
AATSSKKVV

SEQ ID NO: 1265756 - protein, 9 aa, Homo Sapiens
YQQPRWVAL

SEQ ID NO: 1265757 - protein, 9 aa, Homo Sapiens
MNYENSHSH

SEQ ID NO: 1265758 - protein, 9 aa, Homo Sapiens
VWGADASSL

SEQ ID NO: 1265759 - protein, 9 aa, Homo Sapiens
LGLCYQISC

SEQ ID NO: 1265760 - protein, 9 aa, Homo Sapiens
EVAGFLDRS

SEQ ID NO: 1265761 - protein, 9 aa, Homo Sapiens
LQGRLAARN

SEQ ID NO: 1265762 - protein, 9 aa, Homo Sapiens
PMEGKIIKD

SEQ ID NO: 1265763 - protein, 9 aa, Homo Sapiens
VNDGMFGRC

SEQ ID NO: 1265764 - protein, 9 aa, Homo Sapiens
FHLTQGEPK

SEQ ID NO: 1265765 - protein, 9 aa, Homo Sapiens
KKTHTPCVP

SEQ ID NO: 1265766 - protein, 9 aa, Homo Sapiens
VADVLIKHS

SEQ ID NO: 1265767 - protein, 9 aa, Homo Sapiens
IFYYLEVHQ

SEQ ID NO: 1265768 - protein, 9 aa, Homo Sapiens
LATKPLSWA

SEQ ID NO: 1265769 - protein, 9 aa, Homo Sapiens
ETERIIPFL

SEQ ID NO: 1265770 - protein, 9 aa, Homo Sapiens
RIEVLYTST

SEQ ID NO: 1265771 - protein, 9 aa, Homo Sapiens
PYKGDVETL

SEQ ID NO: 1265772 - protein, 9 aa, Homo Sapiens
VDEVSEKVL

SEQ ID NO: 1265773 - protein, 9 aa, Homo Sapiens
MAQTCDPAA

SEQ ID NO: 1265774 - protein, 9 aa, Homo Sapiens
EIPYECEEC

SEQ ID NO: 1265775 - protein, 9 aa, Homo Sapiens
RHFKVASLE

SEQ ID NO: 1265776 - protein, 9 aa, Homo Sapiens
DRWCSIVRS

SEQ ID NO: 1265777 - protein, 9 aa, Homo Sapiens
SMQPYSPTN

SEQ ID NO: 1265778 - protein, 9 aa, Homo Sapiens
DVFEITDFT

SEQ ID NO: 1265779 - protein, 9 aa, Homo Sapiens
RVQTTRTSA

SEQ ID NO: 1265780 - protein, 9 aa, Homo Sapiens
IRKEKNDIH

SEQ ID NO: 1265781 - protein, 9 aa, Homo Sapiens
HQQGVLQKV

SEQ ID NO: 1265782 - protein, 9 aa, Homo Sapiens
RCRHQSPDC

SEQ ID NO: 1265783 - protein, 9 aa, Homo Sapiens
QNTWLSYRL

SEQ ID NO: 1265784 - protein, 9 aa, Homo Sapiens
SFEKVAAEA

SEQ ID NO: 1265785 - protein, 9 aa, Homo Sapiens
MGSSSSNQY

SEQ ID NO: 1265786 - protein, 9 aa, Homo Sapiens
QNRQTKWRK

SEQ ID NO: 1265787 - protein, 9 aa, Homo Sapiens
IISRWNWLQ

SEQ ID NO: 1265788 - protein, 9 aa, Homo Sapiens
RAVLWLDWF

SEQ ID NO: 1265789 - protein, 9 aa, Homo Sapiens
LEISRILNN

SEQ ID NO: 1265790 - protein, 9 aa, Homo Sapiens
DHIDKKDVP

SEQ ID NO: 1265791 - protein, 9 aa, Homo Sapiens
HHVRISRSL

SEQ ID NO: 1265792 - protein, 9 aa, Homo Sapiens
ETYRDDVRR

SEQ ID NO: 1265793 - protein, 9 aa, Homo Sapiens
GRNGVALEE

SEQ ID NO: 1265794 - protein, 9 aa, Homo Sapiens
LKPSTSLTS

SEQ ID NO: 1265795 - protein, 9 aa, Homo Sapiens
QAKRNNIVK

SEQ ID NO: 1265796 - protein, 9 aa, Homo Sapiens
SVTIFSFQT

SEQ ID NO: 1265797 - protein, 9 aa, Homo Sapiens
RPGKPFLYD

SEQ ID NO: 1265798 - protein, 9 aa, Homo Sapiens
GAVSTYDGL

SEQ ID NO: 1265799 - protein, 9 aa, Homo Sapiens
ADTCQCVNG

SEQ ID NO: 1265800 - protein, 9 aa, Homo Sapiens
TLYPIIGKC

SEQ ID NO: 1265801 - protein, 9 aa, Homo Sapiens
RKALLKILK

SEQ ID NO: 1265802 - protein, 9 aa, Homo Sapiens
LCAVCGEIQ

SEQ ID NO: 1265803 - protein, 9 aa, Homo Sapiens
MWMVHIDEE

SEQ ID NO: 1265804 - protein, 9 aa, Homo Sapiens
CILPGTEQE

SEQ ID NO: 1265805 - protein, 9 aa, Homo Sapiens
SNALSLKIT

SEQ ID NO: 1265806 - protein, 9 aa, Homo Sapiens
RLSSSPGKA

SEQ ID NO: 1265807 - protein, 9 aa, Homo Sapiens
LARHEWAQK

SEQ ID NO: 1265808 - protein, 9 aa, Homo Sapiens
HQLAGLLQL

SEQ ID NO: 1265809 - protein, 9 aa, Homo Sapiens
LPDLEVKEW

SEQ ID NO: 1265810 - protein, 9 aa, Homo Sapiens
YFWVKEARD

SEQ ID NO: 1265811 - protein, 9 aa, Homo Sapiens
DDSGEGPSS

SEQ ID NO: 1265812 - protein, 9 aa, Homo Sapiens
KKLSDSFGT

SEQ ID NO: 1265813 - protein, 9 aa, Homo Sapiens
QSGFPTLSW

SEQ ID NO: 1265814 - protein, 9 aa, Homo Sapiens
LYTYKSKMA

SEQ ID NO: 1265815 - protein, 9 aa, Homo Sapiens
LTDQRISPA

SEQ ID NO: 1265816 - protein, 9 aa, Homo Sapiens
QTPNKPQKK

SEQ ID NO: 1265817 - protein, 9 aa, Homo Sapiens
PFANIAHSN

SEQ ID NO: 1265818 - protein, 9 aa, Homo Sapiens
AHVMKQEVL

SEQ ID NO: 1265819 - protein, 9 aa, Homo Sapiens
RDPKCYVQD

SEQ ID NO: 1265820 - protein, 9 aa, Homo Sapiens
AAEQLQQSL

SEQ ID NO: 1265821 - protein, 9 aa, Homo Sapiens
RSSSPAPRT

SEQ ID NO: 1265822 - protein, 9 aa, Homo Sapiens
SPPFRLHLL

SEQ ID NO: 1265823 - protein, 9 aa, Homo Sapiens
WDCDYSLAN

SEQ ID NO: 1265824 - protein, 9 aa, Homo Sapiens
SPYHADPSL

SEQ ID NO: 1265825 - protein, 9 aa, Homo Sapiens
ANYLITSLA

SEQ ID NO: 1265826 - protein, 9 aa, Homo Sapiens
IITFIIIAL

SEQ ID NO: 1265827 - protein, 9 aa, Homo Sapiens
ASSSSMVFP

SEQ ID NO: 1265828 - protein, 9 aa, Homo Sapiens
SGTPETRKC

SEQ ID NO: 1265829 - protein, 9 aa, Homo Sapiens
AYYNMIAAK

SEQ ID NO: 1265830 - protein, 9 aa, Homo Sapiens
AISFLTPMA

SEQ ID NO: 1265831 - protein, 9 aa, Homo Sapiens
CVSTYSFMP

SEQ ID NO: 1265832 - protein, 9 aa, Homo Sapiens
DQEARCREE

SEQ ID NO: 1265833 - protein, 9 aa, Homo Sapiens
GLENQESLQ

SEQ ID NO: 1265834 - protein, 9 aa, Homo Sapiens
CHHVYKTLE

SEQ ID NO: 1265835 - protein, 9 aa, Homo Sapiens
PSPHPPPAC

SEQ ID NO: 1265836 - protein, 9 aa, Homo Sapiens
KHPALCSRF

SEQ ID NO: 1265837 - protein, 9 aa, Homo Sapiens
IIEHMPPKS

SEQ ID NO: 1265838 - protein, 9 aa, Homo Sapiens
HPVRVPDQE

SEQ ID NO: 1265839 - protein, 9 aa, Homo Sapiens
SAGREKKSH

SEQ ID NO: 1265840 - protein, 9 aa, Homo Sapiens
LVMITYGVS

SEQ ID NO: 1265841 - protein, 9 aa, Homo Sapiens
RMQDLKSTV

SEQ ID NO: 1265842 - protein, 9 aa, Homo Sapiens
VGFFIHCRR

SEQ ID NO: 1265843 - protein, 9 aa, Homo Sapiens
PFSCPQCSR

SEQ ID NO: 1265844 - protein, 9 aa, Homo Sapiens
PTLEDQECH

SEQ ID NO: 1265845 - protein, 9 aa, Homo Sapiens
SCPEGVRQQ

SEQ ID NO: 1265846 - protein, 9 aa, Homo Sapiens
ALHRVAVQH

SEQ ID NO: 1265847 - protein, 9 aa, Homo Sapiens
PPILSYCTL

SEQ ID NO: 1265848 - protein, 9 aa, Homo Sapiens
VNKLMEHER

SEQ ID NO: 1265849 - protein, 9 aa, Homo Sapiens
NPGSDQIQL

SEQ ID NO: 1265850 - protein, 9 aa, Homo Sapiens
VASLDCEDL

SEQ ID NO: 1265851 - protein, 9 aa, Homo Sapiens
IPFDRDKYL

SEQ ID NO: 1265852 - protein, 9 aa, Homo Sapiens
NELEVQTRV

SEQ ID NO: 1265853 - protein, 9 aa, Homo Sapiens
FHVLTERIA

SEQ ID NO: 1265854 - protein, 9 aa, Homo Sapiens
QKSKNQEHE

SEQ ID NO: 1265855 - protein, 9 aa, Homo Sapiens
GLLSTGSAE

SEQ ID NO: 1265856 - protein, 9 aa, Homo Sapiens
LKEGHRRPP

SEQ ID NO: 1265857 - protein, 9 aa, Homo Sapiens
WRCKCYGHR

SEQ ID NO: 1265858 - protein, 9 aa, Homo Sapiens
MVIFTLSVT

SEQ ID NO: 1265859 - protein, 9 aa, Homo Sapiens
KYKEDVTYA

SEQ ID NO: 1265860 - protein, 9 aa, Homo Sapiens
PARSGLKRS

SEQ ID NO: 1265861 - protein, 9 aa, Homo Sapiens
CQQCFSSLS

SEQ ID NO: 1265862 - protein, 9 aa, Homo Sapiens
YVFVRDSAK

SEQ ID NO: 1265863 - protein, 9 aa, Homo Sapiens
SDIAVLIPK

SEQ ID NO: 1265864 - protein, 9 aa, Homo Sapiens
SRHTLKHDT

SEQ ID NO: 1265865 - protein, 9 aa, Homo Sapiens
REWRIFQLH

SEQ ID NO: 1265866 - protein, 9 aa, Homo Sapiens
GMFGTSHGA

SEQ ID NO: 1265867 - protein, 9 aa, Homo Sapiens
TLSYLRESG

SEQ ID NO: 1265868 - protein, 9 aa, Homo Sapiens
HGRHRKIKR

SEQ ID NO: 1265869 - protein, 9 aa, Homo Sapiens
LTKLKDVKS

SEQ ID NO: 1265870 - protein, 9 aa, Homo Sapiens
TIHGMSQAC

SEQ ID NO: 1265871 - protein, 9 aa, Homo Sapiens
LLLAGISLR

SEQ ID NO: 1265872 - protein, 9 aa, Homo Sapiens
NAENESPKC

SEQ ID NO: 1265873 - protein, 9 aa, Homo Sapiens
GSISTVHYP

SEQ ID NO: 1265874 - protein, 9 aa, Homo Sapiens
TGTKSLDVL

SEQ ID NO: 1265875 - protein, 9 aa, Homo Sapiens
GPQGDIEVL

SEQ ID NO: 1265876 - protein, 9 aa, Homo Sapiens
PMPKVGFIP

SEQ ID NO: 1265877 - protein, 9 aa, Homo Sapiens
KEGENIRKK

SEQ ID NO: 1265878 - protein, 9 aa, Homo Sapiens
LHNVQEVEK

SEQ ID NO: 1265879 - protein, 9 aa, Homo Sapiens
QLKRPRHVI

SEQ ID NO: 1265880 - protein, 9 aa, Homo Sapiens
LKHDTLKGL

SEQ ID NO: 1265881 - protein, 9 aa, Homo Sapiens
SSDADGECQ

SEQ ID NO: 1265882 - protein, 9 aa, Homo Sapiens
DLSCTLGSP

SEQ ID NO: 1265883 - protein, 9 aa, Homo Sapiens
DLKASPTLV

SEQ ID NO: 1265884 - protein, 9 aa, Homo Sapiens
AYRGILNSP

SEQ ID NO: 1265885 - protein, 9 aa, Homo Sapiens
HGSITRDST

SEQ ID NO: 1265886 - protein, 9 aa, Homo Sapiens
CQEQKAKME

SEQ ID NO: 1265887 - protein, 9 aa, Homo Sapiens
GHRIDYVLQ

SEQ ID NO: 1265888 - protein, 9 aa, Homo Sapiens
VMVQMLLDA

SEQ ID NO: 1265889 - protein, 9 aa, Homo Sapiens
KKECQEEAD

SEQ ID NO: 1265890 - protein, 9 aa, Homo Sapiens
LPSLPARSG

SEQ ID NO: 1265891 - protein, 9 aa, Homo Sapiens
YEGSGSTTG

SEQ ID NO: 1265892 - protein, 9 aa, Homo Sapiens
HRVYGDIIH

SEQ ID NO: 1265893 - protein, 9 aa, Homo Sapiens
DMGGMSTDV

SEQ ID NO: 1265894 - protein, 9 aa, Homo Sapiens
FGKVILVWE

SEQ ID NO: 1265895 - protein, 9 aa, Homo Sapiens
NTIQGALEL

SEQ ID NO: 1265896 - protein, 9 aa, Homo Sapiens
RHIHTLLWD

SEQ ID NO: 1265897 - protein, 9 aa, Homo Sapiens
DEHLLCHRF

SEQ ID NO: 1265898 - protein, 9 aa, Homo Sapiens
PPDMIVTTH

SEQ ID NO: 1265899 - protein, 9 aa, Homo Sapiens
RQLAEKRIL

SEQ ID NO: 1265900 - protein, 9 aa, Homo Sapiens
WITKMEIHR

SEQ ID NO: 1265901 - protein, 9 aa, Homo Sapiens
FYTKIHIYF

SEQ ID NO: 1265902 - protein, 9 aa, Homo Sapiens
VVNRVSAIR

SEQ ID NO: 1265903 - protein, 9 aa, Homo Sapiens
PLLQDAIRI

SEQ ID NO: 1265904 - protein, 9 aa, Homo Sapiens
VKAAFKKAN

SEQ ID NO: 1265905 - protein, 9 aa, Homo Sapiens
NSWCLVQGF

SEQ ID NO: 1265906 - protein, 9 aa, Homo Sapiens
VKVWYLEEE

SEQ ID NO: 1265907 - protein, 9 aa, Homo Sapiens
HNDVVTLLA

SEQ ID NO: 1265908 - protein, 9 aa, Homo Sapiens
DFPCINSLV

SEQ ID NO: 1265909 - protein, 9 aa, Homo Sapiens
TIDFEESLV

SEQ ID NO: 1265910 - protein, 9 aa, Homo Sapiens
EHLVITSFC

SEQ ID NO: 1265911 - protein, 9 aa, Homo Sapiens
DVIGIQHAK

SEQ ID NO: 1265912 - protein, 9 aa, Homo Sapiens
GFITLVNVI

SEQ ID NO: 1265913 - protein, 9 aa, Homo Sapiens
DESCYNCGR

SEQ ID NO: 1265914 - protein, 9 aa, Homo Sapiens
TFNAAVMAS

SEQ ID NO: 1265915 - protein, 9 aa, Homo Sapiens
TETRVQVWF

SEQ ID NO: 1265916 - protein, 9 aa, Homo Sapiens
QGWWEFPPK

SEQ ID NO: 1265917 - protein, 9 aa, Homo Sapiens
QADLEILVS

SEQ ID NO: 1265918 - protein, 9 aa, Homo Sapiens
LSALTLVRL

SEQ ID NO: 1265919 - protein, 9 aa, Homo Sapiens
EELYAIKMT

SEQ ID NO: 1265920 - protein, 9 aa, Homo Sapiens
SCKTGPGTP

SEQ ID NO: 1265921 - protein, 9 aa, Homo Sapiens
RMDPTWHPW

SEQ ID NO: 1265922 - protein, 9 aa, Homo Sapiens
VCWWLPYWS

SEQ ID NO: 1265923 - protein, 9 aa, Homo Sapiens
PMWDNPGSL

SEQ ID NO: 1265924 - protein, 9 aa, Homo Sapiens
IVHAQPYHM

SEQ ID NO: 1265925 - protein, 9 aa, Homo Sapiens
GYAETYHWS

SEQ ID NO: 1265926 - protein, 9 aa, Homo Sapiens
KPKYFSAFI

SEQ ID NO: 1265927 - protein, 9 aa, Homo Sapiens
LSNIARKSL

SEQ ID NO: 1265928 - protein, 9 aa, Homo Sapiens
QQLEEMCKR

SEQ ID NO: 1265929 - protein, 9 aa, Homo Sapiens
TRIAMETYY

SEQ ID NO: 1265930 - protein, 9 aa, Homo Sapiens
QTEKKKLRY

SEQ ID NO: 1265931 - protein, 9 aa, Homo Sapiens
CECAPGSAG

SEQ ID NO: 1265932 - protein, 9 aa, Homo Sapiens
SWITIVMPL

SEQ ID NO: 1265933 - protein, 9 aa, Homo Sapiens
NVKFRKITD

SEQ ID NO: 1265934 - protein, 9 aa, Homo Sapiens
HLWALLAGA

SEQ ID NO: 1265935 - protein, 9 aa, Homo Sapiens
DQDVCKISD

SEQ ID NO: 1265936 - protein, 9 aa, Homo Sapiens
PSPMLPAQF

SEQ ID NO: 1265937 - protein, 9 aa, Homo Sapiens
HNGVIHFDD

SEQ ID NO: 1265938 - protein, 9 aa, Homo Sapiens
HHMIMFLDE

SEQ ID NO: 1265939 - protein, 9 aa, Homo Sapiens
YQVTAEDLD

SEQ ID NO: 1265940 - protein, 9 aa, Homo Sapiens
RAGLDGRSR

SEQ ID NO: 1265941 - protein, 9 aa, Homo Sapiens
KPQPDVDHQ

SEQ ID NO: 1265942 - protein, 9 aa, Homo Sapiens
DDINLLGVL

SEQ ID NO: 1265943 - protein, 9 aa, Homo Sapiens
MYTVEYSFS

SEQ ID NO: 1265944 - protein, 9 aa, Homo Sapiens
LIEAPEHDA

SEQ ID NO: 1265945 - protein, 9 aa, Homo Sapiens
NPWERKSYW

SEQ ID NO: 1265946 - protein, 9 aa, Homo Sapiens
FSEAKNKAM

SEQ ID NO: 1265947 - protein, 9 aa, Homo Sapiens
KCRVHDLEI

SEQ ID NO: 1265948 - protein, 9 aa, Homo Sapiens
DARARVGVA

SEQ ID NO: 1265949 - protein, 9 aa, Homo Sapiens
STTTTRSLA

SEQ ID NO: 1265950 - protein, 9 aa, Homo Sapiens
NYPMSVAVL

SEQ ID NO: 1265951 - protein, 9 aa, Homo Sapiens
VGGNAGVRG

SEQ ID NO: 1265952 - protein, 9 aa, Homo Sapiens
PKGMTKLCS

SEQ ID NO: 1265953 - protein, 9 aa, Homo Sapiens
KPSSQSQIS

SEQ ID NO: 1265954 - protein, 9 aa, Homo Sapiens
MFTRYILHP

SEQ ID NO: 1265955 - protein, 9 aa, Homo Sapiens
IGHNGHELR

SEQ ID NO: 1265956 - protein, 9 aa, Homo Sapiens
GEIMKWCGY

SEQ ID NO: 1265957 - protein, 9 aa, Homo Sapiens
LSQTEIVRS

SEQ ID NO: 1265958 - protein, 9 aa, Homo Sapiens
IKCGKRRYC

SEQ ID NO: 1265959 - protein, 9 aa, Homo Sapiens
LHQEVMKLV

SEQ ID NO: 1265960 - protein, 9 aa, Homo Sapiens
LQVTMAVLL

SEQ ID NO: 1265961 - protein, 9 aa, Homo Sapiens
YHLSLEAST

SEQ ID NO: 1265962 - protein, 9 aa, Homo Sapiens
PLIPYYSNM

SEQ ID NO: 1265963 - protein, 9 aa, Homo Sapiens
QDLNNELRE

SEQ ID NO: 1265964 - protein, 9 aa, Homo Sapiens
RVTDLIMLR

SEQ ID NO: 1265965 - protein, 9 aa, Homo Sapiens
TSLMDCQAR

SEQ ID NO: 1265966 - protein, 9 aa, Homo Sapiens
GFPNKHIRF

SEQ ID NO: 1265967 - protein, 9 aa, Homo Sapiens
LKDRHMENL

SEQ ID NO: 1265968 - protein, 9 aa, Homo Sapiens
WVQGNACIS

SEQ ID NO: 1265969 - protein, 9 aa, Homo Sapiens
LRTARCRQQ

SEQ ID NO: 1265970 - protein, 9 aa, Homo Sapiens
KGLILPAVL

SEQ ID NO: 1265971 - protein, 9 aa, Homo Sapiens
LKSGLDLCS

SEQ ID NO: 1265972 - protein, 9 aa, Homo Sapiens
DVLCVTVSI

SEQ ID NO: 1265973 - protein, 9 aa, Homo Sapiens
MFPPNAAAA

SEQ ID NO: 1265974 - protein, 9 aa, Homo Sapiens
HIPKNKETR

SEQ ID NO: 1265975 - protein, 9 aa, Homo Sapiens
PVTPYWTSP

SEQ ID NO: 1265976 - protein, 9 aa, Homo Sapiens
KVRAYANDT

SEQ ID NO: 1265977 - protein, 9 aa, Homo Sapiens
ERGEQGIPG

SEQ ID NO: 1265978 - protein, 9 aa, Homo Sapiens
SDAYHHLDS

SEQ ID NO: 1265979 - protein, 9 aa, Homo Sapiens
AERKTNKWS

SEQ ID NO: 1265980 - protein, 9 aa, Homo Sapiens
AENEMLTLA

SEQ ID NO: 1265981 - protein, 9 aa, Homo Sapiens
GIRLSTSLL

SEQ ID NO: 1265982 - protein, 9 aa, Homo Sapiens
PTETNSLIL

SEQ ID NO: 1265983 - protein, 9 aa, Homo Sapiens
YMSEETHRK

SEQ ID NO: 1265984 - protein, 9 aa, Homo Sapiens
VKYSKIHSF

SEQ ID NO: 1265985 - protein, 9 aa, Homo Sapiens
TTLTKKPDV

SEQ ID NO: 1265986 - protein, 9 aa, Homo Sapiens
PQEAILVAL

SEQ ID NO: 1265987 - protein, 9 aa, Homo Sapiens
DPNGTLFRL

SEQ ID NO: 1265988 - protein, 9 aa, Homo Sapiens
KAFGQSSVL

SEQ ID NO: 1265989 - protein, 9 aa, Homo Sapiens
RYDSIPMST

SEQ ID NO: 1265990 - protein, 9 aa, Homo Sapiens
VTYTQCTDG

SEQ ID NO: 1265991 - protein, 9 aa, Homo Sapiens
DGSLIALSF

SEQ ID NO: 1265992 - protein, 9 aa, Homo Sapiens
LPPPPPAQS

SEQ ID NO: 1265993 - protein, 9 aa, Homo Sapiens
SHLQNLTEL

SEQ ID NO: 1265994 - protein, 9 aa, Homo Sapiens
DTYVDEQMT

SEQ ID NO: 1265995 - protein, 9 aa, Homo Sapiens
QVIMVVVVP

SEQ ID NO: 1265996 - protein, 9 aa, Homo Sapiens
FQPSVVVLQ

SEQ ID NO: 1265997 - protein, 9 aa, Homo Sapiens
DKPGEGTYA

SEQ ID NO: 1265998 - protein, 9 aa, Homo Sapiens
DYPHLQKVL

SEQ ID NO: 1265999 - protein, 9 aa, Homo Sapiens
DLPPSWTMD

SEQ ID NO: 1266000 - protein, 9 aa, Homo Sapiens
KEMVRVQGP

SEQ ID NO: 1266001 - protein, 9 aa, Homo Sapiens
QTAPAGRSS

SEQ ID NO: 1266002 - protein, 9 aa, Homo Sapiens
RVLHNVQEV

SEQ ID NO: 1266003 - protein, 9 aa, Homo Sapiens
AVLQWIRET

SEQ ID NO: 1266004 - protein, 9 aa, Homo Sapiens
VKLHGFQAR

SEQ ID NO: 1266005 - protein, 9 aa, Homo Sapiens
MEKHSSGLD

SEQ ID NO: 1266006 - protein, 9 aa, Homo Sapiens
IKVVHVTVF

SEQ ID NO: 1266007 - protein, 9 aa, Homo Sapiens
LSQTRAIKD

SEQ ID NO: 1266008 - protein, 9 aa, Homo Sapiens
ISDIDGIIT

SEQ ID NO: 1266009 - protein, 9 aa, Homo Sapiens
KCFKGLYVV

SEQ ID NO: 1266010 - protein, 9 aa, Homo Sapiens
AMHTSQQSV

SEQ ID NO: 1266011 - protein, 9 aa, Homo Sapiens
ASRTQIVHV

SEQ ID NO: 1266012 - protein, 9 aa, Homo Sapiens
LSGGLEPKG

SEQ ID NO: 1266013 - protein, 9 aa, Homo Sapiens
NLVCALSTL

SEQ ID NO: 1266014 - protein, 9 aa, Homo Sapiens
CLLIMLFLL

SEQ ID NO: 1266015 - protein, 9 aa, Homo Sapiens
GSAGHWISR

SEQ ID NO: 1266016 - protein, 9 aa, Homo Sapiens
TVTLENLTD

SEQ ID NO: 1266017 - protein, 9 aa, Homo Sapiens
TYHDISMNH

SEQ ID NO: 1266018 - protein, 9 aa, Homo Sapiens
FGNVLVIIT

SEQ ID NO: 1266019 - protein, 9 aa, Homo Sapiens
AAPDGRYMH

SEQ ID NO: 1266020 - protein, 9 aa, Homo Sapiens
EEGQEYEDE

SEQ ID NO: 1266021 - protein, 9 aa, Homo Sapiens
TIQAQPQIA

SEQ ID NO: 1266022 - protein, 9 aa, Homo Sapiens
SVLASLIGI

SEQ ID NO: 1266023 - protein, 9 aa, Homo Sapiens
TGTLVPARA

SEQ ID NO: 1266024 - protein, 9 aa, Homo Sapiens
VTTTLKLIL

SEQ ID NO: 1266025 - protein, 9 aa, Homo Sapiens
SPESLGYLT

SEQ ID NO: 1266026 - protein, 9 aa, Homo Sapiens
TENKFQPKR

SEQ ID NO: 1266027 - protein, 9 aa, Homo Sapiens
FMDDPTVHP

SEQ ID NO: 1266028 - protein, 9 aa, Homo Sapiens
FGHMKMVLL

SEQ ID NO: 1266029 - protein, 9 aa, Homo Sapiens
LFPGCVLRL

SEQ ID NO: 1266030 - protein, 9 aa, Homo Sapiens
LSEQLGQEY

SEQ ID NO: 1266031 - protein, 9 aa, Homo Sapiens
PHRVSRLRT

SEQ ID NO: 1266032 - protein, 9 aa, Homo Sapiens
ETQQRRMSL

SEQ ID NO: 1266033 - protein, 9 aa, Homo Sapiens
TPWAIFPVW

SEQ ID NO: 1266034 - protein, 9 aa, Homo Sapiens
QRESASIHD

SEQ ID NO: 1266035 - protein, 9 aa, Homo Sapiens
AACCDDMAL

SEQ ID NO: 1266036 - protein, 9 aa, Homo Sapiens
GDRQKAMKC

SEQ ID NO: 1266037 - protein, 9 aa, Homo Sapiens
SKQEGHIWS

SEQ ID NO: 1266038 - protein, 9 aa, Homo Sapiens
VAHLDGRLA

SEQ ID NO: 1266039 - protein, 9 aa, Homo Sapiens
DVYQPEASM

SEQ ID NO: 1266040 - protein, 9 aa, Homo Sapiens
YTAMKSKEM

SEQ ID NO: 1266041 - protein, 9 aa, Homo Sapiens
QAEEEWRQV

SEQ ID NO: 1266042 - protein, 9 aa, Homo Sapiens
CEEEIPEES

SEQ ID NO: 1266043 - protein, 9 aa, Homo Sapiens
INHSYTGMW

SEQ ID NO: 1266044 - protein, 9 aa, Homo Sapiens
REEHSLSAP

SEQ ID NO: 1266045 - protein, 9 aa, Homo Sapiens
MLSHLSVVG

SEQ ID NO: 1266046 - protein, 9 aa, Homo Sapiens
KESPARSVM

SEQ ID NO: 1266047 - protein, 9 aa, Homo Sapiens
KPKVHNHQP

SEQ ID NO: 1266048 - protein, 9 aa, Homo Sapiens
CISCITKFD

SEQ ID NO: 1266049 - protein, 9 aa, Homo Sapiens
RVREGSLPG

SEQ ID NO: 1266050 - protein, 9 aa, Homo Sapiens
HYYQIMPKY

SEQ ID NO: 1266051 - protein, 9 aa, Homo Sapiens
RVGCLQVSL

SEQ ID NO: 1266052 - protein, 9 aa, Homo Sapiens
GITMLDTGS

SEQ ID NO: 1266053 - protein, 9 aa, Homo Sapiens
TWRHRRSIV

SEQ ID NO: 1266054 - protein, 9 aa, Homo Sapiens
GMPYSAPNV

SEQ ID NO: 1266055 - protein, 9 aa, Homo Sapiens
PFQEKRLHS

SEQ ID NO: 1266056 - protein, 9 aa, Homo Sapiens
NGGKCFMVK

SEQ ID NO: 1266057 - protein, 9 aa, Homo Sapiens
IMQESHTES

SEQ ID NO: 1266058 - protein, 9 aa, Homo Sapiens
GPGSDYIIN

SEQ ID NO: 1266059 - protein, 9 aa, Homo Sapiens
GDTCHRTCF

SEQ ID NO: 1266060 - protein, 9 aa, Homo Sapiens
IPLDRKDQF

SEQ ID NO: 1266061 - protein, 9 aa, Homo Sapiens
NDQQHIHVY

SEQ ID NO: 1266062 - protein, 9 aa, Homo Sapiens
SGNTSMWLA

SEQ ID NO: 1266063 - protein, 9 aa, Homo Sapiens
EALDPVPFD

SEQ ID NO: 1266064 - protein, 9 aa, Homo Sapiens
IILHIRSSE

SEQ ID NO: 1266065 - protein, 9 aa, Homo Sapiens
IKGVGAETM

SEQ ID NO: 1266066 - protein, 9 aa, Homo Sapiens
HHQAKLNLK

SEQ ID NO: 1266067 - protein, 9 aa, Homo Sapiens
ASIYLLAIY

SEQ ID NO: 1266068 - protein, 9 aa, Homo Sapiens
MYCRETCNC

SEQ ID NO: 1266069 - protein, 9 aa, Homo Sapiens
HIIHAGEKL

SEQ ID NO: 1266070 - protein, 9 aa, Homo Sapiens
TTSTDQRPS

SEQ ID NO: 1266071 - protein, 9 aa, Homo Sapiens
HDLEIEGRD

SEQ ID NO: 1266072 - protein, 9 aa, Homo Sapiens
FLGMLQMND

SEQ ID NO: 1266073 - protein, 9 aa, Homo Sapiens
KMYELSWRM

SEQ ID NO: 1266074 - protein, 9 aa, Homo Sapiens
RQYDVVADC

SEQ ID NO: 1266075 - protein, 9 aa, Homo Sapiens
TIRIPNRFL

SEQ ID NO: 1266076 - protein, 9 aa, Homo Sapiens
HRIALHIAD

SEQ ID NO: 1266077 - protein, 9 aa, Homo Sapiens
AVLDGFDAL

SEQ ID NO: 1266078 - protein, 9 aa, Homo Sapiens
IAKVSPPVL

SEQ ID NO: 1266079 - protein, 9 aa, Homo Sapiens
HSAGSVESP

SEQ ID NO: 1266080 - protein, 9 aa, Homo Sapiens
PLDLLPDRI

SEQ ID NO: 1266081 - protein, 9 aa, Homo Sapiens
SGELYFWVK

SEQ ID NO: 1266082 - protein, 9 aa, Homo Sapiens
SNKHHMIMF

SEQ ID NO: 1266083 - protein, 9 aa, Homo Sapiens
ETVYQIHKQ

SEQ ID NO: 1266084 - protein, 9 aa, Homo Sapiens
EETHRKVVI

SEQ ID NO: 1266085 - protein, 9 aa, Homo Sapiens
NVLRERQLH

SEQ ID NO: 1266086 - protein, 9 aa, Homo Sapiens
GKVPLSLRL

SEQ ID NO: 1266087 - protein, 9 aa, Homo Sapiens
TFTEEETTQ

SEQ ID NO: 1266088 - protein, 9 aa, Homo Sapiens
QHSSSINVV

SEQ ID NO: 1266089 - protein, 9 aa, Homo Sapiens
YRNGKYNLD

SEQ ID NO: 1266090 - protein, 9 aa, Homo Sapiens
GVYVLLIRN

SEQ ID NO: 1266091 - protein, 9 aa, Homo Sapiens
KYSKIHSFH

SEQ ID NO: 1266092 - protein, 9 aa, Homo Sapiens
VNNFFVTEG

SEQ ID NO: 1266093 - protein, 9 aa, Homo Sapiens
SAADLTTGT

SEQ ID NO: 1266094 - protein, 9 aa, Homo Sapiens
GGQQSHHGH

SEQ ID NO: 1266095 - protein, 9 aa, Homo Sapiens
DQLCLDPMT

SEQ ID NO: 1266096 - protein, 9 aa, Homo Sapiens
LMAYDFHDS

SEQ ID NO: 1266097 - protein, 9 aa, Homo Sapiens
TSYSPRPTY

SEQ ID NO: 1266098 - protein, 9 aa, Homo Sapiens
ARQLLAVGQ

SEQ ID NO: 1266099 - protein, 9 aa, Homo Sapiens
KLHQAEGAV

SEQ ID NO: 1266100 - protein, 9 aa, Homo Sapiens
RRSTAATSS

SEQ ID NO: 1266101 - protein, 9 aa, Homo Sapiens
RGTGLGLFC

SEQ ID NO: 1266102 - protein, 9 aa, Homo Sapiens
DMRRAEATW

SEQ ID NO: 1266103 - protein, 9 aa, Homo Sapiens
TLIRRYQEI

SEQ ID NO: 1266104 - protein, 9 aa, Homo Sapiens
GEVIVKRAG

SEQ ID NO: 1266105 - protein, 9 aa, Homo Sapiens
NSKGTDFLQ

SEQ ID NO: 1266106 - protein, 9 aa, Homo Sapiens
RWQGPCRHA

SEQ ID NO: 1266107 - protein, 9 aa, Homo Sapiens
EMAHQIYVL

SEQ ID NO: 1266108 - protein, 9 aa, Homo Sapiens
MMQFLNDRL

SEQ ID NO: 1266109 - protein, 9 aa, Homo Sapiens
VTLENLTDE

SEQ ID NO: 1266110 - protein, 9 aa, Homo Sapiens
GRGRPGAGP

SEQ ID NO: 1266111 - protein, 9 aa, Homo Sapiens
ETYVKLDKP

SEQ ID NO: 1266112 - protein, 9 aa, Homo Sapiens
MREALKLHI

SEQ ID NO: 1266113 - protein, 9 aa, Homo Sapiens
DMPLQPSIL

SEQ ID NO: 1266114 - protein, 9 aa, Homo Sapiens
MCLALEAEE

SEQ ID NO: 1266115 - protein, 9 aa, Homo Sapiens
INQQMGAFV

SEQ ID NO: 1266116 - protein, 9 aa, Homo Sapiens
IQLKYFVLG

SEQ ID NO: 1266117 - protein, 9 aa, Homo Sapiens
ITEGVATAL

SEQ ID NO: 1266118 - protein, 9 aa, Homo Sapiens
HLRDVPDAI

SEQ ID NO: 1266119 - protein, 9 aa, Homo Sapiens
ARHLIHNYN

SEQ ID NO: 1266120 - protein, 9 aa, Homo Sapiens
NDAHVPIIH

SEQ ID NO: 1266121 - protein, 9 aa, Homo Sapiens
RFSYTSQHP

SEQ ID NO: 1266122 - protein, 9 aa, Homo Sapiens
KLSNCLAQI

SEQ ID NO: 1266123 - protein, 9 aa, Homo Sapiens
AVWTNERLK

SEQ ID NO: 1266124 - protein, 9 aa, Homo Sapiens
MNRLTDVLY

SEQ ID NO: 1266125 - protein, 9 aa, Homo Sapiens
ASAPAPISP

SEQ ID NO: 1266126 - protein, 9 aa, Homo Sapiens
KHPGTGKVE

SEQ ID NO: 1266127 - protein, 9 aa, Homo Sapiens
IIIVGPGYD

SEQ ID NO: 1266128 - protein, 9 aa, Homo Sapiens
NDFRSMEAI

SEQ ID NO: 1266129 - protein, 9 aa, Homo Sapiens
PCGGYLAPG

SEQ ID NO: 1266130 - protein, 9 aa, Homo Sapiens
ELLQSIKDH

SEQ ID NO: 1266131 - protein, 9 aa, Homo Sapiens
LHAEFLPCH

SEQ ID NO: 1266132 - protein, 9 aa, Homo Sapiens
QTMWWAFEN

SEQ ID NO: 1266133 - protein, 9 aa, Homo Sapiens
FECSSNCTT

SEQ ID NO: 1266134 - protein, 9 aa, Homo Sapiens
AYRCIYKPD

SEQ ID NO: 1266135 - protein, 9 aa, Homo Sapiens
LLPDVLLER

SEQ ID NO: 1266136 - protein, 9 aa, Homo Sapiens
GPGLPTGFD

SEQ ID NO: 1266137 - protein, 9 aa, Homo Sapiens
FRKITDPCL

SEQ ID NO: 1266138 - protein, 9 aa, Homo Sapiens
DCSIICVEY

SEQ ID NO: 1266139 - protein, 9 aa, Homo Sapiens
GSSGPGNVL

SEQ ID NO: 1266140 - protein, 9 aa, Homo Sapiens
SDWYTMLYK

SEQ ID NO: 1266141 - protein, 9 aa, Homo Sapiens
RYPRTTDGK

SEQ ID NO: 1266142 - protein, 9 aa, Homo Sapiens
TPSHLAVLQ

SEQ ID NO: 1266143 - protein, 9 aa, Homo Sapiens
GKQQYSKGG

SEQ ID NO: 1266144 - protein, 9 aa, Homo Sapiens
LGVPELRDS

SEQ ID NO: 1266145 - protein, 9 aa, Homo Sapiens
WRSIMIQKG

SEQ ID NO: 1266146 - protein, 9 aa, Homo Sapiens
FAGSIFIGR

SEQ ID NO: 1266147 - protein, 9 aa, Homo Sapiens
EIFDLPEEH

SEQ ID NO: 1266148 - protein, 9 aa, Homo Sapiens
RVRPPGCHV

SEQ ID NO: 1266149 - protein, 9 aa, Homo Sapiens
FIGLLSSVS

SEQ ID NO: 1266150 - protein, 9 aa, Homo Sapiens
NAREEQPTG

SEQ ID NO: 1266151 - protein, 9 aa, Homo Sapiens
VKMLKENTS

SEQ ID NO: 1266152 - protein, 9 aa, Homo Sapiens
GDVMIAITR

SEQ ID NO: 1266153 - protein, 9 aa, Homo Sapiens
IMSRMFADG

SEQ ID NO: 1266154 - protein, 9 aa, Homo Sapiens
KNSSRSYCI

SEQ ID NO: 1266155 - protein, 9 aa, Homo Sapiens
TIVMPLLTF

SEQ ID NO: 1266156 - protein, 9 aa, Homo Sapiens
TLTQDVQMF

SEQ ID NO: 1266157 - protein, 9 aa, Homo Sapiens
HKLGFTGST

SEQ ID NO: 1266158 - protein, 9 aa, Homo Sapiens
LAAKNINLW

SEQ ID NO: 1266159 - protein, 9 aa, Homo Sapiens
THRKVVILG

SEQ ID NO: 1266160 - protein, 9 aa, Homo Sapiens
VKQIISRAN

SEQ ID NO: 1266161 - protein, 9 aa, Homo Sapiens
LKENTSPSE

SEQ ID NO: 1266162 - protein, 9 aa, Homo Sapiens
KSARSSVPW

SEQ ID NO: 1266163 - protein, 9 aa, Homo Sapiens
MNNGFFLKV

SEQ ID NO: 1266164 - protein, 9 aa, Homo Sapiens
YDRREYSHF

SEQ ID NO: 1266165 - protein, 9 aa, Homo Sapiens
KAISFAGCF

SEQ ID NO: 1266166 - protein, 9 aa, Homo Sapiens
ADDRVHEQG

SEQ ID NO: 1266167 - protein, 9 aa, Homo Sapiens
GYNNDFRSM

SEQ ID NO: 1266168 - protein, 9 aa, Homo Sapiens
KNDVVKIPE

SEQ ID NO: 1266169 - protein, 9 aa, Homo Sapiens
LWFIGLSED

SEQ ID NO: 1266170 - protein, 9 aa, Homo Sapiens
TTEEQVSEP

SEQ ID NO: 1266171 - protein, 9 aa, Homo Sapiens
TYTGTHRHT

SEQ ID NO: 1266172 - protein, 9 aa, Homo Sapiens
PTCSKDLQM

SEQ ID NO: 1266173 - protein, 9 aa, Homo Sapiens
HAFSQRSNL

SEQ ID NO: 1266174 - protein, 9 aa, Homo Sapiens
SASYQEAKY

SEQ ID NO: 1266175 - protein, 9 aa, Homo Sapiens
VFGVRSSLA

SEQ ID NO: 1266176 - protein, 9 aa, Homo Sapiens
RMLEAVRHV

SEQ ID NO: 1266177 - protein, 9 aa, Homo Sapiens
FGVNGHVTC

SEQ ID NO: 1266178 - protein, 9 aa, Homo Sapiens
VCDVLKAVS

SEQ ID NO: 1266179 - protein, 9 aa, Homo Sapiens
LDVHKVLSA

SEQ ID NO: 1266180 - protein, 9 aa, Homo Sapiens
GNEANYLRV

SEQ ID NO: 1266181 - protein, 9 aa, Homo Sapiens
MEFCGEGSL

SEQ ID NO: 1266182 - protein, 9 aa, Homo Sapiens
RNIIGFVKL

SEQ ID NO: 1266183 - protein, 9 aa, Homo Sapiens
MTCPRCILT

SEQ ID NO: 1266184 - protein, 9 aa, Homo Sapiens
SQNDIPIPQ

SEQ ID NO: 1266185 - protein, 9 aa, Homo Sapiens
DLHWLYLSE

SEQ ID NO: 1266186 - protein, 9 aa, Homo Sapiens
IAIKRYFSI

SEQ ID NO: 1266187 - protein, 9 aa, Homo Sapiens
RLTDVLYMV

SEQ ID NO: 1266188 - protein, 9 aa, Homo Sapiens
AVLLQNWPS

SEQ ID NO: 1266189 - protein, 9 aa, Homo Sapiens
ECGKAFSAK

SEQ ID NO: 1266190 - protein, 9 aa, Homo Sapiens
GDQRRPPVS

SEQ ID NO: 1266191 - protein, 9 aa, Homo Sapiens
EDLETLMLF

SEQ ID NO: 1266192 - protein, 9 aa, Homo Sapiens
HGSSFGNQY

SEQ ID NO: 1266193 - protein, 9 aa, Homo Sapiens
FPGERLMGY

SEQ ID NO: 1266194 - protein, 9 aa, Homo Sapiens
VSIDSKPSA

SEQ ID NO: 1266195 - protein, 9 aa, Homo Sapiens
QARLSHLHG

SEQ ID NO: 1266196 - protein, 9 aa, Homo Sapiens
PITSLHDAH

SEQ ID NO: 1266197 - protein, 9 aa, Homo Sapiens
HRLLAEEEQ

SEQ ID NO: 1266198 - protein, 9 aa, Homo Sapiens
KPTVIEVEL

SEQ ID NO: 1266199 - protein, 9 aa, Homo Sapiens
DLRMAREKG

SEQ ID NO: 1266200 - protein, 9 aa, Homo Sapiens
GNRCPGRYM

SEQ ID NO: 1266201 - protein, 9 aa, Homo Sapiens
ALSEAMGFF

SEQ ID NO: 1266202 - protein, 9 aa, Homo Sapiens
LDSAQKNIY

SEQ ID NO: 1266203 - protein, 9 aa, Homo Sapiens
RANPSNFLL

SEQ ID NO: 1266204 - protein, 9 aa, Homo Sapiens
HSDGDSIKK

SEQ ID NO: 1266205 - protein, 9 aa, Homo Sapiens
LGKADLEVQ

SEQ ID NO: 1266206 - protein, 9 aa, Homo Sapiens
LMVQAAEPP

SEQ ID NO: 1266207 - protein, 9 aa, Homo Sapiens
IFAPLQSIQ

SEQ ID NO: 1266208 - protein, 9 aa, Homo Sapiens
SSHWRKALR

SEQ ID NO: 1266209 - protein, 9 aa, Homo Sapiens
YKRIGVSAW

SEQ ID NO: 1266210 - protein, 9 aa, Homo Sapiens
GTAIAKCLG

SEQ ID NO: 1266211 - protein, 9 aa, Homo Sapiens
RKEWESQCK

SEQ ID NO: 1266212 - protein, 9 aa, Homo Sapiens
NVPLRVKIP

SEQ ID NO: 1266213 - protein, 9 aa, Homo Sapiens
YMWSFCFSP

SEQ ID NO: 1266214 - protein, 9 aa, Homo Sapiens
GEQPLSVMV

SEQ ID NO: 1266215 - protein, 9 aa, Homo Sapiens
VTSLDAELQ

SEQ ID NO: 1266216 - protein, 9 aa, Homo Sapiens
PAASLMATA

SEQ ID NO: 1266217 - protein, 9 aa, Homo Sapiens
NSCAHTVYT

SEQ ID NO: 1266218 - protein, 9 aa, Homo Sapiens
LLKSCGKHV

SEQ ID NO: 1266219 - protein, 9 aa, Homo Sapiens
VGAVSAQAE

SEQ ID NO: 1266220 - protein, 9 aa, Homo Sapiens
SSMSVTSLD

SEQ ID NO: 1266221 - protein, 9 aa, Homo Sapiens
HVRHYRPIY

SEQ ID NO: 1266222 - protein, 9 aa, Homo Sapiens
GYLVIKVVA

SEQ ID NO: 1266223 - protein, 9 aa, Homo Sapiens
SCGCSKGGC

SEQ ID NO: 1266224 - protein, 9 aa, Homo Sapiens
GTLTQDVQM

SEQ ID NO: 1266225 - protein, 9 aa, Homo Sapiens
RCCLPTLVS

SEQ ID NO: 1266226 - protein, 9 aa, Homo Sapiens
RREVPMCTD

SEQ ID NO: 1266227 - protein, 9 aa, Homo Sapiens
EHWNSQKQM

SEQ ID NO: 1266228 - protein, 9 aa, Homo Sapiens
LPWDVGYTG

SEQ ID NO: 1266229 - protein, 9 aa, Homo Sapiens
SSYCHLQKY

SEQ ID NO: 1266230 - protein, 9 aa, Homo Sapiens
RQELKYKQR

SEQ ID NO: 1266231 - protein, 9 aa, Homo Sapiens
QLDWDVTTV

SEQ ID NO: 1266232 - protein, 9 aa, Homo Sapiens
DMGAMGDVV

SEQ ID NO: 1266233 - protein, 9 aa, Homo Sapiens
PQAIQAAQG

SEQ ID NO: 1266234 - protein, 9 aa, Homo Sapiens
KYPVYHNQY

SEQ ID NO: 1266235 - protein, 9 aa, Homo Sapiens
IVRVLKLWQ

SEQ ID NO: 1266236 - protein, 9 aa, Homo Sapiens
EEEEEVAVA

SEQ ID NO: 1266237 - protein, 9 aa, Homo Sapiens
VLKTCPLSW

SEQ ID NO: 1266238 - protein, 9 aa, Homo Sapiens
IQAAQGLLA

SEQ ID NO: 1266239 - protein, 9 aa, Homo Sapiens
RVNAEFVLL

SEQ ID NO: 1266240 - protein, 9 aa, Homo Sapiens
YTTKSPQER

SEQ ID NO: 1266241 - protein, 9 aa, Homo Sapiens
FAMRNVCPP

SEQ ID NO: 1266242 - protein, 9 aa, Homo Sapiens
ALDPFRVNA

SEQ ID NO: 1266243 - protein, 9 aa, Homo Sapiens
SSHPANPTC

SEQ ID NO: 1266244 - protein, 9 aa, Homo Sapiens
GKYPVYHNQ

SEQ ID NO: 1266245 - protein, 9 aa, Homo Sapiens
QMFLPQSSH

SEQ ID NO: 1266246 - protein, 9 aa, Homo Sapiens
LHEQKMKET

SEQ ID NO: 1266247 - protein, 9 aa, Homo Sapiens
MKETNHLAA

SEQ ID NO: 1266248 - protein, 9 aa, Homo Sapiens
SLGFILYTL

SEQ ID NO: 1266249 - protein, 9 aa, Homo Sapiens
KETNHLAAI

SEQ ID NO: 1266250 - protein, 9 aa, Homo Sapiens
WDVGYTGTA

SEQ ID NO: 1266251 - protein, 9 aa, Homo Sapiens
NAFVAVFTV

SEQ ID NO: 1266252 - protein, 9 aa, Homo Sapiens
RNVCPPRGF

SEQ ID NO: 1266253 - protein, 9 aa, Homo Sapiens
EVPMCTDPE

SEQ ID NO: 1266254 - protein, 9 aa, Homo Sapiens
SRREVPMCT

SEQ ID NO: 1266255 - protein, 9 aa, Homo Sapiens
SPILSFQYL

SEQ ID NO: 1266256 - protein, 9 aa, Homo Sapiens
FLVFLCRVV

SEQ ID NO: 1266257 - protein, 9 aa, Homo Sapiens
AELLEEHWN

SEQ ID NO: 1266258 - protein, 9 aa, Homo Sapiens
PRYVTRYKA

SEQ ID NO: 1266259 - protein, 9 aa, Homo Sapiens
FLSPSRNDE

SEQ ID NO: 1266260 - protein, 9 aa, Homo Sapiens
VPTPQAIQA

SEQ ID NO: 1266261 - protein, 9 aa, Homo Sapiens
MLPAFLCEV

SEQ ID NO: 1266262 - protein, 9 aa, Homo Sapiens
VYTTKSPQE

SEQ ID NO: 1266263 - protein, 9 aa, Homo Sapiens
HTHQHMHQH

SEQ ID NO: 1266264 - protein, 9 aa, Homo Sapiens
YPVYHNQYS

SEQ ID NO: 1266265 - protein, 9 aa, Homo Sapiens
QAIQAAQGL

SEQ ID NO: 1266266 - protein, 9 aa, Homo Sapiens
ERQELKYKQ

SEQ ID NO: 1266267 - protein, 9 aa, Homo Sapiens
NDEIEYDVP

SEQ ID NO: 1266268 - protein, 9 aa, Homo Sapiens
RYKAVTQLE

SEQ ID NO: 1266269 - protein, 9 aa, Homo Sapiens
SLAMLPAFL

SEQ ID NO: 1266270 - protein, 9 aa, Homo Sapiens
MRNVCPPRG

SEQ ID NO: 1266271 - protein, 9 aa, Homo Sapiens
YKAVTQLEW

SEQ ID NO: 1266272 - protein, 9 aa, Homo Sapiens
GMNSVAVAK

SEQ ID NO: 1266273 - protein, 9 aa, Homo Sapiens
DGLKLNAFV

SEQ ID NO: 1266274 - protein, 9 aa, Homo Sapiens
YLIGMNSVA

SEQ ID NO: 1266275 - protein, 9 aa, Homo Sapiens
CPPRGFPPY

SEQ ID NO: 1266276 - protein, 9 aa, Homo Sapiens
YCHLQKYLI

SEQ ID NO: 1266277 - protein, 9 aa, Homo Sapiens
KLWQKNGVF

SEQ ID NO: 1266278 - protein, 9 aa, Homo Sapiens
TLFLSPSRN

SEQ ID NO: 1266279 - protein, 9 aa, Homo Sapiens
EQKMKETNH

SEQ ID NO: 1266280 - protein, 9 aa, Homo Sapiens
QYLQANFIE

SEQ ID NO: 1266281 - protein, 9 aa, Homo Sapiens
LSFQYLQAN

SEQ ID NO: 1266282 - protein, 9 aa, Homo Sapiens
SRNDEIEYD

SEQ ID NO: 1266283 - protein, 9 aa, Homo Sapiens
PQSSHPANP

SEQ ID NO: 1266284 - protein, 9 aa, Homo Sapiens
LRQRGMEIF

SEQ ID NO: 1266285 - protein, 9 aa, Homo Sapiens
ELLEEHWNS

SEQ ID NO: 1266286 - protein, 9 aa, Homo Sapiens
VDIWSLGFI

SEQ ID NO: 1266287 - protein, 9 aa, Homo Sapiens
KSKIVRVLK

SEQ ID NO: 1266288 - protein, 9 aa, Homo Sapiens
HMHQHTFTP

SEQ ID NO: 1266289 - protein, 9 aa, Homo Sapiens
PYSVLKTCP

SEQ ID NO: 1266290 - protein, 9 aa, Homo Sapiens
PQERAILGL

SEQ ID NO: 1266291 - protein, 9 aa, Homo Sapiens
LFLSPSRND

SEQ ID NO: 1266292 - protein, 9 aa, Homo Sapiens
RGDSSYCHL

SEQ ID NO: 1266293 - protein, 9 aa, Homo Sapiens
SYRGDSSYC

SEQ ID NO: 1266294 - protein, 9 aa, Homo Sapiens
AAEEEEEVA

SEQ ID NO: 1266295 - protein, 9 aa, Homo Sapiens
HEQKMKETN

SEQ ID NO: 1266296 - protein, 9 aa, Homo Sapiens
NQTYAISSS

SEQ ID NO: 1266297 - protein, 9 aa, Homo Sapiens
KYLIGMNSV

SEQ ID NO: 1266298 - protein, 9 aa, Homo Sapiens
HNWLSTISP

SEQ ID NO: 1266299 - protein, 9 aa, Homo Sapiens
FLCRVVSSK

SEQ ID NO: 1266300 - protein, 9 aa, Homo Sapiens
LQANPLDMG

SEQ ID NO: 1266301 - protein, 9 aa, Homo Sapiens
QKMKETNHL

SEQ ID NO: 1266302 - protein, 9 aa, Homo Sapiens
RQRGMEIFE

SEQ ID NO: 1266303 - protein, 9 aa, Homo Sapiens
LCRVVSSKA

SEQ ID NO: 1266304 - protein, 9 aa, Homo Sapiens
LGFILYTLV

SEQ ID NO: 1266305 - protein, 9 aa, Homo Sapiens
QSSHPANPT

SEQ ID NO: 1266306 - protein, 9 aa, Homo Sapiens
NGYFSPNFK

SEQ ID NO: 1266307 - protein, 9 aa, Homo Sapiens
VPYSVLKTC

SEQ ID NO: 1266308 - protein, 9 aa, Homo Sapiens
LKTCPLSWV

SEQ ID NO: 1266309 - protein, 9 aa, Homo Sapiens
NAEFVLLTV

SEQ ID NO: 1266310 - protein, 9 aa, Homo Sapiens
LPQSSHPAN

SEQ ID NO: 1266311 - protein, 9 aa, Homo Sapiens
QHTHQHMHQ

SEQ ID NO: 1266312 - protein, 9 aa, Homo Sapiens
PWDVGYTGT

SEQ ID NO: 1266313 - protein, 9 aa, Homo Sapiens
YGSYRGDSS

SEQ ID NO: 1266314 - protein, 9 aa, Homo Sapiens
GAAEEEEEV

SEQ ID NO: 1266315 - protein, 9 aa, Homo Sapiens
FQYLQANFI

SEQ ID NO: 1266316 - protein, 9 aa, Homo Sapiens
LLEEHWNSQ

SEQ ID NO: 1266317 - protein, 9 aa, Homo Sapiens
FILYTLVSG

SEQ ID NO: 1266318 - protein, 9 aa, Homo Sapiens
SSPILSFQY

SEQ ID NO: 1266319 - protein, 9 aa, Homo Sapiens
PFRVNAEFV

SEQ ID NO: 1266320 - protein, 9 aa, Homo Sapiens
KANGYFSPN

SEQ ID NO: 1266321 - protein, 9 aa, Homo Sapiens
NKDKANGYF

SEQ ID NO: 1266322 - protein, 9 aa, Homo Sapiens
QKYLIGMNS

SEQ ID NO: 1266323 - protein, 9 aa, Homo Sapiens
EEHWNSQKQ

SEQ ID NO: 1266324 - protein, 9 aa, Homo Sapiens
WDVTTVHQL

SEQ ID NO: 1266325 - protein, 9 aa, Homo Sapiens
KAVTQLEWR

SEQ ID NO: 1266326 - protein, 9 aa, Homo Sapiens
EEEEVAVAA

SEQ ID NO: 1266327 - protein, 9 aa, Homo Sapiens
LKLWQKNGV

SEQ ID NO: 1266328 - protein, 9 aa, Homo Sapiens
YAELLEEHW

SEQ ID NO: 1266329 - protein, 9 aa, Homo Sapiens
INHNWLSTI

SEQ ID NO: 1266330 - protein, 9 aa, Homo Sapiens
ASLAMLPAF

SEQ ID NO: 1266331 - protein, 9 aa, Homo Sapiens
LKLNAFVAV

SEQ ID NO: 1266332 - protein, 9 aa, Homo Sapiens
YSVLKTCPL

SEQ ID NO: 1266333 - protein, 9 aa, Homo Sapiens
TTVHQLSAF

SEQ ID NO: 1266334 - protein, 9 aa, Homo Sapiens
EVAVAAAGA

SEQ ID NO: 1266335 - protein, 9 aa, Homo Sapiens
ILSFQYLQA

SEQ ID NO: 1266336 - protein, 9 aa, Homo Sapiens
GSYRGDSSY

SEQ ID NO: 1266337 - protein, 9 aa, Homo Sapiens
SYCHLQKYL

SEQ ID NO: 1266338 - protein, 9 aa, Homo Sapiens
LVFLCRVVS

SEQ ID NO: 1266339 - protein, 9 aa, Homo Sapiens
CDSSLNQTY

SEQ ID NO: 1266340 - protein, 9 aa, Homo Sapiens
LDPFRVNAE

SEQ ID NO: 1266341 - protein, 9 aa, Homo Sapiens
AEEEEEVAV

SEQ ID NO: 1266342 - protein, 9 aa, Homo Sapiens
LNAFVAVFT

SEQ ID NO: 1266343 - protein, 9 aa, Homo Sapiens
KDKANGYFS

SEQ ID NO: 1266344 - protein, 9 aa, Homo Sapiens
RAVTITDLQ

SEQ ID NO: 1266345 - protein, 9 aa, Homo Sapiens
KLCPYTHGN

SEQ ID NO: 1266346 - protein, 9 aa, Homo Sapiens
AFVAVFTVL

SEQ ID NO: 1266347 - protein, 9 aa, Homo Sapiens
TNHLAAIEI

SEQ ID NO: 1266348 - protein, 9 aa, Homo Sapiens
DVGYTGTAP

SEQ ID NO: 1266349 - protein, 9 aa, Homo Sapiens
YVTRYKAVT

SEQ ID NO: 1266350 - protein, 9 aa, Homo Sapiens
DKANGYFSP

SEQ ID NO: 1266351 - protein, 9 aa, Homo Sapiens
VTRYKAVTQ

SEQ ID NO: 1266352 - protein, 9 aa, Homo Sapiens
LSSPILSFQ

SEQ ID NO: 1266353 - protein, 9 aa, Homo Sapiens
SPQERAILG

SEQ ID NO: 1266354 - protein, 9 aa, Homo Sapiens
LEEHWNSQK

SEQ ID NO: 1266355 - protein, 9 aa, Homo Sapiens
VRVLKLWQK

SEQ ID NO: 1266356 - protein, 9 aa, Homo Sapiens
QRGMEIFEY

SEQ ID NO: 1266357 - protein, 9 aa, Homo Sapiens
QHMHQHTFT

SEQ ID NO: 1266358 - protein, 9 aa, Homo Sapiens
PTPQAIQAA

SEQ ID NO: 1266359 - protein, 9 aa, Homo Sapiens
TDPEPRQEV

SEQ ID NO: 1266360 - protein, 9 aa, Homo Sapiens
QAAQGLLAC

SEQ ID NO: 1266361 - protein, 9 aa, Homo Sapiens
GFLRQRGME

SEQ ID NO: 1266362 - protein, 9 aa, Homo Sapiens
PMCTDPEPR

SEQ ID NO: 1266363 - protein, 9 aa, Homo Sapiens
KYKQRVRDL

SEQ ID NO: 1266364 - protein, 9 aa, Homo Sapiens
EEEVAVAAA

SEQ ID NO: 1266365 - protein, 9 aa, Homo Sapiens
SLNQTYAIS

SEQ ID NO: 1266366 - protein, 9 aa, Homo Sapiens
LIGMNSVAV

SEQ ID NO: 1266367 - protein, 9 aa, Homo Sapiens
CRVVSSKAI

SEQ ID NO: 1266368 - protein, 9 aa, Homo Sapiens
CCLPTLVSL

SEQ ID NO: 1266369 - protein, 9 aa, Homo Sapiens
FVAVFTVLS

SEQ ID NO: 1266370 - protein, 9 aa, Homo Sapiens
DIWSLGFIL

SEQ ID NO: 1266371 - protein, 9 aa, Homo Sapiens
LQMFLPQSS

SEQ ID NO: 1266372 - protein, 9 aa, Homo Sapiens
QHQHTHQHM

SEQ ID NO: 1266373 - protein, 9 aa, Homo Sapiens
RVPTPQAIQ

SEQ ID NO: 1266374 - protein, 9 aa, Homo Sapiens
VNAEFVLLT

SEQ ID NO: 1266375 - protein, 9 aa, Homo Sapiens
GYFSPNFKV

SEQ ID NO: 1266376 - protein, 9 aa, Homo Sapiens
AMRNVCPPR

SEQ ID NO: 1266377 - protein, 9 aa, Homo Sapiens
AVTQLEWRC

SEQ ID NO: 1266378 - protein, 9 aa, Homo Sapiens
KANKDKANG

SEQ ID NO: 1266379 - protein, 9 aa, Homo Sapiens
LDMGAMGDV

SEQ ID NO: 1266380 - protein, 9 aa, Homo Sapiens
LDWDVTTVH

SEQ ID NO: 1266381 - protein, 9 aa, Homo Sapiens
NVCPPRGFP

SEQ ID NO: 1266382 - protein, 9 aa, Homo Sapiens
AQLDWDVTT

SEQ ID NO: 1266383 - protein, 9 aa, Homo Sapiens
IWSLGFILY

SEQ ID NO: 1266384 - protein, 9 aa, Homo Sapiens
CSLPWDVGY

SEQ ID NO: 1266385 - protein, 9 aa, Homo Sapiens
YKQRVRDLA

SEQ ID NO: 1266386 - protein, 9 aa, Homo Sapiens
GDSSYCHLQ

SEQ ID NO: 1266387 - protein, 9 aa, Homo Sapiens
HQHTHQHMH

SEQ ID NO: 1266388 - protein, 9 aa, Homo Sapiens
QELKYKQRV

SEQ ID NO: 1266389 - protein, 9 aa, Homo Sapiens
QTYAISSSL

SEQ ID NO: 1266390 - protein, 9 aa, Homo Sapiens
MFLPQSSHP

SEQ ID NO: 1266391 - protein, 9 aa, Homo Sapiens
SVPYSVLKT

SEQ ID NO: 1266392 - protein, 9 aa, Homo Sapiens
FLFLRCCLP

SEQ ID NO: 1266393 - protein, 9 aa, Homo Sapiens
VLQMFLPQS

SEQ ID NO: 1266394 - protein, 9 aa, Homo Sapiens
AEFVLLTVK

SEQ ID NO: 1266395 - protein, 9 aa, Homo Sapiens
HWNSQKQMK

SEQ ID NO: 1266396 - protein, 9 aa, Homo Sapiens
IGMNSVAVA

SEQ ID NO: 1266397 - protein, 9 aa, Homo Sapiens
LRCCLPTLV

SEQ ID NO: 1266398 - protein, 9 aa, Homo Sapiens
QRVRDLARE

SEQ ID NO: 1266399 - protein, 9 aa, Homo Sapiens
DWDVTTVHQ

SEQ ID NO: 1266400 - protein, 9 aa, Homo Sapiens
TPQAIQAAQ

SEQ ID NO: 1266401 - protein, 9 aa, Homo Sapiens
GYTGTAPPG

SEQ ID NO: 1266402 - protein, 9 aa, Homo Sapiens
KASLAMLPA

SEQ ID NO: 1266403 - protein, 9 aa, Homo Sapiens
LYINHNWLS

SEQ ID NO: 1266404 - protein, 9 aa, Homo Sapiens
VPMCTDPEP

SEQ ID NO: 1266405 - protein, 9 aa, Homo Sapiens
ANKDKANGY

SEQ ID NO: 1266406 - protein, 9 aa, Homo Sapiens
WSLGFILYT

SEQ ID NO: 1266407 - protein, 9 aa, Homo Sapiens
NPLDMGAMG

SEQ ID NO: 1266408 - protein, 9 aa, Homo Sapiens
DSSYCHLQK

SEQ ID NO: 1266409 - protein, 9 aa, Homo Sapiens
AIQAAQGLL

SEQ ID NO: 1266410 - protein, 9 aa, Homo Sapiens
RYVTRYKAV

SEQ ID NO: 1266411 - protein, 9 aa, Homo Sapiens
LPAFLCEVQ

SEQ ID NO: 1266412 - protein, 9 aa, Homo Sapiens
LSPSRNDEI

SEQ ID NO: 1266413 - protein, 9 aa, Homo Sapiens
AFLFLRCCL

SEQ ID NO: 1266414 - protein, 9 aa, Homo Sapiens
DGFLRQRGM

SEQ ID NO: 1266415 - protein, 9 aa, Homo Sapiens
QANPLDMGA

SEQ ID NO: 1266416 - protein, 9 aa, Homo Sapiens
GFILYTLVS

SEQ ID NO: 1266417 - protein, 9 aa, Homo Sapiens
KMKETNHLA

SEQ ID NO: 1266418 - protein, 9 aa, Homo Sapiens
PVYHNQYST

SEQ ID NO: 1266419 - protein, 9 aa, Homo Sapiens
THQHMHQHT

SEQ ID NO: 1266420 - protein, 9 aa, Homo Sapiens
DVTTVHQLS

SEQ ID NO: 1266421 - protein, 9 aa, Homo Sapiens
SFQYLQANF

SEQ ID NO: 1266422 - protein, 9 aa, Homo Sapiens
FLRQRGMEI

SEQ ID NO: 1266423 - protein, 9 aa, Homo Sapiens
SSLNQTYAI

SEQ ID NO: 1266424 - protein, 9 aa, Homo Sapiens
GMEIFEYSS

SEQ ID NO: 1266425 - protein, 9 aa, Homo Sapiens
LQKYLIGMN

SEQ ID NO: 1266426 - protein, 9 aa, Homo Sapiens
MCTDPEPRQ

SEQ ID NO: 1266427 - protein, 9 aa, Homo Sapiens
ISVPYSVLK

SEQ ID NO: 1266428 - protein, 9 aa, Homo Sapiens
LFLRCCLPT

SEQ ID NO: 1266429 - protein, 9 aa, Homo Sapiens
PSRNDEIEY

SEQ ID NO: 1266430 - protein, 9 aa, Homo Sapiens
CHLQKYLIG

SEQ ID NO: 1266431 - protein, 9 aa, Homo Sapiens
LGQEGKYPV

SEQ ID NO: 1266432 - protein, 9 aa, Homo Sapiens
VGYTGTAPP

SEQ ID NO: 1266433 - protein, 9 aa, Homo Sapiens
EGKYPVYHN

SEQ ID NO: 1266434 - protein, 9 aa, Homo Sapiens
GLKLNAFVA

SEQ ID NO: 1266435 - protein, 9 aa, Homo Sapiens
FRVNAEFVL

SEQ ID NO: 1266436 - protein, 9 aa, Homo Sapiens
WLSTISPGA

SEQ ID NO: 1266437 - protein, 9 aa, Homo Sapiens
SVLKTCPLS

SEQ ID NO: 1266438 - protein, 9 aa, Homo Sapiens
RVLKLWQKN

SEQ ID NO: 1266439 - protein, 9 aa, Homo Sapiens
KLGQEGKYP

SEQ ID NO: 1266440 - protein, 9 aa, Homo Sapiens
LLQANPLDM

SEQ ID NO: 1266441 - protein, 9 aa, Homo Sapiens
KLNAFVAVF

SEQ ID NO: 1266442 - protein, 9 aa, Homo Sapiens
VCPPRGFPP

SEQ ID NO: 1266443 - protein, 9 aa, Homo Sapiens
FLRCCLPTL

SEQ ID NO: 1266444 - protein, 9 aa, Homo Sapiens
ANGYFSPNF

SEQ ID NO: 1266445 - protein, 9 aa, Homo Sapiens
YRGDSSYCH

SEQ ID NO: 1266446 - protein, 9 aa, Homo Sapiens
VFLCRVVSS

SEQ ID NO: 1266447 - protein, 9 aa, Homo Sapiens
EEVAVAAAG

SEQ ID NO: 1266448 - protein, 9 aa, Homo Sapiens
GDFLVFLCR

SEQ ID NO: 1266449 - protein, 9 aa, Homo Sapiens
VAQLDWDVT

SEQ ID NO: 1266450 - protein, 9 aa, Homo Sapiens
ELKYKQRVR

SEQ ID NO: 1266451 - protein, 9 aa, Homo Sapiens
TISVPYSVL

SEQ ID NO: 1266452 - protein, 9 aa, Homo Sapiens
NWLSTISPG

SEQ ID NO: 1266453 - protein, 9 aa, Homo Sapiens
TTKSPQERA

SEQ ID NO: 1266454 - protein, 9 aa, Homo Sapiens
EVDIWSLGF

SEQ ID NO: 1266455 - protein, 9 aa, Homo Sapiens
KSPQERAIL

SEQ ID NO: 1266456 - protein, 9 aa, Homo Sapiens
KQRVRDLAR

SEQ ID NO: 1266457 - protein, 9 aa, Homo Sapiens
TKSPQERAI

SEQ ID NO: 1266458 - protein, 9 aa, Homo Sapiens
VAVAAAGAA

SEQ ID NO: 1266459 - protein, 9 aa, Homo Sapiens
TRYKAVTQL

SEQ ID NO: 1266460 - protein, 9 aa, Homo Sapiens
ENCDSSLNQ

SEQ ID NO: 1266461 - protein, 9 aa, Homo Sapiens
DSSLNQTYA

SEQ ID NO: 1266462 - protein, 9 aa, Homo Sapiens
LGDFLVFLC

SEQ ID NO: 1266463 - protein, 9 aa, Homo Sapiens
CTDPEPRQE

SEQ ID NO: 1266464 - protein, 9 aa, Homo Sapiens
NHNWLSTIS

SEQ ID NO: 1266465 - protein, 9 aa, Homo Sapiens
QELYINHNW

SEQ ID NO: 1266466 - protein, 9 aa, Homo Sapiens
MHQHTFTPF

SEQ ID NO: 1266467 - protein, 9 aa, Homo Sapiens
AMLPAFLCE

SEQ ID NO: 1266468 - protein, 9 aa, Homo Sapiens
DFLVFLCRV

SEQ ID NO: 1266469 - protein, 9 aa, Homo Sapiens
LNQTYAISS

SEQ ID NO: 1266470 - protein, 9 aa, Homo Sapiens
CLPTLVSLR

SEQ ID NO: 1266471 - protein, 9 aa, Homo Sapiens
SKIVRVLKL

SEQ ID NO: 1266472 - protein, 9 aa, Homo Sapiens
VTTVHQLSA

SEQ ID NO: 1266473 - protein, 9 aa, Homo Sapiens
LKYKQRVRD

SEQ ID NO: 1266474 - protein, 9 aa, Homo Sapiens
YINHNWLST

SEQ ID NO: 1266475 - protein, 9 aa, Homo Sapiens
SAFLFLRCC

SEQ ID NO: 1266476 - protein, 9 aa, Homo Sapiens
ANPLDMGAM

SEQ ID NO: 1266477 - protein, 9 aa, Homo Sapiens
HLQKYLIGM

SEQ ID NO: 1266478 - protein, 9 aa, Homo Sapiens
RNDEIEYDV

SEQ ID NO: 1266479 - protein, 9 aa, Homo Sapiens
RKASLAMLP

SEQ ID NO: 1266480 - protein, 9 aa, Homo Sapiens
PAFLCEVQD

SEQ ID NO: 1266481 - protein, 9 aa, Homo Sapiens
RGMEIFEYS

SEQ ID NO: 1266482 - protein, 9 aa, Homo Sapiens
FLPQSSHPA

SEQ ID NO: 1266483 - protein, 9 aa, Homo Sapiens
GQEGKYPVY

SEQ ID NO: 1266484 - protein, 9 aa, Homo Sapiens
QEGKYPVYH

SEQ ID NO: 1266485 - protein, 9 aa, Homo Sapiens
HQHMHQHTF

SEQ ID NO: 1266486 - protein, 9 aa, Homo Sapiens
PLDMGAMGD

SEQ ID NO: 1266487 - protein, 9 aa, Homo Sapiens
KIVRVLKLW

SEQ ID NO: 1266488 - protein, 9 aa, Homo Sapiens
VAVFTVLSG

SEQ ID NO: 1266489 - protein, 9 aa, Homo Sapiens
NCDSSLNQT

SEQ ID NO: 1266490 - protein, 9 aa, Homo Sapiens
SPSRNDEIE

SEQ ID NO: 1266491 - protein, 9 aa, Homo Sapiens
LAMLPAFLC

SEQ ID NO: 1266492 - protein, 9 aa, Homo Sapiens
ETNHLAAIE

SEQ ID NO: 1266493 - protein, 9 aa, Homo Sapiens
MGAMGDVVI

SEQ ID NO: 1266494 - protein, 9 aa, Homo Sapiens
SVYTTKSPQ

SEQ ID NO: 1266495 - protein, 9 aa, Homo Sapiens
VLKLWQKNG

SEQ ID NO: 1266496 - protein, 9 aa, Homo Sapiens
MEIFEYSSK

SEQ ID NO: 1266497 - protein, 9 aa, Homo Sapiens
REVPMCTDP

SEQ ID NO: 1266498 - protein, 9 aa, Homo Sapiens
DPFRVNAEF

SEQ ID NO: 1266499 - protein, 9 aa, Homo Sapiens
WNSQKQMKL

SEQ ID NO: 1266500 - protein, 9 aa, Homo Sapiens
EYGSYRGDS

SEQ ID NO: 1266501 - protein, 9 aa, Homo Sapiens
PILSFQYLQ

SEQ ID NO: 1266502 - protein, 9 aa, Homo Sapiens
QERAILGLP

SEQ ID NO: 1266503 - protein, 9 aa, Homo Sapiens
YTGTAPPGD

SEQ ID NO: 1266504 - protein, 9 aa, Homo Sapiens
YEYGSYRGD

SEQ ID NO: 1266505 - protein, 9 aa, Homo Sapiens
SLPWDVGYT

SEQ ID NO: 1266506 - protein, 9 aa, Homo Sapiens
ELYINHNWL

SEQ ID NO: 1266507 - protein, 9 aa, Homo Sapiens
NVGRKISQQ

SEQ ID NO: 1266508 - protein, 9 aa, Homo Sapiens
QKNNGESWK

SEQ ID NO: 1266509 - protein, 9 aa, Homo Sapiens
AGDASDQWT

SEQ ID NO: 1266510 - protein, 9 aa, Homo Sapiens
GRKISQQVI

SEQ ID NO: 1266511 - protein, 9 aa, Homo Sapiens
LLQFLLFLS

SEQ ID NO: 1266512 - protein, 9 aa, Homo Sapiens
KENTVMVAS

SEQ ID NO: 1266513 - protein, 9 aa, Homo Sapiens
LILFLGASI

SEQ ID NO: 1266514 - protein, 9 aa, Homo Sapiens
VWFDDQTVH

SEQ ID NO: 1266515 - protein, 9 aa, Homo Sapiens
PQDVLDAHL

SEQ ID NO: 1266516 - protein, 9 aa, Homo Sapiens
DIIKSEILD

SEQ ID NO: 1266517 - protein, 9 aa, Homo Sapiens
CGAINMGDA

SEQ ID NO: 1266518 - protein, 9 aa, Homo Sapiens
NGNRWKEIR

SEQ ID NO: 1266519 - protein, 9 aa, Homo Sapiens
VGNLMNQEY

SEQ ID NO: 1266520 - protein, 9 aa, Homo Sapiens
PGSGPSFSA

SEQ ID NO: 1266521 - protein, 9 aa, Homo Sapiens
EASKVAKQV

SEQ ID NO: 1266522 - protein, 9 aa, Homo Sapiens
KTITAKSHR

SEQ ID NO: 1266523 - protein, 9 aa, Homo Sapiens
NAGVTQRAS

SEQ ID NO: 1266524 - protein, 9 aa, Homo Sapiens
TQRASDPAQ

SEQ ID NO: 1266525 - protein, 9 aa, Homo Sapiens
PTRPQDVLD

SEQ ID NO: 1266526 - protein, 9 aa, Homo Sapiens
NHEEKILNR

SEQ ID NO: 1266527 - protein, 9 aa, Homo Sapiens
NNGESWKLM

SEQ ID NO: 1266528 - protein, 9 aa, Homo Sapiens
KESQLLSGI

SEQ ID NO: 1266529 - protein, 9 aa, Homo Sapiens
PDSGLRLLL

SEQ ID NO: 1266530 - protein, 9 aa, Homo Sapiens
SGHVLHRLF

SEQ ID NO: 1266531 - protein, 9 aa, Homo Sapiens
SKVAKQVES

SEQ ID NO: 1266532 - protein, 9 aa, Homo Sapiens
ARLPTRPQD

SEQ ID NO: 1266533 - protein, 9 aa, Homo Sapiens
RPLEVSITK

SEQ ID NO: 1266534 - protein, 9 aa, Homo Sapiens
EKKRNKAEK

SEQ ID NO: 1266535 - protein, 9 aa, Homo Sapiens
VTQRASDPA

SEQ ID NO: 1266536 - protein, 9 aa, Homo Sapiens
IIEDIIKSE

SEQ ID NO: 1266537 - protein, 9 aa, Homo Sapiens
GVTQRASDP

SEQ ID NO: 1266538 - protein, 9 aa, Homo Sapiens
AGVGKSALT

SEQ ID NO: 1266539 - protein, 9 aa, Homo Sapiens
YHDILEPQR

SEQ ID NO: 1266540 - protein, 9 aa, Homo Sapiens
LRGQPQSSQ

SEQ ID NO: 1266541 - protein, 9 aa, Homo Sapiens
ISVNTVDKE

SEQ ID NO: 1266542 - protein, 9 aa, Homo Sapiens
DFVTPDKFD

SEQ ID NO: 1266543 - protein, 9 aa, Homo Sapiens
ASTTKEGEL

SEQ ID NO: 1266544 - protein, 9 aa, Homo Sapiens
FCQMAAASS

SEQ ID NO: 1266545 - protein, 9 aa, Homo Sapiens
SFPGSGPSF

SEQ ID NO: 1266546 - protein, 9 aa, Homo Sapiens
LNIVHQDLK

SEQ ID NO: 1266547 - protein, 9 aa, Homo Sapiens
GGGAFPLLL

SEQ ID NO: 1266548 - protein, 9 aa, Homo Sapiens
RGQPQSSQK

SEQ ID NO: 1266549 - protein, 9 aa, Homo Sapiens
YGEVNHNQK

SEQ ID NO: 1266550 - protein, 9 aa, Homo Sapiens
VFPVEQQRI

SEQ ID NO: 1266551 - protein, 9 aa, Homo Sapiens
CDVGNLMNQ

SEQ ID NO: 1266552 - protein, 9 aa, Homo Sapiens
EVSITKAEV

SEQ ID NO: 1266553 - protein, 9 aa, Homo Sapiens
AARLPTRPQ

SEQ ID NO: 1266554 - protein, 9 aa, Homo Sapiens
TSPEPPNTT

SEQ ID NO: 1266555 - protein, 9 aa, Homo Sapiens
SVNTVDKEN

SEQ ID NO: 1266556 - protein, 9 aa, Homo Sapiens
KPKHQQKRS

SEQ ID NO: 1266557 - protein, 9 aa, Homo Sapiens
GAVLSRSGH

SEQ ID NO: 1266558 - protein, 9 aa, Homo Sapiens
FFLTRSHSV

SEQ ID NO: 1266559 - protein, 9 aa, Homo Sapiens
NLRSVFPVE

SEQ ID NO: 1266560 - protein, 9 aa, Homo Sapiens
VHQDLKPEN

SEQ ID NO: 1266561 - protein, 9 aa, Homo Sapiens
TVSDRPLEV

SEQ ID NO: 1266562 - protein, 9 aa, Homo Sapiens
HIPTMPSMG

SEQ ID NO: 1266563 - protein, 9 aa, Homo Sapiens
RRPKLYYET

SEQ ID NO: 1266564 - protein, 9 aa, Homo Sapiens
LSRSGHVLH

SEQ ID NO: 1266565 - protein, 9 aa, Homo Sapiens
SSNGNRWKE

SEQ ID NO: 1266566 - protein, 9 aa, Homo Sapiens
NVQELFPVY

SEQ ID NO: 1266567 - protein, 9 aa, Homo Sapiens
SNGNRWKEI

SEQ ID NO: 1266568 - protein, 9 aa, Homo Sapiens
RSAVEYNIF

SEQ ID NO: 1266569 - protein, 9 aa, Homo Sapiens
FSAEESPGD

SEQ ID NO: 1266570 - protein, 9 aa, Homo Sapiens
VVGAAGVGK

SEQ ID NO: 1266571 - protein, 9 aa, Homo Sapiens
TVDKENTVM

SEQ ID NO: 1266572 - protein, 9 aa, Homo Sapiens
NEWDLNVQE

SEQ ID NO: 1266573 - protein, 9 aa, Homo Sapiens
IRIVHIHSV

SEQ ID NO: 1266574 - protein, 9 aa, Homo Sapiens
HKLNIVHQD

SEQ ID NO: 1266575 - protein, 9 aa, Homo Sapiens
AVVTLQNWQ

SEQ ID NO: 1266576 - protein, 9 aa, Homo Sapiens
NTVDKENTV

SEQ ID NO: 1266577 - protein, 9 aa, Homo Sapiens
AIRIVHIHS

SEQ ID NO: 1266578 - protein, 9 aa, Homo Sapiens
VRRCPDHER

SEQ ID NO: 1266579 - protein, 9 aa, Homo Sapiens
VSDRPLEVS

SEQ ID NO: 1266580 - protein, 9 aa, Homo Sapiens
LTRSHSVTQ

SEQ ID NO: 1266581 - protein, 9 aa, Homo Sapiens
KLMDSAGNK

SEQ ID NO: 1266582 - protein, 9 aa, Homo Sapiens
DLCRFCQMA

SEQ ID NO: 1266583 - protein, 9 aa, Homo Sapiens
GDASDQWTC

SEQ ID NO: 1266584 - protein, 9 aa, Homo Sapiens
EDIIEDIIK

SEQ ID NO: 1266585 - protein, 9 aa, Homo Sapiens
HEEKILNRE

SEQ ID NO: 1266586 - protein, 9 aa, Homo Sapiens
ALLRHLSRL

SEQ ID NO: 1266587 - protein, 9 aa, Homo Sapiens
FFFFLTRSH

SEQ ID NO: 1266588 - protein, 9 aa, Homo Sapiens
VSKYHDILE

SEQ ID NO: 1266589 - protein, 9 aa, Homo Sapiens
GNLMNQEYT

SEQ ID NO: 1266590 - protein, 9 aa, Homo Sapiens
SVFPVEQQR

SEQ ID NO: 1266591 - protein, 9 aa, Homo Sapiens
AEKVDAIRI

SEQ ID NO: 1266592 - protein, 9 aa, Homo Sapiens
TEVVRRCPD

SEQ ID NO: 1266593 - protein, 9 aa, Homo Sapiens
MNLRSVFPV

SEQ ID NO: 1266594 - protein, 9 aa, Homo Sapiens
SGIRWEVYP

SEQ ID NO: 1266595 - protein, 9 aa, Homo Sapiens
MPPPPPPAP

SEQ ID NO: 1266596 - protein, 9 aa, Homo Sapiens
PDHERCSDS

SEQ ID NO: 1266597 - protein, 9 aa, Homo Sapiens
PTMPSMGVP

SEQ ID NO: 1266598 - protein, 9 aa, Homo Sapiens
IISSNGNRW

SEQ ID NO: 1266599 - protein, 9 aa, Homo Sapiens
VESIQLECK

SEQ ID NO: 1266600 - protein, 9 aa, Homo Sapiens
FPLRRRPKL

SEQ ID NO: 1266601 - protein, 9 aa, Homo Sapiens
VTLEDIIED

SEQ ID NO: 1266602 - protein, 9 aa, Homo Sapiens
SVLMVSKYH

SEQ ID NO: 1266603 - protein, 9 aa, Homo Sapiens
NLLREKNMK

SEQ ID NO: 1266604 - protein, 9 aa, Homo Sapiens
VAKQVESIQ

SEQ ID NO: 1266605 - protein, 9 aa, Homo Sapiens
QKRSSQNHM

SEQ ID NO: 1266606 - protein, 9 aa, Homo Sapiens
KVIEPVGNH

SEQ ID NO: 1266607 - protein, 9 aa, Homo Sapiens
KVAKQVESI

SEQ ID NO: 1266608 - protein, 9 aa, Homo Sapiens
LGIISSNGN

SEQ ID NO: 1266609 - protein, 9 aa, Homo Sapiens
EFSWSRLIL

SEQ ID NO: 1266610 - protein, 9 aa, Homo Sapiens
FLSPEVWFD

SEQ ID NO: 1266611 - protein, 9 aa, Homo Sapiens
FILLLNTVV

SEQ ID NO: 1266612 - protein, 9 aa, Homo Sapiens
GAFPLLLQF

SEQ ID NO: 1266613 - protein, 9 aa, Homo Sapiens
PLEVSITKA

SEQ ID NO: 1266614 - protein, 9 aa, Homo Sapiens
GLKVEKKRN

SEQ ID NO: 1266615 - protein, 9 aa, Homo Sapiens
GQPQSSQKC

SEQ ID NO: 1266616 - protein, 9 aa, Homo Sapiens
LMNQEYTPQ

SEQ ID NO: 1266617 - protein, 9 aa, Homo Sapiens
HVNEWDLNV

SEQ ID NO: 1266618 - protein, 9 aa, Homo Sapiens
RMGDMGPCG

SEQ ID NO: 1266619 - protein, 9 aa, Homo Sapiens
LHQPDSGLR

SEQ ID NO: 1266620 - protein, 9 aa, Homo Sapiens
LLQHIGGGA

SEQ ID NO: 1266621 - protein, 9 aa, Homo Sapiens
LQFLLFLSP

SEQ ID NO: 1266622 - protein, 9 aa, Homo Sapiens
LRSVFPVEQ

SEQ ID NO: 1266623 - protein, 9 aa, Homo Sapiens
SWKLMDSAG

SEQ ID NO: 1266624 - protein, 9 aa, Homo Sapiens
LEDIIEDII

SEQ ID NO: 1266625 - protein, 9 aa, Homo Sapiens
QTVHGKVDH

SEQ ID NO: 1266626 - protein, 9 aa, Homo Sapiens
VDFVTPDKF

SEQ ID NO: 1266627 - protein, 9 aa, Homo Sapiens
FFFFFLTRS

SEQ ID NO: 1266628 - protein, 9 aa, Homo Sapiens
LLLNTVVSY

SEQ ID NO: 1266629 - protein, 9 aa, Homo Sapiens
REKNMKLPL

SEQ ID NO: 1266630 - protein, 9 aa, Homo Sapiens
DVGNLMNQE

SEQ ID NO: 1266631 - protein, 9 aa, Homo Sapiens
LRGTSQPLR

SEQ ID NO: 1266632 - protein, 9 aa, Homo Sapiens
LPYLRGTSQ

SEQ ID NO: 1266633 - protein, 9 aa, Homo Sapiens
WTCTSPEAS

SEQ ID NO: 1266634 - protein, 9 aa, Homo Sapiens
RPKLYYETS

SEQ ID NO: 1266635 - protein, 9 aa, Homo Sapiens
KEHHLRGQP

SEQ ID NO: 1266636 - protein, 9 aa, Homo Sapiens
KVEKKRNKA

SEQ ID NO: 1266637 - protein, 9 aa, Homo Sapiens
VISLVLKKN

SEQ ID NO: 1266638 - protein, 9 aa, Homo Sapiens
FFFLTRSHS

SEQ ID NO: 1266639 - protein, 9 aa, Homo Sapiens
LHKLNIVHQ

SEQ ID NO: 1266640 - protein, 9 aa, Homo Sapiens
LQHIGGGAF

SEQ ID NO: 1266641 - protein, 9 aa, Homo Sapiens
TRPQDVLDA

SEQ ID NO: 1266642 - protein, 9 aa, Homo Sapiens
KLNIVHQDL

SEQ ID NO: 1266643 - protein, 9 aa, Homo Sapiens
LNTVVSYIM

SEQ ID NO: 1266644 - protein, 9 aa, Homo Sapiens
HIKEHHLRG

SEQ ID NO: 1266645 - protein, 9 aa, Homo Sapiens
GPCGAINMG

SEQ ID NO: 1266646 - protein, 9 aa, Homo Sapiens
AFPLLLQFL

SEQ ID NO: 1266647 - protein, 9 aa, Homo Sapiens
AEFSWSRLI

SEQ ID NO: 1266648 - protein, 9 aa, Homo Sapiens
IYAFILLLN

SEQ ID NO: 1266649 - protein, 9 aa, Homo Sapiens
SQLLSGIRW

SEQ ID NO: 1266650 - protein, 9 aa, Homo Sapiens
ISSNGNRWK

SEQ ID NO: 1266651 - protein, 9 aa, Homo Sapiens
FFSFFFFFL

SEQ ID NO: 1266652 - protein, 9 aa, Homo Sapiens
NGESWKLMD

SEQ ID NO: 1266653 - protein, 9 aa, Homo Sapiens
IKEHHLRGQ

SEQ ID NO: 1266654 - protein, 9 aa, Homo Sapiens
TVTEPYGEV

SEQ ID NO: 1266655 - protein, 9 aa, Homo Sapiens
KHQQKRSSQ

SEQ ID NO: 1266656 - protein, 9 aa, Homo Sapiens
GDLCRFCQM

SEQ ID NO: 1266657 - protein, 9 aa, Homo Sapiens
VDAIRIVHI

SEQ ID NO: 1266658 - protein, 9 aa, Homo Sapiens
TPDKFDENA

SEQ ID NO: 1266659 - protein, 9 aa, Homo Sapiens
PVEQQRILQ

SEQ ID NO: 1266660 - protein, 9 aa, Homo Sapiens
SHRSAVEYN

SEQ ID NO: 1266661 - protein, 9 aa, Homo Sapiens
KNNGESWKL

SEQ ID NO: 1266662 - protein, 9 aa, Homo Sapiens
LLSGIRWEV

SEQ ID NO: 1266663 - protein, 9 aa, Homo Sapiens
QLLSGIRWE

SEQ ID NO: 1266664 - protein, 9 aa, Homo Sapiens
GESWKLMDS

SEQ ID NO: 1266665 - protein, 9 aa, Homo Sapiens
HLRGQPQSS

SEQ ID NO: 1266666 - protein, 9 aa, Homo Sapiens
DHERCSDSD

SEQ ID NO: 1266667 - protein, 9 aa, Homo Sapiens
SDRPLEVSI

SEQ ID NO: 1266668 - protein, 9 aa, Homo Sapiens
TLQNWQFEE

SEQ ID NO: 1266669 - protein, 9 aa, Homo Sapiens
LLLLQHIGG

SEQ ID NO: 1266670 - protein, 9 aa, Homo Sapiens
CPDHERCSD

SEQ ID NO: 1266671 - protein, 9 aa, Homo Sapiens
PQNLLREKN

SEQ ID NO: 1266672 - protein, 9 aa, Homo Sapiens
GGAFPLLLQ

SEQ ID NO: 1266673 - protein, 9 aa, Homo Sapiens
MGDMGPCGA

SEQ ID NO: 1266674 - protein, 9 aa, Homo Sapiens
ASDQWTCTS

SEQ ID NO: 1266675 - protein, 9 aa, Homo Sapiens
LRRRPKLYY

SEQ ID NO: 1266676 - protein, 9 aa, Homo Sapiens
GTSQPLRGC

SEQ ID NO: 1266677 - protein, 9 aa, Homo Sapiens
DSGLRLLLL

SEQ ID NO: 1266678 - protein, 9 aa, Homo Sapiens
DFPLRRRPK

SEQ ID NO: 1266679 - protein, 9 aa, Homo Sapiens
KAPSVISLV

SEQ ID NO: 1266680 - protein, 9 aa, Homo Sapiens
KYHDILEPQ

SEQ ID NO: 1266681 - protein, 9 aa, Homo Sapiens
RKESQLLSG

SEQ ID NO: 1266682 - protein, 9 aa, Homo Sapiens
VTLQNWQFE

SEQ ID NO: 1266683 - protein, 9 aa, Homo Sapiens
PSFSAEESP

SEQ ID NO: 1266684 - protein, 9 aa, Homo Sapiens
LCDVGNLMN

SEQ ID NO: 1266685 - protein, 9 aa, Homo Sapiens
RSVFPVEQQ

SEQ ID NO: 1266686 - protein, 9 aa, Homo Sapiens
VAARLPTRP

SEQ ID NO: 1266687 - protein, 9 aa, Homo Sapiens
VDKENTVMV

SEQ ID NO: 1266688 - protein, 9 aa, Homo Sapiens
AKSHRSAVE

SEQ ID NO: 1266689 - protein, 9 aa, Homo Sapiens
SPTSPEPPN

SEQ ID NO: 1266690 - protein, 9 aa, Homo Sapiens
PVGNHEEKI

SEQ ID NO: 1266691 - protein, 9 aa, Homo Sapiens
ISLVLKKNN

SEQ ID NO: 1266692 - protein, 9 aa, Homo Sapiens
YNPNAGVTQ

SEQ ID NO: 1266693 - protein, 9 aa, Homo Sapiens
LRHLSRLLA

SEQ ID NO: 1266694 - protein, 9 aa, Homo Sapiens
FSWSRLILF

SEQ ID NO: 1266695 - protein, 9 aa, Homo Sapiens
QPDSGLRLL

SEQ ID NO: 1266696 - protein, 9 aa, Homo Sapiens
VVTLQNWQF

SEQ ID NO: 1266697 - protein, 9 aa, Homo Sapiens
LPVDFVTPD

SEQ ID NO: 1266698 - protein, 9 aa, Homo Sapiens
EVWFDDQTV

SEQ ID NO: 1266699 - protein, 9 aa, Homo Sapiens
RPQDVLDAH

SEQ ID NO: 1266700 - protein, 9 aa, Homo Sapiens
GMPPPPPPA

SEQ ID NO: 1266701 - protein, 9 aa, Homo Sapiens
EPPNTTSPE

SEQ ID NO: 1266702 - protein, 9 aa, Homo Sapiens
AGVTQRASD

SEQ ID NO: 1266703 - protein, 9 aa, Homo Sapiens
QQVIHLFDE

SEQ ID NO: 1266704 - protein, 9 aa, Homo Sapiens
SRSGHVLHR

SEQ ID NO: 1266705 - protein, 9 aa, Homo Sapiens
ITAKSHRSA

SEQ ID NO: 1266706 - protein, 9 aa, Homo Sapiens
EKVDAIRIV

SEQ ID NO: 1266707 - protein, 9 aa, Homo Sapiens
VGAAGVGKS

SEQ ID NO: 1266708 - protein, 9 aa, Homo Sapiens
GIRWEVYPV

SEQ ID NO: 1266709 - protein, 9 aa, Homo Sapiens
FLTRSHSVT

SEQ ID NO: 1266710 - protein, 9 aa, Homo Sapiens
VVRRCPDHE

SEQ ID NO: 1266711 - protein, 9 aa, Homo Sapiens
AAGVGKSAL

SEQ ID NO: 1266712 - protein, 9 aa, Homo Sapiens
QRASDPAQA

SEQ ID NO: 1266713 - protein, 9 aa, Homo Sapiens
PKHQQKRSS

SEQ ID NO: 1266714 - protein, 9 aa, Homo Sapiens
LLNTVVSYI

SEQ ID NO: 1266715 - protein, 9 aa, Homo Sapiens
VNTVDKENT

SEQ ID NO: 1266716 - protein, 9 aa, Homo Sapiens
LVLKKNNRD

SEQ ID NO: 1266717 - protein, 9 aa, Homo Sapiens
WSRLILFLG

SEQ ID NO: 1266718 - protein, 9 aa, Homo Sapiens
SFSAEESPG

SEQ ID NO: 1266719 - protein, 9 aa, Homo Sapiens
CRFCQMAAA

SEQ ID NO: 1266720 - protein, 9 aa, Homo Sapiens
NPNAVVTLQ

SEQ ID NO: 1266721 - protein, 9 aa, Homo Sapiens
VAEKVDAIR

SEQ ID NO: 1266722 - protein, 9 aa, Homo Sapiens
ASKVAKQVE

SEQ ID NO: 1266723 - protein, 9 aa, Homo Sapiens
DRFLHQPDS

SEQ ID NO: 1266724 - protein, 9 aa, Homo Sapiens
LLREKNMKL

SEQ ID NO: 1266725 - protein, 9 aa, Homo Sapiens
QWTCTSPEA

SEQ ID NO: 1266726 - protein, 9 aa, Homo Sapiens
PNTTSPESP

SEQ ID NO: 1266727 - protein, 9 aa, Homo Sapiens
SQQVIHLFD

SEQ ID NO: 1266728 - protein, 9 aa, Homo Sapiens
HQQKRSSQN

SEQ ID NO: 1266729 - protein, 9 aa, Homo Sapiens
DLNVQELFP

SEQ ID NO: 1266730 - protein, 9 aa, Homo Sapiens
KEGELASTQ

SEQ ID NO: 1266731 - protein, 9 aa, Homo Sapiens
QAEFSWSRL

SEQ ID NO: 1266732 - protein, 9 aa, Homo Sapiens
QFLLFLSPE

SEQ ID NO: 1266733 - protein, 9 aa, Homo Sapiens
EVVRRCPDH

SEQ ID NO: 1266734 - protein, 9 aa, Homo Sapiens
EGDLCRFCQ

SEQ ID NO: 1266735 - protein, 9 aa, Homo Sapiens
LQNWQFEEW

SEQ ID NO: 1266736 - protein, 9 aa, Homo Sapiens
NMKLPLPES

SEQ ID NO: 1266737 - protein, 9 aa, Homo Sapiens
PSALLRHLS

SEQ ID NO: 1266738 - protein, 9 aa, Homo Sapiens
RKISQQVIH

SEQ ID NO: 1266739 - protein, 9 aa, Homo Sapiens
IVHQDLKPE

SEQ ID NO: 1266740 - protein, 9 aa, Homo Sapiens
NIVHQDLKP

SEQ ID NO: 1266741 - protein, 9 aa, Homo Sapiens
QDLKPENIL

SEQ ID NO: 1266742 - protein, 9 aa, Homo Sapiens
SVISLVLKK

SEQ ID NO: 1266743 - protein, 9 aa, Homo Sapiens
KSHRSAVEY

SEQ ID NO: 1266744 - protein, 9 aa, Homo Sapiens
RRRPKLYYE

SEQ ID NO: 1266745 - protein, 9 aa, Homo Sapiens
DIIEDIIKS

SEQ ID NO: 1266746 - protein, 9 aa, Homo Sapiens
EPVGNHEEK

SEQ ID NO: 1266747 - protein, 9 aa, Homo Sapiens
PYLRGTSQP

SEQ ID NO: 1266748 - protein, 9 aa, Homo Sapiens
VTVSDRPLE

SEQ ID NO: 1266749 - protein, 9 aa, Homo Sapiens
VGNHEEKIL

SEQ ID NO: 1266750 - protein, 9 aa, Homo Sapiens
LLRHLSRLL

SEQ ID NO: 1266751 - protein, 9 aa, Homo Sapiens
AVLSRSGHV

SEQ ID NO: 1266752 - protein, 9 aa, Homo Sapiens
PKLYYETSI

SEQ ID NO: 1266753 - protein, 9 aa, Homo Sapiens
RETVTEPYG

SEQ ID NO: 1266754 - protein, 9 aa, Homo Sapiens
MFGLKVEKK

SEQ ID NO: 1266755 - protein, 9 aa, Homo Sapiens
NPNAGVTQR

SEQ ID NO: 1266756 - protein, 9 aa, Homo Sapiens
RSGHVLHRL

SEQ ID NO: 1266757 - protein, 9 aa, Homo Sapiens
MPSMGVPHS

SEQ ID NO: 1266758 - protein, 9 aa, Homo Sapiens
HIGGGAFPL

SEQ ID NO: 1266759 - protein, 9 aa, Homo Sapiens
DQWTCTSPE

SEQ ID NO: 1266760 - protein, 9 aa, Homo Sapiens
MGPCGAINM

SEQ ID NO: 1266761 - protein, 9 aa, Homo Sapiens
QNLLREKNM

SEQ ID NO: 1266762 - protein, 9 aa, Homo Sapiens
RRCPDHERC

SEQ ID NO: 1266763 - protein, 9 aa, Homo Sapiens
EEEGDLCRF

SEQ ID NO: 1266764 - protein, 9 aa, Homo Sapiens
ETVTEPYGE

SEQ ID NO: 1266765 - protein, 9 aa, Homo Sapiens
PCGAINMGD

SEQ ID NO: 1266766 - protein, 9 aa, Homo Sapiens
LSGIRWEVY

SEQ ID NO: 1266767 - protein, 9 aa, Homo Sapiens
WDLNVQELF

SEQ ID NO: 1266768 - protein, 9 aa, Homo Sapiens
GNHEEKILN

SEQ ID NO: 1266769 - protein, 9 aa, Homo Sapiens
DASDQWTCT

SEQ ID NO: 1266770 - protein, 9 aa, Homo Sapiens
HQDLKPENI

SEQ ID NO: 1266771 - protein, 9 aa, Homo Sapiens
HLSRLLAPA

SEQ ID NO: 1266772 - protein, 9 aa, Homo Sapiens
FPGSGPSFS

SEQ ID NO: 1266773 - protein, 9 aa, Homo Sapiens
APSALLRHL

SEQ ID NO: 1266774 - protein, 9 aa, Homo Sapiens
AAGDASDQW

SEQ ID NO: 1266775 - protein, 9 aa, Homo Sapiens
NAVVTLQNW

SEQ ID NO: 1266776 - protein, 9 aa, Homo Sapiens
SGLRLLLLL

SEQ ID NO: 1266777 - protein, 9 aa, Homo Sapiens
LLLQFLLFL

SEQ ID NO: 1266778 - protein, 9 aa, Homo Sapiens
LVVVGAAGV

SEQ ID NO: 1266779 - protein, 9 aa, Homo Sapiens
PNAGVTQRA

SEQ ID NO: 1266780 - protein, 9 aa, Homo Sapiens
QRETVTEPY

SEQ ID NO: 1266781 - protein, 9 aa, Homo Sapiens
KISQQVIHL

SEQ ID NO: 1266782 - protein, 9 aa, Homo Sapiens
QVESIQLEC

SEQ ID NO: 1266783 - protein, 9 aa, Homo Sapiens
VEKKRNKAE

SEQ ID NO: 1266784 - protein, 9 aa, Homo Sapiens
PDKFDENAK

SEQ ID NO: 1266785 - protein, 9 aa, Homo Sapiens
DQTVHGKVD

SEQ ID NO: 1266786 - protein, 9 aa, Homo Sapiens
LSPEVWFDD

SEQ ID NO: 1266787 - protein, 9 aa, Homo Sapiens
AFILLLNTV

SEQ ID NO: 1266788 - protein, 9 aa, Homo Sapiens
HRSAVEYNI

SEQ ID NO: 1266789 - protein, 9 aa, Homo Sapiens
NTVVSYIMQ

SEQ ID NO: 1266790 - protein, 9 aa, Homo Sapiens
EKNMKLPLP

SEQ ID NO: 1266791 - protein, 9 aa, Homo Sapiens
QNWQFEEWG

SEQ ID NO: 1266792 - protein, 9 aa, Homo Sapiens
QQKRSSQNH

SEQ ID NO: 1266793 - protein, 9 aa, Homo Sapiens
TKEGELAST

SEQ ID NO: 1266794 - protein, 9 aa, Homo Sapiens
TTKEGELAS

SEQ ID NO: 1266795 - protein, 9 aa, Homo Sapiens
SWSRLILFL

SEQ ID NO: 1266796 - protein, 9 aa, Homo Sapiens
EPYGEVNHN

SEQ ID NO: 1266797 - protein, 9 aa, Homo Sapiens
RSSQNHMDW

SEQ ID NO: 1266798 - protein, 9 aa, Homo Sapiens
TRSHSVTQA

SEQ ID NO: 1266799 - protein, 9 aa, Homo Sapiens
LLFLSPEVW

SEQ ID NO: 1266800 - protein, 9 aa, Homo Sapiens
KLVVVGAAG

SEQ ID NO: 1266801 - protein, 9 aa, Homo Sapiens
MVSKYHDIL

SEQ ID NO: 1266802 - protein, 9 aa, Homo Sapiens
MGVPHSLVH

SEQ ID NO: 1266803 - protein, 9 aa, Homo Sapiens
RFLHQPDSG

SEQ ID NO: 1266804 - protein, 9 aa, Homo Sapiens
KQVESIQLE

SEQ ID NO: 1266805 - protein, 9 aa, Homo Sapiens
STTKEGELA

SEQ ID NO: 1266806 - protein, 9 aa, Homo Sapiens
DKENTVMVA

SEQ ID NO: 1266807 - protein, 9 aa, Homo Sapiens
FVTPDKFDE

SEQ ID NO: 1266808 - protein, 9 aa, Homo Sapiens
GHVLHRLFG

SEQ ID NO: 1266809 - protein, 9 aa, Homo Sapiens
FGLKVEKKR

SEQ ID NO: 1266810 - protein, 9 aa, Homo Sapiens
SKYHDILEP

SEQ ID NO: 1266811 - protein, 9 aa, Homo Sapiens
LREKNMKLP

SEQ ID NO: 1266812 - protein, 9 aa, Homo Sapiens
RHLSRLLAP

SEQ ID NO: 1266813 - protein, 9 aa, Homo Sapiens
SLVLKKNNR

SEQ ID NO: 1266814 - protein, 9 aa, Homo Sapiens
HQPDSGLRL

SEQ ID NO: 1266815 - protein, 9 aa, Homo Sapiens
WFDDQTVHG

SEQ ID NO: 1266816 - protein, 9 aa, Homo Sapiens
PLRRRPKLY

SEQ ID NO: 1266817 - protein, 9 aa, Homo Sapiens
HDILEPQRE

SEQ ID NO: 1266818 - protein, 9 aa, Homo Sapiens
DKAPSVISL

SEQ ID NO: 1266819 - protein, 9 aa, Homo Sapiens
VGRKISQQV

SEQ ID NO: 1266820 - protein, 9 aa, Homo Sapiens
VLSRSGHVL

SEQ ID NO: 1266821 - protein, 9 aa, Homo Sapiens
LKVEKKRNK

SEQ ID NO: 1266822 - protein, 9 aa, Homo Sapiens
YAFILLLNT

SEQ ID NO: 1266823 - protein, 9 aa, Homo Sapiens
RGTSQPLRG

SEQ ID NO: 1266824 - protein, 9 aa, Homo Sapiens
FLLFLSPEV

SEQ ID NO: 1266825 - protein, 9 aa, Homo Sapiens
TLPVDFVTP

SEQ ID NO: 1266826 - protein, 9 aa, Homo Sapiens
HVLHRLFGK

SEQ ID NO: 1266827 - protein, 9 aa, Homo Sapiens
LFLSPEVWF

SEQ ID NO: 1266828 - protein, 9 aa, Homo Sapiens
FPLLLQFLL

SEQ ID NO: 1266829 - protein, 9 aa, Homo Sapiens
IPTMPSMGV

SEQ ID NO: 1266830 - protein, 9 aa, Homo Sapiens
LLLLLQHIG

SEQ ID NO: 1266831 - protein, 9 aa, Homo Sapiens
AKQVESIQL

SEQ ID NO: 1266832 - protein, 9 aa, Homo Sapiens
TVAEKVDAI

SEQ ID NO: 1266833 - protein, 9 aa, Homo Sapiens
TASTTKEGE

SEQ ID NO: 1266834 - protein, 9 aa, Homo Sapiens
LMVSKYHDI

SEQ ID NO: 1266835 - protein, 9 aa, Homo Sapiens
ALCDVGNLM

SEQ ID NO: 1266836 - protein, 9 aa, Homo Sapiens
LSTASTTKE

SEQ ID NO: 1266837 - protein, 9 aa, Homo Sapiens
VIEPVGNHE

SEQ ID NO: 1266838 - protein, 9 aa, Homo Sapiens
GNRWKEIRR

SEQ ID NO: 1266839 - protein, 9 aa, Homo Sapiens
MRMGDMGPC

SEQ ID NO: 1266840 - protein, 9 aa, Homo Sapiens
GSGPSFSAE

SEQ ID NO: 1266841 - protein, 9 aa, Homo Sapiens
APSVISLVL

SEQ ID NO: 1266842 - protein, 9 aa, Homo Sapiens
PVDFVTPDK

SEQ ID NO: 1266843 - protein, 9 aa, Homo Sapiens
SPEVWFDDQ

SEQ ID NO: 1266844 - protein, 9 aa, Homo Sapiens
TAKSHRSAV

SEQ ID NO: 1266845 - protein, 9 aa, Homo Sapiens
KLYYETSIH

SEQ ID NO: 1266846 - protein, 9 aa, Homo Sapiens
DAIRIVHIH

SEQ ID NO: 1266847 - protein, 9 aa, Homo Sapiens
MNQEYTPQI

SEQ ID NO: 1266848 - protein, 9 aa, Homo Sapiens
LEVSITKAE

SEQ ID NO: 1266849 - protein, 9 aa, Homo Sapiens
FLHQPDSGL

SEQ ID NO: 1266850 - protein, 9 aa, Homo Sapiens
RSHSVTQAG

SEQ ID NO: 1266851 - protein, 9 aa, Homo Sapiens
TITAKSHRS

SEQ ID NO: 1266852 - protein, 9 aa, Homo Sapiens
EWDLNVQEL

SEQ ID NO: 1266853 - protein, 9 aa, Homo Sapiens
RCPDHERCS

SEQ ID NO: 1266854 - protein, 9 aa, Homo Sapiens
LRLLLLLQH

SEQ ID NO: 1266855 - protein, 9 aa, Homo Sapiens
QVIHLFDEK

SEQ ID NO: 1266856 - protein, 9 aa, Homo Sapiens
VQELFPVYA

SEQ ID NO: 1266857 - protein, 9 aa, Homo Sapiens
LLLQHIGGG

SEQ ID NO: 1266858 - protein, 9 aa, Homo Sapiens
KVDAIRIVH

SEQ ID NO: 1266859 - protein, 9 aa, Homo Sapiens
SQPLRGCLH

SEQ ID NO: 1266860 - protein, 9 aa, Homo Sapiens
GLRLLLLLQ

SEQ ID NO: 1266861 - protein, 9 aa, Homo Sapiens
QHIGGGAFP

SEQ ID NO: 1266862 - protein, 9 aa, Homo Sapiens
AHIPTMPSM

SEQ ID NO: 1266863 - protein, 9 aa, Homo Sapiens
FSFFFFFLT

SEQ ID NO: 1266864 - protein, 9 aa, Homo Sapiens
GAAGVGKSA

SEQ ID NO: 1266865 - protein, 9 aa, Homo Sapiens
PNAVVTLQN

SEQ ID NO: 1266866 - protein, 9 aa, Homo Sapiens
RFCQMAAAS

SEQ ID NO: 1266867 - protein, 9 aa, Homo Sapiens
DLSTASTTK

SEQ ID NO: 1266868 - protein, 9 aa, Homo Sapiens
VLMVSKYHD

SEQ ID NO: 1266869 - protein, 9 aa, Homo Sapiens
DISVNTVDK

SEQ ID NO: 1266870 - protein, 9 aa, Homo Sapiens
RLLLLLQHI

SEQ ID NO: 1266871 - protein, 9 aa, Homo Sapiens
NFFSFFFFF

SEQ ID NO: 1266872 - protein, 9 aa, Homo Sapiens
GIISSNGNR

SEQ ID NO: 1266873 - protein, 9 aa, Homo Sapiens
STASTTKEG

SEQ ID NO: 1266874 - protein, 9 aa, Homo Sapiens
IEPVGNHEE

SEQ ID NO: 1266875 - protein, 9 aa, Homo Sapiens
PYGEVNHNQ

SEQ ID NO: 1266876 - protein, 9 aa, Homo Sapiens
TLEDIIEDI

SEQ ID NO: 1266877 - protein, 9 aa, Homo Sapiens
RLPTRPQDV

SEQ ID NO: 1266878 - protein, 9 aa, Homo Sapiens
SMGVPHSLV

SEQ ID NO: 1266879 - protein, 9 aa, Homo Sapiens
SDQWTCTSP

SEQ ID NO: 1266880 - protein, 9 aa, Homo Sapiens
VTPDKFDEN

SEQ ID NO: 1266881 - protein, 9 aa, Homo Sapiens
LNVQELFPV

SEQ ID NO: 1266882 - protein, 9 aa, Homo Sapiens
TMPSMGVPH

SEQ ID NO: 1266883 - protein, 9 aa, Homo Sapiens
DDQTVHGKV

SEQ ID NO: 1266884 - protein, 9 aa, Homo Sapiens
WKLMDSAGN

SEQ ID NO: 1266885 - protein, 9 aa, Homo Sapiens
KRSSQNHMD

SEQ ID NO: 1266886 - protein, 9 aa, Homo Sapiens
EEGDLCRFC

SEQ ID NO: 1266887 - protein, 9 aa, Homo Sapiens
ESQLLSGIR

SEQ ID NO: 1266888 - protein, 9 aa, Homo Sapiens
PPNTTSPES

SEQ ID NO: 1266889 - protein, 9 aa, Homo Sapiens
QPLRGCLHA

SEQ ID NO: 1266890 - protein, 9 aa, Homo Sapiens
SPEPPNTTS

SEQ ID NO: 1266891 - protein, 9 aa, Homo Sapiens
DMGPCGAIN

SEQ ID NO: 1266892 - protein, 9 aa, Homo Sapiens
QNFFSFFFF

SEQ ID NO: 1266893 - protein, 9 aa, Homo Sapiens
VTEPYGEVN

SEQ ID NO: 1266894 - protein, 9 aa, Homo Sapiens
PEPPNTTSP

SEQ ID NO: 1266895 - protein, 9 aa, Homo Sapiens
PSMGVPHSL

SEQ ID NO: 1266896 - protein, 9 aa, Homo Sapiens
SALLRHLSR

SEQ ID NO: 1266897 - protein, 9 aa, Homo Sapiens
YLRGTSQPL

SEQ ID NO: 1266898 - protein, 9 aa, Homo Sapiens
KNMKLPLPE

SEQ ID NO: 1266899 - protein, 9 aa, Homo Sapiens
LKPKHQQKR

SEQ ID NO: 1266900 - protein, 9 aa, Homo Sapiens
EHHLRGQPQ

SEQ ID NO: 1266901 - protein, 9 aa, Homo Sapiens
PLLLQFLLF

SEQ ID NO: 1266902 - protein, 9 aa, Homo Sapiens
ILLLNTVVS

SEQ ID NO: 1266903 - protein, 9 aa, Homo Sapiens
RLILFLGAS

SEQ ID NO: 1266904 - protein, 9 aa, Homo Sapiens
IEDIIKSEI

SEQ ID NO: 1266905 - protein, 9 aa, Homo Sapiens
GDMGPCGAI

SEQ ID NO: 1266906 - protein, 9 aa, Homo Sapiens
SRLILFLGA

SEQ ID NO: 1266907 - protein, 9 aa, Homo Sapiens
DRPLEVSIT

SEQ ID NO: 1266908 - protein, 9 aa, Homo Sapiens
NTTSPESPD

SEQ ID NO: 1266909 - protein, 9 aa, Homo Sapiens
LPTRPQDVL

SEQ ID NO: 1266910 - protein, 9 aa, Homo Sapiens
LCRFCQMAA

SEQ ID NO: 1266911 - protein, 9 aa, Homo Sapiens
FPVEQQRIL

SEQ ID NO: 1266912 - protein, 9 aa, Homo Sapiens
VVVGAAGVG

SEQ ID NO: 1266913 - protein, 9 aa, Homo Sapiens
HHLRGQPQS

SEQ ID NO: 1266914 - protein, 9 aa, Homo Sapiens
NRWKEIRRF

SEQ ID NO: 1266915 - protein, 9 aa, Homo Sapiens
FDDQTVHGK

SEQ ID NO: 1266916 - protein, 9 aa, Homo Sapiens
TSQPLRGCL

SEQ ID NO: 1266917 - protein, 9 aa, Homo Sapiens
ISQQVIHLF

SEQ ID NO: 1266918 - protein, 9 aa, Homo Sapiens
IGGGAFPLL

SEQ ID NO: 1266919 - protein, 9 aa, Homo Sapiens
PTSPEPPNT

SEQ ID NO: 1266920 - protein, 9 aa, Homo Sapiens
GPSFSAEES

SEQ ID NO: 1266921 - protein, 9 aa, Homo Sapiens
SGPSFSAEE

SEQ ID NO: 1266922 - protein, 9 aa, Homo Sapiens
NLMNQEYTP

SEQ ID NO: 1266923 - protein, 9 aa, Homo Sapiens
EDIIKSEIL

SEQ ID NO: 1266924 - protein, 9 aa, Homo Sapiens
TEPYGEVNH

SEQ ID NO: 1266925 - protein, 9 aa, Homo Sapiens
SFFFFFLTR

SEQ ID NO: 1266926 - protein, 9 aa, Homo Sapiens
YKLVVVGAA

SEQ ID NO: 1266927 - protein, 9 aa, Homo Sapiens
ESWKLMDSA

SEQ ID NO: 1266928 - protein, 9 aa, Homo Sapiens
VNEWDLNVQ

SEQ ID NO: 1266929 - protein, 9 aa, Homo Sapiens
MAPSALLRH

SEQ ID NO: 1266930 - protein, 9 aa, Homo Sapiens
PEVWFDDQT

SEQ ID NO: 1266931 - protein, 9 aa, Homo Sapiens
PSVISLVLK

SEQ ID NO: 1266932 - protein, 9 aa, Homo Sapiens
PDPSSEGRP

SEQ ID NO: 1266933 - protein, 9 aa, Homo Sapiens
TLHDEEANN

SEQ ID NO: 1266934 - protein, 9 aa, Homo Sapiens
KMETPVTLI

SEQ ID NO: 1266935 - protein, 9 aa, Homo Sapiens
TVRPPMYED

SEQ ID NO: 1266936 - protein, 9 aa, Homo Sapiens
MLLNKKYGS

SEQ ID NO: 1266937 - protein, 9 aa, Homo Sapiens
DPCTLDVEW

SEQ ID NO: 1266938 - protein, 9 aa, Homo Sapiens
GDKMETPVT

SEQ ID NO: 1266939 - protein, 9 aa, Homo Sapiens
WGSPYSPLR

SEQ ID NO: 1266940 - protein, 9 aa, Homo Sapiens
EGDKMETPV

SEQ ID NO: 1266941 - protein, 9 aa, Homo Sapiens
KLLSGYLTA

SEQ ID NO: 1266942 - protein, 9 aa, Homo Sapiens
IFPHFLKMW

SEQ ID NO: 1266943 - protein, 9 aa, Homo Sapiens
TPFGPITVR

SEQ ID NO: 1266944 - protein, 9 aa, Homo Sapiens
VTITKEEST

SEQ ID NO: 1266945 - protein, 9 aa, Homo Sapiens
PLKTSNAET

SEQ ID NO: 1266946 - protein, 9 aa, Homo Sapiens
WNGWNVMDF

SEQ ID NO: 1266947 - protein, 9 aa, Homo Sapiens
HFLKMWWKK

SEQ ID NO: 1266948 - protein, 9 aa, Homo Sapiens
VLSAPEVAE

SEQ ID NO: 1266949 - protein, 9 aa, Homo Sapiens
KLQLKLQKI

SEQ ID NO: 1266950 - protein, 9 aa, Homo Sapiens
KLEIFPHFL

SEQ ID NO: 1266951 - protein, 9 aa, Homo Sapiens
KTKLQLKLQ

SEQ ID NO: 1266952 - protein, 9 aa, Homo Sapiens
PSFVQKPDS

SEQ ID NO: 1266953 - protein, 9 aa, Homo Sapiens
SEGRPPALP

SEQ ID NO: 1266954 - protein, 9 aa, Homo Sapiens
GSYLWNGWN

SEQ ID NO: 1266955 - protein, 9 aa, Homo Sapiens
LHDEEANND

SEQ ID NO: 1266956 - protein, 9 aa, Homo Sapiens
KTQRKAKRA

SEQ ID NO: 1266957 - protein, 9 aa, Homo Sapiens
LWNGWNVMD

SEQ ID NO: 1266958 - protein, 9 aa, Homo Sapiens
LKLQKIEWE

SEQ ID NO: 1266959 - protein, 9 aa, Homo Sapiens
FFVWSIVGL

SEQ ID NO: 1266960 - protein, 9 aa, Homo Sapiens
KTSNAETPT

SEQ ID NO: 1266961 - protein, 9 aa, Homo Sapiens
SCKAGCSDP

SEQ ID NO: 1266962 - protein, 9 aa, Homo Sapiens
GHRESCSGQ

SEQ ID NO: 1266963 - protein, 9 aa, Homo Sapiens
GGMNQRPIL

SEQ ID NO: 1266964 - protein, 9 aa, Homo Sapiens
WKLLSGYLT

SEQ ID NO: 1266965 - protein, 9 aa, Homo Sapiens
LILCLLRIL

SEQ ID NO: 1266966 - protein, 9 aa, Homo Sapiens
PLTQRPDPC

SEQ ID NO: 1266967 - protein, 9 aa, Homo Sapiens
FGPITVRPP

SEQ ID NO: 1266968 - protein, 9 aa, Homo Sapiens
TKLQLKLQK

SEQ ID NO: 1266969 - protein, 9 aa, Homo Sapiens
KDLSEQLEQ

SEQ ID NO: 1266970 - protein, 9 aa, Homo Sapiens
LLLILCLLR

SEQ ID NO: 1266971 - protein, 9 aa, Homo Sapiens
CSRSFSYAS

SEQ ID NO: 1266972 - protein, 9 aa, Homo Sapiens
VAHMLLNKK

SEQ ID NO: 1266973 - protein, 9 aa, Homo Sapiens
LPPGFSCKA

SEQ ID NO: 1266974 - protein, 9 aa, Homo Sapiens
ITVRPPMYE

SEQ ID NO: 1266975 - protein, 9 aa, Homo Sapiens
KRKKRAKET

SEQ ID NO: 1266976 - protein, 9 aa, Homo Sapiens
FVWSIVGLS

SEQ ID NO: 1266977 - protein, 9 aa, Homo Sapiens
FRVHITLHD

SEQ ID NO: 1266978 - protein, 9 aa, Homo Sapiens
FFFVWSIVG

SEQ ID NO: 1266979 - protein, 9 aa, Homo Sapiens
ASAPRQGNM

SEQ ID NO: 1266980 - protein, 9 aa, Homo Sapiens
TVLEGDKME

SEQ ID NO: 1266981 - protein, 9 aa, Homo Sapiens
SPLREDWSV

SEQ ID NO: 1266982 - protein, 9 aa, Homo Sapiens
SCMGGMNQR

SEQ ID NO: 1266983 - protein, 9 aa, Homo Sapiens
AFISEASAP

SEQ ID NO: 1266984 - protein, 9 aa, Homo Sapiens
EIFPHFLKM

SEQ ID NO: 1266985 - protein, 9 aa, Homo Sapiens
PSLPTPGRV

SEQ ID NO: 1266986 - protein, 9 aa, Homo Sapiens
ITEKEKDFL

SEQ ID NO: 1266987 - protein, 9 aa, Homo Sapiens
AKKKQKRKK

SEQ ID NO: 1266988 - protein, 9 aa, Homo Sapiens
ITKEESTEK

SEQ ID NO: 1266989 - protein, 9 aa, Homo Sapiens
NQRPILTII

SEQ ID NO: 1266990 - protein, 9 aa, Homo Sapiens
KEESTEKLS

SEQ ID NO: 1266991 - protein, 9 aa, Homo Sapiens
PSSEGRPPA

SEQ ID NO: 1266992 - protein, 9 aa, Homo Sapiens
EKEKDFLWS

SEQ ID NO: 1266993 - protein, 9 aa, Homo Sapiens
GYLTANVDR

SEQ ID NO: 1266994 - protein, 9 aa, Homo Sapiens
RVHITLHDE

SEQ ID NO: 1266995 - protein, 9 aa, Homo Sapiens
SVAHMLLNK

SEQ ID NO: 1266996 - protein, 9 aa, Homo Sapiens
VWGSPYSPL

SEQ ID NO: 1266997 - protein, 9 aa, Homo Sapiens
PPGFSCKAG

SEQ ID NO: 1266998 - protein, 9 aa, Homo Sapiens
PPTVHNLEL

SEQ ID NO: 1266999 - protein, 9 aa, Homo Sapiens
LLLLLILCL

SEQ ID NO: 1267000 - protein, 9 aa, Homo Sapiens
QPDPSSEGR

SEQ ID NO: 1267001 - protein, 9 aa, Homo Sapiens
DSMDVLTGT

SEQ ID NO: 1267002 - protein, 9 aa, Homo Sapiens
SSCMGGMNQ

SEQ ID NO: 1267003 - protein, 9 aa, Homo Sapiens
LLTNRLYLP

SEQ ID NO: 1267004 - protein, 9 aa, Homo Sapiens
PQHKLEIFP

SEQ ID NO: 1267005 - protein, 9 aa, Homo Sapiens
EGRPPALPL

SEQ ID NO: 1267006 - protein, 9 aa, Homo Sapiens
PLDLPFPSH

SEQ ID NO: 1267007 - protein, 9 aa, Homo Sapiens
LIPPTVHNL

SEQ ID NO: 1267008 - protein, 9 aa, Homo Sapiens
FLLPPGFSC

SEQ ID NO: 1267009 - protein, 9 aa, Homo Sapiens
PTPFGPITV

SEQ ID NO: 1267010 - protein, 9 aa, Homo Sapiens
AHMLLNKKY

SEQ ID NO: 1267011 - protein, 9 aa, Homo Sapiens
SKDLSEQLE

SEQ ID NO: 1267012 - protein, 9 aa, Homo Sapiens
MNQRPILTI

SEQ ID NO: 1267013 - protein, 9 aa, Homo Sapiens
RLYLPFMMM

SEQ ID NO: 1267014 - protein, 9 aa, Homo Sapiens
PPTVTPIPS

SEQ ID NO: 1267015 - protein, 9 aa, Homo Sapiens
TSNAETPTE

SEQ ID NO: 1267016 - protein, 9 aa, Homo Sapiens
RESCSGQSS

SEQ ID NO: 1267017 - protein, 9 aa, Homo Sapiens
TVHNLELYE

SEQ ID NO: 1267018 - protein, 9 aa, Homo Sapiens
LGSVAHMLL

SEQ ID NO: 1267019 - protein, 9 aa, Homo Sapiens
SLPTPGRVL

SEQ ID NO: 1267020 - protein, 9 aa, Homo Sapiens
KQKRKKRAK

SEQ ID NO: 1267021 - protein, 9 aa, Homo Sapiens
VQTVLEGDK

SEQ ID NO: 1267022 - protein, 9 aa, Homo Sapiens
SCSGQSSGY

SEQ ID NO: 1267023 - protein, 9 aa, Homo Sapiens
PTVTPIPSL

SEQ ID NO: 1267024 - protein, 9 aa, Homo Sapiens
FWLIPPTVH

SEQ ID NO: 1267025 - protein, 9 aa, Homo Sapiens
GLGSVAHML

SEQ ID NO: 1267026 - protein, 9 aa, Homo Sapiens
PMKGCSRSF

SEQ ID NO: 1267027 - protein, 9 aa, Homo Sapiens
IQAFSRAHQ

SEQ ID NO: 1267028 - protein, 9 aa, Homo Sapiens
LREDWSVYP

SEQ ID NO: 1267029 - protein, 9 aa, Homo Sapiens
DKMETPVTL

SEQ ID NO: 1267030 - protein, 9 aa, Homo Sapiens
PVQKPLDLP

SEQ ID NO: 1267031 - protein, 9 aa, Homo Sapiens
LQLKLQKIE

SEQ ID NO: 1267032 - protein, 9 aa, Homo Sapiens
LKMWWKKRT

SEQ ID NO: 1267033 - protein, 9 aa, Homo Sapiens
PITVRPPMY

SEQ ID NO: 1267034 - protein, 9 aa, Homo Sapiens
RAHQIGQNK

SEQ ID NO: 1267035 - protein, 9 aa, Homo Sapiens
ESKDLSEQL

SEQ ID NO: 1267036 - protein, 9 aa, Homo Sapiens
GFSCKAGCS

SEQ ID NO: 1267037 - protein, 9 aa, Homo Sapiens
KRAETLTQD

SEQ ID NO: 1267038 - protein, 9 aa, Homo Sapiens
SNAETPTES

SEQ ID NO: 1267039 - protein, 9 aa, Homo Sapiens
CKAGCSDPY

SEQ ID NO: 1267040 - protein, 9 aa, Homo Sapiens
SRAHQIGQN

SEQ ID NO: 1267041 - protein, 9 aa, Homo Sapiens
PPKPLKTSN

SEQ ID NO: 1267042 - protein, 9 aa, Homo Sapiens
LLNKKYGSY

SEQ ID NO: 1267043 - protein, 9 aa, Homo Sapiens
LGHRESCSG

SEQ ID NO: 1267044 - protein, 9 aa, Homo Sapiens
PHFLKMWWK

SEQ ID NO: 1267045 - protein, 9 aa, Homo Sapiens
ITLHDEEAN

SEQ ID NO: 1267046 - protein, 9 aa, Homo Sapiens
QIGQNKKVM

SEQ ID NO: 1267047 - protein, 9 aa, Homo Sapiens
IPPTVHNLE

SEQ ID NO: 1267048 - protein, 9 aa, Homo Sapiens
LLLLILCLL

SEQ ID NO: 1267049 - protein, 9 aa, Homo Sapiens
SAFISEASA

SEQ ID NO: 1267050 - protein, 9 aa, Homo Sapiens
SSEGRPPAL

SEQ ID NO: 1267051 - protein, 9 aa, Homo Sapiens
CSGQSSGYG

SEQ ID NO: 1267052 - protein, 9 aa, Homo Sapiens
LSEITEKEK

SEQ ID NO: 1267053 - protein, 9 aa, Homo Sapiens
QRKAKRAET

SEQ ID NO: 1267054 - protein, 9 aa, Homo Sapiens
HRESCSGQS

SEQ ID NO: 1267055 - protein, 9 aa, Homo Sapiens
SQPDPSSEG

SEQ ID NO: 1267056 - protein, 9 aa, Homo Sapiens
VVCFFFVWS

SEQ ID NO: 1267057 - protein, 9 aa, Homo Sapiens
APPTVTPIP

SEQ ID NO: 1267058 - protein, 9 aa, Homo Sapiens
NHLLTNRLY

SEQ ID NO: 1267059 - protein, 9 aa, Homo Sapiens
QHKLEIFPH

SEQ ID NO: 1267060 - protein, 9 aa, Homo Sapiens
KGCSRSFSY

SEQ ID NO: 1267061 - protein, 9 aa, Homo Sapiens
TKEESTEKL

SEQ ID NO: 1267062 - protein, 9 aa, Homo Sapiens
RVLSAPEVA

SEQ ID NO: 1267063 - protein, 9 aa, Homo Sapiens
LLPPGFSCK

SEQ ID NO: 1267064 - protein, 9 aa, Homo Sapiens
QLKLQKIEW

SEQ ID NO: 1267065 - protein, 9 aa, Homo Sapiens
LYLPFMMMP

SEQ ID NO: 1267066 - protein, 9 aa, Homo Sapiens
FLKMWWKKR

SEQ ID NO: 1267067 - protein, 9 aa, Homo Sapiens
SGYLTANVD

SEQ ID NO: 1267068 - protein, 9 aa, Homo Sapiens
RSFSYASTR

SEQ ID NO: 1267069 - protein, 9 aa, Homo Sapiens
NAETPTESV

SEQ ID NO: 1267070 - protein, 9 aa, Homo Sapiens
NRLYLPFMM

SEQ ID NO: 1267071 - protein, 9 aa, Homo Sapiens
GSVAHMLLN

SEQ ID NO: 1267072 - protein, 9 aa, Homo Sapiens
KAKRAETLT

SEQ ID NO: 1267073 - protein, 9 aa, Homo Sapiens
VKTQRKAKR

SEQ ID NO: 1267074 - protein, 9 aa, Homo Sapiens
SMDVLTGTN

SEQ ID NO: 1267075 - protein, 9 aa, Homo Sapiens
KTVTITKEE

SEQ ID NO: 1267076 - protein, 9 aa, Homo Sapiens
FISEASAPR

SEQ ID NO: 1267077 - protein, 9 aa, Homo Sapiens
AKRAETLTQ

SEQ ID NO: 1267078 - protein, 9 aa, Homo Sapiens
LTQRPDPCT

SEQ ID NO: 1267079 - protein, 9 aa, Homo Sapiens
IPVQKPLDL

SEQ ID NO: 1267080 - protein, 9 aa, Homo Sapiens
YLTANVDRR

SEQ ID NO: 1267081 - protein, 9 aa, Homo Sapiens
SEITEKEKD

SEQ ID NO: 1267082 - protein, 9 aa, Homo Sapiens
GPITVRPPM

SEQ ID NO: 1267083 - protein, 9 aa, Homo Sapiens
LEAVVCFFF

SEQ ID NO: 1267084 - protein, 9 aa, Homo Sapiens
RAETLTQDY

SEQ ID NO: 1267085 - protein, 9 aa, Homo Sapiens
QKRKKRAKE

SEQ ID NO: 1267086 - protein, 9 aa, Homo Sapiens
LEGDKMETP

SEQ ID NO: 1267087 - protein, 9 aa, Homo Sapiens
HITLHDEEA

SEQ ID NO: 1267088 - protein, 9 aa, Homo Sapiens
PFGPITVRP

SEQ ID NO: 1267089 - protein, 9 aa, Homo Sapiens
CFFFVWSIV

SEQ ID NO: 1267090 - protein, 9 aa, Homo Sapiens
PYSPLREDW

SEQ ID NO: 1267091 - protein, 9 aa, Homo Sapiens
GRVLSAPEV

SEQ ID NO: 1267092 - protein, 9 aa, Homo Sapiens
LPTPGRVLS

SEQ ID NO: 1267093 - protein, 9 aa, Homo Sapiens
DPLSEITEK

SEQ ID NO: 1267094 - protein, 9 aa, Homo Sapiens
REAAKKKQK

SEQ ID NO: 1267095 - protein, 9 aa, Homo Sapiens
SFVQKPDSM

SEQ ID NO: 1267096 - protein, 9 aa, Homo Sapiens
LSGYLTANV

SEQ ID NO: 1267097 - protein, 9 aa, Homo Sapiens
LEIFPHFLK

SEQ ID NO: 1267098 - protein, 9 aa, Homo Sapiens
EAAKKKQKR

SEQ ID NO: 1267099 - protein, 9 aa, Homo Sapiens
MKGCSRSFS

SEQ ID NO: 1267100 - protein, 9 aa, Homo Sapiens
KKTKLQLKL

SEQ ID NO: 1267101 - protein, 9 aa, Homo Sapiens
TPGRVLSAP

SEQ ID NO: 1267102 - protein, 9 aa, Homo Sapiens
SGLGHRESC

SEQ ID NO: 1267103 - protein, 9 aa, Homo Sapiens
FHKGSYLWN

SEQ ID NO: 1267104 - protein, 9 aa, Homo Sapiens
LIPVQKPLD

SEQ ID NO: 1267105 - protein, 9 aa, Homo Sapiens
VRPPMYEDY

SEQ ID NO: 1267106 - protein, 9 aa, Homo Sapiens
EAVVCFFFV

SEQ ID NO: 1267107 - protein, 9 aa, Homo Sapiens
YSPLREDWS

SEQ ID NO: 1267108 - protein, 9 aa, Homo Sapiens
SPYSPLRED

SEQ ID NO: 1267109 - protein, 9 aa, Homo Sapiens
GSPYSPLRE

SEQ ID NO: 1267110 - protein, 9 aa, Homo Sapiens
HKGSYLWNG

SEQ ID NO: 1267111 - protein, 9 aa, Homo Sapiens
AFSRAHQIG

SEQ ID NO: 1267112 - protein, 9 aa, Homo Sapiens
ESCSGQSSG

SEQ ID NO: 1267113 - protein, 9 aa, Homo Sapiens
PLSEITEKE

SEQ ID NO: 1267114 - protein, 9 aa, Homo Sapiens
LTNRLYLPF

SEQ ID NO: 1267115 - protein, 9 aa, Homo Sapiens
TKKTKLQLK

SEQ ID NO: 1267116 - protein, 9 aa, Homo Sapiens
SRSFSYAST

SEQ ID NO: 1267117 - protein, 9 aa, Homo Sapiens
CTLDVEWRS

SEQ ID NO: 1267118 - protein, 9 aa, Homo Sapiens
MGGMNQRPI

SEQ ID NO: 1267119 - protein, 9 aa, Homo Sapiens
FSRAHQIGQ

SEQ ID NO: 1267120 - protein, 9 aa, Homo Sapiens
VLEGDKMET

SEQ ID NO: 1267121 - protein, 9 aa, Homo Sapiens
VAPPTVTPI

SEQ ID NO: 1267122 - protein, 9 aa, Homo Sapiens
KEKDFLWSH

SEQ ID NO: 1267123 - protein, 9 aa, Homo Sapiens
GMNQRPILT

SEQ ID NO: 1267124 - protein, 9 aa, Homo Sapiens
LTANVDRRP

SEQ ID NO: 1267125 - protein, 9 aa, Homo Sapiens
VQKPDSMDV

SEQ ID NO: 1267126 - protein, 9 aa, Homo Sapiens
LLILCLLRI

SEQ ID NO: 1267127 - protein, 9 aa, Homo Sapiens
RPDPCTLDV

SEQ ID NO: 1267128 - protein, 9 aa, Homo Sapiens
ESAFISEAS

SEQ ID NO: 1267129 - protein, 9 aa, Homo Sapiens
QAFSRAHQI

SEQ ID NO: 1267130 - protein, 9 aa, Homo Sapiens
LKTSNAETP

SEQ ID NO: 1267131 - protein, 9 aa, Homo Sapiens
TEKEKDFLW

SEQ ID NO: 1267132 - protein, 9 aa, Homo Sapiens
AHQIGQNKK

SEQ ID NO: 1267133 - protein, 9 aa, Homo Sapiens
FPHFLKMWW

SEQ ID NO: 1267134 - protein, 9 aa, Homo Sapiens
TVTPIPSLE

SEQ ID NO: 1267135 - protein, 9 aa, Homo Sapiens
EASAPRQGN

SEQ ID NO: 1267136 - protein, 9 aa, Homo Sapiens
CMGGMNQRP

SEQ ID NO: 1267137 - protein, 9 aa, Homo Sapiens
HQIGQNKKV

SEQ ID NO: 1267138 - protein, 9 aa, Homo Sapiens
TQLIPVQKP

SEQ ID NO: 1267139 - protein, 9 aa, Homo Sapiens
KKQKRKKRA

SEQ ID NO: 1267140 - protein, 9 aa, Homo Sapiens
EITEKEKDF

SEQ ID NO: 1267141 - protein, 9 aa, Homo Sapiens
AAKKKQKRK

SEQ ID NO: 1267142 - protein, 9 aa, Homo Sapiens
PGRVLSAPE

SEQ ID NO: 1267143 - protein, 9 aa, Homo Sapiens
TANVDRRPA

SEQ ID NO: 1267144 - protein, 9 aa, Homo Sapiens
KPLKTSNAE

SEQ ID NO: 1267145 - protein, 9 aa, Homo Sapiens
ISEASAPRQ

SEQ ID NO: 1267146 - protein, 9 aa, Homo Sapiens
AVVCFFFVW

SEQ ID NO: 1267147 - protein, 9 aa, Homo Sapiens
DLSEQLEQY

SEQ ID NO: 1267148 - protein, 9 aa, Homo Sapiens
VHNLELYEN

SEQ ID NO: 1267149 - protein, 9 aa, Homo Sapiens
SEASAPRQG

SEQ ID NO: 1267150 - protein, 9 aa, Homo Sapiens
HLLTNRLYL

SEQ ID NO: 1267151 - protein, 9 aa, Homo Sapiens
VFWLIPPTV

SEQ ID NO: 1267152 - protein, 9 aa, Homo Sapiens
QRPDPCTLD

SEQ ID NO: 1267153 - protein, 9 aa, Homo Sapiens
QKPDSMDVL

SEQ ID NO: 1267154 - protein, 9 aa, Homo Sapiens
PDPCTLDVE

SEQ ID NO: 1267155 - protein, 9 aa, Homo Sapiens
PCTLDVEWR

SEQ ID NO: 1267156 - protein, 9 aa, Homo Sapiens
LLSGYLTAN

SEQ ID NO: 1267157 - protein, 9 aa, Homo Sapiens
PTPGRVLSA

SEQ ID NO: 1267158 - protein, 9 aa, Homo Sapiens
SYLWNGWNV

SEQ ID NO: 1267159 - protein, 9 aa, Homo Sapiens
PGFSCKAGC

SEQ ID NO: 1267160 - protein, 9 aa, Homo Sapiens
GCSRSFSYA

SEQ ID NO: 1267161 - protein, 9 aa, Homo Sapiens
VTPIPSLEA

SEQ ID NO: 1267162 - protein, 9 aa, Homo Sapiens
VCESKDLSE

SEQ ID NO: 1267163 - protein, 9 aa, Homo Sapiens
VQKPLDLPF

SEQ ID NO: 1267164 - protein, 9 aa, Homo Sapiens
RKAKRAETL

SEQ ID NO: 1267165 - protein, 9 aa, Homo Sapiens
TNRLYLPFM

SEQ ID NO: 1267166 - protein, 9 aa, Homo Sapiens
TVTITKEES

SEQ ID NO: 1267167 - protein, 9 aa, Homo Sapiens
DEEANNDIF

SEQ ID NO: 1267168 - protein, 9 aa, Homo Sapiens
CESKDLSEQ

SEQ ID NO: 1267169 - protein, 9 aa, Homo Sapiens
LLLLLLILC

SEQ ID NO: 1267170 - protein, 9 aa, Homo Sapiens
FVQKPDSMD

SEQ ID NO: 1267171 - protein, 9 aa, Homo Sapiens
FSYASTRSS

SEQ ID NO: 1267172 - protein, 9 aa, Homo Sapiens
WLIPPTVHN

SEQ ID NO: 1267173 - protein, 9 aa, Homo Sapiens
KLQKIEWEK

SEQ ID NO: 1267174 - protein, 9 aa, Homo Sapiens
YLPFMMMPH

SEQ ID NO: 1267175 - protein, 9 aa, Homo Sapiens
KKKQKRKKR

SEQ ID NO: 1267176 - protein, 9 aa, Homo Sapiens
VFHKGSYLW

SEQ ID NO: 1267177 - protein, 9 aa, Homo Sapiens
QTVLEGDKM

SEQ ID NO: 1267178 - protein, 9 aa, Homo Sapiens
SAPRQGNMY

SEQ ID NO: 1267179 - protein, 9 aa, Homo Sapiens
PDSMDVLTG

SEQ ID NO: 1267180 - protein, 9 aa, Homo Sapiens
WKSSLTCHH

SEQ ID NO: 1267181 - protein, 9 aa, Homo Sapiens
QLIPVQKPL

SEQ ID NO: 1267182 - protein, 9 aa, Homo Sapiens
DPSSEGRPP

SEQ ID NO: 1267183 - protein, 9 aa, Homo Sapiens
FSCKAGCSD

SEQ ID NO: 1267184 - protein, 9 aa, Homo Sapiens
HDEEANNDI

SEQ ID NO: 1267185 - protein, 9 aa, Homo Sapiens
PLREDWSVY

SEQ ID NO: 1267186 - protein, 9 aa, Homo Sapiens
VCFFFVWSI

SEQ ID NO: 1267187 - protein, 9 aa, Homo Sapiens
KPLDLPFPS

SEQ ID NO: 1267188 - protein, 9 aa, Homo Sapiens
QRPILTIIT

SEQ ID NO: 1267189 - protein, 9 aa, Homo Sapiens
TITKEESTE

SEQ ID NO: 1267190 - protein, 9 aa, Homo Sapiens
HKLEIFPHF

SEQ ID NO: 1267191 - protein, 9 aa, Homo Sapiens
GLGHRESCS

SEQ ID NO: 1267192 - protein, 9 aa, Homo Sapiens
KGSYLWNGW

SEQ ID NO: 1267193 - protein, 9 aa, Homo Sapiens
PKPLKTSNA

SEQ ID NO: 1267194 - protein, 9 aa, Homo Sapiens
VHITLHDEE

SEQ ID NO: 1267195 - protein, 9 aa, Homo Sapiens
PTVHNLELY

SEQ ID NO: 1267196 - protein, 9 aa, Homo Sapiens
TQRPDPCTL

SEQ ID NO: 1267197 - protein, 9 aa, Homo Sapiens
TQRKAKRAE

SEQ ID NO: 1267198 - protein, 9 aa, Homo Sapiens
YLWNGWNVM

SEQ ID NO: 1267199 - protein, 9 aa, Homo Sapiens
EESTEKLSS

SEQ ID NO: 1267200 - protein, 9 aa, Homo Sapiens
QKPLDLPFP

SEQ ID NO: 1267201 - protein, 9 aa, Homo Sapiens
KPDSMDVLT

SEQ ID NO: 1267202 - protein, 9 aa, Homo Sapiens
HMLLNKKYG

SEQ ID NO: 1267203 - protein, 9 aa, Homo Sapiens
SFSYASTRS

SEQ ID NO: 1267204 - protein, 9 aa, Homo Sapiens
PGCDCKGNR

SEQ ID NO: 1267205 - protein, 9 aa, Homo Sapiens
TNHLKSTPV

SEQ ID NO: 1267206 - protein, 9 aa, Homo Sapiens
HLLEALSTT

SEQ ID NO: 1267207 - protein, 9 aa, Homo Sapiens
WVPCVWSSN

SEQ ID NO: 1267208 - protein, 9 aa, Homo Sapiens
RLHYFRVPR

SEQ ID NO: 1267209 - protein, 9 aa, Homo Sapiens
CVKVKIYLI

SEQ ID NO: 1267210 - protein, 9 aa, Homo Sapiens
MTPTVFSSH

SEQ ID NO: 1267211 - protein, 9 aa, Homo Sapiens
LQGSVRKAL

SEQ ID NO: 1267212 - protein, 9 aa, Homo Sapiens
CKEAINVLS

SEQ ID NO: 1267213 - protein, 9 aa, Homo Sapiens
YTLTLGGIP

SEQ ID NO: 1267214 - protein, 9 aa, Homo Sapiens
IETEDESMP

SEQ ID NO: 1267215 - protein, 9 aa, Homo Sapiens
RHGAPASKL

SEQ ID NO: 1267216 - protein, 9 aa, Homo Sapiens
EETLRKNTE

SEQ ID NO: 1267217 - protein, 9 aa, Homo Sapiens
SCRLGRRSW

SEQ ID NO: 1267218 - protein, 9 aa, Homo Sapiens
PRHGAPASK

SEQ ID NO: 1267219 - protein, 9 aa, Homo Sapiens
GQPGPAWRS

SEQ ID NO: 1267220 - protein, 9 aa, Homo Sapiens
ETTFHFHGK

SEQ ID NO: 1267221 - protein, 9 aa, Homo Sapiens
SSHHTAGGM

SEQ ID NO: 1267222 - protein, 9 aa, Homo Sapiens
VVRSRKSQG

SEQ ID NO: 1267223 - protein, 9 aa, Homo Sapiens
RLLQGRHPA

SEQ ID NO: 1267224 - protein, 9 aa, Homo Sapiens
PHRTLVMPV

SEQ ID NO: 1267225 - protein, 9 aa, Homo Sapiens
ASVCHEDCG

SEQ ID NO: 1267226 - protein, 9 aa, Homo Sapiens
KTLDPLYQL

SEQ ID NO: 1267227 - protein, 9 aa, Homo Sapiens
RRNLDSERP

SEQ ID NO: 1267228 - protein, 9 aa, Homo Sapiens
TPACGSTNH

SEQ ID NO: 1267229 - protein, 9 aa, Homo Sapiens
TLPNMKVPH

SEQ ID NO: 1267230 - protein, 9 aa, Homo Sapiens
VAEVDAAMC

SEQ ID NO: 1267231 - protein, 9 aa, Homo Sapiens
RHYWSLDSK

SEQ ID NO: 1267232 - protein, 9 aa, Homo Sapiens
NSDLPCYEF

SEQ ID NO: 1267233 - protein, 9 aa, Homo Sapiens
KLAQGAYGT

SEQ ID NO: 1267234 - protein, 9 aa, Homo Sapiens
RDPLSKITE

SEQ ID NO: 1267235 - protein, 9 aa, Homo Sapiens
VQDKPSVSH

SEQ ID NO: 1267236 - protein, 9 aa, Homo Sapiens
FVTYSCVAE

SEQ ID NO: 1267237 - protein, 9 aa, Homo Sapiens
PGPAWRSSV

SEQ ID NO: 1267238 - protein, 9 aa, Homo Sapiens
RSWRQSGQP

SEQ ID NO: 1267239 - protein, 9 aa, Homo Sapiens
NMKVPHRTL

SEQ ID NO: 1267240 - protein, 9 aa, Homo Sapiens
NTRRRVDWL

SEQ ID NO: 1267241 - protein, 9 aa, Homo Sapiens
CVAEVDAAM

SEQ ID NO: 1267242 - protein, 9 aa, Homo Sapiens
AREAPLCSY

SEQ ID NO: 1267243 - protein, 9 aa, Homo Sapiens
PSQESEVEE

SEQ ID NO: 1267244 - protein, 9 aa, Homo Sapiens
LVMPVKQKV

SEQ ID NO: 1267245 - protein, 9 aa, Homo Sapiens
GSTTASPLG

SEQ ID NO: 1267246 - protein, 9 aa, Homo Sapiens
LQLLYESKL

SEQ ID NO: 1267247 - protein, 9 aa, Homo Sapiens
VFSSHHTAG

SEQ ID NO: 1267248 - protein, 9 aa, Homo Sapiens
FTAQENCFQ

SEQ ID NO: 1267249 - protein, 9 aa, Homo Sapiens
KIYLIQLEQ

SEQ ID NO: 1267250 - protein, 9 aa, Homo Sapiens
SSVQRRRGS

SEQ ID NO: 1267251 - protein, 9 aa, Homo Sapiens
EAINVLSHL

SEQ ID NO: 1267252 - protein, 9 aa, Homo Sapiens
WASVEPYSA

SEQ ID NO: 1267253 - protein, 9 aa, Homo Sapiens
PVLWTVCAV

SEQ ID NO: 1267254 - protein, 9 aa, Homo Sapiens
RILMGSMLR

SEQ ID NO: 1267255 - protein, 9 aa, Homo Sapiens
PFLPDASMK

SEQ ID NO: 1267256 - protein, 9 aa, Homo Sapiens
PKLKEIQVR

SEQ ID NO: 1267257 - protein, 9 aa, Homo Sapiens
SVEPYSADI

SEQ ID NO: 1267258 - protein, 9 aa, Homo Sapiens
YNCKEAINV

SEQ ID NO: 1267259 - protein, 9 aa, Homo Sapiens
FRGALQPHP

SEQ ID NO: 1267260 - protein, 9 aa, Homo Sapiens
EGQRLLQGR

SEQ ID NO: 1267261 - protein, 9 aa, Homo Sapiens
AWSAREAPL

SEQ ID NO: 1267262 - protein, 9 aa, Homo Sapiens
SVQRRRGSW

SEQ ID NO: 1267263 - protein, 9 aa, Homo Sapiens
TTFHFHGKD

SEQ ID NO: 1267264 - protein, 9 aa, Homo Sapiens
ADRCTLPNM

SEQ ID NO: 1267265 - protein, 9 aa, Homo Sapiens
PPSQESEVE

SEQ ID NO: 1267266 - protein, 9 aa, Homo Sapiens
PDASMKKEL

SEQ ID NO: 1267267 - protein, 9 aa, Homo Sapiens
LNTRRRVDW

SEQ ID NO: 1267268 - protein, 9 aa, Homo Sapiens
EEQLPGRTP

SEQ ID NO: 1267269 - protein, 9 aa, Homo Sapiens
KQKVQRGVR

SEQ ID NO: 1267270 - protein, 9 aa, Homo Sapiens
HGAPASKLP

SEQ ID NO: 1267271 - protein, 9 aa, Homo Sapiens
LCNRGPSAH

SEQ ID NO: 1267272 - protein, 9 aa, Homo Sapiens
NTKLEEQVQ

SEQ ID NO: 1267273 - protein, 9 aa, Homo Sapiens
VQRGVRCQN

SEQ ID NO: 1267274 - protein, 9 aa, Homo Sapiens
SGEARDSVD

SEQ ID NO: 1267275 - protein, 9 aa, Homo Sapiens
FSGDSEYID

SEQ ID NO: 1267276 - protein, 9 aa, Homo Sapiens
KVKIYLIQL

SEQ ID NO: 1267277 - protein, 9 aa, Homo Sapiens
GTAVDLESL

SEQ ID NO: 1267278 - protein, 9 aa, Homo Sapiens
ITCETTFHF

SEQ ID NO: 1267279 - protein, 9 aa, Homo Sapiens
NGTCYLEFQ

SEQ ID NO: 1267280 - protein, 9 aa, Homo Sapiens
SPLGPESTT

SEQ ID NO: 1267281 - protein, 9 aa, Homo Sapiens
PVKQKVQRG

SEQ ID NO: 1267282 - protein, 9 aa, Homo Sapiens
TVCAVRVTV

SEQ ID NO: 1267283 - protein, 9 aa, Homo Sapiens
KRAWAPLDE

SEQ ID NO: 1267284 - protein, 9 aa, Homo Sapiens
VPCVWSSNL

SEQ ID NO: 1267285 - protein, 9 aa, Homo Sapiens
CETTFHFHG

SEQ ID NO: 1267286 - protein, 9 aa, Homo Sapiens
YQLSLVFDE

SEQ ID NO: 1267287 - protein, 9 aa, Homo Sapiens
SWKRSWRQS

SEQ ID NO: 1267288 - protein, 9 aa, Homo Sapiens
RLGRRSWKR

SEQ ID NO: 1267289 - protein, 9 aa, Homo Sapiens
NHLKSTPVA

SEQ ID NO: 1267290 - protein, 9 aa, Homo Sapiens
QVCNSDLPC

SEQ ID NO: 1267291 - protein, 9 aa, Homo Sapiens
RMLQNFLLC

SEQ ID NO: 1267292 - protein, 9 aa, Homo Sapiens
GQVRRPEIG

SEQ ID NO: 1267293 - protein, 9 aa, Homo Sapiens
LHSPSRDTT

SEQ ID NO: 1267294 - protein, 9 aa, Homo Sapiens
LAGTFTAQE

SEQ ID NO: 1267295 - protein, 9 aa, Homo Sapiens
NRGPSAHSA

SEQ ID NO: 1267296 - protein, 9 aa, Homo Sapiens
EDEQLLGPR

SEQ ID NO: 1267297 - protein, 9 aa, Homo Sapiens
KVKHLQLLY

SEQ ID NO: 1267298 - protein, 9 aa, Homo Sapiens
PADPVVRSR

SEQ ID NO: 1267299 - protein, 9 aa, Homo Sapiens
QNFLLCQPQ

SEQ ID NO: 1267300 - protein, 9 aa, Homo Sapiens
LQPHPEGAA

SEQ ID NO: 1267301 - protein, 9 aa, Homo Sapiens
SLRLAGTFT

SEQ ID NO: 1267302 - protein, 9 aa, Homo Sapiens
KALHSPSRD

SEQ ID NO: 1267303 - protein, 9 aa, Homo Sapiens
QKDQLAILL

SEQ ID NO: 1267304 - protein, 9 aa, Homo Sapiens
KALVSFYDY

SEQ ID NO: 1267305 - protein, 9 aa, Homo Sapiens
RRSWKRSWR

SEQ ID NO: 1267306 - protein, 9 aa, Homo Sapiens
FWASVEPYS

SEQ ID NO: 1267307 - protein, 9 aa, Homo Sapiens
AQGAYGTAV

SEQ ID NO: 1267308 - protein, 9 aa, Homo Sapiens
KTAYRQYLY

SEQ ID NO: 1267309 - protein, 9 aa, Homo Sapiens
SEYIDFLHS

SEQ ID NO: 1267310 - protein, 9 aa, Homo Sapiens
ASVEPYSAD

SEQ ID NO: 1267311 - protein, 9 aa, Homo Sapiens
RYVSGRLHY

SEQ ID NO: 1267312 - protein, 9 aa, Homo Sapiens
DRARRFEET

SEQ ID NO: 1267313 - protein, 9 aa, Homo Sapiens
YRRILMGSM

SEQ ID NO: 1267314 - protein, 9 aa, Homo Sapiens
LCVQALASV

SEQ ID NO: 1267315 - protein, 9 aa, Homo Sapiens
VKHLQLLYE

SEQ ID NO: 1267316 - protein, 9 aa, Homo Sapiens
VKIYLIQLE

SEQ ID NO: 1267317 - protein, 9 aa, Homo Sapiens
DEWIHTLNH

SEQ ID NO: 1267318 - protein, 9 aa, Homo Sapiens
KPKLKEIQV

SEQ ID NO: 1267319 - protein, 9 aa, Homo Sapiens
TLDPLYQLS

SEQ ID NO: 1267320 - protein, 9 aa, Homo Sapiens
VMPVKQKVQ

SEQ ID NO: 1267321 - protein, 9 aa, Homo Sapiens
GPSAHSAHS

SEQ ID NO: 1267322 - protein, 9 aa, Homo Sapiens
RLFNTQCVK

SEQ ID NO: 1267323 - protein, 9 aa, Homo Sapiens
AWDESLVPK

SEQ ID NO: 1267324 - protein, 9 aa, Homo Sapiens
FLPDASMKK

SEQ ID NO: 1267325 - protein, 9 aa, Homo Sapiens
SVRKALHSP

SEQ ID NO: 1267326 - protein, 9 aa, Homo Sapiens
WKRSWRQSG

SEQ ID NO: 1267327 - protein, 9 aa, Homo Sapiens
PLGKESADS

SEQ ID NO: 1267328 - protein, 9 aa, Homo Sapiens
KGNRPAEPP

SEQ ID NO: 1267329 - protein, 9 aa, Homo Sapiens
APFRYVSGR

SEQ ID NO: 1267330 - protein, 9 aa, Homo Sapiens
KKPKLKEIQ

SEQ ID NO: 1267331 - protein, 9 aa, Homo Sapiens
ASMKKELIF

SEQ ID NO: 1267332 - protein, 9 aa, Homo Sapiens
PASKLPVPS

SEQ ID NO: 1267333 - protein, 9 aa, Homo Sapiens
LPNMKVPHR

SEQ ID NO: 1267334 - protein, 9 aa, Homo Sapiens
GMFSGDSEY

SEQ ID NO: 1267335 - protein, 9 aa, Homo Sapiens
LGMNRLTQV

SEQ ID NO: 1267336 - protein, 9 aa, Homo Sapiens
RKKPKLKEI

SEQ ID NO: 1267337 - protein, 9 aa, Homo Sapiens
ARRFEETLR

SEQ ID NO: 1267338 - protein, 9 aa, Homo Sapiens
SRSCRLGRR

SEQ ID NO: 1267339 - protein, 9 aa, Homo Sapiens
PCVWSSNLA

SEQ ID NO: 1267340 - protein, 9 aa, Homo Sapiens
CGSTNHLKS

SEQ ID NO: 1267341 - protein, 9 aa, Homo Sapiens
TCETTFHFH

SEQ ID NO: 1267342 - protein, 9 aa, Homo Sapiens
RRFEETLRK

SEQ ID NO: 1267343 - protein, 9 aa, Homo Sapiens
HHTAGGMTP

SEQ ID NO: 1267344 - protein, 9 aa, Homo Sapiens
FLILLGSTK

SEQ ID NO: 1267345 - protein, 9 aa, Homo Sapiens
CNRGPSAHS

SEQ ID NO: 1267346 - protein, 9 aa, Homo Sapiens
TCYLEFQKD

SEQ ID NO: 1267347 - protein, 9 aa, Homo Sapiens
EDESMPEVV

SEQ ID NO: 1267348 - protein, 9 aa, Homo Sapiens
TLGGIPGYI

SEQ ID NO: 1267349 - protein, 9 aa, Homo Sapiens
SADITSEEV

SEQ ID NO: 1267350 - protein, 9 aa, Homo Sapiens
SERPTYTNL

SEQ ID NO: 1267351 - protein, 9 aa, Homo Sapiens
LLQGRHPAS

SEQ ID NO: 1267352 - protein, 9 aa, Homo Sapiens
TPGILLQDG

SEQ ID NO: 1267353 - protein, 9 aa, Homo Sapiens
ESMPEVVEK

SEQ ID NO: 1267354 - protein, 9 aa, Homo Sapiens
SLDSKCITL

SEQ ID NO: 1267355 - protein, 9 aa, Homo Sapiens
QVRRPEIGD

SEQ ID NO: 1267356 - protein, 9 aa, Homo Sapiens
FPQEIQYWG

SEQ ID NO: 1267357 - protein, 9 aa, Homo Sapiens
YDYQIFQEL

SEQ ID NO: 1267358 - protein, 9 aa, Homo Sapiens
EFQKDQLAI

SEQ ID NO: 1267359 - protein, 9 aa, Homo Sapiens
SASGEARDS

SEQ ID NO: 1267360 - protein, 9 aa, Homo Sapiens
IQVRLEEHL

SEQ ID NO: 1267361 - protein, 9 aa, Homo Sapiens
KRHYWSLDS

SEQ ID NO: 1267362 - protein, 9 aa, Homo Sapiens
GSASGEARD

SEQ ID NO: 1267363 - protein, 9 aa, Homo Sapiens
PANRRTTPI

SEQ ID NO: 1267364 - protein, 9 aa, Homo Sapiens
PYSADITSE

SEQ ID NO: 1267365 - protein, 9 aa, Homo Sapiens
MPFSPGSRV

SEQ ID NO: 1267366 - protein, 9 aa, Homo Sapiens
AINVLSHLP

SEQ ID NO: 1267367 - protein, 9 aa, Homo Sapiens
WPVLWTVCA

SEQ ID NO: 1267368 - protein, 9 aa, Homo Sapiens
GAYGTAVDL

SEQ ID NO: 1267369 - protein, 9 aa, Homo Sapiens
PLSKITEQE

SEQ ID NO: 1267370 - protein, 9 aa, Homo Sapiens
EPYSADITS

SEQ ID NO: 1267371 - protein, 9 aa, Homo Sapiens
YWSLDSKCI

SEQ ID NO: 1267372 - protein, 9 aa, Homo Sapiens
EQLPGRTPG

SEQ ID NO: 1267373 - protein, 9 aa, Homo Sapiens
ASPLGPEST

SEQ ID NO: 1267374 - protein, 9 aa, Homo Sapiens
GDITCETTF

SEQ ID NO: 1267375 - protein, 9 aa, Homo Sapiens
GLGGEAVGT

SEQ ID NO: 1267376 - protein, 9 aa, Homo Sapiens
VEALPLLEA

SEQ ID NO: 1267377 - protein, 9 aa, Homo Sapiens
LLEALSTTW

SEQ ID NO: 1267378 - protein, 9 aa, Homo Sapiens
YNVKTAYRQ

SEQ ID NO: 1267379 - protein, 9 aa, Homo Sapiens
VAIKKMNLQ

SEQ ID NO: 1267380 - protein, 9 aa, Homo Sapiens
KYWVPCVWS

SEQ ID NO: 1267381 - protein, 9 aa, Homo Sapiens
QYLYGFEEY

SEQ ID NO: 1267382 - protein, 9 aa, Homo Sapiens
GTCYLEFQK

SEQ ID NO: 1267383 - protein, 9 aa, Homo Sapiens
MKVPHRTLV

SEQ ID NO: 1267384 - protein, 9 aa, Homo Sapiens
TYSCVAEVD

SEQ ID NO: 1267385 - protein, 9 aa, Homo Sapiens
LSFRMLQNF

SEQ ID NO: 1267386 - protein, 9 aa, Homo Sapiens
GGEAVGTGE

SEQ ID NO: 1267387 - protein, 9 aa, Homo Sapiens
EALPLLEAI

SEQ ID NO: 1267388 - protein, 9 aa, Homo Sapiens
ILMGSMLRK

SEQ ID NO: 1267389 - protein, 9 aa, Homo Sapiens
DEQLLGPRC

SEQ ID NO: 1267390 - protein, 9 aa, Homo Sapiens
LASVCHEDC

SEQ ID NO: 1267391 - protein, 9 aa, Homo Sapiens
VRCQNIQVR

SEQ ID NO: 1267392 - protein, 9 aa, Homo Sapiens
TEDESMPEV

SEQ ID NO: 1267393 - protein, 9 aa, Homo Sapiens
DPLYQLSLV

SEQ ID NO: 1267394 - protein, 9 aa, Homo Sapiens
SAREAPLCS

SEQ ID NO: 1267395 - protein, 9 aa, Homo Sapiens
YSCVAEVDA

SEQ ID NO: 1267396 - protein, 9 aa, Homo Sapiens
RFEETLRKN

SEQ ID NO: 1267397 - protein, 9 aa, Homo Sapiens
VCAVRVTVD

SEQ ID NO: 1267398 - protein, 9 aa, Homo Sapiens
ETEDESMPE

SEQ ID NO: 1267399 - protein, 9 aa, Homo Sapiens
LMGSMLRKR

SEQ ID NO: 1267400 - protein, 9 aa, Homo Sapiens
WTVCAVRVT

SEQ ID NO: 1267401 - protein, 9 aa, Homo Sapiens
ENTKLEEQV

SEQ ID NO: 1267402 - protein, 9 aa, Homo Sapiens
DESLVPKHP

SEQ ID NO: 1267403 - protein, 9 aa, Homo Sapiens
KVQRGVRCQ

SEQ ID NO: 1267404 - protein, 9 aa, Homo Sapiens
IYLIQLEQY

SEQ ID NO: 1267405 - protein, 9 aa, Homo Sapiens
SLQDLENTK

SEQ ID NO: 1267406 - protein, 9 aa, Homo Sapiens
VEPYSADIT

SEQ ID NO: 1267407 - protein, 9 aa, Homo Sapiens
MPVKQKVQR

SEQ ID NO: 1267408 - protein, 9 aa, Homo Sapiens
HPGLGGEAV

SEQ ID NO: 1267409 - protein, 9 aa, Homo Sapiens
VPHRTLVMP

SEQ ID NO: 1267410 - protein, 9 aa, Homo Sapiens
LSLVFDESP

SEQ ID NO: 1267411 - protein, 9 aa, Homo Sapiens
RAWAPLDEW

SEQ ID NO: 1267412 - protein, 9 aa, Homo Sapiens
TKFFLLAVM

SEQ ID NO: 1267413 - protein, 9 aa, Homo Sapiens
SRKSQGPAK

SEQ ID NO: 1267414 - protein, 9 aa, Homo Sapiens
AIKKMNLQQ

SEQ ID NO: 1267415 - protein, 9 aa, Homo Sapiens
AYGTAVDLE

SEQ ID NO: 1267416 - protein, 9 aa, Homo Sapiens
PNMKVPHRT

SEQ ID NO: 1267417 - protein, 9 aa, Homo Sapiens
SDSLEQPRG

SEQ ID NO: 1267418 - protein, 9 aa, Homo Sapiens
PTVFSSHHT

SEQ ID NO: 1267419 - protein, 9 aa, Homo Sapiens
VKVKIYLIQ

SEQ ID NO: 1267420 - protein, 9 aa, Homo Sapiens
LLHLLEALS

SEQ ID NO: 1267421 - protein, 9 aa, Homo Sapiens
CRRNLDSER

SEQ ID NO: 1267422 - protein, 9 aa, Homo Sapiens
RVDWLTEKM

SEQ ID NO: 1267423 - protein, 9 aa, Homo Sapiens
KKMNLQQQP

SEQ ID NO: 1267424 - protein, 9 aa, Homo Sapiens
TVSTMPHTL

SEQ ID NO: 1267425 - protein, 9 aa, Homo Sapiens
YSADITSEE

SEQ ID NO: 1267426 - protein, 9 aa, Homo Sapiens
DKPSVSHMP

SEQ ID NO: 1267427 - protein, 9 aa, Homo Sapiens
INVLSHLPS

SEQ ID NO: 1267428 - protein, 9 aa, Homo Sapiens
LKALVSFYD

SEQ ID NO: 1267429 - protein, 9 aa, Homo Sapiens
QSGQPGPAW

SEQ ID NO: 1267430 - protein, 9 aa, Homo Sapiens
EPPSQESEV

SEQ ID NO: 1267431 - protein, 9 aa, Homo Sapiens
KFFLLAVMS

SEQ ID NO: 1267432 - protein, 9 aa, Homo Sapiens
FLLCQPQLG

SEQ ID NO: 1267433 - protein, 9 aa, Homo Sapiens
LPLLEAIEI

SEQ ID NO: 1267434 - protein, 9 aa, Homo Sapiens
SLVPKHPGS

SEQ ID NO: 1267435 - protein, 9 aa, Homo Sapiens
FRMLQNFLL

SEQ ID NO: 1267436 - protein, 9 aa, Homo Sapiens
QCVKVKIYL

SEQ ID NO: 1267437 - protein, 9 aa, Homo Sapiens
KCTKRAWAP

SEQ ID NO: 1267438 - protein, 9 aa, Homo Sapiens
EHPGLGGEA

SEQ ID NO: 1267439 - protein, 9 aa, Homo Sapiens
RHPASEAIQ

SEQ ID NO: 1267440 - protein, 9 aa, Homo Sapiens
IHTLNHILQ

SEQ ID NO: 1267441 - protein, 9 aa, Homo Sapiens
VRPGCDCKG

SEQ ID NO: 1267442 - protein, 9 aa, Homo Sapiens
EVAIKKMNL

SEQ ID NO: 1267443 - protein, 9 aa, Homo Sapiens
VRRPEIGDQ

SEQ ID NO: 1267444 - protein, 9 aa, Homo Sapiens
RTPGILLQD

SEQ ID NO: 1267445 - protein, 9 aa, Homo Sapiens
SCVKMPFSP

SEQ ID NO: 1267446 - protein, 9 aa, Homo Sapiens
ILKCTKRAW

SEQ ID NO: 1267447 - protein, 9 aa, Homo Sapiens
RRSRSCRLG

SEQ ID NO: 1267448 - protein, 9 aa, Homo Sapiens
LEQPRGLEG

SEQ ID NO: 1267449 - protein, 9 aa, Homo Sapiens
QEVAIKKMN

SEQ ID NO: 1267450 - protein, 9 aa, Homo Sapiens
GPAWRSSVQ

SEQ ID NO: 1267451 - protein, 9 aa, Homo Sapiens
KMNLQQQPK

SEQ ID NO: 1267452 - protein, 9 aa, Homo Sapiens
QKVKHLQLL

SEQ ID NO: 1267453 - protein, 9 aa, Homo Sapiens
NCKEAINVL

SEQ ID NO: 1267454 - protein, 9 aa, Homo Sapiens
EIGDQAHMP

SEQ ID NO: 1267455 - protein, 9 aa, Homo Sapiens
QRRRGSWRS

SEQ ID NO: 1267456 - protein, 9 aa, Homo Sapiens
TTASPLGPE

SEQ ID NO: 1267457 - protein, 9 aa, Homo Sapiens
HYWSLDSKC

SEQ ID NO: 1267458 - protein, 9 aa, Homo Sapiens
HPEGAASDL

SEQ ID NO: 1267459 - protein, 9 aa, Homo Sapiens
APASKLPVP

SEQ ID NO: 1267460 - protein, 9 aa, Homo Sapiens
AKLAQGAYG

SEQ ID NO: 1267461 - protein, 9 aa, Homo Sapiens
GPRCRRRSR

SEQ ID NO: 1267462 - protein, 9 aa, Homo Sapiens
SYTLTLGGI

SEQ ID NO: 1267463 - protein, 9 aa, Homo Sapiens
YWVPCVWSS

SEQ ID NO: 1267464 - protein, 9 aa, Homo Sapiens
PQEHPGLGG

SEQ ID NO: 1267465 - protein, 9 aa, Homo Sapiens
LHLLEALST

SEQ ID NO: 1267466 - protein, 9 aa, Homo Sapiens
AGTFTAQEN

SEQ ID NO: 1267467 - protein, 9 aa, Homo Sapiens
QLPGRTPGI

SEQ ID NO: 1267468 - protein, 9 aa, Homo Sapiens
KESADSSMS

SEQ ID NO: 1267469 - protein, 9 aa, Homo Sapiens
WIHTLNHIL

SEQ ID NO: 1267470 - protein, 9 aa, Homo Sapiens
LLLCVQALA

SEQ ID NO: 1267471 - protein, 9 aa, Homo Sapiens
GAPASKLPV

SEQ ID NO: 1267472 - protein, 9 aa, Homo Sapiens
NTQCVKVKI

SEQ ID NO: 1267473 - protein, 9 aa, Homo Sapiens
LKCTKRAWA

SEQ ID NO: 1267474 - protein, 9 aa, Homo Sapiens
GTFTAQENC

SEQ ID NO: 1267475 - protein, 9 aa, Homo Sapiens
ILLGSTKFF

SEQ ID NO: 1267476 - protein, 9 aa, Homo Sapiens
VPLGKESAD

SEQ ID NO: 1267477 - protein, 9 aa, Homo Sapiens
LTLGGIPGY

SEQ ID NO: 1267478 - protein, 9 aa, Homo Sapiens
VRSRKSQGP

SEQ ID NO: 1267479 - protein, 9 aa, Homo Sapiens
VLSHLPSHH

SEQ ID NO: 1267480 - protein, 9 aa, Homo Sapiens
GRLHYFRVP

SEQ ID NO: 1267481 - protein, 9 aa, Homo Sapiens
LGRRSWKRS

SEQ ID NO: 1267482 - protein, 9 aa, Homo Sapiens
YLEFQKDQL

SEQ ID NO: 1267483 - protein, 9 aa, Homo Sapiens
DSLEQPRGL

SEQ ID NO: 1267484 - protein, 9 aa, Homo Sapiens
MFSGDSEYI

SEQ ID NO: 1267485 - protein, 9 aa, Homo Sapiens
FYDYQIFQE

SEQ ID NO: 1267486 - protein, 9 aa, Homo Sapiens
KSDSLEQPR

SEQ ID NO: 1267487 - protein, 9 aa, Homo Sapiens
SSNLAAQAR

SEQ ID NO: 1267488 - protein, 9 aa, Homo Sapiens
VWSSNLAAQ

SEQ ID NO: 1267489 - protein, 9 aa, Homo Sapiens
FEETLRKNT

SEQ ID NO: 1267490 - protein, 9 aa, Homo Sapiens
SAHSAHSAP

SEQ ID NO: 1267491 - protein, 9 aa, Homo Sapiens
RRPEIGDQA

SEQ ID NO: 1267492 - protein, 9 aa, Homo Sapiens
VIFLNTRRR

SEQ ID NO: 1267493 - protein, 9 aa, Homo Sapiens
KLLHLLEAL

SEQ ID NO: 1267494 - protein, 9 aa, Homo Sapiens
GDSEYIDFL

SEQ ID NO: 1267495 - protein, 9 aa, Homo Sapiens
QGAYGTAVD

SEQ ID NO: 1267496 - protein, 9 aa, Homo Sapiens
SMPEVVEKE

SEQ ID NO: 1267497 - protein, 9 aa, Homo Sapiens
IRLFNTQCV

SEQ ID NO: 1267498 - protein, 9 aa, Homo Sapiens
MKKELIFDG

SEQ ID NO: 1267499 - protein, 9 aa, Homo Sapiens
IKKMNLQQQ

SEQ ID NO: 1267500 - protein, 9 aa, Homo Sapiens
IVQDKPSVS

SEQ ID NO: 1267501 - protein, 9 aa, Homo Sapiens
GRHPASEAI

SEQ ID NO: 1267502 - protein, 9 aa, Homo Sapiens
FQKDQLAIL

SEQ ID NO: 1267503 - protein, 9 aa, Homo Sapiens
STKFFLLAV

SEQ ID NO: 1267504 - protein, 9 aa, Homo Sapiens
RQVCNSDLP

SEQ ID NO: 1267505 - protein, 9 aa, Homo Sapiens
EALSTTWFL

SEQ ID NO: 1267506 - protein, 9 aa, Homo Sapiens
SFPQEIQYW

SEQ ID NO: 1267507 - protein, 9 aa, Homo Sapiens
IFLNTRRRV

SEQ ID NO: 1267508 - protein, 9 aa, Homo Sapiens
YRQVCNSDL

SEQ ID NO: 1267509 - protein, 9 aa, Homo Sapiens
VIETEDESM

SEQ ID NO: 1267510 - protein, 9 aa, Homo Sapiens
ITSYTLTLG

SEQ ID NO: 1267511 - protein, 9 aa, Homo Sapiens
DADRCTLPN

SEQ ID NO: 1267512 - protein, 9 aa, Homo Sapiens
FFRGALQPH

SEQ ID NO: 1267513 - protein, 9 aa, Homo Sapiens
GVRCQNIQV

SEQ ID NO: 1267514 - protein, 9 aa, Homo Sapiens
DLENTKLEE

SEQ ID NO: 1267515 - protein, 9 aa, Homo Sapiens
RSRKSQGPA

SEQ ID NO: 1267516 - protein, 9 aa, Homo Sapiens
LSTTWFLFS

SEQ ID NO: 1267517 - protein, 9 aa, Homo Sapiens
NVNGSCVKM

SEQ ID NO: 1267518 - protein, 9 aa, Homo Sapiens
ISTRDPLSK

SEQ ID NO: 1267519 - protein, 9 aa, Homo Sapiens
STTASPLGP

SEQ ID NO: 1267520 - protein, 9 aa, Homo Sapiens
DICRRNLDS

SEQ ID NO: 1267521 - protein, 9 aa, Homo Sapiens
KPSVSHMPI

SEQ ID NO: 1267522 - protein, 9 aa, Homo Sapiens
TMPHTLGMN

SEQ ID NO: 1267523 - protein, 9 aa, Homo Sapiens
ESLVPKHPG

SEQ ID NO: 1267524 - protein, 9 aa, Homo Sapiens
ETLRKNTEE

SEQ ID NO: 1267525 - protein, 9 aa, Homo Sapiens
LQNFLLCQP

SEQ ID NO: 1267526 - protein, 9 aa, Homo Sapiens
RKRHYWSLD

SEQ ID NO: 1267527 - protein, 9 aa, Homo Sapiens
LPCYEFLWG

SEQ ID NO: 1267528 - protein, 9 aa, Homo Sapiens
GRRSWKRSW

SEQ ID NO: 1267529 - protein, 9 aa, Homo Sapiens
DSERPTYTN

SEQ ID NO: 1267530 - protein, 9 aa, Homo Sapiens
HTLGMNRLT

SEQ ID NO: 1267531 - protein, 9 aa, Homo Sapiens
VSGRLHYFR

SEQ ID NO: 1267532 - protein, 9 aa, Homo Sapiens
ALQPHPEGA

SEQ ID NO: 1267533 - protein, 9 aa, Homo Sapiens
AVEALPLLE

SEQ ID NO: 1267534 - protein, 9 aa, Homo Sapiens
IGQVRRPEI

SEQ ID NO: 1267535 - protein, 9 aa, Homo Sapiens
QNIQVRPSG

SEQ ID NO: 1267536 - protein, 9 aa, Homo Sapiens
FRYVSGRLH

SEQ ID NO: 1267537 - protein, 9 aa, Homo Sapiens
TSYTLTLGG

SEQ ID NO: 1267538 - protein, 9 aa, Homo Sapiens
CMIRLFNTQ

SEQ ID NO: 1267539 - protein, 9 aa, Homo Sapiens
TQCVKVKIY

SEQ ID NO: 1267540 - protein, 9 aa, Homo Sapiens
TLRKNTEEQ

SEQ ID NO: 1267541 - protein, 9 aa, Homo Sapiens
LYQLSLVFD

SEQ ID NO: 1267542 - protein, 9 aa, Homo Sapiens
LSKITEQEK

SEQ ID NO: 1267543 - protein, 9 aa, Homo Sapiens
SMLRKRKMY

SEQ ID NO: 1267544 - protein, 9 aa, Homo Sapiens
MLQNFLLCQ

SEQ ID NO: 1267545 - protein, 9 aa, Homo Sapiens
RGLEGEDKP

SEQ ID NO: 1267546 - protein, 9 aa, Homo Sapiens
CKGNRPAEP

SEQ ID NO: 1267547 - protein, 9 aa, Homo Sapiens
GEARDSVDA

SEQ ID NO: 1267548 - protein, 9 aa, Homo Sapiens
SPGSTTASP

SEQ ID NO: 1267549 - protein, 9 aa, Homo Sapiens
AQIVQDKPS

SEQ ID NO: 1267550 - protein, 9 aa, Homo Sapiens
VQRRRGSWR

SEQ ID NO: 1267551 - protein, 9 aa, Homo Sapiens
HLQLLYESK

SEQ ID NO: 1267552 - protein, 9 aa, Homo Sapiens
LAQGAYGTA

SEQ ID NO: 1267553 - protein, 9 aa, Homo Sapiens
CDCKGNRPA

SEQ ID NO: 1267554 - protein, 9 aa, Homo Sapiens
VLWTVCAVR

SEQ ID NO: 1267555 - protein, 9 aa, Homo Sapiens
SSLQDLENT

SEQ ID NO: 1267556 - protein, 9 aa, Homo Sapiens
FLNTRRRVD

SEQ ID NO: 1267557 - protein, 9 aa, Homo Sapiens
RRILMGSML

SEQ ID NO: 1267558 - protein, 9 aa, Homo Sapiens
PGLGGEAVG

SEQ ID NO: 1267559 - protein, 9 aa, Homo Sapiens
VQALASVCH

SEQ ID NO: 1267560 - protein, 9 aa, Homo Sapiens
LGKESADSS

SEQ ID NO: 1267561 - protein, 9 aa, Homo Sapiens
RSSVQRRRG

SEQ ID NO: 1267562 - protein, 9 aa, Homo Sapiens
GCDCKGNRP

SEQ ID NO: 1267563 - protein, 9 aa, Homo Sapiens
WRQSGQPGP

SEQ ID NO: 1267564 - protein, 9 aa, Homo Sapiens
KLKEIQVRL

SEQ ID NO: 1267565 - protein, 9 aa, Homo Sapiens
NIQVRPSGK

SEQ ID NO: 1267566 - protein, 9 aa, Homo Sapiens
VKQKVQRGV

SEQ ID NO: 1267567 - protein, 9 aa, Homo Sapiens
IVIETEDES

SEQ ID NO: 1267568 - protein, 9 aa, Homo Sapiens
PQEIQYWGI

SEQ ID NO: 1267569 - protein, 9 aa, Homo Sapiens
LGGEAVGTG

SEQ ID NO: 1267570 - protein, 9 aa, Homo Sapiens
KHLQLLYES

SEQ ID NO: 1267571 - protein, 9 aa, Homo Sapiens
MGSMLRKRK

SEQ ID NO: 1267572 - protein, 9 aa, Homo Sapiens
SQKVKHLQL

SEQ ID NO: 1267573 - protein, 9 aa, Homo Sapiens
RRRVDWLTE

SEQ ID NO: 1267574 - protein, 9 aa, Homo Sapiens
SGDSEYIDF

SEQ ID NO: 1267575 - protein, 9 aa, Homo Sapiens
GAAWSAREA

SEQ ID NO: 1267576 - protein, 9 aa, Homo Sapiens
GQEVAIKKM

SEQ ID NO: 1267577 - protein, 9 aa, Homo Sapiens
SGQPGPAWR

SEQ ID NO: 1267578 - protein, 9 aa, Homo Sapiens
QRGVRCQNI

SEQ ID NO: 1267579 - protein, 9 aa, Homo Sapiens
LPDASMKKE

SEQ ID NO: 1267580 - protein, 9 aa, Homo Sapiens
SKITEQEKD

SEQ ID NO: 1267581 - protein, 9 aa, Homo Sapiens
EQLCALSFP

SEQ ID NO: 1267582 - protein, 9 aa, Homo Sapiens
HRTLVMPVK

SEQ ID NO: 1267583 - protein, 9 aa, Homo Sapiens
PGSTTASPL

SEQ ID NO: 1267584 - protein, 9 aa, Homo Sapiens
RARRFEETL

SEQ ID NO: 1267585 - protein, 9 aa, Homo Sapiens
PVRPGCDCK

SEQ ID NO: 1267586 - protein, 9 aa, Homo Sapiens
LCQPQLGTQ

SEQ ID NO: 1267587 - protein, 9 aa, Homo Sapiens
TPQEHPGLG

SEQ ID NO: 1267588 - protein, 9 aa, Homo Sapiens
ALSFPQEIQ

SEQ ID NO: 1267589 - protein, 9 aa, Homo Sapiens
PSAHSAHSA

SEQ ID NO: 1267590 - protein, 9 aa, Homo Sapiens
GSVRKALHS

SEQ ID NO: 1267591 - protein, 9 aa, Homo Sapiens
PLLEAIEIY

SEQ ID NO: 1267592 - protein, 9 aa, Homo Sapiens
QLCALSFPQ

SEQ ID NO: 1267593 - protein, 9 aa, Homo Sapiens
TLRKRHYWS

SEQ ID NO: 1267594 - protein, 9 aa, Homo Sapiens
LLGSTKFFL

SEQ ID NO: 1267595 - protein, 9 aa, Homo Sapiens
DASMKKELI

SEQ ID NO: 1267596 - protein, 9 aa, Homo Sapiens
LVSFYDYQI

SEQ ID NO: 1267597 - protein, 9 aa, Homo Sapiens
AWRSSVQRR

SEQ ID NO: 1267598 - protein, 9 aa, Homo Sapiens
QALASVCHE

SEQ ID NO: 1267599 - protein, 9 aa, Homo Sapiens
EAPLCSYRT

SEQ ID NO: 1267600 - protein, 9 aa, Homo Sapiens
LLCQPQLGT

SEQ ID NO: 1267601 - protein, 9 aa, Homo Sapiens
AEVDAAMCA

SEQ ID NO: 1267602 - protein, 9 aa, Homo Sapiens
PGRTPGILL

SEQ ID NO: 1267603 - protein, 9 aa, Homo Sapiens
QRLLQGRHP

SEQ ID NO: 1267604 - protein, 9 aa, Homo Sapiens
CQNIQVRPS

SEQ ID NO: 1267605 - protein, 9 aa, Homo Sapiens
VKMPFSPGS

SEQ ID NO: 1267606 - protein, 9 aa, Homo Sapiens
GRTPGILLQ

SEQ ID NO: 1267607 - protein, 9 aa, Homo Sapiens
KLPVPSGSE

SEQ ID NO: 1267608 - protein, 9 aa, Homo Sapiens
RKSQGPAKP

SEQ ID NO: 1267609 - protein, 9 aa, Homo Sapiens
TLTLGGIPG

SEQ ID NO: 1267610 - protein, 9 aa, Homo Sapiens
NVKTAYRQY

SEQ ID NO: 1267611 - protein, 9 aa, Homo Sapiens
LRLAGTFTA

SEQ ID NO: 1267612 - protein, 9 aa, Homo Sapiens
LKEIQVRLE

SEQ ID NO: 1267613 - protein, 9 aa, Homo Sapiens
LFNTQCVKV

SEQ ID NO: 1267614 - protein, 9 aa, Homo Sapiens
LCALSFPQE

SEQ ID NO: 1267615 - protein, 9 aa, Homo Sapiens
SKLPVPSGS

SEQ ID NO: 1267616 - protein, 9 aa, Homo Sapiens
RSRSCRLGR

SEQ ID NO: 1267617 - protein, 9 aa, Homo Sapiens
PAQIVQDKP

SEQ ID NO: 1267618 - protein, 9 aa, Homo Sapiens
PHTLGMNRL

SEQ ID NO: 1267619 - protein, 9 aa, Homo Sapiens
RQYLYGFEE

SEQ ID NO: 1267620 - protein, 9 aa, Homo Sapiens
QEHPGLGGE

SEQ ID NO: 1267621 - protein, 9 aa, Homo Sapiens
SHHTAGGMT

SEQ ID NO: 1267622 - protein, 9 aa, Homo Sapiens
VSTMPHTLG

SEQ ID NO: 1267623 - protein, 9 aa, Homo Sapiens
YRQYLYGFE

SEQ ID NO: 1267624 - protein, 9 aa, Homo Sapiens
AHSAHSAPT

SEQ ID NO: 1267625 - protein, 9 aa, Homo Sapiens
SFYDYQIFQ

SEQ ID NO: 1267626 - protein, 9 aa, Homo Sapiens
LSFPQEIQY

SEQ ID NO: 1267627 - protein, 9 aa, Homo Sapiens
NLDSERPTY

SEQ ID NO: 1267628 - protein, 9 aa, Homo Sapiens
STNHLKSTP

SEQ ID NO: 1267629 - protein, 9 aa, Homo Sapiens
QDLENTKLE

SEQ ID NO: 1267630 - protein, 9 aa, Homo Sapiens
KEAINVLSH

SEQ ID NO: 1267631 - protein, 9 aa, Homo Sapiens
WSAREAPLC

SEQ ID NO: 1267632 - protein, 9 aa, Homo Sapiens
PLGPESTTF

SEQ ID NO: 1267633 - protein, 9 aa, Homo Sapiens
GKESADSSM

SEQ ID NO: 1267634 - protein, 9 aa, Homo Sapiens
LVPLGKESA

SEQ ID NO: 1267635 - protein, 9 aa, Homo Sapiens
YGTAVDLES

SEQ ID NO: 1267636 - protein, 9 aa, Homo Sapiens
PAWRSSVQR

SEQ ID NO: 1267637 - protein, 9 aa, Homo Sapiens
RGVRCQNIQ

SEQ ID NO: 1267638 - protein, 9 aa, Homo Sapiens
VGDITCETT

SEQ ID NO: 1267639 - protein, 9 aa, Homo Sapiens
LSSLQDLEN

SEQ ID NO: 1267640 - protein, 9 aa, Homo Sapiens
NGSCVKMPF

SEQ ID NO: 1267641 - protein, 9 aa, Homo Sapiens
PEIGDQAHM

SEQ ID NO: 1267642 - protein, 9 aa, Homo Sapiens
ARDSVDAEG

SEQ ID NO: 1267643 - protein, 9 aa, Homo Sapiens
LVPKHPGSR

SEQ ID NO: 1267644 - protein, 9 aa, Homo Sapiens
FNTQCVKVK

SEQ ID NO: 1267645 - protein, 9 aa, Homo Sapiens
NHILQISPE

SEQ ID NO: 1267646 - protein, 9 aa, Homo Sapiens
LILLGSTKF

SEQ ID NO: 1267647 - protein, 9 aa, Homo Sapiens
CVWSSNLAA

SEQ ID NO: 1267648 - protein, 9 aa, Homo Sapiens
PFRYVSGRL

SEQ ID NO: 1267649 - protein, 9 aa, Homo Sapiens
ALSTTWFLF

SEQ ID NO: 1267650 - protein, 9 aa, Homo Sapiens
VTYSCVAEV

SEQ ID NO: 1267651 - protein, 9 aa, Homo Sapiens
VEDEQLLGP

SEQ ID NO: 1267652 - protein, 9 aa, Homo Sapiens
VSFYDYQIF

SEQ ID NO: 1267653 - protein, 9 aa, Homo Sapiens
AYRQYLYGF

SEQ ID NO: 1267654 - protein, 9 aa, Homo Sapiens
LEFQKDQLA

SEQ ID NO: 1267655 - protein, 9 aa, Homo Sapiens
RGPSAHSAH

SEQ ID NO: 1267656 - protein, 9 aa, Homo Sapiens
EIQVRLEEH

SEQ ID NO: 1267657 - protein, 9 aa, Homo Sapiens
IQVRPSGKL

SEQ ID NO: 1267658 - protein, 9 aa, Homo Sapiens
GALQPHPEG

SEQ ID NO: 1267659 - protein, 9 aa, Homo Sapiens
PSSLVPLGK

SEQ ID NO: 1267660 - protein, 9 aa, Homo Sapiens
RRRSRSCRL

SEQ ID NO: 1267661 - protein, 9 aa, Homo Sapiens
PHPEGAASD

SEQ ID NO: 1267662 - protein, 9 aa, Homo Sapiens
CRRRSRSCR

SEQ ID NO: 1267663 - protein, 9 aa, Homo Sapiens
CALSFPQEI

SEQ ID NO: 1267664 - protein, 9 aa, Homo Sapiens
WDESLVPKH

SEQ ID NO: 1267665 - protein, 9 aa, Homo Sapiens
TVFSSHHTA

SEQ ID NO: 1267666 - protein, 9 aa, Homo Sapiens
LEALSTTWF

SEQ ID NO: 1267667 - protein, 9 aa, Homo Sapiens
SLEQPRGLE

SEQ ID NO: 1267668 - protein, 9 aa, Homo Sapiens
KEIQVRLEE

SEQ ID NO: 1267669 - protein, 9 aa, Homo Sapiens
RNLDSERPT

SEQ ID NO: 1267670 - protein, 9 aa, Homo Sapiens
KVPHRTLVM

SEQ ID NO: 1267671 - protein, 9 aa, Homo Sapiens
TAVEALPLL

SEQ ID NO: 1267672 - protein, 9 aa, Homo Sapiens
SCVAEVDAA

SEQ ID NO: 1267673 - protein, 9 aa, Homo Sapiens
EGSASGEAR

SEQ ID NO: 1267674 - protein, 9 aa, Homo Sapiens
GQRLLQGRH

SEQ ID NO: 1267675 - protein, 9 aa, Homo Sapiens
ALASVCHED

SEQ ID NO: 1267676 - protein, 9 aa, Homo Sapiens
VRKALHSPS

SEQ ID NO: 1267677 - protein, 9 aa, Homo Sapiens
CVQALASVC

SEQ ID NO: 1267678 - protein, 9 aa, Homo Sapiens
WSLDSKCIT

SEQ ID NO: 1267679 - protein, 9 aa, Homo Sapiens
LQGRHPASE

SEQ ID NO: 1267680 - protein, 9 aa, Homo Sapiens
SVITSYTLT

SEQ ID NO: 1267681 - protein, 9 aa, Homo Sapiens
EQPRGLEGE

SEQ ID NO: 1267682 - protein, 9 aa, Homo Sapiens
RPEIGDQAH

SEQ ID NO: 1267683 - protein, 9 aa, Homo Sapiens
QLSFRMLQN

SEQ ID NO: 1267684 - protein, 9 aa, Homo Sapiens
RTLVMPVKQ

SEQ ID NO: 1267685 - protein, 9 aa, Homo Sapiens
TLNHILQIS

SEQ ID NO: 1267686 - protein, 9 aa, Homo Sapiens
TLGMNRLTQ

SEQ ID NO: 1267687 - protein, 9 aa, Homo Sapiens
LAWDESLVP

SEQ ID NO: 1267688 - protein, 9 aa, Homo Sapiens
TRDPLSKIT

SEQ ID NO: 1267689 - protein, 9 aa, Homo Sapiens
SLAWDESLV

SEQ ID NO: 1267690 - protein, 9 aa, Homo Sapiens
CNSDLPCYE

SEQ ID NO: 1267691 - protein, 9 aa, Homo Sapiens
LWTVCAVRV

SEQ ID NO: 1267692 - protein, 9 aa, Homo Sapiens
QGRHPASEA

SEQ ID NO: 1267693 - protein, 9 aa, Homo Sapiens
DPLSKITEQ

SEQ ID NO: 1267694 - protein, 9 aa, Homo Sapiens
SLVPLGKES

SEQ ID NO: 1267695 - protein, 9 aa, Homo Sapiens
ADPVVRSRK

SEQ ID NO: 1267696 - protein, 9 aa, Homo Sapiens
RPGCDCKGN

SEQ ID NO: 1267697 - protein, 9 aa, Homo Sapiens
RDSVDAEGP

SEQ ID NO: 1267698 - protein, 9 aa, Homo Sapiens
CTKRAWAPL

SEQ ID NO: 1267699 - protein, 9 aa, Homo Sapiens
REILKCTKR

SEQ ID NO: 1267700 - protein, 9 aa, Homo Sapiens
DCKGNRPAE

SEQ ID NO: 1267701 - protein, 9 aa, Homo Sapiens
DLPCYEFLW

SEQ ID NO: 1267702 - protein, 9 aa, Homo Sapiens
SDLPCYEFL

SEQ ID NO: 1267703 - protein, 9 aa, Homo Sapiens
SWRQSGQPG

SEQ ID NO: 1267704 - protein, 9 aa, Homo Sapiens
GSMLRKRKM

SEQ ID NO: 1267705 - protein, 9 aa, Homo Sapiens
PRGLEGEDK

SEQ ID NO: 1267706 - protein, 9 aa, Homo Sapiens
QGSVRKALH

SEQ ID NO: 1267707 - protein, 9 aa, Homo Sapiens
AGAAWSARE

SEQ ID NO: 1267708 - protein, 9 aa, Homo Sapiens
ASGEARDSV

SEQ ID NO: 1267709 - protein, 9 aa, Homo Sapiens
AVGMFSGDS

SEQ ID NO: 1267710 - protein, 9 aa, Homo Sapiens
PACGSTNHL

SEQ ID NO: 1267711 - protein, 9 aa, Homo Sapiens
VNGSCVKMP

SEQ ID NO: 1267712 - protein, 9 aa, Homo Sapiens
DESMPEVVE

SEQ ID NO: 1267713 - protein, 9 aa, Homo Sapiens
QPRGLEGED

SEQ ID NO: 1267714 - protein, 9 aa, Homo Sapiens
GFVTYSCVA

SEQ ID NO: 1267715 - protein, 9 aa, Homo Sapiens
RCRRRSRSC

SEQ ID NO: 1267716 - protein, 9 aa, Homo Sapiens
VKTAYRQYL

SEQ ID NO: 1267717 - protein, 9 aa, Homo Sapiens
LDSERPTYT

SEQ ID NO: 1267718 - protein, 9 aa, Homo Sapiens
ESQKVKHLQ

SEQ ID NO: 1267719 - protein, 9 aa, Homo Sapiens
TPTVFSSHH

SEQ ID NO: 1267720 - protein, 9 aa, Homo Sapiens
SFRMLQNFL

SEQ ID NO: 1267721 - protein, 9 aa, Homo Sapiens
RSWKRSWRQ

SEQ ID NO: 1267722 - protein, 9 aa, Homo Sapiens
DITCETTFH

SEQ ID NO: 1267723 - protein, 9 aa, Homo Sapiens
RSCRLGRRS

SEQ ID NO: 1267724 - protein, 9 aa, Homo Sapiens
QPHPEGAAS

SEQ ID NO: 1267725 - protein, 9 aa, Homo Sapiens
SGRLHYFRV

SEQ ID NO: 1267726 - protein, 9 aa, Homo Sapiens
QLLGPRCRR

SEQ ID NO: 1267727 - protein, 9 aa, Homo Sapiens
EARDSVDAE

SEQ ID NO: 1267728 - protein, 9 aa, Homo Sapiens
GSCVKMPFS

SEQ ID NO: 1267729 - protein, 9 aa, Homo Sapiens
MWPVLWTVC

SEQ ID NO: 1267730 - protein, 9 aa, Homo Sapiens
YVSGRLHYF

SEQ ID NO: 1267731 - protein, 9 aa, Homo Sapiens
MIRLFNTQC

SEQ ID NO: 1267732 - protein, 9 aa, Homo Sapiens
HTLNHILQI

SEQ ID NO: 1267733 - protein, 9 aa, Homo Sapiens
TAYRQYLYG

SEQ ID NO: 1267734 - protein, 9 aa, Homo Sapiens
ACGSTNHLK

SEQ ID NO: 1267735 - protein, 9 aa, Homo Sapiens
PVVRSRKSQ

SEQ ID NO: 1267736 - protein, 9 aa, Homo Sapiens
VCNSDLPCY

SEQ ID NO: 1267737 - protein, 9 aa, Homo Sapiens
GSTKFFLLA

SEQ ID NO: 1267738 - protein, 9 aa, Homo Sapiens
LLEAIEIYP

SEQ ID NO: 1267739 - protein, 9 aa, Homo Sapiens
EILKCTKRA

SEQ ID NO: 1267740 - protein, 9 aa, Homo Sapiens
IGDQAHMPY

SEQ ID NO: 1267741 - protein, 9 aa, Homo Sapiens
PLYQLSLVF

SEQ ID NO: 1267742 - protein, 9 aa, Homo Sapiens
ALPLLEAIE

SEQ ID NO: 1267743 - protein, 9 aa, Homo Sapiens
TASPLGPES

SEQ ID NO: 1267744 - protein, 9 aa, Homo Sapiens
HILQISPEG

SEQ ID NO: 1267745 - protein, 9 aa, Homo Sapiens
TGQEVAIKK

SEQ ID NO: 1267746 - protein, 9 aa, Homo Sapiens
STRDPLSKI

SEQ ID NO: 1267747 - protein, 9 aa, Homo Sapiens
TLVMPVKQK

SEQ ID NO: 1267748 - protein, 9 aa, Homo Sapiens
LPGRTPGIL

SEQ ID NO: 1267749 - protein, 9 aa, Homo Sapiens
RGALQPHPE

SEQ ID NO: 1267750 - protein, 9 aa, Homo Sapiens
CVKMPFSPG

SEQ ID NO: 1267751 - protein, 9 aa, Homo Sapiens
QIVQDKPSV

SEQ ID NO: 1267752 - protein, 9 aa, Homo Sapiens
CTLPNMKVP

SEQ ID NO: 1267753 - protein, 9 aa, Homo Sapiens
MPHTLGMNR

SEQ ID NO: 1267754 - protein, 9 aa, Homo Sapiens
EQLLGPRCR

SEQ ID NO: 1267755 - protein, 9 aa, Homo Sapiens
TFTAQENCF

SEQ ID NO: 1267756 - protein, 9 aa, Homo Sapiens
PSVSHMPIR

SEQ ID NO: 1267757 - protein, 9 aa, Homo Sapiens
LENTKLEEQ

SEQ ID NO: 1267758 - protein, 9 aa, Homo Sapiens
SSLVPLGKE

SEQ ID NO: 1267759 - protein, 9 aa, Homo Sapiens
DPVVRSRKS

SEQ ID NO: 1267760 - protein, 9 aa, Homo Sapiens
SEEQLPGRT

SEQ ID NO: 1267761 - protein, 9 aa, Homo Sapiens
TFHFHGKDL

SEQ ID NO: 1267762 - protein, 9 aa, Homo Sapiens
WRSSVQRRR

SEQ ID NO: 1267763 - protein, 9 aa, Homo Sapiens
ASKLPVPSG

SEQ ID NO: 1267764 - protein, 9 aa, Homo Sapiens
DRCTLPNMK

SEQ ID NO: 1267765 - protein, 9 aa, Homo Sapiens
QDKPSVSHM

SEQ ID NO: 1267766 - protein, 9 aa, Homo Sapiens
DSEYIDFLH

SEQ ID NO: 1267767 - protein, 9 aa, Homo Sapiens
WSSNLAAQA

SEQ ID NO: 1267768 - protein, 9 aa, Homo Sapiens
LNHILQISP

SEQ ID NO: 1267769 - protein, 9 aa, Homo Sapiens
REAPLCSYR

SEQ ID NO: 1267770 - protein, 9 aa, Homo Sapiens
ICRRNLDSE

SEQ ID NO: 1267771 - protein, 9 aa, Homo Sapiens
LGSTKFFLL

SEQ ID NO: 1267772 - protein, 9 aa, Homo Sapiens
LQDLENTKL

SEQ ID NO: 1267773 - protein, 9 aa, Homo Sapiens
PTPACGSTN

SEQ ID NO: 1267774 - protein, 9 aa, Homo Sapiens
LLGPRCRRR

SEQ ID NO: 1267775 - protein, 9 aa, Homo Sapiens
MLRKRKMYE

SEQ ID NO: 1267776 - protein, 9 aa, Homo Sapiens
RRVDWLTEK

SEQ ID NO: 1267777 - protein, 9 aa, Homo Sapiens
RKALHSPSR

SEQ ID NO: 1267778 - protein, 9 aa, Homo Sapiens
CYLEFQKDQ

SEQ ID NO: 1267779 - protein, 9 aa, Homo Sapiens
LDPLYQLSL

SEQ ID NO: 1267780 - protein, 9 aa, Homo Sapiens
VPKHPGSRK

SEQ ID NO: 1267781 - protein, 9 aa, Homo Sapiens
KMPFSPGSR

SEQ ID NO: 1267782 - protein, 9 aa, Homo Sapiens
LGPRCRRRS

SEQ ID NO: 1267783 - protein, 9 aa, Homo Sapiens
RCQNIQVRP

SEQ ID NO: 1267784 - protein, 9 aa, Homo Sapiens
STMPHTLGM

SEQ ID NO: 1267785 - protein, 9 aa, Homo Sapiens
TRRRVDWLT

SEQ ID NO: 1267786 - protein, 9 aa, Homo Sapiens
TAQENCFQY

SEQ ID NO: 1267787 - protein, 9 aa, Homo Sapiens
ALVSFYDYQ

SEQ ID NO: 1267788 - protein, 9 aa, Homo Sapiens
LRKRHYWSL

SEQ ID NO: 1267789 - protein, 9 aa, Homo Sapiens
CRLGRRSWK

SEQ ID NO: 1267790 - protein, 9 aa, Homo Sapiens
QPGPAWRSS

SEQ ID NO: 1267791 - protein, 9 aa, Homo Sapiens
RCTLPNMKV

SEQ ID NO: 1267792 - protein, 9 aa, Homo Sapiens
VITSYTLTL

SEQ ID NO: 1267793 - protein, 9 aa, Homo Sapiens
HSAHSAPTS

SEQ ID NO: 1267794 - protein, 9 aa, Homo Sapiens
VGMFSGDSE

SEQ ID NO: 1267795 - protein, 9 aa, Homo Sapiens
RQSGQPGPA

SEQ ID NO: 1267796 - protein, 9 aa, Homo Sapiens
NVLSHLPSH

SEQ ID NO: 1267797 - protein, 9 aa, Homo Sapiens
NFLLCQPQL

SEQ ID NO: 1267798 - protein, 9 aa, Homo Sapiens
KKELIFDGG

SEQ ID NO: 1267799 - protein, 9 aa, Homo Sapiens
LESQKVKHL

SEQ ID NO: 1267800 - protein, 9 aa, Homo Sapiens
SMKKELIFD

SEQ ID NO: 1267801 - protein, 9 aa, Homo Sapiens
ALHSPSRDT

SEQ ID NO: 1267802 - protein, 9 aa, Homo Sapiens
EWIHTLNHI

SEQ ID NO: 1267803 - protein, 9 aa, Homo Sapiens
QKVQRGVRC

SEQ ID NO: 1267804 - protein, 9 aa, Homo Sapiens
LEAIEIYPL

SEQ ID NO: 1267805 - protein, 9 aa, Homo Sapiens
AAWSAREAP

SEQ ID NO: 1267806 - protein, 9 aa, Homo Sapiens
GSTNHLKST

SEQ ID NO: 1267807 - protein, 9 aa, Homo Sapiens
KITEQEKDF

SEQ ID NO: 1267808 - protein, 9 aa, Homo Sapiens
PRCRRRSRS

SEQ ID NO: 1267809 - protein, 9 aa, Homo Sapiens
QLSLVFDES

SEQ ID NO: 1267810 - protein, 9 aa, Homo Sapiens
RLAGTFTAQ

SEQ ID NO: 1267811 - protein, 9 aa, Homo Sapiens
TKRAWAPLD

SEQ ID NO: 1267812 - protein, 9 aa, Homo Sapiens
ALKALVSFY

SEQ ID NO: 1267813 - protein, 9 aa, Homo Sapiens
FSSHHTAGG

SEQ ID NO: 1267814 - protein, 9 aa, Homo Sapiens
KRSWRQSGQ

SEQ ID NO: 1267815 - protein, 9 aa, Homo Sapiens
LLCVQALAS

SEQ ID NO: 1267816 - protein, 9 aa, Homo Sapiens
KMWPVLWTV

SEQ ID NO: 1267817 - protein, 9 aa, Homo Sapiens
SASPSIRSA

SEQ ID NO: 1267818 - protein, 9 aa, Homo Sapiens
QPSRPTGRT

SEQ ID NO: 1267819 - protein, 9 aa, Homo Sapiens
IDGFSGHAG

SEQ ID NO: 1267820 - protein, 9 aa, Homo Sapiens
SQGLPASRT

SEQ ID NO: 1267821 - protein, 9 aa, Homo Sapiens
TGIHTDTHT

SEQ ID NO: 1267822 - protein, 9 aa, Homo Sapiens
EVEIGTVVV

SEQ ID NO: 1267823 - protein, 9 aa, Homo Sapiens
SNVAPPAFS

SEQ ID NO: 1267824 - protein, 9 aa, Homo Sapiens
AAMWGIFVF

SEQ ID NO: 1267825 - protein, 9 aa, Homo Sapiens
RHTHTQAYT

SEQ ID NO: 1267826 - protein, 9 aa, Homo Sapiens
NISEKKVTW

SEQ ID NO: 1267827 - protein, 9 aa, Homo Sapiens
ANLRWRRKR

SEQ ID NO: 1267828 - protein, 9 aa, Homo Sapiens
YGCYCVLGD

SEQ ID NO: 1267829 - protein, 9 aa, Homo Sapiens
QCKEYLPMY

SEQ ID NO: 1267830 - protein, 9 aa, Homo Sapiens
YFFPFFFIL

SEQ ID NO: 1267831 - protein, 9 aa, Homo Sapiens
WGTGVCLHC

SEQ ID NO: 1267832 - protein, 9 aa, Homo Sapiens
KWRQQSACI

SEQ ID NO: 1267833 - protein, 9 aa, Homo Sapiens
IKELSCHNL

SEQ ID NO: 1267834 - protein, 9 aa, Homo Sapiens
PRMKSSTGI

SEQ ID NO: 1267835 - protein, 9 aa, Homo Sapiens
YSRVQFQFE

SEQ ID NO: 1267836 - protein, 9 aa, Homo Sapiens
TDVNDNPPH

SEQ ID NO: 1267837 - protein, 9 aa, Homo Sapiens
AACPSLGPG

SEQ ID NO: 1267838 - protein, 9 aa, Homo Sapiens
ETKVTSTVS

SEQ ID NO: 1267839 - protein, 9 aa, Homo Sapiens
SLPLLIANT

SEQ ID NO: 1267840 - protein, 9 aa, Homo Sapiens
CFLIQSQVK

SEQ ID NO: 1267841 - protein, 9 aa, Homo Sapiens
SPVSHFAKW

SEQ ID NO: 1267842 - protein, 9 aa, Homo Sapiens
EADMMKRQT

SEQ ID NO: 1267843 - protein, 9 aa, Homo Sapiens
GRVSHIETA

SEQ ID NO: 1267844 - protein, 9 aa, Homo Sapiens
VWKEVRGEW

SEQ ID NO: 1267845 - protein, 9 aa, Homo Sapiens
RSSRRLPGA

SEQ ID NO: 1267846 - protein, 9 aa, Homo Sapiens
TDTESASGQ

SEQ ID NO: 1267847 - protein, 9 aa, Homo Sapiens
PVVVNCLHI

SEQ ID NO: 1267848 - protein, 9 aa, Homo Sapiens
VIPAPPNTH

SEQ ID NO: 1267849 - protein, 9 aa, Homo Sapiens
TDEIVDHWR

SEQ ID NO: 1267850 - protein, 9 aa, Homo Sapiens
QESTKGHDE

SEQ ID NO: 1267851 - protein, 9 aa, Homo Sapiens
LHPACAVSS

SEQ ID NO: 1267852 - protein, 9 aa, Homo Sapiens
ACTMPPLLH

SEQ ID NO: 1267853 - protein, 9 aa, Homo Sapiens
MREDRTKRL

SEQ ID NO: 1267854 - protein, 9 aa, Homo Sapiens
IVSKNAGET

SEQ ID NO: 1267855 - protein, 9 aa, Homo Sapiens
AGLRSPLRE

SEQ ID NO: 1267856 - protein, 9 aa, Homo Sapiens
CSILLEFPL

SEQ ID NO: 1267857 - protein, 9 aa, Homo Sapiens
ALAEGTAGH

SEQ ID NO: 1267858 - protein, 9 aa, Homo Sapiens
TICHLQQGI

SEQ ID NO: 1267859 - protein, 9 aa, Homo Sapiens
NTICHLQQG

SEQ ID NO: 1267860 - protein, 9 aa, Homo Sapiens
ANTLRQQQQ

SEQ ID NO: 1267861 - protein, 9 aa, Homo Sapiens
PGVQLRHRL

SEQ ID NO: 1267862 - protein, 9 aa, Homo Sapiens
KELWEKMEL

SEQ ID NO: 1267863 - protein, 9 aa, Homo Sapiens
VASYVAWID

SEQ ID NO: 1267864 - protein, 9 aa, Homo Sapiens
LHPTKEEVN

SEQ ID NO: 1267865 - protein, 9 aa, Homo Sapiens
LEFSPFRWL

SEQ ID NO: 1267866 - protein, 9 aa, Homo Sapiens
GCTDDEGPV

SEQ ID NO: 1267867 - protein, 9 aa, Homo Sapiens
KHKKPQPRF

SEQ ID NO: 1267868 - protein, 9 aa, Homo Sapiens
LPHKKYPAW

SEQ ID NO: 1267869 - protein, 9 aa, Homo Sapiens
CACHPWPSG

SEQ ID NO: 1267870 - protein, 9 aa, Homo Sapiens
PHRRGMAPN

SEQ ID NO: 1267871 - protein, 9 aa, Homo Sapiens
LPPEPGDPD

SEQ ID NO: 1267872 - protein, 9 aa, Homo Sapiens
LPLAVGVIT

SEQ ID NO: 1267873 - protein, 9 aa, Homo Sapiens
GIFLTGDFN

SEQ ID NO: 1267874 - protein, 9 aa, Homo Sapiens
AYTLTYTGT

SEQ ID NO: 1267875 - protein, 9 aa, Homo Sapiens
DKWYSEELK

SEQ ID NO: 1267876 - protein, 9 aa, Homo Sapiens
RTKAAGGPC

SEQ ID NO: 1267877 - protein, 9 aa, Homo Sapiens
KELEKRQEE

SEQ ID NO: 1267878 - protein, 9 aa, Homo Sapiens
PHHPLKAPA

SEQ ID NO: 1267879 - protein, 9 aa, Homo Sapiens
AVGKARRRN

SEQ ID NO: 1267880 - protein, 9 aa, Homo Sapiens
LLPVGQRMT

SEQ ID NO: 1267881 - protein, 9 aa, Homo Sapiens
YPERWSLAG

SEQ ID NO: 1267882 - protein, 9 aa, Homo Sapiens
PVCLGAAAH

SEQ ID NO: 1267883 - protein, 9 aa, Homo Sapiens
PTWCGGAHG

SEQ ID NO: 1267884 - protein, 9 aa, Homo Sapiens
NTSLNDLLS

SEQ ID NO: 1267885 - protein, 9 aa, Homo Sapiens
NFISTKEEL

SEQ ID NO: 1267886 - protein, 9 aa, Homo Sapiens
LQASLKEDK

SEQ ID NO: 1267887 - protein, 9 aa, Homo Sapiens
AGDALPVCL

SEQ ID NO: 1267888 - protein, 9 aa, Homo Sapiens
ASACTMPPL

SEQ ID NO: 1267889 - protein, 9 aa, Homo Sapiens
WMTGVQPSA

SEQ ID NO: 1267890 - protein, 9 aa, Homo Sapiens
AVGKLLIEG

SEQ ID NO: 1267891 - protein, 9 aa, Homo Sapiens
SLPLRSSGQ

SEQ ID NO: 1267892 - protein, 9 aa, Homo Sapiens
CFAWVEADG

SEQ ID NO: 1267893 - protein, 9 aa, Homo Sapiens
QELCDLMST

SEQ ID NO: 1267894 - protein, 9 aa, Homo Sapiens
RRTVTVPAG

SEQ ID NO: 1267895 - protein, 9 aa, Homo Sapiens
KEVAKSPAK

SEQ ID NO: 1267896 - protein, 9 aa, Homo Sapiens
SSGGRTAAV

SEQ ID NO: 1267897 - protein, 9 aa, Homo Sapiens
PRTMAGPSA

SEQ ID NO: 1267898 - protein, 9 aa, Homo Sapiens
SSLVASSQN

SEQ ID NO: 1267899 - protein, 9 aa, Homo Sapiens
GPTWCGGAH

SEQ ID NO: 1267900 - protein, 9 aa, Homo Sapiens
DSYFYTAIV

SEQ ID NO: 1267901 - protein, 9 aa, Homo Sapiens
QVHTQTHTG

SEQ ID NO: 1267902 - protein, 9 aa, Homo Sapiens
RLDRKDLLG

SEQ ID NO: 1267903 - protein, 9 aa, Homo Sapiens
THRHTHTHT

SEQ ID NO: 1267904 - protein, 9 aa, Homo Sapiens
EVAKSPAKA

SEQ ID NO: 1267905 - protein, 9 aa, Homo Sapiens
AFIVQALCL

SEQ ID NO: 1267906 - protein, 9 aa, Homo Sapiens
DMMKRQTQI

SEQ ID NO: 1267907 - protein, 9 aa, Homo Sapiens
QGGSPVGDV

SEQ ID NO: 1267908 - protein, 9 aa, Homo Sapiens
QPHSWPQRP

SEQ ID NO: 1267909 - protein, 9 aa, Homo Sapiens
DRIEHFMFG

SEQ ID NO: 1267910 - protein, 9 aa, Homo Sapiens
GSSCPLGSV

SEQ ID NO: 1267911 - protein, 9 aa, Homo Sapiens
KTVKPKEVA

SEQ ID NO: 1267912 - protein, 9 aa, Homo Sapiens
LKNFVKIAR

SEQ ID NO: 1267913 - protein, 9 aa, Homo Sapiens
QPNLLIFIH

SEQ ID NO: 1267914 - protein, 9 aa, Homo Sapiens
HAEHEVRLA

SEQ ID NO: 1267915 - protein, 9 aa, Homo Sapiens
WRIARFVLP

SEQ ID NO: 1267916 - protein, 9 aa, Homo Sapiens
PTPCTDTES

SEQ ID NO: 1267917 - protein, 9 aa, Homo Sapiens
RAIPNNGSP

SEQ ID NO: 1267918 - protein, 9 aa, Homo Sapiens
MWGIFVFKE

SEQ ID NO: 1267919 - protein, 9 aa, Homo Sapiens
RRWGAWHPG

SEQ ID NO: 1267920 - protein, 9 aa, Homo Sapiens
PAQMCASLS

SEQ ID NO: 1267921 - protein, 9 aa, Homo Sapiens
EEAINEAKA

SEQ ID NO: 1267922 - protein, 9 aa, Homo Sapiens
RRPPAPTPC

SEQ ID NO: 1267923 - protein, 9 aa, Homo Sapiens
RSASSRAST

SEQ ID NO: 1267924 - protein, 9 aa, Homo Sapiens
ETALPTRRP

SEQ ID NO: 1267925 - protein, 9 aa, Homo Sapiens
PPSPSRTSS

SEQ ID NO: 1267926 - protein, 9 aa, Homo Sapiens
PRALCSQRR

SEQ ID NO: 1267927 - protein, 9 aa, Homo Sapiens
PSFMPCLYI

SEQ ID NO: 1267928 - protein, 9 aa, Homo Sapiens
TGAQAMYQV

SEQ ID NO: 1267929 - protein, 9 aa, Homo Sapiens
QLLQASSLS

SEQ ID NO: 1267930 - protein, 9 aa, Homo Sapiens
TSSHFKWIL

SEQ ID NO: 1267931 - protein, 9 aa, Homo Sapiens
AGHRSRKLG

SEQ ID NO: 1267932 - protein, 9 aa, Homo Sapiens
PTLEEVPAM

SEQ ID NO: 1267933 - protein, 9 aa, Homo Sapiens
CGCLTHEIL

SEQ ID NO: 1267934 - protein, 9 aa, Homo Sapiens
MSTRRSNMG

SEQ ID NO: 1267935 - protein, 9 aa, Homo Sapiens
FQFEMESFD

SEQ ID NO: 1267936 - protein, 9 aa, Homo Sapiens
YGSYPPARQ

SEQ ID NO: 1267937 - protein, 9 aa, Homo Sapiens
LCWWLLSSQ

SEQ ID NO: 1267938 - protein, 9 aa, Homo Sapiens
GADGCGSRA

SEQ ID NO: 1267939 - protein, 9 aa, Homo Sapiens
LTLPQLSLT

SEQ ID NO: 1267940 - protein, 9 aa, Homo Sapiens
KHEYQYMPR

SEQ ID NO: 1267941 - protein, 9 aa, Homo Sapiens
ADMMKRQTQ

SEQ ID NO: 1267942 - protein, 9 aa, Homo Sapiens
PISTLVHAD

SEQ ID NO: 1267943 - protein, 9 aa, Homo Sapiens
PAISMKSPI

SEQ ID NO: 1267944 - protein, 9 aa, Homo Sapiens
LADGAHVWL

SEQ ID NO: 1267945 - protein, 9 aa, Homo Sapiens
TATTAPSVL

SEQ ID NO: 1267946 - protein, 9 aa, Homo Sapiens
TYLEIIILV

SEQ ID NO: 1267947 - protein, 9 aa, Homo Sapiens
ALALDVAVQ

SEQ ID NO: 1267948 - protein, 9 aa, Homo Sapiens
IAKTRGKVD

SEQ ID NO: 1267949 - protein, 9 aa, Homo Sapiens
RIDLPHKKY

SEQ ID NO: 1267950 - protein, 9 aa, Homo Sapiens
HPASGRASR

SEQ ID NO: 1267951 - protein, 9 aa, Homo Sapiens
TLPKFTKKH

SEQ ID NO: 1267952 - protein, 9 aa, Homo Sapiens
GGCLPPEPG

SEQ ID NO: 1267953 - protein, 9 aa, Homo Sapiens
SQSRQHIVC

SEQ ID NO: 1267954 - protein, 9 aa, Homo Sapiens
DWRIARFVL

SEQ ID NO: 1267955 - protein, 9 aa, Homo Sapiens
EPPPPPEQA

SEQ ID NO: 1267956 - protein, 9 aa, Homo Sapiens
LAYCSLSFP

SEQ ID NO: 1267957 - protein, 9 aa, Homo Sapiens
EVLYQLEKW

SEQ ID NO: 1267958 - protein, 9 aa, Homo Sapiens
TLDFKKQSA

SEQ ID NO: 1267959 - protein, 9 aa, Homo Sapiens
HCQPNLLIF

SEQ ID NO: 1267960 - protein, 9 aa, Homo Sapiens
RLGRNSIRQ

SEQ ID NO: 1267961 - protein, 9 aa, Homo Sapiens
AHRHTHRHT

SEQ ID NO: 1267962 - protein, 9 aa, Homo Sapiens
LTALVDLED

SEQ ID NO: 1267963 - protein, 9 aa, Homo Sapiens
FNGSEIIIE

SEQ ID NO: 1267964 - protein, 9 aa, Homo Sapiens
TAAGRPPRM

SEQ ID NO: 1267965 - protein, 9 aa, Homo Sapiens
ETKSQPHSW

SEQ ID NO: 1267966 - protein, 9 aa, Homo Sapiens
APSTRAAPP

SEQ ID NO: 1267967 - protein, 9 aa, Homo Sapiens
EHLLNWAQK

SEQ ID NO: 1267968 - protein, 9 aa, Homo Sapiens
VRTKAAGGP

SEQ ID NO: 1267969 - protein, 9 aa, Homo Sapiens
SAVTALLPP

SEQ ID NO: 1267970 - protein, 9 aa, Homo Sapiens
RHTQEYTGT

SEQ ID NO: 1267971 - protein, 9 aa, Homo Sapiens
PGWEEASQV

SEQ ID NO: 1267972 - protein, 9 aa, Homo Sapiens
ILAANLATA

SEQ ID NO: 1267973 - protein, 9 aa, Homo Sapiens
TDAPVVVNC

SEQ ID NO: 1267974 - protein, 9 aa, Homo Sapiens
LFLNATCWQ

SEQ ID NO: 1267975 - protein, 9 aa, Homo Sapiens
HLLVVQLLV

SEQ ID NO: 1267976 - protein, 9 aa, Homo Sapiens
LASRLKPTR

SEQ ID NO: 1267977 - protein, 9 aa, Homo Sapiens
SQRPPRQVR

SEQ ID NO: 1267978 - protein, 9 aa, Homo Sapiens
GIKKGGATE

SEQ ID NO: 1267979 - protein, 9 aa, Homo Sapiens
DTNVHRVTA

SEQ ID NO: 1267980 - protein, 9 aa, Homo Sapiens
IHNTDGPKM

SEQ ID NO: 1267981 - protein, 9 aa, Homo Sapiens
PMGMRASRC

SEQ ID NO: 1267982 - protein, 9 aa, Homo Sapiens
ADGALLRGL

SEQ ID NO: 1267983 - protein, 9 aa, Homo Sapiens
LYRKHCVEQ

SEQ ID NO: 1267984 - protein, 9 aa, Homo Sapiens
YLVVAVTAI

SEQ ID NO: 1267985 - protein, 9 aa, Homo Sapiens
CRPACTCIS

SEQ ID NO: 1267986 - protein, 9 aa, Homo Sapiens
TDLSRTELR

SEQ ID NO: 1267987 - protein, 9 aa, Homo Sapiens
HALHGQPAS

SEQ ID NO: 1267988 - protein, 9 aa, Homo Sapiens
QNGQRNQHV

SEQ ID NO: 1267989 - protein, 9 aa, Homo Sapiens
GSSHLPTLA

SEQ ID NO: 1267990 - protein, 9 aa, Homo Sapiens
EGKLVDRKL

SEQ ID NO: 1267991 - protein, 9 aa, Homo Sapiens
LKLRRTVTV

SEQ ID NO: 1267992 - protein, 9 aa, Homo Sapiens
VESGKVYAL

SEQ ID NO: 1267993 - protein, 9 aa, Homo Sapiens
TALVDLEDW

SEQ ID NO: 1267994 - protein, 9 aa, Homo Sapiens
RAREALVAE

SEQ ID NO: 1267995 - protein, 9 aa, Homo Sapiens
IPLLGSLAG

SEQ ID NO: 1267996 - protein, 9 aa, Homo Sapiens
RFHAHVSQV

SEQ ID NO: 1267997 - protein, 9 aa, Homo Sapiens
GECGSGGVD

SEQ ID NO: 1267998 - protein, 9 aa, Homo Sapiens
HRHTHRHRH

SEQ ID NO: 1267999 - protein, 9 aa, Homo Sapiens
VGPLPCVLP

SEQ ID NO: 1268000 - protein, 9 aa, Homo Sapiens
EASQVGGTQ

SEQ ID NO: 1268001 - protein, 9 aa, Homo Sapiens
VIYVPDFIS

SEQ ID NO: 1268002 - protein, 9 aa, Homo Sapiens
LAPTKHSRK

SEQ ID NO: 1268003 - protein, 9 aa, Homo Sapiens
KTWQRRLRA

SEQ ID NO: 1268004 - protein, 9 aa, Homo Sapiens
AAPDASRED

SEQ ID NO: 1268005 - protein, 9 aa, Homo Sapiens
NKSKIVVKK

SEQ ID NO: 1268006 - protein, 9 aa, Homo Sapiens
GQQPRRPVV

SEQ ID NO: 1268007 - protein, 9 aa, Homo Sapiens
GFDTNTEGC

SEQ ID NO: 1268008 - protein, 9 aa, Homo Sapiens
RHTHRHTQE

SEQ ID NO: 1268009 - protein, 9 aa, Homo Sapiens
KCGITPLPK

SEQ ID NO: 1268010 - protein, 9 aa, Homo Sapiens
EAIKYLKNF

SEQ ID NO: 1268011 - protein, 9 aa, Homo Sapiens
AIYHFRLLT

SEQ ID NO: 1268012 - protein, 9 aa, Homo Sapiens
SVRPCSVTV

SEQ ID NO: 1268013 - protein, 9 aa, Homo Sapiens
LRTLDPLCL

SEQ ID NO: 1268014 - protein, 9 aa, Homo Sapiens
WPRLSLVVT

SEQ ID NO: 1268015 - protein, 9 aa, Homo Sapiens
GLSSFDKVV

SEQ ID NO: 1268016 - protein, 9 aa, Homo Sapiens
RAVGLWGTG

SEQ ID NO: 1268017 - protein, 9 aa, Homo Sapiens
RHHTREIFV

SEQ ID NO: 1268018 - protein, 9 aa, Homo Sapiens
ASPSIRSAS

SEQ ID NO: 1268019 - protein, 9 aa, Homo Sapiens
SDLIEKRLA

SEQ ID NO: 1268020 - protein, 9 aa, Homo Sapiens
ALVSNFIST

SEQ ID NO: 1268021 - protein, 9 aa, Homo Sapiens
FFPFFFILV

SEQ ID NO: 1268022 - protein, 9 aa, Homo Sapiens
VGQRMTEPT

SEQ ID NO: 1268023 - protein, 9 aa, Homo Sapiens
RTFRVCLKH

SEQ ID NO: 1268024 - protein, 9 aa, Homo Sapiens
LKTLPLLSP

SEQ ID NO: 1268025 - protein, 9 aa, Homo Sapiens
LAVFPAISM

SEQ ID NO: 1268026 - protein, 9 aa, Homo Sapiens
RPPRMELPV

SEQ ID NO: 1268027 - protein, 9 aa, Homo Sapiens
CYPDNHANR

SEQ ID NO: 1268028 - protein, 9 aa, Homo Sapiens
NWGSLPLRS

SEQ ID NO: 1268029 - protein, 9 aa, Homo Sapiens
LLRGLGLQL

SEQ ID NO: 1268030 - protein, 9 aa, Homo Sapiens
TFRVCLKHY

SEQ ID NO: 1268031 - protein, 9 aa, Homo Sapiens
VWSMKLRNE

SEQ ID NO: 1268032 - protein, 9 aa, Homo Sapiens
RMELPVGCR

SEQ ID NO: 1268033 - protein, 9 aa, Homo Sapiens
VVVNCLHIL

SEQ ID NO: 1268034 - protein, 9 aa, Homo Sapiens
NLGPWKLIK

SEQ ID NO: 1268035 - protein, 9 aa, Homo Sapiens
FVLFLNATC

SEQ ID NO: 1268036 - protein, 9 aa, Homo Sapiens
EGPGCTDDE

SEQ ID NO: 1268037 - protein, 9 aa, Homo Sapiens
MGLDSEEGR

SEQ ID NO: 1268038 - protein, 9 aa, Homo Sapiens
RQHDTRPEM

SEQ ID NO: 1268039 - protein, 9 aa, Homo Sapiens
PRKDIKHEY

SEQ ID NO: 1268040 - protein, 9 aa, Homo Sapiens
VLPAPLARH

SEQ ID NO: 1268041 - protein, 9 aa, Homo Sapiens
PPRSRLAAA

SEQ ID NO: 1268042 - protein, 9 aa, Homo Sapiens
SSSQTVARH

SEQ ID NO: 1268043 - protein, 9 aa, Homo Sapiens
VLPGEADLA

SEQ ID NO: 1268044 - protein, 9 aa, Homo Sapiens
LVAMAAGAD

SEQ ID NO: 1268045 - protein, 9 aa, Homo Sapiens
QTILLGPIS

SEQ ID NO: 1268046 - protein, 9 aa, Homo Sapiens
QHQRCHTGK

SEQ ID NO: 1268047 - protein, 9 aa, Homo Sapiens
QRPETQEDR

SEQ ID NO: 1268048 - protein, 9 aa, Homo Sapiens
LPRRAPQGV

SEQ ID NO: 1268049 - protein, 9 aa, Homo Sapiens
PKRPSVSRI

SEQ ID NO: 1268050 - protein, 9 aa, Homo Sapiens
RFEVGPRDM

SEQ ID NO: 1268051 - protein, 9 aa, Homo Sapiens
ATTAPSVLT

SEQ ID NO: 1268052 - protein, 9 aa, Homo Sapiens
SPEEIVAAM

SEQ ID NO: 1268053 - protein, 9 aa, Homo Sapiens
LYSVKSLSV

SEQ ID NO: 1268054 - protein, 9 aa, Homo Sapiens
DREARAAHR

SEQ ID NO: 1268055 - protein, 9 aa, Homo Sapiens
THTHTQAHR

SEQ ID NO: 1268056 - protein, 9 aa, Homo Sapiens
SRKTWQRRL

SEQ ID NO: 1268057 - protein, 9 aa, Homo Sapiens
FEGQQPRRP

SEQ ID NO: 1268058 - protein, 9 aa, Homo Sapiens
FLKIKHSSA

SEQ ID NO: 1268059 - protein, 9 aa, Homo Sapiens
EPTPRMKSS

SEQ ID NO: 1268060 - protein, 9 aa, Homo Sapiens
YTAIVAVVA

SEQ ID NO: 1268061 - protein, 9 aa, Homo Sapiens
AESLKKFLS

SEQ ID NO: 1268062 - protein, 9 aa, Homo Sapiens
CPLGSVLCW

SEQ ID NO: 1268063 - protein, 9 aa, Homo Sapiens
GPTLEEVPA

SEQ ID NO: 1268064 - protein, 9 aa, Homo Sapiens
ACTCISMTT

SEQ ID NO: 1268065 - protein, 9 aa, Homo Sapiens
LTDEIVDHW

SEQ ID NO: 1268066 - protein, 9 aa, Homo Sapiens
TRAAPPSLR

SEQ ID NO: 1268067 - protein, 9 aa, Homo Sapiens
ADTLPYTAT

SEQ ID NO: 1268068 - protein, 9 aa, Homo Sapiens
GETCGCLTH

SEQ ID NO: 1268069 - protein, 9 aa, Homo Sapiens
TESASGQAV

SEQ ID NO: 1268070 - protein, 9 aa, Homo Sapiens
LAARQPAQR

SEQ ID NO: 1268071 - protein, 9 aa, Homo Sapiens
SRLKPTRST

SEQ ID NO: 1268072 - protein, 9 aa, Homo Sapiens
PEARRLIVS

SEQ ID NO: 1268073 - protein, 9 aa, Homo Sapiens
YCEFLGCFV

SEQ ID NO: 1268074 - protein, 9 aa, Homo Sapiens
LVSASASPS

SEQ ID NO: 1268075 - protein, 9 aa, Homo Sapiens
PLPTSQQPP

SEQ ID NO: 1268076 - protein, 9 aa, Homo Sapiens
DKGNFGQTA

SEQ ID NO: 1268077 - protein, 9 aa, Homo Sapiens
RPWPRLSLV

SEQ ID NO: 1268078 - protein, 9 aa, Homo Sapiens
RSIRTNLML

SEQ ID NO: 1268079 - protein, 9 aa, Homo Sapiens
DKEQFEEFA

SEQ ID NO: 1268080 - protein, 9 aa, Homo Sapiens
LHLVVQWPP

SEQ ID NO: 1268081 - protein, 9 aa, Homo Sapiens
QPEMAAMRL

SEQ ID NO: 1268082 - protein, 9 aa, Homo Sapiens
HTARPHPCR

SEQ ID NO: 1268083 - protein, 9 aa, Homo Sapiens
STPPLALAT

SEQ ID NO: 1268084 - protein, 9 aa, Homo Sapiens
EALQVLLQV

SEQ ID NO: 1268085 - protein, 9 aa, Homo Sapiens
NAKTHVLDI

SEQ ID NO: 1268086 - protein, 9 aa, Homo Sapiens
DTHTGTDRN

SEQ ID NO: 1268087 - protein, 9 aa, Homo Sapiens
SRPTGRTPT

SEQ ID NO: 1268088 - protein, 9 aa, Homo Sapiens
VRHQRSGHG

SEQ ID NO: 1268089 - protein, 9 aa, Homo Sapiens
YAQSCHFKR

SEQ ID NO: 1268090 - protein, 9 aa, Homo Sapiens
VGVITFGSA

SEQ ID NO: 1268091 - protein, 9 aa, Homo Sapiens
DWLASRLKP

SEQ ID NO: 1268092 - protein, 9 aa, Homo Sapiens
VEQGKQQLM

SEQ ID NO: 1268093 - protein, 9 aa, Homo Sapiens
AGLVLLRQW

SEQ ID NO: 1268094 - protein, 9 aa, Homo Sapiens
RHALHGQPA

SEQ ID NO: 1268095 - protein, 9 aa, Homo Sapiens
YCSILLEFP

SEQ ID NO: 1268096 - protein, 9 aa, Homo Sapiens
AFDVTPTTS

SEQ ID NO: 1268097 - protein, 9 aa, Homo Sapiens
SGTILAYCS

SEQ ID NO: 1268098 - protein, 9 aa, Homo Sapiens
AMRLMPKFL

SEQ ID NO: 1268099 - protein, 9 aa, Homo Sapiens
VAFEGQQPR

SEQ ID NO: 1268100 - protein, 9 aa, Homo Sapiens
VPGSASLFH

SEQ ID NO: 1268101 - protein, 9 aa, Homo Sapiens
GQWSHFQRV

SEQ ID NO: 1268102 - protein, 9 aa, Homo Sapiens
DLQASLKED

SEQ ID NO: 1268103 - protein, 9 aa, Homo Sapiens
DTPFRKPGW

SEQ ID NO: 1268104 - protein, 9 aa, Homo Sapiens
CVLPHVDFQ

SEQ ID NO: 1268105 - protein, 9 aa, Homo Sapiens
SDTNYLLKM

SEQ ID NO: 1268106 - protein, 9 aa, Homo Sapiens
VYPERWSLA

SEQ ID NO: 1268107 - protein, 9 aa, Homo Sapiens
QAKKTCVSD

SEQ ID NO: 1268108 - protein, 9 aa, Homo Sapiens
WMCRHPRPQ

SEQ ID NO: 1268109 - protein, 9 aa, Homo Sapiens
VTLCIIPQE

SEQ ID NO: 1268110 - protein, 9 aa, Homo Sapiens
ARHRHVLPA

SEQ ID NO: 1268111 - protein, 9 aa, Homo Sapiens
LYVRAPQLR

SEQ ID NO: 1268112 - protein, 9 aa, Homo Sapiens
CPECYPDNH

SEQ ID NO: 1268113 - protein, 9 aa, Homo Sapiens
PSSPPPPLP

SEQ ID NO: 1268114 - protein, 9 aa, Homo Sapiens
ASWVQVILM

SEQ ID NO: 1268115 - protein, 9 aa, Homo Sapiens
AGGPAGWAR

SEQ ID NO: 1268116 - protein, 9 aa, Homo Sapiens
IDPKMDAGM

SEQ ID NO: 1268117 - protein, 9 aa, Homo Sapiens
RNHHMAVHM

SEQ ID NO: 1268118 - protein, 9 aa, Homo Sapiens
SRKLGEHVV

SEQ ID NO: 1268119 - protein, 9 aa, Homo Sapiens
DTLPYTATT

SEQ ID NO: 1268120 - protein, 9 aa, Homo Sapiens
DAMNYRLLP

SEQ ID NO: 1268121 - protein, 9 aa, Homo Sapiens
KAAGGPCLP

SEQ ID NO: 1268122 - protein, 9 aa, Homo Sapiens
EVWKEVRGE

SEQ ID NO: 1268123 - protein, 9 aa, Homo Sapiens
AAHCSTGSS

SEQ ID NO: 1268124 - protein, 9 aa, Homo Sapiens
GLSVTLCII

SEQ ID NO: 1268125 - protein, 9 aa, Homo Sapiens
VTNDTESDT

SEQ ID NO: 1268126 - protein, 9 aa, Homo Sapiens
YVAWIDSVL

SEQ ID NO: 1268127 - protein, 9 aa, Homo Sapiens
FYKDSQGVI

SEQ ID NO: 1268128 - protein, 9 aa, Homo Sapiens
YTRVASYVA

SEQ ID NO: 1268129 - protein, 9 aa, Homo Sapiens
PTRSTVSRT

SEQ ID NO: 1268130 - protein, 9 aa, Homo Sapiens
DGIELTEVS

SEQ ID NO: 1268131 - protein, 9 aa, Homo Sapiens
NDLYWKAQR

SEQ ID NO: 1268132 - protein, 9 aa, Homo Sapiens
DLSRTELRD

SEQ ID NO: 1268133 - protein, 9 aa, Homo Sapiens
IIIEGKLVD

SEQ ID NO: 1268134 - protein, 9 aa, Homo Sapiens
RSILLDEGE

SEQ ID NO: 1268135 - protein, 9 aa, Homo Sapiens
QGLPASRTT

SEQ ID NO: 1268136 - protein, 9 aa, Homo Sapiens
LDSEEGRRP

SEQ ID NO: 1268137 - protein, 9 aa, Homo Sapiens
SWPVAQRMG

SEQ ID NO: 1268138 - protein, 9 aa, Homo Sapiens
ACAKRVVCD

SEQ ID NO: 1268139 - protein, 9 aa, Homo Sapiens
CGITPLPKP

SEQ ID NO: 1268140 - protein, 9 aa, Homo Sapiens
AEVLVHVHA

SEQ ID NO: 1268141 - protein, 9 aa, Homo Sapiens
PLPLPTSQQ

SEQ ID NO: 1268142 - protein, 9 aa, Homo Sapiens
STDLSRTEL

SEQ ID NO: 1268143 - protein, 9 aa, Homo Sapiens
SADQCKEYL

SEQ ID NO: 1268144 - protein, 9 aa, Homo Sapiens
SIRTNLMLM

SEQ ID NO: 1268145 - protein, 9 aa, Homo Sapiens
SNSGVWLDG

SEQ ID NO: 1268146 - protein, 9 aa, Homo Sapiens
VRNEFYKDS

SEQ ID NO: 1268147 - protein, 9 aa, Homo Sapiens
KHRMYVYVL

SEQ ID NO: 1268148 - protein, 9 aa, Homo Sapiens
LEKWETLVS

SEQ ID NO: 1268149 - protein, 9 aa, Homo Sapiens
SRGYPNDTV

SEQ ID NO: 1268150 - protein, 9 aa, Homo Sapiens
RAEFSSLLS

SEQ ID NO: 1268151 - protein, 9 aa, Homo Sapiens
PSVSRICRQ

SEQ ID NO: 1268152 - protein, 9 aa, Homo Sapiens
KYHLCVQLS

SEQ ID NO: 1268153 - protein, 9 aa, Homo Sapiens
MIQLFFSVF

SEQ ID NO: 1268154 - protein, 9 aa, Homo Sapiens
KHLMEKKIN

SEQ ID NO: 1268155 - protein, 9 aa, Homo Sapiens
MLHHCQPNL

SEQ ID NO: 1268156 - protein, 9 aa, Homo Sapiens
TKAAGGPCL

SEQ ID NO: 1268157 - protein, 9 aa, Homo Sapiens
VASLQGIRV

SEQ ID NO: 1268158 - protein, 9 aa, Homo Sapiens
DGSSFAQHQ

SEQ ID NO: 1268159 - protein, 9 aa, Homo Sapiens
HSSSQCTQG

SEQ ID NO: 1268160 - protein, 9 aa, Homo Sapiens
ILVQDTDMA

SEQ ID NO: 1268161 - protein, 9 aa, Homo Sapiens
AEFSSLLSL

SEQ ID NO: 1268162 - protein, 9 aa, Homo Sapiens
GRSQGLPAS

SEQ ID NO: 1268163 - protein, 9 aa, Homo Sapiens
ADQCKEYLP

SEQ ID NO: 1268164 - protein, 9 aa, Homo Sapiens
HQCLSLTMS

SEQ ID NO: 1268165 - protein, 9 aa, Homo Sapiens
FDVTPTTSS

SEQ ID NO: 1268166 - protein, 9 aa, Homo Sapiens
SHSTPPLAL

SEQ ID NO: 1268167 - protein, 9 aa, Homo Sapiens
PGPIIFLQP

SEQ ID NO: 1268168 - protein, 9 aa, Homo Sapiens
LPVGCRPLC

SEQ ID NO: 1268169 - protein, 9 aa, Homo Sapiens
TPPLALATP

SEQ ID NO: 1268170 - protein, 9 aa, Homo Sapiens
EKKVTWMKR

SEQ ID NO: 1268171 - protein, 9 aa, Homo Sapiens
GPAGWARQA

SEQ ID NO: 1268172 - protein, 9 aa, Homo Sapiens
HASGAELVG

SEQ ID NO: 1268173 - protein, 9 aa, Homo Sapiens
IRTNLMLMS

SEQ ID NO: 1268174 - protein, 9 aa, Homo Sapiens
SPVPCTPQH

SEQ ID NO: 1268175 - protein, 9 aa, Homo Sapiens
PFEDRTTFP

SEQ ID NO: 1268176 - protein, 9 aa, Homo Sapiens
SPQVTGEAG

SEQ ID NO: 1268177 - protein, 9 aa, Homo Sapiens
RRNLILRKP

SEQ ID NO: 1268178 - protein, 9 aa, Homo Sapiens
GLSPGACRP

SEQ ID NO: 1268179 - protein, 9 aa, Homo Sapiens
GSPVGDVGL

SEQ ID NO: 1268180 - protein, 9 aa, Homo Sapiens
PSLHPACAV

SEQ ID NO: 1268181 - protein, 9 aa, Homo Sapiens
HEYHIVKKS

SEQ ID NO: 1268182 - protein, 9 aa, Homo Sapiens
DGTTRRTKT

SEQ ID NO: 1268183 - protein, 9 aa, Homo Sapiens
VGPHARVDA

SEQ ID NO: 1268184 - protein, 9 aa, Homo Sapiens
QVQSQEHVE

SEQ ID NO: 1268185 - protein, 9 aa, Homo Sapiens
ACRPACTCI

SEQ ID NO: 1268186 - protein, 9 aa, Homo Sapiens
LTLALKEIP

SEQ ID NO: 1268187 - protein, 9 aa, Homo Sapiens
GTILAYCSL

SEQ ID NO: 1268188 - protein, 9 aa, Homo Sapiens
ASRKTWQRR

SEQ ID NO: 1268189 - protein, 9 aa, Homo Sapiens
MFLLEFLLP

SEQ ID NO: 1268190 - protein, 9 aa, Homo Sapiens
VHVESGKVY

SEQ ID NO: 1268191 - protein, 9 aa, Homo Sapiens
ILVPRLECS

SEQ ID NO: 1268192 - protein, 9 aa, Homo Sapiens
PPGSPSLSC

SEQ ID NO: 1268193 - protein, 9 aa, Homo Sapiens
SRTELRDGQ

SEQ ID NO: 1268194 - protein, 9 aa, Homo Sapiens
EQFEEFAKV

SEQ ID NO: 1268195 - protein, 9 aa, Homo Sapiens
SVLCWWLLS

SEQ ID NO: 1268196 - protein, 9 aa, Homo Sapiens
GLVLLRQWQ

SEQ ID NO: 1268197 - protein, 9 aa, Homo Sapiens
TRLMAPVGS

SEQ ID NO: 1268198 - protein, 9 aa, Homo Sapiens
ISTLVHADQ

SEQ ID NO: 1268199 - protein, 9 aa, Homo Sapiens
VLPHVDFQL

SEQ ID NO: 1268200 - protein, 9 aa, Homo Sapiens
RPVVVPGVQ

SEQ ID NO: 1268201 - protein, 9 aa, Homo Sapiens
SHIETAPFK

SEQ ID NO: 1268202 - protein, 9 aa, Homo Sapiens
ASASPSIRS

SEQ ID NO: 1268203 - protein, 9 aa, Homo Sapiens
PILAPGEDG

SEQ ID NO: 1268204 - protein, 9 aa, Homo Sapiens
TGSSCPLGS

SEQ ID NO: 1268205 - protein, 9 aa, Homo Sapiens
SDPPSPSRT

SEQ ID NO: 1268206 - protein, 9 aa, Homo Sapiens
RTNLMLMSR

SEQ ID NO: 1268207 - protein, 9 aa, Homo Sapiens
PTPCRVASL

SEQ ID NO: 1268208 - protein, 9 aa, Homo Sapiens
KGECGSGGV

SEQ ID NO: 1268209 - protein, 9 aa, Homo Sapiens
FFILVPRLE

SEQ ID NO: 1268210 - protein, 9 aa, Homo Sapiens
RSQGLPASR

SEQ ID NO: 1268211 - protein, 9 aa, Homo Sapiens
PTVTIWMCR

SEQ ID NO: 1268212 - protein, 9 aa, Homo Sapiens
WDIVAEGQT

SEQ ID NO: 1268213 - protein, 9 aa, Homo Sapiens
CRAFLGPFA

SEQ ID NO: 1268214 - protein, 9 aa, Homo Sapiens
KLDGMQRRV

SEQ ID NO: 1268215 - protein, 9 aa, Homo Sapiens
MKMLHHCQP

SEQ ID NO: 1268216 - protein, 9 aa, Homo Sapiens
KEQFEEFAK

SEQ ID NO: 1268217 - protein, 9 aa, Homo Sapiens
LDDQIQWPT

SEQ ID NO: 1268218 - protein, 9 aa, Homo Sapiens
ERGGGCLPP

SEQ ID NO: 1268219 - protein, 9 aa, Homo Sapiens
PSGTPPSPV

SEQ ID NO: 1268220 - protein, 9 aa, Homo Sapiens
ALNLTLALK

SEQ ID NO: 1268221 - protein, 9 aa, Homo Sapiens
PDNRTPTWR

SEQ ID NO: 1268222 - protein, 9 aa, Homo Sapiens
HINDIVPES

SEQ ID NO: 1268223 - protein, 9 aa, Homo Sapiens
SCPLGSVLC

SEQ ID NO: 1268224 - protein, 9 aa, Homo Sapiens
AQFTVDRIP

SEQ ID NO: 1268225 - protein, 9 aa, Homo Sapiens
IKYSGPYHI

SEQ ID NO: 1268226 - protein, 9 aa, Homo Sapiens
LPGEADLAD

SEQ ID NO: 1268227 - protein, 9 aa, Homo Sapiens
ILLDEGEDE

SEQ ID NO: 1268228 - protein, 9 aa, Homo Sapiens
CPPVPGSAS

SEQ ID NO: 1268229 - protein, 9 aa, Homo Sapiens
GHRHAEPGP

SEQ ID NO: 1268230 - protein, 9 aa, Homo Sapiens
HLPTLASRV

SEQ ID NO: 1268231 - protein, 9 aa, Homo Sapiens
GHGDHLDRR

SEQ ID NO: 1268232 - protein, 9 aa, Homo Sapiens
TQAHRHTHR

SEQ ID NO: 1268233 - protein, 9 aa, Homo Sapiens
VSVHVESGK

SEQ ID NO: 1268234 - protein, 9 aa, Homo Sapiens
VDAMNYRLL

SEQ ID NO: 1268235 - protein, 9 aa, Homo Sapiens
SVSRICRQK

SEQ ID NO: 1268236 - protein, 9 aa, Homo Sapiens
LVVQLLVTQ

SEQ ID NO: 1268237 - protein, 9 aa, Homo Sapiens
KHSSALVSL

SEQ ID NO: 1268238 - protein, 9 aa, Homo Sapiens
PVPGSASLF

SEQ ID NO: 1268239 - protein, 9 aa, Homo Sapiens
LVQKAQFTV

SEQ ID NO: 1268240 - protein, 9 aa, Homo Sapiens
HHTREIFVL

SEQ ID NO: 1268241 - protein, 9 aa, Homo Sapiens
WDPWNLGPW

SEQ ID NO: 1268242 - protein, 9 aa, Homo Sapiens
QDVYSVVIS

SEQ ID NO: 1268243 - protein, 9 aa, Homo Sapiens
TMPPLLHPQ

SEQ ID NO: 1268244 - protein, 9 aa, Homo Sapiens
SSSGGRTAA

SEQ ID NO: 1268245 - protein, 9 aa, Homo Sapiens
RGGRMRVAF

SEQ ID NO: 1268246 - protein, 9 aa, Homo Sapiens
HHMAVHMQT

SEQ ID NO: 1268247 - protein, 9 aa, Homo Sapiens
RVWVPDNRT

SEQ ID NO: 1268248 - protein, 9 aa, Homo Sapiens
ALQQASPSR

SEQ ID NO: 1268249 - protein, 9 aa, Homo Sapiens
SCHFKRVQQ

SEQ ID NO: 1268250 - protein, 9 aa, Homo Sapiens
VSALDELDT

SEQ ID NO: 1268251 - protein, 9 aa, Homo Sapiens
VACAKRVVC

SEQ ID NO: 1268252 - protein, 9 aa, Homo Sapiens
AYTHTQVHT

SEQ ID NO: 1268253 - protein, 9 aa, Homo Sapiens
PEPGDPDAV

SEQ ID NO: 1268254 - protein, 9 aa, Homo Sapiens
HEYQYMPRP

SEQ ID NO: 1268255 - protein, 9 aa, Homo Sapiens
VRLAARQPA

SEQ ID NO: 1268256 - protein, 9 aa, Homo Sapiens
HAFIVQALC

SEQ ID NO: 1268257 - protein, 9 aa, Homo Sapiens
PPSPTIPCP

SEQ ID NO: 1268258 - protein, 9 aa, Homo Sapiens
INNQIIVNT

SEQ ID NO: 1268259 - protein, 9 aa, Homo Sapiens
SPIGLGGQH

SEQ ID NO: 1268260 - protein, 9 aa, Homo Sapiens
ASSFWLIFI

SEQ ID NO: 1268261 - protein, 9 aa, Homo Sapiens
GYRERGGGC

SEQ ID NO: 1268262 - protein, 9 aa, Homo Sapiens
QAMYQVFWS

SEQ ID NO: 1268263 - protein, 9 aa, Homo Sapiens
VVHHALARH

SEQ ID NO: 1268264 - protein, 9 aa, Homo Sapiens
NRPKRPSVS

SEQ ID NO: 1268265 - protein, 9 aa, Homo Sapiens
VRVKANLRW

SEQ ID NO: 1268266 - protein, 9 aa, Homo Sapiens
LLEFPLQLE

SEQ ID NO: 1268267 - protein, 9 aa, Homo Sapiens
EARAAHRRP

SEQ ID NO: 1268268 - protein, 9 aa, Homo Sapiens
ALPVCLGAA

SEQ ID NO: 1268269 - protein, 9 aa, Homo Sapiens
WRQGGSPVG

SEQ ID NO: 1268270 - protein, 9 aa, Homo Sapiens
PVGSVMSCS

SEQ ID NO: 1268271 - protein, 9 aa, Homo Sapiens
CLPPEPGDP

SEQ ID NO: 1268272 - protein, 9 aa, Homo Sapiens
YPPARQPSR

SEQ ID NO: 1268273 - protein, 9 aa, Homo Sapiens
LWDLGVLQP

SEQ ID NO: 1268274 - protein, 9 aa, Homo Sapiens
VTGEAGTSE

SEQ ID NO: 1268275 - protein, 9 aa, Homo Sapiens
DAQPSTTEK

SEQ ID NO: 1268276 - protein, 9 aa, Homo Sapiens
HTDTHTGTD

SEQ ID NO: 1268277 - protein, 9 aa, Homo Sapiens
GRAQGRRAP

SEQ ID NO: 1268278 - protein, 9 aa, Homo Sapiens
VWQDASSFW

SEQ ID NO: 1268279 - protein, 9 aa, Homo Sapiens
PPVKVRTKA

SEQ ID NO: 1268280 - protein, 9 aa, Homo Sapiens
TGQPILPDF

SEQ ID NO: 1268281 - protein, 9 aa, Homo Sapiens
YLDSGCGFC

SEQ ID NO: 1268282 - protein, 9 aa, Homo Sapiens
HHCQPNLLI

SEQ ID NO: 1268283 - protein, 9 aa, Homo Sapiens
GPIIFLQPP

SEQ ID NO: 1268284 - protein, 9 aa, Homo Sapiens
NGSSDPTKA

SEQ ID NO: 1268285 - protein, 9 aa, Homo Sapiens
ARHQLFVVM

SEQ ID NO: 1268286 - protein, 9 aa, Homo Sapiens
EGEKQRVLS

SEQ ID NO: 1268287 - protein, 9 aa, Homo Sapiens
PGQPCLPPT

SEQ ID NO: 1268288 - protein, 9 aa, Homo Sapiens
TWQRRLRAC

SEQ ID NO: 1268289 - protein, 9 aa, Homo Sapiens
LEFNTQREE

SEQ ID NO: 1268290 - protein, 9 aa, Homo Sapiens
SGPYHIGGS

SEQ ID NO: 1268291 - protein, 9 aa, Homo Sapiens
TQEVEIGTV

SEQ ID NO: 1268292 - protein, 9 aa, Homo Sapiens
QLLLLLLLD

SEQ ID NO: 1268293 - protein, 9 aa, Homo Sapiens
FMLSMYQTD

SEQ ID NO: 1268294 - protein, 9 aa, Homo Sapiens
MLSMYQTDF

SEQ ID NO: 1268295 - protein, 9 aa, Homo Sapiens
GLPASRTTA

SEQ ID NO: 1268296 - protein, 9 aa, Homo Sapiens
KWMAEIECD

SEQ ID NO: 1268297 - protein, 9 aa, Homo Sapiens
ISEKKVTWM

SEQ ID NO: 1268298 - protein, 9 aa, Homo Sapiens
PTLDFKKQS

SEQ ID NO: 1268299 - protein, 9 aa, Homo Sapiens
SGPCHAAAL

SEQ ID NO: 1268300 - protein, 9 aa, Homo Sapiens
GTQEVEIGT

SEQ ID NO: 1268301 - protein, 9 aa, Homo Sapiens
FWLKVLLVQ

SEQ ID NO: 1268302 - protein, 9 aa, Homo Sapiens
GRTPTTRLM

SEQ ID NO: 1268303 - protein, 9 aa, Homo Sapiens
VDIHLLREE

SEQ ID NO: 1268304 - protein, 9 aa, Homo Sapiens
KPTLDFKKQ

SEQ ID NO: 1268305 - protein, 9 aa, Homo Sapiens
LSNVAPPAF

SEQ ID NO: 1268306 - protein, 9 aa, Homo Sapiens
PQWAPHSAG

SEQ ID NO: 1268307 - protein, 9 aa, Homo Sapiens
GCPKRKGNN

SEQ ID NO: 1268308 - protein, 9 aa, Homo Sapiens
NADGLIAHT

SEQ ID NO: 1268309 - protein, 9 aa, Homo Sapiens
CGKKVENTR

SEQ ID NO: 1268310 - protein, 9 aa, Homo Sapiens
LLCSHLGET

SEQ ID NO: 1268311 - protein, 9 aa, Homo Sapiens
LPGMGPHVP

SEQ ID NO: 1268312 - protein, 9 aa, Homo Sapiens
AFCFLIQSQ

SEQ ID NO: 1268313 - protein, 9 aa, Homo Sapiens
YQGPGWEEA

SEQ ID NO: 1268314 - protein, 9 aa, Homo Sapiens
VAGTAGARH

SEQ ID NO: 1268315 - protein, 9 aa, Homo Sapiens
SYDAVQHCR

SEQ ID NO: 1268316 - protein, 9 aa, Homo Sapiens
RVAGTAGAR

SEQ ID NO: 1268317 - protein, 9 aa, Homo Sapiens
SRSNSGVWL

SEQ ID NO: 1268318 - protein, 9 aa, Homo Sapiens
LSLTLPQLS

SEQ ID NO: 1268319 - protein, 9 aa, Homo Sapiens
LPPKPSTPH

SEQ ID NO: 1268320 - protein, 9 aa, Homo Sapiens
CVEQGKQQL

SEQ ID NO: 1268321 - protein, 9 aa, Homo Sapiens
PALNLTLAL

SEQ ID NO: 1268322 - protein, 9 aa, Homo Sapiens
RPACTCISM

SEQ ID NO: 1268323 - protein, 9 aa, Homo Sapiens
CHNLELERN

SEQ ID NO: 1268324 - protein, 9 aa, Homo Sapiens
QDIPDGLFW

SEQ ID NO: 1268325 - protein, 9 aa, Homo Sapiens
KIKHSSALV

SEQ ID NO: 1268326 - protein, 9 aa, Homo Sapiens
SSQNWGSLP

SEQ ID NO: 1268327 - protein, 9 aa, Homo Sapiens
FPDAQPSTT

SEQ ID NO: 1268328 - protein, 9 aa, Homo Sapiens
GGATENTSY

SEQ ID NO: 1268329 - protein, 9 aa, Homo Sapiens
KNKEKLRKT

SEQ ID NO: 1268330 - protein, 9 aa, Homo Sapiens
SYFYTAIVA

SEQ ID NO: 1268331 - protein, 9 aa, Homo Sapiens
LNATCWQPW

SEQ ID NO: 1268332 - protein, 9 aa, Homo Sapiens
TRPEMREDR

SEQ ID NO: 1268333 - protein, 9 aa, Homo Sapiens
PRLCIWKFF

SEQ ID NO: 1268334 - protein, 9 aa, Homo Sapiens
DPDAVVASS

SEQ ID NO: 1268335 - protein, 9 aa, Homo Sapiens
YSGPYHIGG

SEQ ID NO: 1268336 - protein, 9 aa, Homo Sapiens
WRQQSACIG

SEQ ID NO: 1268337 - protein, 9 aa, Homo Sapiens
HDTRPEMRE

SEQ ID NO: 1268338 - protein, 9 aa, Homo Sapiens
DVCRAFLGP

SEQ ID NO: 1268339 - protein, 9 aa, Homo Sapiens
TSELEFNTQ

SEQ ID NO: 1268340 - protein, 9 aa, Homo Sapiens
WTEGEKQRV

SEQ ID NO: 1268341 - protein, 9 aa, Homo Sapiens
SYPYIRTLL

SEQ ID NO: 1268342 - protein, 9 aa, Homo Sapiens
VSEGGPEAP

SEQ ID NO: 1268343 - protein, 9 aa, Homo Sapiens
NTDGPKMET

SEQ ID NO: 1268344 - protein, 9 aa, Homo Sapiens
AARYRRPTM

SEQ ID NO: 1268345 - protein, 9 aa, Homo Sapiens
REKVKDMFK

SEQ ID NO: 1268346 - protein, 9 aa, Homo Sapiens
VVVPGVQLR

SEQ ID NO: 1268347 - protein, 9 aa, Homo Sapiens
KNVLVTGEF

SEQ ID NO: 1268348 - protein, 9 aa, Homo Sapiens
AAGEGPGCT

SEQ ID NO: 1268349 - protein, 9 aa, Homo Sapiens
NNGSPQGVQ

SEQ ID NO: 1268350 - protein, 9 aa, Homo Sapiens
VDAQVGPLP

SEQ ID NO: 1268351 - protein, 9 aa, Homo Sapiens
PCVKTWASL

SEQ ID NO: 1268352 - protein, 9 aa, Homo Sapiens
FHRRRAQGH

SEQ ID NO: 1268353 - protein, 9 aa, Homo Sapiens
TFWLKVLLV

SEQ ID NO: 1268354 - protein, 9 aa, Homo Sapiens
CHHWSKASE

SEQ ID NO: 1268355 - protein, 9 aa, Homo Sapiens
IQVHQALQQ

SEQ ID NO: 1268356 - protein, 9 aa, Homo Sapiens
RGKVDIHLL

SEQ ID NO: 1268357 - protein, 9 aa, Homo Sapiens
CSSLHLFSS

SEQ ID NO: 1268358 - protein, 9 aa, Homo Sapiens
RRRNLILRK

SEQ ID NO: 1268359 - protein, 9 aa, Homo Sapiens
RTMPPALPL

SEQ ID NO: 1268360 - protein, 9 aa, Homo Sapiens
PNNGSPQGV

SEQ ID NO: 1268361 - protein, 9 aa, Homo Sapiens
VLTALGRSQ

SEQ ID NO: 1268362 - protein, 9 aa, Homo Sapiens
GRRWGAWHP

SEQ ID NO: 1268363 - protein, 9 aa, Homo Sapiens
HLRSIRTNL

SEQ ID NO: 1268364 - protein, 9 aa, Homo Sapiens
AVGLWGTGV

SEQ ID NO: 1268365 - protein, 9 aa, Homo Sapiens
RLRSILLDE

SEQ ID NO: 1268366 - protein, 9 aa, Homo Sapiens
PTITAKLYV

SEQ ID NO: 1268367 - protein, 9 aa, Homo Sapiens
NSGVETSFR

SEQ ID NO: 1268368 - protein, 9 aa, Homo Sapiens
WLLPGMGPH

SEQ ID NO: 1268369 - protein, 9 aa, Homo Sapiens
PCPTDSLLC

SEQ ID NO: 1268370 - protein, 9 aa, Homo Sapiens
LEFLLPLGI

SEQ ID NO: 1268371 - protein, 9 aa, Homo Sapiens
ENNHIDWRI

SEQ ID NO: 1268372 - protein, 9 aa, Homo Sapiens
KVTSTVSLV

SEQ ID NO: 1268373 - protein, 9 aa, Homo Sapiens
PEHRRVVIE

SEQ ID NO: 1268374 - protein, 9 aa, Homo Sapiens
VKSSEYYEN

SEQ ID NO: 1268375 - protein, 9 aa, Homo Sapiens
GAWHPGSWP

SEQ ID NO: 1268376 - protein, 9 aa, Homo Sapiens
LLRQWQRAK

SEQ ID NO: 1268377 - protein, 9 aa, Homo Sapiens
VHQALQQAS

SEQ ID NO: 1268378 - protein, 9 aa, Homo Sapiens
KILFQALSP

SEQ ID NO: 1268379 - protein, 9 aa, Homo Sapiens
PTKHSRKKM

SEQ ID NO: 1268380 - protein, 9 aa, Homo Sapiens
LGSVLCWWL

SEQ ID NO: 1268381 - protein, 9 aa, Homo Sapiens
LTGVMICAY

SEQ ID NO: 1268382 - protein, 9 aa, Homo Sapiens
APDASREDS

SEQ ID NO: 1268383 - protein, 9 aa, Homo Sapiens
GVIPAPPNT

SEQ ID NO: 1268384 - protein, 9 aa, Homo Sapiens
DLLGHSKTR

SEQ ID NO: 1268385 - protein, 9 aa, Homo Sapiens
DELNKSKIV

SEQ ID NO: 1268386 - protein, 9 aa, Homo Sapiens
CPAQMCASL

SEQ ID NO: 1268387 - protein, 9 aa, Homo Sapiens
RLSNVAPPA

SEQ ID NO: 1268388 - protein, 9 aa, Homo Sapiens
LLLLLLLDL

SEQ ID NO: 1268389 - protein, 9 aa, Homo Sapiens
PSLRAARAH

SEQ ID NO: 1268390 - protein, 9 aa, Homo Sapiens
SYHMKPLQM

SEQ ID NO: 1268391 - protein, 9 aa, Homo Sapiens
GYRCRWCSS

SEQ ID NO: 1268392 - protein, 9 aa, Homo Sapiens
KLHPQKLQD

SEQ ID NO: 1268393 - protein, 9 aa, Homo Sapiens
YPDNHANRS

SEQ ID NO: 1268394 - protein, 9 aa, Homo Sapiens
RSDLIEKRL

SEQ ID NO: 1268395 - protein, 9 aa, Homo Sapiens
TLEEVPAML

SEQ ID NO: 1268396 - protein, 9 aa, Homo Sapiens
RLIVSKNAG

SEQ ID NO: 1268397 - protein, 9 aa, Homo Sapiens
HVPRQLPGP

SEQ ID NO: 1268398 - protein, 9 aa, Homo Sapiens
STKGHDEAK

SEQ ID NO: 1268399 - protein, 9 aa, Homo Sapiens
DYKWRFLLG

SEQ ID NO: 1268400 - protein, 9 aa, Homo Sapiens
PLSAVTALL

SEQ ID NO: 1268401 - protein, 9 aa, Homo Sapiens
LCSSLHLFS

SEQ ID NO: 1268402 - protein, 9 aa, Homo Sapiens
AALQAKKTC

SEQ ID NO: 1268403 - protein, 9 aa, Homo Sapiens
PGGVIPAPP

SEQ ID NO: 1268404 - protein, 9 aa, Homo Sapiens
TEAIKYLKN

SEQ ID NO: 1268405 - protein, 9 aa, Homo Sapiens
LELWKYEAI

SEQ ID NO: 1268406 - protein, 9 aa, Homo Sapiens
PPALPLEAV

SEQ ID NO: 1268407 - protein, 9 aa, Homo Sapiens
VMMKMLHHC

SEQ ID NO: 1268408 - protein, 9 aa, Homo Sapiens
LLRGARPVC

SEQ ID NO: 1268409 - protein, 9 aa, Homo Sapiens
CGIMDPPSL

SEQ ID NO: 1268410 - protein, 9 aa, Homo Sapiens
TPQHCPPVP

SEQ ID NO: 1268411 - protein, 9 aa, Homo Sapiens
TALPTRRPP

SEQ ID NO: 1268412 - protein, 9 aa, Homo Sapiens
SSPIGLGGQ

SEQ ID NO: 1268413 - protein, 9 aa, Homo Sapiens
LNWAQKEYG

SEQ ID NO: 1268414 - protein, 9 aa, Homo Sapiens
NLPGCPKRK

SEQ ID NO: 1268415 - protein, 9 aa, Homo Sapiens
LLCEYLLYG

SEQ ID NO: 1268416 - protein, 9 aa, Homo Sapiens
KGTEVPWPE

SEQ ID NO: 1268417 - protein, 9 aa, Homo Sapiens
VRAREALVA

SEQ ID NO: 1268418 - protein, 9 aa, Homo Sapiens
INEAKAITS

SEQ ID NO: 1268419 - protein, 9 aa, Homo Sapiens
GGRTAAVGK

SEQ ID NO: 1268420 - protein, 9 aa, Homo Sapiens
AELVGFQRD

SEQ ID NO: 1268421 - protein, 9 aa, Homo Sapiens
MFKEEQQKL

SEQ ID NO: 1268422 - protein, 9 aa, Homo Sapiens
WHPGSWPVA

SEQ ID NO: 1268423 - protein, 9 aa, Homo Sapiens
GPAPALPSQ

SEQ ID NO: 1268424 - protein, 9 aa, Homo Sapiens
VLEEVIREG

SEQ ID NO: 1268425 - protein, 9 aa, Homo Sapiens
NHANRSLVL

SEQ ID NO: 1268426 - protein, 9 aa, Homo Sapiens
LCDLMSTRR

SEQ ID NO: 1268427 - protein, 9 aa, Homo Sapiens
RTKTKVTKT

SEQ ID NO: 1268428 - protein, 9 aa, Homo Sapiens
LPLLIANTL

SEQ ID NO: 1268429 - protein, 9 aa, Homo Sapiens
GVDSKDKTS

SEQ ID NO: 1268430 - protein, 9 aa, Homo Sapiens
VDYFYLEIF

SEQ ID NO: 1268431 - protein, 9 aa, Homo Sapiens
SSRASTSWC

SEQ ID NO: 1268432 - protein, 9 aa, Homo Sapiens
TQEYTGTHR

SEQ ID NO: 1268433 - protein, 9 aa, Homo Sapiens
PVGQRMTEP

SEQ ID NO: 1268434 - protein, 9 aa, Homo Sapiens
PCHAAALAL

SEQ ID NO: 1268435 - protein, 9 aa, Homo Sapiens
FSGHAGNHG

SEQ ID NO: 1268436 - protein, 9 aa, Homo Sapiens
GLNTTQAGG

SEQ ID NO: 1268437 - protein, 9 aa, Homo Sapiens
KWRFLLGGS

SEQ ID NO: 1268438 - protein, 9 aa, Homo Sapiens
AAKHKKPQP

SEQ ID NO: 1268439 - protein, 9 aa, Homo Sapiens
SIPLLGSLA

SEQ ID NO: 1268440 - protein, 9 aa, Homo Sapiens
DSEEGRRPL

SEQ ID NO: 1268441 - protein, 9 aa, Homo Sapiens
LLGHIWVER

SEQ ID NO: 1268442 - protein, 9 aa, Homo Sapiens
FSQDVYSVV

SEQ ID NO: 1268443 - protein, 9 aa, Homo Sapiens
VCHLQARGP

SEQ ID NO: 1268444 - protein, 9 aa, Homo Sapiens
QKILFQALS

SEQ ID NO: 1268445 - protein, 9 aa, Homo Sapiens
KNPILAPGE

SEQ ID NO: 1268446 - protein, 9 aa, Homo Sapiens
EGGPEAPST

SEQ ID NO: 1268447 - protein, 9 aa, Homo Sapiens
LRKGRNNKL

SEQ ID NO: 1268448 - protein, 9 aa, Homo Sapiens
DLADGAHVW

SEQ ID NO: 1268449 - protein, 9 aa, Homo Sapiens
SSYVSVHVE

SEQ ID NO: 1268450 - protein, 9 aa, Homo Sapiens
TGMHRHTHT

SEQ ID NO: 1268451 - protein, 9 aa, Homo Sapiens
ASAAPDASR

SEQ ID NO: 1268452 - protein, 9 aa, Homo Sapiens
LVEWKWRQQ

SEQ ID NO: 1268453 - protein, 9 aa, Homo Sapiens
FFNSIPLLG

SEQ ID NO: 1268454 - protein, 9 aa, Homo Sapiens
EVVNENAKT

SEQ ID NO: 1268455 - protein, 9 aa, Homo Sapiens
ESLKKFLSV

SEQ ID NO: 1268456 - protein, 9 aa, Homo Sapiens
HRHVLPAPL

SEQ ID NO: 1268457 - protein, 9 aa, Homo Sapiens
SVVISEDAL

SEQ ID NO: 1268458 - protein, 9 aa, Homo Sapiens
ALAPRHRGG

SEQ ID NO: 1268459 - protein, 9 aa, Homo Sapiens
QMARPGGPE

SEQ ID NO: 1268460 - protein, 9 aa, Homo Sapiens
WPGDKGNFG

SEQ ID NO: 1268461 - protein, 9 aa, Homo Sapiens
YQLRTLDPL

SEQ ID NO: 1268462 - protein, 9 aa, Homo Sapiens
PHSWPQRPE

SEQ ID NO: 1268463 - protein, 9 aa, Homo Sapiens
WKEVRGEWR

SEQ ID NO: 1268464 - protein, 9 aa, Homo Sapiens
PHSAGLSPG

SEQ ID NO: 1268465 - protein, 9 aa, Homo Sapiens
STVSLVGRS

SEQ ID NO: 1268466 - protein, 9 aa, Homo Sapiens
ILLRGARPV

SEQ ID NO: 1268467 - protein, 9 aa, Homo Sapiens
EHVLEEVIR

SEQ ID NO: 1268468 - protein, 9 aa, Homo Sapiens
FEVGPRDMK

SEQ ID NO: 1268469 - protein, 9 aa, Homo Sapiens
DFVFSKYCH

SEQ ID NO: 1268470 - protein, 9 aa, Homo Sapiens
YTDKTDKQE

SEQ ID NO: 1268471 - protein, 9 aa, Homo Sapiens
RVDAHVVLE

SEQ ID NO: 1268472 - protein, 9 aa, Homo Sapiens
DIKWFVARL

SEQ ID NO: 1268473 - protein, 9 aa, Homo Sapiens
YQGYSEYDG

SEQ ID NO: 1268474 - protein, 9 aa, Homo Sapiens
LPGCPKRKG

SEQ ID NO: 1268475 - protein, 9 aa, Homo Sapiens
TRRTKTKVT

SEQ ID NO: 1268476 - protein, 9 aa, Homo Sapiens
GQLLLLLLL

SEQ ID NO: 1268477 - protein, 9 aa, Homo Sapiens
EKVKDMFKE

SEQ ID NO: 1268478 - protein, 9 aa, Homo Sapiens
EAMSAIEMI

SEQ ID NO: 1268479 - protein, 9 aa, Homo Sapiens
HCSTGSSCP

SEQ ID NO: 1268480 - protein, 9 aa, Homo Sapiens
EPGDPDAVV

SEQ ID NO: 1268481 - protein, 9 aa, Homo Sapiens
TVTVPAGIR

SEQ ID NO: 1268482 - protein, 9 aa, Homo Sapiens
HPRPQLSLT

SEQ ID NO: 1268483 - protein, 9 aa, Homo Sapiens
TPGPIIFLQ

SEQ ID NO: 1268484 - protein, 9 aa, Homo Sapiens
VRAPQLRET

SEQ ID NO: 1268485 - protein, 9 aa, Homo Sapiens
WSMKLRNES

SEQ ID NO: 1268486 - protein, 9 aa, Homo Sapiens
ETAPFKAPE

SEQ ID NO: 1268487 - protein, 9 aa, Homo Sapiens
THTGIHTDT

SEQ ID NO: 1268488 - protein, 9 aa, Homo Sapiens
EKKLHPQKL

SEQ ID NO: 1268489 - protein, 9 aa, Homo Sapiens
LSRVSGVLT

SEQ ID NO: 1268490 - protein, 9 aa, Homo Sapiens
IMDPPSLMT

SEQ ID NO: 1268491 - protein, 9 aa, Homo Sapiens
HATLMDLVD

SEQ ID NO: 1268492 - protein, 9 aa, Homo Sapiens
LSPGACRPA

SEQ ID NO: 1268493 - protein, 9 aa, Homo Sapiens
RQPAQRRHA

SEQ ID NO: 1268494 - protein, 9 aa, Homo Sapiens
KAANEAKGK

SEQ ID NO: 1268495 - protein, 9 aa, Homo Sapiens
FLNSTNSWW

SEQ ID NO: 1268496 - protein, 9 aa, Homo Sapiens
RTPGPIIFL

SEQ ID NO: 1268497 - protein, 9 aa, Homo Sapiens
KYCHRALLL

SEQ ID NO: 1268498 - protein, 9 aa, Homo Sapiens
PMYCSILLE

SEQ ID NO: 1268499 - protein, 9 aa, Homo Sapiens
ARHALHGQP

SEQ ID NO: 1268500 - protein, 9 aa, Homo Sapiens
QSTPWMTGV

SEQ ID NO: 1268501 - protein, 9 aa, Homo Sapiens
GQVQSQEHV

SEQ ID NO: 1268502 - protein, 9 aa, Homo Sapiens
LPTSQQPPV

SEQ ID NO: 1268503 - protein, 9 aa, Homo Sapiens
ESPWRPKTR

SEQ ID NO: 1268504 - protein, 9 aa, Homo Sapiens
KDHCMAHKL

SEQ ID NO: 1268505 - protein, 9 aa, Homo Sapiens
QVGPLPCVL

SEQ ID NO: 1268506 - protein, 9 aa, Homo Sapiens
EEASQVGGT

SEQ ID NO: 1268507 - protein, 9 aa, Homo Sapiens
GPCHAAALA

SEQ ID NO: 1268508 - protein, 9 aa, Homo Sapiens
ERYKEEFQR

SEQ ID NO: 1268509 - protein, 9 aa, Homo Sapiens
GDPDAVVAS

SEQ ID NO: 1268510 - protein, 9 aa, Homo Sapiens
SYPPARQPS

SEQ ID NO: 1268511 - protein, 9 aa, Homo Sapiens
VGKARRRNA

SEQ ID NO: 1268512 - protein, 9 aa, Homo Sapiens
PDGQSLPQA

SEQ ID NO: 1268513 - protein, 9 aa, Homo Sapiens
NQKKAKIKK

SEQ ID NO: 1268514 - protein, 9 aa, Homo Sapiens
PCCCRETLK

SEQ ID NO: 1268515 - protein, 9 aa, Homo Sapiens
GPISTLVHA

SEQ ID NO: 1268516 - protein, 9 aa, Homo Sapiens
LATPTPSQQ

SEQ ID NO: 1268517 - protein, 9 aa, Homo Sapiens
HVHAEHEVR

SEQ ID NO: 1268518 - protein, 9 aa, Homo Sapiens
CMAHKLFNN

SEQ ID NO: 1268519 - protein, 9 aa, Homo Sapiens
SRVSGVLTA

SEQ ID NO: 1268520 - protein, 9 aa, Homo Sapiens
TAPKPPQLR

SEQ ID NO: 1268521 - protein, 9 aa, Homo Sapiens
LAGDALPVC

SEQ ID NO: 1268522 - protein, 9 aa, Homo Sapiens
QAVRPCVKT

SEQ ID NO: 1268523 - protein, 9 aa, Homo Sapiens
RRVQRAHAR

SEQ ID NO: 1268524 - protein, 9 aa, Homo Sapiens
FRFCLPVGL

SEQ ID NO: 1268525 - protein, 9 aa, Homo Sapiens
VCLGAAAHQ

SEQ ID NO: 1268526 - protein, 9 aa, Homo Sapiens
LKEIPSKLE

SEQ ID NO: 1268527 - protein, 9 aa, Homo Sapiens
CIIISGERG

SEQ ID NO: 1268528 - protein, 9 aa, Homo Sapiens
AVQVVRARE

SEQ ID NO: 1268529 - protein, 9 aa, Homo Sapiens
SGKQKPHRR

SEQ ID NO: 1268530 - protein, 9 aa, Homo Sapiens
HTQAHRHTH

SEQ ID NO: 1268531 - protein, 9 aa, Homo Sapiens
AQVGPLPCV

SEQ ID NO: 1268532 - protein, 9 aa, Homo Sapiens
AGARHHTRE

SEQ ID NO: 1268533 - protein, 9 aa, Homo Sapiens
RQWQRAKRN

SEQ ID NO: 1268534 - protein, 9 aa, Homo Sapiens
PVVVPGVQL

SEQ ID NO: 1268535 - protein, 9 aa, Homo Sapiens
AKAITSVNS

SEQ ID NO: 1268536 - protein, 9 aa, Homo Sapiens
LGGQHTRGA

SEQ ID NO: 1268537 - protein, 9 aa, Homo Sapiens
CLPRRAPQG

SEQ ID NO: 1268538 - protein, 9 aa, Homo Sapiens
ATPTSPVSH

SEQ ID NO: 1268539 - protein, 9 aa, Homo Sapiens
PPAPTPCTD

SEQ ID NO: 1268540 - protein, 9 aa, Homo Sapiens
PPVIYVPDF

SEQ ID NO: 1268541 - protein, 9 aa, Homo Sapiens
SLLCLLRLS

SEQ ID NO: 1268542 - protein, 9 aa, Homo Sapiens
KSQPHSWPQ

SEQ ID NO: 1268543 - protein, 9 aa, Homo Sapiens
PEEESYPYI

SEQ ID NO: 1268544 - protein, 9 aa, Homo Sapiens
LALKEIPSK

SEQ ID NO: 1268545 - protein, 9 aa, Homo Sapiens
LDSSSASHE

SEQ ID NO: 1268546 - protein, 9 aa, Homo Sapiens
HRHTLTQAY

SEQ ID NO: 1268547 - protein, 9 aa, Homo Sapiens
QRLHPTKEE

SEQ ID NO: 1268548 - protein, 9 aa, Homo Sapiens
LALSRVSGV

SEQ ID NO: 1268549 - protein, 9 aa, Homo Sapiens
CIGASNQNC

SEQ ID NO: 1268550 - protein, 9 aa, Homo Sapiens
QPSAGYRCR

SEQ ID NO: 1268551 - protein, 9 aa, Homo Sapiens
PPPPPEQAR

SEQ ID NO: 1268552 - protein, 9 aa, Homo Sapiens
FTVDRIPIK

SEQ ID NO: 1268553 - protein, 9 aa, Homo Sapiens
LQVSAYSKD

SEQ ID NO: 1268554 - protein, 9 aa, Homo Sapiens
GPLPCVLPH

SEQ ID NO: 1268555 - protein, 9 aa, Homo Sapiens
RNLPGCPKR

SEQ ID NO: 1268556 - protein, 9 aa, Homo Sapiens
RVYPERWSL

SEQ ID NO: 1268557 - protein, 9 aa, Homo Sapiens
FLHAKDHCM

SEQ ID NO: 1268558 - protein, 9 aa, Homo Sapiens
MMKRQTQIT

SEQ ID NO: 1268559 - protein, 9 aa, Homo Sapiens
SLHLFSSID

SEQ ID NO: 1268560 - protein, 9 aa, Homo Sapiens
GQTILLGPI

SEQ ID NO: 1268561 - protein, 9 aa, Homo Sapiens
RRLDRKDLL

SEQ ID NO: 1268562 - protein, 9 aa, Homo Sapiens
YSVKSLSVF

SEQ ID NO: 1268563 - protein, 9 aa, Homo Sapiens
CRAVGLWGT

SEQ ID NO: 1268564 - protein, 9 aa, Homo Sapiens
CSQRRLRHS

SEQ ID NO: 1268565 - protein, 9 aa, Homo Sapiens
MEKKINNQI

SEQ ID NO: 1268566 - protein, 9 aa, Homo Sapiens
NEAKGKVES

SEQ ID NO: 1268567 - protein, 9 aa, Homo Sapiens
IETAPFKAP

SEQ ID NO: 1268568 - protein, 9 aa, Homo Sapiens
PDASREDSG

SEQ ID NO: 1268569 - protein, 9 aa, Homo Sapiens
TRSTVSRTM

SEQ ID NO: 1268570 - protein, 9 aa, Homo Sapiens
SEYYENKKS

SEQ ID NO: 1268571 - protein, 9 aa, Homo Sapiens
QTAAGRPPR

SEQ ID NO: 1268572 - protein, 9 aa, Homo Sapiens
HTGTDRNTQ

SEQ ID NO: 1268573 - protein, 9 aa, Homo Sapiens
ELKGVPIRF

SEQ ID NO: 1268574 - protein, 9 aa, Homo Sapiens
WGSLPLRSS

SEQ ID NO: 1268575 - protein, 9 aa, Homo Sapiens
LLTDEIVDH

SEQ ID NO: 1268576 - protein, 9 aa, Homo Sapiens
FLPEVTWMA

SEQ ID NO: 1268577 - protein, 9 aa, Homo Sapiens
ASPEEESYP

SEQ ID NO: 1268578 - protein, 9 aa, Homo Sapiens
PAPLARHAL

SEQ ID NO: 1268579 - protein, 9 aa, Homo Sapiens
AKIKKKTGS

SEQ ID NO: 1268580 - protein, 9 aa, Homo Sapiens
CLYINRRLA

SEQ ID NO: 1268581 - protein, 9 aa, Homo Sapiens
FILALSRVS

SEQ ID NO: 1268582 - protein, 9 aa, Homo Sapiens
PTTSSLVAS

SEQ ID NO: 1268583 - protein, 9 aa, Homo Sapiens
THTGTDRNT

SEQ ID NO: 1268584 - protein, 9 aa, Homo Sapiens
SLLTQPSPA

SEQ ID NO: 1268585 - protein, 9 aa, Homo Sapiens
IKHEYQYMP

SEQ ID NO: 1268586 - protein, 9 aa, Homo Sapiens
WVSTDLSRT

SEQ ID NO: 1268587 - protein, 9 aa, Homo Sapiens
EQSFLLCEY

SEQ ID NO: 1268588 - protein, 9 aa, Homo Sapiens
KKRVWVPDN

SEQ ID NO: 1268589 - protein, 9 aa, Homo Sapiens
QWQRAKRNA

SEQ ID NO: 1268590 - protein, 9 aa, Homo Sapiens
SSWRSSSPR

SEQ ID NO: 1268591 - protein, 9 aa, Homo Sapiens
PVKVRTKAA

SEQ ID NO: 1268592 - protein, 9 aa, Homo Sapiens
MAPVGSVMS

SEQ ID NO: 1268593 - protein, 9 aa, Homo Sapiens
LNSWGEARV

SEQ ID NO: 1268594 - protein, 9 aa, Homo Sapiens
MALKELEKV

SEQ ID NO: 1268595 - protein, 9 aa, Homo Sapiens
GSSSTAEAI

SEQ ID NO: 1268596 - protein, 9 aa, Homo Sapiens
LILRKPEWI

SEQ ID NO: 1268597 - protein, 9 aa, Homo Sapiens
AVTAISCVF

SEQ ID NO: 1268598 - protein, 9 aa, Homo Sapiens
PLCPAQMCA

SEQ ID NO: 1268599 - protein, 9 aa, Homo Sapiens
MMKMLHHCQ

SEQ ID NO: 1268600 - protein, 9 aa, Homo Sapiens
LAGIGMRLE

SEQ ID NO: 1268601 - protein, 9 aa, Homo Sapiens
RMRVAFEGQ

SEQ ID NO: 1268602 - protein, 9 aa, Homo Sapiens
QPTPCRVAS

SEQ ID NO: 1268603 - protein, 9 aa, Homo Sapiens
GCYCVLGDK

SEQ ID NO: 1268604 - protein, 9 aa, Homo Sapiens
VLELWKYEA

SEQ ID NO: 1268605 - protein, 9 aa, Homo Sapiens
DFSDTLSSS

SEQ ID NO: 1268606 - protein, 9 aa, Homo Sapiens
GMAPLGITG

SEQ ID NO: 1268607 - protein, 9 aa, Homo Sapiens
VLLRQWQRA

SEQ ID NO: 1268608 - protein, 9 aa, Homo Sapiens
TTRLMAPVG

SEQ ID NO: 1268609 - protein, 9 aa, Homo Sapiens
VGCRPLCPA

SEQ ID NO: 1268610 - protein, 9 aa, Homo Sapiens
PKVSPPSPT

SEQ ID NO: 1268611 - protein, 9 aa, Homo Sapiens
TLTQAYTHT

SEQ ID NO: 1268612 - protein, 9 aa, Homo Sapiens
ETGEVVNEN

SEQ ID NO: 1268613 - protein, 9 aa, Homo Sapiens
NSLAIYQLR

SEQ ID NO: 1268614 - protein, 9 aa, Homo Sapiens
KYLKNFVKI

SEQ ID NO: 1268615 - protein, 9 aa, Homo Sapiens
GLFWMLTCT

SEQ ID NO: 1268616 - protein, 9 aa, Homo Sapiens
PAFDVTPTT

SEQ ID NO: 1268617 - protein, 9 aa, Homo Sapiens
QGYSEYDGN

SEQ ID NO: 1268618 - protein, 9 aa, Homo Sapiens
LCQVTAKGI

SEQ ID NO: 1268619 - protein, 9 aa, Homo Sapiens
SLPQAGLRS

SEQ ID NO: 1268620 - protein, 9 aa, Homo Sapiens
RSRLAAASG

SEQ ID NO: 1268621 - protein, 9 aa, Homo Sapiens
AANEAKGKV

SEQ ID NO: 1268622 - protein, 9 aa, Homo Sapiens
SSLLSLTET

SEQ ID NO: 1268623 - protein, 9 aa, Homo Sapiens
YHMKPLQMA

SEQ ID NO: 1268624 - protein, 9 aa, Homo Sapiens
PCSVTVWCC

SEQ ID NO: 1268625 - protein, 9 aa, Homo Sapiens
PPPLPLSAV

SEQ ID NO: 1268626 - protein, 9 aa, Homo Sapiens
SEKKVTWMK

SEQ ID NO: 1268627 - protein, 9 aa, Homo Sapiens
RHAAPEHRR

SEQ ID NO: 1268628 - protein, 9 aa, Homo Sapiens
ASNSSRGYP

SEQ ID NO: 1268629 - protein, 9 aa, Homo Sapiens
TAPFKAPEL

SEQ ID NO: 1268630 - protein, 9 aa, Homo Sapiens
SRTMPPALP

SEQ ID NO: 1268631 - protein, 9 aa, Homo Sapiens
PGSASLFHR

SEQ ID NO: 1268632 - protein, 9 aa, Homo Sapiens
LSSLGEHTF

SEQ ID NO: 1268633 - protein, 9 aa, Homo Sapiens
ASYVAWIDS

SEQ ID NO: 1268634 - protein, 9 aa, Homo Sapiens
LHPQWAPHS

SEQ ID NO: 1268635 - protein, 9 aa, Homo Sapiens
AQKEYGAVT

SEQ ID NO: 1268636 - protein, 9 aa, Homo Sapiens
HGPTLEEVP

SEQ ID NO: 1268637 - protein, 9 aa, Homo Sapiens
VVKKKPKQL

SEQ ID NO: 1268638 - protein, 9 aa, Homo Sapiens
ELALVGPHA

SEQ ID NO: 1268639 - protein, 9 aa, Homo Sapiens
VAMAAGADG

SEQ ID NO: 1268640 - protein, 9 aa, Homo Sapiens
PLPPPGSPS

SEQ ID NO: 1268641 - protein, 9 aa, Homo Sapiens
QSRQHIVCL

SEQ ID NO: 1268642 - protein, 9 aa, Homo Sapiens
LGHIWVERA

SEQ ID NO: 1268643 - protein, 9 aa, Homo Sapiens
EEKTENGQI

SEQ ID NO: 1268644 - protein, 9 aa, Homo Sapiens
VYSMNDVCR

SEQ ID NO: 1268645 - protein, 9 aa, Homo Sapiens
LTFSFLVFR

SEQ ID NO: 1268646 - protein, 9 aa, Homo Sapiens
ITGQPILPD

SEQ ID NO: 1268647 - protein, 9 aa, Homo Sapiens
PTDSLLCSH

SEQ ID NO: 1268648 - protein, 9 aa, Homo Sapiens
RVLIPLYSV

SEQ ID NO: 1268649 - protein, 9 aa, Homo Sapiens
APPAFSGRI

SEQ ID NO: 1268650 - protein, 9 aa, Homo Sapiens
WEEASQVGG

SEQ ID NO: 1268651 - protein, 9 aa, Homo Sapiens
GAELVGFQR

SEQ ID NO: 1268652 - protein, 9 aa, Homo Sapiens
AASGPCHAA

SEQ ID NO: 1268653 - protein, 9 aa, Homo Sapiens
KVSPPSPTI

SEQ ID NO: 1268654 - protein, 9 aa, Homo Sapiens
RRPTMAKVV

SEQ ID NO: 1268655 - protein, 9 aa, Homo Sapiens
PALPSQFSS

SEQ ID NO: 1268656 - protein, 9 aa, Homo Sapiens
QAYTLTYTG

SEQ ID NO: 1268657 - protein, 9 aa, Homo Sapiens
QCIIISGER

SEQ ID NO: 1268658 - protein, 9 aa, Homo Sapiens
VHAEHEVRL

SEQ ID NO: 1268659 - protein, 9 aa, Homo Sapiens
VTGEFFGGF

SEQ ID NO: 1268660 - protein, 9 aa, Homo Sapiens
PGSWPVAQR

SEQ ID NO: 1268661 - protein, 9 aa, Homo Sapiens
NNTRIVDDS

SEQ ID NO: 1268662 - protein, 9 aa, Homo Sapiens
QDTDMALKE

SEQ ID NO: 1268663 - protein, 9 aa, Homo Sapiens
CGGAHGLSR

SEQ ID NO: 1268664 - protein, 9 aa, Homo Sapiens
WVQVILMPQ

SEQ ID NO: 1268665 - protein, 9 aa, Homo Sapiens
SLAIYQLRT

SEQ ID NO: 1268666 - protein, 9 aa, Homo Sapiens
SVCNSGVET

SEQ ID NO: 1268667 - protein, 9 aa, Homo Sapiens
RERGGGCLP

SEQ ID NO: 1268668 - protein, 9 aa, Homo Sapiens
RGYAQSCHF

SEQ ID NO: 1268669 - protein, 9 aa, Homo Sapiens
KWFVARLQK

SEQ ID NO: 1268670 - protein, 9 aa, Homo Sapiens
SGCGFCCAC

SEQ ID NO: 1268671 - protein, 9 aa, Homo Sapiens
PRSRLAAAS

SEQ ID NO: 1268672 - protein, 9 aa, Homo Sapiens
GQAVRPCVK

SEQ ID NO: 1268673 - protein, 9 aa, Homo Sapiens
IREGWRWGW

SEQ ID NO: 1268674 - protein, 9 aa, Homo Sapiens
VEIGTVVVL

SEQ ID NO: 1268675 - protein, 9 aa, Homo Sapiens
RGARPVCHL

SEQ ID NO: 1268676 - protein, 9 aa, Homo Sapiens
PLALATPTP

SEQ ID NO: 1268677 - protein, 9 aa, Homo Sapiens
CTPKPTRMA

SEQ ID NO: 1268678 - protein, 9 aa, Homo Sapiens
LASRVAGTA

SEQ ID NO: 1268679 - protein, 9 aa, Homo Sapiens
TPWMTGVQP

SEQ ID NO: 1268680 - protein, 9 aa, Homo Sapiens
NDVCRAFLG

SEQ ID NO: 1268681 - protein, 9 aa, Homo Sapiens
SREQHFYES

SEQ ID NO: 1268682 - protein, 9 aa, Homo Sapiens
TASEYKYVV

SEQ ID NO: 1268683 - protein, 9 aa, Homo Sapiens
SKIVVKKKP

SEQ ID NO: 1268684 - protein, 9 aa, Homo Sapiens
LSCHNLELE

SEQ ID NO: 1268685 - protein, 9 aa, Homo Sapiens
EHTFFRLAL

SEQ ID NO: 1268686 - protein, 9 aa, Homo Sapiens
SPVGDVGLG

SEQ ID NO: 1268687 - protein, 9 aa, Homo Sapiens
QAMGQVQSQ

SEQ ID NO: 1268688 - protein, 9 aa, Homo Sapiens
RLNSWGEAR

SEQ ID NO: 1268689 - protein, 9 aa, Homo Sapiens
PVCHLQARG

SEQ ID NO: 1268690 - protein, 9 aa, Homo Sapiens
PPRATRRPR

SEQ ID NO: 1268691 - protein, 9 aa, Homo Sapiens
QSADQCKEY

SEQ ID NO: 1268692 - protein, 9 aa, Homo Sapiens
SFLVFRFCL

SEQ ID NO: 1268693 - protein, 9 aa, Homo Sapiens
PASGRASRK

SEQ ID NO: 1268694 - protein, 9 aa, Homo Sapiens
DSQGVILVY

SEQ ID NO: 1268695 - protein, 9 aa, Homo Sapiens
PECYPDNHA

SEQ ID NO: 1268696 - protein, 9 aa, Homo Sapiens
HTREIFVLF

SEQ ID NO: 1268697 - protein, 9 aa, Homo Sapiens
NDTESDTNY

SEQ ID NO: 1268698 - protein, 9 aa, Homo Sapiens
ASSQNWGSL

SEQ ID NO: 1268699 - protein, 9 aa, Homo Sapiens
DSPVPCTPQ

SEQ ID NO: 1268700 - protein, 9 aa, Homo Sapiens
LFPDAQPST

SEQ ID NO: 1268701 - protein, 9 aa, Homo Sapiens
LALFYQGPG

SEQ ID NO: 1268702 - protein, 9 aa, Homo Sapiens
GRILHQPEM

SEQ ID NO: 1268703 - protein, 9 aa, Homo Sapiens
HQGRPTHQL

SEQ ID NO: 1268704 - protein, 9 aa, Homo Sapiens
MYQTDFILV

SEQ ID NO: 1268705 - protein, 9 aa, Homo Sapiens
RHTHRHRHT

SEQ ID NO: 1268706 - protein, 9 aa, Homo Sapiens
AARAHQRTG

SEQ ID NO: 1268707 - protein, 9 aa, Homo Sapiens
LHGQPASRA

SEQ ID NO: 1268708 - protein, 9 aa, Homo Sapiens
WRWGWGQLL

SEQ ID NO: 1268709 - protein, 9 aa, Homo Sapiens
MPCLYINRR

SEQ ID NO: 1268710 - protein, 9 aa, Homo Sapiens
REALVAELA

SEQ ID NO: 1268711 - protein, 9 aa, Homo Sapiens
RARIKGLSS

SEQ ID NO: 1268712 - protein, 9 aa, Homo Sapiens
ELPVGCRPL

SEQ ID NO: 1268713 - protein, 9 aa, Homo Sapiens
PSASLHPAS

SEQ ID NO: 1268714 - protein, 9 aa, Homo Sapiens
GLIAHTAPK

SEQ ID NO: 1268715 - protein, 9 aa, Homo Sapiens
AVAALKTLP

SEQ ID NO: 1268716 - protein, 9 aa, Homo Sapiens
PQHCPPVPG

SEQ ID NO: 1268717 - protein, 9 aa, Homo Sapiens
DFKKQSADQ

SEQ ID NO: 1268718 - protein, 9 aa, Homo Sapiens
DPNRHATLM

SEQ ID NO: 1268719 - protein, 9 aa, Homo Sapiens
FKKQSADQC

SEQ ID NO: 1268720 - protein, 9 aa, Homo Sapiens
DAGLSVTLC

SEQ ID NO: 1268721 - protein, 9 aa, Homo Sapiens
FILVPRLEC

SEQ ID NO: 1268722 - protein, 9 aa, Homo Sapiens
LLLSQSRQH

SEQ ID NO: 1268723 - protein, 9 aa, Homo Sapiens
ATLMDLVDF

SEQ ID NO: 1268724 - protein, 9 aa, Homo Sapiens
EGMETGEGL

SEQ ID NO: 1268725 - protein, 9 aa, Homo Sapiens
VFKEIKGLQ

SEQ ID NO: 1268726 - protein, 9 aa, Homo Sapiens
TILAYCSLS

SEQ ID NO: 1268727 - protein, 9 aa, Homo Sapiens
YTHTQVHTQ

SEQ ID NO: 1268728 - protein, 9 aa, Homo Sapiens
RTAAVGKAR

SEQ ID NO: 1268729 - protein, 9 aa, Homo Sapiens
LPHVDFQLV

SEQ ID NO: 1268730 - protein, 9 aa, Homo Sapiens
GMGPHVPRQ

SEQ ID NO: 1268731 - protein, 9 aa, Homo Sapiens
IAADTLPYT

SEQ ID NO: 1268732 - protein, 9 aa, Homo Sapiens
LVVAVTAIS

SEQ ID NO: 1268733 - protein, 9 aa, Homo Sapiens
AAASGPCHA

SEQ ID NO: 1268734 - protein, 9 aa, Homo Sapiens
DDQIQWPTV

SEQ ID NO: 1268735 - protein, 9 aa, Homo Sapiens
SFLLCEYLL

SEQ ID NO: 1268736 - protein, 9 aa, Homo Sapiens
SNDTTASEY

SEQ ID NO: 1268737 - protein, 9 aa, Homo Sapiens
FQRIFDLQN

SEQ ID NO: 1268738 - protein, 9 aa, Homo Sapiens
ESLEPPSLH

SEQ ID NO: 1268739 - protein, 9 aa, Homo Sapiens
EESLEPPSL

SEQ ID NO: 1268740 - protein, 9 aa, Homo Sapiens
ALVDLEDWE

SEQ ID NO: 1268741 - protein, 9 aa, Homo Sapiens
IEGKLVDRK

SEQ ID NO: 1268742 - protein, 9 aa, Homo Sapiens
HTQAYTLTY

SEQ ID NO: 1268743 - protein, 9 aa, Homo Sapiens
TAAVGKARR

SEQ ID NO: 1268744 - protein, 9 aa, Homo Sapiens
LDRKDLLGY

SEQ ID NO: 1268745 - protein, 9 aa, Homo Sapiens
SDDFFIGKV

SEQ ID NO: 1268746 - protein, 9 aa, Homo Sapiens
SHEYHIVKK

SEQ ID NO: 1268747 - protein, 9 aa, Homo Sapiens
GALDKTGGL

SEQ ID NO: 1268748 - protein, 9 aa, Homo Sapiens
SIRSASSRA

SEQ ID NO: 1268749 - protein, 9 aa, Homo Sapiens
EDLHAFIVQ

SEQ ID NO: 1268750 - protein, 9 aa, Homo Sapiens
GGPEAPSTR

SEQ ID NO: 1268751 - protein, 9 aa, Homo Sapiens
FPFFFILVP

SEQ ID NO: 1268752 - protein, 9 aa, Homo Sapiens
SLVVTGDQS

SEQ ID NO: 1268753 - protein, 9 aa, Homo Sapiens
GVQVRTSGR

SEQ ID NO: 1268754 - protein, 9 aa, Homo Sapiens
LISIKYSGP

SEQ ID NO: 1268755 - protein, 9 aa, Homo Sapiens
TFTSSHFKW

SEQ ID NO: 1268756 - protein, 9 aa, Homo Sapiens
KSKIVVKKK

SEQ ID NO: 1268757 - protein, 9 aa, Homo Sapiens
IPCPTDSLL

SEQ ID NO: 1268758 - protein, 9 aa, Homo Sapiens
TWMKRRRRN

SEQ ID NO: 1268759 - protein, 9 aa, Homo Sapiens
AQAMYQVFW

SEQ ID NO: 1268760 - protein, 9 aa, Homo Sapiens
ISVFMLSMY

SEQ ID NO: 1268761 - protein, 9 aa, Homo Sapiens
SKTRAFITH

SEQ ID NO: 1268762 - protein, 9 aa, Homo Sapiens
GDKGNFGQT

SEQ ID NO: 1268763 - protein, 9 aa, Homo Sapiens
GEFFGGFLL

SEQ ID NO: 1268764 - protein, 9 aa, Homo Sapiens
GAYLDSGCG

SEQ ID NO: 1268765 - protein, 9 aa, Homo Sapiens
DVGLGVQVL

SEQ ID NO: 1268766 - protein, 9 aa, Homo Sapiens
EDAAGHRHA

SEQ ID NO: 1268767 - protein, 9 aa, Homo Sapiens
CIIPQEELN

SEQ ID NO: 1268768 - protein, 9 aa, Homo Sapiens
LALATPTPS

SEQ ID NO: 1268769 - protein, 9 aa, Homo Sapiens
ERAEFSSLL

SEQ ID NO: 1268770 - protein, 9 aa, Homo Sapiens
PWPSGPCRA

SEQ ID NO: 1268771 - protein, 9 aa, Homo Sapiens
IKGLSSFDK

SEQ ID NO: 1268772 - protein, 9 aa, Homo Sapiens
SGQAVRPCV

SEQ ID NO: 1268773 - protein, 9 aa, Homo Sapiens
PTWRPRSSR

SEQ ID NO: 1268774 - protein, 9 aa, Homo Sapiens
HSKTRAFIT

SEQ ID NO: 1268775 - protein, 9 aa, Homo Sapiens
MAKVVNLGV

SEQ ID NO: 1268776 - protein, 9 aa, Homo Sapiens
HVSTTAMTP

SEQ ID NO: 1268777 - protein, 9 aa, Homo Sapiens
RQTSELEFN

SEQ ID NO: 1268778 - protein, 9 aa, Homo Sapiens
GGQHTRGAS

SEQ ID NO: 1268779 - protein, 9 aa, Homo Sapiens
GGPAGWARQ

SEQ ID NO: 1268780 - protein, 9 aa, Homo Sapiens
STTAMTPTV

SEQ ID NO: 1268781 - protein, 9 aa, Homo Sapiens
GPHVPRQLP

SEQ ID NO: 1268782 - protein, 9 aa, Homo Sapiens
KPTRMASAA

SEQ ID NO: 1268783 - protein, 9 aa, Homo Sapiens
SQPHSWPQR

SEQ ID NO: 1268784 - protein, 9 aa, Homo Sapiens
QTHTGIHTD

SEQ ID NO: 1268785 - protein, 9 aa, Homo Sapiens
NEFYKDSQG

SEQ ID NO: 1268786 - protein, 9 aa, Homo Sapiens
VLRLDGSQR

SEQ ID NO: 1268787 - protein, 9 aa, Homo Sapiens
LTCTTLSVR

SEQ ID NO: 1268788 - protein, 9 aa, Homo Sapiens
SSASSHPRM

SEQ ID NO: 1268789 - protein, 9 aa, Homo Sapiens
PVPCTPQHC

SEQ ID NO: 1268790 - protein, 9 aa, Homo Sapiens
RRAPVKLSL

SEQ ID NO: 1268791 - protein, 9 aa, Homo Sapiens
LLRRLQEAL

SEQ ID NO: 1268792 - protein, 9 aa, Homo Sapiens
GRNNKLIKV

SEQ ID NO: 1268793 - protein, 9 aa, Homo Sapiens
HVDFQLVLP

SEQ ID NO: 1268794 - protein, 9 aa, Homo Sapiens
LSSYVSVHV

SEQ ID NO: 1268795 - protein, 9 aa, Homo Sapiens
PDNHANRSL

SEQ ID NO: 1268796 - protein, 9 aa, Homo Sapiens
PGEADLADG

SEQ ID NO: 1268797 - protein, 9 aa, Homo Sapiens
SDTLSSSKE

SEQ ID NO: 1268798 - protein, 9 aa, Homo Sapiens
GTHRHTHTH

SEQ ID NO: 1268799 - protein, 9 aa, Homo Sapiens
GFGASAAPD

SEQ ID NO: 1268800 - protein, 9 aa, Homo Sapiens
VDEGDKEQF

SEQ ID NO: 1268801 - protein, 9 aa, Homo Sapiens
LGQRLGPKS

SEQ ID NO: 1268802 - protein, 9 aa, Homo Sapiens
AEASPEEES

SEQ ID NO: 1268803 - protein, 9 aa, Homo Sapiens
QKAQFTVDR

SEQ ID NO: 1268804 - protein, 9 aa, Homo Sapiens
RKYHLCVQL

SEQ ID NO: 1268805 - protein, 9 aa, Homo Sapiens
SQCTQGRRW

SEQ ID NO: 1268806 - protein, 9 aa, Homo Sapiens
LEVVVVHEL

SEQ ID NO: 1268807 - protein, 9 aa, Homo Sapiens
HIWVERAIP

SEQ ID NO: 1268808 - protein, 9 aa, Homo Sapiens
VVASSSGGR

SEQ ID NO: 1268809 - protein, 9 aa, Homo Sapiens
FSVFVLFLN

SEQ ID NO: 1268810 - protein, 9 aa, Homo Sapiens
GDKEQFEEF

SEQ ID NO: 1268811 - protein, 9 aa, Homo Sapiens
VLLRRLQEA

SEQ ID NO: 1268812 - protein, 9 aa, Homo Sapiens
LDLPILDDQ

SEQ ID NO: 1268813 - protein, 9 aa, Homo Sapiens
TTVVCIMPL

SEQ ID NO: 1268814 - protein, 9 aa, Homo Sapiens
TRRSNMGHK

SEQ ID NO: 1268815 - protein, 9 aa, Homo Sapiens
KVDIHLLRE

SEQ ID NO: 1268816 - protein, 9 aa, Homo Sapiens
QNWGSLPLR

SEQ ID NO: 1268817 - protein, 9 aa, Homo Sapiens
KEKLRKTCW

SEQ ID NO: 1268818 - protein, 9 aa, Homo Sapiens
GFSGHAGNH

SEQ ID NO: 1268819 - protein, 9 aa, Homo Sapiens
KELSCHNLE

SEQ ID NO: 1268820 - protein, 9 aa, Homo Sapiens
PWPEVWKEV

SEQ ID NO: 1268821 - protein, 9 aa, Homo Sapiens
KRRRRNLIL

SEQ ID NO: 1268822 - protein, 9 aa, Homo Sapiens
VKPKEVAKS

SEQ ID NO: 1268823 - protein, 9 aa, Homo Sapiens
MSSAWPPTV

SEQ ID NO: 1268824 - protein, 9 aa, Homo Sapiens
KEEVNHYHA

SEQ ID NO: 1268825 - protein, 9 aa, Homo Sapiens
LPKFTKKHT

SEQ ID NO: 1268826 - protein, 9 aa, Homo Sapiens
LEDLHAFIV

SEQ ID NO: 1268827 - protein, 9 aa, Homo Sapiens
PEVWKEVRG

SEQ ID NO: 1268828 - protein, 9 aa, Homo Sapiens
DQCKEYLPM

SEQ ID NO: 1268829 - protein, 9 aa, Homo Sapiens
TSLNDLLSI

SEQ ID NO: 1268830 - protein, 9 aa, Homo Sapiens
GTAGHRSLP

SEQ ID NO: 1268831 - protein, 9 aa, Homo Sapiens
AREALVAEL

SEQ ID NO: 1268832 - protein, 9 aa, Homo Sapiens
SHFKWILLL

SEQ ID NO: 1268833 - protein, 9 aa, Homo Sapiens
GARHHTREI

SEQ ID NO: 1268834 - protein, 9 aa, Homo Sapiens
VSTDLSRTE

SEQ ID NO: 1268835 - protein, 9 aa, Homo Sapiens
QKLQDNFET

SEQ ID NO: 1268836 - protein, 9 aa, Homo Sapiens
ARAHQRTGR

SEQ ID NO: 1268837 - protein, 9 aa, Homo Sapiens
VVMMKMLHH

SEQ ID NO: 1268838 - protein, 9 aa, Homo Sapiens
RAHQRTGRQ

SEQ ID NO: 1268839 - protein, 9 aa, Homo Sapiens
KSSEYYENK

SEQ ID NO: 1268840 - protein, 9 aa, Homo Sapiens
WASLSNTST

SEQ ID NO: 1268841 - protein, 9 aa, Homo Sapiens
DELVEWKWR

SEQ ID NO: 1268842 - protein, 9 aa, Homo Sapiens
LATALQNTE

SEQ ID NO: 1268843 - protein, 9 aa, Homo Sapiens
SSPPPPLPL

SEQ ID NO: 1268844 - protein, 9 aa, Homo Sapiens
CTTLSVRPC

SEQ ID NO: 1268845 - protein, 9 aa, Homo Sapiens
GLYDRIEHF

SEQ ID NO: 1268846 - protein, 9 aa, Homo Sapiens
ASGRDREAR

SEQ ID NO: 1268847 - protein, 9 aa, Homo Sapiens
LLGSLAGTM

SEQ ID NO: 1268848 - protein, 9 aa, Homo Sapiens
VPWPEVWKE

SEQ ID NO: 1268849 - protein, 9 aa, Homo Sapiens
IISGERGSG

SEQ ID NO: 1268850 - protein, 9 aa, Homo Sapiens
MNYRLLPYH

SEQ ID NO: 1268851 - protein, 9 aa, Homo Sapiens
TDSLLCSHL

SEQ ID NO: 1268852 - protein, 9 aa, Homo Sapiens
TKADWLASR

SEQ ID NO: 1268853 - protein, 9 aa, Homo Sapiens
YTGTHRHTH

SEQ ID NO: 1268854 - protein, 9 aa, Homo Sapiens
CHRALLLPE

SEQ ID NO: 1268855 - protein, 9 aa, Homo Sapiens
EALTMNIVS

SEQ ID NO: 1268856 - protein, 9 aa, Homo Sapiens
IYQLRTLDP

SEQ ID NO: 1268857 - protein, 9 aa, Homo Sapiens
GIHTDTHTG

SEQ ID NO: 1268858 - protein, 9 aa, Homo Sapiens
GYPWVEYCE

SEQ ID NO: 1268859 - protein, 9 aa, Homo Sapiens
CTQGRRWGA

SEQ ID NO: 1268860 - protein, 9 aa, Homo Sapiens
PYVEALTMN

SEQ ID NO: 1268861 - protein, 9 aa, Homo Sapiens
AGPSASLHP

SEQ ID NO: 1268862 - protein, 9 aa, Homo Sapiens
RGYRERGGG

SEQ ID NO: 1268863 - protein, 9 aa, Homo Sapiens
ICIDQQNGQ

SEQ ID NO: 1268864 - protein, 9 aa, Homo Sapiens
AAGRPPRME

SEQ ID NO: 1268865 - protein, 9 aa, Homo Sapiens
KDIKHEYQY

SEQ ID NO: 1268866 - protein, 9 aa, Homo Sapiens
AANLATALQ

SEQ ID NO: 1268867 - protein, 9 aa, Homo Sapiens
VQVILMPQP

SEQ ID NO: 1268868 - protein, 9 aa, Homo Sapiens
DDIKWFVAR

SEQ ID NO: 1268869 - protein, 9 aa, Homo Sapiens
PGPTWCGGA

SEQ ID NO: 1268870 - protein, 9 aa, Homo Sapiens
KVSDRRKPP

SEQ ID NO: 1268871 - protein, 9 aa, Homo Sapiens
LIEKRLAKM

SEQ ID NO: 1268872 - protein, 9 aa, Homo Sapiens
DLAGDALPV

SEQ ID NO: 1268873 - protein, 9 aa, Homo Sapiens
ALDDIKWFV

SEQ ID NO: 1268874 - protein, 9 aa, Homo Sapiens
SHFAKWSGS

SEQ ID NO: 1268875 - protein, 9 aa, Homo Sapiens
HFRLLTDEI

SEQ ID NO: 1268876 - protein, 9 aa, Homo Sapiens
VTVWCCRAS

SEQ ID NO: 1268877 - protein, 9 aa, Homo Sapiens
LLPPRATRR

SEQ ID NO: 1268878 - protein, 9 aa, Homo Sapiens
EVLRLGRNS

SEQ ID NO: 1268879 - protein, 9 aa, Homo Sapiens
VASSSGGRT

SEQ ID NO: 1268880 - protein, 9 aa, Homo Sapiens
IYVPDFISK

SEQ ID NO: 1268881 - protein, 9 aa, Homo Sapiens
LTALGRSQG

SEQ ID NO: 1268882 - protein, 9 aa, Homo Sapiens
SLLIAADTL

SEQ ID NO: 1268883 - protein, 9 aa, Homo Sapiens
DSLLCSHLG

SEQ ID NO: 1268884 - protein, 9 aa, Homo Sapiens
SVTVWCCRA

SEQ ID NO: 1268885 - protein, 9 aa, Homo Sapiens
MVSEGGPEA

SEQ ID NO: 1268886 - protein, 9 aa, Homo Sapiens
GSQRPPRQV

SEQ ID NO: 1268887 - protein, 9 aa, Homo Sapiens
GRPPRMELP

SEQ ID NO: 1268888 - protein, 9 aa, Homo Sapiens
PCRAVGLWG

SEQ ID NO: 1268889 - protein, 9 aa, Homo Sapiens
VCNSGVETS

SEQ ID NO: 1268890 - protein, 9 aa, Homo Sapiens
PPSLRAARA

SEQ ID NO: 1268891 - protein, 9 aa, Homo Sapiens
VRPCSVTVW

SEQ ID NO: 1268892 - protein, 9 aa, Homo Sapiens
SKYCHRALL

SEQ ID NO: 1268893 - protein, 9 aa, Homo Sapiens
ILGALDKTG

SEQ ID NO: 1268894 - protein, 9 aa, Homo Sapiens
KHSRKKMAA

SEQ ID NO: 1268895 - protein, 9 aa, Homo Sapiens
CQPNLLIFI

SEQ ID NO: 1268896 - protein, 9 aa, Homo Sapiens
RHRLGQRLG

SEQ ID NO: 1268897 - protein, 9 aa, Homo Sapiens
LRQWQRAKR

SEQ ID NO: 1268898 - protein, 9 aa, Homo Sapiens
PGSSHLPTL

SEQ ID NO: 1268899 - protein, 9 aa, Homo Sapiens
GKLLIEGRS

SEQ ID NO: 1268900 - protein, 9 aa, Homo Sapiens
MAAGADGCG

SEQ ID NO: 1268901 - protein, 9 aa, Homo Sapiens
GIFVEGMET

SEQ ID NO: 1268902 - protein, 9 aa, Homo Sapiens
LVQDTDMAL

SEQ ID NO: 1268903 - protein, 9 aa, Homo Sapiens
PTIPCPTDS

SEQ ID NO: 1268904 - protein, 9 aa, Homo Sapiens
HALARHEVL

SEQ ID NO: 1268905 - protein, 9 aa, Homo Sapiens
RDSDSVCNS

SEQ ID NO: 1268906 - protein, 9 aa, Homo Sapiens
GLGGQHTRG

SEQ ID NO: 1268907 - protein, 9 aa, Homo Sapiens
PFFFILVPR

SEQ ID NO: 1268908 - protein, 9 aa, Homo Sapiens
VHELGVAVD

SEQ ID NO: 1268909 - protein, 9 aa, Homo Sapiens
ARHEVLLRR

SEQ ID NO: 1268910 - protein, 9 aa, Homo Sapiens
VVNENAKTH

SEQ ID NO: 1268911 - protein, 9 aa, Homo Sapiens
NTRIVDDSF

SEQ ID NO: 1268912 - protein, 9 aa, Homo Sapiens
KKINNQIIV

SEQ ID NO: 1268913 - protein, 9 aa, Homo Sapiens
CIMPLVAFR

SEQ ID NO: 1268914 - protein, 9 aa, Homo Sapiens
PEAPSTRAA

SEQ ID NO: 1268915 - protein, 9 aa, Homo Sapiens
TCISMTTIS

SEQ ID NO: 1268916 - protein, 9 aa, Homo Sapiens
SFAQHQRCH

SEQ ID NO: 1268917 - protein, 9 aa, Homo Sapiens
LLSLTETQV

SEQ ID NO: 1268918 - protein, 9 aa, Homo Sapiens
LGITGQPIL

SEQ ID NO: 1268919 - protein, 9 aa, Homo Sapiens
GAHVWLLPG

SEQ ID NO: 1268920 - protein, 9 aa, Homo Sapiens
STQSTPWMT

SEQ ID NO: 1268921 - protein, 9 aa, Homo Sapiens
RRDPGWERS

SEQ ID NO: 1268922 - protein, 9 aa, Homo Sapiens
IWKFFPKKK

SEQ ID NO: 1268923 - protein, 9 aa, Homo Sapiens
ESTKGHDEA

SEQ ID NO: 1268924 - protein, 9 aa, Homo Sapiens
LCSHLGETA

SEQ ID NO: 1268925 - protein, 9 aa, Homo Sapiens
TILVQDTDM

SEQ ID NO: 1268926 - protein, 9 aa, Homo Sapiens
SLFGTDAPV

SEQ ID NO: 1268927 - protein, 9 aa, Homo Sapiens
GYGCYCVLG

SEQ ID NO: 1268928 - protein, 9 aa, Homo Sapiens
QRRVQRAHA

SEQ ID NO: 1268929 - protein, 9 aa, Homo Sapiens
ALCSQRRLR

SEQ ID NO: 1268930 - protein, 9 aa, Homo Sapiens
CEFLGCFVD

SEQ ID NO: 1268931 - protein, 9 aa, Homo Sapiens
SDGSSFAQH

SEQ ID NO: 1268932 - protein, 9 aa, Homo Sapiens
RSSSPRRAS

SEQ ID NO: 1268933 - protein, 9 aa, Homo Sapiens
NLTLALKEI

SEQ ID NO: 1268934 - protein, 9 aa, Homo Sapiens
IDQQNGQRN

SEQ ID NO: 1268935 - protein, 9 aa, Homo Sapiens
VQGNNDLYW

SEQ ID NO: 1268936 - protein, 9 aa, Homo Sapiens
RAAHRRPTQ

SEQ ID NO: 1268937 - protein, 9 aa, Homo Sapiens
TGEFFGGFL

SEQ ID NO: 1268938 - protein, 9 aa, Homo Sapiens
NSLPLLIAN

SEQ ID NO: 1268939 - protein, 9 aa, Homo Sapiens
SSSTAEAIG

SEQ ID NO: 1268940 - protein, 9 aa, Homo Sapiens
APRLHPPFP

SEQ ID NO: 1268941 - protein, 9 aa, Homo Sapiens
LTSTLMGAC

SEQ ID NO: 1268942 - protein, 9 aa, Homo Sapiens
TSPVSHFAK

SEQ ID NO: 1268943 - protein, 9 aa, Homo Sapiens
YPGERTCSW

SEQ ID NO: 1268944 - protein, 9 aa, Homo Sapiens
HRRGMAPNG

SEQ ID NO: 1268945 - protein, 9 aa, Homo Sapiens
RQGGSPVGD

SEQ ID NO: 1268946 - protein, 9 aa, Homo Sapiens
LYDRIEHFM

SEQ ID NO: 1268947 - protein, 9 aa, Homo Sapiens
ILLEFPLQL

SEQ ID NO: 1268948 - protein, 9 aa, Homo Sapiens
ALPTRRPPA

SEQ ID NO: 1268949 - protein, 9 aa, Homo Sapiens
DPPSGTPPS

SEQ ID NO: 1268950 - protein, 9 aa, Homo Sapiens
GEPTPLPLP

SEQ ID NO: 1268951 - protein, 9 aa, Homo Sapiens
RHQRSGHGD

SEQ ID NO: 1268952 - protein, 9 aa, Homo Sapiens
IHTDTHTGT

SEQ ID NO: 1268953 - protein, 9 aa, Homo Sapiens
IIISGERGS

SEQ ID NO: 1268954 - protein, 9 aa, Homo Sapiens
TPTWRPRSS

SEQ ID NO: 1268955 - protein, 9 aa, Homo Sapiens
HDEAKIKAL

SEQ ID NO: 1268956 - protein, 9 aa, Homo Sapiens
VRVLIPLYS

SEQ ID NO: 1268957 - protein, 9 aa, Homo Sapiens
RPRALCSQR

SEQ ID NO: 1268958 - protein, 9 aa, Homo Sapiens
NHIDWRIAR

SEQ ID NO: 1268959 - protein, 9 aa, Homo Sapiens
VIRIDLPHK

SEQ ID NO: 1268960 - protein, 9 aa, Homo Sapiens
DVAVQVVRA

SEQ ID NO: 1268961 - protein, 9 aa, Homo Sapiens
VVCIMPLVA

SEQ ID NO: 1268962 - protein, 9 aa, Homo Sapiens
LLMNGSSST

SEQ ID NO: 1268963 - protein, 9 aa, Homo Sapiens
THRHTQEYT

SEQ ID NO: 1268964 - protein, 9 aa, Homo Sapiens
TDDEGPVRR

SEQ ID NO: 1268965 - protein, 9 aa, Homo Sapiens
HLLNWAQKE

SEQ ID NO: 1268966 - protein, 9 aa, Homo Sapiens
VNEYCFAWV

SEQ ID NO: 1268967 - protein, 9 aa, Homo Sapiens
AGILHLVVQ

SEQ ID NO: 1268968 - protein, 9 aa, Homo Sapiens
GQSLPQAGL

SEQ ID NO: 1268969 - protein, 9 aa, Homo Sapiens
LYQLEKWET

SEQ ID NO: 1268970 - protein, 9 aa, Homo Sapiens
HRHTHTQAY

SEQ ID NO: 1268971 - protein, 9 aa, Homo Sapiens
SLHPASGRA

SEQ ID NO: 1268972 - protein, 9 aa, Homo Sapiens
QPSPASACT

SEQ ID NO: 1268973 - protein, 9 aa, Homo Sapiens
DLLSIFAYP

SEQ ID NO: 1268974 - protein, 9 aa, Homo Sapiens
IYHFRLLTD

SEQ ID NO: 1268975 - protein, 9 aa, Homo Sapiens
LMLRVNEYC

SEQ ID NO: 1268976 - protein, 9 aa, Homo Sapiens
ASHEYHIVK

SEQ ID NO: 1268977 - protein, 9 aa, Homo Sapiens
IWMCRHPRP

SEQ ID NO: 1268978 - protein, 9 aa, Homo Sapiens
NVDGIELTE

SEQ ID NO: 1268979 - protein, 9 aa, Homo Sapiens
SPPPPLPLS

SEQ ID NO: 1268980 - protein, 9 aa, Homo Sapiens
KGHDEAKIK

SEQ ID NO: 1268981 - protein, 9 aa, Homo Sapiens
LNCALDDIK

SEQ ID NO: 1268982 - protein, 9 aa, Homo Sapiens
GDGSRHSVS

SEQ ID NO: 1268983 - protein, 9 aa, Homo Sapiens
AQEKTYLEI

SEQ ID NO: 1268984 - protein, 9 aa, Homo Sapiens
MQNLNDHLA

SEQ ID NO: 1268985 - protein, 9 aa, Homo Sapiens
SSHLPTLAS

SEQ ID NO: 1268986 - protein, 9 aa, Homo Sapiens
SFPGSSHLP

SEQ ID NO: 1268987 - protein, 9 aa, Homo Sapiens
ATCWQPWPA

SEQ ID NO: 1268988 - protein, 9 aa, Homo Sapiens
VVIEVALAP

SEQ ID NO: 1268989 - protein, 9 aa, Homo Sapiens
AQRRHAAPE

SEQ ID NO: 1268990 - protein, 9 aa, Homo Sapiens
TGEVVNENA

SEQ ID NO: 1268991 - protein, 9 aa, Homo Sapiens
STRAAPPSL

SEQ ID NO: 1268992 - protein, 9 aa, Homo Sapiens
NDELVEWKW

SEQ ID NO: 1268993 - protein, 9 aa, Homo Sapiens
KKLHPQKLQ

SEQ ID NO: 1268994 - protein, 9 aa, Homo Sapiens
LSLTMSSAW

SEQ ID NO: 1268995 - protein, 9 aa, Homo Sapiens
CAKRVVCDP

SEQ ID NO: 1268996 - protein, 9 aa, Homo Sapiens
PSLGPGGVI

SEQ ID NO: 1268997 - protein, 9 aa, Homo Sapiens
PRLSLVVTG

SEQ ID NO: 1268998 - protein, 9 aa, Homo Sapiens
KTGGLTSTG

SEQ ID NO: 1268999 - protein, 9 aa, Homo Sapiens
CCCRETLKS

SEQ ID NO: 1269000 - protein, 9 aa, Homo Sapiens
DPLTVKECI

SEQ ID NO: 1269001 - protein, 9 aa, Homo Sapiens
ERGSGKTEA

SEQ ID NO: 1269002 - protein, 9 aa, Homo Sapiens
HCVEQGKQQ

SEQ ID NO: 1269003 - protein, 9 aa, Homo Sapiens
GKVQGNNDL

SEQ ID NO: 1269004 - protein, 9 aa, Homo Sapiens
TFNRNHHMA

SEQ ID NO: 1269005 - protein, 9 aa, Homo Sapiens
TQAYTHTQV

SEQ ID NO: 1269006 - protein, 9 aa, Homo Sapiens
LDVAVQVVR

SEQ ID NO: 1269007 - protein, 9 aa, Homo Sapiens
TPMGMRASR

SEQ ID NO: 1269008 - protein, 9 aa, Homo Sapiens
SLVGRSGIL

SEQ ID NO: 1269009 - protein, 9 aa, Homo Sapiens
EEVIREGWR

SEQ ID NO: 1269010 - protein, 9 aa, Homo Sapiens
FCCACHPWP

SEQ ID NO: 1269011 - protein, 9 aa, Homo Sapiens
TPKPTRMAS

SEQ ID NO: 1269012 - protein, 9 aa, Homo Sapiens
KVHLKLRRT

SEQ ID NO: 1269013 - protein, 9 aa, Homo Sapiens
LAFILALSR

SEQ ID NO: 1269014 - protein, 9 aa, Homo Sapiens
KGLSSFDKV

SEQ ID NO: 1269015 - protein, 9 aa, Homo Sapiens
AVFPAISMK

SEQ ID NO: 1269016 - protein, 9 aa, Homo Sapiens
RMKSSTGIT

SEQ ID NO: 1269017 - protein, 9 aa, Homo Sapiens
NNHIDWRIA

SEQ ID NO: 1269018 - protein, 9 aa, Homo Sapiens
MPPLLHPQW

SEQ ID NO: 1269019 - protein, 9 aa, Homo Sapiens
MNVLELWKY

SEQ ID NO: 1269020 - protein, 9 aa, Homo Sapiens
AHTAPKPPQ

SEQ ID NO: 1269021 - protein, 9 aa, Homo Sapiens
LGEHTFFRL

SEQ ID NO: 1269022 - protein, 9 aa, Homo Sapiens
RQEESQHEI

SEQ ID NO: 1269023 - protein, 9 aa, Homo Sapiens
LLDEGEDEA

SEQ ID NO: 1269024 - protein, 9 aa, Homo Sapiens
DHLASYLDH

SEQ ID NO: 1269025 - protein, 9 aa, Homo Sapiens
CIDQQNGQR

SEQ ID NO: 1269026 - protein, 9 aa, Homo Sapiens
HDGHEEKTE

SEQ ID NO: 1269027 - protein, 9 aa, Homo Sapiens
AKHKKPQPR

SEQ ID NO: 1269028 - protein, 9 aa, Homo Sapiens
VITFGSAHL

SEQ ID NO: 1269029 - protein, 9 aa, Homo Sapiens
LGLQLALFY

SEQ ID NO: 1269030 - protein, 9 aa, Homo Sapiens
PQPPVKVRT

SEQ ID NO: 1269031 - protein, 9 aa, Homo Sapiens
EGDVNAVGK

SEQ ID NO: 1269032 - protein, 9 aa, Homo Sapiens
PQLSLTLPQ

SEQ ID NO: 1269033 - protein, 9 aa, Homo Sapiens
SAMHNRKYN

SEQ ID NO: 1269034 - protein, 9 aa, Homo Sapiens
SMNDVCRAF

SEQ ID NO: 1269035 - protein, 9 aa, Homo Sapiens
WRFLLGGSK

SEQ ID NO: 1269036 - protein, 9 aa, Homo Sapiens
VLVTGEFFG

SEQ ID NO: 1269037 - protein, 9 aa, Homo Sapiens
LQAKKTCVS

SEQ ID NO: 1269038 - protein, 9 aa, Homo Sapiens
VQPSAGYRC

SEQ ID NO: 1269039 - protein, 9 aa, Homo Sapiens
TDTVLILCG

SEQ ID NO: 1269040 - protein, 9 aa, Homo Sapiens
LTQPQPPVK

SEQ ID NO: 1269041 - protein, 9 aa, Homo Sapiens
SAIEMIDPK

SEQ ID NO: 1269042 - protein, 9 aa, Homo Sapiens
TPCTDTESA

SEQ ID NO: 1269043 - protein, 9 aa, Homo Sapiens
FLSVMEAKV

SEQ ID NO: 1269044 - protein, 9 aa, Homo Sapiens
GDQSSPIGL

SEQ ID NO: 1269045 - protein, 9 aa, Homo Sapiens
NLRWRRKRY

SEQ ID NO: 1269046 - protein, 9 aa, Homo Sapiens
VGFQRDLGS

SEQ ID NO: 1269047 - protein, 9 aa, Homo Sapiens
SRAQRHAGH

SEQ ID NO: 1269048 - protein, 9 aa, Homo Sapiens
PTKEEVNHY

SEQ ID NO: 1269049 - protein, 9 aa, Homo Sapiens
DPKHRMYVY

SEQ ID NO: 1269050 - protein, 9 aa, Homo Sapiens
KLTALVDLE

SEQ ID NO: 1269051 - protein, 9 aa, Homo Sapiens
VNENAKTHV

SEQ ID NO: 1269052 - protein, 9 aa, Homo Sapiens
RIVDDSFKY

SEQ ID NO: 1269053 - protein, 9 aa, Homo Sapiens
SAAACPSLG

SEQ ID NO: 1269054 - protein, 9 aa, Homo Sapiens
QEVEIGTVV

SEQ ID NO: 1269055 - protein, 9 aa, Homo Sapiens
PERWSLAGI

SEQ ID NO: 1269056 - protein, 9 aa, Homo Sapiens
VAEGQTPMG

SEQ ID NO: 1269057 - protein, 9 aa, Homo Sapiens
GDVNAVGKL

SEQ ID NO: 1269058 - protein, 9 aa, Homo Sapiens
KPSFMPCLY

SEQ ID NO: 1269059 - protein, 9 aa, Homo Sapiens
TGHAGLNTT

SEQ ID NO: 1269060 - protein, 9 aa, Homo Sapiens
VLEVVVVHE

SEQ ID NO: 1269061 - protein, 9 aa, Homo Sapiens
RAQGHPALH

SEQ ID NO: 1269062 - protein, 9 aa, Homo Sapiens
PSAAHCSTG

SEQ ID NO: 1269063 - protein, 9 aa, Homo Sapiens
PLWDLGVLQ

SEQ ID NO: 1269064 - protein, 9 aa, Homo Sapiens
RWRRKRYAL

SEQ ID NO: 1269065 - protein, 9 aa, Homo Sapiens
SSSKEKSSD

SEQ ID NO: 1269066 - protein, 9 aa, Homo Sapiens
SGPCRAVGL

SEQ ID NO: 1269067 - protein, 9 aa, Homo Sapiens
MKSPIFGPE

SEQ ID NO: 1269068 - protein, 9 aa, Homo Sapiens
RPLCPAQMC

SEQ ID NO: 1269069 - protein, 9 aa, Homo Sapiens
WPTVHGLLR

SEQ ID NO: 1269070 - protein, 9 aa, Homo Sapiens
KKTCVSDPI

SEQ ID NO: 1269071 - protein, 9 aa, Homo Sapiens
PGPHDDFVA

SEQ ID NO: 1269072 - protein, 9 aa, Homo Sapiens
CSVPIQYTD

SEQ ID NO: 1269073 - protein, 9 aa, Homo Sapiens
PCRVASLQG

SEQ ID NO: 1269074 - protein, 9 aa, Homo Sapiens
TILLRGARP

SEQ ID NO: 1269075 - protein, 9 aa, Homo Sapiens
RAAPPSLRA

SEQ ID NO: 1269076 - protein, 9 aa, Homo Sapiens
HLASYLDHV

SEQ ID NO: 1269077 - protein, 9 aa, Homo Sapiens
RTCSWTIHQ

SEQ ID NO: 1269078 - protein, 9 aa, Homo Sapiens
ADLADGAHV

SEQ ID NO: 1269079 - protein, 9 aa, Homo Sapiens
VDSKDKTSA

SEQ ID NO: 1269080 - protein, 9 aa, Homo Sapiens
QRPPRQVRE

SEQ ID NO: 1269081 - protein, 9 aa, Homo Sapiens
ALVAELALV

SEQ ID NO: 1269082 - protein, 9 aa, Homo Sapiens
VGLGVQVLP

SEQ ID NO: 1269083 - protein, 9 aa, Homo Sapiens
EWAPGAEGI

SEQ ID NO: 1269084 - protein, 9 aa, Homo Sapiens
CEYLLYGRM

SEQ ID NO: 1269085 - protein, 9 aa, Homo Sapiens
HDDFVADGA

SEQ ID NO: 1269086 - protein, 9 aa, Homo Sapiens
AGHRHAEPG

SEQ ID NO: 1269087 - protein, 9 aa, Homo Sapiens
LPYTATTAP

SEQ ID NO: 1269088 - protein, 9 aa, Homo Sapiens
LGSLAGTML

SEQ ID NO: 1269089 - protein, 9 aa, Homo Sapiens
TSSLVASSQ

SEQ ID NO: 1269090 - protein, 9 aa, Homo Sapiens
AWPPTVTIW

SEQ ID NO: 1269091 - protein, 9 aa, Homo Sapiens
RRAPQGVNP

SEQ ID NO: 1269092 - protein, 9 aa, Homo Sapiens
SSSQCTQGR

SEQ ID NO: 1269093 - protein, 9 aa, Homo Sapiens
LCLLRLSRL

SEQ ID NO: 1269094 - protein, 9 aa, Homo Sapiens
GILHLVVQW

SEQ ID NO: 1269095 - protein, 9 aa, Homo Sapiens
SKNAGETLL

SEQ ID NO: 1269096 - protein, 9 aa, Homo Sapiens
RSRKLGEHV

SEQ ID NO: 1269097 - protein, 9 aa, Homo Sapiens
FFFILVPRL

SEQ ID NO: 1269098 - protein, 9 aa, Homo Sapiens
GASGRDREA

SEQ ID NO: 1269099 - protein, 9 aa, Homo Sapiens
QWAPHSAGL

SEQ ID NO: 1269100 - protein, 9 aa, Homo Sapiens
PGDPDAVVA

SEQ ID NO: 1269101 - protein, 9 aa, Homo Sapiens
PLLGSLAGT

SEQ ID NO: 1269102 - protein, 9 aa, Homo Sapiens
ILLNVDGIE

SEQ ID NO: 1269103 - protein, 9 aa, Homo Sapiens
HLYGSYPPA

SEQ ID NO: 1269104 - protein, 9 aa, Homo Sapiens
AFSGRILHQ

SEQ ID NO: 1269105 - protein, 9 aa, Homo Sapiens
GIRNTICHL

SEQ ID NO: 1269106 - protein, 9 aa, Homo Sapiens
RLMPKFLNS

SEQ ID NO: 1269107 - protein, 9 aa, Homo Sapiens
KAKIKKKTG

SEQ ID NO: 1269108 - protein, 9 aa, Homo Sapiens
NTTQAGGMA

SEQ ID NO: 1269109 - protein, 9 aa, Homo Sapiens
KIEADMMKR

SEQ ID NO: 1269110 - protein, 9 aa, Homo Sapiens
HRHAEPGPG

SEQ ID NO: 1269111 - protein, 9 aa, Homo Sapiens
QHPPPAKHS

SEQ ID NO: 1269112 - protein, 9 aa, Homo Sapiens
KSNDTTASE

SEQ ID NO: 1269113 - protein, 9 aa, Homo Sapiens
AYSRVQFQF

SEQ ID NO: 1269114 - protein, 9 aa, Homo Sapiens
MNDVCRAFL

SEQ ID NO: 1269115 - protein, 9 aa, Homo Sapiens
VTWMARKFT

SEQ ID NO: 1269116 - protein, 9 aa, Homo Sapiens
SSHPRMSDN

SEQ ID NO: 1269117 - protein, 9 aa, Homo Sapiens
THEILAGFL

SEQ ID NO: 1269118 - protein, 9 aa, Homo Sapiens
FNTQREERL

SEQ ID NO: 1269119 - protein, 9 aa, Homo Sapiens
SPRRASGCR

SEQ ID NO: 1269120 - protein, 9 aa, Homo Sapiens
ADGAHVWLL

SEQ ID NO: 1269121 - protein, 9 aa, Homo Sapiens
LQPTQPQPS

SEQ ID NO: 1269122 - protein, 9 aa, Homo Sapiens
CHPWPSGPC

SEQ ID NO: 1269123 - protein, 9 aa, Homo Sapiens
TAGHRSLPM

SEQ ID NO: 1269124 - protein, 9 aa, Homo Sapiens
ARVDAHVVL

SEQ ID NO: 1269125 - protein, 9 aa, Homo Sapiens
QTSELEFNT

SEQ ID NO: 1269126 - protein, 9 aa, Homo Sapiens
WSAMHNRKY

SEQ ID NO: 1269127 - protein, 9 aa, Homo Sapiens
TLALKEIPS

SEQ ID NO: 1269128 - protein, 9 aa, Homo Sapiens
SCHNLELER

SEQ ID NO: 1269129 - protein, 9 aa, Homo Sapiens
EGTAGHRSL

SEQ ID NO: 1269130 - protein, 9 aa, Homo Sapiens
VIAKTRGKV

SEQ ID NO: 1269131 - protein, 9 aa, Homo Sapiens
PWPAIATWP

SEQ ID NO: 1269132 - protein, 9 aa, Homo Sapiens
KQSADQCKE

SEQ ID NO: 1269133 - protein, 9 aa, Homo Sapiens
KPLPPPGSP

SEQ ID NO: 1269134 - protein, 9 aa, Homo Sapiens
GIFVFKEIK

SEQ ID NO: 1269135 - protein, 9 aa, Homo Sapiens
ILALSRVSG

SEQ ID NO: 1269136 - protein, 9 aa, Homo Sapiens
LVFRFCLPV

SEQ ID NO: 1269137 - protein, 9 aa, Homo Sapiens
AAGADGCGS

SEQ ID NO: 1269138 - protein, 9 aa, Homo Sapiens
ELWKYEAIQ

SEQ ID NO: 1269139 - protein, 9 aa, Homo Sapiens
LPLSAVTAL

SEQ ID NO: 1269140 - protein, 9 aa, Homo Sapiens
AKHSSSQCT

SEQ ID NO: 1269141 - protein, 9 aa, Homo Sapiens
GNLVQKAQF

SEQ ID NO: 1269142 - protein, 9 aa, Homo Sapiens
FPAISMKSP

SEQ ID NO: 1269143 - protein, 9 aa, Homo Sapiens
DNRTPTWRP

SEQ ID NO: 1269144 - protein, 9 aa, Homo Sapiens
VIEVALAPR

SEQ ID NO: 1269145 - protein, 9 aa, Homo Sapiens
MLLPVGQRM

SEQ ID NO: 1269146 - protein, 9 aa, Homo Sapiens
GPPRSRLAA

SEQ ID NO: 1269147 - protein, 9 aa, Homo Sapiens
VVQLLVTQG

SEQ ID NO: 1269148 - protein, 9 aa, Homo Sapiens
ANNTRIVDD

SEQ ID NO: 1269149 - protein, 9 aa, Homo Sapiens
RLGQRLGPK

SEQ ID NO: 1269150 - protein, 9 aa, Homo Sapiens
ESLYRKHCV

SEQ ID NO: 1269151 - protein, 9 aa, Homo Sapiens
LPVGQRMTE

SEQ ID NO: 1269152 - protein, 9 aa, Homo Sapiens
TLRPWPRLS

SEQ ID NO: 1269153 - protein, 9 aa, Homo Sapiens
ASLFHRRRA

SEQ ID NO: 1269154 - protein, 9 aa, Homo Sapiens
APSSPPPPL

SEQ ID NO: 1269155 - protein, 9 aa, Homo Sapiens
LPPRATRRP

SEQ ID NO: 1269156 - protein, 9 aa, Homo Sapiens
AARGHLLVV

SEQ ID NO: 1269157 - protein, 9 aa, Homo Sapiens
PPPGSPSLS

SEQ ID NO: 1269158 - protein, 9 aa, Homo Sapiens
WPSAAHCST

SEQ ID NO: 1269159 - protein, 9 aa, Homo Sapiens
QLEKWETLV

SEQ ID NO: 1269160 - protein, 9 aa, Homo Sapiens
DVTPTTSSL

SEQ ID NO: 1269161 - protein, 9 aa, Homo Sapiens
QVTAKGIWT

SEQ ID NO: 1269162 - protein, 9 aa, Homo Sapiens
NSIPLLGSL

SEQ ID NO: 1269163 - protein, 9 aa, Homo Sapiens
WQDASSFWL

SEQ ID NO: 1269164 - protein, 9 aa, Homo Sapiens
RLRHSTLRP

SEQ ID NO: 1269165 - protein, 9 aa, Homo Sapiens
ACRAGGPAG

SEQ ID NO: 1269166 - protein, 9 aa, Homo Sapiens
RVTAQALYQ

SEQ ID NO: 1269167 - protein, 9 aa, Homo Sapiens
AAHRRPTQT

SEQ ID NO: 1269168 - protein, 9 aa, Homo Sapiens
ALPLEAVAA

SEQ ID NO: 1269169 - protein, 9 aa, Homo Sapiens
QRHAGHRSR

SEQ ID NO: 1269170 - protein, 9 aa, Homo Sapiens
RHPRPQLSL

SEQ ID NO: 1269171 - protein, 9 aa, Homo Sapiens
PGERTCSWT

SEQ ID NO: 1269172 - protein, 9 aa, Homo Sapiens
ARAAHRRPT

SEQ ID NO: 1269173 - protein, 9 aa, Homo Sapiens
RWGAWHPGS

SEQ ID NO: 1269174 - protein, 9 aa, Homo Sapiens
VPRLECSGT

SEQ ID NO: 1269175 - protein, 9 aa, Homo Sapiens
FSKYCHRAL

SEQ ID NO: 1269176 - protein, 9 aa, Homo Sapiens
TTAMTPTVT

SEQ ID NO: 1269177 - protein, 9 aa, Homo Sapiens
ISIKYSGPY

SEQ ID NO: 1269178 - protein, 9 aa, Homo Sapiens
RKDIKHEYQ

SEQ ID NO: 1269179 - protein, 9 aa, Homo Sapiens
QLALFYQGP

SEQ ID NO: 1269180 - protein, 9 aa, Homo Sapiens
KREKVKDMF

SEQ ID NO: 1269181 - protein, 9 aa, Homo Sapiens
PWPRLSLVV

SEQ ID NO: 1269182 - protein, 9 aa, Homo Sapiens
HSTPPLALA

SEQ ID NO: 1269183 - protein, 9 aa, Homo Sapiens
ENIPVVRRL

SEQ ID NO: 1269184 - protein, 9 aa, Homo Sapiens
LTWKSNDTT

SEQ ID NO: 1269185 - protein, 9 aa, Homo Sapiens
SLPVQKKSY

SEQ ID NO: 1269186 - protein, 9 aa, Homo Sapiens
IFVFKEIKG

SEQ ID NO: 1269187 - protein, 9 aa, Homo Sapiens
RSPQVTGEA

SEQ ID NO: 1269188 - protein, 9 aa, Homo Sapiens
FHAHVSQVE

SEQ ID NO: 1269189 - protein, 9 aa, Homo Sapiens
SIKYSGPYH

SEQ ID NO: 1269190 - protein, 9 aa, Homo Sapiens
QGPGWEEAS

SEQ ID NO: 1269191 - protein, 9 aa, Homo Sapiens
TMAGPSASL

SEQ ID NO: 1269192 - protein, 9 aa, Homo Sapiens
PGAEGIFLT

SEQ ID NO: 1269193 - protein, 9 aa, Homo Sapiens
MEPCCCRET

SEQ ID NO: 1269194 - protein, 9 aa, Homo Sapiens
HTQVHTQTH

SEQ ID NO: 1269195 - protein, 9 aa, Homo Sapiens
ECSGTILAY

SEQ ID NO: 1269196 - protein, 9 aa, Homo Sapiens
PEMREDRTK

SEQ ID NO: 1269197 - protein, 9 aa, Homo Sapiens
SFLPEVTWM

SEQ ID NO: 1269198 - protein, 9 aa, Homo Sapiens
VNAVGKLLI

SEQ ID NO: 1269199 - protein, 9 aa, Homo Sapiens
NPDLRRRDP

SEQ ID NO: 1269200 - protein, 9 aa, Homo Sapiens
SQGVILVYD

SEQ ID NO: 1269201 - protein, 9 aa, Homo Sapiens
SVPIQYTDK

SEQ ID NO: 1269202 - protein, 9 aa, Homo Sapiens
GQPASRAQR

SEQ ID NO: 1269203 - protein, 9 aa, Homo Sapiens
GKQKPHRRG

SEQ ID NO: 1269204 - protein, 9 aa, Homo Sapiens
LENNHIDWR

SEQ ID NO: 1269205 - protein, 9 aa, Homo Sapiens
THTARPHPC

SEQ ID NO: 1269206 - protein, 9 aa, Homo Sapiens
AEAPRLHPP

SEQ ID NO: 1269207 - protein, 9 aa, Homo Sapiens
DDCNIHVIA

SEQ ID NO: 1269208 - protein, 9 aa, Homo Sapiens
VFVLFLNAT

SEQ ID NO: 1269209 - protein, 9 aa, Homo Sapiens
VWLLPGMGP

SEQ ID NO: 1269210 - protein, 9 aa, Homo Sapiens
DGFSGHAGN

SEQ ID NO: 1269211 - protein, 9 aa, Homo Sapiens
EAVAALKTL

SEQ ID NO: 1269212 - protein, 9 aa, Homo Sapiens
TLLLGDNSD

SEQ ID NO: 1269213 - protein, 9 aa, Homo Sapiens
RSTVSRTMP

SEQ ID NO: 1269214 - protein, 9 aa, Homo Sapiens
CTMPPLLHP

SEQ ID NO: 1269215 - protein, 9 aa, Homo Sapiens
QKKAKIKKK

SEQ ID NO: 1269216 - protein, 9 aa, Homo Sapiens
GVQLRHRLG

SEQ ID NO: 1269217 - protein, 9 aa, Homo Sapiens
PSPASACTM

SEQ ID NO: 1269218 - protein, 9 aa, Homo Sapiens
GGLFPDAQP

SEQ ID NO: 1269219 - protein, 9 aa, Homo Sapiens
GTEVPWPEV

SEQ ID NO: 1269220 - protein, 9 aa, Homo Sapiens
DVASNSSRG

SEQ ID NO: 1269221 - protein, 9 aa, Homo Sapiens
TPTTRLMAP

SEQ ID NO: 1269222 - protein, 9 aa, Homo Sapiens
TQAGGMAKM

SEQ ID NO: 1269223 - protein, 9 aa, Homo Sapiens
KEYLPMYCS

SEQ ID NO: 1269224 - protein, 9 aa, Homo Sapiens
DNHANRSLV

SEQ ID NO: 1269225 - protein, 9 aa, Homo Sapiens
GITANCCHH

SEQ ID NO: 1269226 - protein, 9 aa, Homo Sapiens
LEVLRLGRN

SEQ ID NO: 1269227 - protein, 9 aa, Homo Sapiens
CGDTFWLKV

SEQ ID NO: 1269228 - protein, 9 aa, Homo Sapiens
EEVPAMLDK

SEQ ID NO: 1269229 - protein, 9 aa, Homo Sapiens
ITKRGLKSL

SEQ ID NO: 1269230 - protein, 9 aa, Homo Sapiens
KPHRRGMAP

SEQ ID NO: 1269231 - protein, 9 aa, Homo Sapiens
KVQGNNDLY

SEQ ID NO: 1269232 - protein, 9 aa, Homo Sapiens
PPHFPRRSY

SEQ ID NO: 1269233 - protein, 9 aa, Homo Sapiens
LPQLSLTQP

SEQ ID NO: 1269234 - protein, 9 aa, Homo Sapiens
SSHFKWILL

SEQ ID NO: 1269235 - protein, 9 aa, Homo Sapiens
PPSLMTSTF

SEQ ID NO: 1269236 - protein, 9 aa, Homo Sapiens
PKRKGNNVF

SEQ ID NO: 1269237 - protein, 9 aa, Homo Sapiens
LHQCLSLTM

SEQ ID NO: 1269238 - protein, 9 aa, Homo Sapiens
CPSLGPGGV

SEQ ID NO: 1269239 - protein, 9 aa, Homo Sapiens
CHAAALALD

SEQ ID NO: 1269240 - protein, 9 aa, Homo Sapiens
KKNISEKKV

SEQ ID NO: 1269241 - protein, 9 aa, Homo Sapiens
NTQREERLR

SEQ ID NO: 1269242 - protein, 9 aa, Homo Sapiens
NTEGCILQW

SEQ ID NO: 1269243 - protein, 9 aa, Homo Sapiens
PWRPKTRRC

SEQ ID NO: 1269244 - protein, 9 aa, Homo Sapiens
EDGTTRRTK

SEQ ID NO: 1269245 - protein, 9 aa, Homo Sapiens
QVRTSGRAQ

SEQ ID NO: 1269246 - protein, 9 aa, Homo Sapiens
VLQPTQPQP

SEQ ID NO: 1269247 - protein, 9 aa, Homo Sapiens
LVSNFISTK

SEQ ID NO: 1269248 - protein, 9 aa, Homo Sapiens
MSCSLLTQP

SEQ ID NO: 1269249 - protein, 9 aa, Homo Sapiens
CSLSFPGSS

SEQ ID NO: 1269250 - protein, 9 aa, Homo Sapiens
LNTTQAGGM

SEQ ID NO: 1269251 - protein, 9 aa, Homo Sapiens
LLHINDIVP

SEQ ID NO: 1269252 - protein, 9 aa, Homo Sapiens
ILHLVVQWP

SEQ ID NO: 1269253 - protein, 9 aa, Homo Sapiens
GDCPRTMAG

SEQ ID NO: 1269254 - protein, 9 aa, Homo Sapiens
DFVADGALL

SEQ ID NO: 1269255 - protein, 9 aa, Homo Sapiens
CYCVLGDKG

SEQ ID NO: 1269256 - protein, 9 aa, Homo Sapiens
SLQGIRVQR

SEQ ID NO: 1269257 - protein, 9 aa, Homo Sapiens
MYCSILLEF

SEQ ID NO: 1269258 - protein, 9 aa, Homo Sapiens
LPVQKKSYE

SEQ ID NO: 1269259 - protein, 9 aa, Homo Sapiens
HPGSWPVAQ

SEQ ID NO: 1269260 - protein, 9 aa, Homo Sapiens
EAFCFLIQS

SEQ ID NO: 1269261 - protein, 9 aa, Homo Sapiens
IANTLRQQQ

SEQ ID NO: 1269262 - protein, 9 aa, Homo Sapiens
KGVPIRFEV

SEQ ID NO: 1269263 - protein, 9 aa, Homo Sapiens
SILLEFPLQ

SEQ ID NO: 1269264 - protein, 9 aa, Homo Sapiens
QNQDPKHRM

SEQ ID NO: 1269265 - protein, 9 aa, Homo Sapiens
LVDLEDWEE

SEQ ID NO: 1269266 - protein, 9 aa, Homo Sapiens
SSFWLIFIV

SEQ ID NO: 1269267 - protein, 9 aa, Homo Sapiens
TVTIWMCRH

SEQ ID NO: 1269268 - protein, 9 aa, Homo Sapiens
IEVAKLDGM

SEQ ID NO: 1269269 - protein, 9 aa, Homo Sapiens
ALATPTPSQ

SEQ ID NO: 1269270 - protein, 9 aa, Homo Sapiens
SLLCSHLGE

SEQ ID NO: 1269271 - protein, 9 aa, Homo Sapiens
LPASRTTAL

SEQ ID NO: 1269272 - protein, 9 aa, Homo Sapiens
KWILLLTIL

SEQ ID NO: 1269273 - protein, 9 aa, Homo Sapiens
AESPWRPKT

SEQ ID NO: 1269274 - protein, 9 aa, Homo Sapiens
GRPYRNRPK

SEQ ID NO: 1269275 - protein, 9 aa, Homo Sapiens
ERSWGLEFS

SEQ ID NO: 1269276 - protein, 9 aa, Homo Sapiens
DTESDTNYL

SEQ ID NO: 1269277 - protein, 9 aa, Homo Sapiens
VRRQPAQRR

SEQ ID NO: 1269278 - protein, 9 aa, Homo Sapiens
KEVRGEWRQ

SEQ ID NO: 1269279 - protein, 9 aa, Homo Sapiens
IPDGLFWML

SEQ ID NO: 1269280 - protein, 9 aa, Homo Sapiens
DLPHKKYPA

SEQ ID NO: 1269281 - protein, 9 aa, Homo Sapiens
SYVAWIDSV

SEQ ID NO: 1269282 - protein, 9 aa, Homo Sapiens
LQARGPAPA

SEQ ID NO: 1269283 - protein, 9 aa, Homo Sapiens
LSLLIAADT

SEQ ID NO: 1269284 - protein, 9 aa, Homo Sapiens
SRLNSWGEA

SEQ ID NO: 1269285 - protein, 9 aa, Homo Sapiens
VTGDQSSPI

SEQ ID NO: 1269286 - protein, 9 aa, Homo Sapiens
AVRPCVKTW

SEQ ID NO: 1269287 - protein, 9 aa, Homo Sapiens
PAQRRVQRA

SEQ ID NO: 1269288 - protein, 9 aa, Homo Sapiens
STPGSSSQT

SEQ ID NO: 1269289 - protein, 9 aa, Homo Sapiens
PDAVVASSS

SEQ ID NO: 1269290 - protein, 9 aa, Homo Sapiens
LEEVPAMLD

SEQ ID NO: 1269291 - protein, 9 aa, Homo Sapiens
QPRRPVVVP

SEQ ID NO: 1269292 - protein, 9 aa, Homo Sapiens
WLKVLLVQH

SEQ ID NO: 1269293 - protein, 9 aa, Homo Sapiens
HTHRHTQEY

SEQ ID NO: 1269294 - protein, 9 aa, Homo Sapiens
DTLSSSKEK

SEQ ID NO: 1269295 - protein, 9 aa, Homo Sapiens
QHCPPVPGS

SEQ ID NO: 1269296 - protein, 9 aa, Homo Sapiens
ASSHPRMSD

SEQ ID NO: 1269297 - protein, 9 aa, Homo Sapiens
SMKLRNESL

SEQ ID NO: 1269298 - protein, 9 aa, Homo Sapiens
PSIRSASSR

SEQ ID NO: 1269299 - protein, 9 aa, Homo Sapiens
NESYDAVQH

SEQ ID NO: 1269300 - protein, 9 aa, Homo Sapiens
LAANLATAL

SEQ ID NO: 1269301 - protein, 9 aa, Homo Sapiens
MIDPKMDAG

SEQ ID NO: 1269302 - protein, 9 aa, Homo Sapiens
EKTYLEIII

SEQ ID NO: 1269303 - protein, 9 aa, Homo Sapiens
WPSGPCRAV

SEQ ID NO: 1269304 - protein, 9 aa, Homo Sapiens
GSLPLRSSG

SEQ ID NO: 1269305 - protein, 9 aa, Homo Sapiens
VEGMETGEG

SEQ ID NO: 1269306 - protein, 9 aa, Homo Sapiens
TGVCLHCTP

SEQ ID NO: 1269307 - protein, 9 aa, Homo Sapiens
PIQYTDKTD

SEQ ID NO: 1269308 - protein, 9 aa, Homo Sapiens
VEYCEFLGC

SEQ ID NO: 1269309 - protein, 9 aa, Homo Sapiens
VKLSLSWDI

SEQ ID NO: 1269310 - protein, 9 aa, Homo Sapiens
PASRTTALL

SEQ ID NO: 1269311 - protein, 9 aa, Homo Sapiens
QRTGRQHPP

SEQ ID NO: 1269312 - protein, 9 aa, Homo Sapiens
TAKGIWTMT

SEQ ID NO: 1269313 - protein, 9 aa, Homo Sapiens
IKYLKNFVK

SEQ ID NO: 1269314 - protein, 9 aa, Homo Sapiens
ISGERGSGK

SEQ ID NO: 1269315 - protein, 9 aa, Homo Sapiens
LILCGKKVE

SEQ ID NO: 1269316 - protein, 9 aa, Homo Sapiens
PLYSVKSLS

SEQ ID NO: 1269317 - protein, 9 aa, Homo Sapiens
PCLPRRAPQ

SEQ ID NO: 1269318 - protein, 9 aa, Homo Sapiens
GGVIPAPPN

SEQ ID NO: 1269319 - protein, 9 aa, Homo Sapiens
QPASRAQRH

SEQ ID NO: 1269320 - protein, 9 aa, Homo Sapiens
RVNEYCFAW

SEQ ID NO: 1269321 - protein, 9 aa, Homo Sapiens
DEGDKEQFE

SEQ ID NO: 1269322 - protein, 9 aa, Homo Sapiens
DTFWLKVLL

SEQ ID NO: 1269323 - protein, 9 aa, Homo Sapiens
PGMGPHVPR

SEQ ID NO: 1269324 - protein, 9 aa, Homo Sapiens
KTKVTKTVK

SEQ ID NO: 1269325 - protein, 9 aa, Homo Sapiens
ILDDQIQWP

SEQ ID NO: 1269326 - protein, 9 aa, Homo Sapiens
RATRRPRAL

SEQ ID NO: 1269327 - protein, 9 aa, Homo Sapiens
KADWLASRL

SEQ ID NO: 1269328 - protein, 9 aa, Homo Sapiens
TSGKQKPHR

SEQ ID NO: 1269329 - protein, 9 aa, Homo Sapiens
YTLTYTGTH

SEQ ID NO: 1269330 - protein, 9 aa, Homo Sapiens
EFQRIFDLQ

SEQ ID NO: 1269331 - protein, 9 aa, Homo Sapiens
ELVGFQRDL

SEQ ID NO: 1269332 - protein, 9 aa, Homo Sapiens
SPSIRSASS

SEQ ID NO: 1269333 - protein, 9 aa, Homo Sapiens
LLCLLRLSR

SEQ ID NO: 1269334 - protein, 9 aa, Homo Sapiens
SRASTSWCS

SEQ ID NO: 1269335 - protein, 9 aa, Homo Sapiens
RIKGLSSFD

SEQ ID NO: 1269336 - protein, 9 aa, Homo Sapiens
SVTLCIIPQ

SEQ ID NO: 1269337 - protein, 9 aa, Homo Sapiens
QGVQVRTSG

SEQ ID NO: 1269338 - protein, 9 aa, Homo Sapiens
FLSFYNGNG

SEQ ID NO: 1269339 - protein, 9 aa, Homo Sapiens
PLAVGVITF

SEQ ID NO: 1269340 - protein, 9 aa, Homo Sapiens
GYAQSCHFK

SEQ ID NO: 1269341 - protein, 9 aa, Homo Sapiens
QLGKGTEVP

SEQ ID NO: 1269342 - protein, 9 aa, Homo Sapiens
GRDREARAA

SEQ ID NO: 1269343 - protein, 9 aa, Homo Sapiens
LRRLQEALQ

SEQ ID NO: 1269344 - protein, 9 aa, Homo Sapiens
IKWFVARLQ

SEQ ID NO: 1269345 - protein, 9 aa, Homo Sapiens
AISMKSPIF

SEQ ID NO: 1269346 - protein, 9 aa, Homo Sapiens
TMAKVVNLG

SEQ ID NO: 1269347 - protein, 9 aa, Homo Sapiens
DRKELEKRQ

SEQ ID NO: 1269348 - protein, 9 aa, Homo Sapiens
VLGDKGIPV

SEQ ID NO: 1269349 - protein, 9 aa, Homo Sapiens
EIAAKHKKP

SEQ ID NO: 1269350 - protein, 9 aa, Homo Sapiens
IRSASSRAS

SEQ ID NO: 1269351 - protein, 9 aa, Homo Sapiens
TLCIIPQEE

SEQ ID NO: 1269352 - protein, 9 aa, Homo Sapiens
TWMARKFTH

SEQ ID NO: 1269353 - protein, 9 aa, Homo Sapiens
HLKLRRTVT

SEQ ID NO: 1269354 - protein, 9 aa, Homo Sapiens
RSGHGDHLD

SEQ ID NO: 1269355 - protein, 9 aa, Homo Sapiens
ERTCSWTIH

SEQ ID NO: 1269356 - protein, 9 aa, Homo Sapiens
VTAISCVFL

SEQ ID NO: 1269357 - protein, 9 aa, Homo Sapiens
THTQVHTQT

SEQ ID NO: 1269358 - protein, 9 aa, Homo Sapiens
TMNIVSSYA

SEQ ID NO: 1269359 - protein, 9 aa, Homo Sapiens
CKEYLPMYC

SEQ ID NO: 1269360 - protein, 9 aa, Homo Sapiens
GTGHIINKN

SEQ ID NO: 1269361 - protein, 9 aa, Homo Sapiens
IATWPSAAH

SEQ ID NO: 1269362 - protein, 9 aa, Homo Sapiens
AEGIFLTGD

SEQ ID NO: 1269363 - protein, 9 aa, Homo Sapiens
IRFEVGPRD

SEQ ID NO: 1269364 - protein, 9 aa, Homo Sapiens
LLDSSSASH

SEQ ID NO: 1269365 - protein, 9 aa, Homo Sapiens
TVSLVGRSG

SEQ ID NO: 1269366 - protein, 9 aa, Homo Sapiens
LNLTLALKE

SEQ ID NO: 1269367 - protein, 9 aa, Homo Sapiens
EGQQPRRPV

SEQ ID NO: 1269368 - protein, 9 aa, Homo Sapiens
DGPKMETLT

SEQ ID NO: 1269369 - protein, 9 aa, Homo Sapiens
GVDYFYLEI

SEQ ID NO: 1269370 - protein, 9 aa, Homo Sapiens
SAGYRCRWC

SEQ ID NO: 1269371 - protein, 9 aa, Homo Sapiens
TWASLSNTS

SEQ ID NO: 1269372 - protein, 9 aa, Homo Sapiens
NLATALQNT

SEQ ID NO: 1269373 - protein, 9 aa, Homo Sapiens
HANRSLVLP

SEQ ID NO: 1269374 - protein, 9 aa, Homo Sapiens
DVNDNPPHF

SEQ ID NO: 1269375 - protein, 9 aa, Homo Sapiens
HAGNHGHSM

SEQ ID NO: 1269376 - protein, 9 aa, Homo Sapiens
TRGKVDIHL

SEQ ID NO: 1269377 - protein, 9 aa, Homo Sapiens
GQFARTPGP

SEQ ID NO: 1269378 - protein, 9 aa, Homo Sapiens
SSPRRASGC

SEQ ID NO: 1269379 - protein, 9 aa, Homo Sapiens
TDGPKMETL

SEQ ID NO: 1269380 - protein, 9 aa, Homo Sapiens
ETGEGLEEI

SEQ ID NO: 1269381 - protein, 9 aa, Homo Sapiens
SGRILHQPE

SEQ ID NO: 1269382 - protein, 9 aa, Homo Sapiens
PPRQVREHV

SEQ ID NO: 1269383 - protein, 9 aa, Homo Sapiens
RKGRNNKLI

SEQ ID NO: 1269384 - protein, 9 aa, Homo Sapiens
RLHPTKEEV

SEQ ID NO: 1269385 - protein, 9 aa, Homo Sapiens
CVSDPISTS

SEQ ID NO: 1269386 - protein, 9 aa, Homo Sapiens
TREIFVLFL

SEQ ID NO: 1269387 - protein, 9 aa, Homo Sapiens
PQRLHPTKE

SEQ ID NO: 1269388 - protein, 9 aa, Homo Sapiens
ELEELRKCG

SEQ ID NO: 1269389 - protein, 9 aa, Homo Sapiens
RASRKTWQR

SEQ ID NO: 1269390 - protein, 9 aa, Homo Sapiens
PVIRIDLPH

SEQ ID NO: 1269391 - protein, 9 aa, Homo Sapiens
TVVVLRLDG

SEQ ID NO: 1269392 - protein, 9 aa, Homo Sapiens
GHLLVVQLL

SEQ ID NO: 1269393 - protein, 9 aa, Homo Sapiens
PKTVKPKEV

SEQ ID NO: 1269394 - protein, 9 aa, Homo Sapiens
RAHARHRHV

SEQ ID NO: 1269395 - protein, 9 aa, Homo Sapiens
QCSVPIQYT

SEQ ID NO: 1269396 - protein, 9 aa, Homo Sapiens
LSVRPCSVT

SEQ ID NO: 1269397 - protein, 9 aa, Homo Sapiens
TWRPRSSRR

SEQ ID NO: 1269398 - protein, 9 aa, Homo Sapiens
LNVDGIELT

SEQ ID NO: 1269399 - protein, 9 aa, Homo Sapiens
HFLIKELSC

SEQ ID NO: 1269400 - protein, 9 aa, Homo Sapiens
PEEQAGGPP

SEQ ID NO: 1269401 - protein, 9 aa, Homo Sapiens
LSLSWDIVA

SEQ ID NO: 1269402 - protein, 9 aa, Homo Sapiens
APVKLSLSW

SEQ ID NO: 1269403 - protein, 9 aa, Homo Sapiens
NVLELWKYE

SEQ ID NO: 1269404 - protein, 9 aa, Homo Sapiens
IAAKHKKPQ

SEQ ID NO: 1269405 - protein, 9 aa, Homo Sapiens
QHTRGASGR

SEQ ID NO: 1269406 - protein, 9 aa, Homo Sapiens
ARGPAPALP

SEQ ID NO: 1269407 - protein, 9 aa, Homo Sapiens
NVAPPAFSG

SEQ ID NO: 1269408 - protein, 9 aa, Homo Sapiens
GSYPPARQP

SEQ ID NO: 1269409 - protein, 9 aa, Homo Sapiens
TEVPWPEVW

SEQ ID NO: 1269410 - protein, 9 aa, Homo Sapiens
YGPYVEALT

SEQ ID NO: 1269411 - protein, 9 aa, Homo Sapiens
RHVLPAPLA

SEQ ID NO: 1269412 - protein, 9 aa, Homo Sapiens
HFPRRSYQY

SEQ ID NO: 1269413 - protein, 9 aa, Homo Sapiens
AKTRGKVDI

SEQ ID NO: 1269414 - protein, 9 aa, Homo Sapiens
GEKQRVLST

SEQ ID NO: 1269415 - protein, 9 aa, Homo Sapiens
GTTRRTKTK

SEQ ID NO: 1269416 - protein, 9 aa, Homo Sapiens
DGDSPEEIV

SEQ ID NO: 1269417 - protein, 9 aa, Homo Sapiens
FKGIKKGGA

SEQ ID NO: 1269418 - protein, 9 aa, Homo Sapiens
FLARLRSIL

SEQ ID NO: 1269419 - protein, 9 aa, Homo Sapiens
ACRTFRVCL

SEQ ID NO: 1269420 - protein, 9 aa, Homo Sapiens
PEEIVAAMV

SEQ ID NO: 1269421 - protein, 9 aa, Homo Sapiens
ASRTTALLR

SEQ ID NO: 1269422 - protein, 9 aa, Homo Sapiens
LDDIKWFVA

SEQ ID NO: 1269423 - protein, 9 aa, Homo Sapiens
SASSRASTS

SEQ ID NO: 1269424 - protein, 9 aa, Homo Sapiens
KVRTKAAGG

SEQ ID NO: 1269425 - protein, 9 aa, Homo Sapiens
SAGLSPGAC

SEQ ID NO: 1269426 - protein, 9 aa, Homo Sapiens
QLSLTQPQP

SEQ ID NO: 1269427 - protein, 9 aa, Homo Sapiens
YRCRWCSSW

SEQ ID NO: 1269428 - protein, 9 aa, Homo Sapiens
PEMAAMRLM

SEQ ID NO: 1269429 - protein, 9 aa, Homo Sapiens
EFLLPLGII

SEQ ID NO: 1269430 - protein, 9 aa, Homo Sapiens
CRPLCPAQM

SEQ ID NO: 1269431 - protein, 9 aa, Homo Sapiens
LRLGRNSIR

SEQ ID NO: 1269432 - protein, 9 aa, Homo Sapiens
DKTGGLTST

SEQ ID NO: 1269433 - protein, 9 aa, Homo Sapiens
FLNATCWQP

SEQ ID NO: 1269434 - protein, 9 aa, Homo Sapiens
VFRFCLPVG

SEQ ID NO: 1269435 - protein, 9 aa, Homo Sapiens
VAVTAISCV

SEQ ID NO: 1269436 - protein, 9 aa, Homo Sapiens
APVVVNCLH

SEQ ID NO: 1269437 - protein, 9 aa, Homo Sapiens
GHSKTRAFI

SEQ ID NO: 1269438 - protein, 9 aa, Homo Sapiens
VFMLSMYQT

SEQ ID NO: 1269439 - protein, 9 aa, Homo Sapiens
SPFRWLLGI

SEQ ID NO: 1269440 - protein, 9 aa, Homo Sapiens
LPLPTSQQP

SEQ ID NO: 1269441 - protein, 9 aa, Homo Sapiens
SLGEHTFFR

SEQ ID NO: 1269442 - protein, 9 aa, Homo Sapiens
MHNRKYNCT

SEQ ID NO: 1269443 - protein, 9 aa, Homo Sapiens
CWQPWPAIA

SEQ ID NO: 1269444 - protein, 9 aa, Homo Sapiens
VPQRLHPTK

SEQ ID NO: 1269445 - protein, 9 aa, Homo Sapiens
LGRSQGLPA

SEQ ID NO: 1269446 - protein, 9 aa, Homo Sapiens
VPAMLDKPD

SEQ ID NO: 1269447 - protein, 9 aa, Homo Sapiens
HAAALALDV

SEQ ID NO: 1269448 - protein, 9 aa, Homo Sapiens
RPTHQLLQA

SEQ ID NO: 1269449 - protein, 9 aa, Homo Sapiens
TLYLVVAVT

SEQ ID NO: 1269450 - protein, 9 aa, Homo Sapiens
LRKCGITPL

SEQ ID NO: 1269451 - protein, 9 aa, Homo Sapiens
RSWGLEFSP

SEQ ID NO: 1269452 - protein, 9 aa, Homo Sapiens
IYTRVASYV

SEQ ID NO: 1269453 - protein, 9 aa, Homo Sapiens
AAPPSLRAA

SEQ ID NO: 1269454 - protein, 9 aa, Homo Sapiens
MGPHVPRQL

SEQ ID NO: 1269455 - protein, 9 aa, Homo Sapiens
PWNLGPWKL

SEQ ID NO: 1269456 - protein, 9 aa, Homo Sapiens
PSWSAMHNR

SEQ ID NO: 1269457 - protein, 9 aa, Homo Sapiens
EQAGGPPRS

SEQ ID NO: 1269458 - protein, 9 aa, Homo Sapiens
TAISCVFLA

SEQ ID NO: 1269459 - protein, 9 aa, Homo Sapiens
SIFAYPHTV

SEQ ID NO: 1269460 - protein, 9 aa, Homo Sapiens
VQVRTSGRA

SEQ ID NO: 1269461 - protein, 9 aa, Homo Sapiens
KMLHHCQPN

SEQ ID NO: 1269462 - protein, 9 aa, Homo Sapiens
QRSGHGDHL

SEQ ID NO: 1269463 - protein, 9 aa, Homo Sapiens
EGDKEQFEE

SEQ ID NO: 1269464 - protein, 9 aa, Homo Sapiens
LALDVAVQV

SEQ ID NO: 1269465 - protein, 9 aa, Homo Sapiens
NHHMAVHMQ

SEQ ID NO: 1269466 - protein, 9 aa, Homo Sapiens
LPQAGLRSP

SEQ ID NO: 1269467 - protein, 9 aa, Homo Sapiens
PTGRTPTTR

SEQ ID NO: 1269468 - protein, 9 aa, Homo Sapiens
HLQARGPAP

SEQ ID NO: 1269469 - protein, 9 aa, Homo Sapiens
CALDDIKWF

SEQ ID NO: 1269470 - protein, 9 aa, Homo Sapiens
GMQRRVLFE

SEQ ID NO: 1269471 - protein, 9 aa, Homo Sapiens
LHAKDHCMA

SEQ ID NO: 1269472 - protein, 9 aa, Homo Sapiens
LKPTRSTVS

SEQ ID NO: 1269473 - protein, 9 aa, Homo Sapiens
DDFVADGAL

SEQ ID NO: 1269474 - protein, 9 aa, Homo Sapiens
RVKANLRWR

SEQ ID NO: 1269475 - protein, 9 aa, Homo Sapiens
SHPRMSDNA

SEQ ID NO: 1269476 - protein, 9 aa, Homo Sapiens
TRMASAAAC

SEQ ID NO: 1269477 - protein, 9 aa, Homo Sapiens
TQTHTGIHT

SEQ ID NO: 1269478 - protein, 9 aa, Homo Sapiens
VNLDDCNIH

SEQ ID NO: 1269479 - protein, 9 aa, Homo Sapiens
GTAGARHHT

SEQ ID NO: 1269480 - protein, 9 aa, Homo Sapiens
PPPPEQARI

SEQ ID NO: 1269481 - protein, 9 aa, Homo Sapiens
LLGPISTLV

SEQ ID NO: 1269482 - protein, 9 aa, Homo Sapiens
HVSQVEPVR

SEQ ID NO: 1269483 - protein, 9 aa, Homo Sapiens
RMASAAACP

SEQ ID NO: 1269484 - protein, 9 aa, Homo Sapiens
PPAKHSSSQ

SEQ ID NO: 1269485 - protein, 9 aa, Homo Sapiens
CPKRKGNNV

SEQ ID NO: 1269486 - protein, 9 aa, Homo Sapiens
RTFNRNHHM

SEQ ID NO: 1269487 - protein, 9 aa, Homo Sapiens
ASGRASRKT

SEQ ID NO: 1269488 - protein, 9 aa, Homo Sapiens
GHAGLNTTQ

SEQ ID NO: 1269489 - protein, 9 aa, Homo Sapiens
RHTLTQAYT

SEQ ID NO: 1269490 - protein, 9 aa, Homo Sapiens
SSALVSLGF

SEQ ID NO: 1269491 - protein, 9 aa, Homo Sapiens
RTGRQHPPP

SEQ ID NO: 1269492 - protein, 9 aa, Homo Sapiens
MTFDRFHAH

SEQ ID NO: 1269493 - protein, 9 aa, Homo Sapiens
SSDDFFIGK

SEQ ID NO: 1269494 - protein, 9 aa, Homo Sapiens
EWKWRQQSA

SEQ ID NO: 1269495 - protein, 9 aa, Homo Sapiens
TTRRTKTKV

SEQ ID NO: 1269496 - protein, 9 aa, Homo Sapiens
EYLPMYCSI

SEQ ID NO: 1269497 - protein, 9 aa, Homo Sapiens
TCWQPWPAI

SEQ ID NO: 1269498 - protein, 9 aa, Homo Sapiens
FCFLIQSQV

SEQ ID NO: 1269499 - protein, 9 aa, Homo Sapiens
RPPAPTPCT

SEQ ID NO: 1269500 - protein, 9 aa, Homo Sapiens
PTVHGLLRQ

SEQ ID NO: 1269501 - protein, 9 aa, Homo Sapiens
TVDEGDKEQ

SEQ ID NO: 1269502 - protein, 9 aa, Homo Sapiens
TLTLRKGRN

SEQ ID NO: 1269503 - protein, 9 aa, Homo Sapiens
ATALQNTEE

SEQ ID NO: 1269504 - protein, 9 aa, Homo Sapiens
LPILDDQIQ

SEQ ID NO: 1269505 - protein, 9 aa, Homo Sapiens
VSNFISTKE

SEQ ID NO: 1269506 - protein, 9 aa, Homo Sapiens
ESSYFLSFY

SEQ ID NO: 1269507 - protein, 9 aa, Homo Sapiens
PARQPSRPT

SEQ ID NO: 1269508 - protein, 9 aa, Homo Sapiens
ALLPPRATR

SEQ ID NO: 1269509 - protein, 9 aa, Homo Sapiens
PGDKGNFGQ

SEQ ID NO: 1269510 - protein, 9 aa, Homo Sapiens
DGALLRGLG

SEQ ID NO: 1269511 - protein, 9 aa, Homo Sapiens
EYCEFLGCF

SEQ ID NO: 1269512 - protein, 9 aa, Homo Sapiens
VFSKYCHRA

SEQ ID NO: 1269513 - protein, 9 aa, Homo Sapiens
PPGVDYFYL

SEQ ID NO: 1269514 - protein, 9 aa, Homo Sapiens
KAGKGLTGV

SEQ ID NO: 1269515 - protein, 9 aa, Homo Sapiens
RLCQVTAKG

SEQ ID NO: 1269516 - protein, 9 aa, Homo Sapiens
QWPTVHGLL

SEQ ID NO: 1269517 - protein, 9 aa, Homo Sapiens
LVVTGDQSS

SEQ ID NO: 1269518 - protein, 9 aa, Homo Sapiens
GSVMSCSLL

SEQ ID NO: 1269519 - protein, 9 aa, Homo Sapiens
SLTQPQPPV

SEQ ID NO: 1269520 - protein, 9 aa, Homo Sapiens
LCSQRRLRH

SEQ ID NO: 1269521 - protein, 9 aa, Homo Sapiens
NRHATLMDL

SEQ ID NO: 1269522 - protein, 9 aa, Homo Sapiens
AKELWEKME

SEQ ID NO: 1269523 - protein, 9 aa, Homo Sapiens
NDLLGHSKT

SEQ ID NO: 1269524 - protein, 9 aa, Homo Sapiens
IPLYSVKSL

SEQ ID NO: 1269525 - protein, 9 aa, Homo Sapiens
HRSRKLGEH

SEQ ID NO: 1269526 - protein, 9 aa, Homo Sapiens
QVHQALQQA

SEQ ID NO: 1269527 - protein, 9 aa, Homo Sapiens
CLTHEILAG

SEQ ID NO: 1269528 - protein, 9 aa, Homo Sapiens
SPASACTMP

SEQ ID NO: 1269529 - protein, 9 aa, Homo Sapiens
WGIFVFKEI

SEQ ID NO: 1269530 - protein, 9 aa, Homo Sapiens
WLDEPKNPI

SEQ ID NO: 1269531 - protein, 9 aa, Homo Sapiens
SKHMWPGDK

SEQ ID NO: 1269532 - protein, 9 aa, Homo Sapiens
LFYQGPGWE

SEQ ID NO: 1269533 - protein, 9 aa, Homo Sapiens
TNTEGCILQ

SEQ ID NO: 1269534 - protein, 9 aa, Homo Sapiens
ALDVAVQVV

SEQ ID NO: 1269535 - protein, 9 aa, Homo Sapiens
VARHQLFVV

SEQ ID NO: 1269536 - protein, 9 aa, Homo Sapiens
GIELTEVSR

SEQ ID NO: 1269537 - protein, 9 aa, Homo Sapiens
MAAMRLMPK

SEQ ID NO: 1269538 - protein, 9 aa, Homo Sapiens
EQAPPVIYV

SEQ ID NO: 1269539 - protein, 9 aa, Homo Sapiens
SLHPACAVS

SEQ ID NO: 1269540 - protein, 9 aa, Homo Sapiens
PHVSTTAMT

SEQ ID NO: 1269541 - protein, 9 aa, Homo Sapiens
VHRVTAQAL

SEQ ID NO: 1269542 - protein, 9 aa, Homo Sapiens
SAAHCSTGS

SEQ ID NO: 1269543 - protein, 9 aa, Homo Sapiens
LGPISTLVH

SEQ ID NO: 1269544 - protein, 9 aa, Homo Sapiens
SEAYSRVQF

SEQ ID NO: 1269545 - protein, 9 aa, Homo Sapiens
APPVIYVPD

SEQ ID NO: 1269546 - protein, 9 aa, Homo Sapiens
IVAAMVYNE

SEQ ID NO: 1269547 - protein, 9 aa, Homo Sapiens
AFFNSIPLL

SEQ ID NO: 1269548 - protein, 9 aa, Homo Sapiens
QRMTEPTPR

SEQ ID NO: 1269549 - protein, 9 aa, Homo Sapiens
SLEPPSLHP

SEQ ID NO: 1269550 - protein, 9 aa, Homo Sapiens
RLMAPVGSV

SEQ ID NO: 1269551 - protein, 9 aa, Homo Sapiens
STLMGACVT

SEQ ID NO: 1269552 - protein, 9 aa, Homo Sapiens
QSKALVSNF

SEQ ID NO: 1269553 - protein, 9 aa, Homo Sapiens
PVGCRPLCP

SEQ ID NO: 1269554 - protein, 9 aa, Homo Sapiens
QLPGPHDDF

SEQ ID NO: 1269555 - protein, 9 aa, Homo Sapiens
DGLFWMLTC

SEQ ID NO: 1269556 - protein, 9 aa, Homo Sapiens
PGQWSHFQR

SEQ ID NO: 1269557 - protein, 9 aa, Homo Sapiens
PPVPGSASL

SEQ ID NO: 1269558 - protein, 9 aa, Homo Sapiens
LRQLGKGTE

SEQ ID NO: 1269559 - protein, 9 aa, Homo Sapiens
VKVSDRRKP

SEQ ID NO: 1269560 - protein, 9 aa, Homo Sapiens
RLSLVVTGD

SEQ ID NO: 1269561 - protein, 9 aa, Homo Sapiens
TITAKLYVR

SEQ ID NO: 1269562 - protein, 9 aa, Homo Sapiens
EEESLEPPS

SEQ ID NO: 1269563 - protein, 9 aa, Homo Sapiens
LEPGPTWCG

SEQ ID NO: 1269564 - protein, 9 aa, Homo Sapiens
VAPPAFSGR

SEQ ID NO: 1269565 - protein, 9 aa, Homo Sapiens
GPSASLHPA

SEQ ID NO: 1269566 - protein, 9 aa, Homo Sapiens
HIINKNNRR

SEQ ID NO: 1269567 - protein, 9 aa, Homo Sapiens
GPGGVIPAP

SEQ ID NO: 1269568 - protein, 9 aa, Homo Sapiens
YDRIEHFMF

SEQ ID NO: 1269569 - protein, 9 aa, Homo Sapiens
FGASAAPDA

SEQ ID NO: 1269570 - protein, 9 aa, Homo Sapiens
SLSFPGSSH

SEQ ID NO: 1269571 - protein, 9 aa, Homo Sapiens
GSSFAQHQR

SEQ ID NO: 1269572 - protein, 9 aa, Homo Sapiens
RELLMNGSS

SEQ ID NO: 1269573 - protein, 9 aa, Homo Sapiens
GLTGVMICA

SEQ ID NO: 1269574 - protein, 9 aa, Homo Sapiens
ATENTSYYI

SEQ ID NO: 1269575 - protein, 9 aa, Homo Sapiens
RLLTDEIVD

SEQ ID NO: 1269576 - protein, 9 aa, Homo Sapiens
LRACRAGGP

SEQ ID NO: 1269577 - protein, 9 aa, Homo Sapiens
LAPRHRGGR

SEQ ID NO: 1269578 - protein, 9 aa, Homo Sapiens
DTHTARPHP

SEQ ID NO: 1269579 - protein, 9 aa, Homo Sapiens
IGTVVVLRL

SEQ ID NO: 1269580 - protein, 9 aa, Homo Sapiens
GGGCLPPEP

SEQ ID NO: 1269581 - protein, 9 aa, Homo Sapiens
DGSRHSVSR

SEQ ID NO: 1269582 - protein, 9 aa, Homo Sapiens
SVFMLSMYQ

SEQ ID NO: 1269583 - protein, 9 aa, Homo Sapiens
SGDGSRHSV

SEQ ID NO: 1269584 - protein, 9 aa, Homo Sapiens
STPWMTGVQ

SEQ ID NO: 1269585 - protein, 9 aa, Homo Sapiens
MSAIEMIDP

SEQ ID NO: 1269586 - protein, 9 aa, Homo Sapiens
LVGFQRDLG

SEQ ID NO: 1269587 - protein, 9 aa, Homo Sapiens
LPTLASRVA

SEQ ID NO: 1269588 - protein, 9 aa, Homo Sapiens
QAPPVIYVP

SEQ ID NO: 1269589 - protein, 9 aa, Homo Sapiens
SSQCTQGRR

SEQ ID NO: 1269590 - protein, 9 aa, Homo Sapiens
PQVTGEAGT

SEQ ID NO: 1269591 - protein, 9 aa, Homo Sapiens
PLARHALHG

SEQ ID NO: 1269592 - protein, 9 aa, Homo Sapiens
AHVVLEVVV

SEQ ID NO: 1269593 - protein, 9 aa, Homo Sapiens
EAYSRVQFQ

SEQ ID NO: 1269594 - protein, 9 aa, Homo Sapiens
VEWKWRQQS

SEQ ID NO: 1269595 - protein, 9 aa, Homo Sapiens
PAQRRHAAP

SEQ ID NO: 1269596 - protein, 9 aa, Homo Sapiens
RVASLQGIR

SEQ ID NO: 1269597 - protein, 9 aa, Homo Sapiens
THRHTHRHR

SEQ ID NO: 1269598 - protein, 9 aa, Homo Sapiens
TVSRTMPPA

SEQ ID NO: 1269599 - protein, 9 aa, Homo Sapiens
RVASYVAWI

SEQ ID NO: 1269600 - protein, 9 aa, Homo Sapiens
VHLKLRRTV

SEQ ID NO: 1269601 - protein, 9 aa, Homo Sapiens
NGQRNQHVF

SEQ ID NO: 1269602 - protein, 9 aa, Homo Sapiens
GDTFWLKVL

SEQ ID NO: 1269603 - protein, 9 aa, Homo Sapiens
KGLTGVMIC

SEQ ID NO: 1269604 - protein, 9 aa, Homo Sapiens
EDFVFSKYC

SEQ ID NO: 1269605 - protein, 9 aa, Homo Sapiens
HQALQQASP

SEQ ID NO: 1269606 - protein, 9 aa, Homo Sapiens
GERGSGKTE

SEQ ID NO: 1269607 - protein, 9 aa, Homo Sapiens
EASPEEESY

SEQ ID NO: 1269608 - protein, 9 aa, Homo Sapiens
IAAMWGIFV

SEQ ID NO: 1269609 - protein, 9 aa, Homo Sapiens
PRHRGGRMR

SEQ ID NO: 1269610 - protein, 9 aa, Homo Sapiens
VGSVMSCSL

SEQ ID NO: 1269611 - protein, 9 aa, Homo Sapiens
GVWLDGYAR

SEQ ID NO: 1269612 - protein, 9 aa, Homo Sapiens
IVVKKKPKQ

SEQ ID NO: 1269613 - protein, 9 aa, Homo Sapiens
LNSTNSWWT

SEQ ID NO: 1269614 - protein, 9 aa, Homo Sapiens
RVQFQFEME

SEQ ID NO: 1269615 - protein, 9 aa, Homo Sapiens
TWPSAAHCS

SEQ ID NO: 1269616 - protein, 9 aa, Homo Sapiens
EVVVVHELG

SEQ ID NO: 1269617 - protein, 9 aa, Homo Sapiens
YHASGAELV

SEQ ID NO: 1269618 - protein, 9 aa, Homo Sapiens
TSTFTSSHF

SEQ ID NO: 1269619 - protein, 9 aa, Homo Sapiens
IKHSSALVS

SEQ ID NO: 1269620 - protein, 9 aa, Homo Sapiens
TNYLLKMAL

SEQ ID NO: 1269621 - protein, 9 aa, Homo Sapiens
RPRSSRRLP

SEQ ID NO: 1269622 - protein, 9 aa, Homo Sapiens
EYTGTHRHT

SEQ ID NO: 1269623 - protein, 9 aa, Homo Sapiens
IVQALCLQG

SEQ ID NO: 1269624 - protein, 9 aa, Homo Sapiens
PTRMASAAA

SEQ ID NO: 1269625 - protein, 9 aa, Homo Sapiens
AAPEHRRVV

SEQ ID NO: 1269626 - protein, 9 aa, Homo Sapiens
QPPVKVRTK

SEQ ID NO: 1269627 - protein, 9 aa, Homo Sapiens
KRVWVPDNR

SEQ ID NO: 1269628 - protein, 9 aa, Homo Sapiens
PLGSVLCWW

SEQ ID NO: 1269629 - protein, 9 aa, Homo Sapiens
LLPLGIILF

SEQ ID NO: 1269630 - protein, 9 aa, Homo Sapiens
QEYTGTHRH

SEQ ID NO: 1269631 - protein, 9 aa, Homo Sapiens
LYLVVAVTA

SEQ ID NO: 1269632 - protein, 9 aa, Homo Sapiens
RAGGPAGWA

SEQ ID NO: 1269633 - protein, 9 aa, Homo Sapiens
AHVSQVEPV

SEQ ID NO: 1269634 - protein, 9 aa, Homo Sapiens
SGGLFPDAQ

SEQ ID NO: 1269635 - protein, 9 aa, Homo Sapiens
DVNAVGKLL

SEQ ID NO: 1269636 - protein, 9 aa, Homo Sapiens
VHHALARHE

SEQ ID NO: 1269637 - protein, 9 aa, Homo Sapiens
HQLLQASSL

SEQ ID NO: 1269638 - protein, 9 aa, Homo Sapiens
WKWRQQSAC

SEQ ID NO: 1269639 - protein, 9 aa, Homo Sapiens
NTMGLYDRI

SEQ ID NO: 1269640 - protein, 9 aa, Homo Sapiens
NNDLYWKAQ

SEQ ID NO: 1269641 - protein, 9 aa, Homo Sapiens
SGRAQGRRA

SEQ ID NO: 1269642 - protein, 9 aa, Homo Sapiens
AMNYRLLPY

SEQ ID NO: 1269643 - protein, 9 aa, Homo Sapiens
LRRLCQVTA

SEQ ID NO: 1269644 - protein, 9 aa, Homo Sapiens
MTPTVTSSK

SEQ ID NO: 1269645 - protein, 9 aa, Homo Sapiens
YFYLEIFDE

SEQ ID NO: 1269646 - protein, 9 aa, Homo Sapiens
VLIPLYSVK

SEQ ID NO: 1269647 - protein, 9 aa, Homo Sapiens
ASLKEDKWY

SEQ ID NO: 1269648 - protein, 9 aa, Homo Sapiens
QLVLPGEAD

SEQ ID NO: 1269649 - protein, 9 aa, Homo Sapiens
RDSYFYTAI

SEQ ID NO: 1269650 - protein, 9 aa, Homo Sapiens
LLHPQWAPH

SEQ ID NO: 1269651 - protein, 9 aa, Homo Sapiens
RKAESLKKF

SEQ ID NO: 1269652 - protein, 9 aa, Homo Sapiens
MPPALPLEA

SEQ ID NO: 1269653 - protein, 9 aa, Homo Sapiens
SNSSRGYPN

SEQ ID NO: 1269654 - protein, 9 aa, Homo Sapiens
HTAPKPPQL

SEQ ID NO: 1269655 - protein, 9 aa, Homo Sapiens
KLRRTVTVP

SEQ ID NO: 1269656 - protein, 9 aa, Homo Sapiens
EVWSMKLRN

SEQ ID NO: 1269657 - protein, 9 aa, Homo Sapiens
CACRTFRVC

SEQ ID NO: 1269658 - protein, 9 aa, Homo Sapiens
GKGTEVPWP

SEQ ID NO: 1269659 - protein, 9 aa, Homo Sapiens
LSQSRQHIV

SEQ ID NO: 1269660 - protein, 9 aa, Homo Sapiens
VVAVTAISC

SEQ ID NO: 1269661 - protein, 9 aa, Homo Sapiens
KKVTWMKRR

SEQ ID NO: 1269662 - protein, 9 aa, Homo Sapiens
AQSCHFKRV

SEQ ID NO: 1269663 - protein, 9 aa, Homo Sapiens
SGGRTAAVG

SEQ ID NO: 1269664 - protein, 9 aa, Homo Sapiens
YQVFWSEAD

SEQ ID NO: 1269665 - protein, 9 aa, Homo Sapiens
YLLYGRMSF

SEQ ID NO: 1269666 - protein, 9 aa, Homo Sapiens
STGSSCPLG

SEQ ID NO: 1269667 - protein, 9 aa, Homo Sapiens
MCRHPRPQL

SEQ ID NO: 1269668 - protein, 9 aa, Homo Sapiens
CLHCTPKPT

SEQ ID NO: 1269669 - protein, 9 aa, Homo Sapiens
GATENTSYY

SEQ ID NO: 1269670 - protein, 9 aa, Homo Sapiens
NRNHHMAVH

SEQ ID NO: 1269671 - protein, 9 aa, Homo Sapiens
RVLSTGRVQ

SEQ ID NO: 1269672 - protein, 9 aa, Homo Sapiens
LEEVIREGW

SEQ ID NO: 1269673 - protein, 9 aa, Homo Sapiens
GLSEVWSMK

SEQ ID NO: 1269674 - protein, 9 aa, Homo Sapiens
LHAFIVQAL

SEQ ID NO: 1269675 - protein, 9 aa, Homo Sapiens
KEEFQRIFD

SEQ ID NO: 1269676 - protein, 9 aa, Homo Sapiens
KYSGPYHIG

SEQ ID NO: 1269677 - protein, 9 aa, Homo Sapiens
HARVDAHVV

SEQ ID NO: 1269678 - protein, 9 aa, Homo Sapiens
SSKEKSSDD

SEQ ID NO: 1269679 - protein, 9 aa, Homo Sapiens
PGAESPWRP

SEQ ID NO: 1269680 - protein, 9 aa, Homo Sapiens
YSVVISEDA

SEQ ID NO: 1269681 - protein, 9 aa, Homo Sapiens
DTLTSTLMG

SEQ ID NO: 1269682 - protein, 9 aa, Homo Sapiens
WSHFQRVKR

SEQ ID NO: 1269683 - protein, 9 aa, Homo Sapiens
VQESTKGHD

SEQ ID NO: 1269684 - protein, 9 aa, Homo Sapiens
AARQPAQRR

SEQ ID NO: 1269685 - protein, 9 aa, Homo Sapiens
GTHRHTHRH

SEQ ID NO: 1269686 - protein, 9 aa, Homo Sapiens
SFYNGNGWK

SEQ ID NO: 1269687 - protein, 9 aa, Homo Sapiens
TCGIMDPPS

SEQ ID NO: 1269688 - protein, 9 aa, Homo Sapiens
GSPSLSCLG

SEQ ID NO: 1269689 - protein, 9 aa, Homo Sapiens
PKPTRMASA

SEQ ID NO: 1269690 - protein, 9 aa, Homo Sapiens
MPLVAFRFL

SEQ ID NO: 1269691 - protein, 9 aa, Homo Sapiens
RHSTLRPWP

SEQ ID NO: 1269692 - protein, 9 aa, Homo Sapiens
ARGNSRLNS

SEQ ID NO: 1269693 - protein, 9 aa, Homo Sapiens
PTTRLMAPV

SEQ ID NO: 1269694 - protein, 9 aa, Homo Sapiens
KPKEVAKSP

SEQ ID NO: 1269695 - protein, 9 aa, Homo Sapiens
FVADGALLR

SEQ ID NO: 1269696 - protein, 9 aa, Homo Sapiens
VNDNPPHFP

SEQ ID NO: 1269697 - protein, 9 aa, Homo Sapiens
VTIWMCRHP

SEQ ID NO: 1269698 - protein, 9 aa, Homo Sapiens
FVEGMETGE

SEQ ID NO: 1269699 - protein, 9 aa, Homo Sapiens
RILHQPEMA

SEQ ID NO: 1269700 - protein, 9 aa, Homo Sapiens
PYTATTAPS

SEQ ID NO: 1269701 - protein, 9 aa, Homo Sapiens
AKGKVESEK

SEQ ID NO: 1269702 - protein, 9 aa, Homo Sapiens
SWRSSSPRR

SEQ ID NO: 1269703 - protein, 9 aa, Homo Sapiens
SKDSQPNGE

SEQ ID NO: 1269704 - protein, 9 aa, Homo Sapiens
FPGSSHLPT

SEQ ID NO: 1269705 - protein, 9 aa, Homo Sapiens
AKDHCMAHK

SEQ ID NO: 1269706 - protein, 9 aa, Homo Sapiens
PPRMELPVG

SEQ ID NO: 1269707 - protein, 9 aa, Homo Sapiens
DEPKNPILA

SEQ ID NO: 1269708 - protein, 9 aa, Homo Sapiens
FSLPVQKKS

SEQ ID NO: 1269709 - protein, 9 aa, Homo Sapiens
IVAEGQTPM

SEQ ID NO: 1269710 - protein, 9 aa, Homo Sapiens
VAAMVYNEF

SEQ ID NO: 1269711 - protein, 9 aa, Homo Sapiens
NDLLSIFAY

SEQ ID NO: 1269712 - protein, 9 aa, Homo Sapiens
VPESVTQER

SEQ ID NO: 1269713 - protein, 9 aa, Homo Sapiens
HRRRAQGHP

SEQ ID NO: 1269714 - protein, 9 aa, Homo Sapiens
SRVQFQFEM

SEQ ID NO: 1269715 - protein, 9 aa, Homo Sapiens
RFCLPVGLL

SEQ ID NO: 1269716 - protein, 9 aa, Homo Sapiens
ATANNTRIV

SEQ ID NO: 1269717 - protein, 9 aa, Homo Sapiens
KSLEVLYQL

SEQ ID NO: 1269718 - protein, 9 aa, Homo Sapiens
NRGYAQSCH

SEQ ID NO: 1269719 - protein, 9 aa, Homo Sapiens
VIHLPGQWS

SEQ ID NO: 1269720 - protein, 9 aa, Homo Sapiens
SFMPCLYIN

SEQ ID NO: 1269721 - protein, 9 aa, Homo Sapiens
RPYRNRPKR

SEQ ID NO: 1269722 - protein, 9 aa, Homo Sapiens
LRKPEWIFK

SEQ ID NO: 1269723 - protein, 9 aa, Homo Sapiens
VTAKGIWTM

SEQ ID NO: 1269724 - protein, 9 aa, Homo Sapiens
TPRMKSSTG

SEQ ID NO: 1269725 - protein, 9 aa, Homo Sapiens
ELLMNGSSS

SEQ ID NO: 1269726 - protein, 9 aa, Homo Sapiens
DGHEEKTEN

SEQ ID NO: 1269727 - protein, 9 aa, Homo Sapiens
ESYPYIRTL

SEQ ID NO: 1269728 - protein, 9 aa, Homo Sapiens
TRIVDDSFK

SEQ ID NO: 1269729 - protein, 9 aa, Homo Sapiens
VSLCSSLHL

SEQ ID NO: 1269730 - protein, 9 aa, Homo Sapiens
GSRAPGCAG

SEQ ID NO: 1269731 - protein, 9 aa, Homo Sapiens
RGNSRLNSW

SEQ ID NO: 1269732 - protein, 9 aa, Homo Sapiens
CLLRLSRLI

SEQ ID NO: 1269733 - protein, 9 aa, Homo Sapiens
NEYCFAWVE

SEQ ID NO: 1269734 - protein, 9 aa, Homo Sapiens
LRGARPVCH

SEQ ID NO: 1269735 - protein, 9 aa, Homo Sapiens
MTEPTPRMK

SEQ ID NO: 1269736 - protein, 9 aa, Homo Sapiens
AGLSVTLCI

SEQ ID NO: 1269737 - protein, 9 aa, Homo Sapiens
VYPGERTCS

SEQ ID NO: 1269738 - protein, 9 aa, Homo Sapiens
RLAAASGPC

SEQ ID NO: 1269739 - protein, 9 aa, Homo Sapiens
SQRRLRHST

SEQ ID NO: 1269740 - protein, 9 aa, Homo Sapiens
WLKLTALVD

SEQ ID NO: 1269741 - protein, 9 aa, Homo Sapiens
DLAPTKHSR

SEQ ID NO: 1269742 - protein, 9 aa, Homo Sapiens
HVWLLPGMG

SEQ ID NO: 1269743 - protein, 9 aa, Homo Sapiens
AKKTCVSDP

SEQ ID NO: 1269744 - protein, 9 aa, Homo Sapiens
NEAKAITSV

SEQ ID NO: 1269745 - protein, 9 aa, Homo Sapiens
VLRLGRNSI

SEQ ID NO: 1269746 - protein, 9 aa, Homo Sapiens
RRLCQVTAK

SEQ ID NO: 1269747 - protein, 9 aa, Homo Sapiens
QLRTLDPLC

SEQ ID NO: 1269748 - protein, 9 aa, Homo Sapiens
LRHRLGQRL

SEQ ID NO: 1269749 - protein, 9 aa, Homo Sapiens
EHVVHHALA

SEQ ID NO: 1269750 - protein, 9 aa, Homo Sapiens
CDLMSTRRS

SEQ ID NO: 1269751 - protein, 9 aa, Homo Sapiens
GNSRLNSWG

SEQ ID NO: 1269752 - protein, 9 aa, Homo Sapiens
GRTAAVGKA

SEQ ID NO: 1269753 - protein, 9 aa, Homo Sapiens
NSGYQGYSE

SEQ ID NO: 1269754 - protein, 9 aa, Homo Sapiens
ASRLKPTRS

SEQ ID NO: 1269755 - protein, 9 aa, Homo Sapiens
GTVVVLRLD

SEQ ID NO: 1269756 - protein, 9 aa, Homo Sapiens
GCMIQLFFS

SEQ ID NO: 1269757 - protein, 9 aa, Homo Sapiens
THQLLQASS

SEQ ID NO: 1269758 - protein, 9 aa, Homo Sapiens
IRIDLPHKK

SEQ ID NO: 1269759 - protein, 9 aa, Homo Sapiens
LEEAINEAK

SEQ ID NO: 1269760 - protein, 9 aa, Homo Sapiens
ECDDIDMLK

SEQ ID NO: 1269761 - protein, 9 aa, Homo Sapiens
LAAASGPCH

SEQ ID NO: 1269762 - protein, 9 aa, Homo Sapiens
AINEAKAIT

SEQ ID NO: 1269763 - protein, 9 aa, Homo Sapiens
SGVWLDGYA

SEQ ID NO: 1269764 - protein, 9 aa, Homo Sapiens
MCASLSLLI

SEQ ID NO: 1269765 - protein, 9 aa, Homo Sapiens
ITFGSAHLY

SEQ ID NO: 1269766 - protein, 9 aa, Homo Sapiens
AEGQTPMGM

SEQ ID NO: 1269767 - protein, 9 aa, Homo Sapiens
TAPSVLTAL

SEQ ID NO: 1269768 - protein, 9 aa, Homo Sapiens
VIREGWRWG

SEQ ID NO: 1269769 - protein, 9 aa, Homo Sapiens
FLLPLGIIL

SEQ ID NO: 1269770 - protein, 9 aa, Homo Sapiens
HLPGQWSHF

SEQ ID NO: 1269771 - protein, 9 aa, Homo Sapiens
EPGPTWCGG

SEQ ID NO: 1269772 - protein, 9 aa, Homo Sapiens
ALQNTEECE

SEQ ID NO: 1269773 - protein, 9 aa, Homo Sapiens
LLIAADTLP

SEQ ID NO: 1269774 - protein, 9 aa, Homo Sapiens
VVVLRLDGS

SEQ ID NO: 1269775 - protein, 9 aa, Homo Sapiens
EVPAMLDKP

SEQ ID NO: 1269776 - protein, 9 aa, Homo Sapiens
HLQQGICRL

SEQ ID NO: 1269777 - protein, 9 aa, Homo Sapiens
GAQEKTYLE

SEQ ID NO: 1269778 - protein, 9 aa, Homo Sapiens
RLCIWKFFP

SEQ ID NO: 1269779 - protein, 9 aa, Homo Sapiens
QFTVDRIPI

SEQ ID NO: 1269780 - protein, 9 aa, Homo Sapiens
NPILAPGED

SEQ ID NO: 1269781 - protein, 9 aa, Homo Sapiens
ASSRASTSW

SEQ ID NO: 1269782 - protein, 9 aa, Homo Sapiens
VGDVGLGVQ

SEQ ID NO: 1269783 - protein, 9 aa, Homo Sapiens
LMSTRRSNM

SEQ ID NO: 1269784 - protein, 9 aa, Homo Sapiens
SEDSDSSDD

SEQ ID NO: 1269785 - protein, 9 aa, Homo Sapiens
CLPPTTCEE

SEQ ID NO: 1269786 - protein, 9 aa, Homo Sapiens
FTSSHFKWI

SEQ ID NO: 1269787 - protein, 9 aa, Homo Sapiens
LLLLDLPIL

SEQ ID NO: 1269788 - protein, 9 aa, Homo Sapiens
SRCLNLGRP

SEQ ID NO: 1269789 - protein, 9 aa, Homo Sapiens
QVVRAREAL

SEQ ID NO: 1269790 - protein, 9 aa, Homo Sapiens
GKKVENTRW

SEQ ID NO: 1269791 - protein, 9 aa, Homo Sapiens
SQDVYSVVI

SEQ ID NO: 1269792 - protein, 9 aa, Homo Sapiens
DGCGSRAPG

SEQ ID NO: 1269793 - protein, 9 aa, Homo Sapiens
RRLIVSKNA

SEQ ID NO: 1269794 - protein, 9 aa, Homo Sapiens
CTCISMTTI

SEQ ID NO: 1269795 - protein, 9 aa, Homo Sapiens
NVMLLPVGQ

SEQ ID NO: 1269796 - protein, 9 aa, Homo Sapiens
LVQAMGQVQ

SEQ ID NO: 1269797 - protein, 9 aa, Homo Sapiens
SQNWGSLPL

SEQ ID NO: 1269798 - protein, 9 aa, Homo Sapiens
LCEYLLYGR

SEQ ID NO: 1269799 - protein, 9 aa, Homo Sapiens
MPKFLNSTN

SEQ ID NO: 1269800 - protein, 9 aa, Homo Sapiens
MTSTFTSSH

SEQ ID NO: 1269801 - protein, 9 aa, Homo Sapiens
TLTSTLMGA

SEQ ID NO: 1269802 - protein, 9 aa, Homo Sapiens
ACHPWPSGP

SEQ ID NO: 1269803 - protein, 9 aa, Homo Sapiens
LSFPGSSHL

SEQ ID NO: 1269804 - protein, 9 aa, Homo Sapiens
DGLIAHTAP

SEQ ID NO: 1269805 - protein, 9 aa, Homo Sapiens
QKKSYEYTT

SEQ ID NO: 1269806 - protein, 9 aa, Homo Sapiens
LQEALQVLL

SEQ ID NO: 1269807 - protein, 9 aa, Homo Sapiens
AGEGPGCTD

SEQ ID NO: 1269808 - protein, 9 aa, Homo Sapiens
AEHEVRLAA

SEQ ID NO: 1269809 - protein, 9 aa, Homo Sapiens
QSCHFKRVQ

SEQ ID NO: 1269810 - protein, 9 aa, Homo Sapiens
ARQPAQRRV

SEQ ID NO: 1269811 - protein, 9 aa, Homo Sapiens
MKRRRRNLI

SEQ ID NO: 1269812 - protein, 9 aa, Homo Sapiens
NVLVTGEFF

SEQ ID NO: 1269813 - protein, 9 aa, Homo Sapiens
PWKLIKTPQ

SEQ ID NO: 1269814 - protein, 9 aa, Homo Sapiens
LVAELALVG

SEQ ID NO: 1269815 - protein, 9 aa, Homo Sapiens
WRSSSPRRA

SEQ ID NO: 1269816 - protein, 9 aa, Homo Sapiens
PHVDFQLVL

SEQ ID NO: 1269817 - protein, 9 aa, Homo Sapiens
QRLGPKSAA

SEQ ID NO: 1269818 - protein, 9 aa, Homo Sapiens
LPGPHDDFV

SEQ ID NO: 1269819 - protein, 9 aa, Homo Sapiens
HSSALVSLG

SEQ ID NO: 1269820 - protein, 9 aa, Homo Sapiens
MRLMPKFLN

SEQ ID NO: 1269821 - protein, 9 aa, Homo Sapiens
KAITSVNSL

SEQ ID NO: 1269822 - protein, 9 aa, Homo Sapiens
RSRSNSGVW

SEQ ID NO: 1269823 - protein, 9 aa, Homo Sapiens
RRRDPGWER

SEQ ID NO: 1269824 - protein, 9 aa, Homo Sapiens
EAKGKVESE

SEQ ID NO: 1269825 - protein, 9 aa, Homo Sapiens
CGSGGVDSK

SEQ ID NO: 1269826 - protein, 9 aa, Homo Sapiens
ISMTTISRA

SEQ ID NO: 1269827 - protein, 9 aa, Homo Sapiens
HRRPTQTAA

SEQ ID NO: 1269828 - protein, 9 aa, Homo Sapiens
GCLPPEPGD

SEQ ID NO: 1269829 - protein, 9 aa, Homo Sapiens
EVRHQRSGH

SEQ ID NO: 1269830 - protein, 9 aa, Homo Sapiens
LGEHVVHHA

SEQ ID NO: 1269831 - protein, 9 aa, Homo Sapiens
AKLYVRAPQ

SEQ ID NO: 1269832 - protein, 9 aa, Homo Sapiens
ELRKCGITP

SEQ ID NO: 1269833 - protein, 9 aa, Homo Sapiens
VTVDEGDKE

SEQ ID NO: 1269834 - protein, 9 aa, Homo Sapiens
ASAAACPSL

SEQ ID NO: 1269835 - protein, 9 aa, Homo Sapiens
CQVTAKGIW

SEQ ID NO: 1269836 - protein, 9 aa, Homo Sapiens
RPETQEDRK

SEQ ID NO: 1269837 - protein, 9 aa, Homo Sapiens
GEVVNENAK

SEQ ID NO: 1269838 - protein, 9 aa, Homo Sapiens
EVTWMARKF

SEQ ID NO: 1269839 - protein, 9 aa, Homo Sapiens
LPVCLGAAA

SEQ ID NO: 1269840 - protein, 9 aa, Homo Sapiens
DLMSTRRSN

SEQ ID NO: 1269841 - protein, 9 aa, Homo Sapiens
AGAYLDSGC

SEQ ID NO: 1269842 - protein, 9 aa, Homo Sapiens
WRPRSSRRL

SEQ ID NO: 1269843 - protein, 9 aa, Homo Sapiens
LQVLLQVSA

SEQ ID NO: 1269844 - protein, 9 aa, Homo Sapiens
MGMRASRCL

SEQ ID NO: 1269845 - protein, 9 aa, Homo Sapiens
VVLEVVVVH

SEQ ID NO: 1269846 - protein, 9 aa, Homo Sapiens
SGRASRKTW

SEQ ID NO: 1269847 - protein, 9 aa, Homo Sapiens
WMKRRRRNL

SEQ ID NO: 1269848 - protein, 9 aa, Homo Sapiens
ILSLLCLLR

SEQ ID NO: 1269849 - protein, 9 aa, Homo Sapiens
RQTQITSME

SEQ ID NO: 1269850 - protein, 9 aa, Homo Sapiens
TKHSRKKMA

SEQ ID NO: 1269851 - protein, 9 aa, Homo Sapiens
AVAAAPRAV

SEQ ID NO: 1269852 - protein, 9 aa, Homo Sapiens
REHVLEEVI

SEQ ID NO: 1269853 - protein, 9 aa, Homo Sapiens
EGIFLTGDF

SEQ ID NO: 1269854 - protein, 9 aa, Homo Sapiens
EARRLIVSK

SEQ ID NO: 1269855 - protein, 9 aa, Homo Sapiens
PPCACRTFR

SEQ ID NO: 1269856 - protein, 9 aa, Homo Sapiens
RALCSQRRL

SEQ ID NO: 1269857 - protein, 9 aa, Homo Sapiens
QVFWSEADV

SEQ ID NO: 1269858 - protein, 9 aa, Homo Sapiens
LSNTSTQST

SEQ ID NO: 1269859 - protein, 9 aa, Homo Sapiens
GACRPACTC

SEQ ID NO: 1269860 - protein, 9 aa, Homo Sapiens
LFWMLTCTT

SEQ ID NO: 1269861 - protein, 9 aa, Homo Sapiens
CRAGGPAGW

SEQ ID NO: 1269862 - protein, 9 aa, Homo Sapiens
LSLLCLLRL

SEQ ID NO: 1269863 - protein, 9 aa, Homo Sapiens
VCRAFLGPF

SEQ ID NO: 1269864 - protein, 9 aa, Homo Sapiens
TRVASYVAW

SEQ ID NO: 1269865 - protein, 9 aa, Homo Sapiens
HTQEYTGTH

SEQ ID NO: 1269866 - protein, 9 aa, Homo Sapiens
APSVLTALG

SEQ ID NO: 1269867 - protein, 9 aa, Homo Sapiens
AQGHPALHQ

SEQ ID NO: 1269868 - protein, 9 aa, Homo Sapiens
MKAANEAKG

SEQ ID NO: 1269869 - protein, 9 aa, Homo Sapiens
TTSSLVASS

SEQ ID NO: 1269870 - protein, 9 aa, Homo Sapiens
FGTDAPVVV

SEQ ID NO: 1269871 - protein, 9 aa, Homo Sapiens
MAGILHLVV

SEQ ID NO: 1269872 - protein, 9 aa, Homo Sapiens
FTVMNENES

SEQ ID NO: 1269873 - protein, 9 aa, Homo Sapiens
RQLGKGTEV

SEQ ID NO: 1269874 - protein, 9 aa, Homo Sapiens
NVIHLPGQW

SEQ ID NO: 1269875 - protein, 9 aa, Homo Sapiens
EGAQEKTYL

SEQ ID NO: 1269876 - protein, 9 aa, Homo Sapiens
LNLGRPYRN

SEQ ID NO: 1269877 - protein, 9 aa, Homo Sapiens
RAARAHQRT

SEQ ID NO: 1269878 - protein, 9 aa, Homo Sapiens
SWPQRPETQ

SEQ ID NO: 1269879 - protein, 9 aa, Homo Sapiens
SSNPDLRRR

SEQ ID NO: 1269880 - protein, 9 aa, Homo Sapiens
DFQLVLPGE

SEQ ID NO: 1269881 - protein, 9 aa, Homo Sapiens
NQDPKHRMY

SEQ ID NO: 1269882 - protein, 9 aa, Homo Sapiens
QLFVVMMKM

SEQ ID NO: 1269883 - protein, 9 aa, Homo Sapiens
SKMDYKWRF

SEQ ID NO: 1269884 - protein, 9 aa, Homo Sapiens
RAQGRRAPV

SEQ ID NO: 1269885 - protein, 9 aa, Homo Sapiens
THRHRHTLT

SEQ ID NO: 1269886 - protein, 9 aa, Homo Sapiens
LDGSQRPPR

SEQ ID NO: 1269887 - protein, 9 aa, Homo Sapiens
PLLIANTLR

SEQ ID NO: 1269888 - protein, 9 aa, Homo Sapiens
HSAGLSPGA

SEQ ID NO: 1269889 - protein, 9 aa, Homo Sapiens
HTGMHRHTH

SEQ ID NO: 1269890 - protein, 9 aa, Homo Sapiens
PKHRMYVYV

SEQ ID NO: 1269891 - protein, 9 aa, Homo Sapiens
KMDYKWRFL

SEQ ID NO: 1269892 - protein, 9 aa, Homo Sapiens
SNFISTKEE

SEQ ID NO: 1269893 - protein, 9 aa, Homo Sapiens
SHLPTLASR

SEQ ID NO: 1269894 - protein, 9 aa, Homo Sapiens
HNTDGPKME

SEQ ID NO: 1269895 - protein, 9 aa, Homo Sapiens
GHIWVERAI

SEQ ID NO: 1269896 - protein, 9 aa, Homo Sapiens
QPAQRRVQR

SEQ ID NO: 1269897 - protein, 9 aa, Homo Sapiens
TAMTPTVTS

SEQ ID NO: 1269898 - protein, 9 aa, Homo Sapiens
SGERGSGKT

SEQ ID NO: 1269899 - protein, 9 aa, Homo Sapiens
RRTKTKVTK

SEQ ID NO: 1269900 - protein, 9 aa, Homo Sapiens
MDYKWRFLL

SEQ ID NO: 1269901 - protein, 9 aa, Homo Sapiens
RLHPPFPCL

SEQ ID NO: 1269902 - protein, 9 aa, Homo Sapiens
WNLGPWKLI

SEQ ID NO: 1269903 - protein, 9 aa, Homo Sapiens
NSDPPSPSR

SEQ ID NO: 1269904 - protein, 9 aa, Homo Sapiens
YSFLPEVTW

SEQ ID NO: 1269905 - protein, 9 aa, Homo Sapiens
DASSFWLIF

SEQ ID NO: 1269906 - protein, 9 aa, Homo Sapiens
HLMEKKINN

SEQ ID NO: 1269907 - protein, 9 aa, Homo Sapiens
LGPWKLIKT

SEQ ID NO: 1269908 - protein, 9 aa, Homo Sapiens
LRSILLDEG

SEQ ID NO: 1269909 - protein, 9 aa, Homo Sapiens
SALDELDTP

SEQ ID NO: 1269910 - protein, 9 aa, Homo Sapiens
RHRGGRMRV

SEQ ID NO: 1269911 - protein, 9 aa, Homo Sapiens
AGYRCRWCS

SEQ ID NO: 1269912 - protein, 9 aa, Homo Sapiens
KRQTQITSM

SEQ ID NO: 1269913 - protein, 9 aa, Homo Sapiens
TGTHRHTHR

SEQ ID NO: 1269914 - protein, 9 aa, Homo Sapiens
REARAAHRR

SEQ ID NO: 1269915 - protein, 9 aa, Homo Sapiens
QAHRHTHRH

SEQ ID NO: 1269916 - protein, 9 aa, Homo Sapiens
VALAPRHRG

SEQ ID NO: 1269917 - protein, 9 aa, Homo Sapiens
TTCEEVPDG

SEQ ID NO: 1269918 - protein, 9 aa, Homo Sapiens
TGTHRHTHT

SEQ ID NO: 1269919 - protein, 9 aa, Homo Sapiens
SELEFNTQR

SEQ ID NO: 1269920 - protein, 9 aa, Homo Sapiens
GPWKLIKTP

SEQ ID NO: 1269921 - protein, 9 aa, Homo Sapiens
MICIDQQNG

SEQ ID NO: 1269922 - protein, 9 aa, Homo Sapiens
EPCCCRETL

SEQ ID NO: 1269923 - protein, 9 aa, Homo Sapiens
PAPTPCTDT

SEQ ID NO: 1269924 - protein, 9 aa, Homo Sapiens
ALLRGLGLQ

SEQ ID NO: 1269925 - protein, 9 aa, Homo Sapiens
HCTPKPTRM

SEQ ID NO: 1269926 - protein, 9 aa, Homo Sapiens
SQPNGEVLL

SEQ ID NO: 1269927 - protein, 9 aa, Homo Sapiens
NPAFDVTPT

SEQ ID NO: 1269928 - protein, 9 aa, Homo Sapiens
LDKTGGLTS

SEQ ID NO: 1269929 - protein, 9 aa, Homo Sapiens
EEQAGGPPR

SEQ ID NO: 1269930 - protein, 9 aa, Homo Sapiens
TIPCPTDSL

SEQ ID NO: 1269931 - protein, 9 aa, Homo Sapiens
TGTDRNTQT

SEQ ID NO: 1269932 - protein, 9 aa, Homo Sapiens
LRVNEYCFA

SEQ ID NO: 1269933 - protein, 9 aa, Homo Sapiens
ITAKLYVRA

SEQ ID NO: 1269934 - protein, 9 aa, Homo Sapiens
HPALHQCLS

SEQ ID NO: 1269935 - protein, 9 aa, Homo Sapiens
KALVSNFIS

SEQ ID NO: 1269936 - protein, 9 aa, Homo Sapiens
SSFAQHQRC

SEQ ID NO: 1269937 - protein, 9 aa, Homo Sapiens
LIAHTAPKP

SEQ ID NO: 1269938 - protein, 9 aa, Homo Sapiens
EKKINNQII

SEQ ID NO: 1269939 - protein, 9 aa, Homo Sapiens
CHFKRVQQR

SEQ ID NO: 1269940 - protein, 9 aa, Homo Sapiens
LSAVTALLP

SEQ ID NO: 1269941 - protein, 9 aa, Homo Sapiens
HVLEEVIRE

SEQ ID NO: 1269942 - protein, 9 aa, Homo Sapiens
TMPPALPLE

SEQ ID NO: 1269943 - protein, 9 aa, Homo Sapiens
NLPRLCIWK

SEQ ID NO: 1269944 - protein, 9 aa, Homo Sapiens
RVQRAHARH

SEQ ID NO: 1269945 - protein, 9 aa, Homo Sapiens
ARHHTREIF

SEQ ID NO: 1269946 - protein, 9 aa, Homo Sapiens
GARPVCHLQ

SEQ ID NO: 1269947 - protein, 9 aa, Homo Sapiens
HFYESLPPE

SEQ ID NO: 1269948 - protein, 9 aa, Homo Sapiens
TCGCLTHEI

SEQ ID NO: 1269949 - protein, 9 aa, Homo Sapiens
AEIECDDID

SEQ ID NO: 1269950 - protein, 9 aa, Homo Sapiens
RWCSSWRSS

SEQ ID NO: 1269951 - protein, 9 aa, Homo Sapiens
PPPAKHSSS

SEQ ID NO: 1269952 - protein, 9 aa, Homo Sapiens
TWKSNDTTA

SEQ ID NO: 1269953 - protein, 9 aa, Homo Sapiens
DRFHAHVSQ

SEQ ID NO: 1269954 - protein, 9 aa, Homo Sapiens
PKEVAKSPA

SEQ ID NO: 1269955 - protein, 9 aa, Homo Sapiens
QKEYGAVTS

SEQ ID NO: 1269956 - protein, 9 aa, Homo Sapiens
IELTEVSRS

SEQ ID NO: 1269957 - protein, 9 aa, Homo Sapiens
YSKDSQPNG

SEQ ID NO: 1269958 - protein, 9 aa, Homo Sapiens
RHATLMDLV

SEQ ID NO: 1269959 - protein, 9 aa, Homo Sapiens
PYRNRPKRP

SEQ ID NO: 1269960 - protein, 9 aa, Homo Sapiens
VQRAHARHR

SEQ ID NO: 1269961 - protein, 9 aa, Homo Sapiens
PRLHPPFPC

SEQ ID NO: 1269962 - protein, 9 aa, Homo Sapiens
HQLFVVMMK

SEQ ID NO: 1269963 - protein, 9 aa, Homo Sapiens
GSGGVDSKD

SEQ ID NO: 1269964 - protein, 9 aa, Homo Sapiens
DNPPHFPRR

SEQ ID NO: 1269965 - protein, 9 aa, Homo Sapiens
VSASASPSI

SEQ ID NO: 1269966 - protein, 9 aa, Homo Sapiens
CCACHPWPS

SEQ ID NO: 1269967 - protein, 9 aa, Homo Sapiens
LNGSSDPTK

SEQ ID NO: 1269968 - protein, 9 aa, Homo Sapiens
KLYVRAPQL

SEQ ID NO: 1269969 - protein, 9 aa, Homo Sapiens
QGRRAPVKL

SEQ ID NO: 1269970 - protein, 9 aa, Homo Sapiens
DQIQWPTVH

SEQ ID NO: 1269971 - protein, 9 aa, Homo Sapiens
LMTSTFTSS

SEQ ID NO: 1269972 - protein, 9 aa, Homo Sapiens
LVASSQNWG

SEQ ID NO: 1269973 - protein, 9 aa, Homo Sapiens
QDSKMDYKW

SEQ ID NO: 1269974 - protein, 9 aa, Homo Sapiens
ARQPSRPTG

SEQ ID NO: 1269975 - protein, 9 aa, Homo Sapiens
SASLFHRRR

SEQ ID NO: 1269976 - protein, 9 aa, Homo Sapiens
CHLQARGPA

SEQ ID NO: 1269977 - protein, 9 aa, Homo Sapiens
VSAYSKDSQ

SEQ ID NO: 1269978 - protein, 9 aa, Homo Sapiens
TEGCILQWK

SEQ ID NO: 1269979 - protein, 9 aa, Homo Sapiens
SFWLIFIVD

SEQ ID NO: 1269980 - protein, 9 aa, Homo Sapiens
LHHLEVLRL

SEQ ID NO: 1269981 - protein, 9 aa, Homo Sapiens
GSVLCWWLL

SEQ ID NO: 1269982 - protein, 9 aa, Homo Sapiens
GLGLQLALF

SEQ ID NO: 1269983 - protein, 9 aa, Homo Sapiens
CRHPRPQLS

SEQ ID NO: 1269984 - protein, 9 aa, Homo Sapiens
TIWMCRHPR

SEQ ID NO: 1269985 - protein, 9 aa, Homo Sapiens
PVGDVGLGV

SEQ ID NO: 1269986 - protein, 9 aa, Homo Sapiens
NTSTQSTPW

SEQ ID NO: 1269987 - protein, 9 aa, Homo Sapiens
YLKNFVKIA

SEQ ID NO: 1269988 - protein, 9 aa, Homo Sapiens
PLTVKECIG

SEQ ID NO: 1269989 - protein, 9 aa, Homo Sapiens
GCRPLCPAQ

SEQ ID NO: 1269990 - protein, 9 aa, Homo Sapiens
GYQGYSEYD

SEQ ID NO: 1269991 - protein, 9 aa, Homo Sapiens
SRRLPGAES

SEQ ID NO: 1269992 - protein, 9 aa, Homo Sapiens
VPGVQLRHR

SEQ ID NO: 1269993 - protein, 9 aa, Homo Sapiens
VPDNRTPTW

SEQ ID NO: 1269994 - protein, 9 aa, Homo Sapiens
AMHNRKYNC

SEQ ID NO: 1269995 - protein, 9 aa, Homo Sapiens
FSDTLSSSK

SEQ ID NO: 1269996 - protein, 9 aa, Homo Sapiens
WKFFPKKKC

SEQ ID NO: 1269997 - protein, 9 aa, Homo Sapiens
SLSLLIAAD

SEQ ID NO: 1269998 - protein, 9 aa, Homo Sapiens
LNKSKIVVK

SEQ ID NO: 1269999 - protein, 9 aa, Homo Sapiens
MNGSSSTAE

SEQ ID NO: 1270000 - protein, 9 aa, Homo Sapiens
SEVWSMKLR

SEQ ID NO: 1270001 - protein, 9 aa, Homo Sapiens
ECIGASNQN

SEQ ID NO: 1270002 - protein, 9 aa, Homo Sapiens
AMAAGADGC

SEQ ID NO: 1270003 - protein, 9 aa, Homo Sapiens
HTHTQAHRH

SEQ ID NO: 1270004 - protein, 9 aa, Homo Sapiens
KPLISREQH

SEQ ID NO: 1270005 - protein, 9 aa, Homo Sapiens
QLFFSVFVL

SEQ ID NO: 1270006 - protein, 9 aa, Homo Sapiens
ALFYQGPGW

SEQ ID NO: 1270007 - protein, 9 aa, Homo Sapiens
LLSQSRQHI

SEQ ID NO: 1270008 - protein, 9 aa, Homo Sapiens
ASGQAVRPC

SEQ ID NO: 1270009 - protein, 9 aa, Homo Sapiens
TDRNTQTHT

SEQ ID NO: 1270010 - protein, 9 aa, Homo Sapiens
KTWASLSNT

SEQ ID NO: 1270011 - protein, 9 aa, Homo Sapiens
TCVSDPIST

SEQ ID NO: 1270012 - protein, 9 aa, Homo Sapiens
NWAQKEYGA

SEQ ID NO: 1270013 - protein, 9 aa, Homo Sapiens
ESDTNYLLK

SEQ ID NO: 1270014 - protein, 9 aa, Homo Sapiens
THTQAYTLT

SEQ ID NO: 1270015 - protein, 9 aa, Homo Sapiens
VWNEAFCFL

SEQ ID NO: 1270016 - protein, 9 aa, Homo Sapiens
KAESLKKFL

SEQ ID NO: 1270017 - protein, 9 aa, Homo Sapiens
DLIEKRLAK

SEQ ID NO: 1270018 - protein, 9 aa, Homo Sapiens
VGGTQEVEI

SEQ ID NO: 1270019 - protein, 9 aa, Homo Sapiens
LHLFSSIDD

SEQ ID NO: 1270020 - protein, 9 aa, Homo Sapiens
EAPSTRAAP

SEQ ID NO: 1270021 - protein, 9 aa, Homo Sapiens
MNENESYDA

SEQ ID NO: 1270022 - protein, 9 aa, Homo Sapiens
CSHLGETAL

SEQ ID NO: 1270023 - protein, 9 aa, Homo Sapiens
AIYQLRTLD

SEQ ID NO: 1270024 - protein, 9 aa, Homo Sapiens
AALKTLPLL

SEQ ID NO: 1270025 - protein, 9 aa, Homo Sapiens
GGVDSKDKT

SEQ ID NO: 1270026 - protein, 9 aa, Homo Sapiens
GLLRQLGKG

SEQ ID NO: 1270027 - protein, 9 aa, Homo Sapiens
EAINEAKAI

SEQ ID NO: 1270028 - protein, 9 aa, Homo Sapiens
PPAFSGRIL

SEQ ID NO: 1270029 - protein, 9 aa, Homo Sapiens
YFYTAIVAV

SEQ ID NO: 1270030 - protein, 9 aa, Homo Sapiens
TALLPPRAT

SEQ ID NO: 1270031 - protein, 9 aa, Homo Sapiens
PRQVREHVL

SEQ ID NO: 1270032 - protein, 9 aa, Homo Sapiens
AFEGQQPRR

SEQ ID NO: 1270033 - protein, 9 aa, Homo Sapiens
MKRQTQITS

SEQ ID NO: 1270034 - protein, 9 aa, Homo Sapiens
MWPGDKGNF

SEQ ID NO: 1270035 - protein, 9 aa, Homo Sapiens
FVFSKYCHR

SEQ ID NO: 1270036 - protein, 9 aa, Homo Sapiens
PLPCVLPHV

SEQ ID NO: 1270037 - protein, 9 aa, Homo Sapiens
LVHVHAEHE

SEQ ID NO: 1270038 - protein, 9 aa, Homo Sapiens
DMFKEEQQK

SEQ ID NO: 1270039 - protein, 9 aa, Homo Sapiens
SEIIIEGKL

SEQ ID NO: 1270040 - protein, 9 aa, Homo Sapiens
WPQRPETQE

SEQ ID NO: 1270041 - protein, 9 aa, Homo Sapiens
KFLNSTNSW

SEQ ID NO: 1270042 - protein, 9 aa, Homo Sapiens
YKDSQGVIL

SEQ ID NO: 1270043 - protein, 9 aa, Homo Sapiens
LEELRKCGI

SEQ ID NO: 1270044 - protein, 9 aa, Homo Sapiens
LLLDLPILD

SEQ ID NO: 1270045 - protein, 9 aa, Homo Sapiens
EDKWYSEEL

SEQ ID NO: 1270046 - protein, 9 aa, Homo Sapiens
EKTENGQIT

SEQ ID NO: 1270047 - protein, 9 aa, Homo Sapiens
EVLVHVHAE

SEQ ID NO: 1270048 - protein, 9 aa, Homo Sapiens
QRAHARHRH

SEQ ID NO: 1270049 - protein, 9 aa, Homo Sapiens
ENAKTHVLD

SEQ ID NO: 1270050 - protein, 9 aa, Homo Sapiens
ILAYCSLSF

SEQ ID NO: 1270051 - protein, 9 aa, Homo Sapiens
TQAYTLTYT

SEQ ID NO: 1270052 - protein, 9 aa, Homo Sapiens
PNSDPPSPS

SEQ ID NO: 1270053 - protein, 9 aa, Homo Sapiens
YTATTAPSV

SEQ ID NO: 1270054 - protein, 9 aa, Homo Sapiens
LPAPLARHA

SEQ ID NO: 1270055 - protein, 9 aa, Homo Sapiens
VQDTDMALK

SEQ ID NO: 1270056 - protein, 9 aa, Homo Sapiens
HEVLLRRLQ

SEQ ID NO: 1270057 - protein, 9 aa, Homo Sapiens
RCLNLGRPY

SEQ ID NO: 1270058 - protein, 9 aa, Homo Sapiens
EEFQRIFDL

SEQ ID NO: 1270059 - protein, 9 aa, Homo Sapiens
VSLVGRSGI

SEQ ID NO: 1270060 - protein, 9 aa, Homo Sapiens
IYFFPFFFI

SEQ ID NO: 1270061 - protein, 9 aa, Homo Sapiens
CVKTWASLS

SEQ ID NO: 1270062 - protein, 9 aa, Homo Sapiens
FDTNTEGCI

SEQ ID NO: 1270063 - protein, 9 aa, Homo Sapiens
RRPLFQKTE

SEQ ID NO: 1270064 - protein, 9 aa, Homo Sapiens
LLGHSKTRA

SEQ ID NO: 1270065 - protein, 9 aa, Homo Sapiens
YKEEFQRIF

SEQ ID NO: 1270066 - protein, 9 aa, Homo Sapiens
RGLGLQLAL

SEQ ID NO: 1270067 - protein, 9 aa, Homo Sapiens
LGHSKTRAF

SEQ ID NO: 1270068 - protein, 9 aa, Homo Sapiens
QGRRWGAWH

SEQ ID NO: 1270069 - protein, 9 aa, Homo Sapiens
LVGPHARVD

SEQ ID NO: 1270070 - protein, 9 aa, Homo Sapiens
RGPAPALPS

SEQ ID NO: 1270071 - protein, 9 aa, Homo Sapiens
TDMALKELE

SEQ ID NO: 1270072 - protein, 9 aa, Homo Sapiens
RNNKLIKVF

SEQ ID NO: 1270073 - protein, 9 aa, Homo Sapiens
NCALDDIKW

SEQ ID NO: 1270074 - protein, 9 aa, Homo Sapiens
GGTQEVEIG

SEQ ID NO: 1270075 - protein, 9 aa, Homo Sapiens
AMTPTVTSS

SEQ ID NO: 1270076 - protein, 9 aa, Homo Sapiens
MRVAFEGQQ

SEQ ID NO: 1270077 - protein, 9 aa, Homo Sapiens
KAKELWEKM

SEQ ID NO: 1270078 - protein, 9 aa, Homo Sapiens
VQALCLQGK

SEQ ID NO: 1270079 - protein, 9 aa, Homo Sapiens
GVITFGSAH

SEQ ID NO: 1270080 - protein, 9 aa, Homo Sapiens
KRKGNNVFV

SEQ ID NO: 1270081 - protein, 9 aa, Homo Sapiens
WMLTCTTLS

SEQ ID NO: 1270082 - protein, 9 aa, Homo Sapiens
TPHVSTTAM

SEQ ID NO: 1270083 - protein, 9 aa, Homo Sapiens
HELGVAVDA

SEQ ID NO: 1270084 - protein, 9 aa, Homo Sapiens
SSQTVARHQ

SEQ ID NO: 1270085 - protein, 9 aa, Homo Sapiens
QFSSTPGSS

SEQ ID NO: 1270086 - protein, 9 aa, Homo Sapiens
HMVSEGGPE

SEQ ID NO: 1270087 - protein, 9 aa, Homo Sapiens
RGSGKTEAT

SEQ ID NO: 1270088 - protein, 9 aa, Homo Sapiens
DAQVGPLPC

SEQ ID NO: 1270089 - protein, 9 aa, Homo Sapiens
AELALVGPH

SEQ ID NO: 1270090 - protein, 9 aa, Homo Sapiens
RPVCHLQAR

SEQ ID NO: 1270091 - protein, 9 aa, Homo Sapiens
DTVLILCGK

SEQ ID NO: 1270092 - protein, 9 aa, Homo Sapiens
RYRRPTMAK

SEQ ID NO: 1270093 - protein, 9 aa, Homo Sapiens
NDIVPESVT

SEQ ID NO: 1270094 - protein, 9 aa, Homo Sapiens
EPPSLHPAC

SEQ ID NO: 1270095 - protein, 9 aa, Homo Sapiens
KKNVLVTGE

SEQ ID NO: 1270096 - protein, 9 aa, Homo Sapiens
LEVLYQLEK

SEQ ID NO: 1270097 - protein, 9 aa, Homo Sapiens
WGLEFSPFR

SEQ ID NO: 1270098 - protein, 9 aa, Homo Sapiens
TVVCIMPLV

SEQ ID NO: 1270099 - protein, 9 aa, Homo Sapiens
VHVHAEHEV

SEQ ID NO: 1270100 - protein, 9 aa, Homo Sapiens
TLASRVAGT

SEQ ID NO: 1270101 - protein, 9 aa, Homo Sapiens
ALSRVSGVL

SEQ ID NO: 1270102 - protein, 9 aa, Homo Sapiens
ECGDTFWLK

SEQ ID NO: 1270103 - protein, 9 aa, Homo Sapiens
PLLHPQWAP

SEQ ID NO: 1270104 - protein, 9 aa, Homo Sapiens
GPEAPSTRA

SEQ ID NO: 1270105 - protein, 9 aa, Homo Sapiens
LWILGALDK

SEQ ID NO: 1270106 - protein, 9 aa, Homo Sapiens
ICRQKILFQ

SEQ ID NO: 1270107 - protein, 9 aa, Homo Sapiens
NATANNTRI

SEQ ID NO: 1270108 - protein, 9 aa, Homo Sapiens
GHAGNHGHS

SEQ ID NO: 1270109 - protein, 9 aa, Homo Sapiens
PQRPETQED

SEQ ID NO: 1270110 - protein, 9 aa, Homo Sapiens
APHSAGLSP

SEQ ID NO: 1270111 - protein, 9 aa, Homo Sapiens
KPKTVKPKE

SEQ ID NO: 1270112 - protein, 9 aa, Homo Sapiens
FLIKELSCH

SEQ ID NO: 1270113 - protein, 9 aa, Homo Sapiens
TQCSVPIQY

SEQ ID NO: 1270114 - protein, 9 aa, Homo Sapiens
DSKMDYKWR

SEQ ID NO: 1270115 - protein, 9 aa, Homo Sapiens
RWSLAGIGM

SEQ ID NO: 1270116 - protein, 9 aa, Homo Sapiens
DELDTPFRK

SEQ ID NO: 1270117 - protein, 9 aa, Homo Sapiens
TESDTNYLL

SEQ ID NO: 1270118 - protein, 9 aa, Homo Sapiens
PLISREQHF

SEQ ID NO: 1270119 - protein, 9 aa, Homo Sapiens
AGTAGARHH

SEQ ID NO: 1270120 - protein, 9 aa, Homo Sapiens
YCSLSFPGS

SEQ ID NO: 1270121 - protein, 9 aa, Homo Sapiens
VDAHVVLEV

SEQ ID NO: 1270122 - protein, 9 aa, Homo Sapiens
QAGGPPRSR

SEQ ID NO: 1270123 - protein, 9 aa, Homo Sapiens
LDTPFRKPG

SEQ ID NO: 1270124 - protein, 9 aa, Homo Sapiens
VPIRFEVGP

SEQ ID NO: 1270125 - protein, 9 aa, Homo Sapiens
TAGARHHTR

SEQ ID NO: 1270126 - protein, 9 aa, Homo Sapiens
AWTEGEKQR

SEQ ID NO: 1270127 - protein, 9 aa, Homo Sapiens
DAVVASSSG

SEQ ID NO: 1270128 - protein, 9 aa, Homo Sapiens
HNRKYNCTL

SEQ ID NO: 1270129 - protein, 9 aa, Homo Sapiens
SMYQTDFIL

SEQ ID NO: 1270130 - protein, 9 aa, Homo Sapiens
QFARTPGPI

SEQ ID NO: 1270131 - protein, 9 aa, Homo Sapiens
KSAAEVLVH

SEQ ID NO: 1270132 - protein, 9 aa, Homo Sapiens
HTLTQAYTH

SEQ ID NO: 1270133 - protein, 9 aa, Homo Sapiens
KANLRWRRK

SEQ ID NO: 1270134 - protein, 9 aa, Homo Sapiens
RQKILFQAL

SEQ ID NO: 1270135 - protein, 9 aa, Homo Sapiens
TLPQLSLTQ

SEQ ID NO: 1270136 - protein, 9 aa, Homo Sapiens
VMNENESYD

SEQ ID NO: 1270137 - protein, 9 aa, Homo Sapiens
WAPGAEGIF

SEQ ID NO: 1270138 - protein, 9 aa, Homo Sapiens
GAESPWRPK

SEQ ID NO: 1270139 - protein, 9 aa, Homo Sapiens
IDLPHKKYP

SEQ ID NO: 1270140 - protein, 9 aa, Homo Sapiens
FSDGSSFAQ

SEQ ID NO: 1270141 - protein, 9 aa, Homo Sapiens
RTMAGPSAS

SEQ ID NO: 1270142 - protein, 9 aa, Homo Sapiens
SLSWDIVAE

SEQ ID NO: 1270143 - protein, 9 aa, Homo Sapiens
HRHTHRHTQ

SEQ ID NO: 1270144 - protein, 9 aa, Homo Sapiens
VFPAISMKS

SEQ ID NO: 1270145 - protein, 9 aa, Homo Sapiens
CEKKLHPQK

SEQ ID NO: 1270146 - protein, 9 aa, Homo Sapiens
RRKPPRYGT

SEQ ID NO: 1270147 - protein, 9 aa, Homo Sapiens
GFCCACHPW

SEQ ID NO: 1270148 - protein, 9 aa, Homo Sapiens
APGAEGIFL

SEQ ID NO: 1270149 - protein, 9 aa, Homo Sapiens
PCTDTESAS

SEQ ID NO: 1270150 - protein, 9 aa, Homo Sapiens
TPLPLPTSQ

SEQ ID NO: 1270151 - protein, 9 aa, Homo Sapiens
FVFKEIKGL

SEQ ID NO: 1270152 - protein, 9 aa, Homo Sapiens
ACPSLGPGG

SEQ ID NO: 1270153 - protein, 9 aa, Homo Sapiens
VVTGDQSSP

SEQ ID NO: 1270154 - protein, 9 aa, Homo Sapiens
RNLILRKPE

SEQ ID NO: 1270155 - protein, 9 aa, Homo Sapiens
VDGIELTEV

SEQ ID NO: 1270156 - protein, 9 aa, Homo Sapiens
TGEGLEEIA

SEQ ID NO: 1270157 - protein, 9 aa, Homo Sapiens
QESSYFLSF

SEQ ID NO: 1270158 - protein, 9 aa, Homo Sapiens
ASLHPASGR

SEQ ID NO: 1270159 - protein, 9 aa, Homo Sapiens
SPSLSCLGH

SEQ ID NO: 1270160 - protein, 9 aa, Homo Sapiens
QVTGEAGTS

SEQ ID NO: 1270161 - protein, 9 aa, Homo Sapiens
KDMFKEEQQ

SEQ ID NO: 1270162 - protein, 9 aa, Homo Sapiens
METGEGLEE

SEQ ID NO: 1270163 - protein, 9 aa, Homo Sapiens
IFVEGMETG

SEQ ID NO: 1270164 - protein, 9 aa, Homo Sapiens
TVKPKEVAK

SEQ ID NO: 1270165 - protein, 9 aa, Homo Sapiens
FFSVFVLFL

SEQ ID NO: 1270166 - protein, 9 aa, Homo Sapiens
GEDAAGHRH

SEQ ID NO: 1270167 - protein, 9 aa, Homo Sapiens
EILNMEPCC

SEQ ID NO: 1270168 - protein, 9 aa, Homo Sapiens
LLDLPILDD

SEQ ID NO: 1270169 - protein, 9 aa, Homo Sapiens
VQAMGQVQS

SEQ ID NO: 1270170 - protein, 9 aa, Homo Sapiens
RRPVVVPGV

SEQ ID NO: 1270171 - protein, 9 aa, Homo Sapiens
GLFPDAQPS

SEQ ID NO: 1270172 - protein, 9 aa, Homo Sapiens
QMICIDQQN

SEQ ID NO: 1270173 - protein, 9 aa, Homo Sapiens
RVSHIETAP

SEQ ID NO: 1270174 - protein, 9 aa, Homo Sapiens
GASAAPDAS

SEQ ID NO: 1270175 - protein, 9 aa, Homo Sapiens
PHDDFVADG

SEQ ID NO: 1270176 - protein, 9 aa, Homo Sapiens
DSSSASHEY

SEQ ID NO: 1270177 - protein, 9 aa, Homo Sapiens
LQQGICRLF

SEQ ID NO: 1270178 - protein, 9 aa, Homo Sapiens
MAPLGITGQ

SEQ ID NO: 1270179 - protein, 9 aa, Homo Sapiens
WAPHSAGLS

SEQ ID NO: 1270180 - protein, 9 aa, Homo Sapiens
VRRLDRKDL

SEQ ID NO: 1270181 - protein, 9 aa, Homo Sapiens
GGRMRVAFE

SEQ ID NO: 1270182 - protein, 9 aa, Homo Sapiens
ECYPDNHAN

SEQ ID NO: 1270183 - protein, 9 aa, Homo Sapiens
EAMFLLEFL

SEQ ID NO: 1270184 - protein, 9 aa, Homo Sapiens
SAYSKDSQP

SEQ ID NO: 1270185 - protein, 9 aa, Homo Sapiens
LMNGSSSTA

SEQ ID NO: 1270186 - protein, 9 aa, Homo Sapiens
ENESYDAVQ

SEQ ID NO: 1270187 - protein, 9 aa, Homo Sapiens
AKRVVCDPQ

SEQ ID NO: 1270188 - protein, 9 aa, Homo Sapiens
VVHELGVAV

SEQ ID NO: 1270189 - protein, 9 aa, Homo Sapiens
STVSRTMPP

SEQ ID NO: 1270190 - protein, 9 aa, Homo Sapiens
LRRTVTVPA

SEQ ID NO: 1270191 - protein, 9 aa, Homo Sapiens
ARTPGPIIF

SEQ ID NO: 1270192 - protein, 9 aa, Homo Sapiens
PSQFSSTPG

SEQ ID NO: 1270193 - protein, 9 aa, Homo Sapiens
SDPTKADWL

SEQ ID NO: 1270194 - protein, 9 aa, Homo Sapiens
AAMRLMPKF

SEQ ID NO: 1270195 - protein, 9 aa, Homo Sapiens
AFILALSRV

SEQ ID NO: 1270196 - protein, 9 aa, Homo Sapiens
KPTRSTVSR

SEQ ID NO: 1270197 - protein, 9 aa, Homo Sapiens
SQTVARHQL

SEQ ID NO: 1270198 - protein, 9 aa, Homo Sapiens
AAALALDVA

SEQ ID NO: 1270199 - protein, 9 aa, Homo Sapiens
LRDSDSVCN

SEQ ID NO: 1270200 - protein, 9 aa, Homo Sapiens
KKGGATENT

SEQ ID NO: 1270201 - protein, 9 aa, Homo Sapiens
EEIVAAMVY

SEQ ID NO: 1270202 - protein, 9 aa, Homo Sapiens
LIKELSCHN

SEQ ID NO: 1270203 - protein, 9 aa, Homo Sapiens
LPLEAVAAL

SEQ ID NO: 1270204 - protein, 9 aa, Homo Sapiens
PSLMTSTFT

SEQ ID NO: 1270205 - protein, 9 aa, Homo Sapiens
IEMIDPKMD

SEQ ID NO: 1270206 - protein, 9 aa, Homo Sapiens
DSDSVCNSG

SEQ ID NO: 1270207 - protein, 9 aa, Homo Sapiens
NLVQKAQFT

SEQ ID NO: 1270208 - protein, 9 aa, Homo Sapiens
LMEKKINNQ

SEQ ID NO: 1270209 - protein, 9 aa, Homo Sapiens
CGSRAPGCA

SEQ ID NO: 1270210 - protein, 9 aa, Homo Sapiens
QRRHAAPEH

SEQ ID NO: 1270211 - protein, 9 aa, Homo Sapiens
PTMAKVVNL

SEQ ID NO: 1270212 - protein, 9 aa, Homo Sapiens
PLEAVAALK

SEQ ID NO: 1270213 - protein, 9 aa, Homo Sapiens
TVWCCRASR

SEQ ID NO: 1270214 - protein, 9 aa, Homo Sapiens
TANNTRIVD

SEQ ID NO: 1270215 - protein, 9 aa, Homo Sapiens
WVPDNRTPT

SEQ ID NO: 1270216 - protein, 9 aa, Homo Sapiens
FGFDTNTEG

SEQ ID NO: 1270217 - protein, 9 aa, Homo Sapiens
WMAEIECDD

SEQ ID NO: 1270218 - protein, 9 aa, Homo Sapiens
VVPGVQLRH

SEQ ID NO: 1270219 - protein, 9 aa, Homo Sapiens
HIVCLNSLK

SEQ ID NO: 1270220 - protein, 9 aa, Homo Sapiens
FNRNHHMAV

SEQ ID NO: 1270221 - protein, 9 aa, Homo Sapiens
IQYTDKTDK

SEQ ID NO: 1270222 - protein, 9 aa, Homo Sapiens
VTPTTSSLV

SEQ ID NO: 1270223 - protein, 9 aa, Homo Sapiens
TENGQITPD

SEQ ID NO: 1270224 - protein, 9 aa, Homo Sapiens
QNLNDHLAS

SEQ ID NO: 1270225 - protein, 9 aa, Homo Sapiens
GSRHSVSRH

SEQ ID NO: 1270226 - protein, 9 aa, Homo Sapiens
RTLDPLCLG

SEQ ID NO: 1270227 - protein, 9 aa, Homo Sapiens
WWLKLTALV

SEQ ID NO: 1270228 - protein, 9 aa, Homo Sapiens
SASASPSIR

SEQ ID NO: 1270229 - protein, 9 aa, Homo Sapiens
PPLLHPQWA

SEQ ID NO: 1270230 - protein, 9 aa, Homo Sapiens
LDEPKNPIL

SEQ ID NO: 1270231 - protein, 9 aa, Homo Sapiens
PALPLEAVA

SEQ ID NO: 1270232 - protein, 9 aa, Homo Sapiens
YQESSYFLS

SEQ ID NO: 1270233 - protein, 9 aa, Homo Sapiens
LVAFRFLRL

SEQ ID NO: 1270234 - protein, 9 aa, Homo Sapiens
PRRASGCRP

SEQ ID NO: 1270235 - protein, 9 aa, Homo Sapiens
QGRVSHIET

SEQ ID NO: 1270236 - protein, 9 aa, Homo Sapiens
VAAAPRAVA

SEQ ID NO: 1270237 - protein, 9 aa, Homo Sapiens
FYQGPGWEE

SEQ ID NO: 1270238 - protein, 9 aa, Homo Sapiens
LVLPGEADL

SEQ ID NO: 1270239 - protein, 9 aa, Homo Sapiens
FEDRTTFPS

SEQ ID NO: 1270240 - protein, 9 aa, Homo Sapiens
RQPSRPTGR

SEQ ID NO: 1270241 - protein, 9 aa, Homo Sapiens
DMALKELEK

SEQ ID NO: 1270242 - protein, 9 aa, Homo Sapiens
STLRPWPRL

SEQ ID NO: 1270243 - protein, 9 aa, Homo Sapiens
GKGLTGVMI

SEQ ID NO: 1270244 - protein, 9 aa, Homo Sapiens
HQERYKEEF

SEQ ID NO: 1270245 - protein, 9 aa, Homo Sapiens
VKVRTKAAG

SEQ ID NO: 1270246 - protein, 9 aa, Homo Sapiens
SPFEDRTTF

SEQ ID NO: 1270247 - protein, 9 aa, Homo Sapiens
EKLRKTCWN

SEQ ID NO: 1270248 - protein, 9 aa, Homo Sapiens
PDLRRRDPG

SEQ ID NO: 1270249 - protein, 9 aa, Homo Sapiens
DCNIHVIAS

SEQ ID NO: 1270250 - protein, 9 aa, Homo Sapiens
SDFSDTLSS

SEQ ID NO: 1270251 - protein, 9 aa, Homo Sapiens
LMAPVGSVM

SEQ ID NO: 1270252 - protein, 9 aa, Homo Sapiens
QIQWPTVHG

SEQ ID NO: 1270253 - protein, 9 aa, Homo Sapiens
LLLLLDLPI

SEQ ID NO: 1270254 - protein, 9 aa, Homo Sapiens
FVVMMKMLH

SEQ ID NO: 1270255 - protein, 9 aa, Homo Sapiens
VCDPQGIRA

SEQ ID NO: 1270256 - protein, 9 aa, Homo Sapiens
KVKDMFKEE

SEQ ID NO: 1270257 - protein, 9 aa, Homo Sapiens
YVSVHVESG

SEQ ID NO: 1270258 - protein, 9 aa, Homo Sapiens
RGASGRDRE

SEQ ID NO: 1270259 - protein, 9 aa, Homo Sapiens
LSLVVTGDQ

SEQ ID NO: 1270260 - protein, 9 aa, Homo Sapiens
AYLDSGCGF

SEQ ID NO: 1270261 - protein, 9 aa, Homo Sapiens
AGHRSLPMA

SEQ ID NO: 1270262 - protein, 9 aa, Homo Sapiens
PPARQPSRP

SEQ ID NO: 1270263 - protein, 9 aa, Homo Sapiens
HPPPAKHSS

SEQ ID NO: 1270264 - protein, 9 aa, Homo Sapiens
SSASHEYHI

SEQ ID NO: 1270265 - protein, 9 aa, Homo Sapiens
ILRKPEWIF

SEQ ID NO: 1270266 - protein, 9 aa, Homo Sapiens
FARTPGPII

SEQ ID NO: 1270267 - protein, 9 aa, Homo Sapiens
EEILNMEPC

SEQ ID NO: 1270268 - protein, 9 aa, Homo Sapiens
HMWPGDKGN

SEQ ID NO: 1270269 - protein, 9 aa, Homo Sapiens
CDPQGIRAW

SEQ ID NO: 1270270 - protein, 9 aa, Homo Sapiens
HGDHLDRRV

SEQ ID NO: 1270271 - protein, 9 aa, Homo Sapiens
AGNHGHSME

SEQ ID NO: 1270272 - protein, 9 aa, Homo Sapiens
SAAEVLVHV

SEQ ID NO: 1270273 - protein, 9 aa, Homo Sapiens
RACRAGGPA

SEQ ID NO: 1270274 - protein, 9 aa, Homo Sapiens
HQRTGRQHP

SEQ ID NO: 1270275 - protein, 9 aa, Homo Sapiens
HTGIHTDTH

SEQ ID NO: 1270276 - protein, 9 aa, Homo Sapiens
QGNNDLYWK

SEQ ID NO: 1270277 - protein, 9 aa, Homo Sapiens
QDASSFWLI

SEQ ID NO: 1270278 - protein, 9 aa, Homo Sapiens
EMKAANEAK

SEQ ID NO: 1270279 - protein, 9 aa, Homo Sapiens
TCSWTIHQP

SEQ ID NO: 1270280 - protein, 9 aa, Homo Sapiens
DTDMALKEL

SEQ ID NO: 1270281 - protein, 9 aa, Homo Sapiens
QTPMGMRAS

SEQ ID NO: 1270282 - protein, 9 aa, Homo Sapiens
KTENGQITP

SEQ ID NO: 1270283 - protein, 9 aa, Homo Sapiens
TSTLMGACV

SEQ ID NO: 1270284 - protein, 9 aa, Homo Sapiens
HPWPSGPCR

SEQ ID NO: 1270285 - protein, 9 aa, Homo Sapiens
NMEPCCCRE

SEQ ID NO: 1270286 - protein, 9 aa, Homo Sapiens
LLNGSSDPT

SEQ ID NO: 1270287 - protein, 9 aa, Homo Sapiens
PVQKKSYEY

SEQ ID NO: 1270288 - protein, 9 aa, Homo Sapiens
LCPAQMCAS

SEQ ID NO: 1270289 - protein, 9 aa, Homo Sapiens
CIWKFFPKK

SEQ ID NO: 1270290 - protein, 9 aa, Homo Sapiens
CKECGDTFW

SEQ ID NO: 1270291 - protein, 9 aa, Homo Sapiens
GSEIIIEGK

SEQ ID NO: 1270292 - protein, 9 aa, Homo Sapiens
LALVGPHAR

SEQ ID NO: 1270293 - protein, 9 aa, Homo Sapiens
EFNTQREER

SEQ ID NO: 1270294 - protein, 9 aa, Homo Sapiens
TRGASGRDR

SEQ ID NO: 1270295 - protein, 9 aa, Homo Sapiens
FSSLLSLTE

SEQ ID NO: 1270296 - protein, 9 aa, Homo Sapiens
IDWRIARFV

SEQ ID NO: 1270297 - protein, 9 aa, Homo Sapiens
AAQKCHKKT

SEQ ID NO: 1270298 - protein, 9 aa, Homo Sapiens
YNGNGWKGN

SEQ ID NO: 1270299 - protein, 9 aa, Homo Sapiens
VAWIDSVLA

SEQ ID NO: 1270300 - protein, 9 aa, Homo Sapiens
AAVAAAPRA

SEQ ID NO: 1270301 - protein, 9 aa, Homo Sapiens
SAWPPTVTI

SEQ ID NO: 1270302 - protein, 9 aa, Homo Sapiens
VPRQLPGPH

SEQ ID NO: 1270303 - protein, 9 aa, Homo Sapiens
LAVGVITFG

SEQ ID NO: 1270304 - protein, 9 aa, Homo Sapiens
EKRQEESQH

SEQ ID NO: 1270305 - protein, 9 aa, Homo Sapiens
VERAIPNNG

SEQ ID NO: 1270306 - protein, 9 aa, Homo Sapiens
AQHQRCHTG

SEQ ID NO: 1270307 - protein, 9 aa, Homo Sapiens
HPVWNEAFC

SEQ ID NO: 1270308 - protein, 9 aa, Homo Sapiens
YYENKKSYQ

SEQ ID NO: 1270309 - protein, 9 aa, Homo Sapiens
TPTTSSLVA

SEQ ID NO: 1270310 - protein, 9 aa, Homo Sapiens
TRRPPAPTP

SEQ ID NO: 1270311 - protein, 9 aa, Homo Sapiens
DGQSLPQAG

SEQ ID NO: 1270312 - protein, 9 aa, Homo Sapiens
AQPSTTEKY

SEQ ID NO: 1270313 - protein, 9 aa, Homo Sapiens
PGACRPACT

SEQ ID NO: 1270314 - protein, 9 aa, Homo Sapiens
PKPSTPHHP

SEQ ID NO: 1270315 - protein, 9 aa, Homo Sapiens
EYQESSYFL

SEQ ID NO: 1270316 - protein, 9 aa, Homo Sapiens
SLAGIGMRL

SEQ ID NO: 1270317 - protein, 9 aa, Homo Sapiens
MGLYDRIEH

SEQ ID NO: 1270318 - protein, 9 aa, Homo Sapiens
GPHDDFVAD

SEQ ID NO: 1270319 - protein, 9 aa, Homo Sapiens
VGKLLIEGR

SEQ ID NO: 1270320 - protein, 9 aa, Homo Sapiens
HRHTHTHTQ

SEQ ID NO: 1270321 - protein, 9 aa, Homo Sapiens
GGPPRSRLA

SEQ ID NO: 1270322 - protein, 9 aa, Homo Sapiens
GMETGEGLE

SEQ ID NO: 1270323 - protein, 9 aa, Homo Sapiens
VQSQEHVEM

SEQ ID NO: 1270324 - protein, 9 aa, Homo Sapiens
RVAFEGQQP

SEQ ID NO: 1270325 - protein, 9 aa, Homo Sapiens
ASSASSHPR

SEQ ID NO: 1270326 - protein, 9 aa, Homo Sapiens
WGAWHPGSW

SEQ ID NO: 1270327 - protein, 9 aa, Homo Sapiens
CSTGSSCPL

SEQ ID NO: 1270328 - protein, 9 aa, Homo Sapiens
KECGDTFWL

SEQ ID NO: 1270329 - protein, 9 aa, Homo Sapiens
HIDWRIARF

SEQ ID NO: 1270330 - protein, 9 aa, Homo Sapiens
LDELDTPFR

SEQ ID NO: 1270331 - protein, 9 aa, Homo Sapiens
RPKRPSVSR

SEQ ID NO: 1270332 - protein, 9 aa, Homo Sapiens
GVLQPTQPQ

SEQ ID NO: 1270333 - protein, 9 aa, Homo Sapiens
LFVVMMKML

SEQ ID NO: 1270334 - protein, 9 aa, Homo Sapiens
CRWCSSWRS

SEQ ID NO: 1270335 - protein, 9 aa, Homo Sapiens
YLISIKYSG

SEQ ID NO: 1270336 - protein, 9 aa, Homo Sapiens
LPPPGSPSL

SEQ ID NO: 1270337 - protein, 9 aa, Homo Sapiens
PPLPLSAVT

SEQ ID NO: 1270338 - protein, 9 aa, Homo Sapiens
SSYFLSFYN

SEQ ID NO: 1270339 - protein, 9 aa, Homo Sapiens
LPGAESPWR

SEQ ID NO: 1270340 - protein, 9 aa, Homo Sapiens
PGCTDDEGP

SEQ ID NO: 1270341 - protein, 9 aa, Homo Sapiens
ERAIPNNGS

SEQ ID NO: 1270342 - protein, 9 aa, Homo Sapiens
ADVASNSSR

SEQ ID NO: 1270343 - protein, 9 aa, Homo Sapiens
TNLMLMSRN

SEQ ID NO: 1270344 - protein, 9 aa, Homo Sapiens
DAHVVLEVV

SEQ ID NO: 1270345 - protein, 9 aa, Homo Sapiens
SGYQGYSEY

SEQ ID NO: 1270346 - protein, 9 aa, Homo Sapiens
ALTMNIVSS

SEQ ID NO: 1270347 - protein, 9 aa, Homo Sapiens
VRPCVKTWA

SEQ ID NO: 1270348 - protein, 9 aa, Homo Sapiens
NLILRKPEW

SEQ ID NO: 1270349 - protein, 9 aa, Homo Sapiens
LLENNHIDW

SEQ ID NO: 1270350 - protein, 9 aa, Homo Sapiens
QPSTTEKYI

SEQ ID NO: 1270351 - protein, 9 aa, Homo Sapiens
VPIQYTDKT

SEQ ID NO: 1270352 - protein, 9 aa, Homo Sapiens
IKKGGATEN

SEQ ID NO: 1270353 - protein, 9 aa, Homo Sapiens
APLGITGQP

SEQ ID NO: 1270354 - protein, 9 aa, Homo Sapiens
PSVLTALGR

SEQ ID NO: 1270355 - protein, 9 aa, Homo Sapiens
PGSSSQTVA

SEQ ID NO: 1270356 - protein, 9 aa, Homo Sapiens
RTTFPSKLE

SEQ ID NO: 1270357 - protein, 9 aa, Homo Sapiens
QHIVCLNSL

SEQ ID NO: 1270358 - protein, 9 aa, Homo Sapiens
RTELRDGQL

SEQ ID NO: 1270359 - protein, 9 aa, Homo Sapiens
PRAAVAAAP

SEQ ID NO: 1270360 - protein, 9 aa, Homo Sapiens
TALGRSQGL

SEQ ID NO: 1270361 - protein, 9 aa, Homo Sapiens
VVRRLDRKD

SEQ ID NO: 1270362 - protein, 9 aa, Homo Sapiens
ILCGKKVEN

SEQ ID NO: 1270363 - protein, 9 aa, Homo Sapiens
HFKWILLLT

SEQ ID NO: 1270364 - protein, 9 aa, Homo Sapiens
VTMQNLNDH

SEQ ID NO: 1270365 - protein, 9 aa, Homo Sapiens
RDPGWERSD

SEQ ID NO: 1270366 - protein, 9 aa, Homo Sapiens
TLMGACVTA

SEQ ID NO: 1270367 - protein, 9 aa, Homo Sapiens
SMTTISRAT

SEQ ID NO: 1270368 - protein, 9 aa, Homo Sapiens
PKFLNSTNS

SEQ ID NO: 1270369 - protein, 9 aa, Homo Sapiens
NGSSSTAEA

SEQ ID NO: 1270370 - protein, 9 aa, Homo Sapiens
MKLRNESLG

SEQ ID NO: 1270371 - protein, 9 aa, Homo Sapiens
NAVGKLLIE

SEQ ID NO: 1270372 - protein, 9 aa, Homo Sapiens
SLGPGGVIP

SEQ ID NO: 1270373 - protein, 9 aa, Homo Sapiens
GPGWEEASQ

SEQ ID NO: 1270374 - protein, 9 aa, Homo Sapiens
EIVAAMVYN

SEQ ID NO: 1270375 - protein, 9 aa, Homo Sapiens
RLGPKSAAE

SEQ ID NO: 1270376 - protein, 9 aa, Homo Sapiens
VQVVRAREA

SEQ ID NO: 1270377 - protein, 9 aa, Homo Sapiens
GEGPGCTDD

SEQ ID NO: 1270378 - protein, 9 aa, Homo Sapiens
EDRTTFPSK

SEQ ID NO: 1270379 - protein, 9 aa, Homo Sapiens
LVRVLIPLY

SEQ ID NO: 1270380 - protein, 9 aa, Homo Sapiens
VYSVVISED

SEQ ID NO: 1270381 - protein, 9 aa, Homo Sapiens
ALDKTGGLT

SEQ ID NO: 1270382 - protein, 9 aa, Homo Sapiens
PEVTWMARK

SEQ ID NO: 1270383 - protein, 9 aa, Homo Sapiens
SVMSCSLLT

SEQ ID NO: 1270384 - protein, 9 aa, Homo Sapiens
YTLTLRKGR

SEQ ID NO: 1270385 - protein, 9 aa, Homo Sapiens
EFYKDSQGV

SEQ ID NO: 1270386 - protein, 9 aa, Homo Sapiens
LPTRRPPAP

SEQ ID NO: 1270387 - protein, 9 aa, Homo Sapiens
SNRDSYFYT

SEQ ID NO: 1270388 - protein, 9 aa, Homo Sapiens
WGWGQLLLL

SEQ ID NO: 1270389 - protein, 9 aa, Homo Sapiens
NSRLNSWGE

SEQ ID NO: 1270390 - protein, 9 aa, Homo Sapiens
MHRHTHTQA

SEQ ID NO: 1270391 - protein, 9 aa, Homo Sapiens
QFQFEMESF

SEQ ID NO: 1270392 - protein, 9 aa, Homo Sapiens
WQPWPAIAT

SEQ ID NO: 1270393 - protein, 9 aa, Homo Sapiens
NDTTASEYK

SEQ ID NO: 1270394 - protein, 9 aa, Homo Sapiens
GVCLHCTPK

SEQ ID NO: 1270395 - protein, 9 aa, Homo Sapiens
KTYLEIIIL

SEQ ID NO: 1270396 - protein, 9 aa, Homo Sapiens
PVIYVPDFI

SEQ ID NO: 1270397 - protein, 9 aa, Homo Sapiens
RRLRACRAG

SEQ ID NO: 1270398 - protein, 9 aa, Homo Sapiens
TPTSPVSHF

SEQ ID NO: 1270399 - protein, 9 aa, Homo Sapiens
PSTPHHPLK

SEQ ID NO: 1270400 - protein, 9 aa, Homo Sapiens
MRASRCLNL

SEQ ID NO: 1270401 - protein, 9 aa, Homo Sapiens
SYLISIKYS

SEQ ID NO: 1270402 - protein, 9 aa, Homo Sapiens
AALALDVAV

SEQ ID NO: 1270403 - protein, 9 aa, Homo Sapiens
RRHAAPEHR

SEQ ID NO: 1270404 - protein, 9 aa, Homo Sapiens
HHLEVLRLG

SEQ ID NO: 1270405 - protein, 9 aa, Homo Sapiens
QASLKEDKW

SEQ ID NO: 1270406 - protein, 9 aa, Homo Sapiens
PHARVDAHV

SEQ ID NO: 1270407 - protein, 9 aa, Homo Sapiens
EKQRVLSTG

SEQ ID NO: 1270408 - protein, 9 aa, Homo Sapiens
GHPALHQCL

SEQ ID NO: 1270409 - protein, 9 aa, Homo Sapiens
ASQVGGTQE

SEQ ID NO: 1270410 - protein, 9 aa, Homo Sapiens
PQAGLRSPL

SEQ ID NO: 1270411 - protein, 9 aa, Homo Sapiens
TTFPSKLET

SEQ ID NO: 1270412 - protein, 9 aa, Homo Sapiens
HPQWAPHSA

SEQ ID NO: 1270413 - protein, 9 aa, Homo Sapiens
TKRGLKSLC

SEQ ID NO: 1270414 - protein, 9 aa, Homo Sapiens
ADGLIAHTA

SEQ ID NO: 1270415 - protein, 9 aa, Homo Sapiens
EHEVRLAAR

SEQ ID NO: 1270416 - protein, 9 aa, Homo Sapiens
QRVLSTGRV

SEQ ID NO: 1270417 - protein, 9 aa, Homo Sapiens
LVTGEFFGG

SEQ ID NO: 1270418 - protein, 9 aa, Homo Sapiens
DHCMAHKLF

SEQ ID NO: 1270419 - protein, 9 aa, Homo Sapiens
RKTWQRRLR

SEQ ID NO: 1270420 - protein, 9 aa, Homo Sapiens
RTPTWRPRS

SEQ ID NO: 1270421 - protein, 9 aa, Homo Sapiens
RMTEPTPRM

SEQ ID NO: 1270422 - protein, 9 aa, Homo Sapiens
SWSAMHNRK

SEQ ID NO: 1270423 - protein, 9 aa, Homo Sapiens
LLSSLGEHT

SEQ ID NO: 1270424 - protein, 9 aa, Homo Sapiens
VQLRHRLGQ

SEQ ID NO: 1270425 - protein, 9 aa, Homo Sapiens
LRSIRTNLM

SEQ ID NO: 1270426 - protein, 9 aa, Homo Sapiens
LISREQHFY

SEQ ID NO: 1270427 - protein, 9 aa, Homo Sapiens
NISVFMLSM

SEQ ID NO: 1270428 - protein, 9 aa, Homo Sapiens
PPSGTPPSP

SEQ ID NO: 1270429 - protein, 9 aa, Homo Sapiens
ALARHEVLL

SEQ ID NO: 1270430 - protein, 9 aa, Homo Sapiens
LGYPWVEYC

SEQ ID NO: 1270431 - protein, 9 aa, Homo Sapiens
PRRAPQGVN

SEQ ID NO: 1270432 - protein, 9 aa, Homo Sapiens
SASGQAVRP

SEQ ID NO: 1270433 - protein, 9 aa, Homo Sapiens
PVWNEAFCF

SEQ ID NO: 1270434 - protein, 9 aa, Homo Sapiens
SLKEDKWYS

SEQ ID NO: 1270435 - protein, 9 aa, Homo Sapiens
ELCDLMSTR

SEQ ID NO: 1270436 - protein, 9 aa, Homo Sapiens
PLGITGQPI

SEQ ID NO: 1270437 - protein, 9 aa, Homo Sapiens
RNRPKRPSV

SEQ ID NO: 1270438 - protein, 9 aa, Homo Sapiens
GLQLALFYQ

SEQ ID NO: 1270439 - protein, 9 aa, Homo Sapiens
LVVKVSDRR

SEQ ID NO: 1270440 - protein, 9 aa, Homo Sapiens
DTRPEMRED

SEQ ID NO: 1270441 - protein, 9 aa, Homo Sapiens
HPTKEEVNH

SEQ ID NO: 1270442 - protein, 9 aa, Homo Sapiens
ILLHINDIV

SEQ ID NO: 1270443 - protein, 9 aa, Homo Sapiens
RYKEEFQRI

SEQ ID NO: 1270444 - protein, 9 aa, Homo Sapiens
GTDRNTQTH

SEQ ID NO: 1270445 - protein, 9 aa, Homo Sapiens
MYQVFWSEA

SEQ ID NO: 1270446 - protein, 9 aa, Homo Sapiens
LRAARAHQR

SEQ ID NO: 1270447 - protein, 9 aa, Homo Sapiens
AQRRVQRAH

SEQ ID NO: 1270448 - protein, 9 aa, Homo Sapiens
EIIIEGKLV

SEQ ID NO: 1270449 - protein, 9 aa, Homo Sapiens
GHRSRKLGE

SEQ ID NO: 1270450 - protein, 9 aa, Homo Sapiens
KVTWMKRRR

SEQ ID NO: 1270451 - protein, 9 aa, Homo Sapiens
MYVYVLTVT

SEQ ID NO: 1270452 - protein, 9 aa, Homo Sapiens
AHRRPTQTA

SEQ ID NO: 1270453 - protein, 9 aa, Homo Sapiens
FDRFHAHVS

SEQ ID NO: 1270454 - protein, 9 aa, Homo Sapiens
PTHQLLQAS

SEQ ID NO: 1270455 - protein, 9 aa, Homo Sapiens
LFHRRRAQG

SEQ ID NO: 1270456 - protein, 9 aa, Homo Sapiens
ASRVAGTAG

SEQ ID NO: 1270457 - protein, 9 aa, Homo Sapiens
LGETALPTR

SEQ ID NO: 1270458 - protein, 9 aa, Homo Sapiens
GETALPTRR

SEQ ID NO: 1270459 - protein, 9 aa, Homo Sapiens
AVDAQVGPL

SEQ ID NO: 1270460 - protein, 9 aa, Homo Sapiens
PDGLFWMLT

SEQ ID NO: 1270461 - protein, 9 aa, Homo Sapiens
ESVNLDDCN

SEQ ID NO: 1270462 - protein, 9 aa, Homo Sapiens
VSRICRQKI

SEQ ID NO: 1270463 - protein, 9 aa, Homo Sapiens
TSTVSLVGR

SEQ ID NO: 1270464 - protein, 9 aa, Homo Sapiens
RHTGMHRHT

SEQ ID NO: 1270465 - protein, 9 aa, Homo Sapiens
ASLSLLIAA

SEQ ID NO: 1270466 - protein, 9 aa, Homo Sapiens
SSDPTKADW

SEQ ID NO: 1270467 - protein, 9 aa, Homo Sapiens
CISMTTISR

SEQ ID NO: 1270468 - protein, 9 aa, Homo Sapiens
CNIHVIASV

SEQ ID NO: 1270469 - protein, 9 aa, Homo Sapiens
ELSCHNLEL

SEQ ID NO: 1270470 - protein, 9 aa, Homo Sapiens
RWGWGQLLL

SEQ ID NO: 1270471 - protein, 9 aa, Homo Sapiens
VRGEWRQGG

SEQ ID NO: 1270472 - protein, 9 aa, Homo Sapiens
LMPKFLNST

SEQ ID NO: 1270473 - protein, 9 aa, Homo Sapiens
PQLSLTQPQ

SEQ ID NO: 1270474 - protein, 9 aa, Homo Sapiens
SWDIVAEGQ

SEQ ID NO: 1270475 - protein, 9 aa, Homo Sapiens
SFDKVVGGM

SEQ ID NO: 1270476 - protein, 9 aa, Homo Sapiens
EFFGGFLLG

SEQ ID NO: 1270477 - protein, 9 aa, Homo Sapiens
RRPRALCSQ

SEQ ID NO: 1270478 - protein, 9 aa, Homo Sapiens
ILFQALSPS

SEQ ID NO: 1270479 - protein, 9 aa, Homo Sapiens
PACTCISMT

SEQ ID NO: 1270480 - protein, 9 aa, Homo Sapiens
GVQPSAGYR

SEQ ID NO: 1270481 - protein, 9 aa, Homo Sapiens
RPTGRTPTT

SEQ ID NO: 1270482 - protein, 9 aa, Homo Sapiens
LGKGTEVPW

SEQ ID NO: 1270483 - protein, 9 aa, Homo Sapiens
RASTSWCSA

SEQ ID NO: 1270484 - protein, 9 aa, Homo Sapiens
RKELEKRQE

SEQ ID NO: 1270485 - protein, 9 aa, Homo Sapiens
LTILLRGAR

SEQ ID NO: 1270486 - protein, 9 aa, Homo Sapiens
SDSSDDFFI

SEQ ID NO: 1270487 - protein, 9 aa, Homo Sapiens
SLYRKHCVE

SEQ ID NO: 1270488 - protein, 9 aa, Homo Sapiens
LHPQKLQDN

SEQ ID NO: 1270489 - protein, 9 aa, Homo Sapiens
VKDMFKEEQ

SEQ ID NO: 1270490 - protein, 9 aa, Homo Sapiens
GNNDLYWKA

SEQ ID NO: 1270491 - protein, 9 aa, Homo Sapiens
PSAGYRCRW

SEQ ID NO: 1270492 - protein, 9 aa, Homo Sapiens
NRDSYFYTA

SEQ ID NO: 1270493 - protein, 9 aa, Homo Sapiens
LRPWPRLSL

SEQ ID NO: 1270494 - protein, 9 aa, Homo Sapiens
LRGLGLQLA

SEQ ID NO: 1270495 - protein, 9 aa, Homo Sapiens
GITGQPILP

SEQ ID NO: 1270496 - protein, 9 aa, Homo Sapiens
TALQNTEEC

SEQ ID NO: 1270497 - protein, 9 aa, Homo Sapiens
HTHTHTQAH

SEQ ID NO: 1270498 - protein, 9 aa, Homo Sapiens
AQGRRAPVK

SEQ ID NO: 1270499 - protein, 9 aa, Homo Sapiens
GQTPMGMRA

SEQ ID NO: 1270500 - protein, 9 aa, Homo Sapiens
ATRRPRALC

SEQ ID NO: 1270501 - protein, 9 aa, Homo Sapiens
LARHEVLLR

SEQ ID NO: 1270502 - protein, 9 aa, Homo Sapiens
ALQVLLQVS

SEQ ID NO: 1270503 - protein, 9 aa, Homo Sapiens
KTCVSDPIS

SEQ ID NO: 1270504 - protein, 9 aa, Homo Sapiens
GCLTHEILA

SEQ ID NO: 1270505 - protein, 9 aa, Homo Sapiens
VTSTVSLVG

SEQ ID NO: 1270506 - protein, 9 aa, Homo Sapiens
CASLSLLIA

SEQ ID NO: 1270507 - protein, 9 aa, Homo Sapiens
TGRTPTTRL

SEQ ID NO: 1270508 - protein, 9 aa, Homo Sapiens
CVYSMNDVC

SEQ ID NO: 1270509 - protein, 9 aa, Homo Sapiens
GRASRKTWQ

SEQ ID NO: 1270510 - protein, 9 aa, Homo Sapiens
HFKRVQQRH

SEQ ID NO: 1270511 - protein, 9 aa, Homo Sapiens
WILLLTILL

SEQ ID NO: 1270512 - protein, 9 aa, Homo Sapiens
TILLGPIST

SEQ ID NO: 1270513 - protein, 9 aa, Homo Sapiens
GPKMETLTP

SEQ ID NO: 1270514 - protein, 9 aa, Homo Sapiens
LLIANTLRQ

SEQ ID NO: 1270515 - protein, 9 aa, Homo Sapiens
GQRLGPKSA

SEQ ID NO: 1270516 - protein, 9 aa, Homo Sapiens
DSDSSDDFF

SEQ ID NO: 1270517 - protein, 9 aa, Homo Sapiens
LSSFDKVVG

SEQ ID NO: 1270518 - protein, 9 aa, Homo Sapiens
KKAKIKKKT

SEQ ID NO: 1270519 - protein, 9 aa, Homo Sapiens
WPNSDPPSP

SEQ ID NO: 1270520 - protein, 9 aa, Homo Sapiens
HARHRHVLP

SEQ ID NO: 1270521 - protein, 9 aa, Homo Sapiens
HGQPASRAQ

SEQ ID NO: 1270522 - protein, 9 aa, Homo Sapiens
IEADMMKRQ

SEQ ID NO: 1270523 - protein, 9 aa, Homo Sapiens
RNEFYKDSQ

SEQ ID NO: 1270524 - protein, 9 aa, Homo Sapiens
LPRLCIWKF

SEQ ID NO: 1270525 - protein, 9 aa, Homo Sapiens
LKIKHSSAL

SEQ ID NO: 1270526 - protein, 9 aa, Homo Sapiens
WLIFIVDVW

SEQ ID NO: 1270527 - protein, 9 aa, Homo Sapiens
TLTYTGTHR

SEQ ID NO: 1270528 - protein, 9 aa, Homo Sapiens
GQHTRGASG

SEQ ID NO: 1270529 - protein, 9 aa, Homo Sapiens
FISTKEELM

SEQ ID NO: 1270530 - protein, 9 aa, Homo Sapiens
YRERGGGCL

SEQ ID NO: 1270531 - protein, 9 aa, Homo Sapiens
NGSPQGVQV

SEQ ID NO: 1270532 - protein, 9 aa, Homo Sapiens
GQRMTEPTP

SEQ ID NO: 1270533 - protein, 9 aa, Homo Sapiens
LMNVLELWK

SEQ ID NO: 1270534 - protein, 9 aa, Homo Sapiens
QYTDKTDKQ

SEQ ID NO: 1270535 - protein, 9 aa, Homo Sapiens
SAAPDASRE

SEQ ID NO: 1270536 - protein, 9 aa, Homo Sapiens
ELNKSKIVV

SEQ ID NO: 1270537 - protein, 9 aa, Homo Sapiens
EQHFYESLP

SEQ ID NO: 1270538 - protein, 9 aa, Homo Sapiens
AIKYLKNFV

SEQ ID NO: 1270539 - protein, 9 aa, Homo Sapiens
YRKHCVEQG

SEQ ID NO: 1270540 - protein, 9 aa, Homo Sapiens
VASSQNWGS

SEQ ID NO: 1270541 - protein, 9 aa, Homo Sapiens
FNSIPLLGS

SEQ ID NO: 1270542 - protein, 9 aa, Homo Sapiens
SGHGDHLDR

SEQ ID NO: 1270543 - protein, 9 aa, Homo Sapiens
SVNLDDCNI

SEQ ID NO: 1270544 - protein, 9 aa, Homo Sapiens
AVGVITFGS

SEQ ID NO: 1270545 - protein, 9 aa, Homo Sapiens
RRPTQTAAG

SEQ ID NO: 1270546 - protein, 9 aa, Homo Sapiens
KHSSSQCTQ

SEQ ID NO: 1270547 - protein, 9 aa, Homo Sapiens
VKANLRWRR

SEQ ID NO: 1270548 - protein, 9 aa, Homo Sapiens
EMIDPKMDA

SEQ ID NO: 1270549 - protein, 9 aa, Homo Sapiens
LSWDIVAEG

SEQ ID NO: 1270550 - protein, 9 aa, Homo Sapiens
AGLSEVWSM

SEQ ID NO: 1270551 - protein, 9 aa, Homo Sapiens
SVFVLFLNA

SEQ ID NO: 1270552 - protein, 9 aa, Homo Sapiens
VVRAREALV

SEQ ID NO: 1270553 - protein, 9 aa, Homo Sapiens
SLCSSLHLF

SEQ ID NO: 1270554 - protein, 9 aa, Homo Sapiens
HAHVSQVEP

SEQ ID NO: 1270555 - protein, 9 aa, Homo Sapiens
VMLLPVGQR

SEQ ID NO: 1270556 - protein, 9 aa, Homo Sapiens
IPRKDIKHE

SEQ ID NO: 1270557 - protein, 9 aa, Homo Sapiens
PHVPRQLPG

SEQ ID NO: 1270558 - protein, 9 aa, Homo Sapiens
GPCLPRRAP

SEQ ID NO: 1270559 - protein, 9 aa, Homo Sapiens
LVPRLECSG

SEQ ID NO: 1270560 - protein, 9 aa, Homo Sapiens
CAGAYLDSG

SEQ ID NO: 1270561 - protein, 9 aa, Homo Sapiens
RKLGEHVVH

SEQ ID NO: 1270562 - protein, 9 aa, Homo Sapiens
ELVEWKWRQ

SEQ ID NO: 1270563 - protein, 9 aa, Homo Sapiens
VSTTAMTPT

SEQ ID NO: 1270564 - protein, 9 aa, Homo Sapiens
ITANCCHHW

SEQ ID NO: 1270565 - protein, 9 aa, Homo Sapiens
SWTIHQPQS

SEQ ID NO: 1270566 - protein, 9 aa, Homo Sapiens
EKHLMEKKI

SEQ ID NO: 1270567 - protein, 9 aa, Homo Sapiens
TKILSLLCL

SEQ ID NO: 1270568 - protein, 9 aa, Homo Sapiens
ANLATALQN

SEQ ID NO: 1270569 - protein, 9 aa, Homo Sapiens
IPVVRRLDR

SEQ ID NO: 1270570 - protein, 9 aa, Homo Sapiens
GGPCLPRRA

SEQ ID NO: 1270571 - protein, 9 aa, Homo Sapiens
APGCAGAYL

SEQ ID NO: 1270572 - protein, 9 aa, Homo Sapiens
HMKPLQMAR

SEQ ID NO: 1270573 - protein, 9 aa, Homo Sapiens
EHRRVVIEV

SEQ ID NO: 1270574 - protein, 9 aa, Homo Sapiens
LHQPEMAAM

SEQ ID NO: 1270575 - protein, 9 aa, Homo Sapiens
AHQRTGRQH

SEQ ID NO: 1270576 - protein, 9 aa, Homo Sapiens
GPCRAVGLW

SEQ ID NO: 1270577 - protein, 9 aa, Homo Sapiens
VAVDAQVGP

SEQ ID NO: 1270578 - protein, 9 aa, Homo Sapiens
FSSTPGSSS

SEQ ID NO: 1270579 - protein, 9 aa, Homo Sapiens
EVRGEWRQG

SEQ ID NO: 1270580 - protein, 9 aa, Homo Sapiens
PPLALATPT

SEQ ID NO: 1270581 - protein, 9 aa, Homo Sapiens
SDSVCNSGV

SEQ ID NO: 1270582 - protein, 9 aa, Homo Sapiens
YRRPTMAKV

SEQ ID NO: 1270583 - protein, 9 aa, Homo Sapiens
RHQLFVVMM

SEQ ID NO: 1270584 - protein, 9 aa, Homo Sapiens
GERTCSWTI

SEQ ID NO: 1270585 - protein, 9 aa, Homo Sapiens
VTAQALYQL

SEQ ID NO: 1270586 - protein, 9 aa, Homo Sapiens
QSQEHVEML

SEQ ID NO: 1270587 - protein, 9 aa, Homo Sapiens
FNLPRLCIW

SEQ ID NO: 1270588 - protein, 9 aa, Homo Sapiens
DGAHVWLLP

SEQ ID NO: 1270589 - protein, 9 aa, Homo Sapiens
SKALVSNFI

SEQ ID NO: 1270590 - protein, 9 aa, Homo Sapiens
APPKVSPPS

SEQ ID NO: 1270591 - protein, 9 aa, Homo Sapiens
IIEGKLVDR

SEQ ID NO: 1270592 - protein, 9 aa, Homo Sapiens
ALVGPHARV

SEQ ID NO: 1270593 - protein, 9 aa, Homo Sapiens
AYCSLSFPG

SEQ ID NO: 1270594 - protein, 9 aa, Homo Sapiens
RMYVYVLTV

SEQ ID NO: 1270595 - protein, 9 aa, Homo Sapiens
SLSNTSTQS

SEQ ID NO: 1270596 - protein, 9 aa, Homo Sapiens
GVAVDAQVG

SEQ ID NO: 1270597 - protein, 9 aa, Homo Sapiens
EAKAITSVN

SEQ ID NO: 1270598 - protein, 9 aa, Homo Sapiens
SRVAGTAGA

SEQ ID NO: 1270599 - protein, 9 aa, Homo Sapiens
HPQKLQDNF

SEQ ID NO: 1270600 - protein, 9 aa, Homo Sapiens
FQALSPSLR

SEQ ID NO: 1270601 - protein, 9 aa, Homo Sapiens
IQLFFSVFV

SEQ ID NO: 1270602 - protein, 9 aa, Homo Sapiens
SSLGEHTFF

SEQ ID NO: 1270603 - protein, 9 aa, Homo Sapiens
DGMQRRVLF

SEQ ID NO: 1270604 - protein, 9 aa, Homo Sapiens
RRAQGHPAL

SEQ ID NO: 1270605 - protein, 9 aa, Homo Sapiens
PPTTCEEVP

SEQ ID NO: 1270606 - protein, 9 aa, Homo Sapiens
GMRASRCLN

SEQ ID NO: 1270607 - protein, 9 aa, Homo Sapiens
SGRDREARA

SEQ ID NO: 1270608 - protein, 9 aa, Homo Sapiens
LGEPTPLPL

SEQ ID NO: 1270609 - protein, 9 aa, Homo Sapiens
CLNLGRPYR

SEQ ID NO: 1270610 - protein, 9 aa, Homo Sapiens
AHARHRHVL

SEQ ID NO: 1270611 - protein, 9 aa, Homo Sapiens
SSLHLFSSI

SEQ ID NO: 1270612 - protein, 9 aa, Homo Sapiens
ANCCHHWSK

SEQ ID NO: 1270613 - protein, 9 aa, Homo Sapiens
GSASLFHRR

SEQ ID NO: 1270614 - protein, 9 aa, Homo Sapiens
RHRHVLPAP

SEQ ID NO: 1270615 - protein, 9 aa, Homo Sapiens
THTQAHRHT

SEQ ID NO: 1270616 - protein, 9 aa, Homo Sapiens
GSWPVAQRM

SEQ ID NO: 1270617 - protein, 9 aa, Homo Sapiens
QKPHRRGMA

SEQ ID NO: 1270618 - protein, 9 aa, Homo Sapiens
LGMAPLGIT

SEQ ID NO: 1270619 - protein, 9 aa, Homo Sapiens
AHVWLLPGM

SEQ ID NO: 1270620 - protein, 9 aa, Homo Sapiens
SLKKFLSVM

SEQ ID NO: 1270621 - protein, 9 aa, Homo Sapiens
KDSQGVILV

SEQ ID NO: 1270622 - protein, 9 aa, Homo Sapiens
EFSSLLSLT

SEQ ID NO: 1270623 - protein, 9 aa, Homo Sapiens
ELDTPFRKP

SEQ ID NO: 1270624 - protein, 9 aa, Homo Sapiens
LPEVTWMAR

SEQ ID NO: 1270625 - protein, 9 aa, Homo Sapiens
TMSSAWPPT

SEQ ID NO: 1270626 - protein, 9 aa, Homo Sapiens
MQRRVLFET

SEQ ID NO: 1270627 - protein, 9 aa, Homo Sapiens
YLEIIILVG

SEQ ID NO: 1270628 - protein, 9 aa, Homo Sapiens
EGRRPLFQK

SEQ ID NO: 1270629 - protein, 9 aa, Homo Sapiens
KECIGASNQ

SEQ ID NO: 1270630 - protein, 9 aa, Homo Sapiens
LQQASPSRD

SEQ ID NO: 1270631 - protein, 9 aa, Homo Sapiens
AERAEFSSL

SEQ ID NO: 1270632 - protein, 9 aa, Homo Sapiens
EFSPFRWLL

SEQ ID NO: 1270633 - protein, 9 aa, Homo Sapiens
SLFHRRRAQ

SEQ ID NO: 1270634 - protein, 9 aa, Homo Sapiens
YFGFDTNTE

SEQ ID NO: 1270635 - protein, 9 aa, Homo Sapiens
HRVTAQALY

SEQ ID NO: 1270636 - protein, 9 aa, Homo Sapiens
PTRRPPAPT

SEQ ID NO: 1270637 - protein, 9 aa, Homo Sapiens
FLLCEYLLY

SEQ ID NO: 1270638 - protein, 9 aa, Homo Sapiens
GGSPVGDVG

SEQ ID NO: 1270639 - protein, 9 aa, Homo Sapiens
PAPALPSQF

SEQ ID NO: 1270640 - protein, 9 aa, Homo Sapiens
IECDDIDML

SEQ ID NO: 1270641 - protein, 9 aa, Homo Sapiens
PPKVSPPSP

SEQ ID NO: 1270642 - protein, 9 aa, Homo Sapiens
MAGPSASLH

SEQ ID NO: 1270643 - protein, 9 aa, Homo Sapiens
AEGTAGHRS

SEQ ID NO: 1270644 - protein, 9 aa, Homo Sapiens
TQPQPPVKV

SEQ ID NO: 1270645 - protein, 9 aa, Homo Sapiens
TFDRFHAHV

SEQ ID NO: 1270646 - protein, 9 aa, Homo Sapiens
NENESYDAV

SEQ ID NO: 1270647 - protein, 9 aa, Homo Sapiens
SYFLSFYNG

SEQ ID NO: 1270648 - protein, 9 aa, Homo Sapiens
SRQHIVCLN

SEQ ID NO: 1270649 - protein, 9 aa, Homo Sapiens
YHFRLLTDE

SEQ ID NO: 1270650 - protein, 9 aa, Homo Sapiens
LLPGMGPHV

SEQ ID NO: 1270651 - protein, 9 aa, Homo Sapiens
FIPRKDIKH

SEQ ID NO: 1270652 - protein, 9 aa, Homo Sapiens
ERWSLAGIG

SEQ ID NO: 1270653 - protein, 9 aa, Homo Sapiens
PRSSRRLPG

SEQ ID NO: 1270654 - protein, 9 aa, Homo Sapiens
HRLGQRLGP

SEQ ID NO: 1270655 - protein, 9 aa, Homo Sapiens
HAEPGPGEV

SEQ ID NO: 1270656 - protein, 9 aa, Homo Sapiens
WGQLLLLLL

SEQ ID NO: 1270657 - protein, 9 aa, Homo Sapiens
TANCCHHWS

SEQ ID NO: 1270658 - protein, 9 aa, Homo Sapiens
TTLSVRPCS

SEQ ID NO: 1270659 - protein, 9 aa, Homo Sapiens
SEGGPEAPS

SEQ ID NO: 1270660 - protein, 9 aa, Homo Sapiens
APALPSQFS

SEQ ID NO: 1270661 - protein, 9 aa, Homo Sapiens
VKRKYHLCV

SEQ ID NO: 1270662 - protein, 9 aa, Homo Sapiens
CTDDEGPVR

SEQ ID NO: 1270663 - protein, 9 aa, Homo Sapiens
IDTHTARPH

SEQ ID NO: 1270664 - protein, 9 aa, Homo Sapiens
ARGHLLVVQ

SEQ ID NO: 1270665 - protein, 9 aa, Homo Sapiens
PRMSDNAPA

SEQ ID NO: 1270666 - protein, 9 aa, Homo Sapiens
ANEAKGKVE

SEQ ID NO: 1270667 - protein, 9 aa, Homo Sapiens
QPCLPPTTC

SEQ ID NO: 1270668 - protein, 9 aa, Homo Sapiens
NQIIVNTVN

SEQ ID NO: 1270669 - protein, 9 aa, Homo Sapiens
QCTQGRRWG

SEQ ID NO: 1270670 - protein, 9 aa, Homo Sapiens
SVHVESGKV

SEQ ID NO: 1270671 - protein, 9 aa, Homo Sapiens
QALQQASPS

SEQ ID NO: 1270672 - protein, 9 aa, Homo Sapiens
QPNGEVLLS

SEQ ID NO: 1270673 - protein, 9 aa, Homo Sapiens
ASLSNTSTQ

SEQ ID NO: 1270674 - protein, 9 aa, Homo Sapiens
NTLRQQQQQ

SEQ ID NO: 1270675 - protein, 9 aa, Homo Sapiens
QVREHVLEE

SEQ ID NO: 1270676 - protein, 9 aa, Homo Sapiens
LELQPPGDC

SEQ ID NO: 1270677 - protein, 9 aa, Homo Sapiens
GCGSRAPGC

SEQ ID NO: 1270678 - protein, 9 aa, Homo Sapiens
TGVQPSAGY

SEQ ID NO: 1270679 - protein, 9 aa, Homo Sapiens
VLLSSLLLG

SEQ ID NO: 1270680 - protein, 9 aa, Homo Sapiens
APRHRGGRM

SEQ ID NO: 1270681 - protein, 9 aa, Homo Sapiens
GRPTHQLLQ

SEQ ID NO: 1270682 - protein, 9 aa, Homo Sapiens
VCIMPLVAF

SEQ ID NO: 1270683 - protein, 9 aa, Homo Sapiens
IHCKAGKGL

SEQ ID NO: 1270684 - protein, 9 aa, Homo Sapiens
TVMNENESY

SEQ ID NO: 1270685 - protein, 9 aa, Homo Sapiens
AADTLPYTA

SEQ ID NO: 1270686 - protein, 9 aa, Homo Sapiens
PVSHFAKWS

SEQ ID NO: 1270687 - protein, 9 aa, Homo Sapiens
RQPAQRRVQ

SEQ ID NO: 1270688 - protein, 9 aa, Homo Sapiens
CKAGKGLTG

SEQ ID NO: 1270689 - protein, 9 aa, Homo Sapiens
RKHCVEQGK

SEQ ID NO: 1270690 - protein, 9 aa, Homo Sapiens
VAELALVGP

SEQ ID NO: 1270691 - protein, 9 aa, Homo Sapiens
KFSQDVYSV

SEQ ID NO: 1270692 - protein, 9 aa, Homo Sapiens
RNTICHLQQ

SEQ ID NO: 1270693 - protein, 9 aa, Homo Sapiens
EVPWPEVWK

SEQ ID NO: 1270694 - protein, 9 aa, Homo Sapiens
DIVAEGQTP

SEQ ID NO: 1270695 - protein, 9 aa, Homo Sapiens
DTTASEYKY

SEQ ID NO: 1270696 - protein, 9 aa, Homo Sapiens
MKPLQMARP

SEQ ID NO: 1270697 - protein, 9 aa, Homo Sapiens
LSIFAYPHT

SEQ ID NO: 1270698 - protein, 9 aa, Homo Sapiens
QLRHRLGQR

SEQ ID NO: 1270699 - protein, 9 aa, Homo Sapiens
LDFKKQSAD

SEQ ID NO: 1270700 - protein, 9 aa, Homo Sapiens
PPSWSAMHN

SEQ ID NO: 1270701 - protein, 9 aa, Homo Sapiens
SPWRPKTRR

SEQ ID NO: 1270702 - protein, 9 aa, Homo Sapiens
KRPSVSRIC

SEQ ID NO: 1270703 - protein, 9 aa, Homo Sapiens
DVYSVVISE

SEQ ID NO: 1270704 - protein, 9 aa, Homo Sapiens
HSTLRPWPR

SEQ ID NO: 1270705 - protein, 9 aa, Homo Sapiens
CVLGDKGIP

SEQ ID NO: 1270706 - protein, 9 aa, Homo Sapiens
APTKHSRKK

SEQ ID NO: 1270707 - protein, 9 aa, Homo Sapiens
TQSTPWMTG

SEQ ID NO: 1270708 - protein, 9 aa, Homo Sapiens
LGVAVDAQV

SEQ ID NO: 1270709 - protein, 9 aa, Homo Sapiens
KQRVLSTGR

SEQ ID NO: 1270710 - protein, 9 aa, Homo Sapiens
VAEAPRLHP

SEQ ID NO: 1270711 - protein, 9 aa, Homo Sapiens
LGDNSDYDY

SEQ ID NO: 1270712 - protein, 9 aa, Homo Sapiens
LSFYNGNGW

SEQ ID NO: 1270713 - protein, 9 aa, Homo Sapiens
PPTVTIWMC

SEQ ID NO: 1270714 - protein, 9 aa, Homo Sapiens
NGNGWKGNP

SEQ ID NO: 1270715 - protein, 9 aa, Homo Sapiens
DPTKADWLA

SEQ ID NO: 1270716 - protein, 9 aa, Homo Sapiens
VVLRLDGSQ

SEQ ID NO: 1270717 - protein, 9 aa, Homo Sapiens
GPYVEALTM

SEQ ID NO: 1270718 - protein, 9 aa, Homo Sapiens
WKLIKTPQL

SEQ ID NO: 1270719 - protein, 9 aa, Homo Sapiens
FGKVQGNND

SEQ ID NO: 1270720 - protein, 9 aa, Homo Sapiens
SVLTALGRS

SEQ ID NO: 1270721 - protein, 9 aa, Homo Sapiens
FAQHQRCHT

SEQ ID NO: 1270722 - protein, 9 aa, Homo Sapiens
LPSQFSSTP

SEQ ID NO: 1270723 - protein, 9 aa, Homo Sapiens
VILMPQPPK

SEQ ID NO: 1270724 - protein, 9 aa, Homo Sapiens
QVLLQVSAY

SEQ ID NO: 1270725 - protein, 9 aa, Homo Sapiens
SASHEYHIV

SEQ ID NO: 1270726 - protein, 9 aa, Homo Sapiens
RSNSGVWLD

SEQ ID NO: 1270727 - protein, 9 aa, Homo Sapiens
GRRPLFQKT

SEQ ID NO: 1270728 - protein, 9 aa, Homo Sapiens
SDRRKPPRY

SEQ ID NO: 1270729 - protein, 9 aa, Homo Sapiens
LVSLCSSLH

SEQ ID NO: 1270730 - protein, 9 aa, Homo Sapiens
NNQIIVNTV

SEQ ID NO: 1270731 - protein, 9 aa, Homo Sapiens
HCMAHKLFN

SEQ ID NO: 1270732 - protein, 9 aa, Homo Sapiens
LLSSLLLGH

SEQ ID NO: 1270733 - protein, 9 aa, Homo Sapiens
HRHRHTLTQ

SEQ ID NO: 1270734 - protein, 9 aa, Homo Sapiens
YCHRALLLP

SEQ ID NO: 1270735 - protein, 9 aa, Homo Sapiens
AYSKDSQPN

SEQ ID NO: 1270736 - protein, 9 aa, Homo Sapiens
SGGVDSKDK

SEQ ID NO: 1270737 - protein, 9 aa, Homo Sapiens
YWLDEPKNP

SEQ ID NO: 1270738 - protein, 9 aa, Homo Sapiens
RASRCLNLG

SEQ ID NO: 1270739 - protein, 9 aa, Homo Sapiens
TLPYTATTA

SEQ ID NO: 1270740 - protein, 9 aa, Homo Sapiens
GGTGHIINK

SEQ ID NO: 1270741 - protein, 9 aa, Homo Sapiens
NVHRVTAQA

SEQ ID NO: 1270742 - protein, 9 aa, Homo Sapiens
FYTAIVAVV

SEQ ID NO: 1270743 - protein, 9 aa, Homo Sapiens
RRLRHSTLR

SEQ ID NO: 1270744 - protein, 9 aa, Homo Sapiens
SLMTSTFTS

SEQ ID NO: 1270745 - protein, 9 aa, Homo Sapiens
TFSFLVFRF

SEQ ID NO: 1270746 - protein, 9 aa, Homo Sapiens
VVVHELGVA

SEQ ID NO: 1270747 - protein, 9 aa, Homo Sapiens
RGEWRQGGS

SEQ ID NO: 1270748 - protein, 9 aa, Homo Sapiens
HSWPQRPET

SEQ ID NO: 1270749 - protein, 9 aa, Homo Sapiens
QWSHFQRVK

SEQ ID NO: 1270750 - protein, 9 aa, Homo Sapiens
RELEELRKC

SEQ ID NO: 1270751 - protein, 9 aa, Homo Sapiens
MHLRSIRTN

SEQ ID NO: 1270752 - protein, 9 aa, Homo Sapiens
FRLLTDEIV

SEQ ID NO: 1270753 - protein, 9 aa, Homo Sapiens
IVNTVNQKK

SEQ ID NO: 1270754 - protein, 9 aa, Homo Sapiens
REQHFYESL

SEQ ID NO: 1270755 - protein, 9 aa, Homo Sapiens
FWMLTCTTL

SEQ ID NO: 1270756 - protein, 9 aa, Homo Sapiens
MLRVNEYCF

SEQ ID NO: 1270757 - protein, 9 aa, Homo Sapiens
RQHIVCLNS

SEQ ID NO: 1270758 - protein, 9 aa, Homo Sapiens
HKKYPAWDA

SEQ ID NO: 1270759 - protein, 9 aa, Homo Sapiens
ASTSWCSAA

SEQ ID NO: 1270760 - protein, 9 aa, Homo Sapiens
ASRAQRHAG

SEQ ID NO: 1270761 - protein, 9 aa, Homo Sapiens
EVIREGWRW

SEQ ID NO: 1270762 - protein, 9 aa, Homo Sapiens
SWVQVILMP

SEQ ID NO: 1270763 - protein, 9 aa, Homo Sapiens
TTASEYKYV

SEQ ID NO: 1270764 - protein, 9 aa, Homo Sapiens
VPCTPQHCP

SEQ ID NO: 1270765 - protein, 9 aa, Homo Sapiens
FMPCLYINR

SEQ ID NO: 1270766 - protein, 9 aa, Homo Sapiens
AMFLLEFLL

SEQ ID NO: 1270767 - protein, 9 aa, Homo Sapiens
VDLEDWEEL

SEQ ID NO: 1270768 - protein, 9 aa, Homo Sapiens
LYGSYPPAR

SEQ ID NO: 1270769 - protein, 9 aa, Homo Sapiens
AMSAIEMID

SEQ ID NO: 1270770 - protein, 9 aa, Homo Sapiens
FWLIFIVDV

SEQ ID NO: 1270771 - protein, 9 aa, Homo Sapiens
PGCAGAYLD

SEQ ID NO: 1270772 - protein, 9 aa, Homo Sapiens
TLSVRPCSV

SEQ ID NO: 1270773 - protein, 9 aa, Homo Sapiens
CRVASLQGI

SEQ ID NO: 1270774 - protein, 9 aa, Homo Sapiens
LGALDKTGG

SEQ ID NO: 1270775 - protein, 9 aa, Homo Sapiens
TFGSAHLYR

SEQ ID NO: 1270776 - protein, 9 aa, Homo Sapiens
TVARHQLFV

SEQ ID NO: 1270777 - protein, 9 aa, Homo Sapiens
IEVALAPRH

SEQ ID NO: 1270778 - protein, 9 aa, Homo Sapiens
PQKLQDNFE

SEQ ID NO: 1270779 - protein, 9 aa, Homo Sapiens
ADGCGSRAP

SEQ ID NO: 1270780 - protein, 9 aa, Homo Sapiens
LRRRDPGWE

SEQ ID NO: 1270781 - protein, 9 aa, Homo Sapiens
QPPGDCPRT

SEQ ID NO: 1270782 - protein, 9 aa, Homo Sapiens
ESYDAVQHC

SEQ ID NO: 1270783 - protein, 9 aa, Homo Sapiens
LLQVSAYSK

SEQ ID NO: 1270784 - protein, 9 aa, Homo Sapiens
KRQEESQHE

SEQ ID NO: 1270785 - protein, 9 aa, Homo Sapiens
TLEPGPTWC

SEQ ID NO: 1270786 - protein, 9 aa, Homo Sapiens
EVAEAPRLH

SEQ ID NO: 1270787 - protein, 9 aa, Homo Sapiens
DTESASGQA

SEQ ID NO: 1270788 - protein, 9 aa, Homo Sapiens
GEADLADGA

SEQ ID NO: 1270789 - protein, 9 aa, Homo Sapiens
HVESGKVYA

SEQ ID NO: 1270790 - protein, 9 aa, Homo Sapiens
EVALAPRHR

SEQ ID NO: 1270791 - protein, 9 aa, Homo Sapiens
ALKEIPSKL

SEQ ID NO: 1270792 - protein, 9 aa, Homo Sapiens
LLLGDNSDY

SEQ ID NO: 1270793 - protein, 9 aa, Homo Sapiens
PQGVQVRTS

SEQ ID NO: 1270794 - protein, 9 aa, Homo Sapiens
PRPQLSLTL

SEQ ID NO: 1270795 - protein, 9 aa, Homo Sapiens
QEALQVLLQ

SEQ ID NO: 1270796 - protein, 9 aa, Homo Sapiens
GDALPVCLG

SEQ ID NO: 1270797 - protein, 9 aa, Homo Sapiens
IWVERAIPN

SEQ ID NO: 1270798 - protein, 9 aa, Homo Sapiens
AAEVLVHVH

SEQ ID NO: 1270799 - protein, 9 aa, Homo Sapiens
LLRQLGKGT

SEQ ID NO: 1270800 - protein, 9 aa, Homo Sapiens
ALGRSQGLP

SEQ ID NO: 1270801 - protein, 9 aa, Homo Sapiens
NDTLTSTLM

SEQ ID NO: 1270802 - protein, 9 aa, Homo Sapiens
WRRKRYALT

SEQ ID NO: 1270803 - protein, 9 aa, Homo Sapiens
PWMTGVQPS

SEQ ID NO: 1270804 - protein, 9 aa, Homo Sapiens
DYFYLEIFD

SEQ ID NO: 1270805 - protein, 9 aa, Homo Sapiens
TNDTESDTN

SEQ ID NO: 1270806 - protein, 9 aa, Homo Sapiens
HPRMSDNAP

SEQ ID NO: 1270807 - protein, 9 aa, Homo Sapiens
RQHPPPAKH

SEQ ID NO: 1270808 - protein, 9 aa, Homo Sapiens
MDPPSLMTS

SEQ ID NO: 1270809 - protein, 9 aa, Homo Sapiens
PWVEYCEFL

SEQ ID NO: 1270810 - protein, 9 aa, Homo Sapiens
RAQRHAGHR

SEQ ID NO: 1270811 - protein, 9 aa, Homo Sapiens
SILLDEGED

SEQ ID NO: 1270812 - protein, 9 aa, Homo Sapiens
HPACAVSSR

SEQ ID NO: 1270813 - protein, 9 aa, Homo Sapiens
LLTQPSPAS

SEQ ID NO: 1270814 - protein, 9 aa, Homo Sapiens
LGPGGVIPA

SEQ ID NO: 1270815 - protein, 9 aa, Homo Sapiens
CRTFRVCLK

SEQ ID NO: 1270816 - protein, 9 aa, Homo Sapiens
MGQVQSQEH

SEQ ID NO: 1270817 - protein, 9 aa, Homo Sapiens
ALHGQPASR

SEQ ID NO: 1270818 - protein, 9 aa, Homo Sapiens
HVLPAPLAR

SEQ ID NO: 1270819 - protein, 9 aa, Homo Sapiens
QGRPTHQLL

SEQ ID NO: 1270820 - protein, 9 aa, Homo Sapiens
PLELQPPGD

SEQ ID NO: 1270821 - protein, 9 aa, Homo Sapiens
AHCSTGSSC

SEQ ID NO: 1270822 - protein, 9 aa, Homo Sapiens
KKFLSVMEA

SEQ ID NO: 1270823 - protein, 9 aa, Homo Sapiens
FQLVLPGEA

SEQ ID NO: 1270824 - protein, 9 aa, Homo Sapiens
HSRKKMAAL

SEQ ID NO: 1270825 - protein, 9 aa, Homo Sapiens
CSVTVWCCR

SEQ ID NO: 1270826 - protein, 9 aa, Homo Sapiens
SSLLLGHIW

SEQ ID NO: 1270827 - protein, 9 aa, Homo Sapiens
TPHHPLKAP

SEQ ID NO: 1270828 - protein, 9 aa, Homo Sapiens
YQLEKWETL

SEQ ID NO: 1270829 - protein, 9 aa, Homo Sapiens
HTHRHRHTL

SEQ ID NO: 1270830 - protein, 9 aa, Homo Sapiens
EESYPYIRT

SEQ ID NO: 1270831 - protein, 9 aa, Homo Sapiens
AEPPPPPEQ

SEQ ID NO: 1270832 - protein, 9 aa, Homo Sapiens
NFVKIARNN

SEQ ID NO: 1270833 - protein, 9 aa, Homo Sapiens
CTDTESASG

SEQ ID NO: 1270834 - protein, 9 aa, Homo Sapiens
VNQKKAKIK

SEQ ID NO: 1270835 - protein, 9 aa, Homo Sapiens
RVVCDPQGI

SEQ ID NO: 1270836 - protein, 9 aa, Homo Sapiens
TGRQHPPPA

SEQ ID NO: 1270837 - protein, 9 aa, Homo Sapiens
LRHSTLRPW

SEQ ID NO: 1270838 - protein, 9 aa, Homo Sapiens
QGHPALHQC

SEQ ID NO: 1270839 - protein, 9 aa, Homo Sapiens
GPLELQPPG

SEQ ID NO: 1270840 - protein, 9 aa, Homo Sapiens
FLLEFLLPL

SEQ ID NO: 1270841 - protein, 9 aa, Homo Sapiens
LNMEPCCCR

SEQ ID NO: 1270842 - protein, 9 aa, Homo Sapiens
RPTMAKVVN

SEQ ID NO: 1270843 - protein, 9 aa, Homo Sapiens
ELMNVLELW

SEQ ID NO: 1270844 - protein, 9 aa, Homo Sapiens
QSFLLCEYL

SEQ ID NO: 1270845 - protein, 9 aa, Homo Sapiens
SRICRQKIL

SEQ ID NO: 1270846 - protein, 9 aa, Homo Sapiens
RAPGCAGAY

SEQ ID NO: 1270847 - protein, 9 aa, Homo Sapiens
EEESYPYIR

SEQ ID NO: 1270848 - protein, 9 aa, Homo Sapiens
VSHFAKWSG

SEQ ID NO: 1270849 - protein, 9 aa, Homo Sapiens
VTWMKRRRR

SEQ ID NO: 1270850 - protein, 9 aa, Homo Sapiens
LWGTGVCLH

SEQ ID NO: 1270851 - protein, 9 aa, Homo Sapiens
IHLPGQWSH

SEQ ID NO: 1270852 - protein, 9 aa, Homo Sapiens
ADWLASRLK

SEQ ID NO: 1270853 - protein, 9 aa, Homo Sapiens
PTQTAAGRP

SEQ ID NO: 1270854 - protein, 9 aa, Homo Sapiens
LKEDKWYSE

SEQ ID NO: 1270855 - protein, 9 aa, Homo Sapiens
SSTPGSSSQ

SEQ ID NO: 1270856 - protein, 9 aa, Homo Sapiens
RLQEALQVL

SEQ ID NO: 1270857 - protein, 9 aa, Homo Sapiens
PSPSRTSSA

SEQ ID NO: 1270858 - protein, 9 aa, Homo Sapiens
VSHIETAPF

SEQ ID NO: 1270859 - protein, 9 aa, Homo Sapiens
LVDAMNYRL

SEQ ID NO: 1270860 - protein, 9 aa, Homo Sapiens
GHIINKNNR

SEQ ID NO: 1270861 - protein, 9 aa, Homo Sapiens
PCTPQHCPP

SEQ ID NO: 1270862 - protein, 9 aa, Homo Sapiens
LTHEILAGF

SEQ ID NO: 1270863 - protein, 9 aa, Homo Sapiens
TVHGLLRQL

SEQ ID NO: 1270864 - protein, 9 aa, Homo Sapiens
VADGALLRG

SEQ ID NO: 1270865 - protein, 9 aa, Homo Sapiens
RTVTVPAGI

SEQ ID NO: 1270866 - protein, 9 aa, Homo Sapiens
SEEGRRPLF

SEQ ID NO: 1270867 - protein, 9 aa, Homo Sapiens
GSPQGVQVR

SEQ ID NO: 1270868 - protein, 9 aa, Homo Sapiens
GAEGIFLTG

SEQ ID NO: 1270869 - protein, 9 aa, Homo Sapiens
GQPCLPPTT

SEQ ID NO: 1270870 - protein, 9 aa, Homo Sapiens
GFLKIKHSS

SEQ ID NO: 1270871 - protein, 9 aa, Homo Sapiens
LNDLLSIFA

SEQ ID NO: 1270872 - protein, 9 aa, Homo Sapiens
TKGHDEAKI

SEQ ID NO: 1270873 - protein, 9 aa, Homo Sapiens
KKSYEYTTL

SEQ ID NO: 1270874 - protein, 9 aa, Homo Sapiens
SGAELVGFQ

SEQ ID NO: 1270875 - protein, 9 aa, Homo Sapiens
RLAARQPAQ

SEQ ID NO: 1270876 - protein, 9 aa, Homo Sapiens
RRRAQGHPA

SEQ ID NO: 1270877 - protein, 9 aa, Homo Sapiens
WCGGAHGLS

SEQ ID NO: 1270878 - protein, 9 aa, Homo Sapiens
CLSLTMSSA

SEQ ID NO: 1270879 - protein, 9 aa, Homo Sapiens
SMSEDSDSS

SEQ ID NO: 1270880 - protein, 9 aa, Homo Sapiens
PTPLPLPTS

SEQ ID NO: 1270881 - protein, 9 aa, Homo Sapiens
GATPTSPVS

SEQ ID NO: 1270882 - protein, 9 aa, Homo Sapiens
QRRLRHSTL

SEQ ID NO: 1270883 - protein, 9 aa, Homo Sapiens
RAAVAAAPR

SEQ ID NO: 1270884 - protein, 9 aa, Homo Sapiens
SQFSSTPGS

SEQ ID NO: 1270885 - protein, 9 aa, Homo Sapiens
QAYTHTQVH

SEQ ID NO: 1270886 - protein, 9 aa, Homo Sapiens
VSPPSPTIP

SEQ ID NO: 1270887 - protein, 9 aa, Homo Sapiens
QLSLTLPQL

SEQ ID NO: 1270888 - protein, 9 aa, Homo Sapiens
RPPRQVREH

SEQ ID NO: 1270889 - protein, 9 aa, Homo Sapiens
RKPPRYGTA

SEQ ID NO: 1270890 - protein, 9 aa, Homo Sapiens
LPDGQSLPQ

SEQ ID NO: 1270891 - protein, 9 aa, Homo Sapiens
EMAAMRLMP

SEQ ID NO: 1270892 - protein, 9 aa, Homo Sapiens
PNRHATLMD

SEQ ID NO: 1270893 - protein, 9 aa, Homo Sapiens
SSKPSFMPC

SEQ ID NO: 1270894 - protein, 9 aa, Homo Sapiens
IQWPTVHGL

SEQ ID NO: 1270895 - protein, 9 aa, Homo Sapiens
VQFQFEMES

SEQ ID NO: 1270896 - protein, 9 aa, Homo Sapiens
PPSLHPACA

SEQ ID NO: 1270897 - protein, 9 aa, Homo Sapiens
RVVIEVALA

SEQ ID NO: 1270898 - protein, 9 aa, Homo Sapiens
PIRFEVGPR

SEQ ID NO: 1270899 - protein, 9 aa, Homo Sapiens
TKEEVNHYH

SEQ ID NO: 1270900 - protein, 9 aa, Homo Sapiens
HDLAPTKHS

SEQ ID NO: 1270901 - protein, 9 aa, Homo Sapiens
DASREDSGS

SEQ ID NO: 1270902 - protein, 9 aa, Homo Sapiens
KRSDLIEKR

SEQ ID NO: 1270903 - protein, 9 aa, Homo Sapiens
RPCVKTWAS

SEQ ID NO: 1270904 - protein, 9 aa, Homo Sapiens
PPPPLPLSA

SEQ ID NO: 1270905 - protein, 9 aa, Homo Sapiens
LKLTALVDL

SEQ ID NO: 1270906 - protein, 9 aa, Homo Sapiens
PCLYINRRL

SEQ ID NO: 1270907 - protein, 9 aa, Homo Sapiens
KNFVKIARN

SEQ ID NO: 1270908 - protein, 9 aa, Homo Sapiens
IHDGHEEKT

SEQ ID NO: 1270909 - protein, 9 aa, Homo Sapiens
HGLLRQLGK

SEQ ID NO: 1270910 - protein, 9 aa, Homo Sapiens
QHDTRPEMR

SEQ ID NO: 1270911 - protein, 9 aa, Homo Sapiens
AVVASSSGG

SEQ ID NO: 1270912 - protein, 9 aa, Homo Sapiens
RGHLLVVQL

SEQ ID NO: 1270913 - protein, 9 aa, Homo Sapiens
TQVHTQTHT

SEQ ID NO: 1270914 - protein, 9 aa, Homo Sapiens
NATCWQPWP

SEQ ID NO: 1270915 - protein, 9 aa, Homo Sapiens
GLDSEEGRR

SEQ ID NO: 1270916 - protein, 9 aa, Homo Sapiens
LLLGHIWVE

SEQ ID NO: 1270917 - protein, 9 aa, Homo Sapiens
TVNQKKAKI

SEQ ID NO: 1270918 - protein, 9 aa, Homo Sapiens
MELPVGCRP

SEQ ID NO: 1270919 - protein, 9 aa, Homo Sapiens
LDSGCGFCC

SEQ ID NO: 1270920 - protein, 9 aa, Homo Sapiens
KPLQMARPG

SEQ ID NO: 1270921 - protein, 9 aa, Homo Sapiens
TQGRRWGAW

SEQ ID NO: 1270922 - protein, 9 aa, Homo Sapiens
VKECIGASN

SEQ ID NO: 1270923 - protein, 9 aa, Homo Sapiens
SACTMPPLL

SEQ ID NO: 1270924 - protein, 9 aa, Homo Sapiens
VGLWGTGVC

SEQ ID NO: 1270925 - protein, 9 aa, Homo Sapiens
NSGVWLDGY

SEQ ID NO: 1270926 - protein, 9 aa, Homo Sapiens
IRNTICHLQ

SEQ ID NO: 1270927 - protein, 9 aa, Homo Sapiens
DQQNGQRNQ

SEQ ID NO: 1270928 - protein, 9 aa, Homo Sapiens
SSRRLPGAE

SEQ ID NO: 1270929 - protein, 9 aa, Homo Sapiens
VPPGVDYFY

SEQ ID NO: 1270930 - protein, 9 aa, Homo Sapiens
SASLHPASG

SEQ ID NO: 1270931 - protein, 9 aa, Homo Sapiens
SGQFARTPG

SEQ ID NO: 1270932 - protein, 9 aa, Homo Sapiens
KGGATENTS

SEQ ID NO: 1270933 - protein, 9 aa, Homo Sapiens
GDVGLGVQV

SEQ ID NO: 1270934 - protein, 9 aa, Homo Sapiens
LKREKVKDM

SEQ ID NO: 1270935 - protein, 9 aa, Homo Sapiens
DTNTEGCIL

SEQ ID NO: 1270936 - protein, 9 aa, Homo Sapiens
ARELLMNGS

SEQ ID NO: 1270937 - protein, 9 aa, Homo Sapiens
KKQSADQCK

SEQ ID NO: 1270938 - protein, 9 aa, Homo Sapiens
APPSLRAAR

SEQ ID NO: 1270939 - protein, 9 aa, Homo Sapiens
PGVDYFYLE

SEQ ID NO: 1270940 - protein, 9 aa, Homo Sapiens
LFFSVFVLF

SEQ ID NO: 1270941 - protein, 9 aa, Homo Sapiens
EVLLRRLQE

SEQ ID NO: 1270942 - protein, 9 aa, Homo Sapiens
QAIQVHQAL

SEQ ID NO: 1270943 - protein, 9 aa, Homo Sapiens
ALHQCLSLT

SEQ ID NO: 1270944 - protein, 9 aa, Homo Sapiens
YVEALTMNI

SEQ ID NO: 1270945 - protein, 9 aa, Homo Sapiens
AQMCASLSL

SEQ ID NO: 1270946 - protein, 9 aa, Homo Sapiens
GHRSLPMAL

SEQ ID NO: 1270947 - protein, 9 aa, Homo Sapiens
PCLPPTTCE

SEQ ID NO: 1270948 - protein, 9 aa, Homo Sapiens
TLSSSKEKS

SEQ ID NO: 1270949 - protein, 9 aa, Homo Sapiens
TSGRAQGRR

SEQ ID NO: 1270950 - protein, 9 aa, Homo Sapiens
HLHHLEVLR

SEQ ID NO: 1270951 - protein, 9 aa, Homo Sapiens
PRRPVVVPG

SEQ ID NO: 1270952 - protein, 9 aa, Homo Sapiens
WCSSWRSSS

SEQ ID NO: 1270953 - protein, 9 aa, Homo Sapiens
EYCFAWVEA

SEQ ID NO: 1270954 - protein, 9 aa, Homo Sapiens
DLPILDDQI

SEQ ID NO: 1270955 - protein, 9 aa, Homo Sapiens
HTHTQAYTL

SEQ ID NO: 1270956 - protein, 9 aa, Homo Sapiens
LFGTDAPVV

SEQ ID NO: 1270957 - protein, 9 aa, Homo Sapiens
ILLLTILLR

SEQ ID NO: 1270958 - protein, 9 aa, Homo Sapiens
IGLGGQHTR

SEQ ID NO: 1270959 - protein, 9 aa, Homo Sapiens
LLLTILLRG

SEQ ID NO: 1270960 - protein, 9 aa, Homo Sapiens
SLLSLTETQ

SEQ ID NO: 1270961 - protein, 9 aa, Homo Sapiens
TLRKGRNNK

SEQ ID NO: 1270962 - protein, 9 aa, Homo Sapiens
QPQPPVKVR

SEQ ID NO: 1270963 - protein, 9 aa, Homo Sapiens
VSRTMPPAL

SEQ ID NO: 1270964 - protein, 9 aa, Homo Sapiens
VCLHCTPKP

SEQ ID NO: 1270965 - protein, 9 aa, Homo Sapiens
LLSIFAYPH

SEQ ID NO: 1270966 - protein, 9 aa, Homo Sapiens
RPSVSRICR

SEQ ID NO: 1270967 - protein, 9 aa, Homo Sapiens
KHCVEQGKQ

SEQ ID NO: 1270968 - protein, 9 aa, Homo Sapiens
SNTSTQSTP

SEQ ID NO: 1270969 - protein, 9 aa, Homo Sapiens
FLVFRFCLP

SEQ ID NO: 1270970 - protein, 9 aa, Homo Sapiens
VLCWWLLSS

SEQ ID NO: 1270971 - protein, 9 aa, Homo Sapiens
ASLQGIRVQ

SEQ ID NO: 1270972 - protein, 9 aa, Homo Sapiens
AWHPGSWPV

SEQ ID NO: 1270973 - protein, 9 aa, Homo Sapiens
QRRLRACRA

SEQ ID NO: 1270974 - protein, 9 aa, Homo Sapiens
KAQFTVDRI

SEQ ID NO: 1270975 - protein, 9 aa, Homo Sapiens
DLRRRDPGW

SEQ ID NO: 1270976 - protein, 9 aa, Homo Sapiens
EDSDSSDDF

SEQ ID NO: 1270977 - protein, 9 aa, Homo Sapiens
TCTTLSVRP

SEQ ID NO: 1270978 - protein, 9 aa, Homo Sapiens
ASSSGGRTA

SEQ ID NO: 1270979 - protein, 9 aa, Homo Sapiens
NCCHHWSKA

SEQ ID NO: 1270980 - protein, 9 aa, Homo Sapiens
GYSEYDGND

SEQ ID NO: 1270981 - protein, 9 aa, Homo Sapiens
LWKYEAIQL

SEQ ID NO: 1270982 - protein, 9 aa, Homo Sapiens
EGWRWGWGQ

SEQ ID NO: 1270983 - protein, 9 aa, Homo Sapiens
QHFYESLPP

SEQ ID NO: 1270984 - protein, 9 aa, Homo Sapiens
KHMWPGDKG

SEQ ID NO: 1270985 - protein, 9 aa, Homo Sapiens
RMSDNAPAS

SEQ ID NO: 1270986 - protein, 9 aa, Homo Sapiens
MASAAACPS

SEQ ID NO: 1270987 - protein, 9 aa, Homo Sapiens
QEVAEAPRL

SEQ ID NO: 1270988 - protein, 9 aa, Homo Sapiens
PHFPRRSYQ

SEQ ID NO: 1270989 - protein, 9 aa, Homo Sapiens
SSFDKVVGG

SEQ ID NO: 1270990 - protein, 9 aa, Homo Sapiens
VASNSSRGY

SEQ ID NO: 1270991 - protein, 9 aa, Homo Sapiens
RLKPTRSTV

SEQ ID NO: 1270992 - protein, 9 aa, Homo Sapiens
VNTVNQKKA

SEQ ID NO: 1270993 - protein, 9 aa, Homo Sapiens
QQNGQRNQH

SEQ ID NO: 1270994 - protein, 9 aa, Homo Sapiens
SPGACRPAC

SEQ ID NO: 1270995 - protein, 9 aa, Homo Sapiens
AGGPCLPRR

SEQ ID NO: 1270996 - protein, 9 aa, Homo Sapiens
CSGTILAYC

SEQ ID NO: 1270997 - protein, 9 aa, Homo Sapiens
ELEKRQEES

SEQ ID NO: 1270998 - protein, 9 aa, Homo Sapiens
TTQAGGMAK

SEQ ID NO: 1270999 - protein, 9 aa, Homo Sapiens
CTPQHCPPV

SEQ ID NO: 1271000 - protein, 9 aa, Homo Sapiens
IVPESVTQE

SEQ ID NO: 1271001 - protein, 9 aa, Homo Sapiens
VLVHVHAEH

SEQ ID NO: 1271002 - protein, 9 aa, Homo Sapiens
NEHLLNWAQ

SEQ ID NO: 1271003 - protein, 9 aa, Homo Sapiens
HQPEMAAMR

SEQ ID NO: 1271004 - protein, 9 aa, Homo Sapiens
NENAKTHVL

SEQ ID NO: 1271005 - protein, 9 aa, Homo Sapiens
PAIATWPSA

SEQ ID NO: 1271006 - protein, 9 aa, Homo Sapiens
WSLAGIGMR

SEQ ID NO: 1271007 - protein, 9 aa, Homo Sapiens
KPSTPHHPL

SEQ ID NO: 1271008 - protein, 9 aa, Homo Sapiens
TFFRLALPR

SEQ ID NO: 1271009 - protein, 9 aa, Homo Sapiens
RDREARAAH

SEQ ID NO: 1271010 - protein, 9 aa, Homo Sapiens
HHALARHEV

SEQ ID NO: 1271011 - protein, 9 aa, Homo Sapiens
QPTQPQPSR

SEQ ID NO: 1271012 - protein, 9 aa, Homo Sapiens
KRKYHLCVQ

SEQ ID NO: 1271013 - protein, 9 aa, Homo Sapiens
GCAGAYLDS

SEQ ID NO: 1271014 - protein, 9 aa, Homo Sapiens
STRRSNMGH

SEQ ID NO: 1271015 - protein, 9 aa, Homo Sapiens
VMSCSLLTQ

SEQ ID NO: 1271016 - protein, 9 aa, Homo Sapiens
ISREQHFYE

SEQ ID NO: 1271017 - protein, 9 aa, Homo Sapiens
SKPSFMPCL

SEQ ID NO: 1271018 - protein, 9 aa, Homo Sapiens
EWRQGGSPV

SEQ ID NO: 1271019 - protein, 9 aa, Homo Sapiens
VWVPDNRTP

SEQ ID NO: 1271020 - protein, 9 aa, Homo Sapiens
LIPLYSVKS

SEQ ID NO: 1271021 - protein, 9 aa, Homo Sapiens
LRSPQVTGE

SEQ ID NO: 1271022 - protein, 9 aa, Homo Sapiens
ELGVAVDAQ

SEQ ID NO: 1271023 - protein, 9 aa, Homo Sapiens
PCVLPHVDF

SEQ ID NO: 1271024 - protein, 9 aa, Homo Sapiens
FSPFRWLLG

SEQ ID NO: 1271025 - protein, 9 aa, Homo Sapiens
RHAGHRSRK

SEQ ID NO: 1271026 - protein, 9 aa, Homo Sapiens
DALPVCLGA

SEQ ID NO: 1271027 - protein, 9 aa, Homo Sapiens
RRGMAPNGL

SEQ ID NO: 1271028 - protein, 9 aa, Homo Sapiens
IGASNQNCR

SEQ ID NO: 1271029 - protein, 9 aa, Homo Sapiens
LLVDAMNYR

SEQ ID NO: 1271030 - protein, 9 aa, Homo Sapiens
EYLLYGRMS

SEQ ID NO: 1271031 - protein, 9 aa, Homo Sapiens
LQPPGDCPR

SEQ ID NO: 1271032 - protein, 9 aa, Homo Sapiens
PTPRMKSST

SEQ ID NO: 1271033 - protein, 9 aa, Homo Sapiens
TGDQSSPIG

SEQ ID NO: 1271034 - protein, 9 aa, Homo Sapiens
RIEHFMFGE

SEQ ID NO: 1271035 - protein, 9 aa, Homo Sapiens
QCLSLTMSS

SEQ ID NO: 1271036 - protein, 9 aa, Homo Sapiens
KILSLLCLL

SEQ ID NO: 1271037 - protein, 9 aa, Homo Sapiens
VLILCGKKV

SEQ ID NO: 1271038 - protein, 9 aa, Homo Sapiens
AAGGPCLPR

SEQ ID NO: 1271039 - protein, 9 aa, Homo Sapiens
TEPTPRMKS

SEQ ID NO: 1271040 - protein, 9 aa, Homo Sapiens
SSCPLGSVL

SEQ ID NO: 1271041 - protein, 9 aa, Homo Sapiens
GRQHPPPAK

SEQ ID NO: 1271042 - protein, 9 aa, Homo Sapiens
NKEKLRKTC

SEQ ID NO: 1271043 - protein, 9 aa, Homo Sapiens
LGPKSAAEV

SEQ ID NO: 1271044 - protein, 9 aa, Homo Sapiens
RHAEPGPGE

SEQ ID NO: 1271045 - protein, 9 aa, Homo Sapiens
ARYRRPTMA

SEQ ID NO: 1271046 - protein, 9 aa, Homo Sapiens
LSRTELRDG

SEQ ID NO: 1271047 - protein, 9 aa, Homo Sapiens
KGKVESEKA

SEQ ID NO: 1271048 - protein, 9 aa, Homo Sapiens
PAFSGRILH

SEQ ID NO: 1271049 - protein, 9 aa, Homo Sapiens
QVSAYSKDS

SEQ ID NO: 1271050 - protein, 9 aa, Homo Sapiens
YVRAPQLRE

SEQ ID NO: 1271051 - protein, 9 aa, Homo Sapiens
TSTQSTPWM

SEQ ID NO: 1271052 - protein, 9 aa, Homo Sapiens
LLVVQLLVT

SEQ ID NO: 1271053 - protein, 9 aa, Homo Sapiens
DSQPNGEVL

SEQ ID NO: 1271054 - protein, 9 aa, Homo Sapiens
PRMELPVGC

SEQ ID NO: 1271055 - protein, 9 aa, Homo Sapiens
GEWRQGGSP

SEQ ID NO: 1271056 - protein, 9 aa, Homo Sapiens
MKSSTGITT

SEQ ID NO: 1271057 - protein, 9 aa, Homo Sapiens
CPRTMAGPS

SEQ ID NO: 1271058 - protein, 9 aa, Homo Sapiens
KTRGKVDIH

SEQ ID NO: 1271059 - protein, 9 aa, Homo Sapiens
AAGHRHAEP

SEQ ID NO: 1271060 - protein, 9 aa, Homo Sapiens
TQEVAEAPR

SEQ ID NO: 1271061 - protein, 9 aa, Homo Sapiens
TFPGGTGHI

SEQ ID NO: 1271062 - protein, 9 aa, Homo Sapiens
GTDAPVVVN

SEQ ID NO: 1271063 - protein, 9 aa, Homo Sapiens
HAGLNTTQA

SEQ ID NO: 1271064 - protein, 9 aa, Homo Sapiens
DMNDTLTST

SEQ ID NO: 1271065 - protein, 9 aa, Homo Sapiens
RLLPYHQNT

SEQ ID NO: 1271066 - protein, 9 aa, Homo Sapiens
GCGFCCACH

SEQ ID NO: 1271067 - protein, 9 aa, Homo Sapiens
ASGPCHAAA

SEQ ID NO: 1271068 - protein, 9 aa, Homo Sapiens
GWGQLLLLL

SEQ ID NO: 1271069 - protein, 9 aa, Homo Sapiens
GHDEAKIKA

SEQ ID NO: 1271070 - protein, 9 aa, Homo Sapiens
GHEEKTENG

SEQ ID NO: 1271071 - protein, 9 aa, Homo Sapiens
EWVSTDLSR

SEQ ID NO: 1271072 - protein, 9 aa, Homo Sapiens
EPTPLPLPT

SEQ ID NO: 1271073 - protein, 9 aa, Homo Sapiens
PTSPVSHFA

SEQ ID NO: 1271074 - protein, 9 aa, Homo Sapiens
ASGAELVGF

SEQ ID NO: 1271075 - protein, 9 aa, Homo Sapiens
AMGQVQSQE

SEQ ID NO: 1271076 - protein, 9 aa, Homo Sapiens
AIATWPSAA

SEQ ID NO: 1271077 - protein, 9 aa, Homo Sapiens
AGADGCGSR

SEQ ID NO: 1271078 - protein, 9 aa, Homo Sapiens
IIVNTVNQK

SEQ ID NO: 1271079 - protein, 9 aa, Homo Sapiens
ARRLIVSKN

SEQ ID NO: 1271080 - protein, 9 aa, Homo Sapiens
GTGVCLHCT

SEQ ID NO: 1271081 - protein, 9 aa, Homo Sapiens
PGCPKRKGN

SEQ ID NO: 1271082 - protein, 9 aa, Homo Sapiens
KEDKWYSEE

SEQ ID NO: 1271083 - protein, 9 aa, Homo Sapiens
CDDIDMLKE

SEQ ID NO: 1271084 - protein, 9 aa, Homo Sapiens
TPCRVASLQ

SEQ ID NO: 1271085 - protein, 9 aa, Homo Sapiens
DSPEEIVAA

SEQ ID NO: 1271086 - protein, 9 aa, Homo Sapiens
PPEPGDPDA

SEQ ID NO: 1271087 - protein, 9 aa, Homo Sapiens
TAKLYVRAP

SEQ ID NO: 1271088 - protein, 9 aa, Homo Sapiens
YRLLPYHQN

SEQ ID NO: 1271089 - protein, 9 aa, Homo Sapiens
LRLDGSQRP

SEQ ID NO: 1271090 - protein, 9 aa, Homo Sapiens
PRQLPGPHD

SEQ ID NO: 1271091 - protein, 9 aa, Homo Sapiens
APEHRRVVI

SEQ ID NO: 1271092 - protein, 9 aa, Homo Sapiens
LLEFLLPLG

SEQ ID NO: 1271093 - protein, 9 aa, Homo Sapiens
HRSLPMALS

SEQ ID NO: 1271094 - protein, 9 aa, Homo Sapiens
TDTHTGTDR

SEQ ID NO: 1271095 - protein, 9 aa, Homo Sapiens
LFQALSPSL

SEQ ID NO: 1271096 - protein, 9 aa, Homo Sapiens
QTVARHQLF

SEQ ID NO: 1271097 - protein, 9 aa, Homo Sapiens
CSLLTQPSP

SEQ ID NO: 1271098 - protein, 9 aa, Homo Sapiens
HVVLEVVVV

SEQ ID NO: 1271099 - protein, 9 aa, Homo Sapiens
AAVGKARRR

SEQ ID NO: 1271100 - protein, 9 aa, Homo Sapiens
LTQAYTHTQ

SEQ ID NO: 1271101 - protein, 9 aa, Homo Sapiens
AGLNTTQAG

SEQ ID NO: 1271102 - protein, 9 aa, Homo Sapiens
NRTPTWRPR

SEQ ID NO: 1271103 - protein, 9 aa, Homo Sapiens
PCACRTFRV

SEQ ID NO: 1271104 - protein, 9 aa, Homo Sapiens
HAKDHCMAH

SEQ ID NO: 1271105 - protein, 9 aa, Homo Sapiens
EAPRLHPPF

SEQ ID NO: 1271106 - protein, 9 aa, Homo Sapiens
LPGQWSHFQ

SEQ ID NO: 1271107 - protein, 9 aa, Homo Sapiens
YPWVEYCEF

SEQ ID NO: 1271108 - protein, 9 aa, Homo Sapiens
RRRRNLILR

SEQ ID NO: 1271109 - protein, 9 aa, Homo Sapiens
PKNPILAPG

SEQ ID NO: 1271110 - protein, 9 aa, Homo Sapiens
SSEYYENKK

SEQ ID NO: 1271111 - protein, 9 aa, Homo Sapiens
RQVREHVLE

SEQ ID NO: 1271112 - protein, 9 aa, Homo Sapiens
LSSLLLGHI

SEQ ID NO: 1271113 - protein, 9 aa, Homo Sapiens
VVKVSDRRK

SEQ ID NO: 1271114 - protein, 9 aa, Homo Sapiens
VAKLDGMQR

SEQ ID NO: 1271115 - protein, 9 aa, Homo Sapiens
SGHAGNHGH

SEQ ID NO: 1271116 - protein, 9 aa, Homo Sapiens
APVGSVMSC

SEQ ID NO: 1271117 - protein, 9 aa, Homo Sapiens
GEHTFFRLA

SEQ ID NO: 1271118 - protein, 9 aa, Homo Sapiens
LDDCNIHVI

SEQ ID NO: 1271119 - protein, 9 aa, Homo Sapiens
HTRGASGRD

SEQ ID NO: 1271120 - protein, 9 aa, Homo Sapiens
ELQPPGDCP

SEQ ID NO: 1271121 - protein, 9 aa, Homo Sapiens
LHPASGRAS

SEQ ID NO: 1271122 - protein, 9 aa, Homo Sapiens
HVVHHALAR

SEQ ID NO: 1271123 - protein, 9 aa, Homo Sapiens
TNVHRVTAQ

SEQ ID NO: 1271124 - protein, 9 aa, Homo Sapiens
LTMSSAWPP

SEQ ID NO: 1271125 - protein, 9 aa, Homo Sapiens
EGQTPMGMR

SEQ ID NO: 1271126 - protein, 9 aa, Homo Sapiens
DRTTFPSKL

SEQ ID NO: 1271127 - protein, 9 aa, Homo Sapiens
LTMNIVSSY

SEQ ID NO: 1271128 - protein, 9 aa, Homo Sapiens
SMKSPIFGP

SEQ ID NO: 1271129 - protein, 9 aa, Homo Sapiens
SNPDLRRRD

SEQ ID NO: 1271130 - protein, 9 aa, Homo Sapiens
PKWMAEIEC

SEQ ID NO: 1271131 - protein, 9 aa, Homo Sapiens
VHGLLRQLG

SEQ ID NO: 1271132 - protein, 9 aa, Homo Sapiens
LPMYCSILL

SEQ ID NO: 1271133 - protein, 9 aa, Homo Sapiens
KINNQIIVN

SEQ ID NO: 1271134 - protein, 9 aa, Homo Sapiens
SSSPRRASG

SEQ ID NO: 1271135 - protein, 9 aa, Homo Sapiens
FITKRGLKS

SEQ ID NO: 1271136 - protein, 9 aa, Homo Sapiens
SSAWPPTVT

SEQ ID NO: 1271137 - protein, 9 aa, Homo Sapiens
NPPHFPRRS

SEQ ID NO: 1271138 - protein, 9 aa, Homo Sapiens
WNEAFCFLI

SEQ ID NO: 1271139 - protein, 9 aa, Homo Sapiens
VFWSEADVT

SEQ ID NO: 1271140 - protein, 9 aa, Homo Sapiens
APLARHALH

SEQ ID NO: 1271141 - protein, 9 aa, Homo Sapiens
GALLRGLGL

SEQ ID NO: 1271142 - protein, 9 aa, Homo Sapiens
PLPLSAVTA

SEQ ID NO: 1271143 - protein, 9 aa, Homo Sapiens
DSSDDFFIG

SEQ ID NO: 1271144 - protein, 9 aa, Homo Sapiens
RKGNNVFVV

SEQ ID NO: 1271145 - protein, 9 aa, Homo Sapiens
IFLTGDFNG

SEQ ID NO: 1271146 - protein, 9 aa, Homo Sapiens
STFTSSHFK

SEQ ID NO: 1271147 - protein, 9 aa, Homo Sapiens
VLYQLEKWE

SEQ ID NO: 1271148 - protein, 9 aa, Homo Sapiens
SWGLEFSPF

SEQ ID NO: 1271149 - protein, 9 aa, Homo Sapiens
GRRAPVKLS

SEQ ID NO: 1271150 - protein, 9 aa, Homo Sapiens
RGYPNDTVS

SEQ ID NO: 1271151 - protein, 9 aa, Homo Sapiens
LARHALHGQ

SEQ ID NO: 1271152 - protein, 9 aa, Homo Sapiens
GPGCTDDEG

SEQ ID NO: 1271153 - protein, 9 aa, Homo Sapiens
NDNPPHFPR

SEQ ID NO: 1271154 - protein, 9 aa, Homo Sapiens
LDGMQRRVL

SEQ ID NO: 1271155 - protein, 9 aa, Homo Sapiens
NLMLMSRNE

SEQ ID NO: 1271156 - protein, 9 aa, Homo Sapiens
VKTWASLSN

SEQ ID NO: 1271157 - protein, 9 aa, Homo Sapiens
CMIQLFFSV

SEQ ID NO: 1271158 - protein, 9 aa, Homo Sapiens
TRRPRALCS

SEQ ID NO: 1271159 - protein, 9 aa, Homo Sapiens
PGSPSLSCL

SEQ ID NO: 1271160 - protein, 9 aa, Homo Sapiens
DAAGHRHAE

SEQ ID NO: 1271161 - protein, 9 aa, Homo Sapiens
DSVCNSGVE

SEQ ID NO: 1271162 - protein, 9 aa, Homo Sapiens
IMPLVAFRF

SEQ ID NO: 1271163 - protein, 9 aa, Homo Sapiens
GKVDIHLLR

SEQ ID NO: 1271164 - protein, 9 aa, Homo Sapiens
QLRRLCQVT

SEQ ID NO: 1271165 - protein, 9 aa, Homo Sapiens
WKYEAIQLT

SEQ ID NO: 1271166 - protein, 9 aa, Homo Sapiens
SLNDLLSIF

SEQ ID NO: 1271167 - protein, 9 aa, Homo Sapiens
RRVVIEVAL

SEQ ID NO: 1271168 - protein, 9 aa, Homo Sapiens
LTYTGTHRH

SEQ ID NO: 1271169 - protein, 9 aa, Homo Sapiens
SALVSLGFF

SEQ ID NO: 1271170 - protein, 9 aa, Homo Sapiens
QPWPAIATW

SEQ ID NO: 1271171 - protein, 9 aa, Homo Sapiens
YYGYGCYCV

SEQ ID NO: 1271172 - protein, 9 aa, Homo Sapiens
TMGLYDRIE

SEQ ID NO: 1271173 - protein, 9 aa, Homo Sapiens
LLNWAQKEY

SEQ ID NO: 1271174 - protein, 9 aa, Homo Sapiens
RHDLAPTKH

SEQ ID NO: 1271175 - protein, 9 aa, Homo Sapiens
KLSLSWDIV

SEQ ID NO: 1271176 - protein, 9 aa, Homo Sapiens
PSGPCRAVG

SEQ ID NO: 1271177 - protein, 9 aa, Homo Sapiens
EMREDRTKR

SEQ ID NO: 1271178 - protein, 9 aa, Homo Sapiens
HRRVVIEVA

SEQ ID NO: 1271179 - protein, 9 aa, Homo Sapiens
SRAPGCAGA

SEQ ID NO: 1271180 - protein, 9 aa, Homo Sapiens
EVAKLDGMQ

SEQ ID NO: 1271181 - protein, 9 aa, Homo Sapiens
LRWRRKRYA

SEQ ID NO: 1271182 - protein, 9 aa, Homo Sapiens
CCHHWSKAS

SEQ ID NO: 1271183 - protein, 9 aa, Homo Sapiens
KLGEHVVHH

SEQ ID NO: 1271184 - protein, 9 aa, Homo Sapiens
LAIYQLRTL

SEQ ID NO: 1271185 - protein, 9 aa, Homo Sapiens
ISMKSPIFG

SEQ ID NO: 1271186 - protein, 9 aa, Homo Sapiens
SGTPPSPVS

SEQ ID NO: 1271187 - protein, 9 aa, Homo Sapiens
CSWTIHQPQ

SEQ ID NO: 1271188 - protein, 9 aa, Homo Sapiens
MTGVQPSAG

SEQ ID NO: 1271189 - protein, 9 aa, Homo Sapiens
MTTISRATW

SEQ ID NO: 1271190 - protein, 9 aa, Homo Sapiens
TPFRKPGWV

SEQ ID NO: 1271191 - protein, 9 aa, Homo Sapiens
AGKGLTGVM

SEQ ID NO: 1271192 - protein, 9 aa, Homo Sapiens
RRLQEALQV

SEQ ID NO: 1271193 - protein, 9 aa, Homo Sapiens
DLHAFIVQA

SEQ ID NO: 1271194 - protein, 9 aa, Homo Sapiens
NLNDHLASY

SEQ ID NO: 1271195 - protein, 9 aa, Homo Sapiens
WMARKFTHI

SEQ ID NO: 1271196 - protein, 9 aa, Homo Sapiens
GGETCGCLT

SEQ ID NO: 1271197 - protein, 9 aa, Homo Sapiens
LEKRQEESQ

SEQ ID NO: 1271198 - protein, 9 aa, Homo Sapiens
GAQAMYQVF

SEQ ID NO: 1271199 - protein, 9 aa, Homo Sapiens
PNGEVLLSS

SEQ ID NO: 1271200 - protein, 9 aa, Homo Sapiens
NEAFCFLIQ

SEQ ID NO: 1271201 - protein, 9 aa, Homo Sapiens
HQRSGHGDH

SEQ ID NO: 1271202 - protein, 9 aa, Homo Sapiens
GSSSQTVAR

SEQ ID NO: 1271203 - protein, 9 aa, Homo Sapiens
QEKTYLEII

SEQ ID NO: 1271204 - protein, 9 aa, Homo Sapiens
QSSPIGLGG

SEQ ID NO: 1271205 - protein, 9 aa, Homo Sapiens
KVQESTKGH

SEQ ID NO: 1271206 - protein, 9 aa, Homo Sapiens
SPEEESYPY

SEQ ID NO: 1271207 - protein, 9 aa, Homo Sapiens
LARLRSILL

SEQ ID NO: 1271208 - protein, 9 aa, Homo Sapiens
NLGRPYRNR

SEQ ID NO: 1271209 - protein, 9 aa, Homo Sapiens
DQSSPIGLG

SEQ ID NO: 1271210 - protein, 9 aa, Homo Sapiens
DGSQRPPRQ

SEQ ID NO: 1271211 - protein, 9 aa, Homo Sapiens
CTVPPGVDY

SEQ ID NO: 1271212 - protein, 9 aa, Homo Sapiens
EHGPTLEEV

SEQ ID NO: 1271213 - protein, 9 aa, Homo Sapiens
YENKKSYQT

SEQ ID NO: 1271214 - protein, 9 aa, Homo Sapiens
EIECDDIDM

SEQ ID NO: 1271215 - protein, 9 aa, Homo Sapiens
GIMDPPSLM

SEQ ID NO: 1271216 - protein, 9 aa, Homo Sapiens
LMDLVDFHK

SEQ ID NO: 1271217 - protein, 9 aa, Homo Sapiens
LSMYQTDFI

SEQ ID NO: 1271218 - protein, 9 aa, Homo Sapiens
HLFSSIDDG

SEQ ID NO: 1271219 - protein, 9 aa, Homo Sapiens
WQRAKRNAV

SEQ ID NO: 1271220 - protein, 9 aa, Homo Sapiens
TVPPGVDYF

SEQ ID NO: 1271221 - protein, 9 aa, Homo Sapiens
MAVHMQTHA

SEQ ID NO: 1271222 - protein, 9 aa, Homo Sapiens
AAARGHLLV

SEQ ID NO: 1271223 - protein, 9 aa, Homo Sapiens
RHRHTLTQA

SEQ ID NO: 1271224 - protein, 9 aa, Homo Sapiens
ARPVCHLQA

SEQ ID NO: 1271225 - protein, 9 aa, Homo Sapiens
LAEGTAGHR

SEQ ID NO: 1271226 - protein, 9 aa, Homo Sapiens
EALVAELAL

SEQ ID NO: 1271227 - protein, 9 aa, Homo Sapiens
KQKPHRRGM

SEQ ID NO: 1271228 - protein, 9 aa, Homo Sapiens
WKSNDTTAS

SEQ ID NO: 1271229 - protein, 9 aa, Homo Sapiens
LSSSKEKSS

SEQ ID NO: 1271230 - protein, 9 aa, Homo Sapiens
VRTSGRAQG

SEQ ID NO: 1271231 - protein, 9 aa, Homo Sapiens
VQKAQFTVD

SEQ ID NO: 1271232 - protein, 9 aa, Homo Sapiens
PWPNSDPPS

SEQ ID NO: 1271233 - protein, 9 aa, Homo Sapiens
SPQGVQVRT

SEQ ID NO: 1271234 - protein, 9 aa, Homo Sapiens
WQRRLRACR

SEQ ID NO: 1271235 - protein, 9 aa, Homo Sapiens
PLVAFRFLR

SEQ ID NO: 1271236 - protein, 9 aa, Homo Sapiens
TLMDLVDFH

SEQ ID NO: 1271237 - protein, 9 aa, Homo Sapiens
YLPMYCSIL

SEQ ID NO: 1271238 - protein, 9 aa, Homo Sapiens
DIPDGLFWM

SEQ ID NO: 1271239 - protein, 9 aa, Homo Sapiens
LKKFLSVME

SEQ ID NO: 1271240 - protein, 9 aa, Homo Sapiens
SYVSVHVES

SEQ ID NO: 1271241 - protein, 9 aa, Homo Sapiens
LIANTLRQQ

SEQ ID NO: 1271242 - protein, 9 aa, Homo Sapiens
YRNRPKRPS

SEQ ID NO: 1271243 - protein, 9 aa, Homo Sapiens
TTAPSVLTA

SEQ ID NO: 1271244 - protein, 9 aa, Homo Sapiens
SPTIPCPTD

SEQ ID NO: 1271245 - protein, 9 aa, Homo Sapiens
VDFQLVLPG

SEQ ID NO: 1271246 - protein, 9 aa, Homo Sapiens
MAHKLFNNL

SEQ ID NO: 1271247 - protein, 9 aa, Homo Sapiens
EPKNPILAP

SEQ ID NO: 1271248 - protein, 9 aa, Homo Sapiens
RVSGVLTAT

SEQ ID NO: 1271249 - protein, 9 aa, Homo Sapiens
AQRHAGHRS

SEQ ID NO: 1271250 - protein, 9 aa, Homo Sapiens
PPKPSTPHH

SEQ ID NO: 1271251 - protein, 9 aa, Homo Sapiens
NGEVLLSSL

SEQ ID NO: 1271252 - protein, 9 aa, Homo Sapiens
ALPSQFSST

SEQ ID NO: 1271253 - protein, 9 aa, Homo Sapiens
PSPFEDRTT

SEQ ID NO: 1271254 - protein, 9 aa, Homo Sapiens
QDPKHRMYV

SEQ ID NO: 1271255 - protein, 9 aa, Homo Sapiens
IEGAQEKTY

SEQ ID NO: 1271256 - protein, 9 aa, Homo Sapiens
YSMNDVCRA

SEQ ID NO: 1271257 - protein, 9 aa, Homo Sapiens
PILDDQIQW

SEQ ID NO: 1271258 - protein, 9 aa, Homo Sapiens
HRHTQEYTG

SEQ ID NO: 1271259 - protein, 9 aa, Homo Sapiens
DSGCGFCCA

SEQ ID NO: 1271260 - protein, 9 aa, Homo Sapiens
PGDCPRTMA

SEQ ID NO: 1271261 - protein, 9 aa, Homo Sapiens
RPEMREDRT

SEQ ID NO: 1271262 - protein, 9 aa, Homo Sapiens
ILHQPEMAA

SEQ ID NO: 1271263 - protein, 9 aa, Homo Sapiens
HEVRLAARQ

SEQ ID NO: 1271264 - protein, 9 aa, Homo Sapiens
ELEFNTQRE

SEQ ID NO: 1271265 - protein, 9 aa, Homo Sapiens
TWCGGAHGL

SEQ ID NO: 1271266 - protein, 9 aa, Homo Sapiens
VVVVHELGV

SEQ ID NO: 1271267 - protein, 9 aa, Homo Sapiens
SLLLGHIWV

SEQ ID NO: 1271268 - protein, 9 aa, Homo Sapiens
RHEVLLRRL

SEQ ID NO: 1271269 - protein, 9 aa, Homo Sapiens
PKSAAEVLV

SEQ ID NO: 1271270 - protein, 9 aa, Homo Sapiens
FKWILLLTI

SEQ ID NO: 1271271 - protein, 9 aa, Homo Sapiens
RGGGCLPPE

SEQ ID NO: 1271272 - protein, 9 aa, Homo Sapiens
EVRLAARQP

SEQ ID NO: 1271273 - protein, 9 aa, Homo Sapiens
ALKTLPLLS

SEQ ID NO: 1271274 - protein, 9 aa, Homo Sapiens
INDIVPESV

SEQ ID NO: 1271275 - protein, 9 aa, Homo Sapiens
TGHIINKNN

SEQ ID NO: 1271276 - protein, 9 aa, Homo Sapiens
RHTHTHTQA

SEQ ID NO: 1271277 - protein, 9 aa, Homo Sapiens
VSKNAGETL

SEQ ID NO: 1271278 - protein, 9 aa, Homo Sapiens
ICHLQQGIC

SEQ ID NO: 1271279 - protein, 9 aa, Homo Sapiens
KFLSVMEAK

SEQ ID NO: 1271280 - protein, 9 aa, Homo Sapiens
KIVVKKKPK

SEQ ID NO: 1271281 - protein, 9 aa, Homo Sapiens
VHTQTHTGI

SEQ ID NO: 1271282 - protein, 9 aa, Homo Sapiens
AESVNLDDC

SEQ ID NO: 1271283 - protein, 9 aa, Homo Sapiens
LEPPSLHPA

SEQ ID NO: 1271284 - protein, 9 aa, Homo Sapiens
VLLQVSAYS

SEQ ID NO: 1271285 - protein, 9 aa, Homo Sapiens
LQMARPGGP

SEQ ID NO: 1271286 - protein, 9 aa, Homo Sapiens
GLEFSPFRW

SEQ ID NO: 1271287 - protein, 9 aa, Homo Sapiens
MLTCTTLSV

SEQ ID NO: 1271288 - protein, 9 aa, Homo Sapiens
QVILMPQPP

SEQ ID NO: 1271289 - protein, 9 aa, Homo Sapiens
GRMRVAFEG

SEQ ID NO: 1271290 - protein, 9 aa, Homo Sapiens
SQVGGTQEV

SEQ ID NO: 1271291 - protein, 9 aa, Homo Sapiens
NTVNQKKAK

SEQ ID NO: 1271292 - protein, 9 aa, Homo Sapiens
QAGLRSPLR

SEQ ID NO: 1271293 - protein, 9 aa, Homo Sapiens
LLNVDGIEL

SEQ ID NO: 1271294 - protein, 9 aa, Homo Sapiens
TQTAAGRPP

SEQ ID NO: 1271295 - protein, 9 aa, Homo Sapiens
VSDRRKPPR

SEQ ID NO: 1271296 - protein, 9 aa, Homo Sapiens
QSLPQAGLR

SEQ ID NO: 1271297 - protein, 9 aa, Homo Sapiens
YCFAWVEAD

SEQ ID NO: 1271298 - protein, 9 aa, Homo Sapiens
MTLLLGDNS

SEQ ID NO: 1271299 - protein, 9 aa, Homo Sapiens
PSRPTGRTP

SEQ ID NO: 1271300 - protein, 9 aa, Homo Sapiens
PVKLSLSWD

SEQ ID NO: 1271301 - protein, 9 aa, Homo Sapiens
PRATRRPRA

SEQ ID NO: 1271302 - protein, 9 aa, Homo Sapiens
SASSHPRMS

SEQ ID NO: 1271303 - protein, 9 aa, Homo Sapiens
CPTDSLLCS

SEQ ID NO: 1271304 - protein, 9 aa, Homo Sapiens
LSEVWSMKL

SEQ ID NO: 1271305 - protein, 9 aa, Homo Sapiens
DIVPESVTQ

SEQ ID NO: 1271306 - protein, 9 aa, Homo Sapiens
RKCGITPLP

SEQ ID NO: 1271307 - protein, 9 aa, Homo Sapiens
ALQAKKTCV

SEQ ID NO: 1271308 - protein, 9 aa, Homo Sapiens
WVEYCEFLG

SEQ ID NO: 1271309 - protein, 9 aa, Homo Sapiens
NIPVVRRLD

SEQ ID NO: 1271310 - protein, 9 aa, Homo Sapiens
RRQPAQRRH

SEQ ID NO: 1271311 - protein, 9 aa, Homo Sapiens
ALDELDTPF

SEQ ID NO: 1271312 - protein, 9 aa, Homo Sapiens
CHLQQGICR

SEQ ID NO: 1271313 - protein, 9 aa, Homo Sapiens
FTKILSLLC

SEQ ID NO: 1271314 - protein, 9 aa, Homo Sapiens
IPNNGSPQG

SEQ ID NO: 1271315 - protein, 9 aa, Homo Sapiens
RLRACRAGG

SEQ ID NO: 1271316 - protein, 9 aa, Homo Sapiens
MSEDSDSSD

SEQ ID NO: 1271317 - protein, 9 aa, Homo Sapiens
QVGGTQEVE

SEQ ID NO: 1271318 - protein, 9 aa, Homo Sapiens
AGRPPRMEL

SEQ ID NO: 1271319 - protein, 9 aa, Homo Sapiens
ESASGQAVR

SEQ ID NO: 1271320 - protein, 9 aa, Homo Sapiens
AMWGIFVFK

SEQ ID NO: 1271321 - protein, 9 aa, Homo Sapiens
VAVQVVRAR

SEQ ID NO: 1271322 - protein, 9 aa, Homo Sapiens
QERYKEEFQ

SEQ ID NO: 1271323 - protein, 9 aa, Homo Sapiens
GVPIRFEVG

SEQ ID NO: 1271324 - protein, 9 aa, Homo Sapiens
KGRNNKLIK

SEQ ID NO: 1271325 - protein, 9 aa, Homo Sapiens
EYYENKKSY

SEQ ID NO: 1271326 - protein, 9 aa, Homo Sapiens
PALHQCLSL

SEQ ID NO: 1271327 - protein, 9 aa, Homo Sapiens
PAKHSSSQC

SEQ ID NO: 1271328 - protein, 9 aa, Homo Sapiens
SEGDVNAVG

SEQ ID NO: 1271329 - protein, 9 aa, Homo Sapiens
NDTNVHRVT

SEQ ID NO: 1271330 - protein, 9 aa, Homo Sapiens
DTNYLLKMA

SEQ ID NO: 1271331 - protein, 9 aa, Homo Sapiens
LEAVAALKT

SEQ ID NO: 1271332 - protein, 9 aa, Homo Sapiens
LKGVPIRFE

SEQ ID NO: 1271333 - protein, 9 aa, Homo Sapiens
LLGDNSDYD

SEQ ID NO: 1271334 - protein, 9 aa, Homo Sapiens
WVKSSEYYE

SEQ ID NO: 1271335 - protein, 9 aa, Homo Sapiens
KCEKKLHPQ

SEQ ID NO: 1271336 - protein, 9 aa, Homo Sapiens
GNATANNTR

SEQ ID NO: 1271337 - protein, 9 aa, Homo Sapiens
AMYQVFWSE

SEQ ID NO: 1271338 - protein, 9 aa, Homo Sapiens
GWRWGWGQL

SEQ ID NO: 1271339 - protein, 9 aa, Homo Sapiens
FSGRILHQP

SEQ ID NO: 1271340 - protein, 9 aa, Homo Sapiens
SWGEARVGS

SEQ ID NO: 1271341 - protein, 9 aa, Homo Sapiens
DILLNVDGI

SEQ ID NO: 1271342 - protein, 9 aa, Homo Sapiens
LCIWKFFPK

SEQ ID NO: 1271343 - protein, 9 aa, Homo Sapiens
TVLILCGKK

SEQ ID NO: 1271344 - protein, 9 aa, Homo Sapiens
TFGKVQGNN

SEQ ID NO: 1271345 - protein, 9 aa, Homo Sapiens
HLGETALPT

SEQ ID NO: 1271346 - protein, 9 aa, Homo Sapiens
HAGHRSRKL

SEQ ID NO: 1271347 - protein, 9 aa, Homo Sapiens
PSPTIPCPT

SEQ ID NO: 1271348 - protein, 9 aa, Homo Sapiens
QEESQHEIK

SEQ ID NO: 1271349 - protein, 9 aa, Homo Sapiens
WPPTVTIWM

SEQ ID NO: 1271350 - protein, 9 aa, Homo Sapiens
HTQTHTGIH

SEQ ID NO: 1271351 - protein, 9 aa, Homo Sapiens
STPHHPLKA

SEQ ID NO: 1271352 - protein, 9 aa, Homo Sapiens
LCGKKVENT

SEQ ID NO: 1271353 - protein, 9 aa, Homo Sapiens
RPCSVTVWC

SEQ ID NO: 1271354 - protein, 9 aa, Homo Sapiens
SLTLPQLSL

SEQ ID NO: 1271355 - protein, 9 aa, Homo Sapiens
SCSLLTQPS

SEQ ID NO: 1271356 - protein, 9 aa, Homo Sapiens
KNISEKKVT

SEQ ID NO: 1271357 - protein, 9 aa, Homo Sapiens
HAAPEHRRV

SEQ ID NO: 1271358 - protein, 9 aa, Homo Sapiens
RPTQTAAGR

SEQ ID NO: 1271359 - protein, 9 aa, Homo Sapiens
AAACPSLGP

SEQ ID NO: 1271360 - protein, 9 aa, Homo Sapiens
GMHRHTHTQ

SEQ ID NO: 1271361 - protein, 9 aa, Homo Sapiens
IAHTAPKPP

SEQ ID NO: 1271362 - protein, 9 aa, Homo Sapiens
FYNGNGWKG

SEQ ID NO: 1271363 - protein, 9 aa, Homo Sapiens
RICRQKILF

SEQ ID NO: 1271364 - protein, 9 aa, Homo Sapiens
SLEVLYQLE

SEQ ID NO: 1271365 - protein, 9 aa, Homo Sapiens
GEVLLSSLL

SEQ ID NO: 1271366 - protein, 9 aa, Homo Sapiens
VLFLNATCW

SEQ ID NO: 1271367 - protein, 9 aa, Homo Sapiens
GLWGTGVCL

SEQ ID NO: 1271368 - protein, 9 aa, Homo Sapiens
RAPVKLSLS

SEQ ID NO: 1271369 - protein, 9 aa, Homo Sapiens
LPPTTCEEV

SEQ ID NO: 1271370 - protein, 9 aa, Homo Sapiens
PSLSCLGHV

SEQ ID NO: 1271371 - protein, 9 aa, Homo Sapiens
LGRPYRNRP

SEQ ID NO: 1271372 - protein, 9 aa, Homo Sapiens
TAIVAVVAV

SEQ ID NO: 1271373 - protein, 9 aa, Homo Sapiens
PDAQPSTTE

SEQ ID NO: 1271374 - protein, 9 aa, Homo Sapiens
SSSASHEYH

SEQ ID NO: 1271375 - protein, 9 aa, Homo Sapiens
SLVASSQNW

SEQ ID NO: 1271376 - protein, 9 aa, Homo Sapiens
LTVKECIGA

SEQ ID NO: 1271377 - protein, 9 aa, Homo Sapiens
HHWSKASEE

SEQ ID NO: 1271378 - protein, 9 aa, Homo Sapiens
ETCGCLTHE

SEQ ID NO: 1271379 - protein, 9 aa, Homo Sapiens
HMAVHMQTH

SEQ ID NO: 1271380 - protein, 9 aa, Homo Sapiens
SNDTNVHRV

SEQ ID NO: 1271381 - protein, 9 aa, Homo Sapiens
RTSGRAQGR

SEQ ID NO: 1271382 - protein, 9 aa, Homo Sapiens
LIVSKNAGE

SEQ ID NO: 1271383 - protein, 9 aa, Homo Sapiens
DIKHEYQYM

SEQ ID NO: 1271384 - protein, 9 aa, Homo Sapiens
NSSRGYPND

SEQ ID NO: 1271385 - protein, 9 aa, Homo Sapiens
QMCASLSLL

SEQ ID NO: 1271386 - protein, 9 aa, Homo Sapiens
LPCVLPHVD

SEQ ID NO: 1271387 - protein, 9 aa, Homo Sapiens
TEGEKQRVL

SEQ ID NO: 1271388 - protein, 9 aa, Homo Sapiens
NHQGRPTHQ

SEQ ID NO: 1271389 - protein, 9 aa, Homo Sapiens
CRQKILFQA

SEQ ID NO: 1271390 - protein, 9 aa, Homo Sapiens
MNDTLTSTL

SEQ ID NO: 1271391 - protein, 9 aa, Homo Sapiens
WAQKEYGAV

SEQ ID NO: 1271392 - protein, 9 aa, Homo Sapiens
HTFFRLALP

SEQ ID NO: 1271393 - protein, 9 aa, Homo Sapiens
GSSDPTKAD

SEQ ID NO: 1271394 - protein, 9 aa, Homo Sapiens
PASACTMPP

SEQ ID NO: 1271395 - protein, 9 aa, Homo Sapiens
HLEVLRLGR

SEQ ID NO: 1271396 - protein, 9 aa, Homo Sapiens
PGGTGHIIN

SEQ ID NO: 1271397 - protein, 9 aa, Homo Sapiens
WLASRLKPT

SEQ ID NO: 1271398 - protein, 9 aa, Homo Sapiens
GIDGFSGHA

SEQ ID NO: 1271399 - protein, 9 aa, Homo Sapiens
FSFLVFRFC

SEQ ID NO: 1271400 - protein, 9 aa, Homo Sapiens
LIAADTLPY

SEQ ID NO: 1271401 - protein, 9 aa, Homo Sapiens
WVERAIPNN

SEQ ID NO: 1271402 - protein, 9 aa, Homo Sapiens
VVISEDALV

SEQ ID NO: 1271403 - protein, 9 aa, Homo Sapiens
LPLRSSGQP

SEQ ID NO: 1271404 - protein, 9 aa, Homo Sapiens
FPGGTGHII

SEQ ID NO: 1271405 - protein, 9 aa, Homo Sapiens
SHLGETALP

SEQ ID NO: 1271406 - protein, 9 aa, Homo Sapiens
NSWGEARVG

SEQ ID NO: 1271407 - protein, 9 aa, Homo Sapiens
VREHVLEEV

SEQ ID NO: 1271408 - protein, 9 aa, Homo Sapiens
NLDDCNIHV

SEQ ID NO: 1271409 - protein, 9 aa, Homo Sapiens
QIIVNTVNQ

SEQ ID NO: 1271410 - protein, 9 aa, Homo Sapiens
LHCTPKPTR

SEQ ID NO: 1271411 - protein, 9 aa, Homo Sapiens
SSYHMKPLQ

SEQ ID NO: 1271412 - protein, 9 aa, Homo Sapiens
PTKADWLAS

SEQ ID NO: 1271413 - protein, 9 aa, Homo Sapiens
PPGDCPRTM

SEQ ID NO: 1271414 - protein, 9 aa, Homo Sapiens
LTLRKGRNN

SEQ ID NO: 1271415 - protein, 9 aa, Homo Sapiens
HCKAGKGLT

SEQ ID NO: 1271416 - protein, 9 aa, Homo Sapiens
GPHARVDAH

SEQ ID NO: 1271417 - protein, 9 aa, Homo Sapiens
HEEKTENGQ

SEQ ID NO: 1271418 - protein, 9 aa, Homo Sapiens
LLLLLLDLP

SEQ ID NO: 1271419 - protein, 9 aa, Homo Sapiens
NGSEIIIEG

SEQ ID NO: 1271420 - protein, 9 aa, Homo Sapiens
ASRCLNLGR

SEQ ID NO: 1271421 - protein, 9 aa, Homo Sapiens
PIGLGGQHT

SEQ ID NO: 1271422 - protein, 9 aa, Homo Sapiens
TQPSPASAC

SEQ ID NO: 1271423 - protein, 9 aa, Homo Sapiens
YKWRFLLGG

SEQ ID NO: 1271424 - protein, 9 aa, Homo Sapiens
RCRWCSSWR

SEQ ID NO: 1271425 - protein, 9 aa, Homo Sapiens
PASRAQRHA

SEQ ID NO: 1271426 - protein, 9 aa, Homo Sapiens
EELRKCGIT

SEQ ID NO: 1271427 - protein, 9 aa, Homo Sapiens
WILGALDKT

SEQ ID NO: 1271428 - protein, 9 aa, Homo Sapiens
LQLALFYQG

SEQ ID NO: 1271429 - protein, 9 aa, Homo Sapiens
TKTKVTKTV

SEQ ID NO: 1271430 - protein, 9 aa, Homo Sapiens
ECGSGGVDS

SEQ ID NO: 1271431 - protein, 9 aa, Homo Sapiens
QPAQRRHAA

SEQ ID NO: 1271432 - protein, 9 aa, Homo Sapiens
PHKKYPAWD

SEQ ID NO: 1271433 - protein, 9 aa, Homo Sapiens
GDSPEEIVA

SEQ ID NO: 1271434 - protein, 9 aa, Homo Sapiens
PPPSWSAMH

SEQ ID NO: 1271435 - protein, 9 aa, Homo Sapiens
ILNMEPCCC

SEQ ID NO: 1271436 - protein, 9 aa, Homo Sapiens
REGWRWGWG

SEQ ID NO: 1271437 - protein, 9 aa, Homo Sapiens
AKLDGMQRR

SEQ ID NO: 1271438 - protein, 9 aa, Homo Sapiens
DPWNLGPWK

SEQ ID NO: 1271439 - protein, 9 aa, Homo Sapiens
APTPCTDTE

SEQ ID NO: 1271440 - protein, 9 aa, Homo Sapiens
DPPSLMTST

SEQ ID NO: 1271441 - protein, 9 aa, Homo Sapiens
RQLPGPHDD

SEQ ID NO: 1271442 - protein, 9 aa, Homo Sapiens
EIGTVVVLR

SEQ ID NO: 1271443 - protein, 9 aa, Homo Sapiens
PLQMARPGG

SEQ ID NO: 1271444 - protein, 9 aa, Homo Sapiens
PVVRRLDRK

SEQ ID NO: 1271445 - protein, 9 aa, Homo Sapiens
YCVLGDKGI

SEQ ID NO: 1271446 - protein, 9 aa, Homo Sapiens
MDLVDFHKE

SEQ ID NO: 1271447 - protein, 9 aa, Homo Sapiens
LTQPSPASA

SEQ ID NO: 1271448 - protein, 9 aa, Homo Sapiens
HRGGRMRVA

SEQ ID NO: 1271449 - protein, 9 aa, Homo Sapiens
QQPRRPVVV

SEQ ID NO: 1271450 - protein, 9 aa, Homo Sapiens
FNTMGLYDR

SEQ ID NO: 1271451 - protein, 9 aa, Homo Sapiens
LHHCQPNLL

SEQ ID NO: 1271452 - protein, 9 aa, Homo Sapiens
LHINDIVPE

SEQ ID NO: 1271453 - protein, 9 aa, Homo Sapiens
DCPRTMAGP

SEQ ID NO: 1271454 - protein, 9 aa, Homo Sapiens
AVTALLPPR

SEQ ID NO: 1271455 - protein, 9 aa, Homo Sapiens
CSSWRSSSP

SEQ ID NO: 1271456 - protein, 9 aa, Homo Sapiens
TFPSKLETT

SEQ ID NO: 1271457 - protein, 9 aa, Homo Sapiens
EADLADGAH

SEQ ID NO: 1271458 - protein, 9 aa, Homo Sapiens
ARIKGLSSF

SEQ ID NO: 1271459 - protein, 9 aa, Homo Sapiens
SSRGYPNDT

SEQ ID NO: 1271460 - protein, 9 aa, Homo Sapiens
HLVVQWPPG

SEQ ID NO: 1271461 - protein, 9 aa, Homo Sapiens
TYTGTHRHT

SEQ ID NO: 1271462 - protein, 9 aa, Homo Sapiens
CNSGVETSF

SEQ ID NO: 1271463 - protein, 9 aa, Homo Sapiens
NYRLLPYHQ

SEQ ID NO: 1271464 - protein, 9 aa, Homo Sapiens
ATWPSAAHC

SEQ ID NO: 1271465 - protein, 9 aa, Homo Sapiens
KYFGFDTNT

SEQ ID NO: 1271466 - protein, 9 aa, Homo Sapiens
LCIIPQEEL

SEQ ID NO: 1271467 - protein, 9 aa, Homo Sapiens
RRLPGAESP

SEQ ID NO: 1271468 - protein, 9 aa, Homo Sapiens
EEGRRPLFQ

SEQ ID NO: 1271469 - protein, 9 aa, Homo Sapiens
PLVAMAAGA

SEQ ID NO: 1271470 - protein, 9 aa, Homo Sapiens
ILLGPISTL

SEQ ID NO: 1271471 - protein, 9 aa, Homo Sapiens
FIVQALCLQ

SEQ ID NO: 1271472 - protein, 9 aa, Homo Sapiens
DAPVVVNCL

SEQ ID NO: 1271473 - protein, 9 aa, Homo Sapiens
KDSQPNGEV

SEQ ID NO: 1271474 - protein, 9 aa, Homo Sapiens
SLTMSSAWP

SEQ ID NO: 1271475 - protein, 9 aa, Homo Sapiens
GPKSAAEVL

SEQ ID NO: 1271476 - protein, 9 aa, Homo Sapiens
WPAIATWPS

SEQ ID NO: 1271477 - protein, 9 aa, Homo Sapiens
AIEMIDPKM

SEQ ID NO: 1271478 - protein, 9 aa, Homo Sapiens
TPGSSSQTV

SEQ ID NO: 1271479 - protein, 9 aa, Homo Sapiens
AIPNNGSPQ

SEQ ID NO: 1271480 - protein, 9 aa, Homo Sapiens
CGFCCACHP

SEQ ID NO: 1271481 - protein, 9 aa, Homo Sapiens
QARGPAPAL

SEQ ID NO: 1271482 - protein, 9 aa, Homo Sapiens
TVKECIGAS

SEQ ID NO: 1271483 - protein, 9 aa, Homo Sapiens
LGVLQPTQP

SEQ ID NO: 1271484 - protein, 9 aa, Homo Sapiens
HCPPVPGSA

SEQ ID NO: 1271485 - protein, 9 aa, Homo Sapiens
VAALKTLPL

SEQ ID NO: 1271486 - protein, 9 aa, Homo Sapiens
SRLAAASGP

SEQ ID NO: 1271487 - protein, 9 aa, Homo Sapiens
GWEEASQVG

SEQ ID NO: 1271488 - protein, 9 aa, Homo Sapiens
PTTCEEVPD

SEQ ID NO: 1271489 - protein, 9 aa, Homo Sapiens
KGIKKGGAT

SEQ ID NO: 1271490 - protein, 9 aa, Homo Sapiens
HIETAPFKA

SEQ ID NO: 1271491 - protein, 9 aa, Homo Sapiens
WLDGYARLV

SEQ ID NO: 1271492 - protein, 9 aa, Homo Sapiens
VVCDPQGIR

SEQ ID NO: 1271493 - protein, 9 aa, Homo Sapiens
RPQLSLTLP

SEQ ID NO: 1271494 - protein, 9 aa, Homo Sapiens
RLPGAESPW

SEQ ID NO: 1271495 - protein, 9 aa, Homo Sapiens
ARLRSILLD

SEQ ID NO: 1271496 - protein, 9 aa, Homo Sapiens
GEHVVHHAL

SEQ ID NO: 1271497 - protein, 9 aa, Homo Sapiens
EVLLSSLLL

SEQ ID NO: 1271498 - protein, 9 aa, Homo Sapiens
TMQNLNDHL

SEQ ID NO: 1271499 - protein, 9 aa, Homo Sapiens
LLTILLRGA

SEQ ID NO: 1271500 - protein, 9 aa, Homo Sapiens
VTALLPPRA

SEQ ID NO: 1271501 - protein, 9 aa, Homo Sapiens
RTPTTRLMA

SEQ ID NO: 1271502 - protein, 9 aa, Homo Sapiens
VWLDGYARL

SEQ ID NO: 1271503 - protein, 9 aa, Homo Sapiens
DLGVLQPTQ

SEQ ID NO: 1271504 - protein, 9 aa, Homo Sapiens
WDLGVLQPT

SEQ ID NO: 1271505 - protein, 9 aa, Homo Sapiens
TWVKSSEYY

SEQ ID NO: 1271506 - protein, 9 aa, Homo Sapiens
LSLTQPQPP

SEQ ID NO: 1271507 - protein, 9 aa, Homo Sapiens
TKSQPHSWP

SEQ ID NO: 1271508 - protein, 9 aa, Homo Sapiens
AGLSPGACR

SEQ ID NO: 1271509 - protein, 9 aa, Homo Sapiens
YGYGCYCVL

SEQ ID NO: 1271510 - protein, 9 aa, Homo Sapiens
PSTRAAPPS

SEQ ID NO: 1271511 - protein, 9 aa, Homo Sapiens
VEALTMNIV

SEQ ID NO: 1271512 - protein, 9 aa, Homo Sapiens
MAEIECDDI

SEQ ID NO: 1271513 - protein, 9 aa, Homo Sapiens
AIQVHQALQ

SEQ ID NO: 1271514 - protein, 9 aa, Homo Sapiens
SLRAARAHQ

SEQ ID NO: 1271515 - protein, 9 aa, Homo Sapiens
QALSPSLRA

SEQ ID NO: 1271516 - protein, 9 aa, Homo Sapiens
DRRKPPRYG

SEQ ID NO: 1271517 - protein, 9 aa, Homo Sapiens
KRVVCDPQG

SEQ ID NO: 1271518 - protein, 9 aa, Homo Sapiens
LVLLRQWQR

SEQ ID NO: 1271519 - protein, 9 aa, Homo Sapiens
TKVTSTVSL

SEQ ID NO: 1271520 - protein, 9 aa, Homo Sapiens
YFLSFYNGN

SEQ ID NO: 1271521 - protein, 9 aa, Homo Sapiens
WPEVWKEVR

SEQ ID NO: 1271522 - protein, 9 aa, Homo Sapiens
LIFADELPG

SEQ ID NO: 1271523 - protein, 9 aa, Homo Sapiens
LSVTLCIIP

SEQ ID NO: 1271524 - protein, 9 aa, Homo Sapiens
HRMYVYVLT

SEQ ID NO: 1271525 - protein, 9 aa, Homo Sapiens
SPPSPTIPC

SEQ ID NO: 1271526 - protein, 9 aa, Homo Sapiens
VQKKSYEYT

SEQ ID NO: 1271527 - protein, 9 aa, Homo Sapiens
AGGPPRSRL

SEQ ID NO: 1271528 - protein, 9 aa, Homo Sapiens
HWSKASEEE

SEQ ID NO: 1271529 - protein, 9 aa, Homo Sapiens
KPQKNNVST

SEQ ID NO: 1271530 - protein, 9 aa, Homo Sapiens
KRRYKAYRQ

SEQ ID NO: 1271531 - protein, 9 aa, Homo Sapiens
VDEYHPTIE

SEQ ID NO: 1271532 - protein, 9 aa, Homo Sapiens
VAGYAGNGR

SEQ ID NO: 1271533 - protein, 9 aa, Homo Sapiens
QSEFGRDLQ

SEQ ID NO: 1271534 - protein, 9 aa, Homo Sapiens
GSTETTTLP

SEQ ID NO: 1271535 - protein, 9 aa, Homo Sapiens
QFSCSSLLS

SEQ ID NO: 1271536 - protein, 9 aa, Homo Sapiens
TSMDGLSPH

SEQ ID NO: 1271537 - protein, 9 aa, Homo Sapiens
EFGRDLQKD

SEQ ID NO: 1271538 - protein, 9 aa, Homo Sapiens
KQHLLQFRH

SEQ ID NO: 1271539 - protein, 9 aa, Homo Sapiens
LAVVSLCYG

SEQ ID NO: 1271540 - protein, 9 aa, Homo Sapiens
PTMGLSLVH

SEQ ID NO: 1271541 - protein, 9 aa, Homo Sapiens
ATAAAMTQL

SEQ ID NO: 1271542 - protein, 9 aa, Homo Sapiens
RDQFSWNNF

SEQ ID NO: 1271543 - protein, 9 aa, Homo Sapiens
TAAAMTQLA

SEQ ID NO: 1271544 - protein, 9 aa, Homo Sapiens
LDTCMKTKS

SEQ ID NO: 1271545 - protein, 9 aa, Homo Sapiens
KAYRQKLEE

SEQ ID NO: 1271546 - protein, 9 aa, Homo Sapiens
VEGVTNIMT

SEQ ID NO: 1271547 - protein, 9 aa, Homo Sapiens
CAGLYPKAA

SEQ ID NO: 1271548 - protein, 9 aa, Homo Sapiens
CGYFNYRID

SEQ ID NO: 1271549 - protein, 9 aa, Homo Sapiens
SCSTAITPT

SEQ ID NO: 1271550 - protein, 9 aa, Homo Sapiens
CIFVPLLRG

SEQ ID NO: 1271551 - protein, 9 aa, Homo Sapiens
GMNWRPILT

SEQ ID NO: 1271552 - protein, 9 aa, Homo Sapiens
MPCSINLLV

SEQ ID NO: 1271553 - protein, 9 aa, Homo Sapiens
HTQTLPEVR

SEQ ID NO: 1271554 - protein, 9 aa, Homo Sapiens
TFFYSLVYN

SEQ ID NO: 1271555 - protein, 9 aa, Homo Sapiens
PKQQMSRYS

SEQ ID NO: 1271556 - protein, 9 aa, Homo Sapiens
HFFFYVGWL

SEQ ID NO: 1271557 - protein, 9 aa, Homo Sapiens
MVESWKSFK

SEQ ID NO: 1271558 - protein, 9 aa, Homo Sapiens
PMGNFFLYL

SEQ ID NO: 1271559 - protein, 9 aa, Homo Sapiens
DELLVFEQF

SEQ ID NO: 1271560 - protein, 9 aa, Homo Sapiens
NTSMDGLSP

SEQ ID NO: 1271561 - protein, 9 aa, Homo Sapiens
AITPTMLAN

SEQ ID NO: 1271562 - protein, 9 aa, Homo Sapiens
EQNSPPKKV

SEQ ID NO: 1271563 - protein, 9 aa, Homo Sapiens
YIRIVTVIL

SEQ ID NO: 1271564 - protein, 9 aa, Homo Sapiens
SSCMGGMNW

SEQ ID NO: 1271565 - protein, 9 aa, Homo Sapiens
ESDLKGPEL

SEQ ID NO: 1271566 - protein, 9 aa, Homo Sapiens
FIVDGRREH

SEQ ID NO: 1271567 - protein, 9 aa, Homo Sapiens
STAITPTML

SEQ ID NO: 1271568 - protein, 9 aa, Homo Sapiens
KKIDEFLAT

SEQ ID NO: 1271569 - protein, 9 aa, Homo Sapiens
LYPKAAKIR

SEQ ID NO: 1271570 - protein, 9 aa, Homo Sapiens
LENGEYWPR

SEQ ID NO: 1271571 - protein, 9 aa, Homo Sapiens
GHRKWVRMV

SEQ ID NO: 1271572 - protein, 9 aa, Homo Sapiens
ELVINKMNQ

SEQ ID NO: 1271573 - protein, 9 aa, Homo Sapiens
QIIMAAYTA

SEQ ID NO: 1271574 - protein, 9 aa, Homo Sapiens
YSLVYNPSL

SEQ ID NO: 1271575 - protein, 9 aa, Homo Sapiens
LKRRYKAYR

SEQ ID NO: 1271576 - protein, 9 aa, Homo Sapiens
HYASESRND

SEQ ID NO: 1271577 - protein, 9 aa, Homo Sapiens
RERLFRWQK

SEQ ID NO: 1271578 - protein, 9 aa, Homo Sapiens
DVKDSDMCV

SEQ ID NO: 1271579 - protein, 9 aa, Homo Sapiens
MFVGSDEFH

SEQ ID NO: 1271580 - protein, 9 aa, Homo Sapiens
IAKKIDEFL

SEQ ID NO: 1271581 - protein, 9 aa, Homo Sapiens
GYSYQGVIF

SEQ ID NO: 1271582 - protein, 9 aa, Homo Sapiens
SEKIHYASE

SEQ ID NO: 1271583 - protein, 9 aa, Homo Sapiens
KFLFLKKYS

SEQ ID NO: 1271584 - protein, 9 aa, Homo Sapiens
NVSTWANVP

SEQ ID NO: 1271585 - protein, 9 aa, Homo Sapiens
IFVPLLRGH

SEQ ID NO: 1271586 - protein, 9 aa, Homo Sapiens
PNHMPCSIN

SEQ ID NO: 1271587 - protein, 9 aa, Homo Sapiens
FRWQKIEKI

SEQ ID NO: 1271588 - protein, 9 aa, Homo Sapiens
SSLPNHMPC

SEQ ID NO: 1271589 - protein, 9 aa, Homo Sapiens
IMAAYTASH

SEQ ID NO: 1271590 - protein, 9 aa, Homo Sapiens
KVPALRLPA

SEQ ID NO: 1271591 - protein, 9 aa, Homo Sapiens
HFFQIGMDT

SEQ ID NO: 1271592 - protein, 9 aa, Homo Sapiens
EVEGVTNIM

SEQ ID NO: 1271593 - protein, 9 aa, Homo Sapiens
YFMCTSVSV

SEQ ID NO: 1271594 - protein, 9 aa, Homo Sapiens
GLNLTCALQ

SEQ ID NO: 1271595 - protein, 9 aa, Homo Sapiens
TTYFMCTSV

SEQ ID NO: 1271596 - protein, 9 aa, Homo Sapiens
TQVLGTQKT

SEQ ID NO: 1271597 - protein, 9 aa, Homo Sapiens
IHYASESRN

SEQ ID NO: 1271598 - protein, 9 aa, Homo Sapiens
SPPKKVKRG

SEQ ID NO: 1271599 - protein, 9 aa, Homo Sapiens
GRDLQKDIR

SEQ ID NO: 1271600 - protein, 9 aa, Homo Sapiens
RDLQKDIRS

SEQ ID NO: 1271601 - protein, 9 aa, Homo Sapiens
TFLLEFQFS

SEQ ID NO: 1271602 - protein, 9 aa, Homo Sapiens
KQQMSRYSP

SEQ ID NO: 1271603 - protein, 9 aa, Homo Sapiens
SDEFHFFQI

SEQ ID NO: 1271604 - protein, 9 aa, Homo Sapiens
HLLQFRHRG

SEQ ID NO: 1271605 - protein, 9 aa, Homo Sapiens
FFAWGPMGN

SEQ ID NO: 1271606 - protein, 9 aa, Homo Sapiens
IKELQENTQ

SEQ ID NO: 1271607 - protein, 9 aa, Homo Sapiens
SWKSFKFRN

SEQ ID NO: 1271608 - protein, 9 aa, Homo Sapiens
AAYTASHSI

SEQ ID NO: 1271609 - protein, 9 aa, Homo Sapiens
SGHNDHESH

SEQ ID NO: 1271610 - protein, 9 aa, Homo Sapiens
PVIIYDEAT

SEQ ID NO: 1271611 - protein, 9 aa, Homo Sapiens
ELTSVLKPV

SEQ ID NO: 1271612 - protein, 9 aa, Homo Sapiens
SCVAGYAGN

SEQ ID NO: 1271613 - protein, 9 aa, Homo Sapiens
KIAKKIDEF

SEQ ID NO: 1271614 - protein, 9 aa, Homo Sapiens
PCSINLLVQ

SEQ ID NO: 1271615 - protein, 9 aa, Homo Sapiens
LRLLHMAIE

SEQ ID NO: 1271616 - protein, 9 aa, Homo Sapiens
IRIVTVILR

SEQ ID NO: 1271617 - protein, 9 aa, Homo Sapiens
IIALSYIRI

SEQ ID NO: 1271618 - protein, 9 aa, Homo Sapiens
LIIALSYIR

SEQ ID NO: 1271619 - protein, 9 aa, Homo Sapiens
EGLSMLTVP

SEQ ID NO: 1271620 - protein, 9 aa, Homo Sapiens
RVFKNANIV

SEQ ID NO: 1271621 - protein, 9 aa, Homo Sapiens
QSEVEGVTN

SEQ ID NO: 1271622 - protein, 9 aa, Homo Sapiens
DLKGPELDI

SEQ ID NO: 1271623 - protein, 9 aa, Homo Sapiens
LLQFRHRGA

SEQ ID NO: 1271624 - protein, 9 aa, Homo Sapiens
MCTSVSVST

SEQ ID NO: 1271625 - protein, 9 aa, Homo Sapiens
NNVSTWANV

SEQ ID NO: 1271626 - protein, 9 aa, Homo Sapiens
TSEGLSMLT

SEQ ID NO: 1271627 - protein, 9 aa, Homo Sapiens
VKIFVNAIA

SEQ ID NO: 1271628 - protein, 9 aa, Homo Sapiens
PGTETQVLG

SEQ ID NO: 1271629 - protein, 9 aa, Homo Sapiens
VINKMNQLL

SEQ ID NO: 1271630 - protein, 9 aa, Homo Sapiens
FHFFQIGMD

SEQ ID NO: 1271631 - protein, 9 aa, Homo Sapiens
LVINKMNQL

SEQ ID NO: 1271632 - protein, 9 aa, Homo Sapiens
TFTGHRKWV

SEQ ID NO: 1271633 - protein, 9 aa, Homo Sapiens
FKQHLLQFR

SEQ ID NO: 1271634 - protein, 9 aa, Homo Sapiens
KDFESVNEG

SEQ ID NO: 1271635 - protein, 9 aa, Homo Sapiens
AKCLLEITD

SEQ ID NO: 1271636 - protein, 9 aa, Homo Sapiens
ICAGLYPKA

SEQ ID NO: 1271637 - protein, 9 aa, Homo Sapiens
GGYSYQGVI

SEQ ID NO: 1271638 - protein, 9 aa, Homo Sapiens
GRVFKNANI

SEQ ID NO: 1271639 - protein, 9 aa, Homo Sapiens
MSRYSPPWW

SEQ ID NO: 1271640 - protein, 9 aa, Homo Sapiens
RVDKDGSGV

SEQ ID NO: 1271641 - protein, 9 aa, Homo Sapiens
AAAMTQLAV

SEQ ID NO: 1271642 - protein, 9 aa, Homo Sapiens
RNSALDTCM

SEQ ID NO: 1271643 - protein, 9 aa, Homo Sapiens
YTASHSILL

SEQ ID NO: 1271644 - protein, 9 aa, Homo Sapiens
QNHFVDEYH

SEQ ID NO: 1271645 - protein, 9 aa, Homo Sapiens
FRHRGAFEL

SEQ ID NO: 1271646 - protein, 9 aa, Homo Sapiens
GKTVSFVDV

SEQ ID NO: 1271647 - protein, 9 aa, Homo Sapiens
LDPNTSMDG

SEQ ID NO: 1271648 - protein, 9 aa, Homo Sapiens
VELTSVLKP

SEQ ID NO: 1271649 - protein, 9 aa, Homo Sapiens
PHDLENGEY

SEQ ID NO: 1271650 - protein, 9 aa, Homo Sapiens
VFKNANIVQ

SEQ ID NO: 1271651 - protein, 9 aa, Homo Sapiens
PPVIIYDEA

SEQ ID NO: 1271652 - protein, 9 aa, Homo Sapiens
ALSYIRIVT

SEQ ID NO: 1271653 - protein, 9 aa, Homo Sapiens
IALSYIRIV

SEQ ID NO: 1271654 - protein, 9 aa, Homo Sapiens
RKMVESWKS

SEQ ID NO: 1271655 - protein, 9 aa, Homo Sapiens
QDDQAEEEQ

SEQ ID NO: 1271656 - protein, 9 aa, Homo Sapiens
NKMNQLLSR

SEQ ID NO: 1271657 - protein, 9 aa, Homo Sapiens
IESGHNDHE

SEQ ID NO: 1271658 - protein, 9 aa, Homo Sapiens
AIESGHNDH

SEQ ID NO: 1271659 - protein, 9 aa, Homo Sapiens
SVPGRVFKN

SEQ ID NO: 1271660 - protein, 9 aa, Homo Sapiens
WCGYFNYRI

SEQ ID NO: 1271661 - protein, 9 aa, Homo Sapiens
KIFVNAIAY

SEQ ID NO: 1271662 - protein, 9 aa, Homo Sapiens
QGVIFPTLR

SEQ ID NO: 1271663 - protein, 9 aa, Homo Sapiens
VYNPSLKTL

SEQ ID NO: 1271664 - protein, 9 aa, Homo Sapiens
SEGLSMLTV

SEQ ID NO: 1271665 - protein, 9 aa, Homo Sapiens
YFNYRIDLP

SEQ ID NO: 1271666 - protein, 9 aa, Homo Sapiens
FYSLVYNPS

SEQ ID NO: 1271667 - protein, 9 aa, Homo Sapiens
ETTTLPGST

SEQ ID NO: 1271668 - protein, 9 aa, Homo Sapiens
ITELVINKM

SEQ ID NO: 1271669 - protein, 9 aa, Homo Sapiens
CPRPHDLEN

SEQ ID NO: 1271670 - protein, 9 aa, Homo Sapiens
LYSGLISTQ

SEQ ID NO: 1271671 - protein, 9 aa, Homo Sapiens
LQFRHRGAF

SEQ ID NO: 1271672 - protein, 9 aa, Homo Sapiens
LEITDDDAN

SEQ ID NO: 1271673 - protein, 9 aa, Homo Sapiens
HRKWVRMVR

SEQ ID NO: 1271674 - protein, 9 aa, Homo Sapiens
EQALRLLHM

SEQ ID NO: 1271675 - protein, 9 aa, Homo Sapiens
MKEFSSTGQ

SEQ ID NO: 1271676 - protein, 9 aa, Homo Sapiens
KNNVSTWAN

SEQ ID NO: 1271677 - protein, 9 aa, Homo Sapiens
KIEKICGFQ

SEQ ID NO: 1271678 - protein, 9 aa, Homo Sapiens
LFRWQKIEK

SEQ ID NO: 1271679 - protein, 9 aa, Homo Sapiens
RKWVRMVRP

SEQ ID NO: 1271680 - protein, 9 aa, Homo Sapiens
KAAKIRLNL

SEQ ID NO: 1271681 - protein, 9 aa, Homo Sapiens
KNDVKDSDM

SEQ ID NO: 1271682 - protein, 9 aa, Homo Sapiens
MAAYTASHS

SEQ ID NO: 1271683 - protein, 9 aa, Homo Sapiens
YLKFLFLKK

SEQ ID NO: 1271684 - protein, 9 aa, Homo Sapiens
TLPEVRDQF

SEQ ID NO: 1271685 - protein, 9 aa, Homo Sapiens
TKIAKKIDE

SEQ ID NO: 1271686 - protein, 9 aa, Homo Sapiens
FVPTMGLSL

SEQ ID NO: 1271687 - protein, 9 aa, Homo Sapiens
ITDDDANRI

SEQ ID NO: 1271688 - protein, 9 aa, Homo Sapiens
LITELVINK

SEQ ID NO: 1271689 - protein, 9 aa, Homo Sapiens
MNDALHGGW

SEQ ID NO: 1271690 - protein, 9 aa, Homo Sapiens
VGTKIAKKI

SEQ ID NO: 1271691 - protein, 9 aa, Homo Sapiens
WRPILTIIT

SEQ ID NO: 1271692 - protein, 9 aa, Homo Sapiens
QHLLQFRHR

SEQ ID NO: 1271693 - protein, 9 aa, Homo Sapiens
FESVNEGKM

SEQ ID NO: 1271694 - protein, 9 aa, Homo Sapiens
YQGVIFPTL

SEQ ID NO: 1271695 - protein, 9 aa, Homo Sapiens
LVFEQFIVD

SEQ ID NO: 1271696 - protein, 9 aa, Homo Sapiens
GFGTKVPAL

SEQ ID NO: 1271697 - protein, 9 aa, Homo Sapiens
DGSGVISDT

SEQ ID NO: 1271698 - protein, 9 aa, Homo Sapiens
HPTIEDSYR

SEQ ID NO: 1271699 - protein, 9 aa, Homo Sapiens
FWCGYFNYR

SEQ ID NO: 1271700 - protein, 9 aa, Homo Sapiens
LNLTCALQN

SEQ ID NO: 1271701 - protein, 9 aa, Homo Sapiens
GRPKQQMSR

SEQ ID NO: 1271702 - protein, 9 aa, Homo Sapiens
PPKKVKRGR

SEQ ID NO: 1271703 - protein, 9 aa, Homo Sapiens
ERLFRWQKI

SEQ ID NO: 1271704 - protein, 9 aa, Homo Sapiens
IETPGTETQ

SEQ ID NO: 1271705 - protein, 9 aa, Homo Sapiens
DQAEEEQED

SEQ ID NO: 1271706 - protein, 9 aa, Homo Sapiens
VSLCYGPLM

SEQ ID NO: 1271707 - protein, 9 aa, Homo Sapiens
FLLTCIFVP

SEQ ID NO: 1271708 - protein, 9 aa, Homo Sapiens
KAAIESGHN

SEQ ID NO: 1271709 - protein, 9 aa, Homo Sapiens
DALHGGWTT

SEQ ID NO: 1271710 - protein, 9 aa, Homo Sapiens
SGSTETTTL

SEQ ID NO: 1271711 - protein, 9 aa, Homo Sapiens
AWGPMGNFF

SEQ ID NO: 1271712 - protein, 9 aa, Homo Sapiens
YAGNGRQCV

SEQ ID NO: 1271713 - protein, 9 aa, Homo Sapiens
FAWGPMGNF

SEQ ID NO: 1271714 - protein, 9 aa, Homo Sapiens
IAKCLLEIT

SEQ ID NO: 1271715 - protein, 9 aa, Homo Sapiens
EGVTNIMTQ

SEQ ID NO: 1271716 - protein, 9 aa, Homo Sapiens
VNAIAYPPL

SEQ ID NO: 1271717 - protein, 9 aa, Homo Sapiens
TTTYFMCTS

SEQ ID NO: 1271718 - protein, 9 aa, Homo Sapiens
ELQENTQTT

SEQ ID NO: 1271719 - protein, 9 aa, Homo Sapiens
IHCPRPHDL

SEQ ID NO: 1271720 - protein, 9 aa, Homo Sapiens
VFEQFIVDG

SEQ ID NO: 1271721 - protein, 9 aa, Homo Sapiens
AGLYPKAAK

SEQ ID NO: 1271722 - protein, 9 aa, Homo Sapiens
KQDFEYNKE

SEQ ID NO: 1271723 - protein, 9 aa, Homo Sapiens
RLFRWQKIE

SEQ ID NO: 1271724 - protein, 9 aa, Homo Sapiens
AVLVFFVPT

SEQ ID NO: 1271725 - protein, 9 aa, Homo Sapiens
VPALRLPAK

SEQ ID NO: 1271726 - protein, 9 aa, Homo Sapiens
FEQFIVDGR

SEQ ID NO: 1271727 - protein, 9 aa, Homo Sapiens
LQNLKRRYK

SEQ ID NO: 1271728 - protein, 9 aa, Homo Sapiens
QAEEEQEDN

SEQ ID NO: 1271729 - protein, 9 aa, Homo Sapiens
DPPVIIYDE

SEQ ID NO: 1271730 - protein, 9 aa, Homo Sapiens
VGSDEFHFF

SEQ ID NO: 1271731 - protein, 9 aa, Homo Sapiens
WKSFKFRNQ

SEQ ID NO: 1271732 - protein, 9 aa, Homo Sapiens
VFFVPTMGL

SEQ ID NO: 1271733 - protein, 9 aa, Homo Sapiens
DDQAEEEQE

SEQ ID NO: 1271734 - protein, 9 aa, Homo Sapiens
IPEQALRLL

SEQ ID NO: 1271735 - protein, 9 aa, Homo Sapiens
SLPNHMPCS

SEQ ID NO: 1271736 - protein, 9 aa, Homo Sapiens
FMKQMNDAL

SEQ ID NO: 1271737 - protein, 9 aa, Homo Sapiens
QRVDKDGSG

SEQ ID NO: 1271738 - protein, 9 aa, Homo Sapiens
ITPTMLANF

SEQ ID NO: 1271739 - protein, 9 aa, Homo Sapiens
GNFFLYLFA

SEQ ID NO: 1271740 - protein, 9 aa, Homo Sapiens
FQRVDKDGS

SEQ ID NO: 1271741 - protein, 9 aa, Homo Sapiens
SLCYGPLMV

SEQ ID NO: 1271742 - protein, 9 aa, Homo Sapiens
LLTCIFVPL

SEQ ID NO: 1271743 - protein, 9 aa, Homo Sapiens
GLDPNTSMD

SEQ ID NO: 1271744 - protein, 9 aa, Homo Sapiens
NSALDTCMK

SEQ ID NO: 1271745 - protein, 9 aa, Homo Sapiens
LSVPGRVFK

SEQ ID NO: 1271746 - protein, 9 aa, Homo Sapiens
NLRLRKDFE

SEQ ID NO: 1271747 - protein, 9 aa, Homo Sapiens
CEGKTVSFV

SEQ ID NO: 1271748 - protein, 9 aa, Homo Sapiens
CVAGYAGNG

SEQ ID NO: 1271749 - protein, 9 aa, Homo Sapiens
FFYSLVYNP

SEQ ID NO: 1271750 - protein, 9 aa, Homo Sapiens
LAVKSLKRP

SEQ ID NO: 1271751 - protein, 9 aa, Homo Sapiens
EQFIVDGRR

SEQ ID NO: 1271752 - protein, 9 aa, Homo Sapiens
YPKAAKIRL

SEQ ID NO: 1271753 - protein, 9 aa, Homo Sapiens
PEVRDQFSW

SEQ ID NO: 1271754 - protein, 9 aa, Homo Sapiens
MTQLAVKSL

SEQ ID NO: 1271755 - protein, 9 aa, Homo Sapiens
CALQNDGIY

SEQ ID NO: 1271756 - protein, 9 aa, Homo Sapiens
GTETQVLGT

SEQ ID NO: 1271757 - protein, 9 aa, Homo Sapiens
KDSDMCVSE

SEQ ID NO: 1271758 - protein, 9 aa, Homo Sapiens
QFRHRGAFE

SEQ ID NO: 1271759 - protein, 9 aa, Homo Sapiens
FGTKVPALR

SEQ ID NO: 1271760 - protein, 9 aa, Homo Sapiens
FEYNKEYRL

SEQ ID NO: 1271761 - protein, 9 aa, Homo Sapiens
LPEVRDQFS

SEQ ID NO: 1271762 - protein, 9 aa, Homo Sapiens
KELQENTQT

SEQ ID NO: 1271763 - protein, 9 aa, Homo Sapiens
TETQVLGTQ

SEQ ID NO: 1271764 - protein, 9 aa, Homo Sapiens
AYTASHSIL

SEQ ID NO: 1271765 - protein, 9 aa, Homo Sapiens
LKGPELDIE

SEQ ID NO: 1271766 - protein, 9 aa, Homo Sapiens
PKAAKIRLN

SEQ ID NO: 1271767 - protein, 9 aa, Homo Sapiens
NDHESHMKQ

SEQ ID NO: 1271768 - protein, 9 aa, Homo Sapiens
IAYLKFLFL

SEQ ID NO: 1271769 - protein, 9 aa, Homo Sapiens
AGNGRQCVA

SEQ ID NO: 1271770 - protein, 9 aa, Homo Sapiens
FLNGGYSYQ

SEQ ID NO: 1271771 - protein, 9 aa, Homo Sapiens
NDALHGGWT

SEQ ID NO: 1271772 - protein, 9 aa, Homo Sapiens
RWQKIEKIC

SEQ ID NO: 1271773 - protein, 9 aa, Homo Sapiens
IVTSEGLSM

SEQ ID NO: 1271774 - protein, 9 aa, Homo Sapiens
QKIEKICGF

SEQ ID NO: 1271775 - protein, 9 aa, Homo Sapiens
FVNAIAYPP

SEQ ID NO: 1271776 - protein, 9 aa, Homo Sapiens
WGPMGNFFL

SEQ ID NO: 1271777 - protein, 9 aa, Homo Sapiens
LQKDIRSDT

SEQ ID NO: 1271778 - protein, 9 aa, Homo Sapiens
DMCVSESND

SEQ ID NO: 1271779 - protein, 9 aa, Homo Sapiens
RLRKDFESV

SEQ ID NO: 1271780 - protein, 9 aa, Homo Sapiens
PTMLANFLA

SEQ ID NO: 1271781 - protein, 9 aa, Homo Sapiens
YGPLMVMYV

SEQ ID NO: 1271782 - protein, 9 aa, Homo Sapiens
TFLLTCIFV

SEQ ID NO: 1271783 - protein, 9 aa, Homo Sapiens
NHFVDEYHP

SEQ ID NO: 1271784 - protein, 9 aa, Homo Sapiens
PQKNNVSTW

SEQ ID NO: 1271785 - protein, 9 aa, Homo Sapiens
EFHFFQIGM

SEQ ID NO: 1271786 - protein, 9 aa, Homo Sapiens
LTSVLKPVF

SEQ ID NO: 1271787 - protein, 9 aa, Homo Sapiens
VKTFTGHRK

SEQ ID NO: 1271788 - protein, 9 aa, Homo Sapiens
ALQNDGIYI

SEQ ID NO: 1271789 - protein, 9 aa, Homo Sapiens
NKEYRLTIN

SEQ ID NO: 1271790 - protein, 9 aa, Homo Sapiens
NLPAGRPKQ

SEQ ID NO: 1271791 - protein, 9 aa, Homo Sapiens
TYFMCTSVS

SEQ ID NO: 1271792 - protein, 9 aa, Homo Sapiens
QALRLLHMA

SEQ ID NO: 1271793 - protein, 9 aa, Homo Sapiens
SIAKCLLEI

SEQ ID NO: 1271794 - protein, 9 aa, Homo Sapiens
VPLLRGHSL

SEQ ID NO: 1271795 - protein, 9 aa, Homo Sapiens
GSGVISDTE

SEQ ID NO: 1271796 - protein, 9 aa, Homo Sapiens
VRDQFSWNN

SEQ ID NO: 1271797 - protein, 9 aa, Homo Sapiens
FLTIAYLKF

SEQ ID NO: 1271798 - protein, 9 aa, Homo Sapiens
DLQKDIRSD

SEQ ID NO: 1271799 - protein, 9 aa, Homo Sapiens
SEVEGVTNI

SEQ ID NO: 1271800 - protein, 9 aa, Homo Sapiens
DFESVNEGK

SEQ ID NO: 1271801 - protein, 9 aa, Homo Sapiens
NWRPILTII

SEQ ID NO: 1271802 - protein, 9 aa, Homo Sapiens
CSTAITPTM

SEQ ID NO: 1271803 - protein, 9 aa, Homo Sapiens
PRPHDLENG

SEQ ID NO: 1271804 - protein, 9 aa, Homo Sapiens
LPLSEKIHY

SEQ ID NO: 1271805 - protein, 9 aa, Homo Sapiens
LFLDCEGKT

SEQ ID NO: 1271806 - protein, 9 aa, Homo Sapiens
DSDMCVSES

SEQ ID NO: 1271807 - protein, 9 aa, Homo Sapiens
KEFSSTGQG

SEQ ID NO: 1271808 - protein, 9 aa, Homo Sapiens
AKIKELQEN

SEQ ID NO: 1271809 - protein, 9 aa, Homo Sapiens
MCVSESNDN

SEQ ID NO: 1271810 - protein, 9 aa, Homo Sapiens
GTKIAKKID

SEQ ID NO: 1271811 - protein, 9 aa, Homo Sapiens
LTCIFVPLL

SEQ ID NO: 1271812 - protein, 9 aa, Homo Sapiens
TQLAVKSLK

SEQ ID NO: 1271813 - protein, 9 aa, Homo Sapiens
GIPEQALRL

SEQ ID NO: 1271814 - protein, 9 aa, Homo Sapiens
LPAGRPKQQ

SEQ ID NO: 1271815 - protein, 9 aa, Homo Sapiens
ISLSLTYFW

SEQ ID NO: 1271816 - protein, 9 aa, Homo Sapiens
EYHPTIEDS

SEQ ID NO: 1271817 - protein, 9 aa, Homo Sapiens
AAMTQLAVK

SEQ ID NO: 1271818 - protein, 9 aa, Homo Sapiens
PGRVFKNAN

SEQ ID NO: 1271819 - protein, 9 aa, Homo Sapiens
HDYVFWCGY

SEQ ID NO: 1271820 - protein, 9 aa, Homo Sapiens
TCMKTKSQP

SEQ ID NO: 1271821 - protein, 9 aa, Homo Sapiens
SRYSPPWWK

SEQ ID NO: 1271822 - protein, 9 aa, Homo Sapiens
QQMSRYSPP

SEQ ID NO: 1271823 - protein, 9 aa, Homo Sapiens
KKVKRGRPP

SEQ ID NO: 1271824 - protein, 9 aa, Homo Sapiens
QNLKRRYKA

SEQ ID NO: 1271825 - protein, 9 aa, Homo Sapiens
KDGSGVISD

SEQ ID NO: 1271826 - protein, 9 aa, Homo Sapiens
VPTMGLSLV

SEQ ID NO: 1271827 - protein, 9 aa, Homo Sapiens
QDFEYNKEY

SEQ ID NO: 1271828 - protein, 9 aa, Homo Sapiens
GLYPKAAKI

SEQ ID NO: 1271829 - protein, 9 aa, Homo Sapiens
QKDIRSDTS

SEQ ID NO: 1271830 - protein, 9 aa, Homo Sapiens
QMSRYSPPW

SEQ ID NO: 1271831 - protein, 9 aa, Homo Sapiens
KVKRGRPPK

SEQ ID NO: 1271832 - protein, 9 aa, Homo Sapiens
KTTTYFMCT

SEQ ID NO: 1271833 - protein, 9 aa, Homo Sapiens
PSVELTSVL

SEQ ID NO: 1271834 - protein, 9 aa, Homo Sapiens
LSLTYFWPK

SEQ ID NO: 1271835 - protein, 9 aa, Homo Sapiens
EKIHYASES

SEQ ID NO: 1271836 - protein, 9 aa, Homo Sapiens
AEEEQEDNE

SEQ ID NO: 1271837 - protein, 9 aa, Homo Sapiens
LDCEGKTVS

SEQ ID NO: 1271838 - protein, 9 aa, Homo Sapiens
VPGRVFKNA

SEQ ID NO: 1271839 - protein, 9 aa, Homo Sapiens
TQTLPEVRD

SEQ ID NO: 1271840 - protein, 9 aa, Homo Sapiens
PVFTFLHFF

SEQ ID NO: 1271841 - protein, 9 aa, Homo Sapiens
TKVPALRLP

SEQ ID NO: 1271842 - protein, 9 aa, Homo Sapiens
AGRPKQQMS

SEQ ID NO: 1271843 - protein, 9 aa, Homo Sapiens
EVRDQFSWN

SEQ ID NO: 1271844 - protein, 9 aa, Homo Sapiens
DEFHFFQIG

SEQ ID NO: 1271845 - protein, 9 aa, Homo Sapiens
TMGLSLVHR

SEQ ID NO: 1271846 - protein, 9 aa, Homo Sapiens
FTGHRKWVR

SEQ ID NO: 1271847 - protein, 9 aa, Homo Sapiens
LQNDGIYIM

SEQ ID NO: 1271848 - protein, 9 aa, Homo Sapiens
TPGTETQVL

SEQ ID NO: 1271849 - protein, 9 aa, Homo Sapiens
RKDFESVNE

SEQ ID NO: 1271850 - protein, 9 aa, Homo Sapiens
SSGSTETTT

SEQ ID NO: 1271851 - protein, 9 aa, Homo Sapiens
LRLRKDFES

SEQ ID NO: 1271852 - protein, 9 aa, Homo Sapiens
VSTWANVPL

SEQ ID NO: 1271853 - protein, 9 aa, Homo Sapiens
NHMPCSINL

SEQ ID NO: 1271854 - protein, 9 aa, Homo Sapiens
LLVFEQFIV

SEQ ID NO: 1271855 - protein, 9 aa, Homo Sapiens
VFTFLHFFF

SEQ ID NO: 1271856 - protein, 9 aa, Homo Sapiens
LSYIRIVTV

SEQ ID NO: 1271857 - protein, 9 aa, Homo Sapiens
KTFTGHRKW

SEQ ID NO: 1271858 - protein, 9 aa, Homo Sapiens
PALRLPAKD

SEQ ID NO: 1271859 - protein, 9 aa, Homo Sapiens
TAITPTMLA

SEQ ID NO: 1271860 - protein, 9 aa, Homo Sapiens
FSMNLYSGL

SEQ ID NO: 1271861 - protein, 9 aa, Homo Sapiens
LEFQFSCSS

SEQ ID NO: 1271862 - protein, 9 aa, Homo Sapiens
FLDCEGKTV

SEQ ID NO: 1271863 - protein, 9 aa, Homo Sapiens
VLVFFVPTM

SEQ ID NO: 1271864 - protein, 9 aa, Homo Sapiens
HMPCSINLL

SEQ ID NO: 1271865 - protein, 9 aa, Homo Sapiens
GGMNWRPIL

SEQ ID NO: 1271866 - protein, 9 aa, Homo Sapiens
ALRLLHMAI

SEQ ID NO: 1271867 - protein, 9 aa, Homo Sapiens
KVTFLLEFQ

SEQ ID NO: 1271868 - protein, 9 aa, Homo Sapiens
MGNFFLYLF

SEQ ID NO: 1271869 - protein, 9 aa, Homo Sapiens
PAGRPKQQM

SEQ ID NO: 1271870 - protein, 9 aa, Homo Sapiens
EFQFSCSSL

SEQ ID NO: 1271871 - protein, 9 aa, Homo Sapiens
VTSEGLSML

SEQ ID NO: 1271872 - protein, 9 aa, Homo Sapiens
QMNDALHGG

SEQ ID NO: 1271873 - protein, 9 aa, Homo Sapiens
FLLEFQFSC

SEQ ID NO: 1271874 - protein, 9 aa, Homo Sapiens
QVLGTQKTE

SEQ ID NO: 1271875 - protein, 9 aa, Homo Sapiens
LSEKIHYAS

SEQ ID NO: 1271876 - protein, 9 aa, Homo Sapiens
VVPVFTFLH

SEQ ID NO: 1271877 - protein, 9 aa, Homo Sapiens
INKMNQLLS

SEQ ID NO: 1271878 - protein, 9 aa, Homo Sapiens
RRYKAYRQK

SEQ ID NO: 1271879 - protein, 9 aa, Homo Sapiens
YHPTIEDSY

SEQ ID NO: 1271880 - protein, 9 aa, Homo Sapiens
DPNTSMDGL

SEQ ID NO: 1271881 - protein, 9 aa, Homo Sapiens
KNLRLRKDF

SEQ ID NO: 1271882 - protein, 9 aa, Homo Sapiens
YNKQDFEYN

SEQ ID NO: 1271883 - protein, 9 aa, Homo Sapiens
LPNHMPCSI

SEQ ID NO: 1271884 - protein, 9 aa, Homo Sapiens
KGPELDIEG

SEQ ID NO: 1271885 - protein, 9 aa, Homo Sapiens
TCIFVPLLR

SEQ ID NO: 1271886 - protein, 9 aa, Homo Sapiens
LQSEVEGVT

SEQ ID NO: 1271887 - protein, 9 aa, Homo Sapiens
LLEITDDDA

SEQ ID NO: 1271888 - protein, 9 aa, Homo Sapiens
KWVRMVRPN

SEQ ID NO: 1271889 - protein, 9 aa, Homo Sapiens
VPVFTFLHF

SEQ ID NO: 1271890 - protein, 9 aa, Homo Sapiens
VIIYDEATS

SEQ ID NO: 1271891 - protein, 9 aa, Homo Sapiens
GPLMVMYVS

SEQ ID NO: 1271892 - protein, 9 aa, Homo Sapiens
VTNIMTQNV

SEQ ID NO: 1271893 - protein, 9 aa, Homo Sapiens
NLTCALQND

SEQ ID NO: 1271894 - protein, 9 aa, Homo Sapiens
NAIAYPPLL

SEQ ID NO: 1271895 - protein, 9 aa, Homo Sapiens
MNWRPILTI

SEQ ID NO: 1271896 - protein, 9 aa, Homo Sapiens
MDGLSPHPA

SEQ ID NO: 1271897 - protein, 9 aa, Homo Sapiens
ETPGTETQV

SEQ ID NO: 1271898 - protein, 9 aa, Homo Sapiens
ALDTCMKTK

SEQ ID NO: 1271899 - protein, 9 aa, Homo Sapiens
AAIESGHND

SEQ ID NO: 1271900 - protein, 9 aa, Homo Sapiens
AAKIRLNLG

SEQ ID NO: 1271901 - protein, 9 aa, Homo Sapiens
DEYHPTIED

SEQ ID NO: 1271902 - protein, 9 aa, Homo Sapiens
QKNNVSTWA

SEQ ID NO: 1271903 - protein, 9 aa, Homo Sapiens
LHGGWTTKM

SEQ ID NO: 1271904 - protein, 9 aa, Homo Sapiens
DTCMKTKSQ

SEQ ID NO: 1271905 - protein, 9 aa, Homo Sapiens
GSDEFHFFQ

SEQ ID NO: 1271906 - protein, 9 aa, Homo Sapiens
TASHSILLI

SEQ ID NO: 1271907 - protein, 9 aa, Homo Sapiens
DGVFSMNLY

SEQ ID NO: 1271908 - protein, 9 aa, Homo Sapiens
ALHGGWTTK

SEQ ID NO: 1271909 - protein, 9 aa, Homo Sapiens
VTFLLEFQF

SEQ ID NO: 1271910 - protein, 9 aa, Homo Sapiens
IFVNAIAYP

SEQ ID NO: 1271911 - protein, 9 aa, Homo Sapiens
HNDHESHMK

SEQ ID NO: 1271912 - protein, 9 aa, Homo Sapiens
PKKVKRGRP

SEQ ID NO: 1271913 - protein, 9 aa, Homo Sapiens
YKAYRQKLE

SEQ ID NO: 1271914 - protein, 9 aa, Homo Sapiens
YFKQHLLQF

SEQ ID NO: 1271915 - protein, 9 aa, Homo Sapiens
PELDIEGPE

SEQ ID NO: 1271916 - protein, 9 aa, Homo Sapiens
SSKPQKNNV

SEQ ID NO: 1271917 - protein, 9 aa, Homo Sapiens
CTSVSVSTF

SEQ ID NO: 1271918 - protein, 9 aa, Homo Sapiens
KDGVFSMNL

SEQ ID NO: 1271919 - protein, 9 aa, Homo Sapiens
VFQRVDKDG

SEQ ID NO: 1271920 - protein, 9 aa, Homo Sapiens
TMLANFLAS

SEQ ID NO: 1271921 - protein, 9 aa, Homo Sapiens
TFLHFFFYV

SEQ ID NO: 1271922 - protein, 9 aa, Homo Sapiens
LRKDFESVN

SEQ ID NO: 1271923 - protein, 9 aa, Homo Sapiens
ALRLPAKDW

SEQ ID NO: 1271924 - protein, 9 aa, Homo Sapiens
GPMGNFFLY

SEQ ID NO: 1271925 - protein, 9 aa, Homo Sapiens
FVPLLRGHS

SEQ ID NO: 1271926 - protein, 9 aa, Homo Sapiens
MMKEFSSTG

SEQ ID NO: 1271927 - protein, 9 aa, Homo Sapiens
ALPLSEKIH

SEQ ID NO: 1271928 - protein, 9 aa, Homo Sapiens
YSYQGVIFP

SEQ ID NO: 1271929 - protein, 9 aa, Homo Sapiens
FTFLHFFFY

SEQ ID NO: 1271930 - protein, 9 aa, Homo Sapiens
HFVDEYHPT

SEQ ID NO: 1271931 - protein, 9 aa, Homo Sapiens
FRKMVESWK

SEQ ID NO: 1271932 - protein, 9 aa, Homo Sapiens
AMTQLAVKS

SEQ ID NO: 1271933 - protein, 9 aa, Homo Sapiens
WQKIEKICG

SEQ ID NO: 1271934 - protein, 9 aa, Homo Sapiens
FKNANIVQG

SEQ ID NO: 1271935 - protein, 9 aa, Homo Sapiens
FVDEYHPTI

SEQ ID NO: 1271936 - protein, 9 aa, Homo Sapiens
EFSSTGQGN

SEQ ID NO: 1271937 - protein, 9 aa, Homo Sapiens
VVSLCYGPL

SEQ ID NO: 1271938 - protein, 9 aa, Homo Sapiens
GKIVTSEGL

SEQ ID NO: 1271939 - protein, 9 aa, Homo Sapiens
MKQMNDALH

SEQ ID NO: 1271940 - protein, 9 aa, Homo Sapiens
ESWKSFKFR

SEQ ID NO: 1271941 - protein, 9 aa, Homo Sapiens
SEFGRDLQK

SEQ ID NO: 1271942 - protein, 9 aa, Homo Sapiens
FVGSDEFHF

SEQ ID NO: 1271943 - protein, 9 aa, Homo Sapiens
CMGGMNWRP

SEQ ID NO: 1271944 - protein, 9 aa, Homo Sapiens
FQFSCSSLL

SEQ ID NO: 1271945 - protein, 9 aa, Homo Sapiens
SDMCVSESN

SEQ ID NO: 1271946 - protein, 9 aa, Homo Sapiens
TPTMLANFL

SEQ ID NO: 1271947 - protein, 9 aa, Homo Sapiens
LHFFFYVGW

SEQ ID NO: 1271948 - protein, 9 aa, Homo Sapiens
LKFLFLKKY

SEQ ID NO: 1271949 - protein, 9 aa, Homo Sapiens
YVFWCGYFN

SEQ ID NO: 1271950 - protein, 9 aa, Homo Sapiens
FLHFFFYVG

SEQ ID NO: 1271951 - protein, 9 aa, Homo Sapiens
VESWKSFKF

SEQ ID NO: 1271952 - protein, 9 aa, Homo Sapiens
SPPWWKEKL

SEQ ID NO: 1271953 - protein, 9 aa, Homo Sapiens
FGPSVELTS

SEQ ID NO: 1271954 - protein, 9 aa, Homo Sapiens
QLITELVIN

SEQ ID NO: 1271955 - protein, 9 aa, Homo Sapiens
LSMLTVPGP

SEQ ID NO: 1271956 - protein, 9 aa, Homo Sapiens
NSPPKKVKR

SEQ ID NO: 1271957 - protein, 9 aa, Homo Sapiens
LLEFQFSCS

SEQ ID NO: 1271958 - protein, 9 aa, Homo Sapiens
GYAGNGRQC

SEQ ID NO: 1271959 - protein, 9 aa, Homo Sapiens
QEDNEEEDD

SEQ ID NO: 1271960 - protein, 9 aa, Homo Sapiens
VDKDGSGVI

SEQ ID NO: 1271961 - protein, 9 aa, Homo Sapiens
PLSEKIHYA

SEQ ID NO: 1271962 - protein, 9 aa, Homo Sapiens
LQENTQTTI

SEQ ID NO: 1271963 - protein, 9 aa, Homo Sapiens
KIVTSEGLS

SEQ ID NO: 1271964 - protein, 9 aa, Homo Sapiens
NLKRRYKAY

SEQ ID NO: 1271965 - protein, 9 aa, Homo Sapiens
PNTSMDGLS

SEQ ID NO: 1271966 - protein, 9 aa, Homo Sapiens
TLPGSTTTA

SEQ ID NO: 1271967 - protein, 9 aa, Homo Sapiens
RYKAYRQKL

SEQ ID NO: 1271968 - protein, 9 aa, Homo Sapiens
SKPQKNNVS

SEQ ID NO: 1271969 - protein, 9 aa, Homo Sapiens
IYDEATSSL

SEQ ID NO: 1271970 - protein, 9 aa, Homo Sapiens
VFSMNLYSG

SEQ ID NO: 1271971 - protein, 9 aa, Homo Sapiens
GHNDHESHM

SEQ ID NO: 1271972 - protein, 9 aa, Homo Sapiens
GAKIKELQE

SEQ ID NO: 1271973 - protein, 9 aa, Homo Sapiens
KGAKIKELQ

SEQ ID NO: 1271974 - protein, 9 aa, Homo Sapiens
GTKVPALRL

SEQ ID NO: 1271975 - protein, 9 aa, Homo Sapiens
HDLENGEYW

SEQ ID NO: 1271976 - protein, 9 aa, Homo Sapiens
FLIIALSYI

SEQ ID NO: 1271977 - protein, 9 aa, Homo Sapiens
RPKQQMSRY

SEQ ID NO: 1271978 - protein, 9 aa, Homo Sapiens
SYQGVIFPT

SEQ ID NO: 1271979 - protein, 9 aa, Homo Sapiens
ILKDPPVII

SEQ ID NO: 1271980 - protein, 9 aa, Homo Sapiens
KDPPVIIYD

SEQ ID NO: 1271981 - protein, 9 aa, Homo Sapiens
QENTQTTIK

SEQ ID NO: 1271982 - protein, 9 aa, Homo Sapiens
QNDGIYIMS

SEQ ID NO: 1271983 - protein, 9 aa, Homo Sapiens
SALDTCMKT

SEQ ID NO: 1271984 - protein, 9 aa, Homo Sapiens
RLLHMAIEP

SEQ ID NO: 1271985 - protein, 9 aa, Homo Sapiens
LVFFVPTMG

SEQ ID NO: 1271986 - protein, 9 aa, Homo Sapiens
LCYGPLMVM

SEQ ID NO: 1271987 - protein, 9 aa, Homo Sapiens
ELLVFEQFI

SEQ ID NO: 1271988 - protein, 9 aa, Homo Sapiens
DLENGEYWP

SEQ ID NO: 1271989 - protein, 9 aa, Homo Sapiens
TTTLPGSTT

SEQ ID NO: 1271990 - protein, 9 aa, Homo Sapiens
KIKELQENT

SEQ ID NO: 1271991 - protein, 9 aa, Homo Sapiens
KIHYASESR

SEQ ID NO: 1271992 - protein, 9 aa, Homo Sapiens
MGGMNWRPI

SEQ ID NO: 1271993 - protein, 9 aa, Homo Sapiens
NKQDFEYNK

SEQ ID NO: 1271994 - protein, 9 aa, Homo Sapiens
TIAYLKFLF

SEQ ID NO: 1271995 - protein, 9 aa, Homo Sapiens
TNIMTQNVE

SEQ ID NO: 1271996 - protein, 9 aa, Homo Sapiens
PPWWKEKLF

SEQ ID NO: 1271997 - protein, 9 aa, Homo Sapiens
QFRKMVESW

SEQ ID NO: 1271998 - protein, 9 aa, Homo Sapiens
VFWCGYFNY

SEQ ID NO: 1271999 - protein, 9 aa, Homo Sapiens
SLVYNPSLK

SEQ ID NO: 1272000 - protein, 9 aa, Homo Sapiens
PWWKEKLFT

SEQ ID NO: 1272001 - protein, 9 aa, Homo Sapiens
EITDDDANR

SEQ ID NO: 1272002 - protein, 9 aa, Homo Sapiens
TCALQNDGI

SEQ ID NO: 1272003 - protein, 9 aa, Homo Sapiens
LTCALQNDG

SEQ ID NO: 1272004 - protein, 9 aa, Homo Sapiens
YNPSLKTLL

SEQ ID NO: 1272005 - protein, 9 aa, Homo Sapiens
LTIAYLKFL

SEQ ID NO: 1272006 - protein, 9 aa, Homo Sapiens
ESGHNDHES

SEQ ID NO: 1272007 - protein, 9 aa, Homo Sapiens
SVELTSVLK

SEQ ID NO: 1272008 - protein, 9 aa, Homo Sapiens
TGHRKWVRM

SEQ ID NO: 1272009 - protein, 9 aa, Homo Sapiens
KMVESWKSF

SEQ ID NO: 1272010 - protein, 9 aa, Homo Sapiens
LVYNPSLKT

SEQ ID NO: 1272011 - protein, 9 aa, Homo Sapiens
AKKIDEFLA

SEQ ID NO: 1272012 - protein, 9 aa, Homo Sapiens
GLFLDCEGK

SEQ ID NO: 1272013 - protein, 9 aa, Homo Sapiens
AFFAWGPMG

SEQ ID NO: 1272014 - protein, 9 aa, Homo Sapiens
SYIRIVTVI

SEQ ID NO: 1272015 - protein, 9 aa, Homo Sapiens
EEQEDNEEE

SEQ ID NO: 1272016 - protein, 9 aa, Homo Sapiens
EYNKEYRLT

SEQ ID NO: 1272017 - protein, 9 aa, Homo Sapiens
VDVKIFVNA

SEQ ID NO: 1272018 - protein, 9 aa, Homo Sapiens
FFVPTMGLS

SEQ ID NO: 1272019 - protein, 9 aa, Homo Sapiens
QNSPPKKVK

SEQ ID NO: 1272020 - protein, 9 aa, Homo Sapiens
CSINLLVQN

SEQ ID NO: 1272021 - protein, 9 aa, Homo Sapiens
SDLKGPELD

SEQ ID NO: 1272022 - protein, 9 aa, Homo Sapiens
IIYDEATSS

SEQ ID NO: 1272023 - protein, 9 aa, Homo Sapiens
LRLPAKDWK

SEQ ID NO: 1272024 - protein, 9 aa, Homo Sapiens
PEQALRLLH

SEQ ID NO: 1272025 - protein, 9 aa, Homo Sapiens
LKDPPVIIY

SEQ ID NO: 1272026 - protein, 9 aa, Homo Sapiens
STFGPSVEL

SEQ ID NO: 1272027 - protein, 9 aa, Homo Sapiens
ELDIEGPEG

SEQ ID NO: 1272028 - protein, 9 aa, Homo Sapiens
VKDSDMCVS

SEQ ID NO: 1272029 - protein, 9 aa, Homo Sapiens
IIMAAYTAS

SEQ ID NO: 1272030 - protein, 9 aa, Homo Sapiens
SMNLYSGLI

SEQ ID NO: 1272031 - protein, 9 aa, Homo Sapiens
CKTTTYFMC

SEQ ID NO: 1272032 - protein, 9 aa, Homo Sapiens
NDVKDSDMC

SEQ ID NO: 1272033 - protein, 9 aa, Homo Sapiens
DVKIFVNAI

SEQ ID NO: 1272034 - protein, 9 aa, Homo Sapiens
TFGPSVELT

SEQ ID NO: 1272035 - protein, 9 aa, Homo Sapiens
NPSLKTLLA

SEQ ID NO: 1272036 - protein, 9 aa, Homo Sapiens
AVVSLCYGP

SEQ ID NO: 1272037 - protein, 9 aa, Homo Sapiens
PGVGTKIAK

SEQ ID NO: 1272038 - protein, 9 aa, Homo Sapiens
KQMNDALHG

SEQ ID NO: 1272039 - protein, 9 aa, Homo Sapiens
SMDGLSPHP

SEQ ID NO: 1272040 - protein, 9 aa, Homo Sapiens
LNGGYSYQG

SEQ ID NO: 1272041 - protein, 9 aa, Homo Sapiens
RYSPPWWKE

SEQ ID NO: 1272042 - protein, 9 aa, Homo Sapiens
GVTNIMTQN

SEQ ID NO: 1272043 - protein, 9 aa, Homo Sapiens
FLSVPGRVF

SEQ ID NO: 1272044 - protein, 9 aa, Homo Sapiens
GLNLPAGRP

SEQ ID NO: 1272045 - protein, 9 aa, Homo Sapiens
CSCVAGYAG

SEQ ID NO: 1272046 - protein, 9 aa, Homo Sapiens
CLLEITDDD

SEQ ID NO: 1272047 - protein, 9 aa, Homo Sapiens
GPSVELTSV

SEQ ID NO: 1272048 - protein, 9 aa, Homo Sapiens
AGYAGNGRQ

SEQ ID NO: 1272049 - protein, 9 aa, Homo Sapiens
GYFNYRIDL

SEQ ID NO: 1272050 - protein, 9 aa, Homo Sapiens
QFIVDGRRE

SEQ ID NO: 1272051 - protein, 9 aa, Homo Sapiens
FGRDLQKDI

SEQ ID NO: 1272052 - protein, 9 aa, Homo Sapiens
HCPRPHDLE

SEQ ID NO: 1272053 - protein, 9 aa, Homo Sapiens
CYGPLMVMY

SEQ ID NO: 1272054 - protein, 9 aa, Homo Sapiens
RPHDLENGE

SEQ ID NO: 1272055 - protein, 9 aa, Homo Sapiens
TELVINKMN

SEQ ID NO: 1272056 - protein, 9 aa, Homo Sapiens
CCSCVAGYA

SEQ ID NO: 1272057 - protein, 9 aa, Homo Sapiens
EQEDNEEED

SEQ ID NO: 1272058 - protein, 9 aa, Homo Sapiens
MKTKSQPMM

SEQ ID NO: 1272059 - protein, 9 aa, Homo Sapiens
SLSLTYFWP

SEQ ID NO: 1272060 - protein, 9 aa, Homo Sapiens
DKDGSGVIS

SEQ ID NO: 1272061 - protein, 9 aa, Homo Sapiens
GPELDIEGP

SEQ ID NO: 1272062 - protein, 9 aa, Homo Sapiens
CQIIMAAYT

SEQ ID NO: 1272063 - protein, 9 aa, Homo Sapiens
SGLDPNTSM

SEQ ID NO: 1272064 - protein, 9 aa, Homo Sapiens
VKRGRPPKP

SEQ ID NO: 1272065 - protein, 9 aa, Homo Sapiens
CMKTKSQPM

SEQ ID NO: 1272066 - protein, 9 aa, Homo Sapiens
AYLKFLFLK

SEQ ID NO: 1272067 - protein, 9 aa, Homo Sapiens
EGKTVSFVD

SEQ ID NO: 1272068 - protein, 9 aa, Homo Sapiens
QLAVKSLKR

SEQ ID NO: 1272069 - protein, 9 aa, Homo Sapiens
YNKEYRLTI

SEQ ID NO: 1272070 - protein, 9 aa, Homo Sapiens
SCMGGMNWR

SEQ ID NO: 1272071 - protein, 9 aa, Homo Sapiens
MNLYSGLIS

SEQ ID NO: 1272072 - protein, 9 aa, Homo Sapiens
QTLPEVRDQ

SEQ ID NO: 1272073 - protein, 9 aa, Homo Sapiens
EEEQEDNEE

SEQ ID NO: 1272074 - protein, 9 aa, Homo Sapiens
LGIPEQALR

SEQ ID NO: 1272075 - protein, 9 aa, Homo Sapiens
GVFSMNLYS

SEQ ID NO: 1272076 - protein, 9 aa, Homo Sapiens
NLYSGLIST

SEQ ID NO: 1272077 - protein, 9 aa, Homo Sapiens
DCEGKTVSF

SEQ ID NO: 1272078 - protein, 9 aa, Homo Sapiens
ETQVLGTQK

SEQ ID NO: 1272079 - protein, 9 aa, Homo Sapiens
AIAYPPLLF

SEQ ID NO: 1272080 - protein, 9 aa, Homo Sapiens
YSPPWWKEK

SEQ ID NO: 1272081 - protein, 9 aa, Homo Sapiens
DFEYNKEYR

SEQ ID NO: 1272082 - protein, 9 aa, Homo Sapiens
GVGTKIAKK

SEQ ID NO: 1272083 - protein, 9 aa, Homo Sapiens
FMCTSVSVS

SEQ ID NO: 1272084 - protein, 9 aa, Homo Sapiens
DYVFWCGYF

SEQ ID NO: 1272085 - protein, 9 aa, Homo Sapiens
GLSMLTVPG

SEQ ID NO: 1272086 - protein, 9 aa, Homo Sapiens
LNLPAGRPK

SEQ ID NO: 1272087 - protein, 9 aa, Homo Sapiens
NGGYSYQGV

SEQ ID NO: 1272088 - protein, 9 aa, Homo Sapiens
KCLLEITDD

SEQ ID NO: 1272089 - protein, 9 aa, Homo Sapiens
HLFNFRSGS

SEQ ID NO: 1272090 - protein, 9 aa, Homo Sapiens
AMISLLKEA

SEQ ID NO: 1272091 - protein, 9 aa, Homo Sapiens
LHPSSWDYR

SEQ ID NO: 1272092 - protein, 9 aa, Homo Sapiens
LSGLPQVRL

SEQ ID NO: 1272093 - protein, 9 aa, Homo Sapiens
WNLKSYKNA

SEQ ID NO: 1272094 - protein, 9 aa, Homo Sapiens
LPLPPSRTT

SEQ ID NO: 1272095 - protein, 9 aa, Homo Sapiens
GEQNHFNSS

SEQ ID NO: 1272096 - protein, 9 aa, Homo Sapiens
CSHPNDDNV

SEQ ID NO: 1272097 - protein, 9 aa, Homo Sapiens
YPGGRVTQG

SEQ ID NO: 1272098 - protein, 9 aa, Homo Sapiens
RMATMFYIG

SEQ ID NO: 1272099 - protein, 9 aa, Homo Sapiens
SSYSKAWRF

SEQ ID NO: 1272100 - protein, 9 aa, Homo Sapiens
DKQQIEEKF

SEQ ID NO: 1272101 - protein, 9 aa, Homo Sapiens
KFKKKEFEL

SEQ ID NO: 1272102 - protein, 9 aa, Homo Sapiens
IVFSHQRLP

SEQ ID NO: 1272103 - protein, 9 aa, Homo Sapiens
ILSKGGVIH

SEQ ID NO: 1272104 - protein, 9 aa, Homo Sapiens
SQQPQQPQA

SEQ ID NO: 1272105 - protein, 9 aa, Homo Sapiens
KGRQEDAKE

SEQ ID NO: 1272106 - protein, 9 aa, Homo Sapiens
EKNHSSKSA

SEQ ID NO: 1272107 - protein, 9 aa, Homo Sapiens
WRQLPRWDP

SEQ ID NO: 1272108 - protein, 9 aa, Homo Sapiens
QQFIVEKGD

SEQ ID NO: 1272109 - protein, 9 aa, Homo Sapiens
GTLRGSLTW

SEQ ID NO: 1272110 - protein, 9 aa, Homo Sapiens
LFIFMTRSS

SEQ ID NO: 1272111 - protein, 9 aa, Homo Sapiens
LQYRHLATY

SEQ ID NO: 1272112 - protein, 9 aa, Homo Sapiens
RIPSARQRK

SEQ ID NO: 1272113 - protein, 9 aa, Homo Sapiens
QLPRWDPVY

SEQ ID NO: 1272114 - protein, 9 aa, Homo Sapiens
TPEERLPME

SEQ ID NO: 1272115 - protein, 9 aa, Homo Sapiens
SVGCIMGQM

SEQ ID NO: 1272116 - protein, 9 aa, Homo Sapiens
ENKILSKGG

SEQ ID NO: 1272117 - protein, 9 aa, Homo Sapiens
LKGREIRMW

SEQ ID NO: 1272118 - protein, 9 aa, Homo Sapiens
PCSFVPIGI

SEQ ID NO: 1272119 - protein, 9 aa, Homo Sapiens
EDGEIEIEQ

SEQ ID NO: 1272120 - protein, 9 aa, Homo Sapiens
SLARPTTVQ

SEQ ID NO: 1272121 - protein, 9 aa, Homo Sapiens
PPTKRIRLQ

SEQ ID NO: 1272122 - protein, 9 aa, Homo Sapiens
GRQEDAKEY

SEQ ID NO: 1272123 - protein, 9 aa, Homo Sapiens
CGLSQEKAV

SEQ ID NO: 1272124 - protein, 9 aa, Homo Sapiens
STWEKKLHK

SEQ ID NO: 1272125 - protein, 9 aa, Homo Sapiens
RRVHMGERP

SEQ ID NO: 1272126 - protein, 9 aa, Homo Sapiens
CGTSPVHDA

SEQ ID NO: 1272127 - protein, 9 aa, Homo Sapiens
PQIQWQNST

SEQ ID NO: 1272128 - protein, 9 aa, Homo Sapiens
GLASRSILL

SEQ ID NO: 1272129 - protein, 9 aa, Homo Sapiens
YSSYSKAWR

SEQ ID NO: 1272130 - protein, 9 aa, Homo Sapiens
TMSTFGYGD

SEQ ID NO: 1272131 - protein, 9 aa, Homo Sapiens
NSFEVSVCA

SEQ ID NO: 1272132 - protein, 9 aa, Homo Sapiens
QQIEEKFKK

SEQ ID NO: 1272133 - protein, 9 aa, Homo Sapiens
RHLACVSQN

SEQ ID NO: 1272134 - protein, 9 aa, Homo Sapiens
EGKEQQEKS

SEQ ID NO: 1272135 - protein, 9 aa, Homo Sapiens
AWRNRTLCP

SEQ ID NO: 1272136 - protein, 9 aa, Homo Sapiens
VMKAVKVGI

SEQ ID NO: 1272137 - protein, 9 aa, Homo Sapiens
DAQVILFEH

SEQ ID NO: 1272138 - protein, 9 aa, Homo Sapiens
RAHRCTTAP

SEQ ID NO: 1272139 - protein, 9 aa, Homo Sapiens
QIRYASMER

SEQ ID NO: 1272140 - protein, 9 aa, Homo Sapiens
LRLMWIFRI

SEQ ID NO: 1272141 - protein, 9 aa, Homo Sapiens
GDMMRPQAP

SEQ ID NO: 1272142 - protein, 9 aa, Homo Sapiens
PVELDMTPF

SEQ ID NO: 1272143 - protein, 9 aa, Homo Sapiens
QAARAALHL

SEQ ID NO: 1272144 - protein, 9 aa, Homo Sapiens
VEMGSVNQA

SEQ ID NO: 1272145 - protein, 9 aa, Homo Sapiens
QDLLDSFVS

SEQ ID NO: 1272146 - protein, 9 aa, Homo Sapiens
QLSSATLNS

SEQ ID NO: 1272147 - protein, 9 aa, Homo Sapiens
THVPGHWRE

SEQ ID NO: 1272148 - protein, 9 aa, Homo Sapiens
PASGLDGYF

SEQ ID NO: 1272149 - protein, 9 aa, Homo Sapiens
DDSSNTSPG

SEQ ID NO: 1272150 - protein, 9 aa, Homo Sapiens
RVIFIDFYL

SEQ ID NO: 1272151 - protein, 9 aa, Homo Sapiens
VGIKEYELE

SEQ ID NO: 1272152 - protein, 9 aa, Homo Sapiens
GRVTQGPRQ

SEQ ID NO: 1272153 - protein, 9 aa, Homo Sapiens
KDQMILEKQ

SEQ ID NO: 1272154 - protein, 9 aa, Homo Sapiens
ASMDRMATM

SEQ ID NO: 1272155 - protein, 9 aa, Homo Sapiens
PGIGCGFSC

SEQ ID NO: 1272156 - protein, 9 aa, Homo Sapiens
KQLSSATLN

SEQ ID NO: 1272157 - protein, 9 aa, Homo Sapiens
MEWTSNSKI

SEQ ID NO: 1272158 - protein, 9 aa, Homo Sapiens
AQTQYGDPA

SEQ ID NO: 1272159 - protein, 9 aa, Homo Sapiens
LKERSDTRD

SEQ ID NO: 1272160 - protein, 9 aa, Homo Sapiens
ESDWLQYRH

SEQ ID NO: 1272161 - protein, 9 aa, Homo Sapiens
ASQAPGTTA

SEQ ID NO: 1272162 - protein, 9 aa, Homo Sapiens
GQQFIVEKG

SEQ ID NO: 1272163 - protein, 9 aa, Homo Sapiens
NYELDEHTD

SEQ ID NO: 1272164 - protein, 9 aa, Homo Sapiens
PWRLPGTYM

SEQ ID NO: 1272165 - protein, 9 aa, Homo Sapiens
KLRRHSSEG

SEQ ID NO: 1272166 - protein, 9 aa, Homo Sapiens
TTAPSGQNK

SEQ ID NO: 1272167 - protein, 9 aa, Homo Sapiens
EKKLHKIVF

SEQ ID NO: 1272168 - protein, 9 aa, Homo Sapiens
MWATDLQIL

SEQ ID NO: 1272169 - protein, 9 aa, Homo Sapiens
QGQQFIVEK

SEQ ID NO: 1272170 - protein, 9 aa, Homo Sapiens
CSYLEHQEK

SEQ ID NO: 1272171 - protein, 9 aa, Homo Sapiens
CVGQLQDIW

SEQ ID NO: 1272172 - protein, 9 aa, Homo Sapiens
NECGAEGFW

SEQ ID NO: 1272173 - protein, 9 aa, Homo Sapiens
TCDCFQGFQ

SEQ ID NO: 1272174 - protein, 9 aa, Homo Sapiens
TIYKNALKG

SEQ ID NO: 1272175 - protein, 9 aa, Homo Sapiens
LQGEEKDGI

SEQ ID NO: 1272176 - protein, 9 aa, Homo Sapiens
AKWPPGGRD

SEQ ID NO: 1272177 - protein, 9 aa, Homo Sapiens
NSNTDQDAG

SEQ ID NO: 1272178 - protein, 9 aa, Homo Sapiens
FTPVTKNVN

SEQ ID NO: 1272179 - protein, 9 aa, Homo Sapiens
CEGQEESFV

SEQ ID NO: 1272180 - protein, 9 aa, Homo Sapiens
KQCLQPPAA

SEQ ID NO: 1272181 - protein, 9 aa, Homo Sapiens
EERFTGLAA

SEQ ID NO: 1272182 - protein, 9 aa, Homo Sapiens
IGCTQPQRV

SEQ ID NO: 1272183 - protein, 9 aa, Homo Sapiens
RPTTVQGVQ

SEQ ID NO: 1272184 - protein, 9 aa, Homo Sapiens
VTPAVGQLE

SEQ ID NO: 1272185 - protein, 9 aa, Homo Sapiens
LTSAIFETK

SEQ ID NO: 1272186 - protein, 9 aa, Homo Sapiens
GACGLSQEK

SEQ ID NO: 1272187 - protein, 9 aa, Homo Sapiens
QKLVETDEE

SEQ ID NO: 1272188 - protein, 9 aa, Homo Sapiens
ERLSNPQIQ

SEQ ID NO: 1272189 - protein, 9 aa, Homo Sapiens
AIIHEENAL

SEQ ID NO: 1272190 - protein, 9 aa, Homo Sapiens
NSSALPTPG

SEQ ID NO: 1272191 - protein, 9 aa, Homo Sapiens
EQLKAEITS

SEQ ID NO: 1272192 - protein, 9 aa, Homo Sapiens
KEQQEKSGE

SEQ ID NO: 1272193 - protein, 9 aa, Homo Sapiens
DEGQLVLMD

SEQ ID NO: 1272194 - protein, 9 aa, Homo Sapiens
CGAEGFWQV

SEQ ID NO: 1272195 - protein, 9 aa, Homo Sapiens
LVMTMLNLF

SEQ ID NO: 1272196 - protein, 9 aa, Homo Sapiens
FHSQSIYYS

SEQ ID NO: 1272197 - protein, 9 aa, Homo Sapiens
PAIYVMENG

SEQ ID NO: 1272198 - protein, 9 aa, Homo Sapiens
DMKNRPSFQ

SEQ ID NO: 1272199 - protein, 9 aa, Homo Sapiens
QLSQGLREH

SEQ ID NO: 1272200 - protein, 9 aa, Homo Sapiens
RLHPSSWDY

SEQ ID NO: 1272201 - protein, 9 aa, Homo Sapiens
ASVLCIQTV

SEQ ID NO: 1272202 - protein, 9 aa, Homo Sapiens
MTSKLDIFV

SEQ ID NO: 1272203 - protein, 9 aa, Homo Sapiens
IDYKEFVAM

SEQ ID NO: 1272204 - protein, 9 aa, Homo Sapiens
NSPATHFAM

SEQ ID NO: 1272205 - protein, 9 aa, Homo Sapiens
KPKATKQQL

SEQ ID NO: 1272206 - protein, 9 aa, Homo Sapiens
PTAQVYEFS

SEQ ID NO: 1272207 - protein, 9 aa, Homo Sapiens
HLWLVCEQP

SEQ ID NO: 1272208 - protein, 9 aa, Homo Sapiens
EKITVTPSC

SEQ ID NO: 1272209 - protein, 9 aa, Homo Sapiens
GAIGKTASA

SEQ ID NO: 1272210 - protein, 9 aa, Homo Sapiens
RTIDYKEFV

SEQ ID NO: 1272211 - protein, 9 aa, Homo Sapiens
SHPNDDNVH

SEQ ID NO: 1272212 - protein, 9 aa, Homo Sapiens
CEEADRGSC

SEQ ID NO: 1272213 - protein, 9 aa, Homo Sapiens
NGCNPVLLR

SEQ ID NO: 1272214 - protein, 9 aa, Homo Sapiens
HNSSALPTP

SEQ ID NO: 1272215 - protein, 9 aa, Homo Sapiens
LHYNKELNI

SEQ ID NO: 1272216 - protein, 9 aa, Homo Sapiens
VISCTVCLK

SEQ ID NO: 1272217 - protein, 9 aa, Homo Sapiens
QSQQPQQPQ

SEQ ID NO: 1272218 - protein, 9 aa, Homo Sapiens
HSPLVTLPS

SEQ ID NO: 1272219 - protein, 9 aa, Homo Sapiens
RAQKARLLA

SEQ ID NO: 1272220 - protein, 9 aa, Homo Sapiens
QLCMICQGD

SEQ ID NO: 1272221 - protein, 9 aa, Homo Sapiens
LRGSLTWRH

SEQ ID NO: 1272222 - protein, 9 aa, Homo Sapiens
RGSCLVGAT

SEQ ID NO: 1272223 - protein, 9 aa, Homo Sapiens
RPTCCISSC

SEQ ID NO: 1272224 - protein, 9 aa, Homo Sapiens
PTVKPSWDN

SEQ ID NO: 1272225 - protein, 9 aa, Homo Sapiens
DGRRLLLPL

SEQ ID NO: 1272226 - protein, 9 aa, Homo Sapiens
VFQLYSPVG

SEQ ID NO: 1272227 - protein, 9 aa, Homo Sapiens
KGQGIKERS

SEQ ID NO: 1272228 - protein, 9 aa, Homo Sapiens
EELESYWCK

SEQ ID NO: 1272229 - protein, 9 aa, Homo Sapiens
AARAALHLF

SEQ ID NO: 1272230 - protein, 9 aa, Homo Sapiens
IQLLALYFH

SEQ ID NO: 1272231 - protein, 9 aa, Homo Sapiens
AKGQNQLTP

SEQ ID NO: 1272232 - protein, 9 aa, Homo Sapiens
DGDTYRLPE

SEQ ID NO: 1272233 - protein, 9 aa, Homo Sapiens
LAIIHEENA

SEQ ID NO: 1272234 - protein, 9 aa, Homo Sapiens
MEGSRPWAV

SEQ ID NO: 1272235 - protein, 9 aa, Homo Sapiens
TAQVYEFSD

SEQ ID NO: 1272236 - protein, 9 aa, Homo Sapiens
KQTEYSLAS

SEQ ID NO: 1272237 - protein, 9 aa, Homo Sapiens
GCNPVLLRR

SEQ ID NO: 1272238 - protein, 9 aa, Homo Sapiens
QARLLGNNL

SEQ ID NO: 1272239 - protein, 9 aa, Homo Sapiens
DSNITPVVL

SEQ ID NO: 1272240 - protein, 9 aa, Homo Sapiens
CELGVFHLL

SEQ ID NO: 1272241 - protein, 9 aa, Homo Sapiens
WRPARAHRC

SEQ ID NO: 1272242 - protein, 9 aa, Homo Sapiens
EAFIPVAES

SEQ ID NO: 1272243 - protein, 9 aa, Homo Sapiens
AKDGEKKIK

SEQ ID NO: 1272244 - protein, 9 aa, Homo Sapiens
IRTHTAEKP

SEQ ID NO: 1272245 - protein, 9 aa, Homo Sapiens
LATQVDETQ

SEQ ID NO: 1272246 - protein, 9 aa, Homo Sapiens
LAPLGEYKL

SEQ ID NO: 1272247 - protein, 9 aa, Homo Sapiens
YNKELNIKL

SEQ ID NO: 1272248 - protein, 9 aa, Homo Sapiens
RLSNPQIQW

SEQ ID NO: 1272249 - protein, 9 aa, Homo Sapiens
AIRLGEAAA

SEQ ID NO: 1272250 - protein, 9 aa, Homo Sapiens
PESQNFKTV

SEQ ID NO: 1272251 - protein, 9 aa, Homo Sapiens
TGLQGEEKD

SEQ ID NO: 1272252 - protein, 9 aa, Homo Sapiens
YAKWPPGGR

SEQ ID NO: 1272253 - protein, 9 aa, Homo Sapiens
PLVRLRQSP

SEQ ID NO: 1272254 - protein, 9 aa, Homo Sapiens
QQCARTDGR

SEQ ID NO: 1272255 - protein, 9 aa, Homo Sapiens
RQLPRWDPV

SEQ ID NO: 1272256 - protein, 9 aa, Homo Sapiens
SGLHHHEAS

SEQ ID NO: 1272257 - protein, 9 aa, Homo Sapiens
KLDHEFLDM

SEQ ID NO: 1272258 - protein, 9 aa, Homo Sapiens
IHILNVLIT

SEQ ID NO: 1272259 - protein, 9 aa, Homo Sapiens
MSTFGYGDV

SEQ ID NO: 1272260 - protein, 9 aa, Homo Sapiens
VPENDAQVI

SEQ ID NO: 1272261 - protein, 9 aa, Homo Sapiens
YLMMLNPIG

SEQ ID NO: 1272262 - protein, 9 aa, Homo Sapiens
TYRLPEFIV

SEQ ID NO: 1272263 - protein, 9 aa, Homo Sapiens
AWTILQSLS

SEQ ID NO: 1272264 - protein, 9 aa, Homo Sapiens
ELGVFHLLA

SEQ ID NO: 1272265 - protein, 9 aa, Homo Sapiens
GVFHLLAEA

SEQ ID NO: 1272266 - protein, 9 aa, Homo Sapiens
STSGRQRSS

SEQ ID NO: 1272267 - protein, 9 aa, Homo Sapiens
KNVNVGTKL

SEQ ID NO: 1272268 - protein, 9 aa, Homo Sapiens
ATMFYIGAH

SEQ ID NO: 1272269 - protein, 9 aa, Homo Sapiens
LPGTYMVVL

SEQ ID NO: 1272270 - protein, 9 aa, Homo Sapiens
VGFGAIGKT

SEQ ID NO: 1272271 - protein, 9 aa, Homo Sapiens
FQNCSCIET

SEQ ID NO: 1272272 - protein, 9 aa, Homo Sapiens
NDAQVILFE

SEQ ID NO: 1272273 - protein, 9 aa, Homo Sapiens
LSTPYHVMR

SEQ ID NO: 1272274 - protein, 9 aa, Homo Sapiens
AELPLPPSR

SEQ ID NO: 1272275 - protein, 9 aa, Homo Sapiens
VLTSAIFET

SEQ ID NO: 1272276 - protein, 9 aa, Homo Sapiens
ARAALHLFN

SEQ ID NO: 1272277 - protein, 9 aa, Homo Sapiens
MTRSSLLSR

SEQ ID NO: 1272278 - protein, 9 aa, Homo Sapiens
FQARLLGNN

SEQ ID NO: 1272279 - protein, 9 aa, Homo Sapiens
VLEDFAKDG

SEQ ID NO: 1272280 - protein, 9 aa, Homo Sapiens
NTDLRFQSS

SEQ ID NO: 1272281 - protein, 9 aa, Homo Sapiens
TWDSNITPV

SEQ ID NO: 1272282 - protein, 9 aa, Homo Sapiens
LQKLVETDE

SEQ ID NO: 1272283 - protein, 9 aa, Homo Sapiens
EAQKDGKVE

SEQ ID NO: 1272284 - protein, 9 aa, Homo Sapiens
ADIEVAKMQ

SEQ ID NO: 1272285 - protein, 9 aa, Homo Sapiens
CIMGQMVCH

SEQ ID NO: 1272286 - protein, 9 aa, Homo Sapiens
DYDEHKTIN

SEQ ID NO: 1272287 - protein, 9 aa, Homo Sapiens
NHKWCLDPR

SEQ ID NO: 1272288 - protein, 9 aa, Homo Sapiens
CNPVLLRRC

SEQ ID NO: 1272289 - protein, 9 aa, Homo Sapiens
PNSPATHFA

SEQ ID NO: 1272290 - protein, 9 aa, Homo Sapiens
TIDYKEFVA

SEQ ID NO: 1272291 - protein, 9 aa, Homo Sapiens
QNCSCIETS

SEQ ID NO: 1272292 - protein, 9 aa, Homo Sapiens
QGIKERSKL

SEQ ID NO: 1272293 - protein, 9 aa, Homo Sapiens
NDKTKGQGI

SEQ ID NO: 1272294 - protein, 9 aa, Homo Sapiens
VEAMISLLK

SEQ ID NO: 1272295 - protein, 9 aa, Homo Sapiens
TPVTKNVNV

SEQ ID NO: 1272296 - protein, 9 aa, Homo Sapiens
NTRHGRSNL

SEQ ID NO: 1272297 - protein, 9 aa, Homo Sapiens
RRQKRELRQ

SEQ ID NO: 1272298 - protein, 9 aa, Homo Sapiens
LRRCTELPE

SEQ ID NO: 1272299 - protein, 9 aa, Homo Sapiens
TCPCLPNLM

SEQ ID NO: 1272300 - protein, 9 aa, Homo Sapiens
GDLLQCSFS

SEQ ID NO: 1272301 - protein, 9 aa, Homo Sapiens
QAFANALSS

SEQ ID NO: 1272302 - protein, 9 aa, Homo Sapiens
LNGCNPVLL

SEQ ID NO: 1272303 - protein, 9 aa, Homo Sapiens
LGVKALLRM

SEQ ID NO: 1272304 - protein, 9 aa, Homo Sapiens
FSPEKNHSS

SEQ ID NO: 1272305 - protein, 9 aa, Homo Sapiens
GIGSHCKCE

SEQ ID NO: 1272306 - protein, 9 aa, Homo Sapiens
GNHKWCLDP

SEQ ID NO: 1272307 - protein, 9 aa, Homo Sapiens
AVSQGTKAV

SEQ ID NO: 1272308 - protein, 9 aa, Homo Sapiens
GVLHQNRSL

SEQ ID NO: 1272309 - protein, 9 aa, Homo Sapiens
DDNVHFRIS

SEQ ID NO: 1272310 - protein, 9 aa, Homo Sapiens
MVGLASRSI

SEQ ID NO: 1272311 - protein, 9 aa, Homo Sapiens
NTVTPAVGQ

SEQ ID NO: 1272312 - protein, 9 aa, Homo Sapiens
YKNALKGKY

SEQ ID NO: 1272313 - protein, 9 aa, Homo Sapiens
EAATGLQGE

SEQ ID NO: 1272314 - protein, 9 aa, Homo Sapiens
YSKAWRFPN

SEQ ID NO: 1272315 - protein, 9 aa, Homo Sapiens
YIIRKGTIG

SEQ ID NO: 1272316 - protein, 9 aa, Homo Sapiens
LKTRLEREG

SEQ ID NO: 1272317 - protein, 9 aa, Homo Sapiens
LLMVTMSTF

SEQ ID NO: 1272318 - protein, 9 aa, Homo Sapiens
VCLKEFQTP

SEQ ID NO: 1272319 - protein, 9 aa, Homo Sapiens
RWDPVYAKW

SEQ ID NO: 1272320 - protein, 9 aa, Homo Sapiens
TPSCKELLF

SEQ ID NO: 1272321 - protein, 9 aa, Homo Sapiens
HVHFRNVKL

SEQ ID NO: 1272322 - protein, 9 aa, Homo Sapiens
CVSQNGCLR

SEQ ID NO: 1272323 - protein, 9 aa, Homo Sapiens
PDLSLTVTV

SEQ ID NO: 1272324 - protein, 9 aa, Homo Sapiens
HEAWRQLPR

SEQ ID NO: 1272325 - protein, 9 aa, Homo Sapiens
TTYISFPVE

SEQ ID NO: 1272326 - protein, 9 aa, Homo Sapiens
HLANDDELI

SEQ ID NO: 1272327 - protein, 9 aa, Homo Sapiens
RMWYAKKQG

SEQ ID NO: 1272328 - protein, 9 aa, Homo Sapiens
QEKSGEDGE

SEQ ID NO: 1272329 - protein, 9 aa, Homo Sapiens
EVNLSSSDY

SEQ ID NO: 1272330 - protein, 9 aa, Homo Sapiens
VAELVGVEA

SEQ ID NO: 1272331 - protein, 9 aa, Homo Sapiens
DLKEHYTPV

SEQ ID NO: 1272332 - protein, 9 aa, Homo Sapiens
DHLLGMWAT

SEQ ID NO: 1272333 - protein, 9 aa, Homo Sapiens
LVTLPSANL

SEQ ID NO: 1272334 - protein, 9 aa, Homo Sapiens
EDFAKDGEK

SEQ ID NO: 1272335 - protein, 9 aa, Homo Sapiens
EVSVCACPG

SEQ ID NO: 1272336 - protein, 9 aa, Homo Sapiens
LTAIRLGEA

SEQ ID NO: 1272337 - protein, 9 aa, Homo Sapiens
FVSFFPELK

SEQ ID NO: 1272338 - protein, 9 aa, Homo Sapiens
ENALTMEVI

SEQ ID NO: 1272339 - protein, 9 aa, Homo Sapiens
SSASQAPGT

SEQ ID NO: 1272340 - protein, 9 aa, Homo Sapiens
YLEHQEKND

SEQ ID NO: 1272341 - protein, 9 aa, Homo Sapiens
RLGEAAAKL

SEQ ID NO: 1272342 - protein, 9 aa, Homo Sapiens
KNKKALSSM

SEQ ID NO: 1272343 - protein, 9 aa, Homo Sapiens
LKEFQTPIT

SEQ ID NO: 1272344 - protein, 9 aa, Homo Sapiens
GDEGQLVLM

SEQ ID NO: 1272345 - protein, 9 aa, Homo Sapiens
HLKGREIRM

SEQ ID NO: 1272346 - protein, 9 aa, Homo Sapiens
KSKTINVSF

SEQ ID NO: 1272347 - protein, 9 aa, Homo Sapiens
RYTCHVQHV

SEQ ID NO: 1272348 - protein, 9 aa, Homo Sapiens
KEHYTPVGS

SEQ ID NO: 1272349 - protein, 9 aa, Homo Sapiens
ELVGVEAGF

SEQ ID NO: 1272350 - protein, 9 aa, Homo Sapiens
SLIFSRSWT

SEQ ID NO: 1272351 - protein, 9 aa, Homo Sapiens
LAYVGRLSA

SEQ ID NO: 1272352 - protein, 9 aa, Homo Sapiens
SNPFCSYLE

SEQ ID NO: 1272353 - protein, 9 aa, Homo Sapiens
DTRDKRKFL

SEQ ID NO: 1272354 - protein, 9 aa, Homo Sapiens
VFHLLAEAP

SEQ ID NO: 1272355 - protein, 9 aa, Homo Sapiens
YASMERLLE

SEQ ID NO: 1272356 - protein, 9 aa, Homo Sapiens
ANALSSLQG

SEQ ID NO: 1272357 - protein, 9 aa, Homo Sapiens
PLFIFMTRS

SEQ ID NO: 1272358 - protein, 9 aa, Homo Sapiens
TRDKRKFLK

SEQ ID NO: 1272359 - protein, 9 aa, Homo Sapiens
CGVYPKKKK

SEQ ID NO: 1272360 - protein, 9 aa, Homo Sapiens
WRLPGTYMV

SEQ ID NO: 1272361 - protein, 9 aa, Homo Sapiens
AVWALWSLL

SEQ ID NO: 1272362 - protein, 9 aa, Homo Sapiens
TLRGSLTWR

SEQ ID NO: 1272363 - protein, 9 aa, Homo Sapiens
KDGEKKIKL

SEQ ID NO: 1272364 - protein, 9 aa, Homo Sapiens
EGDLLQCSF

SEQ ID NO: 1272365 - protein, 9 aa, Homo Sapiens
TTEDNMGGC

SEQ ID NO: 1272366 - protein, 9 aa, Homo Sapiens
MQLKEQKGG

SEQ ID NO: 1272367 - protein, 9 aa, Homo Sapiens
HGLLQLSQG

SEQ ID NO: 1272368 - protein, 9 aa, Homo Sapiens
DFQGQQFIV

SEQ ID NO: 1272369 - protein, 9 aa, Homo Sapiens
TSLEIPQEG

SEQ ID NO: 1272370 - protein, 9 aa, Homo Sapiens
GFGAIGKTA

SEQ ID NO: 1272371 - protein, 9 aa, Homo Sapiens
LHLFNFRSG

SEQ ID NO: 1272372 - protein, 9 aa, Homo Sapiens
EAFQGEQNH

SEQ ID NO: 1272373 - protein, 9 aa, Homo Sapiens
NELSGLPQV

SEQ ID NO: 1272374 - protein, 9 aa, Homo Sapiens
IIAGWDRQE

SEQ ID NO: 1272375 - protein, 9 aa, Homo Sapiens
SAEASPQEE

SEQ ID NO: 1272376 - protein, 9 aa, Homo Sapiens
LRVLDDSSN

SEQ ID NO: 1272377 - protein, 9 aa, Homo Sapiens
EEEEDEADI

SEQ ID NO: 1272378 - protein, 9 aa, Homo Sapiens
AYALILLLC

SEQ ID NO: 1272379 - protein, 9 aa, Homo Sapiens
MGPRTFWNH

SEQ ID NO: 1272380 - protein, 9 aa, Homo Sapiens
TVCLKEFQT

SEQ ID NO: 1272381 - protein, 9 aa, Homo Sapiens
HKQIVPEND

SEQ ID NO: 1272382 - protein, 9 aa, Homo Sapiens
QLYSPVGSG

SEQ ID NO: 1272383 - protein, 9 aa, Homo Sapiens
WRRDMKNRP

SEQ ID NO: 1272384 - protein, 9 aa, Homo Sapiens
IIPFNLMKF

SEQ ID NO: 1272385 - protein, 9 aa, Homo Sapiens
YKKDFAKSQ

SEQ ID NO: 1272386 - protein, 9 aa, Homo Sapiens
WNHLWLVCE

SEQ ID NO: 1272387 - protein, 9 aa, Homo Sapiens
RIIIWNLKS

SEQ ID NO: 1272388 - protein, 9 aa, Homo Sapiens
GGPPGPVNP

SEQ ID NO: 1272389 - protein, 9 aa, Homo Sapiens
VQHVGLPKP

SEQ ID NO: 1272390 - protein, 9 aa, Homo Sapiens
EFGTSMVQR

SEQ ID NO: 1272391 - protein, 9 aa, Homo Sapiens
TILRIPSAR

SEQ ID NO: 1272392 - protein, 9 aa, Homo Sapiens
VTQGPRQEY

SEQ ID NO: 1272393 - protein, 9 aa, Homo Sapiens
LNGPYVATV

SEQ ID NO: 1272394 - protein, 9 aa, Homo Sapiens
PVAESLKDL

SEQ ID NO: 1272395 - protein, 9 aa, Homo Sapiens
CSCIETSGN

SEQ ID NO: 1272396 - protein, 9 aa, Homo Sapiens
EAWRQLPRW

SEQ ID NO: 1272397 - protein, 9 aa, Homo Sapiens
PFNLMKFHL

SEQ ID NO: 1272398 - protein, 9 aa, Homo Sapiens
GQMVCHKIL

SEQ ID NO: 1272399 - protein, 9 aa, Homo Sapiens
SCIETSGNS

SEQ ID NO: 1272400 - protein, 9 aa, Homo Sapiens
SKKLQQENS

SEQ ID NO: 1272401 - protein, 9 aa, Homo Sapiens
QGNTMKRLQ

SEQ ID NO: 1272402 - protein, 9 aa, Homo Sapiens
EVVMAAAAG

SEQ ID NO: 1272403 - protein, 9 aa, Homo Sapiens
RKEHHLVPD

SEQ ID NO: 1272404 - protein, 9 aa, Homo Sapiens
IGSHCKCEG

SEQ ID NO: 1272405 - protein, 9 aa, Homo Sapiens
SFEVSVCAC

SEQ ID NO: 1272406 - protein, 9 aa, Homo Sapiens
LRAQKARLL

SEQ ID NO: 1272407 - protein, 9 aa, Homo Sapiens
GSQPDTAVG

SEQ ID NO: 1272408 - protein, 9 aa, Homo Sapiens
NHLWLVCEQ

SEQ ID NO: 1272409 - protein, 9 aa, Homo Sapiens
DNYELDEHT

SEQ ID NO: 1272410 - protein, 9 aa, Homo Sapiens
NKKALSSMG

SEQ ID NO: 1272411 - protein, 9 aa, Homo Sapiens
AQEIAIILG

SEQ ID NO: 1272412 - protein, 9 aa, Homo Sapiens
AWRQLPRWD

SEQ ID NO: 1272413 - protein, 9 aa, Homo Sapiens
EIRMWYAKK

SEQ ID NO: 1272414 - protein, 9 aa, Homo Sapiens
SQSIYYSLI

SEQ ID NO: 1272415 - protein, 9 aa, Homo Sapiens
GQLVLMDLG

SEQ ID NO: 1272416 - protein, 9 aa, Homo Sapiens
HSIHHSTSH

SEQ ID NO: 1272417 - protein, 9 aa, Homo Sapiens
KILSKGGVI

SEQ ID NO: 1272418 - protein, 9 aa, Homo Sapiens
IRLGEAAAK

SEQ ID NO: 1272419 - protein, 9 aa, Homo Sapiens
NRDLRQALL

SEQ ID NO: 1272420 - protein, 9 aa, Homo Sapiens
HIRTHTAEK

SEQ ID NO: 1272421 - protein, 9 aa, Homo Sapiens
PGPVNPAMS

SEQ ID NO: 1272422 - protein, 9 aa, Homo Sapiens
MNTGTLRGS

SEQ ID NO: 1272423 - protein, 9 aa, Homo Sapiens
TQYGDPAIY

SEQ ID NO: 1272424 - protein, 9 aa, Homo Sapiens
LQPPAATLR

SEQ ID NO: 1272425 - protein, 9 aa, Homo Sapiens
PKSPSLLSE

SEQ ID NO: 1272426 - protein, 9 aa, Homo Sapiens
SIASSQAFA

SEQ ID NO: 1272427 - protein, 9 aa, Homo Sapiens
LPMEGSRPW

SEQ ID NO: 1272428 - protein, 9 aa, Homo Sapiens
ITPVVLAIS

SEQ ID NO: 1272429 - protein, 9 aa, Homo Sapiens
YLSCYVEIH

SEQ ID NO: 1272430 - protein, 9 aa, Homo Sapiens
VRKKPEEIT

SEQ ID NO: 1272431 - protein, 9 aa, Homo Sapiens
LVAAELWEQ

SEQ ID NO: 1272432 - protein, 9 aa, Homo Sapiens
RRGDMMRPQ

SEQ ID NO: 1272433 - protein, 9 aa, Homo Sapiens
QRLPPNMTL

SEQ ID NO: 1272434 - protein, 9 aa, Homo Sapiens
AAAILTSLE

SEQ ID NO: 1272435 - protein, 9 aa, Homo Sapiens
VAMVIVAYG

SEQ ID NO: 1272436 - protein, 9 aa, Homo Sapiens
LLAYVGRLS

SEQ ID NO: 1272437 - protein, 9 aa, Homo Sapiens
QIEEKFKKK

SEQ ID NO: 1272438 - protein, 9 aa, Homo Sapiens
TGPPTKRIR

SEQ ID NO: 1272439 - protein, 9 aa, Homo Sapiens
CCRPTCCIS

SEQ ID NO: 1272440 - protein, 9 aa, Homo Sapiens
PLGCCCTTQ

SEQ ID NO: 1272441 - protein, 9 aa, Homo Sapiens
KNERCGTDL

SEQ ID NO: 1272442 - protein, 9 aa, Homo Sapiens
LSQGLREHA

SEQ ID NO: 1272443 - protein, 9 aa, Homo Sapiens
ALILLLCMV

SEQ ID NO: 1272444 - protein, 9 aa, Homo Sapiens
PSWDNHFAI

SEQ ID NO: 1272445 - protein, 9 aa, Homo Sapiens
YEFSDPPTS

SEQ ID NO: 1272446 - protein, 9 aa, Homo Sapiens
CVALTKVSE

SEQ ID NO: 1272447 - protein, 9 aa, Homo Sapiens
IWNLKSYKN

SEQ ID NO: 1272448 - protein, 9 aa, Homo Sapiens
NDDELISKS

SEQ ID NO: 1272449 - protein, 9 aa, Homo Sapiens
RGSLTWRHA

SEQ ID NO: 1272450 - protein, 9 aa, Homo Sapiens
AIYVMENGA

SEQ ID NO: 1272451 - protein, 9 aa, Homo Sapiens
YFHRSILKC

SEQ ID NO: 1272452 - protein, 9 aa, Homo Sapiens
AFSINPGMM

SEQ ID NO: 1272453 - protein, 9 aa, Homo Sapiens
HHEAWRQLP

SEQ ID NO: 1272454 - protein, 9 aa, Homo Sapiens
GGVCPPRPT

SEQ ID NO: 1272455 - protein, 9 aa, Homo Sapiens
SVFQLYSPV

SEQ ID NO: 1272456 - protein, 9 aa, Homo Sapiens
HMGERPYAC

SEQ ID NO: 1272457 - protein, 9 aa, Homo Sapiens
LRDDGEMAA

SEQ ID NO: 1272458 - protein, 9 aa, Homo Sapiens
YGACGLSQE

SEQ ID NO: 1272459 - protein, 9 aa, Homo Sapiens
DNKSTAQNM

SEQ ID NO: 1272460 - protein, 9 aa, Homo Sapiens
FSDPPTSAR

SEQ ID NO: 1272461 - protein, 9 aa, Homo Sapiens
AGDQGLMLQ

SEQ ID NO: 1272462 - protein, 9 aa, Homo Sapiens
ILQESEDVF

SEQ ID NO: 1272463 - protein, 9 aa, Homo Sapiens
QLEVSMVKP

SEQ ID NO: 1272464 - protein, 9 aa, Homo Sapiens
AAFKGYLGM

SEQ ID NO: 1272465 - protein, 9 aa, Homo Sapiens
WEQRAARMG

SEQ ID NO: 1272466 - protein, 9 aa, Homo Sapiens
PDQRLPKAS

SEQ ID NO: 1272467 - protein, 9 aa, Homo Sapiens
GPQGNTMKR

SEQ ID NO: 1272468 - protein, 9 aa, Homo Sapiens
MILEKQKKI

SEQ ID NO: 1272469 - protein, 9 aa, Homo Sapiens
AQIQIEGDL

SEQ ID NO: 1272470 - protein, 9 aa, Homo Sapiens
LLGMWATDL

SEQ ID NO: 1272471 - protein, 9 aa, Homo Sapiens
GQQVIKVDC

SEQ ID NO: 1272472 - protein, 9 aa, Homo Sapiens
FQGEQNHFN

SEQ ID NO: 1272473 - protein, 9 aa, Homo Sapiens
IYYSLIFLN

SEQ ID NO: 1272474 - protein, 9 aa, Homo Sapiens
AASVLCIQT

SEQ ID NO: 1272475 - protein, 9 aa, Homo Sapiens
EAHADTGET

SEQ ID NO: 1272476 - protein, 9 aa, Homo Sapiens
CKAATATRS

SEQ ID NO: 1272477 - protein, 9 aa, Homo Sapiens
GNDKIAVTT

SEQ ID NO: 1272478 - protein, 9 aa, Homo Sapiens
DLLDSFVSF

SEQ ID NO: 1272479 - protein, 9 aa, Homo Sapiens
EEDLKEHYT

SEQ ID NO: 1272480 - protein, 9 aa, Homo Sapiens
GRDPEPVCV

SEQ ID NO: 1272481 - protein, 9 aa, Homo Sapiens
SQPRAEPTQ

SEQ ID NO: 1272482 - protein, 9 aa, Homo Sapiens
AGFLARCVK

SEQ ID NO: 1272483 - protein, 9 aa, Homo Sapiens
HLAIIHEEN

SEQ ID NO: 1272484 - protein, 9 aa, Homo Sapiens
PSSSSGSSS

SEQ ID NO: 1272485 - protein, 9 aa, Homo Sapiens
SASQAPGTT

SEQ ID NO: 1272486 - protein, 9 aa, Homo Sapiens
FGAFSINPG

SEQ ID NO: 1272487 - protein, 9 aa, Homo Sapiens
FMTRSSLLS

SEQ ID NO: 1272488 - protein, 9 aa, Homo Sapiens
MKNRPSFQE

SEQ ID NO: 1272489 - protein, 9 aa, Homo Sapiens
HCRAHLAND

SEQ ID NO: 1272490 - protein, 9 aa, Homo Sapiens
LPSANLKSP

SEQ ID NO: 1272491 - protein, 9 aa, Homo Sapiens
GCIMGQMVC

SEQ ID NO: 1272492 - protein, 9 aa, Homo Sapiens
EDEADIEVA

SEQ ID NO: 1272493 - protein, 9 aa, Homo Sapiens
DGSQPDTAV

SEQ ID NO: 1272494 - protein, 9 aa, Homo Sapiens
PMEGSRPWA

SEQ ID NO: 1272495 - protein, 9 aa, Homo Sapiens
LDDSSNTSP

SEQ ID NO: 1272496 - protein, 9 aa, Homo Sapiens
ADAKKVRKK

SEQ ID NO: 1272497 - protein, 9 aa, Homo Sapiens
RCRVLTSAI

SEQ ID NO: 1272498 - protein, 9 aa, Homo Sapiens
HSGLHHHEA

SEQ ID NO: 1272499 - protein, 9 aa, Homo Sapiens
QTQYGDPAI

SEQ ID NO: 1272500 - protein, 9 aa, Homo Sapiens
FSVLSTPYH

SEQ ID NO: 1272501 - protein, 9 aa, Homo Sapiens
TAASVLCIQ

SEQ ID NO: 1272502 - protein, 9 aa, Homo Sapiens
EIAESFYIM

SEQ ID NO: 1272503 - protein, 9 aa, Homo Sapiens
VAPIYLMML

SEQ ID NO: 1272504 - protein, 9 aa, Homo Sapiens
HTPYSSYSK

SEQ ID NO: 1272505 - protein, 9 aa, Homo Sapiens
LEHQEKNDV

SEQ ID NO: 1272506 - protein, 9 aa, Homo Sapiens
MMPDILFAL

SEQ ID NO: 1272507 - protein, 9 aa, Homo Sapiens
NSKINALMH

SEQ ID NO: 1272508 - protein, 9 aa, Homo Sapiens
LRYESKKLQ

SEQ ID NO: 1272509 - protein, 9 aa, Homo Sapiens
PQSQQPQQP

SEQ ID NO: 1272510 - protein, 9 aa, Homo Sapiens
SMDRMATMF

SEQ ID NO: 1272511 - protein, 9 aa, Homo Sapiens
ASMERLLER

SEQ ID NO: 1272512 - protein, 9 aa, Homo Sapiens
IEEKFKKKE

SEQ ID NO: 1272513 - protein, 9 aa, Homo Sapiens
ANDDELISK

SEQ ID NO: 1272514 - protein, 9 aa, Homo Sapiens
RVTQGPRQE

SEQ ID NO: 1272515 - protein, 9 aa, Homo Sapiens
LAVWALWSL

SEQ ID NO: 1272516 - protein, 9 aa, Homo Sapiens
CRPTCCISS

SEQ ID NO: 1272517 - protein, 9 aa, Homo Sapiens
FIPVAESLK

SEQ ID NO: 1272518 - protein, 9 aa, Homo Sapiens
NPFCSYLEH

SEQ ID NO: 1272519 - protein, 9 aa, Homo Sapiens
LLPCSFVPI

SEQ ID NO: 1272520 - protein, 9 aa, Homo Sapiens
KHKPKATKQ

SEQ ID NO: 1272521 - protein, 9 aa, Homo Sapiens
RTDGRRLLL

SEQ ID NO: 1272522 - protein, 9 aa, Homo Sapiens
QVLRLMWIF

SEQ ID NO: 1272523 - protein, 9 aa, Homo Sapiens
CTGSVGQAS

SEQ ID NO: 1272524 - protein, 9 aa, Homo Sapiens
VASKEQPSQ

SEQ ID NO: 1272525 - protein, 9 aa, Homo Sapiens
GRRFISDES

SEQ ID NO: 1272526 - protein, 9 aa, Homo Sapiens
GCTQPQRVA

SEQ ID NO: 1272527 - protein, 9 aa, Homo Sapiens
QPPPQSQQP

SEQ ID NO: 1272528 - protein, 9 aa, Homo Sapiens
STEGKEQQE

SEQ ID NO: 1272529 - protein, 9 aa, Homo Sapiens
KKLHKIVFD

SEQ ID NO: 1272530 - protein, 9 aa, Homo Sapiens
SAFSTWEKK

SEQ ID NO: 1272531 - protein, 9 aa, Homo Sapiens
DSALRRSAW

SEQ ID NO: 1272532 - protein, 9 aa, Homo Sapiens
DEAFIPVAE

SEQ ID NO: 1272533 - protein, 9 aa, Homo Sapiens
SLKKKRAEF

SEQ ID NO: 1272534 - protein, 9 aa, Homo Sapiens
AEGTKLDHE

SEQ ID NO: 1272535 - protein, 9 aa, Homo Sapiens
SIWELSSGN

SEQ ID NO: 1272536 - protein, 9 aa, Homo Sapiens
YISFPVELD

SEQ ID NO: 1272537 - protein, 9 aa, Homo Sapiens
AATLRAGEL

SEQ ID NO: 1272538 - protein, 9 aa, Homo Sapiens
MLQSLNALS

SEQ ID NO: 1272539 - protein, 9 aa, Homo Sapiens
PQGNTMKRL

SEQ ID NO: 1272540 - protein, 9 aa, Homo Sapiens
HCFQIEWEK

SEQ ID NO: 1272541 - protein, 9 aa, Homo Sapiens
ENDAQVILF

SEQ ID NO: 1272542 - protein, 9 aa, Homo Sapiens
TCGTSPVHD

SEQ ID NO: 1272543 - protein, 9 aa, Homo Sapiens
QKRELRQVR

SEQ ID NO: 1272544 - protein, 9 aa, Homo Sapiens
NEEGVLHQN

SEQ ID NO: 1272545 - protein, 9 aa, Homo Sapiens
FQMPDLCAQ

SEQ ID NO: 1272546 - protein, 9 aa, Homo Sapiens
SAQLCMICQ

SEQ ID NO: 1272547 - protein, 9 aa, Homo Sapiens
EAMISLLKE

SEQ ID NO: 1272548 - protein, 9 aa, Homo Sapiens
LHVHFRESV

SEQ ID NO: 1272549 - protein, 9 aa, Homo Sapiens
GDYIIRKGT

SEQ ID NO: 1272550 - protein, 9 aa, Homo Sapiens
HMMPDILFA

SEQ ID NO: 1272551 - protein, 9 aa, Homo Sapiens
LDEGDTNSN

SEQ ID NO: 1272552 - protein, 9 aa, Homo Sapiens
WTILQSLSQ

SEQ ID NO: 1272553 - protein, 9 aa, Homo Sapiens
VGCIMGQMV

SEQ ID NO: 1272554 - protein, 9 aa, Homo Sapiens
LVQPTLEEK

SEQ ID NO: 1272555 - protein, 9 aa, Homo Sapiens
SFVSFFPEL

SEQ ID NO: 1272556 - protein, 9 aa, Homo Sapiens
HKWCLDPRV

SEQ ID NO: 1272557 - protein, 9 aa, Homo Sapiens
ETNPESQNF

SEQ ID NO: 1272558 - protein, 9 aa, Homo Sapiens
VNPAMSALG

SEQ ID NO: 1272559 - protein, 9 aa, Homo Sapiens
NQAGYRKDL

SEQ ID NO: 1272560 - protein, 9 aa, Homo Sapiens
AILTSLEIP

SEQ ID NO: 1272561 - protein, 9 aa, Homo Sapiens
MERLLERLT

SEQ ID NO: 1272562 - protein, 9 aa, Homo Sapiens
AELVGVEAG

SEQ ID NO: 1272563 - protein, 9 aa, Homo Sapiens
KTINPEQAR

SEQ ID NO: 1272564 - protein, 9 aa, Homo Sapiens
TRVIFIDFY

SEQ ID NO: 1272565 - protein, 9 aa, Homo Sapiens
DLLQCSFSI

SEQ ID NO: 1272566 - protein, 9 aa, Homo Sapiens
KGREIRMWY

SEQ ID NO: 1272567 - protein, 9 aa, Homo Sapiens
VNLNNQIIK

SEQ ID NO: 1272568 - protein, 9 aa, Homo Sapiens
GIGCGFSCA

SEQ ID NO: 1272569 - protein, 9 aa, Homo Sapiens
CIETSGNSS

SEQ ID NO: 1272570 - protein, 9 aa, Homo Sapiens
TVSLDCAIR

SEQ ID NO: 1272571 - protein, 9 aa, Homo Sapiens
KTRLEREGL

SEQ ID NO: 1272572 - protein, 9 aa, Homo Sapiens
ILLGDEGQL

SEQ ID NO: 1272573 - protein, 9 aa, Homo Sapiens
YTELQKLVE

SEQ ID NO: 1272574 - protein, 9 aa, Homo Sapiens
FFQAVNEAI

SEQ ID NO: 1272575 - protein, 9 aa, Homo Sapiens
ARAHRCTTA

SEQ ID NO: 1272576 - protein, 9 aa, Homo Sapiens
ARQRKKAFS

SEQ ID NO: 1272577 - protein, 9 aa, Homo Sapiens
EDVFTLIES

SEQ ID NO: 1272578 - protein, 9 aa, Homo Sapiens
PTGFPSCHF

SEQ ID NO: 1272579 - protein, 9 aa, Homo Sapiens
CEEFRIHFT

SEQ ID NO: 1272580 - protein, 9 aa, Homo Sapiens
TAPSGQNKN

SEQ ID NO: 1272581 - protein, 9 aa, Homo Sapiens
DTQKTSFKK

SEQ ID NO: 1272582 - protein, 9 aa, Homo Sapiens
AVPFAKNYQ

SEQ ID NO: 1272583 - protein, 9 aa, Homo Sapiens
VTKNVNVGT

SEQ ID NO: 1272584 - protein, 9 aa, Homo Sapiens
LRCRNPVSE

SEQ ID NO: 1272585 - protein, 9 aa, Homo Sapiens
IFIDFYLYN

SEQ ID NO: 1272586 - protein, 9 aa, Homo Sapiens
EYKLLGRMF

SEQ ID NO: 1272587 - protein, 9 aa, Homo Sapiens
TCCISSCCR

SEQ ID NO: 1272588 - protein, 9 aa, Homo Sapiens
LLQLSQGLR

SEQ ID NO: 1272589 - protein, 9 aa, Homo Sapiens
SMQLKEQKG

SEQ ID NO: 1272590 - protein, 9 aa, Homo Sapiens
GLSQEKAVE

SEQ ID NO: 1272591 - protein, 9 aa, Homo Sapiens
WALWSLLVF

SEQ ID NO: 1272592 - protein, 9 aa, Homo Sapiens
AFQGEQNHF

SEQ ID NO: 1272593 - protein, 9 aa, Homo Sapiens
SYSKAWRFP

SEQ ID NO: 1272594 - protein, 9 aa, Homo Sapiens
LFITIYKNA

SEQ ID NO: 1272595 - protein, 9 aa, Homo Sapiens
NALKGKYIE

SEQ ID NO: 1272596 - protein, 9 aa, Homo Sapiens
MGQMVCHKI

SEQ ID NO: 1272597 - protein, 9 aa, Homo Sapiens
NNQIIKAER

SEQ ID NO: 1272598 - protein, 9 aa, Homo Sapiens
QGVAMVIVA

SEQ ID NO: 1272599 - protein, 9 aa, Homo Sapiens
RHLATYKGL

SEQ ID NO: 1272600 - protein, 9 aa, Homo Sapiens
GYTCDCFQG

SEQ ID NO: 1272601 - protein, 9 aa, Homo Sapiens
DQMILEKQK

SEQ ID NO: 1272602 - protein, 9 aa, Homo Sapiens
SGGQQVIKV

SEQ ID NO: 1272603 - protein, 9 aa, Homo Sapiens
ELSSGNQCT

SEQ ID NO: 1272604 - protein, 9 aa, Homo Sapiens
GDWPVPEAH

SEQ ID NO: 1272605 - protein, 9 aa, Homo Sapiens
IPEIAESFY

SEQ ID NO: 1272606 - protein, 9 aa, Homo Sapiens
GCGFSCAFG

SEQ ID NO: 1272607 - protein, 9 aa, Homo Sapiens
NDKIAVTTE

SEQ ID NO: 1272608 - protein, 9 aa, Homo Sapiens
CIQTVIDEC

SEQ ID NO: 1272609 - protein, 9 aa, Homo Sapiens
MRRRLHYNK

SEQ ID NO: 1272610 - protein, 9 aa, Homo Sapiens
GSVNQAGYR

SEQ ID NO: 1272611 - protein, 9 aa, Homo Sapiens
LPTPYCTVS

SEQ ID NO: 1272612 - protein, 9 aa, Homo Sapiens
SDTRDKRKF

SEQ ID NO: 1272613 - protein, 9 aa, Homo Sapiens
KLDIFVGNT

SEQ ID NO: 1272614 - protein, 9 aa, Homo Sapiens
YESKKLQQE

SEQ ID NO: 1272615 - protein, 9 aa, Homo Sapiens
TLFSLMQYC

SEQ ID NO: 1272616 - protein, 9 aa, Homo Sapiens
EQRRGDMMR

SEQ ID NO: 1272617 - protein, 9 aa, Homo Sapiens
LDGYFNSIR

SEQ ID NO: 1272618 - protein, 9 aa, Homo Sapiens
FQHLLDNFH

SEQ ID NO: 1272619 - protein, 9 aa, Homo Sapiens
ESKKLQQEN

SEQ ID NO: 1272620 - protein, 9 aa, Homo Sapiens
SPEKNHSSK

SEQ ID NO: 1272621 - protein, 9 aa, Homo Sapiens
TCGVPGIGC

SEQ ID NO: 1272622 - protein, 9 aa, Homo Sapiens
ILHAAAILT

SEQ ID NO: 1272623 - protein, 9 aa, Homo Sapiens
GDPAIYVME

SEQ ID NO: 1272624 - protein, 9 aa, Homo Sapiens
DSFVSFFPE

SEQ ID NO: 1272625 - protein, 9 aa, Homo Sapiens
LVASKEQPS

SEQ ID NO: 1272626 - protein, 9 aa, Homo Sapiens
PSGQNKNER

SEQ ID NO: 1272627 - protein, 9 aa, Homo Sapiens
TQVDETQQQ

SEQ ID NO: 1272628 - protein, 9 aa, Homo Sapiens
DQRLPKASD

SEQ ID NO: 1272629 - protein, 9 aa, Homo Sapiens
RLLLPLGCC

SEQ ID NO: 1272630 - protein, 9 aa, Homo Sapiens
EALLRMASS

SEQ ID NO: 1272631 - protein, 9 aa, Homo Sapiens
FQRKAAYRD

SEQ ID NO: 1272632 - protein, 9 aa, Homo Sapiens
GLAPLGEYK

SEQ ID NO: 1272633 - protein, 9 aa, Homo Sapiens
CSDDTRMVR

SEQ ID NO: 1272634 - protein, 9 aa, Homo Sapiens
TIGVVGGVL

SEQ ID NO: 1272635 - protein, 9 aa, Homo Sapiens
MMRPQAPGR

SEQ ID NO: 1272636 - protein, 9 aa, Homo Sapiens
DDTRMVRRA

SEQ ID NO: 1272637 - protein, 9 aa, Homo Sapiens
RHSGLHHHE

SEQ ID NO: 1272638 - protein, 9 aa, Homo Sapiens
KYKKLFAVP

SEQ ID NO: 1272639 - protein, 9 aa, Homo Sapiens
FVPIGILVA

SEQ ID NO: 1272640 - protein, 9 aa, Homo Sapiens
VGLPKPLTL

SEQ ID NO: 1272641 - protein, 9 aa, Homo Sapiens
DSSLATQVD

SEQ ID NO: 1272642 - protein, 9 aa, Homo Sapiens
FYLYNANVN

SEQ ID NO: 1272643 - protein, 9 aa, Homo Sapiens
NGVHCFQIE

SEQ ID NO: 1272644 - protein, 9 aa, Homo Sapiens
CPPRPTPAL

SEQ ID NO: 1272645 - protein, 9 aa, Homo Sapiens
LHHHEASSW

SEQ ID NO: 1272646 - protein, 9 aa, Homo Sapiens
LIQLLALYF

SEQ ID NO: 1272647 - protein, 9 aa, Homo Sapiens
VGQLQDIWL

SEQ ID NO: 1272648 - protein, 9 aa, Homo Sapiens
IFSRSWTLD

SEQ ID NO: 1272649 - protein, 9 aa, Homo Sapiens
GHVAAFKGY

SEQ ID NO: 1272650 - protein, 9 aa, Homo Sapiens
VVIFSVLST

SEQ ID NO: 1272651 - protein, 9 aa, Homo Sapiens
GPPTKRIRL

SEQ ID NO: 1272652 - protein, 9 aa, Homo Sapiens
RAEDDLKNK

SEQ ID NO: 1272653 - protein, 9 aa, Homo Sapiens
YWCKAATAT

SEQ ID NO: 1272654 - protein, 9 aa, Homo Sapiens
GDGSRHSGL

SEQ ID NO: 1272655 - protein, 9 aa, Homo Sapiens
ELWEQGDLE

SEQ ID NO: 1272656 - protein, 9 aa, Homo Sapiens
QCSHPNDDN

SEQ ID NO: 1272657 - protein, 9 aa, Homo Sapiens
GLLQLSQGL

SEQ ID NO: 1272658 - protein, 9 aa, Homo Sapiens
VCFSPEKNH

SEQ ID NO: 1272659 - protein, 9 aa, Homo Sapiens
EDDLKNKKA

SEQ ID NO: 1272660 - protein, 9 aa, Homo Sapiens
QGFQLDAAH

SEQ ID NO: 1272661 - protein, 9 aa, Homo Sapiens
YDEHKTINP

SEQ ID NO: 1272662 - protein, 9 aa, Homo Sapiens
KYALISAQL

SEQ ID NO: 1272663 - protein, 9 aa, Homo Sapiens
IWELSSGNQ

SEQ ID NO: 1272664 - protein, 9 aa, Homo Sapiens
RMVRRAAAS

SEQ ID NO: 1272665 - protein, 9 aa, Homo Sapiens
MGSVNQAGY

SEQ ID NO: 1272666 - protein, 9 aa, Homo Sapiens
GVPGIGCGF

SEQ ID NO: 1272667 - protein, 9 aa, Homo Sapiens
QPDTAVGTL

SEQ ID NO: 1272668 - protein, 9 aa, Homo Sapiens
QPPAATLRA

SEQ ID NO: 1272669 - protein, 9 aa, Homo Sapiens
RKKPEEITP

SEQ ID NO: 1272670 - protein, 9 aa, Homo Sapiens
SALGIGITI

SEQ ID NO: 1272671 - protein, 9 aa, Homo Sapiens
ESQNFKTVS

SEQ ID NO: 1272672 - protein, 9 aa, Homo Sapiens
IPVAESLKD

SEQ ID NO: 1272673 - protein, 9 aa, Homo Sapiens
IQIEGDLLQ

SEQ ID NO: 1272674 - protein, 9 aa, Homo Sapiens
GDRTIDYKE

SEQ ID NO: 1272675 - protein, 9 aa, Homo Sapiens
APLGEYKLL

SEQ ID NO: 1272676 - protein, 9 aa, Homo Sapiens
VTQNSQPRA

SEQ ID NO: 1272677 - protein, 9 aa, Homo Sapiens
TNSNTDQDA

SEQ ID NO: 1272678 - protein, 9 aa, Homo Sapiens
GGRDPEPVC

SEQ ID NO: 1272679 - protein, 9 aa, Homo Sapiens
SPLVTLPSA

SEQ ID NO: 1272680 - protein, 9 aa, Homo Sapiens
YSPVGSGGR

SEQ ID NO: 1272681 - protein, 9 aa, Homo Sapiens
RNLCSDDTR

SEQ ID NO: 1272682 - protein, 9 aa, Homo Sapiens
SDWLQYRHL

SEQ ID NO: 1272683 - protein, 9 aa, Homo Sapiens
PGTTAVHHH

SEQ ID NO: 1272684 - protein, 9 aa, Homo Sapiens
HKLHVHFRN

SEQ ID NO: 1272685 - protein, 9 aa, Homo Sapiens
DGSRHSGLH

SEQ ID NO: 1272686 - protein, 9 aa, Homo Sapiens
HKLHVHFRE

SEQ ID NO: 1272687 - protein, 9 aa, Homo Sapiens
PLTAQGVAM

SEQ ID NO: 1272688 - protein, 9 aa, Homo Sapiens
PEIAESFYI

SEQ ID NO: 1272689 - protein, 9 aa, Homo Sapiens
EGQLVLMDL

SEQ ID NO: 1272690 - protein, 9 aa, Homo Sapiens
SSAFQARLL

SEQ ID NO: 1272691 - protein, 9 aa, Homo Sapiens
LKNKKALSS

SEQ ID NO: 1272692 - protein, 9 aa, Homo Sapiens
EHKTINPEQ

SEQ ID NO: 1272693 - protein, 9 aa, Homo Sapiens
KEFGTSMVQ

SEQ ID NO: 1272694 - protein, 9 aa, Homo Sapiens
WPVPEAHAD

SEQ ID NO: 1272695 - protein, 9 aa, Homo Sapiens
DHKLHVHFR

SEQ ID NO: 1272696 - protein, 9 aa, Homo Sapiens
SPSSASQAP

SEQ ID NO: 1272697 - protein, 9 aa, Homo Sapiens
MRHLWRLGV

SEQ ID NO: 1272698 - protein, 9 aa, Homo Sapiens
KGYLGMLKK

SEQ ID NO: 1272699 - protein, 9 aa, Homo Sapiens
LGRNSFEVS

SEQ ID NO: 1272700 - protein, 9 aa, Homo Sapiens
TPGRSCVNL

SEQ ID NO: 1272701 - protein, 9 aa, Homo Sapiens
LKEHYTPVG

SEQ ID NO: 1272702 - protein, 9 aa, Homo Sapiens
AAILTSLEI

SEQ ID NO: 1272703 - protein, 9 aa, Homo Sapiens
GVHCFQIEW

SEQ ID NO: 1272704 - protein, 9 aa, Homo Sapiens
RKGTIGKKM

SEQ ID NO: 1272705 - protein, 9 aa, Homo Sapiens
CLDAFPLLL

SEQ ID NO: 1272706 - protein, 9 aa, Homo Sapiens
KHDTQKTSF

SEQ ID NO: 1272707 - protein, 9 aa, Homo Sapiens
QYSPAGFSR

SEQ ID NO: 1272708 - protein, 9 aa, Homo Sapiens
IEGDLLQCS

SEQ ID NO: 1272709 - protein, 9 aa, Homo Sapiens
DVFTLIESH

SEQ ID NO: 1272710 - protein, 9 aa, Homo Sapiens
SQGTKAVTK

SEQ ID NO: 1272711 - protein, 9 aa, Homo Sapiens
FQLYSPVGS

SEQ ID NO: 1272712 - protein, 9 aa, Homo Sapiens
KEFVAMMTG

SEQ ID NO: 1272713 - protein, 9 aa, Homo Sapiens
KKDFAKSQS

SEQ ID NO: 1272714 - protein, 9 aa, Homo Sapiens
AEGFWQVGI

SEQ ID NO: 1272715 - protein, 9 aa, Homo Sapiens
KELNIKLAR

SEQ ID NO: 1272716 - protein, 9 aa, Homo Sapiens
SGQNKNERC

SEQ ID NO: 1272717 - protein, 9 aa, Homo Sapiens
ALPPIARVP

SEQ ID NO: 1272718 - protein, 9 aa, Homo Sapiens
EYSLASERD

SEQ ID NO: 1272719 - protein, 9 aa, Homo Sapiens
TMLNLFIGG

SEQ ID NO: 1272720 - protein, 9 aa, Homo Sapiens
LTNRDLRQA

SEQ ID NO: 1272721 - protein, 9 aa, Homo Sapiens
GFPSCHFST

SEQ ID NO: 1272722 - protein, 9 aa, Homo Sapiens
QIEGDLLQC

SEQ ID NO: 1272723 - protein, 9 aa, Homo Sapiens
QQEKSGEDG

SEQ ID NO: 1272724 - protein, 9 aa, Homo Sapiens
VQPTLEEKK

SEQ ID NO: 1272725 - protein, 9 aa, Homo Sapiens
GVAMVIVAY

SEQ ID NO: 1272726 - protein, 9 aa, Homo Sapiens
NPQIQWQNS

SEQ ID NO: 1272727 - protein, 9 aa, Homo Sapiens
QLKEQKGGE

SEQ ID NO: 1272728 - protein, 9 aa, Homo Sapiens
SQAFANALS

SEQ ID NO: 1272729 - protein, 9 aa, Homo Sapiens
ARLLGNNLH

SEQ ID NO: 1272730 - protein, 9 aa, Homo Sapiens
NLNNQIIKA

SEQ ID NO: 1272731 - protein, 9 aa, Homo Sapiens
FCTGSVGQA

SEQ ID NO: 1272732 - protein, 9 aa, Homo Sapiens
LCSDDTRMV

SEQ ID NO: 1272733 - protein, 9 aa, Homo Sapiens
GCCCTTQPR

SEQ ID NO: 1272734 - protein, 9 aa, Homo Sapiens
NVSFQCPDG

SEQ ID NO: 1272735 - protein, 9 aa, Homo Sapiens
DCHLCWLLP

SEQ ID NO: 1272736 - protein, 9 aa, Homo Sapiens
CDCHLCWLL

SEQ ID NO: 1272737 - protein, 9 aa, Homo Sapiens
VKQCLQPPA

SEQ ID NO: 1272738 - protein, 9 aa, Homo Sapiens
SDESRRKDL

SEQ ID NO: 1272739 - protein, 9 aa, Homo Sapiens
GRSNLSEGK

SEQ ID NO: 1272740 - protein, 9 aa, Homo Sapiens
SKLRRHSSE

SEQ ID NO: 1272741 - protein, 9 aa, Homo Sapiens
LLQCSFSIL

SEQ ID NO: 1272742 - protein, 9 aa, Homo Sapiens
PSCHFSTPC

SEQ ID NO: 1272743 - protein, 9 aa, Homo Sapiens
HSAEASPQE

SEQ ID NO: 1272744 - protein, 9 aa, Homo Sapiens
ALLVAAELW

SEQ ID NO: 1272745 - protein, 9 aa, Homo Sapiens
IIIAGWDRQ

SEQ ID NO: 1272746 - protein, 9 aa, Homo Sapiens
QNFKTVSKN

SEQ ID NO: 1272747 - protein, 9 aa, Homo Sapiens
RTLCPMRCP

SEQ ID NO: 1272748 - protein, 9 aa, Homo Sapiens
QAVNEAILL

SEQ ID NO: 1272749 - protein, 9 aa, Homo Sapiens
QQVIKVDCV

SEQ ID NO: 1272750 - protein, 9 aa, Homo Sapiens
AMVIVAYGI

SEQ ID NO: 1272751 - protein, 9 aa, Homo Sapiens
KNALKGKYI

SEQ ID NO: 1272752 - protein, 9 aa, Homo Sapiens
QGLMLQSLN

SEQ ID NO: 1272753 - protein, 9 aa, Homo Sapiens
FSLMQYCEE

SEQ ID NO: 1272754 - protein, 9 aa, Homo Sapiens
KAVKVGIKE

SEQ ID NO: 1272755 - protein, 9 aa, Homo Sapiens
QIQIEGDLL

SEQ ID NO: 1272756 - protein, 9 aa, Homo Sapiens
DEDLDSSKG

SEQ ID NO: 1272757 - protein, 9 aa, Homo Sapiens
NTGTLRGSL

SEQ ID NO: 1272758 - protein, 9 aa, Homo Sapiens
EWTSNSKIN

SEQ ID NO: 1272759 - protein, 9 aa, Homo Sapiens
IGITIGVVG

SEQ ID NO: 1272760 - protein, 9 aa, Homo Sapiens
YTCDCFQGF

SEQ ID NO: 1272761 - protein, 9 aa, Homo Sapiens
ERRQKRELR

SEQ ID NO: 1272762 - protein, 9 aa, Homo Sapiens
LRQALLRLV

SEQ ID NO: 1272763 - protein, 9 aa, Homo Sapiens
AIFETKFQV

SEQ ID NO: 1272764 - protein, 9 aa, Homo Sapiens
VSECMRGVR

SEQ ID NO: 1272765 - protein, 9 aa, Homo Sapiens
KQQIEEKFK

SEQ ID NO: 1272766 - protein, 9 aa, Homo Sapiens
DNEPKFLNG

SEQ ID NO: 1272767 - protein, 9 aa, Homo Sapiens
VTLPSANLK

SEQ ID NO: 1272768 - protein, 9 aa, Homo Sapiens
CAQEIAIIL

SEQ ID NO: 1272769 - protein, 9 aa, Homo Sapiens
IYLMMLNPI

SEQ ID NO: 1272770 - protein, 9 aa, Homo Sapiens
ASPSSSSGS

SEQ ID NO: 1272771 - protein, 9 aa, Homo Sapiens
GTSMVQRRC

SEQ ID NO: 1272772 - protein, 9 aa, Homo Sapiens
QTHVPGHWR

SEQ ID NO: 1272773 - protein, 9 aa, Homo Sapiens
CGVPGIGCG

SEQ ID NO: 1272774 - protein, 9 aa, Homo Sapiens
LLGDEGQLV

SEQ ID NO: 1272775 - protein, 9 aa, Homo Sapiens
PRWDPVYAK

SEQ ID NO: 1272776 - protein, 9 aa, Homo Sapiens
DSSKGSSQE

SEQ ID NO: 1272777 - protein, 9 aa, Homo Sapiens
EIEQLKAEI

SEQ ID NO: 1272778 - protein, 9 aa, Homo Sapiens
HLATYKGLF

SEQ ID NO: 1272779 - protein, 9 aa, Homo Sapiens
DLGGVCPPR

SEQ ID NO: 1272780 - protein, 9 aa, Homo Sapiens
FAKDGEKKI

SEQ ID NO: 1272781 - protein, 9 aa, Homo Sapiens
QIKQTEYSL

SEQ ID NO: 1272782 - protein, 9 aa, Homo Sapiens
FALTDDMGR

SEQ ID NO: 1272783 - protein, 9 aa, Homo Sapiens
KEYLGFILN

SEQ ID NO: 1272784 - protein, 9 aa, Homo Sapiens
EQRAARMGG

SEQ ID NO: 1272785 - protein, 9 aa, Homo Sapiens
RSDTRDKRK

SEQ ID NO: 1272786 - protein, 9 aa, Homo Sapiens
PFCSYLEHQ

SEQ ID NO: 1272787 - protein, 9 aa, Homo Sapiens
NFHSKDELK

SEQ ID NO: 1272788 - protein, 9 aa, Homo Sapiens
KLKTRLERE

SEQ ID NO: 1272789 - protein, 9 aa, Homo Sapiens
LHYTGPPTK

SEQ ID NO: 1272790 - protein, 9 aa, Homo Sapiens
VLRVLDDSS

SEQ ID NO: 1272791 - protein, 9 aa, Homo Sapiens
DVCFSPEKN

SEQ ID NO: 1272792 - protein, 9 aa, Homo Sapiens
SKEQPSQDG

SEQ ID NO: 1272793 - protein, 9 aa, Homo Sapiens
WATDLQILS

SEQ ID NO: 1272794 - protein, 9 aa, Homo Sapiens
TFGYGDVYA

SEQ ID NO: 1272795 - protein, 9 aa, Homo Sapiens
SQSQFHSST

SEQ ID NO: 1272796 - protein, 9 aa, Homo Sapiens
LCPMRCPPG

SEQ ID NO: 1272797 - protein, 9 aa, Homo Sapiens
VQTHVPGHW

SEQ ID NO: 1272798 - protein, 9 aa, Homo Sapiens
PQIRYASME

SEQ ID NO: 1272799 - protein, 9 aa, Homo Sapiens
ASRSILLHP

SEQ ID NO: 1272800 - protein, 9 aa, Homo Sapiens
PKASDQPSG

SEQ ID NO: 1272801 - protein, 9 aa, Homo Sapiens
SNPQIQWQN

SEQ ID NO: 1272802 - protein, 9 aa, Homo Sapiens
QIVPENDAQ

SEQ ID NO: 1272803 - protein, 9 aa, Homo Sapiens
TLCPMRCPP

SEQ ID NO: 1272804 - protein, 9 aa, Homo Sapiens
PEERLPMEG

SEQ ID NO: 1272805 - protein, 9 aa, Homo Sapiens
LICVALTKV

SEQ ID NO: 1272806 - protein, 9 aa, Homo Sapiens
MDRMATMFY

SEQ ID NO: 1272807 - protein, 9 aa, Homo Sapiens
DDELISKSF

SEQ ID NO: 1272808 - protein, 9 aa, Homo Sapiens
RVPLVRLRQ

SEQ ID NO: 1272809 - protein, 9 aa, Homo Sapiens
FGTSMVQRR

SEQ ID NO: 1272810 - protein, 9 aa, Homo Sapiens
LLRYESKKL

SEQ ID NO: 1272811 - protein, 9 aa, Homo Sapiens
SRHSGLHHH

SEQ ID NO: 1272812 - protein, 9 aa, Homo Sapiens
VPIGILVAF

SEQ ID NO: 1272813 - protein, 9 aa, Homo Sapiens
NLSSSDYPY

SEQ ID NO: 1272814 - protein, 9 aa, Homo Sapiens
IMGQMVCHK

SEQ ID NO: 1272815 - protein, 9 aa, Homo Sapiens
RALRAQKAR

SEQ ID NO: 1272816 - protein, 9 aa, Homo Sapiens
AQDLLDSFV

SEQ ID NO: 1272817 - protein, 9 aa, Homo Sapiens
MLNLFIGGT

SEQ ID NO: 1272818 - protein, 9 aa, Homo Sapiens
LVLMDLGSM

SEQ ID NO: 1272819 - protein, 9 aa, Homo Sapiens
NPESQNFKT

SEQ ID NO: 1272820 - protein, 9 aa, Homo Sapiens
HLVPDLSLT

SEQ ID NO: 1272821 - protein, 9 aa, Homo Sapiens
GAEGTKLDH

SEQ ID NO: 1272822 - protein, 9 aa, Homo Sapiens
SSQAFANAL

SEQ ID NO: 1272823 - protein, 9 aa, Homo Sapiens
YLKNLVMTM

SEQ ID NO: 1272824 - protein, 9 aa, Homo Sapiens
NHFNSSQGG

SEQ ID NO: 1272825 - protein, 9 aa, Homo Sapiens
VAAELWEQG

SEQ ID NO: 1272826 - protein, 9 aa, Homo Sapiens
MATMFYIGA

SEQ ID NO: 1272827 - protein, 9 aa, Homo Sapiens
AFIPVAESL

SEQ ID NO: 1272828 - protein, 9 aa, Homo Sapiens
ELQKLVETD

SEQ ID NO: 1272829 - protein, 9 aa, Homo Sapiens
PVPEAHADT

SEQ ID NO: 1272830 - protein, 9 aa, Homo Sapiens
QRVAAMSVA

SEQ ID NO: 1272831 - protein, 9 aa, Homo Sapiens
QVYEFSDPP

SEQ ID NO: 1272832 - protein, 9 aa, Homo Sapiens
GLMLQSLNA

SEQ ID NO: 1272833 - protein, 9 aa, Homo Sapiens
QYCEEFRIH

SEQ ID NO: 1272834 - protein, 9 aa, Homo Sapiens
YFNSIRMDM

SEQ ID NO: 1272835 - protein, 9 aa, Homo Sapiens
GSCLVGATA

SEQ ID NO: 1272836 - protein, 9 aa, Homo Sapiens
TSFKKNLMA

SEQ ID NO: 1272837 - protein, 9 aa, Homo Sapiens
LACVSQNGC

SEQ ID NO: 1272838 - protein, 9 aa, Homo Sapiens
YGDPAIYVM

SEQ ID NO: 1272839 - protein, 9 aa, Homo Sapiens
CRNPVSECM

SEQ ID NO: 1272840 - protein, 9 aa, Homo Sapiens
SRTTVSSVA

SEQ ID NO: 1272841 - protein, 9 aa, Homo Sapiens
FGYGDVYAK

SEQ ID NO: 1272842 - protein, 9 aa, Homo Sapiens
QILQESEDV

SEQ ID NO: 1272843 - protein, 9 aa, Homo Sapiens
TCDCHLCWL

SEQ ID NO: 1272844 - protein, 9 aa, Homo Sapiens
HRCTTAPLS

SEQ ID NO: 1272845 - protein, 9 aa, Homo Sapiens
SSSDYPYHY

SEQ ID NO: 1272846 - protein, 9 aa, Homo Sapiens
MVTMSTFGY

SEQ ID NO: 1272847 - protein, 9 aa, Homo Sapiens
TILYAGNHK

SEQ ID NO: 1272848 - protein, 9 aa, Homo Sapiens
LSQEKAVEK

SEQ ID NO: 1272849 - protein, 9 aa, Homo Sapiens
YPYHYTKVT

SEQ ID NO: 1272850 - protein, 9 aa, Homo Sapiens
EEGVLHQNR

SEQ ID NO: 1272851 - protein, 9 aa, Homo Sapiens
NEERFTGLA

SEQ ID NO: 1272852 - protein, 9 aa, Homo Sapiens
DMMRPQAPG

SEQ ID NO: 1272853 - protein, 9 aa, Homo Sapiens
IFSVLSTPY

SEQ ID NO: 1272854 - protein, 9 aa, Homo Sapiens
QVRALRAQK

SEQ ID NO: 1272855 - protein, 9 aa, Homo Sapiens
TYMVVLKEE

SEQ ID NO: 1272856 - protein, 9 aa, Homo Sapiens
EEADRGSCL

SEQ ID NO: 1272857 - protein, 9 aa, Homo Sapiens
NLMCSRFPD

SEQ ID NO: 1272858 - protein, 9 aa, Homo Sapiens
LDSFVSFFP

SEQ ID NO: 1272859 - protein, 9 aa, Homo Sapiens
ELHHEAWRQ

SEQ ID NO: 1272860 - protein, 9 aa, Homo Sapiens
ELAKHAVSQ

SEQ ID NO: 1272861 - protein, 9 aa, Homo Sapiens
ARMPNSPAT

SEQ ID NO: 1272862 - protein, 9 aa, Homo Sapiens
LERKLKTRL

SEQ ID NO: 1272863 - protein, 9 aa, Homo Sapiens
LEKNDGSQP

SEQ ID NO: 1272864 - protein, 9 aa, Homo Sapiens
GQLEVSMVK

SEQ ID NO: 1272865 - protein, 9 aa, Homo Sapiens
TAQNMEGII

SEQ ID NO: 1272866 - protein, 9 aa, Homo Sapiens
VPEAHADTG

SEQ ID NO: 1272867 - protein, 9 aa, Homo Sapiens
RRDMKNRPS

SEQ ID NO: 1272868 - protein, 9 aa, Homo Sapiens
RTHTAEKPF

SEQ ID NO: 1272869 - protein, 9 aa, Homo Sapiens
AEQRRGDMM

SEQ ID NO: 1272870 - protein, 9 aa, Homo Sapiens
VLHQNRSLL

SEQ ID NO: 1272871 - protein, 9 aa, Homo Sapiens
NLMKFHLMV

SEQ ID NO: 1272872 - protein, 9 aa, Homo Sapiens
KKLFAVPFA

SEQ ID NO: 1272873 - protein, 9 aa, Homo Sapiens
TAQGVAMVI

SEQ ID NO: 1272874 - protein, 9 aa, Homo Sapiens
RYESKKLQQ

SEQ ID NO: 1272875 - protein, 9 aa, Homo Sapiens
KLLGRMFRR

SEQ ID NO: 1272876 - protein, 9 aa, Homo Sapiens
SPSLLSETV

SEQ ID NO: 1272877 - protein, 9 aa, Homo Sapiens
QLLALYFHR

SEQ ID NO: 1272878 - protein, 9 aa, Homo Sapiens
QVIKVDCVA

SEQ ID NO: 1272879 - protein, 9 aa, Homo Sapiens
FKTVSKNCS

SEQ ID NO: 1272880 - protein, 9 aa, Homo Sapiens
VSVCACPGR

SEQ ID NO: 1272881 - protein, 9 aa, Homo Sapiens
GHWRELHHE

SEQ ID NO: 1272882 - protein, 9 aa, Homo Sapiens
GNECGAEGF

SEQ ID NO: 1272883 - protein, 9 aa, Homo Sapiens
SWDNHFAIF

SEQ ID NO: 1272884 - protein, 9 aa, Homo Sapiens
PNDDNVHFR

SEQ ID NO: 1272885 - protein, 9 aa, Homo Sapiens
EVALVLAAI

SEQ ID NO: 1272886 - protein, 9 aa, Homo Sapiens
QAGYRKDLG

SEQ ID NO: 1272887 - protein, 9 aa, Homo Sapiens
CAKQLSSAT

SEQ ID NO: 1272888 - protein, 9 aa, Homo Sapiens
SSGNQCTEL

SEQ ID NO: 1272889 - protein, 9 aa, Homo Sapiens
YRDPVFYDT

SEQ ID NO: 1272890 - protein, 9 aa, Homo Sapiens
PYSSYSKAW

SEQ ID NO: 1272891 - protein, 9 aa, Homo Sapiens
FWCEDECFL

SEQ ID NO: 1272892 - protein, 9 aa, Homo Sapiens
EQVRALRAQ

SEQ ID NO: 1272893 - protein, 9 aa, Homo Sapiens
ISFPVELDM

SEQ ID NO: 1272894 - protein, 9 aa, Homo Sapiens
SQEKAVEKF

SEQ ID NO: 1272895 - protein, 9 aa, Homo Sapiens
GQGIKERSK

SEQ ID NO: 1272896 - protein, 9 aa, Homo Sapiens
AKQLSSATL

SEQ ID NO: 1272897 - protein, 9 aa, Homo Sapiens
HFQRKAAYR

SEQ ID NO: 1272898 - protein, 9 aa, Homo Sapiens
SYLAVWALW

SEQ ID NO: 1272899 - protein, 9 aa, Homo Sapiens
YLAVWALWS

SEQ ID NO: 1272900 - protein, 9 aa, Homo Sapiens
TAHIRTHTA

SEQ ID NO: 1272901 - protein, 9 aa, Homo Sapiens
MKAVKVGIK

SEQ ID NO: 1272902 - protein, 9 aa, Homo Sapiens
SCKELLFYP

SEQ ID NO: 1272903 - protein, 9 aa, Homo Sapiens
KYTELQKLV

SEQ ID NO: 1272904 - protein, 9 aa, Homo Sapiens
MKFHLMVAV

SEQ ID NO: 1272905 - protein, 9 aa, Homo Sapiens
LHVHFRNVK

SEQ ID NO: 1272906 - protein, 9 aa, Homo Sapiens
INPEQARGV

SEQ ID NO: 1272907 - protein, 9 aa, Homo Sapiens
QNKNERCGT

SEQ ID NO: 1272908 - protein, 9 aa, Homo Sapiens
DLDSSKGSS

SEQ ID NO: 1272909 - protein, 9 aa, Homo Sapiens
VSQGTKAVT

SEQ ID NO: 1272910 - protein, 9 aa, Homo Sapiens
IPFNLMKFH

SEQ ID NO: 1272911 - protein, 9 aa, Homo Sapiens
LWEQGDLER

SEQ ID NO: 1272912 - protein, 9 aa, Homo Sapiens
AQVLRLMWI

SEQ ID NO: 1272913 - protein, 9 aa, Homo Sapiens
THTAEKPFT

SEQ ID NO: 1272914 - protein, 9 aa, Homo Sapiens
QRRGDMMRP

SEQ ID NO: 1272915 - protein, 9 aa, Homo Sapiens
WRNRTLCPM

SEQ ID NO: 1272916 - protein, 9 aa, Homo Sapiens
TLPSANLKS

SEQ ID NO: 1272917 - protein, 9 aa, Homo Sapiens
KEAQKDGKV

SEQ ID NO: 1272918 - protein, 9 aa, Homo Sapiens
SFVPIGILV

SEQ ID NO: 1272919 - protein, 9 aa, Homo Sapiens
CTTQPRGCS

SEQ ID NO: 1272920 - protein, 9 aa, Homo Sapiens
SCHFSTPCF

SEQ ID NO: 1272921 - protein, 9 aa, Homo Sapiens
ANELSGLPQ

SEQ ID NO: 1272922 - protein, 9 aa, Homo Sapiens
DGDRTIDYK

SEQ ID NO: 1272923 - protein, 9 aa, Homo Sapiens
YEVQFEIFK

SEQ ID NO: 1272924 - protein, 9 aa, Homo Sapiens
APSGQNKNE

SEQ ID NO: 1272925 - protein, 9 aa, Homo Sapiens
NFLSIRGAT

SEQ ID NO: 1272926 - protein, 9 aa, Homo Sapiens
NEPKFLNGP

SEQ ID NO: 1272927 - protein, 9 aa, Homo Sapiens
IPYKSKTIN

SEQ ID NO: 1272928 - protein, 9 aa, Homo Sapiens
NPVLLRRCT

SEQ ID NO: 1272929 - protein, 9 aa, Homo Sapiens
PGHWRELHH

SEQ ID NO: 1272930 - protein, 9 aa, Homo Sapiens
QALLRLVCC

SEQ ID NO: 1272931 - protein, 9 aa, Homo Sapiens
AKSQSQFHS

SEQ ID NO: 1272932 - protein, 9 aa, Homo Sapiens
CLPNLMCSR

SEQ ID NO: 1272933 - protein, 9 aa, Homo Sapiens
DPAIYVMEN

SEQ ID NO: 1272934 - protein, 9 aa, Homo Sapiens
DWPVPEAHA

SEQ ID NO: 1272935 - protein, 9 aa, Homo Sapiens
QFIVEKGDY

SEQ ID NO: 1272936 - protein, 9 aa, Homo Sapiens
SDYPYHYTK

SEQ ID NO: 1272937 - protein, 9 aa, Homo Sapiens
QEEIYPYIR

SEQ ID NO: 1272938 - protein, 9 aa, Homo Sapiens
SSGDWPVPE

SEQ ID NO: 1272939 - protein, 9 aa, Homo Sapiens
NPEALLRMA

SEQ ID NO: 1272940 - protein, 9 aa, Homo Sapiens
QRLPKASDQ

SEQ ID NO: 1272941 - protein, 9 aa, Homo Sapiens
RAALHLFNF

SEQ ID NO: 1272942 - protein, 9 aa, Homo Sapiens
SVNQAGYRK

SEQ ID NO: 1272943 - protein, 9 aa, Homo Sapiens
QPGDYIIRK

SEQ ID NO: 1272944 - protein, 9 aa, Homo Sapiens
SECMRGVRL

SEQ ID NO: 1272945 - protein, 9 aa, Homo Sapiens
LGIGITIGV

SEQ ID NO: 1272946 - protein, 9 aa, Homo Sapiens
WEKKLHKIV

SEQ ID NO: 1272947 - protein, 9 aa, Homo Sapiens
EASPQEEIY

SEQ ID NO: 1272948 - protein, 9 aa, Homo Sapiens
VCVGQLQDI

SEQ ID NO: 1272949 - protein, 9 aa, Homo Sapiens
ILDEGDTNS

SEQ ID NO: 1272950 - protein, 9 aa, Homo Sapiens
VGVGFGAIG

SEQ ID NO: 1272951 - protein, 9 aa, Homo Sapiens
CAVEAMISL

SEQ ID NO: 1272952 - protein, 9 aa, Homo Sapiens
LNNQIIKAE

SEQ ID NO: 1272953 - protein, 9 aa, Homo Sapiens
VLVSYLPRY

SEQ ID NO: 1272954 - protein, 9 aa, Homo Sapiens
DAKEYLGFI

SEQ ID NO: 1272955 - protein, 9 aa, Homo Sapiens
PEALLRMAS

SEQ ID NO: 1272956 - protein, 9 aa, Homo Sapiens
MKRLQEETG

SEQ ID NO: 1272957 - protein, 9 aa, Homo Sapiens
ELVCAVEAM

SEQ ID NO: 1272958 - protein, 9 aa, Homo Sapiens
WELSSGNQC

SEQ ID NO: 1272959 - protein, 9 aa, Homo Sapiens
TLTNRDLRQ

SEQ ID NO: 1272960 - protein, 9 aa, Homo Sapiens
EEEDLKEHY

SEQ ID NO: 1272961 - protein, 9 aa, Homo Sapiens
DECFLKQFC

SEQ ID NO: 1272962 - protein, 9 aa, Homo Sapiens
YALISAQLC

SEQ ID NO: 1272963 - protein, 9 aa, Homo Sapiens
RRLLLPLGC

SEQ ID NO: 1272964 - protein, 9 aa, Homo Sapiens
VCPPRPTPA

SEQ ID NO: 1272965 - protein, 9 aa, Homo Sapiens
LCAKQLSSA

SEQ ID NO: 1272966 - protein, 9 aa, Homo Sapiens
DPLQQAYVG

SEQ ID NO: 1272967 - protein, 9 aa, Homo Sapiens
QNSQPRAEP

SEQ ID NO: 1272968 - protein, 9 aa, Homo Sapiens
FKEFGTSMV

SEQ ID NO: 1272969 - protein, 9 aa, Homo Sapiens
PDVTQNSQP

SEQ ID NO: 1272970 - protein, 9 aa, Homo Sapiens
FSINPGMMA

SEQ ID NO: 1272971 - protein, 9 aa, Homo Sapiens
LCMICQGDI

SEQ ID NO: 1272972 - protein, 9 aa, Homo Sapiens
RLPKASDQP

SEQ ID NO: 1272973 - protein, 9 aa, Homo Sapiens
CCCTTQPRG

SEQ ID NO: 1272974 - protein, 9 aa, Homo Sapiens
VAQVLRLMW

SEQ ID NO: 1272975 - protein, 9 aa, Homo Sapiens
FLSIRGATC

SEQ ID NO: 1272976 - protein, 9 aa, Homo Sapiens
WCEDECFLK

SEQ ID NO: 1272977 - protein, 9 aa, Homo Sapiens
PPQSQQPQQ

SEQ ID NO: 1272978 - protein, 9 aa, Homo Sapiens
GSTSGRQRS

SEQ ID NO: 1272979 - protein, 9 aa, Homo Sapiens
EDEDLDSSK

SEQ ID NO: 1272980 - protein, 9 aa, Homo Sapiens
LGPQGNTMK

SEQ ID NO: 1272981 - protein, 9 aa, Homo Sapiens
SSYKSKHSI

SEQ ID NO: 1272982 - protein, 9 aa, Homo Sapiens
AQKARLLAG

SEQ ID NO: 1272983 - protein, 9 aa, Homo Sapiens
VGSGGRNLT

SEQ ID NO: 1272984 - protein, 9 aa, Homo Sapiens
LYEVQFEIF

SEQ ID NO: 1272985 - protein, 9 aa, Homo Sapiens
LCIQTVIDE

SEQ ID NO: 1272986 - protein, 9 aa, Homo Sapiens
RFISDESRR

SEQ ID NO: 1272987 - protein, 9 aa, Homo Sapiens
KRIRLQHQV

SEQ ID NO: 1272988 - protein, 9 aa, Homo Sapiens
PETFDGDTY

SEQ ID NO: 1272989 - protein, 9 aa, Homo Sapiens
GIKEVALVL

SEQ ID NO: 1272990 - protein, 9 aa, Homo Sapiens
TQHRRVHMG

SEQ ID NO: 1272991 - protein, 9 aa, Homo Sapiens
FANALSSLQ

SEQ ID NO: 1272992 - protein, 9 aa, Homo Sapiens
IVPENDAQV

SEQ ID NO: 1272993 - protein, 9 aa, Homo Sapiens
QPQRVAAMS

SEQ ID NO: 1272994 - protein, 9 aa, Homo Sapiens
PNLMCSRFP

SEQ ID NO: 1272995 - protein, 9 aa, Homo Sapiens
CRDHKLHVH

SEQ ID NO: 1272996 - protein, 9 aa, Homo Sapiens
DFYLYNANV

SEQ ID NO: 1272997 - protein, 9 aa, Homo Sapiens
RDLRQALLR

SEQ ID NO: 1272998 - protein, 9 aa, Homo Sapiens
FWQVGIQQD

SEQ ID NO: 1272999 - protein, 9 aa, Homo Sapiens
SQPDTAVGT

SEQ ID NO: 1273000 - protein, 9 aa, Homo Sapiens
THFAMPPIH

SEQ ID NO: 1273001 - protein, 9 aa, Homo Sapiens
ELCAKQLSS

SEQ ID NO: 1273002 - protein, 9 aa, Homo Sapiens
LDHEFLDME

SEQ ID NO: 1273003 - protein, 9 aa, Homo Sapiens
IFMTRSSLL

SEQ ID NO: 1273004 - protein, 9 aa, Homo Sapiens
QLVASKEQP

SEQ ID NO: 1273005 - protein, 9 aa, Homo Sapiens
KSPSLLSET

SEQ ID NO: 1273006 - protein, 9 aa, Homo Sapiens
LSCWRRDMK

SEQ ID NO: 1273007 - protein, 9 aa, Homo Sapiens
DEHKTINPE

SEQ ID NO: 1273008 - protein, 9 aa, Homo Sapiens
PANPEALLR

SEQ ID NO: 1273009 - protein, 9 aa, Homo Sapiens
FIDFYLYNA

SEQ ID NO: 1273010 - protein, 9 aa, Homo Sapiens
VLRLMWIFR

SEQ ID NO: 1273011 - protein, 9 aa, Homo Sapiens
RDKRKFLKE

SEQ ID NO: 1273012 - protein, 9 aa, Homo Sapiens
AESLKDLID

SEQ ID NO: 1273013 - protein, 9 aa, Homo Sapiens
VIKVDCVAD

SEQ ID NO: 1273014 - protein, 9 aa, Homo Sapiens
TPYSSYSKA

SEQ ID NO: 1273015 - protein, 9 aa, Homo Sapiens
LLDNFHSKD

SEQ ID NO: 1273016 - protein, 9 aa, Homo Sapiens
TLDLGLQEN

SEQ ID NO: 1273017 - protein, 9 aa, Homo Sapiens
VEKGDYPRW

SEQ ID NO: 1273018 - protein, 9 aa, Homo Sapiens
PDILFALTD

SEQ ID NO: 1273019 - protein, 9 aa, Homo Sapiens
LQLSQGLRE

SEQ ID NO: 1273020 - protein, 9 aa, Homo Sapiens
DHEFLDMER

SEQ ID NO: 1273021 - protein, 9 aa, Homo Sapiens
YRHLATYKG

SEQ ID NO: 1273022 - protein, 9 aa, Homo Sapiens
GLPQVRLIR

SEQ ID NO: 1273023 - protein, 9 aa, Homo Sapiens
TQGPRQEYS

SEQ ID NO: 1273024 - protein, 9 aa, Homo Sapiens
NYEELCAKQ

SEQ ID NO: 1273025 - protein, 9 aa, Homo Sapiens
AVVIFSVLS

SEQ ID NO: 1273026 - protein, 9 aa, Homo Sapiens
PVVLAISPS

SEQ ID NO: 1273027 - protein, 9 aa, Homo Sapiens
ITVTPSCKE

SEQ ID NO: 1273028 - protein, 9 aa, Homo Sapiens
EERRQKREL

SEQ ID NO: 1273029 - protein, 9 aa, Homo Sapiens
VFQNCSCIE

SEQ ID NO: 1273030 - protein, 9 aa, Homo Sapiens
VELLRYESK

SEQ ID NO: 1273031 - protein, 9 aa, Homo Sapiens
KVDCVADAM

SEQ ID NO: 1273032 - protein, 9 aa, Homo Sapiens
EVQFEIFKC

SEQ ID NO: 1273033 - protein, 9 aa, Homo Sapiens
VTPSCKELL

SEQ ID NO: 1273034 - protein, 9 aa, Homo Sapiens
ATKQQLKAV

SEQ ID NO: 1273035 - protein, 9 aa, Homo Sapiens
HYTGPPTKR

SEQ ID NO: 1273036 - protein, 9 aa, Homo Sapiens
AQVYEFSDP

SEQ ID NO: 1273037 - protein, 9 aa, Homo Sapiens
LRRSAWTIL

SEQ ID NO: 1273038 - protein, 9 aa, Homo Sapiens
DFAKSQSQF

SEQ ID NO: 1273039 - protein, 9 aa, Homo Sapiens
VLDDSSNTS

SEQ ID NO: 1273040 - protein, 9 aa, Homo Sapiens
QEDAKEYLG

SEQ ID NO: 1273041 - protein, 9 aa, Homo Sapiens
EEEDEADIE

SEQ ID NO: 1273042 - protein, 9 aa, Homo Sapiens
FIFMTRSSL

SEQ ID NO: 1273043 - protein, 9 aa, Homo Sapiens
PYKSKTINV

SEQ ID NO: 1273044 - protein, 9 aa, Homo Sapiens
YKLLGRMFR

SEQ ID NO: 1273045 - protein, 9 aa, Homo Sapiens
WSLLVFLLM

SEQ ID NO: 1273046 - protein, 9 aa, Homo Sapiens
MQYCEEFRI

SEQ ID NO: 1273047 - protein, 9 aa, Homo Sapiens
KEQPSQDGK

SEQ ID NO: 1273048 - protein, 9 aa, Homo Sapiens
PFAKNYQQL

SEQ ID NO: 1273049 - protein, 9 aa, Homo Sapiens
QRAARMGGA

SEQ ID NO: 1273050 - protein, 9 aa, Homo Sapiens
IAEQRRGDM

SEQ ID NO: 1273051 - protein, 9 aa, Homo Sapiens
TDGRRLLLP

SEQ ID NO: 1273052 - protein, 9 aa, Homo Sapiens
TQPRGCSVQ

SEQ ID NO: 1273053 - protein, 9 aa, Homo Sapiens
GVCPPRPTP

SEQ ID NO: 1273054 - protein, 9 aa, Homo Sapiens
LHHEAWRQL

SEQ ID NO: 1273055 - protein, 9 aa, Homo Sapiens
APGTTAVHH

SEQ ID NO: 1273056 - protein, 9 aa, Homo Sapiens
VPLVRLRQS

SEQ ID NO: 1273057 - protein, 9 aa, Homo Sapiens
EGSLKKKRA

SEQ ID NO: 1273058 - protein, 9 aa, Homo Sapiens
KKGTSDGQE

SEQ ID NO: 1273059 - protein, 9 aa, Homo Sapiens
LSETVHYKR

SEQ ID NO: 1273060 - protein, 9 aa, Homo Sapiens
EIVFSHQRL

SEQ ID NO: 1273061 - protein, 9 aa, Homo Sapiens
KGGVIHFLE

SEQ ID NO: 1273062 - protein, 9 aa, Homo Sapiens
MSQYSPAGF

SEQ ID NO: 1273063 - protein, 9 aa, Homo Sapiens
ATGLQGEEK

SEQ ID NO: 1273064 - protein, 9 aa, Homo Sapiens
FEIFKCEEL

SEQ ID NO: 1273065 - protein, 9 aa, Homo Sapiens
PARAHRCTT

SEQ ID NO: 1273066 - protein, 9 aa, Homo Sapiens
PGGRVTQGP

SEQ ID NO: 1273067 - protein, 9 aa, Homo Sapiens
KIKQIMEDK

SEQ ID NO: 1273068 - protein, 9 aa, Homo Sapiens
KNDGSQPDT

SEQ ID NO: 1273069 - protein, 9 aa, Homo Sapiens
VLCIQTVID

SEQ ID NO: 1273070 - protein, 9 aa, Homo Sapiens
VGMQHYTAA

SEQ ID NO: 1273071 - protein, 9 aa, Homo Sapiens
IEIEQLKAE

SEQ ID NO: 1273072 - protein, 9 aa, Homo Sapiens
HLWRLGVKA

SEQ ID NO: 1273073 - protein, 9 aa, Homo Sapiens
LPCSFVPIG

SEQ ID NO: 1273074 - protein, 9 aa, Homo Sapiens
CLKEFQTPI

SEQ ID NO: 1273075 - protein, 9 aa, Homo Sapiens
IEEMEERRQ

SEQ ID NO: 1273076 - protein, 9 aa, Homo Sapiens
QVRLIRANK

SEQ ID NO: 1273077 - protein, 9 aa, Homo Sapiens
QRSSTAAHG

SEQ ID NO: 1273078 - protein, 9 aa, Homo Sapiens
CCILGLICV

SEQ ID NO: 1273079 - protein, 9 aa, Homo Sapiens
AELWEQGDL

SEQ ID NO: 1273080 - protein, 9 aa, Homo Sapiens
RIHILNVLI

SEQ ID NO: 1273081 - protein, 9 aa, Homo Sapiens
ATHFAMPPI

SEQ ID NO: 1273082 - protein, 9 aa, Homo Sapiens
DAFPLLLAY

SEQ ID NO: 1273083 - protein, 9 aa, Homo Sapiens
EFFQAVNEA

SEQ ID NO: 1273084 - protein, 9 aa, Homo Sapiens
AATGLQGEE

SEQ ID NO: 1273085 - protein, 9 aa, Homo Sapiens
LGVFHLLAE

SEQ ID NO: 1273086 - protein, 9 aa, Homo Sapiens
IRNGVHCFQ

SEQ ID NO: 1273087 - protein, 9 aa, Homo Sapiens
CKCEGQEES

SEQ ID NO: 1273088 - protein, 9 aa, Homo Sapiens
ASPQEEIYP

SEQ ID NO: 1273089 - protein, 9 aa, Homo Sapiens
CILGLICVA

SEQ ID NO: 1273090 - protein, 9 aa, Homo Sapiens
AFANALSSL

SEQ ID NO: 1273091 - protein, 9 aa, Homo Sapiens
NPAMSALGE

SEQ ID NO: 1273092 - protein, 9 aa, Homo Sapiens
QMILEKQKK

SEQ ID NO: 1273093 - protein, 9 aa, Homo Sapiens
TMKRLQEET

SEQ ID NO: 1273094 - protein, 9 aa, Homo Sapiens
AHLANDDEL

SEQ ID NO: 1273095 - protein, 9 aa, Homo Sapiens
RQEDAKEYL

SEQ ID NO: 1273096 - protein, 9 aa, Homo Sapiens
GVGFGAIGK

SEQ ID NO: 1273097 - protein, 9 aa, Homo Sapiens
IASSQAFAN

SEQ ID NO: 1273098 - protein, 9 aa, Homo Sapiens
LIFSRSWTL

SEQ ID NO: 1273099 - protein, 9 aa, Homo Sapiens
HILNVLITS

SEQ ID NO: 1273100 - protein, 9 aa, Homo Sapiens
VPFAKNYQQ

SEQ ID NO: 1273101 - protein, 9 aa, Homo Sapiens
FSHQRLPPN

SEQ ID NO: 1273102 - protein, 9 aa, Homo Sapiens
CEDECFLKQ

SEQ ID NO: 1273103 - protein, 9 aa, Homo Sapiens
AHRCTTAPL

SEQ ID NO: 1273104 - protein, 9 aa, Homo Sapiens
RDHKLHVHF

SEQ ID NO: 1273105 - protein, 9 aa, Homo Sapiens
CFQGFQLDA

SEQ ID NO: 1273106 - protein, 9 aa, Homo Sapiens
WRLGVKALL

SEQ ID NO: 1273107 - protein, 9 aa, Homo Sapiens
VSQNGCLRV

SEQ ID NO: 1273108 - protein, 9 aa, Homo Sapiens
QHVGLPKPL

SEQ ID NO: 1273109 - protein, 9 aa, Homo Sapiens
AEGSLKKKR

SEQ ID NO: 1273110 - protein, 9 aa, Homo Sapiens
YKEFVAMMT

SEQ ID NO: 1273111 - protein, 9 aa, Homo Sapiens
SVLCIQTVI

SEQ ID NO: 1273112 - protein, 9 aa, Homo Sapiens
AALHLFNFR

SEQ ID NO: 1273113 - protein, 9 aa, Homo Sapiens
QDEAFIPVA

SEQ ID NO: 1273114 - protein, 9 aa, Homo Sapiens
SINPGMMAA

SEQ ID NO: 1273115 - protein, 9 aa, Homo Sapiens
PLGEYKLLG

SEQ ID NO: 1273116 - protein, 9 aa, Homo Sapiens
SGDWPVPEA

SEQ ID NO: 1273117 - protein, 9 aa, Homo Sapiens
PGRSCVNLA

SEQ ID NO: 1273118 - protein, 9 aa, Homo Sapiens
AHCNLRLHP

SEQ ID NO: 1273119 - protein, 9 aa, Homo Sapiens
HVPGHWREL

SEQ ID NO: 1273120 - protein, 9 aa, Homo Sapiens
GSLARPTTV

SEQ ID NO: 1273121 - protein, 9 aa, Homo Sapiens
AEDDLKNKK

SEQ ID NO: 1273122 - protein, 9 aa, Homo Sapiens
RFCTGSVGQ

SEQ ID NO: 1273123 - protein, 9 aa, Homo Sapiens
PAWRNRTLC

SEQ ID NO: 1273124 - protein, 9 aa, Homo Sapiens
ARTDGRRLL

SEQ ID NO: 1273125 - protein, 9 aa, Homo Sapiens
KVRKKPEEI

SEQ ID NO: 1273126 - protein, 9 aa, Homo Sapiens
APGTLRDDG

SEQ ID NO: 1273127 - protein, 9 aa, Homo Sapiens
STPYHVMRN

SEQ ID NO: 1273128 - protein, 9 aa, Homo Sapiens
GGVIHFLEL

SEQ ID NO: 1273129 - protein, 9 aa, Homo Sapiens
SFPVELDMT

SEQ ID NO: 1273130 - protein, 9 aa, Homo Sapiens
LLGNNLHNA

SEQ ID NO: 1273131 - protein, 9 aa, Homo Sapiens
LPPIARVPL

SEQ ID NO: 1273132 - protein, 9 aa, Homo Sapiens
LDSSKGSSQ

SEQ ID NO: 1273133 - protein, 9 aa, Homo Sapiens
PPSRTTVSS

SEQ ID NO: 1273134 - protein, 9 aa, Homo Sapiens
NVQDTCGTS

SEQ ID NO: 1273135 - protein, 9 aa, Homo Sapiens
AGNHKWCLD

SEQ ID NO: 1273136 - protein, 9 aa, Homo Sapiens
LVSYLPRYL

SEQ ID NO: 1273137 - protein, 9 aa, Homo Sapiens
LMWIFRILK

SEQ ID NO: 1273138 - protein, 9 aa, Homo Sapiens
WCCILGLIC

SEQ ID NO: 1273139 - protein, 9 aa, Homo Sapiens
VIFIDFYLY

SEQ ID NO: 1273140 - protein, 9 aa, Homo Sapiens
PLVTLPSAN

SEQ ID NO: 1273141 - protein, 9 aa, Homo Sapiens
ECFLKQFCV

SEQ ID NO: 1273142 - protein, 9 aa, Homo Sapiens
FSRSWTLDL

SEQ ID NO: 1273143 - protein, 9 aa, Homo Sapiens
LTQHRRVHM

SEQ ID NO: 1273144 - protein, 9 aa, Homo Sapiens
TRIIIWNLK

SEQ ID NO: 1273145 - protein, 9 aa, Homo Sapiens
ITIYKNALK

SEQ ID NO: 1273146 - protein, 9 aa, Homo Sapiens
TKGQGIKER

SEQ ID NO: 1273147 - protein, 9 aa, Homo Sapiens
NALTMEVIR

SEQ ID NO: 1273148 - protein, 9 aa, Homo Sapiens
PWRPARAHR

SEQ ID NO: 1273149 - protein, 9 aa, Homo Sapiens
GGNDKIAVT

SEQ ID NO: 1273150 - protein, 9 aa, Homo Sapiens
KEHHLVPDL

SEQ ID NO: 1273151 - protein, 9 aa, Homo Sapiens
YMVVLKEET

SEQ ID NO: 1273152 - protein, 9 aa, Homo Sapiens
RRFISDESR

SEQ ID NO: 1273153 - protein, 9 aa, Homo Sapiens
LDQDYVNLN

SEQ ID NO: 1273154 - protein, 9 aa, Homo Sapiens
VYEFSDPPT

SEQ ID NO: 1273155 - protein, 9 aa, Homo Sapiens
QNGCLRVFH

SEQ ID NO: 1273156 - protein, 9 aa, Homo Sapiens
CWRRDMKNR

SEQ ID NO: 1273157 - protein, 9 aa, Homo Sapiens
AVGQLEVSM

SEQ ID NO: 1273158 - protein, 9 aa, Homo Sapiens
TELQKLVET

SEQ ID NO: 1273159 - protein, 9 aa, Homo Sapiens
LNEEGVLHQ

SEQ ID NO: 1273160 - protein, 9 aa, Homo Sapiens
KNHSSKSAT

SEQ ID NO: 1273161 - protein, 9 aa, Homo Sapiens
VRALRAQKA

SEQ ID NO: 1273162 - protein, 9 aa, Homo Sapiens
IKQTEYSLA

SEQ ID NO: 1273163 - protein, 9 aa, Homo Sapiens
TINVSFQCP

SEQ ID NO: 1273164 - protein, 9 aa, Homo Sapiens
ACELGVFHL

SEQ ID NO: 1273165 - protein, 9 aa, Homo Sapiens
VMTMLNLFI

SEQ ID NO: 1273166 - protein, 9 aa, Homo Sapiens
GRQRSSTAA

SEQ ID NO: 1273167 - protein, 9 aa, Homo Sapiens
DFAKDGEKK

SEQ ID NO: 1273168 - protein, 9 aa, Homo Sapiens
LGLICVALT

SEQ ID NO: 1273169 - protein, 9 aa, Homo Sapiens
YLPRYLSCY

SEQ ID NO: 1273170 - protein, 9 aa, Homo Sapiens
LPLGCCCTT

SEQ ID NO: 1273171 - protein, 9 aa, Homo Sapiens
NLVMTMLNL

SEQ ID NO: 1273172 - protein, 9 aa, Homo Sapiens
LGEAAAKLK

SEQ ID NO: 1273173 - protein, 9 aa, Homo Sapiens
AVEAMISLL

SEQ ID NO: 1273174 - protein, 9 aa, Homo Sapiens
CPCLPNLMC

SEQ ID NO: 1273175 - protein, 9 aa, Homo Sapiens
IKEVALVLA

SEQ ID NO: 1273176 - protein, 9 aa, Homo Sapiens
DNVHFRISD

SEQ ID NO: 1273177 - protein, 9 aa, Homo Sapiens
EIFKCEELL

SEQ ID NO: 1273178 - protein, 9 aa, Homo Sapiens
KAETLALKI

SEQ ID NO: 1273179 - protein, 9 aa, Homo Sapiens
KDNYELDEH

SEQ ID NO: 1273180 - protein, 9 aa, Homo Sapiens
INPGMMAAA

SEQ ID NO: 1273181 - protein, 9 aa, Homo Sapiens
FAMSQYSPA

SEQ ID NO: 1273182 - protein, 9 aa, Homo Sapiens
QIQWQNSTI

SEQ ID NO: 1273183 - protein, 9 aa, Homo Sapiens
LLSETVHYK

SEQ ID NO: 1273184 - protein, 9 aa, Homo Sapiens
ASKEQPSQD

SEQ ID NO: 1273185 - protein, 9 aa, Homo Sapiens
SGLPQVRLI

SEQ ID NO: 1273186 - protein, 9 aa, Homo Sapiens
LEKQKKITE

SEQ ID NO: 1273187 - protein, 9 aa, Homo Sapiens
AVTTEDNMG

SEQ ID NO: 1273188 - protein, 9 aa, Homo Sapiens
ESFYIMLLK

SEQ ID NO: 1273189 - protein, 9 aa, Homo Sapiens
GKVEEEEEE

SEQ ID NO: 1273190 - protein, 9 aa, Homo Sapiens
LLLAYVGRL

SEQ ID NO: 1273191 - protein, 9 aa, Homo Sapiens
KWPPGGRDP

SEQ ID NO: 1273192 - protein, 9 aa, Homo Sapiens
TKRIRLQHQ

SEQ ID NO: 1273193 - protein, 9 aa, Homo Sapiens
SGRQRSSTA

SEQ ID NO: 1273194 - protein, 9 aa, Homo Sapiens
LGEYKLLGR

SEQ ID NO: 1273195 - protein, 9 aa, Homo Sapiens
RSSTAAHGS

SEQ ID NO: 1273196 - protein, 9 aa, Homo Sapiens
RSWDLGGVC

SEQ ID NO: 1273197 - protein, 9 aa, Homo Sapiens
QGLSKLRRH

SEQ ID NO: 1273198 - protein, 9 aa, Homo Sapiens
SIHHSTSHR

SEQ ID NO: 1273199 - protein, 9 aa, Homo Sapiens
DEADIEVAK

SEQ ID NO: 1273200 - protein, 9 aa, Homo Sapiens
AFPLLLAYV

SEQ ID NO: 1273201 - protein, 9 aa, Homo Sapiens
RSILLHPST

SEQ ID NO: 1273202 - protein, 9 aa, Homo Sapiens
CTQPQRVAA

SEQ ID NO: 1273203 - protein, 9 aa, Homo Sapiens
QCARTDGRR

SEQ ID NO: 1273204 - protein, 9 aa, Homo Sapiens
NLCSDDTRM

SEQ ID NO: 1273205 - protein, 9 aa, Homo Sapiens
DLCAQEIAI

SEQ ID NO: 1273206 - protein, 9 aa, Homo Sapiens
QDYVNLNNQ

SEQ ID NO: 1273207 - protein, 9 aa, Homo Sapiens
ILYAGNHKW

SEQ ID NO: 1273208 - protein, 9 aa, Homo Sapiens
TINPEQARG

SEQ ID NO: 1273209 - protein, 9 aa, Homo Sapiens
LVPDLSLTV

SEQ ID NO: 1273210 - protein, 9 aa, Homo Sapiens
LMKFHLMVA

SEQ ID NO: 1273211 - protein, 9 aa, Homo Sapiens
VCAVEAMIS

SEQ ID NO: 1273212 - protein, 9 aa, Homo Sapiens
AARMGGAGL

SEQ ID NO: 1273213 - protein, 9 aa, Homo Sapiens
LALKIKQIM

SEQ ID NO: 1273214 - protein, 9 aa, Homo Sapiens
LDHLLGMWA

SEQ ID NO: 1273215 - protein, 9 aa, Homo Sapiens
SARQRKKAF

SEQ ID NO: 1273216 - protein, 9 aa, Homo Sapiens
YTFHSQSIY

SEQ ID NO: 1273217 - protein, 9 aa, Homo Sapiens
EKNDGSQPD

SEQ ID NO: 1273218 - protein, 9 aa, Homo Sapiens
LQPEFFQAV

SEQ ID NO: 1273219 - protein, 9 aa, Homo Sapiens
SPKSPSLLS

SEQ ID NO: 1273220 - protein, 9 aa, Homo Sapiens
VSFFPELKE

SEQ ID NO: 1273221 - protein, 9 aa, Homo Sapiens
PIARVPLVR

SEQ ID NO: 1273222 - protein, 9 aa, Homo Sapiens
PPAATLRAG

SEQ ID NO: 1273223 - protein, 9 aa, Homo Sapiens
SEDVFTLIE

SEQ ID NO: 1273224 - protein, 9 aa, Homo Sapiens
SNAPGTLRD

SEQ ID NO: 1273225 - protein, 9 aa, Homo Sapiens
NFKTVSKNC

SEQ ID NO: 1273226 - protein, 9 aa, Homo Sapiens
EVLEDFAKD

SEQ ID NO: 1273227 - protein, 9 aa, Homo Sapiens
DSPTVKPSW

SEQ ID NO: 1273228 - protein, 9 aa, Homo Sapiens
PVSECMRGV

SEQ ID NO: 1273229 - protein, 9 aa, Homo Sapiens
YVNLNNQII

SEQ ID NO: 1273230 - protein, 9 aa, Homo Sapiens
FPSCHFSTP

SEQ ID NO: 1273231 - protein, 9 aa, Homo Sapiens
GIKERSKLL

SEQ ID NO: 1273232 - protein, 9 aa, Homo Sapiens
KKVRKKPEE

SEQ ID NO: 1273233 - protein, 9 aa, Homo Sapiens
SALRRSAWT

SEQ ID NO: 1273234 - protein, 9 aa, Homo Sapiens
CFSPEKNHS

SEQ ID NO: 1273235 - protein, 9 aa, Homo Sapiens
PENDAQVIL

SEQ ID NO: 1273236 - protein, 9 aa, Homo Sapiens
EEMEERRQK

SEQ ID NO: 1273237 - protein, 9 aa, Homo Sapiens
ITIGVVGGV

SEQ ID NO: 1273238 - protein, 9 aa, Homo Sapiens
HSQSIYYSL

SEQ ID NO: 1273239 - protein, 9 aa, Homo Sapiens
GAFSINPGM

SEQ ID NO: 1273240 - protein, 9 aa, Homo Sapiens
VKVGIKEYE

SEQ ID NO: 1273241 - protein, 9 aa, Homo Sapiens
TGSVGQASS

SEQ ID NO: 1273242 - protein, 9 aa, Homo Sapiens
RGCSVQTHV

SEQ ID NO: 1273243 - protein, 9 aa, Homo Sapiens
TMFYIGAHR

SEQ ID NO: 1273244 - protein, 9 aa, Homo Sapiens
LESYWCKAA

SEQ ID NO: 1273245 - protein, 9 aa, Homo Sapiens
MPNSPATHF

SEQ ID NO: 1273246 - protein, 9 aa, Homo Sapiens
DNFHSKDEL

SEQ ID NO: 1273247 - protein, 9 aa, Homo Sapiens
LDNFHSKDE

SEQ ID NO: 1273248 - protein, 9 aa, Homo Sapiens
GYLGMLKKL

SEQ ID NO: 1273249 - protein, 9 aa, Homo Sapiens
EPVCVGQLQ

SEQ ID NO: 1273250 - protein, 9 aa, Homo Sapiens
SHCKCEGQE

SEQ ID NO: 1273251 - protein, 9 aa, Homo Sapiens
IKVDCVADA

SEQ ID NO: 1273252 - protein, 9 aa, Homo Sapiens
TGGPPGPVN

SEQ ID NO: 1273253 - protein, 9 aa, Homo Sapiens
GRRLLLPLG

SEQ ID NO: 1273254 - protein, 9 aa, Homo Sapiens
RKLKTRLER

SEQ ID NO: 1273255 - protein, 9 aa, Homo Sapiens
EEKFKKKEF

SEQ ID NO: 1273256 - protein, 9 aa, Homo Sapiens
PKATKQQLK

SEQ ID NO: 1273257 - protein, 9 aa, Homo Sapiens
DMEWTSNSK

SEQ ID NO: 1273258 - protein, 9 aa, Homo Sapiens
NGPYVATVP

SEQ ID NO: 1273259 - protein, 9 aa, Homo Sapiens
RDPEPVCVG

SEQ ID NO: 1273260 - protein, 9 aa, Homo Sapiens
VIFSVLSTP

SEQ ID NO: 1273261 - protein, 9 aa, Homo Sapiens
RQRSSTAAH

SEQ ID NO: 1273262 - protein, 9 aa, Homo Sapiens
VAAFKGYLG

SEQ ID NO: 1273263 - protein, 9 aa, Homo Sapiens
ASSQAFANA

SEQ ID NO: 1273264 - protein, 9 aa, Homo Sapiens
IGIKEVALV

SEQ ID NO: 1273265 - protein, 9 aa, Homo Sapiens
CRAHLANDD

SEQ ID NO: 1273266 - protein, 9 aa, Homo Sapiens
QFEIFKCEE

SEQ ID NO: 1273267 - protein, 9 aa, Homo Sapiens
ISAQLCMIC

SEQ ID NO: 1273268 - protein, 9 aa, Homo Sapiens
VALLVAAEL

SEQ ID NO: 1273269 - protein, 9 aa, Homo Sapiens
DLKNKKALS

SEQ ID NO: 1273270 - protein, 9 aa, Homo Sapiens
RCTTAPLSR

SEQ ID NO: 1273271 - protein, 9 aa, Homo Sapiens
TPDVTQNSQ

SEQ ID NO: 1273272 - protein, 9 aa, Homo Sapiens
GPPGPVNPA

SEQ ID NO: 1273273 - protein, 9 aa, Homo Sapiens
GDQGLMLQS

SEQ ID NO: 1273274 - protein, 9 aa, Homo Sapiens
VGVEAGFLA

SEQ ID NO: 1273275 - protein, 9 aa, Homo Sapiens
ALRRSAWTI

SEQ ID NO: 1273276 - protein, 9 aa, Homo Sapiens
QGTKAVTKY

SEQ ID NO: 1273277 - protein, 9 aa, Homo Sapiens
SQGLREHAE

SEQ ID NO: 1273278 - protein, 9 aa, Homo Sapiens
RRRLHYNKE

SEQ ID NO: 1273279 - protein, 9 aa, Homo Sapiens
IKQIMEDKR

SEQ ID NO: 1273280 - protein, 9 aa, Homo Sapiens
PTLEEKKGT

SEQ ID NO: 1273281 - protein, 9 aa, Homo Sapiens
SVLSTPYHV

SEQ ID NO: 1273282 - protein, 9 aa, Homo Sapiens
NRTLCPMRC

SEQ ID NO: 1273283 - protein, 9 aa, Homo Sapiens
YSLASERDR

SEQ ID NO: 1273284 - protein, 9 aa, Homo Sapiens
SVQTHVPGH

SEQ ID NO: 1273285 - protein, 9 aa, Homo Sapiens
RVHMGERPY

SEQ ID NO: 1273286 - protein, 9 aa, Homo Sapiens
ILLLCMVGN

SEQ ID NO: 1273287 - protein, 9 aa, Homo Sapiens
VLITSLECN

SEQ ID NO: 1273288 - protein, 9 aa, Homo Sapiens
VFSHQRLPP

SEQ ID NO: 1273289 - protein, 9 aa, Homo Sapiens
KLHKIVFDP

SEQ ID NO: 1273290 - protein, 9 aa, Homo Sapiens
MMNTGTLRG

SEQ ID NO: 1273291 - protein, 9 aa, Homo Sapiens
ALYFHRSIL

SEQ ID NO: 1273292 - protein, 9 aa, Homo Sapiens
LMQYCEEFR

SEQ ID NO: 1273293 - protein, 9 aa, Homo Sapiens
MISLLKEAE

SEQ ID NO: 1273294 - protein, 9 aa, Homo Sapiens
RSAWTILQS

SEQ ID NO: 1273295 - protein, 9 aa, Homo Sapiens
LRMASSQRD

SEQ ID NO: 1273296 - protein, 9 aa, Homo Sapiens
QPTLEEKKG

SEQ ID NO: 1273297 - protein, 9 aa, Homo Sapiens
SPAGFSRED

SEQ ID NO: 1273298 - protein, 9 aa, Homo Sapiens
HVAAFKGYL

SEQ ID NO: 1273299 - protein, 9 aa, Homo Sapiens
CLQPPAATL

SEQ ID NO: 1273300 - protein, 9 aa, Homo Sapiens
HHLVPDLSL

SEQ ID NO: 1273301 - protein, 9 aa, Homo Sapiens
DIEVAKMQT

SEQ ID NO: 1273302 - protein, 9 aa, Homo Sapiens
FLTCDCHLC

SEQ ID NO: 1273303 - protein, 9 aa, Homo Sapiens
SEEQLVASK

SEQ ID NO: 1273304 - protein, 9 aa, Homo Sapiens
LFWCEDECF

SEQ ID NO: 1273305 - protein, 9 aa, Homo Sapiens
CRVLTSAIF

SEQ ID NO: 1273306 - protein, 9 aa, Homo Sapiens
ISDESRRKD

SEQ ID NO: 1273307 - protein, 9 aa, Homo Sapiens
EKKGTSDGQ

SEQ ID NO: 1273308 - protein, 9 aa, Homo Sapiens
DKTKGQGIK

SEQ ID NO: 1273309 - protein, 9 aa, Homo Sapiens
ITTYISFPV

SEQ ID NO: 1273310 - protein, 9 aa, Homo Sapiens
SLERKLKTR

SEQ ID NO: 1273311 - protein, 9 aa, Homo Sapiens
LPPNMTLTC

SEQ ID NO: 1273312 - protein, 9 aa, Homo Sapiens
TWEKKLHKI

SEQ ID NO: 1273313 - protein, 9 aa, Homo Sapiens
STPEERLPM

SEQ ID NO: 1273314 - protein, 9 aa, Homo Sapiens
LASMDRMAT

SEQ ID NO: 1273315 - protein, 9 aa, Homo Sapiens
MVIVAYGIA

SEQ ID NO: 1273316 - protein, 9 aa, Homo Sapiens
IVAYALILL

SEQ ID NO: 1273317 - protein, 9 aa, Homo Sapiens
DCFQGFQLD

SEQ ID NO: 1273318 - protein, 9 aa, Homo Sapiens
LRLHPSSWD

SEQ ID NO: 1273319 - protein, 9 aa, Homo Sapiens
TFDGDTYRL

SEQ ID NO: 1273320 - protein, 9 aa, Homo Sapiens
ASGLDGYFN

SEQ ID NO: 1273321 - protein, 9 aa, Homo Sapiens
KITVTPSCK

SEQ ID NO: 1273322 - protein, 9 aa, Homo Sapiens
GNTMKRLQE

SEQ ID NO: 1273323 - protein, 9 aa, Homo Sapiens
HCKCEGQEE

SEQ ID NO: 1273324 - protein, 9 aa, Homo Sapiens
TTQPRGCSV

SEQ ID NO: 1273325 - protein, 9 aa, Homo Sapiens
KMRVLRVLD

SEQ ID NO: 1273326 - protein, 9 aa, Homo Sapiens
SILLHPSTE

SEQ ID NO: 1273327 - protein, 9 aa, Homo Sapiens
ERLPMEGSR

SEQ ID NO: 1273328 - protein, 9 aa, Homo Sapiens
SHQRLPPNM

SEQ ID NO: 1273329 - protein, 9 aa, Homo Sapiens
ACVSQNGCL

SEQ ID NO: 1273330 - protein, 9 aa, Homo Sapiens
KEVALVLAA

SEQ ID NO: 1273331 - protein, 9 aa, Homo Sapiens
LRCRVLTSA

SEQ ID NO: 1273332 - protein, 9 aa, Homo Sapiens
WDSNITPVV

SEQ ID NO: 1273333 - protein, 9 aa, Homo Sapiens
TGFPSCHFS

SEQ ID NO: 1273334 - protein, 9 aa, Homo Sapiens
KHSIHHSTS

SEQ ID NO: 1273335 - protein, 9 aa, Homo Sapiens
LASRSILLH

SEQ ID NO: 1273336 - protein, 9 aa, Homo Sapiens
FISDESRRK

SEQ ID NO: 1273337 - protein, 9 aa, Homo Sapiens
YALILLLCM

SEQ ID NO: 1273338 - protein, 9 aa, Homo Sapiens
LKNLVMTML

SEQ ID NO: 1273339 - protein, 9 aa, Homo Sapiens
TPVVLAISP

SEQ ID NO: 1273340 - protein, 9 aa, Homo Sapiens
TRSSLLSRS

SEQ ID NO: 1273341 - protein, 9 aa, Homo Sapiens
AESFYIMLL

SEQ ID NO: 1273342 - protein, 9 aa, Homo Sapiens
GYFNSIRMD

SEQ ID NO: 1273343 - protein, 9 aa, Homo Sapiens
LMCSRFPDG

SEQ ID NO: 1273344 - protein, 9 aa, Homo Sapiens
HAVSQGTKA

SEQ ID NO: 1273345 - protein, 9 aa, Homo Sapiens
GIGITIGVV

SEQ ID NO: 1273346 - protein, 9 aa, Homo Sapiens
EERLPMEGS

SEQ ID NO: 1273347 - protein, 9 aa, Homo Sapiens
YTGPPTKRI

SEQ ID NO: 1273348 - protein, 9 aa, Homo Sapiens
VPGHWRELH

SEQ ID NO: 1273349 - protein, 9 aa, Homo Sapiens
SWTLDLGLQ

SEQ ID NO: 1273350 - protein, 9 aa, Homo Sapiens
RSNLSEGKK

SEQ ID NO: 1273351 - protein, 9 aa, Homo Sapiens
SSMQLKEQK

SEQ ID NO: 1273352 - protein, 9 aa, Homo Sapiens
PLQQAYVGM

SEQ ID NO: 1273353 - protein, 9 aa, Homo Sapiens
DGEIEIEQL

SEQ ID NO: 1273354 - protein, 9 aa, Homo Sapiens
NKSTAQNME

SEQ ID NO: 1273355 - protein, 9 aa, Homo Sapiens
FHSKDELKE

SEQ ID NO: 1273356 - protein, 9 aa, Homo Sapiens
SNTRHGRSN

SEQ ID NO: 1273357 - protein, 9 aa, Homo Sapiens
TVTPAVGQL

SEQ ID NO: 1273358 - protein, 9 aa, Homo Sapiens
LALYFHRSI

SEQ ID NO: 1273359 - protein, 9 aa, Homo Sapiens
KPSWDNHFA

SEQ ID NO: 1273360 - protein, 9 aa, Homo Sapiens
EKGRQEDAK

SEQ ID NO: 1273361 - protein, 9 aa, Homo Sapiens
AKKVRKKPE

SEQ ID NO: 1273362 - protein, 9 aa, Homo Sapiens
DEGDTNSNT

SEQ ID NO: 1273363 - protein, 9 aa, Homo Sapiens
YLNEEGVLH

SEQ ID NO: 1273364 - protein, 9 aa, Homo Sapiens
LPRWDPVYA

SEQ ID NO: 1273365 - protein, 9 aa, Homo Sapiens
CGSLARPTT

SEQ ID NO: 1273366 - protein, 9 aa, Homo Sapiens
DYIIRKGTI

SEQ ID NO: 1273367 - protein, 9 aa, Homo Sapiens
KFHLMVAVV

SEQ ID NO: 1273368 - protein, 9 aa, Homo Sapiens
QLVLMDLGS

SEQ ID NO: 1273369 - protein, 9 aa, Homo Sapiens
PGGRDPEPV

SEQ ID NO: 1273370 - protein, 9 aa, Homo Sapiens
AKEYLGFIL

SEQ ID NO: 1273371 - protein, 9 aa, Homo Sapiens
MTMLNLFIG

SEQ ID NO: 1273372 - protein, 9 aa, Homo Sapiens
AMSQYSPAG

SEQ ID NO: 1273373 - protein, 9 aa, Homo Sapiens
DGYFNSIRM

SEQ ID NO: 1273374 - protein, 9 aa, Homo Sapiens
MVVLKEETH

SEQ ID NO: 1273375 - protein, 9 aa, Homo Sapiens
KTSFKKNLM

SEQ ID NO: 1273376 - protein, 9 aa, Homo Sapiens
KGSSQEDED

SEQ ID NO: 1273377 - protein, 9 aa, Homo Sapiens
WQQESSMQL

SEQ ID NO: 1273378 - protein, 9 aa, Homo Sapiens
YCEEFRIHF

SEQ ID NO: 1273379 - protein, 9 aa, Homo Sapiens
LLDSFVSFF

SEQ ID NO: 1273380 - protein, 9 aa, Homo Sapiens
QPEFFQAVN

SEQ ID NO: 1273381 - protein, 9 aa, Homo Sapiens
ESEDVFTLI

SEQ ID NO: 1273382 - protein, 9 aa, Homo Sapiens
NMRHLWRLG

SEQ ID NO: 1273383 - protein, 9 aa, Homo Sapiens
QESSMQLKE

SEQ ID NO: 1273384 - protein, 9 aa, Homo Sapiens
KHFQRKAAY

SEQ ID NO: 1273385 - protein, 9 aa, Homo Sapiens
RQRKKAFST

SEQ ID NO: 1273386 - protein, 9 aa, Homo Sapiens
ASPNVQDTC

SEQ ID NO: 1273387 - protein, 9 aa, Homo Sapiens
RSWTLDLGL

SEQ ID NO: 1273388 - protein, 9 aa, Homo Sapiens
SENKILSKG

SEQ ID NO: 1273389 - protein, 9 aa, Homo Sapiens
KSTAQNMEG

SEQ ID NO: 1273390 - protein, 9 aa, Homo Sapiens
SQNFKTVSK

SEQ ID NO: 1273391 - protein, 9 aa, Homo Sapiens
STFGYGDVY

SEQ ID NO: 1273392 - protein, 9 aa, Homo Sapiens
SIYYSLIFL

SEQ ID NO: 1273393 - protein, 9 aa, Homo Sapiens
RLHYNKELN

SEQ ID NO: 1273394 - protein, 9 aa, Homo Sapiens
MGERPYACA

SEQ ID NO: 1273395 - protein, 9 aa, Homo Sapiens
DRTIDYKEF

SEQ ID NO: 1273396 - protein, 9 aa, Homo Sapiens
AIGIKEVAL

SEQ ID NO: 1273397 - protein, 9 aa, Homo Sapiens
PLPPSRTTV

SEQ ID NO: 1273398 - protein, 9 aa, Homo Sapiens
RGIGSHCKC

SEQ ID NO: 1273399 - protein, 9 aa, Homo Sapiens
VQFEIFKCE

SEQ ID NO: 1273400 - protein, 9 aa, Homo Sapiens
KKLQQENSI

SEQ ID NO: 1273401 - protein, 9 aa, Homo Sapiens
YIYLVAPIY

SEQ ID NO: 1273402 - protein, 9 aa, Homo Sapiens
HSKDELKEF

SEQ ID NO: 1273403 - protein, 9 aa, Homo Sapiens
PPGGRDPEP

SEQ ID NO: 1273404 - protein, 9 aa, Homo Sapiens
LSNPQIQWQ

SEQ ID NO: 1273405 - protein, 9 aa, Homo Sapiens
NPGMMAAAQ

SEQ ID NO: 1273406 - protein, 9 aa, Homo Sapiens
EPKFLNGPY

SEQ ID NO: 1273407 - protein, 9 aa, Homo Sapiens
SKAWRFPNS

SEQ ID NO: 1273408 - protein, 9 aa, Homo Sapiens
WAKGQNQLT

SEQ ID NO: 1273409 - protein, 9 aa, Homo Sapiens
GMMAAAQAA

SEQ ID NO: 1273410 - protein, 9 aa, Homo Sapiens
LSKLRRHSS

SEQ ID NO: 1273411 - protein, 9 aa, Homo Sapiens
NLKSYKNAT

SEQ ID NO: 1273412 - protein, 9 aa, Homo Sapiens
SPTVKPSWD

SEQ ID NO: 1273413 - protein, 9 aa, Homo Sapiens
GITIGVVGG

SEQ ID NO: 1273414 - protein, 9 aa, Homo Sapiens
LLPLGCCCT

SEQ ID NO: 1273415 - protein, 9 aa, Homo Sapiens
DGKVEEEEE

SEQ ID NO: 1273416 - protein, 9 aa, Homo Sapiens
SKTINVSFQ

SEQ ID NO: 1273417 - protein, 9 aa, Homo Sapiens
TNRDLRQAL

SEQ ID NO: 1273418 - protein, 9 aa, Homo Sapiens
VWALWSLLV

SEQ ID NO: 1273419 - protein, 9 aa, Homo Sapiens
QGPRQEYSE

SEQ ID NO: 1273420 - protein, 9 aa, Homo Sapiens
PAATLRAGE

SEQ ID NO: 1273421 - protein, 9 aa, Homo Sapiens
FIVEKGDYP

SEQ ID NO: 1273422 - protein, 9 aa, Homo Sapiens
QLKAEITSL

SEQ ID NO: 1273423 - protein, 9 aa, Homo Sapiens
ILGLICVAL

SEQ ID NO: 1273424 - protein, 9 aa, Homo Sapiens
NDGSQPDTA

SEQ ID NO: 1273425 - protein, 9 aa, Homo Sapiens
QQLKAVMDD

SEQ ID NO: 1273426 - protein, 9 aa, Homo Sapiens
SQAPGTTAV

SEQ ID NO: 1273427 - protein, 9 aa, Homo Sapiens
WDNHFAIFI

SEQ ID NO: 1273428 - protein, 9 aa, Homo Sapiens
GQNKNERCG

SEQ ID NO: 1273429 - protein, 9 aa, Homo Sapiens
PYCTVSLDC

SEQ ID NO: 1273430 - protein, 9 aa, Homo Sapiens
REIRMWYAK

SEQ ID NO: 1273431 - protein, 9 aa, Homo Sapiens
SQYSPAGFS

SEQ ID NO: 1273432 - protein, 9 aa, Homo Sapiens
STILYAGNH

SEQ ID NO: 1273433 - protein, 9 aa, Homo Sapiens
QQESSMQLK

SEQ ID NO: 1273434 - protein, 9 aa, Homo Sapiens
PSARQRKKA

SEQ ID NO: 1273435 - protein, 9 aa, Homo Sapiens
TKNVNVGTK

SEQ ID NO: 1273436 - protein, 9 aa, Homo Sapiens
GSRHSGLHH

SEQ ID NO: 1273437 - protein, 9 aa, Homo Sapiens
SAFQARLLG

SEQ ID NO: 1273438 - protein, 9 aa, Homo Sapiens
KDEEEDLKE

SEQ ID NO: 1273439 - protein, 9 aa, Homo Sapiens
SFYIMLLKD

SEQ ID NO: 1273440 - protein, 9 aa, Homo Sapiens
IKEYELESL

SEQ ID NO: 1273441 - protein, 9 aa, Homo Sapiens
PRGCSVQTH

SEQ ID NO: 1273442 - protein, 9 aa, Homo Sapiens
EILQPEFFQ

SEQ ID NO: 1273443 - protein, 9 aa, Homo Sapiens
ALWSLLVFL

SEQ ID NO: 1273444 - protein, 9 aa, Homo Sapiens
AHMMPDILF

SEQ ID NO: 1273445 - protein, 9 aa, Homo Sapiens
DLRQALLRL

SEQ ID NO: 1273446 - protein, 9 aa, Homo Sapiens
GEIEIEQLK

SEQ ID NO: 1273447 - protein, 9 aa, Homo Sapiens
RNRTLCPMR

SEQ ID NO: 1273448 - protein, 9 aa, Homo Sapiens
CDCFQGFQL

SEQ ID NO: 1273449 - protein, 9 aa, Homo Sapiens
VAYALILLL

SEQ ID NO: 1273450 - protein, 9 aa, Homo Sapiens
NSQPRAEPT

SEQ ID NO: 1273451 - protein, 9 aa, Homo Sapiens
GSLKKKRAE

SEQ ID NO: 1273452 - protein, 9 aa, Homo Sapiens
SLATQVDET

SEQ ID NO: 1273453 - protein, 9 aa, Homo Sapiens
CHVQHVGLP

SEQ ID NO: 1273454 - protein, 9 aa, Homo Sapiens
FLNGPYVAT

SEQ ID NO: 1273455 - protein, 9 aa, Homo Sapiens
VVLAISPSQ

SEQ ID NO: 1273456 - protein, 9 aa, Homo Sapiens
DTCGTSPVH

SEQ ID NO: 1273457 - protein, 9 aa, Homo Sapiens
RFTGLAAYY

SEQ ID NO: 1273458 - protein, 9 aa, Homo Sapiens
IAESFYIML

SEQ ID NO: 1273459 - protein, 9 aa, Homo Sapiens
VEAGFLARC

SEQ ID NO: 1273460 - protein, 9 aa, Homo Sapiens
IDYDEHKTI

SEQ ID NO: 1273461 - protein, 9 aa, Homo Sapiens
TYISFPVEL

SEQ ID NO: 1273462 - protein, 9 aa, Homo Sapiens
EENALTMEV

SEQ ID NO: 1273463 - protein, 9 aa, Homo Sapiens
LSSGNQCTE

SEQ ID NO: 1273464 - protein, 9 aa, Homo Sapiens
GSLTWRHAG

SEQ ID NO: 1273465 - protein, 9 aa, Homo Sapiens
QQPQQPQAR

SEQ ID NO: 1273466 - protein, 9 aa, Homo Sapiens
RELHHEAWR

SEQ ID NO: 1273467 - protein, 9 aa, Homo Sapiens
TSMVQRRCF

SEQ ID NO: 1273468 - protein, 9 aa, Homo Sapiens
LPQVRLIRA

SEQ ID NO: 1273469 - protein, 9 aa, Homo Sapiens
QAEGSLKKK

SEQ ID NO: 1273470 - protein, 9 aa, Homo Sapiens
QWQNSTIDS

SEQ ID NO: 1273471 - protein, 9 aa, Homo Sapiens
VHSPLVTLP

SEQ ID NO: 1273472 - protein, 9 aa, Homo Sapiens
DDDSSLATQ

SEQ ID NO: 1273473 - protein, 9 aa, Homo Sapiens
PSCKELLFY

SEQ ID NO: 1273474 - protein, 9 aa, Homo Sapiens
AIGKTASAT

SEQ ID NO: 1273475 - protein, 9 aa, Homo Sapiens
MCSRFPDGR

SEQ ID NO: 1273476 - protein, 9 aa, Homo Sapiens
GAEGFWQVG

SEQ ID NO: 1273477 - protein, 9 aa, Homo Sapiens
TKQQLKAVM

SEQ ID NO: 1273478 - protein, 9 aa, Homo Sapiens
SCWRRDMKN

SEQ ID NO: 1273479 - protein, 9 aa, Homo Sapiens
YIMLLKDTL

SEQ ID NO: 1273480 - protein, 9 aa, Homo Sapiens
DILFALTDD

SEQ ID NO: 1273481 - protein, 9 aa, Homo Sapiens
FQIEWEKPE

SEQ ID NO: 1273482 - protein, 9 aa, Homo Sapiens
EKQKKITEL

SEQ ID NO: 1273483 - protein, 9 aa, Homo Sapiens
VTTEDNMGG

SEQ ID NO: 1273484 - protein, 9 aa, Homo Sapiens
QHRRVHMGE

SEQ ID NO: 1273485 - protein, 9 aa, Homo Sapiens
EEKKGTSDG

SEQ ID NO: 1273486 - protein, 9 aa, Homo Sapiens
VFTLIESHE

SEQ ID NO: 1273487 - protein, 9 aa, Homo Sapiens
QPRAEPTQN

SEQ ID NO: 1273488 - protein, 9 aa, Homo Sapiens
PQVRLIRAN

SEQ ID NO: 1273489 - protein, 9 aa, Homo Sapiens
SYLEHQEKN

SEQ ID NO: 1273490 - protein, 9 aa, Homo Sapiens
PVYAKWPPG

SEQ ID NO: 1273491 - protein, 9 aa, Homo Sapiens
TASPSSSSG

SEQ ID NO: 1273492 - protein, 9 aa, Homo Sapiens
VELDMTPFM

SEQ ID NO: 1273493 - protein, 9 aa, Homo Sapiens
KLFAVPFAK

SEQ ID NO: 1273494 - protein, 9 aa, Homo Sapiens
SKGGVIHFL

SEQ ID NO: 1273495 - protein, 9 aa, Homo Sapiens
EFSDPPTSA

SEQ ID NO: 1273496 - protein, 9 aa, Homo Sapiens
KATKQQLKA

SEQ ID NO: 1273497 - protein, 9 aa, Homo Sapiens
FPVELDMTP

SEQ ID NO: 1273498 - protein, 9 aa, Homo Sapiens
NQGLSKLRR

SEQ ID NO: 1273499 - protein, 9 aa, Homo Sapiens
LAAYYVATD

SEQ ID NO: 1273500 - protein, 9 aa, Homo Sapiens
LILLLCMVG

SEQ ID NO: 1273501 - protein, 9 aa, Homo Sapiens
IARVPLVRL

SEQ ID NO: 1273502 - protein, 9 aa, Homo Sapiens
PPIARVPLV

SEQ ID NO: 1273503 - protein, 9 aa, Homo Sapiens
SQNGCLRVF

SEQ ID NO: 1273504 - protein, 9 aa, Homo Sapiens
PVLLRRCTE

SEQ ID NO: 1273505 - protein, 9 aa, Homo Sapiens
KSDMEWTSN

SEQ ID NO: 1273506 - protein, 9 aa, Homo Sapiens
RDMKNRPSF

SEQ ID NO: 1273507 - protein, 9 aa, Homo Sapiens
CKELLFYPP

SEQ ID NO: 1273508 - protein, 9 aa, Homo Sapiens
GMWATDLQI

SEQ ID NO: 1273509 - protein, 9 aa, Homo Sapiens
AVKVGIKEY

SEQ ID NO: 1273510 - protein, 9 aa, Homo Sapiens
YYTFHSQSI

SEQ ID NO: 1273511 - protein, 9 aa, Homo Sapiens
NKELNIKLA

SEQ ID NO: 1273512 - protein, 9 aa, Homo Sapiens
RSPLFIFMT

SEQ ID NO: 1273513 - protein, 9 aa, Homo Sapiens
PTKRIRLQH

SEQ ID NO: 1273514 - protein, 9 aa, Homo Sapiens
EMEERRQKR

SEQ ID NO: 1273515 - protein, 9 aa, Homo Sapiens
IFKCEELLL

SEQ ID NO: 1273516 - protein, 9 aa, Homo Sapiens
LYAGNHKWC

SEQ ID NO: 1273517 - protein, 9 aa, Homo Sapiens
AQNMEGIIV

SEQ ID NO: 1273518 - protein, 9 aa, Homo Sapiens
RYLSCYVEI

SEQ ID NO: 1273519 - protein, 9 aa, Homo Sapiens
ELESYWCKA

SEQ ID NO: 1273520 - protein, 9 aa, Homo Sapiens
QSQFHSSTD

SEQ ID NO: 1273521 - protein, 9 aa, Homo Sapiens
QESEDVFTL

SEQ ID NO: 1273522 - protein, 9 aa, Homo Sapiens
GLQGEEKDG

SEQ ID NO: 1273523 - protein, 9 aa, Homo Sapiens
TSGRQRSST

SEQ ID NO: 1273524 - protein, 9 aa, Homo Sapiens
MAAAAGAAV

SEQ ID NO: 1273525 - protein, 9 aa, Homo Sapiens
SDMEWTSNS

SEQ ID NO: 1273526 - protein, 9 aa, Homo Sapiens
ALGIGITIG

SEQ ID NO: 1273527 - protein, 9 aa, Homo Sapiens
LCWLLPWAQ

SEQ ID NO: 1273528 - protein, 9 aa, Homo Sapiens
TCHVQHVGL

SEQ ID NO: 1273529 - protein, 9 aa, Homo Sapiens
DAKKVRKKP

SEQ ID NO: 1273530 - protein, 9 aa, Homo Sapiens
SNITPVVLA

SEQ ID NO: 1273531 - protein, 9 aa, Homo Sapiens
QNHFNSSQG

SEQ ID NO: 1273532 - protein, 9 aa, Homo Sapiens
IGCGFSCAF

SEQ ID NO: 1273533 - protein, 9 aa, Homo Sapiens
LKIKQIMED

SEQ ID NO: 1273534 - protein, 9 aa, Homo Sapiens
LSNAPGTLR

SEQ ID NO: 1273535 - protein, 9 aa, Homo Sapiens
KLHVHFRNV

SEQ ID NO: 1273536 - protein, 9 aa, Homo Sapiens
VSYLPRYLS

SEQ ID NO: 1273537 - protein, 9 aa, Homo Sapiens
SAIFETKFQ

SEQ ID NO: 1273538 - protein, 9 aa, Homo Sapiens
ERFTGLAAY

SEQ ID NO: 1273539 - protein, 9 aa, Homo Sapiens
HAAAILTSL

SEQ ID NO: 1273540 - protein, 9 aa, Homo Sapiens
HEFLDMERK

SEQ ID NO: 1273541 - protein, 9 aa, Homo Sapiens
LNVLITSLE

SEQ ID NO: 1273542 - protein, 9 aa, Homo Sapiens
FKCEELLLT

SEQ ID NO: 1273543 - protein, 9 aa, Homo Sapiens
LRRHSSEGG

SEQ ID NO: 1273544 - protein, 9 aa, Homo Sapiens
SSALPTPGR

SEQ ID NO: 1273545 - protein, 9 aa, Homo Sapiens
QYRHLATYK

SEQ ID NO: 1273546 - protein, 9 aa, Homo Sapiens
SGPDQRLPK

SEQ ID NO: 1273547 - protein, 9 aa, Homo Sapiens
VPQIRYASM

SEQ ID NO: 1273548 - protein, 9 aa, Homo Sapiens
TAGDQGLML

SEQ ID NO: 1273549 - protein, 9 aa, Homo Sapiens
ALKIKQIME

SEQ ID NO: 1273550 - protein, 9 aa, Homo Sapiens
VGQLEVSMV

SEQ ID NO: 1273551 - protein, 9 aa, Homo Sapiens
HCNLRLHPS

SEQ ID NO: 1273552 - protein, 9 aa, Homo Sapiens
VVMAAAAGA

SEQ ID NO: 1273553 - protein, 9 aa, Homo Sapiens
ALVLAAILA

SEQ ID NO: 1273554 - protein, 9 aa, Homo Sapiens
PIGILVAFF

SEQ ID NO: 1273555 - protein, 9 aa, Homo Sapiens
QGRRFISDE

SEQ ID NO: 1273556 - protein, 9 aa, Homo Sapiens
ALHLFNFRS

SEQ ID NO: 1273557 - protein, 9 aa, Homo Sapiens
KFLNGPYVA

SEQ ID NO: 1273558 - protein, 9 aa, Homo Sapiens
VSLDCAIRL

SEQ ID NO: 1273559 - protein, 9 aa, Homo Sapiens
SRSWTLDLG

SEQ ID NO: 1273560 - protein, 9 aa, Homo Sapiens
MPDLCAQEI

SEQ ID NO: 1273561 - protein, 9 aa, Homo Sapiens
IIHEENALT

SEQ ID NO: 1273562 - protein, 9 aa, Homo Sapiens
AHIRTHTAE

SEQ ID NO: 1273563 - protein, 9 aa, Homo Sapiens
ECGAEGFWQ

SEQ ID NO: 1273564 - protein, 9 aa, Homo Sapiens
QEKAVEKFG

SEQ ID NO: 1273565 - protein, 9 aa, Homo Sapiens
TPAVGQLEV

SEQ ID NO: 1273566 - protein, 9 aa, Homo Sapiens
LEDFAKDGE

SEQ ID NO: 1273567 - protein, 9 aa, Homo Sapiens
WLQYRHLAT

SEQ ID NO: 1273568 - protein, 9 aa, Homo Sapiens
HTAEKPFTC

SEQ ID NO: 1273569 - protein, 9 aa, Homo Sapiens
RQKRELRQV

SEQ ID NO: 1273570 - protein, 9 aa, Homo Sapiens
RRSAWTILQ

SEQ ID NO: 1273571 - protein, 9 aa, Homo Sapiens
QKARLLAGR

SEQ ID NO: 1273572 - protein, 9 aa, Homo Sapiens
FQGFQLDAA

SEQ ID NO: 1273573 - protein, 9 aa, Homo Sapiens
IGKTASATF

SEQ ID NO: 1273574 - protein, 9 aa, Homo Sapiens
GTLRDDGEM

SEQ ID NO: 1273575 - protein, 9 aa, Homo Sapiens
RSSYKSKHS

SEQ ID NO: 1273576 - protein, 9 aa, Homo Sapiens
GLSNAPGTL

SEQ ID NO: 1273577 - protein, 9 aa, Homo Sapiens
RLLGNNLHN

SEQ ID NO: 1273578 - protein, 9 aa, Homo Sapiens
RMPNSPATH

SEQ ID NO: 1273579 - protein, 9 aa, Homo Sapiens
FQPPPQSQQ

SEQ ID NO: 1273580 - protein, 9 aa, Homo Sapiens
TEAATGLQG

SEQ ID NO: 1273581 - protein, 9 aa, Homo Sapiens
KGTIGKKMY

SEQ ID NO: 1273582 - protein, 9 aa, Homo Sapiens
ELLRYESKK

SEQ ID NO: 1273583 - protein, 9 aa, Homo Sapiens
RVLRVLDDS

SEQ ID NO: 1273584 - protein, 9 aa, Homo Sapiens
ELPLPPSRT

SEQ ID NO: 1273585 - protein, 9 aa, Homo Sapiens
TQPQRVAAM

SEQ ID NO: 1273586 - protein, 9 aa, Homo Sapiens
AQGVAMVIV

SEQ ID NO: 1273587 - protein, 9 aa, Homo Sapiens
VLLRRCTEL

SEQ ID NO: 1273588 - protein, 9 aa, Homo Sapiens
QRKAAYRDP

SEQ ID NO: 1273589 - protein, 9 aa, Homo Sapiens
DVTQNSQPR

SEQ ID NO: 1273590 - protein, 9 aa, Homo Sapiens
LGDEGQLVL

SEQ ID NO: 1273591 - protein, 9 aa, Homo Sapiens
GWDRQEGGQ

SEQ ID NO: 1273592 - protein, 9 aa, Homo Sapiens
SPSSSSGSS

SEQ ID NO: 1273593 - protein, 9 aa, Homo Sapiens
CARTDGRRL

SEQ ID NO: 1273594 - protein, 9 aa, Homo Sapiens
RCRNPVSEC

SEQ ID NO: 1273595 - protein, 9 aa, Homo Sapiens
VHCFQIEWE

SEQ ID NO: 1273596 - protein, 9 aa, Homo Sapiens
GLICVALTK

SEQ ID NO: 1273597 - protein, 9 aa, Homo Sapiens
RLMWIFRIL

SEQ ID NO: 1273598 - protein, 9 aa, Homo Sapiens
FKKKEFELS

SEQ ID NO: 1273599 - protein, 9 aa, Homo Sapiens
KAWRFPNSS

SEQ ID NO: 1273600 - protein, 9 aa, Homo Sapiens
PLLLAYVGR

SEQ ID NO: 1273601 - protein, 9 aa, Homo Sapiens
KLHVHFRES

SEQ ID NO: 1273602 - protein, 9 aa, Homo Sapiens
NITPVVLAI

SEQ ID NO: 1273603 - protein, 9 aa, Homo Sapiens
AGWDRQEGG

SEQ ID NO: 1273604 - protein, 9 aa, Homo Sapiens
HLLGMWATD

SEQ ID NO: 1273605 - protein, 9 aa, Homo Sapiens
FTGLAAYYV

SEQ ID NO: 1273606 - protein, 9 aa, Homo Sapiens
CHLCWLLPW

SEQ ID NO: 1273607 - protein, 9 aa, Homo Sapiens
ASALGIGIT

SEQ ID NO: 1273608 - protein, 9 aa, Homo Sapiens
WTLDLGLQE

SEQ ID NO: 1273609 - protein, 9 aa, Homo Sapiens
CFQIEWEKP

SEQ ID NO: 1273610 - protein, 9 aa, Homo Sapiens
IETSGNSSA

SEQ ID NO: 1273611 - protein, 9 aa, Homo Sapiens
PCLPNLMCS

SEQ ID NO: 1273612 - protein, 9 aa, Homo Sapiens
AAYRDPVFY

SEQ ID NO: 1273613 - protein, 9 aa, Homo Sapiens
EHHLVPDLS

SEQ ID NO: 1273614 - protein, 9 aa, Homo Sapiens
QTEYSLASE

SEQ ID NO: 1273615 - protein, 9 aa, Homo Sapiens
EDDDSSLAT

SEQ ID NO: 1273616 - protein, 9 aa, Homo Sapiens
SLDCAIRLK

SEQ ID NO: 1273617 - protein, 9 aa, Homo Sapiens
RNPVSECMR

SEQ ID NO: 1273618 - protein, 9 aa, Homo Sapiens
LHQNRSLLF

SEQ ID NO: 1273619 - protein, 9 aa, Homo Sapiens
DWLQYRHLA

SEQ ID NO: 1273620 - protein, 9 aa, Homo Sapiens
RQEGGQVYS

SEQ ID NO: 1273621 - protein, 9 aa, Homo Sapiens
ARVPLVRLR

SEQ ID NO: 1273622 - protein, 9 aa, Homo Sapiens
HVGLPKPLT

SEQ ID NO: 1273623 - protein, 9 aa, Homo Sapiens
FIVAYALIL

SEQ ID NO: 1273624 - protein, 9 aa, Homo Sapiens
IGSNTRHGR

SEQ ID NO: 1273625 - protein, 9 aa, Homo Sapiens
ARPTTVQGV

SEQ ID NO: 1273626 - protein, 9 aa, Homo Sapiens
SSDYPYHYT

SEQ ID NO: 1273627 - protein, 9 aa, Homo Sapiens
VNVGTKLIR

SEQ ID NO: 1273628 - protein, 9 aa, Homo Sapiens
MRVLRVLDD

SEQ ID NO: 1273629 - protein, 9 aa, Homo Sapiens
LEEKKGTSD

SEQ ID NO: 1273630 - protein, 9 aa, Homo Sapiens
KHAVSQGTK

SEQ ID NO: 1273631 - protein, 9 aa, Homo Sapiens
RPARAHRCT

SEQ ID NO: 1273632 - protein, 9 aa, Homo Sapiens
TQKTSFKKN

SEQ ID NO: 1273633 - protein, 9 aa, Homo Sapiens
TVTPSCKEL

SEQ ID NO: 1273634 - protein, 9 aa, Homo Sapiens
DTRMVRRAA

SEQ ID NO: 1273635 - protein, 9 aa, Homo Sapiens
WDLGGVCPP

SEQ ID NO: 1273636 - protein, 9 aa, Homo Sapiens
TAIRLGEAA

SEQ ID NO: 1273637 - protein, 9 aa, Homo Sapiens
SKLDIFVGN

SEQ ID NO: 1273638 - protein, 9 aa, Homo Sapiens
SCTVCLKEF

SEQ ID NO: 1273639 - protein, 9 aa, Homo Sapiens
RPTGFPSCH

SEQ ID NO: 1273640 - protein, 9 aa, Homo Sapiens
LQESEDVFT

SEQ ID NO: 1273641 - protein, 9 aa, Homo Sapiens
DYPYHYTKV

SEQ ID NO: 1273642 - protein, 9 aa, Homo Sapiens
QKKITELKA

SEQ ID NO: 1273643 - protein, 9 aa, Homo Sapiens
PEFFQAVNE

SEQ ID NO: 1273644 - protein, 9 aa, Homo Sapiens
GKEQQEKSG

SEQ ID NO: 1273645 - protein, 9 aa, Homo Sapiens
HLLAEAPGP

SEQ ID NO: 1273646 - protein, 9 aa, Homo Sapiens
LLLPLGCCC

SEQ ID NO: 1273647 - protein, 9 aa, Homo Sapiens
LGMWATDLQ

SEQ ID NO: 1273648 - protein, 9 aa, Homo Sapiens
QSLLTAIRL

SEQ ID NO: 1273649 - protein, 9 aa, Homo Sapiens
NVLITSLEC

SEQ ID NO: 1273650 - protein, 9 aa, Homo Sapiens
EADRGSCLV

SEQ ID NO: 1273651 - protein, 9 aa, Homo Sapiens
AQLCMICQG

SEQ ID NO: 1273652 - protein, 9 aa, Homo Sapiens
FPLLLAYVG

SEQ ID NO: 1273653 - protein, 9 aa, Homo Sapiens
GLAAYYVAT

SEQ ID NO: 1273654 - protein, 9 aa, Homo Sapiens
DYKEFVAMM

SEQ ID NO: 1273655 - protein, 9 aa, Homo Sapiens
EYGACGLSQ

SEQ ID NO: 1273656 - protein, 9 aa, Homo Sapiens
SLLSETVHY

SEQ ID NO: 1273657 - protein, 9 aa, Homo Sapiens
AEKPFTCLS

SEQ ID NO: 1273658 - protein, 9 aa, Homo Sapiens
HEENALTME

SEQ ID NO: 1273659 - protein, 9 aa, Homo Sapiens
VTMSTFGYG

SEQ ID NO: 1273660 - protein, 9 aa, Homo Sapiens
KAATATRSV

SEQ ID NO: 1273661 - protein, 9 aa, Homo Sapiens
SVEMGSVNQ

SEQ ID NO: 1273662 - protein, 9 aa, Homo Sapiens
GVEAGFLAR

SEQ ID NO: 1273663 - protein, 9 aa, Homo Sapiens
HWRELHHEA

SEQ ID NO: 1273664 - protein, 9 aa, Homo Sapiens
PAGFSREDR

SEQ ID NO: 1273665 - protein, 9 aa, Homo Sapiens
GIKEYELES

SEQ ID NO: 1273666 - protein, 9 aa, Homo Sapiens
GEYKLLGRM

SEQ ID NO: 1273667 - protein, 9 aa, Homo Sapiens
NVGTKLIRV

SEQ ID NO: 1273668 - protein, 9 aa, Homo Sapiens
VALVLAAIL

SEQ ID NO: 1273669 - protein, 9 aa, Homo Sapiens
FKGYLGMLK

SEQ ID NO: 1273670 - protein, 9 aa, Homo Sapiens
LNMRHLWRL

SEQ ID NO: 1273671 - protein, 9 aa, Homo Sapiens
APAWRNRTL

SEQ ID NO: 1273672 - protein, 9 aa, Homo Sapiens
FITIYKNAL

SEQ ID NO: 1273673 - protein, 9 aa, Homo Sapiens
EDLDSSKGS

SEQ ID NO: 1273674 - protein, 9 aa, Homo Sapiens
PATHFAMPP

SEQ ID NO: 1273675 - protein, 9 aa, Homo Sapiens
EAGFLARCV

SEQ ID NO: 1273676 - protein, 9 aa, Homo Sapiens
VDPLQQAYV

SEQ ID NO: 1273677 - protein, 9 aa, Homo Sapiens
IDFYLYNAN

SEQ ID NO: 1273678 - protein, 9 aa, Homo Sapiens
FCSYLEHQE

SEQ ID NO: 1273679 - protein, 9 aa, Homo Sapiens
MWIFRILKL

SEQ ID NO: 1273680 - protein, 9 aa, Homo Sapiens
AEASPQEEI

SEQ ID NO: 1273681 - protein, 9 aa, Homo Sapiens
RYASMERLL

SEQ ID NO: 1273682 - protein, 9 aa, Homo Sapiens
NKILSKGGV

SEQ ID NO: 1273683 - protein, 9 aa, Homo Sapiens
LLLCMVGNT

SEQ ID NO: 1273684 - protein, 9 aa, Homo Sapiens
IIRKGTIGK

SEQ ID NO: 1273685 - protein, 9 aa, Homo Sapiens
VKPSWDNHF

SEQ ID NO: 1273686 - protein, 9 aa, Homo Sapiens
LFAVPFAKN

SEQ ID NO: 1273687 - protein, 9 aa, Homo Sapiens
VAESLKDLI

SEQ ID NO: 1273688 - protein, 9 aa, Homo Sapiens
LLKERSDTR

SEQ ID NO: 1273689 - protein, 9 aa, Homo Sapiens
PKNQGLSKL

SEQ ID NO: 1273690 - protein, 9 aa, Homo Sapiens
HKPKATKQQ

SEQ ID NO: 1273691 - protein, 9 aa, Homo Sapiens
FAVPFAKNY

SEQ ID NO: 1273692 - protein, 9 aa, Homo Sapiens
QMVCHKILF

SEQ ID NO: 1273693 - protein, 9 aa, Homo Sapiens
GGRVTQGPR

SEQ ID NO: 1273694 - protein, 9 aa, Homo Sapiens
YKSKTINVS

SEQ ID NO: 1273695 - protein, 9 aa, Homo Sapiens
IRMWYAKKQ

SEQ ID NO: 1273696 - protein, 9 aa, Homo Sapiens
NCSCIETSG

SEQ ID NO: 1273697 - protein, 9 aa, Homo Sapiens
KTKGQGIKE

SEQ ID NO: 1273698 - protein, 9 aa, Homo Sapiens
DKQIKQTEY

SEQ ID NO: 1273699 - protein, 9 aa, Homo Sapiens
WRELHHEAW

SEQ ID NO: 1273700 - protein, 9 aa, Homo Sapiens
PRYLSCYVE

SEQ ID NO: 1273701 - protein, 9 aa, Homo Sapiens
KNLVMTMLN

SEQ ID NO: 1273702 - protein, 9 aa, Homo Sapiens
SCLVGATAQ

SEQ ID NO: 1273703 - protein, 9 aa, Homo Sapiens
CFLKQFCVS

SEQ ID NO: 1273704 - protein, 9 aa, Homo Sapiens
ERKLKTRLE

SEQ ID NO: 1273705 - protein, 9 aa, Homo Sapiens
DRMATMFYI

SEQ ID NO: 1273706 - protein, 9 aa, Homo Sapiens
SYKSKHSIH

SEQ ID NO: 1273707 - protein, 9 aa, Homo Sapiens
KAAYRDPVF

SEQ ID NO: 1273708 - protein, 9 aa, Homo Sapiens
VQDTCGTSP

SEQ ID NO: 1273709 - protein, 9 aa, Homo Sapiens
PAVGQLEVS

SEQ ID NO: 1273710 - protein, 9 aa, Homo Sapiens
KSKHSIHHS

SEQ ID NO: 1273711 - protein, 9 aa, Homo Sapiens
LAKHAVSQG

SEQ ID NO: 1273712 - protein, 9 aa, Homo Sapiens
PDLCAQEIA

SEQ ID NO: 1273713 - protein, 9 aa, Homo Sapiens
MLSCWRRDM

SEQ ID NO: 1273714 - protein, 8 aa, Homo Sapiens
KRTIGKPT

SEQ ID NO: 1273715 - protein, 9 aa, Homo Sapiens
PSRTTVSSV

SEQ ID NO: 1273716 - protein, 9 aa, Homo Sapiens
SMERLLERL

SEQ ID NO: 1273717 - protein, 9 aa, Homo Sapiens
IRKGTIGKK

SEQ ID NO: 1273718 - protein, 9 aa, Homo Sapiens
DPVYAKWPP

SEQ ID NO: 1273719 - protein, 9 aa, Homo Sapiens
VLTAASVLC

SEQ ID NO: 1273720 - protein, 9 aa, Homo Sapiens
WPPGGRDPE

SEQ ID NO: 1273721 - protein, 9 aa, Homo Sapiens
DFKEFGTSM

SEQ ID NO: 1273722 - protein, 9 aa, Homo Sapiens
TRMVRRAAA

SEQ ID NO: 1273723 - protein, 9 aa, Homo Sapiens
PNVQDTCGT

SEQ ID NO: 1273724 - protein, 9 aa, Homo Sapiens
AETLALKIK

SEQ ID NO: 1273725 - protein, 9 aa, Homo Sapiens
AACELGVFH

SEQ ID NO: 1273726 - protein, 9 aa, Homo Sapiens
FEVSVCACP

SEQ ID NO: 1273727 - protein, 9 aa, Homo Sapiens
VNQAGYRKD

SEQ ID NO: 1273728 - protein, 9 aa, Homo Sapiens
PGDYIIRKG

SEQ ID NO: 1273729 - protein, 9 aa, Homo Sapiens
FWNHLWLVC

SEQ ID NO: 1273730 - protein, 9 aa, Homo Sapiens
KQQLKAVMD

SEQ ID NO: 1273731 - protein, 9 aa, Homo Sapiens
QDTCGTSPV

SEQ ID NO: 1273732 - protein, 9 aa, Homo Sapiens
DYVNLNNQI

SEQ ID NO: 1273733 - protein, 9 aa, Homo Sapiens
VSWEQRAAR

SEQ ID NO: 1273734 - protein, 9 aa, Homo Sapiens
TEYSLASER

SEQ ID NO: 1273735 - protein, 9 aa, Homo Sapiens
KEFQTPITY

SEQ ID NO: 1273736 - protein, 9 aa, Homo Sapiens
CWAKGQNQL

SEQ ID NO: 1273737 - protein, 9 aa, Homo Sapiens
FGAIGKTAS

SEQ ID NO: 1273738 - protein, 9 aa, Homo Sapiens
ETLALKIKQ

SEQ ID NO: 1273739 - protein, 9 aa, Homo Sapiens
TSKLDIFVG

SEQ ID NO: 1273740 - protein, 9 aa, Homo Sapiens
DLSLTVTVT

SEQ ID NO: 1273741 - protein, 9 aa, Homo Sapiens
RLPGTYMVV

SEQ ID NO: 1273742 - protein, 9 aa, Homo Sapiens
EKFKKKEFE

SEQ ID NO: 1273743 - protein, 9 aa, Homo Sapiens
DTNSNTDQD

SEQ ID NO: 1273744 - protein, 9 aa, Homo Sapiens
GHLKGREIR

SEQ ID NO: 1273745 - protein, 9 aa, Homo Sapiens
PEKNHSSKS

SEQ ID NO: 1273746 - protein, 9 aa, Homo Sapiens
YCTVSLDCA

SEQ ID NO: 1273747 - protein, 9 aa, Homo Sapiens
TLALKIKQI

SEQ ID NO: 1273748 - protein, 9 aa, Homo Sapiens
FQAVNEAIL

SEQ ID NO: 1273749 - protein, 9 aa, Homo Sapiens
KQIVPENDA

SEQ ID NO: 1273750 - protein, 9 aa, Homo Sapiens
IEQLKAEIT

SEQ ID NO: 1273751 - protein, 9 aa, Homo Sapiens
PQRVAAMSV

SEQ ID NO: 1273752 - protein, 9 aa, Homo Sapiens
LDAFPLLLA

SEQ ID NO: 1273753 - protein, 9 aa, Homo Sapiens
MEERRQKRE

SEQ ID NO: 1273754 - protein, 9 aa, Homo Sapiens
VGLASRSIL

SEQ ID NO: 1273755 - protein, 9 aa, Homo Sapiens
FAKSQSQFH

SEQ ID NO: 1273756 - protein, 9 aa, Homo Sapiens
LYSPVGSGG

SEQ ID NO: 1273757 - protein, 9 aa, Homo Sapiens
EDAKEYLGF

SEQ ID NO: 1273758 - protein, 9 aa, Homo Sapiens
PVGSGGRNL

SEQ ID NO: 1273759 - protein, 9 aa, Homo Sapiens
SAWTILQSL

SEQ ID NO: 1273760 - protein, 9 aa, Homo Sapiens
ADRGSCLVG

SEQ ID NO: 1273761 - protein, 9 aa, Homo Sapiens
ALLRMASSQ

SEQ ID NO: 1273762 - protein, 9 aa, Homo Sapiens
NMEGIIVSA

SEQ ID NO: 1273763 - protein, 9 aa, Homo Sapiens
GCSVQTHVP

SEQ ID NO: 1273764 - protein, 9 aa, Homo Sapiens
FYIMLLKDT

SEQ ID NO: 1273765 - protein, 9 aa, Homo Sapiens
FQGQQFIVE

SEQ ID NO: 1273766 - protein, 9 aa, Homo Sapiens
PVCVGQLQD

SEQ ID NO: 1273767 - protein, 9 aa, Homo Sapiens
SLLTAIRLG

SEQ ID NO: 1273768 - protein, 9 aa, Homo Sapiens
CTVCLKEFQ

SEQ ID NO: 1273769 - protein, 9 aa, Homo Sapiens
GFWQVGIQQ

SEQ ID NO: 1273770 - protein, 9 aa, Homo Sapiens
EDECFLKQF

SEQ ID NO: 1273771 - protein, 9 aa, Homo Sapiens
SPNVQDTCG

SEQ ID NO: 1273772 - protein, 9 aa, Homo Sapiens
TFWNHLWLV

SEQ ID NO: 1273773 - protein, 9 aa, Homo Sapiens
EGTKLDHEF

SEQ ID NO: 1273774 - protein, 9 aa, Homo Sapiens
ALRAQKARL

SEQ ID NO: 1273775 - protein, 9 aa, Homo Sapiens
MIGCTQPQR

SEQ ID NO: 1273776 - protein, 9 aa, Homo Sapiens
GPRTFWNHL

SEQ ID NO: 1273777 - protein, 9 aa, Homo Sapiens
RMASSQRDM

SEQ ID NO: 1273778 - protein, 9 aa, Homo Sapiens
EQQEKSGED

SEQ ID NO: 1273779 - protein, 9 aa, Homo Sapiens
LARPTTVQG

SEQ ID NO: 1273780 - protein, 9 aa, Homo Sapiens
DLIQLLALY

SEQ ID NO: 1273781 - protein, 9 aa, Homo Sapiens
LHSAEASPQ

SEQ ID NO: 1273782 - protein, 9 aa, Homo Sapiens
DTYRLPEFI

SEQ ID NO: 1273783 - protein, 9 aa, Homo Sapiens
HPNDDNVHF

SEQ ID NO: 1273784 - protein, 9 aa, Homo Sapiens
LQQAYVGMQ

SEQ ID NO: 1273785 - protein, 9 aa, Homo Sapiens
TQNSQPRAE

SEQ ID NO: 1273786 - protein, 9 aa, Homo Sapiens
HDTQKTSFK

SEQ ID NO: 1273787 - protein, 9 aa, Homo Sapiens
SPLFIFMTR

SEQ ID NO: 1273788 - protein, 9 aa, Homo Sapiens
ESRRKDLSD

SEQ ID NO: 1273789 - protein, 9 aa, Homo Sapiens
WIFRILKLA

SEQ ID NO: 1273790 - protein, 9 aa, Homo Sapiens
PEAHADTGE

SEQ ID NO: 1273791 - protein, 9 aa, Homo Sapiens
ETFDGDTYR

SEQ ID NO: 1273792 - protein, 9 aa, Homo Sapiens
LISAQLCMI

SEQ ID NO: 1273793 - protein, 9 aa, Homo Sapiens
TEGKEQQEK

SEQ ID NO: 1273794 - protein, 9 aa, Homo Sapiens
IQWQNSTID

SEQ ID NO: 1273795 - protein, 9 aa, Homo Sapiens
ALISAQLCM

SEQ ID NO: 1273796 - protein, 9 aa, Homo Sapiens
SNSKINALM

SEQ ID NO: 1273797 - protein, 9 aa, Homo Sapiens
AYVGMQHYT

SEQ ID NO: 1273798 - protein, 9 aa, Homo Sapiens
LCAQEIAII

SEQ ID NO: 1273799 - protein, 9 aa, Homo Sapiens
CNLRLHPSS

SEQ ID NO: 1273800 - protein, 9 aa, Homo Sapiens
GGQQVIKVD

SEQ ID NO: 1273801 - protein, 9 aa, Homo Sapiens
HLACVSQNG

SEQ ID NO: 1273802 - protein, 9 aa, Homo Sapiens
EDLKEHYTP

SEQ ID NO: 1273803 - protein, 9 aa, Homo Sapiens
GDTYRLPEF

SEQ ID NO: 1273804 - protein, 9 aa, Homo Sapiens
SSKGSSQED

SEQ ID NO: 1273805 - protein, 9 aa, Homo Sapiens
TVKPSWDNH

SEQ ID NO: 1273806 - protein, 9 aa, Homo Sapiens
VMVGLASRS

SEQ ID NO: 1273807 - protein, 9 aa, Homo Sapiens
GRNSFEVSV

SEQ ID NO: 1273808 - protein, 9 aa, Homo Sapiens
CLVGATAQR

SEQ ID NO: 1273809 - protein, 9 aa, Homo Sapiens
PQEEIYPYI

SEQ ID NO: 1273810 - protein, 9 aa, Homo Sapiens
YEELCAKQL

SEQ ID NO: 1273811 - protein, 9 aa, Homo Sapiens
VLSTPYHVM

SEQ ID NO: 1273812 - protein, 9 aa, Homo Sapiens
GLHHHEASS

SEQ ID NO: 1273813 - protein, 9 aa, Homo Sapiens
NPVSECMRG

SEQ ID NO: 1273814 - protein, 9 aa, Homo Sapiens
HFRNVKLLE

SEQ ID NO: 1273815 - protein, 9 aa, Homo Sapiens
PSGGQQVIK

SEQ ID NO: 1273816 - protein, 9 aa, Homo Sapiens
GKTASATFE

SEQ ID NO: 1273817 - protein, 9 aa, Homo Sapiens
IIIWNLKSY

SEQ ID NO: 1273818 - protein, 9 aa, Homo Sapiens
FDGDTYRLP

SEQ ID NO: 1273819 - protein, 9 aa, Homo Sapiens
QWQQESSMQ

SEQ ID NO: 1273820 - protein, 9 aa, Homo Sapiens
NSLERKLKT

SEQ ID NO: 1273821 - protein, 9 aa, Homo Sapiens
LYFHRSILK

SEQ ID NO: 1273822 - protein, 9 aa, Homo Sapiens
RHLWRLGVK

SEQ ID NO: 1273823 - protein, 9 aa, Homo Sapiens
PTCCISSCC

SEQ ID NO: 1273824 - protein, 9 aa, Homo Sapiens
SPATHFAMP

SEQ ID NO: 1273825 - protein, 9 aa, Homo Sapiens
VPGIGCGFS

SEQ ID NO: 1273826 - protein, 9 aa, Homo Sapiens
KIAVTTEDN

SEQ ID NO: 1273827 - protein, 9 aa, Homo Sapiens
YAGNHKWCL

SEQ ID NO: 1273828 - protein, 9 aa, Homo Sapiens
TNPESQNFK

SEQ ID NO: 1273829 - protein, 9 aa, Homo Sapiens
VMAAAAGAA

SEQ ID NO: 1273830 - protein, 9 aa, Homo Sapiens
HLLDNFHSK

SEQ ID NO: 1273831 - protein, 9 aa, Homo Sapiens
PKDEEEDLK

SEQ ID NO: 1273832 - protein, 9 aa, Homo Sapiens
EEQLVASKE

SEQ ID NO: 1273833 - protein, 9 aa, Homo Sapiens
QCLQPPAAT

SEQ ID NO: 1273834 - protein, 9 aa, Homo Sapiens
ESSMQLKEQ

SEQ ID NO: 1273835 - protein, 9 aa, Homo Sapiens
RAHLANDDE

SEQ ID NO: 1273836 - protein, 9 aa, Homo Sapiens
SDDTRMVRR

SEQ ID NO: 1273837 - protein, 9 aa, Homo Sapiens
PGTYMVVLK

SEQ ID NO: 1273838 - protein, 9 aa, Homo Sapiens
IVEKGDYPR

SEQ ID NO: 1273839 - protein, 9 aa, Homo Sapiens
VHKHDTQKT

SEQ ID NO: 1273840 - protein, 9 aa, Homo Sapiens
KPASGLDGY

SEQ ID NO: 1273841 - protein, 9 aa, Homo Sapiens
YVGMQHYTA

SEQ ID NO: 1273842 - protein, 9 aa, Homo Sapiens
LLRMASSQR

SEQ ID NO: 1273843 - protein, 9 aa, Homo Sapiens
HKHDTQKTS

SEQ ID NO: 1273844 - protein, 9 aa, Homo Sapiens
NDDNVHFRI

SEQ ID NO: 1273845 - protein, 9 aa, Homo Sapiens
NDNEPKFLN

SEQ ID NO: 1273846 - protein, 9 aa, Homo Sapiens
QKTSFKKNL

SEQ ID NO: 1273847 - protein, 9 aa, Homo Sapiens
LGGVCPPRP

SEQ ID NO: 1273848 - protein, 9 aa, Homo Sapiens
DQDYVNLNN

SEQ ID NO: 1273849 - protein, 9 aa, Homo Sapiens
TRHGRSNLS

SEQ ID NO: 1273850 - protein, 9 aa, Homo Sapiens
IRYASMERL

SEQ ID NO: 1273851 - protein, 9 aa, Homo Sapiens
FFQPPPQSQ

SEQ ID NO: 1273852 - protein, 9 aa, Homo Sapiens
LKSYKNATE

SEQ ID NO: 1273853 - protein, 9 aa, Homo Sapiens
LGNNLHNAS

SEQ ID NO: 1273854 - protein, 9 aa, Homo Sapiens
EQNHFNSSQ

SEQ ID NO: 1273855 - protein, 9 aa, Homo Sapiens
QMPDLCAQE

SEQ ID NO: 1273856 - protein, 9 aa, Homo Sapiens
VETDEEKLF

SEQ ID NO: 1273857 - protein, 9 aa, Homo Sapiens
SSLATQVDE

SEQ ID NO: 1273858 - protein, 9 aa, Homo Sapiens
LHAAAILTS

SEQ ID NO: 1273859 - protein, 9 aa, Homo Sapiens
AQKDGKVEE

SEQ ID NO: 1273860 - protein, 9 aa, Homo Sapiens
ERSDTRDKR

SEQ ID NO: 1273861 - protein, 9 aa, Homo Sapiens
RLGVKALLR

SEQ ID NO: 1273862 - protein, 9 aa, Homo Sapiens
PTPYCTVSL

SEQ ID NO: 1273863 - protein, 9 aa, Homo Sapiens
YSPAGFSRE

SEQ ID NO: 1273864 - protein, 9 aa, Homo Sapiens
DRGSCLVGA

SEQ ID NO: 1273865 - protein, 9 aa, Homo Sapiens
QAPGTTAVH

SEQ ID NO: 1273866 - protein, 9 aa, Homo Sapiens
LWRLGVKAL

SEQ ID NO: 1273867 - protein, 9 aa, Homo Sapiens
EGFWQVGIQ

SEQ ID NO: 1273868 - protein, 9 aa, Homo Sapiens
FHLMVAVVG

SEQ ID NO: 1273869 - protein, 9 aa, Homo Sapiens
HPSSWDYRH

SEQ ID NO: 1273870 - protein, 9 aa, Homo Sapiens
ILQPEFFQA

SEQ ID NO: 1273871 - protein, 9 aa, Homo Sapiens
KLVETDEEK

SEQ ID NO: 1273872 - protein, 9 aa, Homo Sapiens
RVLTSAIFE

SEQ ID NO: 1273873 - protein, 9 aa, Homo Sapiens
SDPPTSARI

SEQ ID NO: 1273874 - protein, 9 aa, Homo Sapiens
ALPTPGRSC

SEQ ID NO: 1273875 - protein, 9 aa, Homo Sapiens
KERSDTRDK

SEQ ID NO: 1273876 - protein, 9 aa, Homo Sapiens
QNMEGIIVS

SEQ ID NO: 1273877 - protein, 9 aa, Homo Sapiens
VHFRNVKLL

SEQ ID NO: 1273878 - protein, 9 aa, Homo Sapiens
YLYNANVNL

SEQ ID NO: 1273879 - protein, 9 aa, Homo Sapiens
SGLDGYFNS

SEQ ID NO: 1273880 - protein, 9 aa, Homo Sapiens
INVSFQCPD

SEQ ID NO: 1273881 - protein, 9 aa, Homo Sapiens
LPPSRTTVS

SEQ ID NO: 1273882 - protein, 9 aa, Homo Sapiens
NHSSKSATS

SEQ ID NO: 1273883 - protein, 9 aa, Homo Sapiens
VPDLSLTVT

SEQ ID NO: 1273884 - protein, 9 aa, Homo Sapiens
GDTNSNTDQ

SEQ ID NO: 1273885 - protein, 9 aa, Homo Sapiens
IEVAKMQTR

SEQ ID NO: 1273886 - protein, 9 aa, Homo Sapiens
GMIGCTQPQ

SEQ ID NO: 1273887 - protein, 9 aa, Homo Sapiens
QGEQNHFNS

SEQ ID NO: 1273888 - protein, 9 aa, Homo Sapiens
GTKLDHEFL

SEQ ID NO: 1273889 - protein, 9 aa, Homo Sapiens
LLVAAELWE

SEQ ID NO: 1273890 - protein, 9 aa, Homo Sapiens
PPPQSQQPQ

SEQ ID NO: 1273891 - protein, 9 aa, Homo Sapiens
HKTINPEQA

SEQ ID NO: 1273892 - protein, 9 aa, Homo Sapiens
DRQEGGQVY

SEQ ID NO: 1273893 - protein, 9 aa, Homo Sapiens
SKHSIHHST

SEQ ID NO: 1273894 - protein, 9 aa, Homo Sapiens
HFNSSQGGK

SEQ ID NO: 1273895 - protein, 9 aa, Homo Sapiens
QSIYYSLIF

SEQ ID NO: 1273896 - protein, 9 aa, Homo Sapiens
VYAKWPPGG

SEQ ID NO: 1273897 - protein, 9 aa, Homo Sapiens
RRLHYNKEL

SEQ ID NO: 1273898 - protein, 9 aa, Homo Sapiens
SSIWELSSG

SEQ ID NO: 1273899 - protein, 9 aa, Homo Sapiens
PDTAVGTLG

SEQ ID NO: 1273900 - protein, 9 aa, Homo Sapiens
WDPVYAKWP

SEQ ID NO: 1273901 - protein, 9 aa, Homo Sapiens
DDSSLATQV

SEQ ID NO: 1273902 - protein, 9 aa, Homo Sapiens
CCTTQPRGC

SEQ ID NO: 1273903 - protein, 9 aa, Homo Sapiens
TAIGIKEVA

SEQ ID NO: 1273904 - protein, 9 aa, Homo Sapiens
WTSNSKINA

SEQ ID NO: 1273905 - protein, 9 aa, Homo Sapiens
EGDTNSNTD

SEQ ID NO: 1273906 - protein, 9 aa, Homo Sapiens
LVGVEAGFL

SEQ ID NO: 1273907 - protein, 9 aa, Homo Sapiens
IPSARQRKK

SEQ ID NO: 1273908 - protein, 9 aa, Homo Sapiens
TCCRPTCCI

SEQ ID NO: 1273909 - protein, 9 aa, Homo Sapiens
TSAIFETKF

SEQ ID NO: 1273910 - protein, 9 aa, Homo Sapiens
EIEIEQLKA

SEQ ID NO: 1273911 - protein, 9 aa, Homo Sapiens
CHFSTPCFC

SEQ ID NO: 1273912 - protein, 9 aa, Homo Sapiens
TRLEREGLS

SEQ ID NO: 1273913 - protein, 9 aa, Homo Sapiens
RHGRSNLSE

SEQ ID NO: 1273914 - protein, 9 aa, Homo Sapiens
ILFALTDDM

SEQ ID NO: 1273915 - protein, 9 aa, Homo Sapiens
WCKAATATR

SEQ ID NO: 1273916 - protein, 9 aa, Homo Sapiens
EGYTCDCFQ

SEQ ID NO: 1273917 - protein, 9 aa, Homo Sapiens
KNQGLSKLR

SEQ ID NO: 1273918 - protein, 9 aa, Homo Sapiens
LFNFRSGSP

SEQ ID NO: 1273919 - protein, 9 aa, Homo Sapiens
QHLLDNFHS

SEQ ID NO: 1273920 - protein, 9 aa, Homo Sapiens
PVTKNVNVG

SEQ ID NO: 1273921 - protein, 9 aa, Homo Sapiens
RVLDDSSNT

SEQ ID NO: 1273922 - protein, 9 aa, Homo Sapiens
PRTFWNHLW

SEQ ID NO: 1273923 - protein, 9 aa, Homo Sapiens
LPNLMCSRF

SEQ ID NO: 1273924 - protein, 9 aa, Homo Sapiens
PIYLMMLNP

SEQ ID NO: 1273925 - protein, 9 aa, Homo Sapiens
LSKGGVIHF

SEQ ID NO: 1273926 - protein, 9 aa, Homo Sapiens
LSSSDYPYH

SEQ ID NO: 1273927 - protein, 9 aa, Homo Sapiens
IYKNALKGK

SEQ ID NO: 1273928 - protein, 9 aa, Homo Sapiens
HYNKELNIK

SEQ ID NO: 1273929 - protein, 9 aa, Homo Sapiens
GLSKLRRHS

SEQ ID NO: 1273930 - protein, 9 aa, Homo Sapiens
HRRVHMGER

SEQ ID NO: 1273931 - protein, 9 aa, Homo Sapiens
TPYCTVSLD

SEQ ID NO: 1273932 - protein, 9 aa, Homo Sapiens
EILDEGDTN

SEQ ID NO: 1273933 - protein, 9 aa, Homo Sapiens
PKADAKKVR

SEQ ID NO: 1273934 - protein, 9 aa, Homo Sapiens
PSSASQAPG

SEQ ID NO: 1273935 - protein, 9 aa, Homo Sapiens
VHMGERPYA

SEQ ID NO: 1273936 - protein, 9 aa, Homo Sapiens
GTYMVVLKE

SEQ ID NO: 1273937 - protein, 9 aa, Homo Sapiens
LVETDEEKL

SEQ ID NO: 1273938 - protein, 9 aa, Homo Sapiens
TKLDHEFLD

SEQ ID NO: 1273939 - protein, 9 aa, Homo Sapiens
HLLPCSFVP

SEQ ID NO: 1273940 - protein, 9 aa, Homo Sapiens
PSLLSETVH

SEQ ID NO: 1273941 - protein, 9 aa, Homo Sapiens
PTPGRSCVN

SEQ ID NO: 1273942 - protein, 9 aa, Homo Sapiens
KQIKQTEYS

SEQ ID NO: 1273943 - protein, 9 aa, Homo Sapiens
RLFITIYKN

SEQ ID NO: 1273944 - protein, 9 aa, Homo Sapiens
EMGSVNQAG

SEQ ID NO: 1273945 - protein, 9 aa, Homo Sapiens
LTSLEIPQE

SEQ ID NO: 1273946 - protein, 9 aa, Homo Sapiens
IAVTTEDNM

SEQ ID NO: 1273947 - protein, 9 aa, Homo Sapiens
QPRGCSVQT

SEQ ID NO: 1273948 - protein, 9 aa, Homo Sapiens
ILRIPSARQ

SEQ ID NO: 1273949 - protein, 9 aa, Homo Sapiens
SALPTPGRS

SEQ ID NO: 1273950 - protein, 9 aa, Homo Sapiens
CTVSLDCAI

SEQ ID NO: 1273951 - protein, 9 aa, Homo Sapiens
EGVLHQNRS

SEQ ID NO: 1273952 - protein, 9 aa, Homo Sapiens
HGRSNLSEG

SEQ ID NO: 1273953 - protein, 9 aa, Homo Sapiens
LANDDELIS

SEQ ID NO: 1273954 - protein, 9 aa, Homo Sapiens
PGTLRDDGE

SEQ ID NO: 1273955 - protein, 9 aa, Homo Sapiens
HVQHVGLPK

SEQ ID NO: 1273956 - protein, 9 aa, Homo Sapiens
PTTVQGVQL

SEQ ID NO: 1273957 - protein, 9 aa, Homo Sapiens
TTVQGVQLL

SEQ ID NO: 1273958 - protein, 9 aa, Homo Sapiens
LLTAIRLGE

SEQ ID NO: 1273959 - protein, 9 aa, Homo Sapiens
EELCAKQLS

SEQ ID NO: 1273960 - protein, 9 aa, Homo Sapiens
TLEEKKGTS

SEQ ID NO: 1273961 - protein, 9 aa, Homo Sapiens
DKIAVTTED

SEQ ID NO: 1273962 - protein, 9 aa, Homo Sapiens
GIIIAGWDR

SEQ ID NO: 1273963 - protein, 9 aa, Homo Sapiens
FNLMKFHLM

SEQ ID NO: 1273964 - protein, 9 aa, Homo Sapiens
FSTWEKKLH

SEQ ID NO: 1273965 - protein, 9 aa, Homo Sapiens
ILTSLEIPQ

SEQ ID NO: 1273966 - protein, 9 aa, Homo Sapiens
ATAGDQGLM

SEQ ID NO: 1273967 - protein, 9 aa, Homo Sapiens
QYGDPAIYV

SEQ ID NO: 1273968 - protein, 9 aa, Homo Sapiens
TSNSKINAL

SEQ ID NO: 1273969 - protein, 9 aa, Homo Sapiens
YSPKSPSLL

SEQ ID NO: 1273970 - protein, 9 aa, Homo Sapiens
RQALLRLVC

SEQ ID NO: 1273971 - protein, 9 aa, Homo Sapiens
QIEWEKPEH

SEQ ID NO: 1273972 - protein, 9 aa, Homo Sapiens
VNLSSSDYP

SEQ ID NO: 1273973 - protein, 9 aa, Homo Sapiens
KTINVSFQC

SEQ ID NO: 1273974 - protein, 9 aa, Homo Sapiens
SSTEGKEQQ

SEQ ID NO: 1273975 - protein, 9 aa, Homo Sapiens
STAQNMEGI

SEQ ID NO: 1273976 - protein, 9 aa, Homo Sapiens
ACGLSQEKA

SEQ ID NO: 1273977 - protein, 9 aa, Homo Sapiens
TFHSQSIYY

SEQ ID NO: 1273978 - protein, 9 aa, Homo Sapiens
QQAYVGMQH

SEQ ID NO: 1273979 - protein, 9 aa, Homo Sapiens
GSNTRHGRS

SEQ ID NO: 1273980 - protein, 9 aa, Homo Sapiens
IAGWDRQEG

SEQ ID NO: 1273981 - protein, 9 aa, Homo Sapiens
ILEKQKKIT

SEQ ID NO: 1273982 - protein, 9 aa, Homo Sapiens
PEPVCVGQL

SEQ ID NO: 1273983 - protein, 9 aa, Homo Sapiens
KADAKKVRK

SEQ ID NO: 1273984 - protein, 9 aa, Homo Sapiens
LTAASVLCI

SEQ ID NO: 1273985 - protein, 9 aa, Homo Sapiens
ESYWCKAAT

SEQ ID NO: 1273986 - protein, 9 aa, Homo Sapiens
ETSGNSSAV

SEQ ID NO: 1273987 - protein, 9 aa, Homo Sapiens
LRIPSARQR

SEQ ID NO: 1273988 - protein, 9 aa, Homo Sapiens
EEDEADIEV

SEQ ID NO: 1273989 - protein, 9 aa, Homo Sapiens
RNDKTKGQG

SEQ ID NO: 1273990 - protein, 9 aa, Homo Sapiens
ICVALTKVS

SEQ ID NO: 1273991 - protein, 9 aa, Homo Sapiens
LRPTGFPSC

SEQ ID NO: 1273992 - protein, 9 aa, Homo Sapiens
IHEENALTM

SEQ ID NO: 1273993 - protein, 9 aa, Homo Sapiens
GPVNPAMSA

SEQ ID NO: 1273994 - protein, 9 aa, Homo Sapiens
QVHSPLVTL

SEQ ID NO: 1273995 - protein, 9 aa, Homo Sapiens
PLDHLLGMW

SEQ ID NO: 1273996 - protein, 9 aa, Homo Sapiens
LWSLLVFLL

SEQ ID NO: 1273997 - protein, 9 aa, Homo Sapiens
RNGVHCFQI

SEQ ID NO: 1273998 - protein, 9 aa, Homo Sapiens
NLRLHPSSW

SEQ ID NO: 1273999 - protein, 9 aa, Homo Sapiens
KCEGQEESF

SEQ ID NO: 1274000 - protein, 9 aa, Homo Sapiens
DEEEDLKEH

SEQ ID NO: 1274001 - protein, 9 aa, Homo Sapiens
SKGSSQEDE

SEQ ID NO: 1274002 - protein, 9 aa, Homo Sapiens
QEIAIILGI

SEQ ID NO: 1274003 - protein, 9 aa, Homo Sapiens
DPEPVCVGQ

SEQ ID NO: 1274004 - protein, 9 aa, Homo Sapiens
ATQVDETQQ

SEQ ID NO: 1274005 - protein, 9 aa, Homo Sapiens
KDGKVEEEE

SEQ ID NO: 1274006 - protein, 9 aa, Homo Sapiens
KSYKNATEF

SEQ ID NO: 1274007 - protein, 9 aa, Homo Sapiens
TGLAAYYVA

SEQ ID NO: 1274008 - protein, 9 aa, Homo Sapiens
LPTPGRSCV

SEQ ID NO: 1274009 - protein, 9 aa, Homo Sapiens
SPQEEIYPY

SEQ ID NO: 1274010 - protein, 9 aa, Homo Sapiens
NVHFRISDD

SEQ ID NO: 1274011 - protein, 9 aa, Homo Sapiens
LGCCCTTQP

SEQ ID NO: 1274012 - protein, 9 aa, Homo Sapiens
LMVTMSTFG

SEQ ID NO: 1274013 - protein, 9 aa, Homo Sapiens
LFALTDDMG

SEQ ID NO: 1274014 - protein, 9 aa, Homo Sapiens
CSVQTHVPG

SEQ ID NO: 1274015 - protein, 9 aa, Homo Sapiens
RLFWCEDEC

SEQ ID NO: 1274016 - protein, 9 aa, Homo Sapiens
HQRLPPNMT

SEQ ID NO: 1274017 - protein, 9 aa, Homo Sapiens
TLRDDGEMA

SEQ ID NO: 1274018 - protein, 9 aa, Homo Sapiens
LMLQSLNAL

SEQ ID NO: 1274019 - protein, 9 aa, Homo Sapiens
KQKKITELK

SEQ ID NO: 1274020 - protein, 9 aa, Homo Sapiens
SVCACPGRD

SEQ ID NO: 1274021 - protein, 9 aa, Homo Sapiens
AFKGYLGML

SEQ ID NO: 1274022 - protein, 9 aa, Homo Sapiens
LTCDCHLCW

SEQ ID NO: 1274023 - protein, 9 aa, Homo Sapiens
GREIRMWYA

SEQ ID NO: 1274024 - protein, 9 aa, Homo Sapiens
LFSLMQYCE

SEQ ID NO: 1274025 - protein, 9 aa, Homo Sapiens
RTTVSSVAR

SEQ ID NO: 1274026 - protein, 9 aa, Homo Sapiens
RTFWNHLWL

SEQ ID NO: 1274027 - protein, 9 aa, Homo Sapiens
SPVGSGGRN

SEQ ID NO: 1274028 - protein, 9 aa, Homo Sapiens
IYLVAPIYL

SEQ ID NO: 1274029 - protein, 9 aa, Homo Sapiens
PVNPAMSAL

SEQ ID NO: 1274030 - protein, 9 aa, Homo Sapiens
LPRYLSCYV

SEQ ID NO: 1274031 - protein, 9 aa, Homo Sapiens
WSVGCIMGQ

SEQ ID NO: 1274032 - protein, 9 aa, Homo Sapiens
SYLPRYLSC

SEQ ID NO: 1274033 - protein, 9 aa, Homo Sapiens
QAYVGMQHY

SEQ ID NO: 1274034 - protein, 9 aa, Homo Sapiens
SLMQYCEEF

SEQ ID NO: 1274035 - protein, 9 aa, Homo Sapiens
TGSTSGRQR

SEQ ID NO: 1274036 - protein, 9 aa, Homo Sapiens
SRSILLHPS

SEQ ID NO: 1274037 - protein, 9 aa, Homo Sapiens
CSFVPIGIL

SEQ ID NO: 1274038 - protein, 9 aa, Homo Sapiens
LTAQGVAMV

SEQ ID NO: 1274039 - protein, 9 aa, Homo Sapiens
NTMKRLQEE

SEQ ID NO: 1274040 - protein, 9 aa, Homo Sapiens
RSGPDQRLP

SEQ ID NO: 1274041 - protein, 9 aa, Homo Sapiens
PGMMAAAQA

SEQ ID NO: 1274042 - protein, 9 aa, Homo Sapiens
YKKLFAVPF

SEQ ID NO: 1274043 - protein, 9 aa, Homo Sapiens
KVGIKEYEL

SEQ ID NO: 1274044 - protein, 9 aa, Homo Sapiens
LVAPIYLMM

SEQ ID NO: 1274045 - protein, 9 aa, Homo Sapiens
TRIHILNVL

SEQ ID NO: 1274046 - protein, 9 aa, Homo Sapiens
GLDGYFNSI

SEQ ID NO: 1274047 - protein, 9 aa, Homo Sapiens
AKHAVSQGT

SEQ ID NO: 1274048 - protein, 9 aa, Homo Sapiens
ETRIHILNV

SEQ ID NO: 1274049 - protein, 9 aa, Homo Sapiens
RLPPNMTLT

SEQ ID NO: 1274050 - protein, 9 aa, Homo Sapiens
QSNPFCSYL

SEQ ID NO: 1274051 - protein, 9 aa, Homo Sapiens
ILGPQGNTM

SEQ ID NO: 1274052 - protein, 9 aa, Homo Sapiens
DESRRKDLS

SEQ ID NO: 1274053 - protein, 9 aa, Homo Sapiens
LVCAVEAMI

SEQ ID NO: 1274054 - protein, 9 aa, Homo Sapiens
AAELWEQGD

SEQ ID NO: 1274055 - protein, 9 aa, Homo Sapiens
NVNVGTKLI

SEQ ID NO: 1274056 - protein, 9 aa, Homo Sapiens
GTEAATGLQ

SEQ ID NO: 1274057 - protein, 9 aa, Homo Sapiens
RAARMGGAG

SEQ ID NO: 1274058 - protein, 9 aa, Homo Sapiens
KDFAKSQSQ

SEQ ID NO: 1274059 - protein, 9 aa, Homo Sapiens
RGDMMRPQA

SEQ ID NO: 1274060 - protein, 9 aa, Homo Sapiens
DQGLMLQSL

SEQ ID NO: 1274061 - protein, 9 aa, Homo Sapiens
GSHCKCEGQ

SEQ ID NO: 1274062 - protein, 9 aa, Homo Sapiens
DDLKNKKAL

SEQ ID NO: 1274063 - protein, 9 aa, Homo Sapiens
MPDILFALT

SEQ ID NO: 1274064 - protein, 9 aa, Homo Sapiens
LAHGLLQLS

SEQ ID NO: 1274065 - protein, 9 aa, Homo Sapiens
CWLLPWAQN

SEQ ID NO: 1274066 - protein, 9 aa, Homo Sapiens
SNEERFTGL

SEQ ID NO: 1274067 - protein, 9 aa, Homo Sapiens
ELSGLPQVR

SEQ ID NO: 1274068 - protein, 9 aa, Homo Sapiens
AYRDPVFYD

SEQ ID NO: 1274069 - protein, 9 aa, Homo Sapiens
AYPGGRVTQ

SEQ ID NO: 1274070 - protein, 9 aa, Homo Sapiens
YTCHVQHVG

SEQ ID NO: 1274071 - protein, 9 aa, Homo Sapiens
YKSKHSIHH

SEQ ID NO: 1274072 - protein, 9 aa, Homo Sapiens
LPKASDQPS

SEQ ID NO: 1274073 - protein, 9 aa, Homo Sapiens
NAPGTLRDD

SEQ ID NO: 1274074 - protein, 9 aa, Homo Sapiens
AFQARLLGN

SEQ ID NO: 1274075 - protein, 9 aa, Homo Sapiens
KSQSQFHSS

SEQ ID NO: 1274076 - protein, 9 aa, Homo Sapiens
LFAMSQYSP

SEQ ID NO: 1274077 - protein, 9 aa, Homo Sapiens
LLALYFHRS

SEQ ID NO: 1274078 - protein, 9 aa, Homo Sapiens
LAHCNLRLH

SEQ ID NO: 1274079 - protein, 9 aa, Homo Sapiens
RLPMEGSRP

SEQ ID NO: 1274080 - protein, 9 aa, Homo Sapiens
ILNVLITSL

SEQ ID NO: 1274081 - protein, 9 aa, Homo Sapiens
WDRQEGGQV

SEQ ID NO: 1274082 - protein, 9 aa, Homo Sapiens
TGTLRGSLT

SEQ ID NO: 1274083 - protein, 9 aa, Homo Sapiens
LLRRCTELP

SEQ ID NO: 1274084 - protein, 9 aa, Homo Sapiens
KEVLEDFAK

SEQ ID NO: 1274085 - protein, 9 aa, Homo Sapiens
RNSFEVSVC

SEQ ID NO: 1274086 - protein, 9 aa, Homo Sapiens
QGEEKDGIS

SEQ ID NO: 1274087 - protein, 9 aa, Homo Sapiens
EQLVASKEQ

SEQ ID NO: 1274088 - protein, 9 aa, Homo Sapiens
YLGMLKKLV

SEQ ID NO: 1274089 - protein, 9 aa, Homo Sapiens
SWDLGGVCP

SEQ ID NO: 1274090 - protein, 9 aa, Homo Sapiens
MEGIIVSAM

SEQ ID NO: 1274091 - protein, 9 aa, Homo Sapiens
FHLLAEAPG

SEQ ID NO: 1274092 - protein, 9 aa, Homo Sapiens
APIYLMMLN

SEQ ID NO: 1274093 - protein, 9 aa, Homo Sapiens
NGCLRVFHF

SEQ ID NO: 1274094 - protein, 9 aa, Homo Sapiens
ISCTVCLKE

SEQ ID NO: 1274095 - protein, 9 aa, Homo Sapiens
GPDQRLPKA

SEQ ID NO: 1274096 - protein, 9 aa, Homo Sapiens
HLCWLLPWA

SEQ ID NO: 1274097 - protein, 9 aa, Homo Sapiens
PPGPVNPAM

SEQ ID NO: 1274098 - protein, 9 aa, Homo Sapiens
SYWCKAATA

SEQ ID NO: 1274099 - protein, 9 aa, Homo Sapiens
ANPEALLRM

SEQ ID NO: 1274100 - protein, 9 aa, Homo Sapiens
RRAEDDLKN

SEQ ID NO: 1274101 - protein, 9 aa, Homo Sapiens
AFSTWEKKL

SEQ ID NO: 1274102 - protein, 9 aa, Homo Sapiens
CGFSCAFGG

SEQ ID NO: 1274103 - protein, 9 aa, Homo Sapiens
QKDGKVEEE

SEQ ID NO: 1274104 - protein, 9 aa, Homo Sapiens
TAEKPFTCL

SEQ ID NO: 1274105 - protein, 9 aa, Homo Sapiens
SWEQRAARM

SEQ ID NO: 1274106 - protein, 9 aa, Homo Sapiens
YLVAPIYLM

SEQ ID NO: 1274107 - protein, 9 aa, Homo Sapiens
IIWNLKSYK

SEQ ID NO: 1274108 - protein, 9 aa, Homo Sapiens
YCGSLARPT

SEQ ID NO: 1274109 - protein, 9 aa, Homo Sapiens
RKAAYRDPV

SEQ ID NO: 1274110 - protein, 9 aa, Homo Sapiens
NKNERCGTD

SEQ ID NO: 1274111 - protein, 9 aa, Homo Sapiens
YRLPEFIVQ

SEQ ID NO: 1274112 - protein, 9 aa, Homo Sapiens
PKFLNGPYV

SEQ ID NO: 1274113 - protein, 9 aa, Homo Sapiens
EADIEVAKM

SEQ ID NO: 1274114 - protein, 9 aa, Homo Sapiens
ECMRGVRLV

SEQ ID NO: 1274115 - protein, 9 aa, Homo Sapiens
HQNRSLLFM

SEQ ID NO: 1274116 - protein, 9 aa, Homo Sapiens
AHGLLQLSQ

SEQ ID NO: 1274117 - protein, 9 aa, Homo Sapiens
SSCSIPMPS

SEQ ID NO: 1274118 - protein, 9 aa, Homo Sapiens
ERCLQVVWS

SEQ ID NO: 1274119 - protein, 9 aa, Homo Sapiens
ALVHVLVLD

SEQ ID NO: 1274120 - protein, 9 aa, Homo Sapiens
DSGAPPLPP

SEQ ID NO: 1274121 - protein, 9 aa, Homo Sapiens
LAISLPPEP

SEQ ID NO: 1274122 - protein, 9 aa, Homo Sapiens
IITRDRMIN

SEQ ID NO: 1274123 - protein, 9 aa, Homo Sapiens
PFMKICVFI

SEQ ID NO: 1274124 - protein, 9 aa, Homo Sapiens
VSAYSSAPG

SEQ ID NO: 1274125 - protein, 9 aa, Homo Sapiens
DVPSGVVME

SEQ ID NO: 1274126 - protein, 9 aa, Homo Sapiens
DPSLVYRSD

SEQ ID NO: 1274127 - protein, 9 aa, Homo Sapiens
FRHSVVVPC

SEQ ID NO: 1274128 - protein, 9 aa, Homo Sapiens
EQQERREQE

SEQ ID NO: 1274129 - protein, 9 aa, Homo Sapiens
VYRSDVDPE

SEQ ID NO: 1274130 - protein, 9 aa, Homo Sapiens
ELAISLPPE

SEQ ID NO: 1274131 - protein, 9 aa, Homo Sapiens
YSWWDPFMK

SEQ ID NO: 1274132 - protein, 9 aa, Homo Sapiens
LSREALVHV

SEQ ID NO: 1274133 - protein, 9 aa, Homo Sapiens
VVPCEPPEV

SEQ ID NO: 1274134 - protein, 9 aa, Homo Sapiens
EFDVDVPSG

SEQ ID NO: 1274135 - protein, 9 aa, Homo Sapiens
SLQSASGQP

SEQ ID NO: 1274136 - protein, 9 aa, Homo Sapiens
ERRLVHQDL

SEQ ID NO: 1274137 - protein, 9 aa, Homo Sapiens
YQALKRTAE

SEQ ID NO: 1274138 - protein, 9 aa, Homo Sapiens
PLPMCEVPC

SEQ ID NO: 1274139 - protein, 9 aa, Homo Sapiens
AVVAYSEND

SEQ ID NO: 1274140 - protein, 9 aa, Homo Sapiens
SEKVHGFTR

SEQ ID NO: 1274141 - protein, 9 aa, Homo Sapiens
FSCRASEFP

SEQ ID NO: 1274142 - protein, 9 aa, Homo Sapiens
TQKFCLVIV

SEQ ID NO: 1274143 - protein, 9 aa, Homo Sapiens
RLLHTAKNM

SEQ ID NO: 1274144 - protein, 9 aa, Homo Sapiens
ASGQPQETA

SEQ ID NO: 1274145 - protein, 9 aa, Homo Sapiens
PSLVYRSDV

SEQ ID NO: 1274146 - protein, 9 aa, Homo Sapiens
EALVHVLVL

SEQ ID NO: 1274147 - protein, 9 aa, Homo Sapiens
LYKGLQSVF

SEQ ID NO: 1274148 - protein, 9 aa, Homo Sapiens
TQSNLFIAE

SEQ ID NO: 1274149 - protein, 9 aa, Homo Sapiens
FAAESIIII

SEQ ID NO: 1274150 - protein, 9 aa, Homo Sapiens
AHHQPTVDK

SEQ ID NO: 1274151 - protein, 9 aa, Homo Sapiens
SCSEYSLKL

SEQ ID NO: 1274152 - protein, 9 aa, Homo Sapiens
SCRASEFPG

SEQ ID NO: 1274153 - protein, 9 aa, Homo Sapiens
KFCLVIVQG

SEQ ID NO: 1274154 - protein, 9 aa, Homo Sapiens
QERREQEER

SEQ ID NO: 1274155 - protein, 9 aa, Homo Sapiens
DEIVGLAAK

SEQ ID NO: 1274156 - protein, 9 aa, Homo Sapiens
APLAPGAVS

SEQ ID NO: 1274157 - protein, 9 aa, Homo Sapiens
MEPDDVRAC

SEQ ID NO: 1274158 - protein, 9 aa, Homo Sapiens
KGEQGRAGE

SEQ ID NO: 1274159 - protein, 9 aa, Homo Sapiens
DPFMKICVF

SEQ ID NO: 1274160 - protein, 9 aa, Homo Sapiens
EEIHQSYQE

SEQ ID NO: 1274161 - protein, 9 aa, Homo Sapiens
PDDVRACLI

SEQ ID NO: 1274162 - protein, 9 aa, Homo Sapiens
LFPPSSKPD

SEQ ID NO: 1274163 - protein, 9 aa, Homo Sapiens
RSDVDPEVA

SEQ ID NO: 1274164 - protein, 9 aa, Homo Sapiens
SEYSLKLTD

SEQ ID NO: 1274165 - protein, 9 aa, Homo Sapiens
PALFPPSSK

SEQ ID NO: 1274166 - protein, 9 aa, Homo Sapiens
FPATQSNLF

SEQ ID NO: 1274167 - protein, 9 aa, Homo Sapiens
GINMPLLAY

SEQ ID NO: 1274168 - protein, 9 aa, Homo Sapiens
NIITRDRMI

SEQ ID NO: 1274169 - protein, 9 aa, Homo Sapiens
GATNEEIHQ

SEQ ID NO: 1274170 - protein, 9 aa, Homo Sapiens
WLTLGINMP

SEQ ID NO: 1274171 - protein, 9 aa, Homo Sapiens
PCPGVTEAT

SEQ ID NO: 1274172 - protein, 9 aa, Homo Sapiens
IYIYTHIYI

SEQ ID NO: 1274173 - protein, 9 aa, Homo Sapiens
QSYQELVKV

SEQ ID NO: 1274174 - protein, 9 aa, Homo Sapiens
VPSGVVMEG

SEQ ID NO: 1274175 - protein, 9 aa, Homo Sapiens
EWLTLGINM

SEQ ID NO: 1274176 - protein, 9 aa, Homo Sapiens
VGGGDVGKS

SEQ ID NO: 1274177 - protein, 9 aa, Homo Sapiens
SWWDPFMKI

SEQ ID NO: 1274178 - protein, 9 aa, Homo Sapiens
QVSPEPRSF

SEQ ID NO: 1274179 - protein, 9 aa, Homo Sapiens
PGAVSAYSS

SEQ ID NO: 1274180 - protein, 9 aa, Homo Sapiens
WDPFMKICV

SEQ ID NO: 1274181 - protein, 9 aa, Homo Sapiens
VHGLLLTVI

SEQ ID NO: 1274182 - protein, 9 aa, Homo Sapiens
LQSASGQPQ

SEQ ID NO: 1274183 - protein, 9 aa, Homo Sapiens
PMCEVPCGG

SEQ ID NO: 1274184 - protein, 9 aa, Homo Sapiens
AYKDGVHGL

SEQ ID NO: 1274185 - protein, 9 aa, Homo Sapiens
RFSVRASEL

SEQ ID NO: 1274186 - protein, 9 aa, Homo Sapiens
KKSKRNEEQ

SEQ ID NO: 1274187 - protein, 9 aa, Homo Sapiens
QLHFAAESI

SEQ ID NO: 1274188 - protein, 9 aa, Homo Sapiens
KCNVIGNNL

SEQ ID NO: 1274189 - protein, 9 aa, Homo Sapiens
YKGLQSVFP

SEQ ID NO: 1274190 - protein, 9 aa, Homo Sapiens
NWDHPLPMC

SEQ ID NO: 1274191 - protein, 9 aa, Homo Sapiens
PTSSSCSIP

SEQ ID NO: 1274192 - protein, 9 aa, Homo Sapiens
LQRRLPQPP

SEQ ID NO: 1274193 - protein, 9 aa, Homo Sapiens
VHQDLAARN

SEQ ID NO: 1274194 - protein, 9 aa, Homo Sapiens
FFFLHKEFL

SEQ ID NO: 1274195 - protein, 9 aa, Homo Sapiens
FPPSSKPDP

SEQ ID NO: 1274196 - protein, 9 aa, Homo Sapiens
SLVYRSDVD

SEQ ID NO: 1274197 - protein, 9 aa, Homo Sapiens
TSFKKNFGT

SEQ ID NO: 1274198 - protein, 9 aa, Homo Sapiens
ISLPPEPAL

SEQ ID NO: 1274199 - protein, 9 aa, Homo Sapiens
PPEPALFPP

SEQ ID NO: 1274200 - protein, 9 aa, Homo Sapiens
CTFFFLHKE

SEQ ID NO: 1274201 - protein, 9 aa, Homo Sapiens
GLQSVFPAD

SEQ ID NO: 1274202 - protein, 9 aa, Homo Sapiens
PRPCPGVTE

SEQ ID NO: 1274203 - protein, 9 aa, Homo Sapiens
KKAQLHFAA

SEQ ID NO: 1274204 - protein, 9 aa, Homo Sapiens
ASVGQVSPE

SEQ ID NO: 1274205 - protein, 9 aa, Homo Sapiens
VVWSLVKPE

SEQ ID NO: 1274206 - protein, 9 aa, Homo Sapiens
EKVTQKFCL

SEQ ID NO: 1274207 - protein, 9 aa, Homo Sapiens
GQPQETAQD

SEQ ID NO: 1274208 - protein, 9 aa, Homo Sapiens
NETSFKKNF

SEQ ID NO: 1274209 - protein, 9 aa, Homo Sapiens
ILKSTLLVF

SEQ ID NO: 1274210 - protein, 9 aa, Homo Sapiens
INMPLLAYH

SEQ ID NO: 1274211 - protein, 9 aa, Homo Sapiens
RHSVVVPCE

SEQ ID NO: 1274212 - protein, 9 aa, Homo Sapiens
PLAPGAVSA

SEQ ID NO: 1274213 - protein, 9 aa, Homo Sapiens
TFFFLHKEF

SEQ ID NO: 1274214 - protein, 9 aa, Homo Sapiens
SNILRLLHT

SEQ ID NO: 1274215 - protein, 9 aa, Homo Sapiens
AAEWLTLGI

SEQ ID NO: 1274216 - protein, 9 aa, Homo Sapiens
KSLYKGLQS

SEQ ID NO: 1274217 - protein, 9 aa, Homo Sapiens
HINLLFSCR

SEQ ID NO: 1274218 - protein, 9 aa, Homo Sapiens
VHGFTRKSV

SEQ ID NO: 1274219 - protein, 9 aa, Homo Sapiens
AVSAYSSAP

SEQ ID NO: 1274220 - protein, 9 aa, Homo Sapiens
QSVFPADYN

SEQ ID NO: 1274221 - protein, 9 aa, Homo Sapiens
IEQTRDIVK

SEQ ID NO: 1274222 - protein, 9 aa, Homo Sapiens
LAFLVIVIS

SEQ ID NO: 1274223 - protein, 9 aa, Homo Sapiens
MTAKKKAQL

SEQ ID NO: 1274224 - protein, 9 aa, Homo Sapiens
ALFSAHHQP

SEQ ID NO: 1274225 - protein, 9 aa, Homo Sapiens
KGLQSVFPA

SEQ ID NO: 1274226 - protein, 9 aa, Homo Sapiens
MCEVPCGGN

SEQ ID NO: 1274227 - protein, 9 aa, Homo Sapiens
YIHTHTFYV

SEQ ID NO: 1274228 - protein, 9 aa, Homo Sapiens
LAPGAVSAY

SEQ ID NO: 1274229 - protein, 9 aa, Homo Sapiens
DRMINVEFS

SEQ ID NO: 1274230 - protein, 9 aa, Homo Sapiens
RRLVHQDLA

SEQ ID NO: 1274231 - protein, 9 aa, Homo Sapiens
SELAISLPP

SEQ ID NO: 1274232 - protein, 9 aa, Homo Sapiens
LHTAKNMAN

SEQ ID NO: 1274233 - protein, 9 aa, Homo Sapiens
FDVDVPSGV

SEQ ID NO: 1274234 - protein, 9 aa, Homo Sapiens
GEKGEQGRA

SEQ ID NO: 1274235 - protein, 9 aa, Homo Sapiens
RDRMINVEF

SEQ ID NO: 1274236 - protein, 9 aa, Homo Sapiens
RNWDHPLPM

SEQ ID NO: 1274237 - protein, 9 aa, Homo Sapiens
QCTFFFLHK

SEQ ID NO: 1274238 - protein, 9 aa, Homo Sapiens
GDVGKSALT

SEQ ID NO: 1274239 - protein, 9 aa, Homo Sapiens
HTAKNMANL

SEQ ID NO: 1274240 - protein, 9 aa, Homo Sapiens
KAQLHFAAE

SEQ ID NO: 1274241 - protein, 9 aa, Homo Sapiens
VSPEPRSFT

SEQ ID NO: 1274242 - protein, 9 aa, Homo Sapiens
FPQCTFFFL

SEQ ID NO: 1274243 - protein, 9 aa, Homo Sapiens
EERRLVHQD

SEQ ID NO: 1274244 - protein, 9 aa, Homo Sapiens
LELQRRLPQ

SEQ ID NO: 1274245 - protein, 9 aa, Homo Sapiens
APPLPPTGD

SEQ ID NO: 1274246 - protein, 9 aa, Homo Sapiens
QGRAGELGE

SEQ ID NO: 1274247 - protein, 9 aa, Homo Sapiens
ESTSSSGKK

SEQ ID NO: 1274248 - protein, 9 aa, Homo Sapiens
CPGVTEATI

SEQ ID NO: 1274249 - protein, 9 aa, Homo Sapiens
IHQSYQELV

SEQ ID NO: 1274250 - protein, 9 aa, Homo Sapiens
VVAYSENDE

SEQ ID NO: 1274251 - protein, 9 aa, Homo Sapiens
SFKKNFGTY

SEQ ID NO: 1274252 - protein, 9 aa, Homo Sapiens
LKLTDVTKV

SEQ ID NO: 1274253 - protein, 9 aa, Homo Sapiens
LESTSSSGK

SEQ ID NO: 1274254 - protein, 9 aa, Homo Sapiens
STSSSGKKS

SEQ ID NO: 1274255 - protein, 9 aa, Homo Sapiens
SKGEKGEQG

SEQ ID NO: 1274256 - protein, 9 aa, Homo Sapiens
HSVVVPCEP

SEQ ID NO: 1274257 - protein, 9 aa, Homo Sapiens
SIPMPSQAY

SEQ ID NO: 1274258 - protein, 9 aa, Homo Sapiens
IEPVREEKI

SEQ ID NO: 1274259 - protein, 9 aa, Homo Sapiens
SVGQVSPEP

SEQ ID NO: 1274260 - protein, 9 aa, Homo Sapiens
DDYSWWDPF

SEQ ID NO: 1274261 - protein, 9 aa, Homo Sapiens
EPDDVRACL

SEQ ID NO: 1274262 - protein, 9 aa, Homo Sapiens
DDVRACLIS

SEQ ID NO: 1274263 - protein, 9 aa, Homo Sapiens
PLPPTGDAG

SEQ ID NO: 1274264 - protein, 9 aa, Homo Sapiens
RQDVDNASV

SEQ ID NO: 1274265 - protein, 9 aa, Homo Sapiens
RPMTAKKKA

SEQ ID NO: 1274266 - protein, 9 aa, Homo Sapiens
KVIEPVREE

SEQ ID NO: 1274267 - protein, 9 aa, Homo Sapiens
AQLHFAAES

SEQ ID NO: 1274268 - protein, 9 aa, Homo Sapiens
HGFTRKSVR

SEQ ID NO: 1274269 - protein, 9 aa, Homo Sapiens
IIIGALFSA

SEQ ID NO: 1274270 - protein, 9 aa, Homo Sapiens
PVFPATQSN

SEQ ID NO: 1274271 - protein, 9 aa, Homo Sapiens
LHFAAESII

SEQ ID NO: 1274272 - protein, 9 aa, Homo Sapiens
AEWLTLGIN

SEQ ID NO: 1274273 - protein, 9 aa, Homo Sapiens
IPMPSQAYS

SEQ ID NO: 1274274 - protein, 9 aa, Homo Sapiens
CLVIVQGHL

SEQ ID NO: 1274275 - protein, 9 aa, Homo Sapiens
TRDRMINVE

SEQ ID NO: 1274276 - protein, 9 aa, Homo Sapiens
RRLPQPPGP

SEQ ID NO: 1274277 - protein, 9 aa, Homo Sapiens
PMTAKKKAQ

SEQ ID NO: 1274278 - protein, 9 aa, Homo Sapiens
SCSIPMPSQ

SEQ ID NO: 1274279 - protein, 9 aa, Homo Sapiens
LTDVTKVRT

SEQ ID NO: 1274280 - protein, 9 aa, Homo Sapiens
LVIVISSFL

SEQ ID NO: 1274281 - protein, 9 aa, Homo Sapiens
SADEKRYQA

SEQ ID NO: 1274282 - protein, 9 aa, Homo Sapiens
HIYIHTHTF

SEQ ID NO: 1274283 - protein, 9 aa, Homo Sapiens
EKGEQGRAG

SEQ ID NO: 1274284 - protein, 9 aa, Homo Sapiens
ALFPPSSKP

SEQ ID NO: 1274285 - protein, 9 aa, Homo Sapiens
SSFLTKEVF

SEQ ID NO: 1274286 - protein, 9 aa, Homo Sapiens
KGEKGEQGR

SEQ ID NO: 1274287 - protein, 9 aa, Homo Sapiens
FLKVIEPVR

SEQ ID NO: 1274288 - protein, 9 aa, Homo Sapiens
GPLRFSVRA

SEQ ID NO: 1274289 - protein, 9 aa, Homo Sapiens
RLPQPPGPL

SEQ ID NO: 1274290 - protein, 9 aa, Homo Sapiens
GGGDVGKSA

SEQ ID NO: 1274291 - protein, 9 aa, Homo Sapiens
PPVFPATQS

SEQ ID NO: 1274292 - protein, 9 aa, Homo Sapiens
ETSFKKNFG

SEQ ID NO: 1274293 - protein, 9 aa, Homo Sapiens
ITRDRMINV

SEQ ID NO: 1274294 - protein, 9 aa, Homo Sapiens
EVVPRPCPG

SEQ ID NO: 1274295 - protein, 9 aa, Homo Sapiens
QPPGPLRFS

SEQ ID NO: 1274296 - protein, 9 aa, Homo Sapiens
FCLVIVQGH

SEQ ID NO: 1274297 - protein, 9 aa, Homo Sapiens
IYTHIYIHT

SEQ ID NO: 1274298 - protein, 9 aa, Homo Sapiens
KDGVHGLLL

SEQ ID NO: 1274299 - protein, 9 aa, Homo Sapiens
SLYKGLQSV

SEQ ID NO: 1274300 - protein, 9 aa, Homo Sapiens
SSGKKSKRN

SEQ ID NO: 1274301 - protein, 9 aa, Homo Sapiens
FLELQRRLP

SEQ ID NO: 1274302 - protein, 9 aa, Homo Sapiens
ELQRRLPQP

SEQ ID NO: 1274303 - protein, 9 aa, Homo Sapiens
SKVEFDVDV

SEQ ID NO: 1274304 - protein, 9 aa, Homo Sapiens
SENDEIVGL

SEQ ID NO: 1274305 - protein, 9 aa, Homo Sapiens
FSAHHQPTV

SEQ ID NO: 1274306 - protein, 9 aa, Homo Sapiens
AISASEKVH

SEQ ID NO: 1274307 - protein, 9 aa, Homo Sapiens
SLKLTDVTK

SEQ ID NO: 1274308 - protein, 9 aa, Homo Sapiens
DDDYSWWDP

SEQ ID NO: 1274309 - protein, 9 aa, Homo Sapiens
WSLVKPENY

SEQ ID NO: 1274310 - protein, 9 aa, Homo Sapiens
ILRLLHTAK

SEQ ID NO: 1274311 - protein, 9 aa, Homo Sapiens
QVVWSLVKP

SEQ ID NO: 1274312 - protein, 9 aa, Homo Sapiens
ALSREALVH

SEQ ID NO: 1274313 - protein, 9 aa, Homo Sapiens
NEEIHQSYQ

SEQ ID NO: 1274314 - protein, 9 aa, Homo Sapiens
APGAVSAYS

SEQ ID NO: 1274315 - protein, 9 aa, Homo Sapiens
QDVDNASVA

SEQ ID NO: 1274316 - protein, 9 aa, Homo Sapiens
YTHIYIHTH

SEQ ID NO: 1274317 - protein, 9 aa, Homo Sapiens
SASGQPQET

SEQ ID NO: 1274318 - protein, 9 aa, Homo Sapiens
VREEKILNR

SEQ ID NO: 1274319 - protein, 9 aa, Homo Sapiens
GDSGAPPLP

SEQ ID NO: 1274320 - protein, 9 aa, Homo Sapiens
HFAAESIII

SEQ ID NO: 1274321 - protein, 9 aa, Homo Sapiens
PEPALFPPS

SEQ ID NO: 1274322 - protein, 9 aa, Homo Sapiens
CNVIGNNLK

SEQ ID NO: 1274323 - protein, 9 aa, Homo Sapiens
FKKNFGTYT

SEQ ID NO: 1274324 - protein, 9 aa, Homo Sapiens
ATQSNLFIA

SEQ ID NO: 1274325 - protein, 9 aa, Homo Sapiens
STLLVFGVW

SEQ ID NO: 1274326 - protein, 9 aa, Homo Sapiens
EYSLKLTDV

SEQ ID NO: 1274327 - protein, 9 aa, Homo Sapiens
NRASVGQVS

SEQ ID NO: 1274328 - protein, 9 aa, Homo Sapiens
VIGNNLKDL

SEQ ID NO: 1274329 - protein, 9 aa, Homo Sapiens
QALKRTAER

SEQ ID NO: 1274330 - protein, 9 aa, Homo Sapiens
EKVHGFTRK

SEQ ID NO: 1274331 - protein, 9 aa, Homo Sapiens
DVDNASVAR

SEQ ID NO: 1274332 - protein, 9 aa, Homo Sapiens
LVVVGGGDV

SEQ ID NO: 1274333 - protein, 9 aa, Homo Sapiens
ISSFLTKEV

SEQ ID NO: 1274334 - protein, 9 aa, Homo Sapiens
VFPATQSNL

SEQ ID NO: 1274335 - protein, 9 aa, Homo Sapiens
AISLPPEPA

SEQ ID NO: 1274336 - protein, 9 aa, Homo Sapiens
VGQVSPEPR

SEQ ID NO: 1274337 - protein, 9 aa, Homo Sapiens
ASVARLDLE

SEQ ID NO: 1274338 - protein, 9 aa, Homo Sapiens
GAVSAYSSA

SEQ ID NO: 1274339 - protein, 9 aa, Homo Sapiens
LKSTLLVFG

SEQ ID NO: 1274340 - protein, 9 aa, Homo Sapiens
SGAPPLPPT

SEQ ID NO: 1274341 - protein, 9 aa, Homo Sapiens
LLFSCRASE

SEQ ID NO: 1274342 - protein, 9 aa, Homo Sapiens
LPQPPGPLR

SEQ ID NO: 1274343 - protein, 9 aa, Homo Sapiens
ETESKIEQT

SEQ ID NO: 1274344 - protein, 9 aa, Homo Sapiens
REALVHVLV

SEQ ID NO: 1274345 - protein, 9 aa, Homo Sapiens
EPALFPPSS

SEQ ID NO: 1274346 - protein, 9 aa, Homo Sapiens
FLVIVISSF

SEQ ID NO: 1274347 - protein, 9 aa, Homo Sapiens
EPVREEKIL

SEQ ID NO: 1274348 - protein, 9 aa, Homo Sapiens
HSNILRLLH

SEQ ID NO: 1274349 - protein, 9 aa, Homo Sapiens
RASVGQVSP

SEQ ID NO: 1274350 - protein, 9 aa, Homo Sapiens
EKRYQALKR

SEQ ID NO: 1274351 - protein, 9 aa, Homo Sapiens
CSEYSLKLT

SEQ ID NO: 1274352 - protein, 9 aa, Homo Sapiens
VTQKFCLVI

SEQ ID NO: 1274353 - protein, 9 aa, Homo Sapiens
RLVHQDLAA

SEQ ID NO: 1274354 - protein, 9 aa, Homo Sapiens
ASELAISLP

SEQ ID NO: 1274355 - protein, 9 aa, Homo Sapiens
VIVISSFLT

SEQ ID NO: 1274356 - protein, 9 aa, Homo Sapiens
IAYKDGVHG

SEQ ID NO: 1274357 - protein, 9 aa, Homo Sapiens
IYIHTHTFY

SEQ ID NO: 1274358 - protein, 9 aa, Homo Sapiens
PLRFSVRAS

SEQ ID NO: 1274359 - protein, 9 aa, Homo Sapiens
NGMMEPDDV

SEQ ID NO: 1274360 - protein, 9 aa, Homo Sapiens
GKKSKRNEE

SEQ ID NO: 1274361 - protein, 9 aa, Homo Sapiens
EIHQSYQEL

SEQ ID NO: 1274362 - protein, 9 aa, Homo Sapiens
DVDVPSGVV

SEQ ID NO: 1274363 - protein, 9 aa, Homo Sapiens
KERCLQVVW

SEQ ID NO: 1274364 - protein, 9 aa, Homo Sapiens
HQSYQELVK

SEQ ID NO: 1274365 - protein, 9 aa, Homo Sapiens
SVARLDLER

SEQ ID NO: 1274366 - protein, 9 aa, Homo Sapiens
CLQVVWSLV

SEQ ID NO: 1274367 - protein, 9 aa, Homo Sapiens
LPMCEVPCG

SEQ ID NO: 1274368 - protein, 9 aa, Homo Sapiens
DEKRYQALK

SEQ ID NO: 1274369 - protein, 9 aa, Homo Sapiens
FSVRASELA

SEQ ID NO: 1274370 - protein, 9 aa, Homo Sapiens
KDILKSTLL

SEQ ID NO: 1274371 - protein, 9 aa, Homo Sapiens
DVGKSALTI

SEQ ID NO: 1274372 - protein, 9 aa, Homo Sapiens
MINVEFSCA

SEQ ID NO: 1274373 - protein, 9 aa, Homo Sapiens
QRRLPQPPG

SEQ ID NO: 1274374 - protein, 9 aa, Homo Sapiens
VVPRPCPGV

SEQ ID NO: 1274375 - protein, 9 aa, Homo Sapiens
LLLKDILKS

SEQ ID NO: 1274376 - protein, 9 aa, Homo Sapiens
KIEQTRDIV

SEQ ID NO: 1274377 - protein, 9 aa, Homo Sapiens
SAHHQPTVD

SEQ ID NO: 1274378 - protein, 9 aa, Homo Sapiens
YIYTHIYIH

SEQ ID NO: 1274379 - protein, 9 aa, Homo Sapiens
VEETESKIE

SEQ ID NO: 1274380 - protein, 9 aa, Homo Sapiens
PATQSNLFI

SEQ ID NO: 1274381 - protein, 9 aa, Homo Sapiens
DFLELQRRL

SEQ ID NO: 1274382 - protein, 9 aa, Homo Sapiens
KEKVTQKFC

SEQ ID NO: 1274383 - protein, 9 aa, Homo Sapiens
LEERRLVHQ

SEQ ID NO: 1274384 - protein, 9 aa, Homo Sapiens
NVIGNNLKD

SEQ ID NO: 1274385 - protein, 9 aa, Homo Sapiens
QQERREQEE

SEQ ID NO: 1274386 - protein, 9 aa, Homo Sapiens
YSKCNVIGN

SEQ ID NO: 1274387 - protein, 9 aa, Homo Sapiens
PPSSKPDPG

SEQ ID NO: 1274388 - protein, 9 aa, Homo Sapiens
TSSSGKKSK

SEQ ID NO: 1274389 - protein, 9 aa, Homo Sapiens
NILRLLHTA

SEQ ID NO: 1274390 - protein, 9 aa, Homo Sapiens
DNASVARLD

SEQ ID NO: 1274391 - protein, 9 aa, Homo Sapiens
DHPLPMCEV

SEQ ID NO: 1274392 - protein, 9 aa, Homo Sapiens
AYSENDEIV

SEQ ID NO: 1274393 - protein, 9 aa, Homo Sapiens
VVGGGDVGK

SEQ ID NO: 1274394 - protein, 9 aa, Homo Sapiens
AKKKAQLHF

SEQ ID NO: 1274395 - protein, 9 aa, Homo Sapiens
KRYQALKRT

SEQ ID NO: 1274396 - protein, 9 aa, Homo Sapiens
GGDVGKSAL

SEQ ID NO: 1274397 - protein, 9 aa, Homo Sapiens
LFSAHHQPT

SEQ ID NO: 1274398 - protein, 9 aa, Homo Sapiens
CEPPEVGSD

SEQ ID NO: 1274399 - protein, 9 aa, Homo Sapiens
LKDILKSTL

SEQ ID NO: 1274400 - protein, 9 aa, Homo Sapiens
SSADEKRYQ

SEQ ID NO: 1274401 - protein, 9 aa, Homo Sapiens
PVREEKILN

SEQ ID NO: 1274402 - protein, 9 aa, Homo Sapiens
LYSKCNVIG

SEQ ID NO: 1274403 - protein, 9 aa, Homo Sapiens
ESKIEQTRD

SEQ ID NO: 1274404 - protein, 9 aa, Homo Sapiens
IIGALFSAH

SEQ ID NO: 1274405 - protein, 9 aa, Homo Sapiens
VPRPCPGVT

SEQ ID NO: 1274406 - protein, 9 aa, Homo Sapiens
HPLPMCEVP

SEQ ID NO: 1274407 - protein, 9 aa, Homo Sapiens
RCLQVVWSL

SEQ ID NO: 1274408 - protein, 9 aa, Homo Sapiens
LVHVLVLDA

SEQ ID NO: 1274409 - protein, 9 aa, Homo Sapiens
VWSLVKPEN

SEQ ID NO: 1274410 - protein, 9 aa, Homo Sapiens
LPPTGDAGP

SEQ ID NO: 1274411 - protein, 9 aa, Homo Sapiens
ENDEIVGLA

SEQ ID NO: 1274412 - protein, 9 aa, Homo Sapiens
LQSVFPADY

SEQ ID NO: 1274413 - protein, 9 aa, Homo Sapiens
LKVIEPVRE

SEQ ID NO: 1274414 - protein, 9 aa, Homo Sapiens
PPGPLRFSV

SEQ ID NO: 1274415 - protein, 9 aa, Homo Sapiens
TNEEIHQSY

SEQ ID NO: 1274416 - protein, 9 aa, Homo Sapiens
TLGINMPLL

SEQ ID NO: 1274417 - protein, 9 aa, Homo Sapiens
PDPSLVYRS

SEQ ID NO: 1274418 - protein, 9 aa, Homo Sapiens
WWDPFMKIC

SEQ ID NO: 1274419 - protein, 9 aa, Homo Sapiens
KVEFDVDVP

SEQ ID NO: 1274420 - protein, 9 aa, Homo Sapiens
VISSFLTKE

SEQ ID NO: 1274421 - protein, 9 aa, Homo Sapiens
RMINVEFSC

SEQ ID NO: 1274422 - protein, 9 aa, Homo Sapiens
PSSKPDPGL

SEQ ID NO: 1274423 - protein, 9 aa, Homo Sapiens
VRASELAIS

SEQ ID NO: 1274424 - protein, 9 aa, Homo Sapiens
GSKGEKGEQ

SEQ ID NO: 1274425 - protein, 9 aa, Homo Sapiens
PAPLAPGAV

SEQ ID NO: 1274426 - protein, 9 aa, Homo Sapiens
TGDSGAPPL

SEQ ID NO: 1274427 - protein, 9 aa, Homo Sapiens
KSTLLVFGV

SEQ ID NO: 1274428 - protein, 9 aa, Homo Sapiens
LVYRSDVDP

SEQ ID NO: 1274429 - protein, 9 aa, Homo Sapiens
RLVVVGGGD

SEQ ID NO: 1274430 - protein, 9 aa, Homo Sapiens
GQVSPEPRS

SEQ ID NO: 1274431 - protein, 9 aa, Homo Sapiens
KLTDVTKVR

SEQ ID NO: 1274432 - protein, 9 aa, Homo Sapiens
TNRASVGQV

SEQ ID NO: 1274433 - protein, 9 aa, Homo Sapiens
GLLLTVITW

SEQ ID NO: 1274434 - protein, 9 aa, Homo Sapiens
VVVGGGDVG

SEQ ID NO: 1274435 - protein, 9 aa, Homo Sapiens
GAPPLPPTG

SEQ ID NO: 1274436 - protein, 9 aa, Homo Sapiens
VVVPCEPPE

SEQ ID NO: 1274437 - protein, 9 aa, Homo Sapiens
VIEPVREEK

SEQ ID NO: 1274438 - protein, 9 aa, Homo Sapiens
NLLFSCRAS

SEQ ID NO: 1274439 - protein, 9 aa, Homo Sapiens
TPTSSSCSI

SEQ ID NO: 1274440 - protein, 9 aa, Homo Sapiens
LRLLHTAKN

SEQ ID NO: 1274441 - protein, 9 aa, Homo Sapiens
SVVVPCEPP

SEQ ID NO: 1274442 - protein, 9 aa, Homo Sapiens
QKFCLVIVQ

SEQ ID NO: 1274443 - protein, 9 aa, Homo Sapiens
LGINMPLLA

SEQ ID NO: 1274444 - protein, 9 aa, Homo Sapiens
KVTQKFCLV

SEQ ID NO: 1274445 - protein, 9 aa, Homo Sapiens
VDNASVARL

SEQ ID NO: 1274446 - protein, 9 aa, Homo Sapiens
DVEETESKI

SEQ ID NO: 1274447 - protein, 9 aa, Homo Sapiens
TAKKKAQLH

SEQ ID NO: 1274448 - protein, 9 aa, Homo Sapiens
VEFDVDVPS

SEQ ID NO: 1274449 - protein, 9 aa, Homo Sapiens
EETESKIEQ

SEQ ID NO: 1274450 - protein, 9 aa, Homo Sapiens
SNLFIAESR

SEQ ID NO: 1274451 - protein, 9 aa, Homo Sapiens
GNIITRDRM

SEQ ID NO: 1274452 - protein, 9 aa, Homo Sapiens
YRSDVDPEV

SEQ ID NO: 1274453 - protein, 9 aa, Homo Sapiens
IHTHTFYVS

SEQ ID NO: 1274454 - protein, 9 aa, Homo Sapiens
ADEKRYQAL

SEQ ID NO: 1274455 - protein, 9 aa, Homo Sapiens
TSSSCSIPM

SEQ ID NO: 1274456 - protein, 9 aa, Homo Sapiens
YSENDEIVG

SEQ ID NO: 1274457 - protein, 9 aa, Homo Sapiens
SKCNVIGNN

SEQ ID NO: 1274458 - protein, 9 aa, Homo Sapiens
HVLVLDAND

SEQ ID NO: 1274459 - protein, 9 aa, Homo Sapiens
VDVPSGVVM

SEQ ID NO: 1274460 - protein, 9 aa, Homo Sapiens
LVHQDLAAR

SEQ ID NO: 1274461 - protein, 9 aa, Homo Sapiens
KVHGFTRKS

SEQ ID NO: 1274462 - protein, 9 aa, Homo Sapiens
SSSGKKSKR

SEQ ID NO: 1274463 - protein, 9 aa, Homo Sapiens
LLKDILKST

SEQ ID NO: 1274464 - protein, 9 aa, Homo Sapiens
ISLQSASGQ

SEQ ID NO: 1274465 - protein, 9 aa, Homo Sapiens
SVRASELAI

SEQ ID NO: 1274466 - protein, 9 aa, Homo Sapiens
RYQALKRTA

SEQ ID NO: 1274467 - protein, 9 aa, Homo Sapiens
YKDGVHGLL

SEQ ID NO: 1274468 - protein, 9 aa, Homo Sapiens
VHVLVLDAN

SEQ ID NO: 1274469 - protein, 9 aa, Homo Sapiens
QSASGQPQE

SEQ ID NO: 1274470 - protein, 9 aa, Homo Sapiens
SSSCSIPMP

SEQ ID NO: 1274471 - protein, 9 aa, Homo Sapiens
PQCTFFFLH

SEQ ID NO: 1274472 - protein, 9 aa, Homo Sapiens
SLPPEPALF

SEQ ID NO: 1274473 - protein, 9 aa, Homo Sapiens
IGALFSAHH

SEQ ID NO: 1274474 - protein, 9 aa, Homo Sapiens
SLYSKCNVI

SEQ ID NO: 1274475 - protein, 9 aa, Homo Sapiens
NDEIVGLAA

SEQ ID NO: 1274476 - protein, 9 aa, Homo Sapiens
RASELAISL

SEQ ID NO: 1274477 - protein, 9 aa, Homo Sapiens
REVVPRPCP

SEQ ID NO: 1274478 - protein, 9 aa, Homo Sapiens
LQVVWSLVK

SEQ ID NO: 1274479 - protein, 9 aa, Homo Sapiens
NASVARLDL

SEQ ID NO: 1274480 - protein, 9 aa, Homo Sapiens
ENETSFKKN

SEQ ID NO: 1274481 - protein, 9 aa, Homo Sapiens
PREVVPRPC

SEQ ID NO: 1274482 - protein, 9 aa, Homo Sapiens
DVRACLISM

SEQ ID NO: 1274483 - protein, 9 aa, Homo Sapiens
CRASEFPGP

SEQ ID NO: 1274484 - protein, 9 aa, Homo Sapiens
PGPLRFSVR

SEQ ID NO: 1274485 - protein, 9 aa, Homo Sapiens
IGNNLKDLV

SEQ ID NO: 1274486 - protein, 9 aa, Homo Sapiens
ASEKVHGFT

SEQ ID NO: 1274487 - protein, 9 aa, Homo Sapiens
CSIPMPSQA

SEQ ID NO: 1274488 - protein, 9 aa, Homo Sapiens
GEQGRAGEL

SEQ ID NO: 1274489 - protein, 9 aa, Homo Sapiens
QDLAARNVL

SEQ ID NO: 1274490 - protein, 9 aa, Homo Sapiens
ERREQEERR

SEQ ID NO: 1274491 - protein, 9 aa, Homo Sapiens
SGQPQETAQ

SEQ ID NO: 1274492 - protein, 9 aa, Homo Sapiens
SKIEQTRDI

SEQ ID NO: 1274493 - protein, 9 aa, Homo Sapiens
LRFSVRASE

SEQ ID NO: 1274494 - protein, 9 aa, Homo Sapiens
HQDLAARNV

SEQ ID NO: 1274495 - protein, 9 aa, Homo Sapiens
SGKKSKRNE

SEQ ID NO: 1274496 - protein, 9 aa, Homo Sapiens
QSNLFIAES

SEQ ID NO: 1274497 - protein, 9 aa, Homo Sapiens
KKKAQLHFA

SEQ ID NO: 1274498 - protein, 9 aa, Homo Sapiens
TESKIEQTR

SEQ ID NO: 1274499 - protein, 9 aa, Homo Sapiens
SREALVHVL

SEQ ID NO: 1274500 - protein, 9 aa, Homo Sapiens
GVHGLLLTV

SEQ ID NO: 1274501 - protein, 9 aa, Homo Sapiens
VAYSENDEI

SEQ ID NO: 1274502 - protein, 9 aa, Homo Sapiens
DYSWWDPFM

SEQ ID NO: 1274503 - protein, 9 aa, Homo Sapiens
PPLPPTGDA

SEQ ID NO: 1274504 - protein, 9 aa, Homo Sapiens
GALFSAHHQ

SEQ ID NO: 1274505 - protein, 9 aa, Homo Sapiens
SASEKVHGF

SEQ ID NO: 1274506 - protein, 9 aa, Homo Sapiens
LTLGINMPL

SEQ ID NO: 1274507 - protein, 9 aa, Homo Sapiens
WDHPLPMCE

SEQ ID NO: 1274508 - protein, 9 aa, Homo Sapiens
LFSCRASEF

SEQ ID NO: 1274509 - protein, 9 aa, Homo Sapiens
EKSLYKGLQ

SEQ ID NO: 1274510 - protein, 9 aa, Homo Sapiens
VPCEPPEVG

SEQ ID NO: 1274511 - protein, 9 aa, Homo Sapiens
HGLLLTVIT

SEQ ID NO: 1274512 - protein, 9 aa, Homo Sapiens
MMEPDDVRA

SEQ ID NO: 1274513 - protein, 9 aa, Homo Sapiens
PCEPPEVGS

SEQ ID NO: 1274514 - protein, 9 aa, Homo Sapiens
SDVDPEVAK

SEQ ID NO: 1274515 - protein, 9 aa, Homo Sapiens
LPPEPALFP

SEQ ID NO: 1274516 - protein, 9 aa, Homo Sapiens
GMMEPDDVR

SEQ ID NO: 1274517 - protein, 9 aa, Homo Sapiens
IVISSFLTK

SEQ ID NO: 1274518 - protein, 9 aa, Homo Sapiens
LLHTAKNMA

SEQ ID NO: 1274519 - protein, 9 aa, Homo Sapiens
ISASEKVHG

SEQ ID NO: 1274520 - protein, 9 aa, Homo Sapiens
AFLVIVISS

SEQ ID NO: 1274521 - protein, 9 aa, Homo Sapiens
PQPPGPLRF

SEQ ID NO: 1274522 - protein, 9 aa, Homo Sapiens
ATNEEIHQS

SEQ ID NO: 1274523 - protein, 9 aa, Homo Sapiens
DGVHGLLLT

SEQ ID NO: 1274524 - protein, 9 aa, Homo Sapiens
THIYIHTHT

SEQ ID NO: 1274525 - protein, 9 aa, Homo Sapiens
CISLQSASG

SEQ ID NO: 1274526 - protein, 9 aa, Homo Sapiens
YSLKLTDVT

SEQ ID NO: 1274527 - protein, 9 aa, Homo Sapiens
EQGRAGELG

SEQ ID NO: 1274528 - protein, 9 aa, Homo Sapiens
SSKPDPGLF

SEQ ID NO: 1274529 - protein, 9 aa, Homo Sapiens
VARLDLERK

SEQ ID NO: 1274530 - protein, 9 aa, Homo Sapiens
DILKSTLLV

SEQ ID NO: 1274531 - protein, 9 aa, Homo Sapiens
RPCPGVTEA

SEQ ID NO: 1274532 - protein, 9 aa, Homo Sapiens
VRACLISMG

SEQ ID NO: 1274533 - protein, 9 aa, Homo Sapiens
INLLFSCRA

SEQ ID NO: 1274534 - protein, 9 aa, Homo Sapiens
SHINLLFSC

SEQ ID NO: 1274535 - protein, 9 aa, Homo Sapiens
FFLHKEFLL

SEQ ID NO: 1274536 - protein, 9 aa, Homo Sapiens
HRNFRLLEE

SEQ ID NO: 1274537 - protein, 9 aa, Homo Sapiens
CTVGRLCIS

SEQ ID NO: 1274538 - protein, 9 aa, Homo Sapiens
MFKNGEPSG

SEQ ID NO: 1274539 - protein, 9 aa, Homo Sapiens
VSRCKALKE

SEQ ID NO: 1274540 - protein, 9 aa, Homo Sapiens
WEGPLRLQQ

SEQ ID NO: 1274541 - protein, 9 aa, Homo Sapiens
EILNREIGF

SEQ ID NO: 1274542 - protein, 9 aa, Homo Sapiens
RLCALYAGF

SEQ ID NO: 1274543 - protein, 9 aa, Homo Sapiens
HRVLLFFQM

SEQ ID NO: 1274544 - protein, 9 aa, Homo Sapiens
ANADLLNWT

SEQ ID NO: 1274545 - protein, 9 aa, Homo Sapiens
MPHSPGLPA

SEQ ID NO: 1274546 - protein, 9 aa, Homo Sapiens
AGFSLLQQL

SEQ ID NO: 1274547 - protein, 9 aa, Homo Sapiens
FSLLQQLTK

SEQ ID NO: 1274548 - protein, 9 aa, Homo Sapiens
AAAALSVSR

SEQ ID NO: 1274549 - protein, 9 aa, Homo Sapiens
GKAFYCSSH

SEQ ID NO: 1274550 - protein, 9 aa, Homo Sapiens
VQMLEDGQC

SEQ ID NO: 1274551 - protein, 9 aa, Homo Sapiens
CELCTEDFD

SEQ ID NO: 1274552 - protein, 9 aa, Homo Sapiens
HMRKHPELA

SEQ ID NO: 1274553 - protein, 9 aa, Homo Sapiens
PLRTRLGSL

SEQ ID NO: 1274554 - protein, 9 aa, Homo Sapiens
RAKQRHNIM

SEQ ID NO: 1274555 - protein, 9 aa, Homo Sapiens
AAALSVSRC

SEQ ID NO: 1274556 - protein, 9 aa, Homo Sapiens
FLQILISYG

SEQ ID NO: 1274557 - protein, 9 aa, Homo Sapiens
AKQRHNIML

SEQ ID NO: 1274558 - protein, 9 aa, Homo Sapiens
VGMISIHWE

SEQ ID NO: 1274559 - protein, 9 aa, Homo Sapiens
KWCHYEFYF

SEQ ID NO: 1274560 - protein, 9 aa, Homo Sapiens
MRELEAQVH

SEQ ID NO: 1274561 - protein, 9 aa, Homo Sapiens
GVKVHRNFR

SEQ ID NO: 1274562 - protein, 9 aa, Homo Sapiens
KFSQVLDQF

SEQ ID NO: 1274563 - protein, 9 aa, Homo Sapiens
EAAQKDPGC

SEQ ID NO: 1274564 - protein, 9 aa, Homo Sapiens
LKLTSLCFI

SEQ ID NO: 1274565 - protein, 9 aa, Homo Sapiens
SKQSKLQDP

SEQ ID NO: 1274566 - protein, 9 aa, Homo Sapiens
ETSLMPHSP

SEQ ID NO: 1274567 - protein, 9 aa, Homo Sapiens
VKVHRNFRL

SEQ ID NO: 1274568 - protein, 9 aa, Homo Sapiens
AFLKLTSLC

SEQ ID NO: 1274569 - protein, 9 aa, Homo Sapiens
DLLNWTWSR

SEQ ID NO: 1274570 - protein, 9 aa, Homo Sapiens
RRRVEAAQK

SEQ ID NO: 1274571 - protein, 9 aa, Homo Sapiens
IKIETTSNK

SEQ ID NO: 1274572 - protein, 9 aa, Homo Sapiens
FVQNKWCHY

SEQ ID NO: 1274573 - protein, 9 aa, Homo Sapiens
EDEEFCELC

SEQ ID NO: 1274574 - protein, 9 aa, Homo Sapiens
SQVLDQFGE

SEQ ID NO: 1274575 - protein, 9 aa, Homo Sapiens
NREEEILNR

SEQ ID NO: 1274576 - protein, 9 aa, Homo Sapiens
VHMRKHPEL

SEQ ID NO: 1274577 - protein, 9 aa, Homo Sapiens
SENSHQDRP

SEQ ID NO: 1274578 - protein, 9 aa, Homo Sapiens
CSSHLIGHR

SEQ ID NO: 1274579 - protein, 9 aa, Homo Sapiens
IHWEGPLRL

SEQ ID NO: 1274580 - protein, 9 aa, Homo Sapiens
YMLQGVAQL

SEQ ID NO: 1274581 - protein, 9 aa, Homo Sapiens
DLLCPGAEH

SEQ ID NO: 1274582 - protein, 9 aa, Homo Sapiens
RYMFKNGEP

SEQ ID NO: 1274583 - protein, 9 aa, Homo Sapiens
KAYSKGFQE

SEQ ID NO: 1274584 - protein, 9 aa, Homo Sapiens
LAKFSQVLD

SEQ ID NO: 1274585 - protein, 9 aa, Homo Sapiens
VYGSVKRLG

SEQ ID NO: 1274586 - protein, 9 aa, Homo Sapiens
TSFLQILIS

SEQ ID NO: 1274587 - protein, 9 aa, Homo Sapiens
LCISVARYH

SEQ ID NO: 1274588 - protein, 9 aa, Homo Sapiens
PHSPGLPAL

SEQ ID NO: 1274589 - protein, 9 aa, Homo Sapiens
ARMEEKAYS

SEQ ID NO: 1274590 - protein, 9 aa, Homo Sapiens
ALSSVIKEF

SEQ ID NO: 1274591 - protein, 9 aa, Homo Sapiens
KNGEPSGHK

SEQ ID NO: 1274592 - protein, 9 aa, Homo Sapiens
DECGKAFYC

SEQ ID NO: 1274593 - protein, 9 aa, Homo Sapiens
LAQPLRTRL

SEQ ID NO: 1274594 - protein, 9 aa, Homo Sapiens
NKVESSSES

SEQ ID NO: 1274595 - protein, 9 aa, Homo Sapiens
DKRWRQMVF

SEQ ID NO: 1274596 - protein, 9 aa, Homo Sapiens
KKDVHMRKH

SEQ ID NO: 1274597 - protein, 9 aa, Homo Sapiens
YVINGKRKQ

SEQ ID NO: 1274598 - protein, 9 aa, Homo Sapiens
LCALYAGFS

SEQ ID NO: 1274599 - protein, 9 aa, Homo Sapiens
LIDKRWRQM

SEQ ID NO: 1274600 - protein, 9 aa, Homo Sapiens
NTLSVYGSV

SEQ ID NO: 1274601 - protein, 9 aa, Homo Sapiens
KPSKQSKLQ

SEQ ID NO: 1274602 - protein, 9 aa, Homo Sapiens
FSQVLDQFG

SEQ ID NO: 1274603 - protein, 9 aa, Homo Sapiens
AAQKDPGCS

SEQ ID NO: 1274604 - protein, 9 aa, Homo Sapiens
QILISYGYI

SEQ ID NO: 1274605 - protein, 9 aa, Homo Sapiens
KPQLSLVCG

SEQ ID NO: 1274606 - protein, 9 aa, Homo Sapiens
FVWKRPVEI

SEQ ID NO: 1274607 - protein, 9 aa, Homo Sapiens
AQPLRTRLG

SEQ ID NO: 1274608 - protein, 9 aa, Homo Sapiens
TVGRLCISV

SEQ ID NO: 1274609 - protein, 9 aa, Homo Sapiens
SIHWEGPLR

SEQ ID NO: 1274610 - protein, 9 aa, Homo Sapiens
TSLCFIIGV

SEQ ID NO: 1274611 - protein, 9 aa, Homo Sapiens
AYVAKPKSL

SEQ ID NO: 1274612 - protein, 9 aa, Homo Sapiens
WTWSRGGNE

SEQ ID NO: 1274613 - protein, 9 aa, Homo Sapiens
ELCTEDFDL

SEQ ID NO: 1274614 - protein, 9 aa, Homo Sapiens
SSVIKEFRK

SEQ ID NO: 1274615 - protein, 9 aa, Homo Sapiens
ITTGVKVHR

SEQ ID NO: 1274616 - protein, 9 aa, Homo Sapiens
QLSMEEGSG

SEQ ID NO: 1274617 - protein, 9 aa, Homo Sapiens
TDRSSENSH

SEQ ID NO: 1274618 - protein, 9 aa, Homo Sapiens
MRKHPELAD

SEQ ID NO: 1274619 - protein, 9 aa, Homo Sapiens
LSMEEGSGQ

SEQ ID NO: 1274620 - protein, 9 aa, Homo Sapiens
FFQMTSLMT

SEQ ID NO: 1274621 - protein, 9 aa, Homo Sapiens
PVEIVKNPE

SEQ ID NO: 1274622 - protein, 9 aa, Homo Sapiens
LTSLCFIIG

SEQ ID NO: 1274623 - protein, 9 aa, Homo Sapiens
GTDRSSENS

SEQ ID NO: 1274624 - protein, 9 aa, Homo Sapiens
PGAEHGRAS

SEQ ID NO: 1274625 - protein, 9 aa, Homo Sapiens
QNKWCHYEF

SEQ ID NO: 1274626 - protein, 9 aa, Homo Sapiens
SFLQILISY

SEQ ID NO: 1274627 - protein, 9 aa, Homo Sapiens
VLLFFQMTS

SEQ ID NO: 1274628 - protein, 9 aa, Homo Sapiens
ALYAGFSLL

SEQ ID NO: 1274629 - protein, 9 aa, Homo Sapiens
VAQLSMEEG

SEQ ID NO: 1274630 - protein, 9 aa, Homo Sapiens
AAAAALSVS

SEQ ID NO: 1274631 - protein, 9 aa, Homo Sapiens
TKPNFLELL

SEQ ID NO: 1274632 - protein, 9 aa, Homo Sapiens
RCEVREDAR

SEQ ID NO: 1274633 - protein, 9 aa, Homo Sapiens
WKRPVEIVK

SEQ ID NO: 1274634 - protein, 9 aa, Homo Sapiens
MEEKAYSKG

SEQ ID NO: 1274635 - protein, 9 aa, Homo Sapiens
HFRWEVETE

SEQ ID NO: 1274636 - protein, 9 aa, Homo Sapiens
EANTEYLVE

SEQ ID NO: 1274637 - protein, 9 aa, Homo Sapiens
NTEYLVERD

SEQ ID NO: 1274638 - protein, 9 aa, Homo Sapiens
PNFLELLSK

SEQ ID NO: 1274639 - protein, 9 aa, Homo Sapiens
ALSVSRCKA

SEQ ID NO: 1274640 - protein, 9 aa, Homo Sapiens
VINGKRKQS

SEQ ID NO: 1274641 - protein, 9 aa, Homo Sapiens
CFIIGVSVV

SEQ ID NO: 1274642 - protein, 9 aa, Homo Sapiens
HDLSSVARC

SEQ ID NO: 1274643 - protein, 9 aa, Homo Sapiens
RKQSQPQHF

SEQ ID NO: 1274644 - protein, 9 aa, Homo Sapiens
MLQGVAQLS

SEQ ID NO: 1274645 - protein, 9 aa, Homo Sapiens
SNKVESSSE

SEQ ID NO: 1274646 - protein, 9 aa, Homo Sapiens
SLMPHSPGL

SEQ ID NO: 1274647 - protein, 9 aa, Homo Sapiens
SCMGGMNQR

SEQ ID NO: 1274648 - protein, 9 aa, Homo Sapiens
AALSVSRCK

SEQ ID NO: 1274649 - protein, 9 aa, Homo Sapiens
ISIHWEGPL

SEQ ID NO: 1274650 - protein, 9 aa, Homo Sapiens
EPVGNREEE

SEQ ID NO: 1274651 - protein, 9 aa, Homo Sapiens
IETTSNKVE

SEQ ID NO: 1274652 - protein, 9 aa, Homo Sapiens
LQILISYGY

SEQ ID NO: 1274653 - protein, 9 aa, Homo Sapiens
LSSVARCEV

SEQ ID NO: 1274654 - protein, 9 aa, Homo Sapiens
MLEDGQCRC

SEQ ID NO: 1274655 - protein, 9 aa, Homo Sapiens
RLCISVARY

SEQ ID NO: 1274656 - protein, 9 aa, Homo Sapiens
LSLVCGSKV

SEQ ID NO: 1274657 - protein, 9 aa, Homo Sapiens
LSSQELASF

SEQ ID NO: 1274658 - protein, 9 aa, Homo Sapiens
TGNLAKFSQ

SEQ ID NO: 1274659 - protein, 9 aa, Homo Sapiens
KEFRKATEA

SEQ ID NO: 1274660 - protein, 9 aa, Homo Sapiens
EGEFTKPNF

SEQ ID NO: 1274661 - protein, 9 aa, Homo Sapiens
TKARMEEKA

SEQ ID NO: 1274662 - protein, 9 aa, Homo Sapiens
EEEILNREI

SEQ ID NO: 1274663 - protein, 9 aa, Homo Sapiens
VAKKDVHMR

SEQ ID NO: 1274664 - protein, 9 aa, Homo Sapiens
VWKRPVEIV

SEQ ID NO: 1274665 - protein, 9 aa, Homo Sapiens
HQEALMREL

SEQ ID NO: 1274666 - protein, 9 aa, Homo Sapiens
YAGFSLLQQ

SEQ ID NO: 1274667 - protein, 9 aa, Homo Sapiens
RHNIMLLWD

SEQ ID NO: 1274668 - protein, 9 aa, Homo Sapiens
SRCKALKEK

SEQ ID NO: 1274669 - protein, 9 aa, Homo Sapiens
CTEDFDLET

SEQ ID NO: 1274670 - protein, 9 aa, Homo Sapiens
LRRRVEAAQ

SEQ ID NO: 1274671 - protein, 9 aa, Homo Sapiens
SSCMGGMNQ

SEQ ID NO: 1274672 - protein, 9 aa, Homo Sapiens
EFRKATEAL

SEQ ID NO: 1274673 - protein, 9 aa, Homo Sapiens
LLAQPLRTR

SEQ ID NO: 1274674 - protein, 9 aa, Homo Sapiens
SPGLPALLS

SEQ ID NO: 1274675 - protein, 9 aa, Homo Sapiens
NADLLNWTW

SEQ ID NO: 1274676 - protein, 9 aa, Homo Sapiens
LYAGFSLLQ

SEQ ID NO: 1274677 - protein, 9 aa, Homo Sapiens
SVHFRWEVE

SEQ ID NO: 1274678 - protein, 9 aa, Homo Sapiens
YGSVKRLGI

SEQ ID NO: 1274679 - protein, 9 aa, Homo Sapiens
ICTVGRLCI

SEQ ID NO: 1274680 - protein, 9 aa, Homo Sapiens
CEVREDARR

SEQ ID NO: 1274681 - protein, 9 aa, Homo Sapiens
NWLEANTEY

SEQ ID NO: 1274682 - protein, 9 aa, Homo Sapiens
EALMRELEA

SEQ ID NO: 1274683 - protein, 9 aa, Homo Sapiens
KLTSLCFII

SEQ ID NO: 1274684 - protein, 9 aa, Homo Sapiens
LMPHSPGLP

SEQ ID NO: 1274685 - protein, 9 aa, Homo Sapiens
GNREEEILN

SEQ ID NO: 1274686 - protein, 9 aa, Homo Sapiens
IKEFRKATE

SEQ ID NO: 1274687 - protein, 9 aa, Homo Sapiens
REKNKPQLS

SEQ ID NO: 1274688 - protein, 9 aa, Homo Sapiens
ILISYGYIV

SEQ ID NO: 1274689 - protein, 9 aa, Homo Sapiens
HQHQEALMR

SEQ ID NO: 1274690 - protein, 9 aa, Homo Sapiens
LQGVAQLSM

SEQ ID NO: 1274691 - protein, 9 aa, Homo Sapiens
MGGMNQRPI

SEQ ID NO: 1274692 - protein, 9 aa, Homo Sapiens
LLCPGAEHG

SEQ ID NO: 1274693 - protein, 9 aa, Homo Sapiens
WEVETEPIL

SEQ ID NO: 1274694 - protein, 9 aa, Homo Sapiens
AQLSMEEGS

SEQ ID NO: 1274695 - protein, 9 aa, Homo Sapiens
QLSLVCGSK

SEQ ID NO: 1274696 - protein, 9 aa, Homo Sapiens
GTSFLQILI

SEQ ID NO: 1274697 - protein, 9 aa, Homo Sapiens
RWEVETEPI

SEQ ID NO: 1274698 - protein, 9 aa, Homo Sapiens
QEALMRELE

SEQ ID NO: 1274699 - protein, 9 aa, Homo Sapiens
NFLELLSKA

SEQ ID NO: 1274700 - protein, 9 aa, Homo Sapiens
KAFYCSSHL

SEQ ID NO: 1274701 - protein, 9 aa, Homo Sapiens
KNKPQLSLV

SEQ ID NO: 1274702 - protein, 9 aa, Homo Sapiens
IMLLWDREV

SEQ ID NO: 1274703 - protein, 9 aa, Homo Sapiens
AKFSQVLDQ

SEQ ID NO: 1274704 - protein, 9 aa, Homo Sapiens
YCSSHLIGH

SEQ ID NO: 1274705 - protein, 9 aa, Homo Sapiens
DVHMRKHPE

SEQ ID NO: 1274706 - protein, 9 aa, Homo Sapiens
MLLWDREVA

SEQ ID NO: 1274707 - protein, 9 aa, Homo Sapiens
GAEHGRASS

SEQ ID NO: 1274708 - protein, 9 aa, Homo Sapiens
VHFRWEVET

SEQ ID NO: 1274709 - protein, 9 aa, Homo Sapiens
KADLLCPGA

SEQ ID NO: 1274710 - protein, 9 aa, Homo Sapiens
LINWLEANT

SEQ ID NO: 1274711 - protein, 9 aa, Homo Sapiens
QRHNIMLLW

SEQ ID NO: 1274712 - protein, 9 aa, Homo Sapiens
KSLSSQELA

SEQ ID NO: 1274713 - protein, 9 aa, Homo Sapiens
GSPGAPGAN

SEQ ID NO: 1274714 - protein, 9 aa, Homo Sapiens
GQCRCLRCH

SEQ ID NO: 1274715 - protein, 9 aa, Homo Sapiens
YVAKPKSLS

SEQ ID NO: 1274716 - protein, 9 aa, Homo Sapiens
ADLLNWTWS

SEQ ID NO: 1274717 - protein, 9 aa, Homo Sapiens
LWLRYMFKN

SEQ ID NO: 1274718 - protein, 9 aa, Homo Sapiens
LNWTWSRGG

SEQ ID NO: 1274719 - protein, 9 aa, Homo Sapiens
TGVKVHRNF

SEQ ID NO: 1274720 - protein, 9 aa, Homo Sapiens
WLEANTEYL

SEQ ID NO: 1274721 - protein, 9 aa, Homo Sapiens
SLCFIIGVS

SEQ ID NO: 1274722 - protein, 9 aa, Homo Sapiens
GAPGANGLP

SEQ ID NO: 1274723 - protein, 9 aa, Homo Sapiens
VEAAQKDPG

SEQ ID NO: 1274724 - protein, 9 aa, Homo Sapiens
VANADLLNW

SEQ ID NO: 1274725 - protein, 9 aa, Homo Sapiens
RMEEKAYSK

SEQ ID NO: 1274726 - protein, 9 aa, Homo Sapiens
DRSSENSHQ

SEQ ID NO: 1274727 - protein, 9 aa, Homo Sapiens
QKDPGCSGL

SEQ ID NO: 1274728 - protein, 9 aa, Homo Sapiens
QGVAQLSME

SEQ ID NO: 1274729 - protein, 9 aa, Homo Sapiens
MISIHWEGP

SEQ ID NO: 1274730 - protein, 9 aa, Homo Sapiens
CISVARYHI

SEQ ID NO: 1274731 - protein, 9 aa, Homo Sapiens
ETKARMEEK

SEQ ID NO: 1274732 - protein, 9 aa, Homo Sapiens
PFVWKRPVE

SEQ ID NO: 1274733 - protein, 9 aa, Homo Sapiens
MFNSSHSFL

SEQ ID NO: 1274734 - protein, 9 aa, Homo Sapiens
GGMNQRPIL

SEQ ID NO: 1274735 - protein, 9 aa, Homo Sapiens
PGAPGANGL

SEQ ID NO: 1274736 - protein, 9 aa, Homo Sapiens
FKNGEPSGH

SEQ ID NO: 1274737 - protein, 9 aa, Homo Sapiens
CPGAEHGRA

SEQ ID NO: 1274738 - protein, 9 aa, Homo Sapiens
INGKRKQSQ

SEQ ID NO: 1274739 - protein, 9 aa, Homo Sapiens
EFCELCTED

SEQ ID NO: 1274740 - protein, 9 aa, Homo Sapiens
CALYAGFSL

SEQ ID NO: 1274741 - protein, 9 aa, Homo Sapiens
NFVQNKWCH

SEQ ID NO: 1274742 - protein, 9 aa, Homo Sapiens
AKKDVHMRK

SEQ ID NO: 1274743 - protein, 9 aa, Homo Sapiens
NHRVLLFFQ

SEQ ID NO: 1274744 - protein, 9 aa, Homo Sapiens
RGTDRSSEN

SEQ ID NO: 1274745 - protein, 9 aa, Homo Sapiens
NQRPILTII

SEQ ID NO: 1274746 - protein, 9 aa, Homo Sapiens
IGRFKSLSS

SEQ ID NO: 1274747 - protein, 9 aa, Homo Sapiens
RFKSLSSQE

SEQ ID NO: 1274748 - protein, 9 aa, Homo Sapiens
VHRNFRLLE

SEQ ID NO: 1274749 - protein, 9 aa, Homo Sapiens
GVAQLSMEE

SEQ ID NO: 1274750 - protein, 9 aa, Homo Sapiens
SVARCEVRE

SEQ ID NO: 1274751 - protein, 9 aa, Homo Sapiens
KPNFLELLS

SEQ ID NO: 1274752 - protein, 9 aa, Homo Sapiens
KRWRQMVFH

SEQ ID NO: 1274753 - protein, 9 aa, Homo Sapiens
KRPVEIVKN

SEQ ID NO: 1274754 - protein, 9 aa, Homo Sapiens
SVYGSVKRL

SEQ ID NO: 1274755 - protein, 9 aa, Homo Sapiens
AFYCSSHLI

SEQ ID NO: 1274756 - protein, 9 aa, Homo Sapiens
RIDLLAQPL

SEQ ID NO: 1274757 - protein, 9 aa, Homo Sapiens
AEHGRASSV

SEQ ID NO: 1274758 - protein, 9 aa, Homo Sapiens
APGANGLPG

SEQ ID NO: 1274759 - protein, 9 aa, Homo Sapiens
GKDGSPGAP

SEQ ID NO: 1274760 - protein, 9 aa, Homo Sapiens
GMISIHWEG

SEQ ID NO: 1274761 - protein, 9 aa, Homo Sapiens
NKWCHYEFY

SEQ ID NO: 1274762 - protein, 9 aa, Homo Sapiens
VGGTSFLQI

SEQ ID NO: 1274763 - protein, 9 aa, Homo Sapiens
VIKEFRKAT

SEQ ID NO: 1274764 - protein, 9 aa, Homo Sapiens
KDVHMRKHP

SEQ ID NO: 1274765 - protein, 9 aa, Homo Sapiens
AQKDPGCSG

SEQ ID NO: 1274766 - protein, 9 aa, Homo Sapiens
LSVYGSVKR

SEQ ID NO: 1274767 - protein, 9 aa, Homo Sapiens
RTGNLAKFS

SEQ ID NO: 1274768 - protein, 9 aa, Homo Sapiens
HNIMLLWDR

SEQ ID NO: 1274769 - protein, 9 aa, Homo Sapiens
LEANTEYLV

SEQ ID NO: 1274770 - protein, 9 aa, Homo Sapiens
VGRLCISVA

SEQ ID NO: 1274771 - protein, 9 aa, Homo Sapiens
HWEGPLRLQ

SEQ ID NO: 1274772 - protein, 9 aa, Homo Sapiens
LCFIIGVSV

SEQ ID NO: 1274773 - protein, 9 aa, Homo Sapiens
FRKATEALK

SEQ ID NO: 1274774 - protein, 9 aa, Homo Sapiens
EGPLRLQQA

SEQ ID NO: 1274775 - protein, 9 aa, Homo Sapiens
VEIVKNPEF

SEQ ID NO: 1274776 - protein, 9 aa, Homo Sapiens
ANTLSVYGS

SEQ ID NO: 1274777 - protein, 9 aa, Homo Sapiens
DLLAQPLRT

SEQ ID NO: 1274778 - protein, 9 aa, Homo Sapiens
FKSLSSQEL

SEQ ID NO: 1274779 - protein, 9 aa, Homo Sapiens
SSENSHQDR

SEQ ID NO: 1274780 - protein, 9 aa, Homo Sapiens
VANTLSVYG

SEQ ID NO: 1274781 - protein, 9 aa, Homo Sapiens
KDGSPGAPG

SEQ ID NO: 1274782 - protein, 9 aa, Homo Sapiens
EKNKPQLSL

SEQ ID NO: 1274783 - protein, 9 aa, Homo Sapiens
ETTSNKVES

SEQ ID NO: 1274784 - protein, 9 aa, Homo Sapiens
LSVSRCKAL

SEQ ID NO: 1274785 - protein, 9 aa, Homo Sapiens
EGFNFLAKM

SEQ ID NO: 1274786 - protein, 9 aa, Homo Sapiens
TLSVYGSVK

SEQ ID NO: 1274787 - protein, 9 aa, Homo Sapiens
GRFKSLSSQ

SEQ ID NO: 1274788 - protein, 9 aa, Homo Sapiens
NGKRKQSQP

SEQ ID NO: 1274789 - protein, 9 aa, Homo Sapiens
NFLAKMFNS

SEQ ID NO: 1274790 - protein, 9 aa, Homo Sapiens
NWTWSRGGN

SEQ ID NO: 1274791 - protein, 9 aa, Homo Sapiens
DGSPGAPGA

SEQ ID NO: 1274792 - protein, 9 aa, Homo Sapiens
ITSVHFRWE

SEQ ID NO: 1274793 - protein, 9 aa, Homo Sapiens
NKPQLSLVC

SEQ ID NO: 1274794 - protein, 9 aa, Homo Sapiens
SSQELASFK

SEQ ID NO: 1274795 - protein, 9 aa, Homo Sapiens
QSQPQHFTY

SEQ ID NO: 1274796 - protein, 9 aa, Homo Sapiens
CMGGMNQRP

SEQ ID NO: 1274797 - protein, 9 aa, Homo Sapiens
QRPILTIIT

SEQ ID NO: 1274798 - protein, 9 aa, Homo Sapiens
LLNWTWSRG

SEQ ID NO: 1274799 - protein, 9 aa, Homo Sapiens
EDGQCRCLR

SEQ ID NO: 1274800 - protein, 9 aa, Homo Sapiens
VQNKWCHYE

SEQ ID NO: 1274801 - protein, 9 aa, Homo Sapiens
CAYVAKPKS

SEQ ID NO: 1274802 - protein, 9 aa, Homo Sapiens
GFSLLQQLT

SEQ ID NO: 1274803 - protein, 9 aa, Homo Sapiens
ALMRELEAQ

SEQ ID NO: 1274804 - protein, 9 aa, Homo Sapiens
ECGKAFYCS

SEQ ID NO: 1274805 - protein, 9 aa, Homo Sapiens
GTLDKPSKQ

SEQ ID NO: 1274806 - protein, 9 aa, Homo Sapiens
TSLMPHSPG

SEQ ID NO: 1274807 - protein, 9 aa, Homo Sapiens
RPGTLDKPS

SEQ ID NO: 1274808 - protein, 9 aa, Homo Sapiens
VARCEVRED

SEQ ID NO: 1274809 - protein, 9 aa, Homo Sapiens
PVGNREEEI

SEQ ID NO: 1274810 - protein, 9 aa, Homo Sapiens
NIMLLWDRE

SEQ ID NO: 1274811 - protein, 9 aa, Homo Sapiens
NGEPSGHKE

SEQ ID NO: 1274812 - protein, 9 aa, Homo Sapiens
EFTKPNFLE

SEQ ID NO: 1274813 - protein, 9 aa, Homo Sapiens
RRVEAAQKD

SEQ ID NO: 1274814 - protein, 9 aa, Homo Sapiens
TNHRVLLFF

SEQ ID NO: 1274815 - protein, 9 aa, Homo Sapiens
IDLLAQPLR

SEQ ID NO: 1274816 - protein, 9 aa, Homo Sapiens
LLFFQMTSL

SEQ ID NO: 1274817 - protein, 9 aa, Homo Sapiens
LRTRLGSLS

SEQ ID NO: 1274818 - protein, 9 aa, Homo Sapiens
LCTEDFDLE

SEQ ID NO: 1274819 - protein, 9 aa, Homo Sapiens
SPNFVQNKW

SEQ ID NO: 1274820 - protein, 9 aa, Homo Sapiens
LEDGQCRCL

SEQ ID NO: 1274821 - protein, 9 aa, Homo Sapiens
ANTEYLVER

SEQ ID NO: 1274822 - protein, 9 aa, Homo Sapiens
AIKIETTSN

SEQ ID NO: 1274823 - protein, 9 aa, Homo Sapiens
DEEFCELCT

SEQ ID NO: 1274824 - protein, 9 aa, Homo Sapiens
LDKPSKQSK

SEQ ID NO: 1274825 - protein, 9 aa, Homo Sapiens
DGQCRCLRC

SEQ ID NO: 1274826 - protein, 9 aa, Homo Sapiens
QICTVGRLC

SEQ ID NO: 1274827 - protein, 9 aa, Homo Sapiens
NITSVHFRW

SEQ ID NO: 1274828 - protein, 9 aa, Homo Sapiens
ADLLCPGAE

SEQ ID NO: 1274829 - protein, 9 aa, Homo Sapiens
IDKRWRQMV

SEQ ID NO: 1274830 - protein, 9 aa, Homo Sapiens
GEFTKPNFL

SEQ ID NO: 1274831 - protein, 9 aa, Homo Sapiens
TLDKPSKQS

SEQ ID NO: 1274832 - protein, 9 aa, Homo Sapiens
KMFNSSHSF

SEQ ID NO: 1274833 - protein, 9 aa, Homo Sapiens
FEGEFTKPN

SEQ ID NO: 1274834 - protein, 9 aa, Homo Sapiens
RVLLFFQMT

SEQ ID NO: 1274835 - protein, 9 aa, Homo Sapiens
INWLEANTE

SEQ ID NO: 1274836 - protein, 9 aa, Homo Sapiens
QHQEALMRE

SEQ ID NO: 1274837 - protein, 9 aa, Homo Sapiens
DCAYVAKPK

SEQ ID NO: 1274838 - protein, 9 aa, Homo Sapiens
GRLCISVAR

SEQ ID NO: 1274839 - protein, 9 aa, Homo Sapiens
KQRHNIMLL

SEQ ID NO: 1274840 - protein, 9 aa, Homo Sapiens
MNQRPILTI

SEQ ID NO: 1274841 - protein, 9 aa, Homo Sapiens
GNLAKFSQV

SEQ ID NO: 1274842 - protein, 9 aa, Homo Sapiens
RKHPELADK

SEQ ID NO: 1274843 - protein, 9 aa, Homo Sapiens
LCPGAEHGR

SEQ ID NO: 1274844 - protein, 9 aa, Homo Sapiens
EEILNREIG

SEQ ID NO: 1274845 - protein, 9 aa, Homo Sapiens
RVEAAQKDP

SEQ ID NO: 1274846 - protein, 9 aa, Homo Sapiens
LRYMFKNGE

SEQ ID NO: 1274847 - protein, 9 aa, Homo Sapiens
ENSHQDRPE

SEQ ID NO: 1274848 - protein, 9 aa, Homo Sapiens
LFFQMTSLM

SEQ ID NO: 1274849 - protein, 9 aa, Homo Sapiens
ARCEVREDA

SEQ ID NO: 1274850 - protein, 9 aa, Homo Sapiens
DGKDGSPGA

SEQ ID NO: 1274851 - protein, 9 aa, Homo Sapiens
LMRELEAQV

SEQ ID NO: 1274852 - protein, 9 aa, Homo Sapiens
VGNREEEIL

SEQ ID NO: 1274853 - protein, 9 aa, Homo Sapiens
SREKNKPQL

SEQ ID NO: 1274854 - protein, 9 aa, Homo Sapiens
GFNFLAKMF

SEQ ID NO: 1274855 - protein, 9 aa, Homo Sapiens
PGTLDKPSK

SEQ ID NO: 1274856 - protein, 9 aa, Homo Sapiens
DLSSVARCE

SEQ ID NO: 1274857 - protein, 9 aa, Homo Sapiens
GKRKQSQPQ

SEQ ID NO: 1274858 - protein, 9 aa, Homo Sapiens
FCELCTEDF

SEQ ID NO: 1274859 - protein, 9 aa, Homo Sapiens
FYCSSHLIG

SEQ ID NO: 1274860 - protein, 9 aa, Homo Sapiens
TSVHFRWEV

SEQ ID NO: 1274861 - protein, 9 aa, Homo Sapiens
KVHRNFRLL

SEQ ID NO: 1274862 - protein, 9 aa, Homo Sapiens
PSKQSKLQD

SEQ ID NO: 1274863 - protein, 9 aa, Homo Sapiens
SHQHQEALM

SEQ ID NO: 1274864 - protein, 9 aa, Homo Sapiens
QMLEDGQCR

SEQ ID NO: 1274865 - protein, 9 aa, Homo Sapiens
RSSENSHQD

SEQ ID NO: 1274866 - protein, 9 aa, Homo Sapiens
NLAKFSQVL

SEQ ID NO: 1274867 - protein, 9 aa, Homo Sapiens
SVSRCKALK

SEQ ID NO: 1274868 - protein, 9 aa, Homo Sapiens
QCRCLRCHV

SEQ ID NO: 1274869 - protein, 9 aa, Homo Sapiens
IPFVWKRPV

SEQ ID NO: 1274870 - protein, 9 aa, Homo Sapiens
DRGTDRSSE

SEQ ID NO: 1274871 - protein, 9 aa, Homo Sapiens
SQELASFKK

SEQ ID NO: 1274872 - protein, 9 aa, Homo Sapiens
EEKAYSKGF

SEQ ID NO: 1274873 - protein, 9 aa, Homo Sapiens
SSVARCEVR

SEQ ID NO: 1274874 - protein, 9 aa, Homo Sapiens
LSSVIKEFR

SEQ ID NO: 1274875 - protein, 9 aa, Homo Sapiens
FLKLTSLCF

SEQ ID NO: 1274876 - protein, 9 aa, Homo Sapiens
RPVEIVKNP

SEQ ID NO: 1274877 - protein, 9 aa, Homo Sapiens
FNFLAKMFN

SEQ ID NO: 1274878 - protein, 9 aa, Homo Sapiens
SPGAPGANG

SEQ ID NO: 1274879 - protein, 9 aa, Homo Sapiens
TTGVKVHRN

SEQ ID NO: 1274880 - protein, 9 aa, Homo Sapiens
TTSNKVESS

SEQ ID NO: 1274881 - protein, 9 aa, Homo Sapiens
SLSSQELAS

SEQ ID NO: 1274882 - protein, 9 aa, Homo Sapiens
HSPGLPALL

SEQ ID NO: 1274883 - protein, 9 aa, Homo Sapiens
GMNQRPILT

SEQ ID NO: 1274884 - protein, 9 aa, Homo Sapiens
RETSLMPHS

SEQ ID NO: 1274885 - protein, 9 aa, Homo Sapiens
KQSQPQHFT

SEQ ID NO: 1274886 - protein, 9 aa, Homo Sapiens
REEEILNRE

SEQ ID NO: 1274887 - protein, 9 aa, Homo Sapiens
KARMEEKAY

SEQ ID NO: 1274888 - protein, 9 aa, Homo Sapiens
TEYLVERDY

SEQ ID NO: 1274889 - protein, 9 aa, Homo Sapiens
GGTSFLQIL

SEQ ID NO: 1274890 - protein, 9 aa, Homo Sapiens
FRWEVETEP

SEQ ID NO: 1274891 - protein, 9 aa, Homo Sapiens
EKAYSKGFQ

SEQ ID NO: 1274892 - protein, 9 aa, Homo Sapiens
WLRYMFKNG

SEQ ID NO: 1274893 - protein, 9 aa, Homo Sapiens
KIETTSNKV

SEQ ID NO: 1274894 - protein, 9 aa, Homo Sapiens
SVIKEFRKA

SEQ ID NO: 1274895 - protein, 9 aa, Homo Sapiens
YMFKNGEPS

SEQ ID NO: 1274896 - protein, 9 aa, Homo Sapiens
LSPNFVQNK

SEQ ID NO: 1274897 - protein, 9 aa, Homo Sapiens
FLAKMFNSS

SEQ ID NO: 1274898 - protein, 9 aa, Homo Sapiens
LAKMFNSSH

SEQ ID NO: 1274899 - protein, 9 aa, Homo Sapiens
QPLRTRLGS

SEQ ID NO: 1274900 - protein, 9 aa, Homo Sapiens
FQMTSLMTI

SEQ ID NO: 1274901 - protein, 9 aa, Homo Sapiens
DKPSKQSKL

SEQ ID NO: 1274902 - protein, 9 aa, Homo Sapiens
PNFVQNKWC

SEQ ID NO: 1274903 - protein, 9 aa, Homo Sapiens
CGKAFYCSS

SEQ ID NO: 1274904 - protein, 9 aa, Homo Sapiens
GSVKRLGIP

SEQ ID NO: 1274905 - protein, 9 aa, Homo Sapiens
CITTGVKVH

SEQ ID NO: 1274906 - protein, 9 aa, Homo Sapiens
AKMFNSSHS

SEQ ID NO: 1274907 - protein, 9 aa, Homo Sapiens
KRKQSQPQH

SEQ ID NO: 1274908 - protein, 9 aa, Homo Sapiens
FTKPNFLEL

SEQ ID NO: 1274909 - protein, 9 aa, Homo Sapiens
PQLSLVCGS

SEQ ID NO: 1274910 - protein, 9 aa, Homo Sapiens
CRCLRCHVL

SEQ ID NO: 1274911 - protein, 9 aa, Homo Sapiens
EEFCELCTE

SEQ ID NO: 1274912 - protein, 9 aa, Homo Sapiens
TSNKVESSS

SEQ ID NO: 1274913 - protein, 9 aa, Homo Sapiens
SASPSIRSA

SEQ ID NO: 1274914 - protein, 9 aa, Homo Sapiens
SNKMDSLLQ

SEQ ID NO: 1274915 - protein, 9 aa, Homo Sapiens
CKVARLRQN

SEQ ID NO: 1274916 - protein, 9 aa, Homo Sapiens
IVHDVTDIW

SEQ ID NO: 1274917 - protein, 9 aa, Homo Sapiens
YRIHTVEKP

SEQ ID NO: 1274918 - protein, 9 aa, Homo Sapiens
RAQGGLGGA

SEQ ID NO: 1274919 - protein, 9 aa, Homo Sapiens
HTPQDPEPM

SEQ ID NO: 1274920 - protein, 9 aa, Homo Sapiens
YSINWMEDS

SEQ ID NO: 1274921 - protein, 9 aa, Homo Sapiens
EQTTSDLTQ

SEQ ID NO: 1274922 - protein, 9 aa, Homo Sapiens
VQPTYVPVM

SEQ ID NO: 1274923 - protein, 9 aa, Homo Sapiens
RASAQCSDG

SEQ ID NO: 1274924 - protein, 9 aa, Homo Sapiens
VQGAQRREA

SEQ ID NO: 1274925 - protein, 9 aa, Homo Sapiens
EPNNPKNLS

SEQ ID NO: 1274926 - protein, 9 aa, Homo Sapiens
VALLTMWTC

SEQ ID NO: 1274927 - protein, 9 aa, Homo Sapiens
SNHLERHRA

SEQ ID NO: 1274928 - protein, 9 aa, Homo Sapiens
SLPVADVPY

SEQ ID NO: 1274929 - protein, 9 aa, Homo Sapiens
GTSIQGSKL

SEQ ID NO: 1274930 - protein, 9 aa, Homo Sapiens
ECVLSSVLQ

SEQ ID NO: 1274931 - protein, 9 aa, Homo Sapiens
QENGKWLRA

SEQ ID NO: 1274932 - protein, 9 aa, Homo Sapiens
GWARFLHYQ

SEQ ID NO: 1274933 - protein, 9 aa, Homo Sapiens
GGPESRGIL

SEQ ID NO: 1274934 - protein, 9 aa, Homo Sapiens
RIHTVEKPY

SEQ ID NO: 1274935 - protein, 9 aa, Homo Sapiens
PPRCPGHWR

SEQ ID NO: 1274936 - protein, 9 aa, Homo Sapiens
VEKPYQCNE

SEQ ID NO: 1274937 - protein, 9 aa, Homo Sapiens
DKKKKDKKR

SEQ ID NO: 1274938 - protein, 9 aa, Homo Sapiens
QNKHSRYKK

SEQ ID NO: 1274939 - protein, 9 aa, Homo Sapiens
KKKRSAFPS

SEQ ID NO: 1274940 - protein, 9 aa, Homo Sapiens
QEDLGTAEF

SEQ ID NO: 1274941 - protein, 9 aa, Homo Sapiens
GDDDDEEDA

SEQ ID NO: 1274942 - protein, 9 aa, Homo Sapiens
ALIIIGIIT

SEQ ID NO: 1274943 - protein, 9 aa, Homo Sapiens
VRRRGPPQL

SEQ ID NO: 1274944 - protein, 9 aa, Homo Sapiens
SLIDDFSLE

SEQ ID NO: 1274945 - protein, 9 aa, Homo Sapiens
RIGRRSSTE

SEQ ID NO: 1274946 - protein, 9 aa, Homo Sapiens
KGKKVKSSI

SEQ ID NO: 1274947 - protein, 9 aa, Homo Sapiens
VQHDALEVA

SEQ ID NO: 1274948 - protein, 9 aa, Homo Sapiens
MRNLHFHIL

SEQ ID NO: 1274949 - protein, 9 aa, Homo Sapiens
VIADGTLAI

SEQ ID NO: 1274950 - protein, 9 aa, Homo Sapiens
QKNTTALEK

SEQ ID NO: 1274951 - protein, 9 aa, Homo Sapiens
EKTCPVTPA

SEQ ID NO: 1274952 - protein, 9 aa, Homo Sapiens
RTATTTTHR

SEQ ID NO: 1274953 - protein, 9 aa, Homo Sapiens
GDDDGGGDD

SEQ ID NO: 1274954 - protein, 9 aa, Homo Sapiens
EGQKLLHAR

SEQ ID NO: 1274955 - protein, 9 aa, Homo Sapiens
PALLRDGPH

SEQ ID NO: 1274956 - protein, 9 aa, Homo Sapiens
PRCPHSWSC

SEQ ID NO: 1274957 - protein, 9 aa, Homo Sapiens
RHVRARMQP

SEQ ID NO: 1274958 - protein, 9 aa, Homo Sapiens
PHKGKPLEP

SEQ ID NO: 1274959 - protein, 9 aa, Homo Sapiens
SLFTDDCRY

SEQ ID NO: 1274960 - protein, 9 aa, Homo Sapiens
KENALFKWI

SEQ ID NO: 1274961 - protein, 9 aa, Homo Sapiens
NALFKWILR

SEQ ID NO: 1274962 - protein, 9 aa, Homo Sapiens
CSSLQVENE

SEQ ID NO: 1274963 - protein, 9 aa, Homo Sapiens
AAAEGQKLL

SEQ ID NO: 1274964 - protein, 9 aa, Homo Sapiens
LEKMPPPKS

SEQ ID NO: 1274965 - protein, 9 aa, Homo Sapiens
IVTPHKDIW

SEQ ID NO: 1274966 - protein, 9 aa, Homo Sapiens
VGRCSSLQV

SEQ ID NO: 1274967 - protein, 9 aa, Homo Sapiens
CVFAFREEN

SEQ ID NO: 1274968 - protein, 9 aa, Homo Sapiens
GPSIVTPHK

SEQ ID NO: 1274969 - protein, 9 aa, Homo Sapiens
DTGSKGWQT

SEQ ID NO: 1274970 - protein, 9 aa, Homo Sapiens
SVIPTRTAR

SEQ ID NO: 1274971 - protein, 9 aa, Homo Sapiens
DVQSYRAEI

SEQ ID NO: 1274972 - protein, 9 aa, Homo Sapiens
FVDVIGFCM

SEQ ID NO: 1274973 - protein, 9 aa, Homo Sapiens
SGKKLEDSP

SEQ ID NO: 1274974 - protein, 9 aa, Homo Sapiens
CSSSALATA

SEQ ID NO: 1274975 - protein, 9 aa, Homo Sapiens
RPSHDRYWG

SEQ ID NO: 1274976 - protein, 9 aa, Homo Sapiens
KRSAFPSRS

SEQ ID NO: 1274977 - protein, 9 aa, Homo Sapiens
NMVEYKRAM

SEQ ID NO: 1274978 - protein, 9 aa, Homo Sapiens
RLILPMKIP

SEQ ID NO: 1274979 - protein, 9 aa, Homo Sapiens
PGPVPCVIP

SEQ ID NO: 1274980 - protein, 9 aa, Homo Sapiens
VPPPCCRFD

SEQ ID NO: 1274981 - protein, 9 aa, Homo Sapiens
TRSVGRCSS

SEQ ID NO: 1274982 - protein, 9 aa, Homo Sapiens
IGRRSSTET

SEQ ID NO: 1274983 - protein, 9 aa, Homo Sapiens
TMYFLFGNL

SEQ ID NO: 1274984 - protein, 9 aa, Homo Sapiens
HVEDDGETA

SEQ ID NO: 1274985 - protein, 9 aa, Homo Sapiens
SVLQGPSRP

SEQ ID NO: 1274986 - protein, 9 aa, Homo Sapiens
LASEGRPRS

SEQ ID NO: 1274987 - protein, 9 aa, Homo Sapiens
KESTIFQML

SEQ ID NO: 1274988 - protein, 9 aa, Homo Sapiens
RRSYPEFQS

SEQ ID NO: 1274989 - protein, 9 aa, Homo Sapiens
SSSSLGVLG

SEQ ID NO: 1274990 - protein, 9 aa, Homo Sapiens
KMLSLTHLF

SEQ ID NO: 1274991 - protein, 9 aa, Homo Sapiens
LFPCNECTK

SEQ ID NO: 1274992 - protein, 9 aa, Homo Sapiens
ITILRIPSA

SEQ ID NO: 1274993 - protein, 9 aa, Homo Sapiens
DKCVFAFRE

SEQ ID NO: 1274994 - protein, 9 aa, Homo Sapiens
ADQHGVVQG

SEQ ID NO: 1274995 - protein, 9 aa, Homo Sapiens
KVLAVSSMP

SEQ ID NO: 1274996 - protein, 9 aa, Homo Sapiens
FKWILRCYE

SEQ ID NO: 1274997 - protein, 9 aa, Homo Sapiens
PFTVCKPDE

SEQ ID NO: 1274998 - protein, 9 aa, Homo Sapiens
RGCKGVLQE

SEQ ID NO: 1274999 - protein, 9 aa, Homo Sapiens
RCPHSWSCS

SEQ ID NO: 1275000 - protein, 9 aa, Homo Sapiens
AVRRAVALE

SEQ ID NO: 1275001 - protein, 9 aa, Homo Sapiens
LLLAPPGVG

SEQ ID NO: 1275002 - protein, 9 aa, Homo Sapiens
RFLLGRGQQ

SEQ ID NO: 1275003 - protein, 9 aa, Homo Sapiens
SQSWKAGKS

SEQ ID NO: 1275004 - protein, 9 aa, Homo Sapiens
CAAWKPSLR

SEQ ID NO: 1275005 - protein, 9 aa, Homo Sapiens
PRTMAGPSA

SEQ ID NO: 1275006 - protein, 9 aa, Homo Sapiens
ACLEALMRG

SEQ ID NO: 1275007 - protein, 9 aa, Homo Sapiens
RCSSLQVEN

SEQ ID NO: 1275008 - protein, 9 aa, Homo Sapiens
AFLRTVAFW

SEQ ID NO: 1275009 - protein, 9 aa, Homo Sapiens
YQFLAMEQM

SEQ ID NO: 1275010 - protein, 9 aa, Homo Sapiens
ISRPTSRAR

SEQ ID NO: 1275011 - protein, 9 aa, Homo Sapiens
TLDLEDVQS

SEQ ID NO: 1275012 - protein, 9 aa, Homo Sapiens
CISLPPVDK

SEQ ID NO: 1275013 - protein, 9 aa, Homo Sapiens
LPRACTRLQ

SEQ ID NO: 1275014 - protein, 9 aa, Homo Sapiens
KSWKIMRRN

SEQ ID NO: 1275015 - protein, 9 aa, Homo Sapiens
PRAQSCPLP

SEQ ID NO: 1275016 - protein, 9 aa, Homo Sapiens
LCLYVSKGA

SEQ ID NO: 1275017 - protein, 9 aa, Homo Sapiens
RCCVEYGVG

SEQ ID NO: 1275018 - protein, 9 aa, Homo Sapiens
DSGGIRKRA

SEQ ID NO: 1275019 - protein, 9 aa, Homo Sapiens
KIKLLKKRS

SEQ ID NO: 1275020 - protein, 9 aa, Homo Sapiens
TDDCRYVIV

SEQ ID NO: 1275021 - protein, 9 aa, Homo Sapiens
DEYDPKDTW

SEQ ID NO: 1275022 - protein, 9 aa, Homo Sapiens
QRNPLPTAT

SEQ ID NO: 1275023 - protein, 9 aa, Homo Sapiens
EAWCRTTLP

SEQ ID NO: 1275024 - protein, 9 aa, Homo Sapiens
KTCPVTPAT

SEQ ID NO: 1275025 - protein, 9 aa, Homo Sapiens
YDPKDTWQD

SEQ ID NO: 1275026 - protein, 9 aa, Homo Sapiens
SLLQNMWDG

SEQ ID NO: 1275027 - protein, 9 aa, Homo Sapiens
RKRQQEFEI

SEQ ID NO: 1275028 - protein, 9 aa, Homo Sapiens
AQRLQEDLG

SEQ ID NO: 1275029 - protein, 9 aa, Homo Sapiens
HRLILPMKI

SEQ ID NO: 1275030 - protein, 9 aa, Homo Sapiens
LLHPSQRLL

SEQ ID NO: 1275031 - protein, 9 aa, Homo Sapiens
MPHHSLKMR

SEQ ID NO: 1275032 - protein, 9 aa, Homo Sapiens
ADGTLAIPI

SEQ ID NO: 1275033 - protein, 9 aa, Homo Sapiens
DPRMASSSP

SEQ ID NO: 1275034 - protein, 9 aa, Homo Sapiens
GTGACIGMM

SEQ ID NO: 1275035 - protein, 9 aa, Homo Sapiens
TIFQMLIIE

SEQ ID NO: 1275036 - protein, 9 aa, Homo Sapiens
CVEKCPFRT

SEQ ID NO: 1275037 - protein, 9 aa, Homo Sapiens
EQALSALIN

SEQ ID NO: 1275038 - protein, 9 aa, Homo Sapiens
PATAGSLAT

SEQ ID NO: 1275039 - protein, 9 aa, Homo Sapiens
CKFFKGQSN

SEQ ID NO: 1275040 - protein, 9 aa, Homo Sapiens
KCVFAFREE

SEQ ID NO: 1275041 - protein, 9 aa, Homo Sapiens
LQHSQPPTP

SEQ ID NO: 1275042 - protein, 9 aa, Homo Sapiens
ASESWAIVP

SEQ ID NO: 1275043 - protein, 9 aa, Homo Sapiens
LVTEKGSLV

SEQ ID NO: 1275044 - protein, 9 aa, Homo Sapiens
PDEPLSGEK

SEQ ID NO: 1275045 - protein, 9 aa, Homo Sapiens
TPLSISRPT

SEQ ID NO: 1275046 - protein, 9 aa, Homo Sapiens
TSTGPPPSV

SEQ ID NO: 1275047 - protein, 9 aa, Homo Sapiens
QHSQPPTPL

SEQ ID NO: 1275048 - protein, 9 aa, Homo Sapiens
SQNKHSRYK

SEQ ID NO: 1275049 - protein, 9 aa, Homo Sapiens
EGDYDADCE

SEQ ID NO: 1275050 - protein, 9 aa, Homo Sapiens
VYQEYPVVP

SEQ ID NO: 1275051 - protein, 9 aa, Homo Sapiens
HTRSVGRCS

SEQ ID NO: 1275052 - protein, 9 aa, Homo Sapiens
RRSLWYTTH

SEQ ID NO: 1275053 - protein, 9 aa, Homo Sapiens
RSGKKLEDS

SEQ ID NO: 1275054 - protein, 9 aa, Homo Sapiens
NEYFFDLNR

SEQ ID NO: 1275055 - protein, 9 aa, Homo Sapiens
PETPAPSPR

SEQ ID NO: 1275056 - protein, 9 aa, Homo Sapiens
KSTKPSMSP

SEQ ID NO: 1275057 - protein, 9 aa, Homo Sapiens
PRELAVAKS

SEQ ID NO: 1275058 - protein, 9 aa, Homo Sapiens
GVQGNTLQA

SEQ ID NO: 1275059 - protein, 9 aa, Homo Sapiens
SSARHSEAS

SEQ ID NO: 1275060 - protein, 9 aa, Homo Sapiens
GSYSSTTNG

SEQ ID NO: 1275061 - protein, 9 aa, Homo Sapiens
YAQQCCQHG

SEQ ID NO: 1275062 - protein, 9 aa, Homo Sapiens
RSTLMSCTE

SEQ ID NO: 1275063 - protein, 9 aa, Homo Sapiens
HPASGRASR

SEQ ID NO: 1275064 - protein, 9 aa, Homo Sapiens
VQGNTLQAL

SEQ ID NO: 1275065 - protein, 9 aa, Homo Sapiens
TLPKFTKKH

SEQ ID NO: 1275066 - protein, 9 aa, Homo Sapiens
GGDDDDEED

SEQ ID NO: 1275067 - protein, 9 aa, Homo Sapiens
SVGRLCPSC

SEQ ID NO: 1275068 - protein, 9 aa, Homo Sapiens
WALILGIFV

SEQ ID NO: 1275069 - protein, 9 aa, Homo Sapiens
TNADIQMPF

SEQ ID NO: 1275070 - protein, 9 aa, Homo Sapiens
APDDTQYFL

SEQ ID NO: 1275071 - protein, 9 aa, Homo Sapiens
MLIIEKVLK

SEQ ID NO: 1275072 - protein, 9 aa, Homo Sapiens
AADLERFLN

SEQ ID NO: 1275073 - protein, 9 aa, Homo Sapiens
KAPGPHPKP

SEQ ID NO: 1275074 - protein, 9 aa, Homo Sapiens
AKACTGDRP

SEQ ID NO: 1275075 - protein, 9 aa, Homo Sapiens
GFGMEATSL

SEQ ID NO: 1275076 - protein, 9 aa, Homo Sapiens
FFKGQSNTR

SEQ ID NO: 1275077 - protein, 9 aa, Homo Sapiens
LFAVNQKNT

SEQ ID NO: 1275078 - protein, 9 aa, Homo Sapiens
IYGCHWKRY

SEQ ID NO: 1275079 - protein, 9 aa, Homo Sapiens
TPVLYLQCL

SEQ ID NO: 1275080 - protein, 9 aa, Homo Sapiens
QTVTRNRGA

SEQ ID NO: 1275081 - protein, 9 aa, Homo Sapiens
DDDDDEKKR

SEQ ID NO: 1275082 - protein, 9 aa, Homo Sapiens
AFPSRSLSS

SEQ ID NO: 1275083 - protein, 9 aa, Homo Sapiens
HLQENGKWL

SEQ ID NO: 1275084 - protein, 9 aa, Homo Sapiens
SPQNRSRTN

SEQ ID NO: 1275085 - protein, 9 aa, Homo Sapiens
WCRTTLPAS

SEQ ID NO: 1275086 - protein, 9 aa, Homo Sapiens
QMKKYRNYR

SEQ ID NO: 1275087 - protein, 9 aa, Homo Sapiens
GRTQGEVQL

SEQ ID NO: 1275088 - protein, 9 aa, Homo Sapiens
FLIQMFFIH

SEQ ID NO: 1275089 - protein, 9 aa, Homo Sapiens
KWLRACSFH

SEQ ID NO: 1275090 - protein, 9 aa, Homo Sapiens
QCRFREQRR

SEQ ID NO: 1275091 - protein, 9 aa, Homo Sapiens
LVLDVSSIS

SEQ ID NO: 1275092 - protein, 9 aa, Homo Sapiens
LFQSPMHVV

SEQ ID NO: 1275093 - protein, 9 aa, Homo Sapiens
HPDGQCAPR

SEQ ID NO: 1275094 - protein, 9 aa, Homo Sapiens
GRGQQMSQA

SEQ ID NO: 1275095 - protein, 9 aa, Homo Sapiens
FSGSVGRLC

SEQ ID NO: 1275096 - protein, 9 aa, Homo Sapiens
RVLPRACTR

SEQ ID NO: 1275097 - protein, 9 aa, Homo Sapiens
DDDEKKRGS

SEQ ID NO: 1275098 - protein, 9 aa, Homo Sapiens
YEALETQLP

SEQ ID NO: 1275099 - protein, 9 aa, Homo Sapiens
MLRDEDAPE

SEQ ID NO: 1275100 - protein, 9 aa, Homo Sapiens
APASPLSPR

SEQ ID NO: 1275101 - protein, 9 aa, Homo Sapiens
TLGEQKFTF

SEQ ID NO: 1275102 - protein, 9 aa, Homo Sapiens
QKIRSGEAL

SEQ ID NO: 1275103 - protein, 9 aa, Homo Sapiens
GELMSALDS

SEQ ID NO: 1275104 - protein, 9 aa, Homo Sapiens
RAQSCPLPS

SEQ ID NO: 1275105 - protein, 9 aa, Homo Sapiens
LTKRYGGFM

SEQ ID NO: 1275106 - protein, 9 aa, Homo Sapiens
DQSLACEGL

SEQ ID NO: 1275107 - protein, 9 aa, Homo Sapiens
KIDPTEARV

SEQ ID NO: 1275108 - protein, 9 aa, Homo Sapiens
WKFAATGMG

SEQ ID NO: 1275109 - protein, 9 aa, Homo Sapiens
TDKDFEFAL

SEQ ID NO: 1275110 - protein, 9 aa, Homo Sapiens
SSLGVLGGK

SEQ ID NO: 1275111 - protein, 9 aa, Homo Sapiens
YQEYPVVPS

SEQ ID NO: 1275112 - protein, 9 aa, Homo Sapiens
QRREAGDPV

SEQ ID NO: 1275113 - protein, 9 aa, Homo Sapiens
HVELQRNPL

SEQ ID NO: 1275114 - protein, 9 aa, Homo Sapiens
MASSSPYPT

SEQ ID NO: 1275115 - protein, 9 aa, Homo Sapiens
GGPEHSVID

SEQ ID NO: 1275116 - protein, 9 aa, Homo Sapiens
CTRSTLMSC

SEQ ID NO: 1275117 - protein, 9 aa, Homo Sapiens
RGKGSQGFF

SEQ ID NO: 1275118 - protein, 9 aa, Homo Sapiens
QLTAGFRRH

SEQ ID NO: 1275119 - protein, 9 aa, Homo Sapiens
KLLKKRSLC

SEQ ID NO: 1275120 - protein, 9 aa, Homo Sapiens
NGYCCSCPP

SEQ ID NO: 1275121 - protein, 9 aa, Homo Sapiens
LRSPPQALV

SEQ ID NO: 1275122 - protein, 9 aa, Homo Sapiens
RKLKIAPAL

SEQ ID NO: 1275123 - protein, 9 aa, Homo Sapiens
WKTCYIQSS

SEQ ID NO: 1275124 - protein, 9 aa, Homo Sapiens
TQLCHPPRQ

SEQ ID NO: 1275125 - protein, 9 aa, Homo Sapiens
QNLGFQAPV

SEQ ID NO: 1275126 - protein, 9 aa, Homo Sapiens
GLQLLPGGE

SEQ ID NO: 1275127 - protein, 9 aa, Homo Sapiens
GSLEYLYLQ

SEQ ID NO: 1275128 - protein, 9 aa, Homo Sapiens
PGGSRPGWK

SEQ ID NO: 1275129 - protein, 9 aa, Homo Sapiens
APPALGMLH

SEQ ID NO: 1275130 - protein, 9 aa, Homo Sapiens
EPERQRQEN

SEQ ID NO: 1275131 - protein, 9 aa, Homo Sapiens
RTADADQHG

SEQ ID NO: 1275132 - protein, 9 aa, Homo Sapiens
DKQLALIAT

SEQ ID NO: 1275133 - protein, 9 aa, Homo Sapiens
KVTDADTPN

SEQ ID NO: 1275134 - protein, 9 aa, Homo Sapiens
DPEDACVLC

SEQ ID NO: 1275135 - protein, 9 aa, Homo Sapiens
RRHLWLPCQ

SEQ ID NO: 1275136 - protein, 9 aa, Homo Sapiens
IISGWGKQF

SEQ ID NO: 1275137 - protein, 9 aa, Homo Sapiens
LLQRNLLRL

SEQ ID NO: 1275138 - protein, 9 aa, Homo Sapiens
VPNSAYGGT

SEQ ID NO: 1275139 - protein, 9 aa, Homo Sapiens
AIVPVLHNL

SEQ ID NO: 1275140 - protein, 9 aa, Homo Sapiens
NIHHVSLNM

SEQ ID NO: 1275141 - protein, 9 aa, Homo Sapiens
QWKWQCRFR

SEQ ID NO: 1275142 - protein, 9 aa, Homo Sapiens
RLPRPAGRL

SEQ ID NO: 1275143 - protein, 9 aa, Homo Sapiens
ILRSFMKLY

SEQ ID NO: 1275144 - protein, 9 aa, Homo Sapiens
AQGGLGGAA

SEQ ID NO: 1275145 - protein, 9 aa, Homo Sapiens
HSMGQPSDD

SEQ ID NO: 1275146 - protein, 9 aa, Homo Sapiens
PGEKKSQAS

SEQ ID NO: 1275147 - protein, 9 aa, Homo Sapiens
QPMVVQSVG

SEQ ID NO: 1275148 - protein, 9 aa, Homo Sapiens
DSGEKGRDM

SEQ ID NO: 1275149 - protein, 9 aa, Homo Sapiens
RDLPIMIWI

SEQ ID NO: 1275150 - protein, 9 aa, Homo Sapiens
AFAHDHGFQ

SEQ ID NO: 1275151 - protein, 9 aa, Homo Sapiens
RPPWRTSRG

SEQ ID NO: 1275152 - protein, 9 aa, Homo Sapiens
ASPSIRSAS

SEQ ID NO: 1275153 - protein, 9 aa, Homo Sapiens
LLRLAEGVA

SEQ ID NO: 1275154 - protein, 9 aa, Homo Sapiens
SLNANLEGV

SEQ ID NO: 1275155 - protein, 9 aa, Homo Sapiens
RETTSSTPW

SEQ ID NO: 1275156 - protein, 9 aa, Homo Sapiens
KCFIEERLL

SEQ ID NO: 1275157 - protein, 9 aa, Homo Sapiens
KKKKDKKRR

SEQ ID NO: 1275158 - protein, 9 aa, Homo Sapiens
SAIQNIHSV

SEQ ID NO: 1275159 - protein, 9 aa, Homo Sapiens
APTCGLCKV

SEQ ID NO: 1275160 - protein, 9 aa, Homo Sapiens
ILWRLLVTS

SEQ ID NO: 1275161 - protein, 9 aa, Homo Sapiens
IVPEKLPVE

SEQ ID NO: 1275162 - protein, 9 aa, Homo Sapiens
EARGVRRRG

SEQ ID NO: 1275163 - protein, 9 aa, Homo Sapiens
VLFGERLNR

SEQ ID NO: 1275164 - protein, 9 aa, Homo Sapiens
TQHPGPGAS

SEQ ID NO: 1275165 - protein, 9 aa, Homo Sapiens
TAHPSITEG

SEQ ID NO: 1275166 - protein, 9 aa, Homo Sapiens
GIVGQTQLC

SEQ ID NO: 1275167 - protein, 9 aa, Homo Sapiens
SVMNSKNDE

SEQ ID NO: 1275168 - protein, 9 aa, Homo Sapiens
TTHYPTDER

SEQ ID NO: 1275169 - protein, 9 aa, Homo Sapiens
SLKKVVVVT

SEQ ID NO: 1275170 - protein, 9 aa, Homo Sapiens
LEQTHPRLK

SEQ ID NO: 1275171 - protein, 9 aa, Homo Sapiens
GQMFQTKDP

SEQ ID NO: 1275172 - protein, 9 aa, Homo Sapiens
REQRRRSAR

SEQ ID NO: 1275173 - protein, 9 aa, Homo Sapiens
PPGSKGRPP

SEQ ID NO: 1275174 - protein, 9 aa, Homo Sapiens
MQRQRVLVE

SEQ ID NO: 1275175 - protein, 9 aa, Homo Sapiens
AEQLTAGFR

SEQ ID NO: 1275176 - protein, 9 aa, Homo Sapiens
GRVREALHQ

SEQ ID NO: 1275177 - protein, 9 aa, Homo Sapiens
KFDDDSDSP

SEQ ID NO: 1275178 - protein, 9 aa, Homo Sapiens
SGSMGIGLG

SEQ ID NO: 1275179 - protein, 9 aa, Homo Sapiens
RRTTILISA

SEQ ID NO: 1275180 - protein, 9 aa, Homo Sapiens
HSVIDLWRT

SEQ ID NO: 1275181 - protein, 9 aa, Homo Sapiens
PPLILWPQA

SEQ ID NO: 1275182 - protein, 9 aa, Homo Sapiens
KMRRRSWQR

SEQ ID NO: 1275183 - protein, 9 aa, Homo Sapiens
MDMLPKGAA

SEQ ID NO: 1275184 - protein, 9 aa, Homo Sapiens
KADSTTTKK

SEQ ID NO: 1275185 - protein, 9 aa, Homo Sapiens
MDLFHHCRL

SEQ ID NO: 1275186 - protein, 9 aa, Homo Sapiens
RPAGRLGDS

SEQ ID NO: 1275187 - protein, 9 aa, Homo Sapiens
RPLSHAFFK

SEQ ID NO: 1275188 - protein, 9 aa, Homo Sapiens
SLSLMKDST

SEQ ID NO: 1275189 - protein, 9 aa, Homo Sapiens
QHLPRDHGF

SEQ ID NO: 1275190 - protein, 9 aa, Homo Sapiens
VRVLGDPFP

SEQ ID NO: 1275191 - protein, 9 aa, Homo Sapiens
ACRGKGSQG

SEQ ID NO: 1275192 - protein, 9 aa, Homo Sapiens
SKVKVMPHH

SEQ ID NO: 1275193 - protein, 9 aa, Homo Sapiens
WLQAELEQT

SEQ ID NO: 1275194 - protein, 9 aa, Homo Sapiens
NLSRPLPGQ

SEQ ID NO: 1275195 - protein, 9 aa, Homo Sapiens
HAFFKLEIV

SEQ ID NO: 1275196 - protein, 9 aa, Homo Sapiens
SCTETALVM

SEQ ID NO: 1275197 - protein, 9 aa, Homo Sapiens
CLRFLLGRG

SEQ ID NO: 1275198 - protein, 9 aa, Homo Sapiens
LQQWKWQCR

SEQ ID NO: 1275199 - protein, 9 aa, Homo Sapiens
RTTLPASQR

SEQ ID NO: 1275200 - protein, 9 aa, Homo Sapiens
MRRRSWQRR

SEQ ID NO: 1275201 - protein, 9 aa, Homo Sapiens
DVSLSLMKD

SEQ ID NO: 1275202 - protein, 9 aa, Homo Sapiens
GCGFVMAAY

SEQ ID NO: 1275203 - protein, 9 aa, Homo Sapiens
ELQHSQPPT

SEQ ID NO: 1275204 - protein, 9 aa, Homo Sapiens
RLAEGVAAL

SEQ ID NO: 1275205 - protein, 9 aa, Homo Sapiens
SRKTWQRRL

SEQ ID NO: 1275206 - protein, 9 aa, Homo Sapiens
FPLEIKKKG

SEQ ID NO: 1275207 - protein, 9 aa, Homo Sapiens
GDYDADCED

SEQ ID NO: 1275208 - protein, 9 aa, Homo Sapiens
LQAELEQTH

SEQ ID NO: 1275209 - protein, 9 aa, Homo Sapiens
ECRIGSSHL

SEQ ID NO: 1275210 - protein, 9 aa, Homo Sapiens
EVQLVQHDA

SEQ ID NO: 1275211 - protein, 9 aa, Homo Sapiens
RAMLRDEDA

SEQ ID NO: 1275212 - protein, 9 aa, Homo Sapiens
RACSSSALA

SEQ ID NO: 1275213 - protein, 9 aa, Homo Sapiens
VKVKWKSSC

SEQ ID NO: 1275214 - protein, 9 aa, Homo Sapiens
SDKLVDFVV

SEQ ID NO: 1275215 - protein, 9 aa, Homo Sapiens
TMLNPANVP

SEQ ID NO: 1275216 - protein, 9 aa, Homo Sapiens
TSRGQAQDT

SEQ ID NO: 1275217 - protein, 9 aa, Homo Sapiens
RSPHKGKPL

SEQ ID NO: 1275218 - protein, 9 aa, Homo Sapiens
SITVSFVGQ

SEQ ID NO: 1275219 - protein, 9 aa, Homo Sapiens
PLPSPASAL

SEQ ID NO: 1275220 - protein, 9 aa, Homo Sapiens
SLPRLHASV

SEQ ID NO: 1275221 - protein, 9 aa, Homo Sapiens
VSLSLMKDS

SEQ ID NO: 1275222 - protein, 9 aa, Homo Sapiens
DRPILYSNS

SEQ ID NO: 1275223 - protein, 9 aa, Homo Sapiens
LMLHHNIPS

SEQ ID NO: 1275224 - protein, 9 aa, Homo Sapiens
ARTPPQEAD

SEQ ID NO: 1275225 - protein, 9 aa, Homo Sapiens
ASKVPGGSR

SEQ ID NO: 1275226 - protein, 9 aa, Homo Sapiens
TWGTLVSGL

SEQ ID NO: 1275227 - protein, 9 aa, Homo Sapiens
VTEKGSLVE

SEQ ID NO: 1275228 - protein, 9 aa, Homo Sapiens
SGRGRWRPS

SEQ ID NO: 1275229 - protein, 9 aa, Homo Sapiens
FNVINYDLN

SEQ ID NO: 1275230 - protein, 9 aa, Homo Sapiens
AVAGVQGGN

SEQ ID NO: 1275231 - protein, 9 aa, Homo Sapiens
VKKADSTTT

SEQ ID NO: 1275232 - protein, 9 aa, Homo Sapiens
PKPRSLWLT

SEQ ID NO: 1275233 - protein, 9 aa, Homo Sapiens
RRRGPPQLH

SEQ ID NO: 1275234 - protein, 9 aa, Homo Sapiens
LCKVARLRQ

SEQ ID NO: 1275235 - protein, 9 aa, Homo Sapiens
RRGGEEAVQ

SEQ ID NO: 1275236 - protein, 9 aa, Homo Sapiens
VLLALRLWC

SEQ ID NO: 1275237 - protein, 9 aa, Homo Sapiens
GSNLPGRAT

SEQ ID NO: 1275238 - protein, 9 aa, Homo Sapiens
CQYSVSLPD

SEQ ID NO: 1275239 - protein, 9 aa, Homo Sapiens
LIIIGIITY

SEQ ID NO: 1275240 - protein, 9 aa, Homo Sapiens
LLAWKESTI

SEQ ID NO: 1275241 - protein, 9 aa, Homo Sapiens
SKLPRHISP

SEQ ID NO: 1275242 - protein, 9 aa, Homo Sapiens
SAYAQQCCQ

SEQ ID NO: 1275243 - protein, 9 aa, Homo Sapiens
VVRDAVRKP

SEQ ID NO: 1275244 - protein, 9 aa, Homo Sapiens
LDEGRTTTC

SEQ ID NO: 1275245 - protein, 9 aa, Homo Sapiens
RALYAVLFG

SEQ ID NO: 1275246 - protein, 9 aa, Homo Sapiens
RRSWQRRRL

SEQ ID NO: 1275247 - protein, 9 aa, Homo Sapiens
ASAGKLLWR

SEQ ID NO: 1275248 - protein, 9 aa, Homo Sapiens
VEKCPFRTA

SEQ ID NO: 1275249 - protein, 9 aa, Homo Sapiens
PARPAGPME

SEQ ID NO: 1275250 - protein, 9 aa, Homo Sapiens
PSDDRVYFR

SEQ ID NO: 1275251 - protein, 9 aa, Homo Sapiens
DPTEARVQV

SEQ ID NO: 1275252 - protein, 9 aa, Homo Sapiens
FVSLFEDKI

SEQ ID NO: 1275253 - protein, 9 aa, Homo Sapiens
ECYLGLPGS

SEQ ID NO: 1275254 - protein, 9 aa, Homo Sapiens
RELAVAKSW

SEQ ID NO: 1275255 - protein, 9 aa, Homo Sapiens
LHVLNEEQA

SEQ ID NO: 1275256 - protein, 9 aa, Homo Sapiens
SDDRVYFRL

SEQ ID NO: 1275257 - protein, 9 aa, Homo Sapiens
ASSLAWRQY

SEQ ID NO: 1275258 - protein, 9 aa, Homo Sapiens
RTSRGQAQD

SEQ ID NO: 1275259 - protein, 9 aa, Homo Sapiens
EEEGGDDDD

SEQ ID NO: 1275260 - protein, 9 aa, Homo Sapiens
SCPLPSPAS

SEQ ID NO: 1275261 - protein, 9 aa, Homo Sapiens
KGHAGTGCA

SEQ ID NO: 1275262 - protein, 9 aa, Homo Sapiens
TRGKNFRKE

SEQ ID NO: 1275263 - protein, 9 aa, Homo Sapiens
MPYDTRQNP

SEQ ID NO: 1275264 - protein, 9 aa, Homo Sapiens
LRRPQPVLL

SEQ ID NO: 1275265 - protein, 9 aa, Homo Sapiens
LASGSMGIG

SEQ ID NO: 1275266 - protein, 9 aa, Homo Sapiens
TLCQNCPRG

SEQ ID NO: 1275267 - protein, 9 aa, Homo Sapiens
PAHALHPAS

SEQ ID NO: 1275268 - protein, 9 aa, Homo Sapiens
KLPRHISPF

SEQ ID NO: 1275269 - protein, 9 aa, Homo Sapiens
WTVRCEEDF

SEQ ID NO: 1275270 - protein, 9 aa, Homo Sapiens
ISFIGWGSQ

SEQ ID NO: 1275271 - protein, 9 aa, Homo Sapiens
MIVHDVTDI

SEQ ID NO: 1275272 - protein, 9 aa, Homo Sapiens
QPPLPGPHL

SEQ ID NO: 1275273 - protein, 9 aa, Homo Sapiens
LPGPHLQQW

SEQ ID NO: 1275274 - protein, 9 aa, Homo Sapiens
LLAAVAWLI

SEQ ID NO: 1275275 - protein, 9 aa, Homo Sapiens
TYETVMTFL

SEQ ID NO: 1275276 - protein, 9 aa, Homo Sapiens
TGTENKGVD

SEQ ID NO: 1275277 - protein, 9 aa, Homo Sapiens
FGEVVETQE

SEQ ID NO: 1275278 - protein, 9 aa, Homo Sapiens
SLGVLGGKC

SEQ ID NO: 1275279 - protein, 9 aa, Homo Sapiens
EVALLRLAE

SEQ ID NO: 1275280 - protein, 9 aa, Homo Sapiens
LAVHSFSCP

SEQ ID NO: 1275281 - protein, 9 aa, Homo Sapiens
AGGPAGWAR

SEQ ID NO: 1275282 - protein, 9 aa, Homo Sapiens
LPVADVPYR

SEQ ID NO: 1275283 - protein, 9 aa, Homo Sapiens
DTIPPKRVA

SEQ ID NO: 1275284 - protein, 9 aa, Homo Sapiens
LDYQICWAW

SEQ ID NO: 1275285 - protein, 9 aa, Homo Sapiens
VYFRLSLHS

SEQ ID NO: 1275286 - protein, 9 aa, Homo Sapiens
LCQNCPRGP

SEQ ID NO: 1275287 - protein, 9 aa, Homo Sapiens
AYHHPDFPL

SEQ ID NO: 1275288 - protein, 9 aa, Homo Sapiens
GLPCAQDPL

SEQ ID NO: 1275289 - protein, 9 aa, Homo Sapiens
DEKKRGSRS

SEQ ID NO: 1275290 - protein, 9 aa, Homo Sapiens
NGLKTFFSQ

SEQ ID NO: 1275291 - protein, 9 aa, Homo Sapiens
PVPSAEGTS

SEQ ID NO: 1275292 - protein, 9 aa, Homo Sapiens
RPGTPPPLI

SEQ ID NO: 1275293 - protein, 9 aa, Homo Sapiens
EIPEGLPGS

SEQ ID NO: 1275294 - protein, 9 aa, Homo Sapiens
NSREDKRER

SEQ ID NO: 1275295 - protein, 9 aa, Homo Sapiens
ANFNTQQNM

SEQ ID NO: 1275296 - protein, 9 aa, Homo Sapiens
QLLPGQMFQ

SEQ ID NO: 1275297 - protein, 9 aa, Homo Sapiens
QVFELSEKL

SEQ ID NO: 1275298 - protein, 9 aa, Homo Sapiens
PAASCPLCR

SEQ ID NO: 1275299 - protein, 9 aa, Homo Sapiens
FPLDSMVGG

SEQ ID NO: 1275300 - protein, 9 aa, Homo Sapiens
MSKVKVMPH

SEQ ID NO: 1275301 - protein, 9 aa, Homo Sapiens
AFYYNHAFT

SEQ ID NO: 1275302 - protein, 9 aa, Homo Sapiens
SVVTWGTLV

SEQ ID NO: 1275303 - protein, 9 aa, Homo Sapiens
RNGLAMAAG

SEQ ID NO: 1275304 - protein, 9 aa, Homo Sapiens
PLAAAAVRT

SEQ ID NO: 1275305 - protein, 9 aa, Homo Sapiens
PVQGAQRRE

SEQ ID NO: 1275306 - protein, 9 aa, Homo Sapiens
LSPPLPWRS

SEQ ID NO: 1275307 - protein, 9 aa, Homo Sapiens
LDRVMQDVV

SEQ ID NO: 1275308 - protein, 9 aa, Homo Sapiens
LQFELWRNV

SEQ ID NO: 1275309 - protein, 9 aa, Homo Sapiens
SRVGSNLPG

SEQ ID NO: 1275310 - protein, 9 aa, Homo Sapiens
KSEPEKAKG

SEQ ID NO: 1275311 - protein, 9 aa, Homo Sapiens
CSQDLAMPR

SEQ ID NO: 1275312 - protein, 9 aa, Homo Sapiens
PQEADAKRQ

SEQ ID NO: 1275313 - protein, 9 aa, Homo Sapiens
MLQEEANGG

SEQ ID NO: 1275314 - protein, 9 aa, Homo Sapiens
MIVTLECLH

SEQ ID NO: 1275315 - protein, 9 aa, Homo Sapiens
VLLSACCDN

SEQ ID NO: 1275316 - protein, 9 aa, Homo Sapiens
SRSPGARCR

SEQ ID NO: 1275317 - protein, 9 aa, Homo Sapiens
RAQRANLLS

SEQ ID NO: 1275318 - protein, 9 aa, Homo Sapiens
KPLEPNNPK

SEQ ID NO: 1275319 - protein, 9 aa, Homo Sapiens
DKPFKGDLK

SEQ ID NO: 1275320 - protein, 9 aa, Homo Sapiens
GPSRPPAAA

SEQ ID NO: 1275321 - protein, 9 aa, Homo Sapiens
AGPHPRRQC

SEQ ID NO: 1275322 - protein, 9 aa, Homo Sapiens
CPICGCGFV

SEQ ID NO: 1275323 - protein, 9 aa, Homo Sapiens
AVVVDLGTC

SEQ ID NO: 1275324 - protein, 9 aa, Homo Sapiens
RSSGMLGMG

SEQ ID NO: 1275325 - protein, 9 aa, Homo Sapiens
TTSSTPWIS

SEQ ID NO: 1275326 - protein, 9 aa, Homo Sapiens
DPRELAVAK

SEQ ID NO: 1275327 - protein, 9 aa, Homo Sapiens
VDLGTCYCK

SEQ ID NO: 1275328 - protein, 9 aa, Homo Sapiens
FYYNHAFTK

SEQ ID NO: 1275329 - protein, 9 aa, Homo Sapiens
FAVNQKNTT

SEQ ID NO: 1275330 - protein, 9 aa, Homo Sapiens
RTTMPAWTL

SEQ ID NO: 1275331 - protein, 9 aa, Homo Sapiens
VTQEFILLV

SEQ ID NO: 1275332 - protein, 9 aa, Homo Sapiens
KNDPGHDII

SEQ ID NO: 1275333 - protein, 9 aa, Homo Sapiens
HVLVRLISY

SEQ ID NO: 1275334 - protein, 9 aa, Homo Sapiens
LARGRSTSR

SEQ ID NO: 1275335 - protein, 9 aa, Homo Sapiens
KAILDILEY

SEQ ID NO: 1275336 - protein, 9 aa, Homo Sapiens
EDVRPLSHA

SEQ ID NO: 1275337 - protein, 9 aa, Homo Sapiens
YHSLVMCLR

SEQ ID NO: 1275338 - protein, 9 aa, Homo Sapiens
FVLGMDLFH

SEQ ID NO: 1275339 - protein, 9 aa, Homo Sapiens
DAVRKPKFA

SEQ ID NO: 1275340 - protein, 9 aa, Homo Sapiens
RGQQMSQAL

SEQ ID NO: 1275341 - protein, 9 aa, Homo Sapiens
IRSHTGECP

SEQ ID NO: 1275342 - protein, 9 aa, Homo Sapiens
SDEQGGDPK

SEQ ID NO: 1275343 - protein, 9 aa, Homo Sapiens
GPAGWARQA

SEQ ID NO: 1275344 - protein, 9 aa, Homo Sapiens
FHILTWPSW

SEQ ID NO: 1275345 - protein, 9 aa, Homo Sapiens
GDHVEDDGE

SEQ ID NO: 1275346 - protein, 9 aa, Homo Sapiens
PGRAQCIRQ

SEQ ID NO: 1275347 - protein, 9 aa, Homo Sapiens
LVEELRAEW

SEQ ID NO: 1275348 - protein, 9 aa, Homo Sapiens
ALFPCNECT

SEQ ID NO: 1275349 - protein, 9 aa, Homo Sapiens
AQQCCQHGV

SEQ ID NO: 1275350 - protein, 9 aa, Homo Sapiens
ICRDFSRNV

SEQ ID NO: 1275351 - protein, 9 aa, Homo Sapiens
FQAPVKDDQ

SEQ ID NO: 1275352 - protein, 9 aa, Homo Sapiens
SNLPGRATA

SEQ ID NO: 1275353 - protein, 9 aa, Homo Sapiens
SATSRKSIR

SEQ ID NO: 1275354 - protein, 9 aa, Homo Sapiens
PERGAVRSL

SEQ ID NO: 1275355 - protein, 9 aa, Homo Sapiens
PGVGAQCAD

SEQ ID NO: 1275356 - protein, 9 aa, Homo Sapiens
PQEQATGLP

SEQ ID NO: 1275357 - protein, 9 aa, Homo Sapiens
SPSGGFPSR

SEQ ID NO: 1275358 - protein, 9 aa, Homo Sapiens
SKDMSGLHI

SEQ ID NO: 1275359 - protein, 9 aa, Homo Sapiens
GGLSLPRLH

SEQ ID NO: 1275360 - protein, 9 aa, Homo Sapiens
WKSSCISLP

SEQ ID NO: 1275361 - protein, 9 aa, Homo Sapiens
PALSDLVIY

SEQ ID NO: 1275362 - protein, 9 aa, Homo Sapiens
PPLPKPRSL

SEQ ID NO: 1275363 - protein, 9 aa, Homo Sapiens
SGAPPPAAA

SEQ ID NO: 1275364 - protein, 9 aa, Homo Sapiens
RVEVALLRL

SEQ ID NO: 1275365 - protein, 9 aa, Homo Sapiens
QDSLNANLE

SEQ ID NO: 1275366 - protein, 9 aa, Homo Sapiens
ACTRLQRAR

SEQ ID NO: 1275367 - protein, 9 aa, Homo Sapiens
WLVGTDAPD

SEQ ID NO: 1275368 - protein, 9 aa, Homo Sapiens
SDKAFLSLA

SEQ ID NO: 1275369 - protein, 9 aa, Homo Sapiens
QRRRLPSVI

SEQ ID NO: 1275370 - protein, 9 aa, Homo Sapiens
ALRLWCWHK

SEQ ID NO: 1275371 - protein, 9 aa, Homo Sapiens
YVSKGALGL

SEQ ID NO: 1275372 - protein, 9 aa, Homo Sapiens
KDFEFALDM

SEQ ID NO: 1275373 - protein, 9 aa, Homo Sapiens
DKKRRNLQR

SEQ ID NO: 1275374 - protein, 9 aa, Homo Sapiens
SRELLDRCC

SEQ ID NO: 1275375 - protein, 9 aa, Homo Sapiens
VVKFFLQLQ

SEQ ID NO: 1275376 - protein, 9 aa, Homo Sapiens
VPRHQRLSP

SEQ ID NO: 1275377 - protein, 9 aa, Homo Sapiens
SHNKSVNEA

SEQ ID NO: 1275378 - protein, 9 aa, Homo Sapiens
TSGRGRWRP

SEQ ID NO: 1275379 - protein, 9 aa, Homo Sapiens
RREAGDPVA

SEQ ID NO: 1275380 - protein, 9 aa, Homo Sapiens
SVSDVSLSL

SEQ ID NO: 1275381 - protein, 9 aa, Homo Sapiens
VWFLSRKIQ

SEQ ID NO: 1275382 - protein, 9 aa, Homo Sapiens
SGLCSQDLA

SEQ ID NO: 1275383 - protein, 9 aa, Homo Sapiens
AGSLATGLH

SEQ ID NO: 1275384 - protein, 9 aa, Homo Sapiens
ASASPSIRS

SEQ ID NO: 1275385 - protein, 9 aa, Homo Sapiens
RIGGGTPLS

SEQ ID NO: 1275386 - protein, 9 aa, Homo Sapiens
LNEEQALSA

SEQ ID NO: 1275387 - protein, 9 aa, Homo Sapiens
NGLMGRGEH

SEQ ID NO: 1275388 - protein, 9 aa, Homo Sapiens
NYIVLFAAL

SEQ ID NO: 1275389 - protein, 9 aa, Homo Sapiens
QLVVGYRES

SEQ ID NO: 1275390 - protein, 9 aa, Homo Sapiens
ATGLHVNWR

SEQ ID NO: 1275391 - protein, 9 aa, Homo Sapiens
RRLPSVIPT

SEQ ID NO: 1275392 - protein, 9 aa, Homo Sapiens
AHRLPLDGE

SEQ ID NO: 1275393 - protein, 9 aa, Homo Sapiens
HQRLSPPAL

SEQ ID NO: 1275394 - protein, 9 aa, Homo Sapiens
HTVVVGVYR

SEQ ID NO: 1275395 - protein, 9 aa, Homo Sapiens
PTCKFFKGQ

SEQ ID NO: 1275396 - protein, 9 aa, Homo Sapiens
KRKFDDDSD

SEQ ID NO: 1275397 - protein, 9 aa, Homo Sapiens
SRYKKKKHK

SEQ ID NO: 1275398 - protein, 9 aa, Homo Sapiens
IEVQMKKYR

SEQ ID NO: 1275399 - protein, 9 aa, Homo Sapiens
KNQNHLQEN

SEQ ID NO: 1275400 - protein, 9 aa, Homo Sapiens
AMLRDEDAP

SEQ ID NO: 1275401 - protein, 9 aa, Homo Sapiens
AEEPPARER

SEQ ID NO: 1275402 - protein, 9 aa, Homo Sapiens
VQMKKYRNY

SEQ ID NO: 1275403 - protein, 9 aa, Homo Sapiens
VSKGLPLNH

SEQ ID NO: 1275404 - protein, 9 aa, Homo Sapiens
GPACRGKGS

SEQ ID NO: 1275405 - protein, 9 aa, Homo Sapiens
LALSVLNLA

SEQ ID NO: 1275406 - protein, 9 aa, Homo Sapiens
TLSVSLVKD

SEQ ID NO: 1275407 - protein, 9 aa, Homo Sapiens
ARDLCQAHR

SEQ ID NO: 1275408 - protein, 9 aa, Homo Sapiens
APDTIPPKR

SEQ ID NO: 1275409 - protein, 9 aa, Homo Sapiens
SQGFFPMAP

SEQ ID NO: 1275410 - protein, 9 aa, Homo Sapiens
GAGGQALTS

SEQ ID NO: 1275411 - protein, 9 aa, Homo Sapiens
MVRPDEPLS

SEQ ID NO: 1275412 - protein, 9 aa, Homo Sapiens
SARHSEASV

SEQ ID NO: 1275413 - protein, 9 aa, Homo Sapiens
GQISTLVLD

SEQ ID NO: 1275414 - protein, 9 aa, Homo Sapiens
GLSKDMSGL

SEQ ID NO: 1275415 - protein, 9 aa, Homo Sapiens
PFSREPSLV

SEQ ID NO: 1275416 - protein, 9 aa, Homo Sapiens
LIIEKVLKI

SEQ ID NO: 1275417 - protein, 9 aa, Homo Sapiens
TDFSSTFFS

SEQ ID NO: 1275418 - protein, 9 aa, Homo Sapiens
AYAQQCCQH

SEQ ID NO: 1275419 - protein, 9 aa, Homo Sapiens
RSAFPSRSL

SEQ ID NO: 1275420 - protein, 9 aa, Homo Sapiens
TFLRAFLRT

SEQ ID NO: 1275421 - protein, 9 aa, Homo Sapiens
IAPALSDLV

SEQ ID NO: 1275422 - protein, 9 aa, Homo Sapiens
LKIAPALSD

SEQ ID NO: 1275423 - protein, 9 aa, Homo Sapiens
RIWRIGRRS

SEQ ID NO: 1275424 - protein, 9 aa, Homo Sapiens
DLERFLNFC

SEQ ID NO: 1275425 - protein, 9 aa, Homo Sapiens
GGEEAVQSV

SEQ ID NO: 1275426 - protein, 9 aa, Homo Sapiens
TKLTKSVSV

SEQ ID NO: 1275427 - protein, 9 aa, Homo Sapiens
ASAQCSDGI

SEQ ID NO: 1275428 - protein, 9 aa, Homo Sapiens
GFFPMAPET

SEQ ID NO: 1275429 - protein, 9 aa, Homo Sapiens
EYTLGEQKF

SEQ ID NO: 1275430 - protein, 9 aa, Homo Sapiens
SRDLPIMIW

SEQ ID NO: 1275431 - protein, 9 aa, Homo Sapiens
GPHPKPPTP

SEQ ID NO: 1275432 - protein, 9 aa, Homo Sapiens
YYNHAFTKN

SEQ ID NO: 1275433 - protein, 9 aa, Homo Sapiens
TSLLVVGFS

SEQ ID NO: 1275434 - protein, 9 aa, Homo Sapiens
EYDRKEALE

SEQ ID NO: 1275435 - protein, 9 aa, Homo Sapiens
FEISHLQNL

SEQ ID NO: 1275436 - protein, 9 aa, Homo Sapiens
HLVDVNGTG

SEQ ID NO: 1275437 - protein, 9 aa, Homo Sapiens
TRLPKTSPR

SEQ ID NO: 1275438 - protein, 9 aa, Homo Sapiens
DILEYDRKE

SEQ ID NO: 1275439 - protein, 9 aa, Homo Sapiens
ARKQNVCRD

SEQ ID NO: 1275440 - protein, 9 aa, Homo Sapiens
HVLKCAKDQ

SEQ ID NO: 1275441 - protein, 9 aa, Homo Sapiens
TPFSREPSL

SEQ ID NO: 1275442 - protein, 9 aa, Homo Sapiens
TGTGIGPQA

SEQ ID NO: 1275443 - protein, 9 aa, Homo Sapiens
TMAFWLSRS

SEQ ID NO: 1275444 - protein, 9 aa, Homo Sapiens
DIIEDMWLG

SEQ ID NO: 1275445 - protein, 9 aa, Homo Sapiens
QQEGAMVII

SEQ ID NO: 1275446 - protein, 9 aa, Homo Sapiens
PYHDKFHSL

SEQ ID NO: 1275447 - protein, 9 aa, Homo Sapiens
GIFVTILLI

SEQ ID NO: 1275448 - protein, 9 aa, Homo Sapiens
SATEAWCRT

SEQ ID NO: 1275449 - protein, 9 aa, Homo Sapiens
LKKRKFDDD

SEQ ID NO: 1275450 - protein, 9 aa, Homo Sapiens
CCQCQEQPA

SEQ ID NO: 1275451 - protein, 9 aa, Homo Sapiens
MKDSTPVLY

SEQ ID NO: 1275452 - protein, 9 aa, Homo Sapiens
FLLGRGQQM

SEQ ID NO: 1275453 - protein, 9 aa, Homo Sapiens
SATAFAHDH

SEQ ID NO: 1275454 - protein, 9 aa, Homo Sapiens
LGMLHVVQR

SEQ ID NO: 1275455 - protein, 9 aa, Homo Sapiens
EAVRLQKEN

SEQ ID NO: 1275456 - protein, 9 aa, Homo Sapiens
NFSHVPSPD

SEQ ID NO: 1275457 - protein, 9 aa, Homo Sapiens
RKFDDDSDS

SEQ ID NO: 1275458 - protein, 9 aa, Homo Sapiens
EPSLVTLGQ

SEQ ID NO: 1275459 - protein, 9 aa, Homo Sapiens
ATTTTHRTT

SEQ ID NO: 1275460 - protein, 9 aa, Homo Sapiens
AQDPLAAAA

SEQ ID NO: 1275461 - protein, 9 aa, Homo Sapiens
KGRDMRFLM

SEQ ID NO: 1275462 - protein, 9 aa, Homo Sapiens
AQTRRSYPE

SEQ ID NO: 1275463 - protein, 9 aa, Homo Sapiens
PGRVREALH

SEQ ID NO: 1275464 - protein, 9 aa, Homo Sapiens
LEKALSALF

SEQ ID NO: 1275465 - protein, 9 aa, Homo Sapiens
DAPDDTQYF

SEQ ID NO: 1275466 - protein, 9 aa, Homo Sapiens
AYLQPGPVP

SEQ ID NO: 1275467 - protein, 9 aa, Homo Sapiens
KTCYIQSSS

SEQ ID NO: 1275468 - protein, 9 aa, Homo Sapiens
HAFTKNIIK

SEQ ID NO: 1275469 - protein, 9 aa, Homo Sapiens
IGSSHLIST

SEQ ID NO: 1275470 - protein, 9 aa, Homo Sapiens
PKENALFKW

SEQ ID NO: 1275471 - protein, 9 aa, Homo Sapiens
NWRVETVGK

SEQ ID NO: 1275472 - protein, 9 aa, Homo Sapiens
KGPQMPSSS

SEQ ID NO: 1275473 - protein, 9 aa, Homo Sapiens
GMVSLFGVR

SEQ ID NO: 1275474 - protein, 9 aa, Homo Sapiens
PPQEADAKR

SEQ ID NO: 1275475 - protein, 9 aa, Homo Sapiens
LKVTDADTP

SEQ ID NO: 1275476 - protein, 9 aa, Homo Sapiens
SYFTESAST

SEQ ID NO: 1275477 - protein, 9 aa, Homo Sapiens
MIVKGKVIL

SEQ ID NO: 1275478 - protein, 9 aa, Homo Sapiens
DGEALELHD

SEQ ID NO: 1275479 - protein, 9 aa, Homo Sapiens
RRAVALELQ

SEQ ID NO: 1275480 - protein, 9 aa, Homo Sapiens
IDPSPFTVC

SEQ ID NO: 1275481 - protein, 9 aa, Homo Sapiens
TWQRRLRAC

SEQ ID NO: 1275482 - protein, 9 aa, Homo Sapiens
NETPKKKRS

SEQ ID NO: 1275483 - protein, 9 aa, Homo Sapiens
LTDKDFEFA

SEQ ID NO: 1275484 - protein, 9 aa, Homo Sapiens
SPKSLKSGD

SEQ ID NO: 1275485 - protein, 9 aa, Homo Sapiens
DVSRASTSG

SEQ ID NO: 1275486 - protein, 9 aa, Homo Sapiens
EDEGDDDGG

SEQ ID NO: 1275487 - protein, 9 aa, Homo Sapiens
SWQRRRLPS

SEQ ID NO: 1275488 - protein, 9 aa, Homo Sapiens
FEEPERQRQ

SEQ ID NO: 1275489 - protein, 9 aa, Homo Sapiens
EVRVLGDPF

SEQ ID NO: 1275490 - protein, 9 aa, Homo Sapiens
DFGGDHVLP

SEQ ID NO: 1275491 - protein, 9 aa, Homo Sapiens
QPRRGPAAA

SEQ ID NO: 1275492 - protein, 9 aa, Homo Sapiens
RKPKFARHI

SEQ ID NO: 1275493 - protein, 9 aa, Homo Sapiens
LEPYERDHT

SEQ ID NO: 1275494 - protein, 9 aa, Homo Sapiens
FEDKIDLFQ

SEQ ID NO: 1275495 - protein, 9 aa, Homo Sapiens
SDVSLSLMK

SEQ ID NO: 1275496 - protein, 9 aa, Homo Sapiens
HCAAWKPSL

SEQ ID NO: 1275497 - protein, 9 aa, Homo Sapiens
PLILWPQAA

SEQ ID NO: 1275498 - protein, 9 aa, Homo Sapiens
LLVDYITAY

SEQ ID NO: 1275499 - protein, 9 aa, Homo Sapiens
LPGRAQCIR

SEQ ID NO: 1275500 - protein, 9 aa, Homo Sapiens
LRLVDSHHQ

SEQ ID NO: 1275501 - protein, 9 aa, Homo Sapiens
FSCLGTSGR

SEQ ID NO: 1275502 - protein, 9 aa, Homo Sapiens
PLDSMVGGA

SEQ ID NO: 1275503 - protein, 9 aa, Homo Sapiens
RCPYRKGKF

SEQ ID NO: 1275504 - protein, 9 aa, Homo Sapiens
NFQPPVAKK

SEQ ID NO: 1275505 - protein, 9 aa, Homo Sapiens
WPTCKFFKG

SEQ ID NO: 1275506 - protein, 9 aa, Homo Sapiens
VADVPYRLL

SEQ ID NO: 1275507 - protein, 9 aa, Homo Sapiens
TFQLCLGLP

SEQ ID NO: 1275508 - protein, 9 aa, Homo Sapiens
EGTSIQGSK

SEQ ID NO: 1275509 - protein, 9 aa, Homo Sapiens
PCWGRHVRA

SEQ ID NO: 1275510 - protein, 9 aa, Homo Sapiens
LETHILSEQ

SEQ ID NO: 1275511 - protein, 9 aa, Homo Sapiens
TKKSRTSQS

SEQ ID NO: 1275512 - protein, 9 aa, Homo Sapiens
GLDVTVMVH

SEQ ID NO: 1275513 - protein, 9 aa, Homo Sapiens
GHLVDVNGT

SEQ ID NO: 1275514 - protein, 9 aa, Homo Sapiens
QPSDDRVYF

SEQ ID NO: 1275515 - protein, 9 aa, Homo Sapiens
LALKIDPTE

SEQ ID NO: 1275516 - protein, 9 aa, Homo Sapiens
PVYEKYYRP

SEQ ID NO: 1275517 - protein, 9 aa, Homo Sapiens
APETPAPSP

SEQ ID NO: 1275518 - protein, 9 aa, Homo Sapiens
HSLKMRNLH

SEQ ID NO: 1275519 - protein, 9 aa, Homo Sapiens
IYLTDKDFE

SEQ ID NO: 1275520 - protein, 9 aa, Homo Sapiens
WRMIADPDQ

SEQ ID NO: 1275521 - protein, 9 aa, Homo Sapiens
WKCFIEERL

SEQ ID NO: 1275522 - protein, 9 aa, Homo Sapiens
PTPERGAVR

SEQ ID NO: 1275523 - protein, 9 aa, Homo Sapiens
PEHSVIDLW

SEQ ID NO: 1275524 - protein, 9 aa, Homo Sapiens
YSSTTNGHQ

SEQ ID NO: 1275525 - protein, 9 aa, Homo Sapiens
GEQKFTFIE

SEQ ID NO: 1275526 - protein, 9 aa, Homo Sapiens
EGPAEEPPA

SEQ ID NO: 1275527 - protein, 9 aa, Homo Sapiens
KACTGDRPE

SEQ ID NO: 1275528 - protein, 9 aa, Homo Sapiens
QLHNKKEGN

SEQ ID NO: 1275529 - protein, 9 aa, Homo Sapiens
PGPRCPHSW

SEQ ID NO: 1275530 - protein, 9 aa, Homo Sapiens
LILWPQAAP

SEQ ID NO: 1275531 - protein, 9 aa, Homo Sapiens
VEQDKMTPG

SEQ ID NO: 1275532 - protein, 9 aa, Homo Sapiens
LGLLADFPL

SEQ ID NO: 1275533 - protein, 9 aa, Homo Sapiens
VDSHHQLWR

SEQ ID NO: 1275534 - protein, 9 aa, Homo Sapiens
SDMPYDTRQ

SEQ ID NO: 1275535 - protein, 9 aa, Homo Sapiens
FGKFNVINY

SEQ ID NO: 1275536 - protein, 9 aa, Homo Sapiens
ALDRQTATR

SEQ ID NO: 1275537 - protein, 9 aa, Homo Sapiens
QCSQHQPAR

SEQ ID NO: 1275538 - protein, 9 aa, Homo Sapiens
ILYSNSKGL

SEQ ID NO: 1275539 - protein, 9 aa, Homo Sapiens
KWILRCYEH

SEQ ID NO: 1275540 - protein, 9 aa, Homo Sapiens
IKLLKKRSL

SEQ ID NO: 1275541 - protein, 9 aa, Homo Sapiens
ATRVEILWR

SEQ ID NO: 1275542 - protein, 9 aa, Homo Sapiens
AGVQGGNEL

SEQ ID NO: 1275543 - protein, 9 aa, Homo Sapiens
KQIFPTEER

SEQ ID NO: 1275544 - protein, 9 aa, Homo Sapiens
PKRPRAGSL

SEQ ID NO: 1275545 - protein, 9 aa, Homo Sapiens
PWQCGSDHG

SEQ ID NO: 1275546 - protein, 9 aa, Homo Sapiens
LTLDGRVHA

SEQ ID NO: 1275547 - protein, 9 aa, Homo Sapiens
PPPLLLAPP

SEQ ID NO: 1275548 - protein, 9 aa, Homo Sapiens
GSFPVGWKF

SEQ ID NO: 1275549 - protein, 9 aa, Homo Sapiens
APFNFPAMT

SEQ ID NO: 1275550 - protein, 9 aa, Homo Sapiens
GCTAGTQHP

SEQ ID NO: 1275551 - protein, 9 aa, Homo Sapiens
QICWAWEDS

SEQ ID NO: 1275552 - protein, 9 aa, Homo Sapiens
RGQQYGVKN

SEQ ID NO: 1275553 - protein, 9 aa, Homo Sapiens
CGSDHGTTR

SEQ ID NO: 1275554 - protein, 9 aa, Homo Sapiens
RSARWPTCK

SEQ ID NO: 1275555 - protein, 9 aa, Homo Sapiens
FTVTYMLLN

SEQ ID NO: 1275556 - protein, 9 aa, Homo Sapiens
QAQRLEGEA

SEQ ID NO: 1275557 - protein, 9 aa, Homo Sapiens
VHRDQPAEQ

SEQ ID NO: 1275558 - protein, 9 aa, Homo Sapiens
LLQNMWDGN

SEQ ID NO: 1275559 - protein, 9 aa, Homo Sapiens
PAKMRRRSW

SEQ ID NO: 1275560 - protein, 9 aa, Homo Sapiens
YTTGQVFEL

SEQ ID NO: 1275561 - protein, 9 aa, Homo Sapiens
KPGLPCAQD

SEQ ID NO: 1275562 - protein, 9 aa, Homo Sapiens
ATAELKNAT

SEQ ID NO: 1275563 - protein, 9 aa, Homo Sapiens
GTLVSGLGL

SEQ ID NO: 1275564 - protein, 9 aa, Homo Sapiens
QEQRKQSRM

SEQ ID NO: 1275565 - protein, 9 aa, Homo Sapiens
TSQSWKAGK

SEQ ID NO: 1275566 - protein, 9 aa, Homo Sapiens
PRQGLRFQS

SEQ ID NO: 1275567 - protein, 9 aa, Homo Sapiens
LGTGACIGM

SEQ ID NO: 1275568 - protein, 9 aa, Homo Sapiens
ATCQGRKYI

SEQ ID NO: 1275569 - protein, 9 aa, Homo Sapiens
SSCPGEAPC

SEQ ID NO: 1275570 - protein, 9 aa, Homo Sapiens
PKNLSRPLP

SEQ ID NO: 1275571 - protein, 9 aa, Homo Sapiens
DYRGRLSPM

SEQ ID NO: 1275572 - protein, 9 aa, Homo Sapiens
RHMDLHVFH

SEQ ID NO: 1275573 - protein, 9 aa, Homo Sapiens
CSPCCCQEW

SEQ ID NO: 1275574 - protein, 9 aa, Homo Sapiens
PQNRSRTNG

SEQ ID NO: 1275575 - protein, 9 aa, Homo Sapiens
LQPGEKKSQ

SEQ ID NO: 1275576 - protein, 9 aa, Homo Sapiens
TGTLQRSKP

SEQ ID NO: 1275577 - protein, 9 aa, Homo Sapiens
TVDFGGDHV

SEQ ID NO: 1275578 - protein, 9 aa, Homo Sapiens
EALETQLPS

SEQ ID NO: 1275579 - protein, 9 aa, Homo Sapiens
FDEPQEQAT

SEQ ID NO: 1275580 - protein, 9 aa, Homo Sapiens
VLVTEKGSL

SEQ ID NO: 1275581 - protein, 9 aa, Homo Sapiens
TPQVPPPCC

SEQ ID NO: 1275582 - protein, 9 aa, Homo Sapiens
IVTLECLHE

SEQ ID NO: 1275583 - protein, 9 aa, Homo Sapiens
DPSPFTVCK

SEQ ID NO: 1275584 - protein, 9 aa, Homo Sapiens
HPTAHPSIT

SEQ ID NO: 1275585 - protein, 9 aa, Homo Sapiens
HRRENAERL

SEQ ID NO: 1275586 - protein, 9 aa, Homo Sapiens
PGPHPKPPT

SEQ ID NO: 1275587 - protein, 9 aa, Homo Sapiens
GSLATGLHV

SEQ ID NO: 1275588 - protein, 9 aa, Homo Sapiens
HLESSSEGG

SEQ ID NO: 1275589 - protein, 9 aa, Homo Sapiens
KQVSRDLPI

SEQ ID NO: 1275590 - protein, 9 aa, Homo Sapiens
ATPTCGDSP

SEQ ID NO: 1275591 - protein, 9 aa, Homo Sapiens
QRSSACTRS

SEQ ID NO: 1275592 - protein, 9 aa, Homo Sapiens
GGRTVQDSR

SEQ ID NO: 1275593 - protein, 9 aa, Homo Sapiens
HLERHRAKH

SEQ ID NO: 1275594 - protein, 9 aa, Homo Sapiens
ELLPGEGAA

SEQ ID NO: 1275595 - protein, 9 aa, Homo Sapiens
NHLQENGKW

SEQ ID NO: 1275596 - protein, 9 aa, Homo Sapiens
LMGLIPYDQ

SEQ ID NO: 1275597 - protein, 9 aa, Homo Sapiens
CVIPTRGLR

SEQ ID NO: 1275598 - protein, 9 aa, Homo Sapiens
PHDRPILYS

SEQ ID NO: 1275599 - protein, 9 aa, Homo Sapiens
SAAGGTLAS

SEQ ID NO: 1275600 - protein, 9 aa, Homo Sapiens
LGPYHDKFH

SEQ ID NO: 1275601 - protein, 9 aa, Homo Sapiens
QSALRVMQW

SEQ ID NO: 1275602 - protein, 9 aa, Homo Sapiens
HSILLRGFD

SEQ ID NO: 1275603 - protein, 9 aa, Homo Sapiens
CKGSTPTDA

SEQ ID NO: 1275604 - protein, 9 aa, Homo Sapiens
STSRTFRSL

SEQ ID NO: 1275605 - protein, 9 aa, Homo Sapiens
LQASAGKLL

SEQ ID NO: 1275606 - protein, 9 aa, Homo Sapiens
PNSAYGGTD

SEQ ID NO: 1275607 - protein, 9 aa, Homo Sapiens
DRCCVEYGV

SEQ ID NO: 1275608 - protein, 9 aa, Homo Sapiens
LTFEEPERQ

SEQ ID NO: 1275609 - protein, 9 aa, Homo Sapiens
LAEGVAALA

SEQ ID NO: 1275610 - protein, 9 aa, Homo Sapiens
LQPGPVPCV

SEQ ID NO: 1275611 - protein, 9 aa, Homo Sapiens
PQPVLLGLL

SEQ ID NO: 1275612 - protein, 9 aa, Homo Sapiens
QVTAMNMAG

SEQ ID NO: 1275613 - protein, 9 aa, Homo Sapiens
VLNLAECAG

SEQ ID NO: 1275614 - protein, 9 aa, Homo Sapiens
APSSPGPRC

SEQ ID NO: 1275615 - protein, 9 aa, Homo Sapiens
TPTCGDSPS

SEQ ID NO: 1275616 - protein, 9 aa, Homo Sapiens
SKVPGGSRP

SEQ ID NO: 1275617 - protein, 9 aa, Homo Sapiens
CRIGSSHLI

SEQ ID NO: 1275618 - protein, 9 aa, Homo Sapiens
HHPDFPLLE

SEQ ID NO: 1275619 - protein, 9 aa, Homo Sapiens
LEDVQSYRA

SEQ ID NO: 1275620 - protein, 9 aa, Homo Sapiens
FKRIHLRPR

SEQ ID NO: 1275621 - protein, 9 aa, Homo Sapiens
QAAVTFRRR

SEQ ID NO: 1275622 - protein, 9 aa, Homo Sapiens
HVPSPDMSA

SEQ ID NO: 1275623 - protein, 9 aa, Homo Sapiens
TKSEPEKAK

SEQ ID NO: 1275624 - protein, 9 aa, Homo Sapiens
EPQEQATGL

SEQ ID NO: 1275625 - protein, 9 aa, Homo Sapiens
DMPYDTRQN

SEQ ID NO: 1275626 - protein, 9 aa, Homo Sapiens
FPVGWKFAA

SEQ ID NO: 1275627 - protein, 9 aa, Homo Sapiens
LASVVTWGT

SEQ ID NO: 1275628 - protein, 9 aa, Homo Sapiens
HDCCQCQEQ

SEQ ID NO: 1275629 - protein, 9 aa, Homo Sapiens
ERTATEEKA

SEQ ID NO: 1275630 - protein, 9 aa, Homo Sapiens
THVNICVFI

SEQ ID NO: 1275631 - protein, 9 aa, Homo Sapiens
LMQLDVSRM

SEQ ID NO: 1275632 - protein, 9 aa, Homo Sapiens
FSYVFIIIT

SEQ ID NO: 1275633 - protein, 9 aa, Homo Sapiens
LFIWPQHSY

SEQ ID NO: 1275634 - protein, 9 aa, Homo Sapiens
ASDEQGGDP

SEQ ID NO: 1275635 - protein, 9 aa, Homo Sapiens
RAGLHPCGK

SEQ ID NO: 1275636 - protein, 9 aa, Homo Sapiens
RATTKKSRT

SEQ ID NO: 1275637 - protein, 9 aa, Homo Sapiens
ESYFTESAS

SEQ ID NO: 1275638 - protein, 9 aa, Homo Sapiens
PPLPWRSPT

SEQ ID NO: 1275639 - protein, 9 aa, Homo Sapiens
SLACSITVS

SEQ ID NO: 1275640 - protein, 9 aa, Homo Sapiens
FRRHLWLPC

SEQ ID NO: 1275641 - protein, 9 aa, Homo Sapiens
STTNGHQNG

SEQ ID NO: 1275642 - protein, 9 aa, Homo Sapiens
LFGKGPQMP

SEQ ID NO: 1275643 - protein, 9 aa, Homo Sapiens
QKKEEVFLI

SEQ ID NO: 1275644 - protein, 9 aa, Homo Sapiens
RHTLPSQGV

SEQ ID NO: 1275645 - protein, 9 aa, Homo Sapiens
SCLGTSGRG

SEQ ID NO: 1275646 - protein, 9 aa, Homo Sapiens
QDVVYKLVP

SEQ ID NO: 1275647 - protein, 9 aa, Homo Sapiens
SSRASTSWC

SEQ ID NO: 1275648 - protein, 9 aa, Homo Sapiens
KRVALLTMW

SEQ ID NO: 1275649 - protein, 9 aa, Homo Sapiens
ALLRLAEGV

SEQ ID NO: 1275650 - protein, 9 aa, Homo Sapiens
VQKKEEVFL

SEQ ID NO: 1275651 - protein, 9 aa, Homo Sapiens
ESASTGTLQ

SEQ ID NO: 1275652 - protein, 9 aa, Homo Sapiens
TVEKPYQCN

SEQ ID NO: 1275653 - protein, 9 aa, Homo Sapiens
SEPEKAKGE

SEQ ID NO: 1275654 - protein, 9 aa, Homo Sapiens
FHSLKKVVV

SEQ ID NO: 1275655 - protein, 9 aa, Homo Sapiens
RVGSNLPGR

SEQ ID NO: 1275656 - protein, 9 aa, Homo Sapiens
PSPRSGHSP

SEQ ID NO: 1275657 - protein, 9 aa, Homo Sapiens
MVGGAYGTG

SEQ ID NO: 1275658 - protein, 9 aa, Homo Sapiens
PFNFPAMTP

SEQ ID NO: 1275659 - protein, 9 aa, Homo Sapiens
HTTMYFLFG

SEQ ID NO: 1275660 - protein, 9 aa, Homo Sapiens
STIFQMLII

SEQ ID NO: 1275661 - protein, 9 aa, Homo Sapiens
TLTVNISDK

SEQ ID NO: 1275662 - protein, 9 aa, Homo Sapiens
VFLKSLRLV

SEQ ID NO: 1275663 - protein, 9 aa, Homo Sapiens
LTSSAGPKR

SEQ ID NO: 1275664 - protein, 9 aa, Homo Sapiens
EGEAELAVH

SEQ ID NO: 1275665 - protein, 9 aa, Homo Sapiens
YGVKNQNHL

SEQ ID NO: 1275666 - protein, 9 aa, Homo Sapiens
TRLQRARKP

SEQ ID NO: 1275667 - protein, 9 aa, Homo Sapiens
LDSMVGGAY

SEQ ID NO: 1275668 - protein, 9 aa, Homo Sapiens
CNLKIDGTL

SEQ ID NO: 1275669 - protein, 9 aa, Homo Sapiens
IQLASGSMG

SEQ ID NO: 1275670 - protein, 9 aa, Homo Sapiens
LGDSFRPHL

SEQ ID NO: 1275671 - protein, 9 aa, Homo Sapiens
EEVLMVVGG

SEQ ID NO: 1275672 - protein, 9 aa, Homo Sapiens
ETPAPSPRS

SEQ ID NO: 1275673 - protein, 9 aa, Homo Sapiens
LCLFQSPMH

SEQ ID NO: 1275674 - protein, 9 aa, Homo Sapiens
RRALYAVLF

SEQ ID NO: 1275675 - protein, 9 aa, Homo Sapiens
PPLPGRAQC

SEQ ID NO: 1275676 - protein, 9 aa, Homo Sapiens
KTGMVRPDE

SEQ ID NO: 1275677 - protein, 9 aa, Homo Sapiens
RNQQFTRLV

SEQ ID NO: 1275678 - protein, 9 aa, Homo Sapiens
GWGCCLRFL

SEQ ID NO: 1275679 - protein, 9 aa, Homo Sapiens
IQEQRKQSR

SEQ ID NO: 1275680 - protein, 9 aa, Homo Sapiens
LALRLWCWH

SEQ ID NO: 1275681 - protein, 9 aa, Homo Sapiens
HRHMDLHVF

SEQ ID NO: 1275682 - protein, 9 aa, Homo Sapiens
CPPQKSSCP

SEQ ID NO: 1275683 - protein, 9 aa, Homo Sapiens
GGELMSALD

SEQ ID NO: 1275684 - protein, 9 aa, Homo Sapiens
LLPGGELLH

SEQ ID NO: 1275685 - protein, 9 aa, Homo Sapiens
EGDDDGGGD

SEQ ID NO: 1275686 - protein, 9 aa, Homo Sapiens
THILSEQHR

SEQ ID NO: 1275687 - protein, 9 aa, Homo Sapiens
GMLHVVQRG

SEQ ID NO: 1275688 - protein, 9 aa, Homo Sapiens
FERPRTTMP

SEQ ID NO: 1275689 - protein, 9 aa, Homo Sapiens
GLHPCGKAH

SEQ ID NO: 1275690 - protein, 9 aa, Homo Sapiens
CGLCKVARL

SEQ ID NO: 1275691 - protein, 9 aa, Homo Sapiens
ETTSSTPWI

SEQ ID NO: 1275692 - protein, 9 aa, Homo Sapiens
SSWGWGCCL

SEQ ID NO: 1275693 - protein, 9 aa, Homo Sapiens
TLVSGLGLL

SEQ ID NO: 1275694 - protein, 9 aa, Homo Sapiens
LLPGQMFQT

SEQ ID NO: 1275695 - protein, 9 aa, Homo Sapiens
QDPEPMWQA

SEQ ID NO: 1275696 - protein, 9 aa, Homo Sapiens
ILNLQVLKK

SEQ ID NO: 1275697 - protein, 9 aa, Homo Sapiens
SVSAYAQQC

SEQ ID NO: 1275698 - protein, 9 aa, Homo Sapiens
KTTNADIQM

SEQ ID NO: 1275699 - protein, 9 aa, Homo Sapiens
WLPCQRLPR

SEQ ID NO: 1275700 - protein, 9 aa, Homo Sapiens
LVVGYRESA

SEQ ID NO: 1275701 - protein, 9 aa, Homo Sapiens
IRHYRIHTV

SEQ ID NO: 1275702 - protein, 9 aa, Homo Sapiens
EASRDPAKM

SEQ ID NO: 1275703 - protein, 9 aa, Homo Sapiens
ELNFIRCLA

SEQ ID NO: 1275704 - protein, 9 aa, Homo Sapiens
PHHSLKMRN

SEQ ID NO: 1275705 - protein, 9 aa, Homo Sapiens
VVCGSMHQG

SEQ ID NO: 1275706 - protein, 9 aa, Homo Sapiens
RQQEFEISH

SEQ ID NO: 1275707 - protein, 9 aa, Homo Sapiens
PGPHLQQWK

SEQ ID NO: 1275708 - protein, 9 aa, Homo Sapiens
VHGPACRGK

SEQ ID NO: 1275709 - protein, 9 aa, Homo Sapiens
DSRNIDNCW

SEQ ID NO: 1275710 - protein, 9 aa, Homo Sapiens
PRPPLPKPR

SEQ ID NO: 1275711 - protein, 9 aa, Homo Sapiens
GSGPTCGRW

SEQ ID NO: 1275712 - protein, 9 aa, Homo Sapiens
CFIEERLLM

SEQ ID NO: 1275713 - protein, 9 aa, Homo Sapiens
EVRLEKMPP

SEQ ID NO: 1275714 - protein, 9 aa, Homo Sapiens
QFELWRNVL

SEQ ID NO: 1275715 - protein, 9 aa, Homo Sapiens
LYNLASRTE

SEQ ID NO: 1275716 - protein, 9 aa, Homo Sapiens
GHPDGQCAP

SEQ ID NO: 1275717 - protein, 9 aa, Homo Sapiens
EHYPHDRPI

SEQ ID NO: 1275718 - protein, 9 aa, Homo Sapiens
RGEHPYPWQ

SEQ ID NO: 1275719 - protein, 9 aa, Homo Sapiens
GEVVETQEG

SEQ ID NO: 1275720 - protein, 9 aa, Homo Sapiens
LPLIWKKKM

SEQ ID NO: 1275721 - protein, 9 aa, Homo Sapiens
KNLSRPLPG

SEQ ID NO: 1275722 - protein, 9 aa, Homo Sapiens
ATQGCTAGT

SEQ ID NO: 1275723 - protein, 9 aa, Homo Sapiens
LRLAEGVAA

SEQ ID NO: 1275724 - protein, 9 aa, Homo Sapiens
DKFHSLNMV

SEQ ID NO: 1275725 - protein, 9 aa, Homo Sapiens
FSQENYKDH

SEQ ID NO: 1275726 - protein, 9 aa, Homo Sapiens
RKPLIVLNK

SEQ ID NO: 1275727 - protein, 9 aa, Homo Sapiens
DFLLHSLNM

SEQ ID NO: 1275728 - protein, 9 aa, Homo Sapiens
KASQHFTRV

SEQ ID NO: 1275729 - protein, 9 aa, Homo Sapiens
DEPQEQATG

SEQ ID NO: 1275730 - protein, 9 aa, Homo Sapiens
EGSLKKTSR

SEQ ID NO: 1275731 - protein, 9 aa, Homo Sapiens
AAGIHSLAS

SEQ ID NO: 1275732 - protein, 9 aa, Homo Sapiens
EKCPFRTAS

SEQ ID NO: 1275733 - protein, 9 aa, Homo Sapiens
LQCLSKLPR

SEQ ID NO: 1275734 - protein, 9 aa, Homo Sapiens
VELQRNPLP

SEQ ID NO: 1275735 - protein, 9 aa, Homo Sapiens
TVVQYLMQL

SEQ ID NO: 1275736 - protein, 9 aa, Homo Sapiens
IANFNTQQN

SEQ ID NO: 1275737 - protein, 9 aa, Homo Sapiens
DLAMPRHLC

SEQ ID NO: 1275738 - protein, 9 aa, Homo Sapiens
QGPSIVTPH

SEQ ID NO: 1275739 - protein, 9 aa, Homo Sapiens
LVQHDALEV

SEQ ID NO: 1275740 - protein, 9 aa, Homo Sapiens
LGPEKTSLF

SEQ ID NO: 1275741 - protein, 9 aa, Homo Sapiens
FGGAAYLQP

SEQ ID NO: 1275742 - protein, 9 aa, Homo Sapiens
CPYRKGKFR

SEQ ID NO: 1275743 - protein, 9 aa, Homo Sapiens
ITVQKNKNT

SEQ ID NO: 1275744 - protein, 9 aa, Homo Sapiens
EQATGLPTS

SEQ ID NO: 1275745 - protein, 9 aa, Homo Sapiens
RDTGSKGWQ

SEQ ID NO: 1275746 - protein, 9 aa, Homo Sapiens
PVLLGLLSP

SEQ ID NO: 1275747 - protein, 9 aa, Homo Sapiens
EAETYHCLL

SEQ ID NO: 1275748 - protein, 9 aa, Homo Sapiens
TMPAWTLQT

SEQ ID NO: 1275749 - protein, 9 aa, Homo Sapiens
EGLPQVQWA

SEQ ID NO: 1275750 - protein, 9 aa, Homo Sapiens
RVLGDPFPV

SEQ ID NO: 1275751 - protein, 9 aa, Homo Sapiens
GQALTSDSE

SEQ ID NO: 1275752 - protein, 9 aa, Homo Sapiens
KVVVVTVCG

SEQ ID NO: 1275753 - protein, 9 aa, Homo Sapiens
RPDEPLSGE

SEQ ID NO: 1275754 - protein, 9 aa, Homo Sapiens
SHHQLWRVT

SEQ ID NO: 1275755 - protein, 9 aa, Homo Sapiens
TEQFGKFNV

SEQ ID NO: 1275756 - protein, 9 aa, Homo Sapiens
INAAYTLGK

SEQ ID NO: 1275757 - protein, 9 aa, Homo Sapiens
SHLRSGQLH

SEQ ID NO: 1275758 - protein, 9 aa, Homo Sapiens
YAVLFGERL

SEQ ID NO: 1275759 - protein, 9 aa, Homo Sapiens
WGWGCCLRF

SEQ ID NO: 1275760 - protein, 9 aa, Homo Sapiens
NIAKQLCLY

SEQ ID NO: 1275761 - protein, 9 aa, Homo Sapiens
WLVLLWGAA

SEQ ID NO: 1275762 - protein, 9 aa, Homo Sapiens
SPGARCRNS

SEQ ID NO: 1275763 - protein, 9 aa, Homo Sapiens
SDYDEGDYD

SEQ ID NO: 1275764 - protein, 9 aa, Homo Sapiens
QPLSGKVLA

SEQ ID NO: 1275765 - protein, 9 aa, Homo Sapiens
RQEWKCFIE

SEQ ID NO: 1275766 - protein, 9 aa, Homo Sapiens
MGDIFCQGF

SEQ ID NO: 1275767 - protein, 9 aa, Homo Sapiens
RENFSHVPS

SEQ ID NO: 1275768 - protein, 9 aa, Homo Sapiens
WLLCSPCCC

SEQ ID NO: 1275769 - protein, 9 aa, Homo Sapiens
ECPFQCSLC

SEQ ID NO: 1275770 - protein, 9 aa, Homo Sapiens
AVASPYPKR

SEQ ID NO: 1275771 - protein, 9 aa, Homo Sapiens
AAAAPETPA

SEQ ID NO: 1275772 - protein, 9 aa, Homo Sapiens
PSGGEAKTW

SEQ ID NO: 1275773 - protein, 9 aa, Homo Sapiens
VCSHRRGGE

SEQ ID NO: 1275774 - protein, 9 aa, Homo Sapiens
DKLVDFVVT

SEQ ID NO: 1275775 - protein, 9 aa, Homo Sapiens
HYDKCVFAF

SEQ ID NO: 1275776 - protein, 9 aa, Homo Sapiens
VAHVYCHLE

SEQ ID NO: 1275777 - protein, 9 aa, Homo Sapiens
DFTEKIMIV

SEQ ID NO: 1275778 - protein, 9 aa, Homo Sapiens
LKIHKSMIQ

SEQ ID NO: 1275779 - protein, 9 aa, Homo Sapiens
GSDHGTTRL

SEQ ID NO: 1275780 - protein, 9 aa, Homo Sapiens
TCPVTPATA

SEQ ID NO: 1275781 - protein, 9 aa, Homo Sapiens
NRIRLHRLI

SEQ ID NO: 1275782 - protein, 9 aa, Homo Sapiens
FREENKSDM

SEQ ID NO: 1275783 - protein, 9 aa, Homo Sapiens
NADIQMPFT

SEQ ID NO: 1275784 - protein, 9 aa, Homo Sapiens
QLEAVCSHR

SEQ ID NO: 1275785 - protein, 9 aa, Homo Sapiens
LSKLPRHIS

SEQ ID NO: 1275786 - protein, 9 aa, Homo Sapiens
LFSCLGTSG

SEQ ID NO: 1275787 - protein, 9 aa, Homo Sapiens
KRASAQCSD

SEQ ID NO: 1275788 - protein, 9 aa, Homo Sapiens
RVDQSLACE

SEQ ID NO: 1275789 - protein, 9 aa, Homo Sapiens
CCCQEWLDY

SEQ ID NO: 1275790 - protein, 9 aa, Homo Sapiens
LAVAKSWII

SEQ ID NO: 1275791 - protein, 9 aa, Homo Sapiens
LLCSPCCCQ

SEQ ID NO: 1275792 - protein, 9 aa, Homo Sapiens
ALDEGRTTT

SEQ ID NO: 1275793 - protein, 9 aa, Homo Sapiens
SDAICRDFS

SEQ ID NO: 1275794 - protein, 9 aa, Homo Sapiens
HWKRYQRSH

SEQ ID NO: 1275795 - protein, 9 aa, Homo Sapiens
CILLAAVAW

SEQ ID NO: 1275796 - protein, 9 aa, Homo Sapiens
QSWKAGKSW

SEQ ID NO: 1275797 - protein, 9 aa, Homo Sapiens
EEGGDDDDE

SEQ ID NO: 1275798 - protein, 9 aa, Homo Sapiens
HPSQRLLVP

SEQ ID NO: 1275799 - protein, 9 aa, Homo Sapiens
PKDTWQDEE

SEQ ID NO: 1275800 - protein, 9 aa, Homo Sapiens
MPAWTLQTF

SEQ ID NO: 1275801 - protein, 9 aa, Homo Sapiens
HRTATTTTH

SEQ ID NO: 1275802 - protein, 9 aa, Homo Sapiens
NYDVSVYSA

SEQ ID NO: 1275803 - protein, 9 aa, Homo Sapiens
HVLPVQGAQ

SEQ ID NO: 1275804 - protein, 9 aa, Homo Sapiens
HCRLTYVAH

SEQ ID NO: 1275805 - protein, 9 aa, Homo Sapiens
ETYHCLLAC

SEQ ID NO: 1275806 - protein, 9 aa, Homo Sapiens
NITVQKNKN

SEQ ID NO: 1275807 - protein, 9 aa, Homo Sapiens
TVQDSRKRK

SEQ ID NO: 1275808 - protein, 9 aa, Homo Sapiens
GCWSSGRPG

SEQ ID NO: 1275809 - protein, 9 aa, Homo Sapiens
RTTTCKGST

SEQ ID NO: 1275810 - protein, 9 aa, Homo Sapiens
GPRCPHSWS

SEQ ID NO: 1275811 - protein, 9 aa, Homo Sapiens
FRSAAFPAW

SEQ ID NO: 1275812 - protein, 9 aa, Homo Sapiens
CYCKCGFAG

SEQ ID NO: 1275813 - protein, 9 aa, Homo Sapiens
PVMIKGKPF

SEQ ID NO: 1275814 - protein, 9 aa, Homo Sapiens
GAPPECYLG

SEQ ID NO: 1275815 - protein, 9 aa, Homo Sapiens
YTTHYPTDE

SEQ ID NO: 1275816 - protein, 9 aa, Homo Sapiens
AARKKLLEA

SEQ ID NO: 1275817 - protein, 9 aa, Homo Sapiens
QHIMGDIFC

SEQ ID NO: 1275818 - protein, 9 aa, Homo Sapiens
LLRLQSLLS

SEQ ID NO: 1275819 - protein, 9 aa, Homo Sapiens
LGVRLLLRA

SEQ ID NO: 1275820 - protein, 9 aa, Homo Sapiens
LLSPRPPLP

SEQ ID NO: 1275821 - protein, 9 aa, Homo Sapiens
KSVTQEFIL

SEQ ID NO: 1275822 - protein, 9 aa, Homo Sapiens
KGSLVEVIN

SEQ ID NO: 1275823 - protein, 9 aa, Homo Sapiens
GDSFRPHLC

SEQ ID NO: 1275824 - protein, 9 aa, Homo Sapiens
RERAAQTRR

SEQ ID NO: 1275825 - protein, 9 aa, Homo Sapiens
CRPSCCISN

SEQ ID NO: 1275826 - protein, 9 aa, Homo Sapiens
FQMLIIEKV

SEQ ID NO: 1275827 - protein, 9 aa, Homo Sapiens
IRNTGNFQP

SEQ ID NO: 1275828 - protein, 9 aa, Homo Sapiens
MRFLMNLHN

SEQ ID NO: 1275829 - protein, 9 aa, Homo Sapiens
EKGRDMRFL

SEQ ID NO: 1275830 - protein, 9 aa, Homo Sapiens
GPYIFYKDF

SEQ ID NO: 1275831 - protein, 9 aa, Homo Sapiens
GSLKKTSRI

SEQ ID NO: 1275832 - protein, 9 aa, Homo Sapiens
VLMVVGGQA

SEQ ID NO: 1275833 - protein, 9 aa, Homo Sapiens
FYKDFQFHL

SEQ ID NO: 1275834 - protein, 9 aa, Homo Sapiens
LQALGHDSP

SEQ ID NO: 1275835 - protein, 9 aa, Homo Sapiens
STVVQYLMQ

SEQ ID NO: 1275836 - protein, 9 aa, Homo Sapiens
PRTTMPAWT

SEQ ID NO: 1275837 - protein, 9 aa, Homo Sapiens
AASCPLCRG

SEQ ID NO: 1275838 - protein, 9 aa, Homo Sapiens
GTVMIPDVT

SEQ ID NO: 1275839 - protein, 9 aa, Homo Sapiens
HWNGKKMLS

SEQ ID NO: 1275840 - protein, 9 aa, Homo Sapiens
QVCILLAAV

SEQ ID NO: 1275841 - protein, 9 aa, Homo Sapiens
LYVLTLDGR

SEQ ID NO: 1275842 - protein, 9 aa, Homo Sapiens
WYSINWMED

SEQ ID NO: 1275843 - protein, 9 aa, Homo Sapiens
PWQTVTRNR

SEQ ID NO: 1275844 - protein, 9 aa, Homo Sapiens
LFITFPISF

SEQ ID NO: 1275845 - protein, 9 aa, Homo Sapiens
LPCQRLPRV

SEQ ID NO: 1275846 - protein, 9 aa, Homo Sapiens
KSIREAASA

SEQ ID NO: 1275847 - protein, 9 aa, Homo Sapiens
HCLLACPQF

SEQ ID NO: 1275848 - protein, 9 aa, Homo Sapiens
RLVEELRAE

SEQ ID NO: 1275849 - protein, 9 aa, Homo Sapiens
GAVGVGKSA

SEQ ID NO: 1275850 - protein, 9 aa, Homo Sapiens
LPRHISPFW

SEQ ID NO: 1275851 - protein, 9 aa, Homo Sapiens
SDTPTMLNP

SEQ ID NO: 1275852 - protein, 9 aa, Homo Sapiens
YMLLNNLQD

SEQ ID NO: 1275853 - protein, 9 aa, Homo Sapiens
TADADQHGV

SEQ ID NO: 1275854 - protein, 9 aa, Homo Sapiens
GPVPCVIPT

SEQ ID NO: 1275855 - protein, 9 aa, Homo Sapiens
LERHRAKHG

SEQ ID NO: 1275856 - protein, 9 aa, Homo Sapiens
RHLCPPQKS

SEQ ID NO: 1275857 - protein, 9 aa, Homo Sapiens
YEEYKDHRR

SEQ ID NO: 1275858 - protein, 9 aa, Homo Sapiens
SYSSTTNGH

SEQ ID NO: 1275859 - protein, 9 aa, Homo Sapiens
LSLLSHVGR

SEQ ID NO: 1275860 - protein, 9 aa, Homo Sapiens
KIPRQLPQM

SEQ ID NO: 1275861 - protein, 9 aa, Homo Sapiens
GQQYGVKNQ

SEQ ID NO: 1275862 - protein, 9 aa, Homo Sapiens
RSWQRRRLP

SEQ ID NO: 1275863 - protein, 9 aa, Homo Sapiens
PPQALVPRH

SEQ ID NO: 1275864 - protein, 9 aa, Homo Sapiens
QQVWMEECV

SEQ ID NO: 1275865 - protein, 9 aa, Homo Sapiens
GTDFSSTFF

SEQ ID NO: 1275866 - protein, 9 aa, Homo Sapiens
FMCEFRVDQ

SEQ ID NO: 1275867 - protein, 9 aa, Homo Sapiens
PGHWRMMAS

SEQ ID NO: 1275868 - protein, 9 aa, Homo Sapiens
FSRNVCKRG

SEQ ID NO: 1275869 - protein, 9 aa, Homo Sapiens
PLSPRAQSC

SEQ ID NO: 1275870 - protein, 9 aa, Homo Sapiens
IVPVLHNLT

SEQ ID NO: 1275871 - protein, 9 aa, Homo Sapiens
ETVGKEFRS

SEQ ID NO: 1275872 - protein, 9 aa, Homo Sapiens
LKTGQKIRS

SEQ ID NO: 1275873 - protein, 9 aa, Homo Sapiens
DLCQAHRLP

SEQ ID NO: 1275874 - protein, 9 aa, Homo Sapiens
SGTEDHPAG

SEQ ID NO: 1275875 - protein, 9 aa, Homo Sapiens
YIPRGSFPV

SEQ ID NO: 1275876 - protein, 9 aa, Homo Sapiens
CAKDQNGNH

SEQ ID NO: 1275877 - protein, 9 aa, Homo Sapiens
CAQDPLAAA

SEQ ID NO: 1275878 - protein, 9 aa, Homo Sapiens
VVDLGTCYC

SEQ ID NO: 1275879 - protein, 9 aa, Homo Sapiens
WAIVPVLHN

SEQ ID NO: 1275880 - protein, 9 aa, Homo Sapiens
MEATSLLVV

SEQ ID NO: 1275881 - protein, 9 aa, Homo Sapiens
LLVANIHHV

SEQ ID NO: 1275882 - protein, 9 aa, Homo Sapiens
RQHPTAHPS

SEQ ID NO: 1275883 - protein, 9 aa, Homo Sapiens
HFHILTWPS

SEQ ID NO: 1275884 - protein, 9 aa, Homo Sapiens
MRGLADHVL

SEQ ID NO: 1275885 - protein, 9 aa, Homo Sapiens
CPHSRACSS

SEQ ID NO: 1275886 - protein, 9 aa, Homo Sapiens
NLIQNRSPT

SEQ ID NO: 1275887 - protein, 9 aa, Homo Sapiens
MTFLRAFLR

SEQ ID NO: 1275888 - protein, 9 aa, Homo Sapiens
AAPTRGSFE

SEQ ID NO: 1275889 - protein, 9 aa, Homo Sapiens
DDEKSDSDG

SEQ ID NO: 1275890 - protein, 9 aa, Homo Sapiens
QPGEKKSQA

SEQ ID NO: 1275891 - protein, 9 aa, Homo Sapiens
GSGAPPPAA

SEQ ID NO: 1275892 - protein, 9 aa, Homo Sapiens
RGLRATQGC

SEQ ID NO: 1275893 - protein, 9 aa, Homo Sapiens
MEMMEGESY

SEQ ID NO: 1275894 - protein, 9 aa, Homo Sapiens
MAPETRLPK

SEQ ID NO: 1275895 - protein, 9 aa, Homo Sapiens
MNSKNDELN

SEQ ID NO: 1275896 - protein, 9 aa, Homo Sapiens
YSVSLPDTT

SEQ ID NO: 1275897 - protein, 9 aa, Homo Sapiens
DLGTCYCKC

SEQ ID NO: 1275898 - protein, 9 aa, Homo Sapiens
LPSPASALR

SEQ ID NO: 1275899 - protein, 9 aa, Homo Sapiens
GGAAYLQPG

SEQ ID NO: 1275900 - protein, 9 aa, Homo Sapiens
RSDTPTMLN

SEQ ID NO: 1275901 - protein, 9 aa, Homo Sapiens
YKPVDGEAL

SEQ ID NO: 1275902 - protein, 9 aa, Homo Sapiens
PGHSMGQPS

SEQ ID NO: 1275903 - protein, 9 aa, Homo Sapiens
HLRSGQLHP

SEQ ID NO: 1275904 - protein, 9 aa, Homo Sapiens
SAVQTKVQY

SEQ ID NO: 1275905 - protein, 9 aa, Homo Sapiens
DMLPKGAAS

SEQ ID NO: 1275906 - protein, 9 aa, Homo Sapiens
GPGFLWPLA

SEQ ID NO: 1275907 - protein, 9 aa, Homo Sapiens
CMKDLRDAY

SEQ ID NO: 1275908 - protein, 9 aa, Homo Sapiens
YKRAMLRDE

SEQ ID NO: 1275909 - protein, 9 aa, Homo Sapiens
VIISGWGKQ

SEQ ID NO: 1275910 - protein, 9 aa, Homo Sapiens
SQENYKDHS

SEQ ID NO: 1275911 - protein, 9 aa, Homo Sapiens
EKLNILSSK

SEQ ID NO: 1275912 - protein, 9 aa, Homo Sapiens
YIVLFAALF

SEQ ID NO: 1275913 - protein, 9 aa, Homo Sapiens
FRKEKNSRE

SEQ ID NO: 1275914 - protein, 9 aa, Homo Sapiens
SSKAPGPHP

SEQ ID NO: 1275915 - protein, 9 aa, Homo Sapiens
QEFEISHLQ

SEQ ID NO: 1275916 - protein, 9 aa, Homo Sapiens
ILLQRNLLR

SEQ ID NO: 1275917 - protein, 9 aa, Homo Sapiens
ATEAWCRTT

SEQ ID NO: 1275918 - protein, 9 aa, Homo Sapiens
MLHHNIPSS

SEQ ID NO: 1275919 - protein, 9 aa, Homo Sapiens
HTVEKPYQC

SEQ ID NO: 1275920 - protein, 9 aa, Homo Sapiens
VVVGAVGVG

SEQ ID NO: 1275921 - protein, 9 aa, Homo Sapiens
TTHRTTTTS

SEQ ID NO: 1275922 - protein, 9 aa, Homo Sapiens
VNKSVTQEF

SEQ ID NO: 1275923 - protein, 9 aa, Homo Sapiens
PTLSVSLVK

SEQ ID NO: 1275924 - protein, 9 aa, Homo Sapiens
PGAWKFWSL

SEQ ID NO: 1275925 - protein, 9 aa, Homo Sapiens
LRFLLGRGQ

SEQ ID NO: 1275926 - protein, 9 aa, Homo Sapiens
GIITYCCCC

SEQ ID NO: 1275927 - protein, 9 aa, Homo Sapiens
QEQATGLPT

SEQ ID NO: 1275928 - protein, 9 aa, Homo Sapiens
AQPPLPGPH

SEQ ID NO: 1275929 - protein, 9 aa, Homo Sapiens
CSQHQPARQ

SEQ ID NO: 1275930 - protein, 9 aa, Homo Sapiens
FTRVAVVQH

SEQ ID NO: 1275931 - protein, 9 aa, Homo Sapiens
CRDFSRNVC

SEQ ID NO: 1275932 - protein, 9 aa, Homo Sapiens
IAAFKRIHL

SEQ ID NO: 1275933 - protein, 9 aa, Homo Sapiens
GGFPSRSRW

SEQ ID NO: 1275934 - protein, 9 aa, Homo Sapiens
LPQVQWAED

SEQ ID NO: 1275935 - protein, 9 aa, Homo Sapiens
SPGPRCPHS

SEQ ID NO: 1275936 - protein, 9 aa, Homo Sapiens
VVTWGTLVS

SEQ ID NO: 1275937 - protein, 9 aa, Homo Sapiens
LQEEANGGR

SEQ ID NO: 1275938 - protein, 9 aa, Homo Sapiens
FQEAETYHC

SEQ ID NO: 1275939 - protein, 9 aa, Homo Sapiens
GQHLPRDHG

SEQ ID NO: 1275940 - protein, 9 aa, Homo Sapiens
CVLCRQLSC

SEQ ID NO: 1275941 - protein, 9 aa, Homo Sapiens
WLRACSFHS

SEQ ID NO: 1275942 - protein, 9 aa, Homo Sapiens
AQAQRLQED

SEQ ID NO: 1275943 - protein, 9 aa, Homo Sapiens
GQVFELSEK

SEQ ID NO: 1275944 - protein, 9 aa, Homo Sapiens
RRNLAKLVQ

SEQ ID NO: 1275945 - protein, 9 aa, Homo Sapiens
SPHCAAWKP

SEQ ID NO: 1275946 - protein, 9 aa, Homo Sapiens
ENLHVLNEE

SEQ ID NO: 1275947 - protein, 9 aa, Homo Sapiens
NLQVLKKIL

SEQ ID NO: 1275948 - protein, 9 aa, Homo Sapiens
RERTATEEK

SEQ ID NO: 1275949 - protein, 9 aa, Homo Sapiens
ADLERFLNF

SEQ ID NO: 1275950 - protein, 9 aa, Homo Sapiens
RSSHNDSMN

SEQ ID NO: 1275951 - protein, 9 aa, Homo Sapiens
EKYYRPVDT

SEQ ID NO: 1275952 - protein, 9 aa, Homo Sapiens
RIGSSHLIS

SEQ ID NO: 1275953 - protein, 9 aa, Homo Sapiens
GDPRGCKGV

SEQ ID NO: 1275954 - protein, 9 aa, Homo Sapiens
GVKNQNHLQ

SEQ ID NO: 1275955 - protein, 9 aa, Homo Sapiens
DAKVLEQPM

SEQ ID NO: 1275956 - protein, 9 aa, Homo Sapiens
TGECPFQCS

SEQ ID NO: 1275957 - protein, 9 aa, Homo Sapiens
KLVQLVPGE

SEQ ID NO: 1275958 - protein, 9 aa, Homo Sapiens
MGGPESRGI

SEQ ID NO: 1275959 - protein, 9 aa, Homo Sapiens
FFDLNRPSF

SEQ ID NO: 1275960 - protein, 9 aa, Homo Sapiens
AELLPGEGA

SEQ ID NO: 1275961 - protein, 9 aa, Homo Sapiens
CSPPSPQNR

SEQ ID NO: 1275962 - protein, 9 aa, Homo Sapiens
VTDADTPNT

SEQ ID NO: 1275963 - protein, 9 aa, Homo Sapiens
TVMVHSILL

SEQ ID NO: 1275964 - protein, 9 aa, Homo Sapiens
PHLRQLLPM

SEQ ID NO: 1275965 - protein, 9 aa, Homo Sapiens
CLEALMRGL

SEQ ID NO: 1275966 - protein, 9 aa, Homo Sapiens
VSVPHISSP

SEQ ID NO: 1275967 - protein, 9 aa, Homo Sapiens
VPMSLACSI

SEQ ID NO: 1275968 - protein, 9 aa, Homo Sapiens
QASAGKLLW

SEQ ID NO: 1275969 - protein, 9 aa, Homo Sapiens
GAAYLQPGP

SEQ ID NO: 1275970 - protein, 9 aa, Homo Sapiens
LSSKRDLAA

SEQ ID NO: 1275971 - protein, 9 aa, Homo Sapiens
ALRRPQPVL

SEQ ID NO: 1275972 - protein, 9 aa, Homo Sapiens
AEARGVRRR

SEQ ID NO: 1275973 - protein, 9 aa, Homo Sapiens
DYITAYMVL

SEQ ID NO: 1275974 - protein, 9 aa, Homo Sapiens
ELLSLEAVR

SEQ ID NO: 1275975 - protein, 9 aa, Homo Sapiens
ASGRASRKT

SEQ ID NO: 1275976 - protein, 9 aa, Homo Sapiens
SDGGDLDKH

SEQ ID NO: 1275977 - protein, 9 aa, Homo Sapiens
PKSSSKAPG

SEQ ID NO: 1275978 - protein, 9 aa, Homo Sapiens
LVLQFELWR

SEQ ID NO: 1275979 - protein, 9 aa, Homo Sapiens
RRVHLHLFA

SEQ ID NO: 1275980 - protein, 9 aa, Homo Sapiens
LSPRPPLPK

SEQ ID NO: 1275981 - protein, 9 aa, Homo Sapiens
LWRLLVTSQ

SEQ ID NO: 1275982 - protein, 9 aa, Homo Sapiens
TDAPDDTQY

SEQ ID NO: 1275983 - protein, 9 aa, Homo Sapiens
PLSGKVLAV

SEQ ID NO: 1275984 - protein, 9 aa, Homo Sapiens
FPGHLVDVN

SEQ ID NO: 1275985 - protein, 9 aa, Homo Sapiens
PASGRASRK

SEQ ID NO: 1275986 - protein, 9 aa, Homo Sapiens
WSSGRPGRR

SEQ ID NO: 1275987 - protein, 9 aa, Homo Sapiens
SARWPTCKF

SEQ ID NO: 1275988 - protein, 9 aa, Homo Sapiens
LVDSHHQLW

SEQ ID NO: 1275989 - protein, 9 aa, Homo Sapiens
GSLVEVINK

SEQ ID NO: 1275990 - protein, 9 aa, Homo Sapiens
EEANGGRTQ

SEQ ID NO: 1275991 - protein, 9 aa, Homo Sapiens
QCLSKLPRH

SEQ ID NO: 1275992 - protein, 9 aa, Homo Sapiens
LSRPLPGQV

SEQ ID NO: 1275993 - protein, 9 aa, Homo Sapiens
PPTPERGAV

SEQ ID NO: 1275994 - protein, 9 aa, Homo Sapiens
EELNFIRCL

SEQ ID NO: 1275995 - protein, 9 aa, Homo Sapiens
WQTMWCPPG

SEQ ID NO: 1275996 - protein, 9 aa, Homo Sapiens
LRDGPHTPQ

SEQ ID NO: 1275997 - protein, 9 aa, Homo Sapiens
ACCDNVVLI

SEQ ID NO: 1275998 - protein, 9 aa, Homo Sapiens
SWSSRSPGA

SEQ ID NO: 1275999 - protein, 9 aa, Homo Sapiens
RARQSCCLP

SEQ ID NO: 1276000 - protein, 9 aa, Homo Sapiens
PHTPQDPEP

SEQ ID NO: 1276001 - protein, 9 aa, Homo Sapiens
ILMLHHNIP

SEQ ID NO: 1276002 - protein, 9 aa, Homo Sapiens
NLQRNLKVL

SEQ ID NO: 1276003 - protein, 9 aa, Homo Sapiens
CRACLEALM

SEQ ID NO: 1276004 - protein, 9 aa, Homo Sapiens
KSRTSQSWK

SEQ ID NO: 1276005 - protein, 9 aa, Homo Sapiens
HGVVQGMIT

SEQ ID NO: 1276006 - protein, 9 aa, Homo Sapiens
TAGFRRHLW

SEQ ID NO: 1276007 - protein, 9 aa, Homo Sapiens
IDINVTPDK

SEQ ID NO: 1276008 - protein, 9 aa, Homo Sapiens
MRSDTPTML

SEQ ID NO: 1276009 - protein, 9 aa, Homo Sapiens
PRSGHSPHC

SEQ ID NO: 1276010 - protein, 9 aa, Homo Sapiens
MWTCMDMLP

SEQ ID NO: 1276011 - protein, 9 aa, Homo Sapiens
VTEDMDAAL

SEQ ID NO: 1276012 - protein, 9 aa, Homo Sapiens
SCPHSRACS

SEQ ID NO: 1276013 - protein, 9 aa, Homo Sapiens
PSASLHPAS

SEQ ID NO: 1276014 - protein, 9 aa, Homo Sapiens
SSTPWISSK

SEQ ID NO: 1276015 - protein, 9 aa, Homo Sapiens
TLPASQRSS

SEQ ID NO: 1276016 - protein, 9 aa, Homo Sapiens
QLHHRCGRP

SEQ ID NO: 1276017 - protein, 9 aa, Homo Sapiens
ATEEKARRN

SEQ ID NO: 1276018 - protein, 9 aa, Homo Sapiens
PLCSPPSPQ

SEQ ID NO: 1276019 - protein, 9 aa, Homo Sapiens
ACRAGGPAG

SEQ ID NO: 1276020 - protein, 9 aa, Homo Sapiens
PHLQQWKWQ

SEQ ID NO: 1276021 - protein, 9 aa, Homo Sapiens
EYKTTNADI

SEQ ID NO: 1276022 - protein, 9 aa, Homo Sapiens
VLDVSSISH

SEQ ID NO: 1276023 - protein, 9 aa, Homo Sapiens
SRPPAAAGL

SEQ ID NO: 1276024 - protein, 9 aa, Homo Sapiens
KKRSAFPSR

SEQ ID NO: 1276025 - protein, 9 aa, Homo Sapiens
QPRVLPRAC

SEQ ID NO: 1276026 - protein, 9 aa, Homo Sapiens
WGRHVRARM

SEQ ID NO: 1276027 - protein, 9 aa, Homo Sapiens
HLRPRYLRD

SEQ ID NO: 1276028 - protein, 9 aa, Homo Sapiens
TTKKSRTSQ

SEQ ID NO: 1276029 - protein, 9 aa, Homo Sapiens
LLRDGPHTP

SEQ ID NO: 1276030 - protein, 9 aa, Homo Sapiens
PSVIPTRTA

SEQ ID NO: 1276031 - protein, 9 aa, Homo Sapiens
GSMGIGLGM

SEQ ID NO: 1276032 - protein, 9 aa, Homo Sapiens
TPHKDIWNV

SEQ ID NO: 1276033 - protein, 9 aa, Homo Sapiens
THPRLKEQE

SEQ ID NO: 1276034 - protein, 9 aa, Homo Sapiens
RATFSGSVG

SEQ ID NO: 1276035 - protein, 9 aa, Homo Sapiens
MAFWLSRSS

SEQ ID NO: 1276036 - protein, 9 aa, Homo Sapiens
YTPLCSPPS

SEQ ID NO: 1276037 - protein, 9 aa, Homo Sapiens
VFQEAETYH

SEQ ID NO: 1276038 - protein, 9 aa, Homo Sapiens
GMDLFHHCR

SEQ ID NO: 1276039 - protein, 9 aa, Homo Sapiens
LSRSSGMLG

SEQ ID NO: 1276040 - protein, 9 aa, Homo Sapiens
EDDEKSDSD

SEQ ID NO: 1276041 - protein, 9 aa, Homo Sapiens
PRHQRLSPP

SEQ ID NO: 1276042 - protein, 9 aa, Homo Sapiens
GQQMSQALA

SEQ ID NO: 1276043 - protein, 9 aa, Homo Sapiens
MTPLWMFPM

SEQ ID NO: 1276044 - protein, 9 aa, Homo Sapiens
PTRGLRATQ

SEQ ID NO: 1276045 - protein, 9 aa, Homo Sapiens
TRSLPCPGG

SEQ ID NO: 1276046 - protein, 9 aa, Homo Sapiens
IIIGIITYC

SEQ ID NO: 1276047 - protein, 9 aa, Homo Sapiens
NLLSSLSTF

SEQ ID NO: 1276048 - protein, 9 aa, Homo Sapiens
LAAVAWLIS

SEQ ID NO: 1276049 - protein, 9 aa, Homo Sapiens
DHIPDYTPL

SEQ ID NO: 1276050 - protein, 9 aa, Homo Sapiens
PLAHTGPGH

SEQ ID NO: 1276051 - protein, 9 aa, Homo Sapiens
HHDCCQCQE

SEQ ID NO: 1276052 - protein, 9 aa, Homo Sapiens
PHKDIWNVT

SEQ ID NO: 1276053 - protein, 9 aa, Homo Sapiens
HSVSKGLPL

SEQ ID NO: 1276054 - protein, 9 aa, Homo Sapiens
ASTELYNLA

SEQ ID NO: 1276055 - protein, 9 aa, Homo Sapiens
LDVSRMHCV

SEQ ID NO: 1276056 - protein, 9 aa, Homo Sapiens
GWKFAATGM

SEQ ID NO: 1276057 - protein, 9 aa, Homo Sapiens
VHRQAQRLE

SEQ ID NO: 1276058 - protein, 9 aa, Homo Sapiens
LKKVVVVTV

SEQ ID NO: 1276059 - protein, 9 aa, Homo Sapiens
SIRSASSRA

SEQ ID NO: 1276060 - protein, 9 aa, Homo Sapiens
ETQLPSVLI

SEQ ID NO: 1276061 - protein, 9 aa, Homo Sapiens
RSVQSHNKS

SEQ ID NO: 1276062 - protein, 9 aa, Homo Sapiens
LWYTTHYPT

SEQ ID NO: 1276063 - protein, 9 aa, Homo Sapiens
PGSLEYLYL

SEQ ID NO: 1276064 - protein, 9 aa, Homo Sapiens
GEVQLVQHD

SEQ ID NO: 1276065 - protein, 9 aa, Homo Sapiens
IPPKRVALL

SEQ ID NO: 1276066 - protein, 9 aa, Homo Sapiens
TCGDSPSGG

SEQ ID NO: 1276067 - protein, 9 aa, Homo Sapiens
AFRCPYRKG

SEQ ID NO: 1276068 - protein, 9 aa, Homo Sapiens
LERQRLDKQ

SEQ ID NO: 1276069 - protein, 9 aa, Homo Sapiens
RSHTNSSAR

SEQ ID NO: 1276070 - protein, 9 aa, Homo Sapiens
DGGDLDKHM

SEQ ID NO: 1276071 - protein, 9 aa, Homo Sapiens
IPRGSFPVG

SEQ ID NO: 1276072 - protein, 9 aa, Homo Sapiens
SQLLPGQMF

SEQ ID NO: 1276073 - protein, 9 aa, Homo Sapiens
QEEASMQEA

SEQ ID NO: 1276074 - protein, 9 aa, Homo Sapiens
YQICWAWED

SEQ ID NO: 1276075 - protein, 9 aa, Homo Sapiens
GTPPPLILW

SEQ ID NO: 1276076 - protein, 9 aa, Homo Sapiens
YYPPPHLRQ

SEQ ID NO: 1276077 - protein, 9 aa, Homo Sapiens
TSATEAWCR

SEQ ID NO: 1276078 - protein, 9 aa, Homo Sapiens
VMQDVVYKL

SEQ ID NO: 1276079 - protein, 9 aa, Homo Sapiens
FHSLNMVSE

SEQ ID NO: 1276080 - protein, 9 aa, Homo Sapiens
AAYTLGKSH

SEQ ID NO: 1276081 - protein, 9 aa, Homo Sapiens
EAPAPGPLS

SEQ ID NO: 1276082 - protein, 9 aa, Homo Sapiens
EAVRRAVAL

SEQ ID NO: 1276083 - protein, 9 aa, Homo Sapiens
GFLWPLASE

SEQ ID NO: 1276084 - protein, 9 aa, Homo Sapiens
GGTLASVVT

SEQ ID NO: 1276085 - protein, 9 aa, Homo Sapiens
GGTPLSISR

SEQ ID NO: 1276086 - protein, 9 aa, Homo Sapiens
MKRLEDPMQ

SEQ ID NO: 1276087 - protein, 9 aa, Homo Sapiens
FTCTHVNIC

SEQ ID NO: 1276088 - protein, 9 aa, Homo Sapiens
GQPWQTVTR

SEQ ID NO: 1276089 - protein, 9 aa, Homo Sapiens
QWNCAAYLK

SEQ ID NO: 1276090 - protein, 9 aa, Homo Sapiens
PTMLNPANV

SEQ ID NO: 1276091 - protein, 9 aa, Homo Sapiens
MSCTEASRD

SEQ ID NO: 1276092 - protein, 9 aa, Homo Sapiens
RPPGAPPEC

SEQ ID NO: 1276093 - protein, 9 aa, Homo Sapiens
LRVMQWNCA

SEQ ID NO: 1276094 - protein, 9 aa, Homo Sapiens
LVVCGSMHQ

SEQ ID NO: 1276095 - protein, 9 aa, Homo Sapiens
EGGMLHTFL

SEQ ID NO: 1276096 - protein, 9 aa, Homo Sapiens
GGPAGWARQ

SEQ ID NO: 1276097 - protein, 9 aa, Homo Sapiens
FQEEASMQE

SEQ ID NO: 1276098 - protein, 9 aa, Homo Sapiens
ATAFAHDHG

SEQ ID NO: 1276099 - protein, 9 aa, Homo Sapiens
VIPTRGLRA

SEQ ID NO: 1276100 - protein, 9 aa, Homo Sapiens
GPTCGRWPG

SEQ ID NO: 1276101 - protein, 9 aa, Homo Sapiens
FELWRNVLY

SEQ ID NO: 1276102 - protein, 9 aa, Homo Sapiens
TKLEKALSA

SEQ ID NO: 1276103 - protein, 9 aa, Homo Sapiens
GLIILAIMI

SEQ ID NO: 1276104 - protein, 9 aa, Homo Sapiens
KLKIAPALS

SEQ ID NO: 1276105 - protein, 9 aa, Homo Sapiens
LPRPAGRLG

SEQ ID NO: 1276106 - protein, 9 aa, Homo Sapiens
EEVFLIFWN

SEQ ID NO: 1276107 - protein, 9 aa, Homo Sapiens
LGIFVTILL

SEQ ID NO: 1276108 - protein, 9 aa, Homo Sapiens
ISTVERGMV

SEQ ID NO: 1276109 - protein, 9 aa, Homo Sapiens
SLFEDKIDL

SEQ ID NO: 1276110 - protein, 9 aa, Homo Sapiens
PLIWKKKMS

SEQ ID NO: 1276111 - protein, 9 aa, Homo Sapiens
CASNKMDSL

SEQ ID NO: 1276112 - protein, 9 aa, Homo Sapiens
TVTYMLLNN

SEQ ID NO: 1276113 - protein, 9 aa, Homo Sapiens
PPAAAALDE

SEQ ID NO: 1276114 - protein, 9 aa, Homo Sapiens
IFQMLIIEK

SEQ ID NO: 1276115 - protein, 9 aa, Homo Sapiens
LECLHEATL

SEQ ID NO: 1276116 - protein, 9 aa, Homo Sapiens
FLKSLRLVD

SEQ ID NO: 1276117 - protein, 9 aa, Homo Sapiens
AWKFWSLPL

SEQ ID NO: 1276118 - protein, 9 aa, Homo Sapiens
LPSEHPTLE

SEQ ID NO: 1276119 - protein, 9 aa, Homo Sapiens
PQFVLGMDL

SEQ ID NO: 1276120 - protein, 9 aa, Homo Sapiens
AWKPSLRSP

SEQ ID NO: 1276121 - protein, 9 aa, Homo Sapiens
PLDGKWQRF

SEQ ID NO: 1276122 - protein, 9 aa, Homo Sapiens
RNIRNNDLI

SEQ ID NO: 1276123 - protein, 9 aa, Homo Sapiens
DWEKKIEEL

SEQ ID NO: 1276124 - protein, 9 aa, Homo Sapiens
IDDFSLEPL

SEQ ID NO: 1276125 - protein, 9 aa, Homo Sapiens
VQLVQHDAL

SEQ ID NO: 1276126 - protein, 9 aa, Homo Sapiens
GLRATQGCT

SEQ ID NO: 1276127 - protein, 9 aa, Homo Sapiens
WSSRSPGAR

SEQ ID NO: 1276128 - protein, 9 aa, Homo Sapiens
IVKGKVILS

SEQ ID NO: 1276129 - protein, 9 aa, Homo Sapiens
PARKQNVCR

SEQ ID NO: 1276130 - protein, 9 aa, Homo Sapiens
DMDAALGGP

SEQ ID NO: 1276131 - protein, 9 aa, Homo Sapiens
KKILMGLIP

SEQ ID NO: 1276132 - protein, 9 aa, Homo Sapiens
MVYQFQVTA

SEQ ID NO: 1276133 - protein, 9 aa, Homo Sapiens
ALFKWILRC

SEQ ID NO: 1276134 - protein, 9 aa, Homo Sapiens
AVHSFSCPH

SEQ ID NO: 1276135 - protein, 9 aa, Homo Sapiens
RSGDLGNME

SEQ ID NO: 1276136 - protein, 9 aa, Homo Sapiens
QGGDPKQLE

SEQ ID NO: 1276137 - protein, 9 aa, Homo Sapiens
LSPPALLRD

SEQ ID NO: 1276138 - protein, 9 aa, Homo Sapiens
SALFIWPQH

SEQ ID NO: 1276139 - protein, 9 aa, Homo Sapiens
PHPKPPTPE

SEQ ID NO: 1276140 - protein, 9 aa, Homo Sapiens
KVLTSTTTT

SEQ ID NO: 1276141 - protein, 9 aa, Homo Sapiens
SWAIVPVLH

SEQ ID NO: 1276142 - protein, 9 aa, Homo Sapiens
SGGFPSRSR

SEQ ID NO: 1276143 - protein, 9 aa, Homo Sapiens
TTNADIQMP

SEQ ID NO: 1276144 - protein, 9 aa, Homo Sapiens
VNWRVETVG

SEQ ID NO: 1276145 - protein, 9 aa, Homo Sapiens
RPGWKRTQQ

SEQ ID NO: 1276146 - protein, 9 aa, Homo Sapiens
PDGQCAPRT

SEQ ID NO: 1276147 - protein, 9 aa, Homo Sapiens
LNLQVLKKI

SEQ ID NO: 1276148 - protein, 9 aa, Homo Sapiens
GGFGMEATS

SEQ ID NO: 1276149 - protein, 9 aa, Homo Sapiens
GGGDDHDVY

SEQ ID NO: 1276150 - protein, 9 aa, Homo Sapiens
QAQDTSGHR

SEQ ID NO: 1276151 - protein, 9 aa, Homo Sapiens
LPKFTKKHT

SEQ ID NO: 1276152 - protein, 9 aa, Homo Sapiens
ILQASAGKL

SEQ ID NO: 1276153 - protein, 9 aa, Homo Sapiens
PGRRGGAGL

SEQ ID NO: 1276154 - protein, 9 aa, Homo Sapiens
NVCRDVTKP

SEQ ID NO: 1276155 - protein, 9 aa, Homo Sapiens
PPPKSSQEL

SEQ ID NO: 1276156 - protein, 9 aa, Homo Sapiens
AGRLGDSFR

SEQ ID NO: 1276157 - protein, 9 aa, Homo Sapiens
LAHTGPGHV

SEQ ID NO: 1276158 - protein, 9 aa, Homo Sapiens
HTNSSARHS

SEQ ID NO: 1276159 - protein, 9 aa, Homo Sapiens
SCASNKMDS

SEQ ID NO: 1276160 - protein, 9 aa, Homo Sapiens
GAMVIISGW

SEQ ID NO: 1276161 - protein, 9 aa, Homo Sapiens
ADTPNTPAW

SEQ ID NO: 1276162 - protein, 9 aa, Homo Sapiens
MNWVNKSVT

SEQ ID NO: 1276163 - protein, 9 aa, Homo Sapiens
KIAPALSDL

SEQ ID NO: 1276164 - protein, 9 aa, Homo Sapiens
QQFTRLVEE

SEQ ID NO: 1276165 - protein, 9 aa, Homo Sapiens
NVINYDLNQ

SEQ ID NO: 1276166 - protein, 9 aa, Homo Sapiens
GKVLAVSSM

SEQ ID NO: 1276167 - protein, 9 aa, Homo Sapiens
ATTKKSRTS

SEQ ID NO: 1276168 - protein, 9 aa, Homo Sapiens
LLSACCDNV

SEQ ID NO: 1276169 - protein, 9 aa, Homo Sapiens
KTSRILNLQ

SEQ ID NO: 1276170 - protein, 9 aa, Homo Sapiens
CSITVSFVG

SEQ ID NO: 1276171 - protein, 9 aa, Homo Sapiens
QRNLLRLQS

SEQ ID NO: 1276172 - protein, 9 aa, Homo Sapiens
AGPKRPRAG

SEQ ID NO: 1276173 - protein, 9 aa, Homo Sapiens
RTQGEVQLV

SEQ ID NO: 1276174 - protein, 9 aa, Homo Sapiens
YQFQVTAMN

SEQ ID NO: 1276175 - protein, 9 aa, Homo Sapiens
SEHPTLEPA

SEQ ID NO: 1276176 - protein, 9 aa, Homo Sapiens
EMLQEEANG

SEQ ID NO: 1276177 - protein, 9 aa, Homo Sapiens
STDVSTAAT

SEQ ID NO: 1276178 - protein, 9 aa, Homo Sapiens
KTWQRRLRA

SEQ ID NO: 1276179 - protein, 9 aa, Homo Sapiens
SPLSPRAQS

SEQ ID NO: 1276180 - protein, 9 aa, Homo Sapiens
PALGMLHVV

SEQ ID NO: 1276181 - protein, 9 aa, Homo Sapiens
STELYNLAS

SEQ ID NO: 1276182 - protein, 9 aa, Homo Sapiens
ETHILSEQH

SEQ ID NO: 1276183 - protein, 9 aa, Homo Sapiens
QPWQTVTRN

SEQ ID NO: 1276184 - protein, 9 aa, Homo Sapiens
YVAHVYCHL

SEQ ID NO: 1276185 - protein, 9 aa, Homo Sapiens
LQVLWVFQE

SEQ ID NO: 1276186 - protein, 9 aa, Homo Sapiens
GTDAPDDTQ

SEQ ID NO: 1276187 - protein, 9 aa, Homo Sapiens
GPAEEPPAR

SEQ ID NO: 1276188 - protein, 9 aa, Homo Sapiens
PGPDLLRKP

SEQ ID NO: 1276189 - protein, 9 aa, Homo Sapiens
ERHRAKHGT

SEQ ID NO: 1276190 - protein, 9 aa, Homo Sapiens
QPHHDCCQC

SEQ ID NO: 1276191 - protein, 9 aa, Homo Sapiens
VDVQPTYVP

SEQ ID NO: 1276192 - protein, 9 aa, Homo Sapiens
WSCSGLCSQ

SEQ ID NO: 1276193 - protein, 9 aa, Homo Sapiens
DSHHQLWRV

SEQ ID NO: 1276194 - protein, 9 aa, Homo Sapiens
CASVSAYAQ

SEQ ID NO: 1276195 - protein, 9 aa, Homo Sapiens
APETRLPKT

SEQ ID NO: 1276196 - protein, 9 aa, Homo Sapiens
RLQSLLSLY

SEQ ID NO: 1276197 - protein, 9 aa, Homo Sapiens
SGDLGNMEP

SEQ ID NO: 1276198 - protein, 9 aa, Homo Sapiens
AGPSASLHP

SEQ ID NO: 1276199 - protein, 9 aa, Homo Sapiens
QTFQLCLGL

SEQ ID NO: 1276200 - protein, 9 aa, Homo Sapiens
TMAGPSASL

SEQ ID NO: 1276201 - protein, 9 aa, Homo Sapiens
ELAVHRDQP

SEQ ID NO: 1276202 - protein, 9 aa, Homo Sapiens
LWLTSSAGP

SEQ ID NO: 1276203 - protein, 9 aa, Homo Sapiens
SHAFFKLEI

SEQ ID NO: 1276204 - protein, 9 aa, Homo Sapiens
RGRSTSRTF

SEQ ID NO: 1276205 - protein, 9 aa, Homo Sapiens
SQPPSNRIR

SEQ ID NO: 1276206 - protein, 9 aa, Homo Sapiens
LTLRIQKLG

SEQ ID NO: 1276207 - protein, 9 aa, Homo Sapiens
ISDKLVDFV

SEQ ID NO: 1276208 - protein, 9 aa, Homo Sapiens
QMLIIEKVL

SEQ ID NO: 1276209 - protein, 9 aa, Homo Sapiens
TPATAGSLA

SEQ ID NO: 1276210 - protein, 9 aa, Homo Sapiens
VRPDEPLSG

SEQ ID NO: 1276211 - protein, 9 aa, Homo Sapiens
KKKMSCASN

SEQ ID NO: 1276212 - protein, 9 aa, Homo Sapiens
RDQPAEQLT

SEQ ID NO: 1276213 - protein, 9 aa, Homo Sapiens
HPYEALETQ

SEQ ID NO: 1276214 - protein, 9 aa, Homo Sapiens
NLGGELMSA

SEQ ID NO: 1276215 - protein, 9 aa, Homo Sapiens
VEDDGDHVE

SEQ ID NO: 1276216 - protein, 9 aa, Homo Sapiens
KSSCISLPP

SEQ ID NO: 1276217 - protein, 9 aa, Homo Sapiens
YTAFLHLQR

SEQ ID NO: 1276218 - protein, 9 aa, Homo Sapiens
FGNLSFLDF

SEQ ID NO: 1276219 - protein, 9 aa, Homo Sapiens
LLSHVGRPG

SEQ ID NO: 1276220 - protein, 9 aa, Homo Sapiens
SAGKLLWRK

SEQ ID NO: 1276221 - protein, 9 aa, Homo Sapiens
WRVETVGKE

SEQ ID NO: 1276222 - protein, 9 aa, Homo Sapiens
KGQSNTRCP

SEQ ID NO: 1276223 - protein, 9 aa, Homo Sapiens
SLFTHSEVR

SEQ ID NO: 1276224 - protein, 9 aa, Homo Sapiens
AHLQVLWVF

SEQ ID NO: 1276225 - protein, 9 aa, Homo Sapiens
AKRQRQWQW

SEQ ID NO: 1276226 - protein, 9 aa, Homo Sapiens
AGGTLASVV

SEQ ID NO: 1276227 - protein, 9 aa, Homo Sapiens
VALLAKSGI

SEQ ID NO: 1276228 - protein, 9 aa, Homo Sapiens
GMVRPDEPL

SEQ ID NO: 1276229 - protein, 9 aa, Homo Sapiens
DLGNMEPLK

SEQ ID NO: 1276230 - protein, 9 aa, Homo Sapiens
CYEEYKDHR

SEQ ID NO: 1276231 - protein, 9 aa, Homo Sapiens
ERPARTPPQ

SEQ ID NO: 1276232 - protein, 9 aa, Homo Sapiens
IVLNKGLEN

SEQ ID NO: 1276233 - protein, 9 aa, Homo Sapiens
LAMPRHLCP

SEQ ID NO: 1276234 - protein, 9 aa, Homo Sapiens
HSRAQRANL

SEQ ID NO: 1276235 - protein, 9 aa, Homo Sapiens
LAPASPLSP

SEQ ID NO: 1276236 - protein, 9 aa, Homo Sapiens
QYLMQLDVS

SEQ ID NO: 1276237 - protein, 9 aa, Homo Sapiens
PKGAASCTE

SEQ ID NO: 1276238 - protein, 9 aa, Homo Sapiens
PSSPGPRCP

SEQ ID NO: 1276239 - protein, 9 aa, Homo Sapiens
AWKESTIFQ

SEQ ID NO: 1276240 - protein, 9 aa, Homo Sapiens
EVQMKKYRN

SEQ ID NO: 1276241 - protein, 9 aa, Homo Sapiens
AKKADREFP

SEQ ID NO: 1276242 - protein, 9 aa, Homo Sapiens
AFEQDVSRA

SEQ ID NO: 1276243 - protein, 9 aa, Homo Sapiens
IGPQAAAAA

SEQ ID NO: 1276244 - protein, 9 aa, Homo Sapiens
IPRQLPQMS

SEQ ID NO: 1276245 - protein, 9 aa, Homo Sapiens
PPTLSVSLV

SEQ ID NO: 1276246 - protein, 9 aa, Homo Sapiens
IIITILRIP

SEQ ID NO: 1276247 - protein, 9 aa, Homo Sapiens
MPPPKSSQE

SEQ ID NO: 1276248 - protein, 9 aa, Homo Sapiens
AGVGLAASF

SEQ ID NO: 1276249 - protein, 9 aa, Homo Sapiens
WPGLKQEDG

SEQ ID NO: 1276250 - protein, 9 aa, Homo Sapiens
CGRWPGLKQ

SEQ ID NO: 1276251 - protein, 9 aa, Homo Sapiens
SSEGGGMEQ

SEQ ID NO: 1276252 - protein, 9 aa, Homo Sapiens
GGWEDKPFK

SEQ ID NO: 1276253 - protein, 9 aa, Homo Sapiens
PFYKPVDGE

SEQ ID NO: 1276254 - protein, 9 aa, Homo Sapiens
GSEILTKRY

SEQ ID NO: 1276255 - protein, 9 aa, Homo Sapiens
KASKVPGGS

SEQ ID NO: 1276256 - protein, 9 aa, Homo Sapiens
SGGIRKRAS

SEQ ID NO: 1276257 - protein, 9 aa, Homo Sapiens
ELLDRCCVE

SEQ ID NO: 1276258 - protein, 9 aa, Homo Sapiens
AQSCPLPSP

SEQ ID NO: 1276259 - protein, 9 aa, Homo Sapiens
LERFLNFCG

SEQ ID NO: 1276260 - protein, 9 aa, Homo Sapiens
EEAVQSVHR

SEQ ID NO: 1276261 - protein, 9 aa, Homo Sapiens
TECRIGSSH

SEQ ID NO: 1276262 - protein, 9 aa, Homo Sapiens
AFREENKSD

SEQ ID NO: 1276263 - protein, 9 aa, Homo Sapiens
EQGGDPKQL

SEQ ID NO: 1276264 - protein, 9 aa, Homo Sapiens
TPERGAVRS

SEQ ID NO: 1276265 - protein, 9 aa, Homo Sapiens
IITYCCCCR

SEQ ID NO: 1276266 - protein, 9 aa, Homo Sapiens
RRFRSVRSR

SEQ ID NO: 1276267 - protein, 9 aa, Homo Sapiens
ASVSPSRNG

SEQ ID NO: 1276268 - protein, 9 aa, Homo Sapiens
SVSVPHISS

SEQ ID NO: 1276269 - protein, 9 aa, Homo Sapiens
LWPLASEGR

SEQ ID NO: 1276270 - protein, 9 aa, Homo Sapiens
EAVQSVHRQ

SEQ ID NO: 1276271 - protein, 9 aa, Homo Sapiens
TEIPEGLPG

SEQ ID NO: 1276272 - protein, 9 aa, Homo Sapiens
QQWKWQCRF

SEQ ID NO: 1276273 - protein, 9 aa, Homo Sapiens
SSSKAPGPH

SEQ ID NO: 1276274 - protein, 9 aa, Homo Sapiens
VKNQNHLQE

SEQ ID NO: 1276275 - protein, 9 aa, Homo Sapiens
ITFPISFIG

SEQ ID NO: 1276276 - protein, 9 aa, Homo Sapiens
QSQNKHSRY

SEQ ID NO: 1276277 - protein, 9 aa, Homo Sapiens
KNTTALEKK

SEQ ID NO: 1276278 - protein, 9 aa, Homo Sapiens
DSLLQNMWD

SEQ ID NO: 1276279 - protein, 9 aa, Homo Sapiens
YRKGKFRTS

SEQ ID NO: 1276280 - protein, 9 aa, Homo Sapiens
LEVAELLPG

SEQ ID NO: 1276281 - protein, 9 aa, Homo Sapiens
TGNFQPPVA

SEQ ID NO: 1276282 - protein, 9 aa, Homo Sapiens
TVERGMVSL

SEQ ID NO: 1276283 - protein, 9 aa, Homo Sapiens
SHTGECPFQ

SEQ ID NO: 1276284 - protein, 9 aa, Homo Sapiens
HPRRQCSQH

SEQ ID NO: 1276285 - protein, 9 aa, Homo Sapiens
AAVAWLISF

SEQ ID NO: 1276286 - protein, 9 aa, Homo Sapiens
ILRGTYIPR

SEQ ID NO: 1276287 - protein, 9 aa, Homo Sapiens
NDPGHDIIE

SEQ ID NO: 1276288 - protein, 9 aa, Homo Sapiens
IKIIDWIPK

SEQ ID NO: 1276289 - protein, 9 aa, Homo Sapiens
SIRKNGWDT

SEQ ID NO: 1276290 - protein, 9 aa, Homo Sapiens
EISTVERGM

SEQ ID NO: 1276291 - protein, 9 aa, Homo Sapiens
GMEATSLLV

SEQ ID NO: 1276292 - protein, 9 aa, Homo Sapiens
ALVPRHQRL

SEQ ID NO: 1276293 - protein, 9 aa, Homo Sapiens
VSFVGQIST

SEQ ID NO: 1276294 - protein, 9 aa, Homo Sapiens
YFTESASTG

SEQ ID NO: 1276295 - protein, 9 aa, Homo Sapiens
VDSECIDIN

SEQ ID NO: 1276296 - protein, 9 aa, Homo Sapiens
EGGDDDDEE

SEQ ID NO: 1276297 - protein, 9 aa, Homo Sapiens
SSPGPRCPH

SEQ ID NO: 1276298 - protein, 9 aa, Homo Sapiens
QVWFLSRKI

SEQ ID NO: 1276299 - protein, 9 aa, Homo Sapiens
MCEFRVDQS

SEQ ID NO: 1276300 - protein, 9 aa, Homo Sapiens
AQRLEGEAE

SEQ ID NO: 1276301 - protein, 9 aa, Homo Sapiens
FPSAAGGTL

SEQ ID NO: 1276302 - protein, 9 aa, Homo Sapiens
GKGSQGFFP

SEQ ID NO: 1276303 - protein, 9 aa, Homo Sapiens
HPGPGASCG

SEQ ID NO: 1276304 - protein, 9 aa, Homo Sapiens
REHIANFNT

SEQ ID NO: 1276305 - protein, 9 aa, Homo Sapiens
KEFRSAAFP

SEQ ID NO: 1276306 - protein, 9 aa, Homo Sapiens
LDIPEGSSS

SEQ ID NO: 1276307 - protein, 9 aa, Homo Sapiens
TLQALGHDS

SEQ ID NO: 1276308 - protein, 9 aa, Homo Sapiens
VLNEEQALS

SEQ ID NO: 1276309 - protein, 9 aa, Homo Sapiens
SPFGGAAYL

SEQ ID NO: 1276310 - protein, 9 aa, Homo Sapiens
FFPMAPETR

SEQ ID NO: 1276311 - protein, 9 aa, Homo Sapiens
EECVLSSVL

SEQ ID NO: 1276312 - protein, 9 aa, Homo Sapiens
SAAFPAWST

SEQ ID NO: 1276313 - protein, 9 aa, Homo Sapiens
YKDFQFHLE

SEQ ID NO: 1276314 - protein, 9 aa, Homo Sapiens
PGGRTVQDS

SEQ ID NO: 1276315 - protein, 9 aa, Homo Sapiens
LTKSVSVPH

SEQ ID NO: 1276316 - protein, 9 aa, Homo Sapiens
RQRLDKQLA

SEQ ID NO: 1276317 - protein, 9 aa, Homo Sapiens
MEGESYFTE

SEQ ID NO: 1276318 - protein, 9 aa, Homo Sapiens
TSKGKKVKS

SEQ ID NO: 1276319 - protein, 9 aa, Homo Sapiens
VGVGKSALT

SEQ ID NO: 1276320 - protein, 9 aa, Homo Sapiens
DVTVMVHSI

SEQ ID NO: 1276321 - protein, 9 aa, Homo Sapiens
QALVPRHQR

SEQ ID NO: 1276322 - protein, 9 aa, Homo Sapiens
LKLTFEEPE

SEQ ID NO: 1276323 - protein, 9 aa, Homo Sapiens
PSYPNYDVS

SEQ ID NO: 1276324 - protein, 9 aa, Homo Sapiens
IPEGLPGSL

SEQ ID NO: 1276325 - protein, 9 aa, Homo Sapiens
YIKQIFPTE

SEQ ID NO: 1276326 - protein, 9 aa, Homo Sapiens
PLEPNNPKN

SEQ ID NO: 1276327 - protein, 9 aa, Homo Sapiens
RLNRNGLAM

SEQ ID NO: 1276328 - protein, 9 aa, Homo Sapiens
VREHIANFN

SEQ ID NO: 1276329 - protein, 9 aa, Homo Sapiens
NEASRAHWQ

SEQ ID NO: 1276330 - protein, 9 aa, Homo Sapiens
TGTVMIPDV

SEQ ID NO: 1276331 - protein, 9 aa, Homo Sapiens
RFTVTYMLL

SEQ ID NO: 1276332 - protein, 9 aa, Homo Sapiens
QLDVSRMHC

SEQ ID NO: 1276333 - protein, 9 aa, Homo Sapiens
DRVMQDVVY

SEQ ID NO: 1276334 - protein, 9 aa, Homo Sapiens
EGESYFTES

SEQ ID NO: 1276335 - protein, 9 aa, Homo Sapiens
QNHLQENGK

SEQ ID NO: 1276336 - protein, 9 aa, Homo Sapiens
KNATMAFWL

SEQ ID NO: 1276337 - protein, 9 aa, Homo Sapiens
SLHPASGRA

SEQ ID NO: 1276338 - protein, 9 aa, Homo Sapiens
GSMHQGVCE

SEQ ID NO: 1276339 - protein, 9 aa, Homo Sapiens
KLKLTFEEP

SEQ ID NO: 1276340 - protein, 9 aa, Homo Sapiens
DREFPEADA

SEQ ID NO: 1276341 - protein, 9 aa, Homo Sapiens
KKEEVFLIF

SEQ ID NO: 1276342 - protein, 9 aa, Homo Sapiens
DLETHILSE

SEQ ID NO: 1276343 - protein, 9 aa, Homo Sapiens
ALVMRAPRW

SEQ ID NO: 1276344 - protein, 9 aa, Homo Sapiens
VLLGLLSPR

SEQ ID NO: 1276345 - protein, 9 aa, Homo Sapiens
PPGAPPECY

SEQ ID NO: 1276346 - protein, 9 aa, Homo Sapiens
QPLICVVSH

SEQ ID NO: 1276347 - protein, 9 aa, Homo Sapiens
RNLQRNLKV

SEQ ID NO: 1276348 - protein, 9 aa, Homo Sapiens
VPYRLLLLE

SEQ ID NO: 1276349 - protein, 9 aa, Homo Sapiens
QDPLAAAAV

SEQ ID NO: 1276350 - protein, 9 aa, Homo Sapiens
VKFFLQLQG

SEQ ID NO: 1276351 - protein, 9 aa, Homo Sapiens
GAYGTGRWL

SEQ ID NO: 1276352 - protein, 9 aa, Homo Sapiens
QHGVVQGMI

SEQ ID NO: 1276353 - protein, 9 aa, Homo Sapiens
QSVHRQAQR

SEQ ID NO: 1276354 - protein, 9 aa, Homo Sapiens
GLHEGLPQV

SEQ ID NO: 1276355 - protein, 9 aa, Homo Sapiens
SEVRVLGDP

SEQ ID NO: 1276356 - protein, 9 aa, Homo Sapiens
FDDDSDSPS

SEQ ID NO: 1276357 - protein, 9 aa, Homo Sapiens
VSGLGLLAD

SEQ ID NO: 1276358 - protein, 9 aa, Homo Sapiens
VRLECVGNY

SEQ ID NO: 1276359 - protein, 9 aa, Homo Sapiens
TYVAHVYCH

SEQ ID NO: 1276360 - protein, 9 aa, Homo Sapiens
ELQPPGDCP

SEQ ID NO: 1276361 - protein, 9 aa, Homo Sapiens
VLKCAKDQN

SEQ ID NO: 1276362 - protein, 9 aa, Homo Sapiens
CSFHSLKKV

SEQ ID NO: 1276363 - protein, 9 aa, Homo Sapiens
MDGIHELQD

SEQ ID NO: 1276364 - protein, 9 aa, Homo Sapiens
GQAQDTSGH

SEQ ID NO: 1276365 - protein, 9 aa, Homo Sapiens
YFFDLNRPS

SEQ ID NO: 1276366 - protein, 9 aa, Homo Sapiens
RHLWLPCQR

SEQ ID NO: 1276367 - protein, 9 aa, Homo Sapiens
TLKVTDADT

SEQ ID NO: 1276368 - protein, 9 aa, Homo Sapiens
TYHCLLACP

SEQ ID NO: 1276369 - protein, 9 aa, Homo Sapiens
EYDPKDTWQ

SEQ ID NO: 1276370 - protein, 9 aa, Homo Sapiens
FTVCKPDET

SEQ ID NO: 1276371 - protein, 9 aa, Homo Sapiens
LSPMPVPRA

SEQ ID NO: 1276372 - protein, 9 aa, Homo Sapiens
CPFQCSLCS

SEQ ID NO: 1276373 - protein, 9 aa, Homo Sapiens
YLTDKDFEF

SEQ ID NO: 1276374 - protein, 9 aa, Homo Sapiens
TPSLAAYHH

SEQ ID NO: 1276375 - protein, 9 aa, Homo Sapiens
SLRKPGLPC

SEQ ID NO: 1276376 - protein, 9 aa, Homo Sapiens
LMRGLADHV

SEQ ID NO: 1276377 - protein, 9 aa, Homo Sapiens
LYVSKGALG

SEQ ID NO: 1276378 - protein, 9 aa, Homo Sapiens
HPTLEPATS

SEQ ID NO: 1276379 - protein, 9 aa, Homo Sapiens
GPGASCGGS

SEQ ID NO: 1276380 - protein, 9 aa, Homo Sapiens
TTVDFGGDH

SEQ ID NO: 1276381 - protein, 9 aa, Homo Sapiens
HHGLGVHLS

SEQ ID NO: 1276382 - protein, 9 aa, Homo Sapiens
AASTELYNL

SEQ ID NO: 1276383 - protein, 9 aa, Homo Sapiens
MEESPPSAP

SEQ ID NO: 1276384 - protein, 9 aa, Homo Sapiens
MQDVVYKLV

SEQ ID NO: 1276385 - protein, 9 aa, Homo Sapiens
KPSPPTLSV

SEQ ID NO: 1276386 - protein, 9 aa, Homo Sapiens
ASCPLCRGL

SEQ ID NO: 1276387 - protein, 9 aa, Homo Sapiens
EKGSLVEVI

SEQ ID NO: 1276388 - protein, 9 aa, Homo Sapiens
RNVSTRPSA

SEQ ID NO: 1276389 - protein, 9 aa, Homo Sapiens
EGSSSSRRP

SEQ ID NO: 1276390 - protein, 9 aa, Homo Sapiens
AGIHSLASR

SEQ ID NO: 1276391 - protein, 9 aa, Homo Sapiens
GRGEHPYPW

SEQ ID NO: 1276392 - protein, 9 aa, Homo Sapiens
TLDGRVHAL

SEQ ID NO: 1276393 - protein, 9 aa, Homo Sapiens
YGCHWKRYQ

SEQ ID NO: 1276394 - protein, 9 aa, Homo Sapiens
AHSDMPYDT

SEQ ID NO: 1276395 - protein, 9 aa, Homo Sapiens
LQLQGLVAG

SEQ ID NO: 1276396 - protein, 9 aa, Homo Sapiens
VFTCTHVNI

SEQ ID NO: 1276397 - protein, 9 aa, Homo Sapiens
HPGLGGEAV

SEQ ID NO: 1276398 - protein, 9 aa, Homo Sapiens
KLEDSPKSL

SEQ ID NO: 1276399 - protein, 9 aa, Homo Sapiens
TGQVFELSE

SEQ ID NO: 1276400 - protein, 9 aa, Homo Sapiens
PGVSIASSL

SEQ ID NO: 1276401 - protein, 9 aa, Homo Sapiens
RVALLTMWT

SEQ ID NO: 1276402 - protein, 9 aa, Homo Sapiens
EGPELQHSQ

SEQ ID NO: 1276403 - protein, 9 aa, Homo Sapiens
CQGRKYILV

SEQ ID NO: 1276404 - protein, 9 aa, Homo Sapiens
AALAVVAEG

SEQ ID NO: 1276405 - protein, 9 aa, Homo Sapiens
PTSTGPPPS

SEQ ID NO: 1276406 - protein, 9 aa, Homo Sapiens
IRNNDLIKI

SEQ ID NO: 1276407 - protein, 9 aa, Homo Sapiens
SISRPTSRA

SEQ ID NO: 1276408 - protein, 9 aa, Homo Sapiens
WGAAPTRGS

SEQ ID NO: 1276409 - protein, 9 aa, Homo Sapiens
FQSFGGLSL

SEQ ID NO: 1276410 - protein, 9 aa, Homo Sapiens
PRWKTCYIQ

SEQ ID NO: 1276411 - protein, 9 aa, Homo Sapiens
LKIDPTEAR

SEQ ID NO: 1276412 - protein, 9 aa, Homo Sapiens
YFRLSLHSG

SEQ ID NO: 1276413 - protein, 9 aa, Homo Sapiens
LFEDKIDLF

SEQ ID NO: 1276414 - protein, 9 aa, Homo Sapiens
LIKIIDWIP

SEQ ID NO: 1276415 - protein, 9 aa, Homo Sapiens
WGTLVSGLG

SEQ ID NO: 1276416 - protein, 9 aa, Homo Sapiens
FGGDHVLPV

SEQ ID NO: 1276417 - protein, 9 aa, Homo Sapiens
PPPPTKKRG

SEQ ID NO: 1276418 - protein, 9 aa, Homo Sapiens
HHLLGVRLL

SEQ ID NO: 1276419 - protein, 9 aa, Homo Sapiens
QIWEQTTSD

SEQ ID NO: 1276420 - protein, 9 aa, Homo Sapiens
LACSITVSF

SEQ ID NO: 1276421 - protein, 9 aa, Homo Sapiens
NAVRQLVVG

SEQ ID NO: 1276422 - protein, 9 aa, Homo Sapiens
ERQEWKCFI

SEQ ID NO: 1276423 - protein, 9 aa, Homo Sapiens
RQVAIVVKF

SEQ ID NO: 1276424 - protein, 9 aa, Homo Sapiens
LLHARRVHL

SEQ ID NO: 1276425 - protein, 9 aa, Homo Sapiens
WMQPGVSIA

SEQ ID NO: 1276426 - protein, 9 aa, Homo Sapiens
CEEDFSWFG

SEQ ID NO: 1276427 - protein, 9 aa, Homo Sapiens
GKKMLSLTH

SEQ ID NO: 1276428 - protein, 9 aa, Homo Sapiens
LGGELMSAL

SEQ ID NO: 1276429 - protein, 9 aa, Homo Sapiens
AMTPLWMFP

SEQ ID NO: 1276430 - protein, 9 aa, Homo Sapiens
LDILEYDRK

SEQ ID NO: 1276431 - protein, 9 aa, Homo Sapiens
IDLWRTKPP

SEQ ID NO: 1276432 - protein, 9 aa, Homo Sapiens
TLRIQKLGV

SEQ ID NO: 1276433 - protein, 9 aa, Homo Sapiens
CQCQEQPAA

SEQ ID NO: 1276434 - protein, 9 aa, Homo Sapiens
RASTSWCSA

SEQ ID NO: 1276435 - protein, 9 aa, Homo Sapiens
QFVAPGHSM

SEQ ID NO: 1276436 - protein, 9 aa, Homo Sapiens
TRQNPNCKP

SEQ ID NO: 1276437 - protein, 9 aa, Homo Sapiens
KNFRKEKNS

SEQ ID NO: 1276438 - protein, 9 aa, Homo Sapiens
ACIGMMRTA

SEQ ID NO: 1276439 - protein, 9 aa, Homo Sapiens
YGGTDFSST

SEQ ID NO: 1276440 - protein, 9 aa, Homo Sapiens
GSVTTSATE

SEQ ID NO: 1276441 - protein, 9 aa, Homo Sapiens
HPGAWKFWS

SEQ ID NO: 1276442 - protein, 9 aa, Homo Sapiens
RPARTPPQE

SEQ ID NO: 1276443 - protein, 9 aa, Homo Sapiens
DRVYFRLSL

SEQ ID NO: 1276444 - protein, 9 aa, Homo Sapiens
KTWLLCSPC

SEQ ID NO: 1276445 - protein, 9 aa, Homo Sapiens
STKPSMSPS

SEQ ID NO: 1276446 - protein, 9 aa, Homo Sapiens
DVSRMHCVE

SEQ ID NO: 1276447 - protein, 9 aa, Homo Sapiens
SGFEQPLSK

SEQ ID NO: 1276448 - protein, 9 aa, Homo Sapiens
VDDSRNIDN

SEQ ID NO: 1276449 - protein, 9 aa, Homo Sapiens
LFASDEQGG

SEQ ID NO: 1276450 - protein, 9 aa, Homo Sapiens
NTDRSSHND

SEQ ID NO: 1276451 - protein, 9 aa, Homo Sapiens
PVDTGNTGR

SEQ ID NO: 1276452 - protein, 9 aa, Homo Sapiens
GERQEWKCF

SEQ ID NO: 1276453 - protein, 9 aa, Homo Sapiens
FITFPISFI

SEQ ID NO: 1276454 - protein, 9 aa, Homo Sapiens
LPVQGAQRR

SEQ ID NO: 1276455 - protein, 9 aa, Homo Sapiens
APFFVPMSL

SEQ ID NO: 1276456 - protein, 9 aa, Homo Sapiens
FMKLYHSLV

SEQ ID NO: 1276457 - protein, 9 aa, Homo Sapiens
QYSVSLPDT

SEQ ID NO: 1276458 - protein, 9 aa, Homo Sapiens
ARPAGPMEE

SEQ ID NO: 1276459 - protein, 9 aa, Homo Sapiens
QALAVHSFS

SEQ ID NO: 1276460 - protein, 9 aa, Homo Sapiens
SSAGPKRPR

SEQ ID NO: 1276461 - protein, 9 aa, Homo Sapiens
QSCPLPSPA

SEQ ID NO: 1276462 - protein, 9 aa, Homo Sapiens
NKSVTQEFI

SEQ ID NO: 1276463 - protein, 9 aa, Homo Sapiens
VYEYTLGEQ

SEQ ID NO: 1276464 - protein, 9 aa, Homo Sapiens
GLHIGLIIL

SEQ ID NO: 1276465 - protein, 9 aa, Homo Sapiens
ACATKGRIL

SEQ ID NO: 1276466 - protein, 9 aa, Homo Sapiens
LSILMLHHN

SEQ ID NO: 1276467 - protein, 9 aa, Homo Sapiens
IRKRASAQC

SEQ ID NO: 1276468 - protein, 9 aa, Homo Sapiens
WEKKIEELN

SEQ ID NO: 1276469 - protein, 9 aa, Homo Sapiens
EKMPPPKSS

SEQ ID NO: 1276470 - protein, 9 aa, Homo Sapiens
HHRCGRPEV

SEQ ID NO: 1276471 - protein, 9 aa, Homo Sapiens
KRQQEFEIS

SEQ ID NO: 1276472 - protein, 9 aa, Homo Sapiens
GKWQRFHSP

SEQ ID NO: 1276473 - protein, 9 aa, Homo Sapiens
DVRPLSHAF

SEQ ID NO: 1276474 - protein, 9 aa, Homo Sapiens
RAAQTRRSY

SEQ ID NO: 1276475 - protein, 9 aa, Homo Sapiens
ALKIDPTEA

SEQ ID NO: 1276476 - protein, 9 aa, Homo Sapiens
TATPTCGDS

SEQ ID NO: 1276477 - protein, 9 aa, Homo Sapiens
EILTKRYGG

SEQ ID NO: 1276478 - protein, 9 aa, Homo Sapiens
MFQTKDPEE

SEQ ID NO: 1276479 - protein, 9 aa, Homo Sapiens
KKRGSRSKT

SEQ ID NO: 1276480 - protein, 9 aa, Homo Sapiens
PPPCCRFDS

SEQ ID NO: 1276481 - protein, 9 aa, Homo Sapiens
EDKPFKGDL

SEQ ID NO: 1276482 - protein, 9 aa, Homo Sapiens
GVGLAASFA

SEQ ID NO: 1276483 - protein, 9 aa, Homo Sapiens
LRWLGWARF

SEQ ID NO: 1276484 - protein, 9 aa, Homo Sapiens
TATTTTHRT

SEQ ID NO: 1276485 - protein, 9 aa, Homo Sapiens
DYTPLCSPP

SEQ ID NO: 1276486 - protein, 9 aa, Homo Sapiens
FRVLAVIQD

SEQ ID NO: 1276487 - protein, 9 aa, Homo Sapiens
LKVLTSTTT

SEQ ID NO: 1276488 - protein, 9 aa, Homo Sapiens
QHDALEVAE

SEQ ID NO: 1276489 - protein, 9 aa, Homo Sapiens
PGSGAPPPA

SEQ ID NO: 1276490 - protein, 9 aa, Homo Sapiens
PAGCWSSGR

SEQ ID NO: 1276491 - protein, 9 aa, Homo Sapiens
INAVRQLVV

SEQ ID NO: 1276492 - protein, 9 aa, Homo Sapiens
ALAVVAEGL

SEQ ID NO: 1276493 - protein, 9 aa, Homo Sapiens
SALRVMQWN

SEQ ID NO: 1276494 - protein, 9 aa, Homo Sapiens
EKTSLFQAL

SEQ ID NO: 1276495 - protein, 9 aa, Homo Sapiens
DVTDIWLES

SEQ ID NO: 1276496 - protein, 9 aa, Homo Sapiens
PLASEGRPR

SEQ ID NO: 1276497 - protein, 9 aa, Homo Sapiens
TTDPRMASS

SEQ ID NO: 1276498 - protein, 9 aa, Homo Sapiens
TQGEVQLVQ

SEQ ID NO: 1276499 - protein, 9 aa, Homo Sapiens
QNLTLRIQK

SEQ ID NO: 1276500 - protein, 9 aa, Homo Sapiens
IFPTEERIF

SEQ ID NO: 1276501 - protein, 9 aa, Homo Sapiens
IIEKVLKIH

SEQ ID NO: 1276502 - protein, 9 aa, Homo Sapiens
PAGPHPRRQ

SEQ ID NO: 1276503 - protein, 9 aa, Homo Sapiens
EHPYPWQCG

SEQ ID NO: 1276504 - protein, 9 aa, Homo Sapiens
SGRHHGLGV

SEQ ID NO: 1276505 - protein, 9 aa, Homo Sapiens
HDHGFQAAV

SEQ ID NO: 1276506 - protein, 9 aa, Homo Sapiens
RMQPRVLPR

SEQ ID NO: 1276507 - protein, 9 aa, Homo Sapiens
HSDMPYDTR

SEQ ID NO: 1276508 - protein, 9 aa, Homo Sapiens
APTRGSFER

SEQ ID NO: 1276509 - protein, 9 aa, Homo Sapiens
CQEWLDYQI

SEQ ID NO: 1276510 - protein, 9 aa, Homo Sapiens
MQEALVVEM

SEQ ID NO: 1276511 - protein, 9 aa, Homo Sapiens
EDEKLNILS

SEQ ID NO: 1276512 - protein, 9 aa, Homo Sapiens
HDKFHSLNM

SEQ ID NO: 1276513 - protein, 9 aa, Homo Sapiens
TSTTTTPTV

SEQ ID NO: 1276514 - protein, 9 aa, Homo Sapiens
KRKEGSRSV

SEQ ID NO: 1276515 - protein, 9 aa, Homo Sapiens
QRPPWRTSR

SEQ ID NO: 1276516 - protein, 9 aa, Homo Sapiens
RPGRRGGAG

SEQ ID NO: 1276517 - protein, 9 aa, Homo Sapiens
ALSVLNLAE

SEQ ID NO: 1276518 - protein, 9 aa, Homo Sapiens
LLISTLHRH

SEQ ID NO: 1276519 - protein, 9 aa, Homo Sapiens
DIAACVGTK

SEQ ID NO: 1276520 - protein, 9 aa, Homo Sapiens
EAELAVHRD

SEQ ID NO: 1276521 - protein, 9 aa, Homo Sapiens
VQSVHRQAQ

SEQ ID NO: 1276522 - protein, 9 aa, Homo Sapiens
LPCAQDPLA

SEQ ID NO: 1276523 - protein, 9 aa, Homo Sapiens
LSLYSVAVW

SEQ ID NO: 1276524 - protein, 9 aa, Homo Sapiens
VTILLIIIP

SEQ ID NO: 1276525 - protein, 9 aa, Homo Sapiens
TSRKSIREA

SEQ ID NO: 1276526 - protein, 9 aa, Homo Sapiens
GGDHVLPVQ

SEQ ID NO: 1276527 - protein, 9 aa, Homo Sapiens
PHPRRQCSQ

SEQ ID NO: 1276528 - protein, 9 aa, Homo Sapiens
LTVNISDKL

SEQ ID NO: 1276529 - protein, 9 aa, Homo Sapiens
DYTTGQVFE

SEQ ID NO: 1276530 - protein, 9 aa, Homo Sapiens
LKKTSRILN

SEQ ID NO: 1276531 - protein, 9 aa, Homo Sapiens
RPPAAAGLF

SEQ ID NO: 1276532 - protein, 9 aa, Homo Sapiens
DNSHLRSGQ

SEQ ID NO: 1276533 - protein, 9 aa, Homo Sapiens
MKTHSRNIT

SEQ ID NO: 1276534 - protein, 9 aa, Homo Sapiens
SVLNLAECA

SEQ ID NO: 1276535 - protein, 9 aa, Homo Sapiens
STLHRHMDL

SEQ ID NO: 1276536 - protein, 9 aa, Homo Sapiens
GCKGVLQEL

SEQ ID NO: 1276537 - protein, 9 aa, Homo Sapiens
IKIRLLAWK

SEQ ID NO: 1276538 - protein, 9 aa, Homo Sapiens
DRERAAQTR

SEQ ID NO: 1276539 - protein, 9 aa, Homo Sapiens
DGTLAIPIL

SEQ ID NO: 1276540 - protein, 9 aa, Homo Sapiens
VSPRSEQKV

SEQ ID NO: 1276541 - protein, 9 aa, Homo Sapiens
AAGLFSCLG

SEQ ID NO: 1276542 - protein, 9 aa, Homo Sapiens
RVETVGKEF

SEQ ID NO: 1276543 - protein, 9 aa, Homo Sapiens
EATSLLVVG

SEQ ID NO: 1276544 - protein, 9 aa, Homo Sapiens
KWKSSCISL

SEQ ID NO: 1276545 - protein, 9 aa, Homo Sapiens
LPTATPTCG

SEQ ID NO: 1276546 - protein, 9 aa, Homo Sapiens
LVVVGAVGV

SEQ ID NO: 1276547 - protein, 9 aa, Homo Sapiens
SPPQALVPR

SEQ ID NO: 1276548 - protein, 9 aa, Homo Sapiens
LEPNNPKNL

SEQ ID NO: 1276549 - protein, 9 aa, Homo Sapiens
DPLAAAAVR

SEQ ID NO: 1276550 - protein, 9 aa, Homo Sapiens
VDFGGDHVL

SEQ ID NO: 1276551 - protein, 9 aa, Homo Sapiens
LLTMWTCMD

SEQ ID NO: 1276552 - protein, 9 aa, Homo Sapiens
SKAPGPHPK

SEQ ID NO: 1276553 - protein, 9 aa, Homo Sapiens
DLIKIIDWI

SEQ ID NO: 1276554 - protein, 9 aa, Homo Sapiens
HTGECPFQC

SEQ ID NO: 1276555 - protein, 9 aa, Homo Sapiens
RPQPVLLGL

SEQ ID NO: 1276556 - protein, 9 aa, Homo Sapiens
AHALHPASS

SEQ ID NO: 1276557 - protein, 9 aa, Homo Sapiens
NATMAFWLS

SEQ ID NO: 1276558 - protein, 9 aa, Homo Sapiens
KKIEELNFI

SEQ ID NO: 1276559 - protein, 9 aa, Homo Sapiens
FPSRSRWPG

SEQ ID NO: 1276560 - protein, 9 aa, Homo Sapiens
CPRGPSLPM

SEQ ID NO: 1276561 - protein, 9 aa, Homo Sapiens
GLMGRGEHP

SEQ ID NO: 1276562 - protein, 9 aa, Homo Sapiens
LSSTECRIG

SEQ ID NO: 1276563 - protein, 9 aa, Homo Sapiens
EGLHEGLPQ

SEQ ID NO: 1276564 - protein, 9 aa, Homo Sapiens
LLRKPQPRR

SEQ ID NO: 1276565 - protein, 9 aa, Homo Sapiens
WTCMDMLPK

SEQ ID NO: 1276566 - protein, 9 aa, Homo Sapiens
KLEKALSAL

SEQ ID NO: 1276567 - protein, 9 aa, Homo Sapiens
MNGQHLPRD

SEQ ID NO: 1276568 - protein, 9 aa, Homo Sapiens
DADQHGVVQ

SEQ ID NO: 1276569 - protein, 9 aa, Homo Sapiens
TTNGHQNGL

SEQ ID NO: 1276570 - protein, 9 aa, Homo Sapiens
STMEGPELQ

SEQ ID NO: 1276571 - protein, 9 aa, Homo Sapiens
DSDGGDLDK

SEQ ID NO: 1276572 - protein, 9 aa, Homo Sapiens
PAKACTGDR

SEQ ID NO: 1276573 - protein, 9 aa, Homo Sapiens
PTRGSFERP

SEQ ID NO: 1276574 - protein, 9 aa, Homo Sapiens
WRPSHDRYW

SEQ ID NO: 1276575 - protein, 9 aa, Homo Sapiens
HPASSSSSS

SEQ ID NO: 1276576 - protein, 9 aa, Homo Sapiens
EKALSALFI

SEQ ID NO: 1276577 - protein, 9 aa, Homo Sapiens
FLNFCGLDP

SEQ ID NO: 1276578 - protein, 9 aa, Homo Sapiens
DGGGDDHDV

SEQ ID NO: 1276579 - protein, 9 aa, Homo Sapiens
AAFEQDVSR

SEQ ID NO: 1276580 - protein, 9 aa, Homo Sapiens
CLYVSKGAL

SEQ ID NO: 1276581 - protein, 9 aa, Homo Sapiens
DSPKSLKSG

SEQ ID NO: 1276582 - protein, 9 aa, Homo Sapiens
VHSFSCPHS

SEQ ID NO: 1276583 - protein, 9 aa, Homo Sapiens
HLLGVRLLL

SEQ ID NO: 1276584 - protein, 9 aa, Homo Sapiens
VAKSWIIQQ

SEQ ID NO: 1276585 - protein, 9 aa, Homo Sapiens
HWDPEDACV

SEQ ID NO: 1276586 - protein, 9 aa, Homo Sapiens
PGPGASCGG

SEQ ID NO: 1276587 - protein, 9 aa, Homo Sapiens
VYQFQVTAM

SEQ ID NO: 1276588 - protein, 9 aa, Homo Sapiens
RRMEAVRLQ

SEQ ID NO: 1276589 - protein, 9 aa, Homo Sapiens
AELEQTHPR

SEQ ID NO: 1276590 - protein, 9 aa, Homo Sapiens
KFFKGQSNT

SEQ ID NO: 1276591 - protein, 9 aa, Homo Sapiens
VRQLVVGYR

SEQ ID NO: 1276592 - protein, 9 aa, Homo Sapiens
RKNGWDTGT

SEQ ID NO: 1276593 - protein, 9 aa, Homo Sapiens
FLWPLASEG

SEQ ID NO: 1276594 - protein, 9 aa, Homo Sapiens
DCCQCQEQP

SEQ ID NO: 1276595 - protein, 9 aa, Homo Sapiens
DIAVKWRMI

SEQ ID NO: 1276596 - protein, 9 aa, Homo Sapiens
VWMEECVLS

SEQ ID NO: 1276597 - protein, 9 aa, Homo Sapiens
MRATFSGSV

SEQ ID NO: 1276598 - protein, 9 aa, Homo Sapiens
IVSPRSEQK

SEQ ID NO: 1276599 - protein, 9 aa, Homo Sapiens
SRILNLQVL

SEQ ID NO: 1276600 - protein, 9 aa, Homo Sapiens
GEAKTWLLC

SEQ ID NO: 1276601 - protein, 9 aa, Homo Sapiens
RARKPAGCW

SEQ ID NO: 1276602 - protein, 9 aa, Homo Sapiens
LLPGEGAAA

SEQ ID NO: 1276603 - protein, 9 aa, Homo Sapiens
RGKSQGGRI

SEQ ID NO: 1276604 - protein, 9 aa, Homo Sapiens
RTEQFGKFN

SEQ ID NO: 1276605 - protein, 9 aa, Homo Sapiens
KAPTCGLCK

SEQ ID NO: 1276606 - protein, 9 aa, Homo Sapiens
LHEGLPQVQ

SEQ ID NO: 1276607 - protein, 9 aa, Homo Sapiens
VDVNGTGTL

SEQ ID NO: 1276608 - protein, 9 aa, Homo Sapiens
SLMKDSTPV

SEQ ID NO: 1276609 - protein, 9 aa, Homo Sapiens
PTCGLCKVA

SEQ ID NO: 1276610 - protein, 9 aa, Homo Sapiens
LSKDMSGLH

SEQ ID NO: 1276611 - protein, 9 aa, Homo Sapiens
RTVQDSRKR

SEQ ID NO: 1276612 - protein, 9 aa, Homo Sapiens
SWKIMRRNR

SEQ ID NO: 1276613 - protein, 9 aa, Homo Sapiens
FELSEKLEQ

SEQ ID NO: 1276614 - protein, 9 aa, Homo Sapiens
QCQEQPAAV

SEQ ID NO: 1276615 - protein, 9 aa, Homo Sapiens
RQCSQHQPA

SEQ ID NO: 1276616 - protein, 9 aa, Homo Sapiens
GLPGSLEYL

SEQ ID NO: 1276617 - protein, 9 aa, Homo Sapiens
EILWRLLVT

SEQ ID NO: 1276618 - protein, 9 aa, Homo Sapiens
VPSAEGTSI

SEQ ID NO: 1276619 - protein, 9 aa, Homo Sapiens
QLCHPPRQG

SEQ ID NO: 1276620 - protein, 9 aa, Homo Sapiens
KHSRYKKKK

SEQ ID NO: 1276621 - protein, 9 aa, Homo Sapiens
ATRSLPCPG

SEQ ID NO: 1276622 - protein, 9 aa, Homo Sapiens
GQCAPRTSP

SEQ ID NO: 1276623 - protein, 9 aa, Homo Sapiens
YDTRQNPNC

SEQ ID NO: 1276624 - protein, 9 aa, Homo Sapiens
LESSSEGGG

SEQ ID NO: 1276625 - protein, 9 aa, Homo Sapiens
RSPTSTGPP

SEQ ID NO: 1276626 - protein, 9 aa, Homo Sapiens
CTAGTQHPG

SEQ ID NO: 1276627 - protein, 9 aa, Homo Sapiens
AFPAWSTVV

SEQ ID NO: 1276628 - protein, 9 aa, Homo Sapiens
IFWNIKIRL

SEQ ID NO: 1276629 - protein, 9 aa, Homo Sapiens
SRNITVQKN

SEQ ID NO: 1276630 - protein, 9 aa, Homo Sapiens
PVLYLQCLS

SEQ ID NO: 1276631 - protein, 9 aa, Homo Sapiens
LHIGLIILA

SEQ ID NO: 1276632 - protein, 9 aa, Homo Sapiens
KKADSTTTK

SEQ ID NO: 1276633 - protein, 9 aa, Homo Sapiens
SLPLPSSNS

SEQ ID NO: 1276634 - protein, 9 aa, Homo Sapiens
ELSEKLEQS

SEQ ID NO: 1276635 - protein, 9 aa, Homo Sapiens
SMNGQPLIC

SEQ ID NO: 1276636 - protein, 9 aa, Homo Sapiens
KSVSVPHIS

SEQ ID NO: 1276637 - protein, 9 aa, Homo Sapiens
TSDLTQSQD

SEQ ID NO: 1276638 - protein, 9 aa, Homo Sapiens
LAYEMNGQH

SEQ ID NO: 1276639 - protein, 9 aa, Homo Sapiens
YGTGRWLHQ

SEQ ID NO: 1276640 - protein, 9 aa, Homo Sapiens
EHSVIDLWR

SEQ ID NO: 1276641 - protein, 9 aa, Homo Sapiens
TGQKIRSGE

SEQ ID NO: 1276642 - protein, 9 aa, Homo Sapiens
IIGIITYCC

SEQ ID NO: 1276643 - protein, 9 aa, Homo Sapiens
TVMIPDVTQ

SEQ ID NO: 1276644 - protein, 9 aa, Homo Sapiens
VAWLISFFY

SEQ ID NO: 1276645 - protein, 9 aa, Homo Sapiens
PAGPMEESP

SEQ ID NO: 1276646 - protein, 9 aa, Homo Sapiens
QENYKDHSM

SEQ ID NO: 1276647 - protein, 9 aa, Homo Sapiens
DADTPNTPA

SEQ ID NO: 1276648 - protein, 9 aa, Homo Sapiens
SLKKTSRIL

SEQ ID NO: 1276649 - protein, 9 aa, Homo Sapiens
QPVREHIAN

SEQ ID NO: 1276650 - protein, 9 aa, Homo Sapiens
KILRSFMKL

SEQ ID NO: 1276651 - protein, 9 aa, Homo Sapiens
PAAAGLFSC

SEQ ID NO: 1276652 - protein, 9 aa, Homo Sapiens
GEAELAVHR

SEQ ID NO: 1276653 - protein, 9 aa, Homo Sapiens
KVMPAKACT

SEQ ID NO: 1276654 - protein, 9 aa, Homo Sapiens
VRLEKMPPP

SEQ ID NO: 1276655 - protein, 9 aa, Homo Sapiens
ARHSEASVL

SEQ ID NO: 1276656 - protein, 9 aa, Homo Sapiens
IDGTLHREL

SEQ ID NO: 1276657 - protein, 9 aa, Homo Sapiens
ALLRDGPHT

SEQ ID NO: 1276658 - protein, 9 aa, Homo Sapiens
HWRIGGGTP

SEQ ID NO: 1276659 - protein, 9 aa, Homo Sapiens
PMVVQSVGT

SEQ ID NO: 1276660 - protein, 9 aa, Homo Sapiens
EQDSLNANL

SEQ ID NO: 1276661 - protein, 9 aa, Homo Sapiens
TATNLALSV

SEQ ID NO: 1276662 - protein, 9 aa, Homo Sapiens
ACPQFVLGM

SEQ ID NO: 1276663 - protein, 9 aa, Homo Sapiens
CPVTPATAG

SEQ ID NO: 1276664 - protein, 9 aa, Homo Sapiens
TTTPTVISS

SEQ ID NO: 1276665 - protein, 9 aa, Homo Sapiens
DIFCQGFGP

SEQ ID NO: 1276666 - protein, 9 aa, Homo Sapiens
TEKGSLVEV

SEQ ID NO: 1276667 - protein, 9 aa, Homo Sapiens
ALEVAELLP

SEQ ID NO: 1276668 - protein, 9 aa, Homo Sapiens
YERFTVTYM

SEQ ID NO: 1276669 - protein, 9 aa, Homo Sapiens
TATEEKARR

SEQ ID NO: 1276670 - protein, 9 aa, Homo Sapiens
AMVIISGWG

SEQ ID NO: 1276671 - protein, 9 aa, Homo Sapiens
RCGRPEVCG

SEQ ID NO: 1276672 - protein, 9 aa, Homo Sapiens
GRTVQDSRK

SEQ ID NO: 1276673 - protein, 9 aa, Homo Sapiens
LLFITFPIS

SEQ ID NO: 1276674 - protein, 9 aa, Homo Sapiens
LILGIFVTI

SEQ ID NO: 1276675 - protein, 9 aa, Homo Sapiens
DKIDLFQDV

SEQ ID NO: 1276676 - protein, 9 aa, Homo Sapiens
FRLSLHSGP

SEQ ID NO: 1276677 - protein, 9 aa, Homo Sapiens
IPEGSSSSR

SEQ ID NO: 1276678 - protein, 9 aa, Homo Sapiens
ECTKLIIQA

SEQ ID NO: 1276679 - protein, 9 aa, Homo Sapiens
RANLLSSLS

SEQ ID NO: 1276680 - protein, 9 aa, Homo Sapiens
RAPRWKTCY

SEQ ID NO: 1276681 - protein, 9 aa, Homo Sapiens
VLKKILRSF

SEQ ID NO: 1276682 - protein, 9 aa, Homo Sapiens
NIDNCWIET

SEQ ID NO: 1276683 - protein, 9 aa, Homo Sapiens
QRLQEDLGT

SEQ ID NO: 1276684 - protein, 9 aa, Homo Sapiens
AAVTFRRRA

SEQ ID NO: 1276685 - protein, 9 aa, Homo Sapiens
LIFWNIKIR

SEQ ID NO: 1276686 - protein, 9 aa, Homo Sapiens
PRRQCSQHQ

SEQ ID NO: 1276687 - protein, 9 aa, Homo Sapiens
RRGPAAAAP

SEQ ID NO: 1276688 - protein, 9 aa, Homo Sapiens
PASPLSPRA

SEQ ID NO: 1276689 - protein, 9 aa, Homo Sapiens
CCLRFLLGR

SEQ ID NO: 1276690 - protein, 9 aa, Homo Sapiens
LRFQSFGGL

SEQ ID NO: 1276691 - protein, 9 aa, Homo Sapiens
RHISPFWVF

SEQ ID NO: 1276692 - protein, 9 aa, Homo Sapiens
LSVSLVKDE

SEQ ID NO: 1276693 - protein, 9 aa, Homo Sapiens
GPPQLHHRC

SEQ ID NO: 1276694 - protein, 9 aa, Homo Sapiens
SLWLTSSAG

SEQ ID NO: 1276695 - protein, 9 aa, Homo Sapiens
WTLQTFQLC

SEQ ID NO: 1276696 - protein, 9 aa, Homo Sapiens
NISVDSECI

SEQ ID NO: 1276697 - protein, 9 aa, Homo Sapiens
APGHSMGQP

SEQ ID NO: 1276698 - protein, 9 aa, Homo Sapiens
PSNRKPLIV

SEQ ID NO: 1276699 - protein, 9 aa, Homo Sapiens
SSKRDLAAE

SEQ ID NO: 1276700 - protein, 9 aa, Homo Sapiens
RLVDSHHQL

SEQ ID NO: 1276701 - protein, 9 aa, Homo Sapiens
EAPPALGML

SEQ ID NO: 1276702 - protein, 9 aa, Homo Sapiens
RSGHSPHCA

SEQ ID NO: 1276703 - protein, 9 aa, Homo Sapiens
LRIQKLGVL

SEQ ID NO: 1276704 - protein, 9 aa, Homo Sapiens
NRSRTNGSV

SEQ ID NO: 1276705 - protein, 9 aa, Homo Sapiens
LHSGPGFLW

SEQ ID NO: 1276706 - protein, 9 aa, Homo Sapiens
ELKNATMAF

SEQ ID NO: 1276707 - protein, 9 aa, Homo Sapiens
SLASRDGSD

SEQ ID NO: 1276708 - protein, 9 aa, Homo Sapiens
NSSENKLNE

SEQ ID NO: 1276709 - protein, 9 aa, Homo Sapiens
QRRRSARWP

SEQ ID NO: 1276710 - protein, 9 aa, Homo Sapiens
DSTPVLYLQ

SEQ ID NO: 1276711 - protein, 9 aa, Homo Sapiens
RKKLLEAQS

SEQ ID NO: 1276712 - protein, 9 aa, Homo Sapiens
RILNLQVLK

SEQ ID NO: 1276713 - protein, 9 aa, Homo Sapiens
SIASSLAWR

SEQ ID NO: 1276714 - protein, 9 aa, Homo Sapiens
VNICVFIYI

SEQ ID NO: 1276715 - protein, 9 aa, Homo Sapiens
NECTKLIIQ

SEQ ID NO: 1276716 - protein, 9 aa, Homo Sapiens
LPQMSKVKV

SEQ ID NO: 1276717 - protein, 9 aa, Homo Sapiens
YHDKFHSLN

SEQ ID NO: 1276718 - protein, 9 aa, Homo Sapiens
PSIRSASSR

SEQ ID NO: 1276719 - protein, 9 aa, Homo Sapiens
QKLLHARRV

SEQ ID NO: 1276720 - protein, 9 aa, Homo Sapiens
AVHRDQPAE

SEQ ID NO: 1276721 - protein, 9 aa, Homo Sapiens
PQVPPPCCR

SEQ ID NO: 1276722 - protein, 9 aa, Homo Sapiens
SPARPAGPM

SEQ ID NO: 1276723 - protein, 9 aa, Homo Sapiens
PQALVPRHQ

SEQ ID NO: 1276724 - protein, 9 aa, Homo Sapiens
LRGTYIPRG

SEQ ID NO: 1276725 - protein, 9 aa, Homo Sapiens
AAADLERFL

SEQ ID NO: 1276726 - protein, 9 aa, Homo Sapiens
EKKIEELNF

SEQ ID NO: 1276727 - protein, 9 aa, Homo Sapiens
LGMDLFHHC

SEQ ID NO: 1276728 - protein, 9 aa, Homo Sapiens
FQSPMHVVC

SEQ ID NO: 1276729 - protein, 9 aa, Homo Sapiens
ADSTTTKKN

SEQ ID NO: 1276730 - protein, 9 aa, Homo Sapiens
SSSSSSSLG

SEQ ID NO: 1276731 - protein, 9 aa, Homo Sapiens
AQCADSGTE

SEQ ID NO: 1276732 - protein, 9 aa, Homo Sapiens
ESRGILRKM

SEQ ID NO: 1276733 - protein, 9 aa, Homo Sapiens
WKESTIFQM

SEQ ID NO: 1276734 - protein, 9 aa, Homo Sapiens
LHTTMYFLF

SEQ ID NO: 1276735 - protein, 9 aa, Homo Sapiens
GRPRSHSAH

SEQ ID NO: 1276736 - protein, 9 aa, Homo Sapiens
KIDLFQDVK

SEQ ID NO: 1276737 - protein, 9 aa, Homo Sapiens
QYGVKNQNH

SEQ ID NO: 1276738 - protein, 9 aa, Homo Sapiens
EDDFLLHSL

SEQ ID NO: 1276739 - protein, 9 aa, Homo Sapiens
PCGKAHAFQ

SEQ ID NO: 1276740 - protein, 9 aa, Homo Sapiens
QLPQMSKVK

SEQ ID NO: 1276741 - protein, 9 aa, Homo Sapiens
SFIGWGSQS

SEQ ID NO: 1276742 - protein, 9 aa, Homo Sapiens
SWKAGKSWK

SEQ ID NO: 1276743 - protein, 9 aa, Homo Sapiens
DSRDGWGGL

SEQ ID NO: 1276744 - protein, 9 aa, Homo Sapiens
PLPTATPTC

SEQ ID NO: 1276745 - protein, 9 aa, Homo Sapiens
WRMMASVSP

SEQ ID NO: 1276746 - protein, 9 aa, Homo Sapiens
SAFRCPYRK

SEQ ID NO: 1276747 - protein, 9 aa, Homo Sapiens
TRRSYPEFQ

SEQ ID NO: 1276748 - protein, 9 aa, Homo Sapiens
QGLVAGVGL

SEQ ID NO: 1276749 - protein, 9 aa, Homo Sapiens
QTRRSYPEF

SEQ ID NO: 1276750 - protein, 9 aa, Homo Sapiens
DIVSPRSEQ

SEQ ID NO: 1276751 - protein, 9 aa, Homo Sapiens
TRKRIFFAW

SEQ ID NO: 1276752 - protein, 9 aa, Homo Sapiens
GSLPVADVP

SEQ ID NO: 1276753 - protein, 9 aa, Homo Sapiens
SAHHHLLGV

SEQ ID NO: 1276754 - protein, 9 aa, Homo Sapiens
VVTEDMDAA

SEQ ID NO: 1276755 - protein, 9 aa, Homo Sapiens
DVVYKLVPG

SEQ ID NO: 1276756 - protein, 9 aa, Homo Sapiens
GMLHTFLRW

SEQ ID NO: 1276757 - protein, 9 aa, Homo Sapiens
QTHPRLKEQ

SEQ ID NO: 1276758 - protein, 9 aa, Homo Sapiens
ALHPASSSS

SEQ ID NO: 1276759 - protein, 9 aa, Homo Sapiens
FWLSRSSGM

SEQ ID NO: 1276760 - protein, 9 aa, Homo Sapiens
KWRMIADPD

SEQ ID NO: 1276761 - protein, 9 aa, Homo Sapiens
IPDYTPLCS

SEQ ID NO: 1276762 - protein, 9 aa, Homo Sapiens
GLSLPRLHA

SEQ ID NO: 1276763 - protein, 9 aa, Homo Sapiens
PSLRSPPQA

SEQ ID NO: 1276764 - protein, 9 aa, Homo Sapiens
QSHNKSVNE

SEQ ID NO: 1276765 - protein, 9 aa, Homo Sapiens
QNRSRTNGS

SEQ ID NO: 1276766 - protein, 9 aa, Homo Sapiens
QRTAKKADR

SEQ ID NO: 1276767 - protein, 9 aa, Homo Sapiens
EYFFDLNRP

SEQ ID NO: 1276768 - protein, 9 aa, Homo Sapiens
IWKKKMSCA

SEQ ID NO: 1276769 - protein, 9 aa, Homo Sapiens
ARKKLLEAQ

SEQ ID NO: 1276770 - protein, 9 aa, Homo Sapiens
RSAAFPAWS

SEQ ID NO: 1276771 - protein, 9 aa, Homo Sapiens
DRLPRPAGR

SEQ ID NO: 1276772 - protein, 9 aa, Homo Sapiens
FTCPICGCG

SEQ ID NO: 1276773 - protein, 9 aa, Homo Sapiens
DAIIMAESA

SEQ ID NO: 1276774 - protein, 9 aa, Homo Sapiens
DHVEDDGET

SEQ ID NO: 1276775 - protein, 9 aa, Homo Sapiens
RGSFERPRT

SEQ ID NO: 1276776 - protein, 9 aa, Homo Sapiens
SRASTSWCS

SEQ ID NO: 1276777 - protein, 9 aa, Homo Sapiens
PGFLWPLAS

SEQ ID NO: 1276778 - protein, 9 aa, Homo Sapiens
GYCCSCPPG

SEQ ID NO: 1276779 - protein, 9 aa, Homo Sapiens
PGPLSPPLP

SEQ ID NO: 1276780 - protein, 9 aa, Homo Sapiens
RLSLLSHVG

SEQ ID NO: 1276781 - protein, 9 aa, Homo Sapiens
VTDIWLESA

SEQ ID NO: 1276782 - protein, 9 aa, Homo Sapiens
VAEARGVRR

SEQ ID NO: 1276783 - protein, 9 aa, Homo Sapiens
GTCQYSVSL

SEQ ID NO: 1276784 - protein, 9 aa, Homo Sapiens
HVGRPGSGG

SEQ ID NO: 1276785 - protein, 9 aa, Homo Sapiens
RASTSGLGD

SEQ ID NO: 1276786 - protein, 9 aa, Homo Sapiens
QKFTFIEKC

SEQ ID NO: 1276787 - protein, 9 aa, Homo Sapiens
LVMCLRLRT

SEQ ID NO: 1276788 - protein, 9 aa, Homo Sapiens
HLWLPCQRL

SEQ ID NO: 1276789 - protein, 9 aa, Homo Sapiens
TRSTLMSCT

SEQ ID NO: 1276790 - protein, 9 aa, Homo Sapiens
LNEASRAHW

SEQ ID NO: 1276791 - protein, 9 aa, Homo Sapiens
VHPYEALET

SEQ ID NO: 1276792 - protein, 9 aa, Homo Sapiens
GASCGGSRR

SEQ ID NO: 1276793 - protein, 9 aa, Homo Sapiens
TPAPSPRSG

SEQ ID NO: 1276794 - protein, 9 aa, Homo Sapiens
NFPAMTPLW

SEQ ID NO: 1276795 - protein, 9 aa, Homo Sapiens
PGLGGEAVG

SEQ ID NO: 1276796 - protein, 9 aa, Homo Sapiens
PLSPPLPWR

SEQ ID NO: 1276797 - protein, 9 aa, Homo Sapiens
IRSASSRAS

SEQ ID NO: 1276798 - protein, 9 aa, Homo Sapiens
ADADQHGVV

SEQ ID NO: 1276799 - protein, 9 aa, Homo Sapiens
ALHQQDFTR

SEQ ID NO: 1276800 - protein, 9 aa, Homo Sapiens
VNGTGTLSQ

SEQ ID NO: 1276801 - protein, 9 aa, Homo Sapiens
EAVCSHRRG

SEQ ID NO: 1276802 - protein, 9 aa, Homo Sapiens
CVALLAKSG

SEQ ID NO: 1276803 - protein, 9 aa, Homo Sapiens
LCQAHRLPL

SEQ ID NO: 1276804 - protein, 9 aa, Homo Sapiens
IIMAESATA

SEQ ID NO: 1276805 - protein, 9 aa, Homo Sapiens
WSRVGSNLP

SEQ ID NO: 1276806 - protein, 9 aa, Homo Sapiens
GPYHDKFHS

SEQ ID NO: 1276807 - protein, 9 aa, Homo Sapiens
WSTVVQYLM

SEQ ID NO: 1276808 - protein, 9 aa, Homo Sapiens
LQRYSNLIL

SEQ ID NO: 1276809 - protein, 9 aa, Homo Sapiens
ACMRSDTPT

SEQ ID NO: 1276810 - protein, 9 aa, Homo Sapiens
KFAATGMGG

SEQ ID NO: 1276811 - protein, 9 aa, Homo Sapiens
EQLTAGFRR

SEQ ID NO: 1276812 - protein, 9 aa, Homo Sapiens
VALLRLAEG

SEQ ID NO: 1276813 - protein, 9 aa, Homo Sapiens
ALILGIFVT

SEQ ID NO: 1276814 - protein, 9 aa, Homo Sapiens
EDLETHILS

SEQ ID NO: 1276815 - protein, 9 aa, Homo Sapiens
GKSWKIMRR

SEQ ID NO: 1276816 - protein, 9 aa, Homo Sapiens
SALATAELK

SEQ ID NO: 1276817 - protein, 9 aa, Homo Sapiens
WDTGTENKG

SEQ ID NO: 1276818 - protein, 9 aa, Homo Sapiens
ISSRGQQYG

SEQ ID NO: 1276819 - protein, 9 aa, Homo Sapiens
GPDLLRKPQ

SEQ ID NO: 1276820 - protein, 9 aa, Homo Sapiens
ALVVCGSMH

SEQ ID NO: 1276821 - protein, 9 aa, Homo Sapiens
TETALVMRA

SEQ ID NO: 1276822 - protein, 9 aa, Homo Sapiens
CHLESSSEG

SEQ ID NO: 1276823 - protein, 9 aa, Homo Sapiens
YDEGDYDAD

SEQ ID NO: 1276824 - protein, 9 aa, Homo Sapiens
GAASCTETA

SEQ ID NO: 1276825 - protein, 9 aa, Homo Sapiens
VDDRGTCQY

SEQ ID NO: 1276826 - protein, 9 aa, Homo Sapiens
SRARQSCCL

SEQ ID NO: 1276827 - protein, 9 aa, Homo Sapiens
LQGLVAGVG

SEQ ID NO: 1276828 - protein, 9 aa, Homo Sapiens
RSPPQALVP

SEQ ID NO: 1276829 - protein, 9 aa, Homo Sapiens
AQGHPDGQC

SEQ ID NO: 1276830 - protein, 9 aa, Homo Sapiens
PPQLHHRCG

SEQ ID NO: 1276831 - protein, 9 aa, Homo Sapiens
LLSLEAVRR

SEQ ID NO: 1276832 - protein, 9 aa, Homo Sapiens
PASQRSSAC

SEQ ID NO: 1276833 - protein, 9 aa, Homo Sapiens
AGTGCAKEG

SEQ ID NO: 1276834 - protein, 9 aa, Homo Sapiens
HCAVASPYP

SEQ ID NO: 1276835 - protein, 9 aa, Homo Sapiens
FPAMTPLWM

SEQ ID NO: 1276836 - protein, 9 aa, Homo Sapiens
GLFSCLGTS

SEQ ID NO: 1276837 - protein, 9 aa, Homo Sapiens
RGQAQDTSG

SEQ ID NO: 1276838 - protein, 9 aa, Homo Sapiens
AIQNIHSVS

SEQ ID NO: 1276839 - protein, 9 aa, Homo Sapiens
AGYPTGTGI

SEQ ID NO: 1276840 - protein, 9 aa, Homo Sapiens
TRVEILWRL

SEQ ID NO: 1276841 - protein, 9 aa, Homo Sapiens
ADVPYRLLL

SEQ ID NO: 1276842 - protein, 9 aa, Homo Sapiens
CCISNSCCP

SEQ ID NO: 1276843 - protein, 9 aa, Homo Sapiens
VLECVPPAA

SEQ ID NO: 1276844 - protein, 9 aa, Homo Sapiens
TNGHQNGLD

SEQ ID NO: 1276845 - protein, 9 aa, Homo Sapiens
WEQTTSDLT

SEQ ID NO: 1276846 - protein, 9 aa, Homo Sapiens
VNMFVIADG

SEQ ID NO: 1276847 - protein, 9 aa, Homo Sapiens
EALHQQDFT

SEQ ID NO: 1276848 - protein, 9 aa, Homo Sapiens
DALEVAELL

SEQ ID NO: 1276849 - protein, 9 aa, Homo Sapiens
TLHRHMDLH

SEQ ID NO: 1276850 - protein, 9 aa, Homo Sapiens
EEAVVTEDM

SEQ ID NO: 1276851 - protein, 9 aa, Homo Sapiens
LADFPLDSM

SEQ ID NO: 1276852 - protein, 9 aa, Homo Sapiens
SAEGTSIQG

SEQ ID NO: 1276853 - protein, 9 aa, Homo Sapiens
EYKRAMLRD

SEQ ID NO: 1276854 - protein, 9 aa, Homo Sapiens
GRHVRARMQ

SEQ ID NO: 1276855 - protein, 9 aa, Homo Sapiens
RTQQRPPWR

SEQ ID NO: 1276856 - protein, 9 aa, Homo Sapiens
LAAYHHPDF

SEQ ID NO: 1276857 - protein, 9 aa, Homo Sapiens
PGHVLVRLI

SEQ ID NO: 1276858 - protein, 9 aa, Homo Sapiens
TWLLCSPCC

SEQ ID NO: 1276859 - protein, 9 aa, Homo Sapiens
PMPVPRAVP

SEQ ID NO: 1276860 - protein, 9 aa, Homo Sapiens
PLPGQVHGP

SEQ ID NO: 1276861 - protein, 9 aa, Homo Sapiens
LHEATLITI

SEQ ID NO: 1276862 - protein, 9 aa, Homo Sapiens
PEAPPALGM

SEQ ID NO: 1276863 - protein, 9 aa, Homo Sapiens
GECPFQCSL

SEQ ID NO: 1276864 - protein, 9 aa, Homo Sapiens
TLKVLTSTT

SEQ ID NO: 1276865 - protein, 9 aa, Homo Sapiens
VRDAVRKPK

SEQ ID NO: 1276866 - protein, 9 aa, Homo Sapiens
CVDEINGYC

SEQ ID NO: 1276867 - protein, 9 aa, Homo Sapiens
LQNMWDGNI

SEQ ID NO: 1276868 - protein, 9 aa, Homo Sapiens
LLGLLSPRP

SEQ ID NO: 1276869 - protein, 9 aa, Homo Sapiens
ITEGDNSHL

SEQ ID NO: 1276870 - protein, 9 aa, Homo Sapiens
SLFQALGIT

SEQ ID NO: 1276871 - protein, 9 aa, Homo Sapiens
PAPGPLSPP

SEQ ID NO: 1276872 - protein, 9 aa, Homo Sapiens
TNSSARHSE

SEQ ID NO: 1276873 - protein, 9 aa, Homo Sapiens
VKWKSSCIS

SEQ ID NO: 1276874 - protein, 9 aa, Homo Sapiens
MNGQPLICV

SEQ ID NO: 1276875 - protein, 9 aa, Homo Sapiens
DWYSINWME

SEQ ID NO: 1276876 - protein, 9 aa, Homo Sapiens
LVSASASPS

SEQ ID NO: 1276877 - protein, 9 aa, Homo Sapiens
RGSRSKTRG

SEQ ID NO: 1276878 - protein, 9 aa, Homo Sapiens
ARAGLHPCG

SEQ ID NO: 1276879 - protein, 9 aa, Homo Sapiens
EANGGRTQG

SEQ ID NO: 1276880 - protein, 9 aa, Homo Sapiens
SRPTSRARQ

SEQ ID NO: 1276881 - protein, 9 aa, Homo Sapiens
GWQTMWCPP

SEQ ID NO: 1276882 - protein, 9 aa, Homo Sapiens
AKMRRRSWQ

SEQ ID NO: 1276883 - protein, 9 aa, Homo Sapiens
RACTRLQRA

SEQ ID NO: 1276884 - protein, 9 aa, Homo Sapiens
SASSRASTS

SEQ ID NO: 1276885 - protein, 9 aa, Homo Sapiens
PPQKSSCPG

SEQ ID NO: 1276886 - protein, 9 aa, Homo Sapiens
KQLALIATI

SEQ ID NO: 1276887 - protein, 9 aa, Homo Sapiens
KGWQTMWCP

SEQ ID NO: 1276888 - protein, 9 aa, Homo Sapiens
MPVPRAVPV

SEQ ID NO: 1276889 - protein, 9 aa, Homo Sapiens
VMVHSILLR

SEQ ID NO: 1276890 - protein, 9 aa, Homo Sapiens
WYTTHYPTD

SEQ ID NO: 1276891 - protein, 9 aa, Homo Sapiens
NAAYTLGKS

SEQ ID NO: 1276892 - protein, 9 aa, Homo Sapiens
PRSHSAHHH

SEQ ID NO: 1276893 - protein, 9 aa, Homo Sapiens
GVPVALKKS

SEQ ID NO: 1276894 - protein, 9 aa, Homo Sapiens
RAFLRTVAF

SEQ ID NO: 1276895 - protein, 9 aa, Homo Sapiens
SWGWGCCLR

SEQ ID NO: 1276896 - protein, 9 aa, Homo Sapiens
DTGTENKGV

SEQ ID NO: 1276897 - protein, 9 aa, Homo Sapiens
LPPGSKGRP

SEQ ID NO: 1276898 - protein, 9 aa, Homo Sapiens
LSYPDSTDV

SEQ ID NO: 1276899 - protein, 9 aa, Homo Sapiens
SSSSRRPGT

SEQ ID NO: 1276900 - protein, 9 aa, Homo Sapiens
FLLHSLNMA

SEQ ID NO: 1276901 - protein, 9 aa, Homo Sapiens
PPECYLGLP

SEQ ID NO: 1276902 - protein, 9 aa, Homo Sapiens
PGARCRNSI

SEQ ID NO: 1276903 - protein, 9 aa, Homo Sapiens
KKMSCASNK

SEQ ID NO: 1276904 - protein, 9 aa, Homo Sapiens
RRRSLWYTT

SEQ ID NO: 1276905 - protein, 9 aa, Homo Sapiens
LILDSACAT

SEQ ID NO: 1276906 - protein, 9 aa, Homo Sapiens
GTGCAKEGL

SEQ ID NO: 1276907 - protein, 9 aa, Homo Sapiens
RKIQEQRKQ

SEQ ID NO: 1276908 - protein, 9 aa, Homo Sapiens
GNFQPPVAK

SEQ ID NO: 1276909 - protein, 9 aa, Homo Sapiens
ANLEGVSDF

SEQ ID NO: 1276910 - protein, 9 aa, Homo Sapiens
GWLVLLWGA

SEQ ID NO: 1276911 - protein, 9 aa, Homo Sapiens
KIHKSMIQM

SEQ ID NO: 1276912 - protein, 9 aa, Homo Sapiens
LGFQAPVKD

SEQ ID NO: 1276913 - protein, 9 aa, Homo Sapiens
APSPRSGHS

SEQ ID NO: 1276914 - protein, 9 aa, Homo Sapiens
VAALAVVAE

SEQ ID NO: 1276915 - protein, 9 aa, Homo Sapiens
DPMQRQRVL

SEQ ID NO: 1276916 - protein, 9 aa, Homo Sapiens
FLRTVAFWT

SEQ ID NO: 1276917 - protein, 9 aa, Homo Sapiens
DVIGFCMKD

SEQ ID NO: 1276918 - protein, 9 aa, Homo Sapiens
RHSEASVLT

SEQ ID NO: 1276919 - protein, 9 aa, Homo Sapiens
GPELQHSQP

SEQ ID NO: 1276920 - protein, 9 aa, Homo Sapiens
RLGDSFRPH

SEQ ID NO: 1276921 - protein, 9 aa, Homo Sapiens
EKLEKKRIM

SEQ ID NO: 1276922 - protein, 9 aa, Homo Sapiens
KPQPRRGPA

SEQ ID NO: 1276923 - protein, 9 aa, Homo Sapiens
DGQSQPPSN

SEQ ID NO: 1276924 - protein, 9 aa, Homo Sapiens
GRTTTCKGS

SEQ ID NO: 1276925 - protein, 9 aa, Homo Sapiens
KDKKRRNLQ

SEQ ID NO: 1276926 - protein, 9 aa, Homo Sapiens
LPASQRSSA

SEQ ID NO: 1276927 - protein, 9 aa, Homo Sapiens
AEGVAALAV

SEQ ID NO: 1276928 - protein, 9 aa, Homo Sapiens
TRGLRATQG

SEQ ID NO: 1276929 - protein, 9 aa, Homo Sapiens
VSIASSLAW

SEQ ID NO: 1276930 - protein, 9 aa, Homo Sapiens
LGGEAVGTG

SEQ ID NO: 1276931 - protein, 9 aa, Homo Sapiens
DEDEGDDDG

SEQ ID NO: 1276932 - protein, 9 aa, Homo Sapiens
SACCDNVVL

SEQ ID NO: 1276933 - protein, 9 aa, Homo Sapiens
GTQHPGPGA

SEQ ID NO: 1276934 - protein, 9 aa, Homo Sapiens
KQLCLYVSK

SEQ ID NO: 1276935 - protein, 9 aa, Homo Sapiens
CRLTYVAHV

SEQ ID NO: 1276936 - protein, 9 aa, Homo Sapiens
LHHRCGRPE

SEQ ID NO: 1276937 - protein, 9 aa, Homo Sapiens
DEGDDDGGG

SEQ ID NO: 1276938 - protein, 9 aa, Homo Sapiens
AAQGHPDGQ

SEQ ID NO: 1276939 - protein, 9 aa, Homo Sapiens
GRLGDSFRP

SEQ ID NO: 1276940 - protein, 9 aa, Homo Sapiens
TRLLKLAHK

SEQ ID NO: 1276941 - protein, 9 aa, Homo Sapiens
KSMIQMKTH

SEQ ID NO: 1276942 - protein, 9 aa, Homo Sapiens
ERGMVSLFG

SEQ ID NO: 1276943 - protein, 9 aa, Homo Sapiens
NHLERHRAK

SEQ ID NO: 1276944 - protein, 9 aa, Homo Sapiens
EIYLTDKDF

SEQ ID NO: 1276945 - protein, 9 aa, Homo Sapiens
IEVEEEEIL

SEQ ID NO: 1276946 - protein, 9 aa, Homo Sapiens
WGSLYVLTL

SEQ ID NO: 1276947 - protein, 9 aa, Homo Sapiens
MPRHLCPPQ

SEQ ID NO: 1276948 - protein, 9 aa, Homo Sapiens
KWQCRFREQ

SEQ ID NO: 1276949 - protein, 9 aa, Homo Sapiens
SFVGQISTL

SEQ ID NO: 1276950 - protein, 9 aa, Homo Sapiens
KSSSKAPGP

SEQ ID NO: 1276951 - protein, 9 aa, Homo Sapiens
LVDYITAYM

SEQ ID NO: 1276952 - protein, 9 aa, Homo Sapiens
HPCGKAHAF

SEQ ID NO: 1276953 - protein, 9 aa, Homo Sapiens
LEQPMVVQS

SEQ ID NO: 1276954 - protein, 9 aa, Homo Sapiens
NKMDSLLQN

SEQ ID NO: 1276955 - protein, 9 aa, Homo Sapiens
TRDTGSKGW

SEQ ID NO: 1276956 - protein, 9 aa, Homo Sapiens
SVPGSGAPP

SEQ ID NO: 1276957 - protein, 9 aa, Homo Sapiens
CQQIWEQTT

SEQ ID NO: 1276958 - protein, 9 aa, Homo Sapiens
MLSLTHLFL

SEQ ID NO: 1276959 - protein, 9 aa, Homo Sapiens
NLPLDGKWQ

SEQ ID NO: 1276960 - protein, 9 aa, Homo Sapiens
INGYCCSCP

SEQ ID NO: 1276961 - protein, 9 aa, Homo Sapiens
CLFQSPMHV

SEQ ID NO: 1276962 - protein, 9 aa, Homo Sapiens
PSITEGDNS

SEQ ID NO: 1276963 - protein, 9 aa, Homo Sapiens
KEIDRERAA

SEQ ID NO: 1276964 - protein, 9 aa, Homo Sapiens
KVKVMPHHS

SEQ ID NO: 1276965 - protein, 9 aa, Homo Sapiens
AASCTETAL

SEQ ID NO: 1276966 - protein, 9 aa, Homo Sapiens
LQGPSRPPA

SEQ ID NO: 1276967 - protein, 9 aa, Homo Sapiens
QLPCWGRHV

SEQ ID NO: 1276968 - protein, 9 aa, Homo Sapiens
LIGGWEDKP

SEQ ID NO: 1276969 - protein, 9 aa, Homo Sapiens
HKSMIQMKT

SEQ ID NO: 1276970 - protein, 9 aa, Homo Sapiens
SYPNYDVSV

SEQ ID NO: 1276971 - protein, 9 aa, Homo Sapiens
AGCWSSGRP

SEQ ID NO: 1276972 - protein, 9 aa, Homo Sapiens
HLPRDHGFP

SEQ ID NO: 1276973 - protein, 9 aa, Homo Sapiens
LHNKKEGNL

SEQ ID NO: 1276974 - protein, 9 aa, Homo Sapiens
ADREFPEAD

SEQ ID NO: 1276975 - protein, 9 aa, Homo Sapiens
CSHRRGGEE

SEQ ID NO: 1276976 - protein, 9 aa, Homo Sapiens
NIKIRLLAW

SEQ ID NO: 1276977 - protein, 9 aa, Homo Sapiens
LEAVRRAVA

SEQ ID NO: 1276978 - protein, 9 aa, Homo Sapiens
DAKRQRQWQ

SEQ ID NO: 1276979 - protein, 9 aa, Homo Sapiens
YLMQLDVSR

SEQ ID NO: 1276980 - protein, 9 aa, Homo Sapiens
TDADTPNTP

SEQ ID NO: 1276981 - protein, 9 aa, Homo Sapiens
SRFQATCQG

SEQ ID NO: 1276982 - protein, 9 aa, Homo Sapiens
HARRVHLHL

SEQ ID NO: 1276983 - protein, 9 aa, Homo Sapiens
AKDQNGNHV

SEQ ID NO: 1276984 - protein, 9 aa, Homo Sapiens
ISTLHRHMD

SEQ ID NO: 1276985 - protein, 9 aa, Homo Sapiens
RTSQSWKAG

SEQ ID NO: 1276986 - protein, 9 aa, Homo Sapiens
CGFVMAAYL

SEQ ID NO: 1276987 - protein, 9 aa, Homo Sapiens
YKKKKHKHR

SEQ ID NO: 1276988 - protein, 9 aa, Homo Sapiens
PSGGFPSRS

SEQ ID NO: 1276989 - protein, 9 aa, Homo Sapiens
NWTVRCEED

SEQ ID NO: 1276990 - protein, 9 aa, Homo Sapiens
PPKRVALLT

SEQ ID NO: 1276991 - protein, 9 aa, Homo Sapiens
SVIDLWRTK

SEQ ID NO: 1276992 - protein, 9 aa, Homo Sapiens
AGFRRHLWL

SEQ ID NO: 1276993 - protein, 9 aa, Homo Sapiens
AEGQKLLHA

SEQ ID NO: 1276994 - protein, 9 aa, Homo Sapiens
TCMDMLPKG

SEQ ID NO: 1276995 - protein, 9 aa, Homo Sapiens
QEYPVVPSS

SEQ ID NO: 1276996 - protein, 9 aa, Homo Sapiens
KKADREFPE

SEQ ID NO: 1276997 - protein, 9 aa, Homo Sapiens
SVMQPFSDK

SEQ ID NO: 1276998 - protein, 9 aa, Homo Sapiens
SMGQPSDDR

SEQ ID NO: 1276999 - protein, 9 aa, Homo Sapiens
WLTSSAGPK

SEQ ID NO: 1277000 - protein, 9 aa, Homo Sapiens
ERQRLDKQL

SEQ ID NO: 1277001 - protein, 9 aa, Homo Sapiens
GACIGMMRT

SEQ ID NO: 1277002 - protein, 9 aa, Homo Sapiens
KIDGTLHRE

SEQ ID NO: 1277003 - protein, 9 aa, Homo Sapiens
QLALIATIL

SEQ ID NO: 1277004 - protein, 9 aa, Homo Sapiens
SRNVCKRGK

SEQ ID NO: 1277005 - protein, 9 aa, Homo Sapiens
EGVAALAVV

SEQ ID NO: 1277006 - protein, 9 aa, Homo Sapiens
DVTQLTEKD

SEQ ID NO: 1277007 - protein, 9 aa, Homo Sapiens
FVDPRELAV

SEQ ID NO: 1277008 - protein, 9 aa, Homo Sapiens
QGEVQLVQH

SEQ ID NO: 1277009 - protein, 9 aa, Homo Sapiens
KRGKSQGGR

SEQ ID NO: 1277010 - protein, 9 aa, Homo Sapiens
STGTLQRSK

SEQ ID NO: 1277011 - protein, 9 aa, Homo Sapiens
CPGGRTVQD

SEQ ID NO: 1277012 - protein, 9 aa, Homo Sapiens
RAGSLRKPG

SEQ ID NO: 1277013 - protein, 9 aa, Homo Sapiens
RSHTGECPF

SEQ ID NO: 1277014 - protein, 9 aa, Homo Sapiens
PRGSFPVGW

SEQ ID NO: 1277015 - protein, 9 aa, Homo Sapiens
RPEVCGAAH

SEQ ID NO: 1277016 - protein, 9 aa, Homo Sapiens
PMSLACSIT

SEQ ID NO: 1277017 - protein, 9 aa, Homo Sapiens
CEFRVDQSL

SEQ ID NO: 1277018 - protein, 9 aa, Homo Sapiens
DGKWQRFHS

SEQ ID NO: 1277019 - protein, 9 aa, Homo Sapiens
PEEEGGDDD

SEQ ID NO: 1277020 - protein, 9 aa, Homo Sapiens
PWISSKTGS

SEQ ID NO: 1277021 - protein, 9 aa, Homo Sapiens
LLDRCCVEY

SEQ ID NO: 1277022 - protein, 9 aa, Homo Sapiens
RRQCSQHQP

SEQ ID NO: 1277023 - protein, 9 aa, Homo Sapiens
KTHSRNITV

SEQ ID NO: 1277024 - protein, 9 aa, Homo Sapiens
GTCYCKCGF

SEQ ID NO: 1277025 - protein, 9 aa, Homo Sapiens
HDVTDIWLE

SEQ ID NO: 1277026 - protein, 9 aa, Homo Sapiens
YTLGKSHTH

SEQ ID NO: 1277027 - protein, 9 aa, Homo Sapiens
GPMEESPPS

SEQ ID NO: 1277028 - protein, 9 aa, Homo Sapiens
FVPMSLACS

SEQ ID NO: 1277029 - protein, 9 aa, Homo Sapiens
LRSGQLHPH

SEQ ID NO: 1277030 - protein, 9 aa, Homo Sapiens
RWRPSHDRY

SEQ ID NO: 1277031 - protein, 9 aa, Homo Sapiens
KEGSRSVEG

SEQ ID NO: 1277032 - protein, 9 aa, Homo Sapiens
PPWRTSRGQ

SEQ ID NO: 1277033 - protein, 9 aa, Homo Sapiens
WKKKMSCAS

SEQ ID NO: 1277034 - protein, 9 aa, Homo Sapiens
EVEEEEILL

SEQ ID NO: 1277035 - protein, 9 aa, Homo Sapiens
NNGLMGRGE

SEQ ID NO: 1277036 - protein, 9 aa, Homo Sapiens
ACVLCRQLS

SEQ ID NO: 1277037 - protein, 9 aa, Homo Sapiens
PICGCGFVM

SEQ ID NO: 1277038 - protein, 9 aa, Homo Sapiens
GEKGRDMRF

SEQ ID NO: 1277039 - protein, 9 aa, Homo Sapiens
PPPAAAALD

SEQ ID NO: 1277040 - protein, 9 aa, Homo Sapiens
RGAVRSLRH

SEQ ID NO: 1277041 - protein, 9 aa, Homo Sapiens
LSACCDNVV

SEQ ID NO: 1277042 - protein, 9 aa, Homo Sapiens
VEEEEILLN

SEQ ID NO: 1277043 - protein, 9 aa, Homo Sapiens
MEGPELQHS

SEQ ID NO: 1277044 - protein, 9 aa, Homo Sapiens
IVYQEYPVV

SEQ ID NO: 1277045 - protein, 9 aa, Homo Sapiens
DVNGTGTLS

SEQ ID NO: 1277046 - protein, 9 aa, Homo Sapiens
EFRVLAVIQ

SEQ ID NO: 1277047 - protein, 9 aa, Homo Sapiens
PLSHAFFKL

SEQ ID NO: 1277048 - protein, 9 aa, Homo Sapiens
CMRSDTPTM

SEQ ID NO: 1277049 - protein, 9 aa, Homo Sapiens
PQDPEPMWQ

SEQ ID NO: 1277050 - protein, 9 aa, Homo Sapiens
DIPEGSSSS

SEQ ID NO: 1277051 - protein, 9 aa, Homo Sapiens
TLMSCTEAS

SEQ ID NO: 1277052 - protein, 9 aa, Homo Sapiens
IGFCMKDLR

SEQ ID NO: 1277053 - protein, 9 aa, Homo Sapiens
VQTKVQYEL

SEQ ID NO: 1277054 - protein, 9 aa, Homo Sapiens
SGEKGRDMR

SEQ ID NO: 1277055 - protein, 9 aa, Homo Sapiens
SKTRGKNFR

SEQ ID NO: 1277056 - protein, 9 aa, Homo Sapiens
ANIHHVSLN

SEQ ID NO: 1277057 - protein, 9 aa, Homo Sapiens
LDSGFEQPL

SEQ ID NO: 1277058 - protein, 9 aa, Homo Sapiens
RDAVRKPKF

SEQ ID NO: 1277059 - protein, 9 aa, Homo Sapiens
VYEKYYRPV

SEQ ID NO: 1277060 - protein, 9 aa, Homo Sapiens
QRGSGQFVA

SEQ ID NO: 1277061 - protein, 9 aa, Homo Sapiens
RLEKMPPPK

SEQ ID NO: 1277062 - protein, 9 aa, Homo Sapiens
PSPPTLSVS

SEQ ID NO: 1277063 - protein, 9 aa, Homo Sapiens
TEDMDAALG

SEQ ID NO: 1277064 - protein, 9 aa, Homo Sapiens
LAAAAVRTL

SEQ ID NO: 1277065 - protein, 9 aa, Homo Sapiens
PAGRLGDSF

SEQ ID NO: 1277066 - protein, 9 aa, Homo Sapiens
EKVLKIHKS

SEQ ID NO: 1277067 - protein, 9 aa, Homo Sapiens
ALHCAVASP

SEQ ID NO: 1277068 - protein, 9 aa, Homo Sapiens
EIGYIVFLI

SEQ ID NO: 1277069 - protein, 9 aa, Homo Sapiens
AKGHAGTGC

SEQ ID NO: 1277070 - protein, 9 aa, Homo Sapiens
VLTSTTTTP

SEQ ID NO: 1277071 - protein, 9 aa, Homo Sapiens
LPGQMFQTK

SEQ ID NO: 1277072 - protein, 9 aa, Homo Sapiens
DPKQLEAVC

SEQ ID NO: 1277073 - protein, 9 aa, Homo Sapiens
RVLAVIQDL

SEQ ID NO: 1277074 - protein, 9 aa, Homo Sapiens
VFIIITILR

SEQ ID NO: 1277075 - protein, 9 aa, Homo Sapiens
SSGRPGRRG

SEQ ID NO: 1277076 - protein, 9 aa, Homo Sapiens
TKRYGGFMK

SEQ ID NO: 1277077 - protein, 9 aa, Homo Sapiens
PSPQNRSRT

SEQ ID NO: 1277078 - protein, 9 aa, Homo Sapiens
KKKILMGLI

SEQ ID NO: 1277079 - protein, 9 aa, Homo Sapiens
VQYELVHRA

SEQ ID NO: 1277080 - protein, 9 aa, Homo Sapiens
SGISSRGQQ

SEQ ID NO: 1277081 - protein, 9 aa, Homo Sapiens
CPLPSPASA

SEQ ID NO: 1277082 - protein, 9 aa, Homo Sapiens
SYIKQIFPT

SEQ ID NO: 1277083 - protein, 9 aa, Homo Sapiens
NQKNTTALE

SEQ ID NO: 1277084 - protein, 9 aa, Homo Sapiens
AQDTSGHRG

SEQ ID NO: 1277085 - protein, 9 aa, Homo Sapiens
FAFREENKS

SEQ ID NO: 1277086 - protein, 9 aa, Homo Sapiens
HGPACRGKG

SEQ ID NO: 1277087 - protein, 9 aa, Homo Sapiens
VQSYRAEIS

SEQ ID NO: 1277088 - protein, 9 aa, Homo Sapiens
VMPHHSLKM

SEQ ID NO: 1277089 - protein, 9 aa, Homo Sapiens
AAAALDEGR

SEQ ID NO: 1277090 - protein, 9 aa, Homo Sapiens
LATAELKNA

SEQ ID NO: 1277091 - protein, 9 aa, Homo Sapiens
VQLVPGEDK

SEQ ID NO: 1277092 - protein, 9 aa, Homo Sapiens
GTYIPRGSF

SEQ ID NO: 1277093 - protein, 9 aa, Homo Sapiens
AICRDFSRN

SEQ ID NO: 1277094 - protein, 9 aa, Homo Sapiens
GPSASLHPA

SEQ ID NO: 1277095 - protein, 9 aa, Homo Sapiens
GTPLSISRP

SEQ ID NO: 1277096 - protein, 9 aa, Homo Sapiens
TSRARQSCC

SEQ ID NO: 1277097 - protein, 9 aa, Homo Sapiens
VPSPDMSAA

SEQ ID NO: 1277098 - protein, 9 aa, Homo Sapiens
QRYSNLILN

SEQ ID NO: 1277099 - protein, 9 aa, Homo Sapiens
EPEKAKGED

SEQ ID NO: 1277100 - protein, 9 aa, Homo Sapiens
SLVMCLRLR

SEQ ID NO: 1277101 - protein, 9 aa, Homo Sapiens
AVRQLVVGY

SEQ ID NO: 1277102 - protein, 9 aa, Homo Sapiens
QPFSDKAFL

SEQ ID NO: 1277103 - protein, 9 aa, Homo Sapiens
MKIPRQLPQ

SEQ ID NO: 1277104 - protein, 9 aa, Homo Sapiens
PQLHHRCGR

SEQ ID NO: 1277105 - protein, 9 aa, Homo Sapiens
NGRIWRIGR

SEQ ID NO: 1277106 - protein, 9 aa, Homo Sapiens
VPVALKKSA

SEQ ID NO: 1277107 - protein, 9 aa, Homo Sapiens
QNLGGELMS

SEQ ID NO: 1277108 - protein, 9 aa, Homo Sapiens
LRACRAGGP

SEQ ID NO: 1277109 - protein, 9 aa, Homo Sapiens
ALTSDSEEA

SEQ ID NO: 1277110 - protein, 9 aa, Homo Sapiens
IVGQTQLCH

SEQ ID NO: 1277111 - protein, 9 aa, Homo Sapiens
RDMRFLMNL

SEQ ID NO: 1277112 - protein, 9 aa, Homo Sapiens
CTEASRDPA

SEQ ID NO: 1277113 - protein, 9 aa, Homo Sapiens
PLLLAPPGV

SEQ ID NO: 1277114 - protein, 9 aa, Homo Sapiens
EINGYCCSC

SEQ ID NO: 1277115 - protein, 9 aa, Homo Sapiens
TLDIPEGSS

SEQ ID NO: 1277116 - protein, 9 aa, Homo Sapiens
LGGAAASIS

SEQ ID NO: 1277117 - protein, 9 aa, Homo Sapiens
KGKPLEPNN

SEQ ID NO: 1277118 - protein, 9 aa, Homo Sapiens
SVGRCSSLQ

SEQ ID NO: 1277119 - protein, 9 aa, Homo Sapiens
TTMPAWTLQ

SEQ ID NO: 1277120 - protein, 9 aa, Homo Sapiens
RCPGHWRMM

SEQ ID NO: 1277121 - protein, 9 aa, Homo Sapiens
EGRTTTCKG

SEQ ID NO: 1277122 - protein, 9 aa, Homo Sapiens
ACVGTKPSI

SEQ ID NO: 1277123 - protein, 9 aa, Homo Sapiens
LVMIVHDVT

SEQ ID NO: 1277124 - protein, 9 aa, Homo Sapiens
PGTPPPLIL

SEQ ID NO: 1277125 - protein, 9 aa, Homo Sapiens
GSQGFFPMA

SEQ ID NO: 1277126 - protein, 9 aa, Homo Sapiens
PLEIKKKGY

SEQ ID NO: 1277127 - protein, 9 aa, Homo Sapiens
SVDSECIDI

SEQ ID NO: 1277128 - protein, 9 aa, Homo Sapiens
KAGKSWKIM

SEQ ID NO: 1277129 - protein, 9 aa, Homo Sapiens
IAVKWRMIA

SEQ ID NO: 1277130 - protein, 9 aa, Homo Sapiens
RPLPGQVHG

SEQ ID NO: 1277131 - protein, 9 aa, Homo Sapiens
VVLLFLWRR

SEQ ID NO: 1277132 - protein, 9 aa, Homo Sapiens
DRGTCQYSV

SEQ ID NO: 1277133 - protein, 9 aa, Homo Sapiens
LGNMEPLKG

SEQ ID NO: 1277134 - protein, 9 aa, Homo Sapiens
EGNLIQNRS

SEQ ID NO: 1277135 - protein, 9 aa, Homo Sapiens
PEDACVLCR

SEQ ID NO: 1277136 - protein, 9 aa, Homo Sapiens
ASGSYSSTT

SEQ ID NO: 1277137 - protein, 9 aa, Homo Sapiens
LTHPAHQPL

SEQ ID NO: 1277138 - protein, 9 aa, Homo Sapiens
ISNSCCPSC

SEQ ID NO: 1277139 - protein, 9 aa, Homo Sapiens
AHHHLLGVR

SEQ ID NO: 1277140 - protein, 9 aa, Homo Sapiens
LCSPCCCQE

SEQ ID NO: 1277141 - protein, 9 aa, Homo Sapiens
SRGQAQDTS

SEQ ID NO: 1277142 - protein, 9 aa, Homo Sapiens
TKPSMSPSK

SEQ ID NO: 1277143 - protein, 9 aa, Homo Sapiens
KNLPLDGKW

SEQ ID NO: 1277144 - protein, 9 aa, Homo Sapiens
QNVCRDVTK

SEQ ID NO: 1277145 - protein, 9 aa, Homo Sapiens
ARKPAGCWS

SEQ ID NO: 1277146 - protein, 9 aa, Homo Sapiens
YQGAFYYNH

SEQ ID NO: 1277147 - protein, 9 aa, Homo Sapiens
FFSQENYKD

SEQ ID NO: 1277148 - protein, 9 aa, Homo Sapiens
RYVIVGSAA

SEQ ID NO: 1277149 - protein, 9 aa, Homo Sapiens
DDDDEEDAE

SEQ ID NO: 1277150 - protein, 9 aa, Homo Sapiens
DVPYRLLLL

SEQ ID NO: 1277151 - protein, 9 aa, Homo Sapiens
ALSILMLHH

SEQ ID NO: 1277152 - protein, 9 aa, Homo Sapiens
NISDKLVDF

SEQ ID NO: 1277153 - protein, 9 aa, Homo Sapiens
HRDQPAEQL

SEQ ID NO: 1277154 - protein, 9 aa, Homo Sapiens
PYRKGKFRT

SEQ ID NO: 1277155 - protein, 9 aa, Homo Sapiens
PGEGAAAEG

SEQ ID NO: 1277156 - protein, 9 aa, Homo Sapiens
VPGSGAPPP

SEQ ID NO: 1277157 - protein, 9 aa, Homo Sapiens
RAGGPAGWA

SEQ ID NO: 1277158 - protein, 9 aa, Homo Sapiens
RSASSRAST

SEQ ID NO: 1277159 - protein, 9 aa, Homo Sapiens
PGWKRTQQR

SEQ ID NO: 1277160 - protein, 9 aa, Homo Sapiens
SRNIDNCWI

SEQ ID NO: 1277161 - protein, 9 aa, Homo Sapiens
GNTLQALGH

SEQ ID NO: 1277162 - protein, 9 aa, Homo Sapiens
RRGPPQLHH

SEQ ID NO: 1277163 - protein, 9 aa, Homo Sapiens
RSFMKLYHS

SEQ ID NO: 1277164 - protein, 9 aa, Homo Sapiens
HHNIPSSLS

SEQ ID NO: 1277165 - protein, 9 aa, Homo Sapiens
PPGVGAQCA

SEQ ID NO: 1277166 - protein, 9 aa, Homo Sapiens
GSRSKTRGK

SEQ ID NO: 1277167 - protein, 9 aa, Homo Sapiens
SIVTPHKDI

SEQ ID NO: 1277168 - protein, 9 aa, Homo Sapiens
VVGAVGVGK

SEQ ID NO: 1277169 - protein, 9 aa, Homo Sapiens
AVQSVHRQA

SEQ ID NO: 1277170 - protein, 9 aa, Homo Sapiens
CTKLIIQAG

SEQ ID NO: 1277171 - protein, 9 aa, Homo Sapiens
YDVSVYSAA

SEQ ID NO: 1277172 - protein, 9 aa, Homo Sapiens
QAPVKDDQP

SEQ ID NO: 1277173 - protein, 9 aa, Homo Sapiens
PYDTRQNPN

SEQ ID NO: 1277174 - protein, 9 aa, Homo Sapiens
RNEYFFDLN

SEQ ID NO: 1277175 - protein, 9 aa, Homo Sapiens
RMHCVEKCP

SEQ ID NO: 1277176 - protein, 9 aa, Homo Sapiens
GKFNVINYD

SEQ ID NO: 1277177 - protein, 9 aa, Homo Sapiens
LVTLGQPAT

SEQ ID NO: 1277178 - protein, 9 aa, Homo Sapiens
PRLHASVRE

SEQ ID NO: 1277179 - protein, 9 aa, Homo Sapiens
TEERIFNFH

SEQ ID NO: 1277180 - protein, 9 aa, Homo Sapiens
QCADSGTED

SEQ ID NO: 1277181 - protein, 9 aa, Homo Sapiens
PRHISPFWV

SEQ ID NO: 1277182 - protein, 9 aa, Homo Sapiens
AAAPETPAP

SEQ ID NO: 1277183 - protein, 9 aa, Homo Sapiens
LTYVAHVYC

SEQ ID NO: 1277184 - protein, 9 aa, Homo Sapiens
CTGDRPEAR

SEQ ID NO: 1277185 - protein, 9 aa, Homo Sapiens
CTRLQRARK

SEQ ID NO: 1277186 - protein, 9 aa, Homo Sapiens
GFQAAVTFR

SEQ ID NO: 1277187 - protein, 9 aa, Homo Sapiens
LHCAVASPY

SEQ ID NO: 1277188 - protein, 9 aa, Homo Sapiens
RWPTCKFFK

SEQ ID NO: 1277189 - protein, 9 aa, Homo Sapiens
CGKAHAFQE

SEQ ID NO: 1277190 - protein, 9 aa, Homo Sapiens
WKPSLRSPP

SEQ ID NO: 1277191 - protein, 9 aa, Homo Sapiens
MCLRLRTKL

SEQ ID NO: 1277192 - protein, 9 aa, Homo Sapiens
LRTVAFWTG

SEQ ID NO: 1277193 - protein, 9 aa, Homo Sapiens
YPNYDVSVY

SEQ ID NO: 1277194 - protein, 9 aa, Homo Sapiens
DYDEGDYDA

SEQ ID NO: 1277195 - protein, 9 aa, Homo Sapiens
SRDGWGGLW

SEQ ID NO: 1277196 - protein, 9 aa, Homo Sapiens
CCYEEYKDH

SEQ ID NO: 1277197 - protein, 9 aa, Homo Sapiens
YEDLETHIL

SEQ ID NO: 1277198 - protein, 9 aa, Homo Sapiens
ARWPTCKFF

SEQ ID NO: 1277199 - protein, 9 aa, Homo Sapiens
VSMDDSCVA

SEQ ID NO: 1277200 - protein, 9 aa, Homo Sapiens
DSTTTKKNQ

SEQ ID NO: 1277201 - protein, 9 aa, Homo Sapiens
AHEIGYIVF

SEQ ID NO: 1277202 - protein, 9 aa, Homo Sapiens
GGIRKRASA

SEQ ID NO: 1277203 - protein, 9 aa, Homo Sapiens
PDLLRKPQP

SEQ ID NO: 1277204 - protein, 9 aa, Homo Sapiens
DLLRKPQPR

SEQ ID NO: 1277205 - protein, 9 aa, Homo Sapiens
PVREHIANF

SEQ ID NO: 1277206 - protein, 9 aa, Homo Sapiens
YKIKLLKKR

SEQ ID NO: 1277207 - protein, 9 aa, Homo Sapiens
KMSCASNKM

SEQ ID NO: 1277208 - protein, 9 aa, Homo Sapiens
TNGSVTTSA

SEQ ID NO: 1277209 - protein, 9 aa, Homo Sapiens
PVGWKFAAT

SEQ ID NO: 1277210 - protein, 9 aa, Homo Sapiens
IAKQLCLYV

SEQ ID NO: 1277211 - protein, 9 aa, Homo Sapiens
FGERLNRNG

SEQ ID NO: 1277212 - protein, 9 aa, Homo Sapiens
LPCWGRHVR

SEQ ID NO: 1277213 - protein, 9 aa, Homo Sapiens
SRMHCVEKC

SEQ ID NO: 1277214 - protein, 9 aa, Homo Sapiens
DHVLPVQGA

SEQ ID NO: 1277215 - protein, 9 aa, Homo Sapiens
LNRPSFDAI

SEQ ID NO: 1277216 - protein, 9 aa, Homo Sapiens
HSRNITVQK

SEQ ID NO: 1277217 - protein, 9 aa, Homo Sapiens
ANLLSSLST

SEQ ID NO: 1277218 - protein, 9 aa, Homo Sapiens
LYSSKKKIL

SEQ ID NO: 1277219 - protein, 9 aa, Homo Sapiens
ELFGKGPQM

SEQ ID NO: 1277220 - protein, 9 aa, Homo Sapiens
STLDIPEGS

SEQ ID NO: 1277221 - protein, 9 aa, Homo Sapiens
RMIADPDQP

SEQ ID NO: 1277222 - protein, 9 aa, Homo Sapiens
ASRKTWQRR

SEQ ID NO: 1277223 - protein, 9 aa, Homo Sapiens
STPVLYLQC

SEQ ID NO: 1277224 - protein, 9 aa, Homo Sapiens
RRRTTILIS

SEQ ID NO: 1277225 - protein, 9 aa, Homo Sapiens
RCLCLFQSP

SEQ ID NO: 1277226 - protein, 9 aa, Homo Sapiens
DMRFLMNLH

SEQ ID NO: 1277227 - protein, 9 aa, Homo Sapiens
PTEERIFNF

SEQ ID NO: 1277228 - protein, 9 aa, Homo Sapiens
NGWDTGTEN

SEQ ID NO: 1277229 - protein, 9 aa, Homo Sapiens
LRHSRSPHK

SEQ ID NO: 1277230 - protein, 9 aa, Homo Sapiens
TVRCEEDFS

SEQ ID NO: 1277231 - protein, 9 aa, Homo Sapiens
GFPSRSRWP

SEQ ID NO: 1277232 - protein, 9 aa, Homo Sapiens
VGTDAPDDT

SEQ ID NO: 1277233 - protein, 9 aa, Homo Sapiens
AASISVLQG

SEQ ID NO: 1277234 - protein, 9 aa, Homo Sapiens
GVRRRGPPQ

SEQ ID NO: 1277235 - protein, 9 aa, Homo Sapiens
DDRGTCQYS

SEQ ID NO: 1277236 - protein, 9 aa, Homo Sapiens
PSCCISNSC

SEQ ID NO: 1277237 - protein, 9 aa, Homo Sapiens
RNLLRLQSL

SEQ ID NO: 1277238 - protein, 9 aa, Homo Sapiens
YEKYYRPVD

SEQ ID NO: 1277239 - protein, 9 aa, Homo Sapiens
KKKDKKRRN

SEQ ID NO: 1277240 - protein, 9 aa, Homo Sapiens
LEALMRGLA

SEQ ID NO: 1277241 - protein, 9 aa, Homo Sapiens
IEELNFIRC

SEQ ID NO: 1277242 - protein, 9 aa, Homo Sapiens
CQAHRLPLD

SEQ ID NO: 1277243 - protein, 9 aa, Homo Sapiens
VLWVFQEAE

SEQ ID NO: 1277244 - protein, 9 aa, Homo Sapiens
NLKIDGTLH

SEQ ID NO: 1277245 - protein, 9 aa, Homo Sapiens
GAQRREAGD

SEQ ID NO: 1277246 - protein, 9 aa, Homo Sapiens
HIGLIILAI

SEQ ID NO: 1277247 - protein, 9 aa, Homo Sapiens
VPGGSRPGW

SEQ ID NO: 1277248 - protein, 9 aa, Homo Sapiens
PAWTLQTFQ

SEQ ID NO: 1277249 - protein, 9 aa, Homo Sapiens
RPRAGSLRK

SEQ ID NO: 1277250 - protein, 9 aa, Homo Sapiens
TTALEKKKE

SEQ ID NO: 1277251 - protein, 9 aa, Homo Sapiens
VFLIQMFFI

SEQ ID NO: 1277252 - protein, 9 aa, Homo Sapiens
AFMCEFRVD

SEQ ID NO: 1277253 - protein, 9 aa, Homo Sapiens
PLIVLNKGL

SEQ ID NO: 1277254 - protein, 9 aa, Homo Sapiens
CPLAPASPL

SEQ ID NO: 1277255 - protein, 9 aa, Homo Sapiens
TGPGHVLVR

SEQ ID NO: 1277256 - protein, 9 aa, Homo Sapiens
QQMSQALAV

SEQ ID NO: 1277257 - protein, 9 aa, Homo Sapiens
GAQLPCWGR

SEQ ID NO: 1277258 - protein, 9 aa, Homo Sapiens
LMSCTEASR

SEQ ID NO: 1277259 - protein, 9 aa, Homo Sapiens
SGLHISPNS

SEQ ID NO: 1277260 - protein, 9 aa, Homo Sapiens
DSPFGGAAY

SEQ ID NO: 1277261 - protein, 9 aa, Homo Sapiens
EAKTWLLCS

SEQ ID NO: 1277262 - protein, 9 aa, Homo Sapiens
ATRLLKLAH

SEQ ID NO: 1277263 - protein, 9 aa, Homo Sapiens
LPIMIWIYG

SEQ ID NO: 1277264 - protein, 9 aa, Homo Sapiens
GGELLHPSQ

SEQ ID NO: 1277265 - protein, 9 aa, Homo Sapiens
YHSDYDEGD

SEQ ID NO: 1277266 - protein, 9 aa, Homo Sapiens
HNTDRSSHN

SEQ ID NO: 1277267 - protein, 9 aa, Homo Sapiens
QFVLGMDLF

SEQ ID NO: 1277268 - protein, 9 aa, Homo Sapiens
QATCQGRKY

SEQ ID NO: 1277269 - protein, 9 aa, Homo Sapiens
DDDDEKKRG

SEQ ID NO: 1277270 - protein, 9 aa, Homo Sapiens
YPTGTGIGP

SEQ ID NO: 1277271 - protein, 9 aa, Homo Sapiens
LDVTVMVHS

SEQ ID NO: 1277272 - protein, 9 aa, Homo Sapiens
WPLASEGRP

SEQ ID NO: 1277273 - protein, 9 aa, Homo Sapiens
LELQPPGDC

SEQ ID NO: 1277274 - protein, 9 aa, Homo Sapiens
RSSACTRST

SEQ ID NO: 1277275 - protein, 9 aa, Homo Sapiens
KSQGGRILL

SEQ ID NO: 1277276 - protein, 9 aa, Homo Sapiens
FIIITILRI

SEQ ID NO: 1277277 - protein, 9 aa, Homo Sapiens
HRPGTPPPL

SEQ ID NO: 1277278 - protein, 9 aa, Homo Sapiens
LPKGAASCT

SEQ ID NO: 1277279 - protein, 9 aa, Homo Sapiens
KGVWPNTKK

SEQ ID NO: 1277280 - protein, 9 aa, Homo Sapiens
RPRTTMPAW

SEQ ID NO: 1277281 - protein, 9 aa, Homo Sapiens
SRSKTRGKN

SEQ ID NO: 1277282 - protein, 9 aa, Homo Sapiens
IGLIILAIM

SEQ ID NO: 1277283 - protein, 9 aa, Homo Sapiens
RSTSRTFRS

SEQ ID NO: 1277284 - protein, 9 aa, Homo Sapiens
GEHPYPWQC

SEQ ID NO: 1277285 - protein, 9 aa, Homo Sapiens
EIQNNQKTR

SEQ ID NO: 1277286 - protein, 9 aa, Homo Sapiens
RLQKENQIY

SEQ ID NO: 1277287 - protein, 9 aa, Homo Sapiens
PMQRQRVLV

SEQ ID NO: 1277288 - protein, 9 aa, Homo Sapiens
AATRSLPCP

SEQ ID NO: 1277289 - protein, 9 aa, Homo Sapiens
GVSIASSLA

SEQ ID NO: 1277290 - protein, 9 aa, Homo Sapiens
DFQFHLEGK

SEQ ID NO: 1277291 - protein, 9 aa, Homo Sapiens
SSRGQQYGV

SEQ ID NO: 1277292 - protein, 9 aa, Homo Sapiens
EDVQSYRAE

SEQ ID NO: 1277293 - protein, 9 aa, Homo Sapiens
PKKKRSAFP

SEQ ID NO: 1277294 - protein, 9 aa, Homo Sapiens
LCSPPSPQN

SEQ ID NO: 1277295 - protein, 9 aa, Homo Sapiens
PLPQLLDSG

SEQ ID NO: 1277296 - protein, 9 aa, Homo Sapiens
LLADFPLDS

SEQ ID NO: 1277297 - protein, 9 aa, Homo Sapiens
PDYTPLCSP

SEQ ID NO: 1277298 - protein, 9 aa, Homo Sapiens
EEPERQRQE

SEQ ID NO: 1277299 - protein, 9 aa, Homo Sapiens
RPILYSNSK

SEQ ID NO: 1277300 - protein, 9 aa, Homo Sapiens
ILDILEYDR

SEQ ID NO: 1277301 - protein, 9 aa, Homo Sapiens
QSCCLPGLT

SEQ ID NO: 1277302 - protein, 9 aa, Homo Sapiens
LQKENQIYS

SEQ ID NO: 1277303 - protein, 9 aa, Homo Sapiens
WKWQCRFRE

SEQ ID NO: 1277304 - protein, 9 aa, Homo Sapiens
EWKCFIEER

SEQ ID NO: 1277305 - protein, 9 aa, Homo Sapiens
TPQDPEPMW

SEQ ID NO: 1277306 - protein, 9 aa, Homo Sapiens
QCGSDHGTT

SEQ ID NO: 1277307 - protein, 9 aa, Homo Sapiens
RSLWYTTHY

SEQ ID NO: 1277308 - protein, 9 aa, Homo Sapiens
LECSGRHHG

SEQ ID NO: 1277309 - protein, 9 aa, Homo Sapiens
SSRSPGARC

SEQ ID NO: 1277310 - protein, 9 aa, Homo Sapiens
GHVLVRLIS

SEQ ID NO: 1277311 - protein, 9 aa, Homo Sapiens
DFPLDSMVG

SEQ ID NO: 1277312 - protein, 9 aa, Homo Sapiens
KPLIVLNKG

SEQ ID NO: 1277313 - protein, 9 aa, Homo Sapiens
NLEGVSDFF

SEQ ID NO: 1277314 - protein, 9 aa, Homo Sapiens
LVGTDAPDD

SEQ ID NO: 1277315 - protein, 9 aa, Homo Sapiens
SEGRPRSHS

SEQ ID NO: 1277316 - protein, 9 aa, Homo Sapiens
PIMIWIYGG

SEQ ID NO: 1277317 - protein, 9 aa, Homo Sapiens
SPASALRRP

SEQ ID NO: 1277318 - protein, 9 aa, Homo Sapiens
VMPAKACTG

SEQ ID NO: 1277319 - protein, 9 aa, Homo Sapiens
TAGTQHPGP

SEQ ID NO: 1277320 - protein, 9 aa, Homo Sapiens
PESRGILRK

SEQ ID NO: 1277321 - protein, 9 aa, Homo Sapiens
GRHHGLGVH

SEQ ID NO: 1277322 - protein, 9 aa, Homo Sapiens
GGRILLQRN

SEQ ID NO: 1277323 - protein, 9 aa, Homo Sapiens
PYEALETQL

SEQ ID NO: 1277324 - protein, 9 aa, Homo Sapiens
WARFLHYQF

SEQ ID NO: 1277325 - protein, 9 aa, Homo Sapiens
LISTLHRHM

SEQ ID NO: 1277326 - protein, 9 aa, Homo Sapiens
LEAVCSHRR

SEQ ID NO: 1277327 - protein, 9 aa, Homo Sapiens
NTLQALGHD

SEQ ID NO: 1277328 - protein, 9 aa, Homo Sapiens
GDLGNMEPL

SEQ ID NO: 1277329 - protein, 9 aa, Homo Sapiens
TTMYFLFGN

SEQ ID NO: 1277330 - protein, 9 aa, Homo Sapiens
IASESWAIV

SEQ ID NO: 1277331 - protein, 9 aa, Homo Sapiens
YPHDRPILY

SEQ ID NO: 1277332 - protein, 9 aa, Homo Sapiens
REALHQQDF

SEQ ID NO: 1277333 - protein, 9 aa, Homo Sapiens
AGSLRKPGL

SEQ ID NO: 1277334 - protein, 9 aa, Homo Sapiens
EVLMVVGGQ

SEQ ID NO: 1277335 - protein, 9 aa, Homo Sapiens
RLQEDLGTA

SEQ ID NO: 1277336 - protein, 9 aa, Homo Sapiens
TKEIDRERA

SEQ ID NO: 1277337 - protein, 9 aa, Homo Sapiens
FVGQISTLV

SEQ ID NO: 1277338 - protein, 9 aa, Homo Sapiens
TYIPRGSFP

SEQ ID NO: 1277339 - protein, 9 aa, Homo Sapiens
LLKKRKFDD

SEQ ID NO: 1277340 - protein, 9 aa, Homo Sapiens
LHPSQRLLV

SEQ ID NO: 1277341 - protein, 9 aa, Homo Sapiens
QRLPRVEVA

SEQ ID NO: 1277342 - protein, 9 aa, Homo Sapiens
VLKIHKSMI

SEQ ID NO: 1277343 - protein, 9 aa, Homo Sapiens
TSSAGPKRP

SEQ ID NO: 1277344 - protein, 9 aa, Homo Sapiens
WRRFRSVRS

SEQ ID NO: 1277345 - protein, 9 aa, Homo Sapiens
VDFQEEASM

SEQ ID NO: 1277346 - protein, 9 aa, Homo Sapiens
TSRILNLQV

SEQ ID NO: 1277347 - protein, 9 aa, Homo Sapiens
TCKFFKGQS

SEQ ID NO: 1277348 - protein, 9 aa, Homo Sapiens
NPLPTATPT

SEQ ID NO: 1277349 - protein, 9 aa, Homo Sapiens
EYKDHRREN

SEQ ID NO: 1277350 - protein, 9 aa, Homo Sapiens
RKEKNSRED

SEQ ID NO: 1277351 - protein, 9 aa, Homo Sapiens
ASSRASTSW

SEQ ID NO: 1277352 - protein, 9 aa, Homo Sapiens
GNLIQNRSP

SEQ ID NO: 1277353 - protein, 9 aa, Homo Sapiens
AFKRIHLRP

SEQ ID NO: 1277354 - protein, 9 aa, Homo Sapiens
SRSSGMLGM

SEQ ID NO: 1277355 - protein, 9 aa, Homo Sapiens
IQNLGGELM

SEQ ID NO: 1277356 - protein, 9 aa, Homo Sapiens
RATQGCTAG

SEQ ID NO: 1277357 - protein, 9 aa, Homo Sapiens
TVSFVGQIS

SEQ ID NO: 1277358 - protein, 9 aa, Homo Sapiens
ALLVDYITA

SEQ ID NO: 1277359 - protein, 9 aa, Homo Sapiens
ANGGRTQGE

SEQ ID NO: 1277360 - protein, 9 aa, Homo Sapiens
LDLEDVQSY

SEQ ID NO: 1277361 - protein, 9 aa, Homo Sapiens
SHVPSPDMS

SEQ ID NO: 1277362 - protein, 9 aa, Homo Sapiens
KKTSRILNL

SEQ ID NO: 1277363 - protein, 9 aa, Homo Sapiens
PISFIGWGS

SEQ ID NO: 1277364 - protein, 9 aa, Homo Sapiens
QGPSRPPAA

SEQ ID NO: 1277365 - protein, 9 aa, Homo Sapiens
LSLHSGPGF

SEQ ID NO: 1277366 - protein, 9 aa, Homo Sapiens
DLFHHCRLT

SEQ ID NO: 1277367 - protein, 9 aa, Homo Sapiens
GLCKVARLR

SEQ ID NO: 1277368 - protein, 9 aa, Homo Sapiens
RDLCQAHRL

SEQ ID NO: 1277369 - protein, 9 aa, Homo Sapiens
SNRIRLHRL

SEQ ID NO: 1277370 - protein, 9 aa, Homo Sapiens
QLSSTECRI

SEQ ID NO: 1277371 - protein, 9 aa, Homo Sapiens
GNMEPLKGT

SEQ ID NO: 1277372 - protein, 9 aa, Homo Sapiens
SPSIRSASS

SEQ ID NO: 1277373 - protein, 9 aa, Homo Sapiens
NADPVPLPN

SEQ ID NO: 1277374 - protein, 9 aa, Homo Sapiens
VKWRMIADP

SEQ ID NO: 1277375 - protein, 9 aa, Homo Sapiens
EALMRGLAD

SEQ ID NO: 1277376 - protein, 9 aa, Homo Sapiens
PPAATRSLP

SEQ ID NO: 1277377 - protein, 9 aa, Homo Sapiens
EEASMQEAL

SEQ ID NO: 1277378 - protein, 9 aa, Homo Sapiens
KLNILSSKR

SEQ ID NO: 1277379 - protein, 9 aa, Homo Sapiens
TVSMDDSCV

SEQ ID NO: 1277380 - protein, 9 aa, Homo Sapiens
LPQLLDSGF

SEQ ID NO: 1277381 - protein, 9 aa, Homo Sapiens
TRNRGAWSS

SEQ ID NO: 1277382 - protein, 9 aa, Homo Sapiens
RNLHFHILT

SEQ ID NO: 1277383 - protein, 9 aa, Homo Sapiens
HIMGDIFCQ

SEQ ID NO: 1277384 - protein, 9 aa, Homo Sapiens
AYGGTDFSS

SEQ ID NO: 1277385 - protein, 9 aa, Homo Sapiens
PKFARHIKK

SEQ ID NO: 1277386 - protein, 9 aa, Homo Sapiens
VNQKNTTAL

SEQ ID NO: 1277387 - protein, 9 aa, Homo Sapiens
VGAVGVGKS

SEQ ID NO: 1277388 - protein, 9 aa, Homo Sapiens
PGDPRGCKG

SEQ ID NO: 1277389 - protein, 9 aa, Homo Sapiens
ADFPLDSMV

SEQ ID NO: 1277390 - protein, 9 aa, Homo Sapiens
GTLHRELVK

SEQ ID NO: 1277391 - protein, 9 aa, Homo Sapiens
CQNCPRGPS

SEQ ID NO: 1277392 - protein, 9 aa, Homo Sapiens
LLSLYSVAV

SEQ ID NO: 1277393 - protein, 9 aa, Homo Sapiens
KALSALFIW

SEQ ID NO: 1277394 - protein, 9 aa, Homo Sapiens
LQLLPGGEL

SEQ ID NO: 1277395 - protein, 9 aa, Homo Sapiens
SVPHISSPE

SEQ ID NO: 1277396 - protein, 9 aa, Homo Sapiens
LDGKWQRFH

SEQ ID NO: 1277397 - protein, 9 aa, Homo Sapiens
VQDSRKRKE

SEQ ID NO: 1277398 - protein, 9 aa, Homo Sapiens
LVSGLGLLA

SEQ ID NO: 1277399 - protein, 9 aa, Homo Sapiens
LRSFMKLYH

SEQ ID NO: 1277400 - protein, 9 aa, Homo Sapiens
LPGEGAAAE

SEQ ID NO: 1277401 - protein, 9 aa, Homo Sapiens
EKTRKRIFF

SEQ ID NO: 1277402 - protein, 9 aa, Homo Sapiens
CSGRHHGLG

SEQ ID NO: 1277403 - protein, 9 aa, Homo Sapiens
LWRRFRSVR

SEQ ID NO: 1277404 - protein, 9 aa, Homo Sapiens
TMWTCMDML

SEQ ID NO: 1277405 - protein, 9 aa, Homo Sapiens
PRVEVALLR

SEQ ID NO: 1277406 - protein, 9 aa, Homo Sapiens
SEILTKRYG

SEQ ID NO: 1277407 - protein, 9 aa, Homo Sapiens
GGMLHTFLR

SEQ ID NO: 1277408 - protein, 9 aa, Homo Sapiens
IVMEMMEGE

SEQ ID NO: 1277409 - protein, 9 aa, Homo Sapiens
PLPNITLGS

SEQ ID NO: 1277410 - protein, 9 aa, Homo Sapiens
KPAGCWSSG

SEQ ID NO: 1277411 - protein, 9 aa, Homo Sapiens
SGRASRKTW

SEQ ID NO: 1277412 - protein, 9 aa, Homo Sapiens
GTLQRSKPA

SEQ ID NO: 1277413 - protein, 9 aa, Homo Sapiens
HQNLGFQAP

SEQ ID NO: 1277414 - protein, 9 aa, Homo Sapiens
NTTVDFGGD

SEQ ID NO: 1277415 - protein, 9 aa, Homo Sapiens
INWMEDSDV

SEQ ID NO: 1277416 - protein, 9 aa, Homo Sapiens
KKPRKKFPN

SEQ ID NO: 1277417 - protein, 9 aa, Homo Sapiens
ECIDINVTP

SEQ ID NO: 1277418 - protein, 9 aa, Homo Sapiens
KADREFPEA

SEQ ID NO: 1277419 - protein, 9 aa, Homo Sapiens
CVGNYIVLF

SEQ ID NO: 1277420 - protein, 9 aa, Homo Sapiens
DGLLLTPLP

SEQ ID NO: 1277421 - protein, 9 aa, Homo Sapiens
PGHLVDVNG

SEQ ID NO: 1277422 - protein, 9 aa, Homo Sapiens
EDACVLCRQ

SEQ ID NO: 1277423 - protein, 9 aa, Homo Sapiens
IFVTILLII

SEQ ID NO: 1277424 - protein, 9 aa, Homo Sapiens
GRPEVCGAA

SEQ ID NO: 1277425 - protein, 9 aa, Homo Sapiens
PPAAAGLFS

SEQ ID NO: 1277426 - protein, 9 aa, Homo Sapiens
LSLMKDSTP

SEQ ID NO: 1277427 - protein, 9 aa, Homo Sapiens
DDGGGDDHD

SEQ ID NO: 1277428 - protein, 9 aa, Homo Sapiens
GAAASISVL

SEQ ID NO: 1277429 - protein, 9 aa, Homo Sapiens
QFQVTAMNM

SEQ ID NO: 1277430 - protein, 9 aa, Homo Sapiens
QKSSCPGEA

SEQ ID NO: 1277431 - protein, 9 aa, Homo Sapiens
VPVLHNLTE

SEQ ID NO: 1277432 - protein, 9 aa, Homo Sapiens
SGHSPHCAA

SEQ ID NO: 1277433 - protein, 9 aa, Homo Sapiens
QERRHTLPS

SEQ ID NO: 1277434 - protein, 9 aa, Homo Sapiens
MGWLVLLWG

SEQ ID NO: 1277435 - protein, 9 aa, Homo Sapiens
SVFTCTHVN

SEQ ID NO: 1277436 - protein, 9 aa, Homo Sapiens
DCRYVIVGS

SEQ ID NO: 1277437 - protein, 9 aa, Homo Sapiens
IASSLAWRQ

SEQ ID NO: 1277438 - protein, 9 aa, Homo Sapiens
TGRWLHQRG

SEQ ID NO: 1277439 - protein, 9 aa, Homo Sapiens
CRAGGPAGW

SEQ ID NO: 1277440 - protein, 9 aa, Homo Sapiens
RRIIETPPT

SEQ ID NO: 1277441 - protein, 9 aa, Homo Sapiens
PRGCKGVLQ

SEQ ID NO: 1277442 - protein, 9 aa, Homo Sapiens
PVALKKSAD

SEQ ID NO: 1277443 - protein, 9 aa, Homo Sapiens
HAGTGCAKE

SEQ ID NO: 1277444 - protein, 9 aa, Homo Sapiens
ALLTMWTCM

SEQ ID NO: 1277445 - protein, 9 aa, Homo Sapiens
IKQIFPTEE

SEQ ID NO: 1277446 - protein, 9 aa, Homo Sapiens
IQKLGVLSS

SEQ ID NO: 1277447 - protein, 9 aa, Homo Sapiens
LGTCYCKCG

SEQ ID NO: 1277448 - protein, 9 aa, Homo Sapiens
NVKKADSTT

SEQ ID NO: 1277449 - protein, 9 aa, Homo Sapiens
GATPQVPPP

SEQ ID NO: 1277450 - protein, 9 aa, Homo Sapiens
SLRLVDSHH

SEQ ID NO: 1277451 - protein, 9 aa, Homo Sapiens
ENFSHVPSP

SEQ ID NO: 1277452 - protein, 9 aa, Homo Sapiens
SVREMLQEE

SEQ ID NO: 1277453 - protein, 9 aa, Homo Sapiens
PKRVALLTM

SEQ ID NO: 1277454 - protein, 9 aa, Homo Sapiens
SYPDSTDVS

SEQ ID NO: 1277455 - protein, 9 aa, Homo Sapiens
ARATTKKSR

SEQ ID NO: 1277456 - protein, 9 aa, Homo Sapiens
NILSSKRDL

SEQ ID NO: 1277457 - protein, 9 aa, Homo Sapiens
GRWRPSHDR

SEQ ID NO: 1277458 - protein, 9 aa, Homo Sapiens
VFLIFWNIK

SEQ ID NO: 1277459 - protein, 9 aa, Homo Sapiens
ATLDLEDVQ

SEQ ID NO: 1277460 - protein, 9 aa, Homo Sapiens
HDALEVAEL

SEQ ID NO: 1277461 - protein, 9 aa, Homo Sapiens
LHYQFLAME

SEQ ID NO: 1277462 - protein, 9 aa, Homo Sapiens
AVTFRRRAL

SEQ ID NO: 1277463 - protein, 9 aa, Homo Sapiens
MASVSPSRN

SEQ ID NO: 1277464 - protein, 9 aa, Homo Sapiens
AILDILEYD

SEQ ID NO: 1277465 - protein, 9 aa, Homo Sapiens
WVFLKSLRL

SEQ ID NO: 1277466 - protein, 9 aa, Homo Sapiens
DDFLLHSLN

SEQ ID NO: 1277467 - protein, 9 aa, Homo Sapiens
KWQRFHSPH

SEQ ID NO: 1277468 - protein, 9 aa, Homo Sapiens
SLATGLHVN

SEQ ID NO: 1277469 - protein, 9 aa, Homo Sapiens
DRSGDLGNM

SEQ ID NO: 1277470 - protein, 9 aa, Homo Sapiens
EEAAALLVD

SEQ ID NO: 1277471 - protein, 9 aa, Homo Sapiens
FDIAVKWRM

SEQ ID NO: 1277472 - protein, 9 aa, Homo Sapiens
GGATPQVPP

SEQ ID NO: 1277473 - protein, 9 aa, Homo Sapiens
RLECVGNYI

SEQ ID NO: 1277474 - protein, 9 aa, Homo Sapiens
LPRVEVALL

SEQ ID NO: 1277475 - protein, 9 aa, Homo Sapiens
KDSTPVLYL

SEQ ID NO: 1277476 - protein, 9 aa, Homo Sapiens
ATMAFWLSR

SEQ ID NO: 1277477 - protein, 9 aa, Homo Sapiens
GAFYYNHAF

SEQ ID NO: 1277478 - protein, 9 aa, Homo Sapiens
TCGRWPGLK

SEQ ID NO: 1277479 - protein, 9 aa, Homo Sapiens
LQRNPLPTA

SEQ ID NO: 1277480 - protein, 9 aa, Homo Sapiens
SPRSGHSPH

SEQ ID NO: 1277481 - protein, 9 aa, Homo Sapiens
VTPHKDIWN

SEQ ID NO: 1277482 - protein, 9 aa, Homo Sapiens
HMDLHVFHA

SEQ ID NO: 1277483 - protein, 9 aa, Homo Sapiens
ASEGRPRSH

SEQ ID NO: 1277484 - protein, 9 aa, Homo Sapiens
SASLSYPDS

SEQ ID NO: 1277485 - protein, 9 aa, Homo Sapiens
KRAMLRDED

SEQ ID NO: 1277486 - protein, 9 aa, Homo Sapiens
KGVLQELRG

SEQ ID NO: 1277487 - protein, 9 aa, Homo Sapiens
PTYVPVMIK

SEQ ID NO: 1277488 - protein, 9 aa, Homo Sapiens
PSVPGSGAP

SEQ ID NO: 1277489 - protein, 9 aa, Homo Sapiens
SQHQPARQH

SEQ ID NO: 1277490 - protein, 9 aa, Homo Sapiens
QVAIVVKFF

SEQ ID NO: 1277491 - protein, 9 aa, Homo Sapiens
PEKTSLFQA

SEQ ID NO: 1277492 - protein, 9 aa, Homo Sapiens
WRTSRGQAQ

SEQ ID NO: 1277493 - protein, 9 aa, Homo Sapiens
AVRSLRHSR

SEQ ID NO: 1277494 - protein, 9 aa, Homo Sapiens
YVDDSRNID

SEQ ID NO: 1277495 - protein, 9 aa, Homo Sapiens
VSRASTSGL

SEQ ID NO: 1277496 - protein, 9 aa, Homo Sapiens
TGCAKEGLH

SEQ ID NO: 1277497 - protein, 9 aa, Homo Sapiens
GESYFTESA

SEQ ID NO: 1277498 - protein, 9 aa, Homo Sapiens
GLLSPRPPL

SEQ ID NO: 1277499 - protein, 9 aa, Homo Sapiens
QVHGPACRG

SEQ ID NO: 1277500 - protein, 9 aa, Homo Sapiens
CPQFVLGMD

SEQ ID NO: 1277501 - protein, 9 aa, Homo Sapiens
RELLDRCCV

SEQ ID NO: 1277502 - protein, 9 aa, Homo Sapiens
HIRSHTGEC

SEQ ID NO: 1277503 - protein, 9 aa, Homo Sapiens
GVQGGNELP

SEQ ID NO: 1277504 - protein, 9 aa, Homo Sapiens
NIAAFKRIH

SEQ ID NO: 1277505 - protein, 9 aa, Homo Sapiens
AVRKPKFAR

SEQ ID NO: 1277506 - protein, 9 aa, Homo Sapiens
EMNGQHLPR

SEQ ID NO: 1277507 - protein, 9 aa, Homo Sapiens
MSCASNKMD

SEQ ID NO: 1277508 - protein, 9 aa, Homo Sapiens
DTRQNPNCK

SEQ ID NO: 1277509 - protein, 9 aa, Homo Sapiens
PCVIPTRGL

SEQ ID NO: 1277510 - protein, 9 aa, Homo Sapiens
LEDPMQRQR

SEQ ID NO: 1277511 - protein, 9 aa, Homo Sapiens
TQQRPPWRT

SEQ ID NO: 1277512 - protein, 9 aa, Homo Sapiens
ILTKRYGGF

SEQ ID NO: 1277513 - protein, 9 aa, Homo Sapiens
SGSYSSTTN

SEQ ID NO: 1277514 - protein, 9 aa, Homo Sapiens
TYMLLNNLQ

SEQ ID NO: 1277515 - protein, 9 aa, Homo Sapiens
YFLFGNLSF

SEQ ID NO: 1277516 - protein, 9 aa, Homo Sapiens
ITYCCCCRG

SEQ ID NO: 1277517 - protein, 9 aa, Homo Sapiens
KFAPFFVPM

SEQ ID NO: 1277518 - protein, 9 aa, Homo Sapiens
AGLHPCGKA

SEQ ID NO: 1277519 - protein, 9 aa, Homo Sapiens
MGQPSDDRV

SEQ ID NO: 1277520 - protein, 9 aa, Homo Sapiens
VTTSATEAW

SEQ ID NO: 1277521 - protein, 9 aa, Homo Sapiens
MPAKACTGD

SEQ ID NO: 1277522 - protein, 9 aa, Homo Sapiens
AACVGTKPS

SEQ ID NO: 1277523 - protein, 9 aa, Homo Sapiens
FWVFLKSLR

SEQ ID NO: 1277524 - protein, 9 aa, Homo Sapiens
ERGAVRSLR

SEQ ID NO: 1277525 - protein, 9 aa, Homo Sapiens
TFRRRALYA

SEQ ID NO: 1277526 - protein, 9 aa, Homo Sapiens
KMPPPKSSQ

SEQ ID NO: 1277527 - protein, 9 aa, Homo Sapiens
QRLSPPALL

SEQ ID NO: 1277528 - protein, 9 aa, Homo Sapiens
LIDDFSLEP

SEQ ID NO: 1277529 - protein, 9 aa, Homo Sapiens
EQPMVVQSV

SEQ ID NO: 1277530 - protein, 9 aa, Homo Sapiens
QATGLPTSV

SEQ ID NO: 1277531 - protein, 9 aa, Homo Sapiens
ASMQEALVV

SEQ ID NO: 1277532 - protein, 9 aa, Homo Sapiens
LGRGQQMSQ

SEQ ID NO: 1277533 - protein, 9 aa, Homo Sapiens
RVMQDVVYK

SEQ ID NO: 1277534 - protein, 9 aa, Homo Sapiens
RNNDLIKII

SEQ ID NO: 1277535 - protein, 9 aa, Homo Sapiens
GFRRHLWLP

SEQ ID NO: 1277536 - protein, 9 aa, Homo Sapiens
VHLHLFASD

SEQ ID NO: 1277537 - protein, 9 aa, Homo Sapiens
AAPETPAPS

SEQ ID NO: 1277538 - protein, 9 aa, Homo Sapiens
SAGPKRPRA

SEQ ID NO: 1277539 - protein, 9 aa, Homo Sapiens
DQHGVVQGM

SEQ ID NO: 1277540 - protein, 9 aa, Homo Sapiens
VQYLMQLDV

SEQ ID NO: 1277541 - protein, 9 aa, Homo Sapiens
NRKPLIVLN

SEQ ID NO: 1277542 - protein, 9 aa, Homo Sapiens
MGRGEHPYP

SEQ ID NO: 1277543 - protein, 9 aa, Homo Sapiens
SPRPPLPKP

SEQ ID NO: 1277544 - protein, 9 aa, Homo Sapiens
TCTHVNICV

SEQ ID NO: 1277545 - protein, 9 aa, Homo Sapiens
SQHFTRVAV

SEQ ID NO: 1277546 - protein, 9 aa, Homo Sapiens
TCQYSVSLP

SEQ ID NO: 1277547 - protein, 9 aa, Homo Sapiens
ATHQNLGFQ

SEQ ID NO: 1277548 - protein, 9 aa, Homo Sapiens
PPSNRIRLH

SEQ ID NO: 1277549 - protein, 9 aa, Homo Sapiens
IRLHRLILP

SEQ ID NO: 1277550 - protein, 9 aa, Homo Sapiens
YVLTLDGRV

SEQ ID NO: 1277551 - protein, 9 aa, Homo Sapiens
CWHKSRLLQ

SEQ ID NO: 1277552 - protein, 9 aa, Homo Sapiens
PVPLPNITL

SEQ ID NO: 1277553 - protein, 9 aa, Homo Sapiens
GYIVFLIQM

SEQ ID NO: 1277554 - protein, 9 aa, Homo Sapiens
REPSLVTLG

SEQ ID NO: 1277555 - protein, 9 aa, Homo Sapiens
ILARGRSTS

SEQ ID NO: 1277556 - protein, 9 aa, Homo Sapiens
SLEAVRRAV

SEQ ID NO: 1277557 - protein, 9 aa, Homo Sapiens
LHRLILPMK

SEQ ID NO: 1277558 - protein, 9 aa, Homo Sapiens
NLHFHILTW

SEQ ID NO: 1277559 - protein, 9 aa, Homo Sapiens
PGQVHGPAC

SEQ ID NO: 1277560 - protein, 9 aa, Homo Sapiens
VGWKFAATG

SEQ ID NO: 1277561 - protein, 9 aa, Homo Sapiens
HYQFLAMEQ

SEQ ID NO: 1277562 - protein, 9 aa, Homo Sapiens
ISTLVLDVS

SEQ ID NO: 1277563 - protein, 9 aa, Homo Sapiens
VSASASPSI

SEQ ID NO: 1277564 - protein, 9 aa, Homo Sapiens
IPDVTQLTE

SEQ ID NO: 1277565 - protein, 9 aa, Homo Sapiens
DVQPTYVPV

SEQ ID NO: 1277566 - protein, 9 aa, Homo Sapiens
WRIGRRSST

SEQ ID NO: 1277567 - protein, 9 aa, Homo Sapiens
DALGTGACI

SEQ ID NO: 1277568 - protein, 9 aa, Homo Sapiens
GSKGRPPRC

SEQ ID NO: 1277569 - protein, 9 aa, Homo Sapiens
SCCISNSCC

SEQ ID NO: 1277570 - protein, 9 aa, Homo Sapiens
RVHLHLFAS

SEQ ID NO: 1277571 - protein, 9 aa, Homo Sapiens
MLPKGAASC

SEQ ID NO: 1277572 - protein, 9 aa, Homo Sapiens
DPKDTWQDE

SEQ ID NO: 1277573 - protein, 9 aa, Homo Sapiens
RARATTKKS

SEQ ID NO: 1277574 - protein, 9 aa, Homo Sapiens
RGSFPVGWK

SEQ ID NO: 1277575 - protein, 9 aa, Homo Sapiens
CQRLPRVEV

SEQ ID NO: 1277576 - protein, 9 aa, Homo Sapiens
AANDIVSPR

SEQ ID NO: 1277577 - protein, 9 aa, Homo Sapiens
WQRFHSPHQ

SEQ ID NO: 1277578 - protein, 9 aa, Homo Sapiens
PEKAKGEDG

SEQ ID NO: 1277579 - protein, 9 aa, Homo Sapiens
SFHSLKKVV

SEQ ID NO: 1277580 - protein, 9 aa, Homo Sapiens
QEWKCFIEE

SEQ ID NO: 1277581 - protein, 9 aa, Homo Sapiens
ICVVSHPGL

SEQ ID NO: 1277582 - protein, 9 aa, Homo Sapiens
QLVQHDALE

SEQ ID NO: 1277583 - protein, 9 aa, Homo Sapiens
VLTLDGRVH

SEQ ID NO: 1277584 - protein, 9 aa, Homo Sapiens
TPLWMFPMA

SEQ ID NO: 1277585 - protein, 9 aa, Homo Sapiens
CVLSSVLQT

SEQ ID NO: 1277586 - protein, 9 aa, Homo Sapiens
EVEQDKMTP

SEQ ID NO: 1277587 - protein, 9 aa, Homo Sapiens
GRSTSRTFR

SEQ ID NO: 1277588 - protein, 9 aa, Homo Sapiens
EHIANFNTQ

SEQ ID NO: 1277589 - protein, 9 aa, Homo Sapiens
DHGFQAAVT

SEQ ID NO: 1277590 - protein, 9 aa, Homo Sapiens
RNLAKLVQL

SEQ ID NO: 1277591 - protein, 9 aa, Homo Sapiens
HSLVMCLRL

SEQ ID NO: 1277592 - protein, 9 aa, Homo Sapiens
EASMQEALV

SEQ ID NO: 1277593 - protein, 9 aa, Homo Sapiens
KRLEDPMQR

SEQ ID NO: 1277594 - protein, 9 aa, Homo Sapiens
QDKMTPGNL

SEQ ID NO: 1277595 - protein, 9 aa, Homo Sapiens
QAHRLPLDG

SEQ ID NO: 1277596 - protein, 9 aa, Homo Sapiens
HVNICVFIY

SEQ ID NO: 1277597 - protein, 9 aa, Homo Sapiens
AEGSLKKTS

SEQ ID NO: 1277598 - protein, 9 aa, Homo Sapiens
SLYSVAVWP

SEQ ID NO: 1277599 - protein, 9 aa, Homo Sapiens
RDSPFGGAA

SEQ ID NO: 1277600 - protein, 9 aa, Homo Sapiens
MVVGGQALE

SEQ ID NO: 1277601 - protein, 9 aa, Homo Sapiens
AYTLGKSHT

SEQ ID NO: 1277602 - protein, 9 aa, Homo Sapiens
DSGTEDHPA

SEQ ID NO: 1277603 - protein, 9 aa, Homo Sapiens
ARGVRRRGP

SEQ ID NO: 1277604 - protein, 9 aa, Homo Sapiens
MRAPRWKTC

SEQ ID NO: 1277605 - protein, 9 aa, Homo Sapiens
LEIYLTDKD

SEQ ID NO: 1277606 - protein, 9 aa, Homo Sapiens
FGMEATSLL

SEQ ID NO: 1277607 - protein, 9 aa, Homo Sapiens
SCSGLCSQD

SEQ ID NO: 1277608 - protein, 9 aa, Homo Sapiens
EIEVQMKKY

SEQ ID NO: 1277609 - protein, 9 aa, Homo Sapiens
RKLILDSAC

SEQ ID NO: 1277610 - protein, 9 aa, Homo Sapiens
NNSSENKLN

SEQ ID NO: 1277611 - protein, 9 aa, Homo Sapiens
ITVSFVGQI

SEQ ID NO: 1277612 - protein, 9 aa, Homo Sapiens
PMEESPPSA

SEQ ID NO: 1277613 - protein, 9 aa, Homo Sapiens
NNDLIKIID

SEQ ID NO: 1277614 - protein, 9 aa, Homo Sapiens
FLIFWNIKI

SEQ ID NO: 1277615 - protein, 9 aa, Homo Sapiens
MAGPSASLH

SEQ ID NO: 1277616 - protein, 9 aa, Homo Sapiens
CGDSPSGGF

SEQ ID NO: 1277617 - protein, 9 aa, Homo Sapiens
QSLLSLYSV

SEQ ID NO: 1277618 - protein, 9 aa, Homo Sapiens
EGAAAEGQK

SEQ ID NO: 1277619 - protein, 9 aa, Homo Sapiens
LVDVNGTGT

SEQ ID NO: 1277620 - protein, 9 aa, Homo Sapiens
PGLTHPAHQ

SEQ ID NO: 1277621 - protein, 9 aa, Homo Sapiens
REMLQEEAN

SEQ ID NO: 1277622 - protein, 9 aa, Homo Sapiens
QMSQALAVH

SEQ ID NO: 1277623 - protein, 9 aa, Homo Sapiens
SQDLAMPRH

SEQ ID NO: 1277624 - protein, 9 aa, Homo Sapiens
QGGLGGAAA

SEQ ID NO: 1277625 - protein, 9 aa, Homo Sapiens
PCPGGRTVQ

SEQ ID NO: 1277626 - protein, 9 aa, Homo Sapiens
VRRAVALEL

SEQ ID NO: 1277627 - protein, 9 aa, Homo Sapiens
YPEFQSSSV

SEQ ID NO: 1277628 - protein, 9 aa, Homo Sapiens
ESQLLPGQM

SEQ ID NO: 1277629 - protein, 9 aa, Homo Sapiens
ASISVLQGP

SEQ ID NO: 1277630 - protein, 9 aa, Homo Sapiens
RPPLPKPRS

SEQ ID NO: 1277631 - protein, 9 aa, Homo Sapiens
IRSGEALGS

SEQ ID NO: 1277632 - protein, 9 aa, Homo Sapiens
APSYPNYDV

SEQ ID NO: 1277633 - protein, 9 aa, Homo Sapiens
RTMAGPSAS

SEQ ID NO: 1277634 - protein, 9 aa, Homo Sapiens
HYPHDRPIL

SEQ ID NO: 1277635 - protein, 9 aa, Homo Sapiens
AETYHCLLA

SEQ ID NO: 1277636 - protein, 9 aa, Homo Sapiens
ASLHPASGR

SEQ ID NO: 1277637 - protein, 9 aa, Homo Sapiens
SMGIGLGMA

SEQ ID NO: 1277638 - protein, 9 aa, Homo Sapiens
WQRRRLPSV

SEQ ID NO: 1277639 - protein, 9 aa, Homo Sapiens
IGYIVFLIQ

SEQ ID NO: 1277640 - protein, 9 aa, Homo Sapiens
RQSCCLPGL

SEQ ID NO: 1277641 - protein, 9 aa, Homo Sapiens
QALGHDSPL

SEQ ID NO: 1277642 - protein, 9 aa, Homo Sapiens
SLVEVINKK

SEQ ID NO: 1277643 - protein, 9 aa, Homo Sapiens
LLDSGFEQP

SEQ ID NO: 1277644 - protein, 9 aa, Homo Sapiens
ALFIWPQHS

SEQ ID NO: 1277645 - protein, 9 aa, Homo Sapiens
NSHLRSGQL

SEQ ID NO: 1277646 - protein, 9 aa, Homo Sapiens
AAFKRIHLR

SEQ ID NO: 1277647 - protein, 9 aa, Homo Sapiens
EHPGLGGEA

SEQ ID NO: 1277648 - protein, 9 aa, Homo Sapiens
YVFIIITIL

SEQ ID NO: 1277649 - protein, 9 aa, Homo Sapiens
PPLPGPHLQ

SEQ ID NO: 1277650 - protein, 9 aa, Homo Sapiens
VCKPDETGK

SEQ ID NO: 1277651 - protein, 9 aa, Homo Sapiens
LLRAKGHAG

SEQ ID NO: 1277652 - protein, 9 aa, Homo Sapiens
YKDHRRENA

SEQ ID NO: 1277653 - protein, 9 aa, Homo Sapiens
PPSPQNRSR

SEQ ID NO: 1277654 - protein, 9 aa, Homo Sapiens
THSRNITVQ

SEQ ID NO: 1277655 - protein, 9 aa, Homo Sapiens
RKQNVCRDV

SEQ ID NO: 1277656 - protein, 9 aa, Homo Sapiens
LPGSLEYLY

SEQ ID NO: 1277657 - protein, 9 aa, Homo Sapiens
SLLSLYSVA

SEQ ID NO: 1277658 - protein, 9 aa, Homo Sapiens
APPPAAAAL

SEQ ID NO: 1277659 - protein, 9 aa, Homo Sapiens
HPKPPTPER

SEQ ID NO: 1277660 - protein, 9 aa, Homo Sapiens
IPTRGLRAT

SEQ ID NO: 1277661 - protein, 9 aa, Homo Sapiens
LTPSLAAYH

SEQ ID NO: 1277662 - protein, 9 aa, Homo Sapiens
LGEQKFTFI

SEQ ID NO: 1277663 - protein, 9 aa, Homo Sapiens
CWGRHVRAR

SEQ ID NO: 1277664 - protein, 9 aa, Homo Sapiens
TTSDLTQSQ

SEQ ID NO: 1277665 - protein, 9 aa, Homo Sapiens
LSPRAQSCP

SEQ ID NO: 1277666 - protein, 9 aa, Homo Sapiens
HLQRYSNLI

SEQ ID NO: 1277667 - protein, 9 aa, Homo Sapiens
TLVLDVSSI

SEQ ID NO: 1277668 - protein, 9 aa, Homo Sapiens
RWLHQRGSG

SEQ ID NO: 1277669 - protein, 9 aa, Homo Sapiens
SLAAYHHPD

SEQ ID NO: 1277670 - protein, 9 aa, Homo Sapiens
LKNATMAFW

SEQ ID NO: 1277671 - protein, 9 aa, Homo Sapiens
ITLTVNISD

SEQ ID NO: 1277672 - protein, 9 aa, Homo Sapiens
NGGRTQGEV

SEQ ID NO: 1277673 - protein, 9 aa, Homo Sapiens
SGPTCGRWP

SEQ ID NO: 1277674 - protein, 9 aa, Homo Sapiens
WVFQEAETY

SEQ ID NO: 1277675 - protein, 9 aa, Homo Sapiens
PRPAGRLGD

SEQ ID NO: 1277676 - protein, 9 aa, Homo Sapiens
LIKQRKKKV

SEQ ID NO: 1277677 - protein, 9 aa, Homo Sapiens
CHPPRQGLR

SEQ ID NO: 1277678 - protein, 9 aa, Homo Sapiens
SYVFIIITI

SEQ ID NO: 1277679 - protein, 9 aa, Homo Sapiens
VRCEEDFSW

SEQ ID NO: 1277680 - protein, 9 aa, Homo Sapiens
GSLRKPGLP

SEQ ID NO: 1277681 - protein, 9 aa, Homo Sapiens
VMEMMEGES

SEQ ID NO: 1277682 - protein, 9 aa, Homo Sapiens
HIANFNTQQ

SEQ ID NO: 1277683 - protein, 9 aa, Homo Sapiens
VASPYPKRK

SEQ ID NO: 1277684 - protein, 9 aa, Homo Sapiens
RALSILMLH

SEQ ID NO: 1277685 - protein, 9 aa, Homo Sapiens
HSDYDEGDY

SEQ ID NO: 1277686 - protein, 9 aa, Homo Sapiens
WQRRLRACR

SEQ ID NO: 1277687 - protein, 9 aa, Homo Sapiens
GEGAAAEGQ

SEQ ID NO: 1277688 - protein, 9 aa, Homo Sapiens
ATINAAYTL

SEQ ID NO: 1277689 - protein, 9 aa, Homo Sapiens
YEYTLGEQK

SEQ ID NO: 1277690 - protein, 9 aa, Homo Sapiens
GVNLLVANI

SEQ ID NO: 1277691 - protein, 9 aa, Homo Sapiens
EMMEGESYF

SEQ ID NO: 1277692 - protein, 9 aa, Homo Sapiens
GKSQGGRIL

SEQ ID NO: 1277693 - protein, 9 aa, Homo Sapiens
ATPQVPPPC

SEQ ID NO: 1277694 - protein, 9 aa, Homo Sapiens
EKKPRKKFP

SEQ ID NO: 1277695 - protein, 9 aa, Homo Sapiens
VANIHHVSL

SEQ ID NO: 1277696 - protein, 9 aa, Homo Sapiens
AMAAGIHSL

SEQ ID NO: 1277697 - protein, 9 aa, Homo Sapiens
VFELSEKLE

SEQ ID NO: 1277698 - protein, 9 aa, Homo Sapiens
KQNVCRDVT

SEQ ID NO: 1277699 - protein, 9 aa, Homo Sapiens
KYYRPVDTG

SEQ ID NO: 1277700 - protein, 9 aa, Homo Sapiens
QGGRILLQR

SEQ ID NO: 1277701 - protein, 9 aa, Homo Sapiens
TMEGPELQH

SEQ ID NO: 1277702 - protein, 9 aa, Homo Sapiens
PSWSSRSPG

SEQ ID NO: 1277703 - protein, 9 aa, Homo Sapiens
FRRRALYAV

SEQ ID NO: 1277704 - protein, 9 aa, Homo Sapiens
RGMVSLFGV

SEQ ID NO: 1277705 - protein, 9 aa, Homo Sapiens
PTCGDSPSG

SEQ ID NO: 1277706 - protein, 9 aa, Homo Sapiens
QRLDKQLAL

SEQ ID NO: 1277707 - protein, 9 aa, Homo Sapiens
MIPDVTQLT

SEQ ID NO: 1277708 - protein, 9 aa, Homo Sapiens
LAVHRDQPA

SEQ ID NO: 1277709 - protein, 9 aa, Homo Sapiens
NLHVLNEEQ

SEQ ID NO: 1277710 - protein, 9 aa, Homo Sapiens
TLQTFQLCL

SEQ ID NO: 1277711 - protein, 9 aa, Homo Sapiens
VPLPNITLG

SEQ ID NO: 1277712 - protein, 9 aa, Homo Sapiens
IDRERAAQT

SEQ ID NO: 1277713 - protein, 9 aa, Homo Sapiens
VPVMIKGKP

SEQ ID NO: 1277714 - protein, 9 aa, Homo Sapiens
KVPGGSRPG

SEQ ID NO: 1277715 - protein, 9 aa, Homo Sapiens
NWVNKSVTQ

SEQ ID NO: 1277716 - protein, 9 aa, Homo Sapiens
KPRSLWLTS

SEQ ID NO: 1277717 - protein, 9 aa, Homo Sapiens
VTRNRGAWS

SEQ ID NO: 1277718 - protein, 9 aa, Homo Sapiens
SKNDELNGV

SEQ ID NO: 1277719 - protein, 9 aa, Homo Sapiens
RRRRTTILI

SEQ ID NO: 1277720 - protein, 9 aa, Homo Sapiens
GRCSSLQVE

SEQ ID NO: 1277721 - protein, 9 aa, Homo Sapiens
LYLQCLSKL

SEQ ID NO: 1277722 - protein, 9 aa, Homo Sapiens
VTVMVHSIL

SEQ ID NO: 1277723 - protein, 9 aa, Homo Sapiens
SKKKILMGL

SEQ ID NO: 1277724 - protein, 9 aa, Homo Sapiens
QRARKPAGC

SEQ ID NO: 1277725 - protein, 9 aa, Homo Sapiens
ASNKMDSLL

SEQ ID NO: 1277726 - protein, 9 aa, Homo Sapiens
WKFWSLPLP

SEQ ID NO: 1277727 - protein, 9 aa, Homo Sapiens
ASTGTLQRS

SEQ ID NO: 1277728 - protein, 9 aa, Homo Sapiens
LAVIQDLIS

SEQ ID NO: 1277729 - protein, 9 aa, Homo Sapiens
RMMASVSPS

SEQ ID NO: 1277730 - protein, 9 aa, Homo Sapiens
QVLWVFQEA

SEQ ID NO: 1277731 - protein, 9 aa, Homo Sapiens
PQVQWAEDS

SEQ ID NO: 1277732 - protein, 9 aa, Homo Sapiens
RGILRKMSD

SEQ ID NO: 1277733 - protein, 9 aa, Homo Sapiens
GPSWSSRSP

SEQ ID NO: 1277734 - protein, 9 aa, Homo Sapiens
DDRVYFRLS

SEQ ID NO: 1277735 - protein, 9 aa, Homo Sapiens
RLRTKLEKA

SEQ ID NO: 1277736 - protein, 9 aa, Homo Sapiens
QTTSDLTQS

SEQ ID NO: 1277737 - protein, 9 aa, Homo Sapiens
RLVLQFELW

SEQ ID NO: 1277738 - protein, 9 aa, Homo Sapiens
ERFLNFCGL

SEQ ID NO: 1277739 - protein, 9 aa, Homo Sapiens
FGGLSLPRL

SEQ ID NO: 1277740 - protein, 9 aa, Homo Sapiens
AHTGPGHVL

SEQ ID NO: 1277741 - protein, 9 aa, Homo Sapiens
LPGQVHGPA

SEQ ID NO: 1277742 - protein, 9 aa, Homo Sapiens
DEGDYDADC

SEQ ID NO: 1277743 - protein, 9 aa, Homo Sapiens
HYWPLENMD

SEQ ID NO: 1277744 - protein, 9 aa, Homo Sapiens
GPHLQQWKW

SEQ ID NO: 1277745 - protein, 9 aa, Homo Sapiens
YERDHTVVV

SEQ ID NO: 1277746 - protein, 9 aa, Homo Sapiens
KLEEVLMVV

SEQ ID NO: 1277747 - protein, 9 aa, Homo Sapiens
NTTALEKKK

SEQ ID NO: 1277748 - protein, 9 aa, Homo Sapiens
DEGRTTTCK

SEQ ID NO: 1277749 - protein, 9 aa, Homo Sapiens
NSAYGGTDF

SEQ ID NO: 1277750 - protein, 9 aa, Homo Sapiens
RGPAAAAPE

SEQ ID NO: 1277751 - protein, 9 aa, Homo Sapiens
DPRGCKGVL

SEQ ID NO: 1277752 - protein, 9 aa, Homo Sapiens
FGVQGNTLQ

SEQ ID NO: 1277753 - protein, 9 aa, Homo Sapiens
GPSVPGSGA

SEQ ID NO: 1277754 - protein, 9 aa, Homo Sapiens
LFLWRRFRS

SEQ ID NO: 1277755 - protein, 9 aa, Homo Sapiens
DPLPQLLDS

SEQ ID NO: 1277756 - protein, 9 aa, Homo Sapiens
RSPGARCRN

SEQ ID NO: 1277757 - protein, 9 aa, Homo Sapiens
APRWKTCYI

SEQ ID NO: 1277758 - protein, 9 aa, Homo Sapiens
VGSNLPGRA

SEQ ID NO: 1277759 - protein, 9 aa, Homo Sapiens
LILPMKIPR

SEQ ID NO: 1277760 - protein, 9 aa, Homo Sapiens
DPVPLPNIT

SEQ ID NO: 1277761 - protein, 9 aa, Homo Sapiens
SMDDSCVAL

SEQ ID NO: 1277762 - protein, 9 aa, Homo Sapiens
RLEDPMQRQ

SEQ ID NO: 1277763 - protein, 9 aa, Homo Sapiens
VGQISTLVL

SEQ ID NO: 1277764 - protein, 9 aa, Homo Sapiens
AKQLCLYVS

SEQ ID NO: 1277765 - protein, 9 aa, Homo Sapiens
GLGPEKTSL

SEQ ID NO: 1277766 - protein, 9 aa, Homo Sapiens
THSEVRVLG

SEQ ID NO: 1277767 - protein, 9 aa, Homo Sapiens
RIIETPPTP

SEQ ID NO: 1277768 - protein, 9 aa, Homo Sapiens
MLLNNLQDF

SEQ ID NO: 1277769 - protein, 9 aa, Homo Sapiens
PEVCGAAHG

SEQ ID NO: 1277770 - protein, 9 aa, Homo Sapiens
CGRPEVCGA

SEQ ID NO: 1277771 - protein, 9 aa, Homo Sapiens
LYHSDYDEG

SEQ ID NO: 1277772 - protein, 9 aa, Homo Sapiens
QQIWEQTTS

SEQ ID NO: 1277773 - protein, 9 aa, Homo Sapiens
GELLHPSQR

SEQ ID NO: 1277774 - protein, 9 aa, Homo Sapiens
LDALGTGAC

SEQ ID NO: 1277775 - protein, 9 aa, Homo Sapiens
FCMKDLRDA

SEQ ID NO: 1277776 - protein, 9 aa, Homo Sapiens
IVFLIQMFF

SEQ ID NO: 1277777 - protein, 9 aa, Homo Sapiens
PVAEARGVR

SEQ ID NO: 1277778 - protein, 9 aa, Homo Sapiens
DPEPMWQAP

SEQ ID NO: 1277779 - protein, 9 aa, Homo Sapiens
CRVIVPEKL

SEQ ID NO: 1277780 - protein, 9 aa, Homo Sapiens
RASRKTWQR

SEQ ID NO: 1277781 - protein, 9 aa, Homo Sapiens
ATNLALSVL

SEQ ID NO: 1277782 - protein, 9 aa, Homo Sapiens
PQPRRGPAA

SEQ ID NO: 1277783 - protein, 9 aa, Homo Sapiens
HDRPILYSN

SEQ ID NO: 1277784 - protein, 9 aa, Homo Sapiens
CQGFGPFRW

SEQ ID NO: 1277785 - protein, 9 aa, Homo Sapiens
LRSVQSHNK

SEQ ID NO: 1277786 - protein, 9 aa, Homo Sapiens
TTLPASQRS

SEQ ID NO: 1277787 - protein, 9 aa, Homo Sapiens
NLAKLVQLV

SEQ ID NO: 1277788 - protein, 9 aa, Homo Sapiens
ERDHTVVVG

SEQ ID NO: 1277789 - protein, 9 aa, Homo Sapiens
QGFFPMAPE

SEQ ID NO: 1277790 - protein, 9 aa, Homo Sapiens
PDSTDVSTA

SEQ ID NO: 1277791 - protein, 9 aa, Homo Sapiens
RIQKLGVLS

SEQ ID NO: 1277792 - protein, 9 aa, Homo Sapiens
NMDGIHELQ

SEQ ID NO: 1277793 - protein, 9 aa, Homo Sapiens
RGPPQLHHR

SEQ ID NO: 1277794 - protein, 9 aa, Homo Sapiens
GGDPKQLEA

SEQ ID NO: 1277795 - protein, 9 aa, Homo Sapiens
DFQEEASMQ

SEQ ID NO: 1277796 - protein, 9 aa, Homo Sapiens
AFPSAAGGT

SEQ ID NO: 1277797 - protein, 9 aa, Homo Sapiens
DSGFEQPLS

SEQ ID NO: 1277798 - protein, 9 aa, Homo Sapiens
ISGISSRGQ

SEQ ID NO: 1277799 - protein, 9 aa, Homo Sapiens
GKMSLIDDF

SEQ ID NO: 1277800 - protein, 9 aa, Homo Sapiens
MSGLSCRFY

SEQ ID NO: 1277801 - protein, 9 aa, Homo Sapiens
LGDWYSINW

SEQ ID NO: 1277802 - protein, 9 aa, Homo Sapiens
KNGWDTGTE

SEQ ID NO: 1277803 - protein, 9 aa, Homo Sapiens
EGAMVIISG

SEQ ID NO: 1277804 - protein, 9 aa, Homo Sapiens
PASALRRPQ

SEQ ID NO: 1277805 - protein, 9 aa, Homo Sapiens
QDVSRASTS

SEQ ID NO: 1277806 - protein, 9 aa, Homo Sapiens
QCIRQVLQL

SEQ ID NO: 1277807 - protein, 9 aa, Homo Sapiens
KDMSGLHIS

SEQ ID NO: 1277808 - protein, 9 aa, Homo Sapiens
SACTRSTLM

SEQ ID NO: 1277809 - protein, 9 aa, Homo Sapiens
WQCRFREQR

SEQ ID NO: 1277810 - protein, 9 aa, Homo Sapiens
HSRACSSSA

SEQ ID NO: 1277811 - protein, 9 aa, Homo Sapiens
LQPPGDCPR

SEQ ID NO: 1277812 - protein, 9 aa, Homo Sapiens
LNANLEGVS

SEQ ID NO: 1277813 - protein, 9 aa, Homo Sapiens
HPSITEGDN

SEQ ID NO: 1277814 - protein, 9 aa, Homo Sapiens
LQEDLGTAE

SEQ ID NO: 1277815 - protein, 9 aa, Homo Sapiens
THQNLGFQA

SEQ ID NO: 1277816 - protein, 9 aa, Homo Sapiens
QLCLYVSKG

SEQ ID NO: 1277817 - protein, 9 aa, Homo Sapiens
IRKNGWDTG

SEQ ID NO: 1277818 - protein, 9 aa, Homo Sapiens
YPPPHLRQL

SEQ ID NO: 1277819 - protein, 9 aa, Homo Sapiens
KPRKKFPNN

SEQ ID NO: 1277820 - protein, 9 aa, Homo Sapiens
HLFASDEQG

SEQ ID NO: 1277821 - protein, 9 aa, Homo Sapiens
PLSISRPTS

SEQ ID NO: 1277822 - protein, 9 aa, Homo Sapiens
EDWEKKIEE

SEQ ID NO: 1277823 - protein, 9 aa, Homo Sapiens
QPPVAKKPT

SEQ ID NO: 1277824 - protein, 9 aa, Homo Sapiens
AHPSITEGD

SEQ ID NO: 1277825 - protein, 9 aa, Homo Sapiens
HEGLPQVQW

SEQ ID NO: 1277826 - protein, 9 aa, Homo Sapiens
SMVGGAYGT

SEQ ID NO: 1277827 - protein, 9 aa, Homo Sapiens
PFGGAAYLQ

SEQ ID NO: 1277828 - protein, 9 aa, Homo Sapiens
GGAAASISV

SEQ ID NO: 1277829 - protein, 9 aa, Homo Sapiens
FPMAPETRL

SEQ ID NO: 1277830 - protein, 9 aa, Homo Sapiens
SRDPAKMRR

SEQ ID NO: 1277831 - protein, 9 aa, Homo Sapiens
CTHVNICVF

SEQ ID NO: 1277832 - protein, 9 aa, Homo Sapiens
LPRLHASVR

SEQ ID NO: 1277833 - protein, 9 aa, Homo Sapiens
HALHPASSS

SEQ ID NO: 1277834 - protein, 9 aa, Homo Sapiens
WQCGSDHGT

SEQ ID NO: 1277835 - protein, 9 aa, Homo Sapiens
FLRWLGWAR

SEQ ID NO: 1277836 - protein, 9 aa, Homo Sapiens
WVNKSVTQE

SEQ ID NO: 1277837 - protein, 9 aa, Homo Sapiens
RGGEEAVQS

SEQ ID NO: 1277838 - protein, 9 aa, Homo Sapiens
NGTGTLSQS

SEQ ID NO: 1277839 - protein, 9 aa, Homo Sapiens
VMIPDVTQL

SEQ ID NO: 1277840 - protein, 9 aa, Homo Sapiens
LHASVREML

SEQ ID NO: 1277841 - protein, 9 aa, Homo Sapiens
ANWTVRCEE

SEQ ID NO: 1277842 - protein, 9 aa, Homo Sapiens
PIVYQEYPV

SEQ ID NO: 1277843 - protein, 9 aa, Homo Sapiens
LIQNRSPTP

SEQ ID NO: 1277844 - protein, 9 aa, Homo Sapiens
EQKFTFIEK

SEQ ID NO: 1277845 - protein, 9 aa, Homo Sapiens
KRRNLQRNL

SEQ ID NO: 1277846 - protein, 9 aa, Homo Sapiens
RKEGSRSVE

SEQ ID NO: 1277847 - protein, 9 aa, Homo Sapiens
AVSSMPCFY

SEQ ID NO: 1277848 - protein, 9 aa, Homo Sapiens
FPNNWELWL

SEQ ID NO: 1277849 - protein, 9 aa, Homo Sapiens
LQRARKPAG

SEQ ID NO: 1277850 - protein, 9 aa, Homo Sapiens
SPPALLRDG

SEQ ID NO: 1277851 - protein, 9 aa, Homo Sapiens
HRLPLDGEE

SEQ ID NO: 1277852 - protein, 9 aa, Homo Sapiens
LIEVEEEEI

SEQ ID NO: 1277853 - protein, 9 aa, Homo Sapiens
QTQLCHPPR

SEQ ID NO: 1277854 - protein, 9 aa, Homo Sapiens
GAAAEGQKL

SEQ ID NO: 1277855 - protein, 9 aa, Homo Sapiens
GDWYSINWM

SEQ ID NO: 1277856 - protein, 9 aa, Homo Sapiens
KHVDEYDPK

SEQ ID NO: 1277857 - protein, 9 aa, Homo Sapiens
VSVYSAASP

SEQ ID NO: 1277858 - protein, 9 aa, Homo Sapiens
PSAEGTSIQ

SEQ ID NO: 1277859 - protein, 9 aa, Homo Sapiens
GHAGTGCAK

SEQ ID NO: 1277860 - protein, 9 aa, Homo Sapiens
DPSNRKPLI

SEQ ID NO: 1277861 - protein, 9 aa, Homo Sapiens
ASQHFTRVA

SEQ ID NO: 1277862 - protein, 9 aa, Homo Sapiens
IQMKTHSRN

SEQ ID NO: 1277863 - protein, 9 aa, Homo Sapiens
HKGKPLEPN

SEQ ID NO: 1277864 - protein, 9 aa, Homo Sapiens
IAACVGTKP

SEQ ID NO: 1277865 - protein, 9 aa, Homo Sapiens
LGWARFLHY

SEQ ID NO: 1277866 - protein, 9 aa, Homo Sapiens
LRACSFHSL

SEQ ID NO: 1277867 - protein, 9 aa, Homo Sapiens
YVIVGSAAY

SEQ ID NO: 1277868 - protein, 9 aa, Homo Sapiens
HWRMMASVS

SEQ ID NO: 1277869 - protein, 9 aa, Homo Sapiens
ARQHPTAHP

SEQ ID NO: 1277870 - protein, 9 aa, Homo Sapiens
NGKWLRACS

SEQ ID NO: 1277871 - protein, 9 aa, Homo Sapiens
TKLIIQAGI

SEQ ID NO: 1277872 - protein, 9 aa, Homo Sapiens
LFHHCRLTY

SEQ ID NO: 1277873 - protein, 9 aa, Homo Sapiens
KVLKIHKSM

SEQ ID NO: 1277874 - protein, 9 aa, Homo Sapiens
PGLPCAQDP

SEQ ID NO: 1277875 - protein, 9 aa, Homo Sapiens
PPPHLRQLL

SEQ ID NO: 1277876 - protein, 9 aa, Homo Sapiens
VAGVGLAAS

SEQ ID NO: 1277877 - protein, 9 aa, Homo Sapiens
YWPLENMDG

SEQ ID NO: 1277878 - protein, 9 aa, Homo Sapiens
VTPATAGSL

SEQ ID NO: 1277879 - protein, 9 aa, Homo Sapiens
FTESASTGT

SEQ ID NO: 1277880 - protein, 9 aa, Homo Sapiens
GAPPPAAAA

SEQ ID NO: 1277881 - protein, 9 aa, Homo Sapiens
YHHPDFPLL

SEQ ID NO: 1277882 - protein, 9 aa, Homo Sapiens
ALRVMQWNC

SEQ ID NO: 1277883 - protein, 9 aa, Homo Sapiens
MDSLLQNMW

SEQ ID NO: 1277884 - protein, 9 aa, Homo Sapiens
GVLGGKCGQ

SEQ ID NO: 1277885 - protein, 9 aa, Homo Sapiens
AHDHGFQAA

SEQ ID NO: 1277886 - protein, 9 aa, Homo Sapiens
LMGRGEHPY

SEQ ID NO: 1277887 - protein, 9 aa, Homo Sapiens
KLILDSACA

SEQ ID NO: 1277888 - protein, 9 aa, Homo Sapiens
SASASPSIR

SEQ ID NO: 1277889 - protein, 9 aa, Homo Sapiens
KSLRLVDSH

SEQ ID NO: 1277890 - protein, 9 aa, Homo Sapiens
NNPKNLSRP

SEQ ID NO: 1277891 - protein, 9 aa, Homo Sapiens
DKINADPVP

SEQ ID NO: 1277892 - protein, 9 aa, Homo Sapiens
GDSPSGGFP

SEQ ID NO: 1277893 - protein, 9 aa, Homo Sapiens
PAEEPPARE

SEQ ID NO: 1277894 - protein, 9 aa, Homo Sapiens
DGHVLKCAK

SEQ ID NO: 1277895 - protein, 9 aa, Homo Sapiens
NLGFQAPVK

SEQ ID NO: 1277896 - protein, 9 aa, Homo Sapiens
CLGTSGRGR

SEQ ID NO: 1277897 - protein, 9 aa, Homo Sapiens
LFGERLNRN

SEQ ID NO: 1277898 - protein, 9 aa, Homo Sapiens
SVQSHNKSV

SEQ ID NO: 1277899 - protein, 9 aa, Homo Sapiens
GSFERPRTT

SEQ ID NO: 1277900 - protein, 9 aa, Homo Sapiens
SRTADADQH

SEQ ID NO: 1277901 - protein, 9 aa, Homo Sapiens
LKKILRSFM

SEQ ID NO: 1277902 - protein, 9 aa, Homo Sapiens
GKNFRKEKN

SEQ ID NO: 1277903 - protein, 9 aa, Homo Sapiens
STVERGMVS

SEQ ID NO: 1277904 - protein, 9 aa, Homo Sapiens
HRRGGEEAV

SEQ ID NO: 1277905 - protein, 9 aa, Homo Sapiens
QVLKKILRS

SEQ ID NO: 1277906 - protein, 9 aa, Homo Sapiens
YCCSCPPGR

SEQ ID NO: 1277907 - protein, 9 aa, Homo Sapiens
GLKTFFSQE

SEQ ID NO: 1277908 - protein, 9 aa, Homo Sapiens
PPCCRFDSP

SEQ ID NO: 1277909 - protein, 9 aa, Homo Sapiens
ASVREMLQE

SEQ ID NO: 1277910 - protein, 9 aa, Homo Sapiens
PLAPASPLS

SEQ ID NO: 1277911 - protein, 9 aa, Homo Sapiens
EQFGKFNVI

SEQ ID NO: 1277912 - protein, 9 aa, Homo Sapiens
IMIWIYGGA

SEQ ID NO: 1277913 - protein, 9 aa, Homo Sapiens
LRENFSHVP

SEQ ID NO: 1277914 - protein, 9 aa, Homo Sapiens
LGVLGGKCG

SEQ ID NO: 1277915 - protein, 9 aa, Homo Sapiens
ASPLSPRAQ

SEQ ID NO: 1277916 - protein, 9 aa, Homo Sapiens
SCPLCRGLR

SEQ ID NO: 1277917 - protein, 9 aa, Homo Sapiens
KIQEQRKQS

SEQ ID NO: 1277918 - protein, 9 aa, Homo Sapiens
GPKRPRAGS

SEQ ID NO: 1277919 - protein, 9 aa, Homo Sapiens
VMQPFSDKA

SEQ ID NO: 1277920 - protein, 9 aa, Homo Sapiens
AAALDEGRT

SEQ ID NO: 1277921 - protein, 9 aa, Homo Sapiens
TTTCKGSTP

SEQ ID NO: 1277922 - protein, 9 aa, Homo Sapiens
MDDIAACVG

SEQ ID NO: 1277923 - protein, 9 aa, Homo Sapiens
VMNSKNDEL

SEQ ID NO: 1277924 - protein, 9 aa, Homo Sapiens
RWKTCYIQS

SEQ ID NO: 1277925 - protein, 9 aa, Homo Sapiens
SCISLPPVD

SEQ ID NO: 1277926 - protein, 9 aa, Homo Sapiens
QHFTRVAVV

SEQ ID NO: 1277927 - protein, 9 aa, Homo Sapiens
KLEIYLTDK

SEQ ID NO: 1277928 - protein, 9 aa, Homo Sapiens
GSKGWQTMW

SEQ ID NO: 1277929 - protein, 9 aa, Homo Sapiens
MEAVRLQKE

SEQ ID NO: 1277930 - protein, 9 aa, Homo Sapiens
TDPRMASSS

SEQ ID NO: 1277931 - protein, 9 aa, Homo Sapiens
VGGAYGTGR

SEQ ID NO: 1277932 - protein, 9 aa, Homo Sapiens
LHPCGKAHA

SEQ ID NO: 1277933 - protein, 9 aa, Homo Sapiens
LFQALGITT

SEQ ID NO: 1277934 - protein, 9 aa, Homo Sapiens
DLEDVQSYR

SEQ ID NO: 1277935 - protein, 9 aa, Homo Sapiens
SSENKLNEA

SEQ ID NO: 1277936 - protein, 9 aa, Homo Sapiens
DDEKKRGSR

SEQ ID NO: 1277937 - protein, 9 aa, Homo Sapiens
VQNLTLRIQ

SEQ ID NO: 1277938 - protein, 9 aa, Homo Sapiens
VIVPEKLPV

SEQ ID NO: 1277939 - protein, 9 aa, Homo Sapiens
YPDSTDVST

SEQ ID NO: 1277940 - protein, 9 aa, Homo Sapiens
RACRAGGPA

SEQ ID NO: 1277941 - protein, 9 aa, Homo Sapiens
TGSKGWQTM

SEQ ID NO: 1277942 - protein, 9 aa, Homo Sapiens
RTKLEKALS

SEQ ID NO: 1277943 - protein, 9 aa, Homo Sapiens
LWVFQEAET

SEQ ID NO: 1277944 - protein, 9 aa, Homo Sapiens
AQRANLLSS

SEQ ID NO: 1277945 - protein, 9 aa, Homo Sapiens
ILGIFVTIL

SEQ ID NO: 1277946 - protein, 9 aa, Homo Sapiens
PHSRACSSS

SEQ ID NO: 1277947 - protein, 9 aa, Homo Sapiens
TCYCKCGFA

SEQ ID NO: 1277948 - protein, 9 aa, Homo Sapiens
KKPSPPTLS

SEQ ID NO: 1277949 - protein, 9 aa, Homo Sapiens
GRILARGRS

SEQ ID NO: 1277950 - protein, 9 aa, Homo Sapiens
GHDIIEDMW

SEQ ID NO: 1277951 - protein, 9 aa, Homo Sapiens
DSPSGGFPS

SEQ ID NO: 1277952 - protein, 9 aa, Homo Sapiens
ISHLQNLQR

SEQ ID NO: 1277953 - protein, 9 aa, Homo Sapiens
MAPSSPGPR

SEQ ID NO: 1277954 - protein, 9 aa, Homo Sapiens
TESASTGTL

SEQ ID NO: 1277955 - protein, 9 aa, Homo Sapiens
LHQQDFTRA

SEQ ID NO: 1277956 - protein, 9 aa, Homo Sapiens
WDPEDACVL

SEQ ID NO: 1277957 - protein, 9 aa, Homo Sapiens
KAKGEDGEK

SEQ ID NO: 1277958 - protein, 9 aa, Homo Sapiens
LNRNGLAMA

SEQ ID NO: 1277959 - protein, 9 aa, Homo Sapiens
VFAFREENK

SEQ ID NO: 1277960 - protein, 9 aa, Homo Sapiens
GGSRPGWKR

SEQ ID NO: 1277961 - protein, 9 aa, Homo Sapiens
DQPAEQLTA

SEQ ID NO: 1277962 - protein, 9 aa, Homo Sapiens
LSHVGRPGS

SEQ ID NO: 1277963 - protein, 9 aa, Homo Sapiens
GDPVAEARG

SEQ ID NO: 1277964 - protein, 9 aa, Homo Sapiens
QPTYVPVMI

SEQ ID NO: 1277965 - protein, 9 aa, Homo Sapiens
LDRSGDLGN

SEQ ID NO: 1277966 - protein, 9 aa, Homo Sapiens
QKLEEVLMV

SEQ ID NO: 1277967 - protein, 9 aa, Homo Sapiens
RIRNTGNFQ

SEQ ID NO: 1277968 - protein, 9 aa, Homo Sapiens
CYTAFLHLQ

SEQ ID NO: 1277969 - protein, 9 aa, Homo Sapiens
YIVFLIQMF

SEQ ID NO: 1277970 - protein, 9 aa, Homo Sapiens
PRCPGHWRM

SEQ ID NO: 1277971 - protein, 9 aa, Homo Sapiens
QPGVSIASS

SEQ ID NO: 1277972 - protein, 9 aa, Homo Sapiens
QGNTLQALG

SEQ ID NO: 1277973 - protein, 9 aa, Homo Sapiens
MSLIDDFSL

SEQ ID NO: 1277974 - protein, 9 aa, Homo Sapiens
KCAKDQNGN

SEQ ID NO: 1277975 - protein, 9 aa, Homo Sapiens
GKKLEDSPK

SEQ ID NO: 1277976 - protein, 9 aa, Homo Sapiens
TLECLHEAT

SEQ ID NO: 1277977 - protein, 9 aa, Homo Sapiens
IHHVSLNMT

SEQ ID NO: 1277978 - protein, 9 aa, Homo Sapiens
PFFVPMSLA

SEQ ID NO: 1277979 - protein, 9 aa, Homo Sapiens
GTGRWLHQR

SEQ ID NO: 1277980 - protein, 9 aa, Homo Sapiens
LHWRIGGGT

SEQ ID NO: 1277981 - protein, 9 aa, Homo Sapiens
DLPIMIWIY

SEQ ID NO: 1277982 - protein, 9 aa, Homo Sapiens
CIDINVTPD

SEQ ID NO: 1277983 - protein, 9 aa, Homo Sapiens
FQWSRVGSN

SEQ ID NO: 1277984 - protein, 9 aa, Homo Sapiens
NLTLRIQKL

SEQ ID NO: 1277985 - protein, 9 aa, Homo Sapiens
CSGLCSQDL

SEQ ID NO: 1277986 - protein, 9 aa, Homo Sapiens
DDDGGGDDH

SEQ ID NO: 1277987 - protein, 9 aa, Homo Sapiens
RLSLHSGPG

SEQ ID NO: 1277988 - protein, 9 aa, Homo Sapiens
WRLLVTSQA

SEQ ID NO: 1277989 - protein, 9 aa, Homo Sapiens
EDKIDLFQD

SEQ ID NO: 1277990 - protein, 9 aa, Homo Sapiens
QAEGSLKKT

SEQ ID NO: 1277991 - protein, 9 aa, Homo Sapiens
RHSRSPHKG

SEQ ID NO: 1277992 - protein, 9 aa, Homo Sapiens
ARMQPRVLP

SEQ ID NO: 1277993 - protein, 9 aa, Homo Sapiens
TMKRLEDPM

SEQ ID NO: 1277994 - protein, 9 aa, Homo Sapiens
AVQTKVQYE

SEQ ID NO: 1277995 - protein, 9 aa, Homo Sapiens
QVSRDLPIM

SEQ ID NO: 1277996 - protein, 9 aa, Homo Sapiens
SINWMEDSD

SEQ ID NO: 1277997 - protein, 9 aa, Homo Sapiens
AGKLLWRKF

SEQ ID NO: 1277998 - protein, 9 aa, Homo Sapiens
DLNRPSFDA

SEQ ID NO: 1277999 - protein, 9 aa, Homo Sapiens
KPVDGEALE

SEQ ID NO: 1278000 - protein, 9 aa, Homo Sapiens
SRTNGSVTT

SEQ ID NO: 1278001 - protein, 9 aa, Homo Sapiens
VEPEEEGGD

SEQ ID NO: 1278002 - protein, 9 aa, Homo Sapiens
GVRLLLRAK

SEQ ID NO: 1278003 - protein, 9 aa, Homo Sapiens
PAPSPRSGH

SEQ ID NO: 1278004 - protein, 9 aa, Homo Sapiens
SCVALLAKS

SEQ ID NO: 1278005 - protein, 9 aa, Homo Sapiens
VSFDEPQEQ

SEQ ID NO: 1278006 - protein, 9 aa, Homo Sapiens
VGKEFRSAA

SEQ ID NO: 1278007 - protein, 9 aa, Homo Sapiens
GKWLRACSF

SEQ ID NO: 1278008 - protein, 9 aa, Homo Sapiens
VLLFLWRRF

SEQ ID NO: 1278009 - protein, 9 aa, Homo Sapiens
LDGHVLKCA

SEQ ID NO: 1278010 - protein, 9 aa, Homo Sapiens
TVNISDKLV

SEQ ID NO: 1278011 - protein, 9 aa, Homo Sapiens
PQLLDSGFE

SEQ ID NO: 1278012 - protein, 9 aa, Homo Sapiens
IDPTEARVQ

SEQ ID NO: 1278013 - protein, 9 aa, Homo Sapiens
GKEFRSAAF

SEQ ID NO: 1278014 - protein, 9 aa, Homo Sapiens
LMVVGGQAL

SEQ ID NO: 1278015 - protein, 9 aa, Homo Sapiens
WSLPLPSSN

SEQ ID NO: 1278016 - protein, 9 aa, Homo Sapiens
WFLSRKIQE

SEQ ID NO: 1278017 - protein, 9 aa, Homo Sapiens
RKPAGCWSS

SEQ ID NO: 1278018 - protein, 9 aa, Homo Sapiens
CWSSGRPGR

SEQ ID NO: 1278019 - protein, 9 aa, Homo Sapiens
ACSSSALAT

SEQ ID NO: 1278020 - protein, 9 aa, Homo Sapiens
VDEYDPKDT

SEQ ID NO: 1278021 - protein, 9 aa, Homo Sapiens
PGGELLHPS

SEQ ID NO: 1278022 - protein, 9 aa, Homo Sapiens
NDLIKIIDW

SEQ ID NO: 1278023 - protein, 9 aa, Homo Sapiens
LTSTTTTPT

SEQ ID NO: 1278024 - protein, 9 aa, Homo Sapiens
LFGNLSFLD

SEQ ID NO: 1278025 - protein, 9 aa, Homo Sapiens
FFVPMSLAC

SEQ ID NO: 1278026 - protein, 9 aa, Homo Sapiens
CCVEYGVGI

SEQ ID NO: 1278027 - protein, 9 aa, Homo Sapiens
HASVREMLQ

SEQ ID NO: 1278028 - protein, 9 aa, Homo Sapiens
LICVVSHPG

SEQ ID NO: 1278029 - protein, 9 aa, Homo Sapiens
EQDVSRAST

SEQ ID NO: 1278030 - protein, 9 aa, Homo Sapiens
PQMSKVKVM

SEQ ID NO: 1278031 - protein, 9 aa, Homo Sapiens
AVVTEDMDA

SEQ ID NO: 1278032 - protein, 9 aa, Homo Sapiens
THPAHQPLG

SEQ ID NO: 1278033 - protein, 9 aa, Homo Sapiens
APALSDLVI

SEQ ID NO: 1278034 - protein, 9 aa, Homo Sapiens
KTRKLKIAP

SEQ ID NO: 1278035 - protein, 9 aa, Homo Sapiens
CLTGIYGCH

SEQ ID NO: 1278036 - protein, 9 aa, Homo Sapiens
PQEHPGLGG

SEQ ID NO: 1278037 - protein, 9 aa, Homo Sapiens
MKSTKPSMS

SEQ ID NO: 1278038 - protein, 9 aa, Homo Sapiens
ADAKRQRQW

SEQ ID NO: 1278039 - protein, 9 aa, Homo Sapiens
HVYCHLESS

SEQ ID NO: 1278040 - protein, 9 aa, Homo Sapiens
GRWLHQRGS

SEQ ID NO: 1278041 - protein, 9 aa, Homo Sapiens
QWSRVGSNL

SEQ ID NO: 1278042 - protein, 9 aa, Homo Sapiens
HSPHCAAWK

SEQ ID NO: 1278043 - protein, 9 aa, Homo Sapiens
GPESRGILR

SEQ ID NO: 1278044 - protein, 9 aa, Homo Sapiens
PLPGRAQCI

SEQ ID NO: 1278045 - protein, 9 aa, Homo Sapiens
VMRAPRWKT

SEQ ID NO: 1278046 - protein, 9 aa, Homo Sapiens
SPSRNGRIW

SEQ ID NO: 1278047 - protein, 9 aa, Homo Sapiens
TTTTPTVIS

SEQ ID NO: 1278048 - protein, 9 aa, Homo Sapiens
LSALFIWPQ

SEQ ID NO: 1278049 - protein, 9 aa, Homo Sapiens
SPCCCQEWL

SEQ ID NO: 1278050 - protein, 9 aa, Homo Sapiens
EISHLQNLQ

SEQ ID NO: 1278051 - protein, 9 aa, Homo Sapiens
GLLADFPLD

SEQ ID NO: 1278052 - protein, 9 aa, Homo Sapiens
KFWSLPLPS

SEQ ID NO: 1278053 - protein, 9 aa, Homo Sapiens
IGGWEDKPF

SEQ ID NO: 1278054 - protein, 9 aa, Homo Sapiens
LDSVMNSKN

SEQ ID NO: 1278055 - protein, 9 aa, Homo Sapiens
TGDRPEARR

SEQ ID NO: 1278056 - protein, 9 aa, Homo Sapiens
PEIQNNQKT

SEQ ID NO: 1278057 - protein, 9 aa, Homo Sapiens
SASTGTLQR

SEQ ID NO: 1278058 - protein, 9 aa, Homo Sapiens
SSSSSLGVL

SEQ ID NO: 1278059 - protein, 9 aa, Homo Sapiens
VLQGPSRPP

SEQ ID NO: 1278060 - protein, 9 aa, Homo Sapiens
LHARRVHLH

SEQ ID NO: 1278061 - protein, 9 aa, Homo Sapiens
PSNRIRLHR

SEQ ID NO: 1278062 - protein, 9 aa, Homo Sapiens
ARRVHLHLF

SEQ ID NO: 1278063 - protein, 9 aa, Homo Sapiens
HSAVQTKVQ

SEQ ID NO: 1278064 - protein, 9 aa, Homo Sapiens
TRVAVVQHA

SEQ ID NO: 1278065 - protein, 9 aa, Homo Sapiens
PGAGGQALT

SEQ ID NO: 1278066 - protein, 9 aa, Homo Sapiens
GKGPQMPSS

SEQ ID NO: 1278067 - protein, 9 aa, Homo Sapiens
WRNVSTRPS

SEQ ID NO: 1278068 - protein, 9 aa, Homo Sapiens
SKGRPPRCP

SEQ ID NO: 1278069 - protein, 9 aa, Homo Sapiens
TKVQYELVH

SEQ ID NO: 1278070 - protein, 9 aa, Homo Sapiens
GDHVLPVQG

SEQ ID NO: 1278071 - protein, 9 aa, Homo Sapiens
AAAVRTLSP

SEQ ID NO: 1278072 - protein, 9 aa, Homo Sapiens
EDDGDHVED

SEQ ID NO: 1278073 - protein, 9 aa, Homo Sapiens
GSSSSRRPG

SEQ ID NO: 1278074 - protein, 9 aa, Homo Sapiens
WEDKPFKGD

SEQ ID NO: 1278075 - protein, 9 aa, Homo Sapiens
PLPGPHLQQ

SEQ ID NO: 1278076 - protein, 9 aa, Homo Sapiens
GLHVNWRVE

SEQ ID NO: 1278077 - protein, 9 aa, Homo Sapiens
TTILISACI

SEQ ID NO: 1278078 - protein, 9 aa, Homo Sapiens
ICGCGFVMA

SEQ ID NO: 1278079 - protein, 9 aa, Homo Sapiens
SENKLNEAS

SEQ ID NO: 1278080 - protein, 9 aa, Homo Sapiens
TPPPLILWP

SEQ ID NO: 1278081 - protein, 9 aa, Homo Sapiens
CCQEWLDYQ

SEQ ID NO: 1278082 - protein, 9 aa, Homo Sapiens
CCDNVVLIW

SEQ ID NO: 1278083 - protein, 9 aa, Homo Sapiens
KSSCPGEAP

SEQ ID NO: 1278084 - protein, 9 aa, Homo Sapiens
SPPSPQNRS

SEQ ID NO: 1278085 - protein, 9 aa, Homo Sapiens
DEKSDSDGG

SEQ ID NO: 1278086 - protein, 9 aa, Homo Sapiens
TSSTPWISS

SEQ ID NO: 1278087 - protein, 9 aa, Homo Sapiens
SSSEGGGME

SEQ ID NO: 1278088 - protein, 9 aa, Homo Sapiens
KQRTAKKAD

SEQ ID NO: 1278089 - protein, 9 aa, Homo Sapiens
RRLRACRAG

SEQ ID NO: 1278090 - protein, 9 aa, Homo Sapiens
LPGGELLHP

SEQ ID NO: 1278091 - protein, 9 aa, Homo Sapiens
ATSRKSIRE

SEQ ID NO: 1278092 - protein, 9 aa, Homo Sapiens
PGASCGGSR

SEQ ID NO: 1278093 - protein, 9 aa, Homo Sapiens
TLQRSKPAK

SEQ ID NO: 1278094 - protein, 9 aa, Homo Sapiens
CRGKGSQGF

SEQ ID NO: 1278095 - protein, 9 aa, Homo Sapiens
SLPCPGGRT

SEQ ID NO: 1278096 - protein, 9 aa, Homo Sapiens
FLRAFLRTV

SEQ ID NO: 1278097 - protein, 9 aa, Homo Sapiens
ISVDSECID

SEQ ID NO: 1278098 - protein, 9 aa, Homo Sapiens
WLDYQICWA

SEQ ID NO: 1278099 - protein, 9 aa, Homo Sapiens
PYERDHTVV

SEQ ID NO: 1278100 - protein, 9 aa, Homo Sapiens
EGRPRSHSA

SEQ ID NO: 1278101 - protein, 9 aa, Homo Sapiens
KMSLIDDFS

SEQ ID NO: 1278102 - protein, 9 aa, Homo Sapiens
HRCGRPEVC

SEQ ID NO: 1278103 - protein, 9 aa, Homo Sapiens
RHHGLGVHL

SEQ ID NO: 1278104 - protein, 9 aa, Homo Sapiens
HSEVRVLGD

SEQ ID NO: 1278105 - protein, 9 aa, Homo Sapiens
KKILRSFMK

SEQ ID NO: 1278106 - protein, 9 aa, Homo Sapiens
FHHCRLTYV

SEQ ID NO: 1278107 - protein, 9 aa, Homo Sapiens
QDSRKRKEG

SEQ ID NO: 1278108 - protein, 9 aa, Homo Sapiens
LSISRPTSR

SEQ ID NO: 1278109 - protein, 9 aa, Homo Sapiens
PRQLPQMSK

SEQ ID NO: 1278110 - protein, 9 aa, Homo Sapiens
FCQGFGPFR

SEQ ID NO: 1278111 - protein, 9 aa, Homo Sapiens
TLGKSHTHG

SEQ ID NO: 1278112 - protein, 9 aa, Homo Sapiens
WRIGGGTPL

SEQ ID NO: 1278113 - protein, 9 aa, Homo Sapiens
KPFKGDLKI

SEQ ID NO: 1278114 - protein, 9 aa, Homo Sapiens
RGTCQYSVS

SEQ ID NO: 1278115 - protein, 9 aa, Homo Sapiens
LSRKIQEQR

SEQ ID NO: 1278116 - protein, 9 aa, Homo Sapiens
RKTWQRRLR

SEQ ID NO: 1278117 - protein, 9 aa, Homo Sapiens
EPEEEGGDD

SEQ ID NO: 1278118 - protein, 9 aa, Homo Sapiens
HVRARMQPR

SEQ ID NO: 1278119 - protein, 9 aa, Homo Sapiens
AAAGLFSCL

SEQ ID NO: 1278120 - protein, 9 aa, Homo Sapiens
VVYKLVPGL

SEQ ID NO: 1278121 - protein, 9 aa, Homo Sapiens
SPPTLSVSL

SEQ ID NO: 1278122 - protein, 9 aa, Homo Sapiens
AANWTVRCE

SEQ ID NO: 1278123 - protein, 9 aa, Homo Sapiens
QDTSGHRGS

SEQ ID NO: 1278124 - protein, 9 aa, Homo Sapiens
APGPHPKPP

SEQ ID NO: 1278125 - protein, 9 aa, Homo Sapiens
AGLFSCLGT

SEQ ID NO: 1278126 - protein, 9 aa, Homo Sapiens
WLGWARFLH

SEQ ID NO: 1278127 - protein, 9 aa, Homo Sapiens
ELAVAKSWI

SEQ ID NO: 1278128 - protein, 9 aa, Homo Sapiens
EQTHPRLKE

SEQ ID NO: 1278129 - protein, 9 aa, Homo Sapiens
RHYRIHTVE

SEQ ID NO: 1278130 - protein, 9 aa, Homo Sapiens
QPARQHPTA

SEQ ID NO: 1278131 - protein, 9 aa, Homo Sapiens
PSPASALRR

SEQ ID NO: 1278132 - protein, 9 aa, Homo Sapiens
GDIFCQGFG

SEQ ID NO: 1278133 - protein, 9 aa, Homo Sapiens
ECVGNYIVL

SEQ ID NO: 1278134 - protein, 9 aa, Homo Sapiens
AKVLEQPMV

SEQ ID NO: 1278135 - protein, 9 aa, Homo Sapiens
QEHPGLGGE

SEQ ID NO: 1278136 - protein, 9 aa, Homo Sapiens
SHTNSSARH

SEQ ID NO: 1278137 - protein, 9 aa, Homo Sapiens
AVAKSWIIQ

SEQ ID NO: 1278138 - protein, 9 aa, Homo Sapiens
IMGDIFCQG

SEQ ID NO: 1278139 - protein, 9 aa, Homo Sapiens
VCGSMHQGV

SEQ ID NO: 1278140 - protein, 9 aa, Homo Sapiens
RPPRCPGHW

SEQ ID NO: 1278141 - protein, 9 aa, Homo Sapiens
RLPPGSKGR

SEQ ID NO: 1278142 - protein, 9 aa, Homo Sapiens
CHWNGKKML

SEQ ID NO: 1278143 - protein, 9 aa, Homo Sapiens
QEWLDYQIC

SEQ ID NO: 1278144 - protein, 9 aa, Homo Sapiens
TVCKPDETG

SEQ ID NO: 1278145 - protein, 9 aa, Homo Sapiens
GPLSPPLPW

SEQ ID NO: 1278146 - protein, 9 aa, Homo Sapiens
HHSLKMRNL

SEQ ID NO: 1278147 - protein, 9 aa, Homo Sapiens
LLAPPGVGA

SEQ ID NO: 1278148 - protein, 9 aa, Homo Sapiens
RFREQRRRS

SEQ ID NO: 1278149 - protein, 9 aa, Homo Sapiens
NQAANDIVS

SEQ ID NO: 1278150 - protein, 9 aa, Homo Sapiens
QPPSNRIRL

SEQ ID NO: 1278151 - protein, 9 aa, Homo Sapiens
YHCLLACPQ

SEQ ID NO: 1278152 - protein, 9 aa, Homo Sapiens
VALKKSADI

SEQ ID NO: 1278153 - protein, 9 aa, Homo Sapiens
SRKSIREAA

SEQ ID NO: 1278154 - protein, 9 aa, Homo Sapiens
LRVILQASA

SEQ ID NO: 1278155 - protein, 9 aa, Homo Sapiens
KIRSGEALG

SEQ ID NO: 1278156 - protein, 9 aa, Homo Sapiens
KINADPVPL

SEQ ID NO: 1278157 - protein, 9 aa, Homo Sapiens
NEEQALSAL

SEQ ID NO: 1278158 - protein, 9 aa, Homo Sapiens
GRIWRIGRR

SEQ ID NO: 1278159 - protein, 9 aa, Homo Sapiens
RSRTNGSVT

SEQ ID NO: 1278160 - protein, 9 aa, Homo Sapiens
QGAQRREAG

SEQ ID NO: 1278161 - protein, 9 aa, Homo Sapiens
PLPKPRSLW

SEQ ID NO: 1278162 - protein, 9 aa, Homo Sapiens
GEEAVQSVH

SEQ ID NO: 1278163 - protein, 9 aa, Homo Sapiens
ISVLQGPSR

SEQ ID NO: 1278164 - protein, 9 aa, Homo Sapiens
AAQTRRSYP

SEQ ID NO: 1278165 - protein, 9 aa, Homo Sapiens
RRRNLAKLV

SEQ ID NO: 1278166 - protein, 9 aa, Homo Sapiens
LVQLVPGED

SEQ ID NO: 1278167 - protein, 9 aa, Homo Sapiens
LPMKIPRQL

SEQ ID NO: 1278168 - protein, 9 aa, Homo Sapiens
HSLKKVVVV

SEQ ID NO: 1278169 - protein, 9 aa, Homo Sapiens
RFLNFCGLD

SEQ ID NO: 1278170 - protein, 9 aa, Homo Sapiens
EHPTLEPAT

SEQ ID NO: 1278171 - protein, 9 aa, Homo Sapiens
FPISFIGWG

SEQ ID NO: 1278172 - protein, 9 aa, Homo Sapiens
AAYHHPDFP

SEQ ID NO: 1278173 - protein, 9 aa, Homo Sapiens
VGLAASFAV

SEQ ID NO: 1278174 - protein, 9 aa, Homo Sapiens
YPVVPSSQV

SEQ ID NO: 1278175 - protein, 9 aa, Homo Sapiens
SDSDGGDLD

SEQ ID NO: 1278176 - protein, 9 aa, Homo Sapiens
LLACPQFVL

SEQ ID NO: 1278177 - protein, 9 aa, Homo Sapiens
WISSKTGSI

SEQ ID NO: 1278178 - protein, 9 aa, Homo Sapiens
KKRGKSQGG

SEQ ID NO: 1278179 - protein, 9 aa, Homo Sapiens
KPPTPERGA

SEQ ID NO: 1278180 - protein, 9 aa, Homo Sapiens
NGQHLPRDH

SEQ ID NO: 1278181 - protein, 9 aa, Homo Sapiens
PCQRLPRVE

SEQ ID NO: 1278182 - protein, 9 aa, Homo Sapiens
QAQRLQEDL

SEQ ID NO: 1278183 - protein, 9 aa, Homo Sapiens
DPGHDIIED

SEQ ID NO: 1278184 - protein, 9 aa, Homo Sapiens
ERRHTLPSQ

SEQ ID NO: 1278185 - protein, 9 aa, Homo Sapiens
RLPSVIPTR

SEQ ID NO: 1278186 - protein, 9 aa, Homo Sapiens
GLAMAAGIH

SEQ ID NO: 1278187 - protein, 9 aa, Homo Sapiens
FRDSPFGGA

SEQ ID NO: 1278188 - protein, 9 aa, Homo Sapiens
GWDTGTENK

SEQ ID NO: 1278189 - protein, 9 aa, Homo Sapiens
EAAALLVDY

SEQ ID NO: 1278190 - protein, 9 aa, Homo Sapiens
REDKRERTA

SEQ ID NO: 1278191 - protein, 9 aa, Homo Sapiens
TDRSSHNDS

SEQ ID NO: 1278192 - protein, 9 aa, Homo Sapiens
SYPEFQSSS

SEQ ID NO: 1278193 - protein, 9 aa, Homo Sapiens
WQTVTRNRG

SEQ ID NO: 1278194 - protein, 9 aa, Homo Sapiens
NGQPLICVV

SEQ ID NO: 1278195 - protein, 9 aa, Homo Sapiens
PLLKKRKFD

SEQ ID NO: 1278196 - protein, 9 aa, Homo Sapiens
GQTQLCHPP

SEQ ID NO: 1278197 - protein, 9 aa, Homo Sapiens
SKGKKVKSS

SEQ ID NO: 1278198 - protein, 9 aa, Homo Sapiens
GFQAPVKDD

SEQ ID NO: 1278199 - protein, 9 aa, Homo Sapiens
YLQPGPVPC

SEQ ID NO: 1278200 - protein, 9 aa, Homo Sapiens
RACSFHSLK

SEQ ID NO: 1278201 - protein, 9 aa, Homo Sapiens
EAVVTEDMD

SEQ ID NO: 1278202 - protein, 9 aa, Homo Sapiens
RSMNGQPLI

SEQ ID NO: 1278203 - protein, 9 aa, Homo Sapiens
QMSKVKVMP

SEQ ID NO: 1278204 - protein, 9 aa, Homo Sapiens
LDKQLALIA

SEQ ID NO: 1278205 - protein, 9 aa, Homo Sapiens
SPRAQSCPL

SEQ ID NO: 1278206 - protein, 9 aa, Homo Sapiens
GRPPRCPGH

SEQ ID NO: 1278207 - protein, 9 aa, Homo Sapiens
ACSFHSLKK

SEQ ID NO: 1278208 - protein, 9 aa, Homo Sapiens
YPWQCGSDH

SEQ ID NO: 1278209 - protein, 9 aa, Homo Sapiens
PFTCPICGC

SEQ ID NO: 1278210 - protein, 9 aa, Homo Sapiens
LAKLVQLVP

SEQ ID NO: 1278211 - protein, 9 aa, Homo Sapiens
FQAAVTFRR

SEQ ID NO: 1278212 - protein, 9 aa, Homo Sapiens
GRASRKTWQ

SEQ ID NO: 1278213 - protein, 9 aa, Homo Sapiens
TQEFILLVF

SEQ ID NO: 1278214 - protein, 9 aa, Homo Sapiens
RIRLHRLIL

SEQ ID NO: 1278215 - protein, 9 aa, Homo Sapiens
MAAGIHSLA

SEQ ID NO: 1278216 - protein, 9 aa, Homo Sapiens
KEKKPRKKF

SEQ ID NO: 1278217 - protein, 9 aa, Homo Sapiens
HFTRVAVVQ

SEQ ID NO: 1278218 - protein, 9 aa, Homo Sapiens
YYRPVDTGN

SEQ ID NO: 1278219 - protein, 9 aa, Homo Sapiens
EKIMIVKGK

SEQ ID NO: 1278220 - protein, 9 aa, Homo Sapiens
SKGWQTMWC

SEQ ID NO: 1278221 - protein, 9 aa, Homo Sapiens
QNRSPTPSE

SEQ ID NO: 1278222 - protein, 9 aa, Homo Sapiens
EFRVDQSLA

SEQ ID NO: 1278223 - protein, 9 aa, Homo Sapiens
LLHSLNMAI

SEQ ID NO: 1278224 - protein, 9 aa, Homo Sapiens
GRPGRRGGA

SEQ ID NO: 1278225 - protein, 9 aa, Homo Sapiens
AVNQKNTTA

SEQ ID NO: 1278226 - protein, 9 aa, Homo Sapiens
PVDGEALEL

SEQ ID NO: 1278227 - protein, 9 aa, Homo Sapiens
VAIVVKFFL

SEQ ID NO: 1278228 - protein, 9 aa, Homo Sapiens
PDTIPPKRV

SEQ ID NO: 1278229 - protein, 9 aa, Homo Sapiens
KRERTATEE

SEQ ID NO: 1278230 - protein, 9 aa, Homo Sapiens
RTPPQEADA

SEQ ID NO: 1278231 - protein, 9 aa, Homo Sapiens
FDLNRPSFD

SEQ ID NO: 1278232 - protein, 9 aa, Homo Sapiens
WCPPGPDLL

SEQ ID NO: 1278233 - protein, 9 aa, Homo Sapiens
MVVQSVGTD

SEQ ID NO: 1278234 - protein, 9 aa, Homo Sapiens
PRACTRLQR

SEQ ID NO: 1278235 - protein, 9 aa, Homo Sapiens
SCTEASRDP

SEQ ID NO: 1278236 - protein, 9 aa, Homo Sapiens
TLEYKTTNA

SEQ ID NO: 1278237 - protein, 9 aa, Homo Sapiens
PEGLPGSLE

SEQ ID NO: 1278238 - protein, 9 aa, Homo Sapiens
VSRDLPIMI

SEQ ID NO: 1278239 - protein, 9 aa, Homo Sapiens
TNLALSVLN

SEQ ID NO: 1278240 - protein, 9 aa, Homo Sapiens
YSSVMQPFS

SEQ ID NO: 1278241 - protein, 9 aa, Homo Sapiens
KILMGLIPY

SEQ ID NO: 1278242 - protein, 9 aa, Homo Sapiens
SRACSSSAL

SEQ ID NO: 1278243 - protein, 9 aa, Homo Sapiens
EAANWTVRC

SEQ ID NO: 1278244 - protein, 9 aa, Homo Sapiens
RQTATRLLK

SEQ ID NO: 1278245 - protein, 9 aa, Homo Sapiens
FYKPVDGEA

SEQ ID NO: 1278246 - protein, 9 aa, Homo Sapiens
WPFYKPVDG

SEQ ID NO: 1278247 - protein, 9 aa, Homo Sapiens
LECVGNYIV

SEQ ID NO: 1278248 - protein, 9 aa, Homo Sapiens
TILISACIF

SEQ ID NO: 1278249 - protein, 9 aa, Homo Sapiens
KLLHARRVH

SEQ ID NO: 1278250 - protein, 9 aa, Homo Sapiens
QKENQIYSA

SEQ ID NO: 1278251 - protein, 9 aa, Homo Sapiens
MSPSKPQSS

SEQ ID NO: 1278252 - protein, 9 aa, Homo Sapiens
RARMQPRVL

SEQ ID NO: 1278253 - protein, 9 aa, Homo Sapiens
FSCPHSRAC

SEQ ID NO: 1278254 - protein, 9 aa, Homo Sapiens
PCCCQEWLD

SEQ ID NO: 1278255 - protein, 9 aa, Homo Sapiens
RTVAFWTGT

SEQ ID NO: 1278256 - protein, 9 aa, Homo Sapiens
TGMVRPDEP

SEQ ID NO: 1278257 - protein, 9 aa, Homo Sapiens
RLHRLILPM

SEQ ID NO: 1278258 - protein, 9 aa, Homo Sapiens
MQPGVSIAS

SEQ ID NO: 1278259 - protein, 9 aa, Homo Sapiens
FGKGPQMPS

SEQ ID NO: 1278260 - protein, 9 aa, Homo Sapiens
NQQFTRLVE

SEQ ID NO: 1278261 - protein, 9 aa, Homo Sapiens
RFRSVRSRL

SEQ ID NO: 1278262 - protein, 9 aa, Homo Sapiens
ILPMKIPRQ

SEQ ID NO: 1278263 - protein, 9 aa, Homo Sapiens
FNFPAMTPL

SEQ ID NO: 1278264 - protein, 9 aa, Homo Sapiens
LVANIHHVS

SEQ ID NO: 1278265 - protein, 9 aa, Homo Sapiens
IITILRIPS

SEQ ID NO: 1278266 - protein, 9 aa, Homo Sapiens
NLLVANIHH

SEQ ID NO: 1278267 - protein, 9 aa, Homo Sapiens
LRATQGCTA

SEQ ID NO: 1278268 - protein, 9 aa, Homo Sapiens
VCILLAAVA

SEQ ID NO: 1278269 - protein, 9 aa, Homo Sapiens
KLNEASRAH

SEQ ID NO: 1278270 - protein, 9 aa, Homo Sapiens
ASRDGSDSH

SEQ ID NO: 1278271 - protein, 9 aa, Homo Sapiens
LYAVLFGER

SEQ ID NO: 1278272 - protein, 9 aa, Homo Sapiens
VGYRESAAF

SEQ ID NO: 1278273 - protein, 9 aa, Homo Sapiens
MSGLHISPN

SEQ ID NO: 1278274 - protein, 9 aa, Homo Sapiens
PELQHSQPP

SEQ ID NO: 1278275 - protein, 9 aa, Homo Sapiens
VEILWRLLV

SEQ ID NO: 1278276 - protein, 9 aa, Homo Sapiens
QGAFYYNHA

SEQ ID NO: 1278277 - protein, 9 aa, Homo Sapiens
LLRENFSHV

SEQ ID NO: 1278278 - protein, 9 aa, Homo Sapiens
STECRIGSS

SEQ ID NO: 1278279 - protein, 9 aa, Homo Sapiens
SASLHPASG

SEQ ID NO: 1278280 - protein, 9 aa, Homo Sapiens
AQLPCWGRH

SEQ ID NO: 1278281 - protein, 9 aa, Homo Sapiens
FPAWSTVVQ

SEQ ID NO: 1278282 - protein, 9 aa, Homo Sapiens
NSCCPSCCE

SEQ ID NO: 1278283 - protein, 9 aa, Homo Sapiens
IVEVEQDKM

SEQ ID NO: 1278284 - protein, 9 aa, Homo Sapiens
TCPICGCGF

SEQ ID NO: 1278285 - protein, 9 aa, Homo Sapiens
KEGLHEGLP

SEQ ID NO: 1278286 - protein, 9 aa, Homo Sapiens
PNYDVSVYS

SEQ ID NO: 1278287 - protein, 9 aa, Homo Sapiens
STLVLDVSS

SEQ ID NO: 1278288 - protein, 9 aa, Homo Sapiens
LEYDRKEAL

SEQ ID NO: 1278289 - protein, 9 aa, Homo Sapiens
RCRVIVPEK

SEQ ID NO: 1278290 - protein, 9 aa, Homo Sapiens
TPKKKRSAF

SEQ ID NO: 1278291 - protein, 9 aa, Homo Sapiens
IKQRKKKVL

SEQ ID NO: 1278292 - protein, 9 aa, Homo Sapiens
NSKNDELNG

SEQ ID NO: 1278293 - protein, 9 aa, Homo Sapiens
PVPCVIPTR

SEQ ID NO: 1278294 - protein, 9 aa, Homo Sapiens
GYVDDSRNI

SEQ ID NO: 1278295 - protein, 9 aa, Homo Sapiens
RPIVYQEYP

SEQ ID NO: 1278296 - protein, 9 aa, Homo Sapiens
QTMWCPPGP

SEQ ID NO: 1278297 - protein, 9 aa, Homo Sapiens
WSRELLDRC

SEQ ID NO: 1278298 - protein, 9 aa, Homo Sapiens
THWDPEDAC

SEQ ID NO: 1278299 - protein, 9 aa, Homo Sapiens
HKDIWNVTG

SEQ ID NO: 1278300 - protein, 9 aa, Homo Sapiens
FSHVPSPDM

SEQ ID NO: 1278301 - protein, 9 aa, Homo Sapiens
LTGIYGCHW

SEQ ID NO: 1278302 - protein, 9 aa, Homo Sapiens
PECYLGLPG

SEQ ID NO: 1278303 - protein, 9 aa, Homo Sapiens
IPTRTARWP

SEQ ID NO: 1278304 - protein, 9 aa, Homo Sapiens
DVSVYSAAS

SEQ ID NO: 1278305 - protein, 9 aa, Homo Sapiens
GHSMGQPSD

SEQ ID NO: 1278306 - protein, 9 aa, Homo Sapiens
KVMPHHSLK

SEQ ID NO: 1278307 - protein, 9 aa, Homo Sapiens
EFEISHLQN

SEQ ID NO: 1278308 - protein, 9 aa, Homo Sapiens
GRRGGAGLC

SEQ ID NO: 1278309 - protein, 9 aa, Homo Sapiens
PCAQDPLAA

SEQ ID NO: 1278310 - protein, 9 aa, Homo Sapiens
KLTFEEPER

SEQ ID NO: 1278311 - protein, 9 aa, Homo Sapiens
LAMAAGIHS

SEQ ID NO: 1278312 - protein, 9 aa, Homo Sapiens
ALYAVLFGE

SEQ ID NO: 1278313 - protein, 9 aa, Homo Sapiens
WPLENMDGI

SEQ ID NO: 1278314 - protein, 9 aa, Homo Sapiens
SGSVGRLCP

SEQ ID NO: 1278315 - protein, 9 aa, Homo Sapiens
YIFYKDFQF

SEQ ID NO: 1278316 - protein, 9 aa, Homo Sapiens
MKKYRNYRM

SEQ ID NO: 1278317 - protein, 9 aa, Homo Sapiens
QAANDIVSP

SEQ ID NO: 1278318 - protein, 9 aa, Homo Sapiens
SRKRKEGSR

SEQ ID NO: 1278319 - protein, 9 aa, Homo Sapiens
VSRMHCVEK

SEQ ID NO: 1278320 - protein, 9 aa, Homo Sapiens
QSYRAEISS

SEQ ID NO: 1278321 - protein, 9 aa, Homo Sapiens
LPSVIPTRT

SEQ ID NO: 1278322 - protein, 9 aa, Homo Sapiens
AWCRTTLPA

SEQ ID NO: 1278323 - protein, 9 aa, Homo Sapiens
GVAALAVVA

SEQ ID NO: 1278324 - protein, 9 aa, Homo Sapiens
LRAKGHAGT

SEQ ID NO: 1278325 - protein, 9 aa, Homo Sapiens
DTLCQNCPR

SEQ ID NO: 1278326 - protein, 9 aa, Homo Sapiens
CNECTKLII

SEQ ID NO: 1278327 - protein, 9 aa, Homo Sapiens
SRKIQEQRK

SEQ ID NO: 1278328 - protein, 9 aa, Homo Sapiens
PARAGLHPC

SEQ ID NO: 1278329 - protein, 9 aa, Homo Sapiens
HLCPPQKSS

SEQ ID NO: 1278330 - protein, 9 aa, Homo Sapiens
MQNIPGGKH

SEQ ID NO: 1278331 - protein, 9 aa, Homo Sapiens
PARQHPTAH

SEQ ID NO: 1278332 - protein, 9 aa, Homo Sapiens
HSRYKKKKH

SEQ ID NO: 1278333 - protein, 9 aa, Homo Sapiens
AAEGQKLLH

SEQ ID NO: 1278334 - protein, 9 aa, Homo Sapiens
PPARKQNVC

SEQ ID NO: 1278335 - protein, 9 aa, Homo Sapiens
PKQLEAVCS

SEQ ID NO: 1278336 - protein, 9 aa, Homo Sapiens
LFTDDCRYV

SEQ ID NO: 1278337 - protein, 9 aa, Homo Sapiens
RLWCWHKSR

SEQ ID NO: 1278338 - protein, 9 aa, Homo Sapiens
SLWYTTHYP

SEQ ID NO: 1278339 - protein, 9 aa, Homo Sapiens
PFEELPSEH

SEQ ID NO: 1278340 - protein, 9 aa, Homo Sapiens
FEELPSEHP

SEQ ID NO: 1278341 - protein, 9 aa, Homo Sapiens
SCCLPGLTH

SEQ ID NO: 1278342 - protein, 9 aa, Homo Sapiens
GGEAKTWLL

SEQ ID NO: 1278343 - protein, 9 aa, Homo Sapiens
ERFTVTYML

SEQ ID NO: 1278344 - protein, 9 aa, Homo Sapiens
VKNDPGHDI

SEQ ID NO: 1278345 - protein, 9 aa, Homo Sapiens
TCGLCKVAR

SEQ ID NO: 1278346 - protein, 9 aa, Homo Sapiens
EGLPGSLEY

SEQ ID NO: 1278347 - protein, 9 aa, Homo Sapiens
RNITVQKNK

SEQ ID NO: 1278348 - protein, 9 aa, Homo Sapiens
LRNEYFFDL

SEQ ID NO: 1278349 - protein, 9 aa, Homo Sapiens
WKRTQQRPP

SEQ ID NO: 1278350 - protein, 9 aa, Homo Sapiens
RTNGSVTTS

SEQ ID NO: 1278351 - protein, 9 aa, Homo Sapiens
SVTTSATEA

SEQ ID NO: 1278352 - protein, 9 aa, Homo Sapiens
LHPASSSSS

SEQ ID NO: 1278353 - protein, 9 aa, Homo Sapiens
LPARGFGEV

SEQ ID NO: 1278354 - protein, 9 aa, Homo Sapiens
LEYKTTNAD

SEQ ID NO: 1278355 - protein, 9 aa, Homo Sapiens
LHSLNMAIA

SEQ ID NO: 1278356 - protein, 9 aa, Homo Sapiens
ECLHEATLI

SEQ ID NO: 1278357 - protein, 9 aa, Homo Sapiens
GQVHGPACR

SEQ ID NO: 1278358 - protein, 9 aa, Homo Sapiens
APGPLSPPL

SEQ ID NO: 1278359 - protein, 9 aa, Homo Sapiens
SWSCSGLCS

SEQ ID NO: 1278360 - protein, 9 aa, Homo Sapiens
PLENMDGIH

SEQ ID NO: 1278361 - protein, 9 aa, Homo Sapiens
HILSEQHRN

SEQ ID NO: 1278362 - protein, 9 aa, Homo Sapiens
RAKGHAGTG

SEQ ID NO: 1278363 - protein, 9 aa, Homo Sapiens
PARTPPQEA

SEQ ID NO: 1278364 - protein, 9 aa, Homo Sapiens
LRLQSLLSL

SEQ ID NO: 1278365 - protein, 9 aa, Homo Sapiens
VLYLQCLSK

SEQ ID NO: 1278366 - protein, 9 aa, Homo Sapiens
KKFPNNWEL

SEQ ID NO: 1278367 - protein, 9 aa, Homo Sapiens
DGDHVEDDG

SEQ ID NO: 1278368 - protein, 9 aa, Homo Sapiens
MSLACSITV

SEQ ID NO: 1278369 - protein, 9 aa, Homo Sapiens
IADGTLAIP

SEQ ID NO: 1278370 - protein, 9 aa, Homo Sapiens
RKPGLPCAQ

SEQ ID NO: 1278371 - protein, 9 aa, Homo Sapiens
HDIIEDMWL

SEQ ID NO: 1278372 - protein, 9 aa, Homo Sapiens
EYPVVPSSQ

SEQ ID NO: 1278373 - protein, 9 aa, Homo Sapiens
HMKSTKPSM

SEQ ID NO: 1278374 - protein, 9 aa, Homo Sapiens
FKGQSNTRC

SEQ ID NO: 1278375 - protein, 9 aa, Homo Sapiens
GLPQVQWAE

SEQ ID NO: 1278376 - protein, 9 aa, Homo Sapiens
PSAAGGTLA

SEQ ID NO: 1278377 - protein, 9 aa, Homo Sapiens
GGKFAPFFV

SEQ ID NO: 1278378 - protein, 9 aa, Homo Sapiens
GSRPGWKRT

SEQ ID NO: 1278379 - protein, 9 aa, Homo Sapiens
AKLVQLVPG

SEQ ID NO: 1278380 - protein, 9 aa, Homo Sapiens
SLKMRNLHF

SEQ ID NO: 1278381 - protein, 9 aa, Homo Sapiens
RKSIREAAS

SEQ ID NO: 1278382 - protein, 9 aa, Homo Sapiens
HPAGPHPRR

SEQ ID NO: 1278383 - protein, 9 aa, Homo Sapiens
CPHSWSCSG

SEQ ID NO: 1278384 - protein, 9 aa, Homo Sapiens
SRAQRANLL

SEQ ID NO: 1278385 - protein, 9 aa, Homo Sapiens
SPTSTGPPP

SEQ ID NO: 1278386 - protein, 9 aa, Homo Sapiens
ARGFGEVVE

SEQ ID NO: 1278387 - protein, 9 aa, Homo Sapiens
RNGRIWRIG

SEQ ID NO: 1278388 - protein, 9 aa, Homo Sapiens
RTGTVMIPD

SEQ ID NO: 1278389 - protein, 9 aa, Homo Sapiens
TVMTFLRAF

SEQ ID NO: 1278390 - protein, 9 aa, Homo Sapiens
SLTHLFLVF

SEQ ID NO: 1278391 - protein, 9 aa, Homo Sapiens
VGQTQLCHP

SEQ ID NO: 1278392 - protein, 9 aa, Homo Sapiens
VHSILLRGF

SEQ ID NO: 1278393 - protein, 9 aa, Homo Sapiens
NTGNFQPPV

SEQ ID NO: 1278394 - protein, 9 aa, Homo Sapiens
QVQWAEDSV

SEQ ID NO: 1278395 - protein, 9 aa, Homo Sapiens
MMEGESYFT

SEQ ID NO: 1278396 - protein, 9 aa, Homo Sapiens
IQNIHSVSK

SEQ ID NO: 1278397 - protein, 9 aa, Homo Sapiens
TPLCSPPSP

SEQ ID NO: 1278398 - protein, 9 aa, Homo Sapiens
DKRERTATE

SEQ ID NO: 1278399 - protein, 9 aa, Homo Sapiens
SNRKPLIVL

SEQ ID NO: 1278400 - protein, 9 aa, Homo Sapiens
CGCGFVMAA

SEQ ID NO: 1278401 - protein, 9 aa, Homo Sapiens
SMIQMKTHS

SEQ ID NO: 1278402 - protein, 9 aa, Homo Sapiens
GKPLEPNNP

SEQ ID NO: 1278403 - protein, 9 aa, Homo Sapiens
VDEINGYCC

SEQ ID NO: 1278404 - protein, 9 aa, Homo Sapiens
LQENGKWLR

SEQ ID NO: 1278405 - protein, 9 aa, Homo Sapiens
SSSRFQATC

SEQ ID NO: 1278406 - protein, 9 aa, Homo Sapiens
HSLNMAIAA

SEQ ID NO: 1278407 - protein, 9 aa, Homo Sapiens
RGRLSPMPV

SEQ ID NO: 1278408 - protein, 9 aa, Homo Sapiens
GRILLQRNL

SEQ ID NO: 1278409 - protein, 9 aa, Homo Sapiens
AGPMEESPP

SEQ ID NO: 1278410 - protein, 9 aa, Homo Sapiens
DSMVGGAYG

SEQ ID NO: 1278411 - protein, 9 aa, Homo Sapiens
RDPAKMRRR

SEQ ID NO: 1278412 - protein, 9 aa, Homo Sapiens
PTKKRGKSQ

SEQ ID NO: 1278413 - protein, 9 aa, Homo Sapiens
EGRILARGR

SEQ ID NO: 1278414 - protein, 9 aa, Homo Sapiens
LHQRGSGQF

SEQ ID NO: 1278415 - protein, 9 aa, Homo Sapiens
ADPVPLPNI

SEQ ID NO: 1278416 - protein, 9 aa, Homo Sapiens
GIHSLASRD

SEQ ID NO: 1278417 - protein, 9 aa, Homo Sapiens
MVHSILLRG

SEQ ID NO: 1278418 - protein, 9 aa, Homo Sapiens
RQAQRLEGE

SEQ ID NO: 1278419 - protein, 9 aa, Homo Sapiens
EGDNSHLRS

SEQ ID NO: 1278420 - protein, 9 aa, Homo Sapiens
SFMKLYHSL

SEQ ID NO: 1278421 - protein, 9 aa, Homo Sapiens
AKGEDGEKE

SEQ ID NO: 1278422 - protein, 9 aa, Homo Sapiens
SACATKGRI

SEQ ID NO: 1278423 - protein, 9 aa, Homo Sapiens
RNVLLSACC

SEQ ID NO: 1278424 - protein, 9 aa, Homo Sapiens
PPPLILWPQ

SEQ ID NO: 1278425 - protein, 9 aa, Homo Sapiens
SSTTNGHQN

SEQ ID NO: 1278426 - protein, 9 aa, Homo Sapiens
FCNLKIDGT

SEQ ID NO: 1278427 - protein, 9 aa, Homo Sapiens
RRHTLPSQG

SEQ ID NO: 1278428 - protein, 9 aa, Homo Sapiens
YEMNGQHLP

SEQ ID NO: 1278429 - protein, 9 aa, Homo Sapiens
KFPNNWELW

SEQ ID NO: 1278430 - protein, 9 aa, Homo Sapiens
LIVLNKGLE

SEQ ID NO: 1278431 - protein, 9 aa, Homo Sapiens
VRKPKFARH

SEQ ID NO: 1278432 - protein, 9 aa, Homo Sapiens
GIRKRASAQ

SEQ ID NO: 1278433 - protein, 9 aa, Homo Sapiens
ASVVTWGTL

SEQ ID NO: 1278434 - protein, 9 aa, Homo Sapiens
QVPPPCCRF

SEQ ID NO: 1278435 - protein, 9 aa, Homo Sapiens
CAKEGLHEG

SEQ ID NO: 1278436 - protein, 9 aa, Homo Sapiens
VVGYRESAA

SEQ ID NO: 1278437 - protein, 9 aa, Homo Sapiens
TTSATEAWC

SEQ ID NO: 1278438 - protein, 9 aa, Homo Sapiens
LGTYYPPPH

SEQ ID NO: 1278439 - protein, 9 aa, Homo Sapiens
DPVAEARGV

SEQ ID NO: 1278440 - protein, 9 aa, Homo Sapiens
VSTRPSAAG

SEQ ID NO: 1278441 - protein, 9 aa, Homo Sapiens
GPGDPRGCK

SEQ ID NO: 1278442 - protein, 9 aa, Homo Sapiens
IHKSMIQMK

SEQ ID NO: 1278443 - protein, 9 aa, Homo Sapiens
VGRLCPSCP

SEQ ID NO: 1278444 - protein, 9 aa, Homo Sapiens
SVHRQAQRL

SEQ ID NO: 1278445 - protein, 9 aa, Homo Sapiens
ELEQTHPRL

SEQ ID NO: 1278446 - protein, 9 aa, Homo Sapiens
TVVVGVYRP

SEQ ID NO: 1278447 - protein, 9 aa, Homo Sapiens
PPALLRDGP

SEQ ID NO: 1278448 - protein, 9 aa, Homo Sapiens
DDSRNIDNC

SEQ ID NO: 1278449 - protein, 9 aa, Homo Sapiens
SGGEAKTWL

SEQ ID NO: 1278450 - protein, 9 aa, Homo Sapiens
IETPPTPLL

SEQ ID NO: 1278451 - protein, 9 aa, Homo Sapiens
PAWSTVVQY

SEQ ID NO: 1278452 - protein, 9 aa, Homo Sapiens
QNIHSVSKG

SEQ ID NO: 1278453 - protein, 9 aa, Homo Sapiens
AVAWLISFF

SEQ ID NO: 1278454 - protein, 9 aa, Homo Sapiens
LLKKRSLCT

SEQ ID NO: 1278455 - protein, 9 aa, Homo Sapiens
ALMRGLADH

SEQ ID NO: 1278456 - protein, 9 aa, Homo Sapiens
KRTQQRPPW

SEQ ID NO: 1278457 - protein, 9 aa, Homo Sapiens
RGRRRRRTT

SEQ ID NO: 1278458 - protein, 9 aa, Homo Sapiens
LRKPGLPCA

SEQ ID NO: 1278459 - protein, 9 aa, Homo Sapiens
MLHTFLRWL

SEQ ID NO: 1278460 - protein, 9 aa, Homo Sapiens
NLALSVLNL

SEQ ID NO: 1278461 - protein, 9 aa, Homo Sapiens
PDVTQLTEK

SEQ ID NO: 1278462 - protein, 9 aa, Homo Sapiens
QQKLEEVLM

SEQ ID NO: 1278463 - protein, 9 aa, Homo Sapiens
KMDSLLQNM

SEQ ID NO: 1278464 - protein, 9 aa, Homo Sapiens
NFNTQQNMQ

SEQ ID NO: 1278465 - protein, 9 aa, Homo Sapiens
NIPGGKHPM

SEQ ID NO: 1278466 - protein, 9 aa, Homo Sapiens
PRHLCPPQK

SEQ ID NO: 1278467 - protein, 9 aa, Homo Sapiens
VTYMLLNNL

SEQ ID NO: 1278468 - protein, 9 aa, Homo Sapiens
RLPLDGEER

SEQ ID NO: 1278469 - protein, 9 aa, Homo Sapiens
DSECIDINV

SEQ ID NO: 1278470 - protein, 9 aa, Homo Sapiens
RVIVPEKLP

SEQ ID NO: 1278471 - protein, 9 aa, Homo Sapiens
RLQRARKPA

SEQ ID NO: 1278472 - protein, 9 aa, Homo Sapiens
TRLVEELRA

SEQ ID NO: 1278473 - protein, 9 aa, Homo Sapiens
AELAVHRDQ

SEQ ID NO: 1278474 - protein, 9 aa, Homo Sapiens
SQALAVHSF

SEQ ID NO: 1278475 - protein, 9 aa, Homo Sapiens
VAELLPGEG

SEQ ID NO: 1278476 - protein, 9 aa, Homo Sapiens
SGPGFLWPL

SEQ ID NO: 1278477 - protein, 9 aa, Homo Sapiens
RLSPPALLR

SEQ ID NO: 1278478 - protein, 9 aa, Homo Sapiens
AAALLVDYI

SEQ ID NO: 1278479 - protein, 9 aa, Homo Sapiens
VEELRAEWE

SEQ ID NO: 1278480 - protein, 9 aa, Homo Sapiens
PERQRQENR

SEQ ID NO: 1278481 - protein, 9 aa, Homo Sapiens
LQTFQLCLG

SEQ ID NO: 1278482 - protein, 9 aa, Homo Sapiens
NIRNNDLIK

SEQ ID NO: 1278483 - protein, 9 aa, Homo Sapiens
HLHLFASDE

SEQ ID NO: 1278484 - protein, 9 aa, Homo Sapiens
NCPRGPSLP

SEQ ID NO: 1278485 - protein, 9 aa, Homo Sapiens
AYGTGRWLH

SEQ ID NO: 1278486 - protein, 9 aa, Homo Sapiens
AVKWRMIAD

SEQ ID NO: 1278487 - protein, 9 aa, Homo Sapiens
HSWSCSGLC

SEQ ID NO: 1278488 - protein, 9 aa, Homo Sapiens
KKKPSPPTL

SEQ ID NO: 1278489 - protein, 9 aa, Homo Sapiens
FFLQLQGLV

SEQ ID NO: 1278490 - protein, 9 aa, Homo Sapiens
PPLLLAPPG

SEQ ID NO: 1278491 - protein, 9 aa, Homo Sapiens
PDGQSQPPS

SEQ ID NO: 1278492 - protein, 9 aa, Homo Sapiens
VTFRRRALY

SEQ ID NO: 1278493 - protein, 9 aa, Homo Sapiens
EWLDYQICW

SEQ ID NO: 1278494 - protein, 9 aa, Homo Sapiens
KRPRAGSLR

SEQ ID NO: 1278495 - protein, 9 aa, Homo Sapiens
FTEKIMIVK

SEQ ID NO: 1278496 - protein, 9 aa, Homo Sapiens
LHFHILTWP

SEQ ID NO: 1278497 - protein, 9 aa, Homo Sapiens
HIPDYTPLC

SEQ ID NO: 1278498 - protein, 9 aa, Homo Sapiens
PFWVFLKSL

SEQ ID NO: 1278499 - protein, 9 aa, Homo Sapiens
GLVAGVGLA

SEQ ID NO: 1278500 - protein, 9 aa, Homo Sapiens
SLYVLTLDG

SEQ ID NO: 1278501 - protein, 9 aa, Homo Sapiens
ILSEQHRNF

SEQ ID NO: 1278502 - protein, 9 aa, Homo Sapiens
DGQCAPRTS

SEQ ID NO: 1278503 - protein, 9 aa, Homo Sapiens
SSSLGVLGG

SEQ ID NO: 1278504 - protein, 9 aa, Homo Sapiens
LNILSSKRD

SEQ ID NO: 1278505 - protein, 9 aa, Homo Sapiens
RLLLRAKGH

SEQ ID NO: 1278506 - protein, 9 aa, Homo Sapiens
LSVLNLAEC

SEQ ID NO: 1278507 - protein, 9 aa, Homo Sapiens
VILQASAGK

SEQ ID NO: 1278508 - protein, 9 aa, Homo Sapiens
MLHVVQRGE

SEQ ID NO: 1278509 - protein, 9 aa, Homo Sapiens
FTHSEVRVL

SEQ ID NO: 1278510 - protein, 9 aa, Homo Sapiens
YRPVDTGNT

SEQ ID NO: 1278511 - protein, 9 aa, Homo Sapiens
SPHKGKPLE

SEQ ID NO: 1278512 - protein, 9 aa, Homo Sapiens
HTFLRWLGW

SEQ ID NO: 1278513 - protein, 9 aa, Homo Sapiens
AVLECVPPA

SEQ ID NO: 1278514 - protein, 9 aa, Homo Sapiens
GFCMKDLRD

SEQ ID NO: 1278515 - protein, 9 aa, Homo Sapiens
GRDMRFLMN

SEQ ID NO: 1278516 - protein, 9 aa, Homo Sapiens
RVREALHQQ

SEQ ID NO: 1278517 - protein, 9 aa, Homo Sapiens
ASTSWCSAA

SEQ ID NO: 1278518 - protein, 9 aa, Homo Sapiens
KRLSLLSHV

SEQ ID NO: 1278519 - protein, 9 aa, Homo Sapiens
RVMQWNCAA

SEQ ID NO: 1278520 - protein, 9 aa, Homo Sapiens
HSLNMVSEC

SEQ ID NO: 1278521 - protein, 9 aa, Homo Sapiens
HPPRQGLRF

SEQ ID NO: 1278522 - protein, 9 aa, Homo Sapiens
GAHLQVLWV

SEQ ID NO: 1278523 - protein, 9 aa, Homo Sapiens
QPPGDCPRT

SEQ ID NO: 1278524 - protein, 9 aa, Homo Sapiens
GCHWKRYQR

SEQ ID NO: 1278525 - protein, 9 aa, Homo Sapiens
VLGMDLFHH

SEQ ID NO: 1278526 - protein, 9 aa, Homo Sapiens
YMDDIAACV

SEQ ID NO: 1278527 - protein, 9 aa, Homo Sapiens
SAARKKLLE

SEQ ID NO: 1278528 - protein, 9 aa, Homo Sapiens
SRTSQSWKA

SEQ ID NO: 1278529 - protein, 9 aa, Homo Sapiens
MIADPDQPV

SEQ ID NO: 1278530 - protein, 9 aa, Homo Sapiens
QLLPGGELL

SEQ ID NO: 1278531 - protein, 9 aa, Homo Sapiens
PLELQPPGD

SEQ ID NO: 1278532 - protein, 9 aa, Homo Sapiens
KFNVINYDL

SEQ ID NO: 1278533 - protein, 9 aa, Homo Sapiens
RVILQASAG

SEQ ID NO: 1278534 - protein, 9 aa, Homo Sapiens
ALETQLPSV

SEQ ID NO: 1278535 - protein, 9 aa, Homo Sapiens
SIQGSKLRL

SEQ ID NO: 1278536 - protein, 9 aa, Homo Sapiens
VKVMPHHSL

SEQ ID NO: 1278537 - protein, 9 aa, Homo Sapiens
APPGVGAQC

SEQ ID NO: 1278538 - protein, 9 aa, Homo Sapiens
PFSDKAFLS

SEQ ID NO: 1278539 - protein, 9 aa, Homo Sapiens
DSACATKGR

SEQ ID NO: 1278540 - protein, 9 aa, Homo Sapiens
RATRVEILW

SEQ ID NO: 1278541 - protein, 9 aa, Homo Sapiens
QNIPGGKHP

SEQ ID NO: 1278542 - protein, 9 aa, Homo Sapiens
GLCSQDLAM

SEQ ID NO: 1278543 - protein, 9 aa, Homo Sapiens
KSDSDGGDL

SEQ ID NO: 1278544 - protein, 9 aa, Homo Sapiens
TEDHPAGPH

SEQ ID NO: 1278545 - protein, 9 aa, Homo Sapiens
LKIDGTLHR

SEQ ID NO: 1278546 - protein, 9 aa, Homo Sapiens
QQRPPWRTS

SEQ ID NO: 1278547 - protein, 9 aa, Homo Sapiens
RLDKQLALI

SEQ ID NO: 1278548 - protein, 9 aa, Homo Sapiens
KNSREDKRE

SEQ ID NO: 1278549 - protein, 9 aa, Homo Sapiens
TKSVSVPHI

SEQ ID NO: 1278550 - protein, 9 aa, Homo Sapiens
QLASGSMGI

SEQ ID NO: 1278551 - protein, 9 aa, Homo Sapiens
QPVLLGLLS

SEQ ID NO: 1278552 - protein, 9 aa, Homo Sapiens
YNHAFTKNI

SEQ ID NO: 1278553 - protein, 9 aa, Homo Sapiens
HILTWPSWM

SEQ ID NO: 1278554 - protein, 9 aa, Homo Sapiens
CIQLASGSM

SEQ ID NO: 1278555 - protein, 9 aa, Homo Sapiens
DQVEDDGDH

SEQ ID NO: 1278556 - protein, 9 aa, Homo Sapiens
RDGWGGLWL

SEQ ID NO: 1278557 - protein, 9 aa, Homo Sapiens
LSGKVLAVS

SEQ ID NO: 1278558 - protein, 9 aa, Homo Sapiens
IHSLASRDG

SEQ ID NO: 1278559 - protein, 9 aa, Homo Sapiens
ANGSEILTK

SEQ ID NO: 1278560 - protein, 9 aa, Homo Sapiens
PPRQGLRFQ

SEQ ID NO: 1278561 - protein, 9 aa, Homo Sapiens
PRAGSLRKP

SEQ ID NO: 1278562 - protein, 9 aa, Homo Sapiens
QGHPDGQCA

SEQ ID NO: 1278563 - protein, 9 aa, Homo Sapiens
NSSARHSEA

SEQ ID NO: 1278564 - protein, 9 aa, Homo Sapiens
ERLNRNGLA

SEQ ID NO: 1278565 - protein, 9 aa, Homo Sapiens
SPFWVFLKS

SEQ ID NO: 1278566 - protein, 9 aa, Homo Sapiens
EQDKMTPGN

SEQ ID NO: 1278567 - protein, 9 aa, Homo Sapiens
NPKNLSRPL

SEQ ID NO: 1278568 - protein, 9 aa, Homo Sapiens
RAQCIRQVL

SEQ ID NO: 1278569 - protein, 9 aa, Homo Sapiens
PMAPETRLP

SEQ ID NO: 1278570 - protein, 9 aa, Homo Sapiens
KTRGKNFRK

SEQ ID NO: 1278571 - protein, 9 aa, Homo Sapiens
TQLPSVLID

SEQ ID NO: 1278572 - protein, 9 aa, Homo Sapiens
SGKVLAVSS

SEQ ID NO: 1278573 - protein, 9 aa, Homo Sapiens
LHLFASDEQ

SEQ ID NO: 1278574 - protein, 9 aa, Homo Sapiens
CATKGRILT

SEQ ID NO: 1278575 - protein, 9 aa, Homo Sapiens
GWKRTQQRP

SEQ ID NO: 1278576 - protein, 9 aa, Homo Sapiens
PTGTGIGPQ

SEQ ID NO: 1278577 - protein, 9 aa, Homo Sapiens
EHTRSVGRC

SEQ ID NO: 1278578 - protein, 9 aa, Homo Sapiens
LCPPQKSSC

SEQ ID NO: 1278579 - protein, 9 aa, Homo Sapiens
RSLPCPGGR

SEQ ID NO: 1278580 - protein, 9 aa, Homo Sapiens
DFSRNVCKR

SEQ ID NO: 1278581 - protein, 9 aa, Homo Sapiens
TELYNLASR

SEQ ID NO: 1278582 - protein, 9 aa, Homo Sapiens
LLALRLWCW

SEQ ID NO: 1278583 - protein, 9 aa, Homo Sapiens
KEQDSLNAN

SEQ ID NO: 1278584 - protein, 9 aa, Homo Sapiens
GPLELQPPG

SEQ ID NO: 1278585 - protein, 9 aa, Homo Sapiens
PRKKFPNNW

SEQ ID NO: 1278586 - protein, 9 aa, Homo Sapiens
LLLRAKGHA

SEQ ID NO: 1278587 - protein, 9 aa, Homo Sapiens
ASGSMGIGL

SEQ ID NO: 1278588 - protein, 9 aa, Homo Sapiens
GDNSHLRSG

SEQ ID NO: 1278589 - protein, 9 aa, Homo Sapiens
HQPARQHPT

SEQ ID NO: 1278590 - protein, 9 aa, Homo Sapiens
HPYPWQCGS

SEQ ID NO: 1278591 - protein, 9 aa, Homo Sapiens
LDSACATKG

SEQ ID NO: 1278592 - protein, 9 aa, Homo Sapiens
TALVMRAPR

SEQ ID NO: 1278593 - protein, 9 aa, Homo Sapiens
VVNMFVIAD

SEQ ID NO: 1278594 - protein, 9 aa, Homo Sapiens
VEYKRAMLR

SEQ ID NO: 1278595 - protein, 9 aa, Homo Sapiens
VNLLVANIH

SEQ ID NO: 1278596 - protein, 9 aa, Homo Sapiens
TLHRELVKR

SEQ ID NO: 1278597 - protein, 9 aa, Homo Sapiens
QEAETYHCL

SEQ ID NO: 1278598 - protein, 9 aa, Homo Sapiens
ALGTGACIG

SEQ ID NO: 1278599 - protein, 9 aa, Homo Sapiens
QQCCQHGVA

SEQ ID NO: 1278600 - protein, 9 aa, Homo Sapiens
RVEILWRLL

SEQ ID NO: 1278601 - protein, 9 aa, Homo Sapiens
LCSQDLAMP

SEQ ID NO: 1278602 - protein, 9 aa, Homo Sapiens
EVAELLPGE

SEQ ID NO: 1278603 - protein, 9 aa, Homo Sapiens
QRKQSRMMT

SEQ ID NO: 1278604 - protein, 9 aa, Homo Sapiens
FVTILLIII

SEQ ID NO: 1278605 - protein, 9 aa, Homo Sapiens
GSLYVLTLD

SEQ ID NO: 1278606 - protein, 9 aa, Homo Sapiens
GPEHSVIDL

SEQ ID NO: 1278607 - protein, 9 aa, Homo Sapiens
RFLHYQFLA

SEQ ID NO: 1278608 - protein, 9 aa, Homo Sapiens
MQLDVSRMH

SEQ ID NO: 1278609 - protein, 9 aa, Homo Sapiens
FTRLVEELR

SEQ ID NO: 1278610 - protein, 9 aa, Homo Sapiens
LDVSSISHW

SEQ ID NO: 1278611 - protein, 9 aa, Homo Sapiens
RILLQRNLL

SEQ ID NO: 1278612 - protein, 9 aa, Homo Sapiens
HVDEYDPKD

SEQ ID NO: 1278613 - protein, 9 aa, Homo Sapiens
ELQRNPLPT

SEQ ID NO: 1278614 - protein, 9 aa, Homo Sapiens
VLAVSSMPC

SEQ ID NO: 1278615 - protein, 9 aa, Homo Sapiens
EEYKDHRRE

SEQ ID NO: 1278616 - protein, 9 aa, Homo Sapiens
FSREPSLVT

SEQ ID NO: 1278617 - protein, 9 aa, Homo Sapiens
RRRLPSVIP

SEQ ID NO: 1278618 - protein, 9 aa, Homo Sapiens
PSIVTPHKD

SEQ ID NO: 1278619 - protein, 9 aa, Homo Sapiens
NLLRLQSLL

SEQ ID NO: 1278620 - protein, 9 aa, Homo Sapiens
VLPVQGAQR

SEQ ID NO: 1278621 - protein, 9 aa, Homo Sapiens
HEIGYIVFL

SEQ ID NO: 1278622 - protein, 9 aa, Homo Sapiens
DHPAGPHPR

SEQ ID NO: 1278623 - protein, 9 aa, Homo Sapiens
NIHSVSKGL

SEQ ID NO: 1278624 - protein, 9 aa, Homo Sapiens
GISSRGQQY

SEQ ID NO: 1278625 - protein, 9 aa, Homo Sapiens
RVYFRLSLH

SEQ ID NO: 1278626 - protein, 9 aa, Homo Sapiens
EDHPAGPHP

SEQ ID NO: 1278627 - protein, 9 aa, Homo Sapiens
VSLFEDKID

SEQ ID NO: 1278628 - protein, 9 aa, Homo Sapiens
AQRREAGDP

SEQ ID NO: 1278629 - protein, 9 aa, Homo Sapiens
ETPKKKRSA

SEQ ID NO: 1278630 - protein, 9 aa, Homo Sapiens
TFSGSVGRL

SEQ ID NO: 1278631 - protein, 9 aa, Homo Sapiens
CRTTLPASQ

SEQ ID NO: 1278632 - protein, 9 aa, Homo Sapiens
VREALHQQD

SEQ ID NO: 1278633 - protein, 9 aa, Homo Sapiens
EQRKQSRMM

SEQ ID NO: 1278634 - protein, 9 aa, Homo Sapiens
PPALGMLHV

SEQ ID NO: 1278635 - protein, 9 aa, Homo Sapiens
MMASVSPSR

SEQ ID NO: 1278636 - protein, 9 aa, Homo Sapiens
QQFGAHLQV

SEQ ID NO: 1278637 - protein, 9 aa, Homo Sapiens
SITEGDNSH

SEQ ID NO: 1278638 - protein, 9 aa, Homo Sapiens
GIYGCHWKR

SEQ ID NO: 1278639 - protein, 9 aa, Homo Sapiens
AKEGLHEGL

SEQ ID NO: 1278640 - protein, 9 aa, Homo Sapiens
SMSPSKPQS

SEQ ID NO: 1278641 - protein, 9 aa, Homo Sapiens
MDDSCVALL

SEQ ID NO: 1278642 - protein, 9 aa, Homo Sapiens
SSAFRCPYR

SEQ ID NO: 1278643 - protein, 9 aa, Homo Sapiens
HGFQAAVTF

SEQ ID NO: 1278644 - protein, 9 aa, Homo Sapiens
RRRSWQRRR

SEQ ID NO: 1278645 - protein, 9 aa, Homo Sapiens
GLRFQSFGG

SEQ ID NO: 1278646 - protein, 9 aa, Homo Sapiens
WGCCLRFLL

SEQ ID NO: 1278647 - protein, 9 aa, Homo Sapiens
ANSAARKKL

SEQ ID NO: 1278648 - protein, 9 aa, Homo Sapiens
TFPISFIGW

SEQ ID NO: 1278649 - protein, 9 aa, Homo Sapiens
SAFPSRSLS

SEQ ID NO: 1278650 - protein, 9 aa, Homo Sapiens
SHVGRPGSG

SEQ ID NO: 1278651 - protein, 9 aa, Homo Sapiens
FEQDVSRAS

SEQ ID NO: 1278652 - protein, 9 aa, Homo Sapiens
AAWKPSLRS

SEQ ID NO: 1278653 - protein, 9 aa, Homo Sapiens
FVIADGTLA

SEQ ID NO: 1278654 - protein, 9 aa, Homo Sapiens
TCYIQSSSP

SEQ ID NO: 1278655 - protein, 9 aa, Homo Sapiens
AESATAFAH

SEQ ID NO: 1278656 - protein, 9 aa, Homo Sapiens
PAEQLTAGF

SEQ ID NO: 1278657 - protein, 9 aa, Homo Sapiens
DHTVVVGVY

SEQ ID NO: 1278658 - protein, 9 aa, Homo Sapiens
RMASSSPYP

SEQ ID NO: 1278659 - protein, 9 aa, Homo Sapiens
PRMASSSPY

SEQ ID NO: 1278660 - protein, 9 aa, Homo Sapiens
QIFPTEERI

SEQ ID NO: 1278661 - protein, 9 aa, Homo Sapiens
PPGDCPRTM

SEQ ID NO: 1278662 - protein, 9 aa, Homo Sapiens
PARGFGEVV

SEQ ID NO: 1278663 - protein, 9 aa, Homo Sapiens
LWRNVLYFI

SEQ ID NO: 1278664 - protein, 9 aa, Homo Sapiens
INADPVPLP

SEQ ID NO: 1278665 - protein, 9 aa, Homo Sapiens
QMFQTKDPE

SEQ ID NO: 1278666 - protein, 9 aa, Homo Sapiens
GRWPGLKQE

SEQ ID NO: 1278667 - protein, 9 aa, Homo Sapiens
SSACTRSTL

SEQ ID NO: 1278668 - protein, 9 aa, Homo Sapiens
VRARMQPRV

SEQ ID NO: 1278669 - protein, 9 aa, Homo Sapiens
KVQYELVHR

SEQ ID NO: 1278670 - protein, 9 aa, Homo Sapiens
QNCPRGPSL

SEQ ID NO: 1278671 - protein, 9 aa, Homo Sapiens
RGRWRPSHD

SEQ ID NO: 1278672 - protein, 9 aa, Homo Sapiens
FQPPVAKKP

SEQ ID NO: 1278673 - protein, 9 aa, Homo Sapiens
TTGQVFELS

SEQ ID NO: 1278674 - protein, 9 aa, Homo Sapiens
LKTFFSQEN

SEQ ID NO: 1278675 - protein, 9 aa, Homo Sapiens
VEVALLRLA

SEQ ID NO: 1278676 - protein, 9 aa, Homo Sapiens
ERAAQTRRS

SEQ ID NO: 1278677 - protein, 9 aa, Homo Sapiens
RKRKEGSRS

SEQ ID NO: 1278678 - protein, 9 aa, Homo Sapiens
TPNTPAWEA

SEQ ID NO: 1278679 - protein, 9 aa, Homo Sapiens
DRSSHNDSM

SEQ ID NO: 1278680 - protein, 9 aa, Homo Sapiens
CKPDETGKS

SEQ ID NO: 1278681 - protein, 9 aa, Homo Sapiens
GWEDKPFKG

SEQ ID NO: 1278682 - protein, 9 aa, Homo Sapiens
AATINAAYT

SEQ ID NO: 1278683 - protein, 9 aa, Homo Sapiens
EELPSEHPT

SEQ ID NO: 1278684 - protein, 9 aa, Homo Sapiens
TYYPPPHLR

SEQ ID NO: 1278685 - protein, 9 aa, Homo Sapiens
RQLVVGYRE

SEQ ID NO: 1278686 - protein, 9 aa, Homo Sapiens
KLDRVMQDV

SEQ ID NO: 1278687 - protein, 9 aa, Homo Sapiens
DSTDVSTAA

SEQ ID NO: 1278688 - protein, 9 aa, Homo Sapiens
ASSSPYPTD

SEQ ID NO: 1278689 - protein, 9 aa, Homo Sapiens
HSGPGFLWP

SEQ ID NO: 1278690 - protein, 9 aa, Homo Sapiens
LQSLLSLYS

SEQ ID NO: 1278691 - protein, 9 aa, Homo Sapiens
VERGMVSLF

SEQ ID NO: 1278692 - protein, 9 aa, Homo Sapiens
NMFVIADGT

SEQ ID NO: 1278693 - protein, 9 aa, Homo Sapiens
NKKEGNLIQ

SEQ ID NO: 1278694 - protein, 9 aa, Homo Sapiens
RQLPQMSKV

SEQ ID NO: 1278695 - protein, 9 aa, Homo Sapiens
GHWRMMASV

SEQ ID NO: 1278696 - protein, 9 aa, Homo Sapiens
TGIGPQAAA

SEQ ID NO: 1278697 - protein, 9 aa, Homo Sapiens
IDLFQDVKW

SEQ ID NO: 1278698 - protein, 9 aa, Homo Sapiens
DGTLHRELV

SEQ ID NO: 1278699 - protein, 9 aa, Homo Sapiens
PTEARVQVW

SEQ ID NO: 1278700 - protein, 9 aa, Homo Sapiens
TRKLKIAPA

SEQ ID NO: 1278701 - protein, 9 aa, Homo Sapiens
QISTLVLDV

SEQ ID NO: 1278702 - protein, 9 aa, Homo Sapiens
LTAGFRRHL

SEQ ID NO: 1278703 - protein, 9 aa, Homo Sapiens
FIWPQHSYK

SEQ ID NO: 1278704 - protein, 9 aa, Homo Sapiens
RYKKKKHKH

SEQ ID NO: 1278705 - protein, 9 aa, Homo Sapiens
PACRGKGSQ

SEQ ID NO: 1278706 - protein, 9 aa, Homo Sapiens
RSKTRGKNF

SEQ ID NO: 1278707 - protein, 9 aa, Homo Sapiens
MFVIADGTL

SEQ ID NO: 1278708 - protein, 9 aa, Homo Sapiens
KLYHSLVMC

SEQ ID NO: 1278709 - protein, 9 aa, Homo Sapiens
HVLNEEQAL

SEQ ID NO: 1278710 - protein, 9 aa, Homo Sapiens
RDFTEKIMI

SEQ ID NO: 1278711 - protein, 9 aa, Homo Sapiens
SCPGEAPCW

SEQ ID NO: 1278712 - protein, 9 aa, Homo Sapiens
RLLAWKEST

SEQ ID NO: 1278713 - protein, 9 aa, Homo Sapiens
SSATSRKSI

SEQ ID NO: 1278714 - protein, 9 aa, Homo Sapiens
KKLEDSPKS

SEQ ID NO: 1278715 - protein, 9 aa, Homo Sapiens
SSRFQATCQ

SEQ ID NO: 1278716 - protein, 9 aa, Homo Sapiens
ETRLPKTSP

SEQ ID NO: 1278717 - protein, 9 aa, Homo Sapiens
DFVDVIGFC

SEQ ID NO: 1278718 - protein, 9 aa, Homo Sapiens
SRPLPGQVH

SEQ ID NO: 1278719 - protein, 9 aa, Homo Sapiens
IMIVKGKVI

SEQ ID NO: 1278720 - protein, 9 aa, Homo Sapiens
RRSARWPTC

SEQ ID NO: 1278721 - protein, 9 aa, Homo Sapiens
VDYITAYMV

SEQ ID NO: 1278722 - protein, 9 aa, Homo Sapiens
ASRDPAKMR

SEQ ID NO: 1278723 - protein, 9 aa, Homo Sapiens
SILMLHHNI

SEQ ID NO: 1278724 - protein, 9 aa, Homo Sapiens
ILTWPSWMT

SEQ ID NO: 1278725 - protein, 9 aa, Homo Sapiens
FQATCQGRK

SEQ ID NO: 1278726 - protein, 9 aa, Homo Sapiens
LRTKLEKAL

SEQ ID NO: 1278727 - protein, 9 aa, Homo Sapiens
QALTSDSEE

SEQ ID NO: 1278728 - protein, 9 aa, Homo Sapiens
VRLLLRAKG

SEQ ID NO: 1278729 - protein, 9 aa, Homo Sapiens
PSRPPAAAG

SEQ ID NO: 1278730 - protein, 9 aa, Homo Sapiens
VLQFELWRN

SEQ ID NO: 1278731 - protein, 9 aa, Homo Sapiens
SSTECRIGS

SEQ ID NO: 1278732 - protein, 9 aa, Homo Sapiens
SPFTVCKPD

SEQ ID NO: 1278733 - protein, 9 aa, Homo Sapiens
GGAYGTGRW

SEQ ID NO: 1278734 - protein, 9 aa, Homo Sapiens
GCAKEGLHE

SEQ ID NO: 1278735 - protein, 9 aa, Homo Sapiens
LGGPEHSVI

SEQ ID NO: 1278736 - protein, 9 aa, Homo Sapiens
YRGRLSPMP

SEQ ID NO: 1278737 - protein, 9 aa, Homo Sapiens
SAYGGTDFS

SEQ ID NO: 1278738 - protein, 9 aa, Homo Sapiens
SGLGLLADF

SEQ ID NO: 1278739 - protein, 9 aa, Homo Sapiens
GQKIRSGEA

SEQ ID NO: 1278740 - protein, 9 aa, Homo Sapiens
KTFFSQENY

SEQ ID NO: 1278741 - protein, 9 aa, Homo Sapiens
IIETPPTPL

SEQ ID NO: 1278742 - protein, 9 aa, Homo Sapiens
PILYSNSKG

SEQ ID NO: 1278743 - protein, 9 aa, Homo Sapiens
HLRQLLPML

SEQ ID NO: 1278744 - protein, 9 aa, Homo Sapiens
IQDLISEPS

SEQ ID NO: 1278745 - protein, 9 aa, Homo Sapiens
IVVKFFLQL

SEQ ID NO: 1278746 - protein, 9 aa, Homo Sapiens
LYHSLVMCL

SEQ ID NO: 1278747 - protein, 9 aa, Homo Sapiens
GPHTPQDPE

SEQ ID NO: 1278748 - protein, 9 aa, Homo Sapiens
DMSGLHISP

SEQ ID NO: 1278749 - protein, 9 aa, Homo Sapiens
GSGQFVAPG

SEQ ID NO: 1278750 - protein, 9 aa, Homo Sapiens
LPGLTHPAH

SEQ ID NO: 1278751 - protein, 9 aa, Homo Sapiens
HVNWRVETV

SEQ ID NO: 1278752 - protein, 9 aa, Homo Sapiens
ELALKIDPT

SEQ ID NO: 1278753 - protein, 9 aa, Homo Sapiens
RSHSAHHHL

SEQ ID NO: 1278754 - protein, 9 aa, Homo Sapiens
QRRLRACRA

SEQ ID NO: 1278755 - protein, 9 aa, Homo Sapiens
TTTTHRTTT

SEQ ID NO: 1278756 - protein, 9 aa, Homo Sapiens
RACLEALMR

SEQ ID NO: 1278757 - protein, 9 aa, Homo Sapiens
AGGQALTSD

SEQ ID NO: 1278758 - protein, 9 aa, Homo Sapiens
SLRSPPQAL

SEQ ID NO: 1278759 - protein, 9 aa, Homo Sapiens
NDIVSPRSE

SEQ ID NO: 1278760 - protein, 9 aa, Homo Sapiens
LGLLSPRPP

SEQ ID NO: 1278761 - protein, 9 aa, Homo Sapiens
PPGPDLLRK

SEQ ID NO: 1278762 - protein, 9 aa, Homo Sapiens
ILEYDRKEA

SEQ ID NO: 1278763 - protein, 9 aa, Homo Sapiens
WNCAAYLKL

SEQ ID NO: 1278764 - protein, 9 aa, Homo Sapiens
LENMDGIHE

SEQ ID NO: 1278765 - protein, 9 aa, Homo Sapiens
DEKLNILSS

SEQ ID NO: 1278766 - protein, 9 aa, Homo Sapiens
ESSSEGGGM

SEQ ID NO: 1278767 - protein, 9 aa, Homo Sapiens
DDTQYFLYY

SEQ ID NO: 1278768 - protein, 9 aa, Homo Sapiens
TVKNDPGHD

SEQ ID NO: 1278769 - protein, 9 aa, Homo Sapiens
HSAHHHLLG

SEQ ID NO: 1278770 - protein, 9 aa, Homo Sapiens
ILRKMSDLL

SEQ ID NO: 1278771 - protein, 9 aa, Homo Sapiens
GLAASFAVS

SEQ ID NO: 1278772 - protein, 9 aa, Homo Sapiens
LNFCGLDPE

SEQ ID NO: 1278773 - protein, 9 aa, Homo Sapiens
KPSMSPSKP

SEQ ID NO: 1278774 - protein, 9 aa, Homo Sapiens
LIWKKKMSC

SEQ ID NO: 1278775 - protein, 9 aa, Homo Sapiens
VETVGKEFR

SEQ ID NO: 1278776 - protein, 9 aa, Homo Sapiens
SRGILRKMS

SEQ ID NO: 1278777 - protein, 9 aa, Homo Sapiens
RRPQPVLLG

SEQ ID NO: 1278778 - protein, 9 aa, Homo Sapiens
AGKSWKIMR

SEQ ID NO: 1278779 - protein, 9 aa, Homo Sapiens
ILSSKRDLA

SEQ ID NO: 1278780 - protein, 9 aa, Homo Sapiens
LVPRHQRLS

SEQ ID NO: 1278781 - protein, 9 aa, Homo Sapiens
QCAPRTSPE

SEQ ID NO: 1278782 - protein, 9 aa, Homo Sapiens
PPPPPTKKR

SEQ ID NO: 1278783 - protein, 9 aa, Homo Sapiens
RHSRAQRAN

SEQ ID NO: 1278784 - protein, 9 aa, Homo Sapiens
ILMGLIPYD

SEQ ID NO: 1278785 - protein, 9 aa, Homo Sapiens
QPGPVPCVI

SEQ ID NO: 1278786 - protein, 9 aa, Homo Sapiens
PNNPKNLSR

SEQ ID NO: 1278787 - protein, 9 aa, Homo Sapiens
LSLTHLFLV

SEQ ID NO: 1278788 - protein, 9 aa, Homo Sapiens
LRLWCWHKS

SEQ ID NO: 1278789 - protein, 9 aa, Homo Sapiens
HCVEKCPFR

SEQ ID NO: 1278790 - protein, 9 aa, Homo Sapiens
VSDVSLSLM

SEQ ID NO: 1278791 - protein, 9 aa, Homo Sapiens
YEFRVLAVI

SEQ ID NO: 1278792 - protein, 9 aa, Homo Sapiens
TSLFQALGI

SEQ ID NO: 1278793 - protein, 9 aa, Homo Sapiens
IPGGKHPMA

SEQ ID NO: 1278794 - protein, 9 aa, Homo Sapiens
MVEYKRAML

SEQ ID NO: 1278795 - protein, 9 aa, Homo Sapiens
NFRKEKNSR

SEQ ID NO: 1278796 - protein, 9 aa, Homo Sapiens
PVTPATAGS

SEQ ID NO: 1278797 - protein, 9 aa, Homo Sapiens
GTSGRGRWR

SEQ ID NO: 1278798 - protein, 9 aa, Homo Sapiens
GLHISPNSG

SEQ ID NO: 1278799 - protein, 9 aa, Homo Sapiens
VGAQCADSG

SEQ ID NO: 1278800 - protein, 9 aa, Homo Sapiens
QEADAKRQR

SEQ ID NO: 1278801 - protein, 9 aa, Homo Sapiens
SRSPHKGKP

SEQ ID NO: 1278802 - protein, 9 aa, Homo Sapiens
FQVTAMNMA

SEQ ID NO: 1278803 - protein, 9 aa, Homo Sapiens
QLLDSGFEQ

SEQ ID NO: 1278804 - protein, 9 aa, Homo Sapiens
LLGVRLLLR

SEQ ID NO: 1278805 - protein, 9 aa, Homo Sapiens
TAKKADREF

SEQ ID NO: 1278806 - protein, 9 aa, Homo Sapiens
RKKFPNNWE

SEQ ID NO: 1278807 - protein, 9 aa, Homo Sapiens
ANVKKADST

SEQ ID NO: 1278808 - protein, 9 aa, Homo Sapiens
PKASQHFTR

SEQ ID NO: 1278809 - protein, 9 aa, Homo Sapiens
LAVSSMPCF

SEQ ID NO: 1278810 - protein, 9 aa, Homo Sapiens
RGKNFRKEK

SEQ ID NO: 1278811 - protein, 9 aa, Homo Sapiens
PTCGRWPGL

SEQ ID NO: 1278812 - protein, 9 aa, Homo Sapiens
KEGNLIQNR

SEQ ID NO: 1278813 - protein, 9 aa, Homo Sapiens
VQGGNELPL

SEQ ID NO: 1278814 - protein, 9 aa, Homo Sapiens
CCLPGLTHP

SEQ ID NO: 1278815 - protein, 9 aa, Homo Sapiens
SSALATAEL

SEQ ID NO: 1278816 - protein, 9 aa, Homo Sapiens
DDCRYVIVG

SEQ ID NO: 1278817 - protein, 9 aa, Homo Sapiens
LEKLEKKRI

SEQ ID NO: 1278818 - protein, 9 aa, Homo Sapiens
KIMIVKGKV

SEQ ID NO: 1278819 - protein, 9 aa, Homo Sapiens
MQWNCAAYL

SEQ ID NO: 1278820 - protein, 9 aa, Homo Sapiens
FVAPGHSMG

SEQ ID NO: 1278821 - protein, 9 aa, Homo Sapiens
TPTMLNPAN

SEQ ID NO: 1278822 - protein, 9 aa, Homo Sapiens
TMWCPPGPD

SEQ ID NO: 1278823 - protein, 9 aa, Homo Sapiens
AQCIRQVLQ

SEQ ID NO: 1278824 - protein, 9 aa, Homo Sapiens
ATAGSLATG

SEQ ID NO: 1278825 - protein, 9 aa, Homo Sapiens
GQPLICVVS

SEQ ID NO: 1278826 - protein, 9 aa, Homo Sapiens
ETALVMRAP

SEQ ID NO: 1278827 - protein, 9 aa, Homo Sapiens
PPHLRQLLP

SEQ ID NO: 1278828 - protein, 9 aa, Homo Sapiens
ATFSGSVGR

SEQ ID NO: 1278829 - protein, 9 aa, Homo Sapiens
QTATRLLKL

SEQ ID NO: 1278830 - protein, 9 aa, Homo Sapiens
TGLHVNWRV

SEQ ID NO: 1278831 - protein, 9 aa, Homo Sapiens
RLTYVAHVY

SEQ ID NO: 1278832 - protein, 9 aa, Homo Sapiens
CHWKRYQRS

SEQ ID NO: 1278833 - protein, 9 aa, Homo Sapiens
TATRLLKLA

SEQ ID NO: 1278834 - protein, 9 aa, Homo Sapiens
VGRPGSGGD

SEQ ID NO: 1278835 - protein, 9 aa, Homo Sapiens
CAVASPYPK

SEQ ID NO: 1278836 - protein, 9 aa, Homo Sapiens
GQSQPPSNR

SEQ ID NO: 1278837 - protein, 9 aa, Homo Sapiens
SGLSCRFYQ

SEQ ID NO: 1278838 - protein, 9 aa, Homo Sapiens
GILRKMSDL

SEQ ID NO: 1278839 - protein, 9 aa, Homo Sapiens
CVGTKPSIP

SEQ ID NO: 1278840 - protein, 9 aa, Homo Sapiens
LASRDGSDS

SEQ ID NO: 1278841 - protein, 9 aa, Homo Sapiens
GQSNTRCPR

SEQ ID NO: 1278842 - protein, 9 aa, Homo Sapiens
HYRIHTVEK

SEQ ID NO: 1278843 - protein, 9 aa, Homo Sapiens
IDNCWIETE

SEQ ID NO: 1278844 - protein, 9 aa, Homo Sapiens
CKGVLQELR

SEQ ID NO: 1278845 - protein, 9 aa, Homo Sapiens
YDKCVFAFR

SEQ ID NO: 1278846 - protein, 9 aa, Homo Sapiens
CTETALVMR

SEQ ID NO: 1278847 - protein, 9 aa, Homo Sapiens
ESATAFAHD

SEQ ID NO: 1278848 - protein, 9 aa, Homo Sapiens
KEEVFLIFW

SEQ ID NO: 1278849 - protein, 9 aa, Homo Sapiens
GAAPTRGSF

SEQ ID NO: 1278850 - protein, 9 aa, Homo Sapiens
GALVVCGSM

SEQ ID NO: 1278851 - protein, 9 aa, Homo Sapiens
VAPGHSMGQ

SEQ ID NO: 1278852 - protein, 9 aa, Homo Sapiens
LSLPRLHAS

SEQ ID NO: 1278853 - protein, 9 aa, Homo Sapiens
KKEGNLIQN

SEQ ID NO: 1278854 - protein, 9 aa, Homo Sapiens
PPTKKRGKS

SEQ ID NO: 1278855 - protein, 9 aa, Homo Sapiens
VPHISSPEE

SEQ ID NO: 1278856 - protein, 9 aa, Homo Sapiens
FREQRRRSA

SEQ ID NO: 1278857 - protein, 9 aa, Homo Sapiens
TAFLHLQRY

SEQ ID NO: 1278858 - protein, 9 aa, Homo Sapiens
VAGVQGGNE

SEQ ID NO: 1278859 - protein, 9 aa, Homo Sapiens
VRSLRHSRS

SEQ ID NO: 1278860 - protein, 9 aa, Homo Sapiens
GAVRSLRHS

SEQ ID NO: 1278861 - protein, 9 aa, Homo Sapiens
SETSKGKKV

SEQ ID NO: 1278862 - protein, 9 aa, Homo Sapiens
VYCHLESSS

SEQ ID NO: 1278863 - protein, 9 aa, Homo Sapiens
GFGEVVETQ

SEQ ID NO: 1278864 - protein, 9 aa, Homo Sapiens
RDHTVVVGV

SEQ ID NO: 1278865 - protein, 9 aa, Homo Sapiens
ASQRSSACT

SEQ ID NO: 1278866 - protein, 9 aa, Homo Sapiens
CPRTMAGPS

SEQ ID NO: 1278867 - protein, 9 aa, Homo Sapiens
RSYPEFQSS

SEQ ID NO: 1278868 - protein, 9 aa, Homo Sapiens
ERPRTTMPA

SEQ ID NO: 1278869 - protein, 9 aa, Homo Sapiens
ILLAAVAWL

SEQ ID NO: 1278870 - protein, 9 aa, Homo Sapiens
EQRRRSARW

SEQ ID NO: 1278871 - protein, 9 aa, Homo Sapiens
TVTRNRGAW

SEQ ID NO: 1278872 - protein, 9 aa, Homo Sapiens
ALAVHSFSC

SEQ ID NO: 1278873 - protein, 9 aa, Homo Sapiens
NICVFIYIC

SEQ ID NO: 1278874 - protein, 9 aa, Homo Sapiens
FTDDCRYVI

SEQ ID NO: 1278875 - protein, 9 aa, Homo Sapiens
ENKLNEASR

SEQ ID NO: 1278876 - protein, 9 aa, Homo Sapiens
IQNRSPTPS

SEQ ID NO: 1278877 - protein, 9 aa, Homo Sapiens
AIVVKFFLQ

SEQ ID NO: 1278878 - protein, 9 aa, Homo Sapiens
DDSCVALLA

SEQ ID NO: 1278879 - protein, 9 aa, Homo Sapiens
IMAESATAF

SEQ ID NO: 1278880 - protein, 9 aa, Homo Sapiens
LECVPPAAT

SEQ ID NO: 1278881 - protein, 9 aa, Homo Sapiens
KPKFARHIK

SEQ ID NO: 1278882 - protein, 9 aa, Homo Sapiens
QFTRLVEEL

SEQ ID NO: 1278883 - protein, 9 aa, Homo Sapiens
RTATEEKAR

SEQ ID NO: 1278884 - protein, 9 aa, Homo Sapiens
VSPSRNGRI

SEQ ID NO: 1278885 - protein, 9 aa, Homo Sapiens
PTATPTCGD

SEQ ID NO: 1278886 - protein, 9 aa, Homo Sapiens
VRLQKENQI

SEQ ID NO: 1278887 - protein, 9 aa, Homo Sapiens
YVLVTEKGS

SEQ ID NO: 1278888 - protein, 9 aa, Homo Sapiens
VMIVHDVTD

SEQ ID NO: 1278889 - protein, 9 aa, Homo Sapiens
WCWHKSRLL

SEQ ID NO: 1278890 - protein, 9 aa, Homo Sapiens
NRNGLAMAA

SEQ ID NO: 1278891 - protein, 9 aa, Homo Sapiens
WRSPTSTGP

SEQ ID NO: 1278892 - protein, 9 aa, Homo Sapiens
AAFPAWSTV

SEQ ID NO: 1278893 - protein, 9 aa, Homo Sapiens
LQLHNKKEG

SEQ ID NO: 1278894 - protein, 9 aa, Homo Sapiens
SREDKRERT

SEQ ID NO: 1278895 - protein, 9 aa, Homo Sapiens
SREPSLVTL

SEQ ID NO: 1278896 - protein, 9 aa, Homo Sapiens
ASLSYPDST

SEQ ID NO: 1278897 - protein, 9 aa, Homo Sapiens
KKDKKRRNL

SEQ ID NO: 1278898 - protein, 9 aa, Homo Sapiens
VDVIGFCMK

SEQ ID NO: 1278899 - protein, 9 aa, Homo Sapiens
KEKNSREDK

SEQ ID NO: 1278900 - protein, 9 aa, Homo Sapiens
HTLPSQGVD

SEQ ID NO: 1278901 - protein, 9 aa, Homo Sapiens
PAMTPLWMF

SEQ ID NO: 1278902 - protein, 9 aa, Homo Sapiens
GTYYPPPHL

SEQ ID NO: 1278903 - protein, 9 aa, Homo Sapiens
VDGEALELH

SEQ ID NO: 1278904 - protein, 9 aa, Homo Sapiens
RFQATCQGR

SEQ ID NO: 1278905 - protein, 9 aa, Homo Sapiens
QVWMEECVL

SEQ ID NO: 1278906 - protein, 9 aa, Homo Sapiens
GPEKTSLFQ

SEQ ID NO: 1278907 - protein, 9 aa, Homo Sapiens
IREAASAPS

SEQ ID NO: 1278908 - protein, 9 aa, Homo Sapiens
ISPFWVFLK

SEQ ID NO: 1278909 - protein, 9 aa, Homo Sapiens
TEKIMIVKG

SEQ ID NO: 1278910 - protein, 9 aa, Homo Sapiens
GGRTQGEVQ

SEQ ID NO: 1278911 - protein, 9 aa, Homo Sapiens
PSMSPSKPQ

SEQ ID NO: 1278912 - protein, 9 aa, Homo Sapiens
RSVGRCSSL

SEQ ID NO: 1278913 - protein, 9 aa, Homo Sapiens
PSEHPTLEP

SEQ ID NO: 1278914 - protein, 9 aa, Homo Sapiens
QPAEQLTAG

SEQ ID NO: 1278915 - protein, 9 aa, Homo Sapiens
GEALELHDY

SEQ ID NO: 1278916 - protein, 9 aa, Homo Sapiens
RIVEVEQDK

SEQ ID NO: 1278917 - protein, 9 aa, Homo Sapiens
DACVLCRQL

SEQ ID NO: 1278918 - protein, 9 aa, Homo Sapiens
PAHQPLGSM

SEQ ID NO: 1278919 - protein, 9 aa, Homo Sapiens
TAFAHDHGF

SEQ ID NO: 1278920 - protein, 9 aa, Homo Sapiens
DHRRENAER

SEQ ID NO: 1278921 - protein, 9 aa, Homo Sapiens
FLFGNLSFL

SEQ ID NO: 1278922 - protein, 9 aa, Homo Sapiens
ALQPGEKKS

SEQ ID NO: 1278923 - protein, 9 aa, Homo Sapiens
QAELEQTHP

SEQ ID NO: 1278924 - protein, 9 aa, Homo Sapiens
PKPPTPERG

SEQ ID NO: 1278925 - protein, 9 aa, Homo Sapiens
DTPTMLNPA

SEQ ID NO: 1278926 - protein, 9 aa, Homo Sapiens
VLEQPMVVQ

SEQ ID NO: 1278927 - protein, 9 aa, Homo Sapiens
QGGNELPLG

SEQ ID NO: 1278928 - protein, 9 aa, Homo Sapiens
LAASFAVSS

SEQ ID NO: 1278929 - protein, 9 aa, Homo Sapiens
FLHYQFLAM

SEQ ID NO: 1278930 - protein, 9 aa, Homo Sapiens
CGSMHQGVC

SEQ ID NO: 1278931 - protein, 9 aa, Homo Sapiens
YSSKKKILM

SEQ ID NO: 1278932 - protein, 9 aa, Homo Sapiens
PLPWRSPTS

SEQ ID NO: 1278933 - protein, 9 aa, Homo Sapiens
NEDDFLLHS

SEQ ID NO: 1278934 - protein, 9 aa, Homo Sapiens
RGSGQFVAP

SEQ ID NO: 1278935 - protein, 9 aa, Homo Sapiens
KFHSLNMVS

SEQ ID NO: 1278936 - protein, 9 aa, Homo Sapiens
SNSCCPSCC

SEQ ID NO: 1278937 - protein, 9 aa, Homo Sapiens
WLHQRGSGQ

SEQ ID NO: 1278938 - protein, 9 aa, Homo Sapiens
GIGPQAAAA

SEQ ID NO: 1278939 - protein, 9 aa, Homo Sapiens
FGAHLQVLW

SEQ ID NO: 1278940 - protein, 9 aa, Homo Sapiens
MHQGVCEQR

SEQ ID NO: 1278941 - protein, 9 aa, Homo Sapiens
GGTDFSSTF

SEQ ID NO: 1278942 - protein, 9 aa, Homo Sapiens
VMCLRLRTK

SEQ ID NO: 1278943 - protein, 9 aa, Homo Sapiens
AWTLQTFQL

SEQ ID NO: 1278944 - protein, 9 aa, Homo Sapiens
ASVSAYAQQ

SEQ ID NO: 1278945 - protein, 9 aa, Homo Sapiens
SNETPKKKR

SEQ ID NO: 1278946 - protein, 9 aa, Homo Sapiens
RPVDTGNTG

SEQ ID NO: 1278947 - protein, 9 aa, Homo Sapiens
HEATLITIK

SEQ ID NO: 1278948 - protein, 9 aa, Homo Sapiens
VNISDKLVD

SEQ ID NO: 1278949 - protein, 9 aa, Homo Sapiens
TTTKKNQNS

SEQ ID NO: 1278950 - protein, 9 aa, Homo Sapiens
LIILAIMIY

SEQ ID NO: 1278951 - protein, 9 aa, Homo Sapiens
HSFSCPHSR

SEQ ID NO: 1278952 - protein, 9 aa, Homo Sapiens
SQGGRILLQ

SEQ ID NO: 1278953 - protein, 9 aa, Homo Sapiens
CCSCPPGRA

SEQ ID NO: 1278954 - protein, 9 aa, Homo Sapiens
LHPASGRAS

SEQ ID NO: 1278955 - protein, 9 aa, Homo Sapiens
TEGDNSHLR

SEQ ID NO: 1278956 - protein, 9 aa, Homo Sapiens
LKCAKDQNG

SEQ ID NO: 1278957 - protein, 9 aa, Homo Sapiens
HRTTTTSPT

SEQ ID NO: 1278958 - protein, 9 aa, Homo Sapiens
DGPHTPQDP

SEQ ID NO: 1278959 - protein, 9 aa, Homo Sapiens
SHSAHHHLL

SEQ ID NO: 1278960 - protein, 9 aa, Homo Sapiens
PSRNGRIWR

SEQ ID NO: 1278961 - protein, 9 aa, Homo Sapiens
PAASTELYN

SEQ ID NO: 1278962 - protein, 9 aa, Homo Sapiens
LHTFLRWLG

SEQ ID NO: 1278963 - protein, 9 aa, Homo Sapiens
ARGRSTSRT

SEQ ID NO: 1278964 - protein, 9 aa, Homo Sapiens
RTAKKADRE

SEQ ID NO: 1278965 - protein, 9 aa, Homo Sapiens
DPKASQHFT

SEQ ID NO: 1278966 - protein, 9 aa, Homo Sapiens
PGSKGRPPR

SEQ ID NO: 1278967 - protein, 9 aa, Homo Sapiens
KTGQKIRSG

SEQ ID NO: 1278968 - protein, 9 aa, Homo Sapiens
RSLWLTSSA

SEQ ID NO: 1278969 - protein, 9 aa, Homo Sapiens
RKPQPRRGP

SEQ ID NO: 1278970 - protein, 9 aa, Homo Sapiens
ANDIVSPRS

SEQ ID NO: 1278971 - protein, 9 aa, Homo Sapiens
HSRSPHKGK

SEQ ID NO: 1278972 - protein, 9 aa, Homo Sapiens
NGSVTTSAT

SEQ ID NO: 1278973 - protein, 9 aa, Homo Sapiens
SSSSSSLGV

SEQ ID NO: 1278974 - protein, 9 aa, Homo Sapiens
TCHWNGKKM

SEQ ID NO: 1278975 - protein, 9 aa, Homo Sapiens
SLRHSRSPH

SEQ ID NO: 1278976 - protein, 9 aa, Homo Sapiens
STLEYKTTN

SEQ ID NO: 1278977 - protein, 9 aa, Homo Sapiens
TPPQEADAK

SEQ ID NO: 1278978 - protein, 9 aa, Homo Sapiens
SRLPARGFG

SEQ ID NO: 1278979 - protein, 9 aa, Homo Sapiens
RSGEALGSL

SEQ ID NO: 1278980 - protein, 9 aa, Homo Sapiens
VIGFCMKDL

SEQ ID NO: 1278981 - protein, 9 aa, Homo Sapiens
HQRGSGQFV

SEQ ID NO: 1278982 - protein, 9 aa, Homo Sapiens
PWRSPTSTG

SEQ ID NO: 1278983 - protein, 9 aa, Homo Sapiens
LRLRTKLEK

SEQ ID NO: 1278984 - protein, 9 aa, Homo Sapiens
LAWKESTIF

SEQ ID NO: 1278985 - protein, 9 aa, Homo Sapiens
ECVPPAATR

SEQ ID NO: 1278986 - protein, 9 aa, Homo Sapiens
IQNNQKTRK

SEQ ID NO: 1278987 - protein, 9 aa, Homo Sapiens
KRGSRSKTR

SEQ ID NO: 1278988 - protein, 9 aa, Homo Sapiens
SVSPSRNGR

SEQ ID NO: 1278989 - protein, 9 aa, Homo Sapiens
RHQRLSPPA

SEQ ID NO: 1278990 - protein, 9 aa, Homo Sapiens
LAPPGVGAQ

SEQ ID NO: 1278991 - protein, 9 aa, Homo Sapiens
SMQEALVVE

SEQ ID NO: 1278992 - protein, 9 aa, Homo Sapiens
KIRLLAWKE

SEQ ID NO: 1278993 - protein, 9 aa, Homo Sapiens
PQKSSCPGE

SEQ ID NO: 1278994 - protein, 9 aa, Homo Sapiens
SFERPRTTM

SEQ ID NO: 1278995 - protein, 9 aa, Homo Sapiens
PAAAALDEG

SEQ ID NO: 1278996 - protein, 9 aa, Homo Sapiens
LTMWTCMDM

SEQ ID NO: 1278997 - protein, 9 aa, Homo Sapiens
GQPSDDRVY

SEQ ID NO: 1278998 - protein, 9 aa, Homo Sapiens
MVIISGWGK

SEQ ID NO: 1278999 - protein, 9 aa, Homo Sapiens
DSRKRKEGS

SEQ ID NO: 1279000 - protein, 9 aa, Homo Sapiens
LKSLRLVDS

SEQ ID NO: 1279001 - protein, 9 aa, Homo Sapiens
SESWAIVPV

SEQ ID NO: 1279002 - protein, 9 aa, Homo Sapiens
KDHRRENAE

SEQ ID NO: 1279003 - protein, 9 aa, Homo Sapiens
MYFLFGNLS

SEQ ID NO: 1279004 - protein, 9 aa, Homo Sapiens
CQEQPAAVG

SEQ ID NO: 1279005 - protein, 9 aa, Homo Sapiens
KKMLSLTHL

SEQ ID NO: 1279006 - protein, 9 aa, Homo Sapiens
FPTEERIFN

SEQ ID NO: 1279007 - protein, 9 aa, Homo Sapiens
EKNSREDKR

SEQ ID NO: 1279008 - protein, 9 aa, Homo Sapiens
GPGHVLVRL

SEQ ID NO: 1279009 - protein, 9 aa, Homo Sapiens
IHSVSKGLP

SEQ ID NO: 1279010 - protein, 9 aa, Homo Sapiens
CISNSCCPS

SEQ ID NO: 1279011 - protein, 9 aa, Homo Sapiens
STTTKKNQN

SEQ ID NO: 1279012 - protein, 9 aa, Homo Sapiens
KDFQFHLEG

SEQ ID NO: 1279013 - protein, 9 aa, Homo Sapiens
GDCPRTMAG

SEQ ID NO: 1279014 - protein, 9 aa, Homo Sapiens
FWSLPLPSS

SEQ ID NO: 1279015 - protein, 9 aa, Homo Sapiens
KTRKRIFFA

SEQ ID NO: 1279016 - protein, 9 aa, Homo Sapiens
SLLVVGFSH

SEQ ID NO: 1279017 - protein, 9 aa, Homo Sapiens
FRCPYRKGK

SEQ ID NO: 1279018 - protein, 9 aa, Homo Sapiens
DEPLSGEKY

SEQ ID NO: 1279019 - protein, 9 aa, Homo Sapiens
QEEANGGRT

SEQ ID NO: 1279020 - protein, 9 aa, Homo Sapiens
TGACIGMMR

SEQ ID NO: 1279021 - protein, 9 aa, Homo Sapiens
ETSKGKKVK

SEQ ID NO: 1279022 - protein, 9 aa, Homo Sapiens
GTLASVVTW

SEQ ID NO: 1279023 - protein, 9 aa, Homo Sapiens
FSDKAFLSL

SEQ ID NO: 1279024 - protein, 9 aa, Homo Sapiens
FRVDQSLAC

SEQ ID NO: 1279025 - protein, 9 aa, Homo Sapiens
RPAGPMEES

SEQ ID NO: 1279026 - protein, 9 aa, Homo Sapiens
CPLCRGLRP

SEQ ID NO: 1279027 - protein, 9 aa, Homo Sapiens
AVCSHRRGG

SEQ ID NO: 1279028 - protein, 9 aa, Homo Sapiens
LVAGVGLAA

SEQ ID NO: 1279029 - protein, 9 aa, Homo Sapiens
VCRDVTKPS

SEQ ID NO: 1279030 - protein, 9 aa, Homo Sapiens
PGHDIIEDM

SEQ ID NO: 1279031 - protein, 9 aa, Homo Sapiens
GQKLLHARR

SEQ ID NO: 1279032 - protein, 9 aa, Homo Sapiens
VPCVIPTRG

SEQ ID NO: 1279033 - protein, 9 aa, Homo Sapiens
LSLEAVRRA

SEQ ID NO: 1279034 - protein, 9 aa, Homo Sapiens
NHAFTKNII

SEQ ID NO: 1279035 - protein, 9 aa, Homo Sapiens
VMQWNCAAY

SEQ ID NO: 1279036 - protein, 9 aa, Homo Sapiens
YKTTNADIQ

SEQ ID NO: 1279037 - protein, 9 aa, Homo Sapiens
RWLGWARFL

SEQ ID NO: 1279038 - protein, 9 aa, Homo Sapiens
IWRIGRRSS

SEQ ID NO: 1279039 - protein, 9 aa, Homo Sapiens
DSLNANLEG

SEQ ID NO: 1279040 - protein, 9 aa, Homo Sapiens
GRGRWRPSH

SEQ ID NO: 1279041 - protein, 9 aa, Homo Sapiens
VEVEQDKMT

SEQ ID NO: 1279042 - protein, 9 aa, Homo Sapiens
GHVLKCAKD

SEQ ID NO: 1279043 - protein, 9 aa, Homo Sapiens
VIQDLISEP

SEQ ID NO: 1279044 - protein, 9 aa, Homo Sapiens
GGEAVGTGE

SEQ ID NO: 1279045 - protein, 9 aa, Homo Sapiens
TRGSFERPR

SEQ ID NO: 1279046 - protein, 9 aa, Homo Sapiens
RCEEDFSWF

SEQ ID NO: 1279047 - protein, 9 aa, Homo Sapiens
QHQPARQHP

SEQ ID NO: 1279048 - protein, 9 aa, Homo Sapiens
AELKNATMA

SEQ ID NO: 1279049 - protein, 9 aa, Homo Sapiens
CADSGTEDH

SEQ ID NO: 1279050 - protein, 9 aa, Homo Sapiens
GLGGAAASI

SEQ ID NO: 1279051 - protein, 9 aa, Homo Sapiens
STLMSCTEA

SEQ ID NO: 1279052 - protein, 9 aa, Homo Sapiens
WLSRSSGML

SEQ ID NO: 1279053 - protein, 9 aa, Homo Sapiens
LEDSPKSLK

SEQ ID NO: 1279054 - protein, 9 aa, Homo Sapiens
SFSYVFIII

SEQ ID NO: 1279055 - protein, 9 aa, Homo Sapiens
GGNELPLGS

SEQ ID NO: 1279056 - protein, 9 aa, Homo Sapiens
PRSLWLTSS

SEQ ID NO: 1279057 - protein, 9 aa, Homo Sapiens
AVGVGKSAL

SEQ ID NO: 1279058 - protein, 9 aa, Homo Sapiens
MGIGLGMAI

SEQ ID NO: 1279059 - protein, 9 aa, Homo Sapiens
AFLHLQRYS

SEQ ID NO: 1279060 - protein, 9 aa, Homo Sapiens
CPPGPDLLR

SEQ ID NO: 1279061 - protein, 9 aa, Homo Sapiens
AALLVDYIT

SEQ ID NO: 1279062 - protein, 9 aa, Homo Sapiens
VTWGTLVSG

SEQ ID NO: 1279063 - protein, 9 aa, Homo Sapiens
HLQVLWVFQ

SEQ ID NO: 1279064 - protein, 9 aa, Homo Sapiens
SRNGRIWRI

SEQ ID NO: 1279065 - protein, 9 aa, Homo Sapiens
LDGRVHALQ

SEQ ID NO: 1279066 - protein, 9 aa, Homo Sapiens
QGERQEWKC

SEQ ID NO: 1279067 - protein, 9 aa, Homo Sapiens
RKGKFRTSA

SEQ ID NO: 1279068 - protein, 9 aa, Homo Sapiens
RLPARGFGE

SEQ ID NO: 1279069 - protein, 9 aa, Homo Sapiens
TINAAYTLG

SEQ ID NO: 1279070 - protein, 9 aa, Homo Sapiens
HNKSVNEAL

SEQ ID NO: 1279071 - protein, 9 aa, Homo Sapiens
CMDMLPKGA

SEQ ID NO: 1279072 - protein, 9 aa, Homo Sapiens
YLGDWYSIN

SEQ ID NO: 1279073 - protein, 9 aa, Homo Sapiens
LLGRGQQMS

SEQ ID NO: 1279074 - protein, 9 aa, Homo Sapiens
LFKWILRCY

SEQ ID NO: 1279075 - protein, 9 aa, Homo Sapiens
HHHLLGVRL

SEQ ID NO: 1279076 - protein, 9 aa, Homo Sapiens
QEGAMVIIS

SEQ ID NO: 1279077 - protein, 9 aa, Homo Sapiens
AVLFGERLN

SEQ ID NO: 1279078 - protein, 9 aa, Homo Sapiens
LHVNWRVET

SEQ ID NO: 1279079 - protein, 9 aa, Homo Sapiens
SSSPYPTDV

SEQ ID NO: 1279080 - protein, 9 aa, Homo Sapiens
FTTDPRMAS

SEQ ID NO: 1279081 - protein, 9 aa, Homo Sapiens
GVGAQCADS

SEQ ID NO: 1279082 - protein, 9 aa, Homo Sapiens
SGRPGRRGG

SEQ ID NO: 1279083 - protein, 9 aa, Homo Sapiens
ACTRSTLMS

SEQ ID NO: 1279084 - protein, 9 aa, Homo Sapiens
LRKPQPRRG

SEQ ID NO: 1279085 - protein, 9 aa, Homo Sapiens
PHCAAWKPS

SEQ ID NO: 1279086 - protein, 9 aa, Homo Sapiens
PCNECTKLI

SEQ ID NO: 1279087 - protein, 9 aa, Homo Sapiens
TQGCTAGTQ

SEQ ID NO: 1279088 - protein, 9 aa, Homo Sapiens
TFEEPERQR

SEQ ID NO: 1279089 - protein, 9 aa, Homo Sapiens
ELPSEHPTL

SEQ ID NO: 1279090 - protein, 9 aa, Homo Sapiens
GRAQCIRQV

SEQ ID NO: 1279091 - protein, 9 aa, Homo Sapiens
AVRLQKENQ

SEQ ID NO: 1279092 - protein, 9 aa, Homo Sapiens
STTTTPTVI

SEQ ID NO: 1279093 - protein, 9 aa, Homo Sapiens
DSVMNSKND

SEQ ID NO: 1279094 - protein, 9 aa, Homo Sapiens
LPLDGKWQR

SEQ ID NO: 1279095 - protein, 9 aa, Homo Sapiens
EQQFGAHLQ

SEQ ID NO: 1279096 - protein, 9 aa, Homo Sapiens
ALATAELKN

SEQ ID NO: 1279097 - protein, 9 aa, Homo Sapiens
ASALRRPQP

SEQ ID NO: 1279098 - protein, 9 aa, Homo Sapiens
SGQFVAPGH

SEQ ID NO: 1279099 - protein, 9 aa, Homo Sapiens
NGLSKDMSG

SEQ ID NO: 1279100 - protein, 9 aa, Homo Sapiens
SFPVGWKFA

SEQ ID NO: 1279101 - protein, 9 aa, Homo Sapiens
AAYLQPGPV

SEQ ID NO: 1279102 - protein, 9 aa, Homo Sapiens
EVFLIFWNI

SEQ ID NO: 1279103 - protein, 9 aa, Homo Sapiens
LSHAFFKLE

SEQ ID NO: 1279104 - protein, 9 aa, Homo Sapiens
LPWRSPTST

SEQ ID NO: 1279105 - protein, 9 aa, Homo Sapiens
NKHSRYKKK

SEQ ID NO: 1279106 - protein, 9 aa, Homo Sapiens
ELYNLASRT

SEQ ID NO: 1279107 - protein, 9 aa, Homo Sapiens
QDLAMPRHL

SEQ ID NO: 1279108 - protein, 9 aa, Homo Sapiens
IGIITYCCC

SEQ ID NO: 1279109 - protein, 9 aa, Homo Sapiens
LEIKKKGYI

SEQ ID NO: 1279110 - protein, 9 aa, Homo Sapiens
FTRSNHLER

SEQ ID NO: 1279111 - protein, 9 aa, Homo Sapiens
THRTTTTSP

SEQ ID NO: 1279112 - protein, 9 aa, Homo Sapiens
KKRKFDDDS

SEQ ID NO: 1279113 - protein, 9 aa, Homo Sapiens
LWLPCQRLP

SEQ ID NO: 1279114 - protein, 9 aa, Homo Sapiens
ELWRNVLYF

SEQ ID NO: 1279115 - protein, 9 aa, Homo Sapiens
ETVMTFLRA

SEQ ID NO: 1279116 - protein, 9 aa, Homo Sapiens
KTSLFQALG

SEQ ID NO: 1279117 - protein, 9 aa, Homo Sapiens
IRLLAWKES

SEQ ID NO: 1279118 - protein, 9 aa, Homo Sapiens
SLHSGPGFL

SEQ ID NO: 1279119 - protein, 9 aa, Homo Sapiens
EDKRERTAT

SEQ ID NO: 1279120 - protein, 9 aa, Homo Sapiens
LWCWHKSRL

SEQ ID NO: 1279121 - protein, 9 aa, Homo Sapiens
TEAWCRTTL

SEQ ID NO: 1279122 - protein, 9 aa, Homo Sapiens
ARFLHYQFL

SEQ ID NO: 1279123 - protein, 9 aa, Homo Sapiens
GTGIGPQAA

SEQ ID NO: 1279124 - protein, 9 aa, Homo Sapiens
APAASCPLC

SEQ ID NO: 1279125 - protein, 9 aa, Homo Sapiens
VTLECLHEA

SEQ ID NO: 1279126 - protein, 9 aa, Homo Sapiens
AAASISVLQ

SEQ ID NO: 1279127 - protein, 9 aa, Homo Sapiens
SLLSHVGRP

SEQ ID NO: 1279128 - protein, 9 aa, Homo Sapiens
VSAYAQQCC

SEQ ID NO: 1279129 - protein, 9 aa, Homo Sapiens
ELLHPSQRL

SEQ ID NO: 1279130 - protein, 9 aa, Homo Sapiens
AEGTSIQGS

SEQ ID NO: 1279131 - protein, 9 aa, Homo Sapiens
RIHLRPRYL

SEQ ID NO: 1279132 - protein, 9 aa, Homo Sapiens
KPSLRSPPQ

SEQ ID NO: 1279133 - protein, 9 aa, Homo Sapiens
ISGWGKQFL

SEQ ID NO: 1279134 - protein, 9 aa, Homo Sapiens
EPYERDHTV

SEQ ID NO: 1279135 - protein, 9 aa, Homo Sapiens
FLWRRFRSV

SEQ ID NO: 1279136 - protein, 9 aa, Homo Sapiens
VDGLLLTPL

SEQ ID NO: 1279137 - protein, 9 aa, Homo Sapiens
PHSWSCSGL

SEQ ID NO: 1279138 - protein, 9 aa, Homo Sapiens
VVVDLGTCY

SEQ ID NO: 1279139 - protein, 9 aa, Homo Sapiens
AIIMAESAT

SEQ ID NO: 1279140 - protein, 9 aa, Homo Sapiens
MAESATAFA

SEQ ID NO: 1279141 - protein, 9 aa, Homo Sapiens
VVQYLMQLD

SEQ ID NO: 1279142 - protein, 9 aa, Homo Sapiens
KKRRNLQRN

SEQ ID NO: 1279143 - protein, 9 aa, Homo Sapiens
RDGPHTPQD

SEQ ID NO: 1279144 - protein, 9 aa, Homo Sapiens
QSPMHVVCS

SEQ ID NO: 1279145 - protein, 9 aa, Homo Sapiens
EGSRSVEGS

SEQ ID NO: 1279146 - protein, 9 aa, Homo Sapiens
CLRLRTKLE

SEQ ID NO: 1279147 - protein, 9 aa, Homo Sapiens
QGLRFQSFG

SEQ ID NO: 1279148 - protein, 9 aa, Homo Sapiens
TDIWLESAK

SEQ ID NO: 1279149 - protein, 9 aa, Homo Sapiens
AAAAVRTLS

SEQ ID NO: 1279150 - protein, 9 aa, Homo Sapiens
SRPGWKRTQ

SEQ ID NO: 1279151 - protein, 9 aa, Homo Sapiens
VTAMNMAGL

SEQ ID NO: 1279152 - protein, 9 aa, Homo Sapiens
CLECSGRHH

SEQ ID NO: 1279153 - protein, 9 aa, Homo Sapiens
KVKWKSSCI

SEQ ID NO: 1279154 - protein, 9 aa, Homo Sapiens
PRRGPAAAA

SEQ ID NO: 1279155 - protein, 9 aa, Homo Sapiens
GNELPLGSQ

SEQ ID NO: 1279156 - protein, 9 aa, Homo Sapiens
VDPRELAVA

SEQ ID NO: 1279157 - protein, 9 aa, Homo Sapiens
PGDCPRTMA

SEQ ID NO: 1279158 - protein, 9 aa, Homo Sapiens
KKYRNYRMP

SEQ ID NO: 1279159 - protein, 9 aa, Homo Sapiens
ELDSVMNSK

SEQ ID NO: 1279160 - protein, 9 aa, Homo Sapiens
TIPPKRVAL

SEQ ID NO: 1279161 - protein, 9 aa, Homo Sapiens
AAGGTLASV

SEQ ID NO: 1279162 - protein, 9 aa, Homo Sapiens
GQFVAPGHS

SEQ ID NO: 1279163 - protein, 9 aa, Homo Sapiens
YETVMTFLR

SEQ ID NO: 1279164 - protein, 9 aa, Homo Sapiens
VPPAATRSL

SEQ ID NO: 1279165 - protein, 9 aa, Homo Sapiens
TTCKGSTPT

SEQ ID NO: 1279166 - protein, 9 aa, Homo Sapiens
ENMDGIHEL

SEQ ID NO: 1279167 - protein, 9 aa, Homo Sapiens
FLHLQRYSN

SEQ ID NO: 1279168 - protein, 9 aa, Homo Sapiens
QQEFEISHL

SEQ ID NO: 1279169 - protein, 9 aa, Homo Sapiens
EKTGMVRPD

SEQ ID NO: 1279170 - protein, 9 aa, Homo Sapiens
CLLACPQFV

SEQ ID NO: 1279171 - protein, 9 aa, Homo Sapiens
GPHPRRQCS

SEQ ID NO: 1279172 - protein, 9 aa, Homo Sapiens
RNIDNCWIE

SEQ ID NO: 1279173 - protein, 9 aa, Homo Sapiens
WNGKKMLSL

SEQ ID NO: 1279174 - protein, 9 aa, Homo Sapiens
PTSRARQSC

SEQ ID NO: 1279175 - protein, 9 aa, Homo Sapiens
PHHDCCQCQ

SEQ ID NO: 1279176 - protein, 9 aa, Homo Sapiens
PMKIPRQLP

SEQ ID NO: 1279177 - protein, 9 aa, Homo Sapiens
TKKRGKSQG

SEQ ID NO: 1279178 - protein, 9 aa, Homo Sapiens
LVMRAPRWK

SEQ ID NO: 1279179 - protein, 9 aa, Homo Sapiens
TGIYGCHWK

SEQ ID NO: 1279180 - protein, 9 aa, Homo Sapiens
MHCVEKCPF

SEQ ID NO: 1279181 - protein, 9 aa, Homo Sapiens
KMRNLHFHI

SEQ ID NO: 1279182 - protein, 9 aa, Homo Sapiens
ILEKLEKKR

SEQ ID NO: 1279183 - protein, 9 aa, Homo Sapiens
RPTSRARQS

SEQ ID NO: 1279184 - protein, 9 aa, Homo Sapiens
VIPTRTARW

SEQ ID NO: 1279185 - protein, 9 aa, Homo Sapiens
STRPSAAGW

SEQ ID NO: 1279186 - protein, 9 aa, Homo Sapiens
GGLGGAAAS

SEQ ID NO: 1279187 - protein, 9 aa, Homo Sapiens
SECIDINVT

SEQ ID NO: 1279188 - protein, 9 aa, Homo Sapiens
LDRQTATRL

SEQ ID NO: 1279189 - protein, 9 aa, Homo Sapiens
SPMPVPRAV

SEQ ID NO: 1279190 - protein, 9 aa, Homo Sapiens
QQYGVKNQN

SEQ ID NO: 1279191 - protein, 9 aa, Homo Sapiens
KKSRTSQSW

SEQ ID NO: 1279192 - protein, 9 aa, Homo Sapiens
LEGEAELAV

SEQ ID NO: 1279193 - protein, 9 aa, Homo Sapiens
LFTHSEVRV

SEQ ID NO: 1279194 - protein, 9 aa, Homo Sapiens
AFTRSNHLE

SEQ ID NO: 1279195 - protein, 9 aa, Homo Sapiens
SLSYPDSTD

SEQ ID NO: 1279196 - protein, 9 aa, Homo Sapiens
VIDLWRTKP

SEQ ID NO: 1279197 - protein, 9 aa, Homo Sapiens
PYIFYKDFQ

SEQ ID NO: 1279198 - protein, 9 aa, Homo Sapiens
SPRSEQKVI

SEQ ID NO: 1279199 - protein, 9 aa, Homo Sapiens
EKAKGEDGE

SEQ ID NO: 1279200 - protein, 9 aa, Homo Sapiens
DDIAACVGT

SEQ ID NO: 1279201 - protein, 9 aa, Homo Sapiens
WRNVLYFIL

SEQ ID NO: 1279202 - protein, 9 aa, Homo Sapiens
SFGGLSLPR

SEQ ID NO: 1279203 - protein, 9 aa, Homo Sapiens
KGRPPRCPG

SEQ ID NO: 1279204 - protein, 9 aa, Homo Sapiens
PTRTARWPR

SEQ ID NO: 1279205 - protein, 9 aa, Homo Sapiens
DYQICWAWE

SEQ ID NO: 1279206 - protein, 9 aa, Homo Sapiens
MKLYHSLVM

SEQ ID NO: 1279207 - protein, 9 aa, Homo Sapiens
WKAGKSWKI

SEQ ID NO: 1279208 - protein, 9 aa, Homo Sapiens
TGRCLCLFQ

SEQ ID NO: 1279209 - protein, 9 aa, Homo Sapiens
GYPTGTGIG

SEQ ID NO: 1279210 - protein, 9 aa, Homo Sapiens
YDRKEALED

SEQ ID NO: 1279211 - protein, 9 aa, Homo Sapiens
MWCPPGPDL

SEQ ID NO: 1279212 - protein, 9 aa, Homo Sapiens
RLPRVEVAL

SEQ ID NO: 1279213 - protein, 9 aa, Homo Sapiens
TPWISSKTG

SEQ ID NO: 1279214 - protein, 9 aa, Homo Sapiens
WMEECVLSS

SEQ ID NO: 1279215 - protein, 9 aa, Homo Sapiens
ASCTETALV

SEQ ID NO: 1279216 - protein, 9 aa, Homo Sapiens
VMTFLRAFL

SEQ ID NO: 1279217 - protein, 9 aa, Homo Sapiens
EAGDPVAEA

SEQ ID NO: 1279218 - protein, 9 aa, Homo Sapiens
LDRCCVEYG

SEQ ID NO: 1279219 - protein, 9 aa, Homo Sapiens
EADAKRQRQ

SEQ ID NO: 1279220 - protein, 9 aa, Homo Sapiens
PSLAAYHHP

SEQ ID NO: 1279221 - protein, 9 aa, Homo Sapiens
LPSGGEAKT

SEQ ID NO: 1279222 - protein, 9 aa, Homo Sapiens
NQNHLQENG

SEQ ID NO: 1279223 - protein, 9 aa, Homo Sapiens
LGTSGRGRW

SEQ ID NO: 1279224 - protein, 9 aa, Homo Sapiens
SSKKKILMG

SEQ ID NO: 1279225 - protein, 9 aa, Homo Sapiens
VEDVRPLSH

SEQ ID NO: 1279226 - protein, 9 aa, Homo Sapiens
AMPRHLCPP

SEQ ID NO: 1279227 - protein, 9 aa, Homo Sapiens
FPLLKKRKF

SEQ ID NO: 1279228 - protein, 9 aa, Homo Sapiens
GNYIVLFAA

SEQ ID NO: 1279229 - protein, 9 aa, Homo Sapiens
ACSITVSFV

SEQ ID NO: 1279230 - protein, 9 aa, Homo Sapiens
EKKRGSRSK

SEQ ID NO: 1279231 - protein, 9 aa, Homo Sapiens
RRNLQRNLK

SEQ ID NO: 1279232 - protein, 9 aa, Homo Sapiens
HISPFWVFL

SEQ ID NO: 1279233 - protein, 9 aa, Homo Sapiens
CPGHWRMMA

SEQ ID NO: 1279234 - protein, 9 aa, Homo Sapiens
RLRACRAGG

SEQ ID NO: 1279235 - protein, 9 aa, Homo Sapiens
CLCLFQSPM

SEQ ID NO: 1279236 - protein, 9 aa, Homo Sapiens
NMVYQFQVT

SEQ ID NO: 1279237 - protein, 9 aa, Homo Sapiens
TFFSQENYK

SEQ ID NO: 1279238 - protein, 9 aa, Homo Sapiens
DTPNTPAWE

SEQ ID NO: 1279239 - protein, 9 aa, Homo Sapiens
RPRSHSAHH

SEQ ID NO: 1279240 - protein, 9 aa, Homo Sapiens
TCKGSTPTD

SEQ ID NO: 1279241 - protein, 9 aa, Homo Sapiens
IFCQGFGPF

SEQ ID NO: 1279242 - protein, 9 aa, Homo Sapiens
EEQALSALI

SEQ ID NO: 1279243 - protein, 9 aa, Homo Sapiens
GSVGRLCPS

SEQ ID NO: 1279244 - protein, 9 aa, Homo Sapiens
EANGSEILT

SEQ ID NO: 1279245 - protein, 9 aa, Homo Sapiens
LTSDSEEAD

SEQ ID NO: 1279246 - protein, 9 aa, Homo Sapiens
SSVMQPFSD

SEQ ID NO: 1279247 - protein, 9 aa, Homo Sapiens
QVEDDGDHV

SEQ ID NO: 1279248 - protein, 9 aa, Homo Sapiens
HTGPGHVLV

SEQ ID NO: 1279249 - protein, 9 aa, Homo Sapiens
GGQALTSDS

SEQ ID NO: 1279250 - protein, 9 aa, Homo Sapiens
RILARGRST

SEQ ID NO: 1279251 - protein, 9 aa, Homo Sapiens
PGAPPECYL

SEQ ID NO: 1279252 - protein, 9 aa, Homo Sapiens
QTKVQYELV

SEQ ID NO: 1279253 - protein, 9 aa, Homo Sapiens
LRPIVYQEY

SEQ ID NO: 1279254 - protein, 9 aa, Homo Sapiens
QFGKFNVIN

SEQ ID NO: 1279255 - protein, 9 aa, Homo Sapiens
AVIQDLISE

SEQ ID NO: 1279256 - protein, 9 aa, Homo Sapiens
PGQMFQTKD

SEQ ID NO: 1279257 - protein, 9 aa, Homo Sapiens
LMSALDSVT

SEQ ID NO: 1279258 - protein, 9 aa, Homo Sapiens
LCHPPRQGL

SEQ ID NO: 1279259 - protein, 9 aa, Homo Sapiens
NSAARKKLL

SEQ ID NO: 1279260 - protein, 9 aa, Homo Sapiens
GLGLLADFP

SEQ ID NO: 1279261 - protein, 9 aa, Homo Sapiens
GKFAPFFVP

SEQ ID NO: 1279262 - protein, 9 aa, Homo Sapiens
GLTHPAHQP

SEQ ID NO: 1279263 - protein, 9 aa, Homo Sapiens
TRSNHLERH

SEQ ID NO: 1279264 - protein, 9 aa, Homo Sapiens
CLSKLPRHI

SEQ ID NO: 1279265 - protein, 9 aa, Homo Sapiens
AGTQHPGPG

SEQ ID NO: 1279266 - protein, 9 aa, Homo Sapiens
NGSEILTKR

SEQ ID NO: 1279267 - protein, 9 aa, Homo Sapiens
MDAALGGPR

SEQ ID NO: 1279268 - protein, 9 aa, Homo Sapiens
IHLRPRYLR

SEQ ID NO: 1279269 - protein, 9 aa, Homo Sapiens
RRRRRTTIL

SEQ ID NO: 1279270 - protein, 9 aa, Homo Sapiens
SFSCPHSRA

SEQ ID NO: 1279271 - protein, 9 aa, Homo Sapiens
VGTKPSIPL

SEQ ID NO: 1279272 - protein, 9 aa, Homo Sapiens
GRLSPMPVP

SEQ ID NO: 1279273 - protein, 9 aa, Homo Sapiens
RGVRRRGPP

SEQ ID NO: 1279274 - protein, 9 aa, Homo Sapiens
VQSHNKSVN

SEQ ID NO: 1279275 - protein, 9 aa, Homo Sapiens
RLIGGWEDK

SEQ ID NO: 1279276 - protein, 9 aa, Homo Sapiens
LQRNLLRLQ

SEQ ID NO: 1279277 - protein, 9 aa, Homo Sapiens
VLAVIQDLI

SEQ ID NO: 1279278 - protein, 9 aa, Homo Sapiens
GPAASTELY

SEQ ID NO: 1279279 - protein, 9 aa, Homo Sapiens
EFRSAAFPA

SEQ ID NO: 1279280 - protein, 9 aa, Homo Sapiens
SFDEPQEQA

SEQ ID NO: 1279281 - protein, 9 aa, Homo Sapiens
YNLASRTEY

SEQ ID NO: 1279282 - protein, 9 aa, Homo Sapiens
YCHLESSSE

SEQ ID NO: 1279283 - protein, 9 aa, Homo Sapiens
ILDSACATK

SEQ ID NO: 1279284 - protein, 9 aa, Homo Sapiens
AKTWLLCSP

SEQ ID NO: 1279285 - protein, 9 aa, Homo Sapiens
GGGTPLSIS

SEQ ID NO: 1279286 - protein, 9 aa, Homo Sapiens
LPKPRSLWL

SEQ ID NO: 1279287 - protein, 9 aa, Homo Sapiens
EDMDAALGG

SEQ ID NO: 1279288 - protein, 9 aa, Homo Sapiens
KDTWQDEEY

SEQ ID NO: 1279289 - protein, 9 aa, Homo Sapiens
SHYWPLENM

SEQ ID NO: 1279290 - protein, 9 aa, Homo Sapiens
QLQGLVAGV

SEQ ID NO: 1279291 - protein, 9 aa, Homo Sapiens
APPECYLGL

SEQ ID NO: 1279292 - protein, 9 aa, Homo Sapiens
QRLEGEAEL

SEQ ID NO: 1279293 - protein, 9 aa, Homo Sapiens
RRRALYAVL

SEQ ID NO: 1279294 - protein, 9 aa, Homo Sapiens
LRAFLRTVA

SEQ ID NO: 1279295 - protein, 9 aa, Homo Sapiens
HRQAQRLEG

SEQ ID NO: 1279296 - protein, 9 aa, Homo Sapiens
SHRRGGEEA

SEQ ID NO: 1279297 - protein, 9 aa, Homo Sapiens
GAQCADSGT

SEQ ID NO: 1279298 - protein, 9 aa, Homo Sapiens
ESWAIVPVL

SEQ ID NO: 1279299 - protein, 9 aa, Homo Sapiens
SRGQQYGVK

SEQ ID NO: 1279300 - protein, 9 aa, Homo Sapiens
KKVVVVTVC

SEQ ID NO: 1279301 - protein, 9 aa, Homo Sapiens
QRANLLSSL

SEQ ID NO: 1279302 - protein, 9 aa, Homo Sapiens
KVARLRQNA

SEQ ID NO: 1279303 - protein, 9 aa, Homo Sapiens
VHDVTDIWL

SEQ ID NO: 1279304 - protein, 9 aa, Homo Sapiens
SALRRPQPV

SEQ ID NO: 1279305 - protein, 9 aa, Homo Sapiens
VLSSVLQTH

SEQ ID NO: 1279306 - protein, 9 aa, Homo Sapiens
PEKLPVEAM

SEQ ID NO: 1279307 - protein, 9 aa, Homo Sapiens
AGDPVAEAR

SEQ ID NO: 1279308 - protein, 9 aa, Homo Sapiens
LEEVLMVVG

SEQ ID NO: 1279309 - protein, 9 aa, Homo Sapiens
CRYVIVGSA

SEQ ID NO: 1279310 - protein, 9 aa, Homo Sapiens
REAGDPVAE

SEQ ID NO: 1279311 - protein, 9 aa, Homo Sapiens
EDPMQRQRV

SEQ ID NO: 1279312 - protein, 9 aa, Homo Sapiens
KLTKSVSVP

SEQ ID NO: 1279313 - protein, 9 aa, Homo Sapiens
SRCRVIVPE

SEQ ID NO: 1279314 - protein, 9 aa, Homo Sapiens
TCQGRKYIL

SEQ ID NO: 1279315 - protein, 9 aa, Homo Sapiens
RLLKLAHKY

SEQ ID NO: 1279316 - protein, 9 aa, Homo Sapiens
RLHASVREM

SEQ ID NO: 1279317 - protein, 9 aa, Homo Sapiens
GTEDHPAGP

SEQ ID NO: 1279318 - protein, 9 aa, Homo Sapiens
QEVRLEKMP

SEQ ID NO: 1279319 - protein, 9 aa, Homo Sapiens
RLEGEAELA

SEQ ID NO: 1279320 - protein, 9 aa, Homo Sapiens
LMKDSTPVL

SEQ ID NO: 1279321 - protein, 9 aa, Homo Sapiens
FWNIKIRLL

SEQ ID NO: 1279322 - protein, 9 aa, Homo Sapiens
ALSALFIWP

SEQ ID NO: 1279323 - protein, 9 aa, Homo Sapiens
RGFGEVVET

SEQ ID NO: 1279324 - protein, 9 aa, Homo Sapiens
KRIHLRPRY

SEQ ID NO: 1279325 - protein, 9 aa, Homo Sapiens
FLQLQGLVA

SEQ ID NO: 1279326 - protein, 9 aa, Homo Sapiens
HHCRLTYVA

SEQ ID NO: 1279327 - protein, 9 aa, Homo Sapiens
GLGGEAVGT

SEQ ID NO: 1279328 - protein, 9 aa, Homo Sapiens
EGQPWQTVT

SEQ ID NO: 1279329 - protein, 9 aa, Homo Sapiens
HLQQWKWQC

SEQ ID NO: 1279330 - protein, 9 aa, Homo Sapiens
VDQSLACEG

SEQ ID NO: 1279331 - protein, 9 aa, Homo Sapiens
TSIQGSKLR

SEQ ID NO: 1279332 - protein, 9 aa, Homo Sapiens
LHHNIPSSL

SEQ ID NO: 1279333 - protein, 9 aa, Homo Sapiens
IHTVEKPYQ

SEQ ID NO: 1279334 - protein, 9 aa, Homo Sapiens
PLICVVSHP

SEQ ID NO: 1279335 - protein, 9 aa, Homo Sapiens
CRDVTKPSP

SEQ ID NO: 1279336 - protein, 9 aa, Homo Sapiens
DDGDHVEDD

SEQ ID NO: 1279337 - protein, 9 aa, Homo Sapiens
RSNHLERHR

SEQ ID NO: 1279338 - protein, 9 aa, Homo Sapiens
GCCLRFLLG

SEQ ID NO: 1279339 - protein, 9 aa, Homo Sapiens
ECSGRHHGL

SEQ ID NO: 1279340 - protein, 9 aa, Homo Sapiens
KFFLQLQGL

SEQ ID NO: 1279341 - protein, 9 aa, Homo Sapiens
PYRLLLLEG

SEQ ID NO: 1279342 - protein, 9 aa, Homo Sapiens
GHSPHCAAW

SEQ ID NO: 1279343 - protein, 9 aa, Homo Sapiens
KNDELNGVN

SEQ ID NO: 1279344 - protein, 9 aa, Homo Sapiens
HSLASRDGS

SEQ ID NO: 1279345 - protein, 9 aa, Homo Sapiens
PTAHPSITE

SEQ ID NO: 1279346 - protein, 9 aa, Homo Sapiens
NMEPLKGTT

SEQ ID NO: 1279347 - protein, 9 aa, Homo Sapiens
AALDEGRTT

SEQ ID NO: 1279348 - protein, 9 aa, Homo Sapiens
PETRLPKTS

SEQ ID NO: 1279349 - protein, 9 aa, Homo Sapiens
TYLGDWYSI

SEQ ID NO: 1279350 - protein, 9 aa, Homo Sapiens
MSQALAVHS

SEQ ID NO: 1279351 - protein, 9 aa, Homo Sapiens
MQPFSDKAF

SEQ ID NO: 1279352 - protein, 9 aa, Homo Sapiens
GDPKQLEAV

SEQ ID NO: 1279353 - protein, 9 aa, Homo Sapiens
RSLRHSRSP

SEQ ID NO: 1279354 - protein, 9 aa, Homo Sapiens
QVQNLTLRI

SEQ ID NO: 1279355 - protein, 9 aa, Homo Sapiens
ARNVLLSAC

SEQ ID NO: 1279356 - protein, 9 aa, Homo Sapiens
HGPYIFYKD

SEQ ID NO: 1279357 - protein, 9 aa, Homo Sapiens
HNKKEGNLI

SEQ ID NO: 1279358 - protein, 9 aa, Homo Sapiens
IFYKDFQFH

SEQ ID NO: 1279359 - protein, 9 aa, Homo Sapiens
STPWISSKT

SEQ ID NO: 1279360 - protein, 9 aa, Homo Sapiens
WNIKIRLLA

SEQ ID NO: 1279361 - protein, 9 aa, Homo Sapiens
PPPTKKRGK

SEQ ID NO: 1279362 - protein, 9 aa, Homo Sapiens
SQRSSACTR

SEQ ID NO: 1279363 - protein, 9 aa, Homo Sapiens
FAHDHGFQA

SEQ ID NO: 1279364 - protein, 9 aa, Homo Sapiens
CYLGLPGSL

SEQ ID NO: 1279365 - protein, 9 aa, Homo Sapiens
TLASVVTWG

SEQ ID NO: 1279366 - protein, 9 aa, Homo Sapiens
HGLGVHLSF

SEQ ID NO: 1279367 - protein, 9 aa, Homo Sapiens
NGKKMLSLT

SEQ ID NO: 1279368 - protein, 9 aa, Homo Sapiens
RTTILISAC

SEQ ID NO: 1279369 - protein, 9 aa, Homo Sapiens
DRQTATRLL

SEQ ID NO: 1279370 - protein, 9 aa, Homo Sapiens
IGGGTPLSI

SEQ ID NO: 1279371 - protein, 9 aa, Homo Sapiens
FASDEQGGD

SEQ ID NO: 1279372 - protein, 9 aa, Homo Sapiens
TSDSEEADE

SEQ ID NO: 1279373 - protein, 9 aa, Homo Sapiens
RHSAVQTKV

SEQ ID NO: 1279374 - protein, 9 aa, Homo Sapiens
DSCVALLAK

SEQ ID NO: 1279375 - protein, 9 aa, Homo Sapiens
KGEDGEKEE

SEQ ID NO: 1279376 - protein, 9 aa, Homo Sapiens
LHRHMDLHV

SEQ ID NO: 1279377 - protein, 9 aa, Homo Sapiens
TYCCCCRGK

SEQ ID NO: 1279378 - protein, 9 aa, Homo Sapiens
AHVYCHLES

SEQ ID NO: 1279379 - protein, 9 aa, Homo Sapiens
NVLLSACCD

SEQ ID NO: 1279380 - protein, 9 aa, Homo Sapiens
EELALKIDP

SEQ ID NO: 1279381 - protein, 9 aa, Homo Sapiens
ELMSALDSV

SEQ ID NO: 1279382 - protein, 9 aa, Homo Sapiens
RPSCCISNS

SEQ ID NO: 1279383 - protein, 9 aa, Homo Sapiens
RNPLPTATP

SEQ ID NO: 1279384 - protein, 9 aa, Homo Sapiens
PWRTSRGQA

SEQ ID NO: 1279385 - protein, 9 aa, Homo Sapiens
FPCNECTKL

SEQ ID NO: 1279386 - protein, 9 aa, Homo Sapiens
SISVLQGPS

SEQ ID NO: 1279387 - protein, 9 aa, Homo Sapiens
VLPRACTRL

SEQ ID NO: 1279388 - protein, 9 aa, Homo Sapiens
SIREAASAP

SEQ ID NO: 1279389 - protein, 9 aa, Homo Sapiens
DAICRDFSR

SEQ ID NO: 1279390 - protein, 9 aa, Homo Sapiens
RMEAVRLQK

SEQ ID NO: 1279391 - protein, 9 aa, Homo Sapiens
KYEDLETHI

SEQ ID NO: 1279392 - protein, 9 aa, Homo Sapiens
TAELKNATM

SEQ ID NO: 1279393 - protein, 9 aa, Homo Sapiens
LQVLKKILR

SEQ ID NO: 1279394 - protein, 9 aa, Homo Sapiens
PDDTQYFLY

SEQ ID NO: 1279395 - protein, 9 aa, Homo Sapiens
RNTGNFQPP

SEQ ID NO: 1279396 - protein, 9 aa, Homo Sapiens
VGNYIVLFA

SEQ ID NO: 1279397 - protein, 9 aa, Homo Sapiens
KGSQGFFPM

SEQ ID NO: 1279398 - protein, 9 aa, Homo Sapiens
VREMLQEEA

SEQ ID NO: 1279399 - protein, 9 aa, Homo Sapiens
PEGSSSSRR

SEQ ID NO: 1279400 - protein, 9 aa, Homo Sapiens
PAATRSLPC

SEQ ID NO: 1279401 - protein, 9 aa, Homo Sapiens
KVLEQPMVV

SEQ ID NO: 1279402 - protein, 9 aa, Homo Sapiens
NGLAMAAGI

SEQ ID NO: 1279403 - protein, 9 aa, Homo Sapiens
PSLVTLGQP

SEQ ID NO: 1279404 - protein, 9 aa, Homo Sapiens
IWEQTTSDL

SEQ ID NO: 1279405 - protein, 9 aa, Homo Sapiens
YVPVMIKGK

SEQ ID NO: 1279406 - protein, 9 aa, Homo Sapiens
TEASRDPAK

SEQ ID NO: 1279407 - protein, 9 aa, Homo Sapiens
ESTIFQMLI

SEQ ID NO: 1279408 - protein, 9 aa, Homo Sapiens
PSRSRWPGS

SEQ ID NO: 1279409 - protein, 9 aa, Homo Sapiens
DCPRTMAGP

SEQ ID NO: 1279410 - protein, 9 aa, Homo Sapiens
QSFGGLSLP

SEQ ID NO: 1279411 - protein, 9 aa, Homo Sapiens
LPCPGGRTV

SEQ ID NO: 1279412 - protein, 9 aa, Homo Sapiens
KQLEAVCSH

SEQ ID NO: 1279413 - protein, 9 aa, Homo Sapiens
ACTGDRPEA

SEQ ID NO: 1279414 - protein, 9 aa, Homo Sapiens
PYPWQCGSD

SEQ ID NO: 1279415 - protein, 9 aa, Homo Sapiens
PVADVPYRL

SEQ ID NO: 1279416 - protein, 9 aa, Homo Sapiens
ALGMLHVVQ

SEQ ID NO: 1279417 - protein, 9 aa, Homo Sapiens
CLPGLTHPA

SEQ ID NO: 1279418 - protein, 9 aa, Homo Sapiens
ADSGTEDHP

SEQ ID NO: 1279419 - protein, 9 aa, Homo Sapiens
SRASTSGLG

SEQ ID NO: 1279420 - protein, 9 aa, Homo Sapiens
AYEMNGQHL

SEQ ID NO: 1279421 - protein, 9 aa, Homo Sapiens
CVPPAATRS

SEQ ID NO: 1279422 - protein, 9 aa, Homo Sapiens
ENALFKWIL

SEQ ID NO: 1279423 - protein, 9 aa, Homo Sapiens
NANLEGVSD

SEQ ID NO: 1279424 - protein, 9 aa, Homo Sapiens
QSQPPSNRI

SEQ ID NO: 1279425 - protein, 9 aa, Homo Sapiens
CIRQVLQLL

SEQ ID NO: 1279426 - protein, 9 aa, Homo Sapiens
SVSKGLPLN

SEQ ID NO: 1279427 - protein, 9 aa, Homo Sapiens
RDFSRNVCK

SEQ ID NO: 1279428 - protein, 9 aa, Homo Sapiens
NELPLGSQL

SEQ ID NO: 1279429 - protein, 9 aa, Homo Sapiens
GRRRSLWYT

SEQ ID NO: 1279430 - protein, 9 aa, Homo Sapiens
EIDRERAAQ

SEQ ID NO: 1279431 - protein, 9 aa, Homo Sapiens
CRFREQRRR

SEQ ID NO: 1279432 - protein, 9 aa, Homo Sapiens
WILRCYEHK

SEQ ID NO: 1279433 - protein, 9 aa, Homo Sapiens
VPEKLPVEA

SEQ ID NO: 1279434 - protein, 9 aa, Homo Sapiens
APAPGPLSP

SEQ ID NO: 1279435 - protein, 9 aa, Homo Sapiens
TFLRWLGWA

SEQ ID NO: 1279436 - protein, 9 aa, Homo Sapiens
LATGLHVNW

SEQ ID NO: 1279437 - protein, 9 aa, Homo Sapiens
TPQEHPGLG

SEQ ID NO: 1279438 - protein, 9 aa, Homo Sapiens
RLSPMPVPR

SEQ ID NO: 1279439 - protein, 9 aa, Homo Sapiens
TAMNMAGLG

SEQ ID NO: 1279440 - protein, 9 aa, Homo Sapiens
GERLNRNGL

SEQ ID NO: 1279441 - protein, 9 aa, Homo Sapiens
FLSRKIQEQ

SEQ ID NO: 1279442 - protein, 9 aa, Homo Sapiens
CIGMMRTAK

SEQ ID NO: 1279443 - protein, 9 aa, Homo Sapiens
QHPGPGASC

SEQ ID NO: 1279444 - protein, 9 aa, Homo Sapiens
DEINGYCCS

SEQ ID NO: 1279445 - protein, 9 aa, Homo Sapiens
QHPTAHPSI

SEQ ID NO: 1279446 - protein, 9 aa, Homo Sapiens
CLHEATLIT

SEQ ID NO: 1279447 - protein, 9 aa, Homo Sapiens
MEECVLSSV

SEQ ID NO: 1279448 - protein, 9 aa, Homo Sapiens
SSSALATAE

SEQ ID NO: 1279449 - protein, 9 aa, Homo Sapiens
QFGAHLQVL

SEQ ID NO: 1279450 - protein, 9 aa, Homo Sapiens
LSRCRVIVP

SEQ ID NO: 1279451 - protein, 9 aa, Homo Sapiens
PRVLPRACT

SEQ ID NO: 1279452 - protein, 9 aa, Homo Sapiens
DNEDDFLLH

SEQ ID NO: 1279453 - protein, 9 aa, Homo Sapiens
GRCLCLFQS

SEQ ID NO: 1279454 - protein, 9 aa, Homo Sapiens
ARQSCCLPG

SEQ ID NO: 1279455 - protein, 9 aa, Homo Sapiens
DKDFEFALD

SEQ ID NO: 1279456 - protein, 9 aa, Homo Sapiens
KGAASCTET

SEQ ID NO: 1279457 - protein, 9 aa, Homo Sapiens
TVGKEFRSA

SEQ ID NO: 1279458 - protein, 9 aa, Homo Sapiens
TYVPVMIKG

SEQ ID NO: 1279459 - protein, 9 aa, Homo Sapiens
DEQGGDPKQ

SEQ ID NO: 1279460 - protein, 9 aa, Homo Sapiens
KLVVVGAVG

SEQ ID NO: 1279461 - protein, 9 aa, Homo Sapiens
NKLNEASRA

SEQ ID NO: 1279462 - protein, 9 aa, Homo Sapiens
YLQLHNKKE

SEQ ID NO: 1279463 - protein, 9 aa, Homo Sapiens
SMHQGVCEQ

SEQ ID NO: 1279464 - protein, 9 aa, Homo Sapiens
LKMRNLHFH

SEQ ID NO: 1279465 - protein, 9 aa, Homo Sapiens
AFWLSRSSG

SEQ ID NO: 1279466 - protein, 9 aa, Homo Sapiens
SPPLPWRSP

SEQ ID NO: 1279467 - protein, 9 aa, Homo Sapiens
EIKKKGYIT

SEQ ID NO: 1279468 - protein, 9 aa, Homo Sapiens
YTLGEQKFT

SEQ ID NO: 1279469 - protein, 9 aa, Homo Sapiens
EKSDSDGGD

SEQ ID NO: 1279470 - protein, 9 aa, Homo Sapiens
RFQSFGGLS

SEQ ID NO: 1279471 - protein, 9 aa, Homo Sapiens
KIEELNFIR

SEQ ID NO: 1279472 - protein, 9 aa, Homo Sapiens
QGCTAGTQH

SEQ ID NO: 1279473 - protein, 9 aa, Homo Sapiens
SRSRWPGSS

SEQ ID NO: 1279474 - protein, 9 aa, Homo Sapiens
DKMTPGNLG

SEQ ID NO: 1279475 - protein, 9 aa, Homo Sapiens
EDSPKSLKS

SEQ ID NO: 1279476 - protein, 9 aa, Homo Sapiens
RKRASAQCS

SEQ ID NO: 1279477 - protein, 9 aa, Homo Sapiens
GRRRRRTTI

SEQ ID NO: 1279478 - protein, 9 aa, Homo Sapiens
YLQCLSKLP

SEQ ID NO: 1279479 - protein, 9 aa, Homo Sapiens
LHLQRYSNL

SEQ ID NO: 1279480 - protein, 9 aa, Homo Sapiens
LACPQFVLG

SEQ ID NO: 1279481 - protein, 9 aa, Homo Sapiens
RQGLRFQSF

SEQ ID NO: 1279482 - protein, 9 aa, Homo Sapiens
IEKVLKIHK

SEQ ID NO: 1279483 - protein, 9 aa, Homo Sapiens
MQPRVLPRA

SEQ ID NO: 1279484 - protein, 9 aa, Homo Sapiens
RWPGLKQED

SEQ ID NO: 1279485 - protein, 9 aa, Homo Sapiens
ENGKWLRAC

SEQ ID NO: 1279486 - protein, 9 aa, Homo Sapiens
MIQMKTHSR

SEQ ID NO: 1279487 - protein, 9 aa, Homo Sapiens
DPAKMRRRS

SEQ ID NO: 1279488 - protein, 9 aa, Homo Sapiens
LLFLWRRFR

SEQ ID NO: 1279489 - protein, 9 aa, Homo Sapiens
NVSTRPSAA

SEQ ID NO: 1279490 - protein, 9 aa, Homo Sapiens
RGTYIPRGS

SEQ ID NO: 1279491 - protein, 9 aa, Homo Sapiens
LETQLPSVL

SEQ ID NO: 1279492 - protein, 9 aa, Homo Sapiens
HQQDFTRAI

SEQ ID NO: 1279493 - protein, 9 aa, Homo Sapiens
FAPFFVPMS

SEQ ID NO: 1279494 - protein, 9 aa, Homo Sapiens
GAWKFWSLP

SEQ ID NO: 1279495 - protein, 9 aa, Homo Sapiens
SVTQEFILL

SEQ ID NO: 1279496 - protein, 9 aa, Homo Sapiens
NLPGRATAR

SEQ ID NO: 1279497 - protein, 9 aa, Homo Sapiens
SLVTLGQPA

SEQ ID NO: 1279498 - protein, 9 aa, Homo Sapiens
AWSTVVQYL

SEQ ID NO: 1279499 - protein, 9 aa, Homo Sapiens
MVSLFGVRS

SEQ ID NO: 1279500 - protein, 9 aa, Homo Sapiens
TAGSLATGL

SEQ ID NO: 1279501 - protein, 9 aa, Homo Sapiens
VRPLSHAFF

SEQ ID NO: 1279502 - protein, 9 aa, Homo Sapiens
ATSLLVVGF

SEQ ID NO: 1279503 - protein, 9 aa, Homo Sapiens
YKLVVVGAV

SEQ ID NO: 1279504 - protein, 9 aa, Homo Sapiens
RRRSARWPT

SEQ ID NO: 1279505 - protein, 9 aa, Homo Sapiens
PSPFTVCKP

SEQ ID NO: 1279506 - protein, 9 aa, Homo Sapiens
HPAHQPLGS

SEQ ID NO: 1279507 - protein, 9 aa, Homo Sapiens
QMKTHSRNI

SEQ ID NO: 1279508 - protein, 9 aa, Homo Sapiens
QWAYCGKMN

SEQ ID NO: 1279509 - protein, 9 aa, Homo Sapiens
RSPSSSRHR

SEQ ID NO: 1279510 - protein, 9 aa, Homo Sapiens
SHVCSRTPV

SEQ ID NO: 1279511 - protein, 9 aa, Homo Sapiens
GPAISHINT

SEQ ID NO: 1279512 - protein, 9 aa, Homo Sapiens
YTSQYTPVP

SEQ ID NO: 1279513 - protein, 9 aa, Homo Sapiens
LLSQWAYCG

SEQ ID NO: 1279514 - protein, 9 aa, Homo Sapiens
NSSLSISPN

SEQ ID NO: 1279515 - protein, 9 aa, Homo Sapiens
LQALCQSRE

SEQ ID NO: 1279516 - protein, 9 aa, Homo Sapiens
VKKLNTNIL

SEQ ID NO: 1279517 - protein, 9 aa, Homo Sapiens
SRIHSGATT

SEQ ID NO: 1279518 - protein, 9 aa, Homo Sapiens
IVSKNAGET

SEQ ID NO: 1279519 - protein, 9 aa, Homo Sapiens
MRMQNNSSL

SEQ ID NO: 1279520 - protein, 9 aa, Homo Sapiens
RAPPACHLI

SEQ ID NO: 1279521 - protein, 9 aa, Homo Sapiens
PISESMLER

SEQ ID NO: 1279522 - protein, 9 aa, Homo Sapiens
NNYVTSRSS

SEQ ID NO: 1279523 - protein, 9 aa, Homo Sapiens
VTTKRTVQL

SEQ ID NO: 1279524 - protein, 9 aa, Homo Sapiens
HINTACFEA

SEQ ID NO: 1279525 - protein, 9 aa, Homo Sapiens
AVKKLNTNI

SEQ ID NO: 1279526 - protein, 9 aa, Homo Sapiens
THNCVHLMQ

SEQ ID NO: 1279527 - protein, 9 aa, Homo Sapiens
TSLVAGDLD

SEQ ID NO: 1279528 - protein, 9 aa, Homo Sapiens
IVLESKHLD

SEQ ID NO: 1279529 - protein, 9 aa, Homo Sapiens
WLLQMCKSY

SEQ ID NO: 1279530 - protein, 9 aa, Homo Sapiens
LIKVIESKD

SEQ ID NO: 1279531 - protein, 9 aa, Homo Sapiens
YVTSRSSSF

SEQ ID NO: 1279532 - protein, 9 aa, Homo Sapiens
ILFNNYVTS

SEQ ID NO: 1279533 - protein, 9 aa, Homo Sapiens
KNTNATASN

SEQ ID NO: 1279534 - protein, 9 aa, Homo Sapiens
HLDRATDKS

SEQ ID NO: 1279535 - protein, 9 aa, Homo Sapiens
ENNWQPEHQ

SEQ ID NO: 1279536 - protein, 9 aa, Homo Sapiens
IVFVRTSPQ

SEQ ID NO: 1279537 - protein, 9 aa, Homo Sapiens
NSQARLSFM

SEQ ID NO: 1279538 - protein, 9 aa, Homo Sapiens
ESKHLDRAT

SEQ ID NO: 1279539 - protein, 9 aa, Homo Sapiens
REFIRNTCR

SEQ ID NO: 1279540 - protein, 9 aa, Homo Sapiens
SESMLERLS

SEQ ID NO: 1279541 - protein, 9 aa, Homo Sapiens
LNSQARLSF

SEQ ID NO: 1279542 - protein, 9 aa, Homo Sapiens
ESMLERLSK

SEQ ID NO: 1279543 - protein, 9 aa, Homo Sapiens
LQINDPEQE

SEQ ID NO: 1279544 - protein, 9 aa, Homo Sapiens
IFSGPAISH

SEQ ID NO: 1279545 - protein, 9 aa, Homo Sapiens
VRTSPQQKL

SEQ ID NO: 1279546 - protein, 9 aa, Homo Sapiens
RILQESTRK

SEQ ID NO: 1279547 - protein, 9 aa, Homo Sapiens
PTILHCSCP

SEQ ID NO: 1279548 - protein, 9 aa, Homo Sapiens
RDKLTGRYF

SEQ ID NO: 1279549 - protein, 9 aa, Homo Sapiens
FAETHNCVH

SEQ ID NO: 1279550 - protein, 9 aa, Homo Sapiens
YALDENGDL

SEQ ID NO: 1279551 - protein, 9 aa, Homo Sapiens
LCLVQISNT

SEQ ID NO: 1279552 - protein, 9 aa, Homo Sapiens
FFNDRLLVY

SEQ ID NO: 1279553 - protein, 9 aa, Homo Sapiens
GQERLCLVQ

SEQ ID NO: 1279554 - protein, 9 aa, Homo Sapiens
CSCPKNRKN

SEQ ID NO: 1279555 - protein, 9 aa, Homo Sapiens
NDPEQEFLE

SEQ ID NO: 1279556 - protein, 9 aa, Homo Sapiens
FIVLESKHL

SEQ ID NO: 1279557 - protein, 9 aa, Homo Sapiens
NWDDLINKI

SEQ ID NO: 1279558 - protein, 9 aa, Homo Sapiens
HNCVHLMQA

SEQ ID NO: 1279559 - protein, 9 aa, Homo Sapiens
HKMAGWGTY

SEQ ID NO: 1279560 - protein, 9 aa, Homo Sapiens
QALCQSRED

SEQ ID NO: 1279561 - protein, 9 aa, Homo Sapiens
ESTRKLNTQ

SEQ ID NO: 1279562 - protein, 9 aa, Homo Sapiens
SRHRDSKTD

SEQ ID NO: 1279563 - protein, 9 aa, Homo Sapiens
PFGLIMFCN

SEQ ID NO: 1279564 - protein, 9 aa, Homo Sapiens
RIHSGATTT

SEQ ID NO: 1279565 - protein, 9 aa, Homo Sapiens
TTKRTVQLN

SEQ ID NO: 1279566 - protein, 9 aa, Homo Sapiens
EKRIQKVKN

SEQ ID NO: 1279567 - protein, 9 aa, Homo Sapiens
SPSSSRHRD

SEQ ID NO: 1279568 - protein, 9 aa, Homo Sapiens
ISESMLERL

SEQ ID NO: 1279569 - protein, 9 aa, Homo Sapiens
AGWGTYGSE

SEQ ID NO: 1279570 - protein, 9 aa, Homo Sapiens
GDLWYRQGI

SEQ ID NO: 1279571 - protein, 9 aa, Homo Sapiens
AMQGAYTSQ

SEQ ID NO: 1279572 - protein, 9 aa, Homo Sapiens
IRVVKAFHS

SEQ ID NO: 1279573 - protein, 9 aa, Homo Sapiens
GWLHKRGKY

SEQ ID NO: 1279574 - protein, 9 aa, Homo Sapiens
NECEVSPGV

SEQ ID NO: 1279575 - protein, 9 aa, Homo Sapiens
SLVQSPRLS

SEQ ID NO: 1279576 - protein, 9 aa, Homo Sapiens
QERLCLVQI

SEQ ID NO: 1279577 - protein, 9 aa, Homo Sapiens
TVCKRGNLW

SEQ ID NO: 1279578 - protein, 9 aa, Homo Sapiens
AISHINTAC

SEQ ID NO: 1279579 - protein, 9 aa, Homo Sapiens
WLHKRGKYI

SEQ ID NO: 1279580 - protein, 9 aa, Homo Sapiens
RDSKTDREK

SEQ ID NO: 1279581 - protein, 9 aa, Homo Sapiens
NCVHLMQAA

SEQ ID NO: 1279582 - protein, 9 aa, Homo Sapiens
THTHTHTAI

SEQ ID NO: 1279583 - protein, 9 aa, Homo Sapiens
STLNFLPLS

SEQ ID NO: 1279584 - protein, 9 aa, Homo Sapiens
RTWLLQMCK

SEQ ID NO: 1279585 - protein, 9 aa, Homo Sapiens
DENGDLWYR

SEQ ID NO: 1279586 - protein, 9 aa, Homo Sapiens
RRLIVSKNA

SEQ ID NO: 1279587 - protein, 9 aa, Homo Sapiens
LINKITPPF

SEQ ID NO: 1279588 - protein, 9 aa, Homo Sapiens
LVQISNTLL

SEQ ID NO: 1279589 - protein, 9 aa, Homo Sapiens
EYHTSLVAG

SEQ ID NO: 1279590 - protein, 9 aa, Homo Sapiens
PSLFFNDRL

SEQ ID NO: 1279591 - protein, 9 aa, Homo Sapiens
HTEIVFVRT

SEQ ID NO: 1279592 - protein, 9 aa, Homo Sapiens
SLVAGDLDH

SEQ ID NO: 1279593 - protein, 9 aa, Homo Sapiens
NFLPLSLVQ

SEQ ID NO: 1279594 - protein, 9 aa, Homo Sapiens
APPACHLIF

SEQ ID NO: 1279595 - protein, 9 aa, Homo Sapiens
SGPAISHIN

SEQ ID NO: 1279596 - protein, 9 aa, Homo Sapiens
NYVTSRSSS

SEQ ID NO: 1279597 - protein, 9 aa, Homo Sapiens
IRNTCRAAQ

SEQ ID NO: 1279598 - protein, 9 aa, Homo Sapiens
QEYHTSLVA

SEQ ID NO: 1279599 - protein, 9 aa, Homo Sapiens
MQGAYTSQY

SEQ ID NO: 1279600 - protein, 9 aa, Homo Sapiens
KKLNTNILY

SEQ ID NO: 1279601 - protein, 9 aa, Homo Sapiens
KKNTNATAS

SEQ ID NO: 1279602 - protein, 9 aa, Homo Sapiens
AETHNCVHL

SEQ ID NO: 1279603 - protein, 9 aa, Homo Sapiens
LIMFCNAGI

SEQ ID NO: 1279604 - protein, 9 aa, Homo Sapiens
KNQEKMLLK

SEQ ID NO: 1279605 - protein, 9 aa, Homo Sapiens
QESTRKLNT

SEQ ID NO: 1279606 - protein, 9 aa, Homo Sapiens
EARRLIVSK

SEQ ID NO: 1279607 - protein, 9 aa, Homo Sapiens
KNHTEIVFV

SEQ ID NO: 1279608 - protein, 9 aa, Homo Sapiens
KSGFFVYFF

SEQ ID NO: 1279609 - protein, 9 aa, Homo Sapiens
DTVCKRGNL

SEQ ID NO: 1279610 - protein, 9 aa, Homo Sapiens
FDNLLSQWA

SEQ ID NO: 1279611 - protein, 9 aa, Homo Sapiens
KHLDRATDK

SEQ ID NO: 1279612 - protein, 9 aa, Homo Sapiens
RGKYIKTWR

SEQ ID NO: 1279613 - protein, 9 aa, Homo Sapiens
AQLLGCSHV

SEQ ID NO: 1279614 - protein, 9 aa, Homo Sapiens
RYFSHDDTL

SEQ ID NO: 1279615 - protein, 9 aa, Homo Sapiens
FMNEALSVI

SEQ ID NO: 1279616 - protein, 9 aa, Homo Sapiens
DDLINKITP

SEQ ID NO: 1279617 - protein, 9 aa, Homo Sapiens
ETHNCVHLM

SEQ ID NO: 1279618 - protein, 9 aa, Homo Sapiens
ILHCSCPKN

SEQ ID NO: 1279619 - protein, 9 aa, Homo Sapiens
PEARRLIVS

SEQ ID NO: 1279620 - protein, 9 aa, Homo Sapiens
TSQYTPVPS

SEQ ID NO: 1279621 - protein, 9 aa, Homo Sapiens
CTHTHTHTH

SEQ ID NO: 1279622 - protein, 9 aa, Homo Sapiens
GPMNLDRKV

SEQ ID NO: 1279623 - protein, 9 aa, Homo Sapiens
DLWYRQGIT

SEQ ID NO: 1279624 - protein, 9 aa, Homo Sapiens
HKRGKYIKT

SEQ ID NO: 1279625 - protein, 9 aa, Homo Sapiens
EIVFVRTSP

SEQ ID NO: 1279626 - protein, 9 aa, Homo Sapiens
TSRSSSFPG

SEQ ID NO: 1279627 - protein, 9 aa, Homo Sapiens
SPGVCPNGR

SEQ ID NO: 1279628 - protein, 9 aa, Homo Sapiens
QINDPEQEF

SEQ ID NO: 1279629 - protein, 9 aa, Homo Sapiens
NEVDSFFCG

SEQ ID NO: 1279630 - protein, 9 aa, Homo Sapiens
FVRTSPQQK

SEQ ID NO: 1279631 - protein, 9 aa, Homo Sapiens
RVVKAFHSS

SEQ ID NO: 1279632 - protein, 9 aa, Homo Sapiens
TCRAAQNIS

SEQ ID NO: 1279633 - protein, 9 aa, Homo Sapiens
CHLIFCGEP

SEQ ID NO: 1279634 - protein, 9 aa, Homo Sapiens
QPEHQVPFN

SEQ ID NO: 1279635 - protein, 9 aa, Homo Sapiens
ERTWLLQMC

SEQ ID NO: 1279636 - protein, 9 aa, Homo Sapiens
TEIVFVRTS

SEQ ID NO: 1279637 - protein, 9 aa, Homo Sapiens
ALVSPISES

SEQ ID NO: 1279638 - protein, 9 aa, Homo Sapiens
VCSRTPVET

SEQ ID NO: 1279639 - protein, 9 aa, Homo Sapiens
TEESEIRYS

SEQ ID NO: 1279640 - protein, 9 aa, Homo Sapiens
PAISHINTA

SEQ ID NO: 1279641 - protein, 9 aa, Homo Sapiens
VRDKLTGRY

SEQ ID NO: 1279642 - protein, 9 aa, Homo Sapiens
LIFCGEPPA

SEQ ID NO: 1279643 - protein, 9 aa, Homo Sapiens
GCSHVCSRT

SEQ ID NO: 1279644 - protein, 9 aa, Homo Sapiens
QMCKSYAVP

SEQ ID NO: 1279645 - protein, 9 aa, Homo Sapiens
MQNNSSLSI

SEQ ID NO: 1279646 - protein, 9 aa, Homo Sapiens
FENNWQPEH

SEQ ID NO: 1279647 - protein, 9 aa, Homo Sapiens
SQARLSFMV

SEQ ID NO: 1279648 - protein, 9 aa, Homo Sapiens
LPLSLVQSP

SEQ ID NO: 1279649 - protein, 9 aa, Homo Sapiens
HTHTHTHTA

SEQ ID NO: 1279650 - protein, 9 aa, Homo Sapiens
HTSLVAGDL

SEQ ID NO: 1279651 - protein, 9 aa, Homo Sapiens
KLTGRYFSH

SEQ ID NO: 1279652 - protein, 9 aa, Homo Sapiens
ISHINTACF

SEQ ID NO: 1279653 - protein, 9 aa, Homo Sapiens
LFFNDRLLV

SEQ ID NO: 1279654 - protein, 9 aa, Homo Sapiens
AFHSSLYEG

SEQ ID NO: 1279655 - protein, 9 aa, Homo Sapiens
DPEQEFLER

SEQ ID NO: 1279656 - protein, 9 aa, Homo Sapiens
EVSPGVCPN

SEQ ID NO: 1279657 - protein, 9 aa, Homo Sapiens
NWQPEHQVP

SEQ ID NO: 1279658 - protein, 9 aa, Homo Sapiens
FMVKKVRLP

SEQ ID NO: 1279659 - protein, 9 aa, Homo Sapiens
ECEVSPGVC

SEQ ID NO: 1279660 - protein, 9 aa, Homo Sapiens
FVLPFGLIM

SEQ ID NO: 1279661 - protein, 9 aa, Homo Sapiens
KAFHSSLYE

SEQ ID NO: 1279662 - protein, 9 aa, Homo Sapiens
KRTVQLNVS

SEQ ID NO: 1279663 - protein, 9 aa, Homo Sapiens
VYADGPMNL

SEQ ID NO: 1279664 - protein, 9 aa, Homo Sapiens
LSFMVKKVR

SEQ ID NO: 1279665 - protein, 9 aa, Homo Sapiens
YFSHDDTLD

SEQ ID NO: 1279666 - protein, 9 aa, Homo Sapiens
VVYADGPMN

SEQ ID NO: 1279667 - protein, 9 aa, Homo Sapiens
DVNECEVSP

SEQ ID NO: 1279668 - protein, 9 aa, Homo Sapiens
VLPFGLIMF

SEQ ID NO: 1279669 - protein, 9 aa, Homo Sapiens
ALCQSREDC

SEQ ID NO: 1279670 - protein, 9 aa, Homo Sapiens
INDPEQEFL

SEQ ID NO: 1279671 - protein, 9 aa, Homo Sapiens
NTCRAAQNI

SEQ ID NO: 1279672 - protein, 9 aa, Homo Sapiens
KREFIRNTC

SEQ ID NO: 1279673 - protein, 9 aa, Homo Sapiens
THTHTAIPL

SEQ ID NO: 1279674 - protein, 9 aa, Homo Sapiens
CRAAQNISE

SEQ ID NO: 1279675 - protein, 9 aa, Homo Sapiens
FIRNTCRAA

SEQ ID NO: 1279676 - protein, 9 aa, Homo Sapiens
SKNAGETLL

SEQ ID NO: 1279677 - protein, 9 aa, Homo Sapiens
IIFIFMNEA

SEQ ID NO: 1279678 - protein, 9 aa, Homo Sapiens
GWGTYGSEE

SEQ ID NO: 1279679 - protein, 9 aa, Homo Sapiens
EKKNTNATA

SEQ ID NO: 1279680 - protein, 9 aa, Homo Sapiens
INTEESEIR

SEQ ID NO: 1279681 - protein, 9 aa, Homo Sapiens
SHINTACFE

SEQ ID NO: 1279682 - protein, 9 aa, Homo Sapiens
NNWQPEHQV

SEQ ID NO: 1279683 - protein, 9 aa, Homo Sapiens
RNTCRAAQN

SEQ ID NO: 1279684 - protein, 9 aa, Homo Sapiens
HQVPFNEVR

SEQ ID NO: 1279685 - protein, 9 aa, Homo Sapiens
RFEPQINTE

SEQ ID NO: 1279686 - protein, 9 aa, Homo Sapiens
HRDSKTDRE

SEQ ID NO: 1279687 - protein, 9 aa, Homo Sapiens
IFCGEPPAI

SEQ ID NO: 1279688 - protein, 9 aa, Homo Sapiens
LVVYADGPM

SEQ ID NO: 1279689 - protein, 9 aa, Homo Sapiens
LFIVLESKH

SEQ ID NO: 1279690 - protein, 9 aa, Homo Sapiens
RHRDSKTDR

SEQ ID NO: 1279691 - protein, 9 aa, Homo Sapiens
IKVIESKDY

SEQ ID NO: 1279692 - protein, 9 aa, Homo Sapiens
YFDNLLSQW

SEQ ID NO: 1279693 - protein, 9 aa, Homo Sapiens
GAYTSQYTP

SEQ ID NO: 1279694 - protein, 9 aa, Homo Sapiens
YADGPMNLD

SEQ ID NO: 1279695 - protein, 9 aa, Homo Sapiens
ERLCLVQIS

SEQ ID NO: 1279696 - protein, 9 aa, Homo Sapiens
RLCLVQISN

SEQ ID NO: 1279697 - protein, 9 aa, Homo Sapiens
GRYFSHDDT

SEQ ID NO: 1279698 - protein, 9 aa, Homo Sapiens
WQPEHQVPF

SEQ ID NO: 1279699 - protein, 9 aa, Homo Sapiens
QVTTKRTVQ

SEQ ID NO: 1279700 - protein, 9 aa, Homo Sapiens
SSSRHRDSK

SEQ ID NO: 1279701 - protein, 9 aa, Homo Sapiens
SVCEKKNTN

SEQ ID NO: 1279702 - protein, 9 aa, Homo Sapiens
HCSCPKNRK

SEQ ID NO: 1279703 - protein, 9 aa, Homo Sapiens
FNNYVTSRS

SEQ ID NO: 1279704 - protein, 9 aa, Homo Sapiens
WERTWLLQM

SEQ ID NO: 1279705 - protein, 9 aa, Homo Sapiens
FSGPAISHI

SEQ ID NO: 1279706 - protein, 9 aa, Homo Sapiens
WAYCGKMNF

SEQ ID NO: 1279707 - protein, 9 aa, Homo Sapiens
QNNSSLSIS

SEQ ID NO: 1279708 - protein, 9 aa, Homo Sapiens
VPSLFFNDR

SEQ ID NO: 1279709 - protein, 9 aa, Homo Sapiens
KRELQALCQ

SEQ ID NO: 1279710 - protein, 9 aa, Homo Sapiens
LFNNYVTSR

SEQ ID NO: 1279711 - protein, 9 aa, Homo Sapiens
KLNTNILYL

SEQ ID NO: 1279712 - protein, 9 aa, Homo Sapiens
ARRLIVSKN

SEQ ID NO: 1279713 - protein, 9 aa, Homo Sapiens
MAGWGTYGS

SEQ ID NO: 1279714 - protein, 9 aa, Homo Sapiens
IMFCNAGII

SEQ ID NO: 1279715 - protein, 9 aa, Homo Sapiens
QEFLERPSR

SEQ ID NO: 1279716 - protein, 9 aa, Homo Sapiens
MNSVCEKKN

SEQ ID NO: 1279717 - protein, 9 aa, Homo Sapiens
MDTVCKRGN

SEQ ID NO: 1279718 - protein, 9 aa, Homo Sapiens
SLFFNDRLL

SEQ ID NO: 1279719 - protein, 9 aa, Homo Sapiens
YLDSRIHSG

SEQ ID NO: 1279720 - protein, 9 aa, Homo Sapiens
NTEESEIRY

SEQ ID NO: 1279721 - protein, 9 aa, Homo Sapiens
TWLLQMCKS

SEQ ID NO: 1279722 - protein, 9 aa, Homo Sapiens
LHCSCPKNR

SEQ ID NO: 1279723 - protein, 9 aa, Homo Sapiens
SYLDSRIHS

SEQ ID NO: 1279724 - protein, 9 aa, Homo Sapiens
VQEYHTSLV

SEQ ID NO: 1279725 - protein, 9 aa, Homo Sapiens
VLESKHLDR

SEQ ID NO: 1279726 - protein, 9 aa, Homo Sapiens
IESKDYGQQ

SEQ ID NO: 1279727 - protein, 9 aa, Homo Sapiens
FNDRLLVYG

SEQ ID NO: 1279728 - protein, 9 aa, Homo Sapiens
QARLSFMVK

SEQ ID NO: 1279729 - protein, 9 aa, Homo Sapiens
FFCGLPLVI

SEQ ID NO: 1279730 - protein, 9 aa, Homo Sapiens
ILQESTRKL

SEQ ID NO: 1279731 - protein, 9 aa, Homo Sapiens
VKNQEKMLL

SEQ ID NO: 1279732 - protein, 9 aa, Homo Sapiens
FHKMAGWGT

SEQ ID NO: 1279733 - protein, 9 aa, Homo Sapiens
RPTILHCSC

SEQ ID NO: 1279734 - protein, 9 aa, Homo Sapiens
MFCNAGIIR

SEQ ID NO: 1279735 - protein, 9 aa, Homo Sapiens
VIESKDYGQ

SEQ ID NO: 1279736 - protein, 9 aa, Homo Sapiens
EHQVPFNEV

SEQ ID NO: 1279737 - protein, 9 aa, Homo Sapiens
PLSLVQSPR

SEQ ID NO: 1279738 - protein, 9 aa, Homo Sapiens
HTHTAIPLH

SEQ ID NO: 1279739 - protein, 9 aa, Homo Sapiens
EKRELQALC

SEQ ID NO: 1279740 - protein, 9 aa, Homo Sapiens
FIFMNEALS

SEQ ID NO: 1279741 - protein, 9 aa, Homo Sapiens
RLSFMVKKV

SEQ ID NO: 1279742 - protein, 9 aa, Homo Sapiens
QQFHKMAGW

SEQ ID NO: 1279743 - protein, 9 aa, Homo Sapiens
IFIFMNEAL

SEQ ID NO: 1279744 - protein, 9 aa, Homo Sapiens
THTAIPLHL

SEQ ID NO: 1279745 - protein, 9 aa, Homo Sapiens
KDYGQQLEI

SEQ ID NO: 1279746 - protein, 9 aa, Homo Sapiens
MNEALSVIL

SEQ ID NO: 1279747 - protein, 9 aa, Homo Sapiens
AYTSQYTPV

SEQ ID NO: 1279748 - protein, 9 aa, Homo Sapiens
VKAFHSSLY

SEQ ID NO: 1279749 - protein, 9 aa, Homo Sapiens
VDSFFCGLP

SEQ ID NO: 1279750 - protein, 9 aa, Homo Sapiens
VTSRSSSFP

SEQ ID NO: 1279751 - protein, 9 aa, Homo Sapiens
LHKRGKYIK

SEQ ID NO: 1279752 - protein, 9 aa, Homo Sapiens
SLSISPNTS

SEQ ID NO: 1279753 - protein, 9 aa, Homo Sapiens
CLVQISNTL

SEQ ID NO: 1279754 - protein, 9 aa, Homo Sapiens
ERFEPQINT

SEQ ID NO: 1279755 - protein, 9 aa, Homo Sapiens
EDVNECEVS

SEQ ID NO: 1279756 - protein, 9 aa, Homo Sapiens
AQVTTKRTV

SEQ ID NO: 1279757 - protein, 9 aa, Homo Sapiens
SKDYGQQLE

SEQ ID NO: 1279758 - protein, 9 aa, Homo Sapiens
RLIVSKNAG

SEQ ID NO: 1279759 - protein, 9 aa, Homo Sapiens
EVDSFFCGL

SEQ ID NO: 1279760 - protein, 9 aa, Homo Sapiens
EQEFLERPS

SEQ ID NO: 1279761 - protein, 9 aa, Homo Sapiens
QSYLDSRIH

SEQ ID NO: 1279762 - protein, 9 aa, Homo Sapiens
ARLSFMVKK

SEQ ID NO: 1279763 - protein, 9 aa, Homo Sapiens
QFHKMAGWG

SEQ ID NO: 1279764 - protein, 9 aa, Homo Sapiens
PVQEYHTSL

SEQ ID NO: 1279765 - protein, 9 aa, Homo Sapiens
VQISNTLLK

SEQ ID NO: 1279766 - protein, 9 aa, Homo Sapiens
SSRHRDSKT

SEQ ID NO: 1279767 - protein, 9 aa, Homo Sapiens
PMNLDRKVE

SEQ ID NO: 1279768 - protein, 9 aa, Homo Sapiens
MCKSYAVPC

SEQ ID NO: 1279769 - protein, 9 aa, Homo Sapiens
LDENGDLWY

SEQ ID NO: 1279770 - protein, 9 aa, Homo Sapiens
SSLSISPNT

SEQ ID NO: 1279771 - protein, 9 aa, Homo Sapiens
MRPTILHCS

SEQ ID NO: 1279772 - protein, 9 aa, Homo Sapiens
IFMNEALSV

SEQ ID NO: 1279773 - protein, 9 aa, Homo Sapiens
GKYIKTWRP

SEQ ID NO: 1279774 - protein, 9 aa, Homo Sapiens
DGPMNLDRK

SEQ ID NO: 1279775 - protein, 9 aa, Homo Sapiens
WDDLINKIT

SEQ ID NO: 1279776 - protein, 9 aa, Homo Sapiens
LGCSHVCSR

SEQ ID NO: 1279777 - protein, 9 aa, Homo Sapiens
QQSYLDSRI

SEQ ID NO: 1279778 - protein, 9 aa, Homo Sapiens
KVIESKDYG

SEQ ID NO: 1279779 - protein, 9 aa, Homo Sapiens
STRKLNTQG

SEQ ID NO: 1279780 - protein, 9 aa, Homo Sapiens
AQVPSLFFN

SEQ ID NO: 1279781 - protein, 9 aa, Homo Sapiens
RRILQESTR

SEQ ID NO: 1279782 - protein, 9 aa, Homo Sapiens
VFVRTSPQQ

SEQ ID NO: 1279783 - protein, 9 aa, Homo Sapiens
GKSGFFVYF

SEQ ID NO: 1279784 - protein, 9 aa, Homo Sapiens
SRSSSFPGG

SEQ ID NO: 1279785 - protein, 9 aa, Homo Sapiens
SFMVKKVRL

SEQ ID NO: 1279786 - protein, 9 aa, Homo Sapiens
KRIQKVKNQ

SEQ ID NO: 1279787 - protein, 9 aa, Homo Sapiens
CQSREDCGC

SEQ ID NO: 1279788 - protein, 9 aa, Homo Sapiens
FHSSLYEGL

SEQ ID NO: 1279789 - protein, 9 aa, Homo Sapiens
LCQSREDCG

SEQ ID NO: 1279790 - protein, 9 aa, Homo Sapiens
QQQSYLDSR

SEQ ID NO: 1279791 - protein, 9 aa, Homo Sapiens
FFVYFFDIF

SEQ ID NO: 1279792 - protein, 9 aa, Homo Sapiens
EFIRNTCRA

SEQ ID NO: 1279793 - protein, 9 aa, Homo Sapiens
SPISESMLE

SEQ ID NO: 1279794 - protein, 9 aa, Homo Sapiens
VSKNAGETL

SEQ ID NO: 1279795 - protein, 9 aa, Homo Sapiens
NHTEIVFVR

SEQ ID NO: 1279796 - protein, 9 aa, Homo Sapiens
DGQERLCLV

SEQ ID NO: 1279797 - protein, 9 aa, Homo Sapiens
QIRVVKAFH

SEQ ID NO: 1279798 - protein, 9 aa, Homo Sapiens
PEQEFLERP

SEQ ID NO: 1279799 - protein, 9 aa, Homo Sapiens
QGAYTSQYT

SEQ ID NO: 1279800 - protein, 9 aa, Homo Sapiens
QKVKNQEKM

SEQ ID NO: 1279801 - protein, 9 aa, Homo Sapiens
LNTNILYLC

SEQ ID NO: 1279802 - protein, 9 aa, Homo Sapiens
VHLMQAAEV

SEQ ID NO: 1279803 - protein, 9 aa, Homo Sapiens
NTNILYLCF

SEQ ID NO: 1279804 - protein, 9 aa, Homo Sapiens
QISIIFIFM

SEQ ID NO: 1279805 - protein, 9 aa, Homo Sapiens
NNSSLSISP

SEQ ID NO: 1279806 - protein, 9 aa, Homo Sapiens
DNLLSQWAY

SEQ ID NO: 1279807 - protein, 9 aa, Homo Sapiens
KRGKYIKTW

SEQ ID NO: 1279808 - protein, 9 aa, Homo Sapiens
TRKLNTQGS

SEQ ID NO: 1279809 - protein, 9 aa, Homo Sapiens
ISIIFIFMN

SEQ ID NO: 1279810 - protein, 9 aa, Homo Sapiens
NGDLWYRQG

SEQ ID NO: 1279811 - protein, 9 aa, Homo Sapiens
YRRILQEST

SEQ ID NO: 1279812 - protein, 9 aa, Homo Sapiens
VSPGVCPNG

SEQ ID NO: 1279813 - protein, 9 aa, Homo Sapiens
AAMQGAYTS

SEQ ID NO: 1279814 - protein, 9 aa, Homo Sapiens
LVSPISESM

SEQ ID NO: 1279815 - protein, 9 aa, Homo Sapiens
YHTSLVAGD

SEQ ID NO: 1279816 - protein, 9 aa, Homo Sapiens
KYIKTWRPR

SEQ ID NO: 1279817 - protein, 9 aa, Homo Sapiens
KVKNQEKML

SEQ ID NO: 1279818 - protein, 9 aa, Homo Sapiens
QVPSLFFND

SEQ ID NO: 1279819 - protein, 9 aa, Homo Sapiens
IQKVKNQEK

SEQ ID NO: 1279820 - protein, 9 aa, Homo Sapiens
NLLSQWAYC

SEQ ID NO: 1279821 - protein, 9 aa, Homo Sapiens
FEPQINTEE

SEQ ID NO: 1279822 - protein, 9 aa, Homo Sapiens
CEVSPGVCP

SEQ ID NO: 1279823 - protein, 9 aa, Homo Sapiens
KMAGWGTYG

SEQ ID NO: 1279824 - protein, 9 aa, Homo Sapiens
AAAMQGAYT

SEQ ID NO: 1279825 - protein, 9 aa, Homo Sapiens
LLQMCKSYA

SEQ ID NO: 1279826 - protein, 9 aa, Homo Sapiens
DLQINDPEQ

SEQ ID NO: 1279827 - protein, 9 aa, Homo Sapiens
NSVCEKKNT

SEQ ID NO: 1279828 - protein, 9 aa, Homo Sapiens
VCEKKNTNA

SEQ ID NO: 1279829 - protein, 9 aa, Homo Sapiens
ELQALCQSR

SEQ ID NO: 1279830 - protein, 9 aa, Homo Sapiens
PQINTEESE

SEQ ID NO: 1279831 - protein, 9 aa, Homo Sapiens
HVCSRTPVE

SEQ ID NO: 1279832 - protein, 9 aa, Homo Sapiens
NKITPPFNP

SEQ ID NO: 1279833 - protein, 9 aa, Homo Sapiens
TGKSGFFVY

SEQ ID NO: 1279834 - protein, 9 aa, Homo Sapiens
LQMCKSYAV

SEQ ID NO: 1279835 - protein, 9 aa, Homo Sapiens
LESKHLDRA

SEQ ID NO: 1279836 - protein, 9 aa, Homo Sapiens
SGFFVYFFD

SEQ ID NO: 1279837 - protein, 9 aa, Homo Sapiens
DKLTGRYFS

SEQ ID NO: 1279838 - protein, 9 aa, Homo Sapiens
GFFVYFFDI

SEQ ID NO: 1279839 - protein, 9 aa, Homo Sapiens
GLIMFCNAG

SEQ ID NO: 1279840 - protein, 9 aa, Homo Sapiens
HSSLYEGLE

SEQ ID NO: 1279841 - protein, 9 aa, Homo Sapiens
HTAIPLHLH

SEQ ID NO: 1279842 - protein, 9 aa, Homo Sapiens
VSPISESML

SEQ ID NO: 1279843 - protein, 9 aa, Homo Sapiens
MNLDRKVED

SEQ ID NO: 1279844 - protein, 9 aa, Homo Sapiens
TGRYFSHDD

SEQ ID NO: 1279845 - protein, 9 aa, Homo Sapiens
SIIFIFMNE

SEQ ID NO: 1279846 - protein, 9 aa, Homo Sapiens
YFFDIFPRT

SEQ ID NO: 1279847 - protein, 9 aa, Homo Sapiens
PPACHLIFC

SEQ ID NO: 1279848 - protein, 9 aa, Homo Sapiens
DSRIHSGAT

SEQ ID NO: 1279849 - protein, 9 aa, Homo Sapiens
PAQVPSLFF

SEQ ID NO: 1279850 - protein, 9 aa, Homo Sapiens
ADGPMNLDR

SEQ ID NO: 1279851 - protein, 9 aa, Homo Sapiens
EGWLHKRGK

SEQ ID NO: 1279852 - protein, 9 aa, Homo Sapiens
LSLVQSPRL

SEQ ID NO: 1279853 - protein, 9 aa, Homo Sapiens
LTGRYFSHD

SEQ ID NO: 1279854 - protein, 9 aa, Homo Sapiens
RIQKVKNQE

SEQ ID NO: 1279855 - protein, 9 aa, Homo Sapiens
LPFGLIMFC

SEQ ID NO: 1279856 - protein, 9 aa, Homo Sapiens
SFFCGLPLV

SEQ ID NO: 1279857 - protein, 9 aa, Homo Sapiens
FCGLPLVIK

SEQ ID NO: 1279858 - protein, 9 aa, Homo Sapiens
LIVSKNAGE

SEQ ID NO: 1279859 - protein, 9 aa, Homo Sapiens
INKITPPFN

SEQ ID NO: 1279860 - protein, 9 aa, Homo Sapiens
GLPLVIKLA

SEQ ID NO: 1279861 - protein, 9 aa, Homo Sapiens
AALVSPISE

SEQ ID NO: 1279862 - protein, 9 aa, Homo Sapiens
FLPLSLVQS

SEQ ID NO: 1279863 - protein, 9 aa, Homo Sapiens
LSISPNTSF

SEQ ID NO: 1279864 - protein, 9 aa, Homo Sapiens
EPQINTEES

SEQ ID NO: 1279865 - protein, 9 aa, Homo Sapiens
HLMQAAEVF

SEQ ID NO: 1279866 - protein, 9 aa, Homo Sapiens
QLLGCSHVC

SEQ ID NO: 1279867 - protein, 9 aa, Homo Sapiens
ESKDYGQQL

SEQ ID NO: 1279868 - protein, 9 aa, Homo Sapiens
SCPKNRKNL

SEQ ID NO: 1279869 - protein, 9 aa, Homo Sapiens
VYFFDIFPR

SEQ ID NO: 1279870 - protein, 9 aa, Homo Sapiens
QINTEESEI

SEQ ID NO: 1279871 - protein, 9 aa, Homo Sapiens
CGLPLVIKL

SEQ ID NO: 1279872 - protein, 9 aa, Homo Sapiens
ENGDLWYRQ

SEQ ID NO: 1279873 - protein, 9 aa, Homo Sapiens
DSFFCGLPL

SEQ ID NO: 1279874 - protein, 9 aa, Homo Sapiens
LDSRIHSGA

SEQ ID NO: 1279875 - protein, 9 aa, Homo Sapiens
RMQNNSSLS

SEQ ID NO: 1279876 - protein, 9 aa, Homo Sapiens
PEHQVPFNE

SEQ ID NO: 1279877 - protein, 9 aa, Homo Sapiens
WGTYGSEES

SEQ ID NO: 1279878 - protein, 9 aa, Homo Sapiens
RAVKKLNTN

SEQ ID NO: 1279879 - protein, 9 aa, Homo Sapiens
ALDENGDLW

SEQ ID NO: 1279880 - protein, 9 aa, Homo Sapiens
TILHCSCPK

SEQ ID NO: 1279881 - protein, 9 aa, Homo Sapiens
PSSSRHRDS

SEQ ID NO: 1279882 - protein, 9 aa, Homo Sapiens
RELQALCQS

SEQ ID NO: 1279883 - protein, 9 aa, Homo Sapiens
LLGCSHVCS

SEQ ID NO: 1279884 - protein, 9 aa, Homo Sapiens
ACHLIFCGE

SEQ ID NO: 1279885 - protein, 9 aa, Homo Sapiens
TLNFLPLSL

SEQ ID NO: 1279886 - protein, 9 aa, Homo Sapiens
HTHTHTAIP

SEQ ID NO: 1279887 - protein, 9 aa, Homo Sapiens
CEKKNTNAT

SEQ ID NO: 1279888 - protein, 9 aa, Homo Sapiens
CSHVCSRTP

SEQ ID NO: 1279889 - protein, 9 aa, Homo Sapiens
RMNSVCEKK

SEQ ID NO: 1279890 - protein, 9 aa, Homo Sapiens
PACHLIFCG

SEQ ID NO: 1279891 - protein, 9 aa, Homo Sapiens
TNILYLCFS

SEQ ID NO: 1279892 - protein, 9 aa, Homo Sapiens
TRAVKKLNT

SEQ ID NO: 1279893 - protein, 9 aa, Homo Sapiens
LSQWAYCGK

SEQ ID NO: 1279894 - protein, 9 aa, Homo Sapiens
QGAQVTTKR

SEQ ID NO: 1279895 - protein, 9 aa, Homo Sapiens
LQESTRKLN

SEQ ID NO: 1279896 - protein, 9 aa, Homo Sapiens
SQWAYCGKM

SEQ ID NO: 1279897 - protein, 9 aa, Homo Sapiens
TKRTVQLNV

SEQ ID NO: 1279898 - protein, 9 aa, Homo Sapiens
HLIFCGEPP

SEQ ID NO: 1279899 - protein, 9 aa, Homo Sapiens
GAQVTTKRT

SEQ ID NO: 1279900 - protein, 9 aa, Homo Sapiens
VNECEVSPG

SEQ ID NO: 1279901 - protein, 9 aa, Homo Sapiens
DLINKITPP

SEQ ID NO: 1279902 - protein, 9 aa, Homo Sapiens
VYALDENGD

SEQ ID NO: 1279903 - protein, 9 aa, Homo Sapiens
CVHLMQAAE

SEQ ID NO: 1279904 - protein, 9 aa, Homo Sapiens
RQGAQVTTK

SEQ ID NO: 1279905 - protein, 9 aa, Homo Sapiens
SKHLDRATD

SEQ ID NO: 1279906 - protein, 9 aa, Homo Sapiens
FVYFFDIFP

SEQ ID NO: 1279907 - protein, 9 aa, Homo Sapiens
PLIKVIESK

SEQ ID NO: 1279908 - protein, 9 aa, Homo Sapiens
LNFLPLSLV

SEQ ID NO: 1279909 - protein, 9 aa, Homo Sapiens
SPVQEYHTS

SEQ ID NO: 1279910 - protein, 9 aa, Homo Sapiens
FGLIMFCNA

SEQ ID NO: 1279911 - protein, 9 aa, Homo Sapiens
PCVPSTIFP

SEQ ID NO: 1279912 - protein, 9 aa, Homo Sapiens
VLEKKAYLE

SEQ ID NO: 1279913 - protein, 9 aa, Homo Sapiens
DGVTHKMRR

SEQ ID NO: 1279914 - protein, 9 aa, Homo Sapiens
SRNSPSAIS

SEQ ID NO: 1279915 - protein, 9 aa, Homo Sapiens
MLTCAFCYG

SEQ ID NO: 1279916 - protein, 9 aa, Homo Sapiens
YICDPHPDR

SEQ ID NO: 1279917 - protein, 9 aa, Homo Sapiens
ICNTGYKLQ

SEQ ID NO: 1279918 - protein, 9 aa, Homo Sapiens
GVVDPGKAS

SEQ ID NO: 1279919 - protein, 9 aa, Homo Sapiens
LKAVLEKKA

SEQ ID NO: 1279920 - protein, 9 aa, Homo Sapiens
KLQNNENNI

SEQ ID NO: 1279921 - protein, 9 aa, Homo Sapiens
TILKMRSAK

SEQ ID NO: 1279922 - protein, 9 aa, Homo Sapiens
YTARQATQI

SEQ ID NO: 1279923 - protein, 9 aa, Homo Sapiens
GELPRLVSE

SEQ ID NO: 1279924 - protein, 9 aa, Homo Sapiens
PIGNLKKVL

SEQ ID NO: 1279925 - protein, 9 aa, Homo Sapiens
SKSTMGASP

SEQ ID NO: 1279926 - protein, 9 aa, Homo Sapiens
LVSYATDNE

SEQ ID NO: 1279927 - protein, 9 aa, Homo Sapiens
ISNLGYKVL

SEQ ID NO: 1279928 - protein, 9 aa, Homo Sapiens
ASHPCQRGA

SEQ ID NO: 1279929 - protein, 9 aa, Homo Sapiens
NSPSAISTG

SEQ ID NO: 1279930 - protein, 9 aa, Homo Sapiens
DSRSFITIG

SEQ ID NO: 1279931 - protein, 9 aa, Homo Sapiens
HVCACPGRD

SEQ ID NO: 1279932 - protein, 9 aa, Homo Sapiens
TVVGELPRL

SEQ ID NO: 1279933 - protein, 9 aa, Homo Sapiens
DLSLHVTVA

SEQ ID NO: 1279934 - protein, 9 aa, Homo Sapiens
GSAAAAVSG

SEQ ID NO: 1279935 - protein, 9 aa, Homo Sapiens
PVPSLVPQP

SEQ ID NO: 1279936 - protein, 9 aa, Homo Sapiens
AFWNHTACM

SEQ ID NO: 1279937 - protein, 9 aa, Homo Sapiens
LGVCPPPGA

SEQ ID NO: 1279938 - protein, 9 aa, Homo Sapiens
EPIGNLKKV

SEQ ID NO: 1279939 - protein, 9 aa, Homo Sapiens
HKLKAVLEK

SEQ ID NO: 1279940 - protein, 9 aa, Homo Sapiens
LLKSDNKVV

SEQ ID NO: 1279941 - protein, 9 aa, Homo Sapiens
LEIELVLMV

SEQ ID NO: 1279942 - protein, 9 aa, Homo Sapiens
NESLAAFWN

SEQ ID NO: 1279943 - protein, 9 aa, Homo Sapiens
FQRCDVAWQ

SEQ ID NO: 1279944 - protein, 9 aa, Homo Sapiens
VPSLVPQPP

SEQ ID NO: 1279945 - protein, 9 aa, Homo Sapiens
STRAGDLGI

SEQ ID NO: 1279946 - protein, 9 aa, Homo Sapiens
WDSLNKVWK

SEQ ID NO: 1279947 - protein, 9 aa, Homo Sapiens
MGASPLLEI

SEQ ID NO: 1279948 - protein, 9 aa, Homo Sapiens
ALQSGRGAV

SEQ ID NO: 1279949 - protein, 9 aa, Homo Sapiens
WDGVTHKMR

SEQ ID NO: 1279950 - protein, 9 aa, Homo Sapiens
AAAVSGLEC

SEQ ID NO: 1279951 - protein, 9 aa, Homo Sapiens
SPLLEIELV

SEQ ID NO: 1279952 - protein, 9 aa, Homo Sapiens
SYQENHAKW

SEQ ID NO: 1279953 - protein, 9 aa, Homo Sapiens
LTCAFCYGR

SEQ ID NO: 1279954 - protein, 9 aa, Homo Sapiens
LITTPITPS

SEQ ID NO: 1279955 - protein, 9 aa, Homo Sapiens
TSSKHASRG

SEQ ID NO: 1279956 - protein, 9 aa, Homo Sapiens
GYKLQNNEN

SEQ ID NO: 1279957 - protein, 9 aa, Homo Sapiens
DRGGVLFPF

SEQ ID NO: 1279958 - protein, 9 aa, Homo Sapiens
AINANGLIT

SEQ ID NO: 1279959 - protein, 9 aa, Homo Sapiens
SFSILMSPC

SEQ ID NO: 1279960 - protein, 9 aa, Homo Sapiens
PPLSEDGEI

SEQ ID NO: 1279961 - protein, 9 aa, Homo Sapiens
GEFKDDDFE

SEQ ID NO: 1279962 - protein, 9 aa, Homo Sapiens
TRPPPPLSE

SEQ ID NO: 1279963 - protein, 9 aa, Homo Sapiens
QTFALGQEF

SEQ ID NO: 1279964 - protein, 9 aa, Homo Sapiens
SYLGKRPTK

SEQ ID NO: 1279965 - protein, 9 aa, Homo Sapiens
HDRGGVLFP

SEQ ID NO: 1279966 - protein, 9 aa, Homo Sapiens
VALQSGRGA

SEQ ID NO: 1279967 - protein, 9 aa, Homo Sapiens
SKHASRGGQ

SEQ ID NO: 1279968 - protein, 9 aa, Homo Sapiens
AVSGLECAT

SEQ ID NO: 1279969 - protein, 9 aa, Homo Sapiens
KEGGPWGGR

SEQ ID NO: 1279970 - protein, 9 aa, Homo Sapiens
VLQDLSLHV

SEQ ID NO: 1279971 - protein, 9 aa, Homo Sapiens
SGQSTLTHH

SEQ ID NO: 1279972 - protein, 9 aa, Homo Sapiens
LGPLRQDRA

SEQ ID NO: 1279973 - protein, 9 aa, Homo Sapiens
IHSLLQNLA

SEQ ID NO: 1279974 - protein, 9 aa, Homo Sapiens
DVRANLEAH

SEQ ID NO: 1279975 - protein, 9 aa, Homo Sapiens
SGRGAVSLP

SEQ ID NO: 1279976 - protein, 9 aa, Homo Sapiens
IIIQTFALG

SEQ ID NO: 1279977 - protein, 9 aa, Homo Sapiens
IGNLKKVLE

SEQ ID NO: 1279978 - protein, 9 aa, Homo Sapiens
RKNIKGIHS

SEQ ID NO: 1279979 - protein, 9 aa, Homo Sapiens
KVLEPRLQC

SEQ ID NO: 1279980 - protein, 9 aa, Homo Sapiens
ITYHDRGGV

SEQ ID NO: 1279981 - protein, 9 aa, Homo Sapiens
LPERVPAAR

SEQ ID NO: 1279982 - protein, 9 aa, Homo Sapiens
RPVPSLVPQ

SEQ ID NO: 1279983 - protein, 9 aa, Homo Sapiens
RIQKQLLSD

SEQ ID NO: 1279984 - protein, 9 aa, Homo Sapiens
LLSTRAGDL

SEQ ID NO: 1279985 - protein, 9 aa, Homo Sapiens
RSFITIGDR

SEQ ID NO: 1279986 - protein, 9 aa, Homo Sapiens
FLYTARQAT

SEQ ID NO: 1279987 - protein, 9 aa, Homo Sapiens
YRKFLVSYA

SEQ ID NO: 1279988 - protein, 9 aa, Homo Sapiens
LSTRAGDLG

SEQ ID NO: 1279989 - protein, 9 aa, Homo Sapiens
HSPNQSPRI

SEQ ID NO: 1279990 - protein, 9 aa, Homo Sapiens
HPRGQSSSG

SEQ ID NO: 1279991 - protein, 9 aa, Homo Sapiens
KKVLEPRLQ

SEQ ID NO: 1279992 - protein, 9 aa, Homo Sapiens
CDVAWQLGK

SEQ ID NO: 1279993 - protein, 9 aa, Homo Sapiens
NPTAYALAE

SEQ ID NO: 1279994 - protein, 9 aa, Homo Sapiens
LTHHQAIHG

SEQ ID NO: 1279995 - protein, 9 aa, Homo Sapiens
GFSRNSPSA

SEQ ID NO: 1279996 - protein, 9 aa, Homo Sapiens
SRALGPLRQ

SEQ ID NO: 1279997 - protein, 9 aa, Homo Sapiens
LSLHVTVAE

SEQ ID NO: 1279998 - protein, 9 aa, Homo Sapiens
TEVSHKQVV

SEQ ID NO: 1279999 - protein, 9 aa, Homo Sapiens
HFDERSFLT

SEQ ID NO: 1280000 - protein, 9 aa, Homo Sapiens
ETGIIIQTF

SEQ ID NO: 1280001 - protein, 9 aa, Homo Sapiens
QKAKVGEFK

SEQ ID NO: 1280002 - protein, 9 aa, Homo Sapiens
HLPERVPAA

SEQ ID NO: 1280003 - protein, 9 aa, Homo Sapiens
RSAKGRHKA

SEQ ID NO: 1280004 - protein, 9 aa, Homo Sapiens
CPPPGAVLV

SEQ ID NO: 1280005 - protein, 9 aa, Homo Sapiens
AFSGQSTLT

SEQ ID NO: 1280006 - protein, 9 aa, Homo Sapiens
EATQNTLVN

SEQ ID NO: 1280007 - protein, 9 aa, Homo Sapiens
VCVMAGALE

SEQ ID NO: 1280008 - protein, 9 aa, Homo Sapiens
VCPPPGAVL

SEQ ID NO: 1280009 - protein, 9 aa, Homo Sapiens
PPPPLSEDG

SEQ ID NO: 1280010 - protein, 9 aa, Homo Sapiens
IEETKERLF

SEQ ID NO: 1280011 - protein, 9 aa, Homo Sapiens
LISEATQNT

SEQ ID NO: 1280012 - protein, 9 aa, Homo Sapiens
CYGRDDLEV

SEQ ID NO: 1280013 - protein, 9 aa, Homo Sapiens
VEAFESKEG

SEQ ID NO: 1280014 - protein, 9 aa, Homo Sapiens
YSHSYLGKR

SEQ ID NO: 1280015 - protein, 9 aa, Homo Sapiens
LRRPRTSSK

SEQ ID NO: 1280016 - protein, 9 aa, Homo Sapiens
GLITTPITP

SEQ ID NO: 1280017 - protein, 9 aa, Homo Sapiens
KFLVSYATD

SEQ ID NO: 1280018 - protein, 9 aa, Homo Sapiens
FLVSYATDN

SEQ ID NO: 1280019 - protein, 9 aa, Homo Sapiens
EVHVCACPG

SEQ ID NO: 1280020 - protein, 9 aa, Homo Sapiens
AAIVQAEIE

SEQ ID NO: 1280021 - protein, 9 aa, Homo Sapiens
HMEMISYQE

SEQ ID NO: 1280022 - protein, 9 aa, Homo Sapiens
RRPRTSSKH

SEQ ID NO: 1280023 - protein, 9 aa, Homo Sapiens
VHIKLGVCP

SEQ ID NO: 1280024 - protein, 9 aa, Homo Sapiens
KLKAVLEKK

SEQ ID NO: 1280025 - protein, 9 aa, Homo Sapiens
LHLPERVPA

SEQ ID NO: 1280026 - protein, 9 aa, Homo Sapiens
ALKPNIVEL

SEQ ID NO: 1280027 - protein, 9 aa, Homo Sapiens
QPSPSVSQR

SEQ ID NO: 1280028 - protein, 9 aa, Homo Sapiens
EAEEFVKQC

SEQ ID NO: 1280029 - protein, 9 aa, Homo Sapiens
KNIKGIHSL

SEQ ID NO: 1280030 - protein, 9 aa, Homo Sapiens
DVAWQLGKN

SEQ ID NO: 1280031 - protein, 9 aa, Homo Sapiens
MHSLLPVLA

SEQ ID NO: 1280032 - protein, 9 aa, Homo Sapiens
LPLHLPERV

SEQ ID NO: 1280033 - protein, 9 aa, Homo Sapiens
NLDDCASHP

SEQ ID NO: 1280034 - protein, 9 aa, Homo Sapiens
SEATQNTLV

SEQ ID NO: 1280035 - protein, 9 aa, Homo Sapiens
PLRQDRAER

SEQ ID NO: 1280036 - protein, 9 aa, Homo Sapiens
LGRNSFEVH

SEQ ID NO: 1280037 - protein, 9 aa, Homo Sapiens
IICNTGYKL

SEQ ID NO: 1280038 - protein, 9 aa, Homo Sapiens
YHDRGGVLF

SEQ ID NO: 1280039 - protein, 9 aa, Homo Sapiens
FVHLKREDC

SEQ ID NO: 1280040 - protein, 9 aa, Homo Sapiens
GVTHKMRRM

SEQ ID NO: 1280041 - protein, 9 aa, Homo Sapiens
GQTHGFVHL

SEQ ID NO: 1280042 - protein, 9 aa, Homo Sapiens
TPKHFAEAE

SEQ ID NO: 1280043 - protein, 9 aa, Homo Sapiens
YGKEVSYIC

SEQ ID NO: 1280044 - protein, 9 aa, Homo Sapiens
RPRTSSKHA

SEQ ID NO: 1280045 - protein, 9 aa, Homo Sapiens
REEKAPELP

SEQ ID NO: 1280046 - protein, 9 aa, Homo Sapiens
WQLGKNNEF

SEQ ID NO: 1280047 - protein, 9 aa, Homo Sapiens
DLSYSHSYL

SEQ ID NO: 1280048 - protein, 9 aa, Homo Sapiens
KASKAAWIR

SEQ ID NO: 1280049 - protein, 9 aa, Homo Sapiens
QPPQTSLVK

SEQ ID NO: 1280050 - protein, 9 aa, Homo Sapiens
ICDPHPDRG

SEQ ID NO: 1280051 - protein, 9 aa, Homo Sapiens
IKGIHSLLQ

SEQ ID NO: 1280052 - protein, 9 aa, Homo Sapiens
NKVWKDRID

SEQ ID NO: 1280053 - protein, 9 aa, Homo Sapiens
PRNLDSRSF

SEQ ID NO: 1280054 - protein, 9 aa, Homo Sapiens
HKQVVRNQE

SEQ ID NO: 1280055 - protein, 9 aa, Homo Sapiens
EPCSDIIAT

SEQ ID NO: 1280056 - protein, 9 aa, Homo Sapiens
WNHTACMEE

SEQ ID NO: 1280057 - protein, 9 aa, Homo Sapiens
VPAARASVT

SEQ ID NO: 1280058 - protein, 9 aa, Homo Sapiens
NESMHSLLP

SEQ ID NO: 1280059 - protein, 9 aa, Homo Sapiens
KEVSYICDP

SEQ ID NO: 1280060 - protein, 9 aa, Homo Sapiens
PSLVPQPPQ

SEQ ID NO: 1280061 - protein, 9 aa, Homo Sapiens
ESKEGGPWG

SEQ ID NO: 1280062 - protein, 9 aa, Homo Sapiens
EKEIIALKP

SEQ ID NO: 1280063 - protein, 9 aa, Homo Sapiens
LQSGRGAVS

SEQ ID NO: 1280064 - protein, 9 aa, Homo Sapiens
RNSPSAIST

SEQ ID NO: 1280065 - protein, 9 aa, Homo Sapiens
APSRALGPL

SEQ ID NO: 1280066 - protein, 9 aa, Homo Sapiens
EYRKFLVSY

SEQ ID NO: 1280067 - protein, 9 aa, Homo Sapiens
ATQILLMKS

SEQ ID NO: 1280068 - protein, 9 aa, Homo Sapiens
SPNHSPSHS

SEQ ID NO: 1280069 - protein, 9 aa, Homo Sapiens
QATQILLMK

SEQ ID NO: 1280070 - protein, 9 aa, Homo Sapiens
AVSLPSKAA

SEQ ID NO: 1280071 - protein, 9 aa, Homo Sapiens
KFIRRGFLL

SEQ ID NO: 1280072 - protein, 9 aa, Homo Sapiens
FSILMSPCV

SEQ ID NO: 1280073 - protein, 9 aa, Homo Sapiens
QKQLLSDVA

SEQ ID NO: 1280074 - protein, 9 aa, Homo Sapiens
DITYHDRGG

SEQ ID NO: 1280075 - protein, 9 aa, Homo Sapiens
YALDRNPTA

SEQ ID NO: 1280076 - protein, 9 aa, Homo Sapiens
EVCLLKSDN

SEQ ID NO: 1280077 - protein, 9 aa, Homo Sapiens
MRSAKGRHK

SEQ ID NO: 1280078 - protein, 9 aa, Homo Sapiens
EIELVLMVL

SEQ ID NO: 1280079 - protein, 9 aa, Homo Sapiens
SYSHSYLGK

SEQ ID NO: 1280080 - protein, 9 aa, Homo Sapiens
HLHRPGNEP

SEQ ID NO: 1280081 - protein, 9 aa, Homo Sapiens
EPYNTTLSV

SEQ ID NO: 1280082 - protein, 9 aa, Homo Sapiens
TMGASPLLE

SEQ ID NO: 1280083 - protein, 9 aa, Homo Sapiens
AYRGKKHQE

SEQ ID NO: 1280084 - protein, 9 aa, Homo Sapiens
FIRRGFLLD

SEQ ID NO: 1280085 - protein, 9 aa, Homo Sapiens
PRGQSSSGT

SEQ ID NO: 1280086 - protein, 9 aa, Homo Sapiens
RLISEATQN

SEQ ID NO: 1280087 - protein, 9 aa, Homo Sapiens
VRANLEAHD

SEQ ID NO: 1280088 - protein, 9 aa, Homo Sapiens
AYHMEMISY

SEQ ID NO: 1280089 - protein, 9 aa, Homo Sapiens
TQKAKVGEF

SEQ ID NO: 1280090 - protein, 9 aa, Homo Sapiens
KQLLSDVAQ

SEQ ID NO: 1280091 - protein, 9 aa, Homo Sapiens
VLEPRLQCS

SEQ ID NO: 1280092 - protein, 9 aa, Homo Sapiens
VVDPGKASK

SEQ ID NO: 1280093 - protein, 9 aa, Homo Sapiens
LARNSSLVT

SEQ ID NO: 1280094 - protein, 9 aa, Homo Sapiens
SPSHSPNQS

SEQ ID NO: 1280095 - protein, 9 aa, Homo Sapiens
PAPSRALGP

SEQ ID NO: 1280096 - protein, 9 aa, Homo Sapiens
LSDVAQALD

SEQ ID NO: 1280097 - protein, 9 aa, Homo Sapiens
SQVEAFESK

SEQ ID NO: 1280098 - protein, 9 aa, Homo Sapiens
SKEGGPWGG

SEQ ID NO: 1280099 - protein, 9 aa, Homo Sapiens
AAVSGLECA

SEQ ID NO: 1280100 - protein, 9 aa, Homo Sapiens
PKHIKGISN

SEQ ID NO: 1280101 - protein, 9 aa, Homo Sapiens
TTPITPSSG

SEQ ID NO: 1280102 - protein, 9 aa, Homo Sapiens
HVCVMAGAL

SEQ ID NO: 1280103 - protein, 9 aa, Homo Sapiens
TCAFCYGRD

SEQ ID NO: 1280104 - protein, 9 aa, Homo Sapiens
CSDIIATPG

SEQ ID NO: 1280105 - protein, 9 aa, Homo Sapiens
FEVHVCACP

SEQ ID NO: 1280106 - protein, 9 aa, Homo Sapiens
ISYQENHAK

SEQ ID NO: 1280107 - protein, 9 aa, Homo Sapiens
LQDLSLHVT

SEQ ID NO: 1280108 - protein, 9 aa, Homo Sapiens
RCDVAWQLG

SEQ ID NO: 1280109 - protein, 9 aa, Homo Sapiens
DSEGFSRNS

SEQ ID NO: 1280110 - protein, 9 aa, Homo Sapiens
SPSVSQREE

SEQ ID NO: 1280111 - protein, 9 aa, Homo Sapiens
LYTARQATQ

SEQ ID NO: 1280112 - protein, 9 aa, Homo Sapiens
TTSRSPQHL

SEQ ID NO: 1280113 - protein, 9 aa, Homo Sapiens
KLGVCPPPG

SEQ ID NO: 1280114 - protein, 9 aa, Homo Sapiens
VVGELPRLV

SEQ ID NO: 1280115 - protein, 9 aa, Homo Sapiens
KKHQEAPPH

SEQ ID NO: 1280116 - protein, 9 aa, Homo Sapiens
PKHFAEAEE

SEQ ID NO: 1280117 - protein, 9 aa, Homo Sapiens
TYHDRGGVL

SEQ ID NO: 1280118 - protein, 9 aa, Homo Sapiens
CNEGTRPPP

SEQ ID NO: 1280119 - protein, 9 aa, Homo Sapiens
TRYHKLKAV

SEQ ID NO: 1280120 - protein, 9 aa, Homo Sapiens
QILLMKSLL

SEQ ID NO: 1280121 - protein, 9 aa, Homo Sapiens
PEYRKFLVS

SEQ ID NO: 1280122 - protein, 9 aa, Homo Sapiens
QVEAFESKE

SEQ ID NO: 1280123 - protein, 9 aa, Homo Sapiens
SFGNNHFDE

SEQ ID NO: 1280124 - protein, 9 aa, Homo Sapiens
TVVEPYNTT

SEQ ID NO: 1280125 - protein, 9 aa, Homo Sapiens
FPSIVGHPR

SEQ ID NO: 1280126 - protein, 9 aa, Homo Sapiens
LAAFWNHTA

SEQ ID NO: 1280127 - protein, 9 aa, Homo Sapiens
IDVRANLEA

SEQ ID NO: 1280128 - protein, 9 aa, Homo Sapiens
KVWKDRIDK

SEQ ID NO: 1280129 - protein, 9 aa, Homo Sapiens
PGHPRGQSS

SEQ ID NO: 1280130 - protein, 9 aa, Homo Sapiens
GFQRCDVAW

SEQ ID NO: 1280131 - protein, 9 aa, Homo Sapiens
GIIIQTFAL

SEQ ID NO: 1280132 - protein, 9 aa, Homo Sapiens
SLLPVLASM

SEQ ID NO: 1280133 - protein, 9 aa, Homo Sapiens
KVGEFKDDD

SEQ ID NO: 1280134 - protein, 9 aa, Homo Sapiens
IALKPNIVE

SEQ ID NO: 1280135 - protein, 9 aa, Homo Sapiens
RRGFLLDEA

SEQ ID NO: 1280136 - protein, 9 aa, Homo Sapiens
IVLQDLSLH

SEQ ID NO: 1280137 - protein, 9 aa, Homo Sapiens
IVLYALDRN

SEQ ID NO: 1280138 - protein, 9 aa, Homo Sapiens
ASKAAWIRK

SEQ ID NO: 1280139 - protein, 9 aa, Homo Sapiens
SEGFSRNSP

SEQ ID NO: 1280140 - protein, 9 aa, Homo Sapiens
LKPNIVELK

SEQ ID NO: 1280141 - protein, 9 aa, Homo Sapiens
SRSFITIGD

SEQ ID NO: 1280142 - protein, 9 aa, Homo Sapiens
HLKREDCSP

SEQ ID NO: 1280143 - protein, 9 aa, Homo Sapiens
INANGLITT

SEQ ID NO: 1280144 - protein, 9 aa, Homo Sapiens
IKGISNLGY

SEQ ID NO: 1280145 - protein, 9 aa, Homo Sapiens
GRNSFEVHV

SEQ ID NO: 1280146 - protein, 9 aa, Homo Sapiens
VTAYRGKKH

SEQ ID NO: 1280147 - protein, 9 aa, Homo Sapiens
RKFLVSYAT

SEQ ID NO: 1280148 - protein, 9 aa, Homo Sapiens
VEPYNTTLS

SEQ ID NO: 1280149 - protein, 9 aa, Homo Sapiens
DNKVVDNQA

SEQ ID NO: 1280150 - protein, 9 aa, Homo Sapiens
LKSDNKVVD

SEQ ID NO: 1280151 - protein, 9 aa, Homo Sapiens
LYALDRNPT

SEQ ID NO: 1280152 - protein, 9 aa, Homo Sapiens
PYGKEVSYI

SEQ ID NO: 1280153 - protein, 9 aa, Homo Sapiens
ITTPITPSS

SEQ ID NO: 1280154 - protein, 9 aa, Homo Sapiens
VGELPRLVS

SEQ ID NO: 1280155 - protein, 9 aa, Homo Sapiens
LKREDCSPA

SEQ ID NO: 1280156 - protein, 9 aa, Homo Sapiens
GFLLDEANG

SEQ ID NO: 1280157 - protein, 9 aa, Homo Sapiens
AVLEKKAYL

SEQ ID NO: 1280158 - protein, 9 aa, Homo Sapiens
QIICNTGYK

SEQ ID NO: 1280159 - protein, 9 aa, Homo Sapiens
SILMSPCVP

SEQ ID NO: 1280160 - protein, 9 aa, Homo Sapiens
EAAIVQAEI

SEQ ID NO: 1280161 - protein, 9 aa, Homo Sapiens
FRIQKQLLS

SEQ ID NO: 1280162 - protein, 9 aa, Homo Sapiens
AFCYGRDDL

SEQ ID NO: 1280163 - protein, 9 aa, Homo Sapiens
PPPLSEDGE

SEQ ID NO: 1280164 - protein, 9 aa, Homo Sapiens
DPGKASKAA

SEQ ID NO: 1280165 - protein, 9 aa, Homo Sapiens
PADGDDSLY

SEQ ID NO: 1280166 - protein, 9 aa, Homo Sapiens
RNSSLVTEF

SEQ ID NO: 1280167 - protein, 9 aa, Homo Sapiens
TRAGDLGIN

SEQ ID NO: 1280168 - protein, 9 aa, Homo Sapiens
LDDCASHPC

SEQ ID NO: 1280169 - protein, 9 aa, Homo Sapiens
KGIHSLLQN

SEQ ID NO: 1280170 - protein, 9 aa, Homo Sapiens
ASPLLEIEL

SEQ ID NO: 1280171 - protein, 9 aa, Homo Sapiens
KGISNLGYK

SEQ ID NO: 1280172 - protein, 9 aa, Homo Sapiens
QSFGNNHFD

SEQ ID NO: 1280173 - protein, 9 aa, Homo Sapiens
EGFSRNSPS

SEQ ID NO: 1280174 - protein, 9 aa, Homo Sapiens
FKDDDFERI

SEQ ID NO: 1280175 - protein, 9 aa, Homo Sapiens
AWQLGKNNE

SEQ ID NO: 1280176 - protein, 9 aa, Homo Sapiens
EEPCSDIIA

SEQ ID NO: 1280177 - protein, 9 aa, Homo Sapiens
GQSTLTHHQ

SEQ ID NO: 1280178 - protein, 9 aa, Homo Sapiens
ERVPAARAS

SEQ ID NO: 1280179 - protein, 9 aa, Homo Sapiens
VGRPKHVCV

SEQ ID NO: 1280180 - protein, 9 aa, Homo Sapiens
ILKMRSAKG

SEQ ID NO: 1280181 - protein, 9 aa, Homo Sapiens
RPPPPLSED

SEQ ID NO: 1280182 - protein, 9 aa, Homo Sapiens
HVTVAESSS

SEQ ID NO: 1280183 - protein, 9 aa, Homo Sapiens
VGEFKDDDF

SEQ ID NO: 1280184 - protein, 9 aa, Homo Sapiens
HWDGVTHKM

SEQ ID NO: 1280185 - protein, 9 aa, Homo Sapiens
LLEIELVLM

SEQ ID NO: 1280186 - protein, 9 aa, Homo Sapiens
CVMAGALEG

SEQ ID NO: 1280187 - protein, 9 aa, Homo Sapiens
KEIIALKPN

SEQ ID NO: 1280188 - protein, 9 aa, Homo Sapiens
ISEATQNTL

SEQ ID NO: 1280189 - protein, 9 aa, Homo Sapiens
DRNPTAYAL

SEQ ID NO: 1280190 - protein, 9 aa, Homo Sapiens
PLHLPERVP

SEQ ID NO: 1280191 - protein, 9 aa, Homo Sapiens
LPDITYHDR

SEQ ID NO: 1280192 - protein, 9 aa, Homo Sapiens
KAVLEKKAY

SEQ ID NO: 1280193 - protein, 9 aa, Homo Sapiens
LLIDVRANL

SEQ ID NO: 1280194 - protein, 9 aa, Homo Sapiens
GHPRQQGMM

SEQ ID NO: 1280195 - protein, 9 aa, Homo Sapiens
AEEFVKQCS

SEQ ID NO: 1280196 - protein, 9 aa, Homo Sapiens
PSRALGPLR

SEQ ID NO: 1280197 - protein, 9 aa, Homo Sapiens
TSRSPQHLH

SEQ ID NO: 1280198 - protein, 9 aa, Homo Sapiens
PYNTTLSVH

SEQ ID NO: 1280199 - protein, 9 aa, Homo Sapiens
NSSLVTEFI

SEQ ID NO: 1280200 - protein, 9 aa, Homo Sapiens
VCLLKSDNK

SEQ ID NO: 1280201 - protein, 9 aa, Homo Sapiens
RVPAARASV

SEQ ID NO: 1280202 - protein, 9 aa, Homo Sapiens
PNHSPSHSP

SEQ ID NO: 1280203 - protein, 9 aa, Homo Sapiens
NLKKVLEPR

SEQ ID NO: 1280204 - protein, 9 aa, Homo Sapiens
KQVVRNQEE

SEQ ID NO: 1280205 - protein, 9 aa, Homo Sapiens
DLGINLATA

SEQ ID NO: 1280206 - protein, 9 aa, Homo Sapiens
PCSDIIATP

SEQ ID NO: 1280207 - protein, 9 aa, Homo Sapiens
SQREEKAPE

SEQ ID NO: 1280208 - protein, 9 aa, Homo Sapiens
EIIALKPNI

SEQ ID NO: 1280209 - protein, 9 aa, Homo Sapiens
VGHPRQQGM

SEQ ID NO: 1280210 - protein, 9 aa, Homo Sapiens
GASPLLEIE

SEQ ID NO: 1280211 - protein, 9 aa, Homo Sapiens
NANGLITTP

SEQ ID NO: 1280212 - protein, 9 aa, Homo Sapiens
GNLKKVLEP

SEQ ID NO: 1280213 - protein, 9 aa, Homo Sapiens
AWDSLNKVW

SEQ ID NO: 1280214 - protein, 9 aa, Homo Sapiens
IQKQLLSDV

SEQ ID NO: 1280215 - protein, 9 aa, Homo Sapiens
PSPSVSQRE

SEQ ID NO: 1280216 - protein, 9 aa, Homo Sapiens
SNLGYKVLI

SEQ ID NO: 1280217 - protein, 9 aa, Homo Sapiens
YKLQNNENN

SEQ ID NO: 1280218 - protein, 9 aa, Homo Sapiens
WNESMHSLL

SEQ ID NO: 1280219 - protein, 9 aa, Homo Sapiens
PGKASKAAW

SEQ ID NO: 1280220 - protein, 9 aa, Homo Sapiens
SIVGHPRQQ

SEQ ID NO: 1280221 - protein, 9 aa, Homo Sapiens
HPCQRGARC

SEQ ID NO: 1280222 - protein, 9 aa, Homo Sapiens
IIQTFALGQ

SEQ ID NO: 1280223 - protein, 9 aa, Homo Sapiens
GAVSLPSKA

SEQ ID NO: 1280224 - protein, 9 aa, Homo Sapiens
QVVRNQEEK

SEQ ID NO: 1280225 - protein, 9 aa, Homo Sapiens
VWKDRIDKL

SEQ ID NO: 1280226 - protein, 9 aa, Homo Sapiens
SSLVTEFIL

SEQ ID NO: 1280227 - protein, 9 aa, Homo Sapiens
MSPCVPSTI

SEQ ID NO: 1280228 - protein, 9 aa, Homo Sapiens
IIALKPNIV

SEQ ID NO: 1280229 - protein, 9 aa, Homo Sapiens
GNPPPGHPR

SEQ ID NO: 1280230 - protein, 9 aa, Homo Sapiens
LTQEEPCSD

SEQ ID NO: 1280231 - protein, 9 aa, Homo Sapiens
AIVQAEIEE

SEQ ID NO: 1280232 - protein, 9 aa, Homo Sapiens
SLAAFWNHT

SEQ ID NO: 1280233 - protein, 9 aa, Homo Sapiens
FESKEGGPW

SEQ ID NO: 1280234 - protein, 9 aa, Homo Sapiens
VSHKQVVRN

SEQ ID NO: 1280235 - protein, 9 aa, Homo Sapiens
ELTQEEPCS

SEQ ID NO: 1280236 - protein, 9 aa, Homo Sapiens
MEMISYQEN

SEQ ID NO: 1280237 - protein, 9 aa, Homo Sapiens
HGFVHLKRE

SEQ ID NO: 1280238 - protein, 9 aa, Homo Sapiens
SFEVHVCAC

SEQ ID NO: 1280239 - protein, 9 aa, Homo Sapiens
LMKSLLSKS

SEQ ID NO: 1280240 - protein, 9 aa, Homo Sapiens
CRLISEATQ

SEQ ID NO: 1280241 - protein, 9 aa, Homo Sapiens
RVHIKLGVC

SEQ ID NO: 1280242 - protein, 9 aa, Homo Sapiens
YLGKRPTKD

SEQ ID NO: 1280243 - protein, 9 aa, Homo Sapiens
QDLSLHVTV

SEQ ID NO: 1280244 - protein, 9 aa, Homo Sapiens
QAEIEETKE

SEQ ID NO: 1280245 - protein, 9 aa, Homo Sapiens
ANGLITTPI

SEQ ID NO: 1280246 - protein, 9 aa, Homo Sapiens
RNLDSRSFI

SEQ ID NO: 1280247 - protein, 9 aa, Homo Sapiens
LDLSYSHSY

SEQ ID NO: 1280248 - protein, 9 aa, Homo Sapiens
SLNKVWKDR

SEQ ID NO: 1280249 - protein, 9 aa, Homo Sapiens
ILMSPCVPS

SEQ ID NO: 1280250 - protein, 9 aa, Homo Sapiens
GVCPPPGAV

SEQ ID NO: 1280251 - protein, 9 aa, Homo Sapiens
VSYICDPHP

SEQ ID NO: 1280252 - protein, 9 aa, Homo Sapiens
ATQNTLVNN

SEQ ID NO: 1280253 - protein, 9 aa, Homo Sapiens
QREEKAPEL

SEQ ID NO: 1280254 - protein, 9 aa, Homo Sapiens
FCYGRDDLE

SEQ ID NO: 1280255 - protein, 9 aa, Homo Sapiens
KMRSAKGRH

SEQ ID NO: 1280256 - protein, 9 aa, Homo Sapiens
HSPSHSPNQ

SEQ ID NO: 1280257 - protein, 9 aa, Homo Sapiens
GTRPPPPLS

SEQ ID NO: 1280258 - protein, 9 aa, Homo Sapiens
RGAVSLPSK

SEQ ID NO: 1280259 - protein, 9 aa, Homo Sapiens
KKFIRRGFL

SEQ ID NO: 1280260 - protein, 9 aa, Homo Sapiens
PQPPQTSLV

SEQ ID NO: 1280261 - protein, 9 aa, Homo Sapiens
PRTSSKHAS

SEQ ID NO: 1280262 - protein, 9 aa, Homo Sapiens
CNTGYKLQN

SEQ ID NO: 1280263 - protein, 9 aa, Homo Sapiens
GFVHLKRED

SEQ ID NO: 1280264 - protein, 9 aa, Homo Sapiens
AAAAVSGLE

SEQ ID NO: 1280265 - protein, 9 aa, Homo Sapiens
IRRGFLLDE

SEQ ID NO: 1280266 - protein, 9 aa, Homo Sapiens
APADGDDSL

SEQ ID NO: 1280267 - protein, 9 aa, Homo Sapiens
ALDRNPTAY

SEQ ID NO: 1280268 - protein, 9 aa, Homo Sapiens
NNHFDERSF

SEQ ID NO: 1280269 - protein, 9 aa, Homo Sapiens
EFKDDDFER

SEQ ID NO: 1280270 - protein, 9 aa, Homo Sapiens
ARQATQILL

SEQ ID NO: 1280271 - protein, 9 aa, Homo Sapiens
CLLKSDNKV

SEQ ID NO: 1280272 - protein, 9 aa, Homo Sapiens
MISYQENHA

SEQ ID NO: 1280273 - protein, 9 aa, Homo Sapiens
VSQREEKAP

SEQ ID NO: 1280274 - protein, 9 aa, Homo Sapiens
RGFLLDEAN

SEQ ID NO: 1280275 - protein, 9 aa, Homo Sapiens
FDERSFLTA

SEQ ID NO: 1280276 - protein, 9 aa, Homo Sapiens
ARNSSLVTE

SEQ ID NO: 1280277 - protein, 9 aa, Homo Sapiens
SVSQREEKA

SEQ ID NO: 1280278 - protein, 9 aa, Homo Sapiens
THHQAIHGI

SEQ ID NO: 1280279 - protein, 9 aa, Homo Sapiens
KMRRMLGHR

SEQ ID NO: 1280280 - protein, 9 aa, Homo Sapiens
SMHSLLPVL

SEQ ID NO: 1280281 - protein, 9 aa, Homo Sapiens
VLYALDRNP

SEQ ID NO: 1280282 - protein, 9 aa, Homo Sapiens
SDVAQALDI

SEQ ID NO: 1280283 - protein, 9 aa, Homo Sapiens
EEFVKQCSP

SEQ ID NO: 1280284 - protein, 9 aa, Homo Sapiens
SSKHASRGG

SEQ ID NO: 1280285 - protein, 9 aa, Homo Sapiens
CVRLLIDVR

SEQ ID NO: 1280286 - protein, 9 aa, Homo Sapiens
AGDLGINLA

SEQ ID NO: 1280287 - protein, 9 aa, Homo Sapiens
SGLECATLL

SEQ ID NO: 1280288 - protein, 9 aa, Homo Sapiens
IELVLMVLQ

SEQ ID NO: 1280289 - protein, 9 aa, Homo Sapiens
LSKSTMGAS

SEQ ID NO: 1280290 - protein, 9 aa, Homo Sapiens
LDSRSFITI

SEQ ID NO: 1280291 - protein, 9 aa, Homo Sapiens
YHMEMISYQ

SEQ ID NO: 1280292 - protein, 9 aa, Homo Sapiens
LLSDVAQAL

SEQ ID NO: 1280293 - protein, 9 aa, Homo Sapiens
HSLLPVLAS

SEQ ID NO: 1280294 - protein, 9 aa, Homo Sapiens
GNNHFDERS

SEQ ID NO: 1280295 - protein, 9 aa, Homo Sapiens
KSDNKVVDN

SEQ ID NO: 1280296 - protein, 9 aa, Homo Sapiens
DTVVEPYNT

SEQ ID NO: 1280297 - protein, 9 aa, Homo Sapiens
RQATQILLM

SEQ ID NO: 1280298 - protein, 9 aa, Homo Sapiens
SLHVTVAES

SEQ ID NO: 1280299 - protein, 9 aa, Homo Sapiens
TTLSVHQLV

SEQ ID NO: 1280300 - protein, 9 aa, Homo Sapiens
SAWDSLNKV

SEQ ID NO: 1280301 - protein, 9 aa, Homo Sapiens
RGSAAAAVS

SEQ ID NO: 1280302 - protein, 9 aa, Homo Sapiens
GPLRQDRAE

SEQ ID NO: 1280303 - protein, 9 aa, Homo Sapiens
KHASRGGQS

SEQ ID NO: 1280304 - protein, 9 aa, Homo Sapiens
SPCVPSTIF

SEQ ID NO: 1280305 - protein, 9 aa, Homo Sapiens
FAEAEEFVK

SEQ ID NO: 1280306 - protein, 9 aa, Homo Sapiens
GHPRGQSSS

SEQ ID NO: 1280307 - protein, 9 aa, Homo Sapiens
RGGVLFPFF

SEQ ID NO: 1280308 - protein, 9 aa, Homo Sapiens
HSYLGKRPT

SEQ ID NO: 1280309 - protein, 9 aa, Homo Sapiens
SFITIGDRN

SEQ ID NO: 1280310 - protein, 9 aa, Homo Sapiens
PPGHPRGQS

SEQ ID NO: 1280311 - protein, 9 aa, Homo Sapiens
CAFCYGRDD

SEQ ID NO: 1280312 - protein, 9 aa, Homo Sapiens
THGFVHLKR

SEQ ID NO: 1280313 - protein, 9 aa, Homo Sapiens
HPRQQGMMG

SEQ ID NO: 1280314 - protein, 9 aa, Homo Sapiens
EAFESKEGG

SEQ ID NO: 1280315 - protein, 9 aa, Homo Sapiens
AKVGEFKDD

SEQ ID NO: 1280316 - protein, 9 aa, Homo Sapiens
YVGRPKHVC

SEQ ID NO: 1280317 - protein, 9 aa, Homo Sapiens
LKKVLEPRL

SEQ ID NO: 1280318 - protein, 9 aa, Homo Sapiens
KSLLSKSTM

SEQ ID NO: 1280319 - protein, 9 aa, Homo Sapiens
RTSSKHASR

SEQ ID NO: 1280320 - protein, 9 aa, Homo Sapiens
HQEAPPHIF

SEQ ID NO: 1280321 - protein, 9 aa, Homo Sapiens
SAKGRHKAF

SEQ ID NO: 1280322 - protein, 9 aa, Homo Sapiens
SLLQNLAKA

SEQ ID NO: 1280323 - protein, 9 aa, Homo Sapiens
AEAEEFVKQ

SEQ ID NO: 1280324 - protein, 9 aa, Homo Sapiens
ILLMKSLLS

SEQ ID NO: 1280325 - protein, 9 aa, Homo Sapiens
KPNIVELKK

SEQ ID NO: 1280326 - protein, 9 aa, Homo Sapiens
HIKGISNLG

SEQ ID NO: 1280327 - protein, 9 aa, Homo Sapiens
GHWDGVTHK

SEQ ID NO: 1280328 - protein, 9 aa, Homo Sapiens
DDCASHPCQ

SEQ ID NO: 1280329 - protein, 9 aa, Homo Sapiens
LKMRSAKGR

SEQ ID NO: 1280330 - protein, 9 aa, Homo Sapiens
LNKVWKDRI

SEQ ID NO: 1280331 - protein, 9 aa, Homo Sapiens
NLDSRSFIT

SEQ ID NO: 1280332 - protein, 9 aa, Homo Sapiens
VHLKREDCS

SEQ ID NO: 1280333 - protein, 9 aa, Homo Sapiens
YQENHAKWK

SEQ ID NO: 1280334 - protein, 9 aa, Homo Sapiens
PSVSQREEK

SEQ ID NO: 1280335 - protein, 9 aa, Homo Sapiens
NGLITTPIT

SEQ ID NO: 1280336 - protein, 9 aa, Homo Sapiens
RGQSSSGTS

SEQ ID NO: 1280337 - protein, 9 aa, Homo Sapiens
KSTMGASPL

SEQ ID NO: 1280338 - protein, 9 aa, Homo Sapiens
GRGAVSLPS

SEQ ID NO: 1280339 - protein, 9 aa, Homo Sapiens
DCASHPCQR

SEQ ID NO: 1280340 - protein, 9 aa, Homo Sapiens
HVTVVGELP

SEQ ID NO: 1280341 - protein, 9 aa, Homo Sapiens
ESMHSLLPV

SEQ ID NO: 1280342 - protein, 9 aa, Homo Sapiens
VRLLIDVRA

SEQ ID NO: 1280343 - protein, 9 aa, Homo Sapiens
STMGASPLL

SEQ ID NO: 1280344 - protein, 9 aa, Homo Sapiens
PPPGHPRGQ

SEQ ID NO: 1280345 - protein, 9 aa, Homo Sapiens
DSLNKVWKD

SEQ ID NO: 1280346 - protein, 9 aa, Homo Sapiens
LHVTVAESS

SEQ ID NO: 1280347 - protein, 9 aa, Homo Sapiens
GRPKHVCVM

SEQ ID NO: 1280348 - protein, 9 aa, Homo Sapiens
VSYATDNEK

SEQ ID NO: 1280349 - protein, 9 aa, Homo Sapiens
EVSHKQVVR

SEQ ID NO: 1280350 - protein, 9 aa, Homo Sapiens
YNTTLSVHQ

SEQ ID NO: 1280351 - protein, 9 aa, Homo Sapiens
SLLSKSTMG

SEQ ID NO: 1280352 - protein, 9 aa, Homo Sapiens
TGVVDPGKA

SEQ ID NO: 1280353 - protein, 9 aa, Homo Sapiens
TARQATQIL

SEQ ID NO: 1280354 - protein, 9 aa, Homo Sapiens
NHSPSHSPN

SEQ ID NO: 1280355 - protein, 9 aa, Homo Sapiens
FWNHTACME

SEQ ID NO: 1280356 - protein, 9 aa, Homo Sapiens
LHRPGNEPS

SEQ ID NO: 1280357 - protein, 9 aa, Homo Sapiens
LMSPCVPST

SEQ ID NO: 1280358 - protein, 9 aa, Homo Sapiens
GKASKAAWI

SEQ ID NO: 1280359 - protein, 9 aa, Homo Sapiens
QTHGFVHLK

SEQ ID NO: 1280360 - protein, 9 aa, Homo Sapiens
LSYSHSYLG

SEQ ID NO: 1280361 - protein, 9 aa, Homo Sapiens
LLMKSLLSK

SEQ ID NO: 1280362 - protein, 9 aa, Homo Sapiens
QNESLAAFW

SEQ ID NO: 1280363 - protein, 9 aa, Homo Sapiens
VTHKMRRML

SEQ ID NO: 1280364 - protein, 9 aa, Homo Sapiens
VMLTCAFCY

SEQ ID NO: 1280365 - protein, 9 aa, Homo Sapiens
HSLLQNLAK

SEQ ID NO: 1280366 - protein, 9 aa, Homo Sapiens
FVMLTCAFC

SEQ ID NO: 1280367 - protein, 9 aa, Homo Sapiens
VHVCACPGR

SEQ ID NO: 1280368 - protein, 9 aa, Homo Sapiens
PDITYHDRG

SEQ ID NO: 1280369 - protein, 9 aa, Homo Sapiens
GKKHQEAPP

SEQ ID NO: 1280370 - protein, 9 aa, Homo Sapiens
RALGPLRQD

SEQ ID NO: 1280371 - protein, 9 aa, Homo Sapiens
IVGHPRQQG

SEQ ID NO: 1280372 - protein, 9 aa, Homo Sapiens
FSRNSPSAI

SEQ ID NO: 1280373 - protein, 9 aa, Homo Sapiens
VTVVGELPR

SEQ ID NO: 1280374 - protein, 9 aa, Homo Sapiens
MAPADGDDS

SEQ ID NO: 1280375 - protein, 9 aa, Homo Sapiens
RSPQHLHRP

SEQ ID NO: 1280376 - protein, 9 aa, Homo Sapiens
KHFAEAEEF

SEQ ID NO: 1280377 - protein, 9 aa, Homo Sapiens
VVEPYNTTL

SEQ ID NO: 1280378 - protein, 9 aa, Homo Sapiens
ESLAAFWNH

SEQ ID NO: 1280379 - protein, 9 aa, Homo Sapiens
RYHKLKAVL

SEQ ID NO: 1280380 - protein, 9 aa, Homo Sapiens
PSIVGHPRQ

SEQ ID NO: 1280381 - protein, 9 aa, Homo Sapiens
LDRNPTAYA

SEQ ID NO: 1280382 - protein, 9 aa, Homo Sapiens
QSTLTHHQA

SEQ ID NO: 1280383 - protein, 9 aa, Homo Sapiens
AVFPSIVGH

SEQ ID NO: 1280384 - protein, 9 aa, Homo Sapiens
LETGIIIQT

SEQ ID NO: 1280385 - protein, 9 aa, Homo Sapiens
FSGQSTLTH

SEQ ID NO: 1280386 - protein, 9 aa, Homo Sapiens
VAWQLGKNN

SEQ ID NO: 1280387 - protein, 9 aa, Homo Sapiens
EIEETKERL

SEQ ID NO: 1280388 - protein, 9 aa, Homo Sapiens
SRSPQHLHR

SEQ ID NO: 1280389 - protein, 9 aa, Homo Sapiens
AKGRHKAFS

SEQ ID NO: 1280390 - protein, 9 aa, Homo Sapiens
LVPQPPQTS

SEQ ID NO: 1280391 - protein, 9 aa, Homo Sapiens
PQHLHRPGN

SEQ ID NO: 1280392 - protein, 9 aa, Homo Sapiens
NTGYKLQNN

SEQ ID NO: 1280393 - protein, 9 aa, Homo Sapiens
THKMRRMLG

SEQ ID NO: 1280394 - protein, 9 aa, Homo Sapiens
AAFWNHTAC

SEQ ID NO: 1280395 - protein, 9 aa, Homo Sapiens
TQEEPCSDI

SEQ ID NO: 1280396 - protein, 9 aa, Homo Sapiens
RNSFEVHVC

SEQ ID NO: 1280397 - protein, 9 aa, Homo Sapiens
QHLHRPGNE

SEQ ID NO: 1280398 - protein, 9 aa, Homo Sapiens
PRLVSERNL

SEQ ID NO: 1280399 - protein, 9 aa, Homo Sapiens
QLLSDVAQA

SEQ ID NO: 1280400 - protein, 9 aa, Homo Sapiens
PPRNLDSRS

SEQ ID NO: 1280401 - protein, 9 aa, Homo Sapiens
EGTRPPPPL

SEQ ID NO: 1280402 - protein, 9 aa, Homo Sapiens
TGYKLQNNE

SEQ ID NO: 1280403 - protein, 9 aa, Homo Sapiens
RGKKHQEAP

SEQ ID NO: 1280404 - protein, 9 aa, Homo Sapiens
YHKLKAVLE

SEQ ID NO: 1280405 - protein, 9 aa, Homo Sapiens
SHPCQRGAR

SEQ ID NO: 1280406 - protein, 9 aa, Homo Sapiens
EMISYQENH

SEQ ID NO: 1280407 - protein, 9 aa, Homo Sapiens
INLDDCASH

SEQ ID NO: 1280408 - protein, 9 aa, Homo Sapiens
PLLEIELVL

SEQ ID NO: 1280409 - protein, 9 aa, Homo Sapiens
HFAEAEEFV

SEQ ID NO: 1280410 - protein, 9 aa, Homo Sapiens
NPPPGHPRG

SEQ ID NO: 1280411 - protein, 9 aa, Homo Sapiens
VQAEIEETK

SEQ ID NO: 1280412 - protein, 9 aa, Homo Sapiens
SHSPNQSPR

SEQ ID NO: 1280413 - protein, 9 aa, Homo Sapiens
QEEPCSDII

SEQ ID NO: 1280414 - protein, 9 aa, Homo Sapiens
IVQAEIEET

SEQ ID NO: 1280415 - protein, 9 aa, Homo Sapiens
VFPSIVGHP

SEQ ID NO: 1280416 - protein, 9 aa, Homo Sapiens
PSHSPNQSP

SEQ ID NO: 1280417 - protein, 9 aa, Homo Sapiens
YRGKKHQEA

SEQ ID NO: 1280418 - protein, 9 aa, Homo Sapiens
GIHSLLQNL

SEQ ID NO: 1280419 - protein, 9 aa, Homo Sapiens
SAAAAVSGL

SEQ ID NO: 1280420 - protein, 9 aa, Homo Sapiens
SDNKVVDNQ

SEQ ID NO: 1280421 - protein, 9 aa, Homo Sapiens
CASHPCQRG

SEQ ID NO: 1280422 - protein, 9 aa, Homo Sapiens
IKLGVCPPP

SEQ ID NO: 1280423 - protein, 9 aa, Homo Sapiens
HIKLGVCPP

SEQ ID NO: 1280424 - protein, 9 aa, Homo Sapiens
NTTLSVHQL

SEQ ID NO: 1280425 - protein, 9 aa, Homo Sapiens
TAYRGKKHQ

SEQ ID NO: 1280426 - protein, 9 aa, Homo Sapiens
AEIEETKER

SEQ ID NO: 1280427 - protein, 9 aa, Homo Sapiens
PNIVELKKQ

SEQ ID NO: 1280428 - protein, 9 aa, Homo Sapiens
APKHIKGIS

SEQ ID NO: 1280429 - protein, 9 aa, Homo Sapiens
FGNNHFDER

SEQ ID NO: 1280430 - protein, 9 aa, Homo Sapiens
KHIKGISNL

SEQ ID NO: 1280431 - protein, 9 aa, Homo Sapiens
AFESKEGGP

SEQ ID NO: 1280432 - protein, 9 aa, Homo Sapiens
ALGPLRQDR

SEQ ID NO: 1280433 - protein, 9 aa, Homo Sapiens
GKEVSYICD

SEQ ID NO: 1280434 - protein, 9 aa, Homo Sapiens
FKKFIRRGF

SEQ ID NO: 1280435 - protein, 9 aa, Homo Sapiens
SDSEGFSRN

SEQ ID NO: 1280436 - protein, 9 aa, Homo Sapiens
RANLEAHDC

SEQ ID NO: 1280437 - protein, 9 aa, Homo Sapiens
KHVCVMAGA

SEQ ID NO: 1280438 - protein, 9 aa, Homo Sapiens
GISNLGYKV

SEQ ID NO: 1280439 - protein, 9 aa, Homo Sapiens
TFALGQEFG

SEQ ID NO: 1280440 - protein, 9 aa, Homo Sapiens
LEVCLLKSD

SEQ ID NO: 1280441 - protein, 9 aa, Homo Sapiens
NSFEVHVCA

SEQ ID NO: 1280442 - protein, 9 aa, Homo Sapiens
LKTEVSHKQ

SEQ ID NO: 1280443 - protein, 9 aa, Homo Sapiens
TGIIIQTFA

SEQ ID NO: 1280444 - protein, 9 aa, Homo Sapiens
SHSYLGKRP

SEQ ID NO: 1280445 - protein, 9 aa, Homo Sapiens
DPEYRKFLV

SEQ ID NO: 1280446 - protein, 9 aa, Homo Sapiens
GFKKFIRRG

SEQ ID NO: 1280447 - protein, 9 aa, Homo Sapiens
SLVPQPPQT

SEQ ID NO: 1280448 - protein, 9 aa, Homo Sapiens
NHFDERSFL

SEQ ID NO: 1280449 - protein, 9 aa, Homo Sapiens
TQNTLVNNV

SEQ ID NO: 1280450 - protein, 9 aa, Homo Sapiens
IELTQEEPC

SEQ ID NO: 1280451 - protein, 9 aa, Homo Sapiens
LLPVLASMT

SEQ ID NO: 1280452 - protein, 9 aa, Homo Sapiens
NEGTRPPPP

SEQ ID NO: 1280453 - protein, 9 aa, Homo Sapiens
IQTFALGQE

SEQ ID NO: 1280454 - protein, 9 aa, Homo Sapiens
EVSYICDPH

SEQ ID NO: 1280455 - protein, 9 aa, Homo Sapiens
HKMRRMLGH

SEQ ID NO: 1280456 - protein, 9 aa, Homo Sapiens
TQILLMKSL

SEQ ID NO: 1280457 - protein, 9 aa, Homo Sapiens
PKHVCVMAG

SEQ ID NO: 1280458 - protein, 9 aa, Homo Sapiens
RNPTAYALA

SEQ ID NO: 1280459 - protein, 9 aa, Homo Sapiens
QRCDVAWQL

SEQ ID NO: 1280460 - protein, 9 aa, Homo Sapiens
VSGLECATL

SEQ ID NO: 1280461 - protein, 9 aa, Homo Sapiens
FLLSTRAGD

SEQ ID NO: 1280462 - protein, 9 aa, Homo Sapiens
SSPNHSPSH

SEQ ID NO: 1280463 - protein, 9 aa, Homo Sapiens
MLARNSSLV

SEQ ID NO: 1280464 - protein, 9 aa, Homo Sapiens
KHQEAPPHI

SEQ ID NO: 1280465 - protein, 9 aa, Homo Sapiens
LPRLVSERN

SEQ ID NO: 1280466 - protein, 9 aa, Homo Sapiens
KTEVSHKQV

SEQ ID NO: 1280467 - protein, 9 aa, Homo Sapiens
CVPSTIFPV

SEQ ID NO: 1280468 - protein, 9 aa, Homo Sapiens
LLSKSTMGA

SEQ ID NO: 1280469 - protein, 9 aa, Homo Sapiens
LIDVRANLE

SEQ ID NO: 1280470 - protein, 9 aa, Homo Sapiens
RAGDLGINL

SEQ ID NO: 1280471 - protein, 9 aa, Homo Sapiens
GDLGINLAT

SEQ ID NO: 1280472 - protein, 9 aa, Homo Sapiens
VDPGKASKA

SEQ ID NO: 1280473 - protein, 9 aa, Homo Sapiens
PERVPAARA

SEQ ID NO: 1280474 - protein, 9 aa, Homo Sapiens
MKSLLSKST

SEQ ID NO: 1280475 - protein, 9 aa, Homo Sapiens
NIKGIHSLL

SEQ ID NO: 1280476 - protein, 9 aa, Homo Sapiens
SPQHLHRPG

SEQ ID NO: 1280477 - protein, 9 aa, Homo Sapiens
DERSFLTAP

SEQ ID NO: 1280478 - protein, 9 aa, Homo Sapiens
RLLIDVRAN

SEQ ID NO: 1280479 - protein, 9 aa, Homo Sapiens
TLTHHQAIH

SEQ ID NO: 1280480 - protein, 9 aa, Homo Sapiens
SYICDPHPD

SEQ ID NO: 1280481 - protein, 9 aa, Homo Sapiens
VPQPPQTSL

SEQ ID NO: 1280482 - protein, 9 aa, Homo Sapiens
SHKQVVRNQ

SEQ ID NO: 1280483 - protein, 9 aa, Homo Sapiens
ACRLISEAT

SEQ ID NO: 1280484 - protein, 9 aa, Homo Sapiens
RPKHVCVMA

SEQ ID NO: 1280485 - protein, 9 aa, Homo Sapiens
STLTHHQAI

SEQ ID NO: 1280486 - protein, 9 aa, Homo Sapiens
ELPRLVSER

SEQ ID NO: 1280487 - protein, 9 aa, Homo Sapiens
QSGRGAVSL

SEQ ID NO: 1280488 - protein, 9 aa, Homo Sapiens
KAKVGEFKD

SEQ ID NO: 1280489 - protein, 9 aa, Homo Sapiens
TTVTPTATP

SEQ ID NO: 1280490 - protein, 9 aa, Homo Sapiens
RDVEAPPSY

SEQ ID NO: 1280491 - protein, 9 aa, Homo Sapiens
DPVCSGTAR

SEQ ID NO: 1280492 - protein, 9 aa, Homo Sapiens
NEQNIGNEC

SEQ ID NO: 1280493 - protein, 9 aa, Homo Sapiens
SLNKSSAEV

SEQ ID NO: 1280494 - protein, 9 aa, Homo Sapiens
PGGLTHSLG

SEQ ID NO: 1280495 - protein, 9 aa, Homo Sapiens
TLSKQMVDV

SEQ ID NO: 1280496 - protein, 9 aa, Homo Sapiens
LDRDVEAPP

SEQ ID NO: 1280497 - protein, 9 aa, Homo Sapiens
HARWKCDGD

SEQ ID NO: 1280498 - protein, 9 aa, Homo Sapiens
IHTMLVLEG

SEQ ID NO: 1280499 - protein, 9 aa, Homo Sapiens
FPSLNKSSA

SEQ ID NO: 1280500 - protein, 9 aa, Homo Sapiens
WGPHLLVVR

SEQ ID NO: 1280501 - protein, 9 aa, Homo Sapiens
KAKHLPLSL

SEQ ID NO: 1280502 - protein, 9 aa, Homo Sapiens
MQDRRIVCI

SEQ ID NO: 1280503 - protein, 9 aa, Homo Sapiens
LVILSGCDV

SEQ ID NO: 1280504 - protein, 9 aa, Homo Sapiens
GGFSASLHT

SEQ ID NO: 1280505 - protein, 9 aa, Homo Sapiens
PYVVKKCNQ

SEQ ID NO: 1280506 - protein, 9 aa, Homo Sapiens
MIEQVSMIG

SEQ ID NO: 1280507 - protein, 9 aa, Homo Sapiens
LRGERTWPS

SEQ ID NO: 1280508 - protein, 9 aa, Homo Sapiens
PLKFSKINS

SEQ ID NO: 1280509 - protein, 9 aa, Homo Sapiens
AKHLPLSLN

SEQ ID NO: 1280510 - protein, 9 aa, Homo Sapiens
PNILQNEIF

SEQ ID NO: 1280511 - protein, 9 aa, Homo Sapiens
NSRGFEDCY

SEQ ID NO: 1280512 - protein, 9 aa, Homo Sapiens
EIFGQTLNN

SEQ ID NO: 1280513 - protein, 9 aa, Homo Sapiens
VVDRNDNDP

SEQ ID NO: 1280514 - protein, 9 aa, Homo Sapiens
DGGDPVCSG

SEQ ID NO: 1280515 - protein, 9 aa, Homo Sapiens
LVPSELPGA

SEQ ID NO: 1280516 - protein, 9 aa, Homo Sapiens
IKSLLNEQN

SEQ ID NO: 1280517 - protein, 9 aa, Homo Sapiens
RSTPPGFTA

SEQ ID NO: 1280518 - protein, 9 aa, Homo Sapiens
VETLTHEMY

SEQ ID NO: 1280519 - protein, 9 aa, Homo Sapiens
RLSSPREKN

SEQ ID NO: 1280520 - protein, 9 aa, Homo Sapiens
FTTTLDLTD

SEQ ID NO: 1280521 - protein, 9 aa, Homo Sapiens
VNSGRSYVG

SEQ ID NO: 1280522 - protein, 9 aa, Homo Sapiens
CKPGTGKGL

SEQ ID NO: 1280523 - protein, 9 aa, Homo Sapiens
TMFTPLLNL

SEQ ID NO: 1280524 - protein, 9 aa, Homo Sapiens
QLFQYQECV

SEQ ID NO: 1280525 - protein, 9 aa, Homo Sapiens
EQDLAQCFF

SEQ ID NO: 1280526 - protein, 9 aa, Homo Sapiens
TTTTVTPTA

SEQ ID NO: 1280527 - protein, 9 aa, Homo Sapiens
PLRCKPGTG

SEQ ID NO: 1280528 - protein, 9 aa, Homo Sapiens
RIVCIFLPN

SEQ ID NO: 1280529 - protein, 9 aa, Homo Sapiens
AIDDKIEQA

SEQ ID NO: 1280530 - protein, 9 aa, Homo Sapiens
ECFMIRTSK

SEQ ID NO: 1280531 - protein, 9 aa, Homo Sapiens
RAAPPHPQA

SEQ ID NO: 1280532 - protein, 9 aa, Homo Sapiens
GAAGPSASP

SEQ ID NO: 1280533 - protein, 9 aa, Homo Sapiens
VEDAHVLCQ

SEQ ID NO: 1280534 - protein, 9 aa, Homo Sapiens
SLKKYLHAE

SEQ ID NO: 1280535 - protein, 9 aa, Homo Sapiens
CSRSSPTSW

SEQ ID NO: 1280536 - protein, 9 aa, Homo Sapiens
ILSGCDVTY

SEQ ID NO: 1280537 - protein, 9 aa, Homo Sapiens
LRSQRFSTS

SEQ ID NO: 1280538 - protein, 9 aa, Homo Sapiens
STREDCIAL

SEQ ID NO: 1280539 - protein, 9 aa, Homo Sapiens
GPHLLVVRS

SEQ ID NO: 1280540 - protein, 9 aa, Homo Sapiens
KIHTMLVLE

SEQ ID NO: 1280541 - protein, 9 aa, Homo Sapiens
TTYENGKVT

SEQ ID NO: 1280542 - protein, 9 aa, Homo Sapiens
SLTDIVELR

SEQ ID NO: 1280543 - protein, 9 aa, Homo Sapiens
LKKYLHAEI

SEQ ID NO: 1280544 - protein, 9 aa, Homo Sapiens
WPVPLADMA

SEQ ID NO: 1280545 - protein, 9 aa, Homo Sapiens
CSGTARILI

SEQ ID NO: 1280546 - protein, 9 aa, Homo Sapiens
PPQRLIRVE

SEQ ID NO: 1280547 - protein, 9 aa, Homo Sapiens
VQENRPSLT

SEQ ID NO: 1280548 - protein, 9 aa, Homo Sapiens
EPTVKNARI

SEQ ID NO: 1280549 - protein, 9 aa, Homo Sapiens
KVVVNSGRS

SEQ ID NO: 1280550 - protein, 9 aa, Homo Sapiens
AASAWLTAT

SEQ ID NO: 1280551 - protein, 9 aa, Homo Sapiens
GGLTHSLGN

SEQ ID NO: 1280552 - protein, 9 aa, Homo Sapiens
RSLPFPAPG

SEQ ID NO: 1280553 - protein, 9 aa, Homo Sapiens
SLHTEPPVY

SEQ ID NO: 1280554 - protein, 9 aa, Homo Sapiens
NSHWDVEDA

SEQ ID NO: 1280555 - protein, 9 aa, Homo Sapiens
FGLCFKDCK

SEQ ID NO: 1280556 - protein, 9 aa, Homo Sapiens
SMIGEGACL

SEQ ID NO: 1280557 - protein, 9 aa, Homo Sapiens
NVHRASLAM

SEQ ID NO: 1280558 - protein, 9 aa, Homo Sapiens
QADSIRNDI

SEQ ID NO: 1280559 - protein, 9 aa, Homo Sapiens
DDTKGLFDP

SEQ ID NO: 1280560 - protein, 9 aa, Homo Sapiens
EKAFYTLCA

SEQ ID NO: 1280561 - protein, 9 aa, Homo Sapiens
GFEDCYATD

SEQ ID NO: 1280562 - protein, 9 aa, Homo Sapiens
LLPFRMSSF

SEQ ID NO: 1280563 - protein, 9 aa, Homo Sapiens
MSAFKTPMG

SEQ ID NO: 1280564 - protein, 9 aa, Homo Sapiens
VQNSFLLPF

SEQ ID NO: 1280565 - protein, 9 aa, Homo Sapiens
SLVILSGCD

SEQ ID NO: 1280566 - protein, 9 aa, Homo Sapiens
RSSSTISRC

SEQ ID NO: 1280567 - protein, 9 aa, Homo Sapiens
CFMIRTSKG

SEQ ID NO: 1280568 - protein, 9 aa, Homo Sapiens
MAVLPRLSS

SEQ ID NO: 1280569 - protein, 9 aa, Homo Sapiens
LCNSHWDVE

SEQ ID NO: 1280570 - protein, 9 aa, Homo Sapiens
GTRTITRVK

SEQ ID NO: 1280571 - protein, 9 aa, Homo Sapiens
PNRPREYIQ

SEQ ID NO: 1280572 - protein, 9 aa, Homo Sapiens
KGYGKHAAG

SEQ ID NO: 1280573 - protein, 9 aa, Homo Sapiens
PQGIKGKFG

SEQ ID NO: 1280574 - protein, 9 aa, Homo Sapiens
LTMPSLDYG

SEQ ID NO: 1280575 - protein, 9 aa, Homo Sapiens
TSKQEEMLQ

SEQ ID NO: 1280576 - protein, 9 aa, Homo Sapiens
LNKAKCKHI

SEQ ID NO: 1280577 - protein, 9 aa, Homo Sapiens
VDGAWLEGD

SEQ ID NO: 1280578 - protein, 9 aa, Homo Sapiens
ATPTGTQTP

SEQ ID NO: 1280579 - protein, 9 aa, Homo Sapiens
PRPQPLKGA

SEQ ID NO: 1280580 - protein, 9 aa, Homo Sapiens
THCSWHLTM

SEQ ID NO: 1280581 - protein, 9 aa, Homo Sapiens
LQHHADLTF

SEQ ID NO: 1280582 - protein, 9 aa, Homo Sapiens
KINSGMADI

SEQ ID NO: 1280583 - protein, 9 aa, Homo Sapiens
NEQDLAQCF

SEQ ID NO: 1280584 - protein, 9 aa, Homo Sapiens
FKDCKFMPS

SEQ ID NO: 1280585 - protein, 9 aa, Homo Sapiens
TVKNARIIG

SEQ ID NO: 1280586 - protein, 9 aa, Homo Sapiens
FNSRGFEDC

SEQ ID NO: 1280587 - protein, 9 aa, Homo Sapiens
RSAVSTPAA

SEQ ID NO: 1280588 - protein, 9 aa, Homo Sapiens
PKTTQSMRS

SEQ ID NO: 1280589 - protein, 9 aa, Homo Sapiens
RPSLTDIVE

SEQ ID NO: 1280590 - protein, 9 aa, Homo Sapiens
HALHFVQLH

SEQ ID NO: 1280591 - protein, 9 aa, Homo Sapiens
EKIHTMLVL

SEQ ID NO: 1280592 - protein, 9 aa, Homo Sapiens
LAPPQRLIR

SEQ ID NO: 1280593 - protein, 9 aa, Homo Sapiens
IEQVSMIGE

SEQ ID NO: 1280594 - protein, 9 aa, Homo Sapiens
IGNGYGPGG

SEQ ID NO: 1280595 - protein, 9 aa, Homo Sapiens
KAFYTLCAQ

SEQ ID NO: 1280596 - protein, 9 aa, Homo Sapiens
CECSRSSPT

SEQ ID NO: 1280597 - protein, 9 aa, Homo Sapiens
HCIHARWKC

SEQ ID NO: 1280598 - protein, 9 aa, Homo Sapiens
GAAASAWLT

SEQ ID NO: 1280599 - protein, 9 aa, Homo Sapiens
SEPAEPRLC

SEQ ID NO: 1280600 - protein, 9 aa, Homo Sapiens
PVPLADMAP

SEQ ID NO: 1280601 - protein, 9 aa, Homo Sapiens
GLRSQRFST

SEQ ID NO: 1280602 - protein, 9 aa, Homo Sapiens
TVLGDPACA

SEQ ID NO: 1280603 - protein, 9 aa, Homo Sapiens
SDGLAPPQR

SEQ ID NO: 1280604 - protein, 9 aa, Homo Sapiens
MPSLDYGLA

SEQ ID NO: 1280605 - protein, 9 aa, Homo Sapiens
SSPTSWTTR

SEQ ID NO: 1280606 - protein, 9 aa, Homo Sapiens
LPLSLNGHG

SEQ ID NO: 1280607 - protein, 9 aa, Homo Sapiens
SRAFYGSHG

SEQ ID NO: 1280608 - protein, 9 aa, Homo Sapiens
IVQNSFLLP

SEQ ID NO: 1280609 - protein, 9 aa, Homo Sapiens
LSQGNFCDG

SEQ ID NO: 1280610 - protein, 9 aa, Homo Sapiens
LPFRMSSFP

SEQ ID NO: 1280611 - protein, 9 aa, Homo Sapiens
HLPNRPREY

SEQ ID NO: 1280612 - protein, 9 aa, Homo Sapiens
GDSAIEDIN

SEQ ID NO: 1280613 - protein, 9 aa, Homo Sapiens
ASAWLTATA

SEQ ID NO: 1280614 - protein, 9 aa, Homo Sapiens
TQSMRSGAG

SEQ ID NO: 1280615 - protein, 9 aa, Homo Sapiens
EPAEPRLCS

SEQ ID NO: 1280616 - protein, 9 aa, Homo Sapiens
LKNTLSKQM

SEQ ID NO: 1280617 - protein, 9 aa, Homo Sapiens
SASLHTEPP

SEQ ID NO: 1280618 - protein, 9 aa, Homo Sapiens
PSLNKSSAE

SEQ ID NO: 1280619 - protein, 9 aa, Homo Sapiens
PQGRKGAAA

SEQ ID NO: 1280620 - protein, 9 aa, Homo Sapiens
VCLDEHFSK

SEQ ID NO: 1280621 - protein, 9 aa, Homo Sapiens
FSKINSGMA

SEQ ID NO: 1280622 - protein, 9 aa, Homo Sapiens
DSERRTTLH

SEQ ID NO: 1280623 - protein, 9 aa, Homo Sapiens
AFAALPHDH

SEQ ID NO: 1280624 - protein, 9 aa, Homo Sapiens
TLNYASHAQ

SEQ ID NO: 1280625 - protein, 9 aa, Homo Sapiens
TITRVKVQD

SEQ ID NO: 1280626 - protein, 9 aa, Homo Sapiens
LVRGHAWKT

SEQ ID NO: 1280627 - protein, 9 aa, Homo Sapiens
HARPPPVAR

SEQ ID NO: 1280628 - protein, 9 aa, Homo Sapiens
AAGPSASPA

SEQ ID NO: 1280629 - protein, 9 aa, Homo Sapiens
GPRPQPLKG

SEQ ID NO: 1280630 - protein, 9 aa, Homo Sapiens
HSLRDARAP

SEQ ID NO: 1280631 - protein, 9 aa, Homo Sapiens
LTAASLCHF

SEQ ID NO: 1280632 - protein, 9 aa, Homo Sapiens
EQNIGNECL

SEQ ID NO: 1280633 - protein, 9 aa, Homo Sapiens
GIKGKFGPP

SEQ ID NO: 1280634 - protein, 9 aa, Homo Sapiens
FWIPGTPIR

SEQ ID NO: 1280635 - protein, 9 aa, Homo Sapiens
LLNEQNIGN

SEQ ID NO: 1280636 - protein, 9 aa, Homo Sapiens
KHAAGIAME

SEQ ID NO: 1280637 - protein, 9 aa, Homo Sapiens
GSGPGPGPR

SEQ ID NO: 1280638 - protein, 9 aa, Homo Sapiens
ARPPPVARA

SEQ ID NO: 1280639 - protein, 9 aa, Homo Sapiens
PMGDLQRQL

SEQ ID NO: 1280640 - protein, 9 aa, Homo Sapiens
TYENGKVTL

SEQ ID NO: 1280641 - protein, 9 aa, Homo Sapiens
MREQDILKQ

SEQ ID NO: 1280642 - protein, 9 aa, Homo Sapiens
WERTRSTPP

SEQ ID NO: 1280643 - protein, 9 aa, Homo Sapiens
HECKVCGKT

SEQ ID NO: 1280644 - protein, 9 aa, Homo Sapiens
GNGFAPSGI

SEQ ID NO: 1280645 - protein, 9 aa, Homo Sapiens
TLRTQMYFF

SEQ ID NO: 1280646 - protein, 9 aa, Homo Sapiens
ERTRSTPPG

SEQ ID NO: 1280647 - protein, 9 aa, Homo Sapiens
TWPSPRVHG

SEQ ID NO: 1280648 - protein, 9 aa, Homo Sapiens
QKLMREQDI

SEQ ID NO: 1280649 - protein, 9 aa, Homo Sapiens
FQGKAKHLP

SEQ ID NO: 1280650 - protein, 9 aa, Homo Sapiens
RCKPGTGKG

SEQ ID NO: 1280651 - protein, 9 aa, Homo Sapiens
APPQRLIRV

SEQ ID NO: 1280652 - protein, 9 aa, Homo Sapiens
IKGKFGPPG

SEQ ID NO: 1280653 - protein, 9 aa, Homo Sapiens
RMSSFPKKF

SEQ ID NO: 1280654 - protein, 9 aa, Homo Sapiens
LVVRSCNIL

SEQ ID NO: 1280655 - protein, 9 aa, Homo Sapiens
TDPCQADSI

SEQ ID NO: 1280656 - protein, 9 aa, Homo Sapiens
SGRKSQELP

SEQ ID NO: 1280657 - protein, 9 aa, Homo Sapiens
SQRFSTSAP

SEQ ID NO: 1280658 - protein, 9 aa, Homo Sapiens
VQAQKAKVD

SEQ ID NO: 1280659 - protein, 9 aa, Homo Sapiens
KWESLTDEL

SEQ ID NO: 1280660 - protein, 9 aa, Homo Sapiens
IHARWKCDG

SEQ ID NO: 1280661 - protein, 9 aa, Homo Sapiens
VRGHAWKTK

SEQ ID NO: 1280662 - protein, 9 aa, Homo Sapiens
MVERLRSRV

SEQ ID NO: 1280663 - protein, 9 aa, Homo Sapiens
SAAFSGVDD

SEQ ID NO: 1280664 - protein, 9 aa, Homo Sapiens
HAQNIRNRA

SEQ ID NO: 1280665 - protein, 9 aa, Homo Sapiens
RAKLNKAKC

SEQ ID NO: 1280666 - protein, 9 aa, Homo Sapiens
SKVQVCLDE

SEQ ID NO: 1280667 - protein, 9 aa, Homo Sapiens
TLCAQAINR

SEQ ID NO: 1280668 - protein, 9 aa, Homo Sapiens
LRNSRAFYG

SEQ ID NO: 1280669 - protein, 9 aa, Homo Sapiens
AGPSASPAP

SEQ ID NO: 1280670 - protein, 9 aa, Homo Sapiens
FMIRTSKGN

SEQ ID NO: 1280671 - protein, 9 aa, Homo Sapiens
ELPGAHLGV

SEQ ID NO: 1280672 - protein, 9 aa, Homo Sapiens
VVNSGRSYV

SEQ ID NO: 1280673 - protein, 9 aa, Homo Sapiens
EDCYATDSS

SEQ ID NO: 1280674 - protein, 9 aa, Homo Sapiens
RTWPSPRVH

SEQ ID NO: 1280675 - protein, 9 aa, Homo Sapiens
NTLSKQMVD

SEQ ID NO: 1280676 - protein, 9 aa, Homo Sapiens
SVVAIDDKI

SEQ ID NO: 1280677 - protein, 9 aa, Homo Sapiens
AFYTLCAQA

SEQ ID NO: 1280678 - protein, 9 aa, Homo Sapiens
TRAGSKNCR

SEQ ID NO: 1280679 - protein, 9 aa, Homo Sapiens
WGSGIFWIP

SEQ ID NO: 1280680 - protein, 9 aa, Homo Sapiens
VARARAAPP

SEQ ID NO: 1280681 - protein, 9 aa, Homo Sapiens
LVQENRPSL

SEQ ID NO: 1280682 - protein, 9 aa, Homo Sapiens
AIECFMIRT

SEQ ID NO: 1280683 - protein, 9 aa, Homo Sapiens
KHLPLSLNG

SEQ ID NO: 1280684 - protein, 9 aa, Homo Sapiens
TREDCIALV

SEQ ID NO: 1280685 - protein, 9 aa, Homo Sapiens
STPAAACEC

SEQ ID NO: 1280686 - protein, 9 aa, Homo Sapiens
CKNRHCIHA

SEQ ID NO: 1280687 - protein, 9 aa, Homo Sapiens
PQASGRKSQ

SEQ ID NO: 1280688 - protein, 9 aa, Homo Sapiens
DHSLRDARA

SEQ ID NO: 1280689 - protein, 9 aa, Homo Sapiens
NILQNEIFG

SEQ ID NO: 1280690 - protein, 9 aa, Homo Sapiens
GNWGPHLLV

SEQ ID NO: 1280691 - protein, 9 aa, Homo Sapiens
QELPQGRKG

SEQ ID NO: 1280692 - protein, 9 aa, Homo Sapiens
KVTLVCDAE

SEQ ID NO: 1280693 - protein, 9 aa, Homo Sapiens
QGNFCDGLG

SEQ ID NO: 1280694 - protein, 9 aa, Homo Sapiens
LNGSAAFSG

SEQ ID NO: 1280695 - protein, 9 aa, Homo Sapiens
PAPRSLPFP

SEQ ID NO: 1280696 - protein, 9 aa, Homo Sapiens
TGPNQAPCN

SEQ ID NO: 1280697 - protein, 9 aa, Homo Sapiens
RVMQDRRIV

SEQ ID NO: 1280698 - protein, 9 aa, Homo Sapiens
VSTPAAACE

SEQ ID NO: 1280699 - protein, 9 aa, Homo Sapiens
PSELPGAHL

SEQ ID NO: 1280700 - protein, 9 aa, Homo Sapiens
AKLNKAKCK

SEQ ID NO: 1280701 - protein, 9 aa, Homo Sapiens
VKNARIIGE

SEQ ID NO: 1280702 - protein, 9 aa, Homo Sapiens
RPQPLKGAL

SEQ ID NO: 1280703 - protein, 9 aa, Homo Sapiens
VLVETLTHE

SEQ ID NO: 1280704 - protein, 9 aa, Homo Sapiens
RKSQELPQG

SEQ ID NO: 1280705 - protein, 9 aa, Homo Sapiens
NGSAAFSGV

SEQ ID NO: 1280706 - protein, 9 aa, Homo Sapiens
PAEPRLCST

SEQ ID NO: 1280707 - protein, 9 aa, Homo Sapiens
GIGNGYGPG

SEQ ID NO: 1280708 - protein, 9 aa, Homo Sapiens
RMVERLRSR

SEQ ID NO: 1280709 - protein, 9 aa, Homo Sapiens
HTEPPVYAN

SEQ ID NO: 1280710 - protein, 9 aa, Homo Sapiens
TTRSSRLGA

SEQ ID NO: 1280711 - protein, 9 aa, Homo Sapiens
AFPLRCKPG

SEQ ID NO: 1280712 - protein, 9 aa, Homo Sapiens
AAPPHPQAS

SEQ ID NO: 1280713 - protein, 9 aa, Homo Sapiens
SKQEEMLQK

SEQ ID NO: 1280714 - protein, 9 aa, Homo Sapiens
LNKSSAEVL

SEQ ID NO: 1280715 - protein, 9 aa, Homo Sapiens
SPTSWTTRS

SEQ ID NO: 1280716 - protein, 9 aa, Homo Sapiens
DPVILFPLP

SEQ ID NO: 1280717 - protein, 9 aa, Homo Sapiens
RCTWERTRS

SEQ ID NO: 1280718 - protein, 9 aa, Homo Sapiens
EPRLCSTKG

SEQ ID NO: 1280719 - protein, 9 aa, Homo Sapiens
KKLQASQPT

SEQ ID NO: 1280720 - protein, 9 aa, Homo Sapiens
SVKGKRRDN

SEQ ID NO: 1280721 - protein, 9 aa, Homo Sapiens
PTESLIQLM

SEQ ID NO: 1280722 - protein, 9 aa, Homo Sapiens
PRLSSPREK

SEQ ID NO: 1280723 - protein, 9 aa, Homo Sapiens
SMSAFKTPM

SEQ ID NO: 1280724 - protein, 9 aa, Homo Sapiens
CLDEHFSKM

SEQ ID NO: 1280725 - protein, 9 aa, Homo Sapiens
HHADLTFTT

SEQ ID NO: 1280726 - protein, 9 aa, Homo Sapiens
RTRSTPPGF

SEQ ID NO: 1280727 - protein, 9 aa, Homo Sapiens
DNGLSAAAR

SEQ ID NO: 1280728 - protein, 9 aa, Homo Sapiens
DILERMVER

SEQ ID NO: 1280729 - protein, 9 aa, Homo Sapiens
QDSLKKYLH

SEQ ID NO: 1280730 - protein, 9 aa, Homo Sapiens
DRFLHLPNR

SEQ ID NO: 1280731 - protein, 9 aa, Homo Sapiens
ADSIRNDIT

SEQ ID NO: 1280732 - protein, 9 aa, Homo Sapiens
MEQKWESLT

SEQ ID NO: 1280733 - protein, 9 aa, Homo Sapiens
WESLTDELA

SEQ ID NO: 1280734 - protein, 9 aa, Homo Sapiens
QLHFSLLFK

SEQ ID NO: 1280735 - protein, 9 aa, Homo Sapiens
GSKNCRFPD

SEQ ID NO: 1280736 - protein, 9 aa, Homo Sapiens
PHLLVVRSC

SEQ ID NO: 1280737 - protein, 9 aa, Homo Sapiens
AFDGGDPVC

SEQ ID NO: 1280738 - protein, 9 aa, Homo Sapiens
GKGLRGERT

SEQ ID NO: 1280739 - protein, 9 aa, Homo Sapiens
GFSASLHTE

SEQ ID NO: 1280740 - protein, 9 aa, Homo Sapiens
RQLFQYQEC

SEQ ID NO: 1280741 - protein, 9 aa, Homo Sapiens
PSGIGNGYG

SEQ ID NO: 1280742 - protein, 9 aa, Homo Sapiens
TMPSLDYGL

SEQ ID NO: 1280743 - protein, 9 aa, Homo Sapiens
GHRKALTTC

SEQ ID NO: 1280744 - protein, 9 aa, Homo Sapiens
NQSPKEMHC

SEQ ID NO: 1280745 - protein, 9 aa, Homo Sapiens
NGTRTITRV

SEQ ID NO: 1280746 - protein, 9 aa, Homo Sapiens
APSGIGNGY

SEQ ID NO: 1280747 - protein, 9 aa, Homo Sapiens
VMQDRRIVC

SEQ ID NO: 1280748 - protein, 9 aa, Homo Sapiens
SQGNFCDGL

SEQ ID NO: 1280749 - protein, 9 aa, Homo Sapiens
EKTRAGSKN

SEQ ID NO: 1280750 - protein, 9 aa, Homo Sapiens
KTTQSMRSG

SEQ ID NO: 1280751 - protein, 9 aa, Homo Sapiens
HLLVVRSCN

SEQ ID NO: 1280752 - protein, 9 aa, Homo Sapiens
CCRLEPTVK

SEQ ID NO: 1280753 - protein, 9 aa, Homo Sapiens
FDDDIWEDE

SEQ ID NO: 1280754 - protein, 9 aa, Homo Sapiens
PFPAPGLRS

SEQ ID NO: 1280755 - protein, 9 aa, Homo Sapiens
VVVNSGRSY

SEQ ID NO: 1280756 - protein, 9 aa, Homo Sapiens
FQYQECVRE

SEQ ID NO: 1280757 - protein, 9 aa, Homo Sapiens
VGQAWPVPL

SEQ ID NO: 1280758 - protein, 9 aa, Homo Sapiens
VAIDDKIEQ

SEQ ID NO: 1280759 - protein, 9 aa, Homo Sapiens
QAPCNCLPA

SEQ ID NO: 1280760 - protein, 9 aa, Homo Sapiens
NKHGHARAV

SEQ ID NO: 1280761 - protein, 9 aa, Homo Sapiens
PSLTDIVEL

SEQ ID NO: 1280762 - protein, 9 aa, Homo Sapiens
KTSSARSAV

SEQ ID NO: 1280763 - protein, 9 aa, Homo Sapiens
GNFCDGLGS

SEQ ID NO: 1280764 - protein, 9 aa, Homo Sapiens
TGKGLRGER

SEQ ID NO: 1280765 - protein, 9 aa, Homo Sapiens
TTTVTPTAT

SEQ ID NO: 1280766 - protein, 9 aa, Homo Sapiens
DINATTGKD

SEQ ID NO: 1280767 - protein, 9 aa, Homo Sapiens
QQQQQRQQQ

SEQ ID NO: 1280768 - protein, 9 aa, Homo Sapiens
LFQYQECVR

SEQ ID NO: 1280769 - protein, 9 aa, Homo Sapiens
GPYVVKKCN

SEQ ID NO: 1280770 - protein, 9 aa, Homo Sapiens
QVCLDEHFS

SEQ ID NO: 1280771 - protein, 9 aa, Homo Sapiens
YQECVREEQ

SEQ ID NO: 1280772 - protein, 9 aa, Homo Sapiens
VDRFLHLPN

SEQ ID NO: 1280773 - protein, 9 aa, Homo Sapiens
EQKWESLTD

SEQ ID NO: 1280774 - protein, 9 aa, Homo Sapiens
AWLTATAVV

SEQ ID NO: 1280775 - protein, 9 aa, Homo Sapiens
KPHECKVCG

SEQ ID NO: 1280776 - protein, 9 aa, Homo Sapiens
PHECKVCGK

SEQ ID NO: 1280777 - protein, 9 aa, Homo Sapiens
QKWESLTDE

SEQ ID NO: 1280778 - protein, 9 aa, Homo Sapiens
PRSSSTISR

SEQ ID NO: 1280779 - protein, 9 aa, Homo Sapiens
IQADILKNT

SEQ ID NO: 1280780 - protein, 9 aa, Homo Sapiens
GKHAAGIAM

SEQ ID NO: 1280781 - protein, 9 aa, Homo Sapiens
MIRTSKGNR

SEQ ID NO: 1280782 - protein, 9 aa, Homo Sapiens
SRGFEDCYA

SEQ ID NO: 1280783 - protein, 9 aa, Homo Sapiens
FAPSGIGNG

SEQ ID NO: 1280784 - protein, 9 aa, Homo Sapiens
KAKVDGAWL

SEQ ID NO: 1280785 - protein, 9 aa, Homo Sapiens
RTTLHRILT

SEQ ID NO: 1280786 - protein, 9 aa, Homo Sapiens
RTITRVKVQ

SEQ ID NO: 1280787 - protein, 9 aa, Homo Sapiens
TPPGFTAWK

SEQ ID NO: 1280788 - protein, 9 aa, Homo Sapiens
LPQGRKGAA

SEQ ID NO: 1280789 - protein, 9 aa, Homo Sapiens
AKVDGAWLE

SEQ ID NO: 1280790 - protein, 9 aa, Homo Sapiens
VSGIHITKP

SEQ ID NO: 1280791 - protein, 9 aa, Homo Sapiens
GGDPVCSGT

SEQ ID NO: 1280792 - protein, 9 aa, Homo Sapiens
DLTFTTTLD

SEQ ID NO: 1280793 - protein, 9 aa, Homo Sapiens
LRTQMYFFL

SEQ ID NO: 1280794 - protein, 9 aa, Homo Sapiens
RPPPVARAR

SEQ ID NO: 1280795 - protein, 9 aa, Homo Sapiens
VFENGTRTI

SEQ ID NO: 1280796 - protein, 9 aa, Homo Sapiens
QSPKEMHCL

SEQ ID NO: 1280797 - protein, 9 aa, Homo Sapiens
SGIFWIPGT

SEQ ID NO: 1280798 - protein, 9 aa, Homo Sapiens
KKYLHAEIK

SEQ ID NO: 1280799 - protein, 9 aa, Homo Sapiens
ILTAASLCH

SEQ ID NO: 1280800 - protein, 9 aa, Homo Sapiens
EQDILKQVF

SEQ ID NO: 1280801 - protein, 9 aa, Homo Sapiens
SSFPKKFFF

SEQ ID NO: 1280802 - protein, 9 aa, Homo Sapiens
PPPVARARA

SEQ ID NO: 1280803 - protein, 9 aa, Homo Sapiens
TVTPTATPT

SEQ ID NO: 1280804 - protein, 9 aa, Homo Sapiens
LLNATPGPY

SEQ ID NO: 1280805 - protein, 9 aa, Homo Sapiens
KNCRFPDDL

SEQ ID NO: 1280806 - protein, 9 aa, Homo Sapiens
PELKEKKIW

SEQ ID NO: 1280807 - protein, 9 aa, Homo Sapiens
PGPYVVKKC

SEQ ID NO: 1280808 - protein, 9 aa, Homo Sapiens
RGERTWPSP

SEQ ID NO: 1280809 - protein, 9 aa, Homo Sapiens
ADLTFTTTL

SEQ ID NO: 1280810 - protein, 9 aa, Homo Sapiens
PKEMHCLHP

SEQ ID NO: 1280811 - protein, 9 aa, Homo Sapiens
YVVKKCNQV

SEQ ID NO: 1280812 - protein, 9 aa, Homo Sapiens
LEPTVKNAR

SEQ ID NO: 1280813 - protein, 9 aa, Homo Sapiens
RNSRAFYGS

SEQ ID NO: 1280814 - protein, 9 aa, Homo Sapiens
MRSGAGVQA

SEQ ID NO: 1280815 - protein, 9 aa, Homo Sapiens
KFSKINSGM

SEQ ID NO: 1280816 - protein, 9 aa, Homo Sapiens
TAVVTVLGD

SEQ ID NO: 1280817 - protein, 9 aa, Homo Sapiens
AWPVPLADM

SEQ ID NO: 1280818 - protein, 9 aa, Homo Sapiens
HRAKLNKAK

SEQ ID NO: 1280819 - protein, 9 aa, Homo Sapiens
RLFYAVDFD

SEQ ID NO: 1280820 - protein, 9 aa, Homo Sapiens
GLCFKDCKF

SEQ ID NO: 1280821 - protein, 9 aa, Homo Sapiens
DNDPVILFP

SEQ ID NO: 1280822 - protein, 9 aa, Homo Sapiens
KGAAASAWL

SEQ ID NO: 1280823 - protein, 9 aa, Homo Sapiens
VDFDDDIWE

SEQ ID NO: 1280824 - protein, 9 aa, Homo Sapiens
ALRNSRAFY

SEQ ID NO: 1280825 - protein, 9 aa, Homo Sapiens
GCDVTYTPV

SEQ ID NO: 1280826 - protein, 9 aa, Homo Sapiens
TPGPYVVKK

SEQ ID NO: 1280827 - protein, 9 aa, Homo Sapiens
ENRPSLTDI

SEQ ID NO: 1280828 - protein, 9 aa, Homo Sapiens
PACAFPLRC

SEQ ID NO: 1280829 - protein, 9 aa, Homo Sapiens
IFGQTLNNA

SEQ ID NO: 1280830 - protein, 9 aa, Homo Sapiens
AEPRLCSTK

SEQ ID NO: 1280831 - protein, 9 aa, Homo Sapiens
IWWIVQNSF

SEQ ID NO: 1280832 - protein, 9 aa, Homo Sapiens
LFDPNTHEN

SEQ ID NO: 1280833 - protein, 9 aa, Homo Sapiens
LHFVQLHFS

SEQ ID NO: 1280834 - protein, 9 aa, Homo Sapiens
REQDILKQV

SEQ ID NO: 1280835 - protein, 9 aa, Homo Sapiens
QASQPTESL

SEQ ID NO: 1280836 - protein, 9 aa, Homo Sapiens
HARAVYVLV

SEQ ID NO: 1280837 - protein, 9 aa, Homo Sapiens
IECFMIRTS

SEQ ID NO: 1280838 - protein, 9 aa, Homo Sapiens
HRASLAMSI

SEQ ID NO: 1280839 - protein, 9 aa, Homo Sapiens
LNTLNYASH

SEQ ID NO: 1280840 - protein, 9 aa, Homo Sapiens
QNSFLLPFR

SEQ ID NO: 1280841 - protein, 9 aa, Homo Sapiens
NQAPCNCLP

SEQ ID NO: 1280842 - protein, 9 aa, Homo Sapiens
KFGPPGGRG

SEQ ID NO: 1280843 - protein, 9 aa, Homo Sapiens
NCRFPDDLD

SEQ ID NO: 1280844 - protein, 9 aa, Homo Sapiens
LPFPAPGLR

SEQ ID NO: 1280845 - protein, 9 aa, Homo Sapiens
QDLAQCFFC

SEQ ID NO: 1280846 - protein, 9 aa, Homo Sapiens
KAGGEVPQA

SEQ ID NO: 1280847 - protein, 9 aa, Homo Sapiens
LTHSLGNLK

SEQ ID NO: 1280848 - protein, 9 aa, Homo Sapiens
EMLQKIEQL

SEQ ID NO: 1280849 - protein, 9 aa, Homo Sapiens
GSAAFSGVD

SEQ ID NO: 1280850 - protein, 9 aa, Homo Sapiens
GPGPRPQPL

SEQ ID NO: 1280851 - protein, 9 aa, Homo Sapiens
GLFDPNTHE

SEQ ID NO: 1280852 - protein, 9 aa, Homo Sapiens
TQMYFFLSN

SEQ ID NO: 1280853 - protein, 9 aa, Homo Sapiens
MVLFQQRKD

SEQ ID NO: 1280854 - protein, 9 aa, Homo Sapiens
VLFQQRKDC

SEQ ID NO: 1280855 - protein, 9 aa, Homo Sapiens
GAHLGVLFL

SEQ ID NO: 1280856 - protein, 9 aa, Homo Sapiens
HAAGIAMEA

SEQ ID NO: 1280857 - protein, 9 aa, Homo Sapiens
YTLCAQAIN

SEQ ID NO: 1280858 - protein, 9 aa, Homo Sapiens
RRNIPGSIF

SEQ ID NO: 1280859 - protein, 9 aa, Homo Sapiens
MFTPLLNLL

SEQ ID NO: 1280860 - protein, 9 aa, Homo Sapiens
AFGLCFKDC

SEQ ID NO: 1280861 - protein, 9 aa, Homo Sapiens
PGPRPQPLK

SEQ ID NO: 1280862 - protein, 9 aa, Homo Sapiens
TQTGPNQAP

SEQ ID NO: 1280863 - protein, 9 aa, Homo Sapiens
ENVLVETLT

SEQ ID NO: 1280864 - protein, 9 aa, Homo Sapiens
DAAPVEKIH

SEQ ID NO: 1280865 - protein, 9 aa, Homo Sapiens
DSLKKYLHA

SEQ ID NO: 1280866 - protein, 9 aa, Homo Sapiens
DILKNTLSK

SEQ ID NO: 1280867 - protein, 9 aa, Homo Sapiens
VYVLVVYDP

SEQ ID NO: 1280868 - protein, 9 aa, Homo Sapiens
PRLCSTKGK

SEQ ID NO: 1280869 - protein, 9 aa, Homo Sapiens
DRDVEAPPS

SEQ ID NO: 1280870 - protein, 9 aa, Homo Sapiens
ASVLKDFRR

SEQ ID NO: 1280871 - protein, 9 aa, Homo Sapiens
KMAVLPRLS

SEQ ID NO: 1280872 - protein, 9 aa, Homo Sapiens
VTVLGDPAC

SEQ ID NO: 1280873 - protein, 9 aa, Homo Sapiens
LFEKGYGKH

SEQ ID NO: 1280874 - protein, 9 aa, Homo Sapiens
CDGLGSPPD

SEQ ID NO: 1280875 - protein, 9 aa, Homo Sapiens
ASHAQNIRN

SEQ ID NO: 1280876 - protein, 9 aa, Homo Sapiens
ERRVSDHMD

SEQ ID NO: 1280877 - protein, 9 aa, Homo Sapiens
ARSPRSSST

SEQ ID NO: 1280878 - protein, 9 aa, Homo Sapiens
DVQAQKAKV

SEQ ID NO: 1280879 - protein, 9 aa, Homo Sapiens
VDRNDNDPV

SEQ ID NO: 1280880 - protein, 9 aa, Homo Sapiens
NGLSAAARK

SEQ ID NO: 1280881 - protein, 9 aa, Homo Sapiens
TATPTGTQT

SEQ ID NO: 1280882 - protein, 9 aa, Homo Sapiens
RLGAAGPSA

SEQ ID NO: 1280883 - protein, 9 aa, Homo Sapiens
APRSLPFPA

SEQ ID NO: 1280884 - protein, 9 aa, Homo Sapiens
VQLHFSLLF

SEQ ID NO: 1280885 - protein, 9 aa, Homo Sapiens
DFRRNIPGS

SEQ ID NO: 1280886 - protein, 9 aa, Homo Sapiens
HSLGNLKNL

SEQ ID NO: 1280887 - protein, 9 aa, Homo Sapiens
QRLIRVEGN

SEQ ID NO: 1280888 - protein, 9 aa, Homo Sapiens
LQNEIFGQT

SEQ ID NO: 1280889 - protein, 9 aa, Homo Sapiens
DHALHFVQL

SEQ ID NO: 1280890 - protein, 9 aa, Homo Sapiens
GKMAVLPRL

SEQ ID NO: 1280891 - protein, 9 aa, Homo Sapiens
NDPVILFPL

SEQ ID NO: 1280892 - protein, 9 aa, Homo Sapiens
SGVDDGRLA

SEQ ID NO: 1280893 - protein, 9 aa, Homo Sapiens
CTHSTLRTQ

SEQ ID NO: 1280894 - protein, 9 aa, Homo Sapiens
STPPGFTAW

SEQ ID NO: 1280895 - protein, 9 aa, Homo Sapiens
PVCSGTARI

SEQ ID NO: 1280896 - protein, 9 aa, Homo Sapiens
ITSKQEEML

SEQ ID NO: 1280897 - protein, 9 aa, Homo Sapiens
ETLTHEMYE

SEQ ID NO: 1280898 - protein, 9 aa, Homo Sapiens
NRLFYAVDF

SEQ ID NO: 1280899 - protein, 9 aa, Homo Sapiens
VNAGVSGIH

SEQ ID NO: 1280900 - protein, 9 aa, Homo Sapiens
SERRTTLHR

SEQ ID NO: 1280901 - protein, 9 aa, Homo Sapiens
NWGPHLLVV

SEQ ID NO: 1280902 - protein, 9 aa, Homo Sapiens
LMREQDILK

SEQ ID NO: 1280903 - protein, 9 aa, Homo Sapiens
LKEKKIWWI

SEQ ID NO: 1280904 - protein, 9 aa, Homo Sapiens
GLRGERTWP

SEQ ID NO: 1280905 - protein, 9 aa, Homo Sapiens
WHLTMPSLD

SEQ ID NO: 1280906 - protein, 9 aa, Homo Sapiens
HTMLVLEGS

SEQ ID NO: 1280907 - protein, 9 aa, Homo Sapiens
GEVPQARSP

SEQ ID NO: 1280908 - protein, 9 aa, Homo Sapiens
SKNCRFPDD

SEQ ID NO: 1280909 - protein, 9 aa, Homo Sapiens
GLAPPQRLI

SEQ ID NO: 1280910 - protein, 9 aa, Homo Sapiens
VTPTATPTG

SEQ ID NO: 1280911 - protein, 9 aa, Homo Sapiens
CTWERTRST

SEQ ID NO: 1280912 - protein, 9 aa, Homo Sapiens
TPMGDLQRQ

SEQ ID NO: 1280913 - protein, 9 aa, Homo Sapiens
RCKNRHCIH

SEQ ID NO: 1280914 - protein, 9 aa, Homo Sapiens
CAQAINRRT

SEQ ID NO: 1280915 - protein, 9 aa, Homo Sapiens
MLQKIEQLQ

SEQ ID NO: 1280916 - protein, 9 aa, Homo Sapiens
STLRTQMYF

SEQ ID NO: 1280917 - protein, 9 aa, Homo Sapiens
PHPQASGRK

SEQ ID NO: 1280918 - protein, 9 aa, Homo Sapiens
FLHLPNRPR

SEQ ID NO: 1280919 - protein, 9 aa, Homo Sapiens
TWERTRSTP

SEQ ID NO: 1280920 - protein, 9 aa, Homo Sapiens
HFPSLNKSS

SEQ ID NO: 1280921 - protein, 9 aa, Homo Sapiens
KGKFGPPGG

SEQ ID NO: 1280922 - protein, 9 aa, Homo Sapiens
RGFEDCYAT

SEQ ID NO: 1280923 - protein, 9 aa, Homo Sapiens
PQRLIRVEG

SEQ ID NO: 1280924 - protein, 9 aa, Homo Sapiens
ELSQGNFCD

SEQ ID NO: 1280925 - protein, 9 aa, Homo Sapiens
RLCSTKGKE

SEQ ID NO: 1280926 - protein, 9 aa, Homo Sapiens
RRIVCIFLP

SEQ ID NO: 1280927 - protein, 9 aa, Homo Sapiens
KSQELPQGR

SEQ ID NO: 1280928 - protein, 9 aa, Homo Sapiens
ETTYENGKV

SEQ ID NO: 1280929 - protein, 9 aa, Homo Sapiens
RQKLMREQD

SEQ ID NO: 1280930 - protein, 9 aa, Homo Sapiens
NKSSAEVLE

SEQ ID NO: 1280931 - protein, 9 aa, Homo Sapiens
RNQSPKEMH

SEQ ID NO: 1280932 - protein, 9 aa, Homo Sapiens
FSASLHTEP

SEQ ID NO: 1280933 - protein, 9 aa, Homo Sapiens
PPHPQASGR

SEQ ID NO: 1280934 - protein, 9 aa, Homo Sapiens
SASPAPRSL

SEQ ID NO: 1280935 - protein, 9 aa, Homo Sapiens
RLIRVEGNL

SEQ ID NO: 1280936 - protein, 9 aa, Homo Sapiens
FPAPGLRSQ

SEQ ID NO: 1280937 - protein, 9 aa, Homo Sapiens
RKGAAASAW

SEQ ID NO: 1280938 - protein, 9 aa, Homo Sapiens
PLSLNGHGQ

SEQ ID NO: 1280939 - protein, 9 aa, Homo Sapiens
PGAHLGVLF

SEQ ID NO: 1280940 - protein, 9 aa, Homo Sapiens
VKGKRRDNG

SEQ ID NO: 1280941 - protein, 9 aa, Homo Sapiens
EQVSMIGEG

SEQ ID NO: 1280942 - protein, 9 aa, Homo Sapiens
RILTAASLC

SEQ ID NO: 1280943 - protein, 9 aa, Homo Sapiens
TSSARSAVS

SEQ ID NO: 1280944 - protein, 9 aa, Homo Sapiens
ILACERRVS

SEQ ID NO: 1280945 - protein, 9 aa, Homo Sapiens
SSMSAFKTP

SEQ ID NO: 1280946 - protein, 9 aa, Homo Sapiens
SARSAVSTP

SEQ ID NO: 1280947 - protein, 9 aa, Homo Sapiens
TLTHEMYEA

SEQ ID NO: 1280948 - protein, 9 aa, Homo Sapiens
PHDHSLRDA

SEQ ID NO: 1280949 - protein, 9 aa, Homo Sapiens
VLVPSELPG

SEQ ID NO: 1280950 - protein, 9 aa, Homo Sapiens
KGLFDPNTH

SEQ ID NO: 1280951 - protein, 9 aa, Homo Sapiens
FKNHRAKLN

SEQ ID NO: 1280952 - protein, 9 aa, Homo Sapiens
IVCIFLPND

SEQ ID NO: 1280953 - protein, 9 aa, Homo Sapiens
MDKDILERM

SEQ ID NO: 1280954 - protein, 9 aa, Homo Sapiens
LERMVERLR

SEQ ID NO: 1280955 - protein, 9 aa, Homo Sapiens
QYQECVREE

SEQ ID NO: 1280956 - protein, 9 aa, Homo Sapiens
HWDVEDAHV

SEQ ID NO: 1280957 - protein, 9 aa, Homo Sapiens
GEKPHECKV

SEQ ID NO: 1280958 - protein, 9 aa, Homo Sapiens
RNDNDPVIL

SEQ ID NO: 1280959 - protein, 9 aa, Homo Sapiens
WIPGTPIRL

SEQ ID NO: 1280960 - protein, 9 aa, Homo Sapiens
CNSHWDVED

SEQ ID NO: 1280961 - protein, 9 aa, Homo Sapiens
KQEEMLQKI

SEQ ID NO: 1280962 - protein, 9 aa, Homo Sapiens
EEKAFYTLC

SEQ ID NO: 1280963 - protein, 9 aa, Homo Sapiens
FKTPMGDLQ

SEQ ID NO: 1280964 - protein, 9 aa, Homo Sapiens
RSGAGVQAA

SEQ ID NO: 1280965 - protein, 9 aa, Homo Sapiens
PTSWTTRSS

SEQ ID NO: 1280966 - protein, 9 aa, Homo Sapiens
ASGRKSQEL

SEQ ID NO: 1280967 - protein, 9 aa, Homo Sapiens
DPSDDTKGL

SEQ ID NO: 1280968 - protein, 9 aa, Homo Sapiens
ALHFVQLHF

SEQ ID NO: 1280969 - protein, 9 aa, Homo Sapiens
HDHSLRDAR

SEQ ID NO: 1280970 - protein, 9 aa, Homo Sapiens
TTCSSHMII

SEQ ID NO: 1280971 - protein, 9 aa, Homo Sapiens
FGPPGGRGP

SEQ ID NO: 1280972 - protein, 9 aa, Homo Sapiens
FVQLHFSLL

SEQ ID NO: 1280973 - protein, 9 aa, Homo Sapiens
INVHRASLA

SEQ ID NO: 1280974 - protein, 9 aa, Homo Sapiens
HRKALTTCS

SEQ ID NO: 1280975 - protein, 9 aa, Homo Sapiens
AISKVQVCL

SEQ ID NO: 1280976 - protein, 9 aa, Homo Sapiens
SWHLTMPSL

SEQ ID NO: 1280977 - protein, 9 aa, Homo Sapiens
DLVKWCKAG

SEQ ID NO: 1280978 - protein, 9 aa, Homo Sapiens
TILACERRV

SEQ ID NO: 1280979 - protein, 9 aa, Homo Sapiens
ARSAVSTPA

SEQ ID NO: 1280980 - protein, 9 aa, Homo Sapiens
RAFYGSHGK

SEQ ID NO: 1280981 - protein, 9 aa, Homo Sapiens
DGTDCDLVK

SEQ ID NO: 1280982 - protein, 9 aa, Homo Sapiens
QDRRIVCIF

SEQ ID NO: 1280983 - protein, 9 aa, Homo Sapiens
ATAVVTVLG

SEQ ID NO: 1280984 - protein, 9 aa, Homo Sapiens
PCNCLPAYT

SEQ ID NO: 1280985 - protein, 9 aa, Homo Sapiens
FEDCYATDS

SEQ ID NO: 1280986 - protein, 9 aa, Homo Sapiens
PVARARAAP

SEQ ID NO: 1280987 - protein, 9 aa, Homo Sapiens
TAWKTSSAR

SEQ ID NO: 1280988 - protein, 9 aa, Homo Sapiens
APCAFGLCF

SEQ ID NO: 1280989 - protein, 9 aa, Homo Sapiens
CYATDSSSM

SEQ ID NO: 1280990 - protein, 9 aa, Homo Sapiens
SGCDVTYTP

SEQ ID NO: 1280991 - protein, 9 aa, Homo Sapiens
PVEKIHTML

SEQ ID NO: 1280992 - protein, 9 aa, Homo Sapiens
DCDLVKWCK

SEQ ID NO: 1280993 - protein, 9 aa, Homo Sapiens
KNHRAKLNK

SEQ ID NO: 1280994 - protein, 9 aa, Homo Sapiens
GVSGIHITK

SEQ ID NO: 1280995 - protein, 9 aa, Homo Sapiens
RSSRLGAAG

SEQ ID NO: 1280996 - protein, 9 aa, Homo Sapiens
GDPVCSGTA

SEQ ID NO: 1280997 - protein, 9 aa, Homo Sapiens
FYAVDFDDD

SEQ ID NO: 1280998 - protein, 9 aa, Homo Sapiens
AIHKRNQSP

SEQ ID NO: 1280999 - protein, 9 aa, Homo Sapiens
ISRCTWERT

SEQ ID NO: 1281000 - protein, 9 aa, Homo Sapiens
GYGKHAAGI

SEQ ID NO: 1281001 - protein, 9 aa, Homo Sapiens
AAACECSRS

SEQ ID NO: 1281002 - protein, 9 aa, Homo Sapiens
SLPFPAPGL

SEQ ID NO: 1281003 - protein, 9 aa, Homo Sapiens
TRSTPPGFT

SEQ ID NO: 1281004 - protein, 9 aa, Homo Sapiens
ACECSRSSP

SEQ ID NO: 1281005 - protein, 9 aa, Homo Sapiens
NHRAKLNKA

SEQ ID NO: 1281006 - protein, 9 aa, Homo Sapiens
AAPVEKIHT

SEQ ID NO: 1281007 - protein, 9 aa, Homo Sapiens
KNTLSKQMV

SEQ ID NO: 1281008 - protein, 9 aa, Homo Sapiens
QGKAKHLPL

SEQ ID NO: 1281009 - protein, 9 aa, Homo Sapiens
AACECSRSS

SEQ ID NO: 1281010 - protein, 9 aa, Homo Sapiens
KIWWIVQNS

SEQ ID NO: 1281011 - protein, 9 aa, Homo Sapiens
QVSMIGEGA

SEQ ID NO: 1281012 - protein, 9 aa, Homo Sapiens
PEVNAGVSG

SEQ ID NO: 1281013 - protein, 9 aa, Homo Sapiens
KDILERMVE

SEQ ID NO: 1281014 - protein, 9 aa, Homo Sapiens
KYLHAEIKV

SEQ ID NO: 1281015 - protein, 9 aa, Homo Sapiens
AELSQGNFC

SEQ ID NO: 1281016 - protein, 9 aa, Homo Sapiens
CERRVSDHM

SEQ ID NO: 1281017 - protein, 9 aa, Homo Sapiens
ALTTCSSHM

SEQ ID NO: 1281018 - protein, 9 aa, Homo Sapiens
EIKSLLNEQ

SEQ ID NO: 1281019 - protein, 9 aa, Homo Sapiens
LKDFRRNIP

SEQ ID NO: 1281020 - protein, 9 aa, Homo Sapiens
AGHRKALTT

SEQ ID NO: 1281021 - protein, 9 aa, Homo Sapiens
YLHAEIKVI

SEQ ID NO: 1281022 - protein, 9 aa, Homo Sapiens
SIRNDITKT

SEQ ID NO: 1281023 - protein, 9 aa, Homo Sapiens
TSAPPRHAR

SEQ ID NO: 1281024 - protein, 9 aa, Homo Sapiens
TINVHRASL

SEQ ID NO: 1281025 - protein, 9 aa, Homo Sapiens
FVVDRNDND

SEQ ID NO: 1281026 - protein, 9 aa, Homo Sapiens
KNRHCIHAR

SEQ ID NO: 1281027 - protein, 9 aa, Homo Sapiens
SPRSSSTIS

SEQ ID NO: 1281028 - protein, 9 aa, Homo Sapiens
NGFAPSGIG

SEQ ID NO: 1281029 - protein, 9 aa, Homo Sapiens
FDGGDPVCS

SEQ ID NO: 1281030 - protein, 9 aa, Homo Sapiens
ERRTTLHRI

SEQ ID NO: 1281031 - protein, 9 aa, Homo Sapiens
NRPSLTDIV

SEQ ID NO: 1281032 - protein, 9 aa, Homo Sapiens
QFSTLDRDV

SEQ ID NO: 1281033 - protein, 9 aa, Homo Sapiens
QENRPSLTD

SEQ ID NO: 1281034 - protein, 9 aa, Homo Sapiens
NFCDGLGSP

SEQ ID NO: 1281035 - protein, 9 aa, Homo Sapiens
KDAIECFMI

SEQ ID NO: 1281036 - protein, 9 aa, Homo Sapiens
KLNKAKCKH

SEQ ID NO: 1281037 - protein, 9 aa, Homo Sapiens
SLTINVHRA

SEQ ID NO: 1281038 - protein, 9 aa, Homo Sapiens
LKFSKINSG

SEQ ID NO: 1281039 - protein, 9 aa, Homo Sapiens
SRCTWERTR

SEQ ID NO: 1281040 - protein, 9 aa, Homo Sapiens
PRHARPPPV

SEQ ID NO: 1281041 - protein, 9 aa, Homo Sapiens
EVPQARSPR

SEQ ID NO: 1281042 - protein, 9 aa, Homo Sapiens
ACAFPLRCK

SEQ ID NO: 1281043 - protein, 9 aa, Homo Sapiens
IDDKIEQAM

SEQ ID NO: 1281044 - protein, 9 aa, Homo Sapiens
AVDFDDDIW

SEQ ID NO: 1281045 - protein, 9 aa, Homo Sapiens
THSTLRTQM

SEQ ID NO: 1281046 - protein, 9 aa, Homo Sapiens
GTDCDLVKW

SEQ ID NO: 1281047 - protein, 9 aa, Homo Sapiens
HLPLSLNGH

SEQ ID NO: 1281048 - protein, 9 aa, Homo Sapiens
SELPGAHLG

SEQ ID NO: 1281049 - protein, 9 aa, Homo Sapiens
ASQPTESLI

SEQ ID NO: 1281050 - protein, 9 aa, Homo Sapiens
ASLHTEPPV

SEQ ID NO: 1281051 - protein, 9 aa, Homo Sapiens
RFLHLPNRP

SEQ ID NO: 1281052 - protein, 9 aa, Homo Sapiens
TGKMAVLPR

SEQ ID NO: 1281053 - protein, 9 aa, Homo Sapiens
NDNDPVILF

SEQ ID NO: 1281054 - protein, 9 aa, Homo Sapiens
SGIHITKPV

SEQ ID NO: 1281055 - protein, 9 aa, Homo Sapiens
TAASLCHFT

SEQ ID NO: 1281056 - protein, 9 aa, Homo Sapiens
GSGIFWIPG

SEQ ID NO: 1281057 - protein, 9 aa, Homo Sapiens
GKRRDNGLS

SEQ ID NO: 1281058 - protein, 9 aa, Homo Sapiens
LTINVHRAS

SEQ ID NO: 1281059 - protein, 9 aa, Homo Sapiens
WKTSSARSA

SEQ ID NO: 1281060 - protein, 9 aa, Homo Sapiens
TCSSASTRE

SEQ ID NO: 1281061 - protein, 9 aa, Homo Sapiens
NSGRSYVGI

SEQ ID NO: 1281062 - protein, 9 aa, Homo Sapiens
SAWLTATAV

SEQ ID NO: 1281063 - protein, 9 aa, Homo Sapiens
ERQKSLLSY

SEQ ID NO: 1281064 - protein, 9 aa, Homo Sapiens
RQKSLLSYS

SEQ ID NO: 1281065 - protein, 9 aa, Homo Sapiens
SHAQNIRNR

SEQ ID NO: 1281066 - protein, 9 aa, Homo Sapiens
RARAAPPHP

SEQ ID NO: 1281067 - protein, 9 aa, Homo Sapiens
LFQQRKDCV

SEQ ID NO: 1281068 - protein, 9 aa, Homo Sapiens
DSLVILSGC

SEQ ID NO: 1281069 - protein, 9 aa, Homo Sapiens
FYTLCAQAI

SEQ ID NO: 1281070 - protein, 9 aa, Homo Sapiens
CVREEQRSP

SEQ ID NO: 1281071 - protein, 9 aa, Homo Sapiens
PFRMSSFPK

SEQ ID NO: 1281072 - protein, 9 aa, Homo Sapiens
GPNQAPCNC

SEQ ID NO: 1281073 - protein, 9 aa, Homo Sapiens
QHHADLTFT

SEQ ID NO: 1281074 - protein, 9 aa, Homo Sapiens
VWGSGIFWI

SEQ ID NO: 1281075 - protein, 9 aa, Homo Sapiens
LLIYSVKNS

SEQ ID NO: 1281076 - protein, 9 aa, Homo Sapiens
GPQGIKGKF

SEQ ID NO: 1281077 - protein, 9 aa, Homo Sapiens
AIEDINATT

SEQ ID NO: 1281078 - protein, 9 aa, Homo Sapiens
ECSRSSPTS

SEQ ID NO: 1281079 - protein, 9 aa, Homo Sapiens
DTKGLFDPN

SEQ ID NO: 1281080 - protein, 9 aa, Homo Sapiens
KTRAGSKNC

SEQ ID NO: 1281081 - protein, 9 aa, Homo Sapiens
LCAQAINRR

SEQ ID NO: 1281082 - protein, 9 aa, Homo Sapiens
NAGVSGIHI

SEQ ID NO: 1281083 - protein, 9 aa, Homo Sapiens
THSLGNLKN

SEQ ID NO: 1281084 - protein, 9 aa, Homo Sapiens
AHLVRGHAW

SEQ ID NO: 1281085 - protein, 9 aa, Homo Sapiens
AAASAWLTA

SEQ ID NO: 1281086 - protein, 9 aa, Homo Sapiens
NGKVTLVCD

SEQ ID NO: 1281087 - protein, 9 aa, Homo Sapiens
PPVARARAA

SEQ ID NO: 1281088 - protein, 9 aa, Homo Sapiens
ARAAPPHPQ

SEQ ID NO: 1281089 - protein, 9 aa, Homo Sapiens
GEGACLLLL

SEQ ID NO: 1281090 - protein, 9 aa, Homo Sapiens
RKALTTCSS

SEQ ID NO: 1281091 - protein, 9 aa, Homo Sapiens
ILERMVERL

SEQ ID NO: 1281092 - protein, 9 aa, Homo Sapiens
FEKGYGKHA

SEQ ID NO: 1281093 - protein, 9 aa, Homo Sapiens
IPGTPIRLP

SEQ ID NO: 1281094 - protein, 9 aa, Homo Sapiens
GPSASPAPR

SEQ ID NO: 1281095 - protein, 9 aa, Homo Sapiens
KVQVCLDEH

SEQ ID NO: 1281096 - protein, 9 aa, Homo Sapiens
VPQARSPRS

SEQ ID NO: 1281097 - protein, 9 aa, Homo Sapiens
IHKRNQSPK

SEQ ID NO: 1281098 - protein, 9 aa, Homo Sapiens
DSIRNDITK

SEQ ID NO: 1281099 - protein, 9 aa, Homo Sapiens
LPNRPREYI

SEQ ID NO: 1281100 - protein, 9 aa, Homo Sapiens
VGDSAIEDI

SEQ ID NO: 1281101 - protein, 9 aa, Homo Sapiens
RLPGGLTHS

SEQ ID NO: 1281102 - protein, 9 aa, Homo Sapiens
SRLGAAGPS

SEQ ID NO: 1281103 - protein, 9 aa, Homo Sapiens
LVETLTHEM

SEQ ID NO: 1281104 - protein, 9 aa, Homo Sapiens
TSWTTRSSR

SEQ ID NO: 1281105 - protein, 9 aa, Homo Sapiens
PCAFGLCFK

SEQ ID NO: 1281106 - protein, 9 aa, Homo Sapiens
LTFTTTLDL

SEQ ID NO: 1281107 - protein, 9 aa, Homo Sapiens
VHRASLAMS

SEQ ID NO: 1281108 - protein, 9 aa, Homo Sapiens
RKDSERRTT

SEQ ID NO: 1281109 - protein, 9 aa, Homo Sapiens
ILQNEIFGQ

SEQ ID NO: 1281110 - protein, 9 aa, Homo Sapiens
GKFGPPGGR

SEQ ID NO: 1281111 - protein, 9 aa, Homo Sapiens
KLQASQPTE

SEQ ID NO: 1281112 - protein, 9 aa, Homo Sapiens
ASTREDCIA

SEQ ID NO: 1281113 - protein, 9 aa, Homo Sapiens
HPQASGRKS

SEQ ID NO: 1281114 - protein, 9 aa, Homo Sapiens
TPTATPTGT

SEQ ID NO: 1281115 - protein, 9 aa, Homo Sapiens
SGIGNGYGP

SEQ ID NO: 1281116 - protein, 9 aa, Homo Sapiens
KEKKIWWIV

SEQ ID NO: 1281117 - protein, 9 aa, Homo Sapiens
LQASQPTES

SEQ ID NO: 1281118 - protein, 9 aa, Homo Sapiens
FRMSSFPKK

SEQ ID NO: 1281119 - protein, 9 aa, Homo Sapiens
HADLTFTTT

SEQ ID NO: 1281120 - protein, 9 aa, Homo Sapiens
RSQRFSTSA

SEQ ID NO: 1281121 - protein, 9 aa, Homo Sapiens
EGDDDDDDG

SEQ ID NO: 1281122 - protein, 9 aa, Homo Sapiens
VILSGCDVT

SEQ ID NO: 1281123 - protein, 9 aa, Homo Sapiens
KGLRGERTW

SEQ ID NO: 1281124 - protein, 9 aa, Homo Sapiens
HLVRGHAWK

SEQ ID NO: 1281125 - protein, 9 aa, Homo Sapiens
QGQDSLKKY

SEQ ID NO: 1281126 - protein, 9 aa, Homo Sapiens
HCSWHLTMP

SEQ ID NO: 1281127 - protein, 9 aa, Homo Sapiens
FPLRCKPGT

SEQ ID NO: 1281128 - protein, 9 aa, Homo Sapiens
AGVSGIHIT

SEQ ID NO: 1281129 - protein, 9 aa, Homo Sapiens
DVEDAHVLC

SEQ ID NO: 1281130 - protein, 9 aa, Homo Sapiens
NEIFGQTLN

SEQ ID NO: 1281131 - protein, 9 aa, Homo Sapiens
CSWHLTMPS

SEQ ID NO: 1281132 - protein, 9 aa, Homo Sapiens
VHFPSLNKS

SEQ ID NO: 1281133 - protein, 9 aa, Homo Sapiens
DDKIEQAMD

SEQ ID NO: 1281134 - protein, 9 aa, Homo Sapiens
GFTAWKTSS

SEQ ID NO: 1281135 - protein, 9 aa, Homo Sapiens
VVAIDDKIE

SEQ ID NO: 1281136 - protein, 9 aa, Homo Sapiens
TRSSRLGAA

SEQ ID NO: 1281137 - protein, 9 aa, Homo Sapiens
SHWDVEDAH

SEQ ID NO: 1281138 - protein, 9 aa, Homo Sapiens
SRSSPTSWT

SEQ ID NO: 1281139 - protein, 9 aa, Homo Sapiens
ENGTRTITR

SEQ ID NO: 1281140 - protein, 9 aa, Homo Sapiens
HAWKTKLGE

SEQ ID NO: 1281141 - protein, 9 aa, Homo Sapiens
FYGSHGKPA

SEQ ID NO: 1281142 - protein, 9 aa, Homo Sapiens
LNLLIYSVK

SEQ ID NO: 1281143 - protein, 9 aa, Homo Sapiens
GFAPSGIGN

SEQ ID NO: 1281144 - protein, 9 aa, Homo Sapiens
PRSLPFPAP

SEQ ID NO: 1281145 - protein, 9 aa, Homo Sapiens
LCSTKGKEP

SEQ ID NO: 1281146 - protein, 9 aa, Homo Sapiens
LNATPGPYV

SEQ ID NO: 1281147 - protein, 9 aa, Homo Sapiens
VTDPCQADS

SEQ ID NO: 1281148 - protein, 9 aa, Homo Sapiens
GPGPGPRPQ

SEQ ID NO: 1281149 - protein, 9 aa, Homo Sapiens
AVLPRLSSP

SEQ ID NO: 1281150 - protein, 9 aa, Homo Sapiens
DAIECFMIR

SEQ ID NO: 1281151 - protein, 9 aa, Homo Sapiens
WWIVQNSFL

SEQ ID NO: 1281152 - protein, 9 aa, Homo Sapiens
FTAWKTSSA

SEQ ID NO: 1281153 - protein, 9 aa, Homo Sapiens
AAHLVRGHA

SEQ ID NO: 1281154 - protein, 9 aa, Homo Sapiens
KRNQSPKEM

SEQ ID NO: 1281155 - protein, 9 aa, Homo Sapiens
PAAACECSR

SEQ ID NO: 1281156 - protein, 9 aa, Homo Sapiens
EKPHECKVC

SEQ ID NO: 1281157 - protein, 9 aa, Homo Sapiens
KHGHARAVY

SEQ ID NO: 1281158 - protein, 9 aa, Homo Sapiens
SVLKDFRRN

SEQ ID NO: 1281159 - protein, 9 aa, Homo Sapiens
PTVKNARII

SEQ ID NO: 1281160 - protein, 9 aa, Homo Sapiens
LQKIEQLQQ

SEQ ID NO: 1281161 - protein, 9 aa, Homo Sapiens
SAVSTPAAA

SEQ ID NO: 1281162 - protein, 9 aa, Homo Sapiens
KSLLNEQNI

SEQ ID NO: 1281163 - protein, 9 aa, Homo Sapiens
ISKVQVCLD

SEQ ID NO: 1281164 - protein, 9 aa, Homo Sapiens
PTATPTGTQ

SEQ ID NO: 1281165 - protein, 9 aa, Homo Sapiens
FSTSAPPRH

SEQ ID NO: 1281166 - protein, 9 aa, Homo Sapiens
ADILKNTLS

SEQ ID NO: 1281167 - protein, 9 aa, Homo Sapiens
FENGTRTIT

SEQ ID NO: 1281168 - protein, 9 aa, Homo Sapiens
SSARSAVST

SEQ ID NO: 1281169 - protein, 9 aa, Homo Sapiens
SQELPQGRK

SEQ ID NO: 1281170 - protein, 9 aa, Homo Sapiens
SKINSGMAD

SEQ ID NO: 1281171 - protein, 9 aa, Homo Sapiens
WLTATAVVT

SEQ ID NO: 1281172 - protein, 9 aa, Homo Sapiens
QADILKNTL

SEQ ID NO: 1281173 - protein, 9 aa, Homo Sapiens
RRTTLHRIL

SEQ ID NO: 1281174 - protein, 9 aa, Homo Sapiens
KALTTCSSH

SEQ ID NO: 1281175 - protein, 9 aa, Homo Sapiens
LPELKEKKI

SEQ ID NO: 1281176 - protein, 9 aa, Homo Sapiens
LFYAVDFDD

SEQ ID NO: 1281177 - protein, 9 aa, Homo Sapiens
AQKAKVDGA

SEQ ID NO: 1281178 - protein, 9 aa, Homo Sapiens
LTQFSTLDR

SEQ ID NO: 1281179 - protein, 9 aa, Homo Sapiens
APPHPQASG

SEQ ID NO: 1281180 - protein, 9 aa, Homo Sapiens
DRRIVCIFL

SEQ ID NO: 1281181 - protein, 9 aa, Homo Sapiens
PCQADSIRN

SEQ ID NO: 1281182 - protein, 9 aa, Homo Sapiens
VSMIGEGAC

SEQ ID NO: 1281183 - protein, 9 aa, Homo Sapiens
ASVVAIDDK

SEQ ID NO: 1281184 - protein, 9 aa, Homo Sapiens
DKDILERMV

SEQ ID NO: 1281185 - protein, 9 aa, Homo Sapiens
MIGEGACLL

SEQ ID NO: 1281186 - protein, 9 aa, Homo Sapiens
ELPQGRKGA

SEQ ID NO: 1281187 - protein, 9 aa, Homo Sapiens
QAWPVPLAD

SEQ ID NO: 1281188 - protein, 9 aa, Homo Sapiens
QASGRKSQE

SEQ ID NO: 1281189 - protein, 9 aa, Homo Sapiens
SGMADILVV

SEQ ID NO: 1281190 - protein, 9 aa, Homo Sapiens
NYASHAQNI

SEQ ID NO: 1281191 - protein, 9 aa, Homo Sapiens
SAPPRHARP

SEQ ID NO: 1281192 - protein, 9 aa, Homo Sapiens
QEEMLQKIE

SEQ ID NO: 1281193 - protein, 9 aa, Homo Sapiens
NLLIYSVKN

SEQ ID NO: 1281194 - protein, 9 aa, Homo Sapiens
QSMRSGAGV

SEQ ID NO: 1281195 - protein, 9 aa, Homo Sapiens
PAPGLRSQR

SEQ ID NO: 1281196 - protein, 9 aa, Homo Sapiens
DGLAPPQRL

SEQ ID NO: 1281197 - protein, 9 aa, Homo Sapiens
LVGQAWPVP

SEQ ID NO: 1281198 - protein, 9 aa, Homo Sapiens
RAGSKNCRF

SEQ ID NO: 1281199 - protein, 9 aa, Homo Sapiens
CDVTYTPVA

SEQ ID NO: 1281200 - protein, 9 aa, Homo Sapiens
VQVCLDEHF

SEQ ID NO: 1281201 - protein, 9 aa, Homo Sapiens
AALPHDHSL

SEQ ID NO: 1281202 - protein, 9 aa, Homo Sapiens
AFYGSHGKP

SEQ ID NO: 1281203 - protein, 9 aa, Homo Sapiens
TESLIQLMT

SEQ ID NO: 1281204 - protein, 9 aa, Homo Sapiens
NVLVETLTH

SEQ ID NO: 1281205 - protein, 9 aa, Homo Sapiens
AFSGVDDGR

SEQ ID NO: 1281206 - protein, 9 aa, Homo Sapiens
KRRDNGLSA

SEQ ID NO: 1281207 - protein, 9 aa, Homo Sapiens
ASPAPRSLP

SEQ ID NO: 1281208 - protein, 9 aa, Homo Sapiens
LCFKDCKFM

SEQ ID NO: 1281209 - protein, 9 aa, Homo Sapiens
ERMVERLRS

SEQ ID NO: 1281210 - protein, 9 aa, Homo Sapiens
TFTTTLDLT

SEQ ID NO: 1281211 - protein, 9 aa, Homo Sapiens
QTGPNQAPC

SEQ ID NO: 1281212 - protein, 9 aa, Homo Sapiens
LHTEPPVYA

SEQ ID NO: 1281213 - protein, 9 aa, Homo Sapiens
GAAHLVRGH

SEQ ID NO: 1281214 - protein, 9 aa, Homo Sapiens
GKVTLVCDA

SEQ ID NO: 1281215 - protein, 9 aa, Homo Sapiens
NETTYENGK

SEQ ID NO: 1281216 - protein, 9 aa, Homo Sapiens
GCCRLEPTV

SEQ ID NO: 1281217 - protein, 9 aa, Homo Sapiens
QECVREEQR

SEQ ID NO: 1281218 - protein, 9 aa, Homo Sapiens
SMRSGAGVQ

SEQ ID NO: 1281219 - protein, 9 aa, Homo Sapiens
GDPACAFPL

SEQ ID NO: 1281220 - protein, 9 aa, Homo Sapiens
THEMYEAKY

SEQ ID NO: 1281221 - protein, 9 aa, Homo Sapiens
NRHCIHARW

SEQ ID NO: 1281222 - protein, 9 aa, Homo Sapiens
KDFRRNIPG

SEQ ID NO: 1281223 - protein, 9 aa, Homo Sapiens
GHARAVYVL

SEQ ID NO: 1281224 - protein, 9 aa, Homo Sapiens
VPSELPGAH

SEQ ID NO: 1281225 - protein, 9 aa, Homo Sapiens
PGTGKGLRG

SEQ ID NO: 1281226 - protein, 9 aa, Homo Sapiens
AVYVLVVYD

SEQ ID NO: 1281227 - protein, 9 aa, Homo Sapiens
FLLPFRMSS

SEQ ID NO: 1281228 - protein, 9 aa, Homo Sapiens
LPGGLTHSL

SEQ ID NO: 1281229 - protein, 9 aa, Homo Sapiens
CAFPLRCKP

SEQ ID NO: 1281230 - protein, 9 aa, Homo Sapiens
SPFKVVVNS

SEQ ID NO: 1281231 - protein, 9 aa, Homo Sapiens
LRKDSERRT

SEQ ID NO: 1281232 - protein, 9 aa, Homo Sapiens
STLDRDVEA

SEQ ID NO: 1281233 - protein, 9 aa, Homo Sapiens
SGPGPGPRP

SEQ ID NO: 1281234 - protein, 9 aa, Homo Sapiens
RHARPPPVA

SEQ ID NO: 1281235 - protein, 9 aa, Homo Sapiens
CDLVKWCKA

SEQ ID NO: 1281236 - protein, 9 aa, Homo Sapiens
QNIGNECLC

SEQ ID NO: 1281237 - protein, 9 aa, Homo Sapiens
CSSASTRED

SEQ ID NO: 1281238 - protein, 9 aa, Homo Sapiens
WDVEDAHVL

SEQ ID NO: 1281239 - protein, 9 aa, Homo Sapiens
HKRNQSPKE

SEQ ID NO: 1281240 - protein, 9 aa, Homo Sapiens
PGFTAWKTS

SEQ ID NO: 1281241 - protein, 9 aa, Homo Sapiens
LTATAVVTV

SEQ ID NO: 1281242 - protein, 9 aa, Homo Sapiens
CFKDCKFMP

SEQ ID NO: 1281243 - protein, 9 aa, Homo Sapiens
GKAKHLPLS

SEQ ID NO: 1281244 - protein, 9 aa, Homo Sapiens
CPTENEQDL

SEQ ID NO: 1281245 - protein, 9 aa, Homo Sapiens
RSSPTSWTT

SEQ ID NO: 1281246 - protein, 9 aa, Homo Sapiens
RLEPTVKNA

SEQ ID NO: 1281247 - protein, 9 aa, Homo Sapiens
KPGTGKGLR

SEQ ID NO: 1281248 - protein, 9 aa, Homo Sapiens
AWKTSSARS

SEQ ID NO: 1281249 - protein, 9 aa, Homo Sapiens
FKAGGEVPQ

SEQ ID NO: 1281250 - protein, 9 aa, Homo Sapiens
LGDPACAFP

SEQ ID NO: 1281251 - protein, 9 aa, Homo Sapiens
DCYATDSSS

SEQ ID NO: 1281252 - protein, 9 aa, Homo Sapiens
VLPRLSSPR

SEQ ID NO: 1281253 - protein, 9 aa, Homo Sapiens
ERTWPSPRV

SEQ ID NO: 1281254 - protein, 9 aa, Homo Sapiens
KTPMGDLQR

SEQ ID NO: 1281255 - protein, 9 aa, Homo Sapiens
RASLAMSIQ

SEQ ID NO: 1281256 - protein, 9 aa, Homo Sapiens
QARSPRSSS

SEQ ID NO: 1281257 - protein, 9 aa, Homo Sapiens
GIFWIPGTP

SEQ ID NO: 1281258 - protein, 9 aa, Homo Sapiens
LPGAHLGVL

SEQ ID NO: 1281259 - protein, 9 aa, Homo Sapiens
ASLCHFTSI

SEQ ID NO: 1281260 - protein, 9 aa, Homo Sapiens
PGPGPRPQP

SEQ ID NO: 1281261 - protein, 9 aa, Homo Sapiens
QGIKGKFGP

SEQ ID NO: 1281262 - protein, 9 aa, Homo Sapiens
RRDNGLSAA

SEQ ID NO: 1281263 - protein, 9 aa, Homo Sapiens
ARAVYVLVV

SEQ ID NO: 1281264 - protein, 9 aa, Homo Sapiens
TKGLFDPNT

SEQ ID NO: 1281265 - protein, 9 aa, Homo Sapiens
GRKSQELPQ

SEQ ID NO: 1281266 - protein, 9 aa, Homo Sapiens
GERTWPSPR

SEQ ID NO: 1281267 - protein, 9 aa, Homo Sapiens
VPLADMAPT

SEQ ID NO: 1281268 - protein, 9 aa, Homo Sapiens
ITRVKVQDL

SEQ ID NO: 1281269 - protein, 9 aa, Homo Sapiens
RFSTSAPPR

SEQ ID NO: 1281270 - protein, 9 aa, Homo Sapiens
SAIEDINAT

SEQ ID NO: 1281271 - protein, 9 aa, Homo Sapiens
IHCPTENEQ

SEQ ID NO: 1281272 - protein, 9 aa, Homo Sapiens
RDNGLSAAA

SEQ ID NO: 1281273 - protein, 9 aa, Homo Sapiens
LNEQNIGNE

SEQ ID NO: 1281274 - protein, 9 aa, Homo Sapiens
ARARAAPPH

SEQ ID NO: 1281275 - protein, 9 aa, Homo Sapiens
INSGMADIL

SEQ ID NO: 1281276 - protein, 9 aa, Homo Sapiens
KKIWWIVQN

SEQ ID NO: 1281277 - protein, 9 aa, Homo Sapiens
LLVVRSCNI

SEQ ID NO: 1281278 - protein, 9 aa, Homo Sapiens
PPNILQNEI

SEQ ID NO: 1281279 - protein, 9 aa, Homo Sapiens
TLDRDVEAP

SEQ ID NO: 1281280 - protein, 9 aa, Homo Sapiens
CQADSIRND

SEQ ID NO: 1281281 - protein, 9 aa, Homo Sapiens
RAVYVLVVY

SEQ ID NO: 1281282 - protein, 9 aa, Homo Sapiens
MSSFPKKFF

SEQ ID NO: 1281283 - protein, 9 aa, Homo Sapiens
QPTESLIQL

SEQ ID NO: 1281284 - protein, 9 aa, Homo Sapiens
KLMREQDIL

SEQ ID NO: 1281285 - protein, 9 aa, Homo Sapiens
NTLNYASHA

SEQ ID NO: 1281286 - protein, 9 aa, Homo Sapiens
AAFSGVDDG

SEQ ID NO: 1281287 - protein, 9 aa, Homo Sapiens
DFDDDIWED

SEQ ID NO: 1281288 - protein, 9 aa, Homo Sapiens
LSGCDVTYT

SEQ ID NO: 1281289 - protein, 9 aa, Homo Sapiens
EDINATTGK

SEQ ID NO: 1281290 - protein, 9 aa, Homo Sapiens
LPHDHSLRD

SEQ ID NO: 1281291 - protein, 9 aa, Homo Sapiens
IASVLKDFR

SEQ ID NO: 1281292 - protein, 9 aa, Homo Sapiens
TISRCTWER

SEQ ID NO: 1281293 - protein, 9 aa, Homo Sapiens
TRTITRVKV

SEQ ID NO: 1281294 - protein, 9 aa, Homo Sapiens
APVEKIHTM

SEQ ID NO: 1281295 - protein, 9 aa, Homo Sapiens
CVHFPSLNK

SEQ ID NO: 1281296 - protein, 9 aa, Homo Sapiens
GTGKGLRGE

SEQ ID NO: 1281297 - protein, 9 aa, Homo Sapiens
ENEQDLAQC

SEQ ID NO: 1281298 - protein, 9 aa, Homo Sapiens
SWTTRSSRL

SEQ ID NO: 1281299 - protein, 9 aa, Homo Sapiens
LHLPNRPRE

SEQ ID NO: 1281300 - protein, 9 aa, Homo Sapiens
CAFGLCFKD

SEQ ID NO: 1281301 - protein, 9 aa, Homo Sapiens
LVKWCKAGE

SEQ ID NO: 1281302 - protein, 9 aa, Homo Sapiens
EKGYGKHAA

SEQ ID NO: 1281303 - protein, 9 aa, Homo Sapiens
FTPLLNLLI

SEQ ID NO: 1281304 - protein, 9 aa, Homo Sapiens
WPSPRVHGQ

SEQ ID NO: 1281305 - protein, 9 aa, Homo Sapiens
HLTMPSLDY

SEQ ID NO: 1281306 - protein, 9 aa, Homo Sapiens
QGRKGAAAS

SEQ ID NO: 1281307 - protein, 9 aa, Homo Sapiens
VTCSSASTR

SEQ ID NO: 1281308 - protein, 9 aa, Homo Sapiens
GQAWPVPLA

SEQ ID NO: 1281309 - protein, 9 aa, Homo Sapiens
IVDRFLHLP

SEQ ID NO: 1281310 - protein, 9 aa, Homo Sapiens
RHCIHARWK

SEQ ID NO: 1281311 - protein, 9 aa, Homo Sapiens
LTTCSSHMI

SEQ ID NO: 1281312 - protein, 9 aa, Homo Sapiens
VVTVLGDPA

SEQ ID NO: 1281313 - protein, 9 aa, Homo Sapiens
DILKQVFGI

SEQ ID NO: 1281314 - protein, 9 aa, Homo Sapiens
ALPHDHSLR

SEQ ID NO: 1281315 - protein, 9 aa, Homo Sapiens
AFKTPMGDL

SEQ ID NO: 1281316 - protein, 9 aa, Homo Sapiens
SSRLGAAGP

SEQ ID NO: 1281317 - protein, 9 aa, Homo Sapiens
QMYFFLSNL

SEQ ID NO: 1281318 - protein, 9 aa, Homo Sapiens
REDCIALVL

SEQ ID NO: 1281319 - protein, 9 aa, Homo Sapiens
AVSTPAAAC

SEQ ID NO: 1281320 - protein, 9 aa, Homo Sapiens
QAQKAKVDG

SEQ ID NO: 1281321 - protein, 9 aa, Homo Sapiens
LLNLLIYSV

SEQ ID NO: 1281322 - protein, 9 aa, Homo Sapiens
RTQMYFFLS

SEQ ID NO: 1281323 - protein, 9 aa, Homo Sapiens
TPAAACECS

SEQ ID NO: 1281324 - protein, 9 aa, Homo Sapiens
HFVQLHFSL

SEQ ID NO: 1281325 - protein, 9 aa, Homo Sapiens
PPRHARPPP

SEQ ID NO: 1281326 - protein, 9 aa, Homo Sapiens
NSRAFYGSH

SEQ ID NO: 1281327 - protein, 9 aa, Homo Sapiens
QNEIFGQTL

SEQ ID NO: 1281328 - protein, 9 aa, Homo Sapiens
GDDDDDDGE

SEQ ID NO: 1281329 - protein, 9 aa, Homo Sapiens
TDELASLKE

SEQ ID NO: 1281330 - protein, 9 aa, Homo Sapiens
QRFSTSAPP

SEQ ID NO: 1281331 - protein, 9 aa, Homo Sapiens
SLLNEQNIG

SEQ ID NO: 1281332 - protein, 9 aa, Homo Sapiens
EKKIWWIVQ

SEQ ID NO: 1281333 - protein, 9 aa, Homo Sapiens
SDDTKGLFD

SEQ ID NO: 1281334 - protein, 9 aa, Homo Sapiens
CIHARWKCD

SEQ ID NO: 1281335 - protein, 9 aa, Homo Sapiens
SGAGVQAAH

SEQ ID NO: 1281336 - protein, 9 aa, Homo Sapiens
HCPTENEQD

SEQ ID NO: 1281337 - protein, 9 aa, Homo Sapiens
PSASPAPRS

SEQ ID NO: 1281338 - protein, 9 aa, Homo Sapiens
QQQQQQRQQ

SEQ ID NO: 1281339 - protein, 9 aa, Homo Sapiens
KVDGAWLEG

SEQ ID NO: 1281340 - protein, 9 aa, Homo Sapiens
FSGVDDGRL

SEQ ID NO: 1281341 - protein, 9 aa, Homo Sapiens
AVVTVLGDP

SEQ ID NO: 1281342 - protein, 9 aa, Homo Sapiens
AASLCHFTS

SEQ ID NO: 1281343 - protein, 9 aa, Homo Sapiens
GLTILACER

SEQ ID NO: 1281344 - protein, 9 aa, Homo Sapiens
KGKRRDNGL

SEQ ID NO: 1281345 - protein, 9 aa, Homo Sapiens
KSSAEVLEY

SEQ ID NO: 1281346 - protein, 9 aa, Homo Sapiens
VCSGTARIL

SEQ ID NO: 1281347 - protein, 9 aa, Homo Sapiens
SSSTISRCT

SEQ ID NO: 1281348 - protein, 9 aa, Homo Sapiens
PGLRSQRFS

SEQ ID NO: 1281349 - protein, 9 aa, Homo Sapiens
PQARSPRSS

SEQ ID NO: 1281350 - protein, 9 aa, Homo Sapiens
PTENEQDLA

SEQ ID NO: 1281351 - protein, 9 aa, Homo Sapiens
PPGFTAWKT

SEQ ID NO: 1281352 - protein, 9 aa, Homo Sapiens
NATPGPYVV

SEQ ID NO: 1281353 - protein, 9 aa, Homo Sapiens
SSASTREDC

SEQ ID NO: 1281354 - protein, 9 aa, Homo Sapiens
QKAKVDGAW

SEQ ID NO: 1281355 - protein, 9 aa, Homo Sapiens
EVNAGVSGI

SEQ ID NO: 1281356 - protein, 9 aa, Homo Sapiens
LRCKPGTGK

SEQ ID NO: 1281357 - protein, 9 aa, Homo Sapiens
GGEVPQARS

SEQ ID NO: 1281358 - protein, 9 aa, Homo Sapiens
GLTHSLGNL

SEQ ID NO: 1281359 - protein, 9 aa, Homo Sapiens
GIHITKPVH

SEQ ID NO: 1281360 - protein, 9 aa, Homo Sapiens
DRNDNDPVI

SEQ ID NO: 1281361 - protein, 9 aa, Homo Sapiens
DKIEQAMDL

SEQ ID NO: 1281362 - protein, 9 aa, Homo Sapiens
VLKDFRRNI

SEQ ID NO: 1281363 - protein, 9 aa, Homo Sapiens
TATAVVTVL

SEQ ID NO: 1281364 - protein, 9 aa, Homo Sapiens
ELKEKKIWW

SEQ ID NO: 1281365 - protein, 9 aa, Homo Sapiens
FSTLDRDVE

SEQ ID NO: 1281366 - protein, 9 aa, Homo Sapiens
QRLPGGLTH

SEQ ID NO: 1281367 - protein, 9 aa, Homo Sapiens
VLGDPACAF

SEQ ID NO: 1281368 - protein, 9 aa, Homo Sapiens
IGEGACLLL

SEQ ID NO: 1281369 - protein, 9 aa, Homo Sapiens
NRVMQDRRI

SEQ ID NO: 1281370 - protein, 9 aa, Homo Sapiens
PNQAPCNCL

SEQ ID NO: 1281371 - protein, 9 aa, Homo Sapiens
SSTISRCTW

SEQ ID NO: 1281372 - protein, 9 aa, Homo Sapiens
AGGEVPQAR

SEQ ID NO: 1281373 - protein, 9 aa, Homo Sapiens
GASVVAIDD

SEQ ID NO: 1281374 - protein, 9 aa, Homo Sapiens
LPRLSSPRE

SEQ ID NO: 1281375 - protein, 9 aa, Homo Sapiens
PFKVVVNSG

SEQ ID NO: 1281376 - protein, 9 aa, Homo Sapiens
ACERRVSDH

SEQ ID NO: 1281377 - protein, 9 aa, Homo Sapiens
LTDELASLK

SEQ ID NO: 1281378 - protein, 9 aa, Homo Sapiens
APCNCLPAY

SEQ ID NO: 1281379 - protein, 9 aa, Homo Sapiens
KDSERRTTL

SEQ ID NO: 1281380 - protein, 9 aa, Homo Sapiens
SLCNSHWDV

SEQ ID NO: 1281381 - protein, 9 aa, Homo Sapiens
SLVGQAWPV

SEQ ID NO: 1281382 - protein, 9 aa, Homo Sapiens
QYRILTAAS

SEQ ID NO: 1281383 - protein, 9 aa, Homo Sapiens
STSAPPRHA

SEQ ID NO: 1281384 - protein, 9 aa, Homo Sapiens
YGSHGKPAP

SEQ ID NO: 1281385 - protein, 9 aa, Homo Sapiens
DSAIEDINA

SEQ ID NO: 1281386 - protein, 9 aa, Homo Sapiens
CRLEPTVKN

SEQ ID NO: 1281387 - protein, 9 aa, Homo Sapiens
WTTRSSRLG

SEQ ID NO: 1281388 - protein, 9 aa, Homo Sapiens
YASHAQNIR

SEQ ID NO: 1281389 - protein, 9 aa, Homo Sapiens
GQDSLKKYL

SEQ ID NO: 1281390 - protein, 9 aa, Homo Sapiens
DPACAFPLR

SEQ ID NO: 1281391 - protein, 9 aa, Homo Sapiens
VKWCKAGEC

SEQ ID NO: 1281392 - protein, 9 aa, Homo Sapiens
MDGTDCDLV

SEQ ID NO: 1281393 - protein, 9 aa, Homo Sapiens
SQPTESLIQ

SEQ ID NO: 1281394 - protein, 9 aa, Homo Sapiens
RRVSDHMDL

SEQ ID NO: 1281395 - protein, 9 aa, Homo Sapiens
AGSKNCRFP

SEQ ID NO: 1281396 - protein, 9 aa, Homo Sapiens
APGLRSQRF

SEQ ID NO: 1281397 - protein, 9 aa, Homo Sapiens
ECVREEQRS

SEQ ID NO: 1281398 - protein, 9 aa, Homo Sapiens
FCDGLGSPP

SEQ ID NO: 1281399 - protein, 9 aa, Homo Sapiens
SLTDELASL

SEQ ID NO: 1281400 - protein, 9 aa, Homo Sapiens
TENEQDLAQ

SEQ ID NO: 1281401 - protein, 9 aa, Homo Sapiens
PSDDTKGLF

SEQ ID NO: 1281402 - protein, 9 aa, Homo Sapiens
GHAWKTKLG

SEQ ID NO: 1281403 - protein, 9 aa, Homo Sapiens
FAALPHDHS

SEQ ID NO: 1281404 - protein, 9 aa, Homo Sapiens
VEKIHTMLV

SEQ ID NO: 1281405 - protein, 9 aa, Homo Sapiens
YAVDFDDDI

SEQ ID NO: 1281406 - protein, 9 aa, Homo Sapiens
VLVQENRPS

SEQ ID NO: 1281407 - protein, 9 aa, Homo Sapiens
YGKHAAGIA

SEQ ID NO: 1281408 - protein, 9 aa, Homo Sapiens
TTLHRILTE

SEQ ID NO: 1281409 - protein, 9 aa, Homo Sapiens
ENGKVTLVC

SEQ ID NO: 1281410 - protein, 9 aa, Homo Sapiens
TEPPVYANL

SEQ ID NO: 1281411 - protein, 9 aa, Homo Sapiens
AAGHRKALT

SEQ ID NO: 1281412 - protein, 9 aa, Homo Sapiens
YENGKVTLV

SEQ ID NO: 1281413 - protein, 9 aa, Homo Sapiens
EEMLQKIEQ

SEQ ID NO: 1281414 - protein, 9 aa, Homo Sapiens
SPAPRSLPF

SEQ ID NO: 1281415 - protein, 9 aa, Homo Sapiens
ESLTDELAS

SEQ ID NO: 1281416 - protein, 9 aa, Homo Sapiens
AAISKVQVC

SEQ ID NO: 1281417 - protein, 9 aa, Homo Sapiens
LACERRVSD

SEQ ID NO: 1281418 - protein, 9 aa, Homo Sapiens
ASLAMSIQR

SEQ ID NO: 1281419 - protein, 9 aa, Homo Sapiens
HLNGSAAFS

SEQ ID NO: 1281420 - protein, 9 aa, Homo Sapiens
NSFLLPFRM

SEQ ID NO: 1281421 - protein, 9 aa, Homo Sapiens
TDCDLVKWC

SEQ ID NO: 1281422 - protein, 9 aa, Homo Sapiens
TQFSTLDRD

SEQ ID NO: 1281423 - protein, 9 aa, Homo Sapiens
LHFSLLFKS

SEQ ID NO: 1281424 - protein, 9 aa, Homo Sapiens
LGAAGPSAS

SEQ ID NO: 1281425 - protein, 9 aa, Homo Sapiens
STISRCTWE

SEQ ID NO: 1281426 - protein, 9 aa, Homo Sapiens
SFLLPFRMS

SEQ ID NO: 1281427 - protein, 9 aa, Homo Sapiens
EGNWGPHLL

SEQ ID NO: 1281428 - protein, 9 aa, Homo Sapiens
APPRHARPP

SEQ ID NO: 1281429 - protein, 9 aa, Homo Sapiens
NSGMADILV

SEQ ID NO: 1281430 - protein, 9 aa, Homo Sapiens
HSTLRTQMY

SEQ ID NO: 1281431 - protein, 9 aa, Homo Sapiens
RGHAWKTKL

SEQ ID NO: 1281432 - protein, 9 aa, Homo Sapiens
WIVQNSFLL

SEQ ID NO: 1281433 - protein, 9 aa, Homo Sapiens
ATPGPYVVK

SEQ ID NO: 1281434 - protein, 9 aa, Homo Sapiens
NSPFKVVVN

SEQ ID NO: 1281435 - protein, 9 aa, Homo Sapiens
IRTSKGNRI

SEQ ID NO: 1281436 - protein, 9 aa, Homo Sapiens
FKVVVNSGR

SEQ ID NO: 1281437 - protein, 9 aa, Homo Sapiens
LTILACERR

SEQ ID NO: 1281438 - protein, 9 aa, Homo Sapiens
SPKEMHCLH

SEQ ID NO: 1281439 - protein, 9 aa, Homo Sapiens
GRKGAAASA

SEQ ID NO: 1281440 - protein, 9 aa, Homo Sapiens
LNYASHAQN

SEQ ID NO: 1281441 - protein, 9 aa, Homo Sapiens
YRILTAASL

SEQ ID NO: 1281442 - protein, 9 aa, Homo Sapiens
TTQSMRSGA

SEQ ID NO: 1281443 - protein, 9 aa, Homo Sapiens
NKAKCKHIH

SEQ ID NO: 1281444 - protein, 9 aa, Homo Sapiens
SFPKKFFFL

SEQ ID NO: 1281445 - protein, 9 aa, Homo Sapiens
IEDINATTG

SEQ ID NO: 1281446 - protein, 9 aa, Homo Sapiens
DPCQADSIR

SEQ ID NO: 1281447 - protein, 9 aa, Homo Sapiens
SASTREDCI

SEQ ID NO: 1281448 - protein, 9 aa, Homo Sapiens
IFWIPGTPI

SEQ ID NO: 1281449 - protein, 9 aa, Homo Sapiens
FRRNIPGSI

SEQ ID NO: 1281450 - protein, 9 aa, Homo Sapiens
QDILKQVFG

SEQ ID NO: 1281451 - protein, 9 aa, Homo Sapiens
LTHEMYEAK

SEQ ID NO: 1281452 - protein, 9 aa, Homo Sapiens
RSPRSSSTI

SEQ ID NO: 1281453 - protein, 9 aa, Homo Sapiens
CSTKGKEPR

SEQ ID NO: 1281454 - protein, 9 aa, Homo Sapiens
SLCHFTSIE

SEQ ID NO: 1281455 - protein, 9 aa, Homo Sapiens
ILKNTLSKQ

SEQ ID NO: 1281456 - protein, 9 aa, Homo Sapiens
TVGDSAIED

SEQ ID NO: 1281457 - protein, 9 aa, Homo Sapiens
SAFKTPMGD

SEQ ID NO: 1281458 - protein, 9 aa, Homo Sapiens
HGHARAVYV

SEQ ID NO: 1281459 - protein, 9 aa, Homo Sapiens
PKRQEEVCQ

SEQ ID NO: 1281460 - protein, 9 aa, Homo Sapiens
ISAEDAMEH

SEQ ID NO: 1281461 - protein, 9 aa, Homo Sapiens
EEAVYGRDG

SEQ ID NO: 1281462 - protein, 9 aa, Homo Sapiens
DVAKVNEQL

SEQ ID NO: 1281463 - protein, 9 aa, Homo Sapiens
EHLGVYRRV

SEQ ID NO: 1281464 - protein, 9 aa, Homo Sapiens
GAGFNTKEV

SEQ ID NO: 1281465 - protein, 9 aa, Homo Sapiens
LGVYRRVLA

SEQ ID NO: 1281466 - protein, 9 aa, Homo Sapiens
KPERRPPQG

SEQ ID NO: 1281467 - protein, 9 aa, Homo Sapiens
DAFEVELPK

SEQ ID NO: 1281468 - protein, 9 aa, Homo Sapiens
PYLGMTNQQ

SEQ ID NO: 1281469 - protein, 9 aa, Homo Sapiens
REEEEREHL

SEQ ID NO: 1281470 - protein, 9 aa, Homo Sapiens
DIIRGKTCS

SEQ ID NO: 1281471 - protein, 9 aa, Homo Sapiens
LLPLGIILF

SEQ ID NO: 1281472 - protein, 9 aa, Homo Sapiens
IFSICRFIN

SEQ ID NO: 1281473 - protein, 9 aa, Homo Sapiens
KIFPKHVAH

SEQ ID NO: 1281474 - protein, 9 aa, Homo Sapiens
RAHYTPYRF

SEQ ID NO: 1281475 - protein, 9 aa, Homo Sapiens
FSICRFINS

SEQ ID NO: 1281476 - protein, 9 aa, Homo Sapiens
KGVGAGFNT

SEQ ID NO: 1281477 - protein, 9 aa, Homo Sapiens
GASADFNTS

SEQ ID NO: 1281478 - protein, 9 aa, Homo Sapiens
DTRMVRRAA

SEQ ID NO: 1281479 - protein, 9 aa, Homo Sapiens
AMEHPFFLS

SEQ ID NO: 1281480 - protein, 9 aa, Homo Sapiens
FPVPLVIIV

SEQ ID NO: 1281481 - protein, 9 aa, Homo Sapiens
DAEEAVYGR

SEQ ID NO: 1281482 - protein, 9 aa, Homo Sapiens
QVPLFMVFL

SEQ ID NO: 1281483 - protein, 9 aa, Homo Sapiens
DDTRMVRRA

SEQ ID NO: 1281484 - protein, 9 aa, Homo Sapiens
TEEVPEDKP

SEQ ID NO: 1281485 - protein, 9 aa, Homo Sapiens
AGKSLSYLK

SEQ ID NO: 1281486 - protein, 9 aa, Homo Sapiens
IRMNYAPTR

SEQ ID NO: 1281487 - protein, 9 aa, Homo Sapiens
CNSCCMGGM

SEQ ID NO: 1281488 - protein, 9 aa, Homo Sapiens
ERERFPDSF

SEQ ID NO: 1281489 - protein, 9 aa, Homo Sapiens
YDDEAMILW

SEQ ID NO: 1281490 - protein, 9 aa, Homo Sapiens
ISGTVHVCN

SEQ ID NO: 1281491 - protein, 9 aa, Homo Sapiens
MEHPFFLSL

SEQ ID NO: 1281492 - protein, 9 aa, Homo Sapiens
AGKAALPLP

SEQ ID NO: 1281493 - protein, 9 aa, Homo Sapiens
LGGTPYCWM

SEQ ID NO: 1281494 - protein, 9 aa, Homo Sapiens
ADLFCDGKV

SEQ ID NO: 1281495 - protein, 9 aa, Homo Sapiens
VHVCNVAFE

SEQ ID NO: 1281496 - protein, 9 aa, Homo Sapiens
HVCNVAFEK

SEQ ID NO: 1281497 - protein, 9 aa, Homo Sapiens
QNFEQTPLR

SEQ ID NO: 1281498 - protein, 9 aa, Homo Sapiens
QKHHAVPAP

SEQ ID NO: 1281499 - protein, 9 aa, Homo Sapiens
GGCCWDVRL

SEQ ID NO: 1281500 - protein, 9 aa, Homo Sapiens
TPSVIPSRA

SEQ ID NO: 1281501 - protein, 9 aa, Homo Sapiens
LFHNEGHLK

SEQ ID NO: 1281502 - protein, 9 aa, Homo Sapiens
EHLIYQFRG

SEQ ID NO: 1281503 - protein, 9 aa, Homo Sapiens
PSHYGFAPG

SEQ ID NO: 1281504 - protein, 9 aa, Homo Sapiens
DFEVFFFTI

SEQ ID NO: 1281505 - protein, 9 aa, Homo Sapiens
TECVIRMNY

SEQ ID NO: 1281506 - protein, 9 aa, Homo Sapiens
FHLGHLREG

SEQ ID NO: 1281507 - protein, 9 aa, Homo Sapiens
ASADFNTSF

SEQ ID NO: 1281508 - protein, 9 aa, Homo Sapiens
MILWTHENF

SEQ ID NO: 1281509 - protein, 9 aa, Homo Sapiens
GCEGGCCWD

SEQ ID NO: 1281510 - protein, 9 aa, Homo Sapiens
CHRLVLASC

SEQ ID NO: 1281511 - protein, 9 aa, Homo Sapiens
TRASRRCDH

SEQ ID NO: 1281512 - protein, 9 aa, Homo Sapiens
QCSVPVFYI

SEQ ID NO: 1281513 - protein, 9 aa, Homo Sapiens
TPALPVPGQ

SEQ ID NO: 1281514 - protein, 9 aa, Homo Sapiens
CPVCSCSLN

SEQ ID NO: 1281515 - protein, 9 aa, Homo Sapiens
PLPSPARRL

SEQ ID NO: 1281516 - protein, 9 aa, Homo Sapiens
APGLNKDGI

SEQ ID NO: 1281517 - protein, 9 aa, Homo Sapiens
AFEVELPKN

SEQ ID NO: 1281518 - protein, 9 aa, Homo Sapiens
FAPGLNKDG

SEQ ID NO: 1281519 - protein, 9 aa, Homo Sapiens
FNTKEVIDR

SEQ ID NO: 1281520 - protein, 9 aa, Homo Sapiens
DLGISGTVH

SEQ ID NO: 1281521 - protein, 9 aa, Homo Sapiens
IRGKTCSRR

SEQ ID NO: 1281522 - protein, 9 aa, Homo Sapiens
RMVRRAAAS

SEQ ID NO: 1281523 - protein, 9 aa, Homo Sapiens
HLGHLREGR

SEQ ID NO: 1281524 - protein, 9 aa, Homo Sapiens
LLEFLLPLG

SEQ ID NO: 1281525 - protein, 9 aa, Homo Sapiens
LQEQWKKSG

SEQ ID NO: 1281526 - protein, 9 aa, Homo Sapiens
CDHAGRWEP

SEQ ID NO: 1281527 - protein, 9 aa, Homo Sapiens
SLLFHNEGH

SEQ ID NO: 1281528 - protein, 9 aa, Homo Sapiens
ECVIRMNYA

SEQ ID NO: 1281529 - protein, 9 aa, Homo Sapiens
ISAHGQKHH

SEQ ID NO: 1281530 - protein, 9 aa, Homo Sapiens
YGFAPGLNK

SEQ ID NO: 1281531 - protein, 9 aa, Homo Sapiens
LGVCPYLGM

SEQ ID NO: 1281532 - protein, 9 aa, Homo Sapiens
QLAQNYPKQ

SEQ ID NO: 1281533 - protein, 9 aa, Homo Sapiens
VFTIHFYRF

SEQ ID NO: 1281534 - protein, 9 aa, Homo Sapiens
HLQKEEEKR

SEQ ID NO: 1281535 - protein, 9 aa, Homo Sapiens
CEGGCCWDV

SEQ ID NO: 1281536 - protein, 9 aa, Homo Sapiens
AAQCGPEPG

SEQ ID NO: 1281537 - protein, 9 aa, Homo Sapiens
IFPKHVAHV

SEQ ID NO: 1281538 - protein, 9 aa, Homo Sapiens
TPQTPALPV

SEQ ID NO: 1281539 - protein, 9 aa, Homo Sapiens
LALLCKGVP

SEQ ID NO: 1281540 - protein, 9 aa, Homo Sapiens
LDNISDRRE

SEQ ID NO: 1281541 - protein, 9 aa, Homo Sapiens
RNLCSDDTR

SEQ ID NO: 1281542 - protein, 9 aa, Homo Sapiens
RPKADNQAL

SEQ ID NO: 1281543 - protein, 9 aa, Homo Sapiens
DEISLLFHN

SEQ ID NO: 1281544 - protein, 9 aa, Homo Sapiens
DGALKISAK

SEQ ID NO: 1281545 - protein, 9 aa, Homo Sapiens
VPEDKPAEV

SEQ ID NO: 1281546 - protein, 9 aa, Homo Sapiens
LLFHNEGHL

SEQ ID NO: 1281547 - protein, 9 aa, Homo Sapiens
QEQWKKSGY

SEQ ID NO: 1281548 - protein, 9 aa, Homo Sapiens
FNTYVQLAQ

SEQ ID NO: 1281549 - protein, 9 aa, Homo Sapiens
VRNSAGKSL

SEQ ID NO: 1281550 - protein, 9 aa, Homo Sapiens
ADFNTSFSG

SEQ ID NO: 1281551 - protein, 9 aa, Homo Sapiens
REKIFPKHV

SEQ ID NO: 1281552 - protein, 9 aa, Homo Sapiens
VNEQLSSFD

SEQ ID NO: 1281553 - protein, 9 aa, Homo Sapiens
VELSLPFDK

SEQ ID NO: 1281554 - protein, 9 aa, Homo Sapiens
FLLPLGIIL

SEQ ID NO: 1281555 - protein, 9 aa, Homo Sapiens
CELAPRELK

SEQ ID NO: 1281556 - protein, 9 aa, Homo Sapiens
LIYQFRGHH

SEQ ID NO: 1281557 - protein, 9 aa, Homo Sapiens
EICYKDHIQ

SEQ ID NO: 1281558 - protein, 9 aa, Homo Sapiens
KVMQFCWLQ

SEQ ID NO: 1281559 - protein, 9 aa, Homo Sapiens
IHFYRFLVR

SEQ ID NO: 1281560 - protein, 9 aa, Homo Sapiens
AMFLLEFLL

SEQ ID NO: 1281561 - protein, 9 aa, Homo Sapiens
WKGVGAGFN

SEQ ID NO: 1281562 - protein, 9 aa, Homo Sapiens
NLCSDDTRM

SEQ ID NO: 1281563 - protein, 9 aa, Homo Sapiens
SVIPSRAAP

SEQ ID NO: 1281564 - protein, 9 aa, Homo Sapiens
PYRFGDATR

SEQ ID NO: 1281565 - protein, 9 aa, Homo Sapiens
LTVKEQLIE

SEQ ID NO: 1281566 - protein, 9 aa, Homo Sapiens
LLEICYKDH

SEQ ID NO: 1281567 - protein, 9 aa, Homo Sapiens
QWKGVGAGF

SEQ ID NO: 1281568 - protein, 9 aa, Homo Sapiens
TRMVRRAAA

SEQ ID NO: 1281569 - protein, 9 aa, Homo Sapiens
RRVLAALES

SEQ ID NO: 1281570 - protein, 9 aa, Homo Sapiens
LKISAKDLR

SEQ ID NO: 1281571 - protein, 9 aa, Homo Sapiens
STTEGQNFE

SEQ ID NO: 1281572 - protein, 9 aa, Homo Sapiens
PERRPPQGG

SEQ ID NO: 1281573 - protein, 9 aa, Homo Sapiens
SQTPSVIPS

SEQ ID NO: 1281574 - protein, 9 aa, Homo Sapiens
NISDRRESA

SEQ ID NO: 1281575 - protein, 9 aa, Homo Sapiens
HLREGRLFL

SEQ ID NO: 1281576 - protein, 9 aa, Homo Sapiens
VIPSRAAPR

SEQ ID NO: 1281577 - protein, 9 aa, Homo Sapiens
NIIKLLGAC

SEQ ID NO: 1281578 - protein, 9 aa, Homo Sapiens
DLFCDGKVN

SEQ ID NO: 1281579 - protein, 9 aa, Homo Sapiens
EEREHLQKE

SEQ ID NO: 1281580 - protein, 9 aa, Homo Sapiens
ALLQQLQEQ

SEQ ID NO: 1281581 - protein, 9 aa, Homo Sapiens
LDTCYSTPS

SEQ ID NO: 1281582 - protein, 9 aa, Homo Sapiens
YVQLAQNYP

SEQ ID NO: 1281583 - protein, 9 aa, Homo Sapiens
SEHLGVYRR

SEQ ID NO: 1281584 - protein, 9 aa, Homo Sapiens
VQLAQNYPK

SEQ ID NO: 1281585 - protein, 9 aa, Homo Sapiens
PGKPERRPP

SEQ ID NO: 1281586 - protein, 9 aa, Homo Sapiens
TPYRFGDAT

SEQ ID NO: 1281587 - protein, 9 aa, Homo Sapiens
EHPFFLSLG

SEQ ID NO: 1281588 - protein, 9 aa, Homo Sapiens
RELRQAAQC

SEQ ID NO: 1281589 - protein, 9 aa, Homo Sapiens
PVCSCSLNK

SEQ ID NO: 1281590 - protein, 9 aa, Homo Sapiens
VAGRGQSRA

SEQ ID NO: 1281591 - protein, 9 aa, Homo Sapiens
LCKGVPQTM

SEQ ID NO: 1281592 - protein, 9 aa, Homo Sapiens
EITKQEKDF

SEQ ID NO: 1281593 - protein, 9 aa, Homo Sapiens
LAPRELKAN

SEQ ID NO: 1281594 - protein, 9 aa, Homo Sapiens
DAMEHPFFL

SEQ ID NO: 1281595 - protein, 9 aa, Homo Sapiens
DIPLRRARK

SEQ ID NO: 1281596 - protein, 9 aa, Homo Sapiens
EISLLFHNE

SEQ ID NO: 1281597 - protein, 9 aa, Homo Sapiens
AEEAVYGRD

SEQ ID NO: 1281598 - protein, 9 aa, Homo Sapiens
VIIVSKYDV

SEQ ID NO: 1281599 - protein, 9 aa, Homo Sapiens
KQEKDFLWS

SEQ ID NO: 1281600 - protein, 9 aa, Homo Sapiens
ISSTTEGQN

SEQ ID NO: 1281601 - protein, 9 aa, Homo Sapiens
CSLNKLAQP

SEQ ID NO: 1281602 - protein, 9 aa, Homo Sapiens
REHLQKEEE

SEQ ID NO: 1281603 - protein, 9 aa, Homo Sapiens
FLLEFLLPL

SEQ ID NO: 1281604 - protein, 9 aa, Homo Sapiens
ESVGAGAGK

SEQ ID NO: 1281605 - protein, 9 aa, Homo Sapiens
ALLCKGVPQ

SEQ ID NO: 1281606 - protein, 9 aa, Homo Sapiens
IIKLLGACT

SEQ ID NO: 1281607 - protein, 9 aa, Homo Sapiens
DVVAGRGQS

SEQ ID NO: 1281608 - protein, 9 aa, Homo Sapiens
LPFDKDYII

SEQ ID NO: 1281609 - protein, 9 aa, Homo Sapiens
EKIFPKHVA

SEQ ID NO: 1281610 - protein, 9 aa, Homo Sapiens
AKVGVCMLM

SEQ ID NO: 1281611 - protein, 9 aa, Homo Sapiens
LCSDDTRMV

SEQ ID NO: 1281612 - protein, 9 aa, Homo Sapiens
PKHVAHVLN

SEQ ID NO: 1281613 - protein, 9 aa, Homo Sapiens
YLGMTNQQA

SEQ ID NO: 1281614 - protein, 9 aa, Homo Sapiens
PPKRQEEVC

SEQ ID NO: 1281615 - protein, 9 aa, Homo Sapiens
AQNYPKQKE

SEQ ID NO: 1281616 - protein, 9 aa, Homo Sapiens
VLCELAPRE

SEQ ID NO: 1281617 - protein, 9 aa, Homo Sapiens
TKQEKDFLW

SEQ ID NO: 1281618 - protein, 9 aa, Homo Sapiens
TRHERIHSA

SEQ ID NO: 1281619 - protein, 9 aa, Homo Sapiens
ELSLPFDKD

SEQ ID NO: 1281620 - protein, 9 aa, Homo Sapiens
ISAKDLRSQ

SEQ ID NO: 1281621 - protein, 9 aa, Homo Sapiens
SCSLNKLAQ

SEQ ID NO: 1281622 - protein, 9 aa, Homo Sapiens
MAAKVGVCM

SEQ ID NO: 1281623 - protein, 9 aa, Homo Sapiens
SLPLDNISD

SEQ ID NO: 1281624 - protein, 9 aa, Homo Sapiens
HQVPPQQPQ

SEQ ID NO: 1281625 - protein, 9 aa, Homo Sapiens
ISDRRESAI

SEQ ID NO: 1281626 - protein, 9 aa, Homo Sapiens
DNQALRDIP

SEQ ID NO: 1281627 - protein, 9 aa, Homo Sapiens
LGFQIKKKN

SEQ ID NO: 1281628 - protein, 9 aa, Homo Sapiens
YITHQTPLC

SEQ ID NO: 1281629 - protein, 9 aa, Homo Sapiens
SSTTEGQNF

SEQ ID NO: 1281630 - protein, 9 aa, Homo Sapiens
EDAMEHPFF

SEQ ID NO: 1281631 - protein, 9 aa, Homo Sapiens
HYTPYRFGD

SEQ ID NO: 1281632 - protein, 9 aa, Homo Sapiens
AKVNEQLSS

SEQ ID NO: 1281633 - protein, 9 aa, Homo Sapiens
YQDEISLLF

SEQ ID NO: 1281634 - protein, 9 aa, Homo Sapiens
PKNELLHPP

SEQ ID NO: 1281635 - protein, 9 aa, Homo Sapiens
RARKTTKKR

SEQ ID NO: 1281636 - protein, 9 aa, Homo Sapiens
ASCSPYFRA

SEQ ID NO: 1281637 - protein, 9 aa, Homo Sapiens
YRRVLAALE

SEQ ID NO: 1281638 - protein, 9 aa, Homo Sapiens
PCILSVSYC

SEQ ID NO: 1281639 - protein, 9 aa, Homo Sapiens
RFGDATRTP

SEQ ID NO: 1281640 - protein, 9 aa, Homo Sapiens
SADFNTSFS

SEQ ID NO: 1281641 - protein, 9 aa, Homo Sapiens
SPCILSVSY

SEQ ID NO: 1281642 - protein, 9 aa, Homo Sapiens
YCWMTCAEL

SEQ ID NO: 1281643 - protein, 9 aa, Homo Sapiens
LGHLREGRL

SEQ ID NO: 1281644 - protein, 9 aa, Homo Sapiens
FTIHFYRFL

SEQ ID NO: 1281645 - protein, 9 aa, Homo Sapiens
KDDFEVFFF

SEQ ID NO: 1281646 - protein, 9 aa, Homo Sapiens
HYGFAPGLN

SEQ ID NO: 1281647 - protein, 9 aa, Homo Sapiens
GVGAGFNTK

SEQ ID NO: 1281648 - protein, 9 aa, Homo Sapiens
ASRRCDHAG

SEQ ID NO: 1281649 - protein, 9 aa, Homo Sapiens
DHAGRWEPG

SEQ ID NO: 1281650 - protein, 9 aa, Homo Sapiens
EAIGIPEGG

SEQ ID NO: 1281651 - protein, 9 aa, Homo Sapiens
QTPSVIPSR

SEQ ID NO: 1281652 - protein, 9 aa, Homo Sapiens
KVNCPDGSD

SEQ ID NO: 1281653 - protein, 9 aa, Homo Sapiens
AASQTPSVI

SEQ ID NO: 1281654 - protein, 9 aa, Homo Sapiens
IPSRAAPRA

SEQ ID NO: 1281655 - protein, 9 aa, Homo Sapiens
EEEREHLQK

SEQ ID NO: 1281656 - protein, 9 aa, Homo Sapiens
LSDRWYKVM

SEQ ID NO: 1281657 - protein, 9 aa, Homo Sapiens
KKKGRPKAD

SEQ ID NO: 1281658 - protein, 9 aa, Homo Sapiens
VANFLALLC

SEQ ID NO: 1281659 - protein, 9 aa, Homo Sapiens
PPQQPQQQQ

SEQ ID NO: 1281660 - protein, 9 aa, Homo Sapiens
GRPKADNQA

SEQ ID NO: 1281661 - protein, 9 aa, Homo Sapiens
EAMFLLEFL

SEQ ID NO: 1281662 - protein, 9 aa, Homo Sapiens
VDIIRGKTC

SEQ ID NO: 1281663 - protein, 9 aa, Homo Sapiens
KSLSYLKKC

SEQ ID NO: 1281664 - protein, 9 aa, Homo Sapiens
AAKVGVCML

SEQ ID NO: 1281665 - protein, 9 aa, Homo Sapiens
EVCQSVTPA

SEQ ID NO: 1281666 - protein, 9 aa, Homo Sapiens
VTFNIFSIC

SEQ ID NO: 1281667 - protein, 9 aa, Homo Sapiens
PQTPALPVP

SEQ ID NO: 1281668 - protein, 9 aa, Homo Sapiens
LLQQLQEQW

SEQ ID NO: 1281669 - protein, 9 aa, Homo Sapiens
LFCDGKVNC

SEQ ID NO: 1281670 - protein, 9 aa, Homo Sapiens
PKADNQALR

SEQ ID NO: 1281671 - protein, 9 aa, Homo Sapiens
DRWYKVMQF

SEQ ID NO: 1281672 - protein, 9 aa, Homo Sapiens
EVFFFTIGI

SEQ ID NO: 1281673 - protein, 9 aa, Homo Sapiens
YTPYRFGDA

SEQ ID NO: 1281674 - protein, 9 aa, Homo Sapiens
PCHRLVLAS

SEQ ID NO: 1281675 - protein, 9 aa, Homo Sapiens
SPARRLVLF

SEQ ID NO: 1281676 - protein, 9 aa, Homo Sapiens
QQCSVPVFY

SEQ ID NO: 1281677 - protein, 9 aa, Homo Sapiens
AALLLLLKF

SEQ ID NO: 1281678 - protein, 9 aa, Homo Sapiens
QDEISLLFH

SEQ ID NO: 1281679 - protein, 9 aa, Homo Sapiens
PSVIPSRAA

SEQ ID NO: 1281680 - protein, 9 aa, Homo Sapiens
FPKHVAHVL

SEQ ID NO: 1281681 - protein, 9 aa, Homo Sapiens
KDYIIEIKP

SEQ ID NO: 1281682 - protein, 9 aa, Homo Sapiens
KPAEVSAHL

SEQ ID NO: 1281683 - protein, 9 aa, Homo Sapiens
GHLREGRLF

SEQ ID NO: 1281684 - protein, 9 aa, Homo Sapiens
VGAGFNTKE

SEQ ID NO: 1281685 - protein, 9 aa, Homo Sapiens
YMCNSCCMG

SEQ ID NO: 1281686 - protein, 9 aa, Homo Sapiens
ERRPPQGGN

SEQ ID NO: 1281687 - protein, 9 aa, Homo Sapiens
LREGRLFLR

SEQ ID NO: 1281688 - protein, 9 aa, Homo Sapiens
SAEDAMEHP

SEQ ID NO: 1281689 - protein, 9 aa, Homo Sapiens
FDKDYIIEI

SEQ ID NO: 1281690 - protein, 9 aa, Homo Sapiens
SEAIGIPEG

SEQ ID NO: 1281691 - protein, 9 aa, Homo Sapiens
PEDKPAEVS

SEQ ID NO: 1281692 - protein, 9 aa, Homo Sapiens
AHGQKHHAV

SEQ ID NO: 1281693 - protein, 9 aa, Homo Sapiens
PFDKDYIIE

SEQ ID NO: 1281694 - protein, 9 aa, Homo Sapiens
KLLGACTQD

SEQ ID NO: 1281695 - protein, 9 aa, Homo Sapiens
EVLQDSLDT

SEQ ID NO: 1281696 - protein, 9 aa, Homo Sapiens
ILGTKEDEE

SEQ ID NO: 1281697 - protein, 9 aa, Homo Sapiens
FYITHQTPL

SEQ ID NO: 1281698 - protein, 9 aa, Homo Sapiens
PEPVDIIRG

SEQ ID NO: 1281699 - protein, 9 aa, Homo Sapiens
KADNQALRD

SEQ ID NO: 1281700 - protein, 9 aa, Homo Sapiens
GAGAGKAAL

SEQ ID NO: 1281701 - protein, 9 aa, Homo Sapiens
PPPGKPERR

SEQ ID NO: 1281702 - protein, 9 aa, Homo Sapiens
IVANFLALL

SEQ ID NO: 1281703 - protein, 9 aa, Homo Sapiens
TTEGQNFEQ

SEQ ID NO: 1281704 - protein, 9 aa, Homo Sapiens
KISAKDLRS

SEQ ID NO: 1281705 - protein, 9 aa, Homo Sapiens
MRRRERERF

SEQ ID NO: 1281706 - protein, 9 aa, Homo Sapiens
AGASADFNT

SEQ ID NO: 1281707 - protein, 9 aa, Homo Sapiens
FHNEGHLKE

SEQ ID NO: 1281708 - protein, 9 aa, Homo Sapiens
AEDAMEHPF

SEQ ID NO: 1281709 - protein, 9 aa, Homo Sapiens
SAQKPYECK

SEQ ID NO: 1281710 - protein, 9 aa, Homo Sapiens
NYMCNSCCM

SEQ ID NO: 1281711 - protein, 9 aa, Homo Sapiens
LVIIVSKYD

SEQ ID NO: 1281712 - protein, 9 aa, Homo Sapiens
ALPVPGQGF

SEQ ID NO: 1281713 - protein, 9 aa, Homo Sapiens
LGMTNQQAR

SEQ ID NO: 1281714 - protein, 9 aa, Homo Sapiens
EDPRDAEEA

SEQ ID NO: 1281715 - protein, 9 aa, Homo Sapiens
GFNTKEVID

SEQ ID NO: 1281716 - protein, 9 aa, Homo Sapiens
FSVLCELAP

SEQ ID NO: 1281717 - protein, 9 aa, Homo Sapiens
SDDTRMVRR

SEQ ID NO: 1281718 - protein, 9 aa, Homo Sapiens
GTKEDEEHV

SEQ ID NO: 1281719 - protein, 9 aa, Homo Sapiens
KAALLLLLK

SEQ ID NO: 1281720 - protein, 9 aa, Homo Sapiens
ILSVSYCSS

SEQ ID NO: 1281721 - protein, 9 aa, Homo Sapiens
SRRCDHAGR

SEQ ID NO: 1281722 - protein, 9 aa, Homo Sapiens
GVCMLMTSD

SEQ ID NO: 1281723 - protein, 9 aa, Homo Sapiens
DKPAEVSAH

SEQ ID NO: 1281724 - protein, 9 aa, Homo Sapiens
CWMTCAELY

SEQ ID NO: 1281725 - protein, 9 aa, Homo Sapiens
ARKTTKKRE

SEQ ID NO: 1281726 - protein, 9 aa, Homo Sapiens
HIQQFDDDE

SEQ ID NO: 1281727 - protein, 9 aa, Homo Sapiens
SPDCPVCSC

SEQ ID NO: 1281728 - protein, 9 aa, Homo Sapiens
AGCEGGCCW

SEQ ID NO: 1281729 - protein, 9 aa, Homo Sapiens
SCCMGGMNR

SEQ ID NO: 1281730 - protein, 9 aa, Homo Sapiens
ERFPDSFSM

SEQ ID NO: 1281731 - protein, 9 aa, Homo Sapiens
HERIHSAQK

SEQ ID NO: 1281732 - protein, 9 aa, Homo Sapiens
PDLDVVAGR

SEQ ID NO: 1281733 - protein, 9 aa, Homo Sapiens
SVLCELAPR

SEQ ID NO: 1281734 - protein, 9 aa, Homo Sapiens
FFFTIGITW

SEQ ID NO: 1281735 - protein, 9 aa, Homo Sapiens
SAGKSLSYL

SEQ ID NO: 1281736 - protein, 9 aa, Homo Sapiens
VELPKNELL

SEQ ID NO: 1281737 - protein, 9 aa, Homo Sapiens
REGRLFLRG

SEQ ID NO: 1281738 - protein, 9 aa, Homo Sapiens
EREHLQKEE

SEQ ID NO: 1281739 - protein, 9 aa, Homo Sapiens
AIVVSPCIL

SEQ ID NO: 1281740 - protein, 9 aa, Homo Sapiens
GSGPSEAIG

SEQ ID NO: 1281741 - protein, 9 aa, Homo Sapiens
SGTVHVCNV

SEQ ID NO: 1281742 - protein, 9 aa, Homo Sapiens
HFYRFLVRH

SEQ ID NO: 1281743 - protein, 9 aa, Homo Sapiens
RLLDGALKI

SEQ ID NO: 1281744 - protein, 9 aa, Homo Sapiens
VVSPCILSV

SEQ ID NO: 1281745 - protein, 9 aa, Homo Sapiens
LKDDFEVFF

SEQ ID NO: 1281746 - protein, 9 aa, Homo Sapiens
LLLLKFLAK

SEQ ID NO: 1281747 - protein, 9 aa, Homo Sapiens
ITKQEKDFL

SEQ ID NO: 1281748 - protein, 9 aa, Homo Sapiens
TPLPSPARR

SEQ ID NO: 1281749 - protein, 9 aa, Homo Sapiens
LLLKFLAKQ

SEQ ID NO: 1281750 - protein, 9 aa, Homo Sapiens
SLPFDKDYI

SEQ ID NO: 1281751 - protein, 9 aa, Homo Sapiens
TLSDRWYKV

SEQ ID NO: 1281752 - protein, 9 aa, Homo Sapiens
QYDDEAMIL

SEQ ID NO: 1281753 - protein, 9 aa, Homo Sapiens
EDDIPLRRA

SEQ ID NO: 1281754 - protein, 9 aa, Homo Sapiens
VCPYLGMTN

SEQ ID NO: 1281755 - protein, 9 aa, Homo Sapiens
RCDHAGRWE

SEQ ID NO: 1281756 - protein, 9 aa, Homo Sapiens
GTPYCWMTC

SEQ ID NO: 1281757 - protein, 9 aa, Homo Sapiens
SICRFINSQ

SEQ ID NO: 1281758 - protein, 9 aa, Homo Sapiens
TPYCWMTCA

SEQ ID NO: 1281759 - protein, 9 aa, Homo Sapiens
ITEEVPEDK

SEQ ID NO: 1281760 - protein, 9 aa, Homo Sapiens
RISAEDAME

SEQ ID NO: 1281761 - protein, 9 aa, Homo Sapiens
KDVAKVNEQ

SEQ ID NO: 1281762 - protein, 9 aa, Homo Sapiens
LFMVFLFVY

SEQ ID NO: 1281763 - protein, 9 aa, Homo Sapiens
QEEVCQSVT

SEQ ID NO: 1281764 - protein, 9 aa, Homo Sapiens
RFLVRHKTE

SEQ ID NO: 1281765 - protein, 9 aa, Homo Sapiens
PVFYITHQT

SEQ ID NO: 1281766 - protein, 9 aa, Homo Sapiens
CSDDTRMVR

SEQ ID NO: 1281767 - protein, 9 aa, Homo Sapiens
EAMILWTHE

SEQ ID NO: 1281768 - protein, 9 aa, Homo Sapiens
YQFRGHHEL

SEQ ID NO: 1281769 - protein, 9 aa, Homo Sapiens
QFRGHHELI

SEQ ID NO: 1281770 - protein, 9 aa, Homo Sapiens
AGRGQSRAE

SEQ ID NO: 1281771 - protein, 9 aa, Homo Sapiens
HRLVLASCS

SEQ ID NO: 1281772 - protein, 9 aa, Homo Sapiens
VGVCMLMTS

SEQ ID NO: 1281773 - protein, 9 aa, Homo Sapiens
PDCPVCSCS

SEQ ID NO: 1281774 - protein, 9 aa, Homo Sapiens
SHYGFAPGL

SEQ ID NO: 1281775 - protein, 9 aa, Homo Sapiens
WMTCAELYE

SEQ ID NO: 1281776 - protein, 9 aa, Homo Sapiens
AHYTPYRFG

SEQ ID NO: 1281777 - protein, 9 aa, Homo Sapiens
EVPEDKPAE

SEQ ID NO: 1281778 - protein, 9 aa, Homo Sapiens
RASRRCDHA

SEQ ID NO: 1281779 - protein, 9 aa, Homo Sapiens
PLRRARKTT

SEQ ID NO: 1281780 - protein, 9 aa, Homo Sapiens
DQYDDEAMI

SEQ ID NO: 1281781 - protein, 9 aa, Homo Sapiens
GAGKAALPL

SEQ ID NO: 1281782 - protein, 9 aa, Homo Sapiens
ALKISAKDL

SEQ ID NO: 1281783 - protein, 9 aa, Homo Sapiens
PEIQVPLFM

SEQ ID NO: 1281784 - protein, 9 aa, Homo Sapiens
VPGQGFGPS

SEQ ID NO: 1281785 - protein, 9 aa, Homo Sapiens
PLVIIVSKY

SEQ ID NO: 1281786 - protein, 9 aa, Homo Sapiens
PYCWMTCAE

SEQ ID NO: 1281787 - protein, 9 aa, Homo Sapiens
GQKHHAVPA

SEQ ID NO: 1281788 - protein, 9 aa, Homo Sapiens
MFLLEFLLP

SEQ ID NO: 1281789 - protein, 9 aa, Homo Sapiens
LKFLAKQHT

SEQ ID NO: 1281790 - protein, 9 aa, Homo Sapiens
RRRERERFP

SEQ ID NO: 1281791 - protein, 9 aa, Homo Sapiens
DGKVNCPDG

SEQ ID NO: 1281792 - protein, 9 aa, Homo Sapiens
PVDIIRGKT

SEQ ID NO: 1281793 - protein, 9 aa, Homo Sapiens
IGKHKNIIK

SEQ ID NO: 1281794 - protein, 9 aa, Homo Sapiens
EVELPKNEL

SEQ ID NO: 1281795 - protein, 9 aa, Homo Sapiens
FFTIGITWI

SEQ ID NO: 1281796 - protein, 9 aa, Homo Sapiens
LAQNYPKQK

SEQ ID NO: 1281797 - protein, 9 aa, Homo Sapiens
RVLAALESL

SEQ ID NO: 1281798 - protein, 9 aa, Homo Sapiens
QFILGTKED

SEQ ID NO: 1281799 - protein, 9 aa, Homo Sapiens
VFFFTIGIT

SEQ ID NO: 1281800 - protein, 9 aa, Homo Sapiens
DDFEVFFFT

SEQ ID NO: 1281801 - protein, 9 aa, Homo Sapiens
KHKNIIKLL

SEQ ID NO: 1281802 - protein, 9 aa, Homo Sapiens
CILSVSYCS

SEQ ID NO: 1281803 - protein, 9 aa, Homo Sapiens
YRFLVRHKT

SEQ ID NO: 1281804 - protein, 9 aa, Homo Sapiens
FNTSFSGVD

SEQ ID NO: 1281805 - protein, 9 aa, Homo Sapiens
TEGQNFEQT

SEQ ID NO: 1281806 - protein, 9 aa, Homo Sapiens
FNIFSICRF

SEQ ID NO: 1281807 - protein, 9 aa, Homo Sapiens
RERERFPDS

SEQ ID NO: 1281808 - protein, 9 aa, Homo Sapiens
DPLSEITKQ

SEQ ID NO: 1281809 - protein, 9 aa, Homo Sapiens
AMILWTHEN

SEQ ID NO: 1281810 - protein, 9 aa, Homo Sapiens
LRQAAQCGP

SEQ ID NO: 1281811 - protein, 9 aa, Homo Sapiens
MVFLFVYTV

SEQ ID NO: 1281812 - protein, 9 aa, Homo Sapiens
KGRPKADNQ

SEQ ID NO: 1281813 - protein, 9 aa, Homo Sapiens
PSPARRLVL

SEQ ID NO: 1281814 - protein, 9 aa, Homo Sapiens
RRERERFPD

SEQ ID NO: 1281815 - protein, 9 aa, Homo Sapiens
VPPQQPQQQ

SEQ ID NO: 1281816 - protein, 9 aa, Homo Sapiens
ICRFINSQF

SEQ ID NO: 1281817 - protein, 9 aa, Homo Sapiens
QCGPEPGVS

SEQ ID NO: 1281818 - protein, 9 aa, Homo Sapiens
MFSVLCELA

SEQ ID NO: 1281819 - protein, 9 aa, Homo Sapiens
DTCYSTPSG

SEQ ID NO: 1281820 - protein, 9 aa, Homo Sapiens
QPAGASADF

SEQ ID NO: 1281821 - protein, 9 aa, Homo Sapiens
DHIQQFDDD

SEQ ID NO: 1281822 - protein, 9 aa, Homo Sapiens
GPSEAIGIP

SEQ ID NO: 1281823 - protein, 9 aa, Homo Sapiens
FLALLCKGV

SEQ ID NO: 1281824 - protein, 9 aa, Homo Sapiens
CSCSLNKLA

SEQ ID NO: 1281825 - protein, 9 aa, Homo Sapiens
PSEAIGIPE

SEQ ID NO: 1281826 - protein, 9 aa, Homo Sapiens
CQSVTPAEP

SEQ ID NO: 1281827 - protein, 9 aa, Homo Sapiens
IGIPEGGLL

SEQ ID NO: 1281828 - protein, 9 aa, Homo Sapiens
GKVNCPDGS

SEQ ID NO: 1281829 - protein, 9 aa, Homo Sapiens
GCCWDVRLD

SEQ ID NO: 1281830 - protein, 9 aa, Homo Sapiens
GRLFLRGGT

SEQ ID NO: 1281831 - protein, 9 aa, Homo Sapiens
CVIRMNYAP

SEQ ID NO: 1281832 - protein, 9 aa, Homo Sapiens
QTPALPVPG

SEQ ID NO: 1281833 - protein, 9 aa, Homo Sapiens
SLGGTPYCW

SEQ ID NO: 1281834 - protein, 9 aa, Homo Sapiens
GVCPYLGMT

SEQ ID NO: 1281835 - protein, 9 aa, Homo Sapiens
NFLALLCKG

SEQ ID NO: 1281836 - protein, 9 aa, Homo Sapiens
LEFLLPLGI

SEQ ID NO: 1281837 - protein, 9 aa, Homo Sapiens
PGLNKDGIE

SEQ ID NO: 1281838 - protein, 9 aa, Homo Sapiens
CNLKDDFEV

SEQ ID NO: 1281839 - protein, 9 aa, Homo Sapiens
QLQEQWKKS

SEQ ID NO: 1281840 - protein, 9 aa, Homo Sapiens
RDPLSEITK

SEQ ID NO: 1281841 - protein, 9 aa, Homo Sapiens
GFAPGLNKD

SEQ ID NO: 1281842 - protein, 9 aa, Homo Sapiens
QDSLDTCYS

SEQ ID NO: 1281843 - protein, 9 aa, Homo Sapiens
LLDGALKIS

SEQ ID NO: 1281844 - protein, 9 aa, Homo Sapiens
PVPLVIIVS

SEQ ID NO: 1281845 - protein, 9 aa, Homo Sapiens
TKEDEEHVP

SEQ ID NO: 1281846 - protein, 9 aa, Homo Sapiens
LASCSPYFR

SEQ ID NO: 1281847 - protein, 9 aa, Homo Sapiens
RVQFILGTK

SEQ ID NO: 1281848 - protein, 9 aa, Homo Sapiens
EAVYGRDGY

SEQ ID NO: 1281849 - protein, 9 aa, Homo Sapiens
WYKVMQFCW

SEQ ID NO: 1281850 - protein, 9 aa, Homo Sapiens
LMAAKVGVC

SEQ ID NO: 1281851 - protein, 9 aa, Homo Sapiens
KRQEEVCQS

SEQ ID NO: 1281852 - protein, 9 aa, Homo Sapiens
GIPEGGLLG

SEQ ID NO: 1281853 - protein, 9 aa, Homo Sapiens
HAVPAPSPG

SEQ ID NO: 1281854 - protein, 9 aa, Homo Sapiens
RFPDSFSMR

SEQ ID NO: 1281855 - protein, 9 aa, Homo Sapiens
PKDVAKVNE

SEQ ID NO: 1281856 - protein, 9 aa, Homo Sapiens
SEITKQEKD

SEQ ID NO: 1281857 - protein, 9 aa, Homo Sapiens
IYQFRGHHE

SEQ ID NO: 1281858 - protein, 9 aa, Homo Sapiens
QQLQEQWKK

SEQ ID NO: 1281859 - protein, 9 aa, Homo Sapiens
MLTVKEQLI

SEQ ID NO: 1281860 - protein, 9 aa, Homo Sapiens
AIGIPEGGL

SEQ ID NO: 1281861 - protein, 9 aa, Homo Sapiens
SVGAGAGKA

SEQ ID NO: 1281862 - protein, 9 aa, Homo Sapiens
EEVPEDKPA

SEQ ID NO: 1281863 - protein, 9 aa, Homo Sapiens
YRFGDATRT

SEQ ID NO: 1281864 - protein, 9 aa, Homo Sapiens
SLSYLKKCR

SEQ ID NO: 1281865 - protein, 9 aa, Homo Sapiens
HGQKHHAVP

SEQ ID NO: 1281866 - protein, 9 aa, Homo Sapiens
EGGCCWDVR

SEQ ID NO: 1281867 - protein, 9 aa, Homo Sapiens
RNSAGKSLS

SEQ ID NO: 1281868 - protein, 9 aa, Homo Sapiens
KVNEQLSSF

SEQ ID NO: 1281869 - protein, 9 aa, Homo Sapiens
FYRFLVRHK

SEQ ID NO: 1281870 - protein, 9 aa, Homo Sapiens
NYAPTRGYG

SEQ ID NO: 1281871 - protein, 9 aa, Homo Sapiens
NLKDDFEVF

SEQ ID NO: 1281872 - protein, 9 aa, Homo Sapiens
RGHHELIEY

SEQ ID NO: 1281873 - protein, 9 aa, Homo Sapiens
KNELLHPPL

SEQ ID NO: 1281874 - protein, 9 aa, Homo Sapiens
GREKIFPKH

SEQ ID NO: 1281875 - protein, 9 aa, Homo Sapiens
MCNSCCMGG

SEQ ID NO: 1281876 - protein, 9 aa, Homo Sapiens
PRDAEEAVY

SEQ ID NO: 1281877 - protein, 9 aa, Homo Sapiens
KFLAKQHTD

SEQ ID NO: 1281878 - protein, 9 aa, Homo Sapiens
KEDEEHVPH

SEQ ID NO: 1281879 - protein, 9 aa, Homo Sapiens
SVPVFYITH

SEQ ID NO: 1281880 - protein, 9 aa, Homo Sapiens
TFNIFSICR

SEQ ID NO: 1281881 - protein, 9 aa, Homo Sapiens
FMVFLFVYT

SEQ ID NO: 1281882 - protein, 9 aa, Homo Sapiens
NPSHYGFAP

SEQ ID NO: 1281883 - protein, 9 aa, Homo Sapiens
EEEEREHLQ

SEQ ID NO: 1281884 - protein, 9 aa, Homo Sapiens
RQAAQCGPE

SEQ ID NO: 1281885 - protein, 9 aa, Homo Sapiens
ELAPRELKA

SEQ ID NO: 1281886 - protein, 9 aa, Homo Sapiens
SCSPYFRAR

SEQ ID NO: 1281887 - protein, 9 aa, Homo Sapiens
KDHIQQFDD

SEQ ID NO: 1281888 - protein, 9 aa, Homo Sapiens
VVAGRGQSR

SEQ ID NO: 1281889 - protein, 9 aa, Homo Sapiens
DDEAMILWT

SEQ ID NO: 1281890 - protein, 9 aa, Homo Sapiens
FEVELPKNE

SEQ ID NO: 1281891 - protein, 9 aa, Homo Sapiens
LPSPARRLV

SEQ ID NO: 1281892 - protein, 9 aa, Homo Sapiens
FTPLPSPAR

SEQ ID NO: 1281893 - protein, 9 aa, Homo Sapiens
VQFILGTKE

SEQ ID NO: 1281894 - protein, 9 aa, Homo Sapiens
KNIIKLLGA

SEQ ID NO: 1281895 - protein, 9 aa, Homo Sapiens
TGREKIFPK

SEQ ID NO: 1281896 - protein, 9 aa, Homo Sapiens
RTGREKIFP

SEQ ID NO: 1281897 - protein, 9 aa, Homo Sapiens
RQEEVCQSV

SEQ ID NO: 1281898 - protein, 9 aa, Homo Sapiens
CCMGGMNRR

SEQ ID NO: 1281899 - protein, 9 aa, Homo Sapiens
RRARKTTKK

SEQ ID NO: 1281900 - protein, 9 aa, Homo Sapiens
YNYMCNSCC

SEQ ID NO: 1281901 - protein, 9 aa, Homo Sapiens
VFYITHQTP

SEQ ID NO: 1281902 - protein, 9 aa, Homo Sapiens
LPVPGQGFG

SEQ ID NO: 1281903 - protein, 9 aa, Homo Sapiens
ALLLLLKFL

SEQ ID NO: 1281904 - protein, 9 aa, Homo Sapiens
RRELRQAAQ

SEQ ID NO: 1281905 - protein, 9 aa, Homo Sapiens
KHHAVPAPS

SEQ ID NO: 1281906 - protein, 9 aa, Homo Sapiens
PPGKPERRP

SEQ ID NO: 1281907 - protein, 9 aa, Homo Sapiens
IPLRRARKT

SEQ ID NO: 1281908 - protein, 9 aa, Homo Sapiens
ADNQALRDI

SEQ ID NO: 1281909 - protein, 9 aa, Homo Sapiens
DSLDTCYST

SEQ ID NO: 1281910 - protein, 9 aa, Homo Sapiens
SLGVCPYLG

SEQ ID NO: 1281911 - protein, 9 aa, Homo Sapiens
AGAGKAALP

SEQ ID NO: 1281912 - protein, 9 aa, Homo Sapiens
GGTPYCWMT

SEQ ID NO: 1281913 - protein, 9 aa, Homo Sapiens
RRPPQGGNQ

SEQ ID NO: 1281914 - protein, 9 aa, Homo Sapiens
LDVVAGRGQ

SEQ ID NO: 1281915 - protein, 9 aa, Homo Sapiens
QNYPKQKEV

SEQ ID NO: 1281916 - protein, 9 aa, Homo Sapiens
LLLLLKFLA

SEQ ID NO: 1281917 - protein, 9 aa, Homo Sapiens
RREEEEREH

SEQ ID NO: 1281918 - protein, 9 aa, Homo Sapiens
RDAEEAVYG

SEQ ID NO: 1281919 - protein, 9 aa, Homo Sapiens
HHAVPAPSP

SEQ ID NO: 1281920 - protein, 9 aa, Homo Sapiens
RWYKVMQFC

SEQ ID NO: 1281921 - protein, 9 aa, Homo Sapiens
VCSCSLNKL

SEQ ID NO: 1281922 - protein, 9 aa, Homo Sapiens
RERFPDSFS

SEQ ID NO: 1281923 - protein, 9 aa, Homo Sapiens
RHERIHSAQ

SEQ ID NO: 1281924 - protein, 9 aa, Homo Sapiens
NSCCMGGMN

SEQ ID NO: 1281925 - protein, 9 aa, Homo Sapiens
IGALLQQLQ

SEQ ID NO: 1281926 - protein, 9 aa, Homo Sapiens
PVPGQGFGP

SEQ ID NO: 1281927 - protein, 9 aa, Homo Sapiens
RLVLASCSP

SEQ ID NO: 1281928 - protein, 9 aa, Homo Sapiens
PLFMVFLFV

SEQ ID NO: 1281929 - protein, 9 aa, Homo Sapiens
EGQNFEQTP

SEQ ID NO: 1281930 - protein, 9 aa, Homo Sapiens
IIRGKTCSR

SEQ ID NO: 1281931 - protein, 9 aa, Homo Sapiens
KKGRPKADN

SEQ ID NO: 1281932 - protein, 9 aa, Homo Sapiens
FISSTTEGQ

SEQ ID NO: 1281933 - protein, 9 aa, Homo Sapiens
QAAQCGPEP

SEQ ID NO: 1281934 - protein, 9 aa, Homo Sapiens
DEAMILWTH

SEQ ID NO: 1281935 - protein, 9 aa, Homo Sapiens
DLDVVAGRG

SEQ ID NO: 1281936 - protein, 9 aa, Homo Sapiens
FSLGVCPYL

SEQ ID NO: 1281937 - protein, 9 aa, Homo Sapiens
LSYLKKCRR

SEQ ID NO: 1281938 - protein, 9 aa, Homo Sapiens
LPLDNISDR

SEQ ID NO: 1281939 - protein, 9 aa, Homo Sapiens
RGKTCSRRV

SEQ ID NO: 1281940 - protein, 9 aa, Homo Sapiens
GALKISAKD

SEQ ID NO: 1281941 - protein, 9 aa, Homo Sapiens
KADLFCDGK

SEQ ID NO: 1281942 - protein, 9 aa, Homo Sapiens
FCDGKVNCP

SEQ ID NO: 1281943 - protein, 9 aa, Homo Sapiens
KAALPLPGL

SEQ ID NO: 1281944 - protein, 9 aa, Homo Sapiens
FLVRHKTER

SEQ ID NO: 1281945 - protein, 9 aa, Homo Sapiens
LTLSDRWYK

SEQ ID NO: 1281946 - protein, 9 aa, Homo Sapiens
GISGTVHVC

SEQ ID NO: 1281947 - protein, 9 aa, Homo Sapiens
DDIPLRRAR

SEQ ID NO: 1281948 - protein, 9 aa, Homo Sapiens
EFLLPLGII

SEQ ID NO: 1281949 - protein, 9 aa, Homo Sapiens
VPVFYITHQ

SEQ ID NO: 1281950 - protein, 9 aa, Homo Sapiens
VGAGAGKAA

SEQ ID NO: 1281951 - protein, 9 aa, Homo Sapiens
VIRMNYAPT

SEQ ID NO: 1281952 - protein, 9 aa, Homo Sapiens
QVPPQQPQQ

SEQ ID NO: 1281953 - protein, 9 aa, Homo Sapiens
LSVSYCSSN

SEQ ID NO: 1281954 - protein, 9 aa, Homo Sapiens
IIVSKYDVF

SEQ ID NO: 1281955 - protein, 9 aa, Homo Sapiens
HLIYQFRGH

SEQ ID NO: 1281956 - protein, 9 aa, Homo Sapiens
LRRARKTTK

SEQ ID NO: 1281957 - protein, 9 aa, Homo Sapiens
GKTCSRRVK

SEQ ID NO: 1281958 - protein, 9 aa, Homo Sapiens
SGPSEAIGI

SEQ ID NO: 1281959 - protein, 9 aa, Homo Sapiens
LQQLQEQWK

SEQ ID NO: 1281960 - protein, 9 aa, Homo Sapiens
HYNYMCNSC

SEQ ID NO: 1281961 - protein, 9 aa, Homo Sapiens
TCYSTPSGY

SEQ ID NO: 1281962 - protein, 9 aa, Homo Sapiens
GTVHVCNVA

SEQ ID NO: 1281963 - protein, 9 aa, Homo Sapiens
VSPCILSVS

SEQ ID NO: 1281964 - protein, 9 aa, Homo Sapiens
DCPVCSCSL

SEQ ID NO: 1281965 - protein, 9 aa, Homo Sapiens
LLKFLAKQH

SEQ ID NO: 1281966 - protein, 9 aa, Homo Sapiens
FEVFFFTIG

SEQ ID NO: 1281967 - protein, 9 aa, Homo Sapiens
GKSLSYLKK

SEQ ID NO: 1281968 - protein, 9 aa, Homo Sapiens
CSVPVFYIT

SEQ ID NO: 1281969 - protein, 9 aa, Homo Sapiens
MNYAPTRGY

SEQ ID NO: 1281970 - protein, 9 aa, Homo Sapiens
HAGRWEPGD

SEQ ID NO: 1281971 - protein, 9 aa, Homo Sapiens
LLCKGVPQT

SEQ ID NO: 1281972 - protein, 9 aa, Homo Sapiens
LSLPFDKDY

SEQ ID NO: 1281973 - protein, 9 aa, Homo Sapiens
LGISGTVHV

SEQ ID NO: 1281974 - protein, 9 aa, Homo Sapiens
RMNYAPTRG

SEQ ID NO: 1281975 - protein, 9 aa, Homo Sapiens
GRGQSRAET

SEQ ID NO: 1281976 - protein, 9 aa, Homo Sapiens
VSKYDVFQD

SEQ ID NO: 1281977 - protein, 9 aa, Homo Sapiens
DMFSVLCEL

SEQ ID NO: 1281978 - protein, 9 aa, Homo Sapiens
HPKDVAKVN

SEQ ID NO: 1281979 - protein, 9 aa, Homo Sapiens
PLDNISDRR

SEQ ID NO: 1281980 - protein, 9 aa, Homo Sapiens
DKDYIIEIK

SEQ ID NO: 1281981 - protein, 9 aa, Homo Sapiens
GQNFEQTPL

SEQ ID NO: 1281982 - protein, 9 aa, Homo Sapiens
ELPKNELLH

SEQ ID NO: 1281983 - protein, 9 aa, Homo Sapiens
LCELAPREL

SEQ ID NO: 1281984 - protein, 9 aa, Homo Sapiens
CRFINSQFV

SEQ ID NO: 1281985 - protein, 9 aa, Homo Sapiens
PQFTPLPSP

SEQ ID NO: 1281986 - protein, 9 aa, Homo Sapiens
GKHKNIIKL

SEQ ID NO: 1281987 - protein, 9 aa, Homo Sapiens
LSEITKQEK

SEQ ID NO: 1281988 - protein, 9 aa, Homo Sapiens
HSAQKPYEC

SEQ ID NO: 1281989 - protein, 9 aa, Homo Sapiens
DNISDRRES

SEQ ID NO: 1281990 - protein, 9 aa, Homo Sapiens
RGQSRAETW

SEQ ID NO: 1281991 - protein, 9 aa, Homo Sapiens
IVVSPCILS

SEQ ID NO: 1281992 - protein, 9 aa, Homo Sapiens
IQVPLFMVF

SEQ ID NO: 1281993 - protein, 9 aa, Homo Sapiens
GALLQQLQE

SEQ ID NO: 1281994 - protein, 9 aa, Homo Sapiens
EDKPAEVSA

SEQ ID NO: 1281995 - protein, 9 aa, Homo Sapiens
DFNTSFSGV

SEQ ID NO: 1281996 - protein, 9 aa, Homo Sapiens
YKVMQFCWL

SEQ ID NO: 1281997 - protein, 9 aa, Homo Sapiens
EHLQKEEEK

SEQ ID NO: 1281998 - protein, 9 aa, Homo Sapiens
FRGHHELIE

SEQ ID NO: 1281999 - protein, 9 aa, Homo Sapiens
LDGALKISA

SEQ ID NO: 1282000 - protein, 9 aa, Homo Sapiens
LEICYKDHI

SEQ ID NO: 1282001 - protein, 9 aa, Homo Sapiens
LGTKEDEEH

SEQ ID NO: 1282002 - protein, 9 aa, Homo Sapiens
ISLLFHNEG

SEQ ID NO: 1282003 - protein, 9 aa, Homo Sapiens
RRCDHAGRW

SEQ ID NO: 1282004 - protein, 9 aa, Homo Sapiens
RIHSAQKPY

SEQ ID NO: 1282005 - protein, 9 aa, Homo Sapiens
VYRRVLAAL

SEQ ID NO: 1282006 - protein, 9 aa, Homo Sapiens
CPYLGMTNQ

SEQ ID NO: 1282007 - protein, 9 aa, Homo Sapiens
VCQSVTPAE

SEQ ID NO: 1282008 - protein, 9 aa, Homo Sapiens
GKPERRPPQ

SEQ ID NO: 1282009 - protein, 9 aa, Homo Sapiens
EGRLFLRGG

SEQ ID NO: 1282010 - protein, 9 aa, Homo Sapiens
VLQDSLDTC

SEQ ID NO: 1282011 - protein, 9 aa, Homo Sapiens
TVHVCNVAF

SEQ ID NO: 1282012 - protein, 9 aa, Homo Sapiens
FPDSFSMRR

SEQ ID NO: 1282013 - protein, 9 aa, Homo Sapiens
HKNIIKLLG

SEQ ID NO: 1282014 - protein, 9 aa, Homo Sapiens
DPRDAEEAV

SEQ ID NO: 1282015 - protein, 9 aa, Homo Sapiens
SAHGQKHHA

SEQ ID NO: 1282016 - protein, 9 aa, Homo Sapiens
HLGVYRRVL

SEQ ID NO: 1282017 - protein, 9 aa, Homo Sapiens
LVLASCSPY

SEQ ID NO: 1282018 - protein, 9 aa, Homo Sapiens
PALPVPGQG

SEQ ID NO: 1282019 - protein, 9 aa, Homo Sapiens
ILWTHENFE

SEQ ID NO: 1282020 - protein, 9 aa, Homo Sapiens
IVSKYDVFQ

SEQ ID NO: 1282021 - protein, 9 aa, Homo Sapiens
WEHLIYQFR

SEQ ID NO: 1282022 - protein, 9 aa, Homo Sapiens
EPVDIIRGK

SEQ ID NO: 1282023 - protein, 9 aa, Homo Sapiens
TPQFTPLPS

SEQ ID NO: 1282024 - protein, 9 aa, Homo Sapiens
YAPTRGYGR

SEQ ID NO: 1282025 - protein, 9 aa, Homo Sapiens
TIHFYRFLV

SEQ ID NO: 1282026 - protein, 9 aa, Homo Sapiens
VPLFMVFLF

SEQ ID NO: 1282027 - protein, 9 aa, Homo Sapiens
PAGASADFN

SEQ ID NO: 1282028 - protein, 9 aa, Homo Sapiens
LPKNELLHP

SEQ ID NO: 1282029 - protein, 9 aa, Homo Sapiens
PLSEITKQE

SEQ ID NO: 1282030 - protein, 9 aa, Homo Sapiens
TYVQLAQNY

SEQ ID NO: 1282031 - protein, 9 aa, Homo Sapiens
FEDPRDAEE

SEQ ID NO: 1282032 - protein, 9 aa, Homo Sapiens
VAKVNEQLS

SEQ ID NO: 1282033 - protein, 9 aa, Homo Sapiens
NEQLSSFDI

SEQ ID NO: 1282034 - protein, 9 aa, Homo Sapiens
AQKPYECKE

SEQ ID NO: 1282035 - protein, 9 aa, Homo Sapiens
EEVCQSVTP

SEQ ID NO: 1282036 - protein, 9 aa, Homo Sapiens
NIFSICRFI

SEQ ID NO: 1282037 - protein, 9 aa, Homo Sapiens
ERIHSAQKP

SEQ ID NO: 1282038 - protein, 9 aa, Homo Sapiens
ICYKDHIQQ

SEQ ID NO: 1282039 - protein, 9 aa, Homo Sapiens
ELRQAAQCG

SEQ ID NO: 1282040 - protein, 9 aa, Homo Sapiens
SDRWYKVMQ

SEQ ID NO: 1282041 - protein, 9 aa, Homo Sapiens
KVGVCMLMT

SEQ ID NO: 1282042 - protein, 9 aa, Homo Sapiens
QFTPLPSPA

SEQ ID NO: 1282043 - protein, 9 aa, Homo Sapiens
FILGTKEDE

SEQ ID NO: 1282044 - protein, 9 aa, Homo Sapiens
SLDTCYSTP

SEQ ID NO: 1282045 - protein, 9 aa, Homo Sapiens
FGDATRTPQ

SEQ ID NO: 1282046 - protein, 9 aa, Homo Sapiens
YKDHIQQFD

SEQ ID NO: 1282047 - protein, 9 aa, Homo Sapiens
AQCGPEPGV

SEQ ID NO: 1282048 - protein, 9 aa, Homo Sapiens
VPLVIIVSK

SEQ ID NO: 1282049 - protein, 9 aa, Homo Sapiens
IHSAQKPYE

SEQ ID NO: 1282050 - protein, 9 aa, Homo Sapiens
NTYVQLAQN

SEQ ID NO: 1282051 - protein, 9 aa, Homo Sapiens
AGFNTKEVI

SEQ ID NO: 1282052 - protein, 9 aa, Homo Sapiens
EIQVPLFMV

SEQ ID NO: 1282053 - protein, 9 aa, Homo Sapiens
ANFLALLCK

SEQ ID NO: 1282054 - protein, 9 aa, Homo Sapiens
GKAALPLPG

SEQ ID NO: 1282055 - protein, 9 aa, Homo Sapiens
CYKDHIQQF

SEQ ID NO: 1282056 - protein, 9 aa, Homo Sapiens
GVYRRVLAA

SEQ ID NO: 1282057 - protein, 9 aa, Homo Sapiens
ASQTPSVIP

SEQ ID NO: 1282058 - protein, 9 aa, Homo Sapiens
CDGKVNCPD

SEQ ID NO: 1282059 - protein, 9 aa, Homo Sapiens
LQDSLDTCY

SEQ ID NO: 1282060 - protein, 9 aa, Homo Sapiens
NSAGKSLSY

SEQ ID NO: 1282061 - protein, 9 aa, Homo Sapiens
IKLLGACTQ

SEQ ID NO: 1282062 - protein, 9 aa, Homo Sapiens
AARCLPWPR

SEQ ID NO: 1282063 - protein, 9 aa, Homo Sapiens
VHRKIAEKD

SEQ ID NO: 1282064 - protein, 9 aa, Homo Sapiens
PRATILNSS

SEQ ID NO: 1282065 - protein, 9 aa, Homo Sapiens
QVKSEVHRK

SEQ ID NO: 1282066 - protein, 9 aa, Homo Sapiens
KLVVVGAGC

SEQ ID NO: 1282067 - protein, 9 aa, Homo Sapiens
GLQLHPAGC

SEQ ID NO: 1282068 - protein, 9 aa, Homo Sapiens
AVDSPSQNL

SEQ ID NO: 1282069 - protein, 9 aa, Homo Sapiens
TNHGCWTSR

SEQ ID NO: 1282070 - protein, 9 aa, Homo Sapiens
LEFYGEVRT

SEQ ID NO: 1282071 - protein, 9 aa, Homo Sapiens
HNGELSKML

SEQ ID NO: 1282072 - protein, 9 aa, Homo Sapiens
ARCLPWPRW

SEQ ID NO: 1282073 - protein, 9 aa, Homo Sapiens
LACTATDVR

SEQ ID NO: 1282074 - protein, 9 aa, Homo Sapiens
GTYAVTYGP

SEQ ID NO: 1282075 - protein, 9 aa, Homo Sapiens
QKPSFFFFS

SEQ ID NO: 1282076 - protein, 9 aa, Homo Sapiens
LYLTPSPDV

SEQ ID NO: 1282077 - protein, 9 aa, Homo Sapiens
IPSRFQLNL

SEQ ID NO: 1282078 - protein, 9 aa, Homo Sapiens
GFTFMPIAQ

SEQ ID NO: 1282079 - protein, 9 aa, Homo Sapiens
LNQVKSEVH

SEQ ID NO: 1282080 - protein, 9 aa, Homo Sapiens
TAPFLSGKG

SEQ ID NO: 1282081 - protein, 9 aa, Homo Sapiens
RFSPVRQFS

SEQ ID NO: 1282082 - protein, 9 aa, Homo Sapiens
QGDLWELPF

SEQ ID NO: 1282083 - protein, 9 aa, Homo Sapiens
YYYKYPYYE

SEQ ID NO: 1282084 - protein, 9 aa, Homo Sapiens
LQHQLEAVR

SEQ ID NO: 1282085 - protein, 9 aa, Homo Sapiens
TYGPLTAGM

SEQ ID NO: 1282086 - protein, 9 aa, Homo Sapiens
AQEALEFYG

SEQ ID NO: 1282087 - protein, 9 aa, Homo Sapiens
SLWVEFTTA

SEQ ID NO: 1282088 - protein, 9 aa, Homo Sapiens
TAEEQNSPR

SEQ ID NO: 1282089 - protein, 9 aa, Homo Sapiens
QSSSFSSHL

SEQ ID NO: 1282090 - protein, 9 aa, Homo Sapiens
DMMRRAAAR

SEQ ID NO: 1282091 - protein, 9 aa, Homo Sapiens
ELQGDLWEL

SEQ ID NO: 1282092 - protein, 9 aa, Homo Sapiens
GPFNCTAWT

SEQ ID NO: 1282093 - protein, 9 aa, Homo Sapiens
KAALQHQLE

SEQ ID NO: 1282094 - protein, 9 aa, Homo Sapiens
TRTLPGDRF

SEQ ID NO: 1282095 - protein, 9 aa, Homo Sapiens
SSSFSSHLK

SEQ ID NO: 1282096 - protein, 9 aa, Homo Sapiens
PSRFQLNLD

SEQ ID NO: 1282097 - protein, 9 aa, Homo Sapiens
KSEVHRKIA

SEQ ID NO: 1282098 - protein, 9 aa, Homo Sapiens
QVATAEEQN

SEQ ID NO: 1282099 - protein, 9 aa, Homo Sapiens
VDLACTATD

SEQ ID NO: 1282100 - protein, 9 aa, Homo Sapiens
FIHSRPPLK

SEQ ID NO: 1282101 - protein, 9 aa, Homo Sapiens
YGPLTAGMY

SEQ ID NO: 1282102 - protein, 9 aa, Homo Sapiens
LHPAGCGTA

SEQ ID NO: 1282103 - protein, 9 aa, Homo Sapiens
EFTTASGYL

SEQ ID NO: 1282104 - protein, 9 aa, Homo Sapiens
FFRWSLTLL

SEQ ID NO: 1282105 - protein, 9 aa, Homo Sapiens
RGKTRLYSP

SEQ ID NO: 1282106 - protein, 9 aa, Homo Sapiens
GSRDGIVAL

SEQ ID NO: 1282107 - protein, 9 aa, Homo Sapiens
AVSGSRDGI

SEQ ID NO: 1282108 - protein, 9 aa, Homo Sapiens
RVMAVSDGE

SEQ ID NO: 1282109 - protein, 9 aa, Homo Sapiens
GATTTAPFL

SEQ ID NO: 1282110 - protein, 9 aa, Homo Sapiens
VEFTTASGY

SEQ ID NO: 1282111 - protein, 9 aa, Homo Sapiens
PSAPGLRLP

SEQ ID NO: 1282112 - protein, 9 aa, Homo Sapiens
TQSLLCTNH

SEQ ID NO: 1282113 - protein, 9 aa, Homo Sapiens
IRYTRTLPG

SEQ ID NO: 1282114 - protein, 9 aa, Homo Sapiens
APGLRLPAS

SEQ ID NO: 1282115 - protein, 9 aa, Homo Sapiens
KRSCGSGTR

SEQ ID NO: 1282116 - protein, 9 aa, Homo Sapiens
KTQDHLRQQ

SEQ ID NO: 1282117 - protein, 9 aa, Homo Sapiens
NPDGFTFMP

SEQ ID NO: 1282118 - protein, 9 aa, Homo Sapiens
GAGCVGKSA

SEQ ID NO: 1282119 - protein, 9 aa, Homo Sapiens
ALPPELQGD

SEQ ID NO: 1282120 - protein, 9 aa, Homo Sapiens
QKRSCGSGT

SEQ ID NO: 1282121 - protein, 9 aa, Homo Sapiens
VTHLYLTPS

SEQ ID NO: 1282122 - protein, 9 aa, Homo Sapiens
ETYYYKYPY

SEQ ID NO: 1282123 - protein, 9 aa, Homo Sapiens
EVHRKIAEK

SEQ ID NO: 1282124 - protein, 9 aa, Homo Sapiens
EQHKAALQH

SEQ ID NO: 1282125 - protein, 9 aa, Homo Sapiens
SLFEGMWYL

SEQ ID NO: 1282126 - protein, 9 aa, Homo Sapiens
PKTQDHLRQ

SEQ ID NO: 1282127 - protein, 9 aa, Homo Sapiens
PVTHLYLTP

SEQ ID NO: 1282128 - protein, 9 aa, Homo Sapiens
RDGIVALWR

SEQ ID NO: 1282129 - protein, 9 aa, Homo Sapiens
RQIPSRFQL

SEQ ID NO: 1282130 - protein, 9 aa, Homo Sapiens
SMSLWVEFT

SEQ ID NO: 1282131 - protein, 9 aa, Homo Sapiens
YKYPYYEDP

SEQ ID NO: 1282132 - protein, 9 aa, Homo Sapiens
FFFFFRWSL

SEQ ID NO: 1282133 - protein, 9 aa, Homo Sapiens
CTAWTYHSQ

SEQ ID NO: 1282134 - protein, 9 aa, Homo Sapiens
SKGTLLQTK

SEQ ID NO: 1282135 - protein, 9 aa, Homo Sapiens
ACTATDVRD

SEQ ID NO: 1282136 - protein, 9 aa, Homo Sapiens
SPKRQIPSR

SEQ ID NO: 1282137 - protein, 9 aa, Homo Sapiens
PELQGDLWE

SEQ ID NO: 1282138 - protein, 9 aa, Homo Sapiens
GMWYLVRVD

SEQ ID NO: 1282139 - protein, 9 aa, Homo Sapiens
KYPYYEDPE

SEQ ID NO: 1282140 - protein, 9 aa, Homo Sapiens
FSPVRQFSD

SEQ ID NO: 1282141 - protein, 9 aa, Homo Sapiens
QFSDGAASI

SEQ ID NO: 1282142 - protein, 9 aa, Homo Sapiens
SFSSHLKVH

SEQ ID NO: 1282143 - protein, 9 aa, Homo Sapiens
DLACTATDV

SEQ ID NO: 1282144 - protein, 9 aa, Homo Sapiens
FFFRWSLTL

SEQ ID NO: 1282145 - protein, 9 aa, Homo Sapiens
VMAVSDGET

SEQ ID NO: 1282146 - protein, 9 aa, Homo Sapiens
PPELQGDLW

SEQ ID NO: 1282147 - protein, 9 aa, Homo Sapiens
CLPWPRWTR

SEQ ID NO: 1282148 - protein, 9 aa, Homo Sapiens
VVGAGCVGK

SEQ ID NO: 1282149 - protein, 9 aa, Homo Sapiens
ATILNSSPS

SEQ ID NO: 1282150 - protein, 9 aa, Homo Sapiens
ISPKRQIPS

SEQ ID NO: 1282151 - protein, 9 aa, Homo Sapiens
PDGFTFMPI

SEQ ID NO: 1282152 - protein, 9 aa, Homo Sapiens
RQFSDGAAS

SEQ ID NO: 1282153 - protein, 9 aa, Homo Sapiens
YAVTYGPLT

SEQ ID NO: 1282154 - protein, 9 aa, Homo Sapiens
LILDFIHSR

SEQ ID NO: 1282155 - protein, 9 aa, Homo Sapiens
GKTRLYSPS

SEQ ID NO: 1282156 - protein, 9 aa, Homo Sapiens
LPQNPDGFT

SEQ ID NO: 1282157 - protein, 9 aa, Homo Sapiens
RCLPWPRWT

SEQ ID NO: 1282158 - protein, 9 aa, Homo Sapiens
SLILSIRYT

SEQ ID NO: 1282159 - protein, 9 aa, Homo Sapiens
EGLQLHPAG

SEQ ID NO: 1282160 - protein, 9 aa, Homo Sapiens
EITKQEKDF

SEQ ID NO: 1282161 - protein, 9 aa, Homo Sapiens
LPLLLEKLS

SEQ ID NO: 1282162 - protein, 9 aa, Homo Sapiens
LQGDLWELP

SEQ ID NO: 1282163 - protein, 9 aa, Homo Sapiens
ISQGGIHGH

SEQ ID NO: 1282164 - protein, 9 aa, Homo Sapiens
DLHNGELSK

SEQ ID NO: 1282165 - protein, 9 aa, Homo Sapiens
KQEKDFLWS

SEQ ID NO: 1282166 - protein, 9 aa, Homo Sapiens
LHNGELSKM

SEQ ID NO: 1282167 - protein, 9 aa, Homo Sapiens
ALEFYGEVR

SEQ ID NO: 1282168 - protein, 9 aa, Homo Sapiens
HKAALQHQL

SEQ ID NO: 1282169 - protein, 9 aa, Homo Sapiens
QQNPDLHNG

SEQ ID NO: 1282170 - protein, 9 aa, Homo Sapiens
SQGGIHGHI

SEQ ID NO: 1282171 - protein, 9 aa, Homo Sapiens
ATDVRDVDI

SEQ ID NO: 1282172 - protein, 9 aa, Homo Sapiens
EEQNSPRVL

SEQ ID NO: 1282173 - protein, 9 aa, Homo Sapiens
GEGETYYYK

SEQ ID NO: 1282174 - protein, 9 aa, Homo Sapiens
RTTQSLLCT

SEQ ID NO: 1282175 - protein, 9 aa, Homo Sapiens
TKQEKDFLW

SEQ ID NO: 1282176 - protein, 9 aa, Homo Sapiens
IVALWRMDP

SEQ ID NO: 1282177 - protein, 9 aa, Homo Sapiens
HELILDFIH

SEQ ID NO: 1282178 - protein, 9 aa, Homo Sapiens
RYTRTLPGD

SEQ ID NO: 1282179 - protein, 9 aa, Homo Sapiens
LWVEFTTAS

SEQ ID NO: 1282180 - protein, 9 aa, Homo Sapiens
RWTRTTQSL

SEQ ID NO: 1282181 - protein, 9 aa, Homo Sapiens
ATTTAPFLS

SEQ ID NO: 1282182 - protein, 9 aa, Homo Sapiens
PKRQIPSRF

SEQ ID NO: 1282183 - protein, 9 aa, Homo Sapiens
YLCIPAVDS

SEQ ID NO: 1282184 - protein, 9 aa, Homo Sapiens
VVVRGKTRL

SEQ ID NO: 1282185 - protein, 9 aa, Homo Sapiens
LCIPAVDSP

SEQ ID NO: 1282186 - protein, 9 aa, Homo Sapiens
KTRLYSPSG

SEQ ID NO: 1282187 - protein, 9 aa, Homo Sapiens
HSRPPLKQV

SEQ ID NO: 1282188 - protein, 9 aa, Homo Sapiens
MWYLVRVDE

SEQ ID NO: 1282189 - protein, 9 aa, Homo Sapiens
ALQHQLEAV

SEQ ID NO: 1282190 - protein, 9 aa, Homo Sapiens
LQLHPAGCG

SEQ ID NO: 1282191 - protein, 9 aa, Homo Sapiens
GHISATGRG

SEQ ID NO: 1282192 - protein, 9 aa, Homo Sapiens
TYAVTYGPL

SEQ ID NO: 1282193 - protein, 9 aa, Homo Sapiens
PDLHNGELS

SEQ ID NO: 1282194 - protein, 9 aa, Homo Sapiens
RLPASSPKR

SEQ ID NO: 1282195 - protein, 9 aa, Homo Sapiens
PSFFFFSRP

SEQ ID NO: 1282196 - protein, 9 aa, Homo Sapiens
WPRWTRTTQ

SEQ ID NO: 1282197 - protein, 9 aa, Homo Sapiens
LPASSPKRN

SEQ ID NO: 1282198 - protein, 9 aa, Homo Sapiens
CIPAVDSPS

SEQ ID NO: 1282199 - protein, 9 aa, Homo Sapiens
RATILNSSP

SEQ ID NO: 1282200 - protein, 9 aa, Homo Sapiens
PQNPDGFTF

SEQ ID NO: 1282201 - protein, 9 aa, Homo Sapiens
THLYLTPSP

SEQ ID NO: 1282202 - protein, 9 aa, Homo Sapiens
TQDHLRQQR

SEQ ID NO: 1282203 - protein, 9 aa, Homo Sapiens
NHGCWTSRY

SEQ ID NO: 1282204 - protein, 9 aa, Homo Sapiens
LEKLPLLLE

SEQ ID NO: 1282205 - protein, 9 aa, Homo Sapiens
CTNHGCWTS

SEQ ID NO: 1282206 - protein, 9 aa, Homo Sapiens
FSSHLKVHT

SEQ ID NO: 1282207 - protein, 9 aa, Homo Sapiens
KLPLLLEKL

SEQ ID NO: 1282208 - protein, 9 aa, Homo Sapiens
LRLPASSPK

SEQ ID NO: 1282209 - protein, 9 aa, Homo Sapiens
VDSPSQNLT

SEQ ID NO: 1282210 - protein, 9 aa, Homo Sapiens
QDHLRQQRA

SEQ ID NO: 1282211 - protein, 9 aa, Homo Sapiens
ILDFIHSRP

SEQ ID NO: 1282212 - protein, 9 aa, Homo Sapiens
AFTTQKRSC

SEQ ID NO: 1282213 - protein, 9 aa, Homo Sapiens
RIAFTTQKR

SEQ ID NO: 1282214 - protein, 9 aa, Homo Sapiens
TATDVRDVD

SEQ ID NO: 1282215 - protein, 9 aa, Homo Sapiens
PFNCTAWTY

SEQ ID NO: 1282216 - protein, 9 aa, Homo Sapiens
PRWTRTTQS

SEQ ID NO: 1282217 - protein, 9 aa, Homo Sapiens
LFEGMWYLV

SEQ ID NO: 1282218 - protein, 9 aa, Homo Sapiens
AGCVGKSAL

SEQ ID NO: 1282219 - protein, 9 aa, Homo Sapiens
PPLEKLPLL

SEQ ID NO: 1282220 - protein, 9 aa, Homo Sapiens
QNPDLHNGE

SEQ ID NO: 1282221 - protein, 9 aa, Homo Sapiens
SLVSKGTLL

SEQ ID NO: 1282222 - protein, 9 aa, Homo Sapiens
RRAAARCLP

SEQ ID NO: 1282223 - protein, 9 aa, Homo Sapiens
RQVATAEEQ

SEQ ID NO: 1282224 - protein, 9 aa, Homo Sapiens
PPRATILNS

SEQ ID NO: 1282225 - protein, 9 aa, Homo Sapiens
GCVGKSALT

SEQ ID NO: 1282226 - protein, 9 aa, Homo Sapiens
PEGLQLHPA

SEQ ID NO: 1282227 - protein, 9 aa, Homo Sapiens
IDSLFEGMW

SEQ ID NO: 1282228 - protein, 9 aa, Homo Sapiens
IHSRPPLKQ

SEQ ID NO: 1282229 - protein, 9 aa, Homo Sapiens
WVEFTTASG

SEQ ID NO: 1282230 - protein, 9 aa, Homo Sapiens
NLFFFFFFF

SEQ ID NO: 1282231 - protein, 9 aa, Homo Sapiens
SIRYTRTLP

SEQ ID NO: 1282232 - protein, 9 aa, Homo Sapiens
EEARVMAVS

SEQ ID NO: 1282233 - protein, 9 aa, Homo Sapiens
TTQKRSCGS

SEQ ID NO: 1282234 - protein, 9 aa, Homo Sapiens
VDMMRRAAA

SEQ ID NO: 1282235 - protein, 9 aa, Homo Sapiens
FRWSLTLLP

SEQ ID NO: 1282236 - protein, 9 aa, Homo Sapiens
NPDLHNGEL

SEQ ID NO: 1282237 - protein, 9 aa, Homo Sapiens
FFFSRPSPK

SEQ ID NO: 1282238 - protein, 9 aa, Homo Sapiens
QSLLCTNHG

SEQ ID NO: 1282239 - protein, 9 aa, Homo Sapiens
ITKQEKDFL

SEQ ID NO: 1282240 - protein, 9 aa, Homo Sapiens
MMRRAAARC

SEQ ID NO: 1282241 - protein, 9 aa, Homo Sapiens
MAVSDGETK

SEQ ID NO: 1282242 - protein, 9 aa, Homo Sapiens
LRIAFTTQK

SEQ ID NO: 1282243 - protein, 9 aa, Homo Sapiens
APFLSGKGN

SEQ ID NO: 1282244 - protein, 9 aa, Homo Sapiens
FTTASGYLS

SEQ ID NO: 1282245 - protein, 9 aa, Homo Sapiens
FNCTAWTYH

SEQ ID NO: 1282246 - protein, 9 aa, Homo Sapiens
ILSIRYTRT

SEQ ID NO: 1282247 - protein, 9 aa, Homo Sapiens
LRQQRASAR

SEQ ID NO: 1282248 - protein, 9 aa, Homo Sapiens
SGSRDGIVA

SEQ ID NO: 1282249 - protein, 9 aa, Homo Sapiens
YLTPSPDVP

SEQ ID NO: 1282250 - protein, 9 aa, Homo Sapiens
IHGHISATG

SEQ ID NO: 1282251 - protein, 9 aa, Homo Sapiens
YYKYPYYED

SEQ ID NO: 1282252 - protein, 9 aa, Homo Sapiens
GPLTAGMYT

SEQ ID NO: 1282253 - protein, 9 aa, Homo Sapiens
TYYYKYPYY

SEQ ID NO: 1282254 - protein, 9 aa, Homo Sapiens
SPKTQDHLR

SEQ ID NO: 1282255 - protein, 9 aa, Homo Sapiens
QLPFGPFNC

SEQ ID NO: 1282256 - protein, 9 aa, Homo Sapiens
QHQLEAVRG

SEQ ID NO: 1282257 - protein, 9 aa, Homo Sapiens
VGAGCVGKS

SEQ ID NO: 1282258 - protein, 9 aa, Homo Sapiens
GETYYYKYP

SEQ ID NO: 1282259 - protein, 9 aa, Homo Sapiens
QEALEFYGE

SEQ ID NO: 1282260 - protein, 9 aa, Homo Sapiens
ILNSSPSIR

SEQ ID NO: 1282261 - protein, 9 aa, Homo Sapiens
VRGKTRLYS

SEQ ID NO: 1282262 - protein, 9 aa, Homo Sapiens
TTASGYLSA

SEQ ID NO: 1282263 - protein, 9 aa, Homo Sapiens
VVVGAGCVG

SEQ ID NO: 1282264 - protein, 9 aa, Homo Sapiens
SRDGIVALW

SEQ ID NO: 1282265 - protein, 9 aa, Homo Sapiens
SAPGLRLPA

SEQ ID NO: 1282266 - protein, 9 aa, Homo Sapiens
GIVALWRMD

SEQ ID NO: 1282267 - protein, 9 aa, Homo Sapiens
TRTTQSLLC

SEQ ID NO: 1282268 - protein, 9 aa, Homo Sapiens
VVRGKTRLY

SEQ ID NO: 1282269 - protein, 9 aa, Homo Sapiens
VSKGTLLQT

SEQ ID NO: 1282270 - protein, 9 aa, Homo Sapiens
DGTYAVTYG

SEQ ID NO: 1282271 - protein, 9 aa, Homo Sapiens
EARVMAVSD

SEQ ID NO: 1282272 - protein, 9 aa, Homo Sapiens
IQPPRATIL

SEQ ID NO: 1282273 - protein, 9 aa, Homo Sapiens
LISPKRQIP

SEQ ID NO: 1282274 - protein, 9 aa, Homo Sapiens
LKVHTGERP

SEQ ID NO: 1282275 - protein, 9 aa, Homo Sapiens
LILSIRYTR

SEQ ID NO: 1282276 - protein, 9 aa, Homo Sapiens
IAFTTQKRS

SEQ ID NO: 1282277 - protein, 9 aa, Homo Sapiens
SEVHRKIAE

SEQ ID NO: 1282278 - protein, 9 aa, Homo Sapiens
FFSRPSPKT

SEQ ID NO: 1282279 - protein, 9 aa, Homo Sapiens
QLHPAGCGT

SEQ ID NO: 1282280 - protein, 9 aa, Homo Sapiens
KAQEALEFY

SEQ ID NO: 1282281 - protein, 9 aa, Homo Sapiens
HPAGCGTAF

SEQ ID NO: 1282282 - protein, 9 aa, Homo Sapiens
VATAEEQNS

SEQ ID NO: 1282283 - protein, 9 aa, Homo Sapiens
DPLSEITKQ

SEQ ID NO: 1282284 - protein, 9 aa, Homo Sapiens
HLYLTPSPD

SEQ ID NO: 1282285 - protein, 9 aa, Homo Sapiens
TQKRSCGSG

SEQ ID NO: 1282286 - protein, 9 aa, Homo Sapiens
FGPFNCTAW

SEQ ID NO: 1282287 - protein, 9 aa, Homo Sapiens
AAARCLPWP

SEQ ID NO: 1282288 - protein, 9 aa, Homo Sapiens
GTLLQTKGT

SEQ ID NO: 1282289 - protein, 9 aa, Homo Sapiens
QGGIHGHIS

SEQ ID NO: 1282290 - protein, 9 aa, Homo Sapiens
SIDSLFEGM

SEQ ID NO: 1282291 - protein, 9 aa, Homo Sapiens
SSFSSHLKV

SEQ ID NO: 1282292 - protein, 9 aa, Homo Sapiens
LLQTKGTGA

SEQ ID NO: 1282293 - protein, 9 aa, Homo Sapiens
LDFIHSRPP

SEQ ID NO: 1282294 - protein, 9 aa, Homo Sapiens
PWPRWTRTT

SEQ ID NO: 1282295 - protein, 9 aa, Homo Sapiens
ELILDFIHS

SEQ ID NO: 1282296 - protein, 9 aa, Homo Sapiens
TERFSPVRQ

SEQ ID NO: 1282297 - protein, 9 aa, Homo Sapiens
FFFFFFRWS

SEQ ID NO: 1282298 - protein, 9 aa, Homo Sapiens
FLSGKGNPE

SEQ ID NO: 1282299 - protein, 9 aa, Homo Sapiens
RDPLSEITK

SEQ ID NO: 1282300 - protein, 9 aa, Homo Sapiens
FFFFRWSLT

SEQ ID NO: 1282301 - protein, 9 aa, Homo Sapiens
NGELSKMLG

SEQ ID NO: 1282302 - protein, 9 aa, Homo Sapiens
SHLKVHTGE

SEQ ID NO: 1282303 - protein, 9 aa, Homo Sapiens
FFFFFFFRW

SEQ ID NO: 1282304 - protein, 9 aa, Homo Sapiens
QNSPRVLSS

SEQ ID NO: 1282305 - protein, 9 aa, Homo Sapiens
GIHGHISAT

SEQ ID NO: 1282306 - protein, 9 aa, Homo Sapiens
LPWPRWTRT

SEQ ID NO: 1282307 - protein, 9 aa, Homo Sapiens
PSPKTQDHL

SEQ ID NO: 1282308 - protein, 9 aa, Homo Sapiens
FTFMPIAQA

SEQ ID NO: 1282309 - protein, 9 aa, Homo Sapiens
KYLCIPAVD

SEQ ID NO: 1282310 - protein, 9 aa, Homo Sapiens
FEGMWYLVR

SEQ ID NO: 1282311 - protein, 9 aa, Homo Sapiens
KGTLLQTKG

SEQ ID NO: 1282312 - protein, 9 aa, Homo Sapiens
PPVTHLYLT

SEQ ID NO: 1282313 - protein, 9 aa, Homo Sapiens
TRLYSPSGF

SEQ ID NO: 1282314 - protein, 9 aa, Homo Sapiens
VVVVRGKTR

SEQ ID NO: 1282315 - protein, 9 aa, Homo Sapiens
PLEKLPLLL

SEQ ID NO: 1282316 - protein, 9 aa, Homo Sapiens
SEITKQEKD

SEQ ID NO: 1282317 - protein, 9 aa, Homo Sapiens
TILNSSPSI

SEQ ID NO: 1282318 - protein, 9 aa, Homo Sapiens
FLKAQEALE

SEQ ID NO: 1282319 - protein, 9 aa, Homo Sapiens
TTQSLLCTN

SEQ ID NO: 1282320 - protein, 9 aa, Homo Sapiens
RPSPKTQDH

SEQ ID NO: 1282321 - protein, 9 aa, Homo Sapiens
DSLFEGMWY

SEQ ID NO: 1282322 - protein, 9 aa, Homo Sapiens
PAVDSPSQN

SEQ ID NO: 1282323 - protein, 9 aa, Homo Sapiens
LPPELQGDL

SEQ ID NO: 1282324 - protein, 9 aa, Homo Sapiens
LNSSPSIRP

SEQ ID NO: 1282325 - protein, 9 aa, Homo Sapiens
AALQHQLEA

SEQ ID NO: 1282326 - protein, 9 aa, Homo Sapiens
LFFFFFFFR

SEQ ID NO: 1282327 - protein, 9 aa, Homo Sapiens
VRQFSDGAA

SEQ ID NO: 1282328 - protein, 9 aa, Homo Sapiens
IPAVDSPSQ

SEQ ID NO: 1282329 - protein, 9 aa, Homo Sapiens
NCTAWTYHS

SEQ ID NO: 1282330 - protein, 9 aa, Homo Sapiens
EQNSPRVLS

SEQ ID NO: 1282331 - protein, 9 aa, Homo Sapiens
YTRTLPGDR

SEQ ID NO: 1282332 - protein, 9 aa, Homo Sapiens
PHLEEARVM

SEQ ID NO: 1282333 - protein, 9 aa, Homo Sapiens
DFIHSRPPL

SEQ ID NO: 1282334 - protein, 9 aa, Homo Sapiens
LPPVTHLYL

SEQ ID NO: 1282335 - protein, 9 aa, Homo Sapiens
PLPPVTHLY

SEQ ID NO: 1282336 - protein, 9 aa, Homo Sapiens
HQLEAVRGR

SEQ ID NO: 1282337 - protein, 9 aa, Homo Sapiens
SSHLKVHTG

SEQ ID NO: 1282338 - protein, 9 aa, Homo Sapiens
FTTQKRSCG

SEQ ID NO: 1282339 - protein, 9 aa, Homo Sapiens
SPVRQFSDG

SEQ ID NO: 1282340 - protein, 9 aa, Homo Sapiens
EFYGEVRTR

SEQ ID NO: 1282341 - protein, 9 aa, Homo Sapiens
PGLRLPASS

SEQ ID NO: 1282342 - protein, 9 aa, Homo Sapiens
ILPPLEKLP

SEQ ID NO: 1282343 - protein, 9 aa, Homo Sapiens
PLLLEKLSR

SEQ ID NO: 1282344 - protein, 9 aa, Homo Sapiens
GGIHGHISA

SEQ ID NO: 1282345 - protein, 9 aa, Homo Sapiens
LVVVGAGCV

SEQ ID NO: 1282346 - protein, 9 aa, Homo Sapiens
WTRTTQSLL

SEQ ID NO: 1282347 - protein, 9 aa, Homo Sapiens
DGIVALWRM

SEQ ID NO: 1282348 - protein, 9 aa, Homo Sapiens
CVGKSALTI

SEQ ID NO: 1282349 - protein, 9 aa, Homo Sapiens
PFLSGKGNP

SEQ ID NO: 1282350 - protein, 9 aa, Homo Sapiens
AEEQNSPRV

SEQ ID NO: 1282351 - protein, 9 aa, Homo Sapiens
VKSEVHRKI

SEQ ID NO: 1282352 - protein, 9 aa, Homo Sapiens
VTYGPLTAG

SEQ ID NO: 1282353 - protein, 9 aa, Homo Sapiens
KPSFFFFSR

SEQ ID NO: 1282354 - protein, 9 aa, Homo Sapiens
MRRAAARCL

SEQ ID NO: 1282355 - protein, 9 aa, Homo Sapiens
PAGCGTAFD

SEQ ID NO: 1282356 - protein, 9 aa, Homo Sapiens
LPPLEKLPL

SEQ ID NO: 1282357 - protein, 9 aa, Homo Sapiens
ARVMAVSDG

SEQ ID NO: 1282358 - protein, 9 aa, Homo Sapiens
VSGSRDGIV

SEQ ID NO: 1282359 - protein, 9 aa, Homo Sapiens
ERFSPVRQF

SEQ ID NO: 1282360 - protein, 9 aa, Homo Sapiens
VKYLCIPAV

SEQ ID NO: 1282361 - protein, 9 aa, Homo Sapiens
DHLRQQRAS

SEQ ID NO: 1282362 - protein, 9 aa, Homo Sapiens
DGFTFMPIA

SEQ ID NO: 1282363 - protein, 9 aa, Homo Sapiens
EGMWYLVRV

SEQ ID NO: 1282364 - protein, 9 aa, Homo Sapiens
EALEFYGEV

SEQ ID NO: 1282365 - protein, 9 aa, Homo Sapiens
GLPQNPDGF

SEQ ID NO: 1282366 - protein, 9 aa, Homo Sapiens
HLEEARVMA

SEQ ID NO: 1282367 - protein, 9 aa, Homo Sapiens
HLRQQRASA

SEQ ID NO: 1282368 - protein, 9 aa, Homo Sapiens
LCTNHGCWT

SEQ ID NO: 1282369 - protein, 9 aa, Homo Sapiens
NQVKSEVHR

SEQ ID NO: 1282370 - protein, 9 aa, Homo Sapiens
TTTAPFLSG

SEQ ID NO: 1282371 - protein, 9 aa, Homo Sapiens
LPFGPFNCT

SEQ ID NO: 1282372 - protein, 9 aa, Homo Sapiens
FSRPSPKTQ

SEQ ID NO: 1282373 - protein, 9 aa, Homo Sapiens
FFFFSRPSP

SEQ ID NO: 1282374 - protein, 9 aa, Homo Sapiens
LSEITKQEK

SEQ ID NO: 1282375 - protein, 9 aa, Homo Sapiens
LLCTNHGCW

SEQ ID NO: 1282376 - protein, 9 aa, Homo Sapiens
DVVVVRGKT

SEQ ID NO: 1282377 - protein, 9 aa, Homo Sapiens
LEEARVMAV

SEQ ID NO: 1282378 - protein, 9 aa, Homo Sapiens
RAAARCLPW

SEQ ID NO: 1282379 - protein, 9 aa, Homo Sapiens
HRKIAEKDE

SEQ ID NO: 1282380 - protein, 9 aa, Homo Sapiens
EKLPLLLEK

SEQ ID NO: 1282381 - protein, 9 aa, Homo Sapiens
QPPRATILN

SEQ ID NO: 1282382 - protein, 9 aa, Homo Sapiens
QHKAALQHQ

SEQ ID NO: 1282383 - protein, 9 aa, Homo Sapiens
PFGPFNCTA

SEQ ID NO: 1282384 - protein, 9 aa, Homo Sapiens
CTATDVRDV

SEQ ID NO: 1282385 - protein, 9 aa, Homo Sapiens
LVSKGTLLQ

SEQ ID NO: 1282386 - protein, 9 aa, Homo Sapiens
LQTKGTGAS

SEQ ID NO: 1282387 - protein, 9 aa, Homo Sapiens
KRQIPSRFQ

SEQ ID NO: 1282388 - protein, 9 aa, Homo Sapiens
AGCGTAFDF

SEQ ID NO: 1282389 - protein, 9 aa, Homo Sapiens
PVRQFSDGA

SEQ ID NO: 1282390 - protein, 9 aa, Homo Sapiens
QIPSRFQLN

SEQ ID NO: 1282391 - protein, 9 aa, Homo Sapiens
EGETYYYKY

SEQ ID NO: 1282392 - protein, 9 aa, Homo Sapiens
GCWTSRYHR

SEQ ID NO: 1282393 - protein, 9 aa, Homo Sapiens
GLRLPASSP

SEQ ID NO: 1282394 - protein, 9 aa, Homo Sapiens
PLSEITKQE

SEQ ID NO: 1282395 - protein, 9 aa, Homo Sapiens
GELSKMLGK

SEQ ID NO: 1282396 - protein, 9 aa, Homo Sapiens
DCALPPELQ

SEQ ID NO: 1282397 - protein, 9 aa, Homo Sapiens
CALPPELQG

SEQ ID NO: 1282398 - protein, 9 aa, Homo Sapiens
TLLQTKGTG

SEQ ID NO: 1282399 - protein, 9 aa, Homo Sapiens
AVTYGPLTA

SEQ ID NO: 1282400 - protein, 9 aa, Homo Sapiens
MSLWVEFTT

SEQ ID NO: 1282401 - protein, 9 aa, Homo Sapiens
SFFFFSRPS

SEQ ID NO: 1282402 - protein, 9 aa, Homo Sapiens
HGHISATGR

SEQ ID NO: 1282403 - protein, 9 aa, Homo Sapiens
LKAQEALEF

SEQ ID NO: 1282404 - protein, 9 aa, Homo Sapiens
SGATTTAPF

SEQ ID NO: 1282405 - protein, 9 aa, Homo Sapiens
ATAEEQNSP

SEQ ID NO: 1282406 - protein, 9 aa, Homo Sapiens
LSIRYTRTL

SEQ ID NO: 1282407 - protein, 9 aa, Homo Sapiens
EVDLACTAT

SEQ ID NO: 1282408 - protein, 9 aa, Homo Sapiens
HISATGRGV

SEQ ID NO: 1282409 - protein, 9 aa, Homo Sapiens
SRPSPKTQD

SEQ ID NO: 1282410 - protein, 9 aa, Homo Sapiens
EEVDLACTA

SEQ ID NO: 1282411 - protein, 9 aa, Homo Sapiens
HLKVHTGER

SEQ ID NO: 1282412 - protein, 9 aa, Homo Sapiens
GPSAPGLRL

SEQ ID NO: 1282413 - protein, 9 aa, Homo Sapiens
HGCWTSRYH

SEQ ID NO: 1282414 - protein, 9 aa, Homo Sapiens
SLLCTNHGC

SEQ ID NO: 1282415 - protein, 9 aa, Homo Sapiens
QNPDGFTFM

SEQ ID NO: 1282416 - protein, 9 aa, Homo Sapiens
TTAPFLSGK

SEQ ID NO: 1282417 - protein, 9 aa, Homo Sapiens
QVPPGPSGE

SEQ ID NO: 1282418 - protein, 9 aa, Homo Sapiens
SKINGGGKR

SEQ ID NO: 1282419 - protein, 9 aa, Homo Sapiens
PPLPEPVYF

SEQ ID NO: 1282420 - protein, 9 aa, Homo Sapiens
WNGEKKCCR

SEQ ID NO: 1282421 - protein, 9 aa, Homo Sapiens
ERKKTQEYE

SEQ ID NO: 1282422 - protein, 9 aa, Homo Sapiens
YHRDMALSD

SEQ ID NO: 1282423 - protein, 9 aa, Homo Sapiens
KRIYKAEVC

SEQ ID NO: 1282424 - protein, 9 aa, Homo Sapiens
TQRMKSSCD

SEQ ID NO: 1282425 - protein, 9 aa, Homo Sapiens
IQAYWRCHS

SEQ ID NO: 1282426 - protein, 9 aa, Homo Sapiens
LQECEYRLQ

SEQ ID NO: 1282427 - protein, 9 aa, Homo Sapiens
CHSCASRGF

SEQ ID NO: 1282428 - protein, 9 aa, Homo Sapiens
PLPEPVYFT

SEQ ID NO: 1282429 - protein, 9 aa, Homo Sapiens
NMAAVMVHQ

SEQ ID NO: 1282430 - protein, 9 aa, Homo Sapiens
HWNGEKKCC

SEQ ID NO: 1282431 - protein, 9 aa, Homo Sapiens
SLCFGVCAS

SEQ ID NO: 1282432 - protein, 9 aa, Homo Sapiens
ETNSILWVK

SEQ ID NO: 1282433 - protein, 9 aa, Homo Sapiens
GNDPSKTTQ

SEQ ID NO: 1282434 - protein, 9 aa, Homo Sapiens
SNKLKFLPE

SEQ ID NO: 1282435 - protein, 9 aa, Homo Sapiens
DPVEILQEC

SEQ ID NO: 1282436 - protein, 9 aa, Homo Sapiens
KLACIDSYV

SEQ ID NO: 1282437 - protein, 9 aa, Homo Sapiens
AAEAALSQT

SEQ ID NO: 1282438 - protein, 9 aa, Homo Sapiens
DSGVSVNPA

SEQ ID NO: 1282439 - protein, 9 aa, Homo Sapiens
GERFRICRA

SEQ ID NO: 1282440 - protein, 9 aa, Homo Sapiens
NDIVSALVN

SEQ ID NO: 1282441 - protein, 9 aa, Homo Sapiens
QPLENNLFR

SEQ ID NO: 1282442 - protein, 9 aa, Homo Sapiens
VPKPRENLQ

SEQ ID NO: 1282443 - protein, 9 aa, Homo Sapiens
NVFISQPVK

SEQ ID NO: 1282444 - protein, 9 aa, Homo Sapiens
IQKYLEIHW

SEQ ID NO: 1282445 - protein, 9 aa, Homo Sapiens
VYFTKPPIA

SEQ ID NO: 1282446 - protein, 9 aa, Homo Sapiens
ESCLPWGSL

SEQ ID NO: 1282447 - protein, 9 aa, Homo Sapiens
PQVPPGPSG

SEQ ID NO: 1282448 - protein, 9 aa, Homo Sapiens
STDLESQLC

SEQ ID NO: 1282449 - protein, 9 aa, Homo Sapiens
LHPGQLLQP

SEQ ID NO: 1282450 - protein, 9 aa, Homo Sapiens
TSGEIQKEN

SEQ ID NO: 1282451 - protein, 9 aa, Homo Sapiens
RCHSCASRG

SEQ ID NO: 1282452 - protein, 9 aa, Homo Sapiens
VKGKNLDLI

SEQ ID NO: 1282453 - protein, 9 aa, Homo Sapiens
YIAFVLKDI

SEQ ID NO: 1282454 - protein, 9 aa, Homo Sapiens
IAGIPILFL

SEQ ID NO: 1282455 - protein, 9 aa, Homo Sapiens
AAQKVLTDA

SEQ ID NO: 1282456 - protein, 9 aa, Homo Sapiens
LFDRIYSHQ

SEQ ID NO: 1282457 - protein, 9 aa, Homo Sapiens
LPHRGGDEE

SEQ ID NO: 1282458 - protein, 9 aa, Homo Sapiens
VSALVNAED

SEQ ID NO: 1282459 - protein, 9 aa, Homo Sapiens
KGPESVPLP

SEQ ID NO: 1282460 - protein, 9 aa, Homo Sapiens
ESSKSSTQR

SEQ ID NO: 1282461 - protein, 9 aa, Homo Sapiens
QAYWRCHSC

SEQ ID NO: 1282462 - protein, 9 aa, Homo Sapiens
TVAKPPAVC

SEQ ID NO: 1282463 - protein, 9 aa, Homo Sapiens
SKSSTQRMK

SEQ ID NO: 1282464 - protein, 9 aa, Homo Sapiens
RGVNHLFCE

SEQ ID NO: 1282465 - protein, 9 aa, Homo Sapiens
TISPYMPTF

SEQ ID NO: 1282466 - protein, 9 aa, Homo Sapiens
FTHHERAII

SEQ ID NO: 1282467 - protein, 9 aa, Homo Sapiens
NLCAIHGKR

SEQ ID NO: 1282468 - protein, 9 aa, Homo Sapiens
GGDDSGVSV

SEQ ID NO: 1282469 - protein, 9 aa, Homo Sapiens
LVFAFILSL

SEQ ID NO: 1282470 - protein, 9 aa, Homo Sapiens
KNRSSTVDP

SEQ ID NO: 1282471 - protein, 9 aa, Homo Sapiens
SSTVDPEPQ

SEQ ID NO: 1282472 - protein, 9 aa, Homo Sapiens
LKFLPEEIG

SEQ ID NO: 1282473 - protein, 9 aa, Homo Sapiens
SCLPWGSLC

SEQ ID NO: 1282474 - protein, 9 aa, Homo Sapiens
EPGSAGPQV

SEQ ID NO: 1282475 - protein, 9 aa, Homo Sapiens
AYWRCHSCA

SEQ ID NO: 1282476 - protein, 9 aa, Homo Sapiens
SALVNAEDE

SEQ ID NO: 1282477 - protein, 9 aa, Homo Sapiens
KMGTFPRRR

SEQ ID NO: 1282478 - protein, 9 aa, Homo Sapiens
ILVELESCL

SEQ ID NO: 1282479 - protein, 9 aa, Homo Sapiens
CRAEKTYAV

SEQ ID NO: 1282480 - protein, 9 aa, Homo Sapiens
ALVNAEDEK

SEQ ID NO: 1282481 - protein, 9 aa, Homo Sapiens
GSGLNSDQL

SEQ ID NO: 1282482 - protein, 9 aa, Homo Sapiens
PKKMGTFPR

SEQ ID NO: 1282483 - protein, 9 aa, Homo Sapiens
SLRSNKLKF

SEQ ID NO: 1282484 - protein, 9 aa, Homo Sapiens
LLQPLENNL

SEQ ID NO: 1282485 - protein, 9 aa, Homo Sapiens
DVMICAYLL

SEQ ID NO: 1282486 - protein, 9 aa, Homo Sapiens
ALYVHMLAE

SEQ ID NO: 1282487 - protein, 9 aa, Homo Sapiens
SLFERTSNS

SEQ ID NO: 1282488 - protein, 9 aa, Homo Sapiens
ICRAEKTYA

SEQ ID NO: 1282489 - protein, 9 aa, Homo Sapiens
MAAVMVHQL

SEQ ID NO: 1282490 - protein, 9 aa, Homo Sapiens
GKRPASDMG

SEQ ID NO: 1282491 - protein, 9 aa, Homo Sapiens
GLNCTHIGE

SEQ ID NO: 1282492 - protein, 9 aa, Homo Sapiens
IRERKKTQE

SEQ ID NO: 1282493 - protein, 9 aa, Homo Sapiens
WRCHSCASR

SEQ ID NO: 1282494 - protein, 9 aa, Homo Sapiens
PANYLICSI

SEQ ID NO: 1282495 - protein, 9 aa, Homo Sapiens
FDRIYSHQS

SEQ ID NO: 1282496 - protein, 9 aa, Homo Sapiens
IYKAEVCLW

SEQ ID NO: 1282497 - protein, 9 aa, Homo Sapiens
ALSQTGFSY

SEQ ID NO: 1282498 - protein, 9 aa, Homo Sapiens
PFCGPRGVN

SEQ ID NO: 1282499 - protein, 9 aa, Homo Sapiens
VHMLAELDM

SEQ ID NO: 1282500 - protein, 9 aa, Homo Sapiens
VTKLACIDS

SEQ ID NO: 1282501 - protein, 9 aa, Homo Sapiens
TSNSSWVVV

SEQ ID NO: 1282502 - protein, 9 aa, Homo Sapiens
LQPLENNLF

SEQ ID NO: 1282503 - protein, 9 aa, Homo Sapiens
WGSLCFGVC

SEQ ID NO: 1282504 - protein, 9 aa, Homo Sapiens
SVLQNVFIS

SEQ ID NO: 1282505 - protein, 9 aa, Homo Sapiens
AAAEAALSQ

SEQ ID NO: 1282506 - protein, 9 aa, Homo Sapiens
DDSGVSVNP

SEQ ID NO: 1282507 - protein, 9 aa, Homo Sapiens
FLTISPYMP

SEQ ID NO: 1282508 - protein, 9 aa, Homo Sapiens
YLRGLNCTH

SEQ ID NO: 1282509 - protein, 9 aa, Homo Sapiens
NVIGSVHYE

SEQ ID NO: 1282510 - protein, 9 aa, Homo Sapiens
RGLNCTHIG

SEQ ID NO: 1282511 - protein, 9 aa, Homo Sapiens
LERKETNSI

SEQ ID NO: 1282512 - protein, 9 aa, Homo Sapiens
GYHLERKET

SEQ ID NO: 1282513 - protein, 9 aa, Homo Sapiens
HLLQCGKKV

SEQ ID NO: 1282514 - protein, 9 aa, Homo Sapiens
NQKRIYKAE

SEQ ID NO: 1282515 - protein, 9 aa, Homo Sapiens
GGGKRPASD

SEQ ID NO: 1282516 - protein, 9 aa, Homo Sapiens
DRIYSHQSD

SEQ ID NO: 1282517 - protein, 9 aa, Homo Sapiens
GSAGPQVPP

SEQ ID NO: 1282518 - protein, 9 aa, Homo Sapiens
SGLNSDQLH

SEQ ID NO: 1282519 - protein, 9 aa, Homo Sapiens
CHWNGEKKC

SEQ ID NO: 1282520 - protein, 9 aa, Homo Sapiens
VSVNPARSA

SEQ ID NO: 1282521 - protein, 9 aa, Homo Sapiens
TQEYEKEAE

SEQ ID NO: 1282522 - protein, 9 aa, Homo Sapiens
WTIAGIPIL

SEQ ID NO: 1282523 - protein, 9 aa, Homo Sapiens
DTNLCAIHG

SEQ ID NO: 1282524 - protein, 9 aa, Homo Sapiens
ELESCLPWG

SEQ ID NO: 1282525 - protein, 9 aa, Homo Sapiens
KIWLMNTSL

SEQ ID NO: 1282526 - protein, 9 aa, Homo Sapiens
GGDEEGSRV

SEQ ID NO: 1282527 - protein, 9 aa, Homo Sapiens
IVSALVNAE

SEQ ID NO: 1282528 - protein, 9 aa, Homo Sapiens
FSSYVGSGL

SEQ ID NO: 1282529 - protein, 9 aa, Homo Sapiens
EIRERKKTQ

SEQ ID NO: 1282530 - protein, 9 aa, Homo Sapiens
CTHIGEDRC

SEQ ID NO: 1282531 - protein, 9 aa, Homo Sapiens
RKGPESVPL

SEQ ID NO: 1282532 - protein, 9 aa, Homo Sapiens
MWFSTVTGP

SEQ ID NO: 1282533 - protein, 9 aa, Homo Sapiens
LYVHMLAEL

SEQ ID NO: 1282534 - protein, 9 aa, Homo Sapiens
GNFDCELRL

SEQ ID NO: 1282535 - protein, 9 aa, Homo Sapiens
LISIFVNIY

SEQ ID NO: 1282536 - protein, 9 aa, Homo Sapiens
RFRICRAEK

SEQ ID NO: 1282537 - protein, 9 aa, Homo Sapiens
GDEEGSRVP

SEQ ID NO: 1282538 - protein, 9 aa, Homo Sapiens
TKLACIDSY

SEQ ID NO: 1282539 - protein, 9 aa, Homo Sapiens
GPLPVPFTS

SEQ ID NO: 1282540 - protein, 9 aa, Homo Sapiens
GKGRTDVMI

SEQ ID NO: 1282541 - protein, 9 aa, Homo Sapiens
ACYLRGLNC

SEQ ID NO: 1282542 - protein, 9 aa, Homo Sapiens
RENLQFWRI

SEQ ID NO: 1282543 - protein, 9 aa, Homo Sapiens
TSMIQDGIM

SEQ ID NO: 1282544 - protein, 9 aa, Homo Sapiens
SVNPARSAL

SEQ ID NO: 1282545 - protein, 9 aa, Homo Sapiens
SVPLPHRGG

SEQ ID NO: 1282546 - protein, 9 aa, Homo Sapiens
NRKNRSSTV

SEQ ID NO: 1282547 - protein, 9 aa, Homo Sapiens
RKKTQEYEK

SEQ ID NO: 1282548 - protein, 9 aa, Homo Sapiens
TNLCAIHGK

SEQ ID NO: 1282549 - protein, 9 aa, Homo Sapiens
QEYEKEAER

SEQ ID NO: 1282550 - protein, 9 aa, Homo Sapiens
CIDSYVVSL

SEQ ID NO: 1282551 - protein, 9 aa, Homo Sapiens
KGRTDVMIC

SEQ ID NO: 1282552 - protein, 9 aa, Homo Sapiens
IYSHQSDVW

SEQ ID NO: 1282553 - protein, 9 aa, Homo Sapiens
QKRIYKAEV

SEQ ID NO: 1282554 - protein, 9 aa, Homo Sapiens
HPGQLLQPL

SEQ ID NO: 1282555 - protein, 9 aa, Homo Sapiens
QECEYRLQA

SEQ ID NO: 1282556 - protein, 9 aa, Homo Sapiens
VKVHLLQCG

SEQ ID NO: 1282557 - protein, 9 aa, Homo Sapiens
QQSNQKRIY

SEQ ID NO: 1282558 - protein, 9 aa, Homo Sapiens
YLEIHWETD

SEQ ID NO: 1282559 - protein, 9 aa, Homo Sapiens
LEVIRHLEE

SEQ ID NO: 1282560 - protein, 9 aa, Homo Sapiens
FAFILSLMV

SEQ ID NO: 1282561 - protein, 9 aa, Homo Sapiens
CKAGKGRTD

SEQ ID NO: 1282562 - protein, 9 aa, Homo Sapiens
SNQKRIYKA

SEQ ID NO: 1282563 - protein, 9 aa, Homo Sapiens
KPYKSEECG

SEQ ID NO: 1282564 - protein, 9 aa, Homo Sapiens
NYLICSIAV

SEQ ID NO: 1282565 - protein, 9 aa, Homo Sapiens
LQNVFISQP

SEQ ID NO: 1282566 - protein, 9 aa, Homo Sapiens
ERKETNSIL

SEQ ID NO: 1282567 - protein, 9 aa, Homo Sapiens
INGGGKRPA

SEQ ID NO: 1282568 - protein, 9 aa, Homo Sapiens
SNSSWVVVF

SEQ ID NO: 1282569 - protein, 9 aa, Homo Sapiens
GSRVPKPRE

SEQ ID NO: 1282570 - protein, 9 aa, Homo Sapiens
YVGSGLNSD

SEQ ID NO: 1282571 - protein, 9 aa, Homo Sapiens
KFLPEEIGQ

SEQ ID NO: 1282572 - protein, 9 aa, Homo Sapiens
IHGKRVTIM

SEQ ID NO: 1282573 - protein, 9 aa, Homo Sapiens
AHAVCQQAQ

SEQ ID NO: 1282574 - protein, 9 aa, Homo Sapiens
MPTFTERVK

SEQ ID NO: 1282575 - protein, 9 aa, Homo Sapiens
QSNQKRIYK

SEQ ID NO: 1282576 - protein, 9 aa, Homo Sapiens
ANYLICSIA

SEQ ID NO: 1282577 - protein, 9 aa, Homo Sapiens
GRTDVMICA

SEQ ID NO: 1282578 - protein, 9 aa, Homo Sapiens
EIHWETDYN

SEQ ID NO: 1282579 - protein, 9 aa, Homo Sapiens
IDKFSWGYH

SEQ ID NO: 1282580 - protein, 9 aa, Homo Sapiens
PGNDPSKTT

SEQ ID NO: 1282581 - protein, 9 aa, Homo Sapiens
NLKIHETVA

SEQ ID NO: 1282582 - protein, 9 aa, Homo Sapiens
FSWGYHRDM

SEQ ID NO: 1282583 - protein, 9 aa, Homo Sapiens
LPWGSLCFG

SEQ ID NO: 1282584 - protein, 9 aa, Homo Sapiens
TNSILWVKL

SEQ ID NO: 1282585 - protein, 9 aa, Homo Sapiens
IAFVLKDIK

SEQ ID NO: 1282586 - protein, 9 aa, Homo Sapiens
LVNAEDEKR

SEQ ID NO: 1282587 - protein, 9 aa, Homo Sapiens
LWTIAGIPI

SEQ ID NO: 1282588 - protein, 9 aa, Homo Sapiens
PVPFTSGEI

SEQ ID NO: 1282589 - protein, 9 aa, Homo Sapiens
PYMPTFTER

SEQ ID NO: 1282590 - protein, 9 aa, Homo Sapiens
YKGGNFDCE

SEQ ID NO: 1282591 - protein, 9 aa, Homo Sapiens
GIMAIMYSA

SEQ ID NO: 1282592 - protein, 9 aa, Homo Sapiens
VPLPHRGGD

SEQ ID NO: 1282593 - protein, 9 aa, Homo Sapiens
NKLKFLPEE

SEQ ID NO: 1282594 - protein, 9 aa, Homo Sapiens
HRDMALSDV

SEQ ID NO: 1282595 - protein, 9 aa, Homo Sapiens
HAVCQQAQH

SEQ ID NO: 1282596 - protein, 9 aa, Homo Sapiens
RIYSHQSDV

SEQ ID NO: 1282597 - protein, 9 aa, Homo Sapiens
VAKPPAVCS

SEQ ID NO: 1282598 - protein, 9 aa, Homo Sapiens
NPPLPEPVY

SEQ ID NO: 1282599 - protein, 9 aa, Homo Sapiens
EILQECEYR

SEQ ID NO: 1282600 - protein, 9 aa, Homo Sapiens
GVSVNPARS

SEQ ID NO: 1282601 - protein, 9 aa, Homo Sapiens
RLPFCGPRG

SEQ ID NO: 1282602 - protein, 9 aa, Homo Sapiens
HHERAIIFR

SEQ ID NO: 1282603 - protein, 9 aa, Homo Sapiens
SPYMPTFTE

SEQ ID NO: 1282604 - protein, 9 aa, Homo Sapiens
EDQVVVNMA

SEQ ID NO: 1282605 - protein, 9 aa, Homo Sapiens
PWGSLCFGV

SEQ ID NO: 1282606 - protein, 9 aa, Homo Sapiens
FSTVTGPKL

SEQ ID NO: 1282607 - protein, 9 aa, Homo Sapiens
VLKDIKLLR

SEQ ID NO: 1282608 - protein, 9 aa, Homo Sapiens
VFAFILSLM

SEQ ID NO: 1282609 - protein, 9 aa, Homo Sapiens
NALYVHMLA

SEQ ID NO: 1282610 - protein, 9 aa, Homo Sapiens
LTCHWNGEK

SEQ ID NO: 1282611 - protein, 9 aa, Homo Sapiens
NRSSTVDPE

SEQ ID NO: 1282612 - protein, 9 aa, Homo Sapiens
PESVPLPHR

SEQ ID NO: 1282613 - protein, 9 aa, Homo Sapiens
VPPGPSGEE

SEQ ID NO: 1282614 - protein, 9 aa, Homo Sapiens
KETNSILWV

SEQ ID NO: 1282615 - protein, 9 aa, Homo Sapiens
IKLLRQSLA

SEQ ID NO: 1282616 - protein, 9 aa, Homo Sapiens
KKPYKSEEC

SEQ ID NO: 1282617 - protein, 9 aa, Homo Sapiens
KTQEYEKEA

SEQ ID NO: 1282618 - protein, 9 aa, Homo Sapiens
LRSNKLKFL

SEQ ID NO: 1282619 - protein, 9 aa, Homo Sapiens
IVKGKNLDL

SEQ ID NO: 1282620 - protein, 9 aa, Homo Sapiens
VNDIVSALV

SEQ ID NO: 1282621 - protein, 9 aa, Homo Sapiens
HRGGDEEGS

SEQ ID NO: 1282622 - protein, 9 aa, Homo Sapiens
KFSWGYHRD

SEQ ID NO: 1282623 - protein, 9 aa, Homo Sapiens
AKIWLMNTS

SEQ ID NO: 1282624 - protein, 9 aa, Homo Sapiens
GGNFDCELR

SEQ ID NO: 1282625 - protein, 9 aa, Homo Sapiens
KYLEIHWET

SEQ ID NO: 1282626 - protein, 9 aa, Homo Sapiens
EALFDRIYS

SEQ ID NO: 1282627 - protein, 9 aa, Homo Sapiens
HMLAELDML

SEQ ID NO: 1282628 - protein, 9 aa, Homo Sapiens
FRICRAEKT

SEQ ID NO: 1282629 - protein, 9 aa, Homo Sapiens
KINGGGKRP

SEQ ID NO: 1282630 - protein, 9 aa, Homo Sapiens
LLQCGKKVR

SEQ ID NO: 1282631 - protein, 9 aa, Homo Sapiens
ILQECEYRL

SEQ ID NO: 1282632 - protein, 9 aa, Homo Sapiens
TSKINGGGK

SEQ ID NO: 1282633 - protein, 9 aa, Homo Sapiens
VVVNMAAVM

SEQ ID NO: 1282634 - protein, 9 aa, Homo Sapiens
LPFCGPRGV

SEQ ID NO: 1282635 - protein, 9 aa, Homo Sapiens
QFSSYVGSG

SEQ ID NO: 1282636 - protein, 9 aa, Homo Sapiens
KGKNLDLIS

SEQ ID NO: 1282637 - protein, 9 aa, Homo Sapiens
TFPRRRKGP

SEQ ID NO: 1282638 - protein, 9 aa, Homo Sapiens
AFILSLMVS

SEQ ID NO: 1282639 - protein, 9 aa, Homo Sapiens
PKPRENLQF

SEQ ID NO: 1282640 - protein, 9 aa, Homo Sapiens
LRGLNCTHI

SEQ ID NO: 1282641 - protein, 9 aa, Homo Sapiens
TVTGPKLLM

SEQ ID NO: 1282642 - protein, 9 aa, Homo Sapiens
IDSYVVSLL

SEQ ID NO: 1282643 - protein, 9 aa, Homo Sapiens
SSTQRMKSS

SEQ ID NO: 1282644 - protein, 9 aa, Homo Sapiens
VEILQECEY

SEQ ID NO: 1282645 - protein, 9 aa, Homo Sapiens
IIVKGKNLD

SEQ ID NO: 1282646 - protein, 9 aa, Homo Sapiens
GVNHLFCEI

SEQ ID NO: 1282647 - protein, 9 aa, Homo Sapiens
KVHLLQCGK

SEQ ID NO: 1282648 - protein, 9 aa, Homo Sapiens
IILSVLQNV

SEQ ID NO: 1282649 - protein, 9 aa, Homo Sapiens
VLTDAGPTL

SEQ ID NO: 1282650 - protein, 9 aa, Homo Sapiens
FERTSNSSW

SEQ ID NO: 1282651 - protein, 9 aa, Homo Sapiens
QVVVNMAAV

SEQ ID NO: 1282652 - protein, 9 aa, Homo Sapiens
IIFRRPSRV

SEQ ID NO: 1282653 - protein, 9 aa, Homo Sapiens
IWLMNTSLR

SEQ ID NO: 1282654 - protein, 9 aa, Homo Sapiens
ISPYMPTFT

SEQ ID NO: 1282655 - protein, 9 aa, Homo Sapiens
KDIKLLRQS

SEQ ID NO: 1282656 - protein, 9 aa, Homo Sapiens
DKFSWGYHR

SEQ ID NO: 1282657 - protein, 9 aa, Homo Sapiens
YLICSIAVT

SEQ ID NO: 1282658 - protein, 9 aa, Homo Sapiens
LNCTHIGED

SEQ ID NO: 1282659 - protein, 9 aa, Homo Sapiens
FRQNALYVH

SEQ ID NO: 1282660 - protein, 9 aa, Homo Sapiens
WLMNTSLRS

SEQ ID NO: 1282661 - protein, 9 aa, Homo Sapiens
AIHGKRVTI

SEQ ID NO: 1282662 - protein, 9 aa, Homo Sapiens
QNRPPGYPI

SEQ ID NO: 1282663 - protein, 9 aa, Homo Sapiens
GYHRDMALS

SEQ ID NO: 1282664 - protein, 9 aa, Homo Sapiens
KTTQKKIKG

SEQ ID NO: 1282665 - protein, 9 aa, Homo Sapiens
CLDSKANVI

SEQ ID NO: 1282666 - protein, 9 aa, Homo Sapiens
LSVLQNVFI

SEQ ID NO: 1282667 - protein, 9 aa, Homo Sapiens
RGGDEEGSR

SEQ ID NO: 1282668 - protein, 9 aa, Homo Sapiens
CAIHGKRVT

SEQ ID NO: 1282669 - protein, 9 aa, Homo Sapiens
PLISIFVNI

SEQ ID NO: 1282670 - protein, 9 aa, Homo Sapiens
GPKLLMTLV

SEQ ID NO: 1282671 - protein, 9 aa, Homo Sapiens
CLPWGSLCF

SEQ ID NO: 1282672 - protein, 9 aa, Homo Sapiens
MGTFPRRRK

SEQ ID NO: 1282673 - protein, 9 aa, Homo Sapiens
PFTSGEIQK

SEQ ID NO: 1282674 - protein, 9 aa, Homo Sapiens
LDSKANVIG

SEQ ID NO: 1282675 - protein, 9 aa, Homo Sapiens
ISIFVNIYL

SEQ ID NO: 1282676 - protein, 9 aa, Homo Sapiens
PYKSEECGK

SEQ ID NO: 1282677 - protein, 9 aa, Homo Sapiens
PLLPLISIF

SEQ ID NO: 1282678 - protein, 9 aa, Homo Sapiens
HERAIIFRR

SEQ ID NO: 1282679 - protein, 9 aa, Homo Sapiens
LLPLISIFV

SEQ ID NO: 1282680 - protein, 9 aa, Homo Sapiens
CSIAVTDFL

SEQ ID NO: 1282681 - protein, 9 aa, Homo Sapiens
AEAALSQTG

SEQ ID NO: 1282682 - protein, 9 aa, Homo Sapiens
SGVSVNPAR

SEQ ID NO: 1282683 - protein, 9 aa, Homo Sapiens
NLDLISETT

SEQ ID NO: 1282684 - protein, 9 aa, Homo Sapiens
FLWTIAGIP

SEQ ID NO: 1282685 - protein, 9 aa, Homo Sapiens
TLEVIRHLE

SEQ ID NO: 1282686 - protein, 9 aa, Homo Sapiens
YKSEECGKA

SEQ ID NO: 1282687 - protein, 9 aa, Homo Sapiens
RSNKLKFLP

SEQ ID NO: 1282688 - protein, 9 aa, Homo Sapiens
SSQMFLWTI

SEQ ID NO: 1282689 - protein, 9 aa, Homo Sapiens
PEPVYFTKP

SEQ ID NO: 1282690 - protein, 9 aa, Homo Sapiens
VIRHLEETT

SEQ ID NO: 1282691 - protein, 9 aa, Homo Sapiens
RRRKGPESV

SEQ ID NO: 1282692 - protein, 9 aa, Homo Sapiens
FVLKDIKLL

SEQ ID NO: 1282693 - protein, 9 aa, Homo Sapiens
SRVPKPREN

SEQ ID NO: 1282694 - protein, 9 aa, Homo Sapiens
KSSTQRMKS

SEQ ID NO: 1282695 - protein, 9 aa, Homo Sapiens
LKDIKLLRQ

SEQ ID NO: 1282696 - protein, 9 aa, Homo Sapiens
PALPLLPLI

SEQ ID NO: 1282697 - protein, 9 aa, Homo Sapiens
SGEIQKENS

SEQ ID NO: 1282698 - protein, 9 aa, Homo Sapiens
DMWFSTVTG

SEQ ID NO: 1282699 - protein, 9 aa, Homo Sapiens
PLENNLFRA

SEQ ID NO: 1282700 - protein, 9 aa, Homo Sapiens
TILVELESC

SEQ ID NO: 1282701 - protein, 9 aa, Homo Sapiens
LKIHETVAK

SEQ ID NO: 1282702 - protein, 9 aa, Homo Sapiens
PRENLQFWR

SEQ ID NO: 1282703 - protein, 9 aa, Homo Sapiens
PRGVNHLFC

SEQ ID NO: 1282704 - protein, 9 aa, Homo Sapiens
KIQKYLEIH

SEQ ID NO: 1282705 - protein, 9 aa, Homo Sapiens
DIKLLRQSL

SEQ ID NO: 1282706 - protein, 9 aa, Homo Sapiens
DPSKTTQKK

SEQ ID NO: 1282707 - protein, 9 aa, Homo Sapiens
RRKGPESVP

SEQ ID NO: 1282708 - protein, 9 aa, Homo Sapiens
VTGPKLLMT

SEQ ID NO: 1282709 - protein, 9 aa, Homo Sapiens
NCTHIGEDR

SEQ ID NO: 1282710 - protein, 9 aa, Homo Sapiens
HETVAKPPA

SEQ ID NO: 1282711 - protein, 9 aa, Homo Sapiens
FCGPRGVNH

SEQ ID NO: 1282712 - protein, 9 aa, Homo Sapiens
EPVYFTKPP

SEQ ID NO: 1282713 - protein, 9 aa, Homo Sapiens
ANVIGSVHY

SEQ ID NO: 1282714 - protein, 9 aa, Homo Sapiens
VELESCLPW

SEQ ID NO: 1282715 - protein, 9 aa, Homo Sapiens
ADSLFERTS

SEQ ID NO: 1282716 - protein, 9 aa, Homo Sapiens
NDPSKTTQK

SEQ ID NO: 1282717 - protein, 9 aa, Homo Sapiens
LACIDSYVV

SEQ ID NO: 1282718 - protein, 9 aa, Homo Sapiens
HTGKKPYKS

SEQ ID NO: 1282719 - protein, 9 aa, Homo Sapiens
VLQNVFISQ

SEQ ID NO: 1282720 - protein, 9 aa, Homo Sapiens
RHLEETTNM

SEQ ID NO: 1282721 - protein, 9 aa, Homo Sapiens
ETILVELES

SEQ ID NO: 1282722 - protein, 9 aa, Homo Sapiens
HLEETTNMK

SEQ ID NO: 1282723 - protein, 9 aa, Homo Sapiens
YHLERKETN

SEQ ID NO: 1282724 - protein, 9 aa, Homo Sapiens
VNAEDEKRE

SEQ ID NO: 1282725 - protein, 9 aa, Homo Sapiens
RTSNSSWVV

SEQ ID NO: 1282726 - protein, 9 aa, Homo Sapiens
LQCGKKVRK

SEQ ID NO: 1282727 - protein, 9 aa, Homo Sapiens
KNLDLISET

SEQ ID NO: 1282728 - protein, 9 aa, Homo Sapiens
PGQLLQPLE

SEQ ID NO: 1282729 - protein, 9 aa, Homo Sapiens
SQMFLWTIA

SEQ ID NO: 1282730 - protein, 9 aa, Homo Sapiens
YHHYKGGNF

SEQ ID NO: 1282731 - protein, 9 aa, Homo Sapiens
STQRMKSSC

SEQ ID NO: 1282732 - protein, 9 aa, Homo Sapiens
ALPLLPLIS

SEQ ID NO: 1282733 - protein, 9 aa, Homo Sapiens
TCHWNGEKK

SEQ ID NO: 1282734 - protein, 9 aa, Homo Sapiens
DSLFERTSN

SEQ ID NO: 1282735 - protein, 9 aa, Homo Sapiens
AQKVLTDAG

SEQ ID NO: 1282736 - protein, 9 aa, Homo Sapiens
THHERAIIF

SEQ ID NO: 1282737 - protein, 9 aa, Homo Sapiens
SHQSDVWSF

SEQ ID NO: 1282738 - protein, 9 aa, Homo Sapiens
AIIFRRPSR

SEQ ID NO: 1282739 - protein, 9 aa, Homo Sapiens
VCQQAQHYF

SEQ ID NO: 1282740 - protein, 9 aa, Homo Sapiens
KLKFLPEEI

SEQ ID NO: 1282741 - protein, 9 aa, Homo Sapiens
DEPGNDPSK

SEQ ID NO: 1282742 - protein, 9 aa, Homo Sapiens
VNMAAVMVH

SEQ ID NO: 1282743 - protein, 9 aa, Homo Sapiens
HYKGGNFDC

SEQ ID NO: 1282744 - protein, 9 aa, Homo Sapiens
KIHETVAKP

SEQ ID NO: 1282745 - protein, 9 aa, Homo Sapiens
QNVFISQPV

SEQ ID NO: 1282746 - protein, 9 aa, Homo Sapiens
GKNLDLISE

SEQ ID NO: 1282747 - protein, 9 aa, Homo Sapiens
IAVTDFLVA

SEQ ID NO: 1282748 - protein, 9 aa, Homo Sapiens
LTDAGPTLD

SEQ ID NO: 1282749 - protein, 9 aa, Homo Sapiens
KGGNFDCEL

SEQ ID NO: 1282750 - protein, 9 aa, Homo Sapiens
DIVSALVNA

SEQ ID NO: 1282751 - protein, 9 aa, Homo Sapiens
SSKSSTQRM

SEQ ID NO: 1282752 - protein, 9 aa, Homo Sapiens
CNLKIHETV

SEQ ID NO: 1282753 - protein, 9 aa, Homo Sapiens
QKVLTDAGP

SEQ ID NO: 1282754 - protein, 9 aa, Homo Sapiens
FILSLMVSM

SEQ ID NO: 1282755 - protein, 9 aa, Homo Sapiens
GKKPYKSEE

SEQ ID NO: 1282756 - protein, 9 aa, Homo Sapiens
LPVPFTSGE

SEQ ID NO: 1282757 - protein, 9 aa, Homo Sapiens
PVEILQECE

SEQ ID NO: 1282758 - protein, 9 aa, Homo Sapiens
YVHMLAELD

SEQ ID NO: 1282759 - protein, 9 aa, Homo Sapiens
HWETDYNHS

SEQ ID NO: 1282760 - protein, 9 aa, Homo Sapiens
EEGSRVPKP

SEQ ID NO: 1282761 - protein, 9 aa, Homo Sapiens
KKMGTFPRR

SEQ ID NO: 1282762 - protein, 9 aa, Homo Sapiens
VFISQPVKV

SEQ ID NO: 1282763 - protein, 9 aa, Homo Sapiens
LEETTNMKR

SEQ ID NO: 1282764 - protein, 9 aa, Homo Sapiens
ERAIIFRRP

SEQ ID NO: 1282765 - protein, 9 aa, Homo Sapiens
QAHAVCQQA

SEQ ID NO: 1282766 - protein, 9 aa, Homo Sapiens
MFLWTIAGI

SEQ ID NO: 1282767 - protein, 9 aa, Homo Sapiens
FTSGEIQKE

SEQ ID NO: 1282768 - protein, 9 aa, Homo Sapiens
EGSRVPKPR

SEQ ID NO: 1282769 - protein, 9 aa, Homo Sapiens
IHETVAKPP

SEQ ID NO: 1282770 - protein, 9 aa, Homo Sapiens
KAGKGRTDV

SEQ ID NO: 1282771 - protein, 9 aa, Homo Sapiens
DTSKINGGG

SEQ ID NO: 1282772 - protein, 9 aa, Homo Sapiens
QCGKKVRKK

SEQ ID NO: 1282773 - protein, 9 aa, Homo Sapiens
TNPPLPEPV

SEQ ID NO: 1282774 - protein, 9 aa, Homo Sapiens
SYVGSGLNS

SEQ ID NO: 1282775 - protein, 9 aa, Homo Sapiens
SKTTQKKIK

SEQ ID NO: 1282776 - protein, 9 aa, Homo Sapiens
DSKANVIGS

SEQ ID NO: 1282777 - protein, 9 aa, Homo Sapiens
EVIRHLEET

SEQ ID NO: 1282778 - protein, 9 aa, Homo Sapiens
PLPVPFTSG

SEQ ID NO: 1282779 - protein, 9 aa, Homo Sapiens
GCLDSKANV

SEQ ID NO: 1282780 - protein, 9 aa, Homo Sapiens
DEEGSRVPK

SEQ ID NO: 1282781 - protein, 9 aa, Homo Sapiens
LCAIHGKRV

SEQ ID NO: 1282782 - protein, 9 aa, Homo Sapiens
LMNTSLRSG

SEQ ID NO: 1282783 - protein, 9 aa, Homo Sapiens
ACIDSYVVS

SEQ ID NO: 1282784 - protein, 9 aa, Homo Sapiens
FLVFAFILS

SEQ ID NO: 1282785 - protein, 9 aa, Homo Sapiens
YSHQSDVWS

SEQ ID NO: 1282786 - protein, 9 aa, Homo Sapiens
EEYHHYKGG

SEQ ID NO: 1282787 - protein, 9 aa, Homo Sapiens
AQHYFNEMK

SEQ ID NO: 1282788 - protein, 9 aa, Homo Sapiens
PPKKMGTFP

SEQ ID NO: 1282789 - protein, 9 aa, Homo Sapiens
SSYVGSGLN

SEQ ID NO: 1282790 - protein, 9 aa, Homo Sapiens
YMPTFTERV

SEQ ID NO: 1282791 - protein, 9 aa, Homo Sapiens
RAAAEAALS

SEQ ID NO: 1282792 - protein, 9 aa, Homo Sapiens
QLLQPLENN

SEQ ID NO: 1282793 - protein, 9 aa, Homo Sapiens
DSYVVSLLI

SEQ ID NO: 1282794 - protein, 9 aa, Homo Sapiens
LPEPVYFTK

SEQ ID NO: 1282795 - protein, 9 aa, Homo Sapiens
QAQHYFNEM

SEQ ID NO: 1282796 - protein, 9 aa, Homo Sapiens
GGKRPASDM

SEQ ID NO: 1282797 - protein, 9 aa, Homo Sapiens
ICSIAVTDF

SEQ ID NO: 1282798 - protein, 9 aa, Homo Sapiens
IQDGIMAIM

SEQ ID NO: 1282799 - protein, 9 aa, Homo Sapiens
VPFTSGEIQ

SEQ ID NO: 1282800 - protein, 9 aa, Homo Sapiens
LTISPYMPT

SEQ ID NO: 1282801 - protein, 9 aa, Homo Sapiens
RNRKNRSST

SEQ ID NO: 1282802 - protein, 9 aa, Homo Sapiens
QDGIMAIMY

SEQ ID NO: 1282803 - protein, 9 aa, Homo Sapiens
TDVMICAYL

SEQ ID NO: 1282804 - protein, 9 aa, Homo Sapiens
RERKKTQEY

SEQ ID NO: 1282805 - protein, 9 aa, Homo Sapiens
VGSGLNSDQ

SEQ ID NO: 1282806 - protein, 9 aa, Homo Sapiens
WFSTVTGPK

SEQ ID NO: 1282807 - protein, 9 aa, Homo Sapiens
GDDSGVSVN

SEQ ID NO: 1282808 - protein, 9 aa, Homo Sapiens
DGIMAIMYS

SEQ ID NO: 1282809 - protein, 9 aa, Homo Sapiens
SAGPQVPPG

SEQ ID NO: 1282810 - protein, 9 aa, Homo Sapiens
NGGGKRPAS

SEQ ID NO: 1282811 - protein, 9 aa, Homo Sapiens
ATSMIQDGI

SEQ ID NO: 1282812 - protein, 9 aa, Homo Sapiens
MHAKIWLMN

SEQ ID NO: 1282813 - protein, 9 aa, Homo Sapiens
PSKTTQKKI

SEQ ID NO: 1282814 - protein, 9 aa, Homo Sapiens
LICSIAVTD

SEQ ID NO: 1282815 - protein, 9 aa, Homo Sapiens
KKTQEYEKE

SEQ ID NO: 1282816 - protein, 9 aa, Homo Sapiens
QKYLEIHWE

SEQ ID NO: 1282817 - protein, 9 aa, Homo Sapiens
RSSTVDPEP

SEQ ID NO: 1282818 - protein, 9 aa, Homo Sapiens
TPAAQKVLT

SEQ ID NO: 1282819 - protein, 9 aa, Homo Sapiens
VHLLQCGKK

SEQ ID NO: 1282820 - protein, 9 aa, Homo Sapiens
AGCLDSKAN

SEQ ID NO: 1282821 - protein, 9 aa, Homo Sapiens
KVLTDAGPT

SEQ ID NO: 1282822 - protein, 9 aa, Homo Sapiens
STVTGPKLL

SEQ ID NO: 1282823 - protein, 9 aa, Homo Sapiens
EYHHYKGGN

SEQ ID NO: 1282824 - protein, 9 aa, Homo Sapiens
AGPQVPPGP

SEQ ID NO: 1282825 - protein, 9 aa, Homo Sapiens
LRAAAEAAL

SEQ ID NO: 1282826 - protein, 9 aa, Homo Sapiens
GSLCFGVCA

SEQ ID NO: 1282827 - protein, 9 aa, Homo Sapiens
DQVVVNMAA

SEQ ID NO: 1282828 - protein, 9 aa, Homo Sapiens
HAKIWLMNT

SEQ ID NO: 1282829 - protein, 9 aa, Homo Sapiens
KPRENLQFW

SEQ ID NO: 1282830 - protein, 9 aa, Homo Sapiens
RIYKAEVCL

SEQ ID NO: 1282831 - protein, 9 aa, Homo Sapiens
TGKKPYKSE

SEQ ID NO: 1282832 - protein, 9 aa, Homo Sapiens
PRRRKGPES

SEQ ID NO: 1282833 - protein, 9 aa, Homo Sapiens
SIAVTDFLV

SEQ ID NO: 1282834 - protein, 9 aa, Homo Sapiens
YVKVHLLQC

SEQ ID NO: 1282835 - protein, 9 aa, Homo Sapiens
SWGYHRDMA

SEQ ID NO: 1282836 - protein, 9 aa, Homo Sapiens
RTDVMICAY

SEQ ID NO: 1282837 - protein, 9 aa, Homo Sapiens
HGKRVTIMP

SEQ ID NO: 1282838 - protein, 9 aa, Homo Sapiens
VNPARSALA

SEQ ID NO: 1282839 - protein, 9 aa, Homo Sapiens
HSCASRGFI

SEQ ID NO: 1282840 - protein, 9 aa, Homo Sapiens
LESCLPWGS

SEQ ID NO: 1282841 - protein, 9 aa, Homo Sapiens
RAIIFRRPS

SEQ ID NO: 1282842 - protein, 9 aa, Homo Sapiens
ERTSNSSWV

SEQ ID NO: 1282843 - protein, 9 aa, Homo Sapiens
CGPRGVNHL

SEQ ID NO: 1282844 - protein, 9 aa, Homo Sapiens
HLERKETNS

SEQ ID NO: 1282845 - protein, 9 aa, Homo Sapiens
AVCQQAQHY

SEQ ID NO: 1282846 - protein, 9 aa, Homo Sapiens
ILSVLQNVF

SEQ ID NO: 1282847 - protein, 9 aa, Homo Sapiens
ESVPLPHRG

SEQ ID NO: 1282848 - protein, 9 aa, Homo Sapiens
HHYKGGNFD

SEQ ID NO: 1282849 - protein, 9 aa, Homo Sapiens
PGSAGPQVP

SEQ ID NO: 1282850 - protein, 9 aa, Homo Sapiens
SMIQDGIMA

SEQ ID NO: 1282851 - protein, 9 aa, Homo Sapiens
QQAQHYFNE

SEQ ID NO: 1282852 - protein, 9 aa, Homo Sapiens
RICRAEKTY

SEQ ID NO: 1282853 - protein, 9 aa, Homo Sapiens
YWRCHSCAS

SEQ ID NO: 1282854 - protein, 9 aa, Homo Sapiens
SYVVSLLIV

SEQ ID NO: 1282855 - protein, 9 aa, Homo Sapiens
EAALSQTGF

SEQ ID NO: 1282856 - protein, 9 aa, Homo Sapiens
QIIVKGKNL

SEQ ID NO: 1282857 - protein, 9 aa, Homo Sapiens
LPLISIFVN

SEQ ID NO: 1282858 - protein, 9 aa, Homo Sapiens
TIAGIPILF

SEQ ID NO: 1282859 - protein, 9 aa, Homo Sapiens
RVPKPRENL

SEQ ID NO: 1282860 - protein, 9 aa, Homo Sapiens
QNALYVHML

SEQ ID NO: 1282861 - protein, 9 aa, Homo Sapiens
LDLISETTV

SEQ ID NO: 1282862 - protein, 9 aa, Homo Sapiens
GKRVTIMPK

SEQ ID NO: 1282863 - protein, 9 aa, Homo Sapiens
EPGNDPSKT

SEQ ID NO: 1282864 - protein, 9 aa, Homo Sapiens
LSQTGFSYD

SEQ ID NO: 1282865 - protein, 9 aa, Homo Sapiens
SKANVIGSV

SEQ ID NO: 1282866 - protein, 9 aa, Homo Sapiens
IHWETDYNH

SEQ ID NO: 1282867 - protein, 9 aa, Homo Sapiens
GTGERFRIC

SEQ ID NO: 1282868 - protein, 9 aa, Homo Sapiens
VVNMAAVMV

SEQ ID NO: 1282869 - protein, 9 aa, Homo Sapiens
PHRGGDEEG

SEQ ID NO: 1282870 - protein, 9 aa, Homo Sapiens
IIQAYWRCH

SEQ ID NO: 1282871 - protein, 9 aa, Homo Sapiens
LFLTISPYM

SEQ ID NO: 1282872 - protein, 9 aa, Homo Sapiens
TGPKLLMTL

SEQ ID NO: 1282873 - protein, 9 aa, Homo Sapiens
PLPHRGGDE

SEQ ID NO: 1282874 - protein, 9 aa, Homo Sapiens
QRMKSSCDR

SEQ ID NO: 1282875 - protein, 9 aa, Homo Sapiens
LPLLPLISI

SEQ ID NO: 1282876 - protein, 9 aa, Homo Sapiens
IFRRPSRVH

SEQ ID NO: 1282877 - protein, 9 aa, Homo Sapiens
ERFRICRAE

SEQ ID NO: 1282878 - protein, 9 aa, Homo Sapiens
LEIHWETDY

SEQ ID NO: 1282879 - protein, 9 aa, Homo Sapiens
MNTSLRSGR

SEQ ID NO: 1282880 - protein, 9 aa, Homo Sapiens
WQFSSYVGS

SEQ ID NO: 1282881 - protein, 9 aa, Homo Sapiens
PVYFTKPPI

SEQ ID NO: 1282882 - protein, 9 aa, Homo Sapiens
ALFDRIYSH

SEQ ID NO: 1282883 - protein, 9 aa, Homo Sapiens
GPESVPLPH

SEQ ID NO: 1282884 - protein, 9 aa, Homo Sapiens
DEDQVVVNM

SEQ ID NO: 1282885 - protein, 9 aa, Homo Sapiens
AALSQTGFS

SEQ ID NO: 1282886 - protein, 9 aa, Homo Sapiens
WGYHRDMAL

SEQ ID NO: 1282887 - protein, 9 aa, Homo Sapiens
IRHLEETTN

SEQ ID NO: 1282888 - protein, 9 aa, Homo Sapiens
ILSLMVSMI

SEQ ID NO: 1282889 - protein, 9 aa, Homo Sapiens
KTPAAQKVL

SEQ ID NO: 1282890 - protein, 9 aa, Homo Sapiens
CQQAQHYFN

SEQ ID NO: 1282891 - protein, 9 aa, Homo Sapiens
CYLRGLNCT

SEQ ID NO: 1282892 - protein, 9 aa, Homo Sapiens
RKETNSILW

SEQ ID NO: 1282893 - protein, 9 aa, Homo Sapiens
GQLLQPLEN

SEQ ID NO: 1282894 - protein, 9 aa, Homo Sapiens
CEYRLQARI

SEQ ID NO: 1282895 - protein, 9 aa, Homo Sapiens
TGERFRICR

SEQ ID NO: 1282896 - protein, 9 aa, Homo Sapiens
SLMVSMIGA

SEQ ID NO: 1282897 - protein, 9 aa, Homo Sapiens
CGKKVRKKK

SEQ ID NO: 1282898 - protein, 9 aa, Homo Sapiens
ETVAKPPAV

SEQ ID NO: 1282899 - protein, 9 aa, Homo Sapiens
KSEECGKAF

SEQ ID NO: 1282900 - protein, 9 aa, Homo Sapiens
DTLEVIRHL

SEQ ID NO: 1282901 - protein, 9 aa, Homo Sapiens
IESSKSSTQ

SEQ ID NO: 1282902 - protein, 9 aa, Homo Sapiens
ECEYRLQAR

SEQ ID NO: 1282903 - protein, 9 aa, Homo Sapiens
RKNRSSTVD

SEQ ID NO: 1282904 - protein, 9 aa, Homo Sapiens
PAAQKVLTD

SEQ ID NO: 1282905 - protein, 9 aa, Homo Sapiens
LFERTSNSS

SEQ ID NO: 1282906 - protein, 9 aa, Homo Sapiens
MSLRSNKLK

SEQ ID NO: 1282907 - protein, 9 aa, Homo Sapiens
GPRGVNHLF

SEQ ID NO: 1282908 - protein, 9 aa, Homo Sapiens
AGKGRTDVM

SEQ ID NO: 1282909 - protein, 9 aa, Homo Sapiens
LSLMVSMIG

SEQ ID NO: 1282910 - protein, 9 aa, Homo Sapiens
SATSMIQDG

SEQ ID NO: 1282911 - protein, 9 aa, Homo Sapiens
NTSLRSGRA

SEQ ID NO: 1282912 - protein, 9 aa, Homo Sapiens
MIQDGIMAI

SEQ ID NO: 1282913 - protein, 9 aa, Homo Sapiens
QMFLWTIAG

SEQ ID NO: 1282914 - protein, 9 aa, Homo Sapiens
YKAEVCLWE

SEQ ID NO: 1282915 - protein, 9 aa, Homo Sapiens
AFVLKDIKL

SEQ ID NO: 1282916 - protein, 9 aa, Homo Sapiens
RQNALYVHM

SEQ ID NO: 1282917 - protein, 9 aa, Homo Sapiens
GTFPRRRKG

SEQ ID NO: 1282918 - protein, 9 aa, Homo Sapiens
VLTCHWNGE

SEQ ID NO: 1282919 - protein, 9 aa, Homo Sapiens
FPRRRKGPE

SEQ ID NO: 1282920 - protein, 9 aa, Homo Sapiens
SEECGKAFS

SEQ ID NO: 1282921 - protein, 9 aa, Homo Sapiens
GPQVPPGPS

SEQ ID NO: 1282922 - protein, 9 aa, Homo Sapiens
STVDPEPQV

SEQ ID NO: 1282923 - protein, 9 aa, Homo Sapiens
KANVIGSVH

SEQ ID NO: 1282924 - protein, 9 aa, Homo Sapiens
TVDPEPQVK

SEQ ID NO: 1282925 - protein, 9 aa, Homo Sapiens
YLDVQLCLE

SEQ ID NO: 1282926 - protein, 9 aa, Homo Sapiens
SSESAESRP

SEQ ID NO: 1282927 - protein, 9 aa, Homo Sapiens
LKVLEHKVL

SEQ ID NO: 1282928 - protein, 9 aa, Homo Sapiens
KHDYGDTLS

SEQ ID NO: 1282929 - protein, 9 aa, Homo Sapiens
SGDSSSEHT

SEQ ID NO: 1282930 - protein, 9 aa, Homo Sapiens
LAREKKLLQ

SEQ ID NO: 1282931 - protein, 9 aa, Homo Sapiens
FHNNLLDNN

SEQ ID NO: 1282932 - protein, 9 aa, Homo Sapiens
FGLTQPKYK

SEQ ID NO: 1282933 - protein, 9 aa, Homo Sapiens
VQLRLCMAE

SEQ ID NO: 1282934 - protein, 9 aa, Homo Sapiens
VFHCNETTK

SEQ ID NO: 1282935 - protein, 9 aa, Homo Sapiens
VEKPYQCNQ

SEQ ID NO: 1282936 - protein, 9 aa, Homo Sapiens
RYSFLAEKH

SEQ ID NO: 1282937 - protein, 9 aa, Homo Sapiens
VEILTTNCD

SEQ ID NO: 1282938 - protein, 9 aa, Homo Sapiens
DKHVGTKKL

SEQ ID NO: 1282939 - protein, 9 aa, Homo Sapiens
YTENNDAKE

SEQ ID NO: 1282940 - protein, 9 aa, Homo Sapiens
LLHEARLYH

SEQ ID NO: 1282941 - protein, 9 aa, Homo Sapiens
RTSEDIEGS

SEQ ID NO: 1282942 - protein, 9 aa, Homo Sapiens
IKFVEAPYD

SEQ ID NO: 1282943 - protein, 9 aa, Homo Sapiens
LLKTLAEHK

SEQ ID NO: 1282944 - protein, 9 aa, Homo Sapiens
KVHHLKKYP

SEQ ID NO: 1282945 - protein, 9 aa, Homo Sapiens
VEALPTYCV

SEQ ID NO: 1282946 - protein, 9 aa, Homo Sapiens
LERVNRVNK

SEQ ID NO: 1282947 - protein, 9 aa, Homo Sapiens
PKTLSFRIN

SEQ ID NO: 1282948 - protein, 9 aa, Homo Sapiens
STFHKRNSM

SEQ ID NO: 1282949 - protein, 9 aa, Homo Sapiens
YGIPHSFEN

SEQ ID NO: 1282950 - protein, 9 aa, Homo Sapiens
STIEKMEFK

SEQ ID NO: 1282951 - protein, 9 aa, Homo Sapiens
ICYSGIRVI

SEQ ID NO: 1282952 - protein, 9 aa, Homo Sapiens
VLNPELIKC

SEQ ID NO: 1282953 - protein, 9 aa, Homo Sapiens
LNYLISHQD

SEQ ID NO: 1282954 - protein, 9 aa, Homo Sapiens
TYLIGTELG

SEQ ID NO: 1282955 - protein, 9 aa, Homo Sapiens
SPTLCAPPL

SEQ ID NO: 1282956 - protein, 9 aa, Homo Sapiens
KRLHVKQNQ

SEQ ID NO: 1282957 - protein, 9 aa, Homo Sapiens
LDMIDEDDL

SEQ ID NO: 1282958 - protein, 9 aa, Homo Sapiens
LKTLAEHKQ

SEQ ID NO: 1282959 - protein, 9 aa, Homo Sapiens
NHPPNFSKV

SEQ ID NO: 1282960 - protein, 9 aa, Homo Sapiens
EDEIDKCVK

SEQ ID NO: 1282961 - protein, 9 aa, Homo Sapiens
FAHEFQVGD

SEQ ID NO: 1282962 - protein, 9 aa, Homo Sapiens
QLMVNLLIL

SEQ ID NO: 1282963 - protein, 9 aa, Homo Sapiens
LMTNKLPGS

SEQ ID NO: 1282964 - protein, 9 aa, Homo Sapiens
ITHLVCVLN

SEQ ID NO: 1282965 - protein, 9 aa, Homo Sapiens
FLPSDPNNF

SEQ ID NO: 1282966 - protein, 9 aa, Homo Sapiens
KSSMFRSEE

SEQ ID NO: 1282967 - protein, 9 aa, Homo Sapiens
SSQVPSKRT

SEQ ID NO: 1282968 - protein, 9 aa, Homo Sapiens
LHEARLYHI

SEQ ID NO: 1282969 - protein, 9 aa, Homo Sapiens
QNNMGLVRN

SEQ ID NO: 1282970 - protein, 9 aa, Homo Sapiens
IEPSIFNTL

SEQ ID NO: 1282971 - protein, 9 aa, Homo Sapiens
TDFVPEKVE

SEQ ID NO: 1282972 - protein, 9 aa, Homo Sapiens
SGNMNHCNW

SEQ ID NO: 1282973 - protein, 9 aa, Homo Sapiens
GLPCAVGEP

SEQ ID NO: 1282974 - protein, 9 aa, Homo Sapiens
EHTFSAVKQ

SEQ ID NO: 1282975 - protein, 9 aa, Homo Sapiens
RACMHAFPL

SEQ ID NO: 1282976 - protein, 9 aa, Homo Sapiens
RDWNDVQGL

SEQ ID NO: 1282977 - protein, 9 aa, Homo Sapiens
LRRKQDQQI

SEQ ID NO: 1282978 - protein, 9 aa, Homo Sapiens
SKNQKILYA

SEQ ID NO: 1282979 - protein, 9 aa, Homo Sapiens
NIALLHVWS

SEQ ID NO: 1282980 - protein, 9 aa, Homo Sapiens
HGLVKNTEQ

SEQ ID NO: 1282981 - protein, 9 aa, Homo Sapiens
LDVKDIEGV

SEQ ID NO: 1282982 - protein, 9 aa, Homo Sapiens
ALRKSCQFC

SEQ ID NO: 1282983 - protein, 9 aa, Homo Sapiens
VGDTEDNID

SEQ ID NO: 1282984 - protein, 9 aa, Homo Sapiens
NEQSHTRCT

SEQ ID NO: 1282985 - protein, 9 aa, Homo Sapiens
GGSGNFTLT

SEQ ID NO: 1282986 - protein, 9 aa, Homo Sapiens
PLKLDNLQI

SEQ ID NO: 1282987 - protein, 9 aa, Homo Sapiens
FENLTDTSS

SEQ ID NO: 1282988 - protein, 9 aa, Homo Sapiens
MVFMVLCSL

SEQ ID NO: 1282989 - protein, 9 aa, Homo Sapiens
RQTEGKGLG

SEQ ID NO: 1282990 - protein, 9 aa, Homo Sapiens
QVDCDYVVS

SEQ ID NO: 1282991 - protein, 9 aa, Homo Sapiens
SHILYTEES

SEQ ID NO: 1282992 - protein, 9 aa, Homo Sapiens
IVILSATNM

SEQ ID NO: 1282993 - protein, 9 aa, Homo Sapiens
VYLPYNINE

SEQ ID NO: 1282994 - protein, 9 aa, Homo Sapiens
KIVTLVLNI

SEQ ID NO: 1282995 - protein, 9 aa, Homo Sapiens
DNNQRQCVQ

SEQ ID NO: 1282996 - protein, 9 aa, Homo Sapiens
IRKSDVSRC

SEQ ID NO: 1282997 - protein, 9 aa, Homo Sapiens
TQSMQQQLE

SEQ ID NO: 1282998 - protein, 9 aa, Homo Sapiens
GYEVHHQKF

SEQ ID NO: 1282999 - protein, 9 aa, Homo Sapiens
NAAYLQDMA

SEQ ID NO: 1283000 - protein, 9 aa, Homo Sapiens
ESAESRPTL

SEQ ID NO: 1283001 - protein, 9 aa, Homo Sapiens
TIKVTVLGY

SEQ ID NO: 1283002 - protein, 9 aa, Homo Sapiens
DGSDSTFHK

SEQ ID NO: 1283003 - protein, 9 aa, Homo Sapiens
WLPRYYHIA

SEQ ID NO: 1283004 - protein, 9 aa, Homo Sapiens
KPVLTAVQG

SEQ ID NO: 1283005 - protein, 9 aa, Homo Sapiens
DLPEVINFI

SEQ ID NO: 1283006 - protein, 9 aa, Homo Sapiens
KIYARAEVK

SEQ ID NO: 1283007 - protein, 9 aa, Homo Sapiens
LCVGGVVHS

SEQ ID NO: 1283008 - protein, 9 aa, Homo Sapiens
DRLKVLAVT

SEQ ID NO: 1283009 - protein, 9 aa, Homo Sapiens
RTFCNDARF

SEQ ID NO: 1283010 - protein, 9 aa, Homo Sapiens
LKKTMEING

SEQ ID NO: 1283011 - protein, 9 aa, Homo Sapiens
ATEHVNGNC

SEQ ID NO: 1283012 - protein, 9 aa, Homo Sapiens
EMARFDLPE

SEQ ID NO: 1283013 - protein, 9 aa, Homo Sapiens
CLDLYSSLE

SEQ ID NO: 1283014 - protein, 9 aa, Homo Sapiens
MRSALRVLQ

SEQ ID NO: 1283015 - protein, 9 aa, Homo Sapiens
FAQTFGRIS

SEQ ID NO: 1283016 - protein, 9 aa, Homo Sapiens
NKYKENYKN

SEQ ID NO: 1283017 - protein, 9 aa, Homo Sapiens
TQLNIMKHE

SEQ ID NO: 1283018 - protein, 9 aa, Homo Sapiens
SLKLEHWHQ

SEQ ID NO: 1283019 - protein, 9 aa, Homo Sapiens
FWDEPFNTV

SEQ ID NO: 1283020 - protein, 9 aa, Homo Sapiens
EESPENILD

SEQ ID NO: 1283021 - protein, 9 aa, Homo Sapiens
KVEFKTMNA

SEQ ID NO: 1283022 - protein, 9 aa, Homo Sapiens
RFFENPALL

SEQ ID NO: 1283023 - protein, 9 aa, Homo Sapiens
LEIGQDLIH

SEQ ID NO: 1283024 - protein, 9 aa, Homo Sapiens
LIDNQSNLK

SEQ ID NO: 1283025 - protein, 9 aa, Homo Sapiens
NYCVALTKA

SEQ ID NO: 1283026 - protein, 9 aa, Homo Sapiens
DIGYVHRDL

SEQ ID NO: 1283027 - protein, 9 aa, Homo Sapiens
VFFCILLII

SEQ ID NO: 1283028 - protein, 9 aa, Homo Sapiens
TLLTIIVVD

SEQ ID NO: 1283029 - protein, 9 aa, Homo Sapiens
NCHSECLRL

SEQ ID NO: 1283030 - protein, 9 aa, Homo Sapiens
AYSPGNKNG

SEQ ID NO: 1283031 - protein, 9 aa, Homo Sapiens
LIGLYTMAN

SEQ ID NO: 1283032 - protein, 9 aa, Homo Sapiens
CTAKEIAYP

SEQ ID NO: 1283033 - protein, 9 aa, Homo Sapiens
GDEVMVELS

SEQ ID NO: 1283034 - protein, 9 aa, Homo Sapiens
EIVLEVVSH

SEQ ID NO: 1283035 - protein, 9 aa, Homo Sapiens
KQQKMAIQA

SEQ ID NO: 1283036 - protein, 9 aa, Homo Sapiens
LLEKASENV

SEQ ID NO: 1283037 - protein, 9 aa, Homo Sapiens
DHTAALTNE

SEQ ID NO: 1283038 - protein, 9 aa, Homo Sapiens
CEDSKNIPL

SEQ ID NO: 1283039 - protein, 9 aa, Homo Sapiens
DVDIDLHIY

SEQ ID NO: 1283040 - protein, 9 aa, Homo Sapiens
STSCSVIHE

SEQ ID NO: 1283041 - protein, 9 aa, Homo Sapiens
SPGNKNGVL

SEQ ID NO: 1283042 - protein, 9 aa, Homo Sapiens
SADSVGTDN

SEQ ID NO: 1283043 - protein, 9 aa, Homo Sapiens
DFDEFQYQM

SEQ ID NO: 1283044 - protein, 9 aa, Homo Sapiens
EYEKNNPCS

SEQ ID NO: 1283045 - protein, 9 aa, Homo Sapiens
SEDATYDIS

SEQ ID NO: 1283046 - protein, 9 aa, Homo Sapiens
HPTKKHCSV

SEQ ID NO: 1283047 - protein, 9 aa, Homo Sapiens
LLSQEVVKH

SEQ ID NO: 1283048 - protein, 9 aa, Homo Sapiens
WVLGSGGGP

SEQ ID NO: 1283049 - protein, 9 aa, Homo Sapiens
TVLRWRLYA

SEQ ID NO: 1283050 - protein, 9 aa, Homo Sapiens
KYVCPCSGF

SEQ ID NO: 1283051 - protein, 9 aa, Homo Sapiens
CKNCGEVLR

SEQ ID NO: 1283052 - protein, 9 aa, Homo Sapiens
IDNILDKEL

SEQ ID NO: 1283053 - protein, 9 aa, Homo Sapiens
LVTLSHLAQ

SEQ ID NO: 1283054 - protein, 9 aa, Homo Sapiens
IEKEKETFK

SEQ ID NO: 1283055 - protein, 9 aa, Homo Sapiens
QGLKGYIKG

SEQ ID NO: 1283056 - protein, 9 aa, Homo Sapiens
NPFFESSQT

SEQ ID NO: 1283057 - protein, 9 aa, Homo Sapiens
SEARSLLNT

SEQ ID NO: 1283058 - protein, 9 aa, Homo Sapiens
NSQVTQLTV

SEQ ID NO: 1283059 - protein, 9 aa, Homo Sapiens
YSFLAEKHL

SEQ ID NO: 1283060 - protein, 9 aa, Homo Sapiens
VGRESEYKH

SEQ ID NO: 1283061 - protein, 9 aa, Homo Sapiens
SGSECGNML

SEQ ID NO: 1283062 - protein, 9 aa, Homo Sapiens
SAKKNSNLT

SEQ ID NO: 1283063 - protein, 9 aa, Homo Sapiens
TRFALKTLC

SEQ ID NO: 1283064 - protein, 9 aa, Homo Sapiens
DDQDVKIKL

SEQ ID NO: 1283065 - protein, 9 aa, Homo Sapiens
FSNSSCLNM

SEQ ID NO: 1283066 - protein, 9 aa, Homo Sapiens
ENFTGENIV

SEQ ID NO: 1283067 - protein, 9 aa, Homo Sapiens
DNCLLYVLC

SEQ ID NO: 1283068 - protein, 9 aa, Homo Sapiens
AISNKMRQH

SEQ ID NO: 1283069 - protein, 9 aa, Homo Sapiens
TALQLRNAD

SEQ ID NO: 1283070 - protein, 9 aa, Homo Sapiens
YLTCNTQLG

SEQ ID NO: 1283071 - protein, 9 aa, Homo Sapiens
AALTNEGGV

SEQ ID NO: 1283072 - protein, 9 aa, Homo Sapiens
NNKKLFNYL

SEQ ID NO: 1283073 - protein, 9 aa, Homo Sapiens
NYEKALLEQ

SEQ ID NO: 1283074 - protein, 9 aa, Homo Sapiens
GSRITRLLS

SEQ ID NO: 1283075 - protein, 9 aa, Homo Sapiens
SRGADYAME

SEQ ID NO: 1283076 - protein, 9 aa, Homo Sapiens
ITIFERSND

SEQ ID NO: 1283077 - protein, 9 aa, Homo Sapiens
YHIVLHSGQ

SEQ ID NO: 1283078 - protein, 9 aa, Homo Sapiens
DEIDKCVKE

SEQ ID NO: 1283079 - protein, 9 aa, Homo Sapiens
ITPQHVFVK

SEQ ID NO: 1283080 - protein, 9 aa, Homo Sapiens
ILSRDIRYK

SEQ ID NO: 1283081 - protein, 9 aa, Homo Sapiens
HVGKNKVTD

SEQ ID NO: 1283082 - protein, 9 aa, Homo Sapiens
KRELTEMRS

SEQ ID NO: 1283083 - protein, 9 aa, Homo Sapiens
HSHASHNHS

SEQ ID NO: 1283084 - protein, 9 aa, Homo Sapiens
FELDGEIVA

SEQ ID NO: 1283085 - protein, 9 aa, Homo Sapiens
GQKDSVCWV

SEQ ID NO: 1283086 - protein, 9 aa, Homo Sapiens
FSTCASNLT

SEQ ID NO: 1283087 - protein, 9 aa, Homo Sapiens
FSKFSNPLA

SEQ ID NO: 1283088 - protein, 9 aa, Homo Sapiens
VCNLPHDID

SEQ ID NO: 1283089 - protein, 9 aa, Homo Sapiens
FDGVDVSKV

SEQ ID NO: 1283090 - protein, 9 aa, Homo Sapiens
ITSYNSQVT

SEQ ID NO: 1283091 - protein, 9 aa, Homo Sapiens
NKMINFLQS

SEQ ID NO: 1283092 - protein, 9 aa, Homo Sapiens
QGIAQEDKA

SEQ ID NO: 1283093 - protein, 9 aa, Homo Sapiens
EIKLLFGCY

SEQ ID NO: 1283094 - protein, 9 aa, Homo Sapiens
NALRKAQEV

SEQ ID NO: 1283095 - protein, 9 aa, Homo Sapiens
DIYECVGSS

SEQ ID NO: 1283096 - protein, 9 aa, Homo Sapiens
SGGQPLEGV

SEQ ID NO: 1283097 - protein, 9 aa, Homo Sapiens
TYKSLQDLV

SEQ ID NO: 1283098 - protein, 9 aa, Homo Sapiens
RQLLAIQKL

SEQ ID NO: 1283099 - protein, 9 aa, Homo Sapiens
VGNDELEHS

SEQ ID NO: 1283100 - protein, 9 aa, Homo Sapiens
TRPISLFHS

SEQ ID NO: 1283101 - protein, 9 aa, Homo Sapiens
EYVKTFKGL

SEQ ID NO: 1283102 - protein, 9 aa, Homo Sapiens
AYIDYLSHI

SEQ ID NO: 1283103 - protein, 9 aa, Homo Sapiens
SHSVEVLQK

SEQ ID NO: 1283104 - protein, 9 aa, Homo Sapiens
ITVCSRKRA

SEQ ID NO: 1283105 - protein, 9 aa, Homo Sapiens
CTIDMTLQS

SEQ ID NO: 1283106 - protein, 9 aa, Homo Sapiens
IVEALPTYC

SEQ ID NO: 1283107 - protein, 9 aa, Homo Sapiens
NISDHGLQK

SEQ ID NO: 1283108 - protein, 9 aa, Homo Sapiens
LCDDTISVF

SEQ ID NO: 1283109 - protein, 9 aa, Homo Sapiens
FENNQQPPA

SEQ ID NO: 1283110 - protein, 9 aa, Homo Sapiens
ATIKLHYQS

SEQ ID NO: 1283111 - protein, 9 aa, Homo Sapiens
PPSYLDELY

SEQ ID NO: 1283112 - protein, 9 aa, Homo Sapiens
DTLVHAKFE

SEQ ID NO: 1283113 - protein, 9 aa, Homo Sapiens
IQTGTTPQR

SEQ ID NO: 1283114 - protein, 9 aa, Homo Sapiens
EFGMAYFVL

SEQ ID NO: 1283115 - protein, 9 aa, Homo Sapiens
CVALTKANS

SEQ ID NO: 1283116 - protein, 9 aa, Homo Sapiens
LNHTVAKCY

SEQ ID NO: 1283117 - protein, 9 aa, Homo Sapiens
VDSEYYMGS

SEQ ID NO: 1283118 - protein, 9 aa, Homo Sapiens
RMNKYRSLL

SEQ ID NO: 1283119 - protein, 9 aa, Homo Sapiens
IKLSQDEQG

SEQ ID NO: 1283120 - protein, 9 aa, Homo Sapiens
RNVDTRVVC

SEQ ID NO: 1283121 - protein, 9 aa, Homo Sapiens
NNVLNKVIT

SEQ ID NO: 1283122 - protein, 9 aa, Homo Sapiens
TYIVTFDRT

SEQ ID NO: 1283123 - protein, 9 aa, Homo Sapiens
QHLFKFKKI

SEQ ID NO: 1283124 - protein, 9 aa, Homo Sapiens
PDILVGSLS

SEQ ID NO: 1283125 - protein, 9 aa, Homo Sapiens
WLLNKKHSK

SEQ ID NO: 1283126 - protein, 9 aa, Homo Sapiens
FLESWVLGS

SEQ ID NO: 1283127 - protein, 9 aa, Homo Sapiens
QNHTLLRPN

SEQ ID NO: 1283128 - protein, 9 aa, Homo Sapiens
TSKYSLSSK

SEQ ID NO: 1283129 - protein, 9 aa, Homo Sapiens
TSHRATVSK

SEQ ID NO: 1283130 - protein, 9 aa, Homo Sapiens
PGSDMPPSS

SEQ ID NO: 1283131 - protein, 9 aa, Homo Sapiens
VHGFFLNHY

SEQ ID NO: 1283132 - protein, 9 aa, Homo Sapiens
SSCLNMTDI

SEQ ID NO: 1283133 - protein, 9 aa, Homo Sapiens
SFYKEYISV

SEQ ID NO: 1283134 - protein, 9 aa, Homo Sapiens
QNEENIKSV

SEQ ID NO: 1283135 - protein, 9 aa, Homo Sapiens
KKSASVHGF

SEQ ID NO: 1283136 - protein, 9 aa, Homo Sapiens
IAAGCDHVL

SEQ ID NO: 1283137 - protein, 9 aa, Homo Sapiens
QPKYKYVLN

SEQ ID NO: 1283138 - protein, 9 aa, Homo Sapiens
DLGLLVLYV

SEQ ID NO: 1283139 - protein, 9 aa, Homo Sapiens
FPLSGGQPL

SEQ ID NO: 1283140 - protein, 9 aa, Homo Sapiens
QIANHCPDP

SEQ ID NO: 1283141 - protein, 9 aa, Homo Sapiens
GIPHAKGKI

SEQ ID NO: 1283142 - protein, 9 aa, Homo Sapiens
NNPKFDEVF

SEQ ID NO: 1283143 - protein, 9 aa, Homo Sapiens
DFGNYNKQP

SEQ ID NO: 1283144 - protein, 9 aa, Homo Sapiens
SLSLYNHFY

SEQ ID NO: 1283145 - protein, 9 aa, Homo Sapiens
EQRTSEDIE

SEQ ID NO: 1283146 - protein, 9 aa, Homo Sapiens
RFDGVDVSK

SEQ ID NO: 1283147 - protein, 9 aa, Homo Sapiens
QREKINNSD

SEQ ID NO: 1283148 - protein, 9 aa, Homo Sapiens
IPPSLNTTV

SEQ ID NO: 1283149 - protein, 9 aa, Homo Sapiens
YELQHSDKH

SEQ ID NO: 1283150 - protein, 9 aa, Homo Sapiens
LVTNANLGE

SEQ ID NO: 1283151 - protein, 9 aa, Homo Sapiens
YHIALDWKC

SEQ ID NO: 1283152 - protein, 9 aa, Homo Sapiens
CTPPRLCTD

SEQ ID NO: 1283153 - protein, 9 aa, Homo Sapiens
YMLMEACLC

SEQ ID NO: 1283154 - protein, 9 aa, Homo Sapiens
DAGKLFIVD

SEQ ID NO: 1283155 - protein, 9 aa, Homo Sapiens
PSAGADIET

SEQ ID NO: 1283156 - protein, 9 aa, Homo Sapiens
HFVDFLVQN

SEQ ID NO: 1283157 - protein, 9 aa, Homo Sapiens
TSEDIEGSH

SEQ ID NO: 1283158 - protein, 9 aa, Homo Sapiens
FGESYSGKA

SEQ ID NO: 1283159 - protein, 9 aa, Homo Sapiens
EVCAECNEA

SEQ ID NO: 1283160 - protein, 9 aa, Homo Sapiens
LQDIVEGMK

SEQ ID NO: 1283161 - protein, 9 aa, Homo Sapiens
TDILDIYEC

SEQ ID NO: 1283162 - protein, 9 aa, Homo Sapiens
GKNKVTDES

SEQ ID NO: 1283163 - protein, 9 aa, Homo Sapiens
ASLTNLEHK

SEQ ID NO: 1283164 - protein, 9 aa, Homo Sapiens
GVSSLCDDY

SEQ ID NO: 1283165 - protein, 9 aa, Homo Sapiens
TGTDTRILS

SEQ ID NO: 1283166 - protein, 9 aa, Homo Sapiens
SIVETHDPI

SEQ ID NO: 1283167 - protein, 9 aa, Homo Sapiens
KFFLVFSKL

SEQ ID NO: 1283168 - protein, 9 aa, Homo Sapiens
KQLIPLVEK

SEQ ID NO: 1283169 - protein, 9 aa, Homo Sapiens
STINELQQT

SEQ ID NO: 1283170 - protein, 9 aa, Homo Sapiens
RITRLLSDF

SEQ ID NO: 1283171 - protein, 9 aa, Homo Sapiens
DGTEQYFWS

SEQ ID NO: 1283172 - protein, 9 aa, Homo Sapiens
CHIKLTDFG

SEQ ID NO: 1283173 - protein, 9 aa, Homo Sapiens
FVISYYLCD

SEQ ID NO: 1283174 - protein, 9 aa, Homo Sapiens
QQKMAIQAP

SEQ ID NO: 1283175 - protein, 9 aa, Homo Sapiens
VCIGVPIML

SEQ ID NO: 1283176 - protein, 9 aa, Homo Sapiens
HRKCNNAHE

SEQ ID NO: 1283177 - protein, 9 aa, Homo Sapiens
HCRINTGEK

SEQ ID NO: 1283178 - protein, 9 aa, Homo Sapiens
DVEQPGWPS

SEQ ID NO: 1283179 - protein, 9 aa, Homo Sapiens
FIDAILLSL

SEQ ID NO: 1283180 - protein, 9 aa, Homo Sapiens
NTQDTPVKI

SEQ ID NO: 1283181 - protein, 9 aa, Homo Sapiens
LRVSYVSKS

SEQ ID NO: 1283182 - protein, 9 aa, Homo Sapiens
MKPTGTDTR

SEQ ID NO: 1283183 - protein, 9 aa, Homo Sapiens
MFNFPDTAT

SEQ ID NO: 1283184 - protein, 9 aa, Homo Sapiens
MCVDARTFC

SEQ ID NO: 1283185 - protein, 9 aa, Homo Sapiens
PDVKGGETY

SEQ ID NO: 1283186 - protein, 9 aa, Homo Sapiens
ENYISNNTL

SEQ ID NO: 1283187 - protein, 9 aa, Homo Sapiens
VEQPGWPSP

SEQ ID NO: 1283188 - protein, 9 aa, Homo Sapiens
PSNNGAMGG

SEQ ID NO: 1283189 - protein, 9 aa, Homo Sapiens
FLYKFFCGF

SEQ ID NO: 1283190 - protein, 9 aa, Homo Sapiens
ELFEEELTS

SEQ ID NO: 1283191 - protein, 9 aa, Homo Sapiens
FHIDFGHFF

SEQ ID NO: 1283192 - protein, 9 aa, Homo Sapiens
KQFLEKRLH

SEQ ID NO: 1283193 - protein, 9 aa, Homo Sapiens
DIKCSNIIL

SEQ ID NO: 1283194 - protein, 9 aa, Homo Sapiens
IKCPWTKEE

SEQ ID NO: 1283195 - protein, 9 aa, Homo Sapiens
KNPSTRLWH

SEQ ID NO: 1283196 - protein, 9 aa, Homo Sapiens
YKYVLNEFY

SEQ ID NO: 1283197 - protein, 9 aa, Homo Sapiens
DVQLCLEYL

SEQ ID NO: 1283198 - protein, 9 aa, Homo Sapiens
MYQILQGLS

SEQ ID NO: 1283199 - protein, 9 aa, Homo Sapiens
KKEGLTLNR

SEQ ID NO: 1283200 - protein, 9 aa, Homo Sapiens
ATSGSEYRH

SEQ ID NO: 1283201 - protein, 9 aa, Homo Sapiens
SDKHVGTKK

SEQ ID NO: 1283202 - protein, 9 aa, Homo Sapiens
KAHHNLLAA

SEQ ID NO: 1283203 - protein, 9 aa, Homo Sapiens
YWRVCNKIK

SEQ ID NO: 1283204 - protein, 9 aa, Homo Sapiens
ALTHKSTSL

SEQ ID NO: 1283205 - protein, 9 aa, Homo Sapiens
LLKKSASVH

SEQ ID NO: 1283206 - protein, 9 aa, Homo Sapiens
PQIINKMIN

SEQ ID NO: 1283207 - protein, 9 aa, Homo Sapiens
ASVHGFFLN

SEQ ID NO: 1283208 - protein, 9 aa, Homo Sapiens
ESLCQYAAA

SEQ ID NO: 1283209 - protein, 9 aa, Homo Sapiens
KENYKNHMR

SEQ ID NO: 1283210 - protein, 9 aa, Homo Sapiens
LERDKVVGH

SEQ ID NO: 1283211 - protein, 9 aa, Homo Sapiens
GEQFVCLMA

SEQ ID NO: 1283212 - protein, 9 aa, Homo Sapiens
LPRSHSVLA

SEQ ID NO: 1283213 - protein, 9 aa, Homo Sapiens
RSLATMDSQ

SEQ ID NO: 1283214 - protein, 9 aa, Homo Sapiens
KLVTYECRK

SEQ ID NO: 1283215 - protein, 9 aa, Homo Sapiens
QTSSNLKVI

SEQ ID NO: 1283216 - protein, 9 aa, Homo Sapiens
VLVYWRVCN

SEQ ID NO: 1283217 - protein, 9 aa, Homo Sapiens
QHSDPEDSK

SEQ ID NO: 1283218 - protein, 9 aa, Homo Sapiens
MHVGKNKVT

SEQ ID NO: 1283219 - protein, 9 aa, Homo Sapiens
HVGSEDKKI

SEQ ID NO: 1283220 - protein, 9 aa, Homo Sapiens
CAFNILVPS

SEQ ID NO: 1283221 - protein, 9 aa, Homo Sapiens
SLNYSCVKE

SEQ ID NO: 1283222 - protein, 9 aa, Homo Sapiens
TADYSLYNE

SEQ ID NO: 1283223 - protein, 9 aa, Homo Sapiens
DMNDNRHEF

SEQ ID NO: 1283224 - protein, 9 aa, Homo Sapiens
ELMRELDQN

SEQ ID NO: 1283225 - protein, 9 aa, Homo Sapiens
SKELQGLDG

SEQ ID NO: 1283226 - protein, 9 aa, Homo Sapiens
NDVLGSANP

SEQ ID NO: 1283227 - protein, 9 aa, Homo Sapiens
FLTWNCDKS

SEQ ID NO: 1283228 - protein, 9 aa, Homo Sapiens
YAESLCQYA

SEQ ID NO: 1283229 - protein, 9 aa, Homo Sapiens
HEVMEQVRG

SEQ ID NO: 1283230 - protein, 9 aa, Homo Sapiens
KMYKVEFKT

SEQ ID NO: 1283231 - protein, 9 aa, Homo Sapiens
IDINKPGPL

SEQ ID NO: 1283232 - protein, 9 aa, Homo Sapiens
LEFWDEPFN

SEQ ID NO: 1283233 - protein, 9 aa, Homo Sapiens
HVFEVICTS

SEQ ID NO: 1283234 - protein, 9 aa, Homo Sapiens
YNNIENYST

SEQ ID NO: 1283235 - protein, 9 aa, Homo Sapiens
IPSWLINLA

SEQ ID NO: 1283236 - protein, 9 aa, Homo Sapiens
AQGNKTILE

SEQ ID NO: 1283237 - protein, 9 aa, Homo Sapiens
DWSLKLEHW

SEQ ID NO: 1283238 - protein, 9 aa, Homo Sapiens
NQECAGIQG

SEQ ID NO: 1283239 - protein, 9 aa, Homo Sapiens
FVDFLVQNC

SEQ ID NO: 1283240 - protein, 9 aa, Homo Sapiens
SSASSQVPS

SEQ ID NO: 1283241 - protein, 9 aa, Homo Sapiens
SSEDATYDI

SEQ ID NO: 1283242 - protein, 9 aa, Homo Sapiens
KVQQKHRQK

SEQ ID NO: 1283243 - protein, 9 aa, Homo Sapiens
TQAEMSIIG

SEQ ID NO: 1283244 - protein, 9 aa, Homo Sapiens
LSHINRLQN

SEQ ID NO: 1283245 - protein, 9 aa, Homo Sapiens
PSKPLLRSP

SEQ ID NO: 1283246 - protein, 9 aa, Homo Sapiens
KEEHGLVKN

SEQ ID NO: 1283247 - protein, 9 aa, Homo Sapiens
DSYTTNNMH

SEQ ID NO: 1283248 - protein, 9 aa, Homo Sapiens
GLIDSETMF

SEQ ID NO: 1283249 - protein, 9 aa, Homo Sapiens
NSWTHILMI

SEQ ID NO: 1283250 - protein, 9 aa, Homo Sapiens
NFYELSPNI

SEQ ID NO: 1283251 - protein, 9 aa, Homo Sapiens
LTDTSSPTI

SEQ ID NO: 1283252 - protein, 9 aa, Homo Sapiens
QDWETELLL

SEQ ID NO: 1283253 - protein, 9 aa, Homo Sapiens
CVFQLLTTM

SEQ ID NO: 1283254 - protein, 9 aa, Homo Sapiens
GDYLHETTR

SEQ ID NO: 1283255 - protein, 9 aa, Homo Sapiens
PDDAQGVEE

SEQ ID NO: 1283256 - protein, 9 aa, Homo Sapiens
NLTVCNGQG

SEQ ID NO: 1283257 - protein, 9 aa, Homo Sapiens
TFVGRIVQD

SEQ ID NO: 1283258 - protein, 9 aa, Homo Sapiens
YRNPLFLRL

SEQ ID NO: 1283259 - protein, 9 aa, Homo Sapiens
YTSRAKISG

SEQ ID NO: 1283260 - protein, 9 aa, Homo Sapiens
SHSVLAVDG

SEQ ID NO: 1283261 - protein, 9 aa, Homo Sapiens
NLDSFRFEK

SEQ ID NO: 1283262 - protein, 9 aa, Homo Sapiens
VDYISGCGF

SEQ ID NO: 1283263 - protein, 9 aa, Homo Sapiens
IHAFGGMAN

SEQ ID NO: 1283264 - protein, 9 aa, Homo Sapiens
SATTTTTIV

SEQ ID NO: 1283265 - protein, 9 aa, Homo Sapiens
AFGTLSHSL

SEQ ID NO: 1283266 - protein, 9 aa, Homo Sapiens
TQPVEHSAP

SEQ ID NO: 1283267 - protein, 9 aa, Homo Sapiens
TEQYFWSPS

SEQ ID NO: 1283268 - protein, 9 aa, Homo Sapiens
FGSTEECEK

SEQ ID NO: 1283269 - protein, 9 aa, Homo Sapiens
HYGERITLR

SEQ ID NO: 1283270 - protein, 9 aa, Homo Sapiens
KRGHTGEKP

SEQ ID NO: 1283271 - protein, 9 aa, Homo Sapiens
IGMQPHLQA

SEQ ID NO: 1283272 - protein, 9 aa, Homo Sapiens
RHVQLIVND

SEQ ID NO: 1283273 - protein, 9 aa, Homo Sapiens
AASMESLYY

SEQ ID NO: 1283274 - protein, 9 aa, Homo Sapiens
FLQVQLNDL

SEQ ID NO: 1283275 - protein, 9 aa, Homo Sapiens
QLEISTKMC

SEQ ID NO: 1283276 - protein, 9 aa, Homo Sapiens
DVIAGRGIN

SEQ ID NO: 1283277 - protein, 9 aa, Homo Sapiens
QQKLEQDEN

SEQ ID NO: 1283278 - protein, 9 aa, Homo Sapiens
QLKKTMEIN

SEQ ID NO: 1283279 - protein, 9 aa, Homo Sapiens
SLLEKASEN

SEQ ID NO: 1283280 - protein, 9 aa, Homo Sapiens
YAGSMCESC

SEQ ID NO: 1283281 - protein, 9 aa, Homo Sapiens
SNKRTLTKI

SEQ ID NO: 1283282 - protein, 9 aa, Homo Sapiens
FEVTELKLN

SEQ ID NO: 1283283 - protein, 9 aa, Homo Sapiens
RLAGDDAQK

SEQ ID NO: 1283284 - protein, 9 aa, Homo Sapiens
LHARKHIFP

SEQ ID NO: 1283285 - protein, 9 aa, Homo Sapiens
NICAHMTAS

SEQ ID NO: 1283286 - protein, 9 aa, Homo Sapiens
VEENTYRQL

SEQ ID NO: 1283287 - protein, 9 aa, Homo Sapiens
NCDSYWVEM

SEQ ID NO: 1283288 - protein, 9 aa, Homo Sapiens
HHTPLEGRA

SEQ ID NO: 1283289 - protein, 9 aa, Homo Sapiens
TETCVTTQA

SEQ ID NO: 1283290 - protein, 9 aa, Homo Sapiens
INRLQNLTI

SEQ ID NO: 1283291 - protein, 9 aa, Homo Sapiens
LYGSVCDLM

SEQ ID NO: 1283292 - protein, 9 aa, Homo Sapiens
AHETVPSAP

SEQ ID NO: 1283293 - protein, 9 aa, Homo Sapiens
LQHSDKHVG

SEQ ID NO: 1283294 - protein, 9 aa, Homo Sapiens
VQQKHRQKH

SEQ ID NO: 1283295 - protein, 9 aa, Homo Sapiens
TEHVNGNCT

SEQ ID NO: 1283296 - protein, 9 aa, Homo Sapiens
SVLTDFDGK

SEQ ID NO: 1283297 - protein, 9 aa, Homo Sapiens
SFTSLSTQE

SEQ ID NO: 1283298 - protein, 9 aa, Homo Sapiens
YGVCCKQKL

SEQ ID NO: 1283299 - protein, 9 aa, Homo Sapiens
HTLPLTSYK

SEQ ID NO: 1283300 - protein, 9 aa, Homo Sapiens
YKSANSFTV

SEQ ID NO: 1283301 - protein, 9 aa, Homo Sapiens
LVTYECRKK

SEQ ID NO: 1283302 - protein, 9 aa, Homo Sapiens
LLSTINELQ

SEQ ID NO: 1283303 - protein, 9 aa, Homo Sapiens
NALKPCFFS

SEQ ID NO: 1283304 - protein, 9 aa, Homo Sapiens
KEAKFAQTF

SEQ ID NO: 1283305 - protein, 9 aa, Homo Sapiens
KINNSDAKN

SEQ ID NO: 1283306 - protein, 9 aa, Homo Sapiens
TEDQFNDEH

SEQ ID NO: 1283307 - protein, 9 aa, Homo Sapiens
LSQEPYQQQ

SEQ ID NO: 1283308 - protein, 9 aa, Homo Sapiens
LDTKQIFCV

SEQ ID NO: 1283309 - protein, 9 aa, Homo Sapiens
NGDTCECTD

SEQ ID NO: 1283310 - protein, 9 aa, Homo Sapiens
KLITDDKEG

SEQ ID NO: 1283311 - protein, 9 aa, Homo Sapiens
EDFLLAIQM

SEQ ID NO: 1283312 - protein, 9 aa, Homo Sapiens
ENAAVQKIV

SEQ ID NO: 1283313 - protein, 9 aa, Homo Sapiens
STLNTHKKI

SEQ ID NO: 1283314 - protein, 9 aa, Homo Sapiens
LRKAQEVCN

SEQ ID NO: 1283315 - protein, 9 aa, Homo Sapiens
NHTLLQQDL

SEQ ID NO: 1283316 - protein, 9 aa, Homo Sapiens
EHGLVKNTE

SEQ ID NO: 1283317 - protein, 9 aa, Homo Sapiens
FPQKPIQLY

SEQ ID NO: 1283318 - protein, 9 aa, Homo Sapiens
ALYLICQRC

SEQ ID NO: 1283319 - protein, 9 aa, Homo Sapiens
DCFNIFTKE

SEQ ID NO: 1283320 - protein, 9 aa, Homo Sapiens
LEDQELQLP

SEQ ID NO: 1283321 - protein, 9 aa, Homo Sapiens
GLNTLIQFE

SEQ ID NO: 1283322 - protein, 9 aa, Homo Sapiens
SKQVDCDYV

SEQ ID NO: 1283323 - protein, 9 aa, Homo Sapiens
VNKVIELLQ

SEQ ID NO: 1283324 - protein, 9 aa, Homo Sapiens
ELQGLDGLN

SEQ ID NO: 1283325 - protein, 9 aa, Homo Sapiens
FCHNCNNFR

SEQ ID NO: 1283326 - protein, 9 aa, Homo Sapiens
QMIKINFKF

SEQ ID NO: 1283327 - protein, 9 aa, Homo Sapiens
ERGIIYRDM

SEQ ID NO: 1283328 - protein, 9 aa, Homo Sapiens
QAFCPKFRC

SEQ ID NO: 1283329 - protein, 9 aa, Homo Sapiens
VLEHKVLGP

SEQ ID NO: 1283330 - protein, 9 aa, Homo Sapiens
IINNTENVS

SEQ ID NO: 1283331 - protein, 9 aa, Homo Sapiens
PVPITVPDY

SEQ ID NO: 1283332 - protein, 9 aa, Homo Sapiens
RLHVKQNQH

SEQ ID NO: 1283333 - protein, 9 aa, Homo Sapiens
FLGFEWQKL

SEQ ID NO: 1283334 - protein, 9 aa, Homo Sapiens
HSFNNCCMS

SEQ ID NO: 1283335 - protein, 9 aa, Homo Sapiens
EELAENYSY

SEQ ID NO: 1283336 - protein, 9 aa, Homo Sapiens
EFPYSMNHI

SEQ ID NO: 1283337 - protein, 9 aa, Homo Sapiens
GIAFTDLQP

SEQ ID NO: 1283338 - protein, 9 aa, Homo Sapiens
DEDWQMSVS

SEQ ID NO: 1283339 - protein, 9 aa, Homo Sapiens
SQTDLFCNP

SEQ ID NO: 1283340 - protein, 9 aa, Homo Sapiens
LKVSSIGTF

SEQ ID NO: 1283341 - protein, 9 aa, Homo Sapiens
HYECKQCGK

SEQ ID NO: 1283342 - protein, 9 aa, Homo Sapiens
YYIFLCIQN

SEQ ID NO: 1283343 - protein, 9 aa, Homo Sapiens
GSKEFSAEL

SEQ ID NO: 1283344 - protein, 9 aa, Homo Sapiens
MFVISYYLC

SEQ ID NO: 1283345 - protein, 9 aa, Homo Sapiens
ELYKAVENL

SEQ ID NO: 1283346 - protein, 9 aa, Homo Sapiens
GQVDVDRGP

SEQ ID NO: 1283347 - protein, 9 aa, Homo Sapiens
HTPIYFLLS

SEQ ID NO: 1283348 - protein, 9 aa, Homo Sapiens
TGRSFCDKD

SEQ ID NO: 1283349 - protein, 9 aa, Homo Sapiens
FCPLKNVCC

SEQ ID NO: 1283350 - protein, 9 aa, Homo Sapiens
VKGGETYLI

SEQ ID NO: 1283351 - protein, 9 aa, Homo Sapiens
NHTVAKCYE

SEQ ID NO: 1283352 - protein, 9 aa, Homo Sapiens
ETYLMMADL

SEQ ID NO: 1283353 - protein, 9 aa, Homo Sapiens
IVPLQIILP

SEQ ID NO: 1283354 - protein, 9 aa, Homo Sapiens
LKLEHWHQK

SEQ ID NO: 1283355 - protein, 9 aa, Homo Sapiens
LVAIVSKSF

SEQ ID NO: 1283356 - protein, 9 aa, Homo Sapiens
NLPGSYQCK

SEQ ID NO: 1283357 - protein, 9 aa, Homo Sapiens
ILNYLRHVQ

SEQ ID NO: 1283358 - protein, 9 aa, Homo Sapiens
SNLCRGKNH

SEQ ID NO: 1283359 - protein, 9 aa, Homo Sapiens
DKEGPGWTL

SEQ ID NO: 1283360 - protein, 9 aa, Homo Sapiens
SATEDEIDK

SEQ ID NO: 1283361 - protein, 9 aa, Homo Sapiens
NLEELYKAV

SEQ ID NO: 1283362 - protein, 9 aa, Homo Sapiens
VENALRKAQ

SEQ ID NO: 1283363 - protein, 9 aa, Homo Sapiens
LNEAEFHKH

SEQ ID NO: 1283364 - protein, 9 aa, Homo Sapiens
LNKKHSKKK

SEQ ID NO: 1283365 - protein, 9 aa, Homo Sapiens
NNSDAKNNR

SEQ ID NO: 1283366 - protein, 9 aa, Homo Sapiens
GNMVEENTY

SEQ ID NO: 1283367 - protein, 9 aa, Homo Sapiens
SIIQRGKGL

SEQ ID NO: 1283368 - protein, 9 aa, Homo Sapiens
LRWRLYAIA

SEQ ID NO: 1283369 - protein, 9 aa, Homo Sapiens
KCKSINEKM

SEQ ID NO: 1283370 - protein, 9 aa, Homo Sapiens
NGGQEQALG

SEQ ID NO: 1283371 - protein, 9 aa, Homo Sapiens
SCLSCSHAL

SEQ ID NO: 1283372 - protein, 9 aa, Homo Sapiens
AQKRKDLEK

SEQ ID NO: 1283373 - protein, 9 aa, Homo Sapiens
LTSTAVPSF

SEQ ID NO: 1283374 - protein, 9 aa, Homo Sapiens
SFCDKDFRT

SEQ ID NO: 1283375 - protein, 9 aa, Homo Sapiens
WVPDVGEYN

SEQ ID NO: 1283376 - protein, 9 aa, Homo Sapiens
LCKTAVLKA

SEQ ID NO: 1283377 - protein, 9 aa, Homo Sapiens
PEGTRDVHL

SEQ ID NO: 1283378 - protein, 9 aa, Homo Sapiens
DADFDEFQY

SEQ ID NO: 1283379 - protein, 9 aa, Homo Sapiens
IIERAGQHD

SEQ ID NO: 1283380 - protein, 9 aa, Homo Sapiens
MFQVHHVLC

SEQ ID NO: 1283381 - protein, 9 aa, Homo Sapiens
SNLKKALNR

SEQ ID NO: 1283382 - protein, 9 aa, Homo Sapiens
RCGKLPLSP

SEQ ID NO: 1283383 - protein, 9 aa, Homo Sapiens
YFFNCDCCE

SEQ ID NO: 1283384 - protein, 9 aa, Homo Sapiens
GGTKVIDTK

SEQ ID NO: 1283385 - protein, 9 aa, Homo Sapiens
CPDYCHNMY

SEQ ID NO: 1283386 - protein, 9 aa, Homo Sapiens
LIDSETMFR

SEQ ID NO: 1283387 - protein, 9 aa, Homo Sapiens
LWSTSIKGI

SEQ ID NO: 1283388 - protein, 9 aa, Homo Sapiens
FVCNLPHDI

SEQ ID NO: 1283389 - protein, 9 aa, Homo Sapiens
LDNKKMTAL

SEQ ID NO: 1283390 - protein, 9 aa, Homo Sapiens
MNKYRSLLE

SEQ ID NO: 1283391 - protein, 9 aa, Homo Sapiens
HANYSLAPI

SEQ ID NO: 1283392 - protein, 9 aa, Homo Sapiens
FLSFATSTQ

SEQ ID NO: 1283393 - protein, 9 aa, Homo Sapiens
QRTSEDIEG

SEQ ID NO: 1283394 - protein, 9 aa, Homo Sapiens
KTALQLRNA

SEQ ID NO: 1283395 - protein, 9 aa, Homo Sapiens
ALVERKHPL

SEQ ID NO: 1283396 - protein, 9 aa, Homo Sapiens
VFGSTEECE

SEQ ID NO: 1283397 - protein, 9 aa, Homo Sapiens
QLLDDQDVK

SEQ ID NO: 1283398 - protein, 9 aa, Homo Sapiens
MLSYYMTME

SEQ ID NO: 1283399 - protein, 9 aa, Homo Sapiens
YRSVLENHH

SEQ ID NO: 1283400 - protein, 9 aa, Homo Sapiens
TCVTTQAPK

SEQ ID NO: 1283401 - protein, 9 aa, Homo Sapiens
TMCNHLENI

SEQ ID NO: 1283402 - protein, 9 aa, Homo Sapiens
TLFGIIVRM

SEQ ID NO: 1283403 - protein, 9 aa, Homo Sapiens
SYILTFRLK

SEQ ID NO: 1283404 - protein, 9 aa, Homo Sapiens
SILTSIHSL

SEQ ID NO: 1283405 - protein, 9 aa, Homo Sapiens
RFYQSEIKL

SEQ ID NO: 1283406 - protein, 9 aa, Homo Sapiens
HRATVSKEQ

SEQ ID NO: 1283407 - protein, 9 aa, Homo Sapiens
LSLNQTENM

SEQ ID NO: 1283408 - protein, 9 aa, Homo Sapiens
EIDKCVKEK

SEQ ID NO: 1283409 - protein, 9 aa, Homo Sapiens
RNFYELSPN

SEQ ID NO: 1283410 - protein, 9 aa, Homo Sapiens
FYINEDQIL

SEQ ID NO: 1283411 - protein, 9 aa, Homo Sapiens
IDNQSNLKM

SEQ ID NO: 1283412 - protein, 9 aa, Homo Sapiens
QLHIRETLL

SEQ ID NO: 1283413 - protein, 9 aa, Homo Sapiens
EQDGLAVLG

SEQ ID NO: 1283414 - protein, 9 aa, Homo Sapiens
FDGKDVATK

SEQ ID NO: 1283415 - protein, 9 aa, Homo Sapiens
KCCHFTLED

SEQ ID NO: 1283416 - protein, 9 aa, Homo Sapiens
GYPGSPGPP

SEQ ID NO: 1283417 - protein, 9 aa, Homo Sapiens
EQPHGWVSW

SEQ ID NO: 1283418 - protein, 9 aa, Homo Sapiens
DPEDSKTST

SEQ ID NO: 1283419 - protein, 9 aa, Homo Sapiens
RDYIIEPSI

SEQ ID NO: 1283420 - protein, 9 aa, Homo Sapiens
LIHCSGKEE

SEQ ID NO: 1283421 - protein, 9 aa, Homo Sapiens
KAKYKDDFS

SEQ ID NO: 1283422 - protein, 9 aa, Homo Sapiens
NQTLTQLNI

SEQ ID NO: 1283423 - protein, 9 aa, Homo Sapiens
ELLNAIHNC

SEQ ID NO: 1283424 - protein, 9 aa, Homo Sapiens
MTLFDEKFY

SEQ ID NO: 1283425 - protein, 9 aa, Homo Sapiens
HVLETDEVV

SEQ ID NO: 1283426 - protein, 9 aa, Homo Sapiens
DPPCHRLSR

SEQ ID NO: 1283427 - protein, 9 aa, Homo Sapiens
QCQCTSVCA

SEQ ID NO: 1283428 - protein, 9 aa, Homo Sapiens
RRKQDQQIY

SEQ ID NO: 1283429 - protein, 9 aa, Homo Sapiens
VDREPHEEL

SEQ ID NO: 1283430 - protein, 9 aa, Homo Sapiens
QMSNLKKAL

SEQ ID NO: 1283431 - protein, 9 aa, Homo Sapiens
EEVYLPYNI

SEQ ID NO: 1283432 - protein, 9 aa, Homo Sapiens
LFLVVWLVL

SEQ ID NO: 1283433 - protein, 9 aa, Homo Sapiens
VSGQLIDSI

SEQ ID NO: 1283434 - protein, 9 aa, Homo Sapiens
IHSRNISYC

SEQ ID NO: 1283435 - protein, 9 aa, Homo Sapiens
CRLTFPTSC

SEQ ID NO: 1283436 - protein, 9 aa, Homo Sapiens
RQFLESWVL

SEQ ID NO: 1283437 - protein, 9 aa, Homo Sapiens
RVAALRGEG

SEQ ID NO: 1283438 - protein, 9 aa, Homo Sapiens
TGENIVSKS

SEQ ID NO: 1283439 - protein, 9 aa, Homo Sapiens
SKPLLRSPL

SEQ ID NO: 1283440 - protein, 9 aa, Homo Sapiens
QSADSVGTD

SEQ ID NO: 1283441 - protein, 9 aa, Homo Sapiens
FLFIALLHQ

SEQ ID NO: 1283442 - protein, 9 aa, Homo Sapiens
PCSGFVPSF

SEQ ID NO: 1283443 - protein, 9 aa, Homo Sapiens
PCPRGDLGS

SEQ ID NO: 1283444 - protein, 9 aa, Homo Sapiens
HLFKFKKIE

SEQ ID NO: 1283445 - protein, 9 aa, Homo Sapiens
NLCHLLSAV

SEQ ID NO: 1283446 - protein, 9 aa, Homo Sapiens
SLYNHFYVS

SEQ ID NO: 1283447 - protein, 9 aa, Homo Sapiens
YQILQGLSF

SEQ ID NO: 1283448 - protein, 9 aa, Homo Sapiens
YSDGSKEFS

SEQ ID NO: 1283449 - protein, 9 aa, Homo Sapiens
FMWLMTYVC

SEQ ID NO: 1283450 - protein, 9 aa, Homo Sapiens
QKPRLTSTA

SEQ ID NO: 1283451 - protein, 9 aa, Homo Sapiens
EIYYDSFIR

SEQ ID NO: 1283452 - protein, 9 aa, Homo Sapiens
LPQFLYKFF

SEQ ID NO: 1283453 - protein, 9 aa, Homo Sapiens
GRNYEKALL

SEQ ID NO: 1283454 - protein, 9 aa, Homo Sapiens
HHSTQHKRN

SEQ ID NO: 1283455 - protein, 9 aa, Homo Sapiens
YCVHYYAVK

SEQ ID NO: 1283456 - protein, 9 aa, Homo Sapiens
KPDSVGLPH

SEQ ID NO: 1283457 - protein, 9 aa, Homo Sapiens
SYSKMLLFP

SEQ ID NO: 1283458 - protein, 9 aa, Homo Sapiens
SMLYSVQQL

SEQ ID NO: 1283459 - protein, 9 aa, Homo Sapiens
ENLTDTSSP

SEQ ID NO: 1283460 - protein, 9 aa, Homo Sapiens
IFGHWRTHL

SEQ ID NO: 1283461 - protein, 9 aa, Homo Sapiens
SVLTTNSSW

SEQ ID NO: 1283462 - protein, 9 aa, Homo Sapiens
LIQHGIHDV

SEQ ID NO: 1283463 - protein, 9 aa, Homo Sapiens
KVSIIQRGK

SEQ ID NO: 1283464 - protein, 9 aa, Homo Sapiens
NSMEDTDQG

SEQ ID NO: 1283465 - protein, 9 aa, Homo Sapiens
QGNKTILES

SEQ ID NO: 1283466 - protein, 9 aa, Homo Sapiens
SDTKPEDLN

SEQ ID NO: 1283467 - protein, 9 aa, Homo Sapiens
RSYDGRSLF

SEQ ID NO: 1283468 - protein, 9 aa, Homo Sapiens
EIMSDQLFR

SEQ ID NO: 1283469 - protein, 9 aa, Homo Sapiens
IVLEEGVKC

SEQ ID NO: 1283470 - protein, 9 aa, Homo Sapiens
CSTIDQAVN

SEQ ID NO: 1283471 - protein, 9 aa, Homo Sapiens
LELIKTENN

SEQ ID NO: 1283472 - protein, 9 aa, Homo Sapiens
IYRARTLPI

SEQ ID NO: 1283473 - protein, 9 aa, Homo Sapiens
ALPGVFCGP

SEQ ID NO: 1283474 - protein, 9 aa, Homo Sapiens
GLTLNRKRK

SEQ ID NO: 1283475 - protein, 9 aa, Homo Sapiens
QEKTALQLR

SEQ ID NO: 1283476 - protein, 9 aa, Homo Sapiens
QSNKRTLTK

SEQ ID NO: 1283477 - protein, 9 aa, Homo Sapiens
KQLRYIILT

SEQ ID NO: 1283478 - protein, 9 aa, Homo Sapiens
NISYCKAQC

SEQ ID NO: 1283479 - protein, 9 aa, Homo Sapiens
DNPRLESCQ

SEQ ID NO: 1283480 - protein, 9 aa, Homo Sapiens
PRSTKLITD

SEQ ID NO: 1283481 - protein, 9 aa, Homo Sapiens
NATVAAFTA

SEQ ID NO: 1283482 - protein, 9 aa, Homo Sapiens
EAFGLRLNN

SEQ ID NO: 1283483 - protein, 9 aa, Homo Sapiens
DAQKRKDLE

SEQ ID NO: 1283484 - protein, 9 aa, Homo Sapiens
NVLDPASSD

SEQ ID NO: 1283485 - protein, 9 aa, Homo Sapiens
KKAHHNLLA

SEQ ID NO: 1283486 - protein, 9 aa, Homo Sapiens
PENILDNDP

SEQ ID NO: 1283487 - protein, 9 aa, Homo Sapiens
PLCAPEPDA

SEQ ID NO: 1283488 - protein, 9 aa, Homo Sapiens
LKMCGRKVE

SEQ ID NO: 1283489 - protein, 9 aa, Homo Sapiens
EVYLPYNIN

SEQ ID NO: 1283490 - protein, 9 aa, Homo Sapiens
CNLPHDIDE

SEQ ID NO: 1283491 - protein, 9 aa, Homo Sapiens
DMFCPFYKT

SEQ ID NO: 1283492 - protein, 9 aa, Homo Sapiens
ETHTCEKLY

SEQ ID NO: 1283493 - protein, 9 aa, Homo Sapiens
PSNSIFHVG

SEQ ID NO: 1283494 - protein, 9 aa, Homo Sapiens
HWIKDELDK

SEQ ID NO: 1283495 - protein, 9 aa, Homo Sapiens
IAKLIESCG

SEQ ID NO: 1283496 - protein, 9 aa, Homo Sapiens
LSLRAHETV

SEQ ID NO: 1283497 - protein, 9 aa, Homo Sapiens
EVHTTGVYR

SEQ ID NO: 1283498 - protein, 9 aa, Homo Sapiens
NFSRCSQTL

SEQ ID NO: 1283499 - protein, 9 aa, Homo Sapiens
AMSGLNGAE

SEQ ID NO: 1283500 - protein, 9 aa, Homo Sapiens
PQSQLMQCS

SEQ ID NO: 1283501 - protein, 9 aa, Homo Sapiens
YNLEELYKA

SEQ ID NO: 1283502 - protein, 9 aa, Homo Sapiens
TQQQRINIG

SEQ ID NO: 1283503 - protein, 9 aa, Homo Sapiens
DAGNKGILS

SEQ ID NO: 1283504 - protein, 9 aa, Homo Sapiens
KTKVANQSQ

SEQ ID NO: 1283505 - protein, 9 aa, Homo Sapiens
GSGNFTLTS

SEQ ID NO: 1283506 - protein, 9 aa, Homo Sapiens
ILSKRLLYI

SEQ ID NO: 1283507 - protein, 9 aa, Homo Sapiens
VRRMSTIKV

SEQ ID NO: 1283508 - protein, 9 aa, Homo Sapiens
CRKFKLESQ

SEQ ID NO: 1283509 - protein, 9 aa, Homo Sapiens
IHTEDQFND

SEQ ID NO: 1283510 - protein, 9 aa, Homo Sapiens
YIIEPSIFN

SEQ ID NO: 1283511 - protein, 9 aa, Homo Sapiens
GLSFIHKHG

SEQ ID NO: 1283512 - protein, 9 aa, Homo Sapiens
PEIFMALEG

SEQ ID NO: 1283513 - protein, 9 aa, Homo Sapiens
CNHSFNNCC

SEQ ID NO: 1283514 - protein, 9 aa, Homo Sapiens
SSMFRSEEE

SEQ ID NO: 1283515 - protein, 9 aa, Homo Sapiens
DLDSGYNAL

SEQ ID NO: 1283516 - protein, 9 aa, Homo Sapiens
IIKKGLQYV

SEQ ID NO: 1283517 - protein, 9 aa, Homo Sapiens
NLLMKDQKP

SEQ ID NO: 1283518 - protein, 9 aa, Homo Sapiens
KELLTKIQH

SEQ ID NO: 1283519 - protein, 9 aa, Homo Sapiens
YYHIALDWK

SEQ ID NO: 1283520 - protein, 9 aa, Homo Sapiens
QLFRRVAKD

SEQ ID NO: 1283521 - protein, 9 aa, Homo Sapiens
EIVSNIPDD

SEQ ID NO: 1283522 - protein, 9 aa, Homo Sapiens
GNLEDPAIR

SEQ ID NO: 1283523 - protein, 9 aa, Homo Sapiens
TMEINGTVT

SEQ ID NO: 1283524 - protein, 9 aa, Homo Sapiens
VLQNAHKQK

SEQ ID NO: 1283525 - protein, 9 aa, Homo Sapiens
VEESPENIL

SEQ ID NO: 1283526 - protein, 9 aa, Homo Sapiens
ASLHKELNN

SEQ ID NO: 1283527 - protein, 9 aa, Homo Sapiens
LNTTVYALQ

SEQ ID NO: 1283528 - protein, 9 aa, Homo Sapiens
EVQTDPPSV

SEQ ID NO: 1283529 - protein, 9 aa, Homo Sapiens
STDKKKYGI

SEQ ID NO: 1283530 - protein, 9 aa, Homo Sapiens
LTDFDGKDV

SEQ ID NO: 1283531 - protein, 9 aa, Homo Sapiens
IGHKGPVYK

SEQ ID NO: 1283532 - protein, 9 aa, Homo Sapiens
KKKKRGPEV

SEQ ID NO: 1283533 - protein, 9 aa, Homo Sapiens
QGQIELVIK

SEQ ID NO: 1283534 - protein, 9 aa, Homo Sapiens
EIGKGFLDV

SEQ ID NO: 1283535 - protein, 9 aa, Homo Sapiens
GHLFKEVRC

SEQ ID NO: 1283536 - protein, 9 aa, Homo Sapiens
VDCDYVVSE

SEQ ID NO: 1283537 - protein, 9 aa, Homo Sapiens
LMMADLPYQ

SEQ ID NO: 1283538 - protein, 9 aa, Homo Sapiens
AFTDLQPNL

SEQ ID NO: 1283539 - protein, 9 aa, Homo Sapiens
EKGSHGKLK

SEQ ID NO: 1283540 - protein, 9 aa, Homo Sapiens
VDVSKVLFG

SEQ ID NO: 1283541 - protein, 9 aa, Homo Sapiens
FDQDDNEAP

SEQ ID NO: 1283542 - protein, 9 aa, Homo Sapiens
DLRYRKRPF

SEQ ID NO: 1283543 - protein, 9 aa, Homo Sapiens
KNKMSIALK

SEQ ID NO: 1283544 - protein, 9 aa, Homo Sapiens
TPASLHKEL

SEQ ID NO: 1283545 - protein, 9 aa, Homo Sapiens
YLIDYIIRH

SEQ ID NO: 1283546 - protein, 9 aa, Homo Sapiens
DYEGRYDGD

SEQ ID NO: 1283547 - protein, 9 aa, Homo Sapiens
NQKILYAVC

SEQ ID NO: 1283548 - protein, 9 aa, Homo Sapiens
NLPTNGGQE

SEQ ID NO: 1283549 - protein, 9 aa, Homo Sapiens
ERSNDVLGS

SEQ ID NO: 1283550 - protein, 9 aa, Homo Sapiens
FIITLLFFL

SEQ ID NO: 1283551 - protein, 9 aa, Homo Sapiens
KVLFGRSQP

SEQ ID NO: 1283552 - protein, 9 aa, Homo Sapiens
YTAYFRGSR

SEQ ID NO: 1283553 - protein, 9 aa, Homo Sapiens
YKEYISVII

SEQ ID NO: 1283554 - protein, 9 aa, Homo Sapiens
RLCCEVLAT

SEQ ID NO: 1283555 - protein, 9 aa, Homo Sapiens
GRKIDPVCV

SEQ ID NO: 1283556 - protein, 9 aa, Homo Sapiens
ENVDKTELL

SEQ ID NO: 1283557 - protein, 9 aa, Homo Sapiens
KTFFKLIHC

SEQ ID NO: 1283558 - protein, 9 aa, Homo Sapiens
SAEQSEKAL

SEQ ID NO: 1283559 - protein, 9 aa, Homo Sapiens
KWNELNVCD

SEQ ID NO: 1283560 - protein, 9 aa, Homo Sapiens
YPDILVGSL

SEQ ID NO: 1283561 - protein, 9 aa, Homo Sapiens
STNKVEQIH

SEQ ID NO: 1283562 - protein, 9 aa, Homo Sapiens
FMLKVHHLK

SEQ ID NO: 1283563 - protein, 9 aa, Homo Sapiens
LLRDLEENV

SEQ ID NO: 1283564 - protein, 9 aa, Homo Sapiens
QPASSGQPL

SEQ ID NO: 1283565 - protein, 9 aa, Homo Sapiens
LSFIHKHGF

SEQ ID NO: 1283566 - protein, 9 aa, Homo Sapiens
IKTENNVLN

SEQ ID NO: 1283567 - protein, 9 aa, Homo Sapiens
VILEYAHRM

SEQ ID NO: 1283568 - protein, 9 aa, Homo Sapiens
AFRFDCGVE

SEQ ID NO: 1283569 - protein, 9 aa, Homo Sapiens
HFTCNVLQR

SEQ ID NO: 1283570 - protein, 9 aa, Homo Sapiens
PKYGYWVIV

SEQ ID NO: 1283571 - protein, 9 aa, Homo Sapiens
AATNCHSEC

SEQ ID NO: 1283572 - protein, 9 aa, Homo Sapiens
SKVHLMKFS

SEQ ID NO: 1283573 - protein, 9 aa, Homo Sapiens
PIVPLQIIL

SEQ ID NO: 1283574 - protein, 9 aa, Homo Sapiens
DNNLPTNGG

SEQ ID NO: 1283575 - protein, 9 aa, Homo Sapiens
AIHNCIYNS

SEQ ID NO: 1283576 - protein, 9 aa, Homo Sapiens
VKTFKGLKT

SEQ ID NO: 1283577 - protein, 9 aa, Homo Sapiens
YHQLNHTVA

SEQ ID NO: 1283578 - protein, 9 aa, Homo Sapiens
LKNEGGFTS

SEQ ID NO: 1283579 - protein, 9 aa, Homo Sapiens
LHTGDRIML

SEQ ID NO: 1283580 - protein, 9 aa, Homo Sapiens
SKNKEFLKE

SEQ ID NO: 1283581 - protein, 9 aa, Homo Sapiens
ERKNQDSQY

SEQ ID NO: 1283582 - protein, 9 aa, Homo Sapiens
DTSVLFDPF

SEQ ID NO: 1283583 - protein, 9 aa, Homo Sapiens
FLDKCSATK

SEQ ID NO: 1283584 - protein, 9 aa, Homo Sapiens
SVTGHDNKM

SEQ ID NO: 1283585 - protein, 9 aa, Homo Sapiens
STQHKRNKR

SEQ ID NO: 1283586 - protein, 9 aa, Homo Sapiens
SVHGFFLNH

SEQ ID NO: 1283587 - protein, 9 aa, Homo Sapiens
IPTCFTLYH

SEQ ID NO: 1283588 - protein, 9 aa, Homo Sapiens
EDYIKQFKE

SEQ ID NO: 1283589 - protein, 9 aa, Homo Sapiens
ILYAVCTIG

SEQ ID NO: 1283590 - protein, 9 aa, Homo Sapiens
NVNFNCSAG

SEQ ID NO: 1283591 - protein, 9 aa, Homo Sapiens
GYYLQKNSM

SEQ ID NO: 1283592 - protein, 9 aa, Homo Sapiens
IFERSNDVL

SEQ ID NO: 1283593 - protein, 9 aa, Homo Sapiens
SLLWKSYPI

SEQ ID NO: 1283594 - protein, 9 aa, Homo Sapiens
VNGNCTEEP

SEQ ID NO: 1283595 - protein, 9 aa, Homo Sapiens
GSTEECEKR

SEQ ID NO: 1283596 - protein, 9 aa, Homo Sapiens
DVRRMSTIK

SEQ ID NO: 1283597 - protein, 9 aa, Homo Sapiens
PTNGGQEQA

SEQ ID NO: 1283598 - protein, 9 aa, Homo Sapiens
IIIAECNSV

SEQ ID NO: 1283599 - protein, 9 aa, Homo Sapiens
TNYKIGALC

SEQ ID NO: 1283600 - protein, 9 aa, Homo Sapiens
DENPGNDNT

SEQ ID NO: 1283601 - protein, 9 aa, Homo Sapiens
TKLYWEIDK

SEQ ID NO: 1283602 - protein, 9 aa, Homo Sapiens
LDFVAIPDF

SEQ ID NO: 1283603 - protein, 9 aa, Homo Sapiens
SFFSNQYYL

SEQ ID NO: 1283604 - protein, 9 aa, Homo Sapiens
GKLFIVDSI

SEQ ID NO: 1283605 - protein, 9 aa, Homo Sapiens
LGYDLLCQI

SEQ ID NO: 1283606 - protein, 9 aa, Homo Sapiens
MKDQKPKKQ

SEQ ID NO: 1283607 - protein, 9 aa, Homo Sapiens
SQEPYQQQY

SEQ ID NO: 1283608 - protein, 9 aa, Homo Sapiens
FVGRIVQDL

SEQ ID NO: 1283609 - protein, 9 aa, Homo Sapiens
FHKRNSMTP

SEQ ID NO: 1283610 - protein, 9 aa, Homo Sapiens
SIKHLKEEH

SEQ ID NO: 1283611 - protein, 9 aa, Homo Sapiens
NQTQKDLVL

SEQ ID NO: 1283612 - protein, 9 aa, Homo Sapiens
RFFICTSVS

SEQ ID NO: 1283613 - protein, 9 aa, Homo Sapiens
MLVVLYKIY

SEQ ID NO: 1283614 - protein, 9 aa, Homo Sapiens
FDYITKDLK

SEQ ID NO: 1283615 - protein, 9 aa, Homo Sapiens
APKTDIVAC

SEQ ID NO: 1283616 - protein, 9 aa, Homo Sapiens
KKYGIRLRA

SEQ ID NO: 1283617 - protein, 9 aa, Homo Sapiens
LDVSLDKNM

SEQ ID NO: 1283618 - protein, 9 aa, Homo Sapiens
PGLIDNPNI

SEQ ID NO: 1283619 - protein, 9 aa, Homo Sapiens
RNRDLCVGG

SEQ ID NO: 1283620 - protein, 9 aa, Homo Sapiens
GWNDAGDNV

SEQ ID NO: 1283621 - protein, 9 aa, Homo Sapiens
TSIPGYGFS

SEQ ID NO: 1283622 - protein, 9 aa, Homo Sapiens
NTGEKPYKC

SEQ ID NO: 1283623 - protein, 9 aa, Homo Sapiens
IVLEVVSHK

SEQ ID NO: 1283624 - protein, 9 aa, Homo Sapiens
EDIYDENFP

SEQ ID NO: 1283625 - protein, 9 aa, Homo Sapiens
ARTLPIINA

SEQ ID NO: 1283626 - protein, 9 aa, Homo Sapiens
RGYKCLECW

SEQ ID NO: 1283627 - protein, 9 aa, Homo Sapiens
NNVLQRDLR

SEQ ID NO: 1283628 - protein, 9 aa, Homo Sapiens
KHHRTHEIE

SEQ ID NO: 1283629 - protein, 9 aa, Homo Sapiens
KILYRNPLF

SEQ ID NO: 1283630 - protein, 9 aa, Homo Sapiens
TIYSFSAKH

SEQ ID NO: 1283631 - protein, 9 aa, Homo Sapiens
KKNYTAYFR

SEQ ID NO: 1283632 - protein, 9 aa, Homo Sapiens
LQHLVCYMV

SEQ ID NO: 1283633 - protein, 9 aa, Homo Sapiens
TRGYFFNCD

SEQ ID NO: 1283634 - protein, 9 aa, Homo Sapiens
LEEAKVELQ

SEQ ID NO: 1283635 - protein, 9 aa, Homo Sapiens
PSDPNNFII

SEQ ID NO: 1283636 - protein, 9 aa, Homo Sapiens
VCSRKRALQ

SEQ ID NO: 1283637 - protein, 9 aa, Homo Sapiens
ITNSHQKLI

SEQ ID NO: 1283638 - protein, 9 aa, Homo Sapiens
KAITDRYGL

SEQ ID NO: 1283639 - protein, 9 aa, Homo Sapiens
NVNFENREN

SEQ ID NO: 1283640 - protein, 9 aa, Homo Sapiens
GIPHSFENN

SEQ ID NO: 1283641 - protein, 9 aa, Homo Sapiens
DKCSATKIW

SEQ ID NO: 1283642 - protein, 9 aa, Homo Sapiens
LHVIEDSDR

SEQ ID NO: 1283643 - protein, 9 aa, Homo Sapiens
HNKGLTYKQ

SEQ ID NO: 1283644 - protein, 9 aa, Homo Sapiens
QLLTTMCNH

SEQ ID NO: 1283645 - protein, 9 aa, Homo Sapiens
TCNTQLGKR

SEQ ID NO: 1283646 - protein, 9 aa, Homo Sapiens
IDSIANSFV

SEQ ID NO: 1283647 - protein, 9 aa, Homo Sapiens
NTGFGGQVI

SEQ ID NO: 1283648 - protein, 9 aa, Homo Sapiens
YKVEFKTMN

SEQ ID NO: 1283649 - protein, 9 aa, Homo Sapiens
KRLIHERTV

SEQ ID NO: 1283650 - protein, 9 aa, Homo Sapiens
PILEELHKH

SEQ ID NO: 1283651 - protein, 9 aa, Homo Sapiens
QCAKGYYRT

SEQ ID NO: 1283652 - protein, 9 aa, Homo Sapiens
NALVERKHP

SEQ ID NO: 1283653 - protein, 9 aa, Homo Sapiens
ETDYTVSTD

SEQ ID NO: 1283654 - protein, 9 aa, Homo Sapiens
TQERSFIFI

SEQ ID NO: 1283655 - protein, 9 aa, Homo Sapiens
DNRHEFLHQ

SEQ ID NO: 1283656 - protein, 9 aa, Homo Sapiens
TLSCCVCCF

SEQ ID NO: 1283657 - protein, 9 aa, Homo Sapiens
DSCFHSSLT

SEQ ID NO: 1283658 - protein, 9 aa, Homo Sapiens
DYLHETTRP

SEQ ID NO: 1283659 - protein, 9 aa, Homo Sapiens
SLCYLHTAG

SEQ ID NO: 1283660 - protein, 9 aa, Homo Sapiens
SHRDLPRRT

SEQ ID NO: 1283661 - protein, 9 aa, Homo Sapiens
VMVELSENG

SEQ ID NO: 1283662 - protein, 9 aa, Homo Sapiens
DLCQFTTLC

SEQ ID NO: 1283663 - protein, 9 aa, Homo Sapiens
SKLEWPNPV

SEQ ID NO: 1283664 - protein, 9 aa, Homo Sapiens
QSLPSKPLL

SEQ ID NO: 1283665 - protein, 9 aa, Homo Sapiens
YSCIVSDVH

SEQ ID NO: 1283666 - protein, 9 aa, Homo Sapiens
IHQRIHTCE

SEQ ID NO: 1283667 - protein, 9 aa, Homo Sapiens
AGGKKTEDV

SEQ ID NO: 1283668 - protein, 9 aa, Homo Sapiens
VSGLTYHVA

SEQ ID NO: 1283669 - protein, 9 aa, Homo Sapiens
TTMTPTHEM

SEQ ID NO: 1283670 - protein, 9 aa, Homo Sapiens
PTCFTLYHD

SEQ ID NO: 1283671 - protein, 9 aa, Homo Sapiens
WNFTTPLDE

SEQ ID NO: 1283672 - protein, 9 aa, Homo Sapiens
TILESSYLP

SEQ ID NO: 1283673 - protein, 9 aa, Homo Sapiens
SNSEKCSGE

SEQ ID NO: 1283674 - protein, 9 aa, Homo Sapiens
HTLLRPNDR

SEQ ID NO: 1283675 - protein, 9 aa, Homo Sapiens
ATVIVDAAD

SEQ ID NO: 1283676 - protein, 9 aa, Homo Sapiens
AQAHWKIFT

SEQ ID NO: 1283677 - protein, 9 aa, Homo Sapiens
IFEDEGLNT

SEQ ID NO: 1283678 - protein, 9 aa, Homo Sapiens
SRNGQVRAL

SEQ ID NO: 1283679 - protein, 9 aa, Homo Sapiens
EVHTLPTPV

SEQ ID NO: 1283680 - protein, 9 aa, Homo Sapiens
NATYIVTFD

SEQ ID NO: 1283681 - protein, 9 aa, Homo Sapiens
YPTYEVGIE

SEQ ID NO: 1283682 - protein, 9 aa, Homo Sapiens
CAQDMDNNG

SEQ ID NO: 1283683 - protein, 9 aa, Homo Sapiens
ADQDDLPGL

SEQ ID NO: 1283684 - protein, 9 aa, Homo Sapiens
DVDRLKVLA

SEQ ID NO: 1283685 - protein, 9 aa, Homo Sapiens
FKRKQHTNG

SEQ ID NO: 1283686 - protein, 9 aa, Homo Sapiens
VDINTLQDI

SEQ ID NO: 1283687 - protein, 9 aa, Homo Sapiens
LPSKKKYPE

SEQ ID NO: 1283688 - protein, 9 aa, Homo Sapiens
VCVLLQHLV

SEQ ID NO: 1283689 - protein, 9 aa, Homo Sapiens
CTQYQKTKL

SEQ ID NO: 1283690 - protein, 9 aa, Homo Sapiens
QGTCMTSII

SEQ ID NO: 1283691 - protein, 9 aa, Homo Sapiens
IHNCIYNSN

SEQ ID NO: 1283692 - protein, 9 aa, Homo Sapiens
ELVIKEKKA

SEQ ID NO: 1283693 - protein, 9 aa, Homo Sapiens
DFGHFFDHK

SEQ ID NO: 1283694 - protein, 9 aa, Homo Sapiens
NFYPDILVG

SEQ ID NO: 1283695 - protein, 9 aa, Homo Sapiens
DVSNICAHM

SEQ ID NO: 1283696 - protein, 9 aa, Homo Sapiens
FWSPSDMAS

SEQ ID NO: 1283697 - protein, 9 aa, Homo Sapiens
QEDNNLPTN

SEQ ID NO: 1283698 - protein, 9 aa, Homo Sapiens
KENWSRWIQ

SEQ ID NO: 1283699 - protein, 9 aa, Homo Sapiens
SSHPPQSAV

SEQ ID NO: 1283700 - protein, 9 aa, Homo Sapiens
SGDLHKHIR

SEQ ID NO: 1283701 - protein, 9 aa, Homo Sapiens
IFTDSSGMS

SEQ ID NO: 1283702 - protein, 9 aa, Homo Sapiens
SESAESRPT

SEQ ID NO: 1283703 - protein, 9 aa, Homo Sapiens
SNKSKDSDN

SEQ ID NO: 1283704 - protein, 9 aa, Homo Sapiens
PLFLRLAFL

SEQ ID NO: 1283705 - protein, 9 aa, Homo Sapiens
YIDYLSHIN

SEQ ID NO: 1283706 - protein, 9 aa, Homo Sapiens
FQYQMEMMR

SEQ ID NO: 1283707 - protein, 9 aa, Homo Sapiens
YWSTFLSSA

SEQ ID NO: 1283708 - protein, 9 aa, Homo Sapiens
EPGMRGLPC

SEQ ID NO: 1283709 - protein, 9 aa, Homo Sapiens
DMIDKALMR

SEQ ID NO: 1283710 - protein, 9 aa, Homo Sapiens
SDKNVLLVL

SEQ ID NO: 1283711 - protein, 9 aa, Homo Sapiens
DTLKITNSH

SEQ ID NO: 1283712 - protein, 9 aa, Homo Sapiens
HLGTPLCII

SEQ ID NO: 1283713 - protein, 9 aa, Homo Sapiens
IILKHRKCN

SEQ ID NO: 1283714 - protein, 9 aa, Homo Sapiens
IVISATSAT

SEQ ID NO: 1283715 - protein, 9 aa, Homo Sapiens
PLKEAPQQR

SEQ ID NO: 1283716 - protein, 9 aa, Homo Sapiens
HCSGKEETS

SEQ ID NO: 1283717 - protein, 9 aa, Homo Sapiens
NTVSFKRKQ

SEQ ID NO: 1283718 - protein, 9 aa, Homo Sapiens
PWITVCSRK

SEQ ID NO: 1283719 - protein, 9 aa, Homo Sapiens
SETMFRLLS

SEQ ID NO: 1283720 - protein, 9 aa, Homo Sapiens
CDIVEFVCK

SEQ ID NO: 1283721 - protein, 9 aa, Homo Sapiens
KCVKEKKLK

SEQ ID NO: 1283722 - protein, 9 aa, Homo Sapiens
VLQRIKGLG

SEQ ID NO: 1283723 - protein, 9 aa, Homo Sapiens
DVLTVHLVI

SEQ ID NO: 1283724 - protein, 9 aa, Homo Sapiens
YECYICHAL

SEQ ID NO: 1283725 - protein, 9 aa, Homo Sapiens
YLSHINEDN

SEQ ID NO: 1283726 - protein, 9 aa, Homo Sapiens
HAKQRAEVL

SEQ ID NO: 1283727 - protein, 9 aa, Homo Sapiens
DVHLGTPLC

SEQ ID NO: 1283728 - protein, 9 aa, Homo Sapiens
CHNCNNFRL

SEQ ID NO: 1283729 - protein, 9 aa, Homo Sapiens
LSVEQRTSE

SEQ ID NO: 1283730 - protein, 9 aa, Homo Sapiens
AGQHDVVAI

SEQ ID NO: 1283731 - protein, 9 aa, Homo Sapiens
TSALTHKST

SEQ ID NO: 1283732 - protein, 9 aa, Homo Sapiens
LVIAEHANY

SEQ ID NO: 1283733 - protein, 9 aa, Homo Sapiens
MLFLIYYIS

SEQ ID NO: 1283734 - protein, 9 aa, Homo Sapiens
ATKADGGTK

SEQ ID NO: 1283735 - protein, 9 aa, Homo Sapiens
IWICYSGIR

SEQ ID NO: 1283736 - protein, 9 aa, Homo Sapiens
QLMQCSFYN

SEQ ID NO: 1283737 - protein, 9 aa, Homo Sapiens
KLAGAFDAV

SEQ ID NO: 1283738 - protein, 9 aa, Homo Sapiens
ASLICSVPG

SEQ ID NO: 1283739 - protein, 9 aa, Homo Sapiens
ITGAQCAGV

SEQ ID NO: 1283740 - protein, 9 aa, Homo Sapiens
QDEEQPHGW

SEQ ID NO: 1283741 - protein, 9 aa, Homo Sapiens
VKELDVKDI

SEQ ID NO: 1283742 - protein, 9 aa, Homo Sapiens
AVQGITRHL

SEQ ID NO: 1283743 - protein, 9 aa, Homo Sapiens
LITELQLHI

SEQ ID NO: 1283744 - protein, 9 aa, Homo Sapiens
SPPYILYIL

SEQ ID NO: 1283745 - protein, 9 aa, Homo Sapiens
DHTLPLTSY

SEQ ID NO: 1283746 - protein, 9 aa, Homo Sapiens
ITLARLLFP

SEQ ID NO: 1283747 - protein, 9 aa, Homo Sapiens
ILQEKLNEI

SEQ ID NO: 1283748 - protein, 9 aa, Homo Sapiens
VCWVSECII

SEQ ID NO: 1283749 - protein, 9 aa, Homo Sapiens
GLITELQLH

SEQ ID NO: 1283750 - protein, 9 aa, Homo Sapiens
NFSGSQHDY

SEQ ID NO: 1283751 - protein, 9 aa, Homo Sapiens
PEDKMMLFL

SEQ ID NO: 1283752 - protein, 9 aa, Homo Sapiens
PHIIKLYKV

SEQ ID NO: 1283753 - protein, 9 aa, Homo Sapiens
SIIIAECNS

SEQ ID NO: 1283754 - protein, 9 aa, Homo Sapiens
EAQISFLQV

SEQ ID NO: 1283755 - protein, 9 aa, Homo Sapiens
ESEYKHVYK

SEQ ID NO: 1283756 - protein, 9 aa, Homo Sapiens
TIDHTEDSE

SEQ ID NO: 1283757 - protein, 9 aa, Homo Sapiens
DVSLDKNMT

SEQ ID NO: 1283758 - protein, 9 aa, Homo Sapiens
NLHEGTDPE

SEQ ID NO: 1283759 - protein, 9 aa, Homo Sapiens
FYYYEVTPP

SEQ ID NO: 1283760 - protein, 9 aa, Homo Sapiens
DFLLAIQMN

SEQ ID NO: 1283761 - protein, 9 aa, Homo Sapiens
DDADFDEFQ

SEQ ID NO: 1283762 - protein, 9 aa, Homo Sapiens
VCMNVLREV

SEQ ID NO: 1283763 - protein, 9 aa, Homo Sapiens
VTTFFSSTF

SEQ ID NO: 1283764 - protein, 9 aa, Homo Sapiens
HTLLLSDPT

SEQ ID NO: 1283765 - protein, 9 aa, Homo Sapiens
HIDFGHFFD

SEQ ID NO: 1283766 - protein, 9 aa, Homo Sapiens
HIYVSFLDE

SEQ ID NO: 1283767 - protein, 9 aa, Homo Sapiens
FGFLEAKQA

SEQ ID NO: 1283768 - protein, 9 aa, Homo Sapiens
ESAIQDAIL

SEQ ID NO: 1283769 - protein, 9 aa, Homo Sapiens
MSTLTFVVW

SEQ ID NO: 1283770 - protein, 9 aa, Homo Sapiens
IKHLKEEHG

SEQ ID NO: 1283771 - protein, 9 aa, Homo Sapiens
QNESELIEL

SEQ ID NO: 1283772 - protein, 9 aa, Homo Sapiens
FSQLIDCQE

SEQ ID NO: 1283773 - protein, 9 aa, Homo Sapiens
SCETERIRV

SEQ ID NO: 1283774 - protein, 9 aa, Homo Sapiens
MLKVSSIGT

SEQ ID NO: 1283775 - protein, 9 aa, Homo Sapiens
PTICVQNTP

SEQ ID NO: 1283776 - protein, 9 aa, Homo Sapiens
IELLQEKHG

SEQ ID NO: 1283777 - protein, 9 aa, Homo Sapiens
EASSWSESL

SEQ ID NO: 1283778 - protein, 9 aa, Homo Sapiens
RNISYCKAQ

SEQ ID NO: 1283779 - protein, 9 aa, Homo Sapiens
KTRIMLQYD

SEQ ID NO: 1283780 - protein, 9 aa, Homo Sapiens
NTQLGKRKF

SEQ ID NO: 1283781 - protein, 9 aa, Homo Sapiens
HTHREEEYG

SEQ ID NO: 1283782 - protein, 9 aa, Homo Sapiens
LCVTSALTH

SEQ ID NO: 1283783 - protein, 9 aa, Homo Sapiens
VSGSPSQSG

SEQ ID NO: 1283784 - protein, 9 aa, Homo Sapiens
FDNPRLESC

SEQ ID NO: 1283785 - protein, 9 aa, Homo Sapiens
KSLKELLTK

SEQ ID NO: 1283786 - protein, 9 aa, Homo Sapiens
SYCVVYEAV

SEQ ID NO: 1283787 - protein, 9 aa, Homo Sapiens
ASRGADYAM

SEQ ID NO: 1283788 - protein, 9 aa, Homo Sapiens
GRGINSKVK

SEQ ID NO: 1283789 - protein, 9 aa, Homo Sapiens
NLRDDVDSY

SEQ ID NO: 1283790 - protein, 9 aa, Homo Sapiens
EHSAPKLEG

SEQ ID NO: 1283791 - protein, 9 aa, Homo Sapiens
LIHNSGDCL

SEQ ID NO: 1283792 - protein, 9 aa, Homo Sapiens
ESEQRDLEQ

SEQ ID NO: 1283793 - protein, 9 aa, Homo Sapiens
TSLFKTRKA

SEQ ID NO: 1283794 - protein, 9 aa, Homo Sapiens
LILCVCAFN

SEQ ID NO: 1283795 - protein, 9 aa, Homo Sapiens
LWHVLETDE

SEQ ID NO: 1283796 - protein, 9 aa, Homo Sapiens
NCKLVTYEC

SEQ ID NO: 1283797 - protein, 9 aa, Homo Sapiens
LKVAALCSD

SEQ ID NO: 1283798 - protein, 9 aa, Homo Sapiens
ELQRISRAS

SEQ ID NO: 1283799 - protein, 9 aa, Homo Sapiens
FCGPYPFGI

SEQ ID NO: 1283800 - protein, 9 aa, Homo Sapiens
IVAVEPKHP

SEQ ID NO: 1283801 - protein, 9 aa, Homo Sapiens
HCGYSLDLS

SEQ ID NO: 1283802 - protein, 9 aa, Homo Sapiens
LEELYKAVE

SEQ ID NO: 1283803 - protein, 9 aa, Homo Sapiens
RRSVELNQT

SEQ ID NO: 1283804 - protein, 9 aa, Homo Sapiens
LCRGKNHPP

SEQ ID NO: 1283805 - protein, 9 aa, Homo Sapiens
FGPRKLKTC

SEQ ID NO: 1283806 - protein, 9 aa, Homo Sapiens
FGQKDSVCW

SEQ ID NO: 1283807 - protein, 9 aa, Homo Sapiens
VIDMNDNRH

SEQ ID NO: 1283808 - protein, 9 aa, Homo Sapiens
DCYFTNWTE

SEQ ID NO: 1283809 - protein, 9 aa, Homo Sapiens
MCNLLMKDQ

SEQ ID NO: 1283810 - protein, 9 aa, Homo Sapiens
RDLRSLHLK

SEQ ID NO: 1283811 - protein, 9 aa, Homo Sapiens
SIEYVKTFK

SEQ ID NO: 1283812 - protein, 9 aa, Homo Sapiens
TRDVHLGTP

SEQ ID NO: 1283813 - protein, 9 aa, Homo Sapiens
VFHNKSKFV

SEQ ID NO: 1283814 - protein, 9 aa, Homo Sapiens
QQRINIGEN

SEQ ID NO: 1283815 - protein, 9 aa, Homo Sapiens
TCFTLYHDE

SEQ ID NO: 1283816 - protein, 9 aa, Homo Sapiens
NSQCVICLD

SEQ ID NO: 1283817 - protein, 9 aa, Homo Sapiens
LSTDKKKYG

SEQ ID NO: 1283818 - protein, 9 aa, Homo Sapiens
CDVSERRAL

SEQ ID NO: 1283819 - protein, 9 aa, Homo Sapiens
YSLAPITLN

SEQ ID NO: 1283820 - protein, 9 aa, Homo Sapiens
HLDDPESAI

SEQ ID NO: 1283821 - protein, 9 aa, Homo Sapiens
HLDAGKLFI

SEQ ID NO: 1283822 - protein, 9 aa, Homo Sapiens
LECWDSFAL

SEQ ID NO: 1283823 - protein, 9 aa, Homo Sapiens
SMNHILECE

SEQ ID NO: 1283824 - protein, 9 aa, Homo Sapiens
SVWVARNPH

SEQ ID NO: 1283825 - protein, 9 aa, Homo Sapiens
TFCPLKNVC

SEQ ID NO: 1283826 - protein, 9 aa, Homo Sapiens
VNIKKDSEN

SEQ ID NO: 1283827 - protein, 9 aa, Homo Sapiens
RSLHLKMEP

SEQ ID NO: 1283828 - protein, 9 aa, Homo Sapiens
ARFFICTSV

SEQ ID NO: 1283829 - protein, 9 aa, Homo Sapiens
STPAHSIPW

SEQ ID NO: 1283830 - protein, 9 aa, Homo Sapiens
LKYVCPCSG

SEQ ID NO: 1283831 - protein, 9 aa, Homo Sapiens
CTQTNGLDF

SEQ ID NO: 1283832 - protein, 9 aa, Homo Sapiens
QQKDNKGYC

SEQ ID NO: 1283833 - protein, 9 aa, Homo Sapiens
YITFHSYSK

SEQ ID NO: 1283834 - protein, 9 aa, Homo Sapiens
QVDVDRGPI

SEQ ID NO: 1283835 - protein, 9 aa, Homo Sapiens
QHTNGDAPS

SEQ ID NO: 1283836 - protein, 9 aa, Homo Sapiens
LLPALPKTL

SEQ ID NO: 1283837 - protein, 9 aa, Homo Sapiens
VYGVFTTTI

SEQ ID NO: 1283838 - protein, 9 aa, Homo Sapiens
ARGKTLHTG

SEQ ID NO: 1283839 - protein, 9 aa, Homo Sapiens
DRGAPKLGS

SEQ ID NO: 1283840 - protein, 9 aa, Homo Sapiens
CIEKLDILT

SEQ ID NO: 1283841 - protein, 9 aa, Homo Sapiens
PHCAVRNLQ

SEQ ID NO: 1283842 - protein, 9 aa, Homo Sapiens
SQMYNLCHL

SEQ ID NO: 1283843 - protein, 9 aa, Homo Sapiens
IDNPNIVIR

SEQ ID NO: 1283844 - protein, 9 aa, Homo Sapiens
SSKSPAPVE

SEQ ID NO: 1283845 - protein, 9 aa, Homo Sapiens
IVACSTIDQ

SEQ ID NO: 1283846 - protein, 9 aa, Homo Sapiens
VKEQATFVK

SEQ ID NO: 1283847 - protein, 9 aa, Homo Sapiens
KKGTDIWLG

SEQ ID NO: 1283848 - protein, 9 aa, Homo Sapiens
ELFRSLIPS

SEQ ID NO: 1283849 - protein, 9 aa, Homo Sapiens
TRYAESLCQ

SEQ ID NO: 1283850 - protein, 9 aa, Homo Sapiens
SQGTCMTSI

SEQ ID NO: 1283851 - protein, 9 aa, Homo Sapiens
DSSSEHTLL

SEQ ID NO: 1283852 - protein, 9 aa, Homo Sapiens
SPIWVYTSG

SEQ ID NO: 1283853 - protein, 9 aa, Homo Sapiens
QILQPEKPI

SEQ ID NO: 1283854 - protein, 9 aa, Homo Sapiens
SHCGYSLDL

SEQ ID NO: 1283855 - protein, 9 aa, Homo Sapiens
APEQEEEIE

SEQ ID NO: 1283856 - protein, 9 aa, Homo Sapiens
YWVIVLEEG

SEQ ID NO: 1283857 - protein, 9 aa, Homo Sapiens
GDRGAPKLG

SEQ ID NO: 1283858 - protein, 9 aa, Homo Sapiens
LYTTEMDLR

SEQ ID NO: 1283859 - protein, 9 aa, Homo Sapiens
CMAETSCPQ

SEQ ID NO: 1283860 - protein, 9 aa, Homo Sapiens
YPVWKLGDM

SEQ ID NO: 1283861 - protein, 9 aa, Homo Sapiens
SSGYGQHVS

SEQ ID NO: 1283862 - protein, 9 aa, Homo Sapiens
TLTSSNETV

SEQ ID NO: 1283863 - protein, 9 aa, Homo Sapiens
VFCGPYPFG

SEQ ID NO: 1283864 - protein, 9 aa, Homo Sapiens
LIHERTVWK

SEQ ID NO: 1283865 - protein, 9 aa, Homo Sapiens
LELRSAALH

SEQ ID NO: 1283866 - protein, 9 aa, Homo Sapiens
RPQTLNYLI

SEQ ID NO: 1283867 - protein, 9 aa, Homo Sapiens
RQSLKVLEH

SEQ ID NO: 1283868 - protein, 9 aa, Homo Sapiens
MNVLREVKV

SEQ ID NO: 1283869 - protein, 9 aa, Homo Sapiens
FHWDRKQML

SEQ ID NO: 1283870 - protein, 9 aa, Homo Sapiens
NFNEDNQEC

SEQ ID NO: 1283871 - protein, 9 aa, Homo Sapiens
LQLRNADVN

SEQ ID NO: 1283872 - protein, 9 aa, Homo Sapiens
KAVSSVLAN

SEQ ID NO: 1283873 - protein, 9 aa, Homo Sapiens
FDLMTLHTI

SEQ ID NO: 1283874 - protein, 9 aa, Homo Sapiens
NAQQQMKMT

SEQ ID NO: 1283875 - protein, 9 aa, Homo Sapiens
SCTGFLEET

SEQ ID NO: 1283876 - protein, 9 aa, Homo Sapiens
EEFELDGEI

SEQ ID NO: 1283877 - protein, 9 aa, Homo Sapiens
FFQRSVTGH

SEQ ID NO: 1283878 - protein, 9 aa, Homo Sapiens
ANRTATSGS

SEQ ID NO: 1283879 - protein, 9 aa, Homo Sapiens
HSLGNSSIL

SEQ ID NO: 1283880 - protein, 9 aa, Homo Sapiens
TNAWSKLDH

SEQ ID NO: 1283881 - protein, 9 aa, Homo Sapiens
PHQGPWQRT

SEQ ID NO: 1283882 - protein, 9 aa, Homo Sapiens
KCSATKIWR

SEQ ID NO: 1283883 - protein, 9 aa, Homo Sapiens
IQETGKTMR

SEQ ID NO: 1283884 - protein, 9 aa, Homo Sapiens
EANTGFGGQ

SEQ ID NO: 1283885 - protein, 9 aa, Homo Sapiens
WIKDELDKI

SEQ ID NO: 1283886 - protein, 9 aa, Homo Sapiens
LNSSTEDCI

SEQ ID NO: 1283887 - protein, 9 aa, Homo Sapiens
RSHSVLAVD

SEQ ID NO: 1283888 - protein, 9 aa, Homo Sapiens
KCSPIWVYT

SEQ ID NO: 1283889 - protein, 9 aa, Homo Sapiens
DISDKNVLL

SEQ ID NO: 1283890 - protein, 9 aa, Homo Sapiens
QLEFWDEPF

SEQ ID NO: 1283891 - protein, 9 aa, Homo Sapiens
ATSEEVLST

SEQ ID NO: 1283892 - protein, 9 aa, Homo Sapiens
SLNPSEIRE

SEQ ID NO: 1283893 - protein, 9 aa, Homo Sapiens
ILDTKQIFC

SEQ ID NO: 1283894 - protein, 9 aa, Homo Sapiens
ELDGEIVAL

SEQ ID NO: 1283895 - protein, 9 aa, Homo Sapiens
KFLPSDPNN

SEQ ID NO: 1283896 - protein, 9 aa, Homo Sapiens
ARLYHILGN

SEQ ID NO: 1283897 - protein, 9 aa, Homo Sapiens
MEDTDQGKN

SEQ ID NO: 1283898 - protein, 9 aa, Homo Sapiens
ACKLQEVSQ

SEQ ID NO: 1283899 - protein, 9 aa, Homo Sapiens
HETVPSAPE

SEQ ID NO: 1283900 - protein, 9 aa, Homo Sapiens
NMCCPKQYS

SEQ ID NO: 1283901 - protein, 9 aa, Homo Sapiens
AALHSTQSQ

SEQ ID NO: 1283902 - protein, 9 aa, Homo Sapiens
SEELPWPPV

SEQ ID NO: 1283903 - protein, 9 aa, Homo Sapiens
KKTTVPGCG

SEQ ID NO: 1283904 - protein, 9 aa, Homo Sapiens
PIWVYTSGK

SEQ ID NO: 1283905 - protein, 9 aa, Homo Sapiens
KHNSMEDTD

SEQ ID NO: 1283906 - protein, 9 aa, Homo Sapiens
IGDYTSRAK

SEQ ID NO: 1283907 - protein, 9 aa, Homo Sapiens
TQNNMGLVR

SEQ ID NO: 1283908 - protein, 9 aa, Homo Sapiens
LTMKLFYYY

SEQ ID NO: 1283909 - protein, 9 aa, Homo Sapiens
AKYEFTYAL

SEQ ID NO: 1283910 - protein, 9 aa, Homo Sapiens
YRDMKLDNV

SEQ ID NO: 1283911 - protein, 9 aa, Homo Sapiens
ILTFRLKSE

SEQ ID NO: 1283912 - protein, 9 aa, Homo Sapiens
EISYELKCA

SEQ ID NO: 1283913 - protein, 9 aa, Homo Sapiens
LQGLDGLNN

SEQ ID NO: 1283914 - protein, 9 aa, Homo Sapiens
PSQAITSHR

SEQ ID NO: 1283915 - protein, 9 aa, Homo Sapiens
LIKVHSDLE

SEQ ID NO: 1283916 - protein, 9 aa, Homo Sapiens
LAMVHVAYS

SEQ ID NO: 1283917 - protein, 9 aa, Homo Sapiens
AVENALRKA

SEQ ID NO: 1283918 - protein, 9 aa, Homo Sapiens
NCINEELSE

SEQ ID NO: 1283919 - protein, 9 aa, Homo Sapiens
FRLQCVLEG

SEQ ID NO: 1283920 - protein, 9 aa, Homo Sapiens
LSQEVVKHW

SEQ ID NO: 1283921 - protein, 9 aa, Homo Sapiens
TAEQNESEL

SEQ ID NO: 1283922 - protein, 9 aa, Homo Sapiens
LNYSCVKEL

SEQ ID NO: 1283923 - protein, 9 aa, Homo Sapiens
LTTDSDIEK

SEQ ID NO: 1283924 - protein, 9 aa, Homo Sapiens
QKLYSRTCD

SEQ ID NO: 1283925 - protein, 9 aa, Homo Sapiens
LKIVTLVLN

SEQ ID NO: 1283926 - protein, 9 aa, Homo Sapiens
EMRSALRVL

SEQ ID NO: 1283927 - protein, 9 aa, Homo Sapiens
WTISKDNSW

SEQ ID NO: 1283928 - protein, 9 aa, Homo Sapiens
VCTIDMTLQ

SEQ ID NO: 1283929 - protein, 9 aa, Homo Sapiens
HVLLSTINE

SEQ ID NO: 1283930 - protein, 9 aa, Homo Sapiens
KHCYLGLCM

SEQ ID NO: 1283931 - protein, 9 aa, Homo Sapiens
KQHTNGDAP

SEQ ID NO: 1283932 - protein, 9 aa, Homo Sapiens
GIDICDVSE

SEQ ID NO: 1283933 - protein, 9 aa, Homo Sapiens
CSPAGQSNL

SEQ ID NO: 1283934 - protein, 9 aa, Homo Sapiens
RELDQNEEN

SEQ ID NO: 1283935 - protein, 9 aa, Homo Sapiens
LSFFLAMVH

SEQ ID NO: 1283936 - protein, 9 aa, Homo Sapiens
KKRKRKYDL

SEQ ID NO: 1283937 - protein, 9 aa, Homo Sapiens
FNEDNQECA

SEQ ID NO: 1283938 - protein, 9 aa, Homo Sapiens
VVAAVTVCI

SEQ ID NO: 1283939 - protein, 9 aa, Homo Sapiens
MALQMSNLK

SEQ ID NO: 1283940 - protein, 9 aa, Homo Sapiens
KKPRCWVPD

SEQ ID NO: 1283941 - protein, 9 aa, Homo Sapiens
FHVLLSTIN

SEQ ID NO: 1283942 - protein, 9 aa, Homo Sapiens
KDGKPIASC

SEQ ID NO: 1283943 - protein, 9 aa, Homo Sapiens
NLTAITIFH

SEQ ID NO: 1283944 - protein, 9 aa, Homo Sapiens
LLLASQEAS

SEQ ID NO: 1283945 - protein, 9 aa, Homo Sapiens
IVDLEMLKV

SEQ ID NO: 1283946 - protein, 9 aa, Homo Sapiens
KVLSGSECG

SEQ ID NO: 1283947 - protein, 9 aa, Homo Sapiens
CINEELSEV

SEQ ID NO: 1283948 - protein, 9 aa, Homo Sapiens
LRLCMAETS

SEQ ID NO: 1283949 - protein, 9 aa, Homo Sapiens
YPMPFCDRC

SEQ ID NO: 1283950 - protein, 9 aa, Homo Sapiens
EKRRYSFLA

SEQ ID NO: 1283951 - protein, 9 aa, Homo Sapiens
LNRMNCVMF

SEQ ID NO: 1283952 - protein, 9 aa, Homo Sapiens
EQEDERCAQ

SEQ ID NO: 1283953 - protein, 9 aa, Homo Sapiens
VVLPKNVNI

SEQ ID NO: 1283954 - protein, 9 aa, Homo Sapiens
ELNVCDVVM

SEQ ID NO: 1283955 - protein, 9 aa, Homo Sapiens
WERPSQENG

SEQ ID NO: 1283956 - protein, 9 aa, Homo Sapiens
FGLRLNNAQ

SEQ ID NO: 1283957 - protein, 9 aa, Homo Sapiens
WVLFSLSCN

SEQ ID NO: 1283958 - protein, 9 aa, Homo Sapiens
GCTIIFTDS

SEQ ID NO: 1283959 - protein, 9 aa, Homo Sapiens
KNPQDKIIF

SEQ ID NO: 1283960 - protein, 9 aa, Homo Sapiens
TPEDKMMLF

SEQ ID NO: 1283961 - protein, 9 aa, Homo Sapiens
EISWECDPS

SEQ ID NO: 1283962 - protein, 9 aa, Homo Sapiens
PEIYMTLMK

SEQ ID NO: 1283963 - protein, 9 aa, Homo Sapiens
NFIIGTDMG

SEQ ID NO: 1283964 - protein, 9 aa, Homo Sapiens
CEKLYKCKE

SEQ ID NO: 1283965 - protein, 9 aa, Homo Sapiens
EHSEPKRGK

SEQ ID NO: 1283966 - protein, 9 aa, Homo Sapiens
TPIGDYTSR

SEQ ID NO: 1283967 - protein, 9 aa, Homo Sapiens
VYFEVHTTG

SEQ ID NO: 1283968 - protein, 9 aa, Homo Sapiens
TIVISATSA

SEQ ID NO: 1283969 - protein, 9 aa, Homo Sapiens
WTQDLTQVM

SEQ ID NO: 1283970 - protein, 9 aa, Homo Sapiens
QSLKVLEHK

SEQ ID NO: 1283971 - protein, 9 aa, Homo Sapiens
GDLHKHIRT

SEQ ID NO: 1283972 - protein, 9 aa, Homo Sapiens
MEEVYLPYN

SEQ ID NO: 1283973 - protein, 9 aa, Homo Sapiens
LEMLKVSSI

SEQ ID NO: 1283974 - protein, 9 aa, Homo Sapiens
IENLQKLII

SEQ ID NO: 1283975 - protein, 9 aa, Homo Sapiens
TWADIEAIV

SEQ ID NO: 1283976 - protein, 9 aa, Homo Sapiens
LMEACLCGE

SEQ ID NO: 1283977 - protein, 9 aa, Homo Sapiens
KSSISGPFR

SEQ ID NO: 1283978 - protein, 9 aa, Homo Sapiens
EGPGAEGMT

SEQ ID NO: 1283979 - protein, 9 aa, Homo Sapiens
NEGGFTSKY

SEQ ID NO: 1283980 - protein, 9 aa, Homo Sapiens
VITSYNSQV

SEQ ID NO: 1283981 - protein, 9 aa, Homo Sapiens
DLPLSILTK

SEQ ID NO: 1283982 - protein, 9 aa, Homo Sapiens
QQQKIDELH

SEQ ID NO: 1283983 - protein, 9 aa, Homo Sapiens
TAQGLKGYI

SEQ ID NO: 1283984 - protein, 9 aa, Homo Sapiens
EHALMALKF

SEQ ID NO: 1283985 - protein, 9 aa, Homo Sapiens
LHQIPDVSP

SEQ ID NO: 1283986 - protein, 9 aa, Homo Sapiens
LRSAALHST

SEQ ID NO: 1283987 - protein, 9 aa, Homo Sapiens
EATKACKLQ

SEQ ID NO: 1283988 - protein, 9 aa, Homo Sapiens
GHCQHCGTC

SEQ ID NO: 1283989 - protein, 9 aa, Homo Sapiens
DYGHRTDAD

SEQ ID NO: 1283990 - protein, 9 aa, Homo Sapiens
TDVRRMSTI

SEQ ID NO: 1283991 - protein, 9 aa, Homo Sapiens
KFVPPFKGN

SEQ ID NO: 1283992 - protein, 9 aa, Homo Sapiens
EQDLKLDIQ

SEQ ID NO: 1283993 - protein, 9 aa, Homo Sapiens
EALPLDMID

SEQ ID NO: 1283994 - protein, 9 aa, Homo Sapiens
VLMSHRVCW

SEQ ID NO: 1283995 - protein, 9 aa, Homo Sapiens
ISYYLCDDT

SEQ ID NO: 1283996 - protein, 9 aa, Homo Sapiens
DNPRNTLFA

SEQ ID NO: 1283997 - protein, 9 aa, Homo Sapiens
HCYLGLCMF

SEQ ID NO: 1283998 - protein, 9 aa, Homo Sapiens
IKEISAILG

SEQ ID NO: 1283999 - protein, 9 aa, Homo Sapiens
HTGDRIMLM

SEQ ID NO: 1284000 - protein, 9 aa, Homo Sapiens
VMWEYEPKI

SEQ ID NO: 1284001 - protein, 9 aa, Homo Sapiens
CDDYPGSNK

SEQ ID NO: 1284002 - protein, 9 aa, Homo Sapiens
MMLFLIYYI

SEQ ID NO: 1284003 - protein, 9 aa, Homo Sapiens
LYKAVENLC

SEQ ID NO: 1284004 - protein, 9 aa, Homo Sapiens
YSYDFEDEY

SEQ ID NO: 1284005 - protein, 9 aa, Homo Sapiens
SAEYFPLPY

SEQ ID NO: 1284006 - protein, 9 aa, Homo Sapiens
HSGHLFFRK

SEQ ID NO: 1284007 - protein, 9 aa, Homo Sapiens
CVDYILQKL

SEQ ID NO: 1284008 - protein, 9 aa, Homo Sapiens
PNGQLYYKI

SEQ ID NO: 1284009 - protein, 9 aa, Homo Sapiens
NSHQKLISC

SEQ ID NO: 1284010 - protein, 9 aa, Homo Sapiens
WNKCQRCTN

SEQ ID NO: 1284011 - protein, 9 aa, Homo Sapiens
MKIDEVKST

SEQ ID NO: 1284012 - protein, 9 aa, Homo Sapiens
ISDNVNKYI

SEQ ID NO: 1284013 - protein, 9 aa, Homo Sapiens
ACTQYQKTK

SEQ ID NO: 1284014 - protein, 9 aa, Homo Sapiens
VPWITVCSR

SEQ ID NO: 1284015 - protein, 9 aa, Homo Sapiens
NKVEQIHYG

SEQ ID NO: 1284016 - protein, 9 aa, Homo Sapiens
FEYSVVFNI

SEQ ID NO: 1284017 - protein, 9 aa, Homo Sapiens
RKYDLRYRK

SEQ ID NO: 1284018 - protein, 9 aa, Homo Sapiens
GFTSKYSLS

SEQ ID NO: 1284019 - protein, 9 aa, Homo Sapiens
LYPDGKREQ

SEQ ID NO: 1284020 - protein, 9 aa, Homo Sapiens
SVEVLQKDP

SEQ ID NO: 1284021 - protein, 9 aa, Homo Sapiens
KPPVICSNF

SEQ ID NO: 1284022 - protein, 9 aa, Homo Sapiens
TKPPDGKSK

SEQ ID NO: 1284023 - protein, 9 aa, Homo Sapiens
HEDFLLAIQ

SEQ ID NO: 1284024 - protein, 9 aa, Homo Sapiens
QLNHTVAKC

SEQ ID NO: 1284025 - protein, 9 aa, Homo Sapiens
LPPAALHII

SEQ ID NO: 1284026 - protein, 9 aa, Homo Sapiens
KADGGTKVI

SEQ ID NO: 1284027 - protein, 9 aa, Homo Sapiens
SQVPSKRTC

SEQ ID NO: 1284028 - protein, 9 aa, Homo Sapiens
AQISFLQVQ

SEQ ID NO: 1284029 - protein, 9 aa, Homo Sapiens
KDSCYPQIV

SEQ ID NO: 1284030 - protein, 9 aa, Homo Sapiens
LYWEIDKLK

SEQ ID NO: 1284031 - protein, 9 aa, Homo Sapiens
QIQSCVSPG

SEQ ID NO: 1284032 - protein, 9 aa, Homo Sapiens
NTDIEEYHR

SEQ ID NO: 1284033 - protein, 9 aa, Homo Sapiens
NMPTICVQN

SEQ ID NO: 1284034 - protein, 9 aa, Homo Sapiens
KLYKVISTP

SEQ ID NO: 1284035 - protein, 9 aa, Homo Sapiens
LWQEVCKQL

SEQ ID NO: 1284036 - protein, 9 aa, Homo Sapiens
DNLQILQPE

SEQ ID NO: 1284037 - protein, 9 aa, Homo Sapiens
QKSFNTAVK

SEQ ID NO: 1284038 - protein, 9 aa, Homo Sapiens
VGTPCWMAH

SEQ ID NO: 1284039 - protein, 9 aa, Homo Sapiens
NLGEFWLNE

SEQ ID NO: 1284040 - protein, 9 aa, Homo Sapiens
TLTQLNIMK

SEQ ID NO: 1284041 - protein, 9 aa, Homo Sapiens
LSGGQPLEG

SEQ ID NO: 1284042 - protein, 9 aa, Homo Sapiens
ITDRYGLNT

SEQ ID NO: 1284043 - protein, 9 aa, Homo Sapiens
NGYKAYDHE

SEQ ID NO: 1284044 - protein, 9 aa, Homo Sapiens
IEHLVPHPE

SEQ ID NO: 1284045 - protein, 9 aa, Homo Sapiens
TTMCNHLEN

SEQ ID NO: 1284046 - protein, 9 aa, Homo Sapiens
HVGFRIFID

SEQ ID NO: 1284047 - protein, 9 aa, Homo Sapiens
PDLQPIQYE

SEQ ID NO: 1284048 - protein, 9 aa, Homo Sapiens
AICGISVIL

SEQ ID NO: 1284049 - protein, 9 aa, Homo Sapiens
TQLEFWDEP

SEQ ID NO: 1284050 - protein, 9 aa, Homo Sapiens
TQDTPVKIS

SEQ ID NO: 1284051 - protein, 9 aa, Homo Sapiens
DSETMFRLL

SEQ ID NO: 1284052 - protein, 9 aa, Homo Sapiens
HRLSRELLE

SEQ ID NO: 1284053 - protein, 9 aa, Homo Sapiens
LQMSNLKKA

SEQ ID NO: 1284054 - protein, 9 aa, Homo Sapiens
KLIISETSI

SEQ ID NO: 1284055 - protein, 9 aa, Homo Sapiens
IHVAVAQYA

SEQ ID NO: 1284056 - protein, 9 aa, Homo Sapiens
KSQMYNLCH

SEQ ID NO: 1284057 - protein, 9 aa, Homo Sapiens
CNPMMYDLK

SEQ ID NO: 1284058 - protein, 9 aa, Homo Sapiens
DFPQKPIQL

SEQ ID NO: 1284059 - protein, 9 aa, Homo Sapiens
QLIDSIANS

SEQ ID NO: 1284060 - protein, 9 aa, Homo Sapiens
ENVFLCTGA

SEQ ID NO: 1284061 - protein, 9 aa, Homo Sapiens
HINEDNNTR

SEQ ID NO: 1284062 - protein, 9 aa, Homo Sapiens
KVHSDLEAK

SEQ ID NO: 1284063 - protein, 9 aa, Homo Sapiens
ELCCVKIVV

SEQ ID NO: 1284064 - protein, 9 aa, Homo Sapiens
ISTKMCKKQ

SEQ ID NO: 1284065 - protein, 9 aa, Homo Sapiens
LLFGCYIEL

SEQ ID NO: 1284066 - protein, 9 aa, Homo Sapiens
DNVNKYIGL

SEQ ID NO: 1284067 - protein, 9 aa, Homo Sapiens
MSVLQNAHK

SEQ ID NO: 1284068 - protein, 9 aa, Homo Sapiens
AAFIWNKCQ

SEQ ID NO: 1284069 - protein, 9 aa, Homo Sapiens
FAKKHGKEY

SEQ ID NO: 1284070 - protein, 9 aa, Homo Sapiens
LTEMRSALR

SEQ ID NO: 1284071 - protein, 9 aa, Homo Sapiens
DKLRPENVL

SEQ ID NO: 1284072 - protein, 9 aa, Homo Sapiens
AGSESAEQS

SEQ ID NO: 1284073 - protein, 9 aa, Homo Sapiens
CNNAHENPK

SEQ ID NO: 1284074 - protein, 9 aa, Homo Sapiens
FKSPLYSPQ

SEQ ID NO: 1284075 - protein, 9 aa, Homo Sapiens
VELCCVKIV

SEQ ID NO: 1284076 - protein, 9 aa, Homo Sapiens
IIYECYKGY

SEQ ID NO: 1284077 - protein, 9 aa, Homo Sapiens
ISVIIAKNG

SEQ ID NO: 1284078 - protein, 9 aa, Homo Sapiens
SEEEHLSSS

SEQ ID NO: 1284079 - protein, 9 aa, Homo Sapiens
KCLECWDSF

SEQ ID NO: 1284080 - protein, 9 aa, Homo Sapiens
SIQHSISMH

SEQ ID NO: 1284081 - protein, 9 aa, Homo Sapiens
NQYSSKSPA

SEQ ID NO: 1284082 - protein, 9 aa, Homo Sapiens
KTPEIFMAL

SEQ ID NO: 1284083 - protein, 9 aa, Homo Sapiens
VWMFCVCMW

SEQ ID NO: 1284084 - protein, 9 aa, Homo Sapiens
SQIQSCVSP

SEQ ID NO: 1284085 - protein, 9 aa, Homo Sapiens
TKIWRTPNG

SEQ ID NO: 1284086 - protein, 9 aa, Homo Sapiens
VTYECRKKL

SEQ ID NO: 1284087 - protein, 9 aa, Homo Sapiens
SMFRSEEEH

SEQ ID NO: 1284088 - protein, 9 aa, Homo Sapiens
DWNDVQGLF

SEQ ID NO: 1284089 - protein, 9 aa, Homo Sapiens
LAENYSYDF

SEQ ID NO: 1284090 - protein, 9 aa, Homo Sapiens
QLMYSLVHN

SEQ ID NO: 1284091 - protein, 9 aa, Homo Sapiens
PPINGQVDV

SEQ ID NO: 1284092 - protein, 9 aa, Homo Sapiens
TVEGRNYEK

SEQ ID NO: 1284093 - protein, 9 aa, Homo Sapiens
LYDYYTEED

SEQ ID NO: 1284094 - protein, 9 aa, Homo Sapiens
VTLVLNIKK

SEQ ID NO: 1284095 - protein, 9 aa, Homo Sapiens
ESWVLGSGG

SEQ ID NO: 1284096 - protein, 9 aa, Homo Sapiens
FHCNETTKN

SEQ ID NO: 1284097 - protein, 9 aa, Homo Sapiens
ALLHAASLG

SEQ ID NO: 1284098 - protein, 9 aa, Homo Sapiens
GWTSTLKVT

SEQ ID NO: 1284099 - protein, 9 aa, Homo Sapiens
IDMNDNRHE

SEQ ID NO: 1284100 - protein, 9 aa, Homo Sapiens
LEFQDIGNK

SEQ ID NO: 1284101 - protein, 9 aa, Homo Sapiens
GKEYTLRLL

SEQ ID NO: 1284102 - protein, 9 aa, Homo Sapiens
CHRSFIGSR

SEQ ID NO: 1284103 - protein, 9 aa, Homo Sapiens
FKAELQKLR

SEQ ID NO: 1284104 - protein, 9 aa, Homo Sapiens
FLAMVHVAY

SEQ ID NO: 1284105 - protein, 9 aa, Homo Sapiens
VDTLNATYI

SEQ ID NO: 1284106 - protein, 9 aa, Homo Sapiens
YQCKCLQGF

SEQ ID NO: 1284107 - protein, 9 aa, Homo Sapiens
FRKLNEQSH

SEQ ID NO: 1284108 - protein, 9 aa, Homo Sapiens
VFSKLEWPN

SEQ ID NO: 1284109 - protein, 9 aa, Homo Sapiens
MTQAIPFDN

SEQ ID NO: 1284110 - protein, 9 aa, Homo Sapiens
LFRSLIPSY

SEQ ID NO: 1284111 - protein, 9 aa, Homo Sapiens
SEIREKLAE

SEQ ID NO: 1284112 - protein, 9 aa, Homo Sapiens
VCPCSGFVP

SEQ ID NO: 1284113 - protein, 9 aa, Homo Sapiens
IGQSLSLYN

SEQ ID NO: 1284114 - protein, 9 aa, Homo Sapiens
ATYIVTFDR

SEQ ID NO: 1284115 - protein, 9 aa, Homo Sapiens
QLHVLNKAK

SEQ ID NO: 1284116 - protein, 9 aa, Homo Sapiens
QTVYAMVFM

SEQ ID NO: 1284117 - protein, 9 aa, Homo Sapiens
DIDVLKKID

SEQ ID NO: 1284118 - protein, 9 aa, Homo Sapiens
SCKSLSMFQ

SEQ ID NO: 1284119 - protein, 9 aa, Homo Sapiens
NLYFLLARS

SEQ ID NO: 1284120 - protein, 9 aa, Homo Sapiens
TEGKGLGGN

SEQ ID NO: 1284121 - protein, 9 aa, Homo Sapiens
PLDQGSRHD

SEQ ID NO: 1284122 - protein, 9 aa, Homo Sapiens
SLVKMTRNR

SEQ ID NO: 1284123 - protein, 9 aa, Homo Sapiens
PYNINEGQV

SEQ ID NO: 1284124 - protein, 9 aa, Homo Sapiens
YDNNVLQRD

SEQ ID NO: 1284125 - protein, 9 aa, Homo Sapiens
KTMEINGTV

SEQ ID NO: 1284126 - protein, 9 aa, Homo Sapiens
GSTIEKMEF

SEQ ID NO: 1284127 - protein, 9 aa, Homo Sapiens
YVCATFQGK

SEQ ID NO: 1284128 - protein, 9 aa, Homo Sapiens
MSGLNGAEI

SEQ ID NO: 1284129 - protein, 9 aa, Homo Sapiens
VWLPRYYHI

SEQ ID NO: 1284130 - protein, 9 aa, Homo Sapiens
VVAVEHALM

SEQ ID NO: 1284131 - protein, 9 aa, Homo Sapiens
ATKTVCMNV

SEQ ID NO: 1284132 - protein, 9 aa, Homo Sapiens
APKLGSGKD

SEQ ID NO: 1284133 - protein, 9 aa, Homo Sapiens
LKLSVAIAF

SEQ ID NO: 1284134 - protein, 9 aa, Homo Sapiens
ASYKAFGTC

SEQ ID NO: 1284135 - protein, 9 aa, Homo Sapiens
SSWLLNKKH

SEQ ID NO: 1284136 - protein, 9 aa, Homo Sapiens
SSEHTLLLS

SEQ ID NO: 1284137 - protein, 9 aa, Homo Sapiens
ISYELKCAQ

SEQ ID NO: 1284138 - protein, 9 aa, Homo Sapiens
PYDMFCPFY

SEQ ID NO: 1284139 - protein, 9 aa, Homo Sapiens
YSRTCDIVE

SEQ ID NO: 1284140 - protein, 9 aa, Homo Sapiens
SKQQKDNKG

SEQ ID NO: 1284141 - protein, 9 aa, Homo Sapiens
NESELIELR

SEQ ID NO: 1284142 - protein, 9 aa, Homo Sapiens
TRLWHVLET

SEQ ID NO: 1284143 - protein, 9 aa, Homo Sapiens
TTEMDLREV

SEQ ID NO: 1284144 - protein, 9 aa, Homo Sapiens
TGHLFKEVR

SEQ ID NO: 1284145 - protein, 9 aa, Homo Sapiens
DSQPHQKQP

SEQ ID NO: 1284146 - protein, 9 aa, Homo Sapiens
RHILDTKQI

SEQ ID NO: 1284147 - protein, 9 aa, Homo Sapiens
HICRARTCG

SEQ ID NO: 1284148 - protein, 9 aa, Homo Sapiens
DLYPGIQVI

SEQ ID NO: 1284149 - protein, 9 aa, Homo Sapiens
VHHQKFVFF

SEQ ID NO: 1284150 - protein, 9 aa, Homo Sapiens
ANQYSSKSP

SEQ ID NO: 1284151 - protein, 9 aa, Homo Sapiens
ARMENFAHE

SEQ ID NO: 1284152 - protein, 9 aa, Homo Sapiens
AFIWNKCQR

SEQ ID NO: 1284153 - protein, 9 aa, Homo Sapiens
KAFANGRST

SEQ ID NO: 1284154 - protein, 9 aa, Homo Sapiens
THTCEKLYK

SEQ ID NO: 1284155 - protein, 9 aa, Homo Sapiens
CIEFSNLII

SEQ ID NO: 1284156 - protein, 9 aa, Homo Sapiens
AIPYTCYPI

SEQ ID NO: 1284157 - protein, 9 aa, Homo Sapiens
KYIGLTQFE

SEQ ID NO: 1284158 - protein, 9 aa, Homo Sapiens
TMTAEQNES

SEQ ID NO: 1284159 - protein, 9 aa, Homo Sapiens
AYETGQDLV

SEQ ID NO: 1284160 - protein, 9 aa, Homo Sapiens
EQMCNLLMK

SEQ ID NO: 1284161 - protein, 9 aa, Homo Sapiens
HVLPELNNM

SEQ ID NO: 1284162 - protein, 9 aa, Homo Sapiens
IHSLLDEPN

SEQ ID NO: 1284163 - protein, 9 aa, Homo Sapiens
QEKHGQYGL

SEQ ID NO: 1284164 - protein, 9 aa, Homo Sapiens
SVCWRCDHI

SEQ ID NO: 1284165 - protein, 9 aa, Homo Sapiens
SEWTFQHFT

SEQ ID NO: 1284166 - protein, 9 aa, Homo Sapiens
DDPESAIQD

SEQ ID NO: 1284167 - protein, 9 aa, Homo Sapiens
PYSMNHILE

SEQ ID NO: 1284168 - protein, 9 aa, Homo Sapiens
KFTNFPEMM

SEQ ID NO: 1284169 - protein, 9 aa, Homo Sapiens
PQFMFDIHK

SEQ ID NO: 1284170 - protein, 9 aa, Homo Sapiens
GVYFEVHTT

SEQ ID NO: 1284171 - protein, 9 aa, Homo Sapiens
EKRLHVKQN

SEQ ID NO: 1284172 - protein, 9 aa, Homo Sapiens
QQQRINIGE

SEQ ID NO: 1284173 - protein, 9 aa, Homo Sapiens
RGSYCVVYE

SEQ ID NO: 1284174 - protein, 9 aa, Homo Sapiens
TPLEGRADV

SEQ ID NO: 1284175 - protein, 9 aa, Homo Sapiens
AHKQKLTEI

SEQ ID NO: 1284176 - protein, 9 aa, Homo Sapiens
QLVEILTTN

SEQ ID NO: 1284177 - protein, 9 aa, Homo Sapiens
NIKKDSENT

SEQ ID NO: 1284178 - protein, 9 aa, Homo Sapiens
SYTTNNMHA

SEQ ID NO: 1284179 - protein, 9 aa, Homo Sapiens
RNLDKTCCV

SEQ ID NO: 1284180 - protein, 9 aa, Homo Sapiens
AFVVLARSA

SEQ ID NO: 1284181 - protein, 9 aa, Homo Sapiens
CSATKIWRT

SEQ ID NO: 1284182 - protein, 9 aa, Homo Sapiens
LLCQIGSLE

SEQ ID NO: 1284183 - protein, 9 aa, Homo Sapiens
FVCESLYSA

SEQ ID NO: 1284184 - protein, 9 aa, Homo Sapiens
ENYKNHMRG

SEQ ID NO: 1284185 - protein, 9 aa, Homo Sapiens
GIPGQPGYP

SEQ ID NO: 1284186 - protein, 9 aa, Homo Sapiens
DIFEDEGLN

SEQ ID NO: 1284187 - protein, 9 aa, Homo Sapiens
LIEHIFKLQ

SEQ ID NO: 1284188 - protein, 9 aa, Homo Sapiens
LKMMISNPW

SEQ ID NO: 1284189 - protein, 9 aa, Homo Sapiens
PGYPGSPGP

SEQ ID NO: 1284190 - protein, 9 aa, Homo Sapiens
FCDRCGKLP

SEQ ID NO: 1284191 - protein, 9 aa, Homo Sapiens
PGIDICDVS

SEQ ID NO: 1284192 - protein, 9 aa, Homo Sapiens
HCKTASKVH

SEQ ID NO: 1284193 - protein, 9 aa, Homo Sapiens
REVGRGSYC

SEQ ID NO: 1284194 - protein, 9 aa, Homo Sapiens
VTSALTHKS

SEQ ID NO: 1284195 - protein, 9 aa, Homo Sapiens
ISCYTENND

SEQ ID NO: 1284196 - protein, 9 aa, Homo Sapiens
DSVGTDNFV

SEQ ID NO: 1284197 - protein, 9 aa, Homo Sapiens
PKTDIVACS

SEQ ID NO: 1284198 - protein, 9 aa, Homo Sapiens
IVKVSFDLN

SEQ ID NO: 1284199 - protein, 9 aa, Homo Sapiens
LRGEGPGAE

SEQ ID NO: 1284200 - protein, 9 aa, Homo Sapiens
QAHWKIFTK

SEQ ID NO: 1284201 - protein, 9 aa, Homo Sapiens
ANYSLAPIT

SEQ ID NO: 1284202 - protein, 9 aa, Homo Sapiens
ALVSYQLLE

SEQ ID NO: 1284203 - protein, 9 aa, Homo Sapiens
PAADKYWST

SEQ ID NO: 1284204 - protein, 9 aa, Homo Sapiens
KVPLQNSFE

SEQ ID NO: 1284205 - protein, 9 aa, Homo Sapiens
SRTCDIVEF

SEQ ID NO: 1284206 - protein, 9 aa, Homo Sapiens
NPRLESCQI

SEQ ID NO: 1284207 - protein, 9 aa, Homo Sapiens
CRINTGEKP

SEQ ID NO: 1284208 - protein, 9 aa, Homo Sapiens
IQDWSLKLE

SEQ ID NO: 1284209 - protein, 9 aa, Homo Sapiens
HAKGKIVVS

SEQ ID NO: 1284210 - protein, 9 aa, Homo Sapiens
VVIVEEAHS

SEQ ID NO: 1284211 - protein, 9 aa, Homo Sapiens
RKQHTNGDA

SEQ ID NO: 1284212 - protein, 9 aa, Homo Sapiens
LEYFTSNSC

SEQ ID NO: 1284213 - protein, 9 aa, Homo Sapiens
IVTTFFSST

SEQ ID NO: 1284214 - protein, 9 aa, Homo Sapiens
TDDKEGGLF

SEQ ID NO: 1284215 - protein, 9 aa, Homo Sapiens
QCTSVCAQN

SEQ ID NO: 1284216 - protein, 9 aa, Homo Sapiens
ITSDTAEIV

SEQ ID NO: 1284217 - protein, 9 aa, Homo Sapiens
DRKQQYSIK

SEQ ID NO: 1284218 - protein, 9 aa, Homo Sapiens
EVICTSIPG

SEQ ID NO: 1284219 - protein, 9 aa, Homo Sapiens
TCEKPYKCN

SEQ ID NO: 1284220 - protein, 9 aa, Homo Sapiens
NVLLVLPKN

SEQ ID NO: 1284221 - protein, 9 aa, Homo Sapiens
IDCLVIEYL

SEQ ID NO: 1284222 - protein, 9 aa, Homo Sapiens
PEDSKTSTR

SEQ ID NO: 1284223 - protein, 9 aa, Homo Sapiens
ENLPMNVLK

SEQ ID NO: 1284224 - protein, 9 aa, Homo Sapiens
ESLDASVKA

SEQ ID NO: 1284225 - protein, 9 aa, Homo Sapiens
DNKKMTALI

SEQ ID NO: 1284226 - protein, 9 aa, Homo Sapiens
MEFKKSSVE

SEQ ID NO: 1284227 - protein, 9 aa, Homo Sapiens
YYRTYGVPV

SEQ ID NO: 1284228 - protein, 9 aa, Homo Sapiens
METYLMMAD

SEQ ID NO: 1284229 - protein, 9 aa, Homo Sapiens
IYECVGSSK

SEQ ID NO: 1284230 - protein, 9 aa, Homo Sapiens
SDPNNFIIG

SEQ ID NO: 1284231 - protein, 9 aa, Homo Sapiens
IYMTLMKNG

SEQ ID NO: 1284232 - protein, 9 aa, Homo Sapiens
RAHATANAT

SEQ ID NO: 1284233 - protein, 9 aa, Homo Sapiens
PKFDEVFYF

SEQ ID NO: 1284234 - protein, 9 aa, Homo Sapiens
ESSLRATQQ

SEQ ID NO: 1284235 - protein, 9 aa, Homo Sapiens
QLYSSYWRI

SEQ ID NO: 1284236 - protein, 9 aa, Homo Sapiens
EAIVKVSFD

SEQ ID NO: 1284237 - protein, 9 aa, Homo Sapiens
FHGLITNYK

SEQ ID NO: 1284238 - protein, 9 aa, Homo Sapiens
LKKSASVHG

SEQ ID NO: 1284239 - protein, 9 aa, Homo Sapiens
VHCRINTGE

SEQ ID NO: 1284240 - protein, 9 aa, Homo Sapiens
SIGITNHDE

SEQ ID NO: 1284241 - protein, 9 aa, Homo Sapiens
GSMRPLKMC

SEQ ID NO: 1284242 - protein, 9 aa, Homo Sapiens
NKITQSMQQ

SEQ ID NO: 1284243 - protein, 9 aa, Homo Sapiens
NKSKDSDNE

SEQ ID NO: 1284244 - protein, 9 aa, Homo Sapiens
INLAAKNGV

SEQ ID NO: 1284245 - protein, 9 aa, Homo Sapiens
TRLAGDDAQ

SEQ ID NO: 1284246 - protein, 9 aa, Homo Sapiens
MCAIPSVGW

SEQ ID NO: 1284247 - protein, 9 aa, Homo Sapiens
KEIAYPTYE

SEQ ID NO: 1284248 - protein, 9 aa, Homo Sapiens
RDVHLGTPL

SEQ ID NO: 1284249 - protein, 9 aa, Homo Sapiens
KKNSNLTKI

SEQ ID NO: 1284250 - protein, 9 aa, Homo Sapiens
KLGSGKDSH

SEQ ID NO: 1284251 - protein, 9 aa, Homo Sapiens
YLCDDTISV

SEQ ID NO: 1284252 - protein, 9 aa, Homo Sapiens
KETLLLYPV

SEQ ID NO: 1284253 - protein, 9 aa, Homo Sapiens
DTRILSIAA

SEQ ID NO: 1284254 - protein, 9 aa, Homo Sapiens
TNAATQIFF

SEQ ID NO: 1284255 - protein, 9 aa, Homo Sapiens
GILSRDIRY

SEQ ID NO: 1284256 - protein, 9 aa, Homo Sapiens
NSKVKSAKL

SEQ ID NO: 1284257 - protein, 9 aa, Homo Sapiens
KMMLFLIYY

SEQ ID NO: 1284258 - protein, 9 aa, Homo Sapiens
LPEFPDSCF

SEQ ID NO: 1284259 - protein, 9 aa, Homo Sapiens
TGFGGQVIS

SEQ ID NO: 1284260 - protein, 9 aa, Homo Sapiens
IIAYYKENK

SEQ ID NO: 1284261 - protein, 9 aa, Homo Sapiens
RRKIAKLIE

SEQ ID NO: 1284262 - protein, 9 aa, Homo Sapiens
QTIGKYKSA

SEQ ID NO: 1284263 - protein, 9 aa, Homo Sapiens
RDAIQVVLE

SEQ ID NO: 1284264 - protein, 9 aa, Homo Sapiens
EHLNICLLK

SEQ ID NO: 1284265 - protein, 9 aa, Homo Sapiens
CVVYEAVIR

SEQ ID NO: 1284266 - protein, 9 aa, Homo Sapiens
TEFENLVQR

SEQ ID NO: 1284267 - protein, 9 aa, Homo Sapiens
ETCVTTQAP

SEQ ID NO: 1284268 - protein, 9 aa, Homo Sapiens
FCVNRSLPL

SEQ ID NO: 1284269 - protein, 9 aa, Homo Sapiens
RMNCVMFPG

SEQ ID NO: 1284270 - protein, 9 aa, Homo Sapiens
WADIEAIVK

SEQ ID NO: 1284271 - protein, 9 aa, Homo Sapiens
ELLKQEKRD

SEQ ID NO: 1284272 - protein, 9 aa, Homo Sapiens
ELEFGMAYF

SEQ ID NO: 1284273 - protein, 9 aa, Homo Sapiens
FFTSLYSSY

SEQ ID NO: 1284274 - protein, 9 aa, Homo Sapiens
GIRYYDYDY

SEQ ID NO: 1284275 - protein, 9 aa, Homo Sapiens
WLVLNVFLF

SEQ ID NO: 1284276 - protein, 9 aa, Homo Sapiens
TKVANQSQT

SEQ ID NO: 1284277 - protein, 9 aa, Homo Sapiens
MKSLKELLT

SEQ ID NO: 1284278 - protein, 9 aa, Homo Sapiens
CVDARTFCN

SEQ ID NO: 1284279 - protein, 9 aa, Homo Sapiens
LTWNCDKSS

SEQ ID NO: 1284280 - protein, 9 aa, Homo Sapiens
QEPAVNRTV

SEQ ID NO: 1284281 - protein, 9 aa, Homo Sapiens
LCTPPRLCT

SEQ ID NO: 1284282 - protein, 9 aa, Homo Sapiens
MVSGLTYHV

SEQ ID NO: 1284283 - protein, 9 aa, Homo Sapiens
EELETSLFK

SEQ ID NO: 1284284 - protein, 9 aa, Homo Sapiens
KCLQGFTGQ

SEQ ID NO: 1284285 - protein, 9 aa, Homo Sapiens
YVSKSQPDG

SEQ ID NO: 1284286 - protein, 9 aa, Homo Sapiens
DQVVTMLGQ

SEQ ID NO: 1284287 - protein, 9 aa, Homo Sapiens
AEEKELLKQ

SEQ ID NO: 1284288 - protein, 9 aa, Homo Sapiens
KEHFSGEPS

SEQ ID NO: 1284289 - protein, 9 aa, Homo Sapiens
DIKLTNAWS

SEQ ID NO: 1284290 - protein, 9 aa, Homo Sapiens
QPIQYEPVL

SEQ ID NO: 1284291 - protein, 9 aa, Homo Sapiens
KKKKKAPEQ

SEQ ID NO: 1284292 - protein, 9 aa, Homo Sapiens
LPRYYHIAL

SEQ ID NO: 1284293 - protein, 9 aa, Homo Sapiens
YCKAQCKQG

SEQ ID NO: 1284294 - protein, 9 aa, Homo Sapiens
QSQGTCMTS

SEQ ID NO: 1284295 - protein, 9 aa, Homo Sapiens
FEEASYPAV

SEQ ID NO: 1284296 - protein, 9 aa, Homo Sapiens
VLREQFCLK

SEQ ID NO: 1284297 - protein, 9 aa, Homo Sapiens
SCAKYEFTY

SEQ ID NO: 1284298 - protein, 9 aa, Homo Sapiens
DHRHICRAR

SEQ ID NO: 1284299 - protein, 9 aa, Homo Sapiens
YYLWEFYLP

SEQ ID NO: 1284300 - protein, 9 aa, Homo Sapiens
HCNINSQCV

SEQ ID NO: 1284301 - protein, 9 aa, Homo Sapiens
VTINKDFGT

SEQ ID NO: 1284302 - protein, 9 aa, Homo Sapiens
NYVCATFQG

SEQ ID NO: 1284303 - protein, 9 aa, Homo Sapiens
INAYIHTMS

SEQ ID NO: 1284304 - protein, 9 aa, Homo Sapiens
AKIHSGQLE

SEQ ID NO: 1284305 - protein, 9 aa, Homo Sapiens
RDDVDSYGF

SEQ ID NO: 1284306 - protein, 9 aa, Homo Sapiens
AELRNSASW

SEQ ID NO: 1284307 - protein, 9 aa, Homo Sapiens
IQLHVLNKA

SEQ ID NO: 1284308 - protein, 9 aa, Homo Sapiens
TVTINKDFG

SEQ ID NO: 1284309 - protein, 9 aa, Homo Sapiens
TIPNQRRYV

SEQ ID NO: 1284310 - protein, 9 aa, Homo Sapiens
RRLYYSLTD

SEQ ID NO: 1284311 - protein, 9 aa, Homo Sapiens
TIKLHYQSI

SEQ ID NO: 1284312 - protein, 9 aa, Homo Sapiens
HSYTRDYIC

SEQ ID NO: 1284313 - protein, 9 aa, Homo Sapiens
TKVKCEDSK

SEQ ID NO: 1284314 - protein, 9 aa, Homo Sapiens
EDNQECAGI

SEQ ID NO: 1284315 - protein, 9 aa, Homo Sapiens
FARMENKAL

SEQ ID NO: 1284316 - protein, 9 aa, Homo Sapiens
KKRGPEVQT

SEQ ID NO: 1284317 - protein, 9 aa, Homo Sapiens
EQLRLLERE

SEQ ID NO: 1284318 - protein, 9 aa, Homo Sapiens
MEACLCGEL

SEQ ID NO: 1284319 - protein, 9 aa, Homo Sapiens
IKDELDKIV

SEQ ID NO: 1284320 - protein, 9 aa, Homo Sapiens
IPFYHIVLH

SEQ ID NO: 1284321 - protein, 9 aa, Homo Sapiens
ALLHQIPDV

SEQ ID NO: 1284322 - protein, 9 aa, Homo Sapiens
RAHETVPSA

SEQ ID NO: 1284323 - protein, 9 aa, Homo Sapiens
EEAHSSEDF

SEQ ID NO: 1284324 - protein, 9 aa, Homo Sapiens
GETYLIIPS

SEQ ID NO: 1284325 - protein, 9 aa, Homo Sapiens
SRIDEKFLT

SEQ ID NO: 1284326 - protein, 9 aa, Homo Sapiens
DSDRKVESL

SEQ ID NO: 1284327 - protein, 9 aa, Homo Sapiens
KGTDIWLGV

SEQ ID NO: 1284328 - protein, 9 aa, Homo Sapiens
LEHLNICLL

SEQ ID NO: 1284329 - protein, 9 aa, Homo Sapiens
LGIAFTDLQ

SEQ ID NO: 1284330 - protein, 9 aa, Homo Sapiens
HEGTDPETE

SEQ ID NO: 1284331 - protein, 9 aa, Homo Sapiens
SEQEDERCA

SEQ ID NO: 1284332 - protein, 9 aa, Homo Sapiens
NDICTIDHT

SEQ ID NO: 1284333 - protein, 9 aa, Homo Sapiens
DCERRWRNV

SEQ ID NO: 1284334 - protein, 9 aa, Homo Sapiens
SYTRAVDWL

SEQ ID NO: 1284335 - protein, 9 aa, Homo Sapiens
GVPEDVEQP

SEQ ID NO: 1284336 - protein, 9 aa, Homo Sapiens
TDYTVSTDT

SEQ ID NO: 1284337 - protein, 9 aa, Homo Sapiens
EAKVELQRI

SEQ ID NO: 1284338 - protein, 9 aa, Homo Sapiens
ENVLVAIVS

SEQ ID NO: 1284339 - protein, 9 aa, Homo Sapiens
SLYPVFTSQ

SEQ ID NO: 1284340 - protein, 9 aa, Homo Sapiens
IITSDTAEI

SEQ ID NO: 1284341 - protein, 9 aa, Homo Sapiens
KKGLQYVEA

SEQ ID NO: 1284342 - protein, 9 aa, Homo Sapiens
HTLPTPVLL

SEQ ID NO: 1284343 - protein, 9 aa, Homo Sapiens
NEGGVFTFG

SEQ ID NO: 1284344 - protein, 9 aa, Homo Sapiens
TLDNLLNYN

SEQ ID NO: 1284345 - protein, 9 aa, Homo Sapiens
KIAKEAVID

SEQ ID NO: 1284346 - protein, 9 aa, Homo Sapiens
IPGQPGYPG

SEQ ID NO: 1284347 - protein, 9 aa, Homo Sapiens
QFVCLMAYH

SEQ ID NO: 1284348 - protein, 9 aa, Homo Sapiens
YILVTLSHL

SEQ ID NO: 1284349 - protein, 9 aa, Homo Sapiens
DPNNFIIGT

SEQ ID NO: 1284350 - protein, 9 aa, Homo Sapiens
DVKGGETYL

SEQ ID NO: 1284351 - protein, 9 aa, Homo Sapiens
EDATYDISS

SEQ ID NO: 1284352 - protein, 9 aa, Homo Sapiens
ERRWRNVLF

SEQ ID NO: 1284353 - protein, 9 aa, Homo Sapiens
RRVAALRGE

SEQ ID NO: 1284354 - protein, 9 aa, Homo Sapiens
TVNVSSESA

SEQ ID NO: 1284355 - protein, 9 aa, Homo Sapiens
KPAMYNKLC

SEQ ID NO: 1284356 - protein, 9 aa, Homo Sapiens
RVDCTQLMY

SEQ ID NO: 1284357 - protein, 9 aa, Homo Sapiens
YVSFLDEEI

SEQ ID NO: 1284358 - protein, 9 aa, Homo Sapiens
LKTCGNFKP

SEQ ID NO: 1284359 - protein, 9 aa, Homo Sapiens
EHMKLHSYT

SEQ ID NO: 1284360 - protein, 9 aa, Homo Sapiens
TLSVEQRTS

SEQ ID NO: 1284361 - protein, 9 aa, Homo Sapiens
LPLHGGPEL

SEQ ID NO: 1284362 - protein, 9 aa, Homo Sapiens
NQKYGCNRV

SEQ ID NO: 1284363 - protein, 9 aa, Homo Sapiens
INKMINFLQ

SEQ ID NO: 1284364 - protein, 9 aa, Homo Sapiens
QDKTVKKVQ

SEQ ID NO: 1284365 - protein, 9 aa, Homo Sapiens
VDTAHRITA

SEQ ID NO: 1284366 - protein, 9 aa, Homo Sapiens
WARGKTLHT

SEQ ID NO: 1284367 - protein, 9 aa, Homo Sapiens
TVCSRKRAL

SEQ ID NO: 1284368 - protein, 9 aa, Homo Sapiens
GSKQSEHSP

SEQ ID NO: 1284369 - protein, 9 aa, Homo Sapiens
LIITRLLRI

SEQ ID NO: 1284370 - protein, 9 aa, Homo Sapiens
HGLQKSFLD

SEQ ID NO: 1284371 - protein, 9 aa, Homo Sapiens
KPIQLYSSY

SEQ ID NO: 1284372 - protein, 9 aa, Homo Sapiens
LSTPSDSGG

SEQ ID NO: 1284373 - protein, 9 aa, Homo Sapiens
FVKEQATFV

SEQ ID NO: 1284374 - protein, 9 aa, Homo Sapiens
FCPKFRCGR

SEQ ID NO: 1284375 - protein, 9 aa, Homo Sapiens
SQENAAYLQ

SEQ ID NO: 1284376 - protein, 9 aa, Homo Sapiens
FIGSRFIEV

SEQ ID NO: 1284377 - protein, 9 aa, Homo Sapiens
DLFCNPMMY

SEQ ID NO: 1284378 - protein, 9 aa, Homo Sapiens
EVLREQFCL

SEQ ID NO: 1284379 - protein, 9 aa, Homo Sapiens
TMANNPNMT

SEQ ID NO: 1284380 - protein, 9 aa, Homo Sapiens
LDNLQILQP

SEQ ID NO: 1284381 - protein, 9 aa, Homo Sapiens
KGHSKAVSY

SEQ ID NO: 1284382 - protein, 9 aa, Homo Sapiens
NTVLLGSIT

SEQ ID NO: 1284383 - protein, 9 aa, Homo Sapiens
ESQEKQPSH

SEQ ID NO: 1284384 - protein, 9 aa, Homo Sapiens
FDVIYGKCC

SEQ ID NO: 1284385 - protein, 9 aa, Homo Sapiens
CALTKKCRN

SEQ ID NO: 1284386 - protein, 9 aa, Homo Sapiens
TFSDQSTTL

SEQ ID NO: 1284387 - protein, 9 aa, Homo Sapiens
PGPTVKHSG

SEQ ID NO: 1284388 - protein, 9 aa, Homo Sapiens
LQPISTLLY

SEQ ID NO: 1284389 - protein, 9 aa, Homo Sapiens
SPNIFALSD

SEQ ID NO: 1284390 - protein, 9 aa, Homo Sapiens
YPVLMSHRV

SEQ ID NO: 1284391 - protein, 9 aa, Homo Sapiens
DYDIVILSA

SEQ ID NO: 1284392 - protein, 9 aa, Homo Sapiens
NNPNMTHLK

SEQ ID NO: 1284393 - protein, 9 aa, Homo Sapiens
YLQDMAEHD

SEQ ID NO: 1284394 - protein, 9 aa, Homo Sapiens
PSLNPSEIR

SEQ ID NO: 1284395 - protein, 9 aa, Homo Sapiens
PPQPRNELR

SEQ ID NO: 1284396 - protein, 9 aa, Homo Sapiens
SGHKRFNKL

SEQ ID NO: 1284397 - protein, 9 aa, Homo Sapiens
CSNYDQLQG

SEQ ID NO: 1284398 - protein, 9 aa, Homo Sapiens
HWYSTVLNQ

SEQ ID NO: 1284399 - protein, 9 aa, Homo Sapiens
VQLCLEYLG

SEQ ID NO: 1284400 - protein, 9 aa, Homo Sapiens
PIINNTENV

SEQ ID NO: 1284401 - protein, 9 aa, Homo Sapiens
PSWLTKPLA

SEQ ID NO: 1284402 - protein, 9 aa, Homo Sapiens
ILVGSLSDH

SEQ ID NO: 1284403 - protein, 9 aa, Homo Sapiens
THLGYFFVN

SEQ ID NO: 1284404 - protein, 9 aa, Homo Sapiens
VLGCCYSSE

SEQ ID NO: 1284405 - protein, 9 aa, Homo Sapiens
WTFQHFTNH

SEQ ID NO: 1284406 - protein, 9 aa, Homo Sapiens
SDIEKDHIF

SEQ ID NO: 1284407 - protein, 9 aa, Homo Sapiens
IETCKIIVD

SEQ ID NO: 1284408 - protein, 9 aa, Homo Sapiens
KKMTALIKA

SEQ ID NO: 1284409 - protein, 9 aa, Homo Sapiens
KTMRKNQTT

SEQ ID NO: 1284410 - protein, 9 aa, Homo Sapiens
NNMTQKDIT

SEQ ID NO: 1284411 - protein, 9 aa, Homo Sapiens
DSAFFWEES

SEQ ID NO: 1284412 - protein, 9 aa, Homo Sapiens
ALMALKFIL

SEQ ID NO: 1284413 - protein, 9 aa, Homo Sapiens
NGQLVCAKK

SEQ ID NO: 1284414 - protein, 9 aa, Homo Sapiens
AQEDKAIQA

SEQ ID NO: 1284415 - protein, 9 aa, Homo Sapiens
HNCIYNSND

SEQ ID NO: 1284416 - protein, 9 aa, Homo Sapiens
DKCVKEKKL

SEQ ID NO: 1284417 - protein, 9 aa, Homo Sapiens
AYEAVKLQK

SEQ ID NO: 1284418 - protein, 9 aa, Homo Sapiens
ESSTSGSKS

SEQ ID NO: 1284419 - protein, 9 aa, Homo Sapiens
NLKSMSIVL

SEQ ID NO: 1284420 - protein, 9 aa, Homo Sapiens
KIDTSYKYI

SEQ ID NO: 1284421 - protein, 9 aa, Homo Sapiens
LNLLWQEVC

SEQ ID NO: 1284422 - protein, 9 aa, Homo Sapiens
LDGEIVALP

SEQ ID NO: 1284423 - protein, 9 aa, Homo Sapiens
CDKDFRTGL

SEQ ID NO: 1284424 - protein, 9 aa, Homo Sapiens
PAQPSWLTK

SEQ ID NO: 1284425 - protein, 9 aa, Homo Sapiens
NGQVDVDRG

SEQ ID NO: 1284426 - protein, 9 aa, Homo Sapiens
SSWTQDLTQ

SEQ ID NO: 1284427 - protein, 9 aa, Homo Sapiens
NLQKLIISE

SEQ ID NO: 1284428 - protein, 9 aa, Homo Sapiens
IIVVDASGL

SEQ ID NO: 1284429 - protein, 9 aa, Homo Sapiens
NYSCVKELI

SEQ ID NO: 1284430 - protein, 9 aa, Homo Sapiens
TYHVAHWHL

SEQ ID NO: 1284431 - protein, 9 aa, Homo Sapiens
TSLSTQERS

SEQ ID NO: 1284432 - protein, 9 aa, Homo Sapiens
EDLSTFDYI

SEQ ID NO: 1284433 - protein, 9 aa, Homo Sapiens
LFFTSLYSS

SEQ ID NO: 1284434 - protein, 9 aa, Homo Sapiens
VGHISGLQE

SEQ ID NO: 1284435 - protein, 9 aa, Homo Sapiens
RHICRARTC

SEQ ID NO: 1284436 - protein, 9 aa, Homo Sapiens
TYDISSGNI

SEQ ID NO: 1284437 - protein, 9 aa, Homo Sapiens
KLIHTEDQF

SEQ ID NO: 1284438 - protein, 9 aa, Homo Sapiens
YTFFYSCIV

SEQ ID NO: 1284439 - protein, 9 aa, Homo Sapiens
TSVLHKHFD

SEQ ID NO: 1284440 - protein, 9 aa, Homo Sapiens
EVLGCCYSS

SEQ ID NO: 1284441 - protein, 9 aa, Homo Sapiens
QELQLPLHG

SEQ ID NO: 1284442 - protein, 9 aa, Homo Sapiens
FKLIHCSGK

SEQ ID NO: 1284443 - protein, 9 aa, Homo Sapiens
FKAKGDYLH

SEQ ID NO: 1284444 - protein, 9 aa, Homo Sapiens
KFAQTFGRI

SEQ ID NO: 1284445 - protein, 9 aa, Homo Sapiens
KSLQDLVLP

SEQ ID NO: 1284446 - protein, 9 aa, Homo Sapiens
YNYRSVLEN

SEQ ID NO: 1284447 - protein, 9 aa, Homo Sapiens
NTDETYCIY

SEQ ID NO: 1284448 - protein, 9 aa, Homo Sapiens
LTHKSTSLC

SEQ ID NO: 1284449 - protein, 9 aa, Homo Sapiens
LYKSQMYNL

SEQ ID NO: 1284450 - protein, 9 aa, Homo Sapiens
ELEHSEPKR

SEQ ID NO: 1284451 - protein, 9 aa, Homo Sapiens
EGLTLNRKR

SEQ ID NO: 1284452 - protein, 9 aa, Homo Sapiens
LTIIVVDAS

SEQ ID NO: 1284453 - protein, 9 aa, Homo Sapiens
THLFVKEQA

SEQ ID NO: 1284454 - protein, 9 aa, Homo Sapiens
IDHTEDSEY

SEQ ID NO: 1284455 - protein, 9 aa, Homo Sapiens
GDGNTCTQT

SEQ ID NO: 1284456 - protein, 9 aa, Homo Sapiens
NNMPTICVQ

SEQ ID NO: 1284457 - protein, 9 aa, Homo Sapiens
NFKQEEKLL

SEQ ID NO: 1284458 - protein, 9 aa, Homo Sapiens
DITVFLRHA

SEQ ID NO: 1284459 - protein, 9 aa, Homo Sapiens
GPGPTVKHS

SEQ ID NO: 1284460 - protein, 9 aa, Homo Sapiens
LIGQSLSLY

SEQ ID NO: 1284461 - protein, 9 aa, Homo Sapiens
ECNEAIWKY

SEQ ID NO: 1284462 - protein, 9 aa, Homo Sapiens
GFCLPKTPL

SEQ ID NO: 1284463 - protein, 9 aa, Homo Sapiens
HVFSVFEDY

SEQ ID NO: 1284464 - protein, 9 aa, Homo Sapiens
SFHARQLIL

SEQ ID NO: 1284465 - protein, 9 aa, Homo Sapiens
NIVIRIYNR

SEQ ID NO: 1284466 - protein, 9 aa, Homo Sapiens
VGTDNFVLI

SEQ ID NO: 1284467 - protein, 9 aa, Homo Sapiens
LVIRHILDT

SEQ ID NO: 1284468 - protein, 9 aa, Homo Sapiens
IVVSIAEDL

SEQ ID NO: 1284469 - protein, 9 aa, Homo Sapiens
LWVTKTRIM

SEQ ID NO: 1284470 - protein, 9 aa, Homo Sapiens
IVSNIPDDA

SEQ ID NO: 1284471 - protein, 9 aa, Homo Sapiens
SGYNALVSY

SEQ ID NO: 1284472 - protein, 9 aa, Homo Sapiens
KWIKLCTFH

SEQ ID NO: 1284473 - protein, 9 aa, Homo Sapiens
SLSTQERSF

SEQ ID NO: 1284474 - protein, 9 aa, Homo Sapiens
TTSFPCPLN

SEQ ID NO: 1284475 - protein, 9 aa, Homo Sapiens
VQKIVENLK

SEQ ID NO: 1284476 - protein, 9 aa, Homo Sapiens
MARFDLPEV

SEQ ID NO: 1284477 - protein, 9 aa, Homo Sapiens
SIHTGERHY

SEQ ID NO: 1284478 - protein, 9 aa, Homo Sapiens
SSLFESDMK

SEQ ID NO: 1284479 - protein, 9 aa, Homo Sapiens
NKVMTLFDE

SEQ ID NO: 1284480 - protein, 9 aa, Homo Sapiens
KHKTSHTVE

SEQ ID NO: 1284481 - protein, 9 aa, Homo Sapiens
LRNKVMTLF

SEQ ID NO: 1284482 - protein, 9 aa, Homo Sapiens
YKHVYKGEE

SEQ ID NO: 1284483 - protein, 9 aa, Homo Sapiens
KQPSHRDLP

SEQ ID NO: 1284484 - protein, 9 aa, Homo Sapiens
SWAHIKEEH

SEQ ID NO: 1284485 - protein, 9 aa, Homo Sapiens
IAQEDKAIQ

SEQ ID NO: 1284486 - protein, 9 aa, Homo Sapiens
REPHEELVH

SEQ ID NO: 1284487 - protein, 9 aa, Homo Sapiens
CGNMLLWEG

SEQ ID NO: 1284488 - protein, 9 aa, Homo Sapiens
DPESAIQDA

SEQ ID NO: 1284489 - protein, 9 aa, Homo Sapiens
LGLLSFFLA

SEQ ID NO: 1284490 - protein, 9 aa, Homo Sapiens
SGQLIDSIA

SEQ ID NO: 1284491 - protein, 9 aa, Homo Sapiens
LTTNCDSYW

SEQ ID NO: 1284492 - protein, 9 aa, Homo Sapiens
FEKFHTNLL

SEQ ID NO: 1284493 - protein, 9 aa, Homo Sapiens
IMVFKGHSK

SEQ ID NO: 1284494 - protein, 9 aa, Homo Sapiens
INQSADSVG

SEQ ID NO: 1284495 - protein, 9 aa, Homo Sapiens
VGYYLQKNS

SEQ ID NO: 1284496 - protein, 9 aa, Homo Sapiens
KEEIIYECY

SEQ ID NO: 1284497 - protein, 9 aa, Homo Sapiens
YRHWIKDEL

SEQ ID NO: 1284498 - protein, 9 aa, Homo Sapiens
EIIYECYKG

SEQ ID NO: 1284499 - protein, 9 aa, Homo Sapiens
PIASCETER

SEQ ID NO: 1284500 - protein, 9 aa, Homo Sapiens
AKQAFQSVG

SEQ ID NO: 1284501 - protein, 9 aa, Homo Sapiens
ISSCTAQGL

SEQ ID NO: 1284502 - protein, 9 aa, Homo Sapiens
EFPDSCFHS

SEQ ID NO: 1284503 - protein, 9 aa, Homo Sapiens
PGVFCGPYP

SEQ ID NO: 1284504 - protein, 9 aa, Homo Sapiens
HALFTQSGT

SEQ ID NO: 1284505 - protein, 9 aa, Homo Sapiens
IYDENFPNS

SEQ ID NO: 1284506 - protein, 9 aa, Homo Sapiens
NSFLKENVN

SEQ ID NO: 1284507 - protein, 9 aa, Homo Sapiens
ILANCVLSR

SEQ ID NO: 1284508 - protein, 9 aa, Homo Sapiens
LLIYSLDTS

SEQ ID NO: 1284509 - protein, 9 aa, Homo Sapiens
FCLPKTPLC

SEQ ID NO: 1284510 - protein, 9 aa, Homo Sapiens
HARFFICTS

SEQ ID NO: 1284511 - protein, 9 aa, Homo Sapiens
NWSRWIQYK

SEQ ID NO: 1284512 - protein, 9 aa, Homo Sapiens
ESETDYTVS

SEQ ID NO: 1284513 - protein, 9 aa, Homo Sapiens
LGLLVLYVV

SEQ ID NO: 1284514 - protein, 9 aa, Homo Sapiens
ACYHSTLGG

SEQ ID NO: 1284515 - protein, 9 aa, Homo Sapiens
ACMHAFPLT

SEQ ID NO: 1284516 - protein, 9 aa, Homo Sapiens
LLYIMIEQF

SEQ ID NO: 1284517 - protein, 9 aa, Homo Sapiens
QDPVPITVP

SEQ ID NO: 1284518 - protein, 9 aa, Homo Sapiens
SESIVETHD

SEQ ID NO: 1284519 - protein, 9 aa, Homo Sapiens
CKIIVDMLD

SEQ ID NO: 1284520 - protein, 9 aa, Homo Sapiens
KAPEQEEEI

SEQ ID NO: 1284521 - protein, 9 aa, Homo Sapiens
VTHRRLYYS

SEQ ID NO: 1284522 - protein, 9 aa, Homo Sapiens
LILHKRGHT

SEQ ID NO: 1284523 - protein, 9 aa, Homo Sapiens
LKELLTKIQ

SEQ ID NO: 1284524 - protein, 9 aa, Homo Sapiens
IHLQGNLED

SEQ ID NO: 1284525 - protein, 9 aa, Homo Sapiens
FPSLEHLNI

SEQ ID NO: 1284526 - protein, 9 aa, Homo Sapiens
ILYILPDTY

SEQ ID NO: 1284527 - protein, 9 aa, Homo Sapiens
KQKELARRN

SEQ ID NO: 1284528 - protein, 9 aa, Homo Sapiens
NDTFDLHGK

SEQ ID NO: 1284529 - protein, 9 aa, Homo Sapiens
DIQTGTTPQ

SEQ ID NO: 1284530 - protein, 9 aa, Homo Sapiens
PQDKIIFTK

SEQ ID NO: 1284531 - protein, 9 aa, Homo Sapiens
DTRVVCDGG

SEQ ID NO: 1284532 - protein, 9 aa, Homo Sapiens
FTSNSCVWN

SEQ ID NO: 1284533 - protein, 9 aa, Homo Sapiens
QMFNFYPKW

SEQ ID NO: 1284534 - protein, 9 aa, Homo Sapiens
ISIFKGSAV

SEQ ID NO: 1284535 - protein, 9 aa, Homo Sapiens
QVTGRSFCD

SEQ ID NO: 1284536 - protein, 9 aa, Homo Sapiens
VSLRDCFNI

SEQ ID NO: 1284537 - protein, 9 aa, Homo Sapiens
MHGIIGPSN

SEQ ID NO: 1284538 - protein, 9 aa, Homo Sapiens
HKIYARAEV

SEQ ID NO: 1284539 - protein, 9 aa, Homo Sapiens
AFCPKFRCG

SEQ ID NO: 1284540 - protein, 9 aa, Homo Sapiens
LPELNNMTQ

SEQ ID NO: 1284541 - protein, 9 aa, Homo Sapiens
REAMVCTID

SEQ ID NO: 1284542 - protein, 9 aa, Homo Sapiens
CYHSTLGGQ

SEQ ID NO: 1284543 - protein, 9 aa, Homo Sapiens
ILAQKQLRY

SEQ ID NO: 1284544 - protein, 9 aa, Homo Sapiens
DTAGQELFR

SEQ ID NO: 1284545 - protein, 9 aa, Homo Sapiens
ANPKAWTNA

SEQ ID NO: 1284546 - protein, 9 aa, Homo Sapiens
LFAINFFTS

SEQ ID NO: 1284547 - protein, 9 aa, Homo Sapiens
VMSESIVET

SEQ ID NO: 1284548 - protein, 9 aa, Homo Sapiens
EYEGKHNSM

SEQ ID NO: 1284549 - protein, 9 aa, Homo Sapiens
AQVKKINQE

SEQ ID NO: 1284550 - protein, 9 aa, Homo Sapiens
VKHCYLGLC

SEQ ID NO: 1284551 - protein, 9 aa, Homo Sapiens
LYHDEITER

SEQ ID NO: 1284552 - protein, 9 aa, Homo Sapiens
DVSKVLFGR

SEQ ID NO: 1284553 - protein, 9 aa, Homo Sapiens
IFLLKVLLH

SEQ ID NO: 1284554 - protein, 9 aa, Homo Sapiens
NLVKQHTVK

SEQ ID NO: 1284555 - protein, 9 aa, Homo Sapiens
LDKCSATKI

SEQ ID NO: 1284556 - protein, 9 aa, Homo Sapiens
MNWDVQCYS

SEQ ID NO: 1284557 - protein, 9 aa, Homo Sapiens
KCEDSKNIP

SEQ ID NO: 1284558 - protein, 9 aa, Homo Sapiens
LYPVWKLGD

SEQ ID NO: 1284559 - protein, 9 aa, Homo Sapiens
SHVIKLSQD

SEQ ID NO: 1284560 - protein, 9 aa, Homo Sapiens
CVSPTANKG

SEQ ID NO: 1284561 - protein, 9 aa, Homo Sapiens
RAAGMCGAG

SEQ ID NO: 1284562 - protein, 9 aa, Homo Sapiens
IMTQQQRIN

SEQ ID NO: 1284563 - protein, 9 aa, Homo Sapiens
NSMSCQGIE

SEQ ID NO: 1284564 - protein, 9 aa, Homo Sapiens
KIHSGQLEK

SEQ ID NO: 1284565 - protein, 9 aa, Homo Sapiens
TPPSSNCIN

SEQ ID NO: 1284566 - protein, 9 aa, Homo Sapiens
LDNKNCTYE

SEQ ID NO: 1284567 - protein, 9 aa, Homo Sapiens
LFIVDSIPK

SEQ ID NO: 1284568 - protein, 9 aa, Homo Sapiens
PAALHIIAY

SEQ ID NO: 1284569 - protein, 9 aa, Homo Sapiens
SELFEEELT

SEQ ID NO: 1284570 - protein, 9 aa, Homo Sapiens
VALTKANST

SEQ ID NO: 1284571 - protein, 9 aa, Homo Sapiens
TYLDGFDQD

SEQ ID NO: 1284572 - protein, 9 aa, Homo Sapiens
VFVCESLYS

SEQ ID NO: 1284573 - protein, 9 aa, Homo Sapiens
LKLDIQTGT

SEQ ID NO: 1284574 - protein, 9 aa, Homo Sapiens
ELRNSASWV

SEQ ID NO: 1284575 - protein, 9 aa, Homo Sapiens
GDTCECTDN

SEQ ID NO: 1284576 - protein, 9 aa, Homo Sapiens
WMFCVCMWE

SEQ ID NO: 1284577 - protein, 9 aa, Homo Sapiens
HSPSLPRFI

SEQ ID NO: 1284578 - protein, 9 aa, Homo Sapiens
HLKKYPVDL

SEQ ID NO: 1284579 - protein, 9 aa, Homo Sapiens
HLNICLLKH

SEQ ID NO: 1284580 - protein, 9 aa, Homo Sapiens
PKPAMYNKL

SEQ ID NO: 1284581 - protein, 9 aa, Homo Sapiens
LVCAKKPNN

SEQ ID NO: 1284582 - protein, 9 aa, Homo Sapiens
SMCESCGGL

SEQ ID NO: 1284583 - protein, 9 aa, Homo Sapiens
NRHEFLHQV

SEQ ID NO: 1284584 - protein, 9 aa, Homo Sapiens
TLDVLADMC

SEQ ID NO: 1284585 - protein, 9 aa, Homo Sapiens
HNCNNFRLF

SEQ ID NO: 1284586 - protein, 9 aa, Homo Sapiens
ELQLHIRET

SEQ ID NO: 1284587 - protein, 9 aa, Homo Sapiens
PLALYLESK

SEQ ID NO: 1284588 - protein, 9 aa, Homo Sapiens
AKEIAYPTY

SEQ ID NO: 1284589 - protein, 9 aa, Homo Sapiens
SEIPIKMEC

SEQ ID NO: 1284590 - protein, 9 aa, Homo Sapiens
SSVELCCVK

SEQ ID NO: 1284591 - protein, 9 aa, Homo Sapiens
GTPCWMAHE

SEQ ID NO: 1284592 - protein, 9 aa, Homo Sapiens
VGATVLRWR

SEQ ID NO: 1284593 - protein, 9 aa, Homo Sapiens
KSYASIIEM

SEQ ID NO: 1284594 - protein, 9 aa, Homo Sapiens
NSGDCLSST

SEQ ID NO: 1284595 - protein, 9 aa, Homo Sapiens
LAVPIVPLQ

SEQ ID NO: 1284596 - protein, 9 aa, Homo Sapiens
IYLIDYIIR

SEQ ID NO: 1284597 - protein, 9 aa, Homo Sapiens
PEQEEEIEE

SEQ ID NO: 1284598 - protein, 9 aa, Homo Sapiens
MYKVEFKTM

SEQ ID NO: 1284599 - protein, 9 aa, Homo Sapiens
NLLDNNEAT

SEQ ID NO: 1284600 - protein, 9 aa, Homo Sapiens
NAANMLRQA

SEQ ID NO: 1284601 - protein, 9 aa, Homo Sapiens
IQLYSSYWR

SEQ ID NO: 1284602 - protein, 9 aa, Homo Sapiens
LIEHLVPHP

SEQ ID NO: 1284603 - protein, 9 aa, Homo Sapiens
ESLLWSTSI

SEQ ID NO: 1284604 - protein, 9 aa, Homo Sapiens
NTCTQTNGL

SEQ ID NO: 1284605 - protein, 9 aa, Homo Sapiens
VTGHDNKMQ

SEQ ID NO: 1284606 - protein, 9 aa, Homo Sapiens
QKLEQDENP

SEQ ID NO: 1284607 - protein, 9 aa, Homo Sapiens
VPITVPDYY

SEQ ID NO: 1284608 - protein, 9 aa, Homo Sapiens
FPLRQNNDT

SEQ ID NO: 1284609 - protein, 9 aa, Homo Sapiens
LCASAVFFC

SEQ ID NO: 1284610 - protein, 9 aa, Homo Sapiens
DEDIYDENF

SEQ ID NO: 1284611 - protein, 9 aa, Homo Sapiens
KNKSYSWDS

SEQ ID NO: 1284612 - protein, 9 aa, Homo Sapiens
ERTHTVEKP

SEQ ID NO: 1284613 - protein, 9 aa, Homo Sapiens
LKPCFFSHL

SEQ ID NO: 1284614 - protein, 9 aa, Homo Sapiens
AITSHRATV

SEQ ID NO: 1284615 - protein, 9 aa, Homo Sapiens
CSSGHKRFN

SEQ ID NO: 1284616 - protein, 9 aa, Homo Sapiens
TNNPKFDEV

SEQ ID NO: 1284617 - protein, 9 aa, Homo Sapiens
IVNRAPEFL

SEQ ID NO: 1284618 - protein, 9 aa, Homo Sapiens
LVAWLSMQI

SEQ ID NO: 1284619 - protein, 9 aa, Homo Sapiens
FKQKELARR

SEQ ID NO: 1284620 - protein, 9 aa, Homo Sapiens
SPDDKHLVT

SEQ ID NO: 1284621 - protein, 9 aa, Homo Sapiens
LCAPPLANT

SEQ ID NO: 1284622 - protein, 9 aa, Homo Sapiens
KQAFQSVGT

SEQ ID NO: 1284623 - protein, 9 aa, Homo Sapiens
LLHQIPDVS

SEQ ID NO: 1284624 - protein, 9 aa, Homo Sapiens
LDSGYNALV

SEQ ID NO: 1284625 - protein, 9 aa, Homo Sapiens
KYGYWVIVL

SEQ ID NO: 1284626 - protein, 9 aa, Homo Sapiens
LKMETYLMM

SEQ ID NO: 1284627 - protein, 9 aa, Homo Sapiens
AVIDINKPG

SEQ ID NO: 1284628 - protein, 9 aa, Homo Sapiens
EIQREKINN

SEQ ID NO: 1284629 - protein, 9 aa, Homo Sapiens
LYNEPAQAL

SEQ ID NO: 1284630 - protein, 9 aa, Homo Sapiens
TENEEYNSD

SEQ ID NO: 1284631 - protein, 9 aa, Homo Sapiens
QQFPNTDIE

SEQ ID NO: 1284632 - protein, 9 aa, Homo Sapiens
PSSNCINEE

SEQ ID NO: 1284633 - protein, 9 aa, Homo Sapiens
ENLLSWMFE

SEQ ID NO: 1284634 - protein, 9 aa, Homo Sapiens
NLILSKRLL

SEQ ID NO: 1284635 - protein, 9 aa, Homo Sapiens
ATPIVIVAV

SEQ ID NO: 1284636 - protein, 9 aa, Homo Sapiens
TAICPDYCH

SEQ ID NO: 1284637 - protein, 9 aa, Homo Sapiens
PISLFHSDL

SEQ ID NO: 1284638 - protein, 9 aa, Homo Sapiens
QRGKGLGYA

SEQ ID NO: 1284639 - protein, 9 aa, Homo Sapiens
IKLTNAWSK

SEQ ID NO: 1284640 - protein, 9 aa, Homo Sapiens
RCNLEKEMA

SEQ ID NO: 1284641 - protein, 9 aa, Homo Sapiens
DKSSISGPF

SEQ ID NO: 1284642 - protein, 9 aa, Homo Sapiens
IPYTCYPIC

SEQ ID NO: 1284643 - protein, 9 aa, Homo Sapiens
HYYTAGSSS

SEQ ID NO: 1284644 - protein, 9 aa, Homo Sapiens
REESEQRDL

SEQ ID NO: 1284645 - protein, 9 aa, Homo Sapiens
LMTICASIG

SEQ ID NO: 1284646 - protein, 9 aa, Homo Sapiens
TSNDLLLQV

SEQ ID NO: 1284647 - protein, 9 aa, Homo Sapiens
NRLQNLTID

SEQ ID NO: 1284648 - protein, 9 aa, Homo Sapiens
RLYYSLTDW

SEQ ID NO: 1284649 - protein, 9 aa, Homo Sapiens
TSDVMSESI

SEQ ID NO: 1284650 - protein, 9 aa, Homo Sapiens
ERHYECKQC

SEQ ID NO: 1284651 - protein, 9 aa, Homo Sapiens
PQPRNELRE

SEQ ID NO: 1284652 - protein, 9 aa, Homo Sapiens
LTCNTQLGK

SEQ ID NO: 1284653 - protein, 9 aa, Homo Sapiens
NILEISLIK

SEQ ID NO: 1284654 - protein, 9 aa, Homo Sapiens
SCIVSDVHV

SEQ ID NO: 1284655 - protein, 9 aa, Homo Sapiens
LYNHFYVSV

SEQ ID NO: 1284656 - protein, 9 aa, Homo Sapiens
EEEEDTDPS

SEQ ID NO: 1284657 - protein, 9 aa, Homo Sapiens
AGADIETHC

SEQ ID NO: 1284658 - protein, 9 aa, Homo Sapiens
KRRYSFLAE

SEQ ID NO: 1284659 - protein, 9 aa, Homo Sapiens
SSCFCDSST

SEQ ID NO: 1284660 - protein, 9 aa, Homo Sapiens
VNQEKNSWT

SEQ ID NO: 1284661 - protein, 9 aa, Homo Sapiens
MANLTVCNG

SEQ ID NO: 1284662 - protein, 9 aa, Homo Sapiens
HEFLHQVWN

SEQ ID NO: 1284663 - protein, 9 aa, Homo Sapiens
DRDLRSLHL

SEQ ID NO: 1284664 - protein, 9 aa, Homo Sapiens
SSWSESLLE

SEQ ID NO: 1284665 - protein, 9 aa, Homo Sapiens
KLGDMRWKN

SEQ ID NO: 1284666 - protein, 9 aa, Homo Sapiens
FKKAADIGN

SEQ ID NO: 1284667 - protein, 9 aa, Homo Sapiens
VLYNYRSVL

SEQ ID NO: 1284668 - protein, 9 aa, Homo Sapiens
CQFCDVRLQ

SEQ ID NO: 1284669 - protein, 9 aa, Homo Sapiens
ETLTDLGTS

SEQ ID NO: 1284670 - protein, 9 aa, Homo Sapiens
VIAYEAVKL

SEQ ID NO: 1284671 - protein, 9 aa, Homo Sapiens
NLCRGKNHP

SEQ ID NO: 1284672 - protein, 9 aa, Homo Sapiens
TDLQPNLYP

SEQ ID NO: 1284673 - protein, 9 aa, Homo Sapiens
KSCQFCDVR

SEQ ID NO: 1284674 - protein, 9 aa, Homo Sapiens
LVDREPHEE

SEQ ID NO: 1284675 - protein, 9 aa, Homo Sapiens
KLSQDEQGV

SEQ ID NO: 1284676 - protein, 9 aa, Homo Sapiens
SYPIVCIAK

SEQ ID NO: 1284677 - protein, 9 aa, Homo Sapiens
PIMVFKGHS

SEQ ID NO: 1284678 - protein, 9 aa, Homo Sapiens
KMFQVHHVL

SEQ ID NO: 1284679 - protein, 9 aa, Homo Sapiens
HIFCVNRSL

SEQ ID NO: 1284680 - protein, 9 aa, Homo Sapiens
KVAQRIDRD

SEQ ID NO: 1284681 - protein, 9 aa, Homo Sapiens
SASWVLFSL

SEQ ID NO: 1284682 - protein, 9 aa, Homo Sapiens
KLYSRTCDI

SEQ ID NO: 1284683 - protein, 9 aa, Homo Sapiens
DNVTKLLRS

SEQ ID NO: 1284684 - protein, 9 aa, Homo Sapiens
RKVTHRRLY

SEQ ID NO: 1284685 - protein, 9 aa, Homo Sapiens
ALESIEYVK

SEQ ID NO: 1284686 - protein, 9 aa, Homo Sapiens
LKVLLHLHK

SEQ ID NO: 1284687 - protein, 9 aa, Homo Sapiens
FEATPIVIV

SEQ ID NO: 1284688 - protein, 9 aa, Homo Sapiens
SYASIIEMA

SEQ ID NO: 1284689 - protein, 9 aa, Homo Sapiens
TRVVCDGGS

SEQ ID NO: 1284690 - protein, 9 aa, Homo Sapiens
SDIMAFANS

SEQ ID NO: 1284691 - protein, 9 aa, Homo Sapiens
CLPKTPLCA

SEQ ID NO: 1284692 - protein, 9 aa, Homo Sapiens
KLIESCGKP

SEQ ID NO: 1284693 - protein, 9 aa, Homo Sapiens
EDEGLNTQG

SEQ ID NO: 1284694 - protein, 9 aa, Homo Sapiens
SIANSFVGT

SEQ ID NO: 1284695 - protein, 9 aa, Homo Sapiens
SKRLLYIMI

SEQ ID NO: 1284696 - protein, 9 aa, Homo Sapiens
YYSLDMWSL

SEQ ID NO: 1284697 - protein, 9 aa, Homo Sapiens
DWETELLLI

SEQ ID NO: 1284698 - protein, 9 aa, Homo Sapiens
RIVQDLGLE

SEQ ID NO: 1284699 - protein, 9 aa, Homo Sapiens
SLDTLVHAK

SEQ ID NO: 1284700 - protein, 9 aa, Homo Sapiens
SQFHGLITN

SEQ ID NO: 1284701 - protein, 9 aa, Homo Sapiens
IMSLWVKID

SEQ ID NO: 1284702 - protein, 9 aa, Homo Sapiens
LDMDGNVDI

SEQ ID NO: 1284703 - protein, 9 aa, Homo Sapiens
DTITPQHVF

SEQ ID NO: 1284704 - protein, 9 aa, Homo Sapiens
DLGTSSQVS

SEQ ID NO: 1284705 - protein, 9 aa, Homo Sapiens
DHTEDSEYE

SEQ ID NO: 1284706 - protein, 9 aa, Homo Sapiens
VTSIAMLVV

SEQ ID NO: 1284707 - protein, 9 aa, Homo Sapiens
QDWSLKLEH

SEQ ID NO: 1284708 - protein, 9 aa, Homo Sapiens
KPYKCEYCL

SEQ ID NO: 1284709 - protein, 9 aa, Homo Sapiens
PYKCEYCLQ

SEQ ID NO: 1284710 - protein, 9 aa, Homo Sapiens
RYIFTMLIT

SEQ ID NO: 1284711 - protein, 9 aa, Homo Sapiens
HAMRNSPTF

SEQ ID NO: 1284712 - protein, 9 aa, Homo Sapiens
EYNSDEQND

SEQ ID NO: 1284713 - protein, 9 aa, Homo Sapiens
SSLRATQQS

SEQ ID NO: 1284714 - protein, 9 aa, Homo Sapiens
TASKVHLMK

SEQ ID NO: 1284715 - protein, 9 aa, Homo Sapiens
GNFTLTSSN

SEQ ID NO: 1284716 - protein, 9 aa, Homo Sapiens
HSQITEFEN

SEQ ID NO: 1284717 - protein, 9 aa, Homo Sapiens
PAMYNKLCY

SEQ ID NO: 1284718 - protein, 9 aa, Homo Sapiens
ALTPASLHK

SEQ ID NO: 1284719 - protein, 9 aa, Homo Sapiens
KTRKAHRIE

SEQ ID NO: 1284720 - protein, 9 aa, Homo Sapiens
AREKKLLQV

SEQ ID NO: 1284721 - protein, 9 aa, Homo Sapiens
FMVLCSLGI

SEQ ID NO: 1284722 - protein, 9 aa, Homo Sapiens
FQDIGNKGQ

SEQ ID NO: 1284723 - protein, 9 aa, Homo Sapiens
NIGENPYQC

SEQ ID NO: 1284724 - protein, 9 aa, Homo Sapiens
NTDFVPEKV

SEQ ID NO: 1284725 - protein, 9 aa, Homo Sapiens
QKANIFVQS

SEQ ID NO: 1284726 - protein, 9 aa, Homo Sapiens
LVVWLVLNV

SEQ ID NO: 1284727 - protein, 9 aa, Homo Sapiens
HQLNHTVAK

SEQ ID NO: 1284728 - protein, 9 aa, Homo Sapiens
KAVENLCSY

SEQ ID NO: 1284729 - protein, 9 aa, Homo Sapiens
ASSQVPSKR

SEQ ID NO: 1284730 - protein, 9 aa, Homo Sapiens
GPPCPRGDL

SEQ ID NO: 1284731 - protein, 9 aa, Homo Sapiens
FFLVNYPVY

SEQ ID NO: 1284732 - protein, 9 aa, Homo Sapiens
ATLLVNTTS

SEQ ID NO: 1284733 - protein, 9 aa, Homo Sapiens
NLALASVAI

SEQ ID NO: 1284734 - protein, 9 aa, Homo Sapiens
LPSKPLLRS

SEQ ID NO: 1284735 - protein, 9 aa, Homo Sapiens
TGKELPQTK

SEQ ID NO: 1284736 - protein, 9 aa, Homo Sapiens
LKETLLLYP

SEQ ID NO: 1284737 - protein, 9 aa, Homo Sapiens
KENYISNNT

SEQ ID NO: 1284738 - protein, 9 aa, Homo Sapiens
QFTCIPSCV

SEQ ID NO: 1284739 - protein, 9 aa, Homo Sapiens
LNALRKSCQ

SEQ ID NO: 1284740 - protein, 9 aa, Homo Sapiens
EDLKMYKVE

SEQ ID NO: 1284741 - protein, 9 aa, Homo Sapiens
CGELWTILR

SEQ ID NO: 1284742 - protein, 9 aa, Homo Sapiens
ANKDSCYPQ

SEQ ID NO: 1284743 - protein, 9 aa, Homo Sapiens
FLVNYPVYQ

SEQ ID NO: 1284744 - protein, 9 aa, Homo Sapiens
IDEKFLTKR

SEQ ID NO: 1284745 - protein, 9 aa, Homo Sapiens
NQSADSVGT

SEQ ID NO: 1284746 - protein, 9 aa, Homo Sapiens
KADANRTAT

SEQ ID NO: 1284747 - protein, 9 aa, Homo Sapiens
MAKIHSGQL

SEQ ID NO: 1284748 - protein, 9 aa, Homo Sapiens
MRELDQNEE

SEQ ID NO: 1284749 - protein, 9 aa, Homo Sapiens
AMLVVLYKI

SEQ ID NO: 1284750 - protein, 9 aa, Homo Sapiens
VLNLILYTA

SEQ ID NO: 1284751 - protein, 9 aa, Homo Sapiens
ETYLIIPSL

SEQ ID NO: 1284752 - protein, 9 aa, Homo Sapiens
THLHTPIYF

SEQ ID NO: 1284753 - protein, 9 aa, Homo Sapiens
LVHAKFEFI

SEQ ID NO: 1284754 - protein, 9 aa, Homo Sapiens
EDQELQLPL

SEQ ID NO: 1284755 - protein, 9 aa, Homo Sapiens
NFNCSAGTP

SEQ ID NO: 1284756 - protein, 9 aa, Homo Sapiens
EASYPAVPC

SEQ ID NO: 1284757 - protein, 9 aa, Homo Sapiens
STKMCKKQN

SEQ ID NO: 1284758 - protein, 9 aa, Homo Sapiens
TVLLEHTFS

SEQ ID NO: 1284759 - protein, 9 aa, Homo Sapiens
MSNLKKALN

SEQ ID NO: 1284760 - protein, 9 aa, Homo Sapiens
LENGLAMSG

SEQ ID NO: 1284761 - protein, 9 aa, Homo Sapiens
LVCELAKLA

SEQ ID NO: 1284762 - protein, 9 aa, Homo Sapiens
DQEPAVNRT

SEQ ID NO: 1284763 - protein, 9 aa, Homo Sapiens
HTVKPESTL

SEQ ID NO: 1284764 - protein, 9 aa, Homo Sapiens
DYCHNMYEE

SEQ ID NO: 1284765 - protein, 9 aa, Homo Sapiens
TTLWFLIAF

SEQ ID NO: 1284766 - protein, 9 aa, Homo Sapiens
EASYKAFGT

SEQ ID NO: 1284767 - protein, 9 aa, Homo Sapiens
PETLTDLGT

SEQ ID NO: 1284768 - protein, 9 aa, Homo Sapiens
ESIEYVKTF

SEQ ID NO: 1284769 - protein, 9 aa, Homo Sapiens
IMTVHNDPY

SEQ ID NO: 1284770 - protein, 9 aa, Homo Sapiens
HALMALKFI

SEQ ID NO: 1284771 - protein, 9 aa, Homo Sapiens
DLRSLHLKM

SEQ ID NO: 1284772 - protein, 9 aa, Homo Sapiens
KGPGPTVKH

SEQ ID NO: 1284773 - protein, 9 aa, Homo Sapiens
EAKQAFQSV

SEQ ID NO: 1284774 - protein, 9 aa, Homo Sapiens
VTQQLLDDQ

SEQ ID NO: 1284775 - protein, 9 aa, Homo Sapiens
RDIKCSNII

SEQ ID NO: 1284776 - protein, 9 aa, Homo Sapiens
RSVCWRCDH

SEQ ID NO: 1284777 - protein, 9 aa, Homo Sapiens
IPHSFENNQ

SEQ ID NO: 1284778 - protein, 9 aa, Homo Sapiens
VELNQTQKD

SEQ ID NO: 1284779 - protein, 9 aa, Homo Sapiens
DCLSSTCEG

SEQ ID NO: 1284780 - protein, 9 aa, Homo Sapiens
PHAKQRAEV

SEQ ID NO: 1284781 - protein, 9 aa, Homo Sapiens
MVLCSLGIV

SEQ ID NO: 1284782 - protein, 9 aa, Homo Sapiens
VSDISQYSV

SEQ ID NO: 1284783 - protein, 9 aa, Homo Sapiens
IPLSQEVTH

SEQ ID NO: 1284784 - protein, 9 aa, Homo Sapiens
QDEQGVDIL

SEQ ID NO: 1284785 - protein, 9 aa, Homo Sapiens
HTTGVYRDL

SEQ ID NO: 1284786 - protein, 9 aa, Homo Sapiens
SCYPQIVDV

SEQ ID NO: 1284787 - protein, 9 aa, Homo Sapiens
GGETYLIIP

SEQ ID NO: 1284788 - protein, 9 aa, Homo Sapiens
LVHLDDPES

SEQ ID NO: 1284789 - protein, 9 aa, Homo Sapiens
KKQKRLIHE

SEQ ID NO: 1284790 - protein, 9 aa, Homo Sapiens
SILKIVTLV

SEQ ID NO: 1284791 - protein, 9 aa, Homo Sapiens
NRDLCVGGV

SEQ ID NO: 1284792 - protein, 9 aa, Homo Sapiens
EPSNSIFHV

SEQ ID NO: 1284793 - protein, 9 aa, Homo Sapiens
RNSNLTQQQ

SEQ ID NO: 1284794 - protein, 9 aa, Homo Sapiens
SGPGLIHAF

SEQ ID NO: 1284795 - protein, 9 aa, Homo Sapiens
SSTSGSKSQ

SEQ ID NO: 1284796 - protein, 9 aa, Homo Sapiens
LLAIQKLRS

SEQ ID NO: 1284797 - protein, 9 aa, Homo Sapiens
NPSEIREKL

SEQ ID NO: 1284798 - protein, 9 aa, Homo Sapiens
INENEKSYA

SEQ ID NO: 1284799 - protein, 9 aa, Homo Sapiens
YKDDFSTTG

SEQ ID NO: 1284800 - protein, 9 aa, Homo Sapiens
YYLCDDTIS

SEQ ID NO: 1284801 - protein, 9 aa, Homo Sapiens
WVYTSGKGS

SEQ ID NO: 1284802 - protein, 9 aa, Homo Sapiens
KPQGNKEHG

SEQ ID NO: 1284803 - protein, 9 aa, Homo Sapiens
CRDTKPPDG

SEQ ID NO: 1284804 - protein, 9 aa, Homo Sapiens
AAGPTSNDL

SEQ ID NO: 1284805 - protein, 9 aa, Homo Sapiens
EQNESELIE

SEQ ID NO: 1284806 - protein, 9 aa, Homo Sapiens
AALCSDLHV

SEQ ID NO: 1284807 - protein, 9 aa, Homo Sapiens
YDYDYGEIN

SEQ ID NO: 1284808 - protein, 9 aa, Homo Sapiens
KQDQQIYEM

SEQ ID NO: 1284809 - protein, 9 aa, Homo Sapiens
ELFGESYSG

SEQ ID NO: 1284810 - protein, 9 aa, Homo Sapiens
EKLGSLNLL

SEQ ID NO: 1284811 - protein, 9 aa, Homo Sapiens
SGYGQHVSR

SEQ ID NO: 1284812 - protein, 9 aa, Homo Sapiens
LVHADKIST

SEQ ID NO: 1284813 - protein, 9 aa, Homo Sapiens
AEQSEKALE

SEQ ID NO: 1284814 - protein, 9 aa, Homo Sapiens
QSAYETGQD

SEQ ID NO: 1284815 - protein, 9 aa, Homo Sapiens
FGGPLDQGS

SEQ ID NO: 1284816 - protein, 9 aa, Homo Sapiens
FCNPMMYDL

SEQ ID NO: 1284817 - protein, 9 aa, Homo Sapiens
AVPIVPLQI

SEQ ID NO: 1284818 - protein, 9 aa, Homo Sapiens
RLHLFKAVS

SEQ ID NO: 1284819 - protein, 9 aa, Homo Sapiens
DLIWICYSG

SEQ ID NO: 1284820 - protein, 9 aa, Homo Sapiens
VLQYQKKTL

SEQ ID NO: 1284821 - protein, 9 aa, Homo Sapiens
FMALEGEAH

SEQ ID NO: 1284822 - protein, 9 aa, Homo Sapiens
SQHDYPSYT

SEQ ID NO: 1284823 - protein, 9 aa, Homo Sapiens
AYDHENRNG

SEQ ID NO: 1284824 - protein, 9 aa, Homo Sapiens
GPSNNGAMG

SEQ ID NO: 1284825 - protein, 9 aa, Homo Sapiens
NIFVQSSSP

SEQ ID NO: 1284826 - protein, 9 aa, Homo Sapiens
LVYWRVCNK

SEQ ID NO: 1284827 - protein, 9 aa, Homo Sapiens
TFPTSCDEY

SEQ ID NO: 1284828 - protein, 9 aa, Homo Sapiens
CSSSELIDN

SEQ ID NO: 1284829 - protein, 9 aa, Homo Sapiens
NQDSQYGEL

SEQ ID NO: 1284830 - protein, 9 aa, Homo Sapiens
YVTSTYKSL

SEQ ID NO: 1284831 - protein, 9 aa, Homo Sapiens
IPHAKGKIV

SEQ ID NO: 1284832 - protein, 9 aa, Homo Sapiens
TTFLKASLI

SEQ ID NO: 1284833 - protein, 9 aa, Homo Sapiens
DRCHCGKTF

SEQ ID NO: 1284834 - protein, 9 aa, Homo Sapiens
HSDPEDSKT

SEQ ID NO: 1284835 - protein, 9 aa, Homo Sapiens
PILNYLRHV

SEQ ID NO: 1284836 - protein, 9 aa, Homo Sapiens
GSECTPDSL

SEQ ID NO: 1284837 - protein, 9 aa, Homo Sapiens
KVHDGTLCQ

SEQ ID NO: 1284838 - protein, 9 aa, Homo Sapiens
MVFKGHSKA

SEQ ID NO: 1284839 - protein, 9 aa, Homo Sapiens
KKAPEQEEE

SEQ ID NO: 1284840 - protein, 9 aa, Homo Sapiens
NYLFENGRV

SEQ ID NO: 1284841 - protein, 9 aa, Homo Sapiens
TDLYDYYTE

SEQ ID NO: 1284842 - protein, 9 aa, Homo Sapiens
NFAEDFCPG

SEQ ID NO: 1284843 - protein, 9 aa, Homo Sapiens
NNSVFPEEL

SEQ ID NO: 1284844 - protein, 9 aa, Homo Sapiens
LLSCTGFLE

SEQ ID NO: 1284845 - protein, 9 aa, Homo Sapiens
PEGEDPEME

SEQ ID NO: 1284846 - protein, 9 aa, Homo Sapiens
EWSHIFCVN

SEQ ID NO: 1284847 - protein, 9 aa, Homo Sapiens
IEYLLPPET

SEQ ID NO: 1284848 - protein, 9 aa, Homo Sapiens
DIWLGVDAL

SEQ ID NO: 1284849 - protein, 9 aa, Homo Sapiens
FDEKFYCLL

SEQ ID NO: 1284850 - protein, 9 aa, Homo Sapiens
YLRHVQLIV

SEQ ID NO: 1284851 - protein, 9 aa, Homo Sapiens
FIPLKAFPE

SEQ ID NO: 1284852 - protein, 9 aa, Homo Sapiens
IDCQEFVPG

SEQ ID NO: 1284853 - protein, 9 aa, Homo Sapiens
DDKHLVTLI

SEQ ID NO: 1284854 - protein, 9 aa, Homo Sapiens
TTNNMHAIP

SEQ ID NO: 1284855 - protein, 9 aa, Homo Sapiens
SSELIDNQS

SEQ ID NO: 1284856 - protein, 9 aa, Homo Sapiens
ALDAHHRKA

SEQ ID NO: 1284857 - protein, 9 aa, Homo Sapiens
LVLNVFLFV

SEQ ID NO: 1284858 - protein, 9 aa, Homo Sapiens
IHTVEKPYQ

SEQ ID NO: 1284859 - protein, 9 aa, Homo Sapiens
KFLDTSHYY

SEQ ID NO: 1284860 - protein, 9 aa, Homo Sapiens
EKVHDGTLC

SEQ ID NO: 1284861 - protein, 9 aa, Homo Sapiens
CYKGYILVG

SEQ ID NO: 1284862 - protein, 9 aa, Homo Sapiens
GSSFENLPM

SEQ ID NO: 1284863 - protein, 9 aa, Homo Sapiens
PVQHLFKFK

SEQ ID NO: 1284864 - protein, 9 aa, Homo Sapiens
VKQHTVKPE

SEQ ID NO: 1284865 - protein, 9 aa, Homo Sapiens
DVFVCESLY

SEQ ID NO: 1284866 - protein, 9 aa, Homo Sapiens
VELKVAALC

SEQ ID NO: 1284867 - protein, 9 aa, Homo Sapiens
DEEDLHPTK

SEQ ID NO: 1284868 - protein, 9 aa, Homo Sapiens
NSILKIVTL

SEQ ID NO: 1284869 - protein, 9 aa, Homo Sapiens
QEYLNKCCH

SEQ ID NO: 1284870 - protein, 9 aa, Homo Sapiens
TVAKCYECK

SEQ ID NO: 1284871 - protein, 9 aa, Homo Sapiens
CEKPYKCNE

SEQ ID NO: 1284872 - protein, 9 aa, Homo Sapiens
KNKVTDESR

SEQ ID NO: 1284873 - protein, 9 aa, Homo Sapiens
SLTNLEHKI

SEQ ID NO: 1284874 - protein, 9 aa, Homo Sapiens
VFEDYGLDP

SEQ ID NO: 1284875 - protein, 9 aa, Homo Sapiens
KLHSYTRDY

SEQ ID NO: 1284876 - protein, 9 aa, Homo Sapiens
RLEQARQDL

SEQ ID NO: 1284877 - protein, 9 aa, Homo Sapiens
GQDWLVEVT

SEQ ID NO: 1284878 - protein, 9 aa, Homo Sapiens
FIALLHQIP

SEQ ID NO: 1284879 - protein, 9 aa, Homo Sapiens
HRDLPRRTG

SEQ ID NO: 1284880 - protein, 9 aa, Homo Sapiens
PLKDSDEIM

SEQ ID NO: 1284881 - protein, 9 aa, Homo Sapiens
TAEIVLEVV

SEQ ID NO: 1284882 - protein, 9 aa, Homo Sapiens
DNCKLVTYE

SEQ ID NO: 1284883 - protein, 9 aa, Homo Sapiens
TLKITNSHQ

SEQ ID NO: 1284884 - protein, 9 aa, Homo Sapiens
IPIKMECPT

SEQ ID NO: 1284885 - protein, 9 aa, Homo Sapiens
CSQTLVNFG

SEQ ID NO: 1284886 - protein, 9 aa, Homo Sapiens
PPCPRGDLG

SEQ ID NO: 1284887 - protein, 9 aa, Homo Sapiens
VFKGHSKAV

SEQ ID NO: 1284888 - protein, 9 aa, Homo Sapiens
VNVSSESAE

SEQ ID NO: 1284889 - protein, 9 aa, Homo Sapiens
VQAELCDYD

SEQ ID NO: 1284890 - protein, 9 aa, Homo Sapiens
QFLEKRLHV

SEQ ID NO: 1284891 - protein, 9 aa, Homo Sapiens
NTDRCHCGK

SEQ ID NO: 1284892 - protein, 9 aa, Homo Sapiens
NTYGKQDLD

SEQ ID NO: 1284893 - protein, 9 aa, Homo Sapiens
VQGITRHLT

SEQ ID NO: 1284894 - protein, 9 aa, Homo Sapiens
ENKALQEAK

SEQ ID NO: 1284895 - protein, 9 aa, Homo Sapiens
LWCALSKTV

SEQ ID NO: 1284896 - protein, 9 aa, Homo Sapiens
ILCVCAFNI

SEQ ID NO: 1284897 - protein, 9 aa, Homo Sapiens
FYCSIENVF

SEQ ID NO: 1284898 - protein, 9 aa, Homo Sapiens
VLKAFANGR

SEQ ID NO: 1284899 - protein, 9 aa, Homo Sapiens
LHKHTEQLV

SEQ ID NO: 1284900 - protein, 9 aa, Homo Sapiens
KHVYKGEEA

SEQ ID NO: 1284901 - protein, 9 aa, Homo Sapiens
WDRRQRACM

SEQ ID NO: 1284902 - protein, 9 aa, Homo Sapiens
YGHRTDADS

SEQ ID NO: 1284903 - protein, 9 aa, Homo Sapiens
EKPYKCEYC

SEQ ID NO: 1284904 - protein, 9 aa, Homo Sapiens
NPKAWTNAA

SEQ ID NO: 1284905 - protein, 9 aa, Homo Sapiens
AFFWEESDI

SEQ ID NO: 1284906 - protein, 9 aa, Homo Sapiens
QVPSKRTCS

SEQ ID NO: 1284907 - protein, 9 aa, Homo Sapiens
LLHVIEDSD

SEQ ID NO: 1284908 - protein, 9 aa, Homo Sapiens
LSDPNNYNE

SEQ ID NO: 1284909 - protein, 9 aa, Homo Sapiens
IDISDKNVL

SEQ ID NO: 1284910 - protein, 9 aa, Homo Sapiens
AESLCQYAA

SEQ ID NO: 1284911 - protein, 9 aa, Homo Sapiens
SLIGQSLSL

SEQ ID NO: 1284912 - protein, 9 aa, Homo Sapiens
KLGSLNLLW

SEQ ID NO: 1284913 - protein, 9 aa, Homo Sapiens
AVNLQRSKT

SEQ ID NO: 1284914 - protein, 9 aa, Homo Sapiens
PLTKDDITV

SEQ ID NO: 1284915 - protein, 9 aa, Homo Sapiens
FLCIQNYLF

SEQ ID NO: 1284916 - protein, 9 aa, Homo Sapiens
LNNMTQKDI

SEQ ID NO: 1284917 - protein, 9 aa, Homo Sapiens
TDIEEYHRP

SEQ ID NO: 1284918 - protein, 9 aa, Homo Sapiens
VESLDASVK

SEQ ID NO: 1284919 - protein, 9 aa, Homo Sapiens
SMHAMRNSP

SEQ ID NO: 1284920 - protein, 9 aa, Homo Sapiens
LPGPAGPPC

SEQ ID NO: 1284921 - protein, 9 aa, Homo Sapiens
SGNFTLTSS

SEQ ID NO: 1284922 - protein, 9 aa, Homo Sapiens
EKHSQITEF

SEQ ID NO: 1284923 - protein, 9 aa, Homo Sapiens
HIIAYYKEN

SEQ ID NO: 1284924 - protein, 9 aa, Homo Sapiens
WEIDKLKKL

SEQ ID NO: 1284925 - protein, 9 aa, Homo Sapiens
LLISDTKPE

SEQ ID NO: 1284926 - protein, 9 aa, Homo Sapiens
RRVEHINGK

SEQ ID NO: 1284927 - protein, 9 aa, Homo Sapiens
GERHYECKQ

SEQ ID NO: 1284928 - protein, 9 aa, Homo Sapiens
TTNCDSYWV

SEQ ID NO: 1284929 - protein, 9 aa, Homo Sapiens
YIDYEGRYD

SEQ ID NO: 1284930 - protein, 9 aa, Homo Sapiens
IWDSYTTNN

SEQ ID NO: 1284931 - protein, 9 aa, Homo Sapiens
AEMSIIGMI

SEQ ID NO: 1284932 - protein, 9 aa, Homo Sapiens
PLENGLAMS

SEQ ID NO: 1284933 - protein, 9 aa, Homo Sapiens
ADYAMESSK

SEQ ID NO: 1284934 - protein, 9 aa, Homo Sapiens
LQGLSFIHK

SEQ ID NO: 1284935 - protein, 9 aa, Homo Sapiens
LKHRKCNNA

SEQ ID NO: 1284936 - protein, 9 aa, Homo Sapiens
EQQLKDSCK

SEQ ID NO: 1284937 - protein, 9 aa, Homo Sapiens
YEGILANCV

SEQ ID NO: 1284938 - protein, 9 aa, Homo Sapiens
CESCGGLWL

SEQ ID NO: 1284939 - protein, 9 aa, Homo Sapiens
GYDLLCQIG

SEQ ID NO: 1284940 - protein, 9 aa, Homo Sapiens
KPEDLNSGS

SEQ ID NO: 1284941 - protein, 9 aa, Homo Sapiens
RYTFFYSCI

SEQ ID NO: 1284942 - protein, 9 aa, Homo Sapiens
PISRGDCEV

SEQ ID NO: 1284943 - protein, 9 aa, Homo Sapiens
DVIYGKCCT

SEQ ID NO: 1284944 - protein, 9 aa, Homo Sapiens
PLKERPDLQ

SEQ ID NO: 1284945 - protein, 9 aa, Homo Sapiens
QLANPKAWT

SEQ ID NO: 1284946 - protein, 9 aa, Homo Sapiens
IVGAIPYTC

SEQ ID NO: 1284947 - protein, 9 aa, Homo Sapiens
LTLKEHFSG

SEQ ID NO: 1284948 - protein, 9 aa, Homo Sapiens
YIDLILPDC

SEQ ID NO: 1284949 - protein, 9 aa, Homo Sapiens
VPIVPLQII

SEQ ID NO: 1284950 - protein, 9 aa, Homo Sapiens
TEDNIDNIL

SEQ ID NO: 1284951 - protein, 9 aa, Homo Sapiens
YVCAVFNGI

SEQ ID NO: 1284952 - protein, 9 aa, Homo Sapiens
PESETDYTV

SEQ ID NO: 1284953 - protein, 9 aa, Homo Sapiens
WRLYAIAGY

SEQ ID NO: 1284954 - protein, 9 aa, Homo Sapiens
NLKKQHYLL

SEQ ID NO: 1284955 - protein, 9 aa, Homo Sapiens
LVKHMNQTL

SEQ ID NO: 1284956 - protein, 9 aa, Homo Sapiens
ATKIWRTPN

SEQ ID NO: 1284957 - protein, 9 aa, Homo Sapiens
SVRSVCWRC

SEQ ID NO: 1284958 - protein, 9 aa, Homo Sapiens
TIEIARQLT

SEQ ID NO: 1284959 - protein, 9 aa, Homo Sapiens
DYTSRAKIS

SEQ ID NO: 1284960 - protein, 9 aa, Homo Sapiens
TESFLYCCD

SEQ ID NO: 1284961 - protein, 9 aa, Homo Sapiens
LLYPDGKRE

SEQ ID NO: 1284962 - protein, 9 aa, Homo Sapiens
DYAMESSKP

SEQ ID NO: 1284963 - protein, 9 aa, Homo Sapiens
KKENYISNN

SEQ ID NO: 1284964 - protein, 9 aa, Homo Sapiens
STDFTPHWK

SEQ ID NO: 1284965 - protein, 9 aa, Homo Sapiens
ITSHRATVS

SEQ ID NO: 1284966 - protein, 9 aa, Homo Sapiens
RIGKTWERP

SEQ ID NO: 1284967 - protein, 9 aa, Homo Sapiens
LQNSFEKKL

SEQ ID NO: 1284968 - protein, 9 aa, Homo Sapiens
LQCVLEGTL

SEQ ID NO: 1284969 - protein, 9 aa, Homo Sapiens
QSEIKLLFG

SEQ ID NO: 1284970 - protein, 9 aa, Homo Sapiens
VCLDEDIYD

SEQ ID NO: 1284971 - protein, 9 aa, Homo Sapiens
KRTLTKIKE

SEQ ID NO: 1284972 - protein, 9 aa, Homo Sapiens
FQKFQAFDL

SEQ ID NO: 1284973 - protein, 9 aa, Homo Sapiens
INQLTGTIK

SEQ ID NO: 1284974 - protein, 9 aa, Homo Sapiens
HVCVLLQHL

SEQ ID NO: 1284975 - protein, 9 aa, Homo Sapiens
LCDYDPDEH

SEQ ID NO: 1284976 - protein, 9 aa, Homo Sapiens
EFWDEPFNT

SEQ ID NO: 1284977 - protein, 9 aa, Homo Sapiens
LTESCLSCS

SEQ ID NO: 1284978 - protein, 9 aa, Homo Sapiens
CTEEPMDTT

SEQ ID NO: 1284979 - protein, 9 aa, Homo Sapiens
YMTMEWHEK

SEQ ID NO: 1284980 - protein, 9 aa, Homo Sapiens
LMSHRVCWM

SEQ ID NO: 1284981 - protein, 9 aa, Homo Sapiens
YIKQFKEAR

SEQ ID NO: 1284982 - protein, 9 aa, Homo Sapiens
ILIDRDCHI

SEQ ID NO: 1284983 - protein, 9 aa, Homo Sapiens
SPPFLSRNG

SEQ ID NO: 1284984 - protein, 9 aa, Homo Sapiens
PTQFAPHAK

SEQ ID NO: 1284985 - protein, 9 aa, Homo Sapiens
LAAKNGVPN

SEQ ID NO: 1284986 - protein, 9 aa, Homo Sapiens
QDKIIFTKA

SEQ ID NO: 1284987 - protein, 9 aa, Homo Sapiens
SAVVCIWLR

SEQ ID NO: 1284988 - protein, 9 aa, Homo Sapiens
DQDWETELL

SEQ ID NO: 1284989 - protein, 9 aa, Homo Sapiens
VSLDKNMTR

SEQ ID NO: 1284990 - protein, 9 aa, Homo Sapiens
KSHVIKLSQ

SEQ ID NO: 1284991 - protein, 9 aa, Homo Sapiens
KSYPIVCIA

SEQ ID NO: 1284992 - protein, 9 aa, Homo Sapiens
KLEHWHQKE

SEQ ID NO: 1284993 - protein, 9 aa, Homo Sapiens
LHKSHILYT

SEQ ID NO: 1284994 - protein, 9 aa, Homo Sapiens
SILLIDFFQ

SEQ ID NO: 1284995 - protein, 9 aa, Homo Sapiens
KCSNIILNN

SEQ ID NO: 1284996 - protein, 9 aa, Homo Sapiens
EGNHHSTQH

SEQ ID NO: 1284997 - protein, 9 aa, Homo Sapiens
SCVVEAKTA

SEQ ID NO: 1284998 - protein, 9 aa, Homo Sapiens
TYGVPVDAP

SEQ ID NO: 1284999 - protein, 9 aa, Homo Sapiens
PASSGQPLC

SEQ ID NO: 1285000 - protein, 9 aa, Homo Sapiens
TLNATYIVT

SEQ ID NO: 1285001 - protein, 9 aa, Homo Sapiens
SDEEDIIKE

SEQ ID NO: 1285002 - protein, 9 aa, Homo Sapiens
KVIELLQEK

SEQ ID NO: 1285003 - protein, 9 aa, Homo Sapiens
EFTYALLCH

SEQ ID NO: 1285004 - protein, 9 aa, Homo Sapiens
SCSPAGQSN

SEQ ID NO: 1285005 - protein, 9 aa, Homo Sapiens
MTVHNDPYT

SEQ ID NO: 1285006 - protein, 9 aa, Homo Sapiens
DSDEIMSLW

SEQ ID NO: 1285007 - protein, 9 aa, Homo Sapiens
STERRKLLI

SEQ ID NO: 1285008 - protein, 9 aa, Homo Sapiens
HRMSQDILC

SEQ ID NO: 1285009 - protein, 9 aa, Homo Sapiens
YEGRYDGDS

SEQ ID NO: 1285010 - protein, 9 aa, Homo Sapiens
KAADIGNPV

SEQ ID NO: 1285011 - protein, 9 aa, Homo Sapiens
YASIIEMAC

SEQ ID NO: 1285012 - protein, 9 aa, Homo Sapiens
ENNKKLFNY

SEQ ID NO: 1285013 - protein, 9 aa, Homo Sapiens
SDNELVTFV

SEQ ID NO: 1285014 - protein, 9 aa, Homo Sapiens
LTYHVAHWH

SEQ ID NO: 1285015 - protein, 9 aa, Homo Sapiens
GYNALVSYQ

SEQ ID NO: 1285016 - protein, 9 aa, Homo Sapiens
TLVKVKPNM

SEQ ID NO: 1285017 - protein, 9 aa, Homo Sapiens
PALPGVFCG

SEQ ID NO: 1285018 - protein, 9 aa, Homo Sapiens
EVRHFQCHK

SEQ ID NO: 1285019 - protein, 9 aa, Homo Sapiens
ITNGGKANL

SEQ ID NO: 1285020 - protein, 9 aa, Homo Sapiens
KELPQTKGE

SEQ ID NO: 1285021 - protein, 9 aa, Homo Sapiens
LQLPLHGGP

SEQ ID NO: 1285022 - protein, 9 aa, Homo Sapiens
TVDDSCISS

SEQ ID NO: 1285023 - protein, 9 aa, Homo Sapiens
CASNLTAIT

SEQ ID NO: 1285024 - protein, 9 aa, Homo Sapiens
DCGVEAIAT

SEQ ID NO: 1285025 - protein, 9 aa, Homo Sapiens
CANHTLLQQ

SEQ ID NO: 1285026 - protein, 9 aa, Homo Sapiens
TKDDITVFL

SEQ ID NO: 1285027 - protein, 9 aa, Homo Sapiens
LNAIHNCIY

SEQ ID NO: 1285028 - protein, 9 aa, Homo Sapiens
FQVHHVLCI

SEQ ID NO: 1285029 - protein, 9 aa, Homo Sapiens
WPPVVKPQS

SEQ ID NO: 1285030 - protein, 9 aa, Homo Sapiens
GKTLYFFSL

SEQ ID NO: 1285031 - protein, 9 aa, Homo Sapiens
LSENGKKAM

SEQ ID NO: 1285032 - protein, 9 aa, Homo Sapiens
PQHVFVKCH

SEQ ID NO: 1285033 - protein, 9 aa, Homo Sapiens
FTTTISIFK

SEQ ID NO: 1285034 - protein, 9 aa, Homo Sapiens
NLLNYNNIE

SEQ ID NO: 1285035 - protein, 9 aa, Homo Sapiens
GGKANLYFL

SEQ ID NO: 1285036 - protein, 9 aa, Homo Sapiens
EILTTNCDS

SEQ ID NO: 1285037 - protein, 9 aa, Homo Sapiens
IDSETMFRL

SEQ ID NO: 1285038 - protein, 9 aa, Homo Sapiens
QEEEIEEVE

SEQ ID NO: 1285039 - protein, 9 aa, Homo Sapiens
GKKMCIEKL

SEQ ID NO: 1285040 - protein, 9 aa, Homo Sapiens
AATNRPDMI

SEQ ID NO: 1285041 - protein, 9 aa, Homo Sapiens
TCNVTSSSE

SEQ ID NO: 1285042 - protein, 9 aa, Homo Sapiens
FTSLYSSYG

SEQ ID NO: 1285043 - protein, 9 aa, Homo Sapiens
DNLMQIQKC

SEQ ID NO: 1285044 - protein, 9 aa, Homo Sapiens
LQKLIISET

SEQ ID NO: 1285045 - protein, 9 aa, Homo Sapiens
MLASADDSG

SEQ ID NO: 1285046 - protein, 9 aa, Homo Sapiens
WTMAIVMCA

SEQ ID NO: 1285047 - protein, 9 aa, Homo Sapiens
QSSSPGNIL

SEQ ID NO: 1285048 - protein, 9 aa, Homo Sapiens
MRFALINMK

SEQ ID NO: 1285049 - protein, 9 aa, Homo Sapiens
QMLATLYKS

SEQ ID NO: 1285050 - protein, 9 aa, Homo Sapiens
NQEKNSWTH

SEQ ID NO: 1285051 - protein, 9 aa, Homo Sapiens
LSHSLGNSS

SEQ ID NO: 1285052 - protein, 9 aa, Homo Sapiens
AKSSMFRSE

SEQ ID NO: 1285053 - protein, 9 aa, Homo Sapiens
EDVFVCESL

SEQ ID NO: 1285054 - protein, 9 aa, Homo Sapiens
TGQECRDTK

SEQ ID NO: 1285055 - protein, 9 aa, Homo Sapiens
NLILYTATT

SEQ ID NO: 1285056 - protein, 9 aa, Homo Sapiens
TDFIPQHNK

SEQ ID NO: 1285057 - protein, 9 aa, Homo Sapiens
YCYPDPSYL

SEQ ID NO: 1285058 - protein, 9 aa, Homo Sapiens
EHSNKSKDS

SEQ ID NO: 1285059 - protein, 9 aa, Homo Sapiens
TKHKTSHTV

SEQ ID NO: 1285060 - protein, 9 aa, Homo Sapiens
DENGSTTQK

SEQ ID NO: 1285061 - protein, 9 aa, Homo Sapiens
FEALKFFVN

SEQ ID NO: 1285062 - protein, 9 aa, Homo Sapiens
AQPSWLTKP

SEQ ID NO: 1285063 - protein, 9 aa, Homo Sapiens
FQGLFVRYL

SEQ ID NO: 1285064 - protein, 9 aa, Homo Sapiens
CTYEFLYTV

SEQ ID NO: 1285065 - protein, 9 aa, Homo Sapiens
AHHRKAVSD

SEQ ID NO: 1285066 - protein, 9 aa, Homo Sapiens
GATVLRWRL

SEQ ID NO: 1285067 - protein, 9 aa, Homo Sapiens
FYKEYISVI

SEQ ID NO: 1285068 - protein, 9 aa, Homo Sapiens
KVFSTCASN

SEQ ID NO: 1285069 - protein, 9 aa, Homo Sapiens
HVAVAQYAD

SEQ ID NO: 1285070 - protein, 9 aa, Homo Sapiens
KLFIVDSIP

SEQ ID NO: 1285071 - protein, 9 aa, Homo Sapiens
VMTLFDEKF

SEQ ID NO: 1285072 - protein, 9 aa, Homo Sapiens
KIDPVCVDY

SEQ ID NO: 1285073 - protein, 9 aa, Homo Sapiens
SYIIDLLSC

SEQ ID NO: 1285074 - protein, 9 aa, Homo Sapiens
NLVYNSAVL

SEQ ID NO: 1285075 - protein, 9 aa, Homo Sapiens
NLVSMGFVI

SEQ ID NO: 1285076 - protein, 9 aa, Homo Sapiens
RTDGVMWEY

SEQ ID NO: 1285077 - protein, 9 aa, Homo Sapiens
DEGLNTQGG

SEQ ID NO: 1285078 - protein, 9 aa, Homo Sapiens
KKKKKRGPE

SEQ ID NO: 1285079 - protein, 9 aa, Homo Sapiens
IHTMSEYGR

SEQ ID NO: 1285080 - protein, 9 aa, Homo Sapiens
GYTPYDMFC

SEQ ID NO: 1285081 - protein, 9 aa, Homo Sapiens
GLVDHNHNK

SEQ ID NO: 1285082 - protein, 9 aa, Homo Sapiens
EAAHEQDGL

SEQ ID NO: 1285083 - protein, 9 aa, Homo Sapiens
ESRRLKIDT

SEQ ID NO: 1285084 - protein, 9 aa, Homo Sapiens
TSYNSQVTQ

SEQ ID NO: 1285085 - protein, 9 aa, Homo Sapiens
PTSNDLLLQ

SEQ ID NO: 1285086 - protein, 9 aa, Homo Sapiens
EEINAFSLS

SEQ ID NO: 1285087 - protein, 9 aa, Homo Sapiens
VFEVTELKL

SEQ ID NO: 1285088 - protein, 9 aa, Homo Sapiens
NSCVWNTEN

SEQ ID NO: 1285089 - protein, 9 aa, Homo Sapiens
LCSRLLVGV

SEQ ID NO: 1285090 - protein, 9 aa, Homo Sapiens
NSFEKKLAP

SEQ ID NO: 1285091 - protein, 9 aa, Homo Sapiens
TNWTEKVQF

SEQ ID NO: 1285092 - protein, 9 aa, Homo Sapiens
VMDQEPAVN

SEQ ID NO: 1285093 - protein, 9 aa, Homo Sapiens
IINYCVALT

SEQ ID NO: 1285094 - protein, 9 aa, Homo Sapiens
PSLRCVLQY

SEQ ID NO: 1285095 - protein, 9 aa, Homo Sapiens
AIQVVLEEL

SEQ ID NO: 1285096 - protein, 9 aa, Homo Sapiens
NSRTANIRS

SEQ ID NO: 1285097 - protein, 9 aa, Homo Sapiens
DNQSNLKMC

SEQ ID NO: 1285098 - protein, 9 aa, Homo Sapiens
LRTETCVTT

SEQ ID NO: 1285099 - protein, 9 aa, Homo Sapiens
AALRGEGPG

SEQ ID NO: 1285100 - protein, 9 aa, Homo Sapiens
VNPNKVSPA

SEQ ID NO: 1285101 - protein, 9 aa, Homo Sapiens
LVIKEKKAV

SEQ ID NO: 1285102 - protein, 9 aa, Homo Sapiens
NVHCRINTG

SEQ ID NO: 1285103 - protein, 9 aa, Homo Sapiens
FVNLKSMSI

SEQ ID NO: 1285104 - protein, 9 aa, Homo Sapiens
NKNCTYEFL

SEQ ID NO: 1285105 - protein, 9 aa, Homo Sapiens
FKLVPHSQK

SEQ ID NO: 1285106 - protein, 9 aa, Homo Sapiens
LMLLYPDGK

SEQ ID NO: 1285107 - protein, 9 aa, Homo Sapiens
CFHSSLTEQ

SEQ ID NO: 1285108 - protein, 9 aa, Homo Sapiens
CAKYEFTYA

SEQ ID NO: 1285109 - protein, 9 aa, Homo Sapiens
VAALQDTQN

SEQ ID NO: 1285110 - protein, 9 aa, Homo Sapiens
SECGNMLLW

SEQ ID NO: 1285111 - protein, 9 aa, Homo Sapiens
WKIFTKPDP

SEQ ID NO: 1285112 - protein, 9 aa, Homo Sapiens
DKVVGHISG

SEQ ID NO: 1285113 - protein, 9 aa, Homo Sapiens
LAFLFFTSL

SEQ ID NO: 1285114 - protein, 9 aa, Homo Sapiens
IQRGKGLGY

SEQ ID NO: 1285115 - protein, 9 aa, Homo Sapiens
RGLPCAVGE

SEQ ID NO: 1285116 - protein, 9 aa, Homo Sapiens
NAHKQKLTE

SEQ ID NO: 1285117 - protein, 9 aa, Homo Sapiens
LKNVCCLIG

SEQ ID NO: 1285118 - protein, 9 aa, Homo Sapiens
LILSKRLLY

SEQ ID NO: 1285119 - protein, 9 aa, Homo Sapiens
LTVPWITVC

SEQ ID NO: 1285120 - protein, 9 aa, Homo Sapiens
TCFENLTDT

SEQ ID NO: 1285121 - protein, 9 aa, Homo Sapiens
NCGEVLREQ

SEQ ID NO: 1285122 - protein, 9 aa, Homo Sapiens
KIKTQEKAQ

SEQ ID NO: 1285123 - protein, 9 aa, Homo Sapiens
LMVNLLILM

SEQ ID NO: 1285124 - protein, 9 aa, Homo Sapiens
LKIDTSYKY

SEQ ID NO: 1285125 - protein, 9 aa, Homo Sapiens
KQFKEAREY

SEQ ID NO: 1285126 - protein, 9 aa, Homo Sapiens
NQDPNNNLH

SEQ ID NO: 1285127 - protein, 9 aa, Homo Sapiens
VPNQTLTQL

SEQ ID NO: 1285128 - protein, 9 aa, Homo Sapiens
QIHYGERIT

SEQ ID NO: 1285129 - protein, 9 aa, Homo Sapiens
EGKGLGGNV

SEQ ID NO: 1285130 - protein, 9 aa, Homo Sapiens
YLHTAGRLT

SEQ ID NO: 1285131 - protein, 9 aa, Homo Sapiens
LLMKDQKPK

SEQ ID NO: 1285132 - protein, 9 aa, Homo Sapiens
NIFTKEEEL

SEQ ID NO: 1285133 - protein, 9 aa, Homo Sapiens
DFFQGLFVR

SEQ ID NO: 1285134 - protein, 9 aa, Homo Sapiens
DYINAYIHT

SEQ ID NO: 1285135 - protein, 9 aa, Homo Sapiens
LQPIQYEPV

SEQ ID NO: 1285136 - protein, 9 aa, Homo Sapiens
FTMLITLAR

SEQ ID NO: 1285137 - protein, 9 aa, Homo Sapiens
QVVFRRKLE

SEQ ID NO: 1285138 - protein, 9 aa, Homo Sapiens
KGGETYLII

SEQ ID NO: 1285139 - protein, 9 aa, Homo Sapiens
ISMIQLMVN

SEQ ID NO: 1285140 - protein, 9 aa, Homo Sapiens
CDPSLNTKC

SEQ ID NO: 1285141 - protein, 9 aa, Homo Sapiens
YDLRYRKRP

SEQ ID NO: 1285142 - protein, 9 aa, Homo Sapiens
KGKIVVSIA

SEQ ID NO: 1285143 - protein, 9 aa, Homo Sapiens
RARTLPIIN

SEQ ID NO: 1285144 - protein, 9 aa, Homo Sapiens
LRLNNAQQQ

SEQ ID NO: 1285145 - protein, 9 aa, Homo Sapiens
FSGSQHDYP

SEQ ID NO: 1285146 - protein, 9 aa, Homo Sapiens
FDGYKPLEL

SEQ ID NO: 1285147 - protein, 9 aa, Homo Sapiens
EENVDKTEL

SEQ ID NO: 1285148 - protein, 9 aa, Homo Sapiens
HDLYWKVKF

SEQ ID NO: 1285149 - protein, 9 aa, Homo Sapiens
RRYSFLAEK

SEQ ID NO: 1285150 - protein, 9 aa, Homo Sapiens
DSVGLPHCA

SEQ ID NO: 1285151 - protein, 9 aa, Homo Sapiens
GRLCITHLV

SEQ ID NO: 1285152 - protein, 9 aa, Homo Sapiens
VYDNNVLQR

SEQ ID NO: 1285153 - protein, 9 aa, Homo Sapiens
TTGVYRDLF

SEQ ID NO: 1285154 - protein, 9 aa, Homo Sapiens
KTFKGLKTK

SEQ ID NO: 1285155 - protein, 9 aa, Homo Sapiens
RKIAKLIES

SEQ ID NO: 1285156 - protein, 9 aa, Homo Sapiens
AKAFKSPLY

SEQ ID NO: 1285157 - protein, 9 aa, Homo Sapiens
EAVIDINKP

SEQ ID NO: 1285158 - protein, 9 aa, Homo Sapiens
WTKLYWEID

SEQ ID NO: 1285159 - protein, 9 aa, Homo Sapiens
FSEFSNSSC

SEQ ID NO: 1285160 - protein, 9 aa, Homo Sapiens
DIVLSWAHI

SEQ ID NO: 1285161 - protein, 9 aa, Homo Sapiens
EIDQALDAH

SEQ ID NO: 1285162 - protein, 9 aa, Homo Sapiens
VAICGISVI

SEQ ID NO: 1285163 - protein, 9 aa, Homo Sapiens
SVCWVSECI

SEQ ID NO: 1285164 - protein, 9 aa, Homo Sapiens
VCIPTSFHA

SEQ ID NO: 1285165 - protein, 9 aa, Homo Sapiens
FQDPVPITV

SEQ ID NO: 1285166 - protein, 9 aa, Homo Sapiens
SLRDCFNIF

SEQ ID NO: 1285167 - protein, 9 aa, Homo Sapiens
CGKLPLSPK

SEQ ID NO: 1285168 - protein, 9 aa, Homo Sapiens
TLSTDKKKY

SEQ ID NO: 1285169 - protein, 9 aa, Homo Sapiens
QIINKMINF

SEQ ID NO: 1285170 - protein, 9 aa, Homo Sapiens
IGYVHRDLA

SEQ ID NO: 1285171 - protein, 9 aa, Homo Sapiens
LFVCNLPHD

SEQ ID NO: 1285172 - protein, 9 aa, Homo Sapiens
DLSTFDYIT

SEQ ID NO: 1285173 - protein, 9 aa, Homo Sapiens
STLVHADKI

SEQ ID NO: 1285174 - protein, 9 aa, Homo Sapiens
MALKFILAF

SEQ ID NO: 1285175 - protein, 9 aa, Homo Sapiens
VLFLVVWLV

SEQ ID NO: 1285176 - protein, 9 aa, Homo Sapiens
SCTAQGLKG

SEQ ID NO: 1285177 - protein, 9 aa, Homo Sapiens
SIGRSYDGR

SEQ ID NO: 1285178 - protein, 9 aa, Homo Sapiens
GPTVKHSGH

SEQ ID NO: 1285179 - protein, 9 aa, Homo Sapiens
MGRFIPLKA

SEQ ID NO: 1285180 - protein, 9 aa, Homo Sapiens
IRNVNFNCS

SEQ ID NO: 1285181 - protein, 9 aa, Homo Sapiens
TVPWITVCS

SEQ ID NO: 1285182 - protein, 9 aa, Homo Sapiens
TDKKKYGIR

SEQ ID NO: 1285183 - protein, 9 aa, Homo Sapiens
KRSAFDRCA

SEQ ID NO: 1285184 - protein, 9 aa, Homo Sapiens
KAFKSPLYS

SEQ ID NO: 1285185 - protein, 9 aa, Homo Sapiens
TKKRKRKYD

SEQ ID NO: 1285186 - protein, 9 aa, Homo Sapiens
VAMGRQLLA

SEQ ID NO: 1285187 - protein, 9 aa, Homo Sapiens
LTKANSTSI

SEQ ID NO: 1285188 - protein, 9 aa, Homo Sapiens
IDLHIYVSF

SEQ ID NO: 1285189 - protein, 9 aa, Homo Sapiens
GNMNHCNWH

SEQ ID NO: 1285190 - protein, 9 aa, Homo Sapiens
GSCFILTDQ

SEQ ID NO: 1285191 - protein, 9 aa, Homo Sapiens
SFRFEKRNK

SEQ ID NO: 1285192 - protein, 9 aa, Homo Sapiens
DFSQLIDCQ

SEQ ID NO: 1285193 - protein, 9 aa, Homo Sapiens
ITNALKPCF

SEQ ID NO: 1285194 - protein, 9 aa, Homo Sapiens
QTEGKGLGG

SEQ ID NO: 1285195 - protein, 9 aa, Homo Sapiens
KLLFGCYIE

SEQ ID NO: 1285196 - protein, 9 aa, Homo Sapiens
CASIGITNH

SEQ ID NO: 1285197 - protein, 9 aa, Homo Sapiens
KCEYCLQYF

SEQ ID NO: 1285198 - protein, 9 aa, Homo Sapiens
YTCYPICGV

SEQ ID NO: 1285199 - protein, 9 aa, Homo Sapiens
ASSCFCDSS

SEQ ID NO: 1285200 - protein, 9 aa, Homo Sapiens
YKIVIQLPM

SEQ ID NO: 1285201 - protein, 9 aa, Homo Sapiens
FFESSQTTL

SEQ ID NO: 1285202 - protein, 9 aa, Homo Sapiens
TKTVCMNVL

SEQ ID NO: 1285203 - protein, 9 aa, Homo Sapiens
KVMTLFDEK

SEQ ID NO: 1285204 - protein, 9 aa, Homo Sapiens
GLNTQGGSG

SEQ ID NO: 1285205 - protein, 9 aa, Homo Sapiens
MRPLKMCGR

SEQ ID NO: 1285206 - protein, 9 aa, Homo Sapiens
VEHINGKKN

SEQ ID NO: 1285207 - protein, 9 aa, Homo Sapiens
KKMDALLHA

SEQ ID NO: 1285208 - protein, 9 aa, Homo Sapiens
DMELIPNNS

SEQ ID NO: 1285209 - protein, 9 aa, Homo Sapiens
TPSDSGGPD

SEQ ID NO: 1285210 - protein, 9 aa, Homo Sapiens
AIVGAIPYT

SEQ ID NO: 1285211 - protein, 9 aa, Homo Sapiens
TMTPTHEMF

SEQ ID NO: 1285212 - protein, 9 aa, Homo Sapiens
PVLMSHRVC

SEQ ID NO: 1285213 - protein, 9 aa, Homo Sapiens
EQRAAGMCG

SEQ ID NO: 1285214 - protein, 9 aa, Homo Sapiens
ALLAVPIVP

SEQ ID NO: 1285215 - protein, 9 aa, Homo Sapiens
VHAKFEFIV

SEQ ID NO: 1285216 - protein, 9 aa, Homo Sapiens
TARMENFAH

SEQ ID NO: 1285217 - protein, 9 aa, Homo Sapiens
KLDIQTGTT

SEQ ID NO: 1285218 - protein, 9 aa, Homo Sapiens
NRVQIQSLQ

SEQ ID NO: 1285219 - protein, 9 aa, Homo Sapiens
AECNSVDIK

SEQ ID NO: 1285220 - protein, 9 aa, Homo Sapiens
TPYDMFCPF

SEQ ID NO: 1285221 - protein, 9 aa, Homo Sapiens
CIQNYLFEN

SEQ ID NO: 1285222 - protein, 9 aa, Homo Sapiens
NYKNHMRGR

SEQ ID NO: 1285223 - protein, 9 aa, Homo Sapiens
FWVTILPSK

SEQ ID NO: 1285224 - protein, 9 aa, Homo Sapiens
DVIIQRAYT

SEQ ID NO: 1285225 - protein, 9 aa, Homo Sapiens
NRIGKTWER

SEQ ID NO: 1285226 - protein, 9 aa, Homo Sapiens
RGYFFNCDC

SEQ ID NO: 1285227 - protein, 9 aa, Homo Sapiens
ASQEASYKA

SEQ ID NO: 1285228 - protein, 9 aa, Homo Sapiens
ICHALFTQS

SEQ ID NO: 1285229 - protein, 9 aa, Homo Sapiens
LYFFSLAAN

SEQ ID NO: 1285230 - protein, 9 aa, Homo Sapiens
LLVNTTSFP

SEQ ID NO: 1285231 - protein, 9 aa, Homo Sapiens
PLSILTKKG

SEQ ID NO: 1285232 - protein, 9 aa, Homo Sapiens
NPQDKIIFT

SEQ ID NO: 1285233 - protein, 9 aa, Homo Sapiens
VNLRDDVDS

SEQ ID NO: 1285234 - protein, 9 aa, Homo Sapiens
AGKIFSHMN

SEQ ID NO: 1285235 - protein, 9 aa, Homo Sapiens
AKKEMHLLS

SEQ ID NO: 1285236 - protein, 9 aa, Homo Sapiens
GTYLIGTEL

SEQ ID NO: 1285237 - protein, 9 aa, Homo Sapiens
PFVCAQCST

SEQ ID NO: 1285238 - protein, 9 aa, Homo Sapiens
EKPVLTAVQ

SEQ ID NO: 1285239 - protein, 9 aa, Homo Sapiens
GQLIDSIAN

SEQ ID NO: 1285240 - protein, 9 aa, Homo Sapiens
LTVMQDRLE

SEQ ID NO: 1285241 - protein, 9 aa, Homo Sapiens
HSTQSQEEF

SEQ ID NO: 1285242 - protein, 9 aa, Homo Sapiens
HQKFVFFAE

SEQ ID NO: 1285243 - protein, 9 aa, Homo Sapiens
PLGDLIEHL

SEQ ID NO: 1285244 - protein, 9 aa, Homo Sapiens
TFQHFTNHS

SEQ ID NO: 1285245 - protein, 9 aa, Homo Sapiens
ELEEKRRYS

SEQ ID NO: 1285246 - protein, 9 aa, Homo Sapiens
ETLQQYGVC

SEQ ID NO: 1285247 - protein, 9 aa, Homo Sapiens
KRIVNRAPE

SEQ ID NO: 1285248 - protein, 9 aa, Homo Sapiens
VEPAADKYW

SEQ ID NO: 1285249 - protein, 9 aa, Homo Sapiens
SGLTYHVAH

SEQ ID NO: 1285250 - protein, 9 aa, Homo Sapiens
QPHGWVSWA

SEQ ID NO: 1285251 - protein, 9 aa, Homo Sapiens
EQIHYGERI

SEQ ID NO: 1285252 - protein, 9 aa, Homo Sapiens
TTNSSWTQD

SEQ ID NO: 1285253 - protein, 9 aa, Homo Sapiens
DTAHRITAK

SEQ ID NO: 1285254 - protein, 9 aa, Homo Sapiens
NSASWVLFS

SEQ ID NO: 1285255 - protein, 9 aa, Homo Sapiens
NRTIYLIDY

SEQ ID NO: 1285256 - protein, 9 aa, Homo Sapiens
KTDIVACST

SEQ ID NO: 1285257 - protein, 9 aa, Homo Sapiens
DRVFHCNET

SEQ ID NO: 1285258 - protein, 9 aa, Homo Sapiens
VHADKISTP

SEQ ID NO: 1285259 - protein, 9 aa, Homo Sapiens
CYFTNWTEK

SEQ ID NO: 1285260 - protein, 9 aa, Homo Sapiens
LPTYCVHYY

SEQ ID NO: 1285261 - protein, 9 aa, Homo Sapiens
LPMSAVVCI

SEQ ID NO: 1285262 - protein, 9 aa, Homo Sapiens
IVLSWAHIK

SEQ ID NO: 1285263 - protein, 9 aa, Homo Sapiens
HLSGGMQLK

SEQ ID NO: 1285264 - protein, 9 aa, Homo Sapiens
LLAAWAAER

SEQ ID NO: 1285265 - protein, 9 aa, Homo Sapiens
KYDLIWICY

SEQ ID NO: 1285266 - protein, 9 aa, Homo Sapiens
REPWLLQSQ

SEQ ID NO: 1285267 - protein, 9 aa, Homo Sapiens
EICYNYFYL

SEQ ID NO: 1285268 - protein, 9 aa, Homo Sapiens
QQHANQYSS

SEQ ID NO: 1285269 - protein, 9 aa, Homo Sapiens
YDIVILSAT

SEQ ID NO: 1285270 - protein, 9 aa, Homo Sapiens
NYDQLQGKE

SEQ ID NO: 1285271 - protein, 9 aa, Homo Sapiens
NWTEKVQFV

SEQ ID NO: 1285272 - protein, 9 aa, Homo Sapiens
AFLFFTSLY

SEQ ID NO: 1285273 - protein, 9 aa, Homo Sapiens
TLYLTCNTQ

SEQ ID NO: 1285274 - protein, 9 aa, Homo Sapiens
QTGTTPQRK

SEQ ID NO: 1285275 - protein, 9 aa, Homo Sapiens
IVSLTESCL

SEQ ID NO: 1285276 - protein, 9 aa, Homo Sapiens
NCTEEPMDT

SEQ ID NO: 1285277 - protein, 9 aa, Homo Sapiens
CLNMTDITR

SEQ ID NO: 1285278 - protein, 9 aa, Homo Sapiens
RGDCEVLGC

SEQ ID NO: 1285279 - protein, 9 aa, Homo Sapiens
RVNKCLQED

SEQ ID NO: 1285280 - protein, 9 aa, Homo Sapiens
TVMQDRLEQ

SEQ ID NO: 1285281 - protein, 9 aa, Homo Sapiens
TLLFFLVNY

SEQ ID NO: 1285282 - protein, 9 aa, Homo Sapiens
AAACANHTL

SEQ ID NO: 1285283 - protein, 9 aa, Homo Sapiens
GLTQPKYKY

SEQ ID NO: 1285284 - protein, 9 aa, Homo Sapiens
HSDKHVGTK

SEQ ID NO: 1285285 - protein, 9 aa, Homo Sapiens
YNEFCRLLA

SEQ ID NO: 1285286 - protein, 9 aa, Homo Sapiens
CPRGDLGST

SEQ ID NO: 1285287 - protein, 9 aa, Homo Sapiens
VKSMLYSVQ

SEQ ID NO: 1285288 - protein, 9 aa, Homo Sapiens
CFILTDQLD

SEQ ID NO: 1285289 - protein, 9 aa, Homo Sapiens
EVATANLAL

SEQ ID NO: 1285290 - protein, 9 aa, Homo Sapiens
DNPFFESSQ

SEQ ID NO: 1285291 - protein, 9 aa, Homo Sapiens
KTTVPGCGP

SEQ ID NO: 1285292 - protein, 9 aa, Homo Sapiens
IASCETERI

SEQ ID NO: 1285293 - protein, 9 aa, Homo Sapiens
YWKVKFTAE

SEQ ID NO: 1285294 - protein, 9 aa, Homo Sapiens
EEEDTDPSV

SEQ ID NO: 1285295 - protein, 9 aa, Homo Sapiens
FKEVRCMKL

SEQ ID NO: 1285296 - protein, 9 aa, Homo Sapiens
CVKIVVVDE

SEQ ID NO: 1285297 - protein, 9 aa, Homo Sapiens
VNMCCPKQY

SEQ ID NO: 1285298 - protein, 9 aa, Homo Sapiens
SYVSKSQPD

SEQ ID NO: 1285299 - protein, 9 aa, Homo Sapiens
LCCEVLATP

SEQ ID NO: 1285300 - protein, 9 aa, Homo Sapiens
WLNKVNPNK

SEQ ID NO: 1285301 - protein, 9 aa, Homo Sapiens
DVDQDWETE

SEQ ID NO: 1285302 - protein, 9 aa, Homo Sapiens
NYSYDFEDE

SEQ ID NO: 1285303 - protein, 9 aa, Homo Sapiens
AEHKQLIPL

SEQ ID NO: 1285304 - protein, 9 aa, Homo Sapiens
DRDCHIKLT

SEQ ID NO: 1285305 - protein, 9 aa, Homo Sapiens
ERCAQDMDN

SEQ ID NO: 1285306 - protein, 9 aa, Homo Sapiens
TSTYKSLQD

SEQ ID NO: 1285307 - protein, 9 aa, Homo Sapiens
CQCTSVCAQ

SEQ ID NO: 1285308 - protein, 9 aa, Homo Sapiens
PPQSAVKIP

SEQ ID NO: 1285309 - protein, 9 aa, Homo Sapiens
QCIAAGCDH

SEQ ID NO: 1285310 - protein, 9 aa, Homo Sapiens
SHYYTAGSS

SEQ ID NO: 1285311 - protein, 9 aa, Homo Sapiens
FRSEEEHLS

SEQ ID NO: 1285312 - protein, 9 aa, Homo Sapiens
CFENLTDTS

SEQ ID NO: 1285313 - protein, 9 aa, Homo Sapiens
CAVFNGITL

SEQ ID NO: 1285314 - protein, 9 aa, Homo Sapiens
YKGYILVGQ

SEQ ID NO: 1285315 - protein, 9 aa, Homo Sapiens
NEEYNSDEQ

SEQ ID NO: 1285316 - protein, 9 aa, Homo Sapiens
YCSNNMPTI

SEQ ID NO: 1285317 - protein, 9 aa, Homo Sapiens
TDSSGMSAV

SEQ ID NO: 1285318 - protein, 9 aa, Homo Sapiens
AGQSNLKSN

SEQ ID NO: 1285319 - protein, 9 aa, Homo Sapiens
CWRCDHILV

SEQ ID NO: 1285320 - protein, 9 aa, Homo Sapiens
DCDYVVSEW

SEQ ID NO: 1285321 - protein, 9 aa, Homo Sapiens
FGNYNKQPS

SEQ ID NO: 1285322 - protein, 9 aa, Homo Sapiens
LATMKKEKQ

SEQ ID NO: 1285323 - protein, 9 aa, Homo Sapiens
SIPWSHAMY

SEQ ID NO: 1285324 - protein, 9 aa, Homo Sapiens
EQDENPGND

SEQ ID NO: 1285325 - protein, 9 aa, Homo Sapiens
TSCSVIHET

SEQ ID NO: 1285326 - protein, 9 aa, Homo Sapiens
IYECYKGYI

SEQ ID NO: 1285327 - protein, 9 aa, Homo Sapiens
ISTLLYLGH

SEQ ID NO: 1285328 - protein, 9 aa, Homo Sapiens
SQDEQGVDI

SEQ ID NO: 1285329 - protein, 9 aa, Homo Sapiens
EAALILCVS

SEQ ID NO: 1285330 - protein, 9 aa, Homo Sapiens
SYSWDSAQR

SEQ ID NO: 1285331 - protein, 9 aa, Homo Sapiens
ITRLLSDFV

SEQ ID NO: 1285332 - protein, 9 aa, Homo Sapiens
IFTMLITLA

SEQ ID NO: 1285333 - protein, 9 aa, Homo Sapiens
EDQILINDR

SEQ ID NO: 1285334 - protein, 9 aa, Homo Sapiens
DILVGSLSD

SEQ ID NO: 1285335 - protein, 9 aa, Homo Sapiens
SSFYKEYIS

SEQ ID NO: 1285336 - protein, 9 aa, Homo Sapiens
IDRDCHIKL

SEQ ID NO: 1285337 - protein, 9 aa, Homo Sapiens
TWIIKESNI

SEQ ID NO: 1285338 - protein, 9 aa, Homo Sapiens
KESSTSGSK

SEQ ID NO: 1285339 - protein, 9 aa, Homo Sapiens
AYIHTMSEY

SEQ ID NO: 1285340 - protein, 9 aa, Homo Sapiens
AMVCTIDMT

SEQ ID NO: 1285341 - protein, 9 aa, Homo Sapiens
GYKAYDHEN

SEQ ID NO: 1285342 - protein, 9 aa, Homo Sapiens
KEGPGWTLV

SEQ ID NO: 1285343 - protein, 9 aa, Homo Sapiens
LIYSLDTSV

SEQ ID NO: 1285344 - protein, 9 aa, Homo Sapiens
IKIAKEAVI

SEQ ID NO: 1285345 - protein, 9 aa, Homo Sapiens
HISGLQETL

SEQ ID NO: 1285346 - protein, 9 aa, Homo Sapiens
PTERNGGKD

SEQ ID NO: 1285347 - protein, 9 aa, Homo Sapiens
QLLGRKVPL

SEQ ID NO: 1285348 - protein, 9 aa, Homo Sapiens
WITVCSRKR

SEQ ID NO: 1285349 - protein, 9 aa, Homo Sapiens
QLCLEYLGY

SEQ ID NO: 1285350 - protein, 9 aa, Homo Sapiens
SAATIKLHY

SEQ ID NO: 1285351 - protein, 9 aa, Homo Sapiens
VISYYLCDD

SEQ ID NO: 1285352 - protein, 9 aa, Homo Sapiens
ISFTEIVQD

SEQ ID NO: 1285353 - protein, 9 aa, Homo Sapiens
LKKALNRFE

SEQ ID NO: 1285354 - protein, 9 aa, Homo Sapiens
EEDLHPTKK

SEQ ID NO: 1285355 - protein, 9 aa, Homo Sapiens
TTWADIEAI

SEQ ID NO: 1285356 - protein, 9 aa, Homo Sapiens
KANLYFLLA

SEQ ID NO: 1285357 - protein, 9 aa, Homo Sapiens
VGKNKVTDE

SEQ ID NO: 1285358 - protein, 9 aa, Homo Sapiens
FPDSCFHSS

SEQ ID NO: 1285359 - protein, 9 aa, Homo Sapiens
LQECSNYDQ

SEQ ID NO: 1285360 - protein, 9 aa, Homo Sapiens
YFFSLAANS

SEQ ID NO: 1285361 - protein, 9 aa, Homo Sapiens
LDKTCCVDT

SEQ ID NO: 1285362 - protein, 9 aa, Homo Sapiens
PFISLDLPL

SEQ ID NO: 1285363 - protein, 9 aa, Homo Sapiens
ATMDSQPHQ

SEQ ID NO: 1285364 - protein, 9 aa, Homo Sapiens
KAVKNTYGK

SEQ ID NO: 1285365 - protein, 9 aa, Homo Sapiens
ISEWTFQHF

SEQ ID NO: 1285366 - protein, 9 aa, Homo Sapiens
INIGENPYQ

SEQ ID NO: 1285367 - protein, 9 aa, Homo Sapiens
DLPPINGQV

SEQ ID NO: 1285368 - protein, 9 aa, Homo Sapiens
YELSPNIFA

SEQ ID NO: 1285369 - protein, 9 aa, Homo Sapiens
IPNTDRCHC

SEQ ID NO: 1285370 - protein, 9 aa, Homo Sapiens
NAWSKLDHG

SEQ ID NO: 1285371 - protein, 9 aa, Homo Sapiens
QCKCLQGFT

SEQ ID NO: 1285372 - protein, 9 aa, Homo Sapiens
VHLDDPESA

SEQ ID NO: 1285373 - protein, 9 aa, Homo Sapiens
FKAVSSVLA

SEQ ID NO: 1285374 - protein, 9 aa, Homo Sapiens
HGFFLNHYL

SEQ ID NO: 1285375 - protein, 9 aa, Homo Sapiens
HVLNKAKER

SEQ ID NO: 1285376 - protein, 9 aa, Homo Sapiens
QCTLLCTPP

SEQ ID NO: 1285377 - protein, 9 aa, Homo Sapiens
DHLTLKEHF

SEQ ID NO: 1285378 - protein, 9 aa, Homo Sapiens
DGSKEFSAE

SEQ ID NO: 1285379 - protein, 9 aa, Homo Sapiens
LTRYAESLC

SEQ ID NO: 1285380 - protein, 9 aa, Homo Sapiens
HKRGHTGEK

SEQ ID NO: 1285381 - protein, 9 aa, Homo Sapiens
NTTVYALQT

SEQ ID NO: 1285382 - protein, 9 aa, Homo Sapiens
YPKWTISKD

SEQ ID NO: 1285383 - protein, 9 aa, Homo Sapiens
LKVSIIQRG

SEQ ID NO: 1285384 - protein, 9 aa, Homo Sapiens
SFADQDDLP

SEQ ID NO: 1285385 - protein, 9 aa, Homo Sapiens
TEDCIKRIQ

SEQ ID NO: 1285386 - protein, 9 aa, Homo Sapiens
IIEPSIFNT

SEQ ID NO: 1285387 - protein, 9 aa, Homo Sapiens
SSPETLTDL

SEQ ID NO: 1285388 - protein, 9 aa, Homo Sapiens
EDVECLTYG

SEQ ID NO: 1285389 - protein, 9 aa, Homo Sapiens
KMCIEKLDI

SEQ ID NO: 1285390 - protein, 9 aa, Homo Sapiens
DPVCVDYIL

SEQ ID NO: 1285391 - protein, 9 aa, Homo Sapiens
SKFSNPLAL

SEQ ID NO: 1285392 - protein, 9 aa, Homo Sapiens
SFNNCCMSL

SEQ ID NO: 1285393 - protein, 9 aa, Homo Sapiens
RGKNHPPNF

SEQ ID NO: 1285394 - protein, 9 aa, Homo Sapiens
DHENRNGNG

SEQ ID NO: 1285395 - protein, 9 aa, Homo Sapiens
IAECNSVDI

SEQ ID NO: 1285396 - protein, 9 aa, Homo Sapiens
AINFNEDNQ

SEQ ID NO: 1285397 - protein, 9 aa, Homo Sapiens
MAHEVMEQV

SEQ ID NO: 1285398 - protein, 9 aa, Homo Sapiens
GPGLIHAFG

SEQ ID NO: 1285399 - protein, 9 aa, Homo Sapiens
PKFRCGRTA

SEQ ID NO: 1285400 - protein, 9 aa, Homo Sapiens
KGVINDCRK

SEQ ID NO: 1285401 - protein, 9 aa, Homo Sapiens
DGRSLFILK

SEQ ID NO: 1285402 - protein, 9 aa, Homo Sapiens
GPEVQTDPP

SEQ ID NO: 1285403 - protein, 9 aa, Homo Sapiens
EHEDFLLAI

SEQ ID NO: 1285404 - protein, 9 aa, Homo Sapiens
DTCECTDNA

SEQ ID NO: 1285405 - protein, 9 aa, Homo Sapiens
NAYIHTMSE

SEQ ID NO: 1285406 - protein, 9 aa, Homo Sapiens
VAGIDVNMC

SEQ ID NO: 1285407 - protein, 9 aa, Homo Sapiens
TLENSTESF

SEQ ID NO: 1285408 - protein, 9 aa, Homo Sapiens
GKGFLDVSL

SEQ ID NO: 1285409 - protein, 9 aa, Homo Sapiens
SKCKSINEK

SEQ ID NO: 1285410 - protein, 9 aa, Homo Sapiens
LDVLADMCH

SEQ ID NO: 1285411 - protein, 9 aa, Homo Sapiens
QKFVFFAED

SEQ ID NO: 1285412 - protein, 9 aa, Homo Sapiens
PAAKENWSR

SEQ ID NO: 1285413 - protein, 9 aa, Homo Sapiens
YSPQQTQLL

SEQ ID NO: 1285414 - protein, 9 aa, Homo Sapiens
VADMLLDNC

SEQ ID NO: 1285415 - protein, 9 aa, Homo Sapiens
GGFPLSGGQ

SEQ ID NO: 1285416 - protein, 9 aa, Homo Sapiens
RRREAMVCT

SEQ ID NO: 1285417 - protein, 9 aa, Homo Sapiens
SIPFYHIVL

SEQ ID NO: 1285418 - protein, 9 aa, Homo Sapiens
RLLHVIEDS

SEQ ID NO: 1285419 - protein, 9 aa, Homo Sapiens
QATFVKRLA

SEQ ID NO: 1285420 - protein, 9 aa, Homo Sapiens
HPPQSAVKI

SEQ ID NO: 1285421 - protein, 9 aa, Homo Sapiens
KEVCAECNE

SEQ ID NO: 1285422 - protein, 9 aa, Homo Sapiens
EEKELLKQE

SEQ ID NO: 1285423 - protein, 9 aa, Homo Sapiens
SIAMLVVLY

SEQ ID NO: 1285424 - protein, 9 aa, Homo Sapiens
RHLSGGMQL

SEQ ID NO: 1285425 - protein, 9 aa, Homo Sapiens
IKGSKSGNS

SEQ ID NO: 1285426 - protein, 9 aa, Homo Sapiens
LMKDQKPKK

SEQ ID NO: 1285427 - protein, 9 aa, Homo Sapiens
WDRKQMLAT

SEQ ID NO: 1285428 - protein, 9 aa, Homo Sapiens
MAIVMCAIP

SEQ ID NO: 1285429 - protein, 9 aa, Homo Sapiens
DLIHVAVAQ

SEQ ID NO: 1285430 - protein, 9 aa, Homo Sapiens
YINAYIHTM

SEQ ID NO: 1285431 - protein, 9 aa, Homo Sapiens
DEVKSTTKT

SEQ ID NO: 1285432 - protein, 9 aa, Homo Sapiens
SSSWLLNKK

SEQ ID NO: 1285433 - protein, 9 aa, Homo Sapiens
TERNGGKDN

SEQ ID NO: 1285434 - protein, 9 aa, Homo Sapiens
REFAYGGHH

SEQ ID NO: 1285435 - protein, 9 aa, Homo Sapiens
QLLAIQKLR

SEQ ID NO: 1285436 - protein, 9 aa, Homo Sapiens
GKTMRKNQT

SEQ ID NO: 1285437 - protein, 9 aa, Homo Sapiens
IIFFQRSVT

SEQ ID NO: 1285438 - protein, 9 aa, Homo Sapiens
NSDAKNNRY

SEQ ID NO: 1285439 - protein, 9 aa, Homo Sapiens
IDTSYKYIF

SEQ ID NO: 1285440 - protein, 9 aa, Homo Sapiens
NLIITRLLR

SEQ ID NO: 1285441 - protein, 9 aa, Homo Sapiens
AFLDKCSAT

SEQ ID NO: 1285442 - protein, 9 aa, Homo Sapiens
RLGGWTSTL

SEQ ID NO: 1285443 - protein, 9 aa, Homo Sapiens
RKCNNAHEN

SEQ ID NO: 1285444 - protein, 9 aa, Homo Sapiens
NNAQQQMKM

SEQ ID NO: 1285445 - protein, 9 aa, Homo Sapiens
ICYNYFYLF

SEQ ID NO: 1285446 - protein, 9 aa, Homo Sapiens
DRRQRACMH

SEQ ID NO: 1285447 - protein, 9 aa, Homo Sapiens
EEDQDPPCH

SEQ ID NO: 1285448 - protein, 9 aa, Homo Sapiens
IWIHDIRHF

SEQ ID NO: 1285449 - protein, 9 aa, Homo Sapiens
QDFKRIVNR

SEQ ID NO: 1285450 - protein, 9 aa, Homo Sapiens
VTRPISLFH

SEQ ID NO: 1285451 - protein, 9 aa, Homo Sapiens
VSKHHRTHE

SEQ ID NO: 1285452 - protein, 9 aa, Homo Sapiens
DRYGLNTLI

SEQ ID NO: 1285453 - protein, 9 aa, Homo Sapiens
FTDLQPNLY

SEQ ID NO: 1285454 - protein, 9 aa, Homo Sapiens
ICSNFAEDF

SEQ ID NO: 1285455 - protein, 9 aa, Homo Sapiens
FGIIVRMKF

SEQ ID NO: 1285456 - protein, 9 aa, Homo Sapiens
HDYPSYTAF

SEQ ID NO: 1285457 - protein, 9 aa, Homo Sapiens
ARNPHGFAF

SEQ ID NO: 1285458 - protein, 9 aa, Homo Sapiens
KMDALLHAA

SEQ ID NO: 1285459 - protein, 9 aa, Homo Sapiens
KIPQLRVSY

SEQ ID NO: 1285460 - protein, 9 aa, Homo Sapiens
QYLDTYIGH

SEQ ID NO: 1285461 - protein, 9 aa, Homo Sapiens
QMYNLCHLL

SEQ ID NO: 1285462 - protein, 9 aa, Homo Sapiens
LCYLHTAGR

SEQ ID NO: 1285463 - protein, 9 aa, Homo Sapiens
LNYNNIENY

SEQ ID NO: 1285464 - protein, 9 aa, Homo Sapiens
DYISGCGFS

SEQ ID NO: 1285465 - protein, 9 aa, Homo Sapiens
SEYYMGSVQ

SEQ ID NO: 1285466 - protein, 9 aa, Homo Sapiens
QAKIGMQPH

SEQ ID NO: 1285467 - protein, 9 aa, Homo Sapiens
FRFDCGVEA

SEQ ID NO: 1285468 - protein, 9 aa, Homo Sapiens
EPYQQQYPD

SEQ ID NO: 1285469 - protein, 9 aa, Homo Sapiens
IFCCFSFFM

SEQ ID NO: 1285470 - protein, 9 aa, Homo Sapiens
DTSYKYIFE

SEQ ID NO: 1285471 - protein, 9 aa, Homo Sapiens
TGTIKVAQR

SEQ ID NO: 1285472 - protein, 9 aa, Homo Sapiens
NSVFPEELG

SEQ ID NO: 1285473 - protein, 9 aa, Homo Sapiens
DLLCQIGSL

SEQ ID NO: 1285474 - protein, 9 aa, Homo Sapiens
AEHANYSLA

SEQ ID NO: 1285475 - protein, 9 aa, Homo Sapiens
ILHQRIHTV

SEQ ID NO: 1285476 - protein, 9 aa, Homo Sapiens
HQLFVCNLP

SEQ ID NO: 1285477 - protein, 9 aa, Homo Sapiens
ADQTSLHFV

SEQ ID NO: 1285478 - protein, 9 aa, Homo Sapiens
LEEISCYTE

SEQ ID NO: 1285479 - protein, 9 aa, Homo Sapiens
KITNSHQKL

SEQ ID NO: 1285480 - protein, 9 aa, Homo Sapiens
HYFKKAADI

SEQ ID NO: 1285481 - protein, 9 aa, Homo Sapiens
KAEEKELLK

SEQ ID NO: 1285482 - protein, 9 aa, Homo Sapiens
TRLLSDFVA

SEQ ID NO: 1285483 - protein, 9 aa, Homo Sapiens
RKNQDSQYG

SEQ ID NO: 1285484 - protein, 9 aa, Homo Sapiens
EQSEKALEK

SEQ ID NO: 1285485 - protein, 9 aa, Homo Sapiens
LNTLIQFED

SEQ ID NO: 1285486 - protein, 9 aa, Homo Sapiens
LIRLLLYNF

SEQ ID NO: 1285487 - protein, 9 aa, Homo Sapiens
VCAFNILVP

SEQ ID NO: 1285488 - protein, 9 aa, Homo Sapiens
KCHRSFIGS

SEQ ID NO: 1285489 - protein, 9 aa, Homo Sapiens
FHNKSKFVP

SEQ ID NO: 1285490 - protein, 9 aa, Homo Sapiens
ERWLVAWLS

SEQ ID NO: 1285491 - protein, 9 aa, Homo Sapiens
ATGHLFKEV

SEQ ID NO: 1285492 - protein, 9 aa, Homo Sapiens
LPLDMIDED

SEQ ID NO: 1285493 - protein, 9 aa, Homo Sapiens
KASENVLDP

SEQ ID NO: 1285494 - protein, 9 aa, Homo Sapiens
FHTNLLHQI

SEQ ID NO: 1285495 - protein, 9 aa, Homo Sapiens
LDTYIGHKG

SEQ ID NO: 1285496 - protein, 9 aa, Homo Sapiens
AKENWSRWI

SEQ ID NO: 1285497 - protein, 9 aa, Homo Sapiens
IAFKVPLQN

SEQ ID NO: 1285498 - protein, 9 aa, Homo Sapiens
DLLSCTGFL

SEQ ID NO: 1285499 - protein, 9 aa, Homo Sapiens
PYTCYPICG

SEQ ID NO: 1285500 - protein, 9 aa, Homo Sapiens
FFQGLFVRY

SEQ ID NO: 1285501 - protein, 9 aa, Homo Sapiens
KLCYKKEGG

SEQ ID NO: 1285502 - protein, 9 aa, Homo Sapiens
SWTHILMIT

SEQ ID NO: 1285503 - protein, 9 aa, Homo Sapiens
LLLYNFKQE

SEQ ID NO: 1285504 - protein, 9 aa, Homo Sapiens
AKFAQTFGR

SEQ ID NO: 1285505 - protein, 9 aa, Homo Sapiens
TYLIIPSLE

SEQ ID NO: 1285506 - protein, 9 aa, Homo Sapiens
PRCWVPDVG

SEQ ID NO: 1285507 - protein, 9 aa, Homo Sapiens
TTIVISATS

SEQ ID NO: 1285508 - protein, 9 aa, Homo Sapiens
VQRTDGVMW

SEQ ID NO: 1285509 - protein, 9 aa, Homo Sapiens
RRWRNVLFD

SEQ ID NO: 1285510 - protein, 9 aa, Homo Sapiens
GNLVYNSAV

SEQ ID NO: 1285511 - protein, 9 aa, Homo Sapiens
TDLSVQILG

SEQ ID NO: 1285512 - protein, 9 aa, Homo Sapiens
LAVDGLEDK

SEQ ID NO: 1285513 - protein, 9 aa, Homo Sapiens
KANIFVQSS

SEQ ID NO: 1285514 - protein, 9 aa, Homo Sapiens
EKNNPCSQK

SEQ ID NO: 1285515 - protein, 9 aa, Homo Sapiens
KTLHTGDRI

SEQ ID NO: 1285516 - protein, 9 aa, Homo Sapiens
IGLYTMANN

SEQ ID NO: 1285517 - protein, 9 aa, Homo Sapiens
NVLNKVITV

SEQ ID NO: 1285518 - protein, 9 aa, Homo Sapiens
QLFVCNLPH

SEQ ID NO: 1285519 - protein, 9 aa, Homo Sapiens
FQALVKHMN

SEQ ID NO: 1285520 - protein, 9 aa, Homo Sapiens
KAQGIAQED

SEQ ID NO: 1285521 - protein, 9 aa, Homo Sapiens
LLHLHKVKS

SEQ ID NO: 1285522 - protein, 9 aa, Homo Sapiens
DRRKNCLMD

SEQ ID NO: 1285523 - protein, 9 aa, Homo Sapiens
MESLYYLWE

SEQ ID NO: 1285524 - protein, 9 aa, Homo Sapiens
KYQQKLEQD

SEQ ID NO: 1285525 - protein, 9 aa, Homo Sapiens
NGGKDNCRA

SEQ ID NO: 1285526 - protein, 9 aa, Homo Sapiens
AAASRGADY

SEQ ID NO: 1285527 - protein, 9 aa, Homo Sapiens
WVTILPSKK

SEQ ID NO: 1285528 - protein, 9 aa, Homo Sapiens
QCVLEGTLN

SEQ ID NO: 1285529 - protein, 9 aa, Homo Sapiens
LNLVKQHTV

SEQ ID NO: 1285530 - protein, 9 aa, Homo Sapiens
KTSHTVEKF

SEQ ID NO: 1285531 - protein, 9 aa, Homo Sapiens
GRESEYKHV

SEQ ID NO: 1285532 - protein, 9 aa, Homo Sapiens
KQSSVELCC

SEQ ID NO: 1285533 - protein, 9 aa, Homo Sapiens
HKRNKRNPI

SEQ ID NO: 1285534 - protein, 9 aa, Homo Sapiens
HLILHKRGH

SEQ ID NO: 1285535 - protein, 9 aa, Homo Sapiens
KHSQITEFE

SEQ ID NO: 1285536 - protein, 9 aa, Homo Sapiens
MTYVCAVFN

SEQ ID NO: 1285537 - protein, 9 aa, Homo Sapiens
KGVTIPNQR

SEQ ID NO: 1285538 - protein, 9 aa, Homo Sapiens
SRCNLEKEM

SEQ ID NO: 1285539 - protein, 9 aa, Homo Sapiens
MSESIVETH

SEQ ID NO: 1285540 - protein, 9 aa, Homo Sapiens
CQHCGTCLN

SEQ ID NO: 1285541 - protein, 9 aa, Homo Sapiens
IGNKGQPYR

SEQ ID NO: 1285542 - protein, 9 aa, Homo Sapiens
IDRMKESST

SEQ ID NO: 1285543 - protein, 9 aa, Homo Sapiens
EINAFSLSN

SEQ ID NO: 1285544 - protein, 9 aa, Homo Sapiens
PQAVLYNYR

SEQ ID NO: 1285545 - protein, 9 aa, Homo Sapiens
ILNNRGQIK

SEQ ID NO: 1285546 - protein, 9 aa, Homo Sapiens
HSLLDEPNP

SEQ ID NO: 1285547 - protein, 9 aa, Homo Sapiens
YNEPAQALT

SEQ ID NO: 1285548 - protein, 9 aa, Homo Sapiens
GDNVTKLLR

SEQ ID NO: 1285549 - protein, 9 aa, Homo Sapiens
VTLSTDKKK

SEQ ID NO: 1285550 - protein, 9 aa, Homo Sapiens
NFTGENIVS

SEQ ID NO: 1285551 - protein, 9 aa, Homo Sapiens
CPAAKENWS

SEQ ID NO: 1285552 - protein, 9 aa, Homo Sapiens
KFSTRDYII

SEQ ID NO: 1285553 - protein, 9 aa, Homo Sapiens
FPDTATVKK

SEQ ID NO: 1285554 - protein, 9 aa, Homo Sapiens
PVVAAVTVC

SEQ ID NO: 1285555 - protein, 9 aa, Homo Sapiens
NGNCTEEPM

SEQ ID NO: 1285556 - protein, 9 aa, Homo Sapiens
ILYRNPLFL

SEQ ID NO: 1285557 - protein, 9 aa, Homo Sapiens
CRDAIQVVL

SEQ ID NO: 1285558 - protein, 9 aa, Homo Sapiens
WNELNVCDV

SEQ ID NO: 1285559 - protein, 9 aa, Homo Sapiens
IDEDDLQLM

SEQ ID NO: 1285560 - protein, 9 aa, Homo Sapiens
CTGFLEETS

SEQ ID NO: 1285561 - protein, 9 aa, Homo Sapiens
NTLENSTES

SEQ ID NO: 1285562 - protein, 9 aa, Homo Sapiens
TNGGQEQAL

SEQ ID NO: 1285563 - protein, 9 aa, Homo Sapiens
EFELDGEIV

SEQ ID NO: 1285564 - protein, 9 aa, Homo Sapiens
IAEHANYSL

SEQ ID NO: 1285565 - protein, 9 aa, Homo Sapiens
RGILSFFSN

SEQ ID NO: 1285566 - protein, 9 aa, Homo Sapiens
TEEDTEGDK

SEQ ID NO: 1285567 - protein, 9 aa, Homo Sapiens
IVEEAHSSE

SEQ ID NO: 1285568 - protein, 9 aa, Homo Sapiens
EEYNSDEQN

SEQ ID NO: 1285569 - protein, 9 aa, Homo Sapiens
ESDIMAFAN

SEQ ID NO: 1285570 - protein, 9 aa, Homo Sapiens
SRRLKIDTS

SEQ ID NO: 1285571 - protein, 9 aa, Homo Sapiens
HGIHDVLTV

SEQ ID NO: 1285572 - protein, 9 aa, Homo Sapiens
AENAHLHTL

SEQ ID NO: 1285573 - protein, 9 aa, Homo Sapiens
ILQGLSFIH

SEQ ID NO: 1285574 - protein, 9 aa, Homo Sapiens
RAVNLQRSK

SEQ ID NO: 1285575 - protein, 9 aa, Homo Sapiens
TIKAKYKDD

SEQ ID NO: 1285576 - protein, 9 aa, Homo Sapiens
INKDFGTFE

SEQ ID NO: 1285577 - protein, 9 aa, Homo Sapiens
YDQLQGKEE

SEQ ID NO: 1285578 - protein, 9 aa, Homo Sapiens
SKQSEHSPS

SEQ ID NO: 1285579 - protein, 9 aa, Homo Sapiens
NLAAKNGVP

SEQ ID NO: 1285580 - protein, 9 aa, Homo Sapiens
CYLHTAGRL

SEQ ID NO: 1285581 - protein, 9 aa, Homo Sapiens
TVLLGSITC

SEQ ID NO: 1285582 - protein, 9 aa, Homo Sapiens
ISTSCSVIH

SEQ ID NO: 1285583 - protein, 9 aa, Homo Sapiens
EEIQLCEEL

SEQ ID NO: 1285584 - protein, 9 aa, Homo Sapiens
VIFARMENK

SEQ ID NO: 1285585 - protein, 9 aa, Homo Sapiens
TNNMHAIPL

SEQ ID NO: 1285586 - protein, 9 aa, Homo Sapiens
DLGSSAKNY

SEQ ID NO: 1285587 - protein, 9 aa, Homo Sapiens
ENWSRWIQY

SEQ ID NO: 1285588 - protein, 9 aa, Homo Sapiens
DFVAIPDFE

SEQ ID NO: 1285589 - protein, 9 aa, Homo Sapiens
CVLEGTLNS

SEQ ID NO: 1285590 - protein, 9 aa, Homo Sapiens
HSQKMENLM

SEQ ID NO: 1285591 - protein, 9 aa, Homo Sapiens
GLGGNVWLS

SEQ ID NO: 1285592 - protein, 9 aa, Homo Sapiens
YNEALYDIC

SEQ ID NO: 1285593 - protein, 9 aa, Homo Sapiens
LSKRLLYIM

SEQ ID NO: 1285594 - protein, 9 aa, Homo Sapiens
NYLRHVQLI

SEQ ID NO: 1285595 - protein, 9 aa, Homo Sapiens
ENMLASADD

SEQ ID NO: 1285596 - protein, 9 aa, Homo Sapiens
GRGSYCVVY

SEQ ID NO: 1285597 - protein, 9 aa, Homo Sapiens
HHVLCIPSW

SEQ ID NO: 1285598 - protein, 9 aa, Homo Sapiens
FKTQPVEHS

SEQ ID NO: 1285599 - protein, 9 aa, Homo Sapiens
GGPLDQGSR

SEQ ID NO: 1285600 - protein, 9 aa, Homo Sapiens
DQILINDRN

SEQ ID NO: 1285601 - protein, 9 aa, Homo Sapiens
TDIWLGVDA

SEQ ID NO: 1285602 - protein, 9 aa, Homo Sapiens
NNPCSQKRF

SEQ ID NO: 1285603 - protein, 9 aa, Homo Sapiens
NVTKLLRSS

SEQ ID NO: 1285604 - protein, 9 aa, Homo Sapiens
RRKNCLMDH

SEQ ID NO: 1285605 - protein, 9 aa, Homo Sapiens
LDIYECVGS

SEQ ID NO: 1285606 - protein, 9 aa, Homo Sapiens
IPDIALEQD

SEQ ID NO: 1285607 - protein, 9 aa, Homo Sapiens
CRNWLHKAN

SEQ ID NO: 1285608 - protein, 9 aa, Homo Sapiens
NCVMFPGNS

SEQ ID NO: 1285609 - protein, 9 aa, Homo Sapiens
TIFERSNDV

SEQ ID NO: 1285610 - protein, 9 aa, Homo Sapiens
GLVYSIPFY

SEQ ID NO: 1285611 - protein, 9 aa, Homo Sapiens
KVMNWDVQC

SEQ ID NO: 1285612 - protein, 9 aa, Homo Sapiens
SNSCVWNTE

SEQ ID NO: 1285613 - protein, 9 aa, Homo Sapiens
GNEWSHIFC

SEQ ID NO: 1285614 - protein, 9 aa, Homo Sapiens
KTSLSLRAH

SEQ ID NO: 1285615 - protein, 9 aa, Homo Sapiens
KLWCALSKT

SEQ ID NO: 1285616 - protein, 9 aa, Homo Sapiens
CDYVVSEWS

SEQ ID NO: 1285617 - protein, 9 aa, Homo Sapiens
ENKTKVANQ

SEQ ID NO: 1285618 - protein, 9 aa, Homo Sapiens
IGKKMCIEK

SEQ ID NO: 1285619 - protein, 9 aa, Homo Sapiens
LQRSKTADV

SEQ ID NO: 1285620 - protein, 9 aa, Homo Sapiens
DEDYIKQFK

SEQ ID NO: 1285621 - protein, 9 aa, Homo Sapiens
LEFGMAYFV

SEQ ID NO: 1285622 - protein, 9 aa, Homo Sapiens
ILTTNCDSY

SEQ ID NO: 1285623 - protein, 9 aa, Homo Sapiens
ALVKHMNQT

SEQ ID NO: 1285624 - protein, 9 aa, Homo Sapiens
VAGNISDHG

SEQ ID NO: 1285625 - protein, 9 aa, Homo Sapiens
CSNFAEDFC

SEQ ID NO: 1285626 - protein, 9 aa, Homo Sapiens
LAMSGLNGA

SEQ ID NO: 1285627 - protein, 9 aa, Homo Sapiens
FQAFDLGSS

SEQ ID NO: 1285628 - protein, 9 aa, Homo Sapiens
FILPQFLYK

SEQ ID NO: 1285629 - protein, 9 aa, Homo Sapiens
FIWNKCQRC

SEQ ID NO: 1285630 - protein, 9 aa, Homo Sapiens
LKLDNLQIL

SEQ ID NO: 1285631 - protein, 9 aa, Homo Sapiens
ANFMLKVHH

SEQ ID NO: 1285632 - protein, 9 aa, Homo Sapiens
TSEEVLSTP

SEQ ID NO: 1285633 - protein, 9 aa, Homo Sapiens
KNMAKIHSG

SEQ ID NO: 1285634 - protein, 9 aa, Homo Sapiens
EEDIIKEGM

SEQ ID NO: 1285635 - protein, 9 aa, Homo Sapiens
KSKDSDNEL

SEQ ID NO: 1285636 - protein, 9 aa, Homo Sapiens
YHVAHWHLI

SEQ ID NO: 1285637 - protein, 9 aa, Homo Sapiens
IQRAYTIQW

SEQ ID NO: 1285638 - protein, 9 aa, Homo Sapiens
LFCNPMMYD

SEQ ID NO: 1285639 - protein, 9 aa, Homo Sapiens
LDAGKLFIV

SEQ ID NO: 1285640 - protein, 9 aa, Homo Sapiens
PTSFHARQL

SEQ ID NO: 1285641 - protein, 9 aa, Homo Sapiens
VEKPYECNI

SEQ ID NO: 1285642 - protein, 9 aa, Homo Sapiens
IAFTDLQPN

SEQ ID NO: 1285643 - protein, 9 aa, Homo Sapiens
FDVVFNAAN

SEQ ID NO: 1285644 - protein, 9 aa, Homo Sapiens
DFKLVPHSQ

SEQ ID NO: 1285645 - protein, 9 aa, Homo Sapiens
LTVCNGQGR

SEQ ID NO: 1285646 - protein, 9 aa, Homo Sapiens
SFENLPMNV

SEQ ID NO: 1285647 - protein, 9 aa, Homo Sapiens
WKFKQKELA

SEQ ID NO: 1285648 - protein, 9 aa, Homo Sapiens
CPWTKEEDQ

SEQ ID NO: 1285649 - protein, 9 aa, Homo Sapiens
EFSNSSCLN

SEQ ID NO: 1285650 - protein, 9 aa, Homo Sapiens
DSGYNALVS

SEQ ID NO: 1285651 - protein, 9 aa, Homo Sapiens
DFRLQCVLE

SEQ ID NO: 1285652 - protein, 9 aa, Homo Sapiens
RWRLYAIAG

SEQ ID NO: 1285653 - protein, 9 aa, Homo Sapiens
KACKLQEVS

SEQ ID NO: 1285654 - protein, 9 aa, Homo Sapiens
ENEEYNSDE

SEQ ID NO: 1285655 - protein, 9 aa, Homo Sapiens
QPPGSDMPP

SEQ ID NO: 1285656 - protein, 9 aa, Homo Sapiens
FSNPLALYL

SEQ ID NO: 1285657 - protein, 9 aa, Homo Sapiens
DICTIDHTE

SEQ ID NO: 1285658 - protein, 9 aa, Homo Sapiens
RLYHILGNE

SEQ ID NO: 1285659 - protein, 9 aa, Homo Sapiens
TFHKRNSMT

SEQ ID NO: 1285660 - protein, 9 aa, Homo Sapiens
ESCLSCSHA

SEQ ID NO: 1285661 - protein, 9 aa, Homo Sapiens
LCEELLAQG

SEQ ID NO: 1285662 - protein, 9 aa, Homo Sapiens
YSLHKPQGN

SEQ ID NO: 1285663 - protein, 9 aa, Homo Sapiens
AECNEAIWK

SEQ ID NO: 1285664 - protein, 9 aa, Homo Sapiens
RMSTIKVTV

SEQ ID NO: 1285665 - protein, 9 aa, Homo Sapiens
NPRNTLFAI

SEQ ID NO: 1285666 - protein, 9 aa, Homo Sapiens
MSDQLFRRV

SEQ ID NO: 1285667 - protein, 9 aa, Homo Sapiens
CESLYSAKT

SEQ ID NO: 1285668 - protein, 9 aa, Homo Sapiens
YGKCCTLLV

SEQ ID NO: 1285669 - protein, 9 aa, Homo Sapiens
TAVLKAFAN

SEQ ID NO: 1285670 - protein, 9 aa, Homo Sapiens
QLRLLEREL

SEQ ID NO: 1285671 - protein, 9 aa, Homo Sapiens
ADFDEFQYQ

SEQ ID NO: 1285672 - protein, 9 aa, Homo Sapiens
QEKAQVKKI

SEQ ID NO: 1285673 - protein, 9 aa, Homo Sapiens
SCCVCCFIT

SEQ ID NO: 1285674 - protein, 9 aa, Homo Sapiens
TPLLLCVHE

SEQ ID NO: 1285675 - protein, 9 aa, Homo Sapiens
FTQLEFWDE

SEQ ID NO: 1285676 - protein, 9 aa, Homo Sapiens
HEFQVGDGI

SEQ ID NO: 1285677 - protein, 9 aa, Homo Sapiens
NTENVSSIL

SEQ ID NO: 1285678 - protein, 9 aa, Homo Sapiens
LGLGVLIYE

SEQ ID NO: 1285679 - protein, 9 aa, Homo Sapiens
EGGFTSKYS

SEQ ID NO: 1285680 - protein, 9 aa, Homo Sapiens
VCIWLRHLP

SEQ ID NO: 1285681 - protein, 9 aa, Homo Sapiens
QHLVCYMVQ

SEQ ID NO: 1285682 - protein, 9 aa, Homo Sapiens
SSVLANGMK

SEQ ID NO: 1285683 - protein, 9 aa, Homo Sapiens
YILTFRLKS

SEQ ID NO: 1285684 - protein, 9 aa, Homo Sapiens
AFKVPLQNS

SEQ ID NO: 1285685 - protein, 9 aa, Homo Sapiens
LNQTENMLA

SEQ ID NO: 1285686 - protein, 9 aa, Homo Sapiens
YLHETTRPQ

SEQ ID NO: 1285687 - protein, 9 aa, Homo Sapiens
PNQTLTQLN

SEQ ID NO: 1285688 - protein, 9 aa, Homo Sapiens
SISSFNDKS

SEQ ID NO: 1285689 - protein, 9 aa, Homo Sapiens
STAYSLHKP

SEQ ID NO: 1285690 - protein, 9 aa, Homo Sapiens
NLTKIKLSK

SEQ ID NO: 1285691 - protein, 9 aa, Homo Sapiens
VGVGSFADQ

SEQ ID NO: 1285692 - protein, 9 aa, Homo Sapiens
YDHENRNGN

SEQ ID NO: 1285693 - protein, 9 aa, Homo Sapiens
QLMKVDTAH

SEQ ID NO: 1285694 - protein, 9 aa, Homo Sapiens
FNCDCCELP

SEQ ID NO: 1285695 - protein, 9 aa, Homo Sapiens
DMKLDNVLL

SEQ ID NO: 1285696 - protein, 9 aa, Homo Sapiens
DSVDSEYYM

SEQ ID NO: 1285697 - protein, 9 aa, Homo Sapiens
DYSLYNEPA

SEQ ID NO: 1285698 - protein, 9 aa, Homo Sapiens
TFSAVKQEL

SEQ ID NO: 1285699 - protein, 9 aa, Homo Sapiens
LAYTVTINK

SEQ ID NO: 1285700 - protein, 9 aa, Homo Sapiens
LLKVSIIQR

SEQ ID NO: 1285701 - protein, 9 aa, Homo Sapiens
EKSNYVCAT

SEQ ID NO: 1285702 - protein, 9 aa, Homo Sapiens
CLDEDIYDE

SEQ ID NO: 1285703 - protein, 9 aa, Homo Sapiens
LCSDLHVDV

SEQ ID NO: 1285704 - protein, 9 aa, Homo Sapiens
DTENEEYNS

SEQ ID NO: 1285705 - protein, 9 aa, Homo Sapiens
GYKCLECWD

SEQ ID NO: 1285706 - protein, 9 aa, Homo Sapiens
QEKNSWTHI

SEQ ID NO: 1285707 - protein, 9 aa, Homo Sapiens
NKGILSRDI

SEQ ID NO: 1285708 - protein, 9 aa, Homo Sapiens
WSTSIKGII

SEQ ID NO: 1285709 - protein, 9 aa, Homo Sapiens
PIHAAATNC

SEQ ID NO: 1285710 - protein, 9 aa, Homo Sapiens
TDLFCNPMM

SEQ ID NO: 1285711 - protein, 9 aa, Homo Sapiens
NNLLDNNEA

SEQ ID NO: 1285712 - protein, 9 aa, Homo Sapiens
LVERKHPLR

SEQ ID NO: 1285713 - protein, 9 aa, Homo Sapiens
FIPQHNKQL

SEQ ID NO: 1285714 - protein, 9 aa, Homo Sapiens
ETVLLEHTF

SEQ ID NO: 1285715 - protein, 9 aa, Homo Sapiens
RGIIYRDMK

SEQ ID NO: 1285716 - protein, 9 aa, Homo Sapiens
DPNNYNEFC

SEQ ID NO: 1285717 - protein, 9 aa, Homo Sapiens
ITDDKEGGL

SEQ ID NO: 1285718 - protein, 9 aa, Homo Sapiens
SMIQLMVNL

SEQ ID NO: 1285719 - protein, 9 aa, Homo Sapiens
IAEWSKQQK

SEQ ID NO: 1285720 - protein, 9 aa, Homo Sapiens
LALLAVPIV

SEQ ID NO: 1285721 - protein, 9 aa, Homo Sapiens
SDVSTFTTM

SEQ ID NO: 1285722 - protein, 9 aa, Homo Sapiens
VVCIWLRHL

SEQ ID NO: 1285723 - protein, 9 aa, Homo Sapiens
AQGLKGYIK

SEQ ID NO: 1285724 - protein, 9 aa, Homo Sapiens
IHTCEKPYK

SEQ ID NO: 1285725 - protein, 9 aa, Homo Sapiens
MYNKLCYKK

SEQ ID NO: 1285726 - protein, 9 aa, Homo Sapiens
DQDPPCHRL

SEQ ID NO: 1285727 - protein, 9 aa, Homo Sapiens
AEWSKQQKD

SEQ ID NO: 1285728 - protein, 9 aa, Homo Sapiens
QHKRNKRNP

SEQ ID NO: 1285729 - protein, 9 aa, Homo Sapiens
CNSVDIKLS

SEQ ID NO: 1285730 - protein, 9 aa, Homo Sapiens
AICPDYCHN

SEQ ID NO: 1285731 - protein, 9 aa, Homo Sapiens
NCLMDHEDF

SEQ ID NO: 1285732 - protein, 9 aa, Homo Sapiens
VDHNHNKGL

SEQ ID NO: 1285733 - protein, 9 aa, Homo Sapiens
HHLKKYPVD

SEQ ID NO: 1285734 - protein, 9 aa, Homo Sapiens
KAGSCFILT

SEQ ID NO: 1285735 - protein, 9 aa, Homo Sapiens
LIDNPNIVI

SEQ ID NO: 1285736 - protein, 9 aa, Homo Sapiens
SEYKHVYKG

SEQ ID NO: 1285737 - protein, 9 aa, Homo Sapiens
TLLQQDLVQ

SEQ ID NO: 1285738 - protein, 9 aa, Homo Sapiens
PIYFLLSQL

SEQ ID NO: 1285739 - protein, 9 aa, Homo Sapiens
AHEFQVGDG

SEQ ID NO: 1285740 - protein, 9 aa, Homo Sapiens
MINFLQSVV

SEQ ID NO: 1285741 - protein, 9 aa, Homo Sapiens
AGPPCPRGD

SEQ ID NO: 1285742 - protein, 9 aa, Homo Sapiens
LCVHEQKQQ

SEQ ID NO: 1285743 - protein, 9 aa, Homo Sapiens
GTPEDKMML

SEQ ID NO: 1285744 - protein, 9 aa, Homo Sapiens
PGWTLVKVK

SEQ ID NO: 1285745 - protein, 9 aa, Homo Sapiens
ETYCIYNEA

SEQ ID NO: 1285746 - protein, 9 aa, Homo Sapiens
RLTFPTSCD

SEQ ID NO: 1285747 - protein, 9 aa, Homo Sapiens
RAGQHDVVA

SEQ ID NO: 1285748 - protein, 9 aa, Homo Sapiens
YNALVSYQL

SEQ ID NO: 1285749 - protein, 9 aa, Homo Sapiens
YEFTYALLC

SEQ ID NO: 1285750 - protein, 9 aa, Homo Sapiens
DIEKDHIFS

SEQ ID NO: 1285751 - protein, 9 aa, Homo Sapiens
QENAAYLQD

SEQ ID NO: 1285752 - protein, 9 aa, Homo Sapiens
DEIMSLWVK

SEQ ID NO: 1285753 - protein, 9 aa, Homo Sapiens
PNTDRCHCG

SEQ ID NO: 1285754 - protein, 9 aa, Homo Sapiens
HFSGEPSEE

SEQ ID NO: 1285755 - protein, 9 aa, Homo Sapiens
KRKYDLRYR

SEQ ID NO: 1285756 - protein, 9 aa, Homo Sapiens
KELDVKDIE

SEQ ID NO: 1285757 - protein, 9 aa, Homo Sapiens
WNCDKSSIS

SEQ ID NO: 1285758 - protein, 9 aa, Homo Sapiens
LQGNLEDPA

SEQ ID NO: 1285759 - protein, 9 aa, Homo Sapiens
DKKGVTIPN

SEQ ID NO: 1285760 - protein, 9 aa, Homo Sapiens
SLHFVDFLV

SEQ ID NO: 1285761 - protein, 9 aa, Homo Sapiens
RDKVVGHIS

SEQ ID NO: 1285762 - protein, 9 aa, Homo Sapiens
KKAITLDMD

SEQ ID NO: 1285763 - protein, 9 aa, Homo Sapiens
TICASIGIT

SEQ ID NO: 1285764 - protein, 9 aa, Homo Sapiens
RFALINMKL

SEQ ID NO: 1285765 - protein, 9 aa, Homo Sapiens
GFGGQVISS

SEQ ID NO: 1285766 - protein, 9 aa, Homo Sapiens
QIDISDKNV

SEQ ID NO: 1285767 - protein, 9 aa, Homo Sapiens
AGDDAQKRK

SEQ ID NO: 1285768 - protein, 9 aa, Homo Sapiens
RQRACMHAF

SEQ ID NO: 1285769 - protein, 9 aa, Homo Sapiens
GLAMSGLNG

SEQ ID NO: 1285770 - protein, 9 aa, Homo Sapiens
VLAVTENMR

SEQ ID NO: 1285771 - protein, 9 aa, Homo Sapiens
AGQELFRSL

SEQ ID NO: 1285772 - protein, 9 aa, Homo Sapiens
DGEIVALPP

SEQ ID NO: 1285773 - protein, 9 aa, Homo Sapiens
SFYVYDNNV

SEQ ID NO: 1285774 - protein, 9 aa, Homo Sapiens
MFCVCMWEI

SEQ ID NO: 1285775 - protein, 9 aa, Homo Sapiens
YLIIPSLER

SEQ ID NO: 1285776 - protein, 9 aa, Homo Sapiens
LFIALLHQI

SEQ ID NO: 1285777 - protein, 9 aa, Homo Sapiens
YECRKKLLQ

SEQ ID NO: 1285778 - protein, 9 aa, Homo Sapiens
VDDSCISSS

SEQ ID NO: 1285779 - protein, 9 aa, Homo Sapiens
IDFFQGLFV

SEQ ID NO: 1285780 - protein, 9 aa, Homo Sapiens
LVYNSAVLG

SEQ ID NO: 1285781 - protein, 9 aa, Homo Sapiens
IVTLVLNIK

SEQ ID NO: 1285782 - protein, 9 aa, Homo Sapiens
HPLRGIGIL

SEQ ID NO: 1285783 - protein, 9 aa, Homo Sapiens
HQKSFNTAV

SEQ ID NO: 1285784 - protein, 9 aa, Homo Sapiens
LNPSEIREK

SEQ ID NO: 1285785 - protein, 9 aa, Homo Sapiens
KHLVTLIKT

SEQ ID NO: 1285786 - protein, 9 aa, Homo Sapiens
SFENNQQPP

SEQ ID NO: 1285787 - protein, 9 aa, Homo Sapiens
GGPEMYCYP

SEQ ID NO: 1285788 - protein, 9 aa, Homo Sapiens
TNCDSYWVE

SEQ ID NO: 1285789 - protein, 9 aa, Homo Sapiens
DCEVLGCCY

SEQ ID NO: 1285790 - protein, 9 aa, Homo Sapiens
QQKLYSRTC

SEQ ID NO: 1285791 - protein, 9 aa, Homo Sapiens
DVQGLFEKC

SEQ ID NO: 1285792 - protein, 9 aa, Homo Sapiens
YREKSNYVC

SEQ ID NO: 1285793 - protein, 9 aa, Homo Sapiens
STRLWHVLE

SEQ ID NO: 1285794 - protein, 9 aa, Homo Sapiens
TFFSSTFSD

SEQ ID NO: 1285795 - protein, 9 aa, Homo Sapiens
FNAANMLRQ

SEQ ID NO: 1285796 - protein, 9 aa, Homo Sapiens
LNVHCRINT

SEQ ID NO: 1285797 - protein, 9 aa, Homo Sapiens
QFLYKFFCG

SEQ ID NO: 1285798 - protein, 9 aa, Homo Sapiens
ELNNMTQKD

SEQ ID NO: 1285799 - protein, 9 aa, Homo Sapiens
LASVAIHQV

SEQ ID NO: 1285800 - protein, 9 aa, Homo Sapiens
YNDFGNYNK

SEQ ID NO: 1285801 - protein, 9 aa, Homo Sapiens
PEESEEWTE

SEQ ID NO: 1285802 - protein, 9 aa, Homo Sapiens
VIKNPQFMF

SEQ ID NO: 1285803 - protein, 9 aa, Homo Sapiens
KKAQGIAQE

SEQ ID NO: 1285804 - protein, 9 aa, Homo Sapiens
LAFQDPVPI

SEQ ID NO: 1285805 - protein, 9 aa, Homo Sapiens
SLNQTENML

SEQ ID NO: 1285806 - protein, 9 aa, Homo Sapiens
KTSISSFND

SEQ ID NO: 1285807 - protein, 9 aa, Homo Sapiens
DSTFHKRNS

SEQ ID NO: 1285808 - protein, 9 aa, Homo Sapiens
PDGTEQYFW

SEQ ID NO: 1285809 - protein, 9 aa, Homo Sapiens
NYKIGALCM

SEQ ID NO: 1285810 - protein, 9 aa, Homo Sapiens
SPAGQSNLK

SEQ ID NO: 1285811 - protein, 9 aa, Homo Sapiens
QLMLLYPDG

SEQ ID NO: 1285812 - protein, 9 aa, Homo Sapiens
IYEMLKSST

SEQ ID NO: 1285813 - protein, 9 aa, Homo Sapiens
KLNEISYEL

SEQ ID NO: 1285814 - protein, 9 aa, Homo Sapiens
WEQRAAGMC

SEQ ID NO: 1285815 - protein, 9 aa, Homo Sapiens
WVSECIIMG

SEQ ID NO: 1285816 - protein, 9 aa, Homo Sapiens
RAVDWLGLG

SEQ ID NO: 1285817 - protein, 9 aa, Homo Sapiens
EIFGPVQHL

SEQ ID NO: 1285818 - protein, 9 aa, Homo Sapiens
KLNEQSHTR

SEQ ID NO: 1285819 - protein, 9 aa, Homo Sapiens
IILNNRGQI

SEQ ID NO: 1285820 - protein, 9 aa, Homo Sapiens
KVANQSQTP

SEQ ID NO: 1285821 - protein, 9 aa, Homo Sapiens
IFPVRMIKW

SEQ ID NO: 1285822 - protein, 9 aa, Homo Sapiens
GCNRVQIQS

SEQ ID NO: 1285823 - protein, 9 aa, Homo Sapiens
AYTVTINKD

SEQ ID NO: 1285824 - protein, 9 aa, Homo Sapiens
LCDDYPGSN

SEQ ID NO: 1285825 - protein, 9 aa, Homo Sapiens
TDPSVIHPK

SEQ ID NO: 1285826 - protein, 9 aa, Homo Sapiens
LNKCCHFTL

SEQ ID NO: 1285827 - protein, 9 aa, Homo Sapiens
SNTPIGDYT

SEQ ID NO: 1285828 - protein, 9 aa, Homo Sapiens
LAAWSDHRH

SEQ ID NO: 1285829 - protein, 9 aa, Homo Sapiens
NKWIKLCTF

SEQ ID NO: 1285830 - protein, 9 aa, Homo Sapiens
GPRKLKTCG

SEQ ID NO: 1285831 - protein, 9 aa, Homo Sapiens
IAKEAVIDI

SEQ ID NO: 1285832 - protein, 9 aa, Homo Sapiens
LQVVFRRKL

SEQ ID NO: 1285833 - protein, 9 aa, Homo Sapiens
TNFSGSQHD

SEQ ID NO: 1285834 - protein, 9 aa, Homo Sapiens
VELSENGKK

SEQ ID NO: 1285835 - protein, 9 aa, Homo Sapiens
SNFSRCSQT

SEQ ID NO: 1285836 - protein, 9 aa, Homo Sapiens
GLFCSLVKM

SEQ ID NO: 1285837 - protein, 9 aa, Homo Sapiens
KSASVHGFF

SEQ ID NO: 1285838 - protein, 9 aa, Homo Sapiens
KNCTYEFLY

SEQ ID NO: 1285839 - protein, 9 aa, Homo Sapiens
CIYNSNDVA

SEQ ID NO: 1285840 - protein, 9 aa, Homo Sapiens
ERMHVGKNK

SEQ ID NO: 1285841 - protein, 9 aa, Homo Sapiens
LLRPNDRVG

SEQ ID NO: 1285842 - protein, 9 aa, Homo Sapiens
PKIPLSQEV

SEQ ID NO: 1285843 - protein, 9 aa, Homo Sapiens
EELYKAVEN

SEQ ID NO: 1285844 - protein, 9 aa, Homo Sapiens
VFSVFEDYG

SEQ ID NO: 1285845 - protein, 9 aa, Homo Sapiens
YNSQVTQLT

SEQ ID NO: 1285846 - protein, 9 aa, Homo Sapiens
KEFSAELTL

SEQ ID NO: 1285847 - protein, 9 aa, Homo Sapiens
TSFHARQLI

SEQ ID NO: 1285848 - protein, 9 aa, Homo Sapiens
PALLELLFH

SEQ ID NO: 1285849 - protein, 9 aa, Homo Sapiens
DIVILSATN

SEQ ID NO: 1285850 - protein, 9 aa, Homo Sapiens
GADYAMESS

SEQ ID NO: 1285851 - protein, 9 aa, Homo Sapiens
CSDLHVDVK

SEQ ID NO: 1285852 - protein, 9 aa, Homo Sapiens
FIDCLVIEY

SEQ ID NO: 1285853 - protein, 9 aa, Homo Sapiens
AKGYYRTYG

SEQ ID NO: 1285854 - protein, 9 aa, Homo Sapiens
LWNGDTCEC

SEQ ID NO: 1285855 - protein, 9 aa, Homo Sapiens
GGQVISSLY

SEQ ID NO: 1285856 - protein, 9 aa, Homo Sapiens
EYISSASSQ

SEQ ID NO: 1285857 - protein, 9 aa, Homo Sapiens
GDLSHINRL

SEQ ID NO: 1285858 - protein, 9 aa, Homo Sapiens
AENYSYDFE

SEQ ID NO: 1285859 - protein, 9 aa, Homo Sapiens
QDPNNNLHE

SEQ ID NO: 1285860 - protein, 9 aa, Homo Sapiens
KYKENYKNH

SEQ ID NO: 1285861 - protein, 9 aa, Homo Sapiens
ANHCPDPSC

SEQ ID NO: 1285862 - protein, 9 aa, Homo Sapiens
KIVIQLPMI

SEQ ID NO: 1285863 - protein, 9 aa, Homo Sapiens
FDLGSSAKN

SEQ ID NO: 1285864 - protein, 9 aa, Homo Sapiens
ATANLALAS

SEQ ID NO: 1285865 - protein, 9 aa, Homo Sapiens
LVQMPEDYL

SEQ ID NO: 1285866 - protein, 9 aa, Homo Sapiens
TLMKNGEEI

SEQ ID NO: 1285867 - protein, 9 aa, Homo Sapiens
SSISSCTAQ

SEQ ID NO: 1285868 - protein, 9 aa, Homo Sapiens
LVNYPVYQE

SEQ ID NO: 1285869 - protein, 9 aa, Homo Sapiens
QPVTRPISL

SEQ ID NO: 1285870 - protein, 9 aa, Homo Sapiens
STRGYFFNC

SEQ ID NO: 1285871 - protein, 9 aa, Homo Sapiens
GPSYILTFR

SEQ ID NO: 1285872 - protein, 9 aa, Homo Sapiens
GNSRTANIR

SEQ ID NO: 1285873 - protein, 9 aa, Homo Sapiens
SHTVEKFYK

SEQ ID NO: 1285874 - protein, 9 aa, Homo Sapiens
ALKPCFFSH

SEQ ID NO: 1285875 - protein, 9 aa, Homo Sapiens
PISTLLYLG

SEQ ID NO: 1285876 - protein, 9 aa, Homo Sapiens
TFGRISPVP

SEQ ID NO: 1285877 - protein, 9 aa, Homo Sapiens
LLHARKHIF

SEQ ID NO: 1285878 - protein, 9 aa, Homo Sapiens
INGYKAYDH

SEQ ID NO: 1285879 - protein, 9 aa, Homo Sapiens
IPSCVVEAK

SEQ ID NO: 1285880 - protein, 9 aa, Homo Sapiens
LDTHLHTPI

SEQ ID NO: 1285881 - protein, 9 aa, Homo Sapiens
DLCVGGVVH

SEQ ID NO: 1285882 - protein, 9 aa, Homo Sapiens
LMTYVCAVF

SEQ ID NO: 1285883 - protein, 9 aa, Homo Sapiens
ILLIDFFQG

SEQ ID NO: 1285884 - protein, 9 aa, Homo Sapiens
NEQYLDTYI

SEQ ID NO: 1285885 - protein, 9 aa, Homo Sapiens
KRKQHTNGD

SEQ ID NO: 1285886 - protein, 9 aa, Homo Sapiens
QEKQPSHRD

SEQ ID NO: 1285887 - protein, 9 aa, Homo Sapiens
KLHYQSIGT

SEQ ID NO: 1285888 - protein, 9 aa, Homo Sapiens
IAISNKMRQ

SEQ ID NO: 1285889 - protein, 9 aa, Homo Sapiens
FNTAVKNSY

SEQ ID NO: 1285890 - protein, 9 aa, Homo Sapiens
IFCVNRSLP

SEQ ID NO: 1285891 - protein, 9 aa, Homo Sapiens
ALCSDLHVD

SEQ ID NO: 1285892 - protein, 9 aa, Homo Sapiens
VSNICAHMT

SEQ ID NO: 1285893 - protein, 9 aa, Homo Sapiens
DNILIDRDC

SEQ ID NO: 1285894 - protein, 9 aa, Homo Sapiens
CKNKSYSWD

SEQ ID NO: 1285895 - protein, 9 aa, Homo Sapiens
LQDTQNKDI

SEQ ID NO: 1285896 - protein, 9 aa, Homo Sapiens
CIPTSFHAR

SEQ ID NO: 1285897 - protein, 9 aa, Homo Sapiens
VTIPNQRRY

SEQ ID NO: 1285898 - protein, 9 aa, Homo Sapiens
WSDHRHICR

SEQ ID NO: 1285899 - protein, 9 aa, Homo Sapiens
ISNNTLAEM

SEQ ID NO: 1285900 - protein, 9 aa, Homo Sapiens
NTGEQFVCL

SEQ ID NO: 1285901 - protein, 9 aa, Homo Sapiens
YSIPFYHIV

SEQ ID NO: 1285902 - protein, 9 aa, Homo Sapiens
ATANATVAA

SEQ ID NO: 1285903 - protein, 9 aa, Homo Sapiens
WSLKLEHWH

SEQ ID NO: 1285904 - protein, 9 aa, Homo Sapiens
LRVDCTQLM

SEQ ID NO: 1285905 - protein, 9 aa, Homo Sapiens
VRSVCWRCD

SEQ ID NO: 1285906 - protein, 9 aa, Homo Sapiens
QKYGCNRVQ

SEQ ID NO: 1285907 - protein, 9 aa, Homo Sapiens
MQPASSGQP

SEQ ID NO: 1285908 - protein, 9 aa, Homo Sapiens
KVGDTEDNI

SEQ ID NO: 1285909 - protein, 9 aa, Homo Sapiens
SFLQVQLND

SEQ ID NO: 1285910 - protein, 9 aa, Homo Sapiens
SNYVCATFQ

SEQ ID NO: 1285911 - protein, 9 aa, Homo Sapiens
LINLAAKNG

SEQ ID NO: 1285912 - protein, 9 aa, Homo Sapiens
FVCLMAYHL

SEQ ID NO: 1285913 - protein, 9 aa, Homo Sapiens
STCASNLTA

SEQ ID NO: 1285914 - protein, 9 aa, Homo Sapiens
ADKISTPET

SEQ ID NO: 1285915 - protein, 9 aa, Homo Sapiens
AAATNCHSE

SEQ ID NO: 1285916 - protein, 9 aa, Homo Sapiens
RKQDQQIYE

SEQ ID NO: 1285917 - protein, 9 aa, Homo Sapiens
QKLIRLCCE

SEQ ID NO: 1285918 - protein, 9 aa, Homo Sapiens
NILDNDPSF

SEQ ID NO: 1285919 - protein, 9 aa, Homo Sapiens
GLPRSHSVL

SEQ ID NO: 1285920 - protein, 9 aa, Homo Sapiens
PVTRPISLF

SEQ ID NO: 1285921 - protein, 9 aa, Homo Sapiens
NEFCRLLAR

SEQ ID NO: 1285922 - protein, 9 aa, Homo Sapiens
RSNIHLQGN

SEQ ID NO: 1285923 - protein, 9 aa, Homo Sapiens
EPLQGKTLY

SEQ ID NO: 1285924 - protein, 9 aa, Homo Sapiens
LTFPTSCDE

SEQ ID NO: 1285925 - protein, 9 aa, Homo Sapiens
ALKFFVNLK

SEQ ID NO: 1285926 - protein, 9 aa, Homo Sapiens
RQNNDTFDL

SEQ ID NO: 1285927 - protein, 9 aa, Homo Sapiens
CGEVLREQF

SEQ ID NO: 1285928 - protein, 9 aa, Homo Sapiens
RRKLLIEHI

SEQ ID NO: 1285929 - protein, 9 aa, Homo Sapiens
FLSRNGQVR

SEQ ID NO: 1285930 - protein, 9 aa, Homo Sapiens
CTSVCAQNT

SEQ ID NO: 1285931 - protein, 9 aa, Homo Sapiens
ENSTESFLY

SEQ ID NO: 1285932 - protein, 9 aa, Homo Sapiens
LTLSCCVCC

SEQ ID NO: 1285933 - protein, 9 aa, Homo Sapiens
FMFDIHKNS

SEQ ID NO: 1285934 - protein, 9 aa, Homo Sapiens
RYLADIGYV

SEQ ID NO: 1285935 - protein, 9 aa, Homo Sapiens
SETDYTVST

SEQ ID NO: 1285936 - protein, 9 aa, Homo Sapiens
VQGQCIAAG

SEQ ID NO: 1285937 - protein, 9 aa, Homo Sapiens
PLYSPQQTQ

SEQ ID NO: 1285938 - protein, 9 aa, Homo Sapiens
PDFSDEEDI

SEQ ID NO: 1285939 - protein, 9 aa, Homo Sapiens
EVELAENAH

SEQ ID NO: 1285940 - protein, 9 aa, Homo Sapiens
DRIEICYNY

SEQ ID NO: 1285941 - protein, 9 aa, Homo Sapiens
DCTQLMYSL

SEQ ID NO: 1285942 - protein, 9 aa, Homo Sapiens
QQLKDSCKS

SEQ ID NO: 1285943 - protein, 9 aa, Homo Sapiens
IDEVKSTTK

SEQ ID NO: 1285944 - protein, 9 aa, Homo Sapiens
KMEFKKSSV

SEQ ID NO: 1285945 - protein, 9 aa, Homo Sapiens
DTKQIFCVA

SEQ ID NO: 1285946 - protein, 9 aa, Homo Sapiens
LTFRLKSEE

SEQ ID NO: 1285947 - protein, 9 aa, Homo Sapiens
DMCHEELKE

SEQ ID NO: 1285948 - protein, 9 aa, Homo Sapiens
PPRGSECTP

SEQ ID NO: 1285949 - protein, 9 aa, Homo Sapiens
GLSLYTTEM

SEQ ID NO: 1285950 - protein, 9 aa, Homo Sapiens
HKELNNLLK

SEQ ID NO: 1285951 - protein, 9 aa, Homo Sapiens
PPSLNTTVY

SEQ ID NO: 1285952 - protein, 9 aa, Homo Sapiens
INYCVALTK

SEQ ID NO: 1285953 - protein, 9 aa, Homo Sapiens
KLAANSDNL

SEQ ID NO: 1285954 - protein, 9 aa, Homo Sapiens
YFWSPSDMA

SEQ ID NO: 1285955 - protein, 9 aa, Homo Sapiens
NCVLSRDGS

SEQ ID NO: 1285956 - protein, 9 aa, Homo Sapiens
TVSFKRKQH

SEQ ID NO: 1285957 - protein, 9 aa, Homo Sapiens
IEDIDENQL

SEQ ID NO: 1285958 - protein, 9 aa, Homo Sapiens
SVDYSDGSK

SEQ ID NO: 1285959 - protein, 9 aa, Homo Sapiens
QSMQQQLEV

SEQ ID NO: 1285960 - protein, 9 aa, Homo Sapiens
TENNVLNKV

SEQ ID NO: 1285961 - protein, 9 aa, Homo Sapiens
YGYWVIVLE

SEQ ID NO: 1285962 - protein, 9 aa, Homo Sapiens
HPPNFSKVS

SEQ ID NO: 1285963 - protein, 9 aa, Homo Sapiens
TPLCAPEPD

SEQ ID NO: 1285964 - protein, 9 aa, Homo Sapiens
AYTIQWMEK

SEQ ID NO: 1285965 - protein, 9 aa, Homo Sapiens
KDSVCWVSE

SEQ ID NO: 1285966 - protein, 9 aa, Homo Sapiens
NFTLTSSNE

SEQ ID NO: 1285967 - protein, 9 aa, Homo Sapiens
CAECNEAIW

SEQ ID NO: 1285968 - protein, 9 aa, Homo Sapiens
LFFLVNYPV

SEQ ID NO: 1285969 - protein, 9 aa, Homo Sapiens
QSHTRCTLE

SEQ ID NO: 1285970 - protein, 9 aa, Homo Sapiens
SYKAFGTCV

SEQ ID NO: 1285971 - protein, 9 aa, Homo Sapiens
VCELAKLAG

SEQ ID NO: 1285972 - protein, 9 aa, Homo Sapiens
SWLLNKKHS

SEQ ID NO: 1285973 - protein, 9 aa, Homo Sapiens
LNVCDVVMV

SEQ ID NO: 1285974 - protein, 9 aa, Homo Sapiens
IMSAEYFPL

SEQ ID NO: 1285975 - protein, 9 aa, Homo Sapiens
RRLKIDTSY

SEQ ID NO: 1285976 - protein, 9 aa, Homo Sapiens
NQTSSNLKV

SEQ ID NO: 1285977 - protein, 9 aa, Homo Sapiens
LIDFFQGLF

SEQ ID NO: 1285978 - protein, 9 aa, Homo Sapiens
RMEEVYLPY

SEQ ID NO: 1285979 - protein, 9 aa, Homo Sapiens
TAYSPGNKN

SEQ ID NO: 1285980 - protein, 9 aa, Homo Sapiens
IKRDERMTV

SEQ ID NO: 1285981 - protein, 9 aa, Homo Sapiens
MALEGEAHR

SEQ ID NO: 1285982 - protein, 9 aa, Homo Sapiens
LQRIKGLGY

SEQ ID NO: 1285983 - protein, 9 aa, Homo Sapiens
PGLIHAFGG

SEQ ID NO: 1285984 - protein, 9 aa, Homo Sapiens
KQVDCDYVV

SEQ ID NO: 1285985 - protein, 9 aa, Homo Sapiens
KSQVSKHHR

SEQ ID NO: 1285986 - protein, 9 aa, Homo Sapiens
LCTFHGRDE

SEQ ID NO: 1285987 - protein, 9 aa, Homo Sapiens
LMTLHTIEI

SEQ ID NO: 1285988 - protein, 9 aa, Homo Sapiens
CKTAVLKAF

SEQ ID NO: 1285989 - protein, 9 aa, Homo Sapiens
YYMTMEWHE

SEQ ID NO: 1285990 - protein, 9 aa, Homo Sapiens
INFNEDNQE

SEQ ID NO: 1285991 - protein, 9 aa, Homo Sapiens
YGQHVSRQT

SEQ ID NO: 1285992 - protein, 9 aa, Homo Sapiens
KKKNYTAYF

SEQ ID NO: 1285993 - protein, 9 aa, Homo Sapiens
DICDVSERR

SEQ ID NO: 1285994 - protein, 9 aa, Homo Sapiens
ILEELHKHT

SEQ ID NO: 1285995 - protein, 9 aa, Homo Sapiens
SCLNMTDIT

SEQ ID NO: 1285996 - protein, 9 aa, Homo Sapiens
PNIFALSDE

SEQ ID NO: 1285997 - protein, 9 aa, Homo Sapiens
PRHQKSFNT

SEQ ID NO: 1285998 - protein, 9 aa, Homo Sapiens
IVETHDPIL

SEQ ID NO: 1285999 - protein, 9 aa, Homo Sapiens
FPSQAITSH

SEQ ID NO: 1286000 - protein, 9 aa, Homo Sapiens
MAGVPEDVE

SEQ ID NO: 1286001 - protein, 9 aa, Homo Sapiens
ESEEWTEAI

SEQ ID NO: 1286002 - protein, 9 aa, Homo Sapiens
KLLDLQAKI

SEQ ID NO: 1286003 - protein, 9 aa, Homo Sapiens
CAKKPNNGK

SEQ ID NO: 1286004 - protein, 9 aa, Homo Sapiens
KLDFVAIPD

SEQ ID NO: 1286005 - protein, 9 aa, Homo Sapiens
LDLQAKIGM

SEQ ID NO: 1286006 - protein, 9 aa, Homo Sapiens
NKNVDCSKS

SEQ ID NO: 1286007 - protein, 9 aa, Homo Sapiens
IPAQAHWKI

SEQ ID NO: 1286008 - protein, 9 aa, Homo Sapiens
ESGDGNTCT

SEQ ID NO: 1286009 - protein, 9 aa, Homo Sapiens
VLNQTSSNL

SEQ ID NO: 1286010 - protein, 9 aa, Homo Sapiens
RYGLNTLIQ

SEQ ID NO: 1286011 - protein, 9 aa, Homo Sapiens
EDWQMSVSG

SEQ ID NO: 1286012 - protein, 9 aa, Homo Sapiens
EKKAITLDM

SEQ ID NO: 1286013 - protein, 9 aa, Homo Sapiens
TNSETLVLC

SEQ ID NO: 1286014 - protein, 9 aa, Homo Sapiens
PKSLNYSCV

SEQ ID NO: 1286015 - protein, 9 aa, Homo Sapiens
SASSQVPSK

SEQ ID NO: 1286016 - protein, 9 aa, Homo Sapiens
IKLHYQSIG

SEQ ID NO: 1286017 - protein, 9 aa, Homo Sapiens
NGTVTEFKH

SEQ ID NO: 1286018 - protein, 9 aa, Homo Sapiens
HRTHEIEKN

SEQ ID NO: 1286019 - protein, 9 aa, Homo Sapiens
TLAEHKQLI

SEQ ID NO: 1286020 - protein, 9 aa, Homo Sapiens
ELCDYDPDE

SEQ ID NO: 1286021 - protein, 9 aa, Homo Sapiens
SKEFSAELT

SEQ ID NO: 1286022 - protein, 9 aa, Homo Sapiens
PQFLYKFFC

SEQ ID NO: 1286023 - protein, 9 aa, Homo Sapiens
RSVTGHDNK

SEQ ID NO: 1286024 - protein, 9 aa, Homo Sapiens
SFKLGFLNM

SEQ ID NO: 1286025 - protein, 9 aa, Homo Sapiens
NVDCSKSTH

SEQ ID NO: 1286026 - protein, 9 aa, Homo Sapiens
KSVPVPLKE

SEQ ID NO: 1286027 - protein, 9 aa, Homo Sapiens
FFLFIALLH

SEQ ID NO: 1286028 - protein, 9 aa, Homo Sapiens
FHARQLILQ

SEQ ID NO: 1286029 - protein, 9 aa, Homo Sapiens
STKLITDDK

SEQ ID NO: 1286030 - protein, 9 aa, Homo Sapiens
KSKELQGLD

SEQ ID NO: 1286031 - protein, 9 aa, Homo Sapiens
FKFTNFPEM

SEQ ID NO: 1286032 - protein, 9 aa, Homo Sapiens
LPEVINFIL

SEQ ID NO: 1286033 - protein, 9 aa, Homo Sapiens
SEHSPSLPR

SEQ ID NO: 1286034 - protein, 9 aa, Homo Sapiens
CQEYLNKCC

SEQ ID NO: 1286035 - protein, 9 aa, Homo Sapiens
HHYALYLIC

SEQ ID NO: 1286036 - protein, 9 aa, Homo Sapiens
VIKLSQDEQ

SEQ ID NO: 1286037 - protein, 9 aa, Homo Sapiens
AKVIAYEAV

SEQ ID NO: 1286038 - protein, 9 aa, Homo Sapiens
LLWSTSIKG

SEQ ID NO: 1286039 - protein, 9 aa, Homo Sapiens
RKLLIEHIF

SEQ ID NO: 1286040 - protein, 9 aa, Homo Sapiens
YVFECEACT

SEQ ID NO: 1286041 - protein, 9 aa, Homo Sapiens
DGFDQDDNE

SEQ ID NO: 1286042 - protein, 9 aa, Homo Sapiens
EFQYQMEMM

SEQ ID NO: 1286043 - protein, 9 aa, Homo Sapiens
NTTSFPCPL

SEQ ID NO: 1286044 - protein, 9 aa, Homo Sapiens
SPETLTDLG

SEQ ID NO: 1286045 - protein, 9 aa, Homo Sapiens
RELTEMRSA

SEQ ID NO: 1286046 - protein, 9 aa, Homo Sapiens
WKSYPIVCI

SEQ ID NO: 1286047 - protein, 9 aa, Homo Sapiens
KEAVIDINK

SEQ ID NO: 1286048 - protein, 9 aa, Homo Sapiens
SLDTSVLFD

SEQ ID NO: 1286049 - protein, 9 aa, Homo Sapiens
PDTWWKFKQ

SEQ ID NO: 1286050 - protein, 9 aa, Homo Sapiens
ESTESLLWS

SEQ ID NO: 1286051 - protein, 9 aa, Homo Sapiens
DIGNKGQPY

SEQ ID NO: 1286052 - protein, 9 aa, Homo Sapiens
HANQYSSKS

SEQ ID NO: 1286053 - protein, 9 aa, Homo Sapiens
LYFLLARSD

SEQ ID NO: 1286054 - protein, 9 aa, Homo Sapiens
IITLLFFLV

SEQ ID NO: 1286055 - protein, 9 aa, Homo Sapiens
HSNKSKDSD

SEQ ID NO: 1286056 - protein, 9 aa, Homo Sapiens
PKAWTNAAT

SEQ ID NO: 1286057 - protein, 9 aa, Homo Sapiens
PASLHKELN

SEQ ID NO: 1286058 - protein, 9 aa, Homo Sapiens
QRSVTGHDN

SEQ ID NO: 1286059 - protein, 9 aa, Homo Sapiens
IKVHSDLEA

SEQ ID NO: 1286060 - protein, 9 aa, Homo Sapiens
RQFPSLEHL

SEQ ID NO: 1286061 - protein, 9 aa, Homo Sapiens
AGVPEDVEQ

SEQ ID NO: 1286062 - protein, 9 aa, Homo Sapiens
VDARTFCND

SEQ ID NO: 1286063 - protein, 9 aa, Homo Sapiens
LTTMCNHLE

SEQ ID NO: 1286064 - protein, 9 aa, Homo Sapiens
HKHTEQLVQ

SEQ ID NO: 1286065 - protein, 9 aa, Homo Sapiens
PYQQQYPDS

SEQ ID NO: 1286066 - protein, 9 aa, Homo Sapiens
KELRRVEHI

SEQ ID NO: 1286067 - protein, 9 aa, Homo Sapiens
SKMLLFPYG

SEQ ID NO: 1286068 - protein, 9 aa, Homo Sapiens
CQYAAASQS

SEQ ID NO: 1286069 - protein, 9 aa, Homo Sapiens
QDHTLPLTS

SEQ ID NO: 1286070 - protein, 9 aa, Homo Sapiens
AGSCFILTD

SEQ ID NO: 1286071 - protein, 9 aa, Homo Sapiens
YNKLCYKKE

SEQ ID NO: 1286072 - protein, 9 aa, Homo Sapiens
IHNSGDCLS

SEQ ID NO: 1286073 - protein, 9 aa, Homo Sapiens
PLDMIDEDD

SEQ ID NO: 1286074 - protein, 9 aa, Homo Sapiens
FCCFSFFMV

SEQ ID NO: 1286075 - protein, 9 aa, Homo Sapiens
VCATFQGKM

SEQ ID NO: 1286076 - protein, 9 aa, Homo Sapiens
NVCCLIGPD

SEQ ID NO: 1286077 - protein, 9 aa, Homo Sapiens
ATVAALQDT

SEQ ID NO: 1286078 - protein, 9 aa, Homo Sapiens
LIDCQEFVP

SEQ ID NO: 1286079 - protein, 9 aa, Homo Sapiens
PNNYNEFCR

SEQ ID NO: 1286080 - protein, 9 aa, Homo Sapiens
SRRNEPPQP

SEQ ID NO: 1286081 - protein, 9 aa, Homo Sapiens
LRYPVLMSH

SEQ ID NO: 1286082 - protein, 9 aa, Homo Sapiens
QVVLEELKP

SEQ ID NO: 1286083 - protein, 9 aa, Homo Sapiens
IGSSFENLP

SEQ ID NO: 1286084 - protein, 9 aa, Homo Sapiens
RHQKSFNTA

SEQ ID NO: 1286085 - protein, 9 aa, Homo Sapiens
WETELLLIG

SEQ ID NO: 1286086 - protein, 9 aa, Homo Sapiens
NPLALYLES

SEQ ID NO: 1286087 - protein, 9 aa, Homo Sapiens
FGGQVISSL

SEQ ID NO: 1286088 - protein, 9 aa, Homo Sapiens
GKPIASCET

SEQ ID NO: 1286089 - protein, 9 aa, Homo Sapiens
GPKGVINDC

SEQ ID NO: 1286090 - protein, 9 aa, Homo Sapiens
FLLKVLLHL

SEQ ID NO: 1286091 - protein, 9 aa, Homo Sapiens
MFCPFYKTV

SEQ ID NO: 1286092 - protein, 9 aa, Homo Sapiens
KFVFFAEDV

SEQ ID NO: 1286093 - protein, 9 aa, Homo Sapiens
YLISHQDIL

SEQ ID NO: 1286094 - protein, 9 aa, Homo Sapiens
LYILPDTYQ

SEQ ID NO: 1286095 - protein, 9 aa, Homo Sapiens
QPRNELRES

SEQ ID NO: 1286096 - protein, 9 aa, Homo Sapiens
YKGGNTMKG

SEQ ID NO: 1286097 - protein, 9 aa, Homo Sapiens
QGKTLYFFS

SEQ ID NO: 1286098 - protein, 9 aa, Homo Sapiens
QVAMGRQLL

SEQ ID NO: 1286099 - protein, 9 aa, Homo Sapiens
SHPPQSAVK

SEQ ID NO: 1286100 - protein, 9 aa, Homo Sapiens
QHDVVAIGT

SEQ ID NO: 1286101 - protein, 9 aa, Homo Sapiens
RDTKPPDGK

SEQ ID NO: 1286102 - protein, 9 aa, Homo Sapiens
HFQCHKWPN

SEQ ID NO: 1286103 - protein, 9 aa, Homo Sapiens
IMKRNRDLC

SEQ ID NO: 1286104 - protein, 9 aa, Homo Sapiens
FLKENVNFE

SEQ ID NO: 1286105 - protein, 9 aa, Homo Sapiens
VQPPGSDMP

SEQ ID NO: 1286106 - protein, 9 aa, Homo Sapiens
IWLRHLPSL

SEQ ID NO: 1286107 - protein, 9 aa, Homo Sapiens
MWEYEPKIE

SEQ ID NO: 1286108 - protein, 9 aa, Homo Sapiens
YDLLCQIGS

SEQ ID NO: 1286109 - protein, 9 aa, Homo Sapiens
NEPPQPRNE

SEQ ID NO: 1286110 - protein, 9 aa, Homo Sapiens
CLSSTCEGL

SEQ ID NO: 1286111 - protein, 9 aa, Homo Sapiens
AHEVMEQVR

SEQ ID NO: 1286112 - protein, 9 aa, Homo Sapiens
LPKTLSFRI

SEQ ID NO: 1286113 - protein, 9 aa, Homo Sapiens
NIVLWIMIA

SEQ ID NO: 1286114 - protein, 9 aa, Homo Sapiens
YVYDNNVLQ

SEQ ID NO: 1286115 - protein, 9 aa, Homo Sapiens
CVTTQAPKT

SEQ ID NO: 1286116 - protein, 9 aa, Homo Sapiens
NSLNRMNCV

SEQ ID NO: 1286117 - protein, 9 aa, Homo Sapiens
NLTQQQKID

SEQ ID NO: 1286118 - protein, 9 aa, Homo Sapiens
STRDYIIEP

SEQ ID NO: 1286119 - protein, 9 aa, Homo Sapiens
TPEIFMALE

SEQ ID NO: 1286120 - protein, 9 aa, Homo Sapiens
GSFDLVAIC

SEQ ID NO: 1286121 - protein, 9 aa, Homo Sapiens
EDYSPDDKH

SEQ ID NO: 1286122 - protein, 9 aa, Homo Sapiens
PVCVDYILQ

SEQ ID NO: 1286123 - protein, 9 aa, Homo Sapiens
EYAGSMCES

SEQ ID NO: 1286124 - protein, 9 aa, Homo Sapiens
CYPDPSYLK

SEQ ID NO: 1286125 - protein, 9 aa, Homo Sapiens
LKASLICSV

SEQ ID NO: 1286126 - protein, 9 aa, Homo Sapiens
TGHDNKMQF

SEQ ID NO: 1286127 - protein, 9 aa, Homo Sapiens
NTPIGDYTS

SEQ ID NO: 1286128 - protein, 9 aa, Homo Sapiens
QVKKINQEE

SEQ ID NO: 1286129 - protein, 9 aa, Homo Sapiens
ILSELFEEE

SEQ ID NO: 1286130 - protein, 9 aa, Homo Sapiens
KSLNYSCVK

SEQ ID NO: 1286131 - protein, 9 aa, Homo Sapiens
GKDNCRAAN

SEQ ID NO: 1286132 - protein, 9 aa, Homo Sapiens
PAALISIIK

SEQ ID NO: 1286133 - protein, 9 aa, Homo Sapiens
NVDKTELLH

SEQ ID NO: 1286134 - protein, 9 aa, Homo Sapiens
VEEQLRLLE

SEQ ID NO: 1286135 - protein, 9 aa, Homo Sapiens
PGNKNGVLD

SEQ ID NO: 1286136 - protein, 9 aa, Homo Sapiens
LFEKCVSAK

SEQ ID NO: 1286137 - protein, 9 aa, Homo Sapiens
IEDSDRKVE

SEQ ID NO: 1286138 - protein, 9 aa, Homo Sapiens
ITVFLRHAE

SEQ ID NO: 1286139 - protein, 9 aa, Homo Sapiens
PSLEHLNIC

SEQ ID NO: 1286140 - protein, 9 aa, Homo Sapiens
ADMLLDNCL

SEQ ID NO: 1286141 - protein, 9 aa, Homo Sapiens
ESYTLTIES

SEQ ID NO: 1286142 - protein, 9 aa, Homo Sapiens
YKVISTPTD

SEQ ID NO: 1286143 - protein, 9 aa, Homo Sapiens
YISSASSQV

SEQ ID NO: 1286144 - protein, 9 aa, Homo Sapiens
VTGRSFCDK

SEQ ID NO: 1286145 - protein, 9 aa, Homo Sapiens
GRFIPLKAF

SEQ ID NO: 1286146 - protein, 9 aa, Homo Sapiens
GMTREESEQ

SEQ ID NO: 1286147 - protein, 9 aa, Homo Sapiens
SYLDELYLS

SEQ ID NO: 1286148 - protein, 9 aa, Homo Sapiens
SCDLYPGIQ

SEQ ID NO: 1286149 - protein, 9 aa, Homo Sapiens
EQFQALVKH

SEQ ID NO: 1286150 - protein, 9 aa, Homo Sapiens
AHATANATV

SEQ ID NO: 1286151 - protein, 9 aa, Homo Sapiens
PSTRLWHVL

SEQ ID NO: 1286152 - protein, 9 aa, Homo Sapiens
CTVNLRDDV

SEQ ID NO: 1286153 - protein, 9 aa, Homo Sapiens
KTQEKAQVK

SEQ ID NO: 1286154 - protein, 9 aa, Homo Sapiens
TCTQTNGLD

SEQ ID NO: 1286155 - protein, 9 aa, Homo Sapiens
KHVGTKKLT

SEQ ID NO: 1286156 - protein, 9 aa, Homo Sapiens
KNQKILYAV

SEQ ID NO: 1286157 - protein, 9 aa, Homo Sapiens
KLIRLCCEV

SEQ ID NO: 1286158 - protein, 9 aa, Homo Sapiens
STFTTMTPT

SEQ ID NO: 1286159 - protein, 9 aa, Homo Sapiens
VYSVKKAPD

SEQ ID NO: 1286160 - protein, 9 aa, Homo Sapiens
LAENAHLHT

SEQ ID NO: 1286161 - protein, 9 aa, Homo Sapiens
DNQECAGIQ

SEQ ID NO: 1286162 - protein, 9 aa, Homo Sapiens
CKCLQGFTG

SEQ ID NO: 1286163 - protein, 9 aa, Homo Sapiens
ECVGSSKIL

SEQ ID NO: 1286164 - protein, 9 aa, Homo Sapiens
AKIGMQPHL

SEQ ID NO: 1286165 - protein, 9 aa, Homo Sapiens
SQCVICLDI

SEQ ID NO: 1286166 - protein, 9 aa, Homo Sapiens
MTNKLPGSP

SEQ ID NO: 1286167 - protein, 9 aa, Homo Sapiens
FLEEIQLCE

SEQ ID NO: 1286168 - protein, 9 aa, Homo Sapiens
PNTDIEEYH

SEQ ID NO: 1286169 - protein, 9 aa, Homo Sapiens
VVTMLGQDW

SEQ ID NO: 1286170 - protein, 9 aa, Homo Sapiens
SFVEAAHEQ

SEQ ID NO: 1286171 - protein, 9 aa, Homo Sapiens
KNHMRGRYE

SEQ ID NO: 1286172 - protein, 9 aa, Homo Sapiens
KWTISKDNS

SEQ ID NO: 1286173 - protein, 9 aa, Homo Sapiens
LLAVPIVPL

SEQ ID NO: 1286174 - protein, 9 aa, Homo Sapiens
VTILPSKKK

SEQ ID NO: 1286175 - protein, 9 aa, Homo Sapiens
GVGSFADQD

SEQ ID NO: 1286176 - protein, 9 aa, Homo Sapiens
ILPQFLYKF

SEQ ID NO: 1286177 - protein, 9 aa, Homo Sapiens
DVSRCNLEK

SEQ ID NO: 1286178 - protein, 9 aa, Homo Sapiens
KCLQEDWER

SEQ ID NO: 1286179 - protein, 9 aa, Homo Sapiens
PIVCIAKEL

SEQ ID NO: 1286180 - protein, 9 aa, Homo Sapiens
GQHDVVAIG

SEQ ID NO: 1286181 - protein, 9 aa, Homo Sapiens
CSTDFTPHW

SEQ ID NO: 1286182 - protein, 9 aa, Homo Sapiens
LKENVNFEN

SEQ ID NO: 1286183 - protein, 9 aa, Homo Sapiens
RETVLLEHT

SEQ ID NO: 1286184 - protein, 9 aa, Homo Sapiens
KNTYGKQDL

SEQ ID NO: 1286185 - protein, 9 aa, Homo Sapiens
CCTLLVIYN

SEQ ID NO: 1286186 - protein, 9 aa, Homo Sapiens
REAALILCV

SEQ ID NO: 1286187 - protein, 9 aa, Homo Sapiens
GLLSFFLAM

SEQ ID NO: 1286188 - protein, 9 aa, Homo Sapiens
GSRQSLKVL

SEQ ID NO: 1286189 - protein, 9 aa, Homo Sapiens
GIIYRDMKL

SEQ ID NO: 1286190 - protein, 9 aa, Homo Sapiens
ATTTTTIVI

SEQ ID NO: 1286191 - protein, 9 aa, Homo Sapiens
SQQDEEQPH

SEQ ID NO: 1286192 - protein, 9 aa, Homo Sapiens
IQHSISMHA

SEQ ID NO: 1286193 - protein, 9 aa, Homo Sapiens
VCDVVMVNY

SEQ ID NO: 1286194 - protein, 9 aa, Homo Sapiens
RPKTPEIFM

SEQ ID NO: 1286195 - protein, 9 aa, Homo Sapiens
VCAKKPNNG

SEQ ID NO: 1286196 - protein, 9 aa, Homo Sapiens
KSHILYTEE

SEQ ID NO: 1286197 - protein, 9 aa, Homo Sapiens
SLHLKMEPQ

SEQ ID NO: 1286198 - protein, 9 aa, Homo Sapiens
VLEEISCYT

SEQ ID NO: 1286199 - protein, 9 aa, Homo Sapiens
RRHERTHTV

SEQ ID NO: 1286200 - protein, 9 aa, Homo Sapiens
SIKRSAFDR

SEQ ID NO: 1286201 - protein, 9 aa, Homo Sapiens
RMTVDFMSV

SEQ ID NO: 1286202 - protein, 9 aa, Homo Sapiens
VDWLGLGVL

SEQ ID NO: 1286203 - protein, 9 aa, Homo Sapiens
SPTERNGGK

SEQ ID NO: 1286204 - protein, 9 aa, Homo Sapiens
TDTRILSIA

SEQ ID NO: 1286205 - protein, 9 aa, Homo Sapiens
HNKSKFVPP

SEQ ID NO: 1286206 - protein, 9 aa, Homo Sapiens
INNTDFVPE

SEQ ID NO: 1286207 - protein, 9 aa, Homo Sapiens
ELAENYSYD

SEQ ID NO: 1286208 - protein, 9 aa, Homo Sapiens
PVWKLGDMR

SEQ ID NO: 1286209 - protein, 9 aa, Homo Sapiens
CSPIWVYTS

SEQ ID NO: 1286210 - protein, 9 aa, Homo Sapiens
SPIINNTEN

SEQ ID NO: 1286211 - protein, 9 aa, Homo Sapiens
RLKVLAVTE

SEQ ID NO: 1286212 - protein, 9 aa, Homo Sapiens
GGDRGAPKL

SEQ ID NO: 1286213 - protein, 9 aa, Homo Sapiens
KVISTPTDF

SEQ ID NO: 1286214 - protein, 9 aa, Homo Sapiens
LEKRLHVKQ

SEQ ID NO: 1286215 - protein, 9 aa, Homo Sapiens
ESYSGKASR

SEQ ID NO: 1286216 - protein, 9 aa, Homo Sapiens
NNGAMGGLG

SEQ ID NO: 1286217 - protein, 9 aa, Homo Sapiens
SEKALEKGR

SEQ ID NO: 1286218 - protein, 9 aa, Homo Sapiens
LQILQPEKP

SEQ ID NO: 1286219 - protein, 9 aa, Homo Sapiens
VGLPHCAVR

SEQ ID NO: 1286220 - protein, 9 aa, Homo Sapiens
VLLHLHKVK

SEQ ID NO: 1286221 - protein, 9 aa, Homo Sapiens
QSLSLYNHF

SEQ ID NO: 1286222 - protein, 9 aa, Homo Sapiens
TGAQCAGVE

SEQ ID NO: 1286223 - protein, 9 aa, Homo Sapiens
CHSECLRLL

SEQ ID NO: 1286224 - protein, 9 aa, Homo Sapiens
TEMRSALRV

SEQ ID NO: 1286225 - protein, 9 aa, Homo Sapiens
FCLDLYSSL

SEQ ID NO: 1286226 - protein, 9 aa, Homo Sapiens
YSVVFNIVL

SEQ ID NO: 1286227 - protein, 9 aa, Homo Sapiens
PPFLSRNGQ

SEQ ID NO: 1286228 - protein, 9 aa, Homo Sapiens
GEGPGAEGM

SEQ ID NO: 1286229 - protein, 9 aa, Homo Sapiens
YIRNVNFNC

SEQ ID NO: 1286230 - protein, 9 aa, Homo Sapiens
RGSECTPDS

SEQ ID NO: 1286231 - protein, 9 aa, Homo Sapiens
NVLVAIVSK

SEQ ID NO: 1286232 - protein, 9 aa, Homo Sapiens
EESEEWTEA

SEQ ID NO: 1286233 - protein, 9 aa, Homo Sapiens
CGFSNVFPR

SEQ ID NO: 1286234 - protein, 9 aa, Homo Sapiens
TQHKRNKRN

SEQ ID NO: 1286235 - protein, 9 aa, Homo Sapiens
ALASVAIHQ

SEQ ID NO: 1286236 - protein, 9 aa, Homo Sapiens
TSGNMNHCN

SEQ ID NO: 1286237 - protein, 9 aa, Homo Sapiens
RKQQYSIKR

SEQ ID NO: 1286238 - protein, 9 aa, Homo Sapiens
DLQPIQYEP

SEQ ID NO: 1286239 - protein, 9 aa, Homo Sapiens
SGNSLIWIH

SEQ ID NO: 1286240 - protein, 9 aa, Homo Sapiens
WLINLAAKN

SEQ ID NO: 1286241 - protein, 9 aa, Homo Sapiens
QKQLRYIIL

SEQ ID NO: 1286242 - protein, 9 aa, Homo Sapiens
PSYILTFRL

SEQ ID NO: 1286243 - protein, 9 aa, Homo Sapiens
RSEEEHLSS

SEQ ID NO: 1286244 - protein, 9 aa, Homo Sapiens
GLFEKCVSA

SEQ ID NO: 1286245 - protein, 9 aa, Homo Sapiens
NGLAMSGLN

SEQ ID NO: 1286246 - protein, 9 aa, Homo Sapiens
QLCSSGHKR

SEQ ID NO: 1286247 - protein, 9 aa, Homo Sapiens
GSKSGNSRT

SEQ ID NO: 1286248 - protein, 9 aa, Homo Sapiens
HGKLKVLAK

SEQ ID NO: 1286249 - protein, 9 aa, Homo Sapiens
ALKETLLLY

SEQ ID NO: 1286250 - protein, 9 aa, Homo Sapiens
GVDVDQDWE

SEQ ID NO: 1286251 - protein, 9 aa, Homo Sapiens
SLNRMNCVM

SEQ ID NO: 1286252 - protein, 9 aa, Homo Sapiens
SNCINEELS

SEQ ID NO: 1286253 - protein, 9 aa, Homo Sapiens
MRSRIDEKF

SEQ ID NO: 1286254 - protein, 9 aa, Homo Sapiens
KTVCMNVLR

SEQ ID NO: 1286255 - protein, 9 aa, Homo Sapiens
HNKQLLLSR

SEQ ID NO: 1286256 - protein, 9 aa, Homo Sapiens
LYYSLTDWI

SEQ ID NO: 1286257 - protein, 9 aa, Homo Sapiens
IPDDAQGVE

SEQ ID NO: 1286258 - protein, 9 aa, Homo Sapiens
LRDDVDSYG

SEQ ID NO: 1286259 - protein, 9 aa, Homo Sapiens
AHARFFICT

SEQ ID NO: 1286260 - protein, 9 aa, Homo Sapiens
KSIIIAECN

SEQ ID NO: 1286261 - protein, 9 aa, Homo Sapiens
KTLCQETLC

SEQ ID NO: 1286262 - protein, 9 aa, Homo Sapiens
DRNYIIKFW

SEQ ID NO: 1286263 - protein, 9 aa, Homo Sapiens
LQLHIRETL

SEQ ID NO: 1286264 - protein, 9 aa, Homo Sapiens
LIKCPWTKE

SEQ ID NO: 1286265 - protein, 9 aa, Homo Sapiens
KYGCNRVQI

SEQ ID NO: 1286266 - protein, 9 aa, Homo Sapiens
KSKFVPPFK

SEQ ID NO: 1286267 - protein, 9 aa, Homo Sapiens
EEASYPAVP

SEQ ID NO: 1286268 - protein, 9 aa, Homo Sapiens
FGHFFDHKK

SEQ ID NO: 1286269 - protein, 9 aa, Homo Sapiens
CGPSRCGAD

SEQ ID NO: 1286270 - protein, 9 aa, Homo Sapiens
TEDEIDKCV

SEQ ID NO: 1286271 - protein, 9 aa, Homo Sapiens
VWLVLNVFL

SEQ ID NO: 1286272 - protein, 9 aa, Homo Sapiens
TPSPTLCAP

SEQ ID NO: 1286273 - protein, 9 aa, Homo Sapiens
EEALPLDMI

SEQ ID NO: 1286274 - protein, 9 aa, Homo Sapiens
LVYSIPFYH

SEQ ID NO: 1286275 - protein, 9 aa, Homo Sapiens
REELFGESY

SEQ ID NO: 1286276 - protein, 9 aa, Homo Sapiens
VKHSGHLFF

SEQ ID NO: 1286277 - protein, 9 aa, Homo Sapiens
CEKRWKDLK

SEQ ID NO: 1286278 - protein, 9 aa, Homo Sapiens
TDRYGLNTL

SEQ ID NO: 1286279 - protein, 9 aa, Homo Sapiens
YDGRSLFIL

SEQ ID NO: 1286280 - protein, 9 aa, Homo Sapiens
LADMCHEEL

SEQ ID NO: 1286281 - protein, 9 aa, Homo Sapiens
YIHTMSEYG

SEQ ID NO: 1286282 - protein, 9 aa, Homo Sapiens
QRAYTIQWM

SEQ ID NO: 1286283 - protein, 9 aa, Homo Sapiens
KVDTAHRIT

SEQ ID NO: 1286284 - protein, 9 aa, Homo Sapiens
LTNLEHKIY

SEQ ID NO: 1286285 - protein, 9 aa, Homo Sapiens
LLKVLLHLH

SEQ ID NO: 1286286 - protein, 9 aa, Homo Sapiens
SASVHGFFL

SEQ ID NO: 1286287 - protein, 9 aa, Homo Sapiens
ATMKKEKQQ

SEQ ID NO: 1286288 - protein, 9 aa, Homo Sapiens
RHERTHTVE

SEQ ID NO: 1286289 - protein, 9 aa, Homo Sapiens
SGDGNTCTQ

SEQ ID NO: 1286290 - protein, 9 aa, Homo Sapiens
EVTELKLNP

SEQ ID NO: 1286291 - protein, 9 aa, Homo Sapiens
QKLWCALSK

SEQ ID NO: 1286292 - protein, 9 aa, Homo Sapiens
VMFNFPDTA

SEQ ID NO: 1286293 - protein, 9 aa, Homo Sapiens
LENPGIDIC

SEQ ID NO: 1286294 - protein, 9 aa, Homo Sapiens
VPHSQKMEN

SEQ ID NO: 1286295 - protein, 9 aa, Homo Sapiens
VGAIPYTCY

SEQ ID NO: 1286296 - protein, 9 aa, Homo Sapiens
EQEEEIEEV

SEQ ID NO: 1286297 - protein, 9 aa, Homo Sapiens
LQEKLNEIS

SEQ ID NO: 1286298 - protein, 9 aa, Homo Sapiens
HFDRRKNCL

SEQ ID NO: 1286299 - protein, 9 aa, Homo Sapiens
TFVVWIVIG

SEQ ID NO: 1286300 - protein, 9 aa, Homo Sapiens
LKMYKVEFK

SEQ ID NO: 1286301 - protein, 9 aa, Homo Sapiens
RWRNVLFDS

SEQ ID NO: 1286302 - protein, 9 aa, Homo Sapiens
CDYDPDEHP

SEQ ID NO: 1286303 - protein, 9 aa, Homo Sapiens
RTATSGSEY

SEQ ID NO: 1286304 - protein, 9 aa, Homo Sapiens
AFKSPLYSP

SEQ ID NO: 1286305 - protein, 9 aa, Homo Sapiens
LAIQMNEEQ

SEQ ID NO: 1286306 - protein, 9 aa, Homo Sapiens
KFSNPLALY

SEQ ID NO: 1286307 - protein, 9 aa, Homo Sapiens
TLYKSQMYN

SEQ ID NO: 1286308 - protein, 9 aa, Homo Sapiens
LEENVDKTE

SEQ ID NO: 1286309 - protein, 9 aa, Homo Sapiens
ISDHGLQKS

SEQ ID NO: 1286310 - protein, 9 aa, Homo Sapiens
VVPNQTLTQ

SEQ ID NO: 1286311 - protein, 9 aa, Homo Sapiens
NWLNKVNPN

SEQ ID NO: 1286312 - protein, 9 aa, Homo Sapiens
ITLDMDGNV

SEQ ID NO: 1286313 - protein, 9 aa, Homo Sapiens
SMGFVISNP

SEQ ID NO: 1286314 - protein, 9 aa, Homo Sapiens
AMGRQLLAI

SEQ ID NO: 1286315 - protein, 9 aa, Homo Sapiens
ARMENKALQ

SEQ ID NO: 1286316 - protein, 9 aa, Homo Sapiens
VLSQEPYQQ

SEQ ID NO: 1286317 - protein, 9 aa, Homo Sapiens
EKAGKIFSH

SEQ ID NO: 1286318 - protein, 9 aa, Homo Sapiens
HADKISTPE

SEQ ID NO: 1286319 - protein, 9 aa, Homo Sapiens
DETYCIYNE

SEQ ID NO: 1286320 - protein, 9 aa, Homo Sapiens
KTQPVEHSA

SEQ ID NO: 1286321 - protein, 9 aa, Homo Sapiens
LNRKRTIYS

SEQ ID NO: 1286322 - protein, 9 aa, Homo Sapiens
EISTKMCKK

SEQ ID NO: 1286323 - protein, 9 aa, Homo Sapiens
AFPKEFPYS

SEQ ID NO: 1286324 - protein, 9 aa, Homo Sapiens
GFHNNLLDN

SEQ ID NO: 1286325 - protein, 9 aa, Homo Sapiens
GSYQCKCLQ

SEQ ID NO: 1286326 - protein, 9 aa, Homo Sapiens
AALILCVSP

SEQ ID NO: 1286327 - protein, 9 aa, Homo Sapiens
SSKEIYYDS

SEQ ID NO: 1286328 - protein, 9 aa, Homo Sapiens
VFVFEVTEL

SEQ ID NO: 1286329 - protein, 9 aa, Homo Sapiens
EELHKHTEQ

SEQ ID NO: 1286330 - protein, 9 aa, Homo Sapiens
DGVMWEYEP

SEQ ID NO: 1286331 - protein, 9 aa, Homo Sapiens
DLHIYVSFL

SEQ ID NO: 1286332 - protein, 9 aa, Homo Sapiens
CIGMRFALI

SEQ ID NO: 1286333 - protein, 9 aa, Homo Sapiens
SLTESCLSC

SEQ ID NO: 1286334 - protein, 9 aa, Homo Sapiens
AEQNESELI

SEQ ID NO: 1286335 - protein, 9 aa, Homo Sapiens
LEQSQGTCM

SEQ ID NO: 1286336 - protein, 9 aa, Homo Sapiens
WGECNHSFN

SEQ ID NO: 1286337 - protein, 9 aa, Homo Sapiens
GDCEVLGCC

SEQ ID NO: 1286338 - protein, 9 aa, Homo Sapiens
SNKMRQHYD

SEQ ID NO: 1286339 - protein, 9 aa, Homo Sapiens
MKKEKQQKM

SEQ ID NO: 1286340 - protein, 9 aa, Homo Sapiens
SEKCSGECN

SEQ ID NO: 1286341 - protein, 9 aa, Homo Sapiens
IDYLSHINE

SEQ ID NO: 1286342 - protein, 9 aa, Homo Sapiens
GGHHYPFSG

SEQ ID NO: 1286343 - protein, 9 aa, Homo Sapiens
GSIHTGERH

SEQ ID NO: 1286344 - protein, 9 aa, Homo Sapiens
LTPLLLCVH

SEQ ID NO: 1286345 - protein, 9 aa, Homo Sapiens
SLSDPNNYN

SEQ ID NO: 1286346 - protein, 9 aa, Homo Sapiens
EGRNYEKAL

SEQ ID NO: 1286347 - protein, 9 aa, Homo Sapiens
LSSTCEGLD

SEQ ID NO: 1286348 - protein, 9 aa, Homo Sapiens
CPKFRCGRT

SEQ ID NO: 1286349 - protein, 9 aa, Homo Sapiens
LTDLGTSSQ

SEQ ID NO: 1286350 - protein, 9 aa, Homo Sapiens
SDHGLQKSF

SEQ ID NO: 1286351 - protein, 9 aa, Homo Sapiens
HCQHCGTCL

SEQ ID NO: 1286352 - protein, 9 aa, Homo Sapiens
EKKLLQVVF

SEQ ID NO: 1286353 - protein, 9 aa, Homo Sapiens
SSSEHTLLL

SEQ ID NO: 1286354 - protein, 9 aa, Homo Sapiens
TCKIIVDML

SEQ ID NO: 1286355 - protein, 9 aa, Homo Sapiens
QVSQIQSCV

SEQ ID NO: 1286356 - protein, 9 aa, Homo Sapiens
KISTPETPL

SEQ ID NO: 1286357 - protein, 9 aa, Homo Sapiens
KLKRAVNLQ

SEQ ID NO: 1286358 - protein, 9 aa, Homo Sapiens
NNTENVSSI

SEQ ID NO: 1286359 - protein, 9 aa, Homo Sapiens
KNPQFMFDI

SEQ ID NO: 1286360 - protein, 9 aa, Homo Sapiens
QKCSTVDDS

SEQ ID NO: 1286361 - protein, 9 aa, Homo Sapiens
LVPHSQKME

SEQ ID NO: 1286362 - protein, 9 aa, Homo Sapiens
GPTSNDLLL

SEQ ID NO: 1286363 - protein, 9 aa, Homo Sapiens
SYYMTMEWH

SEQ ID NO: 1286364 - protein, 9 aa, Homo Sapiens
GPEAFRFDC

SEQ ID NO: 1286365 - protein, 9 aa, Homo Sapiens
WTIKAKYKD

SEQ ID NO: 1286366 - protein, 9 aa, Homo Sapiens
LAEHKQLIP

SEQ ID NO: 1286367 - protein, 9 aa, Homo Sapiens
AGTPEDKMM

SEQ ID NO: 1286368 - protein, 9 aa, Homo Sapiens
DHVLPELNN

SEQ ID NO: 1286369 - protein, 9 aa, Homo Sapiens
VHDGTLCQP

SEQ ID NO: 1286370 - protein, 9 aa, Homo Sapiens
HSTQHKRNK

SEQ ID NO: 1286371 - protein, 9 aa, Homo Sapiens
YSHTHREEE

SEQ ID NO: 1286372 - protein, 9 aa, Homo Sapiens
KLRGPSYIL

SEQ ID NO: 1286373 - protein, 9 aa, Homo Sapiens
APLIKVHSD

SEQ ID NO: 1286374 - protein, 9 aa, Homo Sapiens
HTVEKPYQC

SEQ ID NO: 1286375 - protein, 9 aa, Homo Sapiens
ILYTEESNS

SEQ ID NO: 1286376 - protein, 9 aa, Homo Sapiens
TSIHSLLDE

SEQ ID NO: 1286377 - protein, 9 aa, Homo Sapiens
CSKSTHEEQ

SEQ ID NO: 1286378 - protein, 9 aa, Homo Sapiens
HQRIHTVEK

SEQ ID NO: 1286379 - protein, 9 aa, Homo Sapiens
CIYNEALYD

SEQ ID NO: 1286380 - protein, 9 aa, Homo Sapiens
FCDSSTDGS

SEQ ID NO: 1286381 - protein, 9 aa, Homo Sapiens
PRDNPRNTL

SEQ ID NO: 1286382 - protein, 9 aa, Homo Sapiens
MMISNPWER

SEQ ID NO: 1286383 - protein, 9 aa, Homo Sapiens
LDSFRFEKR

SEQ ID NO: 1286384 - protein, 9 aa, Homo Sapiens
LCVLNLILY

SEQ ID NO: 1286385 - protein, 9 aa, Homo Sapiens
LLNTQDTPV

SEQ ID NO: 1286386 - protein, 9 aa, Homo Sapiens
LLDNNEATD

SEQ ID NO: 1286387 - protein, 9 aa, Homo Sapiens
CHRLSRELL

SEQ ID NO: 1286388 - protein, 9 aa, Homo Sapiens
RPLKMCGRK

SEQ ID NO: 1286389 - protein, 9 aa, Homo Sapiens
KCCTLLVIY

SEQ ID NO: 1286390 - protein, 9 aa, Homo Sapiens
NYRSVLENH

SEQ ID NO: 1286391 - protein, 9 aa, Homo Sapiens
LMRELDQNE

SEQ ID NO: 1286392 - protein, 9 aa, Homo Sapiens
FNDKSISTS

SEQ ID NO: 1286393 - protein, 9 aa, Homo Sapiens
LNNAQQQMK

SEQ ID NO: 1286394 - protein, 9 aa, Homo Sapiens
KITQSMQQQ

SEQ ID NO: 1286395 - protein, 9 aa, Homo Sapiens
RGKTLHTGD

SEQ ID NO: 1286396 - protein, 9 aa, Homo Sapiens
DYVFECEAC

SEQ ID NO: 1286397 - protein, 9 aa, Homo Sapiens
GKKTTVPGC

SEQ ID NO: 1286398 - protein, 9 aa, Homo Sapiens
PVFTSQKSD

SEQ ID NO: 1286399 - protein, 9 aa, Homo Sapiens
ESKRELTEM

SEQ ID NO: 1286400 - protein, 9 aa, Homo Sapiens
SKRELTEMR

SEQ ID NO: 1286401 - protein, 9 aa, Homo Sapiens
KILTTDSDI

SEQ ID NO: 1286402 - protein, 9 aa, Homo Sapiens
LMKVDTAHR

SEQ ID NO: 1286403 - protein, 9 aa, Homo Sapiens
RCGRTAFFS

SEQ ID NO: 1286404 - protein, 9 aa, Homo Sapiens
FPKEFPYSM

SEQ ID NO: 1286405 - protein, 9 aa, Homo Sapiens
KERPDLQPI

SEQ ID NO: 1286406 - protein, 9 aa, Homo Sapiens
LNTQDTPVK

SEQ ID NO: 1286407 - protein, 9 aa, Homo Sapiens
HYLLKRMLQ

SEQ ID NO: 1286408 - protein, 9 aa, Homo Sapiens
WLGLGVLIY

SEQ ID NO: 1286409 - protein, 9 aa, Homo Sapiens
DLYDYYTEE

SEQ ID NO: 1286410 - protein, 9 aa, Homo Sapiens
AAHEGLIDS

SEQ ID NO: 1286411 - protein, 9 aa, Homo Sapiens
QVSKHHRTH

SEQ ID NO: 1286412 - protein, 9 aa, Homo Sapiens
QVQLRLCMA

SEQ ID NO: 1286413 - protein, 9 aa, Homo Sapiens
TVPGCGPSR

SEQ ID NO: 1286414 - protein, 9 aa, Homo Sapiens
ESNILEISL

SEQ ID NO: 1286415 - protein, 9 aa, Homo Sapiens
DSEITGAQC

SEQ ID NO: 1286416 - protein, 9 aa, Homo Sapiens
SQTTLLATK

SEQ ID NO: 1286417 - protein, 9 aa, Homo Sapiens
RCVLQYQKK

SEQ ID NO: 1286418 - protein, 9 aa, Homo Sapiens
CVGSSKILR

SEQ ID NO: 1286419 - protein, 9 aa, Homo Sapiens
EACLCGELW

SEQ ID NO: 1286420 - protein, 9 aa, Homo Sapiens
TKKCRNWLH

SEQ ID NO: 1286421 - protein, 9 aa, Homo Sapiens
EKELLKQEK

SEQ ID NO: 1286422 - protein, 9 aa, Homo Sapiens
LVLNIKKPL

SEQ ID NO: 1286423 - protein, 9 aa, Homo Sapiens
IHAAATNCH

SEQ ID NO: 1286424 - protein, 9 aa, Homo Sapiens
KENVNFENR

SEQ ID NO: 1286425 - protein, 9 aa, Homo Sapiens
YSFSAKHAL

SEQ ID NO: 1286426 - protein, 9 aa, Homo Sapiens
TSVCAQNTV

SEQ ID NO: 1286427 - protein, 9 aa, Homo Sapiens
STLTFVVWI

SEQ ID NO: 1286428 - protein, 9 aa, Homo Sapiens
EFKTQPVEH

SEQ ID NO: 1286429 - protein, 9 aa, Homo Sapiens
PKAQLMLLY

SEQ ID NO: 1286430 - protein, 9 aa, Homo Sapiens
GMRFALINM

SEQ ID NO: 1286431 - protein, 9 aa, Homo Sapiens
EKAKVIAYE

SEQ ID NO: 1286432 - protein, 9 aa, Homo Sapiens
AADIGNPVG

SEQ ID NO: 1286433 - protein, 9 aa, Homo Sapiens
MQLKLSVAI

SEQ ID NO: 1286434 - protein, 9 aa, Homo Sapiens
FTCNVLQRI

SEQ ID NO: 1286435 - protein, 9 aa, Homo Sapiens
LLEHTFSAV

SEQ ID NO: 1286436 - protein, 9 aa, Homo Sapiens
TTVEGRNYE

SEQ ID NO: 1286437 - protein, 9 aa, Homo Sapiens
IDWVSPLKP

SEQ ID NO: 1286438 - protein, 9 aa, Homo Sapiens
SFIHKHGFF

SEQ ID NO: 1286439 - protein, 9 aa, Homo Sapiens
SCFCDSSTD

SEQ ID NO: 1286440 - protein, 9 aa, Homo Sapiens
QRYTFFYSC

SEQ ID NO: 1286441 - protein, 9 aa, Homo Sapiens
GQECRDTKP

SEQ ID NO: 1286442 - protein, 9 aa, Homo Sapiens
HVKQNQHEE

SEQ ID NO: 1286443 - protein, 9 aa, Homo Sapiens
NTLQDIVEG

SEQ ID NO: 1286444 - protein, 9 aa, Homo Sapiens
AGNKGILSR

SEQ ID NO: 1286445 - protein, 9 aa, Homo Sapiens
HGSRITRLL

SEQ ID NO: 1286446 - protein, 9 aa, Homo Sapiens
HSSEDFNMG

SEQ ID NO: 1286447 - protein, 9 aa, Homo Sapiens
SFATSTQNN

SEQ ID NO: 1286448 - protein, 9 aa, Homo Sapiens
EDPEMEPVE

SEQ ID NO: 1286449 - protein, 9 aa, Homo Sapiens
WTTFLKASL

SEQ ID NO: 1286450 - protein, 9 aa, Homo Sapiens
NMALQMSNL

SEQ ID NO: 1286451 - protein, 9 aa, Homo Sapiens
CIGVPIMLA

SEQ ID NO: 1286452 - protein, 9 aa, Homo Sapiens
CMLHTVTLC

SEQ ID NO: 1286453 - protein, 9 aa, Homo Sapiens
CFCDSSTDG

SEQ ID NO: 1286454 - protein, 9 aa, Homo Sapiens
NNYNEFCRL

SEQ ID NO: 1286455 - protein, 9 aa, Homo Sapiens
PWSHAMYVP

SEQ ID NO: 1286456 - protein, 9 aa, Homo Sapiens
KGLGGNVWL

SEQ ID NO: 1286457 - protein, 9 aa, Homo Sapiens
EIFMALEGE

SEQ ID NO: 1286458 - protein, 9 aa, Homo Sapiens
LHLFKAVSS

SEQ ID NO: 1286459 - protein, 9 aa, Homo Sapiens
KYFVTFQYP

SEQ ID NO: 1286460 - protein, 9 aa, Homo Sapiens
HHYPFSGIF

SEQ ID NO: 1286461 - protein, 9 aa, Homo Sapiens
RRNPLGDLI

SEQ ID NO: 1286462 - protein, 9 aa, Homo Sapiens
KFFVNLKSM

SEQ ID NO: 1286463 - protein, 9 aa, Homo Sapiens
VVFNIVLWI

SEQ ID NO: 1286464 - protein, 9 aa, Homo Sapiens
KHGKEYTLR

SEQ ID NO: 1286465 - protein, 9 aa, Homo Sapiens
RLIRLLLYN

SEQ ID NO: 1286466 - protein, 9 aa, Homo Sapiens
QHGIHDVLT

SEQ ID NO: 1286467 - protein, 9 aa, Homo Sapiens
AHLHTLVME

SEQ ID NO: 1286468 - protein, 9 aa, Homo Sapiens
KSQLEISTK

SEQ ID NO: 1286469 - protein, 9 aa, Homo Sapiens
IPLKLDNLQ

SEQ ID NO: 1286470 - protein, 9 aa, Homo Sapiens
NKFGGPLDQ

SEQ ID NO: 1286471 - protein, 9 aa, Homo Sapiens
IALLHVWSF

SEQ ID NO: 1286472 - protein, 9 aa, Homo Sapiens
WKERWLVAW

SEQ ID NO: 1286473 - protein, 9 aa, Homo Sapiens
ENPGIDICD

SEQ ID NO: 1286474 - protein, 9 aa, Homo Sapiens
MYNLCHLLS

SEQ ID NO: 1286475 - protein, 9 aa, Homo Sapiens
DWVSPLKPN

SEQ ID NO: 1286476 - protein, 9 aa, Homo Sapiens
QDIGNKGQP

SEQ ID NO: 1286477 - protein, 9 aa, Homo Sapiens
SIENVFLCT

SEQ ID NO: 1286478 - protein, 9 aa, Homo Sapiens
TAYSLHKPQ

SEQ ID NO: 1286479 - protein, 9 aa, Homo Sapiens
HGKEYTLRL

SEQ ID NO: 1286480 - protein, 9 aa, Homo Sapiens
NMVEENTYR

SEQ ID NO: 1286481 - protein, 9 aa, Homo Sapiens
ASWVLFSLS

SEQ ID NO: 1286482 - protein, 9 aa, Homo Sapiens
QCHKWPNPD

SEQ ID NO: 1286483 - protein, 9 aa, Homo Sapiens
SYTGKELPQ

SEQ ID NO: 1286484 - protein, 9 aa, Homo Sapiens
KQGQIELVI

SEQ ID NO: 1286485 - protein, 9 aa, Homo Sapiens
VVIHTLAKE

SEQ ID NO: 1286486 - protein, 9 aa, Homo Sapiens
EGILANCVL

SEQ ID NO: 1286487 - protein, 9 aa, Homo Sapiens
IIFTDSSGM

SEQ ID NO: 1286488 - protein, 9 aa, Homo Sapiens
KKMCIEKLD

SEQ ID NO: 1286489 - protein, 9 aa, Homo Sapiens
HATANATVA

SEQ ID NO: 1286490 - protein, 9 aa, Homo Sapiens
DNKNCTYEF

SEQ ID NO: 1286491 - protein, 9 aa, Homo Sapiens
LVCLDEDIY

SEQ ID NO: 1286492 - protein, 9 aa, Homo Sapiens
MCPLMVLFC

SEQ ID NO: 1286493 - protein, 9 aa, Homo Sapiens
NNTLAEMSK

SEQ ID NO: 1286494 - protein, 9 aa, Homo Sapiens
SSTLNTHKK

SEQ ID NO: 1286495 - protein, 9 aa, Homo Sapiens
NFYPKWTIS

SEQ ID NO: 1286496 - protein, 9 aa, Homo Sapiens
EHVNGNCTE

SEQ ID NO: 1286497 - protein, 9 aa, Homo Sapiens
HETSNSDMQ

SEQ ID NO: 1286498 - protein, 9 aa, Homo Sapiens
DKISTPETP

SEQ ID NO: 1286499 - protein, 9 aa, Homo Sapiens
RYDGDSIKK

SEQ ID NO: 1286500 - protein, 9 aa, Homo Sapiens
NPNKVSPAS

SEQ ID NO: 1286501 - protein, 9 aa, Homo Sapiens
LGLKYVCPC

SEQ ID NO: 1286502 - protein, 9 aa, Homo Sapiens
KKAEEKELL

SEQ ID NO: 1286503 - protein, 9 aa, Homo Sapiens
LQIDWVSPL

SEQ ID NO: 1286504 - protein, 9 aa, Homo Sapiens
CELAKLAGA

SEQ ID NO: 1286505 - protein, 9 aa, Homo Sapiens
TIIVVDASG

SEQ ID NO: 1286506 - protein, 9 aa, Homo Sapiens
DLPQIINKM

SEQ ID NO: 1286507 - protein, 9 aa, Homo Sapiens
IIVTSIAML

SEQ ID NO: 1286508 - protein, 9 aa, Homo Sapiens
GMSSKEIYY

SEQ ID NO: 1286509 - protein, 9 aa, Homo Sapiens
TPIYFLLSQ

SEQ ID NO: 1286510 - protein, 9 aa, Homo Sapiens
KSGNSRTAN

SEQ ID NO: 1286511 - protein, 9 aa, Homo Sapiens
GIPNTDRCH

SEQ ID NO: 1286512 - protein, 9 aa, Homo Sapiens
ARLGGWTST

SEQ ID NO: 1286513 - protein, 9 aa, Homo Sapiens
YLFKNNANR

SEQ ID NO: 1286514 - protein, 9 aa, Homo Sapiens
KTILESSYL

SEQ ID NO: 1286515 - protein, 9 aa, Homo Sapiens
SSLEQFKAI

SEQ ID NO: 1286516 - protein, 9 aa, Homo Sapiens
DELYLSMPK

SEQ ID NO: 1286517 - protein, 9 aa, Homo Sapiens
WVSPLKPNG

SEQ ID NO: 1286518 - protein, 9 aa, Homo Sapiens
FDRVFHCNE

SEQ ID NO: 1286519 - protein, 9 aa, Homo Sapiens
ARQTEGKGL

SEQ ID NO: 1286520 - protein, 9 aa, Homo Sapiens
TGVYRDLFG

SEQ ID NO: 1286521 - protein, 9 aa, Homo Sapiens
RRRREAMVC

SEQ ID NO: 1286522 - protein, 9 aa, Homo Sapiens
QERSFIFIN

SEQ ID NO: 1286523 - protein, 9 aa, Homo Sapiens
RNRKNKMSI

SEQ ID NO: 1286524 - protein, 9 aa, Homo Sapiens
DGNTCTQTN

SEQ ID NO: 1286525 - protein, 9 aa, Homo Sapiens
EFQDIGNKG

SEQ ID NO: 1286526 - protein, 9 aa, Homo Sapiens
LYLICQRCN

SEQ ID NO: 1286527 - protein, 9 aa, Homo Sapiens
SAFGTLSHS

SEQ ID NO: 1286528 - protein, 9 aa, Homo Sapiens
SQVTQLTVE

SEQ ID NO: 1286529 - protein, 9 aa, Homo Sapiens
LFGIIVRMK

SEQ ID NO: 1286530 - protein, 9 aa, Homo Sapiens
LSFFSNQYY

SEQ ID NO: 1286531 - protein, 9 aa, Homo Sapiens
NEWSHIFCV

SEQ ID NO: 1286532 - protein, 9 aa, Homo Sapiens
IYNEALYDI

SEQ ID NO: 1286533 - protein, 9 aa, Homo Sapiens
PNDRVGLIH

SEQ ID NO: 1286534 - protein, 9 aa, Homo Sapiens
ECNHSFNNC

SEQ ID NO: 1286535 - protein, 9 aa, Homo Sapiens
IEQETLQQY

SEQ ID NO: 1286536 - protein, 9 aa, Homo Sapiens
PSVIHPKTD

SEQ ID NO: 1286537 - protein, 9 aa, Homo Sapiens
KLNALRKSC

SEQ ID NO: 1286538 - protein, 9 aa, Homo Sapiens
TAGGKKTED

SEQ ID NO: 1286539 - protein, 9 aa, Homo Sapiens
LRAHETVPS

SEQ ID NO: 1286540 - protein, 9 aa, Homo Sapiens
WSKLDHGIK

SEQ ID NO: 1286541 - protein, 9 aa, Homo Sapiens
IKILSELFE

SEQ ID NO: 1286542 - protein, 9 aa, Homo Sapiens
WIIKESNIL

SEQ ID NO: 1286543 - protein, 9 aa, Homo Sapiens
CVQGQCIAA

SEQ ID NO: 1286544 - protein, 9 aa, Homo Sapiens
TTYLDVQLC

SEQ ID NO: 1286545 - protein, 9 aa, Homo Sapiens
MAETSCPQE

SEQ ID NO: 1286546 - protein, 9 aa, Homo Sapiens
PLKMCGRKV

SEQ ID NO: 1286547 - protein, 9 aa, Homo Sapiens
PNIVIRIYN

SEQ ID NO: 1286548 - protein, 9 aa, Homo Sapiens
IIFTKAEDN

SEQ ID NO: 1286549 - protein, 9 aa, Homo Sapiens
WKLGDMRWK

SEQ ID NO: 1286550 - protein, 9 aa, Homo Sapiens
CVHYYAVKD

SEQ ID NO: 1286551 - protein, 9 aa, Homo Sapiens
VIAEHANYS

SEQ ID NO: 1286552 - protein, 9 aa, Homo Sapiens
RLLYIMIEQ

SEQ ID NO: 1286553 - protein, 9 aa, Homo Sapiens
IVDLKSKCK

SEQ ID NO: 1286554 - protein, 9 aa, Homo Sapiens
QSHHTPLEG

SEQ ID NO: 1286555 - protein, 9 aa, Homo Sapiens
LPQTKGETS

SEQ ID NO: 1286556 - protein, 9 aa, Homo Sapiens
LIDRDCHIK

SEQ ID NO: 1286557 - protein, 9 aa, Homo Sapiens
LHIYVSFLD

SEQ ID NO: 1286558 - protein, 9 aa, Homo Sapiens
CQFTTLCGV

SEQ ID NO: 1286559 - protein, 9 aa, Homo Sapiens
LGGWTSTLK

SEQ ID NO: 1286560 - protein, 9 aa, Homo Sapiens
TWNCDKSSI

SEQ ID NO: 1286561 - protein, 9 aa, Homo Sapiens
ELLTKIQHI

SEQ ID NO: 1286562 - protein, 9 aa, Homo Sapiens
TFEIAISNK

SEQ ID NO: 1286563 - protein, 9 aa, Homo Sapiens
LFVELEFGM

SEQ ID NO: 1286564 - protein, 9 aa, Homo Sapiens
GNSQTKVKC

SEQ ID NO: 1286565 - protein, 9 aa, Homo Sapiens
QIDWVSPLK

SEQ ID NO: 1286566 - protein, 9 aa, Homo Sapiens
QIYEMLKSS

SEQ ID NO: 1286567 - protein, 9 aa, Homo Sapiens
VDLEMLKVS

SEQ ID NO: 1286568 - protein, 9 aa, Homo Sapiens
TPAHSIPWS

SEQ ID NO: 1286569 - protein, 9 aa, Homo Sapiens
FCNDARFIR

SEQ ID NO: 1286570 - protein, 9 aa, Homo Sapiens
TYALLCHDD

SEQ ID NO: 1286571 - protein, 9 aa, Homo Sapiens
SFNTAVKNS

SEQ ID NO: 1286572 - protein, 9 aa, Homo Sapiens
CLSCSHALA

SEQ ID NO: 1286573 - protein, 9 aa, Homo Sapiens
GIFGHWRTH

SEQ ID NO: 1286574 - protein, 9 aa, Homo Sapiens
AQKQLRYII

SEQ ID NO: 1286575 - protein, 9 aa, Homo Sapiens
EPSLRCVLQ

SEQ ID NO: 1286576 - protein, 9 aa, Homo Sapiens
FAPHAKQRA

SEQ ID NO: 1286577 - protein, 9 aa, Homo Sapiens
CYPQIVDVS

SEQ ID NO: 1286578 - protein, 9 aa, Homo Sapiens
NHNKGLTYK

SEQ ID NO: 1286579 - protein, 9 aa, Homo Sapiens
IPWSHAMYV

SEQ ID NO: 1286580 - protein, 9 aa, Homo Sapiens
AHEQDGLAV

SEQ ID NO: 1286581 - protein, 9 aa, Homo Sapiens
FSRCSQTLV

SEQ ID NO: 1286582 - protein, 9 aa, Homo Sapiens
YCVALTKAN

SEQ ID NO: 1286583 - protein, 9 aa, Homo Sapiens
KFDEVFYFE

SEQ ID NO: 1286584 - protein, 9 aa, Homo Sapiens
SDNVNKYIG

SEQ ID NO: 1286585 - protein, 9 aa, Homo Sapiens
VDYSDGSKE

SEQ ID NO: 1286586 - protein, 9 aa, Homo Sapiens
ADYSLYNEP

SEQ ID NO: 1286587 - protein, 9 aa, Homo Sapiens
VSLTESCLS

SEQ ID NO: 1286588 - protein, 9 aa, Homo Sapiens
DDFSTTGTA

SEQ ID NO: 1286589 - protein, 9 aa, Homo Sapiens
LKFFVNLKS

SEQ ID NO: 1286590 - protein, 9 aa, Homo Sapiens
DKIIFTKAE

SEQ ID NO: 1286591 - protein, 9 aa, Homo Sapiens
LSFRINSED

SEQ ID NO: 1286592 - protein, 9 aa, Homo Sapiens
LNATYIVTF

SEQ ID NO: 1286593 - protein, 9 aa, Homo Sapiens
DIPGHCQHC

SEQ ID NO: 1286594 - protein, 9 aa, Homo Sapiens
TLVLCSRLL

SEQ ID NO: 1286595 - protein, 9 aa, Homo Sapiens
RNVNFNCSA

SEQ ID NO: 1286596 - protein, 9 aa, Homo Sapiens
DANRTATSG

SEQ ID NO: 1286597 - protein, 9 aa, Homo Sapiens
NKYRSLLET

SEQ ID NO: 1286598 - protein, 9 aa, Homo Sapiens
ENEKSYASI

SEQ ID NO: 1286599 - protein, 9 aa, Homo Sapiens
NAIVGAIPY

SEQ ID NO: 1286600 - protein, 9 aa, Homo Sapiens
PDSVGLPHC

SEQ ID NO: 1286601 - protein, 9 aa, Homo Sapiens
DLHPTKKHC

SEQ ID NO: 1286602 - protein, 9 aa, Homo Sapiens
KHMNQTLQD

SEQ ID NO: 1286603 - protein, 9 aa, Homo Sapiens
PVNRTIYLI

SEQ ID NO: 1286604 - protein, 9 aa, Homo Sapiens
GDDAQKRKD

SEQ ID NO: 1286605 - protein, 9 aa, Homo Sapiens
DGGTKVIDT

SEQ ID NO: 1286606 - protein, 9 aa, Homo Sapiens
WRCDHILVG

SEQ ID NO: 1286607 - protein, 9 aa, Homo Sapiens
GHYASKNKE

SEQ ID NO: 1286608 - protein, 9 aa, Homo Sapiens
HCPDPSCKQ

SEQ ID NO: 1286609 - protein, 9 aa, Homo Sapiens
LEAKQAFQS

SEQ ID NO: 1286610 - protein, 9 aa, Homo Sapiens
VEHALMALK

SEQ ID NO: 1286611 - protein, 9 aa, Homo Sapiens
DCSKSTHEE

SEQ ID NO: 1286612 - protein, 9 aa, Homo Sapiens
IPKPAMYNK

SEQ ID NO: 1286613 - protein, 9 aa, Homo Sapiens
TMKGDAIDY

SEQ ID NO: 1286614 - protein, 9 aa, Homo Sapiens
SRGDCEVLG

SEQ ID NO: 1286615 - protein, 9 aa, Homo Sapiens
CSLVKMTRN

SEQ ID NO: 1286616 - protein, 9 aa, Homo Sapiens
YFPLPYQAE

SEQ ID NO: 1286617 - protein, 9 aa, Homo Sapiens
FPTSCDEYS

SEQ ID NO: 1286618 - protein, 9 aa, Homo Sapiens
ANIFVQSSS

SEQ ID NO: 1286619 - protein, 9 aa, Homo Sapiens
IWVYTSGKG

SEQ ID NO: 1286620 - protein, 9 aa, Homo Sapiens
CDLMTNKLP

SEQ ID NO: 1286621 - protein, 9 aa, Homo Sapiens
KNEGGFTSK

SEQ ID NO: 1286622 - protein, 9 aa, Homo Sapiens
SESAEQSEK

SEQ ID NO: 1286623 - protein, 9 aa, Homo Sapiens
INTLQDIVE

SEQ ID NO: 1286624 - protein, 9 aa, Homo Sapiens
AALKETLLL

SEQ ID NO: 1286625 - protein, 9 aa, Homo Sapiens
LLSDFVAAQ

SEQ ID NO: 1286626 - protein, 9 aa, Homo Sapiens
SSGMSAVGH

SEQ ID NO: 1286627 - protein, 9 aa, Homo Sapiens
VDCSKSTHE

SEQ ID NO: 1286628 - protein, 9 aa, Homo Sapiens
VLPKNVNIK

SEQ ID NO: 1286629 - protein, 9 aa, Homo Sapiens
HAASLGKLS

SEQ ID NO: 1286630 - protein, 9 aa, Homo Sapiens
LVIEYLLPP

SEQ ID NO: 1286631 - protein, 9 aa, Homo Sapiens
IKVAQRIDR

SEQ ID NO: 1286632 - protein, 9 aa, Homo Sapiens
FLKASLICS

SEQ ID NO: 1286633 - protein, 9 aa, Homo Sapiens
PSNSEKCSG

SEQ ID NO: 1286634 - protein, 9 aa, Homo Sapiens
GILSFFSNQ

SEQ ID NO: 1286635 - protein, 9 aa, Homo Sapiens
IVCIAKELI

SEQ ID NO: 1286636 - protein, 9 aa, Homo Sapiens
RINIGENPY

SEQ ID NO: 1286637 - protein, 9 aa, Homo Sapiens
WYSTVLNQT

SEQ ID NO: 1286638 - protein, 9 aa, Homo Sapiens
AFQDPVPIT

SEQ ID NO: 1286639 - protein, 9 aa, Homo Sapiens
LTTYLDVQL

SEQ ID NO: 1286640 - protein, 9 aa, Homo Sapiens
IRLCCEVLA

SEQ ID NO: 1286641 - protein, 9 aa, Homo Sapiens
MTAEQNESE

SEQ ID NO: 1286642 - protein, 9 aa, Homo Sapiens
PEDVEQPGW

SEQ ID NO: 1286643 - protein, 9 aa, Homo Sapiens
YPLKKLDFV

SEQ ID NO: 1286644 - protein, 9 aa, Homo Sapiens
HQKLISCRR

SEQ ID NO: 1286645 - protein, 9 aa, Homo Sapiens
LADIGYVHR

SEQ ID NO: 1286646 - protein, 9 aa, Homo Sapiens
ADIGNPVGQ

SEQ ID NO: 1286647 - protein, 9 aa, Homo Sapiens
KAKKEMHLL

SEQ ID NO: 1286648 - protein, 9 aa, Homo Sapiens
INFKFTNFP

SEQ ID NO: 1286649 - protein, 9 aa, Homo Sapiens
IHNEISWEC

SEQ ID NO: 1286650 - protein, 9 aa, Homo Sapiens
IHDVLTVHL

SEQ ID NO: 1286651 - protein, 9 aa, Homo Sapiens
EIMSLWVKI

SEQ ID NO: 1286652 - protein, 9 aa, Homo Sapiens
TSSPTISSY

SEQ ID NO: 1286653 - protein, 9 aa, Homo Sapiens
ANCVLSRDG

SEQ ID NO: 1286654 - protein, 9 aa, Homo Sapiens
SRQSLKVLE

SEQ ID NO: 1286655 - protein, 9 aa, Homo Sapiens
FISLDLPLS

SEQ ID NO: 1286656 - protein, 9 aa, Homo Sapiens
YIFLCIQNY

SEQ ID NO: 1286657 - protein, 9 aa, Homo Sapiens
SVELNQTQK

SEQ ID NO: 1286658 - protein, 9 aa, Homo Sapiens
MPHQGPWQR

SEQ ID NO: 1286659 - protein, 9 aa, Homo Sapiens
LQDMAEHDV

SEQ ID NO: 1286660 - protein, 9 aa, Homo Sapiens
LKKLDFVAI

SEQ ID NO: 1286661 - protein, 9 aa, Homo Sapiens
KNKKGTDIW

SEQ ID NO: 1286662 - protein, 9 aa, Homo Sapiens
MLLDNCLLY

SEQ ID NO: 1286663 - protein, 9 aa, Homo Sapiens
AITDRYGLN

SEQ ID NO: 1286664 - protein, 9 aa, Homo Sapiens
STEDCIKRI

SEQ ID NO: 1286665 - protein, 9 aa, Homo Sapiens
NNDTFDLHG

SEQ ID NO: 1286666 - protein, 9 aa, Homo Sapiens
DDSCISSSA

SEQ ID NO: 1286667 - protein, 9 aa, Homo Sapiens
LNTLENSTE

SEQ ID NO: 1286668 - protein, 9 aa, Homo Sapiens
TYCIYNEAL

SEQ ID NO: 1286669 - protein, 9 aa, Homo Sapiens
KMLLFPYGY

SEQ ID NO: 1286670 - protein, 9 aa, Homo Sapiens
DVKDIEGVE

SEQ ID NO: 1286671 - protein, 9 aa, Homo Sapiens
CDRCGKLPL

SEQ ID NO: 1286672 - protein, 9 aa, Homo Sapiens
NCSAGTPVM

SEQ ID NO: 1286673 - protein, 9 aa, Homo Sapiens
HIFPVRMIK

SEQ ID NO: 1286674 - protein, 9 aa, Homo Sapiens
DNPNIVIRI

SEQ ID NO: 1286675 - protein, 9 aa, Homo Sapiens
DILDIYECV

SEQ ID NO: 1286676 - protein, 9 aa, Homo Sapiens
IATLLVNTT

SEQ ID NO: 1286677 - protein, 9 aa, Homo Sapiens
NKVIELLQE

SEQ ID NO: 1286678 - protein, 9 aa, Homo Sapiens
WRNVLFDSS

SEQ ID NO: 1286679 - protein, 9 aa, Homo Sapiens
EEVLSTPSD

SEQ ID NO: 1286680 - protein, 9 aa, Homo Sapiens
LTKKCRNWL

SEQ ID NO: 1286681 - protein, 9 aa, Homo Sapiens
EKCSPIWVY

SEQ ID NO: 1286682 - protein, 9 aa, Homo Sapiens
SVEHLTTFV

SEQ ID NO: 1286683 - protein, 9 aa, Homo Sapiens
ADSVGTDNF

SEQ ID NO: 1286684 - protein, 9 aa, Homo Sapiens
CTQLMYSLV

SEQ ID NO: 1286685 - protein, 9 aa, Homo Sapiens
ISGCGFSNV

SEQ ID NO: 1286686 - protein, 9 aa, Homo Sapiens
YRARTLPII

SEQ ID NO: 1286687 - protein, 9 aa, Homo Sapiens
EKFHTNLLH

SEQ ID NO: 1286688 - protein, 9 aa, Homo Sapiens
YTTNNMHAI

SEQ ID NO: 1286689 - protein, 9 aa, Homo Sapiens
KVVGHISGL

SEQ ID NO: 1286690 - protein, 9 aa, Homo Sapiens
KKKRGPEVQ

SEQ ID NO: 1286691 - protein, 9 aa, Homo Sapiens
GNISDHGLQ

SEQ ID NO: 1286692 - protein, 9 aa, Homo Sapiens
NSNKNVDCS

SEQ ID NO: 1286693 - protein, 9 aa, Homo Sapiens
LFEEELTSK

SEQ ID NO: 1286694 - protein, 9 aa, Homo Sapiens
LDFKLVPHS

SEQ ID NO: 1286695 - protein, 9 aa, Homo Sapiens
EAEFHKHDY

SEQ ID NO: 1286696 - protein, 9 aa, Homo Sapiens
RKGYSHTHR

SEQ ID NO: 1286697 - protein, 9 aa, Homo Sapiens
YILYILPDT

SEQ ID NO: 1286698 - protein, 9 aa, Homo Sapiens
LQEVSQLNK

SEQ ID NO: 1286699 - protein, 9 aa, Homo Sapiens
TVYAMVFMV

SEQ ID NO: 1286700 - protein, 9 aa, Homo Sapiens
QDGLAVLGV

SEQ ID NO: 1286701 - protein, 9 aa, Homo Sapiens
GAIPYTCYP

SEQ ID NO: 1286702 - protein, 9 aa, Homo Sapiens
LRDCFNIFT

SEQ ID NO: 1286703 - protein, 9 aa, Homo Sapiens
LQEKHGQYG

SEQ ID NO: 1286704 - protein, 9 aa, Homo Sapiens
TTQKVKKDK

SEQ ID NO: 1286705 - protein, 9 aa, Homo Sapiens
TYIDLILPD

SEQ ID NO: 1286706 - protein, 9 aa, Homo Sapiens
MQIIQLHVL

SEQ ID NO: 1286707 - protein, 9 aa, Homo Sapiens
KNCELDNNQ

SEQ ID NO: 1286708 - protein, 9 aa, Homo Sapiens
TLQQYGVCC

SEQ ID NO: 1286709 - protein, 9 aa, Homo Sapiens
GSYCVVYEA

SEQ ID NO: 1286710 - protein, 9 aa, Homo Sapiens
DLKMYKVEF

SEQ ID NO: 1286711 - protein, 9 aa, Homo Sapiens
AVLKAFANG

SEQ ID NO: 1286712 - protein, 9 aa, Homo Sapiens
TLRTETCVT

SEQ ID NO: 1286713 - protein, 9 aa, Homo Sapiens
PKPSNSEKC

SEQ ID NO: 1286714 - protein, 9 aa, Homo Sapiens
LNYLRHVQL

SEQ ID NO: 1286715 - protein, 9 aa, Homo Sapiens
LRKSKELQG

SEQ ID NO: 1286716 - protein, 9 aa, Homo Sapiens
KAQLMLLYP

SEQ ID NO: 1286717 - protein, 9 aa, Homo Sapiens
LGSKQSEHS

SEQ ID NO: 1286718 - protein, 9 aa, Homo Sapiens
LSRDIRYKS

SEQ ID NO: 1286719 - protein, 9 aa, Homo Sapiens
EQRNLDKTC

SEQ ID NO: 1286720 - protein, 9 aa, Homo Sapiens
VEHSAPKLE

SEQ ID NO: 1286721 - protein, 9 aa, Homo Sapiens
KAYDHENRN

SEQ ID NO: 1286722 - protein, 9 aa, Homo Sapiens
GPVQHLFKF

SEQ ID NO: 1286723 - protein, 9 aa, Homo Sapiens
SVLQNAHKQ

SEQ ID NO: 1286724 - protein, 9 aa, Homo Sapiens
SKEIYYDSF

SEQ ID NO: 1286725 - protein, 9 aa, Homo Sapiens
KLFYYYEVT

SEQ ID NO: 1286726 - protein, 9 aa, Homo Sapiens
YIILTHVIR

SEQ ID NO: 1286727 - protein, 9 aa, Homo Sapiens
SIFHVGSED

SEQ ID NO: 1286728 - protein, 9 aa, Homo Sapiens
QPSHRDLPR

SEQ ID NO: 1286729 - protein, 9 aa, Homo Sapiens
TPNGQLYYK

SEQ ID NO: 1286730 - protein, 9 aa, Homo Sapiens
LIKILSELF

SEQ ID NO: 1286731 - protein, 9 aa, Homo Sapiens
DLQAKIGMQ

SEQ ID NO: 1286732 - protein, 9 aa, Homo Sapiens
RHGSRITRL

SEQ ID NO: 1286733 - protein, 9 aa, Homo Sapiens
HTEDSEYEA

SEQ ID NO: 1286734 - protein, 9 aa, Homo Sapiens
EDYDIVILS

SEQ ID NO: 1286735 - protein, 9 aa, Homo Sapiens
LILYTATTK

SEQ ID NO: 1286736 - protein, 9 aa, Homo Sapiens
LEHWHQKEL

SEQ ID NO: 1286737 - protein, 9 aa, Homo Sapiens
DRCGKLPLS

SEQ ID NO: 1286738 - protein, 9 aa, Homo Sapiens
YGGHHYPFS

SEQ ID NO: 1286739 - protein, 9 aa, Homo Sapiens
IVTSIAMLV

SEQ ID NO: 1286740 - protein, 9 aa, Homo Sapiens
RNPHGFAFV

SEQ ID NO: 1286741 - protein, 9 aa, Homo Sapiens
YSWDSAQRT

SEQ ID NO: 1286742 - protein, 9 aa, Homo Sapiens
PEMYCYPDP

SEQ ID NO: 1286743 - protein, 9 aa, Homo Sapiens
HQPVTRPIS

SEQ ID NO: 1286744 - protein, 9 aa, Homo Sapiens
TLTKIKEKK

SEQ ID NO: 1286745 - protein, 9 aa, Homo Sapiens
PVTLRTETC

SEQ ID NO: 1286746 - protein, 9 aa, Homo Sapiens
EDAGNKGIL

SEQ ID NO: 1286747 - protein, 9 aa, Homo Sapiens
YISVIIAKN

SEQ ID NO: 1286748 - protein, 9 aa, Homo Sapiens
LCCVKIVVV

SEQ ID NO: 1286749 - protein, 9 aa, Homo Sapiens
FNCSAGTPV

SEQ ID NO: 1286750 - protein, 9 aa, Homo Sapiens
RKHIFPVRM

SEQ ID NO: 1286751 - protein, 9 aa, Homo Sapiens
QLKLSVAIA

SEQ ID NO: 1286752 - protein, 9 aa, Homo Sapiens
CDCCELPTV

SEQ ID NO: 1286753 - protein, 9 aa, Homo Sapiens
TKADGGTKV

SEQ ID NO: 1286754 - protein, 9 aa, Homo Sapiens
DGSSHPPQS

SEQ ID NO: 1286755 - protein, 9 aa, Homo Sapiens
NILIDRDCH

SEQ ID NO: 1286756 - protein, 9 aa, Homo Sapiens
TEASSWSES

SEQ ID NO: 1286757 - protein, 9 aa, Homo Sapiens
YISGCGFSN

SEQ ID NO: 1286758 - protein, 9 aa, Homo Sapiens
LALASVAIH

SEQ ID NO: 1286759 - protein, 9 aa, Homo Sapiens
CGYSLDLSL

SEQ ID NO: 1286760 - protein, 9 aa, Homo Sapiens
SYDFEDEYV

SEQ ID NO: 1286761 - protein, 9 aa, Homo Sapiens
LDTSVLFDP

SEQ ID NO: 1286762 - protein, 9 aa, Homo Sapiens
CFSFFMVAS

SEQ ID NO: 1286763 - protein, 9 aa, Homo Sapiens
LHKELNNLL

SEQ ID NO: 1286764 - protein, 9 aa, Homo Sapiens
DTKPPDGKS

SEQ ID NO: 1286765 - protein, 9 aa, Homo Sapiens
ARQIANHCP

SEQ ID NO: 1286766 - protein, 9 aa, Homo Sapiens
ITNSETLVL

SEQ ID NO: 1286767 - protein, 9 aa, Homo Sapiens
NKMRQHYDR

SEQ ID NO: 1286768 - protein, 9 aa, Homo Sapiens
VVLEELKPD

SEQ ID NO: 1286769 - protein, 9 aa, Homo Sapiens
GPKAQLMLL

SEQ ID NO: 1286770 - protein, 9 aa, Homo Sapiens
CWDSFALEK

SEQ ID NO: 1286771 - protein, 9 aa, Homo Sapiens
LYSPQQTQL

SEQ ID NO: 1286772 - protein, 9 aa, Homo Sapiens
LQLCSSGHK

SEQ ID NO: 1286773 - protein, 9 aa, Homo Sapiens
IFIDAILLS

SEQ ID NO: 1286774 - protein, 9 aa, Homo Sapiens
SDPNNYNEF

SEQ ID NO: 1286775 - protein, 9 aa, Homo Sapiens
HSRNISYCK

SEQ ID NO: 1286776 - protein, 9 aa, Homo Sapiens
LPGSYQCKC

SEQ ID NO: 1286777 - protein, 9 aa, Homo Sapiens
SFYCSIENV

SEQ ID NO: 1286778 - protein, 9 aa, Homo Sapiens
SLSLRAHET

SEQ ID NO: 1286779 - protein, 9 aa, Homo Sapiens
IENVFLCTG

SEQ ID NO: 1286780 - protein, 9 aa, Homo Sapiens
FFWEESDIM

SEQ ID NO: 1286781 - protein, 9 aa, Homo Sapiens
NSPPYILYI

SEQ ID NO: 1286782 - protein, 9 aa, Homo Sapiens
CMHAFPLTS

SEQ ID NO: 1286783 - protein, 9 aa, Homo Sapiens
TAGQELFRS

SEQ ID NO: 1286784 - protein, 9 aa, Homo Sapiens
LAKEFDIYR

SEQ ID NO: 1286785 - protein, 9 aa, Homo Sapiens
ETLLLYPVG

SEQ ID NO: 1286786 - protein, 9 aa, Homo Sapiens
VQDLGLELA

SEQ ID NO: 1286787 - protein, 9 aa, Homo Sapiens
QQLLDDQDV

SEQ ID NO: 1286788 - protein, 9 aa, Homo Sapiens
EIGQDLIHV

SEQ ID NO: 1286789 - protein, 9 aa, Homo Sapiens
WSRWIQYKG

SEQ ID NO: 1286790 - protein, 9 aa, Homo Sapiens
LIGTELGGL

SEQ ID NO: 1286791 - protein, 9 aa, Homo Sapiens
ECKNKSYSW

SEQ ID NO: 1286792 - protein, 9 aa, Homo Sapiens
IIKFWAKLS

SEQ ID NO: 1286793 - protein, 9 aa, Homo Sapiens
LLDDQDVKI

SEQ ID NO: 1286794 - protein, 9 aa, Homo Sapiens
SEPKRGKLS

SEQ ID NO: 1286795 - protein, 9 aa, Homo Sapiens
FGGPEMYCY

SEQ ID NO: 1286796 - protein, 9 aa, Homo Sapiens
IIKRDERMT

SEQ ID NO: 1286797 - protein, 9 aa, Homo Sapiens
ECYKGYILV

SEQ ID NO: 1286798 - protein, 9 aa, Homo Sapiens
IRAHATANA

SEQ ID NO: 1286799 - protein, 9 aa, Homo Sapiens
RKRKYDLRY

SEQ ID NO: 1286800 - protein, 9 aa, Homo Sapiens
SLEHLNICL

SEQ ID NO: 1286801 - protein, 9 aa, Homo Sapiens
KKNFLIKEI

SEQ ID NO: 1286802 - protein, 9 aa, Homo Sapiens
QDRLEQARQ

SEQ ID NO: 1286803 - protein, 9 aa, Homo Sapiens
KVIAYEAVK

SEQ ID NO: 1286804 - protein, 9 aa, Homo Sapiens
TSGDLHKHI

SEQ ID NO: 1286805 - protein, 9 aa, Homo Sapiens
FVVPNQTLT

SEQ ID NO: 1286806 - protein, 9 aa, Homo Sapiens
KENFTGENI

SEQ ID NO: 1286807 - protein, 9 aa, Homo Sapiens
QYSIKRSAF

SEQ ID NO: 1286808 - protein, 9 aa, Homo Sapiens
IDQALDAHH

SEQ ID NO: 1286809 - protein, 9 aa, Homo Sapiens
IGLITELQL

SEQ ID NO: 1286810 - protein, 9 aa, Homo Sapiens
TRAVDWLGL

SEQ ID NO: 1286811 - protein, 9 aa, Homo Sapiens
SLLETDHDR

SEQ ID NO: 1286812 - protein, 9 aa, Homo Sapiens
GYWVIVLEE

SEQ ID NO: 1286813 - protein, 9 aa, Homo Sapiens
MFGIRYYDY

SEQ ID NO: 1286814 - protein, 9 aa, Homo Sapiens
FALINMKLA

SEQ ID NO: 1286815 - protein, 9 aa, Homo Sapiens
LHTASSCFC

SEQ ID NO: 1286816 - protein, 9 aa, Homo Sapiens
KIKEKKKNE

SEQ ID NO: 1286817 - protein, 9 aa, Homo Sapiens
SASDVWMFC

SEQ ID NO: 1286818 - protein, 9 aa, Homo Sapiens
LKENFTGEN

SEQ ID NO: 1286819 - protein, 9 aa, Homo Sapiens
YTRDYICEF

SEQ ID NO: 1286820 - protein, 9 aa, Homo Sapiens
FRCGRTAFF

SEQ ID NO: 1286821 - protein, 9 aa, Homo Sapiens
SVQILGKAA

SEQ ID NO: 1286822 - protein, 9 aa, Homo Sapiens
PSLNTTVYA

SEQ ID NO: 1286823 - protein, 9 aa, Homo Sapiens
RKNCLMDHE

SEQ ID NO: 1286824 - protein, 9 aa, Homo Sapiens
FRIFIDAIL

SEQ ID NO: 1286825 - protein, 9 aa, Homo Sapiens
EMDLREVFS

SEQ ID NO: 1286826 - protein, 9 aa, Homo Sapiens
RNEPPQPRN

SEQ ID NO: 1286827 - protein, 9 aa, Homo Sapiens
VEKAKVIAY

SEQ ID NO: 1286828 - protein, 9 aa, Homo Sapiens
REKINNSDA

SEQ ID NO: 1286829 - protein, 9 aa, Homo Sapiens
CTLLCTPPR

SEQ ID NO: 1286830 - protein, 9 aa, Homo Sapiens
LFKEVRCMK

SEQ ID NO: 1286831 - protein, 9 aa, Homo Sapiens
HDYGDTLSS

SEQ ID NO: 1286832 - protein, 9 aa, Homo Sapiens
AIVMCAIPS

SEQ ID NO: 1286833 - protein, 9 aa, Homo Sapiens
NLEDPAIRW

SEQ ID NO: 1286834 - protein, 9 aa, Homo Sapiens
KVHLMKFSP

SEQ ID NO: 1286835 - protein, 9 aa, Homo Sapiens
MTLHTIEIA

SEQ ID NO: 1286836 - protein, 9 aa, Homo Sapiens
ELYLSMPKR

SEQ ID NO: 1286837 - protein, 9 aa, Homo Sapiens
GSNFSRCSQ

SEQ ID NO: 1286838 - protein, 9 aa, Homo Sapiens
LAQKQLRYI

SEQ ID NO: 1286839 - protein, 9 aa, Homo Sapiens
VGRIVQDLG

SEQ ID NO: 1286840 - protein, 9 aa, Homo Sapiens
YVKTFKGLK

SEQ ID NO: 1286841 - protein, 9 aa, Homo Sapiens
ADLPPINGQ

SEQ ID NO: 1286842 - protein, 9 aa, Homo Sapiens
EIVQDMGAG

SEQ ID NO: 1286843 - protein, 9 aa, Homo Sapiens
PSKKKYPEY

SEQ ID NO: 1286844 - protein, 9 aa, Homo Sapiens
LSLYTTEMD

SEQ ID NO: 1286845 - protein, 9 aa, Homo Sapiens
WDSFALEKS

SEQ ID NO: 1286846 - protein, 9 aa, Homo Sapiens
FFKLIHCSG

SEQ ID NO: 1286847 - protein, 9 aa, Homo Sapiens
HMTASNTQD

SEQ ID NO: 1286848 - protein, 9 aa, Homo Sapiens
LPGVFCGPY

SEQ ID NO: 1286849 - protein, 9 aa, Homo Sapiens
GDYTSRAKI

SEQ ID NO: 1286850 - protein, 9 aa, Homo Sapiens
YTVTINKDF

SEQ ID NO: 1286851 - protein, 9 aa, Homo Sapiens
IIYRDMKLD

SEQ ID NO: 1286852 - protein, 9 aa, Homo Sapiens
MTQQQRINI

SEQ ID NO: 1286853 - protein, 9 aa, Homo Sapiens
YINEDQILI

SEQ ID NO: 1286854 - protein, 9 aa, Homo Sapiens
EARSLLNTQ

SEQ ID NO: 1286855 - protein, 9 aa, Homo Sapiens
VSQIQSCVS

SEQ ID NO: 1286856 - protein, 9 aa, Homo Sapiens
NSLIWIHDI

SEQ ID NO: 1286857 - protein, 9 aa, Homo Sapiens
DDNEAPDSE

SEQ ID NO: 1286858 - protein, 9 aa, Homo Sapiens
DELEHSEPK

SEQ ID NO: 1286859 - protein, 9 aa, Homo Sapiens
KDIEGVEVK

SEQ ID NO: 1286860 - protein, 9 aa, Homo Sapiens
QDTQNKDIN

SEQ ID NO: 1286861 - protein, 9 aa, Homo Sapiens
LCMAETSCP

SEQ ID NO: 1286862 - protein, 9 aa, Homo Sapiens
NALVSYQLL

SEQ ID NO: 1286863 - protein, 9 aa, Homo Sapiens
TDTSSPTIS

SEQ ID NO: 1286864 - protein, 9 aa, Homo Sapiens
DMLLDNCLL

SEQ ID NO: 1286865 - protein, 9 aa, Homo Sapiens
IHDLYWKVK

SEQ ID NO: 1286866 - protein, 9 aa, Homo Sapiens
AGRGINSKV

SEQ ID NO: 1286867 - protein, 9 aa, Homo Sapiens
STQERSFIF

SEQ ID NO: 1286868 - protein, 9 aa, Homo Sapiens
RIHTVEKPY

SEQ ID NO: 1286869 - protein, 9 aa, Homo Sapiens
YPIVCIAKE

SEQ ID NO: 1286870 - protein, 9 aa, Homo Sapiens
EGEDPEMEP

SEQ ID NO: 1286871 - protein, 9 aa, Homo Sapiens
EQSQGTCMT

SEQ ID NO: 1286872 - protein, 9 aa, Homo Sapiens
CLECWDSFA

SEQ ID NO: 1286873 - protein, 9 aa, Homo Sapiens
ASNLTAITI

SEQ ID NO: 1286874 - protein, 9 aa, Homo Sapiens
EAHSSEDFN

SEQ ID NO: 1286875 - protein, 9 aa, Homo Sapiens
HCNWHKMGV

SEQ ID NO: 1286876 - protein, 9 aa, Homo Sapiens
SINQSADSV

SEQ ID NO: 1286877 - protein, 9 aa, Homo Sapiens
LGDMRWKNS

SEQ ID NO: 1286878 - protein, 9 aa, Homo Sapiens
NEGSTIEKM

SEQ ID NO: 1286879 - protein, 9 aa, Homo Sapiens
HTLAKEFDI

SEQ ID NO: 1286880 - protein, 9 aa, Homo Sapiens
VTVCIGVPI

SEQ ID NO: 1286881 - protein, 9 aa, Homo Sapiens
LTKIKEKKK

SEQ ID NO: 1286882 - protein, 9 aa, Homo Sapiens
KVLAVTENM

SEQ ID NO: 1286883 - protein, 9 aa, Homo Sapiens
MNLFNLDSF

SEQ ID NO: 1286884 - protein, 9 aa, Homo Sapiens
QAVLYNYRS

SEQ ID NO: 1286885 - protein, 9 aa, Homo Sapiens
SMKSLKELL

SEQ ID NO: 1286886 - protein, 9 aa, Homo Sapiens
KVSSIGTFR

SEQ ID NO: 1286887 - protein, 9 aa, Homo Sapiens
LKELRRVEH

SEQ ID NO: 1286888 - protein, 9 aa, Homo Sapiens
TLFDEKFYC

SEQ ID NO: 1286889 - protein, 9 aa, Homo Sapiens
IWNKCQRCT

SEQ ID NO: 1286890 - protein, 9 aa, Homo Sapiens
SQTLVNFGF

SEQ ID NO: 1286891 - protein, 9 aa, Homo Sapiens
LIWIHDIRH

SEQ ID NO: 1286892 - protein, 9 aa, Homo Sapiens
FGHWRTHLG

SEQ ID NO: 1286893 - protein, 9 aa, Homo Sapiens
HERTHTVEK

SEQ ID NO: 1286894 - protein, 9 aa, Homo Sapiens
MLKVHHLKK

SEQ ID NO: 1286895 - protein, 9 aa, Homo Sapiens
FTNWTEKVQ

SEQ ID NO: 1286896 - protein, 9 aa, Homo Sapiens
TREESEQRD

SEQ ID NO: 1286897 - protein, 9 aa, Homo Sapiens
CGISVILIF

SEQ ID NO: 1286898 - protein, 9 aa, Homo Sapiens
AKPPAQPSW

SEQ ID NO: 1286899 - protein, 9 aa, Homo Sapiens
IVTFDRTGL

SEQ ID NO: 1286900 - protein, 9 aa, Homo Sapiens
SSHPKPSNS

SEQ ID NO: 1286901 - protein, 9 aa, Homo Sapiens
KAWTNAATQ

SEQ ID NO: 1286902 - protein, 9 aa, Homo Sapiens
SQEKQPSHR

SEQ ID NO: 1286903 - protein, 9 aa, Homo Sapiens
IGTELGGLI

SEQ ID NO: 1286904 - protein, 9 aa, Homo Sapiens
INTGEKPYK

SEQ ID NO: 1286905 - protein, 9 aa, Homo Sapiens
YIIDLLSCT

SEQ ID NO: 1286906 - protein, 9 aa, Homo Sapiens
LKDSDEIMS

SEQ ID NO: 1286907 - protein, 9 aa, Homo Sapiens
PLKKLDFVA

SEQ ID NO: 1286908 - protein, 9 aa, Homo Sapiens
YPYVYSVKK

SEQ ID NO: 1286909 - protein, 9 aa, Homo Sapiens
TNLLHQICL

SEQ ID NO: 1286910 - protein, 9 aa, Homo Sapiens
NDLLLQVLL

SEQ ID NO: 1286911 - protein, 9 aa, Homo Sapiens
IPFDNPRLE

SEQ ID NO: 1286912 - protein, 9 aa, Homo Sapiens
EDLGLLVLY

SEQ ID NO: 1286913 - protein, 9 aa, Homo Sapiens
HKTSHTVEK

SEQ ID NO: 1286914 - protein, 9 aa, Homo Sapiens
GSVCDLMTN

SEQ ID NO: 1286915 - protein, 9 aa, Homo Sapiens
GQVISSLYH

SEQ ID NO: 1286916 - protein, 9 aa, Homo Sapiens
QQLEKGSHG

SEQ ID NO: 1286917 - protein, 9 aa, Homo Sapiens
ELDNNQRQC

SEQ ID NO: 1286918 - protein, 9 aa, Homo Sapiens
SPKAVKNTY

SEQ ID NO: 1286919 - protein, 9 aa, Homo Sapiens
TQKVKKDKQ

SEQ ID NO: 1286920 - protein, 9 aa, Homo Sapiens
LVCIPTSFH

SEQ ID NO: 1286921 - protein, 9 aa, Homo Sapiens
QTKGETSGN

SEQ ID NO: 1286922 - protein, 9 aa, Homo Sapiens
RVNRVNKCL

SEQ ID NO: 1286923 - protein, 9 aa, Homo Sapiens
TGKTMRKNQ

SEQ ID NO: 1286924 - protein, 9 aa, Homo Sapiens
GKKTEDVEC

SEQ ID NO: 1286925 - protein, 9 aa, Homo Sapiens
LYSSLEQFK

SEQ ID NO: 1286926 - protein, 9 aa, Homo Sapiens
EKLHKSHIL

SEQ ID NO: 1286927 - protein, 9 aa, Homo Sapiens
YFVTFQYPY

SEQ ID NO: 1286928 - protein, 9 aa, Homo Sapiens
CNEAIWKYL

SEQ ID NO: 1286929 - protein, 9 aa, Homo Sapiens
HHRKAVSDM

SEQ ID NO: 1286930 - protein, 9 aa, Homo Sapiens
NIDNILDKE

SEQ ID NO: 1286931 - protein, 9 aa, Homo Sapiens
YNSAVLGIS

SEQ ID NO: 1286932 - protein, 9 aa, Homo Sapiens
RTLPIINAS

SEQ ID NO: 1286933 - protein, 9 aa, Homo Sapiens
YISNNTLAE

SEQ ID NO: 1286934 - protein, 9 aa, Homo Sapiens
LCIQNYLFE

SEQ ID NO: 1286935 - protein, 9 aa, Homo Sapiens
TGRKIDPVC

SEQ ID NO: 1286936 - protein, 9 aa, Homo Sapiens
DEFQYQMEM

SEQ ID NO: 1286937 - protein, 9 aa, Homo Sapiens
TNLEHKIYA

SEQ ID NO: 1286938 - protein, 9 aa, Homo Sapiens
PDTATVKKV

SEQ ID NO: 1286939 - protein, 9 aa, Homo Sapiens
TRILSIAAE

SEQ ID NO: 1286940 - protein, 9 aa, Homo Sapiens
NEVKSMLYS

SEQ ID NO: 1286941 - protein, 9 aa, Homo Sapiens
ALTKKCRNW

SEQ ID NO: 1286942 - protein, 9 aa, Homo Sapiens
LDAHHRKAV

SEQ ID NO: 1286943 - protein, 9 aa, Homo Sapiens
VPLKEAPQQ

SEQ ID NO: 1286944 - protein, 9 aa, Homo Sapiens
INEDQILIN

SEQ ID NO: 1286945 - protein, 9 aa, Homo Sapiens
LIHTEDQFN

SEQ ID NO: 1286946 - protein, 9 aa, Homo Sapiens
EHFSGEPSE

SEQ ID NO: 1286947 - protein, 9 aa, Homo Sapiens
VKNTYGKQD

SEQ ID NO: 1286948 - protein, 9 aa, Homo Sapiens
AVLVYWRVC

SEQ ID NO: 1286949 - protein, 9 aa, Homo Sapiens
KMTRNRSKE

SEQ ID NO: 1286950 - protein, 9 aa, Homo Sapiens
SYPAVPCEY

SEQ ID NO: 1286951 - protein, 9 aa, Homo Sapiens
PSWLINLAA

SEQ ID NO: 1286952 - protein, 9 aa, Homo Sapiens
PKLGSGKDS

SEQ ID NO: 1286953 - protein, 9 aa, Homo Sapiens
CVCMWEILM

SEQ ID NO: 1286954 - protein, 9 aa, Homo Sapiens
SKDSDNELV

SEQ ID NO: 1286955 - protein, 9 aa, Homo Sapiens
AYLQDMAEH

SEQ ID NO: 1286956 - protein, 9 aa, Homo Sapiens
LKKAQGIAQ

SEQ ID NO: 1286957 - protein, 9 aa, Homo Sapiens
QFPNTDIEE

SEQ ID NO: 1286958 - protein, 9 aa, Homo Sapiens
DNPDFSDEE

SEQ ID NO: 1286959 - protein, 9 aa, Homo Sapiens
EVVIVEEAH

SEQ ID NO: 1286960 - protein, 9 aa, Homo Sapiens
ELHISMIQL

SEQ ID NO: 1286961 - protein, 9 aa, Homo Sapiens
QHVSRQTSG

SEQ ID NO: 1286962 - protein, 9 aa, Homo Sapiens
RESEYKHVY

SEQ ID NO: 1286963 - protein, 9 aa, Homo Sapiens
EYYMGSVQR

SEQ ID NO: 1286964 - protein, 9 aa, Homo Sapiens
PQHVFSVFE

SEQ ID NO: 1286965 - protein, 9 aa, Homo Sapiens
GTDIWLGVD

SEQ ID NO: 1286966 - protein, 9 aa, Homo Sapiens
CVNRSLPLW

SEQ ID NO: 1286967 - protein, 9 aa, Homo Sapiens
QKDSVCWVS

SEQ ID NO: 1286968 - protein, 9 aa, Homo Sapiens
EEAKVELQR

SEQ ID NO: 1286969 - protein, 9 aa, Homo Sapiens
QLLHEARLY

SEQ ID NO: 1286970 - protein, 9 aa, Homo Sapiens
EIMTVHNDP

SEQ ID NO: 1286971 - protein, 9 aa, Homo Sapiens
QILGKAAIG

SEQ ID NO: 1286972 - protein, 9 aa, Homo Sapiens
AYSLHKPQG

SEQ ID NO: 1286973 - protein, 9 aa, Homo Sapiens
CGRKVEFPT

SEQ ID NO: 1286974 - protein, 9 aa, Homo Sapiens
LRPNDRVGL

SEQ ID NO: 1286975 - protein, 9 aa, Homo Sapiens
CECTDNAYI

SEQ ID NO: 1286976 - protein, 9 aa, Homo Sapiens
YLQKNSMSC

SEQ ID NO: 1286977 - protein, 9 aa, Homo Sapiens
GLIGKKMCI

SEQ ID NO: 1286978 - protein, 9 aa, Homo Sapiens
NLKKALNRF

SEQ ID NO: 1286979 - protein, 9 aa, Homo Sapiens
YSGKASRSL

SEQ ID NO: 1286980 - protein, 9 aa, Homo Sapiens
TDLGTSSQV

SEQ ID NO: 1286981 - protein, 9 aa, Homo Sapiens
DPEMEPVEN

SEQ ID NO: 1286982 - protein, 9 aa, Homo Sapiens
EIAYPTYEV

SEQ ID NO: 1286983 - protein, 9 aa, Homo Sapiens
TENMLASAD

SEQ ID NO: 1286984 - protein, 9 aa, Homo Sapiens
SDMPPSSQS

SEQ ID NO: 1286985 - protein, 9 aa, Homo Sapiens
IEKMEFKKS

SEQ ID NO: 1286986 - protein, 9 aa, Homo Sapiens
IEAIVKVSF

SEQ ID NO: 1286987 - protein, 9 aa, Homo Sapiens
PCFFSHLPS

SEQ ID NO: 1286988 - protein, 9 aa, Homo Sapiens
ASKNKEFLK

SEQ ID NO: 1286989 - protein, 9 aa, Homo Sapiens
CVCAFNILV

SEQ ID NO: 1286990 - protein, 9 aa, Homo Sapiens
TGRLCITHL

SEQ ID NO: 1286991 - protein, 9 aa, Homo Sapiens
KGGNTMKGD

SEQ ID NO: 1286992 - protein, 9 aa, Homo Sapiens
LPYNINEGQ

SEQ ID NO: 1286993 - protein, 9 aa, Homo Sapiens
TSDTAEIVL

SEQ ID NO: 1286994 - protein, 9 aa, Homo Sapiens
VAVEHALMA

SEQ ID NO: 1286995 - protein, 9 aa, Homo Sapiens
SNDLLLQVL

SEQ ID NO: 1286996 - protein, 9 aa, Homo Sapiens
CGVDVDQDW

SEQ ID NO: 1286997 - protein, 9 aa, Homo Sapiens
DIMKRNRDL

SEQ ID NO: 1286998 - protein, 9 aa, Homo Sapiens
MNDNRHEFL

SEQ ID NO: 1286999 - protein, 9 aa, Homo Sapiens
VVGHISGLQ

SEQ ID NO: 1287000 - protein, 9 aa, Homo Sapiens
HTRCTLEAG

SEQ ID NO: 1287001 - protein, 9 aa, Homo Sapiens
LLELLFHSI

SEQ ID NO: 1287002 - protein, 9 aa, Homo Sapiens
YGLNTLIQF

SEQ ID NO: 1287003 - protein, 9 aa, Homo Sapiens
DYQMYYYSL

SEQ ID NO: 1287004 - protein, 9 aa, Homo Sapiens
LLILCVCAF

SEQ ID NO: 1287005 - protein, 9 aa, Homo Sapiens
QQQYPDSHF

SEQ ID NO: 1287006 - protein, 9 aa, Homo Sapiens
HWRTHLGYF

SEQ ID NO: 1287007 - protein, 9 aa, Homo Sapiens
LTTNSSWTQ

SEQ ID NO: 1287008 - protein, 9 aa, Homo Sapiens
VHTTGVYRD

SEQ ID NO: 1287009 - protein, 9 aa, Homo Sapiens
ERRKLLIEH

SEQ ID NO: 1287010 - protein, 9 aa, Homo Sapiens
TDETYCIYN

SEQ ID NO: 1287011 - protein, 9 aa, Homo Sapiens
KNVNIKKDS

SEQ ID NO: 1287012 - protein, 9 aa, Homo Sapiens
LQQHANQYS

SEQ ID NO: 1287013 - protein, 9 aa, Homo Sapiens
KVTDESRQL

SEQ ID NO: 1287014 - protein, 9 aa, Homo Sapiens
CSVIHETSN

SEQ ID NO: 1287015 - protein, 9 aa, Homo Sapiens
AEIVLEVVS

SEQ ID NO: 1287016 - protein, 9 aa, Homo Sapiens
KHRKCNNAH

SEQ ID NO: 1287017 - protein, 9 aa, Homo Sapiens
EKQQKMAIQ

SEQ ID NO: 1287018 - protein, 9 aa, Homo Sapiens
VIHETSNSD

SEQ ID NO: 1287019 - protein, 9 aa, Homo Sapiens
EQEWTKLYW

SEQ ID NO: 1287020 - protein, 9 aa, Homo Sapiens
CIPSCVVEA

SEQ ID NO: 1287021 - protein, 9 aa, Homo Sapiens
GMQLKLSVA

SEQ ID NO: 1287022 - protein, 9 aa, Homo Sapiens
SHTHREEEY

SEQ ID NO: 1287023 - protein, 9 aa, Homo Sapiens
EKQGQIELV

SEQ ID NO: 1287024 - protein, 9 aa, Homo Sapiens
SVNQEKNSW

SEQ ID NO: 1287025 - protein, 9 aa, Homo Sapiens
VSYVSKSQP

SEQ ID NO: 1287026 - protein, 9 aa, Homo Sapiens
GLLVLYVVK

SEQ ID NO: 1287027 - protein, 9 aa, Homo Sapiens
AGPTSNDLL

SEQ ID NO: 1287028 - protein, 9 aa, Homo Sapiens
KRDERMTVD

SEQ ID NO: 1287029 - protein, 9 aa, Homo Sapiens
SWSESLLEV

SEQ ID NO: 1287030 - protein, 9 aa, Homo Sapiens
SVSGSPSQS

SEQ ID NO: 1287031 - protein, 9 aa, Homo Sapiens
FTNFPEMMN

SEQ ID NO: 1287032 - protein, 9 aa, Homo Sapiens
TYRDFRLQC

SEQ ID NO: 1287033 - protein, 9 aa, Homo Sapiens
HASHNHSHS

SEQ ID NO: 1287034 - protein, 9 aa, Homo Sapiens
MIDEDDLQL

SEQ ID NO: 1287035 - protein, 9 aa, Homo Sapiens
FEVICTSIP

SEQ ID NO: 1287036 - protein, 9 aa, Homo Sapiens
KNVDCSKST

SEQ ID NO: 1287037 - protein, 9 aa, Homo Sapiens
FNIVLWIMI

SEQ ID NO: 1287038 - protein, 9 aa, Homo Sapiens
RVSYVSKSQ

SEQ ID NO: 1287039 - protein, 9 aa, Homo Sapiens
FQCHKWPNP

SEQ ID NO: 1287040 - protein, 9 aa, Homo Sapiens
DLVAICGIS

SEQ ID NO: 1287041 - protein, 9 aa, Homo Sapiens
NQLTGTIKV

SEQ ID NO: 1287042 - protein, 9 aa, Homo Sapiens
MENFAHEFQ

SEQ ID NO: 1287043 - protein, 9 aa, Homo Sapiens
VDCTQLMYS

SEQ ID NO: 1287044 - protein, 9 aa, Homo Sapiens
DLHKHIRTH

SEQ ID NO: 1287045 - protein, 9 aa, Homo Sapiens
DQFNDEHQE

SEQ ID NO: 1287046 - protein, 9 aa, Homo Sapiens
GQLYYKIVI

SEQ ID NO: 1287047 - protein, 9 aa, Homo Sapiens
QSSVELCCV

SEQ ID NO: 1287048 - protein, 9 aa, Homo Sapiens
CFNIFTKEE

SEQ ID NO: 1287049 - protein, 9 aa, Homo Sapiens
LILPDCLAP

SEQ ID NO: 1287050 - protein, 9 aa, Homo Sapiens
TLLRPNDRV

SEQ ID NO: 1287051 - protein, 9 aa, Homo Sapiens
IDENQLKDE

SEQ ID NO: 1287052 - protein, 9 aa, Homo Sapiens
VWKLGDMRW

SEQ ID NO: 1287053 - protein, 9 aa, Homo Sapiens
TLFAINFFT

SEQ ID NO: 1287054 - protein, 9 aa, Homo Sapiens
WLTKPLAQQ

SEQ ID NO: 1287055 - protein, 9 aa, Homo Sapiens
CWVPDVGEY

SEQ ID NO: 1287056 - protein, 9 aa, Homo Sapiens
EAMVCTIDM

SEQ ID NO: 1287057 - protein, 9 aa, Homo Sapiens
DLIEHLVPH

SEQ ID NO: 1287058 - protein, 9 aa, Homo Sapiens
CLCGELWTI

SEQ ID NO: 1287059 - protein, 9 aa, Homo Sapiens
SNTQAEMSI

SEQ ID NO: 1287060 - protein, 9 aa, Homo Sapiens
FSNLIITRL

SEQ ID NO: 1287061 - protein, 9 aa, Homo Sapiens
LLVLYVVKK

SEQ ID NO: 1287062 - protein, 9 aa, Homo Sapiens
KRFNKLIWI

SEQ ID NO: 1287063 - protein, 9 aa, Homo Sapiens
DARTFCNDA

SEQ ID NO: 1287064 - protein, 9 aa, Homo Sapiens
VDQDWETEL

SEQ ID NO: 1287065 - protein, 9 aa, Homo Sapiens
GHRDYGHRT

SEQ ID NO: 1287066 - protein, 9 aa, Homo Sapiens
GTIKVAQRI

SEQ ID NO: 1287067 - protein, 9 aa, Homo Sapiens
CHCGKTFAI

SEQ ID NO: 1287068 - protein, 9 aa, Homo Sapiens
QEDKAIQAE

SEQ ID NO: 1287069 - protein, 9 aa, Homo Sapiens
SDISQYSVE

SEQ ID NO: 1287070 - protein, 9 aa, Homo Sapiens
VIGLITELQ

SEQ ID NO: 1287071 - protein, 9 aa, Homo Sapiens
LEQARQDLK

SEQ ID NO: 1287072 - protein, 9 aa, Homo Sapiens
YGLSCMLHT

SEQ ID NO: 1287073 - protein, 9 aa, Homo Sapiens
SNPLALYLE

SEQ ID NO: 1287074 - protein, 9 aa, Homo Sapiens
KVEQIHYGE

SEQ ID NO: 1287075 - protein, 9 aa, Homo Sapiens
KEVRCMKLV

SEQ ID NO: 1287076 - protein, 9 aa, Homo Sapiens
ANLTVCNGQ

SEQ ID NO: 1287077 - protein, 9 aa, Homo Sapiens
ENFAHEFQV

SEQ ID NO: 1287078 - protein, 9 aa, Homo Sapiens
VDVDQDWET

SEQ ID NO: 1287079 - protein, 9 aa, Homo Sapiens
IYEDLKMYK

SEQ ID NO: 1287080 - protein, 9 aa, Homo Sapiens
LLSWMFEKL

SEQ ID NO: 1287081 - protein, 9 aa, Homo Sapiens
LHVWSFFTP

SEQ ID NO: 1287082 - protein, 9 aa, Homo Sapiens
RSLLNTQDT

SEQ ID NO: 1287083 - protein, 9 aa, Homo Sapiens
RDAHQSHHT

SEQ ID NO: 1287084 - protein, 9 aa, Homo Sapiens
DLEDLGLLV

SEQ ID NO: 1287085 - protein, 9 aa, Homo Sapiens
VDENFYPDI

SEQ ID NO: 1287086 - protein, 9 aa, Homo Sapiens
GMGRFIPLK

SEQ ID NO: 1287087 - protein, 9 aa, Homo Sapiens
RSFIGSRFI

SEQ ID NO: 1287088 - protein, 9 aa, Homo Sapiens
ISQYSVEHL

SEQ ID NO: 1287089 - protein, 9 aa, Homo Sapiens
QMSVSGSPS

SEQ ID NO: 1287090 - protein, 9 aa, Homo Sapiens
DSVCWVSEC

SEQ ID NO: 1287091 - protein, 9 aa, Homo Sapiens
KVTHRRLYY

SEQ ID NO: 1287092 - protein, 9 aa, Homo Sapiens
QYGVCCKQK

SEQ ID NO: 1287093 - protein, 9 aa, Homo Sapiens
WHVLETDEV

SEQ ID NO: 1287094 - protein, 9 aa, Homo Sapiens
NAFSLSNSL

SEQ ID NO: 1287095 - protein, 9 aa, Homo Sapiens
TTFFSSTFS

SEQ ID NO: 1287096 - protein, 9 aa, Homo Sapiens
MLMTICASI

SEQ ID NO: 1287097 - protein, 9 aa, Homo Sapiens
SLYSSYGFT

SEQ ID NO: 1287098 - protein, 9 aa, Homo Sapiens
IFLCIQNYL

SEQ ID NO: 1287099 - protein, 9 aa, Homo Sapiens
GQPGYPGSP

SEQ ID NO: 1287100 - protein, 9 aa, Homo Sapiens
LSHINEDNN

SEQ ID NO: 1287101 - protein, 9 aa, Homo Sapiens
ENGSTTQKV

SEQ ID NO: 1287102 - protein, 9 aa, Homo Sapiens
FHSYSKMLL

SEQ ID NO: 1287103 - protein, 9 aa, Homo Sapiens
AVVCIWLRH

SEQ ID NO: 1287104 - protein, 9 aa, Homo Sapiens
QKLIISETS

SEQ ID NO: 1287105 - protein, 9 aa, Homo Sapiens
SDEEDLHPT

SEQ ID NO: 1287106 - protein, 9 aa, Homo Sapiens
YYDYDYGEI

SEQ ID NO: 1287107 - protein, 9 aa, Homo Sapiens
PCWMAHEVM

SEQ ID NO: 1287108 - protein, 9 aa, Homo Sapiens
KLYPVWKLG

SEQ ID NO: 1287109 - protein, 9 aa, Homo Sapiens
TKTRIMLQY

SEQ ID NO: 1287110 - protein, 9 aa, Homo Sapiens
VRHFQCHKW

SEQ ID NO: 1287111 - protein, 9 aa, Homo Sapiens
PPAALHIIA

SEQ ID NO: 1287112 - protein, 9 aa, Homo Sapiens
KFFCGFSQQ

SEQ ID NO: 1287113 - protein, 9 aa, Homo Sapiens
EHKIYARAE

SEQ ID NO: 1287114 - protein, 9 aa, Homo Sapiens
MSLWVKIDL

SEQ ID NO: 1287115 - protein, 9 aa, Homo Sapiens
FTCIPSCVV

SEQ ID NO: 1287116 - protein, 9 aa, Homo Sapiens
YKENYKNHM

SEQ ID NO: 1287117 - protein, 9 aa, Homo Sapiens
NCELDNNQR

SEQ ID NO: 1287118 - protein, 9 aa, Homo Sapiens
LQSQHNDII

SEQ ID NO: 1287119 - protein, 9 aa, Homo Sapiens
SWECDPSLN

SEQ ID NO: 1287120 - protein, 9 aa, Homo Sapiens
IKLYKVIST

SEQ ID NO: 1287121 - protein, 9 aa, Homo Sapiens
ITQSMQQQL

SEQ ID NO: 1287122 - protein, 9 aa, Homo Sapiens
KSPLYSPQQ

SEQ ID NO: 1287123 - protein, 9 aa, Homo Sapiens
ISWECDPSL

SEQ ID NO: 1287124 - protein, 9 aa, Homo Sapiens
NIIAAFIWN

SEQ ID NO: 1287125 - protein, 9 aa, Homo Sapiens
AELCDYDPD

SEQ ID NO: 1287126 - protein, 9 aa, Homo Sapiens
TATSGSEYR

SEQ ID NO: 1287127 - protein, 9 aa, Homo Sapiens
RMENFAHEF

SEQ ID NO: 1287128 - protein, 9 aa, Homo Sapiens
YVRHTEKVH

SEQ ID NO: 1287129 - protein, 9 aa, Homo Sapiens
CKLVTYECR

SEQ ID NO: 1287130 - protein, 9 aa, Homo Sapiens
ELAENAHLH

SEQ ID NO: 1287131 - protein, 9 aa, Homo Sapiens
QVTQLTVEV

SEQ ID NO: 1287132 - protein, 9 aa, Homo Sapiens
MSQDILCDA

SEQ ID NO: 1287133 - protein, 9 aa, Homo Sapiens
KADCYFTNW

SEQ ID NO: 1287134 - protein, 9 aa, Homo Sapiens
CVLNLILYT

SEQ ID NO: 1287135 - protein, 9 aa, Homo Sapiens
WSKQQKDNK

SEQ ID NO: 1287136 - protein, 9 aa, Homo Sapiens
WQKLWCALS

SEQ ID NO: 1287137 - protein, 9 aa, Homo Sapiens
TSTQNNMGL

SEQ ID NO: 1287138 - protein, 9 aa, Homo Sapiens
NIPDIALEQ

SEQ ID NO: 1287139 - protein, 9 aa, Homo Sapiens
LIGKKMCIE

SEQ ID NO: 1287140 - protein, 9 aa, Homo Sapiens
FSEKKAITL

SEQ ID NO: 1287141 - protein, 9 aa, Homo Sapiens
DVFGSTEEC

SEQ ID NO: 1287142 - protein, 9 aa, Homo Sapiens
HTCEKLYKC

SEQ ID NO: 1287143 - protein, 9 aa, Homo Sapiens
FLYVTSTYK

SEQ ID NO: 1287144 - protein, 9 aa, Homo Sapiens
MKKPRCWVP

SEQ ID NO: 1287145 - protein, 9 aa, Homo Sapiens
WEYEPKIEV

SEQ ID NO: 1287146 - protein, 9 aa, Homo Sapiens
TERRKLLIE

SEQ ID NO: 1287147 - protein, 9 aa, Homo Sapiens
CFNIALLHV

SEQ ID NO: 1287148 - protein, 9 aa, Homo Sapiens
FSKLEWPNP

SEQ ID NO: 1287149 - protein, 9 aa, Homo Sapiens
CDEYSRGFL

SEQ ID NO: 1287150 - protein, 9 aa, Homo Sapiens
TVEKPYQCN

SEQ ID NO: 1287151 - protein, 9 aa, Homo Sapiens
LKDSCKSLS

SEQ ID NO: 1287152 - protein, 9 aa, Homo Sapiens
KHFTCNVLQ

SEQ ID NO: 1287153 - protein, 9 aa, Homo Sapiens
PIATLLVNT

SEQ ID NO: 1287154 - protein, 9 aa, Homo Sapiens
CPMQPASSG

SEQ ID NO: 1287155 - protein, 9 aa, Homo Sapiens
QKRKDLEKW

SEQ ID NO: 1287156 - protein, 9 aa, Homo Sapiens
GKCCTLLVI

SEQ ID NO: 1287157 - protein, 9 aa, Homo Sapiens
SLKELLTKI

SEQ ID NO: 1287158 - protein, 9 aa, Homo Sapiens
LYLTCNTQL

SEQ ID NO: 1287159 - protein, 9 aa, Homo Sapiens
VISATSATF

SEQ ID NO: 1287160 - protein, 9 aa, Homo Sapiens
LERELTALK

SEQ ID NO: 1287161 - protein, 9 aa, Homo Sapiens
PLSGGQPLE

SEQ ID NO: 1287162 - protein, 9 aa, Homo Sapiens
LGGNVWLSP

SEQ ID NO: 1287163 - protein, 9 aa, Homo Sapiens
VCAQCSTDF

SEQ ID NO: 1287164 - protein, 9 aa, Homo Sapiens
PLSQEVTHT

SEQ ID NO: 1287165 - protein, 9 aa, Homo Sapiens
VVCDGGSIS

SEQ ID NO: 1287166 - protein, 9 aa, Homo Sapiens
YPGSPGPPG

SEQ ID NO: 1287167 - protein, 9 aa, Homo Sapiens
KALTPASLH

SEQ ID NO: 1287168 - protein, 9 aa, Homo Sapiens
YRTYGVPVD

SEQ ID NO: 1287169 - protein, 9 aa, Homo Sapiens
RMHVGKNKV

SEQ ID NO: 1287170 - protein, 9 aa, Homo Sapiens
INIMSAEYF

SEQ ID NO: 1287171 - protein, 9 aa, Homo Sapiens
YKNHMRGRY

SEQ ID NO: 1287172 - protein, 9 aa, Homo Sapiens
LFCLDLYSS

SEQ ID NO: 1287173 - protein, 9 aa, Homo Sapiens
CQETLCSLQ

SEQ ID NO: 1287174 - protein, 9 aa, Homo Sapiens
ISRGDCEVL

SEQ ID NO: 1287175 - protein, 9 aa, Homo Sapiens
VIEYLLPPE

SEQ ID NO: 1287176 - protein, 9 aa, Homo Sapiens
QCSTDFTPH

SEQ ID NO: 1287177 - protein, 9 aa, Homo Sapiens
FCQEYLNKC

SEQ ID NO: 1287178 - protein, 9 aa, Homo Sapiens
LYPVFTSQK

SEQ ID NO: 1287179 - protein, 9 aa, Homo Sapiens
SIAEWSKQQ

SEQ ID NO: 1287180 - protein, 9 aa, Homo Sapiens
ISMHAMRNS

SEQ ID NO: 1287181 - protein, 9 aa, Homo Sapiens
PTNKWIKLC

SEQ ID NO: 1287182 - protein, 9 aa, Homo Sapiens
SHIFCVNRS

SEQ ID NO: 1287183 - protein, 9 aa, Homo Sapiens
NNLPTNGGQ

SEQ ID NO: 1287184 - protein, 9 aa, Homo Sapiens
TLCQETLCS

SEQ ID NO: 1287185 - protein, 9 aa, Homo Sapiens
DLMTLHTIE

SEQ ID NO: 1287186 - protein, 9 aa, Homo Sapiens
RCPAAKENW

SEQ ID NO: 1287187 - protein, 9 aa, Homo Sapiens
LYSRTCDIV

SEQ ID NO: 1287188 - protein, 9 aa, Homo Sapiens
GILANCVLS

SEQ ID NO: 1287189 - protein, 9 aa, Homo Sapiens
TFFKLIHCS

SEQ ID NO: 1287190 - protein, 9 aa, Homo Sapiens
VVESYTLTI

SEQ ID NO: 1287191 - protein, 9 aa, Homo Sapiens
QVHHVLCIP

SEQ ID NO: 1287192 - protein, 9 aa, Homo Sapiens
LHPTKKHCS

SEQ ID NO: 1287193 - protein, 9 aa, Homo Sapiens
SRKVTHRRL

SEQ ID NO: 1287194 - protein, 9 aa, Homo Sapiens
NELNVCDVV

SEQ ID NO: 1287195 - protein, 9 aa, Homo Sapiens
YLIGTELGG

SEQ ID NO: 1287196 - protein, 9 aa, Homo Sapiens
DVNMCCPKQ

SEQ ID NO: 1287197 - protein, 9 aa, Homo Sapiens
NIMSAEYFP

SEQ ID NO: 1287198 - protein, 9 aa, Homo Sapiens
FAYGGHHYP

SEQ ID NO: 1287199 - protein, 9 aa, Homo Sapiens
YRNLVSMGF

SEQ ID NO: 1287200 - protein, 9 aa, Homo Sapiens
KWTTFLKAS

SEQ ID NO: 1287201 - protein, 9 aa, Homo Sapiens
WLSMQIFAP

SEQ ID NO: 1287202 - protein, 9 aa, Homo Sapiens
ALPTYCVHY

SEQ ID NO: 1287203 - protein, 9 aa, Homo Sapiens
FEIVSNIPD

SEQ ID NO: 1287204 - protein, 9 aa, Homo Sapiens
NEENIKSVQ

SEQ ID NO: 1287205 - protein, 9 aa, Homo Sapiens
VHMSPIINN

SEQ ID NO: 1287206 - protein, 9 aa, Homo Sapiens
AITLDMDGN

SEQ ID NO: 1287207 - protein, 9 aa, Homo Sapiens
AAEGHYASK

SEQ ID NO: 1287208 - protein, 9 aa, Homo Sapiens
VTFQYPYMN

SEQ ID NO: 1287209 - protein, 9 aa, Homo Sapiens
HLVCVLNSD

SEQ ID NO: 1287210 - protein, 9 aa, Homo Sapiens
AHACYHSTL

SEQ ID NO: 1287211 - protein, 9 aa, Homo Sapiens
AGSMCESCG

SEQ ID NO: 1287212 - protein, 9 aa, Homo Sapiens
LCTAKEIAY

SEQ ID NO: 1287213 - protein, 9 aa, Homo Sapiens
EILDNKNCT

SEQ ID NO: 1287214 - protein, 9 aa, Homo Sapiens
EIAISNKMR

SEQ ID NO: 1287215 - protein, 9 aa, Homo Sapiens
KPRCWVPDV

SEQ ID NO: 1287216 - protein, 9 aa, Homo Sapiens
NGQLYYKIV

SEQ ID NO: 1287217 - protein, 9 aa, Homo Sapiens
LTKDDITVF

SEQ ID NO: 1287218 - protein, 9 aa, Homo Sapiens
TESCLSCSH

SEQ ID NO: 1287219 - protein, 9 aa, Homo Sapiens
RDMKLDNVL

SEQ ID NO: 1287220 - protein, 9 aa, Homo Sapiens
IWTMAIVMC

SEQ ID NO: 1287221 - protein, 9 aa, Homo Sapiens
TEPSLNPSE

SEQ ID NO: 1287222 - protein, 9 aa, Homo Sapiens
TLHTGDRIM

SEQ ID NO: 1287223 - protein, 9 aa, Homo Sapiens
DRFQSAYET

SEQ ID NO: 1287224 - protein, 9 aa, Homo Sapiens
SEKKAITLD

SEQ ID NO: 1287225 - protein, 9 aa, Homo Sapiens
HTASSCFCD

SEQ ID NO: 1287226 - protein, 9 aa, Homo Sapiens
FYELSPNIF

SEQ ID NO: 1287227 - protein, 9 aa, Homo Sapiens
GNTMKGDAI

SEQ ID NO: 1287228 - protein, 9 aa, Homo Sapiens
ETSLFKTRK

SEQ ID NO: 1287229 - protein, 9 aa, Homo Sapiens
LKERPDLQP

SEQ ID NO: 1287230 - protein, 9 aa, Homo Sapiens
EVMVELSEN

SEQ ID NO: 1287231 - protein, 9 aa, Homo Sapiens
VKHMNQTLQ

SEQ ID NO: 1287232 - protein, 9 aa, Homo Sapiens
TSGSEYRHP

SEQ ID NO: 1287233 - protein, 9 aa, Homo Sapiens
EKINNSDAK

SEQ ID NO: 1287234 - protein, 9 aa, Homo Sapiens
CMNVLREVK

SEQ ID NO: 1287235 - protein, 9 aa, Homo Sapiens
INGQVDVDR

SEQ ID NO: 1287236 - protein, 9 aa, Homo Sapiens
LYNFKQEEK

SEQ ID NO: 1287237 - protein, 9 aa, Homo Sapiens
ALEISQTLF

SEQ ID NO: 1287238 - protein, 9 aa, Homo Sapiens
EYSVVFNIV

SEQ ID NO: 1287239 - protein, 9 aa, Homo Sapiens
TLLCTPPRL

SEQ ID NO: 1287240 - protein, 9 aa, Homo Sapiens
KDDITVFLR

SEQ ID NO: 1287241 - protein, 9 aa, Homo Sapiens
QEPYQQQYP

SEQ ID NO: 1287242 - protein, 9 aa, Homo Sapiens
AVKNTYGKQ

SEQ ID NO: 1287243 - protein, 9 aa, Homo Sapiens
CVICLDILK

SEQ ID NO: 1287244 - protein, 9 aa, Homo Sapiens
RDLEENVDK

SEQ ID NO: 1287245 - protein, 9 aa, Homo Sapiens
TENNDAKEL

SEQ ID NO: 1287246 - protein, 9 aa, Homo Sapiens
KTASKVHLM

SEQ ID NO: 1287247 - protein, 9 aa, Homo Sapiens
ACANHTLLQ

SEQ ID NO: 1287248 - protein, 9 aa, Homo Sapiens
CVWNTENVN

SEQ ID NO: 1287249 - protein, 9 aa, Homo Sapiens
HGFAFVEFE

SEQ ID NO: 1287250 - protein, 9 aa, Homo Sapiens
CLLYVLCNT

SEQ ID NO: 1287251 - protein, 9 aa, Homo Sapiens
GPLDQGSRH

SEQ ID NO: 1287252 - protein, 9 aa, Homo Sapiens
PHGFAFVEF

SEQ ID NO: 1287253 - protein, 9 aa, Homo Sapiens
KHTEQLVQD

SEQ ID NO: 1287254 - protein, 9 aa, Homo Sapiens
MCHEELKEI

SEQ ID NO: 1287255 - protein, 9 aa, Homo Sapiens
SRTANIRSI

SEQ ID NO: 1287256 - protein, 9 aa, Homo Sapiens
TNKVEQIHY

SEQ ID NO: 1287257 - protein, 9 aa, Homo Sapiens
IYSLDTSVL

SEQ ID NO: 1287258 - protein, 9 aa, Homo Sapiens
DHNHNKGLT

SEQ ID NO: 1287259 - protein, 9 aa, Homo Sapiens
YTLRLLKNQ

SEQ ID NO: 1287260 - protein, 9 aa, Homo Sapiens
RYIILTHVI

SEQ ID NO: 1287261 - protein, 9 aa, Homo Sapiens
FTSLSTQER

SEQ ID NO: 1287262 - protein, 9 aa, Homo Sapiens
LRQNNDTFD

SEQ ID NO: 1287263 - protein, 9 aa, Homo Sapiens
NTQGGSGVF

SEQ ID NO: 1287264 - protein, 9 aa, Homo Sapiens
FTEIVQDMG

SEQ ID NO: 1287265 - protein, 9 aa, Homo Sapiens
DIGNPVGQS

SEQ ID NO: 1287266 - protein, 9 aa, Homo Sapiens
LCQETLCSL

SEQ ID NO: 1287267 - protein, 9 aa, Homo Sapiens
NMLRQASLN

SEQ ID NO: 1287268 - protein, 9 aa, Homo Sapiens
VICTSIPGY

SEQ ID NO: 1287269 - protein, 9 aa, Homo Sapiens
IANHCPDPS

SEQ ID NO: 1287270 - protein, 9 aa, Homo Sapiens
LLYNFKQEE

SEQ ID NO: 1287271 - protein, 9 aa, Homo Sapiens
LDSVDSEYY

SEQ ID NO: 1287272 - protein, 9 aa, Homo Sapiens
ELQPISTLL

SEQ ID NO: 1287273 - protein, 9 aa, Homo Sapiens
LLSLYPVFT

SEQ ID NO: 1287274 - protein, 9 aa, Homo Sapiens
FNFPDTATV

SEQ ID NO: 1287275 - protein, 9 aa, Homo Sapiens
EKSYASIIE

SEQ ID NO: 1287276 - protein, 9 aa, Homo Sapiens
LGTSSQVSS

SEQ ID NO: 1287277 - protein, 9 aa, Homo Sapiens
SLFESDMKR

SEQ ID NO: 1287278 - protein, 9 aa, Homo Sapiens
SLHKELNNL

SEQ ID NO: 1287279 - protein, 9 aa, Homo Sapiens
LLIEHIFKL

SEQ ID NO: 1287280 - protein, 9 aa, Homo Sapiens
IRTIEDIDE

SEQ ID NO: 1287281 - protein, 9 aa, Homo Sapiens
VFNAANMLR

SEQ ID NO: 1287282 - protein, 9 aa, Homo Sapiens
VPSAGADIE

SEQ ID NO: 1287283 - protein, 9 aa, Homo Sapiens
KEAPQQRPV

SEQ ID NO: 1287284 - protein, 9 aa, Homo Sapiens
NKVNPNKVS

SEQ ID NO: 1287285 - protein, 9 aa, Homo Sapiens
FLEAKQAFQ

SEQ ID NO: 1287286 - protein, 9 aa, Homo Sapiens
VSNIPDDAQ

SEQ ID NO: 1287287 - protein, 9 aa, Homo Sapiens
LTDQLDGET

SEQ ID NO: 1287288 - protein, 9 aa, Homo Sapiens
PAVNRTVNR

SEQ ID NO: 1287289 - protein, 9 aa, Homo Sapiens
LLLYPVGLF

SEQ ID NO: 1287290 - protein, 9 aa, Homo Sapiens
YDDRFQSAY

SEQ ID NO: 1287291 - protein, 9 aa, Homo Sapiens
CCEVLATPT

SEQ ID NO: 1287292 - protein, 9 aa, Homo Sapiens
IIKESNILE

SEQ ID NO: 1287293 - protein, 9 aa, Homo Sapiens
ADCYFTNWT

SEQ ID NO: 1287294 - protein, 9 aa, Homo Sapiens
DAHQSHHTP

SEQ ID NO: 1287295 - protein, 9 aa, Homo Sapiens
YPPEIYMTL

SEQ ID NO: 1287296 - protein, 9 aa, Homo Sapiens
AEKQGQIEL

SEQ ID NO: 1287297 - protein, 9 aa, Homo Sapiens
LLLLSLYPV

SEQ ID NO: 1287298 - protein, 9 aa, Homo Sapiens
CEELLAQGE

SEQ ID NO: 1287299 - protein, 9 aa, Homo Sapiens
HSVLAVDGL

SEQ ID NO: 1287300 - protein, 9 aa, Homo Sapiens
DVVFNAANM

SEQ ID NO: 1287301 - protein, 9 aa, Homo Sapiens
GRYDGDSIK

SEQ ID NO: 1287302 - protein, 9 aa, Homo Sapiens
CELDNNQRQ

SEQ ID NO: 1287303 - protein, 9 aa, Homo Sapiens
AKLQECSNY

SEQ ID NO: 1287304 - protein, 9 aa, Homo Sapiens
QTKVKCEDS

SEQ ID NO: 1287305 - protein, 9 aa, Homo Sapiens
SVIPAQAHW

SEQ ID NO: 1287306 - protein, 9 aa, Homo Sapiens
AKKNSNLTK

SEQ ID NO: 1287307 - protein, 9 aa, Homo Sapiens
IALDWKCNC

SEQ ID NO: 1287308 - protein, 9 aa, Homo Sapiens
LKSHLILHK

SEQ ID NO: 1287309 - protein, 9 aa, Homo Sapiens
NPDFSDEED

SEQ ID NO: 1287310 - protein, 9 aa, Homo Sapiens
SDGSKEFSA

SEQ ID NO: 1287311 - protein, 9 aa, Homo Sapiens
NYNKQPSNY

SEQ ID NO: 1287312 - protein, 9 aa, Homo Sapiens
AGIDVNMCC

SEQ ID NO: 1287313 - protein, 9 aa, Homo Sapiens
IIAAFIWNK

SEQ ID NO: 1287314 - protein, 9 aa, Homo Sapiens
SVIHPKTDE

SEQ ID NO: 1287315 - protein, 9 aa, Homo Sapiens
YSAFVVLAR

SEQ ID NO: 1287316 - protein, 9 aa, Homo Sapiens
VHTLPTPVL

SEQ ID NO: 1287317 - protein, 9 aa, Homo Sapiens
YKCLECWDS

SEQ ID NO: 1287318 - protein, 9 aa, Homo Sapiens
TLNRKRKWE

SEQ ID NO: 1287319 - protein, 9 aa, Homo Sapiens
YLNKCCHFT

SEQ ID NO: 1287320 - protein, 9 aa, Homo Sapiens
RMKESSTSG

SEQ ID NO: 1287321 - protein, 9 aa, Homo Sapiens
AYGGHHYPF

SEQ ID NO: 1287322 - protein, 9 aa, Homo Sapiens
LWKSYPIVC

SEQ ID NO: 1287323 - protein, 9 aa, Homo Sapiens
GNYNKQPSN

SEQ ID NO: 1287324 - protein, 9 aa, Homo Sapiens
RKEGSHCLS

SEQ ID NO: 1287325 - protein, 9 aa, Homo Sapiens
DALLHAASL

SEQ ID NO: 1287326 - protein, 9 aa, Homo Sapiens
KLIHCSGKE

SEQ ID NO: 1287327 - protein, 9 aa, Homo Sapiens
SEFSNSSCL

SEQ ID NO: 1287328 - protein, 9 aa, Homo Sapiens
MRGLPCAVG

SEQ ID NO: 1287329 - protein, 9 aa, Homo Sapiens
PIKMECPTS

SEQ ID NO: 1287330 - protein, 9 aa, Homo Sapiens
LYSAKTKSF

SEQ ID NO: 1287331 - protein, 9 aa, Homo Sapiens
TINKDFGTF

SEQ ID NO: 1287332 - protein, 9 aa, Homo Sapiens
GTPSPTLCA

SEQ ID NO: 1287333 - protein, 9 aa, Homo Sapiens
DIEGVEVKD

SEQ ID NO: 1287334 - protein, 9 aa, Homo Sapiens
FFDHKKKKF

SEQ ID NO: 1287335 - protein, 9 aa, Homo Sapiens
ASSGQPLCP

SEQ ID NO: 1287336 - protein, 9 aa, Homo Sapiens
GLVDREPHE

SEQ ID NO: 1287337 - protein, 9 aa, Homo Sapiens
VDRLKVLAV

SEQ ID NO: 1287338 - protein, 9 aa, Homo Sapiens
EINGTVTEF

SEQ ID NO: 1287339 - protein, 9 aa, Homo Sapiens
SDVSRCNLE

SEQ ID NO: 1287340 - protein, 9 aa, Homo Sapiens
FLEKRLHVK

SEQ ID NO: 1287341 - protein, 9 aa, Homo Sapiens
QALDAHHRK

SEQ ID NO: 1287342 - protein, 9 aa, Homo Sapiens
HSDLEAKVN

SEQ ID NO: 1287343 - protein, 9 aa, Homo Sapiens
SLLWSTSIK

SEQ ID NO: 1287344 - protein, 9 aa, Homo Sapiens
CPCSGFVPS

SEQ ID NO: 1287345 - protein, 9 aa, Homo Sapiens
DTATVKKVV

SEQ ID NO: 1287346 - protein, 9 aa, Homo Sapiens
EVHHQKFVF

SEQ ID NO: 1287347 - protein, 9 aa, Homo Sapiens
RTIYSFSAK

SEQ ID NO: 1287348 - protein, 9 aa, Homo Sapiens
ILVTLSHLA

SEQ ID NO: 1287349 - protein, 9 aa, Homo Sapiens
LLERELTAL

SEQ ID NO: 1287350 - protein, 9 aa, Homo Sapiens
DSDNELVTF

SEQ ID NO: 1287351 - protein, 9 aa, Homo Sapiens
FNFYPKWTI

SEQ ID NO: 1287352 - protein, 9 aa, Homo Sapiens
KGYYRTYGV

SEQ ID NO: 1287353 - protein, 9 aa, Homo Sapiens
ILKIVTLVL

SEQ ID NO: 1287354 - protein, 9 aa, Homo Sapiens
GWTLVKVKP

SEQ ID NO: 1287355 - protein, 9 aa, Homo Sapiens
KTLAEHKQL

SEQ ID NO: 1287356 - protein, 9 aa, Homo Sapiens
PAGPPCPRG

SEQ ID NO: 1287357 - protein, 9 aa, Homo Sapiens
KDSSLFESD

SEQ ID NO: 1287358 - protein, 9 aa, Homo Sapiens
LEGDLSHIN

SEQ ID NO: 1287359 - protein, 9 aa, Homo Sapiens
VGWGATVIV

SEQ ID NO: 1287360 - protein, 9 aa, Homo Sapiens
KNCGEVLRE

SEQ ID NO: 1287361 - protein, 9 aa, Homo Sapiens
LGIPNTDRC

SEQ ID NO: 1287362 - protein, 9 aa, Homo Sapiens
DMLMTICAS

SEQ ID NO: 1287363 - protein, 9 aa, Homo Sapiens
VCESLYSAK

SEQ ID NO: 1287364 - protein, 9 aa, Homo Sapiens
KNCLMDHED

SEQ ID NO: 1287365 - protein, 9 aa, Homo Sapiens
LRQFLESWV

SEQ ID NO: 1287366 - protein, 9 aa, Homo Sapiens
MENTGEQFV

SEQ ID NO: 1287367 - protein, 9 aa, Homo Sapiens
EWSKQQKDN

SEQ ID NO: 1287368 - protein, 9 aa, Homo Sapiens
TSGSKSQRY

SEQ ID NO: 1287369 - protein, 9 aa, Homo Sapiens
YIGLTQFEL

SEQ ID NO: 1287370 - protein, 9 aa, Homo Sapiens
VIELLQEKH

SEQ ID NO: 1287371 - protein, 9 aa, Homo Sapiens
RFIPLKAFP

SEQ ID NO: 1287372 - protein, 9 aa, Homo Sapiens
DDAQKRKDL

SEQ ID NO: 1287373 - protein, 9 aa, Homo Sapiens
PDTENEEYN

SEQ ID NO: 1287374 - protein, 9 aa, Homo Sapiens
RSSTLNTHK

SEQ ID NO: 1287375 - protein, 9 aa, Homo Sapiens
VVWLVLNVF

SEQ ID NO: 1287376 - protein, 9 aa, Homo Sapiens
EWTFQHFTN

SEQ ID NO: 1287377 - protein, 9 aa, Homo Sapiens
VQQLEKGSH

SEQ ID NO: 1287378 - protein, 9 aa, Homo Sapiens
YSVEHLTTF

SEQ ID NO: 1287379 - protein, 9 aa, Homo Sapiens
PNQRRYVYY

SEQ ID NO: 1287380 - protein, 9 aa, Homo Sapiens
MEPVENEDY

SEQ ID NO: 1287381 - protein, 9 aa, Homo Sapiens
MESGDGNTC

SEQ ID NO: 1287382 - protein, 9 aa, Homo Sapiens
QTDLFCNPM

SEQ ID NO: 1287383 - protein, 9 aa, Homo Sapiens
FPNTDIEEY

SEQ ID NO: 1287384 - protein, 9 aa, Homo Sapiens
PLRQNNDTF

SEQ ID NO: 1287385 - protein, 9 aa, Homo Sapiens
HTEDQFNDE

SEQ ID NO: 1287386 - protein, 9 aa, Homo Sapiens
LNQTSSNLK

SEQ ID NO: 1287387 - protein, 9 aa, Homo Sapiens
NTLAEMSKG

SEQ ID NO: 1287388 - protein, 9 aa, Homo Sapiens
HTAALTNEG

SEQ ID NO: 1287389 - protein, 9 aa, Homo Sapiens
TNALVERKH

SEQ ID NO: 1287390 - protein, 9 aa, Homo Sapiens
HTCEKPYKC

SEQ ID NO: 1287391 - protein, 9 aa, Homo Sapiens
LRATQQSEN

SEQ ID NO: 1287392 - protein, 9 aa, Homo Sapiens
RKRTIYSFS

SEQ ID NO: 1287393 - protein, 9 aa, Homo Sapiens
EMEPVENED

SEQ ID NO: 1287394 - protein, 9 aa, Homo Sapiens
KEYAGSMCE

SEQ ID NO: 1287395 - protein, 9 aa, Homo Sapiens
AVQKIVENL

SEQ ID NO: 1287396 - protein, 9 aa, Homo Sapiens
HTFSAVKQE

SEQ ID NO: 1287397 - protein, 9 aa, Homo Sapiens
NSNLTQQQK

SEQ ID NO: 1287398 - protein, 9 aa, Homo Sapiens
HVAHWHLIV

SEQ ID NO: 1287399 - protein, 9 aa, Homo Sapiens
NKQLLLSRK

SEQ ID NO: 1287400 - protein, 9 aa, Homo Sapiens
ISLDLPLSI

SEQ ID NO: 1287401 - protein, 9 aa, Homo Sapiens
APQAVLYNY

SEQ ID NO: 1287402 - protein, 9 aa, Homo Sapiens
ECEACTQYQ

SEQ ID NO: 1287403 - protein, 9 aa, Homo Sapiens
CKEKVDLKM

SEQ ID NO: 1287404 - protein, 9 aa, Homo Sapiens
GQPLEGVGP

SEQ ID NO: 1287405 - protein, 9 aa, Homo Sapiens
FTGENIVSK

SEQ ID NO: 1287406 - protein, 9 aa, Homo Sapiens
DLNVHCRIN

SEQ ID NO: 1287407 - protein, 9 aa, Homo Sapiens
DSEYYMGSV

SEQ ID NO: 1287408 - protein, 9 aa, Homo Sapiens
KGMTREESE

SEQ ID NO: 1287409 - protein, 9 aa, Homo Sapiens
YVGATVLRW

SEQ ID NO: 1287410 - protein, 9 aa, Homo Sapiens
FQSAYETGQ

SEQ ID NO: 1287411 - protein, 9 aa, Homo Sapiens
TDSDIEKDH

SEQ ID NO: 1287412 - protein, 9 aa, Homo Sapiens
MIQLMVNLL

SEQ ID NO: 1287413 - protein, 9 aa, Homo Sapiens
QSEHSPSLP

SEQ ID NO: 1287414 - protein, 9 aa, Homo Sapiens
IFVQSSSPG

SEQ ID NO: 1287415 - protein, 9 aa, Homo Sapiens
GLCMFDLNF

SEQ ID NO: 1287416 - protein, 9 aa, Homo Sapiens
DVMKKPRCW

SEQ ID NO: 1287417 - protein, 9 aa, Homo Sapiens
VMKKPRCWV

SEQ ID NO: 1287418 - protein, 9 aa, Homo Sapiens
QDIVEGMKQ

SEQ ID NO: 1287419 - protein, 9 aa, Homo Sapiens
NLLSWMFEK

SEQ ID NO: 1287420 - protein, 9 aa, Homo Sapiens
NQVFHNKSK

SEQ ID NO: 1287421 - protein, 9 aa, Homo Sapiens
NAIHNCIYN

SEQ ID NO: 1287422 - protein, 9 aa, Homo Sapiens
LQHSDPEDS

SEQ ID NO: 1287423 - protein, 9 aa, Homo Sapiens
ENTGEQFVC

SEQ ID NO: 1287424 - protein, 9 aa, Homo Sapiens
MRYLADIGY

SEQ ID NO: 1287425 - protein, 9 aa, Homo Sapiens
PSEIREKLA

SEQ ID NO: 1287426 - protein, 9 aa, Homo Sapiens
NKMSIALKN

SEQ ID NO: 1287427 - protein, 9 aa, Homo Sapiens
LISDTKPED

SEQ ID NO: 1287428 - protein, 9 aa, Homo Sapiens
CSTVDDSCI

SEQ ID NO: 1287429 - protein, 9 aa, Homo Sapiens
GINSKVKSA

SEQ ID NO: 1287430 - protein, 9 aa, Homo Sapiens
SGGMQLKLS

SEQ ID NO: 1287431 - protein, 9 aa, Homo Sapiens
NQSNLKMCC

SEQ ID NO: 1287432 - protein, 9 aa, Homo Sapiens
LSWAHIKEE

SEQ ID NO: 1287433 - protein, 9 aa, Homo Sapiens
ILDIYECVG

SEQ ID NO: 1287434 - protein, 9 aa, Homo Sapiens
FWEESDIMA

SEQ ID NO: 1287435 - protein, 9 aa, Homo Sapiens
ASKVHLMKF

SEQ ID NO: 1287436 - protein, 9 aa, Homo Sapiens
TQQQKIDEL

SEQ ID NO: 1287437 - protein, 9 aa, Homo Sapiens
SMSCQGIES

SEQ ID NO: 1287438 - protein, 9 aa, Homo Sapiens
YSCVKELIL

SEQ ID NO: 1287439 - protein, 9 aa, Homo Sapiens
IVMCAIPSV

SEQ ID NO: 1287440 - protein, 9 aa, Homo Sapiens
HPKPSNSEK

SEQ ID NO: 1287441 - protein, 9 aa, Homo Sapiens
KCRNWLHKA

SEQ ID NO: 1287442 - protein, 9 aa, Homo Sapiens
ADGGTKVID

SEQ ID NO: 1287443 - protein, 9 aa, Homo Sapiens
ILYTATTKC

SEQ ID NO: 1287444 - protein, 9 aa, Homo Sapiens
PEAFRFDCG

SEQ ID NO: 1287445 - protein, 9 aa, Homo Sapiens
ERKHPLRGI

SEQ ID NO: 1287446 - protein, 9 aa, Homo Sapiens
TPPRLCTDN

SEQ ID NO: 1287447 - protein, 9 aa, Homo Sapiens
HTVTLCCPS

SEQ ID NO: 1287448 - protein, 9 aa, Homo Sapiens
ECSNYDQLQ

SEQ ID NO: 1287449 - protein, 9 aa, Homo Sapiens
TQQSENDKL

SEQ ID NO: 1287450 - protein, 9 aa, Homo Sapiens
KGDAIDYLV

SEQ ID NO: 1287451 - protein, 9 aa, Homo Sapiens
IPQHNKQLL

SEQ ID NO: 1287452 - protein, 9 aa, Homo Sapiens
PVLTAVQGI

SEQ ID NO: 1287453 - protein, 9 aa, Homo Sapiens
SLNTTVYAL

SEQ ID NO: 1287454 - protein, 9 aa, Homo Sapiens
RVCNKIKSK

SEQ ID NO: 1287455 - protein, 9 aa, Homo Sapiens
VQLNDLDAM

SEQ ID NO: 1287456 - protein, 9 aa, Homo Sapiens
WNDAGDNVT

SEQ ID NO: 1287457 - protein, 9 aa, Homo Sapiens
ASMESLYYL

SEQ ID NO: 1287458 - protein, 9 aa, Homo Sapiens
VPVPLKEAP

SEQ ID NO: 1287459 - protein, 9 aa, Homo Sapiens
VLCSRLLVG

SEQ ID NO: 1287460 - protein, 9 aa, Homo Sapiens
ESPENILDN

SEQ ID NO: 1287461 - protein, 9 aa, Homo Sapiens
GQIELVIKE

SEQ ID NO: 1287462 - protein, 9 aa, Homo Sapiens
LHLKMEPQS

SEQ ID NO: 1287463 - protein, 9 aa, Homo Sapiens
LNLILYTAT

SEQ ID NO: 1287464 - protein, 9 aa, Homo Sapiens
LHKHFDGYK

SEQ ID NO: 1287465 - protein, 9 aa, Homo Sapiens
DSKTSTRCG

SEQ ID NO: 1287466 - protein, 9 aa, Homo Sapiens
LRHVQLIVN

SEQ ID NO: 1287467 - protein, 9 aa, Homo Sapiens
FENLPMNVL

SEQ ID NO: 1287468 - protein, 9 aa, Homo Sapiens
HSEPKRGKL

SEQ ID NO: 1287469 - protein, 9 aa, Homo Sapiens
NMNHCNWHK

SEQ ID NO: 1287470 - protein, 9 aa, Homo Sapiens
FKRSSTLNT

SEQ ID NO: 1287471 - protein, 9 aa, Homo Sapiens
IAGRGINSK

SEQ ID NO: 1287472 - protein, 9 aa, Homo Sapiens
GLITNYKIG

SEQ ID NO: 1287473 - protein, 9 aa, Homo Sapiens
LELLFHSIH

SEQ ID NO: 1287474 - protein, 9 aa, Homo Sapiens
HCNETTKNV

SEQ ID NO: 1287475 - protein, 9 aa, Homo Sapiens
PRLTSTAVP

SEQ ID NO: 1287476 - protein, 9 aa, Homo Sapiens
WKKKNYTAY

SEQ ID NO: 1287477 - protein, 9 aa, Homo Sapiens
NGQVRALGT

SEQ ID NO: 1287478 - protein, 9 aa, Homo Sapiens
RSTKLITDD

SEQ ID NO: 1287479 - protein, 9 aa, Homo Sapiens
QNYLFENGR

SEQ ID NO: 1287480 - protein, 9 aa, Homo Sapiens
LSCSHALAA

SEQ ID NO: 1287481 - protein, 9 aa, Homo Sapiens
ITLLFFLVN

SEQ ID NO: 1287482 - protein, 9 aa, Homo Sapiens
KNYTAYFRG

SEQ ID NO: 1287483 - protein, 9 aa, Homo Sapiens
SNDIDVLKK

SEQ ID NO: 1287484 - protein, 9 aa, Homo Sapiens
FTLTSSNET

SEQ ID NO: 1287485 - protein, 9 aa, Homo Sapiens
YAMESSKPG

SEQ ID NO: 1287486 - protein, 9 aa, Homo Sapiens
FFNCDCCEL

SEQ ID NO: 1287487 - protein, 9 aa, Homo Sapiens
TSRAKISGQ

SEQ ID NO: 1287488 - protein, 9 aa, Homo Sapiens
SNNGAMGGL

SEQ ID NO: 1287489 - protein, 9 aa, Homo Sapiens
ICAHMTASN

SEQ ID NO: 1287490 - protein, 9 aa, Homo Sapiens
TRDYIIEPS

SEQ ID NO: 1287491 - protein, 9 aa, Homo Sapiens
SNSIFHVGS

SEQ ID NO: 1287492 - protein, 9 aa, Homo Sapiens
NGSTTQKVK

SEQ ID NO: 1287493 - protein, 9 aa, Homo Sapiens
KYNLEELYK

SEQ ID NO: 1287494 - protein, 9 aa, Homo Sapiens
RWFGFLEAK

SEQ ID NO: 1287495 - protein, 9 aa, Homo Sapiens
YLRNSNLTQ

SEQ ID NO: 1287496 - protein, 9 aa, Homo Sapiens
ILNSSTEDC

SEQ ID NO: 1287497 - protein, 9 aa, Homo Sapiens
LLNAIHNCI

SEQ ID NO: 1287498 - protein, 9 aa, Homo Sapiens
LDQNEENIK

SEQ ID NO: 1287499 - protein, 9 aa, Homo Sapiens
GNKTILESS

SEQ ID NO: 1287500 - protein, 9 aa, Homo Sapiens
GFLEAKQAF

SEQ ID NO: 1287501 - protein, 9 aa, Homo Sapiens
WAHIKEEHC

SEQ ID NO: 1287502 - protein, 9 aa, Homo Sapiens
VPEDVEQPG

SEQ ID NO: 1287503 - protein, 9 aa, Homo Sapiens
TLNTHKKIH

SEQ ID NO: 1287504 - protein, 9 aa, Homo Sapiens
LGSITCNVT

SEQ ID NO: 1287505 - protein, 9 aa, Homo Sapiens
YKAYDHENR

SEQ ID NO: 1287506 - protein, 9 aa, Homo Sapiens
LLFFLVNYP

SEQ ID NO: 1287507 - protein, 9 aa, Homo Sapiens
LEELHKHTE

SEQ ID NO: 1287508 - protein, 9 aa, Homo Sapiens
ESLYYLWEF

SEQ ID NO: 1287509 - protein, 9 aa, Homo Sapiens
NMAKIHSGQ

SEQ ID NO: 1287510 - protein, 9 aa, Homo Sapiens
FEIAISNKM

SEQ ID NO: 1287511 - protein, 9 aa, Homo Sapiens
CPEVHTLPT

SEQ ID NO: 1287512 - protein, 9 aa, Homo Sapiens
SYYLCDDTI

SEQ ID NO: 1287513 - protein, 9 aa, Homo Sapiens
NFAHEFQVG

SEQ ID NO: 1287514 - protein, 9 aa, Homo Sapiens
QEVTHTKPA

SEQ ID NO: 1287515 - protein, 9 aa, Homo Sapiens
IMSTLTFVV

SEQ ID NO: 1287516 - protein, 9 aa, Homo Sapiens
VAALCSDLH

SEQ ID NO: 1287517 - protein, 9 aa, Homo Sapiens
KAFEKFHTN

SEQ ID NO: 1287518 - protein, 9 aa, Homo Sapiens
TNRPDMIDK

SEQ ID NO: 1287519 - protein, 9 aa, Homo Sapiens
FNFDRVFHC

SEQ ID NO: 1287520 - protein, 9 aa, Homo Sapiens
VLDNKKMTA

SEQ ID NO: 1287521 - protein, 9 aa, Homo Sapiens
IAIFCCFSF

SEQ ID NO: 1287522 - protein, 9 aa, Homo Sapiens
LNVLDNKKM

SEQ ID NO: 1287523 - protein, 9 aa, Homo Sapiens
ECDPSLNTK

SEQ ID NO: 1287524 - protein, 9 aa, Homo Sapiens
VQVQLRLCM

SEQ ID NO: 1287525 - protein, 9 aa, Homo Sapiens
VIIQRAYTI

SEQ ID NO: 1287526 - protein, 9 aa, Homo Sapiens
VLLSTINEL

SEQ ID NO: 1287527 - protein, 9 aa, Homo Sapiens
NGGKANLYF

SEQ ID NO: 1287528 - protein, 9 aa, Homo Sapiens
RQDIVLSWA

SEQ ID NO: 1287529 - protein, 9 aa, Homo Sapiens
TDRCHCGKT

SEQ ID NO: 1287530 - protein, 9 aa, Homo Sapiens
LISIIKKGL

SEQ ID NO: 1287531 - protein, 9 aa, Homo Sapiens
KSHLILHKR

SEQ ID NO: 1287532 - protein, 9 aa, Homo Sapiens
FDCGVEAIA

SEQ ID NO: 1287533 - protein, 9 aa, Homo Sapiens
TSHTVEKFY

SEQ ID NO: 1287534 - protein, 9 aa, Homo Sapiens
RVFHCNETT

SEQ ID NO: 1287535 - protein, 9 aa, Homo Sapiens
HRKEGSHCL

SEQ ID NO: 1287536 - protein, 9 aa, Homo Sapiens
YECYKGYIL

SEQ ID NO: 1287537 - protein, 9 aa, Homo Sapiens
SLSNSLQNT

SEQ ID NO: 1287538 - protein, 9 aa, Homo Sapiens
KGSKSGNSR

SEQ ID NO: 1287539 - protein, 9 aa, Homo Sapiens
LSMKSLKEL

SEQ ID NO: 1287540 - protein, 9 aa, Homo Sapiens
GLKYVCPCS

SEQ ID NO: 1287541 - protein, 9 aa, Homo Sapiens
FVELEFGMA

SEQ ID NO: 1287542 - protein, 9 aa, Homo Sapiens
NANLGEFWL

SEQ ID NO: 1287543 - protein, 9 aa, Homo Sapiens
YHCNINSQC

SEQ ID NO: 1287544 - protein, 9 aa, Homo Sapiens
LVAICGISV

SEQ ID NO: 1287545 - protein, 9 aa, Homo Sapiens
IHCSGKEET

SEQ ID NO: 1287546 - protein, 9 aa, Homo Sapiens
AGMRYLADI

SEQ ID NO: 1287547 - protein, 9 aa, Homo Sapiens
CCVCCFITP

SEQ ID NO: 1287548 - protein, 9 aa, Homo Sapiens
TADQTSLHF

SEQ ID NO: 1287549 - protein, 9 aa, Homo Sapiens
KSFNTAVKN

SEQ ID NO: 1287550 - protein, 9 aa, Homo Sapiens
LSGGMQLKL

SEQ ID NO: 1287551 - protein, 9 aa, Homo Sapiens
TSNSCVWNT

SEQ ID NO: 1287552 - protein, 9 aa, Homo Sapiens
LDTLVHAKF

SEQ ID NO: 1287553 - protein, 9 aa, Homo Sapiens
LFKTRKAHR

SEQ ID NO: 1287554 - protein, 9 aa, Homo Sapiens
AIHQRIHTC

SEQ ID NO: 1287555 - protein, 9 aa, Homo Sapiens
QENAAVQKI

SEQ ID NO: 1287556 - protein, 9 aa, Homo Sapiens
TFHSYSKML

SEQ ID NO: 1287557 - protein, 9 aa, Homo Sapiens
MTEPSLNPS

SEQ ID NO: 1287558 - protein, 9 aa, Homo Sapiens
PGPAGPPCP

SEQ ID NO: 1287559 - protein, 9 aa, Homo Sapiens
VDLKMMISN

SEQ ID NO: 1287560 - protein, 9 aa, Homo Sapiens
VKMTRNRSK

SEQ ID NO: 1287561 - protein, 9 aa, Homo Sapiens
PITVPDYYK

SEQ ID NO: 1287562 - protein, 9 aa, Homo Sapiens
LSFATSTQN

SEQ ID NO: 1287563 - protein, 9 aa, Homo Sapiens
SFTEIVQDM

SEQ ID NO: 1287564 - protein, 9 aa, Homo Sapiens
HIIKLYKVI

SEQ ID NO: 1287565 - protein, 9 aa, Homo Sapiens
ALKTLCQET

SEQ ID NO: 1287566 - protein, 9 aa, Homo Sapiens
DYSDGSKEF

SEQ ID NO: 1287567 - protein, 9 aa, Homo Sapiens
KMECPTSTS

SEQ ID NO: 1287568 - protein, 9 aa, Homo Sapiens
LLVDYQMYY

SEQ ID NO: 1287569 - protein, 9 aa, Homo Sapiens
DLEENVDKT

SEQ ID NO: 1287570 - protein, 9 aa, Homo Sapiens
LREQFCLKT

SEQ ID NO: 1287571 - protein, 9 aa, Homo Sapiens
NSSWTQDLT

SEQ ID NO: 1287572 - protein, 9 aa, Homo Sapiens
PCSQKRFPS

SEQ ID NO: 1287573 - protein, 9 aa, Homo Sapiens
LDASVKASP

SEQ ID NO: 1287574 - protein, 9 aa, Homo Sapiens
DIDLHIYVS

SEQ ID NO: 1287575 - protein, 9 aa, Homo Sapiens
MLGQDWLVE

SEQ ID NO: 1287576 - protein, 9 aa, Homo Sapiens
LLHVWSFFT

SEQ ID NO: 1287577 - protein, 9 aa, Homo Sapiens
PFYHIVLHS

SEQ ID NO: 1287578 - protein, 9 aa, Homo Sapiens
THLVCVLNS

SEQ ID NO: 1287579 - protein, 9 aa, Homo Sapiens
LHETTRPQE

SEQ ID NO: 1287580 - protein, 9 aa, Homo Sapiens
LSCMLHTVT

SEQ ID NO: 1287581 - protein, 9 aa, Homo Sapiens
STESFLYCC

SEQ ID NO: 1287582 - protein, 9 aa, Homo Sapiens
NSQTKVKCE

SEQ ID NO: 1287583 - protein, 9 aa, Homo Sapiens
FNLDSFRFE

SEQ ID NO: 1287584 - protein, 9 aa, Homo Sapiens
GTLSHSLGN

SEQ ID NO: 1287585 - protein, 9 aa, Homo Sapiens
AQSLPSKPL

SEQ ID NO: 1287586 - protein, 9 aa, Homo Sapiens
KLFNYLFKN

SEQ ID NO: 1287587 - protein, 9 aa, Homo Sapiens
SEQRDLEQM

SEQ ID NO: 1287588 - protein, 9 aa, Homo Sapiens
DWQMSVSGS

SEQ ID NO: 1287589 - protein, 9 aa, Homo Sapiens
IVIVAVEPK

SEQ ID NO: 1287590 - protein, 9 aa, Homo Sapiens
LQAKIGMQP

SEQ ID NO: 1287591 - protein, 9 aa, Homo Sapiens
RGAPKLGSG

SEQ ID NO: 1287592 - protein, 9 aa, Homo Sapiens
VIYGKCCTL

SEQ ID NO: 1287593 - protein, 9 aa, Homo Sapiens
DTYIGHKGP

SEQ ID NO: 1287594 - protein, 9 aa, Homo Sapiens
NIQDWSLKL

SEQ ID NO: 1287595 - protein, 9 aa, Homo Sapiens
SDTAEIVLE

SEQ ID NO: 1287596 - protein, 9 aa, Homo Sapiens
KYRPQTLNY

SEQ ID NO: 1287597 - protein, 9 aa, Homo Sapiens
VNTTSFPCP

SEQ ID NO: 1287598 - protein, 9 aa, Homo Sapiens
EPAVNRTVN

SEQ ID NO: 1287599 - protein, 9 aa, Homo Sapiens
NYISNNTLA

SEQ ID NO: 1287600 - protein, 9 aa, Homo Sapiens
WICYSGIRV

SEQ ID NO: 1287601 - protein, 9 aa, Homo Sapiens
VESYTLTIE

SEQ ID NO: 1287602 - protein, 9 aa, Homo Sapiens
RNLVSMGFV

SEQ ID NO: 1287603 - protein, 9 aa, Homo Sapiens
RSFCDKDFR

SEQ ID NO: 1287604 - protein, 9 aa, Homo Sapiens
KREAALILC

SEQ ID NO: 1287605 - protein, 9 aa, Homo Sapiens
TLQDIVEGM

SEQ ID NO: 1287606 - protein, 9 aa, Homo Sapiens
MCESCGGLW

SEQ ID NO: 1287607 - protein, 9 aa, Homo Sapiens
MSNTQAEMS

SEQ ID NO: 1287608 - protein, 9 aa, Homo Sapiens
NSIFHVGSE

SEQ ID NO: 1287609 - protein, 9 aa, Homo Sapiens
SLPSKPLLR

SEQ ID NO: 1287610 - protein, 9 aa, Homo Sapiens
NELQQTLEN

SEQ ID NO: 1287611 - protein, 9 aa, Homo Sapiens
RSRIDEKFL

SEQ ID NO: 1287612 - protein, 9 aa, Homo Sapiens
LPHSHASHN

SEQ ID NO: 1287613 - protein, 9 aa, Homo Sapiens
TKIKEKKKN

SEQ ID NO: 1287614 - protein, 9 aa, Homo Sapiens
YIHSRNISY

SEQ ID NO: 1287615 - protein, 9 aa, Homo Sapiens
DRMKESSTS

SEQ ID NO: 1287616 - protein, 9 aa, Homo Sapiens
LENSTESFL

SEQ ID NO: 1287617 - protein, 9 aa, Homo Sapiens
NPQFMFDIH

SEQ ID NO: 1287618 - protein, 9 aa, Homo Sapiens
TKSQVSKHH

SEQ ID NO: 1287619 - protein, 9 aa, Homo Sapiens
DCHIKLTDF

SEQ ID NO: 1287620 - protein, 9 aa, Homo Sapiens
ATYDISSGN

SEQ ID NO: 1287621 - protein, 9 aa, Homo Sapiens
NEYRHWIKD

SEQ ID NO: 1287622 - protein, 9 aa, Homo Sapiens
SFKTSGDLH

SEQ ID NO: 1287623 - protein, 9 aa, Homo Sapiens
SLLISDTKP

SEQ ID NO: 1287624 - protein, 9 aa, Homo Sapiens
KTENNVLNK

SEQ ID NO: 1287625 - protein, 9 aa, Homo Sapiens
LEHKVLGPY

SEQ ID NO: 1287626 - protein, 9 aa, Homo Sapiens
QLIDCQEFV

SEQ ID NO: 1287627 - protein, 9 aa, Homo Sapiens
ALEFQDIGN

SEQ ID NO: 1287628 - protein, 9 aa, Homo Sapiens
SLICSVPGP

SEQ ID NO: 1287629 - protein, 9 aa, Homo Sapiens
DQTSLHFVD

SEQ ID NO: 1287630 - protein, 9 aa, Homo Sapiens
LYSSYWRIT

SEQ ID NO: 1287631 - protein, 9 aa, Homo Sapiens
YFEVHTTGV

SEQ ID NO: 1287632 - protein, 9 aa, Homo Sapiens
QSNLKSNIS

SEQ ID NO: 1287633 - protein, 9 aa, Homo Sapiens
PNKVSPASS

SEQ ID NO: 1287634 - protein, 9 aa, Homo Sapiens
QKPIQLYSS

SEQ ID NO: 1287635 - protein, 9 aa, Homo Sapiens
TPCWMAHEV

SEQ ID NO: 1287636 - protein, 9 aa, Homo Sapiens
GKANLYFLL

SEQ ID NO: 1287637 - protein, 9 aa, Homo Sapiens
AFSLSNSLQ

SEQ ID NO: 1287638 - protein, 9 aa, Homo Sapiens
EFAYGGHHY

SEQ ID NO: 1287639 - protein, 9 aa, Homo Sapiens
QNNDTFDLH

SEQ ID NO: 1287640 - protein, 9 aa, Homo Sapiens
GHWRTHLGY

SEQ ID NO: 1287641 - protein, 9 aa, Homo Sapiens
LCQYAAASQ

SEQ ID NO: 1287642 - protein, 9 aa, Homo Sapiens
LYVTSTYKS

SEQ ID NO: 1287643 - protein, 9 aa, Homo Sapiens
KEYISVIIA

SEQ ID NO: 1287644 - protein, 9 aa, Homo Sapiens
WIKLCTFHG

SEQ ID NO: 1287645 - protein, 9 aa, Homo Sapiens
QPVEHSAPK

SEQ ID NO: 1287646 - protein, 9 aa, Homo Sapiens
QEWTKLYWE

SEQ ID NO: 1287647 - protein, 9 aa, Homo Sapiens
TDIVACSTI

SEQ ID NO: 1287648 - protein, 9 aa, Homo Sapiens
MECPTSTST

SEQ ID NO: 1287649 - protein, 9 aa, Homo Sapiens
YNFKQEEKL

SEQ ID NO: 1287650 - protein, 9 aa, Homo Sapiens
FHVGSEDKK

SEQ ID NO: 1287651 - protein, 9 aa, Homo Sapiens
EFHKHDYGD

SEQ ID NO: 1287652 - protein, 9 aa, Homo Sapiens
INAFSLSNS

SEQ ID NO: 1287653 - protein, 9 aa, Homo Sapiens
KSMLYSVQQ

SEQ ID NO: 1287654 - protein, 9 aa, Homo Sapiens
HAAATNCHS

SEQ ID NO: 1287655 - protein, 9 aa, Homo Sapiens
KFHTNLLHQ

SEQ ID NO: 1287656 - protein, 9 aa, Homo Sapiens
KVDLKMMIS

SEQ ID NO: 1287657 - protein, 9 aa, Homo Sapiens
EQFVCLMAY

SEQ ID NO: 1287658 - protein, 9 aa, Homo Sapiens
CGVEAIATR

SEQ ID NO: 1287659 - protein, 9 aa, Homo Sapiens
YYLQKNSMS

SEQ ID NO: 1287660 - protein, 9 aa, Homo Sapiens
LLLCVHEQK

SEQ ID NO: 1287661 - protein, 9 aa, Homo Sapiens
LANCVLSRD

SEQ ID NO: 1287662 - protein, 9 aa, Homo Sapiens
SSILTSIHS

SEQ ID NO: 1287663 - protein, 9 aa, Homo Sapiens
DGKDVATKV

SEQ ID NO: 1287664 - protein, 9 aa, Homo Sapiens
NHFDRRKNC

SEQ ID NO: 1287665 - protein, 9 aa, Homo Sapiens
FSLSNSLQN

SEQ ID NO: 1287666 - protein, 9 aa, Homo Sapiens
HFWVTILPS

SEQ ID NO: 1287667 - protein, 9 aa, Homo Sapiens
EIPIKMECP

SEQ ID NO: 1287668 - protein, 9 aa, Homo Sapiens
GSLNLLWQE

SEQ ID NO: 1287669 - protein, 9 aa, Homo Sapiens
DTEDNIDNI

SEQ ID NO: 1287670 - protein, 9 aa, Homo Sapiens
LLIDFFQGL

SEQ ID NO: 1287671 - protein, 9 aa, Homo Sapiens
KEHMKLHSY

SEQ ID NO: 1287672 - protein, 9 aa, Homo Sapiens
QRINIGENP

SEQ ID NO: 1287673 - protein, 9 aa, Homo Sapiens
IFFQRSVTG

SEQ ID NO: 1287674 - protein, 9 aa, Homo Sapiens
TFTTMTPTH

SEQ ID NO: 1287675 - protein, 9 aa, Homo Sapiens
VLLGSITCN

SEQ ID NO: 1287676 - protein, 9 aa, Homo Sapiens
VACSTIDQA

SEQ ID NO: 1287677 - protein, 9 aa, Homo Sapiens
CNIIAAFIW

SEQ ID NO: 1287678 - protein, 9 aa, Homo Sapiens
KKTMEINGT

SEQ ID NO: 1287679 - protein, 9 aa, Homo Sapiens
AEGHYASKN

SEQ ID NO: 1287680 - protein, 9 aa, Homo Sapiens
KLLQVVFRR

SEQ ID NO: 1287681 - protein, 9 aa, Homo Sapiens
GMRGLPCAV

SEQ ID NO: 1287682 - protein, 9 aa, Homo Sapiens
LPQIINKMI

SEQ ID NO: 1287683 - protein, 9 aa, Homo Sapiens
CLLHARKHI

SEQ ID NO: 1287684 - protein, 9 aa, Homo Sapiens
KPCFFSHLP

SEQ ID NO: 1287685 - protein, 9 aa, Homo Sapiens
LWDTAGQEL

SEQ ID NO: 1287686 - protein, 9 aa, Homo Sapiens
CPLMVLFCL

SEQ ID NO: 1287687 - protein, 9 aa, Homo Sapiens
TPIVIVAVE

SEQ ID NO: 1287688 - protein, 9 aa, Homo Sapiens
YSLDTSVLF

SEQ ID NO: 1287689 - protein, 9 aa, Homo Sapiens
LTPASLHKE

SEQ ID NO: 1287690 - protein, 9 aa, Homo Sapiens
DNKYKENYK

SEQ ID NO: 1287691 - protein, 9 aa, Homo Sapiens
KSDVSRCNL

SEQ ID NO: 1287692 - protein, 9 aa, Homo Sapiens
LSTQERSFI

SEQ ID NO: 1287693 - protein, 9 aa, Homo Sapiens
SVGTDNFVL

SEQ ID NO: 1287694 - protein, 9 aa, Homo Sapiens
AQCAGVELY

SEQ ID NO: 1287695 - protein, 9 aa, Homo Sapiens
IHETSNSDM

SEQ ID NO: 1287696 - protein, 9 aa, Homo Sapiens
VSSVLANGM

SEQ ID NO: 1287697 - protein, 9 aa, Homo Sapiens
TTTIVISAT

SEQ ID NO: 1287698 - protein, 9 aa, Homo Sapiens
SGQLEKLKS

SEQ ID NO: 1287699 - protein, 9 aa, Homo Sapiens
LDQGSRHDS

SEQ ID NO: 1287700 - protein, 9 aa, Homo Sapiens
SWTQDLTQV

SEQ ID NO: 1287701 - protein, 9 aa, Homo Sapiens
SLIWIHDIR

SEQ ID NO: 1287702 - protein, 9 aa, Homo Sapiens
QYPLKKLDF

SEQ ID NO: 1287703 - protein, 9 aa, Homo Sapiens
SENVLDPAS

SEQ ID NO: 1287704 - protein, 9 aa, Homo Sapiens
CEVLGCCYS

SEQ ID NO: 1287705 - protein, 9 aa, Homo Sapiens
LRPENVLVA

SEQ ID NO: 1287706 - protein, 9 aa, Homo Sapiens
QGQCIAAGC

SEQ ID NO: 1287707 - protein, 9 aa, Homo Sapiens
TQKPRLTST

SEQ ID NO: 1287708 - protein, 9 aa, Homo Sapiens
FVVWIVIGF

SEQ ID NO: 1287709 - protein, 9 aa, Homo Sapiens
FGIRYYDYD

SEQ ID NO: 1287710 - protein, 9 aa, Homo Sapiens
YSIKRSAFD

SEQ ID NO: 1287711 - protein, 9 aa, Homo Sapiens
SHGKLKVLA

SEQ ID NO: 1287712 - protein, 9 aa, Homo Sapiens
DICVQGQCI

SEQ ID NO: 1287713 - protein, 9 aa, Homo Sapiens
TTYEIMTVH

SEQ ID NO: 1287714 - protein, 9 aa, Homo Sapiens
HGTFVGRIV

SEQ ID NO: 1287715 - protein, 9 aa, Homo Sapiens
SFLAEKHLL

SEQ ID NO: 1287716 - protein, 9 aa, Homo Sapiens
AGKLFIVDS

SEQ ID NO: 1287717 - protein, 9 aa, Homo Sapiens
LHAASLGKL

SEQ ID NO: 1287718 - protein, 9 aa, Homo Sapiens
AQCSTDFTP

SEQ ID NO: 1287719 - protein, 9 aa, Homo Sapiens
SCFHSSLTE

SEQ ID NO: 1287720 - protein, 9 aa, Homo Sapiens
TDGVMWEYE

SEQ ID NO: 1287721 - protein, 9 aa, Homo Sapiens
LIDSIANSF

SEQ ID NO: 1287722 - protein, 9 aa, Homo Sapiens
TISFTEIVQ

SEQ ID NO: 1287723 - protein, 9 aa, Homo Sapiens
EISQTLFGI

SEQ ID NO: 1287724 - protein, 9 aa, Homo Sapiens
KMETYLMMA

SEQ ID NO: 1287725 - protein, 9 aa, Homo Sapiens
VVFNAANML

SEQ ID NO: 1287726 - protein, 9 aa, Homo Sapiens
STQNNMGLV

SEQ ID NO: 1287727 - protein, 9 aa, Homo Sapiens
FSVFEDYGL

SEQ ID NO: 1287728 - protein, 9 aa, Homo Sapiens
EEKRRYSFL

SEQ ID NO: 1287729 - protein, 9 aa, Homo Sapiens
PIVIVAVEP

SEQ ID NO: 1287730 - protein, 9 aa, Homo Sapiens
SQITEFENL

SEQ ID NO: 1287731 - protein, 9 aa, Homo Sapiens
IIQRGKGLG

SEQ ID NO: 1287732 - protein, 9 aa, Homo Sapiens
VFTSQKSDD

SEQ ID NO: 1287733 - protein, 9 aa, Homo Sapiens
ESLYSAKTK

SEQ ID NO: 1287734 - protein, 9 aa, Homo Sapiens
YYYEVTPPD

SEQ ID NO: 1287735 - protein, 9 aa, Homo Sapiens
LDLSLVETV

SEQ ID NO: 1287736 - protein, 9 aa, Homo Sapiens
AKYKDDFST

SEQ ID NO: 1287737 - protein, 9 aa, Homo Sapiens
QYHQLNHTV

SEQ ID NO: 1287738 - protein, 9 aa, Homo Sapiens
RSTADYSLY

SEQ ID NO: 1287739 - protein, 9 aa, Homo Sapiens
VSSILTSIH

SEQ ID NO: 1287740 - protein, 9 aa, Homo Sapiens
GYGQHVSRQ

SEQ ID NO: 1287741 - protein, 9 aa, Homo Sapiens
FEWQKLWCA

SEQ ID NO: 1287742 - protein, 9 aa, Homo Sapiens
GFPLSGGQP

SEQ ID NO: 1287743 - protein, 9 aa, Homo Sapiens
SSAKKNSNL

SEQ ID NO: 1287744 - protein, 9 aa, Homo Sapiens
LSFYVYDNN

SEQ ID NO: 1287745 - protein, 9 aa, Homo Sapiens
RYPVLMSHR

SEQ ID NO: 1287746 - protein, 9 aa, Homo Sapiens
NTLFAINFF

SEQ ID NO: 1287747 - protein, 9 aa, Homo Sapiens
TKACKLQEV

SEQ ID NO: 1287748 - protein, 9 aa, Homo Sapiens
VAALRGEGP

SEQ ID NO: 1287749 - protein, 9 aa, Homo Sapiens
LRSLHLKME

SEQ ID NO: 1287750 - protein, 9 aa, Homo Sapiens
TCGNFKPSQ

SEQ ID NO: 1287751 - protein, 9 aa, Homo Sapiens
TLLLYPVGL

SEQ ID NO: 1287752 - protein, 9 aa, Homo Sapiens
VSRQTSGFG

SEQ ID NO: 1287753 - protein, 9 aa, Homo Sapiens
KRGPEVQTD

SEQ ID NO: 1287754 - protein, 9 aa, Homo Sapiens
RAALKETLL

SEQ ID NO: 1287755 - protein, 9 aa, Homo Sapiens
SAGADIETH

SEQ ID NO: 1287756 - protein, 9 aa, Homo Sapiens
HLLSQEVVK

SEQ ID NO: 1287757 - protein, 9 aa, Homo Sapiens
RLWHVLETD

SEQ ID NO: 1287758 - protein, 9 aa, Homo Sapiens
WECDPSLNT

SEQ ID NO: 1287759 - protein, 9 aa, Homo Sapiens
DQVAMGRQL

SEQ ID NO: 1287760 - protein, 9 aa, Homo Sapiens
LESWVLGSG

SEQ ID NO: 1287761 - protein, 9 aa, Homo Sapiens
FFLAMVHVA

SEQ ID NO: 1287762 - protein, 9 aa, Homo Sapiens
VEGRNYEKA

SEQ ID NO: 1287763 - protein, 9 aa, Homo Sapiens
VTKTRIMLQ

SEQ ID NO: 1287764 - protein, 9 aa, Homo Sapiens
SPQSQLMQC

SEQ ID NO: 1287765 - protein, 9 aa, Homo Sapiens
FFCILLIIA

SEQ ID NO: 1287766 - protein, 9 aa, Homo Sapiens
DGNMVEENT

SEQ ID NO: 1287767 - protein, 9 aa, Homo Sapiens
IDPVCVDYI

SEQ ID NO: 1287768 - protein, 9 aa, Homo Sapiens
TTTTIVISA

SEQ ID NO: 1287769 - protein, 9 aa, Homo Sapiens
HLQGNLEDP

SEQ ID NO: 1287770 - protein, 9 aa, Homo Sapiens
VCAQNTVIC

SEQ ID NO: 1287771 - protein, 9 aa, Homo Sapiens
YTIQWMEKT

SEQ ID NO: 1287772 - protein, 9 aa, Homo Sapiens
ITSGNMNHC

SEQ ID NO: 1287773 - protein, 9 aa, Homo Sapiens
EKQPSHRDL

SEQ ID NO: 1287774 - protein, 9 aa, Homo Sapiens
IMFSLCYLH

SEQ ID NO: 1287775 - protein, 9 aa, Homo Sapiens
LHTIEIARQ

SEQ ID NO: 1287776 - protein, 9 aa, Homo Sapiens
SYNSQVTQL

SEQ ID NO: 1287777 - protein, 9 aa, Homo Sapiens
IKNPQFMFD

SEQ ID NO: 1287778 - protein, 9 aa, Homo Sapiens
FLLAIQMNE

SEQ ID NO: 1287779 - protein, 9 aa, Homo Sapiens
NSSTEDCIK

SEQ ID NO: 1287780 - protein, 9 aa, Homo Sapiens
SQLLMYPYV

SEQ ID NO: 1287781 - protein, 9 aa, Homo Sapiens
LVEILTTNC

SEQ ID NO: 1287782 - protein, 9 aa, Homo Sapiens
FDEFQYQME

SEQ ID NO: 1287783 - protein, 9 aa, Homo Sapiens
VDTRVVCDG

SEQ ID NO: 1287784 - protein, 9 aa, Homo Sapiens
IKKGLQYVE

SEQ ID NO: 1287785 - protein, 9 aa, Homo Sapiens
IYVSFLDEE

SEQ ID NO: 1287786 - protein, 9 aa, Homo Sapiens
LFESDMKRK

SEQ ID NO: 1287787 - protein, 9 aa, Homo Sapiens
NPNIVIRIY

SEQ ID NO: 1287788 - protein, 9 aa, Homo Sapiens
QDSQYGELI

SEQ ID NO: 1287789 - protein, 9 aa, Homo Sapiens
QHDYPSYTA

SEQ ID NO: 1287790 - protein, 9 aa, Homo Sapiens
GRIVQDLGL

SEQ ID NO: 1287791 - protein, 9 aa, Homo Sapiens
GTEQYFWSP

SEQ ID NO: 1287792 - protein, 9 aa, Homo Sapiens
HVQLIVNDG

SEQ ID NO: 1287793 - protein, 9 aa, Homo Sapiens
NENEKSYAS

SEQ ID NO: 1287794 - protein, 9 aa, Homo Sapiens
DQDVKIKLK

SEQ ID NO: 1287795 - protein, 9 aa, Homo Sapiens
YCHNMYEEM

SEQ ID NO: 1287796 - protein, 9 aa, Homo Sapiens
HLVCYMVQF

SEQ ID NO: 1287797 - protein, 9 aa, Homo Sapiens
SYCKAQCKQ

SEQ ID NO: 1287798 - protein, 9 aa, Homo Sapiens
CIAAGCDHV

SEQ ID NO: 1287799 - protein, 9 aa, Homo Sapiens
KAQVKKINQ

SEQ ID NO: 1287800 - protein, 9 aa, Homo Sapiens
QSLVESSHS

SEQ ID NO: 1287801 - protein, 9 aa, Homo Sapiens
KMMISNPWE

SEQ ID NO: 1287802 - protein, 9 aa, Homo Sapiens
EKVDLKMMI

SEQ ID NO: 1287803 - protein, 9 aa, Homo Sapiens
SLATMDSQP

SEQ ID NO: 1287804 - protein, 9 aa, Homo Sapiens
ELETSLFKT

SEQ ID NO: 1287805 - protein, 9 aa, Homo Sapiens
NPELIKCPW

SEQ ID NO: 1287806 - protein, 9 aa, Homo Sapiens
DSHQLFVCN

SEQ ID NO: 1287807 - protein, 9 aa, Homo Sapiens
CWMAHEVME

SEQ ID NO: 1287808 - protein, 9 aa, Homo Sapiens
PSYLDELYL

SEQ ID NO: 1287809 - protein, 9 aa, Homo Sapiens
TYILVTLSH

SEQ ID NO: 1287810 - protein, 9 aa, Homo Sapiens
KAKVIAYEA

SEQ ID NO: 1287811 - protein, 9 aa, Homo Sapiens
STAVPSFLT

SEQ ID NO: 1287812 - protein, 9 aa, Homo Sapiens
EGRYDGDSI

SEQ ID NO: 1287813 - protein, 9 aa, Homo Sapiens
VWVARNPHG

SEQ ID NO: 1287814 - protein, 9 aa, Homo Sapiens
VEQIHYGER

SEQ ID NO: 1287815 - protein, 9 aa, Homo Sapiens
SAALHSTQS

SEQ ID NO: 1287816 - protein, 9 aa, Homo Sapiens
ANSFLKENV

SEQ ID NO: 1287817 - protein, 9 aa, Homo Sapiens
FVFFAEDVG

SEQ ID NO: 1287818 - protein, 9 aa, Homo Sapiens
RYAESLCQY

SEQ ID NO: 1287819 - protein, 9 aa, Homo Sapiens
ASCETERIR

SEQ ID NO: 1287820 - protein, 9 aa, Homo Sapiens
YTGRLCITH

SEQ ID NO: 1287821 - protein, 9 aa, Homo Sapiens
IIMSTLTFV

SEQ ID NO: 1287822 - protein, 9 aa, Homo Sapiens
VLTVHLVIK

SEQ ID NO: 1287823 - protein, 9 aa, Homo Sapiens
PHSQKMENL

SEQ ID NO: 1287824 - protein, 9 aa, Homo Sapiens
SIALKNIRC

SEQ ID NO: 1287825 - protein, 9 aa, Homo Sapiens
LEKGSHGKL

SEQ ID NO: 1287826 - protein, 9 aa, Homo Sapiens
KNQDSQYGE

SEQ ID NO: 1287827 - protein, 9 aa, Homo Sapiens
ICASIGITN

SEQ ID NO: 1287828 - protein, 9 aa, Homo Sapiens
VLTDFDGKD

SEQ ID NO: 1287829 - protein, 9 aa, Homo Sapiens
KERKGYSHT

SEQ ID NO: 1287830 - protein, 9 aa, Homo Sapiens
TVLNQTSSN

SEQ ID NO: 1287831 - protein, 9 aa, Homo Sapiens
IRHILDTKQ

SEQ ID NO: 1287832 - protein, 9 aa, Homo Sapiens
SHRVCWMII

SEQ ID NO: 1287833 - protein, 9 aa, Homo Sapiens
GSDSTFHKR

SEQ ID NO: 1287834 - protein, 9 aa, Homo Sapiens
EHVGFRIFI

SEQ ID NO: 1287835 - protein, 9 aa, Homo Sapiens
DCLVIEYLL

SEQ ID NO: 1287836 - protein, 9 aa, Homo Sapiens
QPNLYPTVG

SEQ ID NO: 1287837 - protein, 9 aa, Homo Sapiens
EGGSGNFTL

SEQ ID NO: 1287838 - protein, 9 aa, Homo Sapiens
IPLKAFPEH

SEQ ID NO: 1287839 - protein, 9 aa, Homo Sapiens
TELQLHIRE

SEQ ID NO: 1287840 - protein, 9 aa, Homo Sapiens
MFSIGRSYD

SEQ ID NO: 1287841 - protein, 9 aa, Homo Sapiens
KMRQHYDRI

SEQ ID NO: 1287842 - protein, 9 aa, Homo Sapiens
WLMTYVCAV

SEQ ID NO: 1287843 - protein, 9 aa, Homo Sapiens
IDVLKKIDI

SEQ ID NO: 1287844 - protein, 9 aa, Homo Sapiens
CHALFTQSG

SEQ ID NO: 1287845 - protein, 9 aa, Homo Sapiens
LAGDDAQKR

SEQ ID NO: 1287846 - protein, 9 aa, Homo Sapiens
HVYKGEEAT

SEQ ID NO: 1287847 - protein, 9 aa, Homo Sapiens
EQFTCIPSC

SEQ ID NO: 1287848 - protein, 9 aa, Homo Sapiens
LSQDEQGVD

SEQ ID NO: 1287849 - protein, 9 aa, Homo Sapiens
DLCVLNLIL

SEQ ID NO: 1287850 - protein, 9 aa, Homo Sapiens
YLICQRCNE

SEQ ID NO: 1287851 - protein, 9 aa, Homo Sapiens
LHVKQNQHE

SEQ ID NO: 1287852 - protein, 9 aa, Homo Sapiens
ICGISVILI

SEQ ID NO: 1287853 - protein, 9 aa, Homo Sapiens
QYPYMNGRL

SEQ ID NO: 1287854 - protein, 9 aa, Homo Sapiens
ELLQEKHGQ

SEQ ID NO: 1287855 - protein, 9 aa, Homo Sapiens
KNKEFLKEK

SEQ ID NO: 1287856 - protein, 9 aa, Homo Sapiens
RDCFNIFTK

SEQ ID NO: 1287857 - protein, 9 aa, Homo Sapiens
KSSEDATYD

SEQ ID NO: 1287858 - protein, 9 aa, Homo Sapiens
PLKPNGIIL

SEQ ID NO: 1287859 - protein, 9 aa, Homo Sapiens
VTQLTVEVH

SEQ ID NO: 1287860 - protein, 9 aa, Homo Sapiens
TLDMDGNVD

SEQ ID NO: 1287861 - protein, 9 aa, Homo Sapiens
LTLNRKRKW

SEQ ID NO: 1287862 - protein, 9 aa, Homo Sapiens
CMFGIRYYD

SEQ ID NO: 1287863 - protein, 9 aa, Homo Sapiens
LDDQDVKIK

SEQ ID NO: 1287864 - protein, 9 aa, Homo Sapiens
AIVKVSFDL

SEQ ID NO: 1287865 - protein, 9 aa, Homo Sapiens
ALTNEGGVF

SEQ ID NO: 1287866 - protein, 9 aa, Homo Sapiens
GICFNIALL

SEQ ID NO: 1287867 - protein, 9 aa, Homo Sapiens
GDCLSSTCE

SEQ ID NO: 1287868 - protein, 9 aa, Homo Sapiens
FTYALLCHD

SEQ ID NO: 1287869 - protein, 9 aa, Homo Sapiens
DDKEGGLFT

SEQ ID NO: 1287870 - protein, 9 aa, Homo Sapiens
VEKCSPIWV

SEQ ID NO: 1287871 - protein, 9 aa, Homo Sapiens
WRTHLGYFF

SEQ ID NO: 1287872 - protein, 9 aa, Homo Sapiens
VYQDCERRW

SEQ ID NO: 1287873 - protein, 9 aa, Homo Sapiens
RLKIDTSYK

SEQ ID NO: 1287874 - protein, 9 aa, Homo Sapiens
VEEAHSSED

SEQ ID NO: 1287875 - protein, 9 aa, Homo Sapiens
EIYMTLMKN

SEQ ID NO: 1287876 - protein, 9 aa, Homo Sapiens
VIHTLAKEF

SEQ ID NO: 1287877 - protein, 9 aa, Homo Sapiens
PGSYQCKCL

SEQ ID NO: 1287878 - protein, 9 aa, Homo Sapiens
EVLSTPSDS

SEQ ID NO: 1287879 - protein, 9 aa, Homo Sapiens
KKMRSRIDE

SEQ ID NO: 1287880 - protein, 9 aa, Homo Sapiens
QVVTMLGQD

SEQ ID NO: 1287881 - protein, 9 aa, Homo Sapiens
QKRLIHERT

SEQ ID NO: 1287882 - protein, 9 aa, Homo Sapiens
VGSFADQDD

SEQ ID NO: 1287883 - protein, 9 aa, Homo Sapiens
SSCTAQGLK

SEQ ID NO: 1287884 - protein, 9 aa, Homo Sapiens
LEEKRRYSF

SEQ ID NO: 1287885 - protein, 9 aa, Homo Sapiens
RFQSAYETG

SEQ ID NO: 1287886 - protein, 9 aa, Homo Sapiens
LLEDQELQL

SEQ ID NO: 1287887 - protein, 9 aa, Homo Sapiens
LRCVLQYQK

SEQ ID NO: 1287888 - protein, 9 aa, Homo Sapiens
MYPYVYSVK

SEQ ID NO: 1287889 - protein, 9 aa, Homo Sapiens
EKLYPVWKL

SEQ ID NO: 1287890 - protein, 9 aa, Homo Sapiens
HSKAVSYAK

SEQ ID NO: 1287891 - protein, 9 aa, Homo Sapiens
VKPPVICSN

SEQ ID NO: 1287892 - protein, 9 aa, Homo Sapiens
SLRQFLESW

SEQ ID NO: 1287893 - protein, 9 aa, Homo Sapiens
VLSGSECGN

SEQ ID NO: 1287894 - protein, 9 aa, Homo Sapiens
TANATVAAF

SEQ ID NO: 1287895 - protein, 9 aa, Homo Sapiens
FCSLVKMTR

SEQ ID NO: 1287896 - protein, 9 aa, Homo Sapiens
MPPSSQSDD

SEQ ID NO: 1287897 - protein, 9 aa, Homo Sapiens
VSPLKPNGI

SEQ ID NO: 1287898 - protein, 9 aa, Homo Sapiens
PSHRDLPRR

SEQ ID NO: 1287899 - protein, 9 aa, Homo Sapiens
AVAHACYHS

SEQ ID NO: 1287900 - protein, 9 aa, Homo Sapiens
VMQDRLEQA

SEQ ID NO: 1287901 - protein, 9 aa, Homo Sapiens
RNPLGDLIE

SEQ ID NO: 1287902 - protein, 9 aa, Homo Sapiens
SYSGKASRS

SEQ ID NO: 1287903 - protein, 9 aa, Homo Sapiens
EIRAHATAN

SEQ ID NO: 1287904 - protein, 9 aa, Homo Sapiens
KNSMSCQGI

SEQ ID NO: 1287905 - protein, 9 aa, Homo Sapiens
LHISMIQLM

SEQ ID NO: 1287906 - protein, 9 aa, Homo Sapiens
HAKFEFIVR

SEQ ID NO: 1287907 - protein, 9 aa, Homo Sapiens
VAAVTVCIG

SEQ ID NO: 1287908 - protein, 9 aa, Homo Sapiens
KELQGLDGL

SEQ ID NO: 1287909 - protein, 9 aa, Homo Sapiens
TTVYALQTK

SEQ ID NO: 1287910 - protein, 9 aa, Homo Sapiens
LFDEKFYCL

SEQ ID NO: 1287911 - protein, 9 aa, Homo Sapiens
SLPEFPDSC

SEQ ID NO: 1287912 - protein, 9 aa, Homo Sapiens
AVEHALMAL

SEQ ID NO: 1287913 - protein, 9 aa, Homo Sapiens
NYSLAPITL

SEQ ID NO: 1287914 - protein, 9 aa, Homo Sapiens
KDELDKIVA

SEQ ID NO: 1287915 - protein, 9 aa, Homo Sapiens
ISNKMRQHY

SEQ ID NO: 1287916 - protein, 9 aa, Homo Sapiens
YETGQDLVN

SEQ ID NO: 1287917 - protein, 9 aa, Homo Sapiens
VTLSHLAQN

SEQ ID NO: 1287918 - protein, 9 aa, Homo Sapiens
TLAKEFDIY

SEQ ID NO: 1287919 - protein, 9 aa, Homo Sapiens
VNLQRSKTA

SEQ ID NO: 1287920 - protein, 9 aa, Homo Sapiens
ENSNKNVDC

SEQ ID NO: 1287921 - protein, 9 aa, Homo Sapiens
DAHHRKAVS

SEQ ID NO: 1287922 - protein, 9 aa, Homo Sapiens
YAMVFMVLC

SEQ ID NO: 1287923 - protein, 9 aa, Homo Sapiens
QLEKGSHGK

SEQ ID NO: 1287924 - protein, 9 aa, Homo Sapiens
CRGKNHPPN

SEQ ID NO: 1287925 - protein, 9 aa, Homo Sapiens
KSANSFTVS

SEQ ID NO: 1287926 - protein, 9 aa, Homo Sapiens
KLYWEIDKL

SEQ ID NO: 1287927 - protein, 9 aa, Homo Sapiens
PMSAVVCIW

SEQ ID NO: 1287928 - protein, 9 aa, Homo Sapiens
LHSTQSQEE

SEQ ID NO: 1287929 - protein, 9 aa, Homo Sapiens
SLDLSLVET

SEQ ID NO: 1287930 - protein, 9 aa, Homo Sapiens
TFDYITKDL

SEQ ID NO: 1287931 - protein, 9 aa, Homo Sapiens
VVMDQEPAV

SEQ ID NO: 1287932 - protein, 9 aa, Homo Sapiens
LTAVQGITR

SEQ ID NO: 1287933 - protein, 9 aa, Homo Sapiens
LVKMTRNRS

SEQ ID NO: 1287934 - protein, 9 aa, Homo Sapiens
EMLKVSSIG

SEQ ID NO: 1287935 - protein, 9 aa, Homo Sapiens
QFTTLCGVY

SEQ ID NO: 1287936 - protein, 9 aa, Homo Sapiens
GIDVNMCCP

SEQ ID NO: 1287937 - protein, 9 aa, Homo Sapiens
VIVLEEGVK

SEQ ID NO: 1287938 - protein, 9 aa, Homo Sapiens
FTSKYSLSS

SEQ ID NO: 1287939 - protein, 9 aa, Homo Sapiens
GLKCHRSFI

SEQ ID NO: 1287940 - protein, 9 aa, Homo Sapiens
CNLEKEMAH

SEQ ID NO: 1287941 - protein, 9 aa, Homo Sapiens
MGFVISNPD

SEQ ID NO: 1287942 - protein, 9 aa, Homo Sapiens
LDLPLSILT

SEQ ID NO: 1287943 - protein, 9 aa, Homo Sapiens
PGHCQHCGT

SEQ ID NO: 1287944 - protein, 9 aa, Homo Sapiens
IDFGHFFDH

SEQ ID NO: 1287945 - protein, 9 aa, Homo Sapiens
ISIAEWSKQ

SEQ ID NO: 1287946 - protein, 9 aa, Homo Sapiens
LYPGIQVIF

SEQ ID NO: 1287947 - protein, 9 aa, Homo Sapiens
EALPTYCVH

SEQ ID NO: 1287948 - protein, 9 aa, Homo Sapiens
TEMDLREVF

SEQ ID NO: 1287949 - protein, 9 aa, Homo Sapiens
LSNSLQNTN

SEQ ID NO: 1287950 - protein, 9 aa, Homo Sapiens
GEDPEMEPV

SEQ ID NO: 1287951 - protein, 9 aa, Homo Sapiens
ISLFHSDLI

SEQ ID NO: 1287952 - protein, 9 aa, Homo Sapiens
DRKQMLATL

SEQ ID NO: 1287953 - protein, 9 aa, Homo Sapiens
DLYSSLEQF

SEQ ID NO: 1287954 - protein, 9 aa, Homo Sapiens
RKLNEQSHT

SEQ ID NO: 1287955 - protein, 9 aa, Homo Sapiens
VFNIVLWIM

SEQ ID NO: 1287956 - protein, 9 aa, Homo Sapiens
LKWNELNVC

SEQ ID NO: 1287957 - protein, 9 aa, Homo Sapiens
SISSCTAQG

SEQ ID NO: 1287958 - protein, 9 aa, Homo Sapiens
TSVLFDPFE

SEQ ID NO: 1287959 - protein, 9 aa, Homo Sapiens
TEPSLRCVL

SEQ ID NO: 1287960 - protein, 9 aa, Homo Sapiens
PPGSDMPPS

SEQ ID NO: 1287961 - protein, 9 aa, Homo Sapiens
SLCQYAAAS

SEQ ID NO: 1287962 - protein, 9 aa, Homo Sapiens
VIRHILDTK

SEQ ID NO: 1287963 - protein, 9 aa, Homo Sapiens
LLQVVFRRK

SEQ ID NO: 1287964 - protein, 9 aa, Homo Sapiens
AEFHKHDYG

SEQ ID NO: 1287965 - protein, 9 aa, Homo Sapiens
PINGQVDVD

SEQ ID NO: 1287966 - protein, 9 aa, Homo Sapiens
KVLEHKVLG

SEQ ID NO: 1287967 - protein, 9 aa, Homo Sapiens
DPSVIHPKT

SEQ ID NO: 1287968 - protein, 9 aa, Homo Sapiens
LTQLNIMKH

SEQ ID NO: 1287969 - protein, 9 aa, Homo Sapiens
SCVWNTENV

SEQ ID NO: 1287970 - protein, 9 aa, Homo Sapiens
RDLCVGGVV

SEQ ID NO: 1287971 - protein, 9 aa, Homo Sapiens
TATVKKVVN

SEQ ID NO: 1287972 - protein, 9 aa, Homo Sapiens
HPVNRTIYL

SEQ ID NO: 1287973 - protein, 9 aa, Homo Sapiens
VYGLSCMLH

SEQ ID NO: 1287974 - protein, 9 aa, Homo Sapiens
YGKQDLDKL

SEQ ID NO: 1287975 - protein, 9 aa, Homo Sapiens
FGGMANANM

SEQ ID NO: 1287976 - protein, 9 aa, Homo Sapiens
IFARMENKA

SEQ ID NO: 1287977 - protein, 9 aa, Homo Sapiens
FQYPYMNGR

SEQ ID NO: 1287978 - protein, 9 aa, Homo Sapiens
SFLKENVNF

SEQ ID NO: 1287979 - protein, 9 aa, Homo Sapiens
IHYGERITL

SEQ ID NO: 1287980 - protein, 9 aa, Homo Sapiens
YKFFCGFSQ

SEQ ID NO: 1287981 - protein, 9 aa, Homo Sapiens
HGIIGPSNN

SEQ ID NO: 1287982 - protein, 9 aa, Homo Sapiens
MHAFPLTST

SEQ ID NO: 1287983 - protein, 9 aa, Homo Sapiens
LPWPPVVKP

SEQ ID NO: 1287984 - protein, 9 aa, Homo Sapiens
EMSIIGMID

SEQ ID NO: 1287985 - protein, 9 aa, Homo Sapiens
STYKSLQDL

SEQ ID NO: 1287986 - protein, 9 aa, Homo Sapiens
NRKRTIYSF

SEQ ID NO: 1287987 - protein, 9 aa, Homo Sapiens
GNHHSTQHK

SEQ ID NO: 1287988 - protein, 9 aa, Homo Sapiens
HLVTLIKTK

SEQ ID NO: 1287989 - protein, 9 aa, Homo Sapiens
HVDTPEESE

SEQ ID NO: 1287990 - protein, 9 aa, Homo Sapiens
EKNSWTHIL

SEQ ID NO: 1287991 - protein, 9 aa, Homo Sapiens
FLDTSHYYT

SEQ ID NO: 1287992 - protein, 9 aa, Homo Sapiens
LTSSNETVV

SEQ ID NO: 1287993 - protein, 9 aa, Homo Sapiens
AVAGNISDH

SEQ ID NO: 1287994 - protein, 9 aa, Homo Sapiens
ECYICHALF

SEQ ID NO: 1287995 - protein, 9 aa, Homo Sapiens
YQSIGTQQW

SEQ ID NO: 1287996 - protein, 9 aa, Homo Sapiens
SMESLYYLW

SEQ ID NO: 1287997 - protein, 9 aa, Homo Sapiens
IIGPSNNGA

SEQ ID NO: 1287998 - protein, 9 aa, Homo Sapiens
ATEDEIDKC

SEQ ID NO: 1287999 - protein, 9 aa, Homo Sapiens
LRNSNLTQQ

SEQ ID NO: 1288000 - protein, 9 aa, Homo Sapiens
ALTKANSTS

SEQ ID NO: 1288001 - protein, 9 aa, Homo Sapiens
CNRVQIQSL

SEQ ID NO: 1288002 - protein, 9 aa, Homo Sapiens
NNTDFVPEK

SEQ ID NO: 1288003 - protein, 9 aa, Homo Sapiens
TSTAVPSFL

SEQ ID NO: 1288004 - protein, 9 aa, Homo Sapiens
IDLLSCTGF

SEQ ID NO: 1288005 - protein, 9 aa, Homo Sapiens
FCPMQPASS

SEQ ID NO: 1288006 - protein, 9 aa, Homo Sapiens
IWLGVDALG

SEQ ID NO: 1288007 - protein, 9 aa, Homo Sapiens
AWTNAATQI

SEQ ID NO: 1288008 - protein, 9 aa, Homo Sapiens
FVEAAHEQD

SEQ ID NO: 1288009 - protein, 9 aa, Homo Sapiens
DQQIYEMLK

SEQ ID NO: 1288010 - protein, 9 aa, Homo Sapiens
ERPDLQPIQ

SEQ ID NO: 1288011 - protein, 9 aa, Homo Sapiens
WDEPFNTVE

SEQ ID NO: 1288012 - protein, 9 aa, Homo Sapiens
HVGTKKLTK

SEQ ID NO: 1288013 - protein, 9 aa, Homo Sapiens
SLYTTEMDL

SEQ ID NO: 1288014 - protein, 9 aa, Homo Sapiens
LYSSYGFTR

SEQ ID NO: 1288015 - protein, 9 aa, Homo Sapiens
YKGMTREES

SEQ ID NO: 1288016 - protein, 9 aa, Homo Sapiens
RDERKNQDS

SEQ ID NO: 1288017 - protein, 9 aa, Homo Sapiens
QTASKQVDC

SEQ ID NO: 1288018 - protein, 9 aa, Homo Sapiens
HTVAKCYEC

SEQ ID NO: 1288019 - protein, 9 aa, Homo Sapiens
SMGSNDIDV

SEQ ID NO: 1288020 - protein, 9 aa, Homo Sapiens
NLTDTSSPT

SEQ ID NO: 1288021 - protein, 9 aa, Homo Sapiens
LESIEYVKT

SEQ ID NO: 1288022 - protein, 9 aa, Homo Sapiens
IEGVEVKDL

SEQ ID NO: 1288023 - protein, 9 aa, Homo Sapiens
LCSSGHKRF

SEQ ID NO: 1288024 - protein, 9 aa, Homo Sapiens
FEDYGLDPN

SEQ ID NO: 1288025 - protein, 9 aa, Homo Sapiens
IIIMSTLTF

SEQ ID NO: 1288026 - protein, 9 aa, Homo Sapiens
IALLHQIPD

SEQ ID NO: 1288027 - protein, 9 aa, Homo Sapiens
TCNVLQRIK

SEQ ID NO: 1288028 - protein, 9 aa, Homo Sapiens
YDYYTEEDT

SEQ ID NO: 1288029 - protein, 8 aa, Homo Sapiens
GKISSLPT

SEQ ID NO: 1288030 - protein, 9 aa, Homo Sapiens
LCVSPTANK

SEQ ID NO: 1288031 - protein, 9 aa, Homo Sapiens
HITSGNMNH

SEQ ID NO: 1288032 - protein, 9 aa, Homo Sapiens
QHVFVKCHF

SEQ ID NO: 1288033 - protein, 9 aa, Homo Sapiens
DTHLHTPIY

SEQ ID NO: 1288034 - protein, 9 aa, Homo Sapiens
RWLVAWLSM

SEQ ID NO: 1288035 - protein, 9 aa, Homo Sapiens
KVELQRISR

SEQ ID NO: 1288036 - protein, 9 aa, Homo Sapiens
NFDRVFHCN

SEQ ID NO: 1288037 - protein, 9 aa, Homo Sapiens
TVNLRDDVD

SEQ ID NO: 1288038 - protein, 9 aa, Homo Sapiens
DDRFQSAYE

SEQ ID NO: 1288039 - protein, 9 aa, Homo Sapiens
CDDTISVFE

SEQ ID NO: 1288040 - protein, 9 aa, Homo Sapiens
KHRQKHFNR

SEQ ID NO: 1288041 - protein, 9 aa, Homo Sapiens
AKLAGAFDA

SEQ ID NO: 1288042 - protein, 9 aa, Homo Sapiens
PYCSNNMPT

SEQ ID NO: 1288043 - protein, 9 aa, Homo Sapiens
FFENPALLE

SEQ ID NO: 1288044 - protein, 9 aa, Homo Sapiens
KYINNTDFV

SEQ ID NO: 1288045 - protein, 9 aa, Homo Sapiens
ALKVQQKHR

SEQ ID NO: 1288046 - protein, 9 aa, Homo Sapiens
NKSYSWDSA

SEQ ID NO: 1288047 - protein, 9 aa, Homo Sapiens
YALLCHDDE

SEQ ID NO: 1288048 - protein, 9 aa, Homo Sapiens
QKYINNTDF

SEQ ID NO: 1288049 - protein, 9 aa, Homo Sapiens
SLVESSHSV

SEQ ID NO: 1288050 - protein, 9 aa, Homo Sapiens
IVLWIMIAL

SEQ ID NO: 1288051 - protein, 9 aa, Homo Sapiens
SATKIWRTP

SEQ ID NO: 1288052 - protein, 9 aa, Homo Sapiens
ADKYWSTFL

SEQ ID NO: 1288053 - protein, 9 aa, Homo Sapiens
VLVAIVSKS

SEQ ID NO: 1288054 - protein, 9 aa, Homo Sapiens
KTEPSLRCV

SEQ ID NO: 1288055 - protein, 9 aa, Homo Sapiens
KPIASCETE

SEQ ID NO: 1288056 - protein, 9 aa, Homo Sapiens
QKHRQKHFN

SEQ ID NO: 1288057 - protein, 9 aa, Homo Sapiens
LFLRLAFLQ

SEQ ID NO: 1288058 - protein, 9 aa, Homo Sapiens
KNSPPYILY

SEQ ID NO: 1288059 - protein, 9 aa, Homo Sapiens
AHRMSQDIL

SEQ ID NO: 1288060 - protein, 9 aa, Homo Sapiens
LEQDENPGN

SEQ ID NO: 1288061 - protein, 9 aa, Homo Sapiens
IWHCKTASK

SEQ ID NO: 1288062 - protein, 9 aa, Homo Sapiens
PHEELVHRV

SEQ ID NO: 1288063 - protein, 9 aa, Homo Sapiens
CEACTQYQK

SEQ ID NO: 1288064 - protein, 9 aa, Homo Sapiens
YNINEGQVQ

SEQ ID NO: 1288065 - protein, 9 aa, Homo Sapiens
MTPTHEMFV

SEQ ID NO: 1288066 - protein, 9 aa, Homo Sapiens
SPLKPNGII

SEQ ID NO: 1288067 - protein, 9 aa, Homo Sapiens
SRNISYCKA

SEQ ID NO: 1288068 - protein, 9 aa, Homo Sapiens
LEHTFSAVK

SEQ ID NO: 1288069 - protein, 9 aa, Homo Sapiens
VQEKTALQL

SEQ ID NO: 1288070 - protein, 9 aa, Homo Sapiens
IIAECNSVD

SEQ ID NO: 1288071 - protein, 9 aa, Homo Sapiens
NFLIKEISA

SEQ ID NO: 1288072 - protein, 9 aa, Homo Sapiens
DRLEQARQD

SEQ ID NO: 1288073 - protein, 9 aa, Homo Sapiens
LIHVAVAQY

SEQ ID NO: 1288074 - protein, 9 aa, Homo Sapiens
NNRIGKTWE

SEQ ID NO: 1288075 - protein, 9 aa, Homo Sapiens
RPDMIDKAL

SEQ ID NO: 1288076 - protein, 9 aa, Homo Sapiens
MLATLYKSP

SEQ ID NO: 1288077 - protein, 9 aa, Homo Sapiens
CNETTKNVY

SEQ ID NO: 1288078 - protein, 9 aa, Homo Sapiens
NKLAANSDN

SEQ ID NO: 1288079 - protein, 9 aa, Homo Sapiens
KFQAFDLGS

SEQ ID NO: 1288080 - protein, 9 aa, Homo Sapiens
GLYTMANNP

SEQ ID NO: 1288081 - protein, 9 aa, Homo Sapiens
DIEAIVKVS

SEQ ID NO: 1288082 - protein, 9 aa, Homo Sapiens
SEDIEGSHW

SEQ ID NO: 1288083 - protein, 9 aa, Homo Sapiens
NVLQRIKGL

SEQ ID NO: 1288084 - protein, 9 aa, Homo Sapiens
VYFYINEDQ

SEQ ID NO: 1288085 - protein, 9 aa, Homo Sapiens
GSNDIDVLK

SEQ ID NO: 1288086 - protein, 9 aa, Homo Sapiens
PVYFYINED

SEQ ID NO: 1288087 - protein, 9 aa, Homo Sapiens
LNKVNPNKV

SEQ ID NO: 1288088 - protein, 9 aa, Homo Sapiens
ERAGQHDVV

SEQ ID NO: 1288089 - protein, 9 aa, Homo Sapiens
EPFVCAQCS

SEQ ID NO: 1288090 - protein, 9 aa, Homo Sapiens
SSHSVEVLQ

SEQ ID NO: 1288091 - protein, 9 aa, Homo Sapiens
LEQQLKDSC

SEQ ID NO: 1288092 - protein, 9 aa, Homo Sapiens
NRVNKCLQE

SEQ ID NO: 1288093 - protein, 9 aa, Homo Sapiens
ELIKILSEL

SEQ ID NO: 1288094 - protein, 9 aa, Homo Sapiens
NLLAAWAAE

SEQ ID NO: 1288095 - protein, 9 aa, Homo Sapiens
RTCDIVEFV

SEQ ID NO: 1288096 - protein, 9 aa, Homo Sapiens
SNIILNNRG

SEQ ID NO: 1288097 - protein, 9 aa, Homo Sapiens
FYHIVLHSG

SEQ ID NO: 1288098 - protein, 9 aa, Homo Sapiens
RCHCGKTFA

SEQ ID NO: 1288099 - protein, 9 aa, Homo Sapiens
EQETLQQYG

SEQ ID NO: 1288100 - protein, 9 aa, Homo Sapiens
QFLESWVLG

SEQ ID NO: 1288101 - protein, 9 aa, Homo Sapiens
PVPLKEAPQ

SEQ ID NO: 1288102 - protein, 9 aa, Homo Sapiens
LVDYQMYYY

SEQ ID NO: 1288103 - protein, 9 aa, Homo Sapiens
VTNANLGEF

SEQ ID NO: 1288104 - protein, 9 aa, Homo Sapiens
LDNCLLYVL

SEQ ID NO: 1288105 - protein, 9 aa, Homo Sapiens
QYFWSPSDM

SEQ ID NO: 1288106 - protein, 9 aa, Homo Sapiens
CWVSECIIM

SEQ ID NO: 1288107 - protein, 9 aa, Homo Sapiens
TGERHYECK

SEQ ID NO: 1288108 - protein, 9 aa, Homo Sapiens
RNGGKDNCR

SEQ ID NO: 1288109 - protein, 9 aa, Homo Sapiens
VELAENAHL

SEQ ID NO: 1288110 - protein, 9 aa, Homo Sapiens
FKTRKAHRI

SEQ ID NO: 1288111 - protein, 9 aa, Homo Sapiens
ENAAYLQDM

SEQ ID NO: 1288112 - protein, 9 aa, Homo Sapiens
HSFTSLSTQ

SEQ ID NO: 1288113 - protein, 9 aa, Homo Sapiens
KNVCCLIGP

SEQ ID NO: 1288114 - protein, 9 aa, Homo Sapiens
QPGYPGSPG

SEQ ID NO: 1288115 - protein, 9 aa, Homo Sapiens
LPIINASYG

SEQ ID NO: 1288116 - protein, 9 aa, Homo Sapiens
SNSLNRMNC

SEQ ID NO: 1288117 - protein, 9 aa, Homo Sapiens
EESDIMAFA

SEQ ID NO: 1288118 - protein, 9 aa, Homo Sapiens
EELGYDLLC

SEQ ID NO: 1288119 - protein, 9 aa, Homo Sapiens
VTSTYKSLQ

SEQ ID NO: 1288120 - protein, 9 aa, Homo Sapiens
ELIPNNSVF

SEQ ID NO: 1288121 - protein, 9 aa, Homo Sapiens
SDENGSTTQ

SEQ ID NO: 1288122 - protein, 9 aa, Homo Sapiens
LIWICYSGI

SEQ ID NO: 1288123 - protein, 9 aa, Homo Sapiens
SSTEDCIKR

SEQ ID NO: 1288124 - protein, 9 aa, Homo Sapiens
VSSFYKEYI

SEQ ID NO: 1288125 - protein, 9 aa, Homo Sapiens
RVEHINGKK

SEQ ID NO: 1288126 - protein, 9 aa, Homo Sapiens
GIHDVLTVH

SEQ ID NO: 1288127 - protein, 9 aa, Homo Sapiens
HAFGGMANA

SEQ ID NO: 1288128 - protein, 9 aa, Homo Sapiens
HCLSMLGRP

SEQ ID NO: 1288129 - protein, 9 aa, Homo Sapiens
GTISFTEIV

SEQ ID NO: 1288130 - protein, 9 aa, Homo Sapiens
IVDMLDSDG

SEQ ID NO: 1288131 - protein, 9 aa, Homo Sapiens
LKRAVNLQR

SEQ ID NO: 1288132 - protein, 9 aa, Homo Sapiens
KNNRIGKTW

SEQ ID NO: 1288133 - protein, 9 aa, Homo Sapiens
ECTPDSLHK

SEQ ID NO: 1288134 - protein, 9 aa, Homo Sapiens
VEYEKNNPC

SEQ ID NO: 1288135 - protein, 9 aa, Homo Sapiens
KALEFQDIG

SEQ ID NO: 1288136 - protein, 9 aa, Homo Sapiens
TASKQVDCD

SEQ ID NO: 1288137 - protein, 9 aa, Homo Sapiens
GENLLSWMF

SEQ ID NO: 1288138 - protein, 9 aa, Homo Sapiens
PDSEELPWP

SEQ ID NO: 1288139 - protein, 9 aa, Homo Sapiens
GGKDNCRAA

SEQ ID NO: 1288140 - protein, 9 aa, Homo Sapiens
QTLNYLISH

SEQ ID NO: 1288141 - protein, 9 aa, Homo Sapiens
IQSCVSPGM

SEQ ID NO: 1288142 - protein, 9 aa, Homo Sapiens
GSSHPPQSA

SEQ ID NO: 1288143 - protein, 9 aa, Homo Sapiens
FLVFSKLEW

SEQ ID NO: 1288144 - protein, 9 aa, Homo Sapiens
KTCCVDTKE

SEQ ID NO: 1288145 - protein, 9 aa, Homo Sapiens
VLPELNNMT

SEQ ID NO: 1288146 - protein, 9 aa, Homo Sapiens
PFDNPRLES

SEQ ID NO: 1288147 - protein, 9 aa, Homo Sapiens
RCSQTLVNF

SEQ ID NO: 1288148 - protein, 9 aa, Homo Sapiens
RPNDRVGLI

SEQ ID NO: 1288149 - protein, 9 aa, Homo Sapiens
FYPDILVGS

SEQ ID NO: 1288150 - protein, 9 aa, Homo Sapiens
HMNNIMSKS

SEQ ID NO: 1288151 - protein, 9 aa, Homo Sapiens
WPWKKKNYT

SEQ ID NO: 1288152 - protein, 9 aa, Homo Sapiens
RDERMTVDF

SEQ ID NO: 1288153 - protein, 9 aa, Homo Sapiens
VLQLTEASS

SEQ ID NO: 1288154 - protein, 9 aa, Homo Sapiens
KILYAVCTI

SEQ ID NO: 1288155 - protein, 9 aa, Homo Sapiens
HNHSHSHEE

SEQ ID NO: 1288156 - protein, 9 aa, Homo Sapiens
IDLILPDCL

SEQ ID NO: 1288157 - protein, 9 aa, Homo Sapiens
LHTAGRLTL

SEQ ID NO: 1288158 - protein, 9 aa, Homo Sapiens
GQELFRSLI

SEQ ID NO: 1288159 - protein, 9 aa, Homo Sapiens
HMKLHSYTR

SEQ ID NO: 1288160 - protein, 9 aa, Homo Sapiens
NNQRQCVQY

SEQ ID NO: 1288161 - protein, 9 aa, Homo Sapiens
YTAGSSSVR

SEQ ID NO: 1288162 - protein, 9 aa, Homo Sapiens
IERAGQHDV

SEQ ID NO: 1288163 - protein, 9 aa, Homo Sapiens
LQKNSMSCQ

SEQ ID NO: 1288164 - protein, 9 aa, Homo Sapiens
EGTRDVHLG

SEQ ID NO: 1288165 - protein, 9 aa, Homo Sapiens
KGYSHTHRE

SEQ ID NO: 1288166 - protein, 9 aa, Homo Sapiens
QECRDTKPP

SEQ ID NO: 1288167 - protein, 9 aa, Homo Sapiens
KDSDNELVT

SEQ ID NO: 1288168 - protein, 9 aa, Homo Sapiens
KTDLSVQIL

SEQ ID NO: 1288169 - protein, 9 aa, Homo Sapiens
RISEWTFQH

SEQ ID NO: 1288170 - protein, 9 aa, Homo Sapiens
NKCCHFTLE

SEQ ID NO: 1288171 - protein, 9 aa, Homo Sapiens
VKPESTLET

SEQ ID NO: 1288172 - protein, 9 aa, Homo Sapiens
QQYGVCCKQ

SEQ ID NO: 1288173 - protein, 9 aa, Homo Sapiens
VLAVDGLED

SEQ ID NO: 1288174 - protein, 9 aa, Homo Sapiens
CLMDHEDFR

SEQ ID NO: 1288175 - protein, 9 aa, Homo Sapiens
SDFPLRQNN

SEQ ID NO: 1288176 - protein, 9 aa, Homo Sapiens
LILCVSPTA

SEQ ID NO: 1288177 - protein, 9 aa, Homo Sapiens
CFFSHLPSQ

SEQ ID NO: 1288178 - protein, 9 aa, Homo Sapiens
PSPTLCAPP

SEQ ID NO: 1288179 - protein, 9 aa, Homo Sapiens
SLRCVLQYQ

SEQ ID NO: 1288180 - protein, 9 aa, Homo Sapiens
DLKMMISNP

SEQ ID NO: 1288181 - protein, 9 aa, Homo Sapiens
ICTIDHTED

SEQ ID NO: 1288182 - protein, 9 aa, Homo Sapiens
HTNLLHQIC

SEQ ID NO: 1288183 - protein, 9 aa, Homo Sapiens
GSCIEFSNL

SEQ ID NO: 1288184 - protein, 9 aa, Homo Sapiens
KRNRDLCVG

SEQ ID NO: 1288185 - protein, 9 aa, Homo Sapiens
NLLWQEVCK

SEQ ID NO: 1288186 - protein, 9 aa, Homo Sapiens
TANLALASV

SEQ ID NO: 1288187 - protein, 9 aa, Homo Sapiens
LSRNGQVRA

SEQ ID NO: 1288188 - protein, 9 aa, Homo Sapiens
TEKVHDGTL

SEQ ID NO: 1288189 - protein, 9 aa, Homo Sapiens
GIAQEDKAI

SEQ ID NO: 1288190 - protein, 9 aa, Homo Sapiens
SQEASYKAF

SEQ ID NO: 1288191 - protein, 9 aa, Homo Sapiens
SVLHKHFDG

SEQ ID NO: 1288192 - protein, 9 aa, Homo Sapiens
RSNDVLGSA

SEQ ID NO: 1288193 - protein, 9 aa, Homo Sapiens
PFLSRNGQV

SEQ ID NO: 1288194 - protein, 9 aa, Homo Sapiens
LGQDWLVEV

SEQ ID NO: 1288195 - protein, 9 aa, Homo Sapiens
GDTEDNIDN

SEQ ID NO: 1288196 - protein, 9 aa, Homo Sapiens
SQEVTHTKP

SEQ ID NO: 1288197 - protein, 9 aa, Homo Sapiens
TVAALQDTQ

SEQ ID NO: 1288198 - protein, 9 aa, Homo Sapiens
EHSPSLPRF

SEQ ID NO: 1288199 - protein, 9 aa, Homo Sapiens
KYVLNEFYR

SEQ ID NO: 1288200 - protein, 9 aa, Homo Sapiens
ENVNFENRE

SEQ ID NO: 1288201 - protein, 9 aa, Homo Sapiens
VTSVLHKHF

SEQ ID NO: 1288202 - protein, 9 aa, Homo Sapiens
QHANQYSSK

SEQ ID NO: 1288203 - protein, 9 aa, Homo Sapiens
TYGKQDLDK

SEQ ID NO: 1288204 - protein, 9 aa, Homo Sapiens
NMQIIQLHV

SEQ ID NO: 1288205 - protein, 9 aa, Homo Sapiens
HCVFQLLTT

SEQ ID NO: 1288206 - protein, 9 aa, Homo Sapiens
LYKVISTPT

SEQ ID NO: 1288207 - protein, 9 aa, Homo Sapiens
QSQHNDIIR

SEQ ID NO: 1288208 - protein, 9 aa, Homo Sapiens
NLFCLDLYS

SEQ ID NO: 1288209 - protein, 9 aa, Homo Sapiens
DDVDSYGFI

SEQ ID NO: 1288210 - protein, 9 aa, Homo Sapiens
DYPGSNKPL

SEQ ID NO: 1288211 - protein, 9 aa, Homo Sapiens
FFICTSVST

SEQ ID NO: 1288212 - protein, 9 aa, Homo Sapiens
QCPEVHTLP

SEQ ID NO: 1288213 - protein, 9 aa, Homo Sapiens
QHCGTCLNL

SEQ ID NO: 1288214 - protein, 9 aa, Homo Sapiens
AHSIPWSHA

SEQ ID NO: 1288215 - protein, 9 aa, Homo Sapiens
TQCTLLCTP

SEQ ID NO: 1288216 - protein, 9 aa, Homo Sapiens
GCTFEEASY

SEQ ID NO: 1288217 - protein, 9 aa, Homo Sapiens
VCAECNEAI

SEQ ID NO: 1288218 - protein, 9 aa, Homo Sapiens
SVLAVDGLE

SEQ ID NO: 1288219 - protein, 9 aa, Homo Sapiens
PRGSECTPD

SEQ ID NO: 1288220 - protein, 9 aa, Homo Sapiens
FPYSMNHIL

SEQ ID NO: 1288221 - protein, 9 aa, Homo Sapiens
VLLQHLVCY

SEQ ID NO: 1288222 - protein, 9 aa, Homo Sapiens
NSNLTKIKL

SEQ ID NO: 1288223 - protein, 9 aa, Homo Sapiens
HKHFDGYKP

SEQ ID NO: 1288224 - protein, 9 aa, Homo Sapiens
ANNPNMTHL

SEQ ID NO: 1288225 - protein, 9 aa, Homo Sapiens
IDKCVKEKK

SEQ ID NO: 1288226 - protein, 9 aa, Homo Sapiens
TFFYSCIVS

SEQ ID NO: 1288227 - protein, 9 aa, Homo Sapiens
IMSDQLFRR

SEQ ID NO: 1288228 - protein, 9 aa, Homo Sapiens
KDIKLTNAW

SEQ ID NO: 1288229 - protein, 9 aa, Homo Sapiens
GNLVTNANL

SEQ ID NO: 1288230 - protein, 9 aa, Homo Sapiens
CERRWRNVL

SEQ ID NO: 1288231 - protein, 9 aa, Homo Sapiens
SIIKKGLQY

SEQ ID NO: 1288232 - protein, 9 aa, Homo Sapiens
CCFITPLPE

SEQ ID NO: 1288233 - protein, 9 aa, Homo Sapiens
LEYAHRMSQ

SEQ ID NO: 1288234 - protein, 9 aa, Homo Sapiens
YLDTYIGHK

SEQ ID NO: 1288235 - protein, 9 aa, Homo Sapiens
IKLLFGCYI

SEQ ID NO: 1288236 - protein, 9 aa, Homo Sapiens
CAKGYYRTY

SEQ ID NO: 1288237 - protein, 9 aa, Homo Sapiens
CAPPLANTS

SEQ ID NO: 1288238 - protein, 9 aa, Homo Sapiens
ECNSVDIKL

SEQ ID NO: 1288239 - protein, 9 aa, Homo Sapiens
ACIVQAELC

SEQ ID NO: 1288240 - protein, 9 aa, Homo Sapiens
KMCKKQNDR

SEQ ID NO: 1288241 - protein, 9 aa, Homo Sapiens
FKRIVNRAP

SEQ ID NO: 1288242 - protein, 9 aa, Homo Sapiens
KRTIYSFSA

SEQ ID NO: 1288243 - protein, 9 aa, Homo Sapiens
PKILYRNPL

SEQ ID NO: 1288244 - protein, 9 aa, Homo Sapiens
AHSSEDFNM

SEQ ID NO: 1288245 - protein, 9 aa, Homo Sapiens
SHQLFVCNL

SEQ ID NO: 1288246 - protein, 9 aa, Homo Sapiens
HLHTLVMEV

SEQ ID NO: 1288247 - protein, 9 aa, Homo Sapiens
VFECEACTQ

SEQ ID NO: 1288248 - protein, 9 aa, Homo Sapiens
DNNVLQRDL

SEQ ID NO: 1288249 - protein, 9 aa, Homo Sapiens
TSHYYTAGS

SEQ ID NO: 1288250 - protein, 9 aa, Homo Sapiens
ELIDNQSNL

SEQ ID NO: 1288251 - protein, 9 aa, Homo Sapiens
EGSHCLSML

SEQ ID NO: 1288252 - protein, 9 aa, Homo Sapiens
LDTSHYYTA

SEQ ID NO: 1288253 - protein, 9 aa, Homo Sapiens
NDCRKFKLE

SEQ ID NO: 1288254 - protein, 9 aa, Homo Sapiens
DQLFRRVAK

SEQ ID NO: 1288255 - protein, 9 aa, Homo Sapiens
KINFKFTNF

SEQ ID NO: 1288256 - protein, 9 aa, Homo Sapiens
WSHAMYVPG

SEQ ID NO: 1288257 - protein, 9 aa, Homo Sapiens
FERSNDVLG

SEQ ID NO: 1288258 - protein, 9 aa, Homo Sapiens
LPCAVGEPG

SEQ ID NO: 1288259 - protein, 9 aa, Homo Sapiens
ELRSAALHS

SEQ ID NO: 1288260 - protein, 9 aa, Homo Sapiens
YHSTLGGQG

SEQ ID NO: 1288261 - protein, 9 aa, Homo Sapiens
KVIDTKNIL

SEQ ID NO: 1288262 - protein, 9 aa, Homo Sapiens
SFSAKHALF

SEQ ID NO: 1288263 - protein, 9 aa, Homo Sapiens
HEARLYHIL

SEQ ID NO: 1288264 - protein, 9 aa, Homo Sapiens
YLLKRMLQQ

SEQ ID NO: 1288265 - protein, 9 aa, Homo Sapiens
GNKNGVLDF

SEQ ID NO: 1288266 - protein, 9 aa, Homo Sapiens
FVAIPDFEA

SEQ ID NO: 1288267 - protein, 9 aa, Homo Sapiens
GVDVSKVLF

SEQ ID NO: 1288268 - protein, 9 aa, Homo Sapiens
NCLLYVLCN

SEQ ID NO: 1288269 - protein, 9 aa, Homo Sapiens
FGTLSHSLG

SEQ ID NO: 1288270 - protein, 9 aa, Homo Sapiens
NDELEHSEP

SEQ ID NO: 1288271 - protein, 9 aa, Homo Sapiens
GDLIEHLVP

SEQ ID NO: 1288272 - protein, 9 aa, Homo Sapiens
RTLTKIKEK

SEQ ID NO: 1288273 - protein, 9 aa, Homo Sapiens
WIILKHRKC

SEQ ID NO: 1288274 - protein, 9 aa, Homo Sapiens
NNMHAIPLR

SEQ ID NO: 1288275 - protein, 9 aa, Homo Sapiens
ELQLPLHGG

SEQ ID NO: 1288276 - protein, 9 aa, Homo Sapiens
EWQKLWCAL

SEQ ID NO: 1288277 - protein, 9 aa, Homo Sapiens
EDKMMLFLI

SEQ ID NO: 1288278 - protein, 9 aa, Homo Sapiens
FADQDDLPG

SEQ ID NO: 1288279 - protein, 9 aa, Homo Sapiens
AGNISDHGL

SEQ ID NO: 1288280 - protein, 9 aa, Homo Sapiens
ECEKRWKDL

SEQ ID NO: 1288281 - protein, 9 aa, Homo Sapiens
VANSFLKEN

SEQ ID NO: 1288282 - protein, 9 aa, Homo Sapiens
SALTHKSTS

SEQ ID NO: 1288283 - protein, 9 aa, Homo Sapiens
LIPNNSVFP

SEQ ID NO: 1288284 - protein, 9 aa, Homo Sapiens
TIEDIDENQ

SEQ ID NO: 1288285 - protein, 9 aa, Homo Sapiens
WNGDTCECT

SEQ ID NO: 1288286 - protein, 9 aa, Homo Sapiens
AQLMLLYPD

SEQ ID NO: 1288287 - protein, 9 aa, Homo Sapiens
FFLVFSKLE

SEQ ID NO: 1288288 - protein, 9 aa, Homo Sapiens
ALEQDKTVK

SEQ ID NO: 1288289 - protein, 9 aa, Homo Sapiens
TCIPSCVVE

SEQ ID NO: 1288290 - protein, 9 aa, Homo Sapiens
YTEEDTEGD

SEQ ID NO: 1288291 - protein, 9 aa, Homo Sapiens
ASVKASPPQ

SEQ ID NO: 1288292 - protein, 9 aa, Homo Sapiens
VHHLKKYPV

SEQ ID NO: 1288293 - protein, 9 aa, Homo Sapiens
NAAVQKIVE

SEQ ID NO: 1288294 - protein, 9 aa, Homo Sapiens
AFEKFHTNL

SEQ ID NO: 1288295 - protein, 9 aa, Homo Sapiens
TQPKYKYVL

SEQ ID NO: 1288296 - protein, 9 aa, Homo Sapiens
NSDNLMQIQ

SEQ ID NO: 1288297 - protein, 9 aa, Homo Sapiens
ANLYFLLAR

SEQ ID NO: 1288298 - protein, 9 aa, Homo Sapiens
KQSEHSPSL

SEQ ID NO: 1288299 - protein, 9 aa, Homo Sapiens
NKVSPASSV

SEQ ID NO: 1288300 - protein, 9 aa, Homo Sapiens
VFQLLTTMC

SEQ ID NO: 1288301 - protein, 9 aa, Homo Sapiens
SSFNDKSIS

SEQ ID NO: 1288302 - protein, 9 aa, Homo Sapiens
STVDDSCIS

SEQ ID NO: 1288303 - protein, 9 aa, Homo Sapiens
GMRYLADIG

SEQ ID NO: 1288304 - protein, 9 aa, Homo Sapiens
YSPDDKHLV

SEQ ID NO: 1288305 - protein, 9 aa, Homo Sapiens
LVEPAADKY

SEQ ID NO: 1288306 - protein, 9 aa, Homo Sapiens
DLYWKVKFT

SEQ ID NO: 1288307 - protein, 9 aa, Homo Sapiens
SSSDEEDLH

SEQ ID NO: 1288308 - protein, 9 aa, Homo Sapiens
EDVEQPGWP

SEQ ID NO: 1288309 - protein, 9 aa, Homo Sapiens
ARFDLPEVI

SEQ ID NO: 1288310 - protein, 9 aa, Homo Sapiens
GTRDVHLGT

SEQ ID NO: 1288311 - protein, 9 aa, Homo Sapiens
QDENPGNDN

SEQ ID NO: 1288312 - protein, 9 aa, Homo Sapiens
RKHPLRGIG

SEQ ID NO: 1288313 - protein, 9 aa, Homo Sapiens
VKRKTNNPK

SEQ ID NO: 1288314 - protein, 9 aa, Homo Sapiens
QLCEELLAQ

SEQ ID NO: 1288315 - protein, 9 aa, Homo Sapiens
ITNYKIGAL

SEQ ID NO: 1288316 - protein, 9 aa, Homo Sapiens
AATIKLHYQ

SEQ ID NO: 1288317 - protein, 9 aa, Homo Sapiens
QKELARRNI

SEQ ID NO: 1288318 - protein, 9 aa, Homo Sapiens
VLEELKPDQ

SEQ ID NO: 1288319 - protein, 9 aa, Homo Sapiens
DPEDLSTFD

SEQ ID NO: 1288320 - protein, 9 aa, Homo Sapiens
LLCTPPRLC

SEQ ID NO: 1288321 - protein, 9 aa, Homo Sapiens
KPSNSEKCS

SEQ ID NO: 1288322 - protein, 9 aa, Homo Sapiens
DTSHYYTAG

SEQ ID NO: 1288323 - protein, 9 aa, Homo Sapiens
YSPGNKNGV

SEQ ID NO: 1288324 - protein, 9 aa, Homo Sapiens
VCWRCDHIL

SEQ ID NO: 1288325 - protein, 9 aa, Homo Sapiens
LTSIHSLLD

SEQ ID NO: 1288326 - protein, 9 aa, Homo Sapiens
MTICASIGI

SEQ ID NO: 1288327 - protein, 9 aa, Homo Sapiens
QLYYKIVIQ

SEQ ID NO: 1288328 - protein, 9 aa, Homo Sapiens
MELIPNNSV

SEQ ID NO: 1288329 - protein, 9 aa, Homo Sapiens
CTSVSTFSF

SEQ ID NO: 1288330 - protein, 9 aa, Homo Sapiens
PGCGPSRCG

SEQ ID NO: 1288331 - protein, 9 aa, Homo Sapiens
EIQLCEELL

SEQ ID NO: 1288332 - protein, 9 aa, Homo Sapiens
EDDADFDEF

SEQ ID NO: 1288333 - protein, 9 aa, Homo Sapiens
KKKAPEQEE

SEQ ID NO: 1288334 - protein, 9 aa, Homo Sapiens
TIQWMEKTS

SEQ ID NO: 1288335 - protein, 9 aa, Homo Sapiens
HWKIFTKPD

SEQ ID NO: 1288336 - protein, 9 aa, Homo Sapiens
CYLGLCMFD

SEQ ID NO: 1288337 - protein, 9 aa, Homo Sapiens
LLNKKHSKK

SEQ ID NO: 1288338 - protein, 9 aa, Homo Sapiens
WIAIFCCFS

SEQ ID NO: 1288339 - protein, 9 aa, Homo Sapiens
EVMLSYYMT

SEQ ID NO: 1288340 - protein, 9 aa, Homo Sapiens
VELQRISRA

SEQ ID NO: 1288341 - protein, 9 aa, Homo Sapiens
RLTSTAVPS

SEQ ID NO: 1288342 - protein, 9 aa, Homo Sapiens
PAHSIPWSH

SEQ ID NO: 1288343 - protein, 9 aa, Homo Sapiens
VIDINKPGP

SEQ ID NO: 1288344 - protein, 9 aa, Homo Sapiens
MSIIGMIDM

SEQ ID NO: 1288345 - protein, 9 aa, Homo Sapiens
MPFCDRCGK

SEQ ID NO: 1288346 - protein, 9 aa, Homo Sapiens
TLTFVVWIV

SEQ ID NO: 1288347 - protein, 9 aa, Homo Sapiens
NPLGDLIEH

SEQ ID NO: 1288348 - protein, 9 aa, Homo Sapiens
ILNTLENST

SEQ ID NO: 1288349 - protein, 9 aa, Homo Sapiens
HHNLLAAWA

SEQ ID NO: 1288350 - protein, 9 aa, Homo Sapiens
IVENLKKQI

SEQ ID NO: 1288351 - protein, 9 aa, Homo Sapiens
NPCSQKRFP

SEQ ID NO: 1288352 - protein, 9 aa, Homo Sapiens
STPSDSGGP

SEQ ID NO: 1288353 - protein, 9 aa, Homo Sapiens
LASQEASYK

SEQ ID NO: 1288354 - protein, 9 aa, Homo Sapiens
LKPNGIILG

SEQ ID NO: 1288355 - protein, 9 aa, Homo Sapiens
EWARGKTLH

SEQ ID NO: 1288356 - protein, 9 aa, Homo Sapiens
LIHAFGGMA

SEQ ID NO: 1288357 - protein, 9 aa, Homo Sapiens
KIIVDMLDS

SEQ ID NO: 1288358 - protein, 9 aa, Homo Sapiens
QVIFCGDFN

SEQ ID NO: 1288359 - protein, 9 aa, Homo Sapiens
LQGKTLYFF

SEQ ID NO: 1288360 - protein, 9 aa, Homo Sapiens
RHFQCHKWP

SEQ ID NO: 1288361 - protein, 9 aa, Homo Sapiens
DYYTEEDTE

SEQ ID NO: 1288362 - protein, 9 aa, Homo Sapiens
FGYGIPHSF

SEQ ID NO: 1288363 - protein, 9 aa, Homo Sapiens
IKESNILEI

SEQ ID NO: 1288364 - protein, 9 aa, Homo Sapiens
ATSTQNNMG

SEQ ID NO: 1288365 - protein, 9 aa, Homo Sapiens
IANSFVGTR

SEQ ID NO: 1288366 - protein, 9 aa, Homo Sapiens
FIYGTYLIG

SEQ ID NO: 1288367 - protein, 9 aa, Homo Sapiens
LYTATTKCS

SEQ ID NO: 1288368 - protein, 9 aa, Homo Sapiens
EDSDRKVES

SEQ ID NO: 1288369 - protein, 9 aa, Homo Sapiens
EYFTSNSCV

SEQ ID NO: 1288370 - protein, 9 aa, Homo Sapiens
FATSTQNNM

SEQ ID NO: 1288371 - protein, 9 aa, Homo Sapiens
VQHLFKFKK

SEQ ID NO: 1288372 - protein, 9 aa, Homo Sapiens
YSLYNEPAQ

SEQ ID NO: 1288373 - protein, 9 aa, Homo Sapiens
IPNQRRYVY

SEQ ID NO: 1288374 - protein, 9 aa, Homo Sapiens
RREAMVCTI

SEQ ID NO: 1288375 - protein, 9 aa, Homo Sapiens
PKEFPYSMN

SEQ ID NO: 1288376 - protein, 9 aa, Homo Sapiens
QETHTCEKL

SEQ ID NO: 1288377 - protein, 9 aa, Homo Sapiens
GLRLNNAQQ

SEQ ID NO: 1288378 - protein, 9 aa, Homo Sapiens
HNNLLDNNE

SEQ ID NO: 1288379 - protein, 9 aa, Homo Sapiens
EGKHNSMED

SEQ ID NO: 1288380 - protein, 9 aa, Homo Sapiens
DEEQPHGWV

SEQ ID NO: 1288381 - protein, 9 aa, Homo Sapiens
WVARNPHGF

SEQ ID NO: 1288382 - protein, 9 aa, Homo Sapiens
HIVDLEMLK

SEQ ID NO: 1288383 - protein, 9 aa, Homo Sapiens
HYPFSGIFE

SEQ ID NO: 1288384 - protein, 9 aa, Homo Sapiens
AIQDHTLPL

SEQ ID NO: 1288385 - protein, 9 aa, Homo Sapiens
KEYTLRLLK

SEQ ID NO: 1288386 - protein, 9 aa, Homo Sapiens
CVKELILAV

SEQ ID NO: 1288387 - protein, 9 aa, Homo Sapiens
AKNPQDKII

SEQ ID NO: 1288388 - protein, 9 aa, Homo Sapiens
PLQGKTLYF

SEQ ID NO: 1288389 - protein, 9 aa, Homo Sapiens
LVNTTSFPC

SEQ ID NO: 1288390 - protein, 9 aa, Homo Sapiens
MSTIKVTVL

SEQ ID NO: 1288391 - protein, 9 aa, Homo Sapiens
KDSCKSLSM

SEQ ID NO: 1288392 - protein, 9 aa, Homo Sapiens
SDSTFHKRN

SEQ ID NO: 1288393 - protein, 9 aa, Homo Sapiens
QSENDKLQK

SEQ ID NO: 1288394 - protein, 9 aa, Homo Sapiens
CTIDHTEDS

SEQ ID NO: 1288395 - protein, 9 aa, Homo Sapiens
ACLCGELWT

SEQ ID NO: 1288396 - protein, 9 aa, Homo Sapiens
HRSFIGSRF

SEQ ID NO: 1288397 - protein, 9 aa, Homo Sapiens
NLQRSKTAD

SEQ ID NO: 1288398 - protein, 9 aa, Homo Sapiens
GRQLLAIQK

SEQ ID NO: 1288399 - protein, 9 aa, Homo Sapiens
FITIFERSN

SEQ ID NO: 1288400 - protein, 9 aa, Homo Sapiens
TTDSDIEKD

SEQ ID NO: 1288401 - protein, 9 aa, Homo Sapiens
ELIKTENNV

SEQ ID NO: 1288402 - protein, 9 aa, Homo Sapiens
KKERKGYSH

SEQ ID NO: 1288403 - protein, 9 aa, Homo Sapiens
SFDLVAICG

SEQ ID NO: 1288404 - protein, 9 aa, Homo Sapiens
FIVDSIPKV

SEQ ID NO: 1288405 - protein, 9 aa, Homo Sapiens
VLTAVQGIT

SEQ ID NO: 1288406 - protein, 9 aa, Homo Sapiens
IQNYLFENG

SEQ ID NO: 1288407 - protein, 9 aa, Homo Sapiens
QTTLWFLIA

SEQ ID NO: 1288408 - protein, 9 aa, Homo Sapiens
LEELKPDQK

SEQ ID NO: 1288409 - protein, 9 aa, Homo Sapiens
LKAFPEHLY

SEQ ID NO: 1288410 - protein, 9 aa, Homo Sapiens
ECGNMLLWE

SEQ ID NO: 1288411 - protein, 9 aa, Homo Sapiens
CAQNTVICS

SEQ ID NO: 1288412 - protein, 9 aa, Homo Sapiens
EEIIYECYK

SEQ ID NO: 1288413 - protein, 9 aa, Homo Sapiens
PENVLVAIV

SEQ ID NO: 1288414 - protein, 9 aa, Homo Sapiens
AAHEQDGLA

SEQ ID NO: 1288415 - protein, 9 aa, Homo Sapiens
ERKGYSHTH

SEQ ID NO: 1288416 - protein, 9 aa, Homo Sapiens
TNALKPCFF

SEQ ID NO: 1288417 - protein, 9 aa, Homo Sapiens
TAALTNEGG

SEQ ID NO: 1288418 - protein, 9 aa, Homo Sapiens
QKVKKDKQN

SEQ ID NO: 1288419 - protein, 9 aa, Homo Sapiens
VYAMVFMVL

SEQ ID NO: 1288420 - protein, 9 aa, Homo Sapiens
MDLREVFSR

SEQ ID NO: 1288421 - protein, 9 aa, Homo Sapiens
SCYTENNDA

SEQ ID NO: 1288422 - protein, 9 aa, Homo Sapiens
KQKLTEISR

SEQ ID NO: 1288423 - protein, 9 aa, Homo Sapiens
DSEELPWPP

SEQ ID NO: 1288424 - protein, 9 aa, Homo Sapiens
IVDSIPKVV

SEQ ID NO: 1288425 - protein, 9 aa, Homo Sapiens
QDLKLDIQT

SEQ ID NO: 1288426 - protein, 9 aa, Homo Sapiens
TQLGKRKFC

SEQ ID NO: 1288427 - protein, 9 aa, Homo Sapiens
TFCNDARFI

SEQ ID NO: 1288428 - protein, 9 aa, Homo Sapiens
TNEGGVFTF

SEQ ID NO: 1288429 - protein, 9 aa, Homo Sapiens
LTFVVWIVI

SEQ ID NO: 1288430 - protein, 9 aa, Homo Sapiens
MCGRKVEFP

SEQ ID NO: 1288431 - protein, 9 aa, Homo Sapiens
ESSQTTLLA

SEQ ID NO: 1288432 - protein, 9 aa, Homo Sapiens
TVFLRHAEL

SEQ ID NO: 1288433 - protein, 9 aa, Homo Sapiens
WKVKFTAEE

SEQ ID NO: 1288434 - protein, 9 aa, Homo Sapiens
LVESSHSVE

SEQ ID NO: 1288435 - protein, 9 aa, Homo Sapiens
QDPPCHRLS

SEQ ID NO: 1288436 - protein, 9 aa, Homo Sapiens
GGMQLKLSV

SEQ ID NO: 1288437 - protein, 9 aa, Homo Sapiens
PQIHDLYWK

SEQ ID NO: 1288438 - protein, 9 aa, Homo Sapiens
FQRSVTGHD

SEQ ID NO: 1288439 - protein, 9 aa, Homo Sapiens
TGDRIEICY

SEQ ID NO: 1288440 - protein, 9 aa, Homo Sapiens
STTQKVKKD

SEQ ID NO: 1288441 - protein, 9 aa, Homo Sapiens
SENGKKAMV

SEQ ID NO: 1288442 - protein, 9 aa, Homo Sapiens
VILSATNMK

SEQ ID NO: 1288443 - protein, 9 aa, Homo Sapiens
SKTSTRCGE

SEQ ID NO: 1288444 - protein, 9 aa, Homo Sapiens
CLKMETYLM

SEQ ID NO: 1288445 - protein, 9 aa, Homo Sapiens
DLKLDIQTG

SEQ ID NO: 1288446 - protein, 9 aa, Homo Sapiens
PTTVEGRNY

SEQ ID NO: 1288447 - protein, 9 aa, Homo Sapiens
NGYTPYDMF

SEQ ID NO: 1288448 - protein, 9 aa, Homo Sapiens
ELPQTKGET

SEQ ID NO: 1288449 - protein, 9 aa, Homo Sapiens
YTLTIESGP

SEQ ID NO: 1288450 - protein, 9 aa, Homo Sapiens
DDYPGSNKP

SEQ ID NO: 1288451 - protein, 9 aa, Homo Sapiens
QGLSFIHKH

SEQ ID NO: 1288452 - protein, 9 aa, Homo Sapiens
LSTFDYITK

SEQ ID NO: 1288453 - protein, 9 aa, Homo Sapiens
MSTLVHADK

SEQ ID NO: 1288454 - protein, 9 aa, Homo Sapiens
MVELSENGK

SEQ ID NO: 1288455 - protein, 9 aa, Homo Sapiens
YINNTDFVP

SEQ ID NO: 1288456 - protein, 9 aa, Homo Sapiens
ELLRRKIAK

SEQ ID NO: 1288457 - protein, 9 aa, Homo Sapiens
VLARQIANH

SEQ ID NO: 1288458 - protein, 9 aa, Homo Sapiens
ILEYAHRMS

SEQ ID NO: 1288459 - protein, 9 aa, Homo Sapiens
QRIKGLGYN

SEQ ID NO: 1288460 - protein, 9 aa, Homo Sapiens
VIQKCSTVD

SEQ ID NO: 1288461 - protein, 9 aa, Homo Sapiens
KLQEVSQLN

SEQ ID NO: 1288462 - protein, 9 aa, Homo Sapiens
LGKAAIGLY

SEQ ID NO: 1288463 - protein, 9 aa, Homo Sapiens
LHLHKVKSL

SEQ ID NO: 1288464 - protein, 9 aa, Homo Sapiens
KDNCRAANF

SEQ ID NO: 1288465 - protein, 9 aa, Homo Sapiens
CYSGIRVIP

SEQ ID NO: 1288466 - protein, 9 aa, Homo Sapiens
GCGPSRCGA

SEQ ID NO: 1288467 - protein, 9 aa, Homo Sapiens
KVLLHLHKV

SEQ ID NO: 1288468 - protein, 9 aa, Homo Sapiens
KTNNPKFDE

SEQ ID NO: 1288469 - protein, 9 aa, Homo Sapiens
PDIALEQDK

SEQ ID NO: 1288470 - protein, 9 aa, Homo Sapiens
TEECEKRWK

SEQ ID NO: 1288471 - protein, 9 aa, Homo Sapiens
LYLGHLLLP

SEQ ID NO: 1288472 - protein, 9 aa, Homo Sapiens
LHTVTLCCP

SEQ ID NO: 1288473 - protein, 9 aa, Homo Sapiens
IPNNSVFPE

SEQ ID NO: 1288474 - protein, 9 aa, Homo Sapiens
HPDSEELPW

SEQ ID NO: 1288475 - protein, 9 aa, Homo Sapiens
HMNQTLQDK

SEQ ID NO: 1288476 - protein, 9 aa, Homo Sapiens
HETTRPQEM

SEQ ID NO: 1288477 - protein, 9 aa, Homo Sapiens
DPVPITVPD

SEQ ID NO: 1288478 - protein, 9 aa, Homo Sapiens
YLSFYVYDN

SEQ ID NO: 1288479 - protein, 9 aa, Homo Sapiens
ISQTLFGII

SEQ ID NO: 1288480 - protein, 9 aa, Homo Sapiens
RKKAEEKEL

SEQ ID NO: 1288481 - protein, 9 aa, Homo Sapiens
SDVMSESIV

SEQ ID NO: 1288482 - protein, 9 aa, Homo Sapiens
HEELVHRVK

SEQ ID NO: 1288483 - protein, 9 aa, Homo Sapiens
GSECGNMLL

SEQ ID NO: 1288484 - protein, 9 aa, Homo Sapiens
HRQKHFNRQ

SEQ ID NO: 1288485 - protein, 9 aa, Homo Sapiens
YCVVYEAVI

SEQ ID NO: 1288486 - protein, 9 aa, Homo Sapiens
SSNCINEEL

SEQ ID NO: 1288487 - protein, 9 aa, Homo Sapiens
TQQQETHTC

SEQ ID NO: 1288488 - protein, 9 aa, Homo Sapiens
MKVDTAHRI

SEQ ID NO: 1288489 - protein, 9 aa, Homo Sapiens
DVDSYGFIT

SEQ ID NO: 1288490 - protein, 9 aa, Homo Sapiens
EISCYTENN

SEQ ID NO: 1288491 - protein, 9 aa, Homo Sapiens
KNSNLTKIK

SEQ ID NO: 1288492 - protein, 9 aa, Homo Sapiens
SMRPLKMCG

SEQ ID NO: 1288493 - protein, 9 aa, Homo Sapiens
NTQAEMSII

SEQ ID NO: 1288494 - protein, 9 aa, Homo Sapiens
TRIMLQYDA

SEQ ID NO: 1288495 - protein, 9 aa, Homo Sapiens
LSYYMTMEW

SEQ ID NO: 1288496 - protein, 9 aa, Homo Sapiens
SVFEDYGLD

SEQ ID NO: 1288497 - protein, 9 aa, Homo Sapiens
IGPSNNGAM

SEQ ID NO: 1288498 - protein, 9 aa, Homo Sapiens
STYILVTLS

SEQ ID NO: 1288499 - protein, 9 aa, Homo Sapiens
NALRKSCQF

SEQ ID NO: 1288500 - protein, 9 aa, Homo Sapiens
QEIMSDQLF

SEQ ID NO: 1288501 - protein, 9 aa, Homo Sapiens
NLTVPWITV

SEQ ID NO: 1288502 - protein, 9 aa, Homo Sapiens
HSTLGGQGR

SEQ ID NO: 1288503 - protein, 9 aa, Homo Sapiens
HARQLILQY

SEQ ID NO: 1288504 - protein, 9 aa, Homo Sapiens
NRKNKMSIA

SEQ ID NO: 1288505 - protein, 9 aa, Homo Sapiens
TVKHSGHLF

SEQ ID NO: 1288506 - protein, 9 aa, Homo Sapiens
MTALIKAVQ

SEQ ID NO: 1288507 - protein, 9 aa, Homo Sapiens
LGFEWQKLW

SEQ ID NO: 1288508 - protein, 9 aa, Homo Sapiens
KELLKQEKR

SEQ ID NO: 1288509 - protein, 9 aa, Homo Sapiens
SRSEIPIKM

SEQ ID NO: 1288510 - protein, 9 aa, Homo Sapiens
ATVLRWRLY

SEQ ID NO: 1288511 - protein, 9 aa, Homo Sapiens
RRQRACMHA

SEQ ID NO: 1288512 - protein, 9 aa, Homo Sapiens
IGQDLIHVA

SEQ ID NO: 1288513 - protein, 9 aa, Homo Sapiens
LKEAPQQRP

SEQ ID NO: 1288514 - protein, 9 aa, Homo Sapiens
YDLIWICYS

SEQ ID NO: 1288515 - protein, 9 aa, Homo Sapiens
HKHIRTHTG

SEQ ID NO: 1288516 - protein, 9 aa, Homo Sapiens
PQLRVSYVS

SEQ ID NO: 1288517 - protein, 9 aa, Homo Sapiens
YGSVCDLMT

SEQ ID NO: 1288518 - protein, 9 aa, Homo Sapiens
IGSRFIEVM

SEQ ID NO: 1288519 - protein, 9 aa, Homo Sapiens
PKGVINDCR

SEQ ID NO: 1288520 - protein, 9 aa, Homo Sapiens
DVSTFTTMT

SEQ ID NO: 1288521 - protein, 9 aa, Homo Sapiens
DIVACSTID

SEQ ID NO: 1288522 - protein, 9 aa, Homo Sapiens
SFFLAMVHV

SEQ ID NO: 1288523 - protein, 9 aa, Homo Sapiens
FYSCIVSDV

SEQ ID NO: 1288524 - protein, 9 aa, Homo Sapiens
QHNKQLLLS

SEQ ID NO: 1288525 - protein, 9 aa, Homo Sapiens
SDQLFRRVA

SEQ ID NO: 1288526 - protein, 9 aa, Homo Sapiens
HKHDYGDTL

SEQ ID NO: 1288527 - protein, 9 aa, Homo Sapiens
LRGPSYILT

SEQ ID NO: 1288528 - protein, 9 aa, Homo Sapiens
ISQTDLFCN

SEQ ID NO: 1288529 - protein, 9 aa, Homo Sapiens
YECVGSSKI

SEQ ID NO: 1288530 - protein, 9 aa, Homo Sapiens
VYWRVCNKI

SEQ ID NO: 1288531 - protein, 9 aa, Homo Sapiens
KIGMQPHLQ

SEQ ID NO: 1288532 - protein, 9 aa, Homo Sapiens
VKDIEGVEV

SEQ ID NO: 1288533 - protein, 9 aa, Homo Sapiens
IYGKCCTLL

SEQ ID NO: 1288534 - protein, 9 aa, Homo Sapiens
IEYVKTFKG

SEQ ID NO: 1288535 - protein, 9 aa, Homo Sapiens
LLQHLVCYM

SEQ ID NO: 1288536 - protein, 9 aa, Homo Sapiens
LIRTIEDID

SEQ ID NO: 1288537 - protein, 9 aa, Homo Sapiens
CSGKEETSK

SEQ ID NO: 1288538 - protein, 9 aa, Homo Sapiens
TKVIDTKNI

SEQ ID NO: 1288539 - protein, 9 aa, Homo Sapiens
DFIPQHNKQ

SEQ ID NO: 1288540 - protein, 9 aa, Homo Sapiens
EECEKRWKD

SEQ ID NO: 1288541 - protein, 9 aa, Homo Sapiens
KICALTKKC

SEQ ID NO: 1288542 - protein, 9 aa, Homo Sapiens
TMKLFYYYE

SEQ ID NO: 1288543 - protein, 9 aa, Homo Sapiens
LLCVHEQKQ

SEQ ID NO: 1288544 - protein, 9 aa, Homo Sapiens
HLPPAALHI

SEQ ID NO: 1288545 - protein, 9 aa, Homo Sapiens
TNGGKANLY

SEQ ID NO: 1288546 - protein, 9 aa, Homo Sapiens
QTFGRISPV

SEQ ID NO: 1288547 - protein, 9 aa, Homo Sapiens
RSLLETDHD

SEQ ID NO: 1288548 - protein, 9 aa, Homo Sapiens
LLNYNNIEN

SEQ ID NO: 1288549 - protein, 9 aa, Homo Sapiens
DATYDISSG

SEQ ID NO: 1288550 - protein, 9 aa, Homo Sapiens
ELRRVEHIN

SEQ ID NO: 1288551 - protein, 9 aa, Homo Sapiens
FNYLFKNNA

SEQ ID NO: 1288552 - protein, 9 aa, Homo Sapiens
TLSFRINSE

SEQ ID NO: 1288553 - protein, 9 aa, Homo Sapiens
PYVYSVKKA

SEQ ID NO: 1288554 - protein, 9 aa, Homo Sapiens
SQTLFGIIV

SEQ ID NO: 1288555 - protein, 9 aa, Homo Sapiens
TAVKNSYYP

SEQ ID NO: 1288556 - protein, 9 aa, Homo Sapiens
QKIVENLKK

SEQ ID NO: 1288557 - protein, 9 aa, Homo Sapiens
EFCQEYLNK

SEQ ID NO: 1288558 - protein, 9 aa, Homo Sapiens
HKPQGNKEH

SEQ ID NO: 1288559 - protein, 9 aa, Homo Sapiens
LQKYINNTD

SEQ ID NO: 1288560 - protein, 9 aa, Homo Sapiens
QQYPDSHFQ

SEQ ID NO: 1288561 - protein, 9 aa, Homo Sapiens
CYTENNDAK

SEQ ID NO: 1288562 - protein, 9 aa, Homo Sapiens
ILLKENFTG

SEQ ID NO: 1288563 - protein, 9 aa, Homo Sapiens
SQPHQKQPQ

SEQ ID NO: 1288564 - protein, 9 aa, Homo Sapiens
FLFFTSLYS

SEQ ID NO: 1288565 - protein, 9 aa, Homo Sapiens
LEDLGLLVL

SEQ ID NO: 1288566 - protein, 9 aa, Homo Sapiens
EGDLSHINR

SEQ ID NO: 1288567 - protein, 9 aa, Homo Sapiens
SFNDKSIST

SEQ ID NO: 1288568 - protein, 9 aa, Homo Sapiens
SYTLTIESG

SEQ ID NO: 1288569 - protein, 9 aa, Homo Sapiens
KEFDIYREV

SEQ ID NO: 1288570 - protein, 9 aa, Homo Sapiens
DERKNQDSQ

SEQ ID NO: 1288571 - protein, 9 aa, Homo Sapiens
QTSLHFVDF

SEQ ID NO: 1288572 - protein, 9 aa, Homo Sapiens
NLVTNANLG

SEQ ID NO: 1288573 - protein, 9 aa, Homo Sapiens
LQAAGPTSN

SEQ ID NO: 1288574 - protein, 9 aa, Homo Sapiens
TCEKLYKCK

SEQ ID NO: 1288575 - protein, 9 aa, Homo Sapiens
AIPFDNPRL

SEQ ID NO: 1288576 - protein, 9 aa, Homo Sapiens
LLAIQMNEE

SEQ ID NO: 1288577 - protein, 9 aa, Homo Sapiens
EATPIVIVA

SEQ ID NO: 1288578 - protein, 9 aa, Homo Sapiens
DQNEENIKS

SEQ ID NO: 1288579 - protein, 9 aa, Homo Sapiens
YASKNKEFL

SEQ ID NO: 1288580 - protein, 9 aa, Homo Sapiens
GECNHSFNN

SEQ ID NO: 1288581 - protein, 9 aa, Homo Sapiens
HYQSIGTQQ

SEQ ID NO: 1288582 - protein, 9 aa, Homo Sapiens
EEQLRLLER

SEQ ID NO: 1288583 - protein, 9 aa, Homo Sapiens
SVVFNIVLW

SEQ ID NO: 1288584 - protein, 9 aa, Homo Sapiens
QSCVSPGMF

SEQ ID NO: 1288585 - protein, 9 aa, Homo Sapiens
GDRIEICYN

SEQ ID NO: 1288586 - protein, 9 aa, Homo Sapiens
ADMCHEELK

SEQ ID NO: 1288587 - protein, 9 aa, Homo Sapiens
EGLNTQGGS

SEQ ID NO: 1288588 - protein, 9 aa, Homo Sapiens
GFEWQKLWC

SEQ ID NO: 1288589 - protein, 9 aa, Homo Sapiens
AWIAIFCCF

SEQ ID NO: 1288590 - protein, 9 aa, Homo Sapiens
VPGCGPSRC

SEQ ID NO: 1288591 - protein, 9 aa, Homo Sapiens
INDCRKFKL

SEQ ID NO: 1288592 - protein, 9 aa, Homo Sapiens
DEEDIIKEG

SEQ ID NO: 1288593 - protein, 9 aa, Homo Sapiens
KVFAIQDHT

SEQ ID NO: 1288594 - protein, 9 aa, Homo Sapiens
FKKQKRLIH

SEQ ID NO: 1288595 - protein, 9 aa, Homo Sapiens
INELQQTLE

SEQ ID NO: 1288596 - protein, 9 aa, Homo Sapiens
IQREKINNS

SEQ ID NO: 1288597 - protein, 9 aa, Homo Sapiens
RQIANHCPD

SEQ ID NO: 1288598 - protein, 9 aa, Homo Sapiens
CSNNMPTIC

SEQ ID NO: 1288599 - protein, 9 aa, Homo Sapiens
SCMLHTVTL

SEQ ID NO: 1288600 - protein, 9 aa, Homo Sapiens
SCKKNFLIK

SEQ ID NO: 1288601 - protein, 9 aa, Homo Sapiens
ICDVSERRA

SEQ ID NO: 1288602 - protein, 9 aa, Homo Sapiens
NSTESFLYC

SEQ ID NO: 1288603 - protein, 9 aa, Homo Sapiens
EDVDRLKVL

SEQ ID NO: 1288604 - protein, 9 aa, Homo Sapiens
HHLVQMPED

SEQ ID NO: 1288605 - protein, 9 aa, Homo Sapiens
ATNCHSECL

SEQ ID NO: 1288606 - protein, 9 aa, Homo Sapiens
KIFSHMNNI

SEQ ID NO: 1288607 - protein, 9 aa, Homo Sapiens
EGSTIEKME

SEQ ID NO: 1288608 - protein, 9 aa, Homo Sapiens
KHPLRGIGI

SEQ ID NO: 1288609 - protein, 9 aa, Homo Sapiens
NVNIKKDSE

SEQ ID NO: 1288610 - protein, 9 aa, Homo Sapiens
LAANSDNLM

SEQ ID NO: 1288611 - protein, 9 aa, Homo Sapiens
RNYEKALLE

SEQ ID NO: 1288612 - protein, 9 aa, Homo Sapiens
ELSENGKKA

SEQ ID NO: 1288613 - protein, 9 aa, Homo Sapiens
TLYHDEITE

SEQ ID NO: 1288614 - protein, 9 aa, Homo Sapiens
VINDCRKFK

SEQ ID NO: 1288615 - protein, 9 aa, Homo Sapiens
NEDQILIND

SEQ ID NO: 1288616 - protein, 9 aa, Homo Sapiens
HGLITNYKI

SEQ ID NO: 1288617 - protein, 9 aa, Homo Sapiens
TQQLLDDQD

SEQ ID NO: 1288618 - protein, 9 aa, Homo Sapiens
QFHGLITNY

SEQ ID NO: 1288619 - protein, 9 aa, Homo Sapiens
EGHYASKNK

SEQ ID NO: 1288620 - protein, 9 aa, Homo Sapiens
RVQIQSLQQ

SEQ ID NO: 1288621 - protein, 9 aa, Homo Sapiens
LRRKIAKLI

SEQ ID NO: 1288622 - protein, 9 aa, Homo Sapiens
SCDEYSRGF

SEQ ID NO: 1288623 - protein, 9 aa, Homo Sapiens
PEFPDSCFH

SEQ ID NO: 1288624 - protein, 9 aa, Homo Sapiens
PQGENLLSW

SEQ ID NO: 1288625 - protein, 9 aa, Homo Sapiens
IINIMSAEY

SEQ ID NO: 1288626 - protein, 9 aa, Homo Sapiens
EPLTKDDIT

SEQ ID NO: 1288627 - protein, 9 aa, Homo Sapiens
EPHEELVHR

SEQ ID NO: 1288628 - protein, 9 aa, Homo Sapiens
LFYYYEVTP

SEQ ID NO: 1288629 - protein, 9 aa, Homo Sapiens
YVYSVKKAP

SEQ ID NO: 1288630 - protein, 9 aa, Homo Sapiens
DELDKIVAY

SEQ ID NO: 1288631 - protein, 9 aa, Homo Sapiens
TMDSQPHQK

SEQ ID NO: 1288632 - protein, 9 aa, Homo Sapiens
PKTPLCAPE

SEQ ID NO: 1288633 - protein, 9 aa, Homo Sapiens
QCVICLDIL

SEQ ID NO: 1288634 - protein, 9 aa, Homo Sapiens
LLRRKIAKL

SEQ ID NO: 1288635 - protein, 9 aa, Homo Sapiens
DENFYPDIL

SEQ ID NO: 1288636 - protein, 9 aa, Homo Sapiens
YIGHKGPVY

SEQ ID NO: 1288637 - protein, 9 aa, Homo Sapiens
TCCVDTKEA

SEQ ID NO: 1288638 - protein, 9 aa, Homo Sapiens
ENYSYDFED

SEQ ID NO: 1288639 - protein, 9 aa, Homo Sapiens
KKQHYLLKR

SEQ ID NO: 1288640 - protein, 9 aa, Homo Sapiens
FCVCMWEIL

SEQ ID NO: 1288641 - protein, 9 aa, Homo Sapiens
CAHARFFIC

SEQ ID NO: 1288642 - protein, 9 aa, Homo Sapiens
HTPLEGRAD

SEQ ID NO: 1288643 - protein, 9 aa, Homo Sapiens
EDIIKEGMI

SEQ ID NO: 1288644 - protein, 9 aa, Homo Sapiens
DYTVSTDTR

SEQ ID NO: 1288645 - protein, 9 aa, Homo Sapiens
GKNHPPNFS

SEQ ID NO: 1288646 - protein, 9 aa, Homo Sapiens
ENALRKAQE

SEQ ID NO: 1288647 - protein, 9 aa, Homo Sapiens
PKAVKNTYG

SEQ ID NO: 1288648 - protein, 9 aa, Homo Sapiens
QLPLHGGPE

SEQ ID NO: 1288649 - protein, 9 aa, Homo Sapiens
YLADIGYVH

SEQ ID NO: 1288650 - protein, 9 aa, Homo Sapiens
LTQQQKIDE

SEQ ID NO: 1288651 - protein, 9 aa, Homo Sapiens
EWTKLYWEI

SEQ ID NO: 1288652 - protein, 9 aa, Homo Sapiens
YRDFRLQCV

SEQ ID NO: 1288653 - protein, 9 aa, Homo Sapiens
EACTQYQKT

SEQ ID NO: 1288654 - protein, 9 aa, Homo Sapiens
GIQVIFCGD

SEQ ID NO: 1288655 - protein, 9 aa, Homo Sapiens
NHNKITQSM

SEQ ID NO: 1288656 - protein, 9 aa, Homo Sapiens
LSCTGFLEE

SEQ ID NO: 1288657 - protein, 9 aa, Homo Sapiens
PRSHSVLAV

SEQ ID NO: 1288658 - protein, 9 aa, Homo Sapiens
KCNNAHENP

SEQ ID NO: 1288659 - protein, 9 aa, Homo Sapiens
KLEWPNPVL

SEQ ID NO: 1288660 - protein, 9 aa, Homo Sapiens
SVEQRTSED

SEQ ID NO: 1288661 - protein, 9 aa, Homo Sapiens
KCSTVDDSC

SEQ ID NO: 1288662 - protein, 9 aa, Homo Sapiens
RCDHILVGT

SEQ ID NO: 1288663 - protein, 9 aa, Homo Sapiens
VAKCYECKQ

SEQ ID NO: 1288664 - protein, 9 aa, Homo Sapiens
NNLHEGTDP

SEQ ID NO: 1288665 - protein, 9 aa, Homo Sapiens
NLEHKIYAR

SEQ ID NO: 1288666 - protein, 9 aa, Homo Sapiens
IKMECPTST

SEQ ID NO: 1288667 - protein, 9 aa, Homo Sapiens
HYASKNKEF

SEQ ID NO: 1288668 - protein, 9 aa, Homo Sapiens
VDYQMYYYS

SEQ ID NO: 1288669 - protein, 9 aa, Homo Sapiens
ELSPNIFAL

SEQ ID NO: 1288670 - protein, 9 aa, Homo Sapiens
VKASPPQQK

SEQ ID NO: 1288671 - protein, 9 aa, Homo Sapiens
CCFSFFMVA

SEQ ID NO: 1288672 - protein, 9 aa, Homo Sapiens
EEIFGPVQH

SEQ ID NO: 1288673 - protein, 9 aa, Homo Sapiens
GPAGPPCPR

SEQ ID NO: 1288674 - protein, 9 aa, Homo Sapiens
QSTAYSLHK

SEQ ID NO: 1288675 - protein, 9 aa, Homo Sapiens
KPRLTSTAV

SEQ ID NO: 1288676 - protein, 9 aa, Homo Sapiens
KHFDGYKPL

SEQ ID NO: 1288677 - protein, 9 aa, Homo Sapiens
YKSLQDLVL

SEQ ID NO: 1288678 - protein, 9 aa, Homo Sapiens
GEVLREQFC

SEQ ID NO: 1288679 - protein, 9 aa, Homo Sapiens
FVEKCSPIW

SEQ ID NO: 1288680 - protein, 9 aa, Homo Sapiens
FCDKDFRTG

SEQ ID NO: 1288681 - protein, 9 aa, Homo Sapiens
LKITNSHQK

SEQ ID NO: 1288682 - protein, 9 aa, Homo Sapiens
SLKVLEHKV

SEQ ID NO: 1288683 - protein, 9 aa, Homo Sapiens
AAVQKIVEN

SEQ ID NO: 1288684 - protein, 9 aa, Homo Sapiens
YTVSTDTRD

SEQ ID NO: 1288685 - protein, 9 aa, Homo Sapiens
GKSSEDATY

SEQ ID NO: 1288686 - protein, 9 aa, Homo Sapiens
CYSAFVVLA

SEQ ID NO: 1288687 - protein, 9 aa, Homo Sapiens
TYLMMADLP

SEQ ID NO: 1288688 - protein, 9 aa, Homo Sapiens
IQLCEELLA

SEQ ID NO: 1288689 - protein, 9 aa, Homo Sapiens
CIVQAELCD

SEQ ID NO: 1288690 - protein, 9 aa, Homo Sapiens
FYPKWTISK

SEQ ID NO: 1288691 - protein, 9 aa, Homo Sapiens
SSTFSDQST

SEQ ID NO: 1288692 - protein, 9 aa, Homo Sapiens
LPKNVNIKK

SEQ ID NO: 1288693 - protein, 9 aa, Homo Sapiens
YIFTMLITL

SEQ ID NO: 1288694 - protein, 9 aa, Homo Sapiens
ETCKIIVDM

SEQ ID NO: 1288695 - protein, 9 aa, Homo Sapiens
YSMNHILEC

SEQ ID NO: 1288696 - protein, 9 aa, Homo Sapiens
CTSIPGYGF

SEQ ID NO: 1288697 - protein, 9 aa, Homo Sapiens
ALRGEGPGA

SEQ ID NO: 1288698 - protein, 9 aa, Homo Sapiens
NDRVGLIHD

SEQ ID NO: 1288699 - protein, 9 aa, Homo Sapiens
GSFADQDDL

SEQ ID NO: 1288700 - protein, 9 aa, Homo Sapiens
DSIANSFVG

SEQ ID NO: 1288701 - protein, 9 aa, Homo Sapiens
KGLVDREPH

SEQ ID NO: 1288702 - protein, 9 aa, Homo Sapiens
PKYKYVLNE

SEQ ID NO: 1288703 - protein, 9 aa, Homo Sapiens
CAHMTASNT

SEQ ID NO: 1288704 - protein, 9 aa, Homo Sapiens
QQVSQIQSC

SEQ ID NO: 1288705 - protein, 9 aa, Homo Sapiens
STLKVTPLQ

SEQ ID NO: 1288706 - protein, 9 aa, Homo Sapiens
YQMYYYSLD

SEQ ID NO: 1288707 - protein, 9 aa, Homo Sapiens
QRTDGVMWE

SEQ ID NO: 1288708 - protein, 9 aa, Homo Sapiens
SWLINLAAK

SEQ ID NO: 1288709 - protein, 9 aa, Homo Sapiens
NPALPGVFC

SEQ ID NO: 1288710 - protein, 9 aa, Homo Sapiens
PGMRGLPCA

SEQ ID NO: 1288711 - protein, 9 aa, Homo Sapiens
RTHLGYFFV

SEQ ID NO: 1288712 - protein, 9 aa, Homo Sapiens
NIATSPQSQ

SEQ ID NO: 1288713 - protein, 9 aa, Homo Sapiens
CLVAVENAL

SEQ ID NO: 1288714 - protein, 9 aa, Homo Sapiens
NTMKGDAID

SEQ ID NO: 1288715 - protein, 9 aa, Homo Sapiens
LEQDKTVKK

SEQ ID NO: 1288716 - protein, 9 aa, Homo Sapiens
HMSPIINNT

SEQ ID NO: 1288717 - protein, 9 aa, Homo Sapiens
YFTSNSCVW

SEQ ID NO: 1288718 - protein, 9 aa, Homo Sapiens
ARKHIFPVR

SEQ ID NO: 1288719 - protein, 9 aa, Homo Sapiens
MQDRLEQAR

SEQ ID NO: 1288720 - protein, 9 aa, Homo Sapiens
SDEIMSLWV

SEQ ID NO: 1288721 - protein, 9 aa, Homo Sapiens
NLDKTCCVD

SEQ ID NO: 1288722 - protein, 9 aa, Homo Sapiens
FVCAQCSTD

SEQ ID NO: 1288723 - protein, 9 aa, Homo Sapiens
PHSFENNQQ

SEQ ID NO: 1288724 - protein, 9 aa, Homo Sapiens
KIAKLIESC

SEQ ID NO: 1288725 - protein, 9 aa, Homo Sapiens
FSTRDYIIE

SEQ ID NO: 1288726 - protein, 9 aa, Homo Sapiens
DERCAQDMD

SEQ ID NO: 1288727 - protein, 9 aa, Homo Sapiens
QMPEDYLEN

SEQ ID NO: 1288728 - protein, 9 aa, Homo Sapiens
NKKHSKKKR

SEQ ID NO: 1288729 - protein, 9 aa, Homo Sapiens
IFHWDRKQM

SEQ ID NO: 1288730 - protein, 9 aa, Homo Sapiens
VPLQNSFEK

SEQ ID NO: 1288731 - protein, 9 aa, Homo Sapiens
EYKHVYKGE

SEQ ID NO: 1288732 - protein, 9 aa, Homo Sapiens
SAFFWEESD

SEQ ID NO: 1288733 - protein, 9 aa, Homo Sapiens
TTTISIFKG

SEQ ID NO: 1288734 - protein, 9 aa, Homo Sapiens
QIPSWLINL

SEQ ID NO: 1288735 - protein, 9 aa, Homo Sapiens
RHTEKVHDG

SEQ ID NO: 1288736 - protein, 9 aa, Homo Sapiens
GAVAHACYH

SEQ ID NO: 1288737 - protein, 9 aa, Homo Sapiens
FESDMKRKG

SEQ ID NO: 1288738 - protein, 9 aa, Homo Sapiens
DCQEFVPGQ

SEQ ID NO: 1288739 - protein, 9 aa, Homo Sapiens
LGSGKDSHH

SEQ ID NO: 1288740 - protein, 9 aa, Homo Sapiens
FVPSAGADI

SEQ ID NO: 1288741 - protein, 9 aa, Homo Sapiens
LTEASSWSE

SEQ ID NO: 1288742 - protein, 9 aa, Homo Sapiens
PLWVTKTRI

SEQ ID NO: 1288743 - protein, 9 aa, Homo Sapiens
NVSSESAES

SEQ ID NO: 1288744 - protein, 9 aa, Homo Sapiens
VQGLFEKCV

SEQ ID NO: 1288745 - protein, 9 aa, Homo Sapiens
SDRKVESLL

SEQ ID NO: 1288746 - protein, 9 aa, Homo Sapiens
KNHPPNFSK

SEQ ID NO: 1288747 - protein, 9 aa, Homo Sapiens
YEKALLEQL

SEQ ID NO: 1288748 - protein, 9 aa, Homo Sapiens
YLWEFYLPY

SEQ ID NO: 1288749 - protein, 9 aa, Homo Sapiens
PAQAHWKIF

SEQ ID NO: 1288750 - protein, 9 aa, Homo Sapiens
SFIGSRFIE

SEQ ID NO: 1288751 - protein, 9 aa, Homo Sapiens
VNLKSMSIV

SEQ ID NO: 1288752 - protein, 9 aa, Homo Sapiens
VDLKSKCKS

SEQ ID NO: 1288753 - protein, 9 aa, Homo Sapiens
PTVKHSGHL

SEQ ID NO: 1288754 - protein, 9 aa, Homo Sapiens
HCAVRNLQD

SEQ ID NO: 1288755 - protein, 9 aa, Homo Sapiens
YEKNNPCSQ

SEQ ID NO: 1288756 - protein, 9 aa, Homo Sapiens
GVMWEYEPK

SEQ ID NO: 1288757 - protein, 9 aa, Homo Sapiens
TIYLIDYII

SEQ ID NO: 1288758 - protein, 9 aa, Homo Sapiens
NNCCMSLWV

SEQ ID NO: 1288759 - protein, 9 aa, Homo Sapiens
QDVKIKLKI

SEQ ID NO: 1288760 - protein, 9 aa, Homo Sapiens
DSCYPQIVD

SEQ ID NO: 1288761 - protein, 9 aa, Homo Sapiens
ISLDTLVHA

SEQ ID NO: 1288762 - protein, 9 aa, Homo Sapiens
ACRGNLVYN

SEQ ID NO: 1288763 - protein, 9 aa, Homo Sapiens
HLALLAVPI

SEQ ID NO: 1288764 - protein, 9 aa, Homo Sapiens
GLTYHVAHW

SEQ ID NO: 1288765 - protein, 9 aa, Homo Sapiens
AHQSHHTPL

SEQ ID NO: 1288766 - protein, 9 aa, Homo Sapiens
FFIYRARTL

SEQ ID NO: 1288767 - protein, 9 aa, Homo Sapiens
ANMLRQASL

SEQ ID NO: 1288768 - protein, 9 aa, Homo Sapiens
FSLCYLHTA

SEQ ID NO: 1288769 - protein, 9 aa, Homo Sapiens
DAAACANHT

SEQ ID NO: 1288770 - protein, 9 aa, Homo Sapiens
IYSFSAKHA

SEQ ID NO: 1288771 - protein, 9 aa, Homo Sapiens
RNYIIKFWA

SEQ ID NO: 1288772 - protein, 9 aa, Homo Sapiens
KKGVTIPNQ

SEQ ID NO: 1288773 - protein, 9 aa, Homo Sapiens
AYPTYEVGI

SEQ ID NO: 1288774 - protein, 9 aa, Homo Sapiens
LHIIAYYKE

SEQ ID NO: 1288775 - protein, 9 aa, Homo Sapiens
EYTLRLLKN

SEQ ID NO: 1288776 - protein, 9 aa, Homo Sapiens
YRDTITPQH

SEQ ID NO: 1288777 - protein, 9 aa, Homo Sapiens
NKTILESSY

SEQ ID NO: 1288778 - protein, 9 aa, Homo Sapiens
EVGRGSYCV

SEQ ID NO: 1288779 - protein, 9 aa, Homo Sapiens
KQPSNYGPM

SEQ ID NO: 1288780 - protein, 9 aa, Homo Sapiens
NTHKKIHTG

SEQ ID NO: 1288781 - protein, 9 aa, Homo Sapiens
VESSHSVEV

SEQ ID NO: 1288782 - protein, 9 aa, Homo Sapiens
FLDVSLDKN

SEQ ID NO: 1288783 - protein, 9 aa, Homo Sapiens
FSIGRSYDG

SEQ ID NO: 1288784 - protein, 9 aa, Homo Sapiens
TTVPGCGPS

SEQ ID NO: 1288785 - protein, 9 aa, Homo Sapiens
ANLALASVA

SEQ ID NO: 1288786 - protein, 9 aa, Homo Sapiens
ILKHRKCNN

SEQ ID NO: 1288787 - protein, 9 aa, Homo Sapiens
TAVQGITRH

SEQ ID NO: 1288788 - protein, 9 aa, Homo Sapiens
HCGTCLNLP

SEQ ID NO: 1288789 - protein, 9 aa, Homo Sapiens
TQIIKRDER

SEQ ID NO: 1288790 - protein, 9 aa, Homo Sapiens
FHVDTPEES

SEQ ID NO: 1288791 - protein, 9 aa, Homo Sapiens
TKMCKKQND

SEQ ID NO: 1288792 - protein, 9 aa, Homo Sapiens
YAHRMSQDI

SEQ ID NO: 1288793 - protein, 9 aa, Homo Sapiens
IPGHCQHCG

SEQ ID NO: 1288794 - protein, 9 aa, Homo Sapiens
APLENGLAM

SEQ ID NO: 1288795 - protein, 9 aa, Homo Sapiens
MDQEPAVNR

SEQ ID NO: 1288796 - protein, 9 aa, Homo Sapiens
VFMVLCSLG

SEQ ID NO: 1288797 - protein, 9 aa, Homo Sapiens
ICALTKKCR

SEQ ID NO: 1288798 - protein, 9 aa, Homo Sapiens
ASIGITNHD

SEQ ID NO: 1288799 - protein, 9 aa, Homo Sapiens
EMYCYPDPS

SEQ ID NO: 1288800 - protein, 9 aa, Homo Sapiens
MTLMKNGEE

SEQ ID NO: 1288801 - protein, 9 aa, Homo Sapiens
AVSSVLANG

SEQ ID NO: 1288802 - protein, 9 aa, Homo Sapiens
SAFVVLARS

SEQ ID NO: 1288803 - protein, 9 aa, Homo Sapiens
TLNYLISHQ

SEQ ID NO: 1288804 - protein, 9 aa, Homo Sapiens
SRCSQTLVN

SEQ ID NO: 1288805 - protein, 9 aa, Homo Sapiens
VATANLALA

SEQ ID NO: 1288806 - protein, 9 aa, Homo Sapiens
DTPEESEEW

SEQ ID NO: 1288807 - protein, 9 aa, Homo Sapiens
EESEQRDLE

SEQ ID NO: 1288808 - protein, 9 aa, Homo Sapiens
KIIFTKAED

SEQ ID NO: 1288809 - protein, 9 aa, Homo Sapiens
SAVFFCILL

SEQ ID NO: 1288810 - protein, 9 aa, Homo Sapiens
ITVPDYYKI

SEQ ID NO: 1288811 - protein, 9 aa, Homo Sapiens
VITNALKPC

SEQ ID NO: 1288812 - protein, 9 aa, Homo Sapiens
FQHFTNHSV

SEQ ID NO: 1288813 - protein, 9 aa, Homo Sapiens
KLVPHSQKM

SEQ ID NO: 1288814 - protein, 9 aa, Homo Sapiens
YEVHHQKFV

SEQ ID NO: 1288815 - protein, 9 aa, Homo Sapiens
LPALPKTLS

SEQ ID NO: 1288816 - protein, 9 aa, Homo Sapiens
QDLIHVAVA

SEQ ID NO: 1288817 - protein, 9 aa, Homo Sapiens
IEFSNLIIT

SEQ ID NO: 1288818 - protein, 9 aa, Homo Sapiens
EKNMAKIHS

SEQ ID NO: 1288819 - protein, 9 aa, Homo Sapiens
HKTYIDLIL

SEQ ID NO: 1288820 - protein, 9 aa, Homo Sapiens
DLSLVETVS

SEQ ID NO: 1288821 - protein, 9 aa, Homo Sapiens
SVCDLMTNK

SEQ ID NO: 1288822 - protein, 9 aa, Homo Sapiens
PLLLCVHEQ

SEQ ID NO: 1288823 - protein, 9 aa, Homo Sapiens
QSEKALEKG

SEQ ID NO: 1288824 - protein, 9 aa, Homo Sapiens
SKYSLSSKT

SEQ ID NO: 1288825 - protein, 9 aa, Homo Sapiens
NPALLELLF

SEQ ID NO: 1288826 - protein, 9 aa, Homo Sapiens
KPQHVFSVF

SEQ ID NO: 1288827 - protein, 9 aa, Homo Sapiens
EDLHPTKKH

SEQ ID NO: 1288828 - protein, 9 aa, Homo Sapiens
RKSCQFCDV

SEQ ID NO: 1288829 - protein, 9 aa, Homo Sapiens
IYFLLSQLS

SEQ ID NO: 1288830 - protein, 9 aa, Homo Sapiens
FALKVQQKH

SEQ ID NO: 1288831 - protein, 9 aa, Homo Sapiens
SEIKLLFGC

SEQ ID NO: 1288832 - protein, 9 aa, Homo Sapiens
PHAKGKIVV

SEQ ID NO: 1288833 - protein, 9 aa, Homo Sapiens
TCECTDNAY

SEQ ID NO: 1288834 - protein, 9 aa, Homo Sapiens
DQDDLPGLA

SEQ ID NO: 1288835 - protein, 9 aa, Homo Sapiens
DSDIEKDHI

SEQ ID NO: 1288836 - protein, 9 aa, Homo Sapiens
NDNRHEFLH

SEQ ID NO: 1288837 - protein, 9 aa, Homo Sapiens
FLVVWLVLN

SEQ ID NO: 1288838 - protein, 9 aa, Homo Sapiens
NFMLKVHHL

SEQ ID NO: 1288839 - protein, 9 aa, Homo Sapiens
NCIYNSNDV

SEQ ID NO: 1288840 - protein, 9 aa, Homo Sapiens
DCKNCGEVL

SEQ ID NO: 1288841 - protein, 9 aa, Homo Sapiens
EQYLDTYIG

SEQ ID NO: 1288842 - protein, 9 aa, Homo Sapiens
GSSVLTDFD

SEQ ID NO: 1288843 - protein, 9 aa, Homo Sapiens
TLLYLGHLL

SEQ ID NO: 1288844 - protein, 9 aa, Homo Sapiens
ALQTLLTII

SEQ ID NO: 1288845 - protein, 9 aa, Homo Sapiens
DTSSPTISS

SEQ ID NO: 1288846 - protein, 9 aa, Homo Sapiens
STADYSLYN

SEQ ID NO: 1288847 - protein, 9 aa, Homo Sapiens
LITDDKEGG

SEQ ID NO: 1288848 - protein, 9 aa, Homo Sapiens
GDSSSEHTL

SEQ ID NO: 1288849 - protein, 9 aa, Homo Sapiens
HVIKLSQDE

SEQ ID NO: 1288850 - protein, 9 aa, Homo Sapiens
KTAVLKAFA

SEQ ID NO: 1288851 - protein, 9 aa, Homo Sapiens
PQTLNYLIS

SEQ ID NO: 1288852 - protein, 9 aa, Homo Sapiens
DVLADMCHE

SEQ ID NO: 1288853 - protein, 9 aa, Homo Sapiens
DYSPDDKHL

SEQ ID NO: 1288854 - protein, 9 aa, Homo Sapiens
IKRSAFDRC

SEQ ID NO: 1288855 - protein, 9 aa, Homo Sapiens
MWLMTYVCA

SEQ ID NO: 1288856 - protein, 9 aa, Homo Sapiens
SKFVPPFKG

SEQ ID NO: 1288857 - protein, 9 aa, Homo Sapiens
GGKKTEDVE

SEQ ID NO: 1288858 - protein, 9 aa, Homo Sapiens
KGKYFVTFQ

SEQ ID NO: 1288859 - protein, 9 aa, Homo Sapiens
YLMMADLPY

SEQ ID NO: 1288860 - protein, 9 aa, Homo Sapiens
ENILDNDPS

SEQ ID NO: 1288861 - protein, 9 aa, Homo Sapiens
KKLDFVAIP

SEQ ID NO: 1288862 - protein, 9 aa, Homo Sapiens
DTKPEDLNS

SEQ ID NO: 1288863 - protein, 9 aa, Homo Sapiens
ILPSKKKYP

SEQ ID NO: 1288864 - protein, 9 aa, Homo Sapiens
CTLLVIYNL

SEQ ID NO: 1288865 - protein, 9 aa, Homo Sapiens
ISDTKPEDL

SEQ ID NO: 1288866 - protein, 9 aa, Homo Sapiens
YTMANNPNM

SEQ ID NO: 1288867 - protein, 9 aa, Homo Sapiens
KLCTFHGRD

SEQ ID NO: 1288868 - protein, 9 aa, Homo Sapiens
FALKTLCQE

SEQ ID NO: 1288869 - protein, 9 aa, Homo Sapiens
NVNKYIGLT

SEQ ID NO: 1288870 - protein, 9 aa, Homo Sapiens
PELIKCPWT

SEQ ID NO: 1288871 - protein, 9 aa, Homo Sapiens
SCVSPGMFS

SEQ ID NO: 1288872 - protein, 9 aa, Homo Sapiens
IISETSIFD

SEQ ID NO: 1288873 - protein, 9 aa, Homo Sapiens
SWVLFSLSC

SEQ ID NO: 1288874 - protein, 9 aa, Homo Sapiens
LPTNGGQEQ

SEQ ID NO: 1288875 - protein, 9 aa, Homo Sapiens
WWKFKQKEL

SEQ ID NO: 1288876 - protein, 9 aa, Homo Sapiens
TLVHADKIS

SEQ ID NO: 1288877 - protein, 9 aa, Homo Sapiens
AGLIGKKMC

SEQ ID NO: 1288878 - protein, 9 aa, Homo Sapiens
ILSFFSNQY

SEQ ID NO: 1288879 - protein, 9 aa, Homo Sapiens
KVKCEDSKN

SEQ ID NO: 1288880 - protein, 9 aa, Homo Sapiens
YGTYLIGTE

SEQ ID NO: 1288881 - protein, 9 aa, Homo Sapiens
SHQKLISCR

SEQ ID NO: 1288882 - protein, 9 aa, Homo Sapiens
TKPEDLNSG

SEQ ID NO: 1288883 - protein, 9 aa, Homo Sapiens
KMRSRIDEK

SEQ ID NO: 1288884 - protein, 9 aa, Homo Sapiens
RLIHERTVW

SEQ ID NO: 1288885 - protein, 9 aa, Homo Sapiens
QTQKDLVLK

SEQ ID NO: 1288886 - protein, 9 aa, Homo Sapiens
SSLCDDYPG

SEQ ID NO: 1288887 - protein, 9 aa, Homo Sapiens
VIEDSDRKV

SEQ ID NO: 1288888 - protein, 9 aa, Homo Sapiens
FHKHDYGDT

SEQ ID NO: 1288889 - protein, 9 aa, Homo Sapiens
KRSSTLNTH

SEQ ID NO: 1288890 - protein, 9 aa, Homo Sapiens
TICVQNTPK

SEQ ID NO: 1288891 - protein, 9 aa, Homo Sapiens
RDNPRNTLF

SEQ ID NO: 1288892 - protein, 9 aa, Homo Sapiens
AASRGADYA

SEQ ID NO: 1288893 - protein, 9 aa, Homo Sapiens
YIVTFDRTG

SEQ ID NO: 1288894 - protein, 9 aa, Homo Sapiens
SLDASVKAS

SEQ ID NO: 1288895 - protein, 9 aa, Homo Sapiens
PMPFCDRCG

SEQ ID NO: 1288896 - protein, 9 aa, Homo Sapiens
CSAGTPVMF

SEQ ID NO: 1288897 - protein, 9 aa, Homo Sapiens
QPLEGVGPF

SEQ ID NO: 1288898 - protein, 9 aa, Homo Sapiens
NFTTPLDEY

SEQ ID NO: 1288899 - protein, 9 aa, Homo Sapiens
KQKANIFVQ

SEQ ID NO: 1288900 - protein, 9 aa, Homo Sapiens
TFDLMTLHT

SEQ ID NO: 1288901 - protein, 9 aa, Homo Sapiens
ANATVAAFT

SEQ ID NO: 1288902 - protein, 9 aa, Homo Sapiens
VIPAQAHWK

SEQ ID NO: 1288903 - protein, 9 aa, Homo Sapiens
SNDVLGSAN

SEQ ID NO: 1288904 - protein, 9 aa, Homo Sapiens
LMKNGEEIV

SEQ ID NO: 1288905 - protein, 9 aa, Homo Sapiens
PSCVVEAKT

SEQ ID NO: 1288906 - protein, 9 aa, Homo Sapiens
WVIVLEEGV

SEQ ID NO: 1288907 - protein, 9 aa, Homo Sapiens
ILTSIHSLL

SEQ ID NO: 1288908 - protein, 9 aa, Homo Sapiens
YTLRVDCTQ

SEQ ID NO: 1288909 - protein, 9 aa, Homo Sapiens
LEEIQLCEE

SEQ ID NO: 1288910 - protein, 9 aa, Homo Sapiens
SEEVLSTPS

SEQ ID NO: 1288911 - protein, 9 aa, Homo Sapiens
FSDEEDIIK

SEQ ID NO: 1288912 - protein, 9 aa, Homo Sapiens
HENRNGNGL

SEQ ID NO: 1288913 - protein, 9 aa, Homo Sapiens
QYSVEHLTT

SEQ ID NO: 1288914 - protein, 9 aa, Homo Sapiens
TNSHQKLIS

SEQ ID NO: 1288915 - protein, 9 aa, Homo Sapiens
CHNMYEEME

SEQ ID NO: 1288916 - protein, 9 aa, Homo Sapiens
AFGLRLNNA

SEQ ID NO: 1288917 - protein, 9 aa, Homo Sapiens
HINRLQNLT

SEQ ID NO: 1288918 - protein, 9 aa, Homo Sapiens
QDQQIYEML

SEQ ID NO: 1288919 - protein, 9 aa, Homo Sapiens
WTHILMITE

SEQ ID NO: 1288920 - protein, 9 aa, Homo Sapiens
SCVKELILA

SEQ ID NO: 1288921 - protein, 9 aa, Homo Sapiens
TPQGENLLS

SEQ ID NO: 1288922 - protein, 9 aa, Homo Sapiens
PTYCVHYYA

SEQ ID NO: 1288923 - protein, 9 aa, Homo Sapiens
DLQPNLYPT

SEQ ID NO: 1288924 - protein, 9 aa, Homo Sapiens
NHTLLRPND

SEQ ID NO: 1288925 - protein, 9 aa, Homo Sapiens
LLSFFLAMV

SEQ ID NO: 1288926 - protein, 9 aa, Homo Sapiens
EITGAQCAG

SEQ ID NO: 1288927 - protein, 9 aa, Homo Sapiens
GYSHTHREE

SEQ ID NO: 1288928 - protein, 9 aa, Homo Sapiens
SGNSRTANI

SEQ ID NO: 1288929 - protein, 9 aa, Homo Sapiens
IATSPQSQL

SEQ ID NO: 1288930 - protein, 9 aa, Homo Sapiens
YNKQPSNYG

SEQ ID NO: 1288931 - protein, 9 aa, Homo Sapiens
FGRISPVPS

SEQ ID NO: 1288932 - protein, 9 aa, Homo Sapiens
VDTPEESEE

SEQ ID NO: 1288933 - protein, 9 aa, Homo Sapiens
PPKEVCAEC

SEQ ID NO: 1288934 - protein, 9 aa, Homo Sapiens
RNSASWVLF

SEQ ID NO: 1288935 - protein, 9 aa, Homo Sapiens
SNICAHMTA

SEQ ID NO: 1288936 - protein, 9 aa, Homo Sapiens
LLTTMCNHL

SEQ ID NO: 1288937 - protein, 9 aa, Homo Sapiens
ICTSVSTFS

SEQ ID NO: 1288938 - protein, 9 aa, Homo Sapiens
QEKLNEISY

SEQ ID NO: 1288939 - protein, 9 aa, Homo Sapiens
SVKASPPQQ

SEQ ID NO: 1288940 - protein, 9 aa, Homo Sapiens
RYYHIALDW

SEQ ID NO: 1288941 - protein, 9 aa, Homo Sapiens
ETGKTMRKN

SEQ ID NO: 1288942 - protein, 9 aa, Homo Sapiens
TVEKPYECN

SEQ ID NO: 1288943 - protein, 9 aa, Homo Sapiens
AWSKLDHGI

SEQ ID NO: 1288944 - protein, 9 aa, Homo Sapiens
RIDEKFLTK

SEQ ID NO: 1288945 - protein, 9 aa, Homo Sapiens
SKVLFGRSQ

SEQ ID NO: 1288946 - protein, 9 aa, Homo Sapiens
TYIGHKGPV

SEQ ID NO: 1288947 - protein, 9 aa, Homo Sapiens
MTREESEQR

SEQ ID NO: 1288948 - protein, 9 aa, Homo Sapiens
SKSGNSRTA

SEQ ID NO: 1288949 - protein, 9 aa, Homo Sapiens
RAYTIQWME

SEQ ID NO: 1288950 - protein, 9 aa, Homo Sapiens
CLVIEYLLP

SEQ ID NO: 1288951 - protein, 9 aa, Homo Sapiens
YVCPCSGFV

SEQ ID NO: 1288952 - protein, 9 aa, Homo Sapiens
FVFEVTELK

SEQ ID NO: 1288953 - protein, 9 aa, Homo Sapiens
GCGFSNVFP

SEQ ID NO: 1288954 - protein, 9 aa, Homo Sapiens
ALRKAQEVC

SEQ ID NO: 1288955 - protein, 9 aa, Homo Sapiens
VDIDLHIYV

SEQ ID NO: 1288956 - protein, 9 aa, Homo Sapiens
HSGQLEKLK

SEQ ID NO: 1288957 - protein, 9 aa, Homo Sapiens
PQSAVKIPG

SEQ ID NO: 1288958 - protein, 9 aa, Homo Sapiens
KNNPCSQKR

SEQ ID NO: 1288959 - protein, 9 aa, Homo Sapiens
HLFKAVSSV

SEQ ID NO: 1288960 - protein, 9 aa, Homo Sapiens
YKAVENLCS

SEQ ID NO: 1288961 - protein, 9 aa, Homo Sapiens
VGRGSYCVV

SEQ ID NO: 1288962 - protein, 9 aa, Homo Sapiens
KESNILEIS

SEQ ID NO: 1288963 - protein, 9 aa, Homo Sapiens
NLFNLDSFR

SEQ ID NO: 1288964 - protein, 9 aa, Homo Sapiens
RHWIKDELD

SEQ ID NO: 1288965 - protein, 9 aa, Homo Sapiens
AMYNKLCYK

SEQ ID NO: 1288966 - protein, 9 aa, Homo Sapiens
LHSYTRDYI

SEQ ID NO: 1288967 - protein, 9 aa, Homo Sapiens
IQMNEEQYQ

SEQ ID NO: 1288968 - protein, 9 aa, Homo Sapiens
PEMEPVENE

SEQ ID NO: 1288969 - protein, 9 aa, Homo Sapiens
IQVIFCGDF

SEQ ID NO: 1288970 - protein, 9 aa, Homo Sapiens
AANHHYALY

SEQ ID NO: 1288971 - protein, 9 aa, Homo Sapiens
LHYQSIGTQ

SEQ ID NO: 1288972 - protein, 9 aa, Homo Sapiens
NHSFNNCCM

SEQ ID NO: 1288973 - protein, 9 aa, Homo Sapiens
KVAALCSDL

SEQ ID NO: 1288974 - protein, 9 aa, Homo Sapiens
LYIMIEQFL

SEQ ID NO: 1288975 - protein, 9 aa, Homo Sapiens
LFNYLFKNN

SEQ ID NO: 1288976 - protein, 9 aa, Homo Sapiens
SLWNGDTCE

SEQ ID NO: 1288977 - protein, 9 aa, Homo Sapiens
SHINRLQNL

SEQ ID NO: 1288978 - protein, 9 aa, Homo Sapiens
SWVLGSGGG

SEQ ID NO: 1288979 - protein, 9 aa, Homo Sapiens
CVLSRDGSL

SEQ ID NO: 1288980 - protein, 9 aa, Homo Sapiens
HVFVKCHFD

SEQ ID NO: 1288981 - protein, 9 aa, Homo Sapiens
PHSHASHNH

SEQ ID NO: 1288982 - protein, 9 aa, Homo Sapiens
PSPPFLSRN

SEQ ID NO: 1288983 - protein, 9 aa, Homo Sapiens
EDNIDNILD

SEQ ID NO: 1288984 - protein, 9 aa, Homo Sapiens
SNILEISLI

SEQ ID NO: 1288985 - protein, 9 aa, Homo Sapiens
RNPLFLRLA

SEQ ID NO: 1288986 - protein, 9 aa, Homo Sapiens
DIVEGMKQK

SEQ ID NO: 1288987 - protein, 9 aa, Homo Sapiens
HEGLIDSET

SEQ ID NO: 1288988 - protein, 9 aa, Homo Sapiens
IKNKKGTDI

SEQ ID NO: 1288989 - protein, 9 aa, Homo Sapiens
NPLFLRLAF

SEQ ID NO: 1288990 - protein, 9 aa, Homo Sapiens
TNCHSECLR

SEQ ID NO: 1288991 - protein, 9 aa, Homo Sapiens
GPPRGSECT

SEQ ID NO: 1288992 - protein, 9 aa, Homo Sapiens
EFENLVQRM

SEQ ID NO: 1288993 - protein, 9 aa, Homo Sapiens
STSGSKSQR

SEQ ID NO: 1288994 - protein, 9 aa, Homo Sapiens
KHRKEGSHC

SEQ ID NO: 1288995 - protein, 9 aa, Homo Sapiens
GFRIFIDAI

SEQ ID NO: 1288996 - protein, 9 aa, Homo Sapiens
LFTQSGTMK

SEQ ID NO: 1288997 - protein, 9 aa, Homo Sapiens
NRTATSGSE

SEQ ID NO: 1288998 - protein, 9 aa, Homo Sapiens
DDAQGVEER

SEQ ID NO: 1288999 - protein, 9 aa, Homo Sapiens
KLDNLQILQ

SEQ ID NO: 1289000 - protein, 9 aa, Homo Sapiens
LIISETSIF

SEQ ID NO: 1289001 - protein, 9 aa, Homo Sapiens
TLCGVYHLD

SEQ ID NO: 1289002 - protein, 9 aa, Homo Sapiens
MCIEKLDIL

SEQ ID NO: 1289003 - protein, 9 aa, Homo Sapiens
VFSTCASNL

SEQ ID NO: 1289004 - protein, 9 aa, Homo Sapiens
KQQKDNKGY

SEQ ID NO: 1289005 - protein, 9 aa, Homo Sapiens
YILPDTYQH

SEQ ID NO: 1289006 - protein, 9 aa, Homo Sapiens
SKAVSYAKF

SEQ ID NO: 1289007 - protein, 9 aa, Homo Sapiens
NVIKNPQFM

SEQ ID NO: 1289008 - protein, 9 aa, Homo Sapiens
DIALEQDKT

SEQ ID NO: 1289009 - protein, 9 aa, Homo Sapiens
HDVVAIGTG

SEQ ID NO: 1289010 - protein, 9 aa, Homo Sapiens
HLFVKEQAT

SEQ ID NO: 1289011 - protein, 9 aa, Homo Sapiens
AANMLRQAS

SEQ ID NO: 1289012 - protein, 9 aa, Homo Sapiens
EYFPLPYQA

SEQ ID NO: 1289013 - protein, 9 aa, Homo Sapiens
YKNCELDNN

SEQ ID NO: 1289014 - protein, 9 aa, Homo Sapiens
CDHLTLKEH

SEQ ID NO: 1289015 - protein, 9 aa, Homo Sapiens
LVKVKPNMY

SEQ ID NO: 1289016 - protein, 9 aa, Homo Sapiens
LHHLVQMPE

SEQ ID NO: 1289017 - protein, 9 aa, Homo Sapiens
SPESETDYT

SEQ ID NO: 1289018 - protein, 9 aa, Homo Sapiens
ANLGEFWLN

SEQ ID NO: 1289019 - protein, 9 aa, Homo Sapiens
SVIHETSNS

SEQ ID NO: 1289020 - protein, 9 aa, Homo Sapiens
CAIPSVGWN

SEQ ID NO: 1289021 - protein, 9 aa, Homo Sapiens
PLDEYIEQL

SEQ ID NO: 1289022 - protein, 9 aa, Homo Sapiens
VQSSSPGNI

SEQ ID NO: 1289023 - protein, 9 aa, Homo Sapiens
EQDKTVKKV

SEQ ID NO: 1289024 - protein, 9 aa, Homo Sapiens
SWLTKPLAQ

SEQ ID NO: 1289025 - protein, 9 aa, Homo Sapiens
DMPPSSQSD

SEQ ID NO: 1289026 - protein, 9 aa, Homo Sapiens
KKEKQQKMA

SEQ ID NO: 1289027 - protein, 9 aa, Homo Sapiens
HLHTPIYFL

SEQ ID NO: 1289028 - protein, 9 aa, Homo Sapiens
CFTLYHDEI

SEQ ID NO: 1289029 - protein, 9 aa, Homo Sapiens
TSCDEYSRG

SEQ ID NO: 1289030 - protein, 9 aa, Homo Sapiens
TCASNLTAI

SEQ ID NO: 1289031 - protein, 9 aa, Homo Sapiens
PALPKTLSF

SEQ ID NO: 1289032 - protein, 9 aa, Homo Sapiens
SMEDTDQGK

SEQ ID NO: 1289033 - protein, 9 aa, Homo Sapiens
QKNSMSCQG

SEQ ID NO: 1289034 - protein, 9 aa, Homo Sapiens
SHTRCTLEA

SEQ ID NO: 1289035 - protein, 9 aa, Homo Sapiens
NNNLHEGTD

SEQ ID NO: 1289036 - protein, 9 aa, Homo Sapiens
EDCIKRIQD

SEQ ID NO: 1289037 - protein, 9 aa, Homo Sapiens
HNKITQSMQ

SEQ ID NO: 1289038 - protein, 9 aa, Homo Sapiens
IVQDMGAGL

SEQ ID NO: 1289039 - protein, 9 aa, Homo Sapiens
CNDARFIRR

SEQ ID NO: 1289040 - protein, 9 aa, Homo Sapiens
QTLTQLNIM

SEQ ID NO: 1289041 - protein, 9 aa, Homo Sapiens
NFPDTATVK

SEQ ID NO: 1289042 - protein, 9 aa, Homo Sapiens
KKCRNWLHK

SEQ ID NO: 1289043 - protein, 9 aa, Homo Sapiens
TKQIFCVAD

SEQ ID NO: 1289044 - protein, 9 aa, Homo Sapiens
INSQCVICL

SEQ ID NO: 1289045 - protein, 9 aa, Homo Sapiens
ADANRTATS

SEQ ID NO: 1289046 - protein, 9 aa, Homo Sapiens
GSQHDYPSY

SEQ ID NO: 1289047 - protein, 9 aa, Homo Sapiens
EKLNEISYE

SEQ ID NO: 1289048 - protein, 9 aa, Homo Sapiens
QNSFEKKLA

SEQ ID NO: 1289049 - protein, 9 aa, Homo Sapiens
LYTMANNPN

SEQ ID NO: 1289050 - protein, 9 aa, Homo Sapiens
KASLICSVP

SEQ ID NO: 1289051 - protein, 9 aa, Homo Sapiens
ENQQFPNTD

SEQ ID NO: 1289052 - protein, 9 aa, Homo Sapiens
LCAPEPDAF

SEQ ID NO: 1289053 - protein, 9 aa, Homo Sapiens
KTCGNFKPS

SEQ ID NO: 1289054 - protein, 9 aa, Homo Sapiens
DSSLFESDM

SEQ ID NO: 1289055 - protein, 9 aa, Homo Sapiens
GGLVDHNHN

SEQ ID NO: 1289056 - protein, 9 aa, Homo Sapiens
CKTASKVHL

SEQ ID NO: 1289057 - protein, 9 aa, Homo Sapiens
TWGFHNNLL

SEQ ID NO: 1289058 - protein, 9 aa, Homo Sapiens
GKYFVTFQY

SEQ ID NO: 1289059 - protein, 9 aa, Homo Sapiens
SGDCLSSTC

SEQ ID NO: 1289060 - protein, 9 aa, Homo Sapiens
QLIRTIEDI

SEQ ID NO: 1289061 - protein, 9 aa, Homo Sapiens
NVDTRVVCD

SEQ ID NO: 1289062 - protein, 9 aa, Homo Sapiens
TNKWIKLCT

SEQ ID NO: 1289063 - protein, 9 aa, Homo Sapiens
SLRATQQSE

SEQ ID NO: 1289064 - protein, 9 aa, Homo Sapiens
FDRRKNCLM

SEQ ID NO: 1289065 - protein, 9 aa, Homo Sapiens
VYSIPFYHI

SEQ ID NO: 1289066 - protein, 9 aa, Homo Sapiens
TLATGHLFK

SEQ ID NO: 1289067 - protein, 9 aa, Homo Sapiens
KKKKAPEQE

SEQ ID NO: 1289068 - protein, 9 aa, Homo Sapiens
FKGHSKAVS

SEQ ID NO: 1289069 - protein, 9 aa, Homo Sapiens
IFSHMNNIM

SEQ ID NO: 1289070 - protein, 9 aa, Homo Sapiens
KNVLLVLPK

SEQ ID NO: 1289071 - protein, 9 aa, Homo Sapiens
LIKEISAIL

SEQ ID NO: 1289072 - protein, 9 aa, Homo Sapiens
FLKKEGLTL

SEQ ID NO: 1289073 - protein, 9 aa, Homo Sapiens
SLYYLWEFY

SEQ ID NO: 1289074 - protein, 9 aa, Homo Sapiens
EAFRFDCGV

SEQ ID NO: 1289075 - protein, 9 aa, Homo Sapiens
NRPDMIDKA

SEQ ID NO: 1289076 - protein, 9 aa, Homo Sapiens
QHYLLKRML

SEQ ID NO: 1289077 - protein, 9 aa, Homo Sapiens
HDVLTVHLV

SEQ ID NO: 1289078 - protein, 9 aa, Homo Sapiens
LHVLNKAKE

SEQ ID NO: 1289079 - protein, 9 aa, Homo Sapiens
MCCPKQYST

SEQ ID NO: 1289080 - protein, 9 aa, Homo Sapiens
SVTPPSSNC

SEQ ID NO: 1289081 - protein, 9 aa, Homo Sapiens
HSVEVLQKD

SEQ ID NO: 1289082 - protein, 9 aa, Homo Sapiens
MSAEYFPLP

SEQ ID NO: 1289083 - protein, 9 aa, Homo Sapiens
PPSSNCINE

SEQ ID NO: 1289084 - protein, 9 aa, Homo Sapiens
QMCNLLMKD

SEQ ID NO: 1289085 - protein, 9 aa, Homo Sapiens
KYRSLLETD

SEQ ID NO: 1289086 - protein, 9 aa, Homo Sapiens
DTAEIVLEV

SEQ ID NO: 1289087 - protein, 9 aa, Homo Sapiens
RGNLVYNSA

SEQ ID NO: 1289088 - protein, 9 aa, Homo Sapiens
STLLYLGHL

SEQ ID NO: 1289089 - protein, 9 aa, Homo Sapiens
KMSIALKNI

SEQ ID NO: 1289090 - protein, 9 aa, Homo Sapiens
LTKIKLSKF

SEQ ID NO: 1289091 - protein, 9 aa, Homo Sapiens
WRVCNKIKS

SEQ ID NO: 1289092 - protein, 9 aa, Homo Sapiens
DSKDSSLFE

SEQ ID NO: 1289093 - protein, 9 aa, Homo Sapiens
IVVNGQLVC

SEQ ID NO: 1289094 - protein, 9 aa, Homo Sapiens
HIALDWKCN

SEQ ID NO: 1289095 - protein, 9 aa, Homo Sapiens
VAVENALRK

SEQ ID NO: 1289096 - protein, 9 aa, Homo Sapiens
IYRDMKLDN

SEQ ID NO: 1289097 - protein, 9 aa, Homo Sapiens
LFKAVSSVL

SEQ ID NO: 1289098 - protein, 9 aa, Homo Sapiens
RYYDYDYGE

SEQ ID NO: 1289099 - protein, 9 aa, Homo Sapiens
WSPSDMAST

SEQ ID NO: 1289100 - protein, 9 aa, Homo Sapiens
EHKQLIPLV

SEQ ID NO: 1289101 - protein, 9 aa, Homo Sapiens
GYSLDLSLV

SEQ ID NO: 1289102 - protein, 9 aa, Homo Sapiens
DFKRIVNRA

SEQ ID NO: 1289103 - protein, 9 aa, Homo Sapiens
ASKQVDCDY

SEQ ID NO: 1289104 - protein, 9 aa, Homo Sapiens
SIETCKIIV

SEQ ID NO: 1289105 - protein, 9 aa, Homo Sapiens
ENTYRQLPC

SEQ ID NO: 1289106 - protein, 9 aa, Homo Sapiens
VMLSYYMTM

SEQ ID NO: 1289107 - protein, 9 aa, Homo Sapiens
IEKDHIFSS

SEQ ID NO: 1289108 - protein, 9 aa, Homo Sapiens
ILGKAAIGL

SEQ ID NO: 1289109 - protein, 9 aa, Homo Sapiens
YEDYDIVIL

SEQ ID NO: 1289110 - protein, 9 aa, Homo Sapiens
IKTQEKAQV

SEQ ID NO: 1289111 - protein, 9 aa, Homo Sapiens
SETLVLCSR

SEQ ID NO: 1289112 - protein, 9 aa, Homo Sapiens
DGKPIASCE

SEQ ID NO: 1289113 - protein, 9 aa, Homo Sapiens
TYLDVQLCL

SEQ ID NO: 1289114 - protein, 9 aa, Homo Sapiens
HCMFGIRYY

SEQ ID NO: 1289115 - protein, 9 aa, Homo Sapiens
HQGPWQRTW

SEQ ID NO: 1289116 - protein, 9 aa, Homo Sapiens
GPGWTLVKV

SEQ ID NO: 1289117 - protein, 9 aa, Homo Sapiens
VFTTTISIF

SEQ ID NO: 1289118 - protein, 9 aa, Homo Sapiens
MYCYPDPSY

SEQ ID NO: 1289119 - protein, 9 aa, Homo Sapiens
CVLLQHLVC

SEQ ID NO: 1289120 - protein, 9 aa, Homo Sapiens
GGFTSKYSL

SEQ ID NO: 1289121 - protein, 9 aa, Homo Sapiens
YEIMTVHND

SEQ ID NO: 1289122 - protein, 9 aa, Homo Sapiens
IQVVLEELK

SEQ ID NO: 1289123 - protein, 9 aa, Homo Sapiens
EQATFVKRL

SEQ ID NO: 1289124 - protein, 9 aa, Homo Sapiens
FEDEGLNTQ

SEQ ID NO: 1289125 - protein, 9 aa, Homo Sapiens
SHNHSHSHE

SEQ ID NO: 1289126 - protein, 9 aa, Homo Sapiens
ASENVLDPA

SEQ ID NO: 1289127 - protein, 9 aa, Homo Sapiens
DAIQVVLEE

SEQ ID NO: 1289128 - protein, 9 aa, Homo Sapiens
HDIRHFSQR

SEQ ID NO: 1289129 - protein, 9 aa, Homo Sapiens
VSIIQRGKG

SEQ ID NO: 1289130 - protein, 9 aa, Homo Sapiens
TLPIINASY

SEQ ID NO: 1289131 - protein, 9 aa, Homo Sapiens
IEHIFKLQE

SEQ ID NO: 1289132 - protein, 9 aa, Homo Sapiens
GAQCAGVEL

SEQ ID NO: 1289133 - protein, 9 aa, Homo Sapiens
PPYILYILP

SEQ ID NO: 1289134 - protein, 9 aa, Homo Sapiens
HFDGYKPLE

SEQ ID NO: 1289135 - protein, 9 aa, Homo Sapiens
ITFHSYSKM

SEQ ID NO: 1289136 - protein, 9 aa, Homo Sapiens
QDDNEAPDS

SEQ ID NO: 1289137 - protein, 9 aa, Homo Sapiens
WLLQSQHND

SEQ ID NO: 1289138 - protein, 9 aa, Homo Sapiens
ALHIIAYYK

SEQ ID NO: 1289139 - protein, 9 aa, Homo Sapiens
VSSESAESR

SEQ ID NO: 1289140 - protein, 9 aa, Homo Sapiens
LEWPNPVLL

SEQ ID NO: 1289141 - protein, 9 aa, Homo Sapiens
LKQLMKVDT

SEQ ID NO: 1289142 - protein, 9 aa, Homo Sapiens
NKQPSNYGP

SEQ ID NO: 1289143 - protein, 9 aa, Homo Sapiens
NCDKSSISG

SEQ ID NO: 1289144 - protein, 9 aa, Homo Sapiens
QRAAGMCGA

SEQ ID NO: 1289145 - protein, 9 aa, Homo Sapiens
AKGKIVVSI

SEQ ID NO: 1289146 - protein, 9 aa, Homo Sapiens
INSKVKSAK

SEQ ID NO: 1289147 - protein, 9 aa, Homo Sapiens
LHKHIRTHT

SEQ ID NO: 1289148 - protein, 9 aa, Homo Sapiens
TWERPSQEN

SEQ ID NO: 1289149 - protein, 9 aa, Homo Sapiens
IAVLVYWRV

SEQ ID NO: 1289150 - protein, 9 aa, Homo Sapiens
SPSLPRFIS

SEQ ID NO: 1289151 - protein, 9 aa, Homo Sapiens
ALLELLFHS

SEQ ID NO: 1289152 - protein, 9 aa, Homo Sapiens
NKCLQEDWE

SEQ ID NO: 1289153 - protein, 9 aa, Homo Sapiens
VLADMCHEE

SEQ ID NO: 1289154 - protein, 9 aa, Homo Sapiens
WTNAATQIF

SEQ ID NO: 1289155 - protein, 9 aa, Homo Sapiens
YSTVLNQTS

SEQ ID NO: 1289156 - protein, 9 aa, Homo Sapiens
PQTKGETSG

SEQ ID NO: 1289157 - protein, 9 aa, Homo Sapiens
AKEAVIDIN

SEQ ID NO: 1289158 - protein, 9 aa, Homo Sapiens
QISFLQVQL

SEQ ID NO: 1289159 - protein, 9 aa, Homo Sapiens
PWKKKNYTA

SEQ ID NO: 1289160 - protein, 9 aa, Homo Sapiens
PLLKVSIIQ

SEQ ID NO: 1289161 - protein, 9 aa, Homo Sapiens
QFNDEHQER

SEQ ID NO: 1289162 - protein, 9 aa, Homo Sapiens
HSYSKMLLF

SEQ ID NO: 1289163 - protein, 9 aa, Homo Sapiens
CDLYPGIQV

SEQ ID NO: 1289164 - protein, 9 aa, Homo Sapiens
APHAKQRAE

SEQ ID NO: 1289165 - protein, 9 aa, Homo Sapiens
RPENVLVAI

SEQ ID NO: 1289166 - protein, 9 aa, Homo Sapiens
MLCVTSALT

SEQ ID NO: 1289167 - protein, 9 aa, Homo Sapiens
KLKKMRSRI

SEQ ID NO: 1289168 - protein, 9 aa, Homo Sapiens
GSMCESCGG

SEQ ID NO: 1289169 - protein, 9 aa, Homo Sapiens
SELIDNQSN

SEQ ID NO: 1289170 - protein, 9 aa, Homo Sapiens
TEDSEYEAE

SEQ ID NO: 1289171 - protein, 9 aa, Homo Sapiens
HRTDADSES

SEQ ID NO: 1289172 - protein, 9 aa, Homo Sapiens
QSQLMQCSF

SEQ ID NO: 1289173 - protein, 9 aa, Homo Sapiens
DSCKSLSMF

SEQ ID NO: 1289174 - protein, 9 aa, Homo Sapiens
VSKVLFGRS

SEQ ID NO: 1289175 - protein, 9 aa, Homo Sapiens
YEAVKLQKE

SEQ ID NO: 1289176 - protein, 9 aa, Homo Sapiens
SVDSEYYMG

SEQ ID NO: 1289177 - protein, 9 aa, Homo Sapiens
LEVRHFQCH

SEQ ID NO: 1289178 - protein, 9 aa, Homo Sapiens
DVVAIGTGE

SEQ ID NO: 1289179 - protein, 9 aa, Homo Sapiens
RPDLQPIQY

SEQ ID NO: 1289180 - protein, 9 aa, Homo Sapiens
HFTNHSVDG

SEQ ID NO: 1289181 - protein, 9 aa, Homo Sapiens
AIVDLKSKC

SEQ ID NO: 1289182 - protein, 9 aa, Homo Sapiens
CCPKQYSTK

SEQ ID NO: 1289183 - protein, 9 aa, Homo Sapiens
LQPNLYPTV

SEQ ID NO: 1289184 - protein, 9 aa, Homo Sapiens
SITCNVTSS

SEQ ID NO: 1289185 - protein, 9 aa, Homo Sapiens
GMVSGLTYH

SEQ ID NO: 1289186 - protein, 9 aa, Homo Sapiens
TPEESEEWT

SEQ ID NO: 1289187 - protein, 9 aa, Homo Sapiens
GLSCMLHTV

SEQ ID NO: 1289188 - protein, 9 aa, Homo Sapiens
GSHCLSMLG

SEQ ID NO: 1289189 - protein, 9 aa, Homo Sapiens
KQHTVKPES

SEQ ID NO: 1289190 - protein, 9 aa, Homo Sapiens
NLPMNVLKF

SEQ ID NO: 1289191 - protein, 9 aa, Homo Sapiens
VLNVFLFVD

SEQ ID NO: 1289192 - protein, 9 aa, Homo Sapiens
FPTQFAPHA

SEQ ID NO: 1289193 - protein, 9 aa, Homo Sapiens
IQTIGKYKS

SEQ ID NO: 1289194 - protein, 9 aa, Homo Sapiens
SRITRLLSD

SEQ ID NO: 1289195 - protein, 9 aa, Homo Sapiens
ANTGFGGQV

SEQ ID NO: 1289196 - protein, 9 aa, Homo Sapiens
IDICDVSER

SEQ ID NO: 1289197 - protein, 9 aa, Homo Sapiens
TISIFKGSA

SEQ ID NO: 1289198 - protein, 9 aa, Homo Sapiens
HGLTPLLLC

SEQ ID NO: 1289199 - protein, 9 aa, Homo Sapiens
EVKSMLYSV

SEQ ID NO: 1289200 - protein, 9 aa, Homo Sapiens
AHWKIFTKP

SEQ ID NO: 1289201 - protein, 9 aa, Homo Sapiens
GKIVVSIAE

SEQ ID NO: 1289202 - protein, 9 aa, Homo Sapiens
LLMYPYVYS

SEQ ID NO: 1289203 - protein, 9 aa, Homo Sapiens
NHCNWHKMG

SEQ ID NO: 1289204 - protein, 9 aa, Homo Sapiens
KEMHLLSQE

SEQ ID NO: 1289205 - protein, 9 aa, Homo Sapiens
TATVAALQD

SEQ ID NO: 1289206 - protein, 9 aa, Homo Sapiens
VEAAHEQDG

SEQ ID NO: 1289207 - protein, 9 aa, Homo Sapiens
NYIIKFWAK

SEQ ID NO: 1289208 - protein, 9 aa, Homo Sapiens
AGDNVTKLL

SEQ ID NO: 1289209 - protein, 9 aa, Homo Sapiens
LPSDPNNFI

SEQ ID NO: 1289210 - protein, 9 aa, Homo Sapiens
MVCTIDMTL

SEQ ID NO: 1289211 - protein, 9 aa, Homo Sapiens
LIIVTSIAM

SEQ ID NO: 1289212 - protein, 9 aa, Homo Sapiens
ERMTVDFMS

SEQ ID NO: 1289213 - protein, 9 aa, Homo Sapiens
APQIHDLYW

SEQ ID NO: 1289214 - protein, 9 aa, Homo Sapiens
IFHVGSEDK

SEQ ID NO: 1289215 - protein, 9 aa, Homo Sapiens
IELVIKEKK

SEQ ID NO: 1289216 - protein, 9 aa, Homo Sapiens
ITEFENLVQ

SEQ ID NO: 1289217 - protein, 9 aa, Homo Sapiens
QDMAEHDVT

SEQ ID NO: 1289218 - protein, 9 aa, Homo Sapiens
LPHCAVRNL

SEQ ID NO: 1289219 - protein, 9 aa, Homo Sapiens
VVNGQLVCA

SEQ ID NO: 1289220 - protein, 9 aa, Homo Sapiens
ESAEQSEKA

SEQ ID NO: 1289221 - protein, 9 aa, Homo Sapiens
TLPTPVLLP

SEQ ID NO: 1289222 - protein, 9 aa, Homo Sapiens
WTLVKVKPN

SEQ ID NO: 1289223 - protein, 9 aa, Homo Sapiens
NQRRYVYYY

SEQ ID NO: 1289224 - protein, 9 aa, Homo Sapiens
ENGLAMSGL

SEQ ID NO: 1289225 - protein, 9 aa, Homo Sapiens
TITPQHVFV

SEQ ID NO: 1289226 - protein, 9 aa, Homo Sapiens
KMCGRKVEF

SEQ ID NO: 1289227 - protein, 9 aa, Homo Sapiens
YWEIDKLKK

SEQ ID NO: 1289228 - protein, 9 aa, Homo Sapiens
LARSAMGMF

SEQ ID NO: 1289229 - protein, 9 aa, Homo Sapiens
HVLCIPSWM

SEQ ID NO: 1289230 - protein, 9 aa, Homo Sapiens
TIEKMEFKK

SEQ ID NO: 1289231 - protein, 9 aa, Homo Sapiens
NKKMTALIK

SEQ ID NO: 1289232 - protein, 9 aa, Homo Sapiens
IVIRIYNRY

SEQ ID NO: 1289233 - protein, 9 aa, Homo Sapiens
FICTSVSTF

SEQ ID NO: 1289234 - protein, 9 aa, Homo Sapiens
QWPWKKKNY

SEQ ID NO: 1289235 - protein, 9 aa, Homo Sapiens
SCIEFSNLI

SEQ ID NO: 1289236 - protein, 9 aa, Homo Sapiens
ALLHVWSFF

SEQ ID NO: 1289237 - protein, 9 aa, Homo Sapiens
KQQYSIKRS

SEQ ID NO: 1289238 - protein, 9 aa, Homo Sapiens
QHVFSVFED

SEQ ID NO: 1289239 - protein, 9 aa, Homo Sapiens
KAKGDYLHE

SEQ ID NO: 1289240 - protein, 9 aa, Homo Sapiens
LRLLERELT

SEQ ID NO: 1289241 - protein, 9 aa, Homo Sapiens
SSVLTDFDG

SEQ ID NO: 1289242 - protein, 9 aa, Homo Sapiens
RKKMDALLH

SEQ ID NO: 1289243 - protein, 9 aa, Homo Sapiens
TVIVDAADL

SEQ ID NO: 1289244 - protein, 9 aa, Homo Sapiens
SHASHNHSH

SEQ ID NO: 1289245 - protein, 9 aa, Homo Sapiens
VLTTNSSWT

SEQ ID NO: 1289246 - protein, 9 aa, Homo Sapiens
LLETDHDRY

SEQ ID NO: 1289247 - protein, 9 aa, Homo Sapiens
CVLQYQKKT

SEQ ID NO: 1289248 - protein, 9 aa, Homo Sapiens
MPEDYLENV

SEQ ID NO: 1289249 - protein, 9 aa, Homo Sapiens
EQYFWSPSD

SEQ ID NO: 1289250 - protein, 9 aa, Homo Sapiens
QLTEASSWS

SEQ ID NO: 1289251 - protein, 9 aa, Homo Sapiens
QFMFDIHKN

SEQ ID NO: 1289252 - protein, 9 aa, Homo Sapiens
SYQCKCLQG

SEQ ID NO: 1289253 - protein, 9 aa, Homo Sapiens
FAIQDHTLP

SEQ ID NO: 1289254 - protein, 9 aa, Homo Sapiens
EHINGKKNT

SEQ ID NO: 1289255 - protein, 9 aa, Homo Sapiens
KYKYVLNEF

SEQ ID NO: 1289256 - protein, 9 aa, Homo Sapiens
NVFLCTGAD

SEQ ID NO: 1289257 - protein, 9 aa, Homo Sapiens
ADIGYVHRD

SEQ ID NO: 1289258 - protein, 9 aa, Homo Sapiens
TDRNYIIKF

SEQ ID NO: 1289259 - protein, 9 aa, Homo Sapiens
NHHYALYLI

SEQ ID NO: 1289260 - protein, 9 aa, Homo Sapiens
SHRATVSKE

SEQ ID NO: 1289261 - protein, 9 aa, Homo Sapiens
TVHNDPYTF

SEQ ID NO: 1289262 - protein, 9 aa, Homo Sapiens
AKEFDIYRE

SEQ ID NO: 1289263 - protein, 9 aa, Homo Sapiens
TSIAMLVVL

SEQ ID NO: 1289264 - protein, 9 aa, Homo Sapiens
WHCKTASKV

SEQ ID NO: 1289265 - protein, 9 aa, Homo Sapiens
VQMPEDYLE

SEQ ID NO: 1289266 - protein, 9 aa, Homo Sapiens
KHIFPVRMI

SEQ ID NO: 1289267 - protein, 9 aa, Homo Sapiens
PEDLSTFDY

SEQ ID NO: 1289268 - protein, 9 aa, Homo Sapiens
SDHRHICRA

SEQ ID NO: 1289269 - protein, 9 aa, Homo Sapiens
VLRWRLYAI

SEQ ID NO: 1289270 - protein, 9 aa, Homo Sapiens
AADKYWSTF

SEQ ID NO: 1289271 - protein, 9 aa, Homo Sapiens
RVEEQLRLL

SEQ ID NO: 1289272 - protein, 9 aa, Homo Sapiens
ANSDNLMQI

SEQ ID NO: 1289273 - protein, 9 aa, Homo Sapiens
IVQDLGLEL

SEQ ID NO: 1289274 - protein, 9 aa, Homo Sapiens
CQEFVPGQA

SEQ ID NO: 1289275 - protein, 9 aa, Homo Sapiens
QLRNADVNV

SEQ ID NO: 1289276 - protein, 9 aa, Homo Sapiens
NGTISFTEI

SEQ ID NO: 1289277 - protein, 9 aa, Homo Sapiens
RNTLFAINF

SEQ ID NO: 1289278 - protein, 9 aa, Homo Sapiens
VICSNFAED

SEQ ID NO: 1289279 - protein, 9 aa, Homo Sapiens
VHHVLCIPS

SEQ ID NO: 1289280 - protein, 9 aa, Homo Sapiens
SAYETGQDL

SEQ ID NO: 1289281 - protein, 9 aa, Homo Sapiens
GKYKSANSF

SEQ ID NO: 1289282 - protein, 9 aa, Homo Sapiens
RIMLQYDAV

SEQ ID NO: 1289283 - protein, 9 aa, Homo Sapiens
CDKSSISGP

SEQ ID NO: 1289284 - protein, 9 aa, Homo Sapiens
YPAVPCEYS

SEQ ID NO: 1289285 - protein, 9 aa, Homo Sapiens
PMQPASSGQ

SEQ ID NO: 1289286 - protein, 9 aa, Homo Sapiens
DLSHINRLQ

SEQ ID NO: 1289287 - protein, 9 aa, Homo Sapiens
INGTVTEFK

SEQ ID NO: 1289288 - protein, 9 aa, Homo Sapiens
LNICLLKHT

SEQ ID NO: 1289289 - protein, 9 aa, Homo Sapiens
ALQDTQNKD

SEQ ID NO: 1289290 - protein, 9 aa, Homo Sapiens
YYMGSVQRD

SEQ ID NO: 1289291 - protein, 9 aa, Homo Sapiens
LEHKIYARA

SEQ ID NO: 1289292 - protein, 9 aa, Homo Sapiens
LKKQHYLLK

SEQ ID NO: 1289293 - protein, 9 aa, Homo Sapiens
MQQQLEVIS

SEQ ID NO: 1289294 - protein, 9 aa, Homo Sapiens
SKKKYPEYG

SEQ ID NO: 1289295 - protein, 9 aa, Homo Sapiens
GTKVIDTKN

SEQ ID NO: 1289296 - protein, 9 aa, Homo Sapiens
YFTNWTEKV

SEQ ID NO: 1289297 - protein, 9 aa, Homo Sapiens
FYQSEIKLL

SEQ ID NO: 1289298 - protein, 9 aa, Homo Sapiens
GEIVALPPV

SEQ ID NO: 1289299 - protein, 9 aa, Homo Sapiens
VLARSAMGM

SEQ ID NO: 1289300 - protein, 9 aa, Homo Sapiens
WFGFLEAKQ

SEQ ID NO: 1289301 - protein, 9 aa, Homo Sapiens
PFPTQFAPH

SEQ ID NO: 1289302 - protein, 9 aa, Homo Sapiens
TMAIVMCAI

SEQ ID NO: 1289303 - protein, 9 aa, Homo Sapiens
LPDCLAPRV

SEQ ID NO: 1289304 - protein, 9 aa, Homo Sapiens
SLNLLWQEV

SEQ ID NO: 1289305 - protein, 9 aa, Homo Sapiens
RDFRLQCVL

SEQ ID NO: 1289306 - protein, 9 aa, Homo Sapiens
RIVNRAPEF

SEQ ID NO: 1289307 - protein, 9 aa, Homo Sapiens
GIQETGKTM

SEQ ID NO: 1289308 - protein, 9 aa, Homo Sapiens
CLSMLGRPD

SEQ ID NO: 1289309 - protein, 9 aa, Homo Sapiens
LITLARLLF

SEQ ID NO: 1289310 - protein, 9 aa, Homo Sapiens
AFKRSSTLN

SEQ ID NO: 1289311 - protein, 9 aa, Homo Sapiens
YEDVDRLKV

SEQ ID NO: 1289312 - protein, 9 aa, Homo Sapiens
SISMHAMRN

SEQ ID NO: 1289313 - protein, 9 aa, Homo Sapiens
KMINFLQSV

SEQ ID NO: 1289314 - protein, 9 aa, Homo Sapiens
LKPKIPLSQ

SEQ ID NO: 1289315 - protein, 9 aa, Homo Sapiens
IHTLAKEFD

SEQ ID NO: 1289316 - protein, 9 aa, Homo Sapiens
INNTENVSS

SEQ ID NO: 1289317 - protein, 9 aa, Homo Sapiens
ASSWSESLL

SEQ ID NO: 1289318 - protein, 9 aa, Homo Sapiens
KTLSFRINS

SEQ ID NO: 1289319 - protein, 9 aa, Homo Sapiens
SLRAHETVP

SEQ ID NO: 1289320 - protein, 9 aa, Homo Sapiens
AVMFNFPDT

SEQ ID NO: 1289321 - protein, 9 aa, Homo Sapiens
KIPLSQEVT

SEQ ID NO: 1289322 - protein, 9 aa, Homo Sapiens
KPKIPLSQE

SEQ ID NO: 1289323 - protein, 9 aa, Homo Sapiens
TVCIGVPIM

SEQ ID NO: 1289324 - protein, 9 aa, Homo Sapiens
VRHTEKVHD

SEQ ID NO: 1289325 - protein, 9 aa, Homo Sapiens
IHERTVWKY

SEQ ID NO: 1289326 - protein, 9 aa, Homo Sapiens
ENNVLNKVI

SEQ ID NO: 1289327 - protein, 9 aa, Homo Sapiens
LLDNCLLYV

SEQ ID NO: 1289328 - protein, 9 aa, Homo Sapiens
DNLLNYNNI

SEQ ID NO: 1289329 - protein, 9 aa, Homo Sapiens
SMQQQLEVI

SEQ ID NO: 1289330 - protein, 9 aa, Homo Sapiens
LLQSQHNDI

SEQ ID NO: 1289331 - protein, 9 aa, Homo Sapiens
LNTHKKIHT

SEQ ID NO: 1289332 - protein, 9 aa, Homo Sapiens
LDGFDQDDN

SEQ ID NO: 1289333 - protein, 9 aa, Homo Sapiens
WEESDIMAF

SEQ ID NO: 1289334 - protein, 9 aa, Homo Sapiens
GSTYILVTL

SEQ ID NO: 1289335 - protein, 9 aa, Homo Sapiens
SQAITSHRA

SEQ ID NO: 1289336 - protein, 9 aa, Homo Sapiens
LRKSCQFCD

SEQ ID NO: 1289337 - protein, 9 aa, Homo Sapiens
NPGIDICDV

SEQ ID NO: 1289338 - protein, 9 aa, Homo Sapiens
LTGTIKVAQ

SEQ ID NO: 1289339 - protein, 9 aa, Homo Sapiens
VFLANKDSC

SEQ ID NO: 1289340 - protein, 9 aa, Homo Sapiens
ILEISLIKK

SEQ ID NO: 1289341 - protein, 9 aa, Homo Sapiens
GPEMYCYPD

SEQ ID NO: 1289342 - protein, 9 aa, Homo Sapiens
HKRNSMTPN

SEQ ID NO: 1289343 - protein, 9 aa, Homo Sapiens
LDLYSSLEQ

SEQ ID NO: 1289344 - protein, 9 aa, Homo Sapiens
QPAQSLPSK

SEQ ID NO: 1289345 - protein, 9 aa, Homo Sapiens
SEITGAQCA

SEQ ID NO: 1289346 - protein, 9 aa, Homo Sapiens
HTDFIPQHN

SEQ ID NO: 1289347 - protein, 9 aa, Homo Sapiens
WQMSVSGSP

SEQ ID NO: 1289348 - protein, 9 aa, Homo Sapiens
KTWERPSQE

SEQ ID NO: 1289349 - protein, 9 aa, Homo Sapiens
KLLIEHIFK

SEQ ID NO: 1289350 - protein, 9 aa, Homo Sapiens
KKTSISSFN

SEQ ID NO: 1289351 - protein, 9 aa, Homo Sapiens
LLTIIVVDA

SEQ ID NO: 1289352 - protein, 9 aa, Homo Sapiens
KDSDEIMSL

SEQ ID NO: 1289353 - protein, 9 aa, Homo Sapiens
NINSQCVIC

SEQ ID NO: 1289354 - protein, 9 aa, Homo Sapiens
CPLKNVCCL

SEQ ID NO: 1289355 - protein, 9 aa, Homo Sapiens
LVSMGFVIS

SEQ ID NO: 1289356 - protein, 9 aa, Homo Sapiens
FGMAYFVLS

SEQ ID NO: 1289357 - protein, 9 aa, Homo Sapiens
TLSHSLGNS

SEQ ID NO: 1289358 - protein, 9 aa, Homo Sapiens
LQQYGVCCK

SEQ ID NO: 1289359 - protein, 9 aa, Homo Sapiens
WNDVQGLFE

SEQ ID NO: 1289360 - protein, 9 aa, Homo Sapiens
NKDSCYPQI

SEQ ID NO: 1289361 - protein, 9 aa, Homo Sapiens
KLQKYINNT

SEQ ID NO: 1289362 - protein, 9 aa, Homo Sapiens
KGDYLHETT

SEQ ID NO: 1289363 - protein, 9 aa, Homo Sapiens
TIGKYKSAN

SEQ ID NO: 1289364 - protein, 9 aa, Homo Sapiens
VDSYGFITY

SEQ ID NO: 1289365 - protein, 9 aa, Homo Sapiens
KPLLRSPLP

SEQ ID NO: 1289366 - protein, 9 aa, Homo Sapiens
SSSELIDNQ

SEQ ID NO: 1289367 - protein, 9 aa, Homo Sapiens
IGNPVGQSG

SEQ ID NO: 1289368 - protein, 9 aa, Homo Sapiens
LLASQEASY

SEQ ID NO: 1289369 - protein, 9 aa, Homo Sapiens
VSTFTTMTP

SEQ ID NO: 1289370 - protein, 9 aa, Homo Sapiens
KGFLDVSLD

SEQ ID NO: 1289371 - protein, 9 aa, Homo Sapiens
ELAKLAGAF

SEQ ID NO: 1289372 - protein, 9 aa, Homo Sapiens
PRYIFTMLI

SEQ ID NO: 1289373 - protein, 9 aa, Homo Sapiens
RDCHIKLTD

SEQ ID NO: 1289374 - protein, 9 aa, Homo Sapiens
SQCPEVHTL

SEQ ID NO: 1289375 - protein, 9 aa, Homo Sapiens
GATKTVCMN

SEQ ID NO: 1289376 - protein, 9 aa, Homo Sapiens
VIVDAADLV

SEQ ID NO: 1289377 - protein, 9 aa, Homo Sapiens
GIQTIGKYK

SEQ ID NO: 1289378 - protein, 9 aa, Homo Sapiens
LFCSLVKMT

SEQ ID NO: 1289379 - protein, 9 aa, Homo Sapiens
DNIDNILDK

SEQ ID NO: 1289380 - protein, 9 aa, Homo Sapiens
LHQRIHTVE

SEQ ID NO: 1289381 - protein, 9 aa, Homo Sapiens
DAGDNVTKL

SEQ ID NO: 1289382 - protein, 9 aa, Homo Sapiens
SSFENLPMN

SEQ ID NO: 1289383 - protein, 9 aa, Homo Sapiens
CFITPLPEI

SEQ ID NO: 1289384 - protein, 9 aa, Homo Sapiens
DYIIEPSIF

SEQ ID NO: 1289385 - protein, 9 aa, Homo Sapiens
RTIYLIDYI

SEQ ID NO: 1289386 - protein, 9 aa, Homo Sapiens
IKKDSENTP

SEQ ID NO: 1289387 - protein, 9 aa, Homo Sapiens
HTLLQQDLV

SEQ ID NO: 1289388 - protein, 9 aa, Homo Sapiens
PLIKVHSDL

SEQ ID NO: 1289389 - protein, 9 aa, Homo Sapiens
MIKINFKFT

SEQ ID NO: 1289390 - protein, 9 aa, Homo Sapiens
ENFYPDILV

SEQ ID NO: 1289391 - protein, 9 aa, Homo Sapiens
CGVYHLDIL

SEQ ID NO: 1289392 - protein, 9 aa, Homo Sapiens
KEGSHCLSM

SEQ ID NO: 1289393 - protein, 9 aa, Homo Sapiens
EEHGLVKNT

SEQ ID NO: 1289394 - protein, 9 aa, Homo Sapiens
NTYRQLPCN

SEQ ID NO: 1289395 - protein, 9 aa, Homo Sapiens
DLILPDCLA

SEQ ID NO: 1289396 - protein, 9 aa, Homo Sapiens
LLLSLYPVF

SEQ ID NO: 1289397 - protein, 9 aa, Homo Sapiens
PSKNQKILY

SEQ ID NO: 1289398 - protein, 9 aa, Homo Sapiens
KTPLCAPEP

SEQ ID NO: 1289399 - protein, 9 aa, Homo Sapiens
GLKELRRVE

SEQ ID NO: 1289400 - protein, 9 aa, Homo Sapiens
VAWLSMQIF

SEQ ID NO: 1289401 - protein, 9 aa, Homo Sapiens
KRKTNNPKF

SEQ ID NO: 1289402 - protein, 9 aa, Homo Sapiens
KYEFTYALL

SEQ ID NO: 1289403 - protein, 9 aa, Homo Sapiens
KDDFSTTGT

SEQ ID NO: 1289404 - protein, 9 aa, Homo Sapiens
KQMLATLYK

SEQ ID NO: 1289405 - protein, 9 aa, Homo Sapiens
HQIPDVSPT

SEQ ID NO: 1289406 - protein, 9 aa, Homo Sapiens
QFAPHAKQR

SEQ ID NO: 1289407 - protein, 9 aa, Homo Sapiens
SVVIHTLAK

SEQ ID NO: 1289408 - protein, 9 aa, Homo Sapiens
QNAQGNKTI

SEQ ID NO: 1289409 - protein, 9 aa, Homo Sapiens
SYTRDYICE

SEQ ID NO: 1289410 - protein, 9 aa, Homo Sapiens
LIDYIIRHN

SEQ ID NO: 1289411 - protein, 9 aa, Homo Sapiens
QKILYAVCT

SEQ ID NO: 1289412 - protein, 9 aa, Homo Sapiens
CAGVELYPG

SEQ ID NO: 1289413 - protein, 9 aa, Homo Sapiens
TSYKYIFEI

SEQ ID NO: 1289414 - protein, 9 aa, Homo Sapiens
TLVHAKFEF

SEQ ID NO: 1289415 - protein, 9 aa, Homo Sapiens
NYNEFCRLL

SEQ ID NO: 1289416 - protein, 9 aa, Homo Sapiens
GMAGVPEDV

SEQ ID NO: 1289417 - protein, 9 aa, Homo Sapiens
EDQFNDEHQ

SEQ ID NO: 1289418 - protein, 9 aa, Homo Sapiens
NYNNIENYS

SEQ ID NO: 1289419 - protein, 9 aa, Homo Sapiens
KTEDVECLT

SEQ ID NO: 1289420 - protein, 9 aa, Homo Sapiens
LKVQQKHRQ

SEQ ID NO: 1289421 - protein, 9 aa, Homo Sapiens
DKKKYGIRL

SEQ ID NO: 1289422 - protein, 9 aa, Homo Sapiens
FDLPEVINF

SEQ ID NO: 1289423 - protein, 9 aa, Homo Sapiens
IQKCSTVDD

SEQ ID NO: 1289424 - protein, 9 aa, Homo Sapiens
LQLTEASSW

SEQ ID NO: 1289425 - protein, 9 aa, Homo Sapiens
FNIFTKEEE

SEQ ID NO: 1289426 - protein, 9 aa, Homo Sapiens
SECTPDSLH

SEQ ID NO: 1289427 - protein, 9 aa, Homo Sapiens
HRRLYYSLT

SEQ ID NO: 1289428 - protein, 9 aa, Homo Sapiens
LHSTDRNYI

SEQ ID NO: 1289429 - protein, 9 aa, Homo Sapiens
GSDMPPSSQ

SEQ ID NO: 1289430 - protein, 9 aa, Homo Sapiens
ARTFCNDAR

SEQ ID NO: 1289431 - protein, 9 aa, Homo Sapiens
IFTKEEELE

SEQ ID NO: 1289432 - protein, 9 aa, Homo Sapiens
AMVFMVLCS

SEQ ID NO: 1289433 - protein, 9 aa, Homo Sapiens
ANHHYALYL

SEQ ID NO: 1289434 - protein, 9 aa, Homo Sapiens
ELNQTQKDL

SEQ ID NO: 1289435 - protein, 9 aa, Homo Sapiens
RFDCGVEAI

SEQ ID NO: 1289436 - protein, 9 aa, Homo Sapiens
LSLVETVSE

SEQ ID NO: 1289437 - protein, 9 aa, Homo Sapiens
LKCHRSFIG

SEQ ID NO: 1289438 - protein, 9 aa, Homo Sapiens
RHEFLHQVW

SEQ ID NO: 1289439 - protein, 9 aa, Homo Sapiens
ESSHSVEVL

SEQ ID NO: 1289440 - protein, 9 aa, Homo Sapiens
VIVAVEPKH

SEQ ID NO: 1289441 - protein, 9 aa, Homo Sapiens
DKMMLFLIY

SEQ ID NO: 1289442 - protein, 9 aa, Homo Sapiens
ISDKNVLLV

SEQ ID NO: 1289443 - protein, 9 aa, Homo Sapiens
LNEISYELK

SEQ ID NO: 1289444 - protein, 9 aa, Homo Sapiens
NCTYEFLYT

SEQ ID NO: 1289445 - protein, 9 aa, Homo Sapiens
VELEFGMAY

SEQ ID NO: 1289446 - protein, 9 aa, Homo Sapiens
AFDLGSSAK

SEQ ID NO: 1289447 - protein, 9 aa, Homo Sapiens
YSSLEQFKA

SEQ ID NO: 1289448 - protein, 9 aa, Homo Sapiens
RNGQVRALG

SEQ ID NO: 1289449 - protein, 9 aa, Homo Sapiens
TLCAPPLAN

SEQ ID NO: 1289450 - protein, 9 aa, Homo Sapiens
WEVMLSYYM

SEQ ID NO: 1289451 - protein, 9 aa, Homo Sapiens
ISMGSNDID

SEQ ID NO: 1289452 - protein, 9 aa, Homo Sapiens
KVNPNKVSP

SEQ ID NO: 1289453 - protein, 9 aa, Homo Sapiens
LAKLAGAFD

SEQ ID NO: 1289454 - protein, 9 aa, Homo Sapiens
KLRPENVLV

SEQ ID NO: 1289455 - protein, 9 aa, Homo Sapiens
FLANKDSCY

SEQ ID NO: 1289456 - protein, 9 aa, Homo Sapiens
TTPLDEYIE

SEQ ID NO: 1289457 - protein, 9 aa, Homo Sapiens
LRYIILTHV

SEQ ID NO: 1289458 - protein, 9 aa, Homo Sapiens
LVAVENALR

SEQ ID NO: 1289459 - protein, 9 aa, Homo Sapiens
LRDERKNQD

SEQ ID NO: 1289460 - protein, 9 aa, Homo Sapiens
NEAEFHKHD

SEQ ID NO: 1289461 - protein, 9 aa, Homo Sapiens
LEATKACKL

SEQ ID NO: 1289462 - protein, 9 aa, Homo Sapiens
VHLGTPLCI

SEQ ID NO: 1289463 - protein, 9 aa, Homo Sapiens
TILPSKKKY

SEQ ID NO: 1289464 - protein, 9 aa, Homo Sapiens
LETDHDRYS

SEQ ID NO: 1289465 - protein, 9 aa, Homo Sapiens
LYHILGNEM

SEQ ID NO: 1289466 - protein, 9 aa, Homo Sapiens
MANNPNMTH

SEQ ID NO: 1289467 - protein, 9 aa, Homo Sapiens
NISLDTLVH

SEQ ID NO: 1289468 - protein, 9 aa, Homo Sapiens
KHLKEEHGL

SEQ ID NO: 1289469 - protein, 9 aa, Homo Sapiens
QQDEEQPHG

SEQ ID NO: 1289470 - protein, 9 aa, Homo Sapiens
VTPPSSNCI

SEQ ID NO: 1289471 - protein, 9 aa, Homo Sapiens
ILHHLVQMP

SEQ ID NO: 1289472 - protein, 9 aa, Homo Sapiens
HNMYEEMET

SEQ ID NO: 1289473 - protein, 9 aa, Homo Sapiens
SAIQDAILE

SEQ ID NO: 1289474 - protein, 9 aa, Homo Sapiens
GKHNSMEDT

SEQ ID NO: 1289475 - protein, 9 aa, Homo Sapiens
YEDLKMYKV

SEQ ID NO: 1289476 - protein, 9 aa, Homo Sapiens
ALLRKSKEL

SEQ ID NO: 1289477 - protein, 9 aa, Homo Sapiens
KRAVNLQRS

SEQ ID NO: 1289478 - protein, 9 aa, Homo Sapiens
NKVTDESRQ

SEQ ID NO: 1289479 - protein, 9 aa, Homo Sapiens
QLVCAKKPN

SEQ ID NO: 1289480 - protein, 9 aa, Homo Sapiens
MKRNRDLCV

SEQ ID NO: 1289481 - protein, 9 aa, Homo Sapiens
NSEKCSGEC

SEQ ID NO: 1289482 - protein, 9 aa, Homo Sapiens
MEINGTVTE

SEQ ID NO: 1289483 - protein, 9 aa, Homo Sapiens
YQQQYPDSH

SEQ ID NO: 1289484 - protein, 9 aa, Homo Sapiens
LCGELWTIL

SEQ ID NO: 1289485 - protein, 9 aa, Homo Sapiens
GGHRDYGHR

SEQ ID NO: 1289486 - protein, 9 aa, Homo Sapiens
KIDEVKSTT

SEQ ID NO: 1289487 - protein, 9 aa, Homo Sapiens
INMKLALIR

SEQ ID NO: 1289488 - protein, 9 aa, Homo Sapiens
HSAPKLEGQ

SEQ ID NO: 1289489 - protein, 9 aa, Homo Sapiens
QNAHKQKLT

SEQ ID NO: 1289490 - protein, 9 aa, Homo Sapiens
TVKPESTLE

SEQ ID NO: 1289491 - protein, 9 aa, Homo Sapiens
FESSQTTLL

SEQ ID NO: 1289492 - protein, 9 aa, Homo Sapiens
CKSLSMFQQ

SEQ ID NO: 1289493 - protein, 9 aa, Homo Sapiens
RLLSDFVAA

SEQ ID NO: 1289494 - protein, 9 aa, Homo Sapiens
IRYYDYDYG

SEQ ID NO: 1289495 - protein, 9 aa, Homo Sapiens
VIVEEAHSS

SEQ ID NO: 1289496 - protein, 9 aa, Homo Sapiens
LKAFANGRS

SEQ ID NO: 1289497 - protein, 9 aa, Homo Sapiens
RDTITPQHV

SEQ ID NO: 1289498 - protein, 9 aa, Homo Sapiens
RIEICYNYF

SEQ ID NO: 1289499 - protein, 9 aa, Homo Sapiens
NTGDRIEIC

SEQ ID NO: 1289500 - protein, 9 aa, Homo Sapiens
RKTNNPKFD

SEQ ID NO: 1289501 - protein, 9 aa, Homo Sapiens
PEVQTDPPS

SEQ ID NO: 1289502 - protein, 9 aa, Homo Sapiens
MAYFVLSLF

SEQ ID NO: 1289503 - protein, 9 aa, Homo Sapiens
VLHKHFDGY

SEQ ID NO: 1289504 - protein, 9 aa, Homo Sapiens
VMCAIPSVG

SEQ ID NO: 1289505 - protein, 9 aa, Homo Sapiens
VNFIDCLVI

SEQ ID NO: 1289506 - protein, 9 aa, Homo Sapiens
KFVEAPYDI

SEQ ID NO: 1289507 - protein, 9 aa, Homo Sapiens
CCLIGPDNI

SEQ ID NO: 1289508 - protein, 9 aa, Homo Sapiens
NIIPPSLNT

SEQ ID NO: 1289509 - protein, 9 aa, Homo Sapiens
SKHHRTHEI

SEQ ID NO: 1289510 - protein, 9 aa, Homo Sapiens
HNSMEDTDQ

SEQ ID NO: 1289511 - protein, 9 aa, Homo Sapiens
FTDSSGMSA

SEQ ID NO: 1289512 - protein, 9 aa, Homo Sapiens
QVISSLYHE

SEQ ID NO: 1289513 - protein, 9 aa, Homo Sapiens
KNFLIKEIS

SEQ ID NO: 1289514 - protein, 9 aa, Homo Sapiens
MGRQLLAIQ

SEQ ID NO: 1289515 - protein, 9 aa, Homo Sapiens
FSIETCKII

SEQ ID NO: 1289516 - protein, 9 aa, Homo Sapiens
GNSLIWIHD

SEQ ID NO: 1289517 - protein, 9 aa, Homo Sapiens
PTLCAPPLA

SEQ ID NO: 1289518 - protein, 9 aa, Homo Sapiens
QDWLVEVTD

SEQ ID NO: 1289519 - protein, 9 aa, Homo Sapiens
SQLMQCSFY

SEQ ID NO: 1289520 - protein, 9 aa, Homo Sapiens
NKGLTYKQA

SEQ ID NO: 1289521 - protein, 9 aa, Homo Sapiens
YTRAVDWLG

SEQ ID NO: 1289522 - protein, 9 aa, Homo Sapiens
LQRISRASD

SEQ ID NO: 1289523 - protein, 9 aa, Homo Sapiens
AQTFGRISP

SEQ ID NO: 1289524 - protein, 9 aa, Homo Sapiens
ETFKAELQK

SEQ ID NO: 1289525 - protein, 9 aa, Homo Sapiens
RLNNAQQQM

SEQ ID NO: 1289526 - protein, 9 aa, Homo Sapiens
RNKVMTLFD

SEQ ID NO: 1289527 - protein, 9 aa, Homo Sapiens
DYIKQFKEA

SEQ ID NO: 1289528 - protein, 9 aa, Homo Sapiens
NNSCSPAGQ

SEQ ID NO: 1289529 - protein, 9 aa, Homo Sapiens
AIFCCFSFF

SEQ ID NO: 1289530 - protein, 9 aa, Homo Sapiens
LDEYIEQLK

SEQ ID NO: 1289531 - protein, 9 aa, Homo Sapiens
SSGQPLCPL

SEQ ID NO: 1289532 - protein, 9 aa, Homo Sapiens
SHLILHKRG

SEQ ID NO: 1289533 - protein, 9 aa, Homo Sapiens
LRDLEENVD

SEQ ID NO: 1289534 - protein, 9 aa, Homo Sapiens
ILHKRGHTG

SEQ ID NO: 1289535 - protein, 9 aa, Homo Sapiens
FIYRARTLP

SEQ ID NO: 1289536 - protein, 9 aa, Homo Sapiens
EEQPHGWVS

SEQ ID NO: 1289537 - protein, 9 aa, Homo Sapiens
LKVLAVTEN

SEQ ID NO: 1289538 - protein, 9 aa, Homo Sapiens
RTYGVPVDA

SEQ ID NO: 1289539 - protein, 9 aa, Homo Sapiens
LAGAFDAVP

SEQ ID NO: 1289540 - protein, 9 aa, Homo Sapiens
IALKNIRCR

SEQ ID NO: 1289541 - protein, 9 aa, Homo Sapiens
RKIDPVCVD

SEQ ID NO: 1289542 - protein, 9 aa, Homo Sapiens
RFGGPEMYC

SEQ ID NO: 1289543 - protein, 9 aa, Homo Sapiens
QPSWLTKPL

SEQ ID NO: 1289544 - protein, 9 aa, Homo Sapiens
SGCGFSNVF

SEQ ID NO: 1289545 - protein, 9 aa, Homo Sapiens
NDVQGLFEK

SEQ ID NO: 1289546 - protein, 9 aa, Homo Sapiens
KGSHGKLKV

SEQ ID NO: 1289547 - protein, 9 aa, Homo Sapiens
SLFKTRKAH

SEQ ID NO: 1289548 - protein, 9 aa, Homo Sapiens
FLCKTAVLK

SEQ ID NO: 1289549 - protein, 9 aa, Homo Sapiens
TFKAELQKL

SEQ ID NO: 1289550 - protein, 9 aa, Homo Sapiens
LDNNQRQCV

SEQ ID NO: 1289551 - protein, 9 aa, Homo Sapiens
GATVIVDAA

SEQ ID NO: 1289552 - protein, 9 aa, Homo Sapiens
KQLMKVDTA

SEQ ID NO: 1289553 - protein, 9 aa, Homo Sapiens
QAFDLGSSA

SEQ ID NO: 1289554 - protein, 9 aa, Homo Sapiens
IGMRFALIN

SEQ ID NO: 1289555 - protein, 9 aa, Homo Sapiens
DKTCCVDTK

SEQ ID NO: 1289556 - protein, 9 aa, Homo Sapiens
GTLDNLLNY

SEQ ID NO: 1289557 - protein, 9 aa, Homo Sapiens
TTISIFKGS

SEQ ID NO: 1289558 - protein, 9 aa, Homo Sapiens
RATQQSEND

SEQ ID NO: 1289559 - protein, 9 aa, Homo Sapiens
LSQEVTHTK

SEQ ID NO: 1289560 - protein, 9 aa, Homo Sapiens
ENPALLELL

SEQ ID NO: 1289561 - protein, 9 aa, Homo Sapiens
FTLYHDEIT

SEQ ID NO: 1289562 - protein, 9 aa, Homo Sapiens
GHISGLQET

SEQ ID NO: 1289563 - protein, 9 aa, Homo Sapiens
LSAFGTLSH

SEQ ID NO: 1289564 - protein, 9 aa, Homo Sapiens
ILTTDSDIE

SEQ ID NO: 1289565 - protein, 9 aa, Homo Sapiens
KEFPYSMNH

SEQ ID NO: 1289566 - protein, 9 aa, Homo Sapiens
EFSNLIITR

SEQ ID NO: 1289567 - protein, 9 aa, Homo Sapiens
DLVCELAKL

SEQ ID NO: 1289568 - protein, 9 aa, Homo Sapiens
VQILGKAAI

SEQ ID NO: 1289569 - protein, 9 aa, Homo Sapiens
AHHNLLAAW

SEQ ID NO: 1289570 - protein, 9 aa, Homo Sapiens
RDLEDLGLL

SEQ ID NO: 1289571 - protein, 9 aa, Homo Sapiens
NDGSDSTFH

SEQ ID NO: 1289572 - protein, 9 aa, Homo Sapiens
VLLVLPKNK

SEQ ID NO: 1289573 - protein, 9 aa, Homo Sapiens
GHFFDHKKK

SEQ ID NO: 1289574 - protein, 9 aa, Homo Sapiens
QRACMHAFP

SEQ ID NO: 1289575 - protein, 9 aa, Homo Sapiens
LYRNPLFLR

SEQ ID NO: 1289576 - protein, 9 aa, Homo Sapiens
ECWDSFALE

SEQ ID NO: 1289577 - protein, 9 aa, Homo Sapiens
RFALKTLCQ

SEQ ID NO: 1289578 - protein, 9 aa, Homo Sapiens
TSTLKVTPL

SEQ ID NO: 1289579 - protein, 9 aa, Homo Sapiens
VHNDPYTFL

SEQ ID NO: 1289580 - protein, 9 aa, Homo Sapiens
KPTGTDTRI

SEQ ID NO: 1289581 - protein, 9 aa, Homo Sapiens
ISSFNDKSI

SEQ ID NO: 1289582 - protein, 9 aa, Homo Sapiens
DTWWKFKQK

SEQ ID NO: 1289583 - protein, 9 aa, Homo Sapiens
QEFVPGQAF

SEQ ID NO: 1289584 - protein, 9 aa, Homo Sapiens
AALISIIKK

SEQ ID NO: 1289585 - protein, 9 aa, Homo Sapiens
RKSDVSRCN

SEQ ID NO: 1289586 - protein, 9 aa, Homo Sapiens
LHFVDFLVQ

SEQ ID NO: 1289587 - protein, 9 aa, Homo Sapiens
DVMSESIVE

SEQ ID NO: 1289588 - protein, 9 aa, Homo Sapiens
MLITLARLL

SEQ ID NO: 1289589 - protein, 9 aa, Homo Sapiens
ISYCKAQCK

SEQ ID NO: 1289590 - protein, 9 aa, Homo Sapiens
VVLARSAMG

SEQ ID NO: 1289591 - protein, 9 aa, Homo Sapiens
KFRCGRTAF

SEQ ID NO: 1289592 - protein, 9 aa, Homo Sapiens
QITEFENLV

SEQ ID NO: 1289593 - protein, 9 aa, Homo Sapiens
QIIKRDERM

SEQ ID NO: 1289594 - protein, 9 aa, Homo Sapiens
FDHKKKKFG

SEQ ID NO: 1289595 - protein, 9 aa, Homo Sapiens
KLKTCGNFK

SEQ ID NO: 1289596 - protein, 9 aa, Homo Sapiens
GVFTTTISI

SEQ ID NO: 1289597 - protein, 9 aa, Homo Sapiens
FSSTFSDQS

SEQ ID NO: 1289598 - protein, 9 aa, Homo Sapiens
DFSDEEDII

SEQ ID NO: 1289599 - protein, 9 aa, Homo Sapiens
PAGQSNLKS

SEQ ID NO: 1289600 - protein, 9 aa, Homo Sapiens
WDTAGQELF

SEQ ID NO: 1289601 - protein, 9 aa, Homo Sapiens
MKLHSYTRD

SEQ ID NO: 1289602 - protein, 9 aa, Homo Sapiens
KDYINAYIH

SEQ ID NO: 1289603 - protein, 9 aa, Homo Sapiens
RMENKALQE

SEQ ID NO: 1289604 - protein, 9 aa, Homo Sapiens
RIFIDAILL

SEQ ID NO: 1289605 - protein, 9 aa, Homo Sapiens
IHSGQLEKL

SEQ ID NO: 1289606 - protein, 9 aa, Homo Sapiens
KQEIMSDQL

SEQ ID NO: 1289607 - protein, 9 aa, Homo Sapiens
ATNRPDMID

SEQ ID NO: 1289608 - protein, 9 aa, Homo Sapiens
EQVVESYTL

SEQ ID NO: 1289609 - protein, 9 aa, Homo Sapiens
GAPKLGSGK

SEQ ID NO: 1289610 - protein, 9 aa, Homo Sapiens
KTYIDLILP

SEQ ID NO: 1289611 - protein, 9 aa, Homo Sapiens
TLKVTPLQP

SEQ ID NO: 1289612 - protein, 9 aa, Homo Sapiens
PWPPVVKPQ

SEQ ID NO: 1289613 - protein, 9 aa, Homo Sapiens
QALVKHMNQ

SEQ ID NO: 1289614 - protein, 9 aa, Homo Sapiens
QEDERCAQD

SEQ ID NO: 1289615 - protein, 9 aa, Homo Sapiens
ENLKKQHYL

SEQ ID NO: 1289616 - protein, 9 aa, Homo Sapiens
LHEGTDPET

SEQ ID NO: 1289617 - protein, 9 aa, Homo Sapiens
FNNCCMSLW

SEQ ID NO: 1289618 - protein, 9 aa, Homo Sapiens
FKTSGDLHK

SEQ ID NO: 1289619 - protein, 9 aa, Homo Sapiens
SNKNVDCSK

SEQ ID NO: 1289620 - protein, 9 aa, Homo Sapiens
CTIIFTDSS

SEQ ID NO: 1289621 - protein, 9 aa, Homo Sapiens
EKMEFKKSS

SEQ ID NO: 1289622 - protein, 9 aa, Homo Sapiens
HLHKVKSLS

SEQ ID NO: 1289623 - protein, 9 aa, Homo Sapiens
DQDDNEAPD

SEQ ID NO: 1289624 - protein, 9 aa, Homo Sapiens
ELGYDLLCQ

SEQ ID NO: 1289625 - protein, 9 aa, Homo Sapiens
EQSHTRCTL

SEQ ID NO: 1289626 - protein, 9 aa, Homo Sapiens
FWENKTKVA

SEQ ID NO: 1289627 - protein, 9 aa, Homo Sapiens
ILESSYLPS

SEQ ID NO: 1289628 - protein, 9 aa, Homo Sapiens
IFTKAEDNL

SEQ ID NO: 1289629 - protein, 9 aa, Homo Sapiens
IFTKAEDNK

SEQ ID NO: 1289630 - protein, 9 aa, Homo Sapiens
FKVPLQNSF

SEQ ID NO: 1289631 - protein, 9 aa, Homo Sapiens
CDGGSISKG

SEQ ID NO: 1289632 - protein, 9 aa, Homo Sapiens
WENKTKVAN

SEQ ID NO: 1289633 - protein, 9 aa, Homo Sapiens
ELHKHTEQL

SEQ ID NO: 1289634 - protein, 9 aa, Homo Sapiens
TFQYPYMNG

SEQ ID NO: 1289635 - protein, 9 aa, Homo Sapiens
FDLVAICGI

SEQ ID NO: 1289636 - protein, 9 aa, Homo Sapiens
IFTQLEFWD

SEQ ID NO: 1289637 - protein, 9 aa, Homo Sapiens
HRHICRART

SEQ ID NO: 1289638 - protein, 9 aa, Homo Sapiens
AVGWGATVI

SEQ ID NO: 1289639 - protein, 9 aa, Homo Sapiens
LTMTAEQNE

SEQ ID NO: 1289640 - protein, 9 aa, Homo Sapiens
TEIVQDMGA

SEQ ID NO: 1289641 - protein, 9 aa, Homo Sapiens
LANKDSCYP

SEQ ID NO: 1289642 - protein, 9 aa, Homo Sapiens
LKSKCKSIN

SEQ ID NO: 1289643 - protein, 9 aa, Homo Sapiens
QMYYYSLDM

SEQ ID NO: 1289644 - protein, 9 aa, Homo Sapiens
RKQMLATLY

SEQ ID NO: 1289645 - protein, 9 aa, Homo Sapiens
EYAHRMSQD

SEQ ID NO: 1289646 - protein, 9 aa, Homo Sapiens
KKLFNYLFK

SEQ ID NO: 1289647 - protein, 9 aa, Homo Sapiens
VAHACYHST

SEQ ID NO: 1289648 - protein, 9 aa, Homo Sapiens
NSCSPAGQS

SEQ ID NO: 1289649 - protein, 9 aa, Homo Sapiens
VEQRTSEDI

SEQ ID NO: 1289650 - protein, 9 aa, Homo Sapiens
MGTPQGENL

SEQ ID NO: 1289651 - protein, 9 aa, Homo Sapiens
DKYWSTFLS

SEQ ID NO: 1289652 - protein, 9 aa, Homo Sapiens
HSTDRNYII

SEQ ID NO: 1289653 - protein, 9 aa, Homo Sapiens
MTMEWHEKH

SEQ ID NO: 1289654 - protein, 9 aa, Homo Sapiens
EYKNCELDN

SEQ ID NO: 1289655 - protein, 9 aa, Homo Sapiens
LHKRGHTGE

SEQ ID NO: 1289656 - protein, 9 aa, Homo Sapiens
EALKFFVNL

SEQ ID NO: 1289657 - protein, 9 aa, Homo Sapiens
KEIYYDSFI

SEQ ID NO: 1289658 - protein, 9 aa, Homo Sapiens
IDNCKLVTY

SEQ ID NO: 1289659 - protein, 9 aa, Homo Sapiens
QGLFEKCVS

SEQ ID NO: 1289660 - protein, 9 aa, Homo Sapiens
ACSTIDQAV

SEQ ID NO: 1289661 - protein, 9 aa, Homo Sapiens
HISMIQLMV

SEQ ID NO: 1289662 - protein, 9 aa, Homo Sapiens
LTQPKYKYV

SEQ ID NO: 1289663 - protein, 9 aa, Homo Sapiens
NSDEQNDTQ

SEQ ID NO: 1289664 - protein, 9 aa, Homo Sapiens
IKCSNIILN

SEQ ID NO: 1289665 - protein, 9 aa, Homo Sapiens
KGILSRDIR

SEQ ID NO: 1289666 - protein, 9 aa, Homo Sapiens
CGNFKPSQK

SEQ ID NO: 1289667 - protein, 9 aa, Homo Sapiens
PDSCFHSSL

SEQ ID NO: 1289668 - protein, 9 aa, Homo Sapiens
LCITHLVCV

SEQ ID NO: 1289669 - protein, 9 aa, Homo Sapiens
QAAGPTSND

SEQ ID NO: 1289670 - protein, 9 aa, Homo Sapiens
LKKMRSRID

SEQ ID NO: 1289671 - protein, 9 aa, Homo Sapiens
PRYYHIALD

SEQ ID NO: 1289672 - protein, 9 aa, Homo Sapiens
TQEKAQVKK

SEQ ID NO: 1289673 - protein, 9 aa, Homo Sapiens
FILTDQLDG

SEQ ID NO: 1289674 - protein, 9 aa, Homo Sapiens
AHEGLIDSE

SEQ ID NO: 1289675 - protein, 9 aa, Homo Sapiens
VTMLGQDWL

SEQ ID NO: 1289676 - protein, 9 aa, Homo Sapiens
QLLMYPYVY

SEQ ID NO: 1289677 - protein, 9 aa, Homo Sapiens
QHFTNHSVD

SEQ ID NO: 1289678 - protein, 9 aa, Homo Sapiens
STVLNQTSS

SEQ ID NO: 1289679 - protein, 9 aa, Homo Sapiens
ATKACKLQE

SEQ ID NO: 1289680 - protein, 9 aa, Homo Sapiens
DSFYCSIEN

SEQ ID NO: 1289681 - protein, 9 aa, Homo Sapiens
AALHIIAYY

SEQ ID NO: 1289682 - protein, 9 aa, Homo Sapiens
HEKKAHHNL

SEQ ID NO: 1289683 - protein, 9 aa, Homo Sapiens
GKTWERPSQ

SEQ ID NO: 1289684 - protein, 9 aa, Homo Sapiens
ETLVLCSRL

SEQ ID NO: 1289685 - protein, 9 aa, Homo Sapiens
YQLLHEARL

SEQ ID NO: 1289686 - protein, 9 aa, Homo Sapiens
VCDLMTNKL

SEQ ID NO: 1289687 - protein, 9 aa, Homo Sapiens
LGLCMFDLN

SEQ ID NO: 1289688 - protein, 9 aa, Homo Sapiens
LLTKIQHIL

SEQ ID NO: 1289689 - protein, 9 aa, Homo Sapiens
NDIDVLKKI

SEQ ID NO: 1289690 - protein, 9 aa, Homo Sapiens
YQDCERRWR

SEQ ID NO: 1289691 - protein, 9 aa, Homo Sapiens
LFCHNCNNF

SEQ ID NO: 1289692 - protein, 9 aa, Homo Sapiens
NYLFKNNAN

SEQ ID NO: 1289693 - protein, 9 aa, Homo Sapiens
DEVMVELSE

SEQ ID NO: 1289694 - protein, 9 aa, Homo Sapiens
SNIHLQGNL

SEQ ID NO: 1289695 - protein, 9 aa, Homo Sapiens
KLHKSHILY

SEQ ID NO: 1289696 - protein, 9 aa, Homo Sapiens
VPEGTRDVH

SEQ ID NO: 1289697 - protein, 9 aa, Homo Sapiens
STEECEKRW

SEQ ID NO: 1289698 - protein, 9 aa, Homo Sapiens
TSLSLRAHE

SEQ ID NO: 1289699 - protein, 9 aa, Homo Sapiens
RGADYAMES

SEQ ID NO: 1289700 - protein, 9 aa, Homo Sapiens
LALYLESKL

SEQ ID NO: 1289701 - protein, 9 aa, Homo Sapiens
ELTEMRSAL

SEQ ID NO: 1289702 - protein, 9 aa, Homo Sapiens
DTDLYDYYT

SEQ ID NO: 1289703 - protein, 9 aa, Homo Sapiens
PPAQPSWLT

SEQ ID NO: 1289704 - protein, 9 aa, Homo Sapiens
LSLYNHFYV

SEQ ID NO: 1289705 - protein, 9 aa, Homo Sapiens
LNQTQKDLV

SEQ ID NO: 1289706 - protein, 9 aa, Homo Sapiens
QRIHTVEKP

SEQ ID NO: 1289707 - protein, 9 aa, Homo Sapiens
QQKHRQKHF

SEQ ID NO: 1289708 - protein, 9 aa, Homo Sapiens
ELTVMQDRL

SEQ ID NO: 1289709 - protein, 9 aa, Homo Sapiens
TDFDGKDVA

SEQ ID NO: 1289710 - protein, 9 aa, Homo Sapiens
KSYSWDSAQ

SEQ ID NO: 1289711 - protein, 9 aa, Homo Sapiens
CIWLRHLPS

SEQ ID NO: 1289712 - protein, 9 aa, Homo Sapiens
FEYQDFKRI

SEQ ID NO: 1289713 - protein, 9 aa, Homo Sapiens
TCDIVEFVC

SEQ ID NO: 1289714 - protein, 9 aa, Homo Sapiens
YPVFTSQKS

SEQ ID NO: 1289715 - protein, 9 aa, Homo Sapiens
LHTPIYFLL

SEQ ID NO: 1289716 - protein, 9 aa, Homo Sapiens
TEDVECLTY

SEQ ID NO: 1289717 - protein, 9 aa, Homo Sapiens
NIGSSFENL

SEQ ID NO: 1289718 - protein, 9 aa, Homo Sapiens
AVFFCILLI

SEQ ID NO: 1289719 - protein, 9 aa, Homo Sapiens
HLKEEHGLV

SEQ ID NO: 1289720 - protein, 9 aa, Homo Sapiens
LFGESYSGK

SEQ ID NO: 1289721 - protein, 9 aa, Homo Sapiens
REEINAFSL

SEQ ID NO: 1289722 - protein, 9 aa, Homo Sapiens
IVDAADLVV

SEQ ID NO: 1289723 - protein, 9 aa, Homo Sapiens
STESLLWST

SEQ ID NO: 1289724 - protein, 9 aa, Homo Sapiens
PDYCHNMYE

SEQ ID NO: 1289725 - protein, 9 aa, Homo Sapiens
LKEHFSGEP

SEQ ID NO: 1289726 - protein, 9 aa, Homo Sapiens
SLYNEPAQA

SEQ ID NO: 1289727 - protein, 9 aa, Homo Sapiens
KERWLVAWL

SEQ ID NO: 1289728 - protein, 9 aa, Homo Sapiens
LINENEKSY

SEQ ID NO: 1289729 - protein, 9 aa, Homo Sapiens
VLSTPSDSG

SEQ ID NO: 1289730 - protein, 9 aa, Homo Sapiens
DLSVQILGK

SEQ ID NO: 1289731 - protein, 9 aa, Homo Sapiens
YRPQTLNYL

SEQ ID NO: 1289732 - protein, 9 aa, Homo Sapiens
KTSGDLHKH

SEQ ID NO: 1289733 - protein, 9 aa, Homo Sapiens
RLLLYNFKQ

SEQ ID NO: 1289734 - protein, 9 aa, Homo Sapiens
MKGDAIDYL

SEQ ID NO: 1289735 - protein, 9 aa, Homo Sapiens
MYYYSLDMW

SEQ ID NO: 1289736 - protein, 9 aa, Homo Sapiens
QIHDLYWKV

SEQ ID NO: 1289737 - protein, 9 aa, Homo Sapiens
RKSKELQGL

SEQ ID NO: 1289738 - protein, 9 aa, Homo Sapiens
EGPGWTLVK

SEQ ID NO: 1289739 - protein, 9 aa, Homo Sapiens
DWLGLGVLI

SEQ ID NO: 1289740 - protein, 9 aa, Homo Sapiens
YHDEITERE

SEQ ID NO: 1289741 - protein, 9 aa, Homo Sapiens
FVEESPENI

SEQ ID NO: 1289742 - protein, 9 aa, Homo Sapiens
CAVGEPGAK

SEQ ID NO: 1289743 - protein, 9 aa, Homo Sapiens
IINKMINFL

SEQ ID NO: 1289744 - protein, 9 aa, Homo Sapiens
LFRRVAKDP

SEQ ID NO: 1289745 - protein, 9 aa, Homo Sapiens
RTIEDIDEN

SEQ ID NO: 1289746 - protein, 9 aa, Homo Sapiens
QTTLLATKK

SEQ ID NO: 1289747 - protein, 9 aa, Homo Sapiens
DVLKKIDIP

SEQ ID NO: 1289748 - protein, 9 aa, Homo Sapiens
SVLFDPFEL

SEQ ID NO: 1289749 - protein, 9 aa, Homo Sapiens
QQYSIKRSA

SEQ ID NO: 1289750 - protein, 9 aa, Homo Sapiens
LLDLQAKIG

SEQ ID NO: 1289751 - protein, 9 aa, Homo Sapiens
NIPDDAQGV

SEQ ID NO: 1289752 - protein, 9 aa, Homo Sapiens
TFEEASYPA

SEQ ID NO: 1289753 - protein, 9 aa, Homo Sapiens
VQIQSLQQS

SEQ ID NO: 1289754 - protein, 9 aa, Homo Sapiens
HNSGDCLSS

SEQ ID NO: 1289755 - protein, 9 aa, Homo Sapiens
ELKVAALCS

SEQ ID NO: 1289756 - protein, 9 aa, Homo Sapiens
LEISTKMCK

SEQ ID NO: 1289757 - protein, 9 aa, Homo Sapiens
LFWENKTKV

SEQ ID NO: 1289758 - protein, 9 aa, Homo Sapiens
NNFIIGTDM

SEQ ID NO: 1289759 - protein, 9 aa, Homo Sapiens
IGKYKSANS

SEQ ID NO: 1289760 - protein, 9 aa, Homo Sapiens
SMENTGEQF

SEQ ID NO: 1289761 - protein, 9 aa, Homo Sapiens
AAGMCGAGL

SEQ ID NO: 1289762 - protein, 9 aa, Homo Sapiens
REKSNYVCA

SEQ ID NO: 1289763 - protein, 9 aa, Homo Sapiens
EYRHWIKDE

SEQ ID NO: 1289764 - protein, 9 aa, Homo Sapiens
KLLILCVCA

SEQ ID NO: 1289765 - protein, 9 aa, Homo Sapiens
LGEFWLNEG

SEQ ID NO: 1289766 - protein, 9 aa, Homo Sapiens
YPGSNKPLS

SEQ ID NO: 1289767 - protein, 9 aa, Homo Sapiens
PDRDLRSLH

SEQ ID NO: 1289768 - protein, 9 aa, Homo Sapiens
RKDYINAYI

SEQ ID NO: 1289769 - protein, 9 aa, Homo Sapiens
YEVTPPDYQ

SEQ ID NO: 1289770 - protein, 9 aa, Homo Sapiens
FGPVQHLFK

SEQ ID NO: 1289771 - protein, 9 aa, Homo Sapiens
LTNAWSKLD

SEQ ID NO: 1289772 - protein, 9 aa, Homo Sapiens
ARSLLNTQD

SEQ ID NO: 1289773 - protein, 9 aa, Homo Sapiens
TAKEIAYPT

SEQ ID NO: 1289774 - protein, 9 aa, Homo Sapiens
FYVYDNNVL

SEQ ID NO: 1289775 - protein, 9 aa, Homo Sapiens
QPISTLLYL

SEQ ID NO: 1289776 - protein, 9 aa, Homo Sapiens
RSVELNQTQ

SEQ ID NO: 1289777 - protein, 9 aa, Homo Sapiens
DINTLQDIV

SEQ ID NO: 1289778 - protein, 9 aa, Homo Sapiens
IALEQDKTV

SEQ ID NO: 1289779 - protein, 9 aa, Homo Sapiens
PGIQVIFCG

SEQ ID NO: 1289780 - protein, 9 aa, Homo Sapiens
GKVLSGSEC

SEQ ID NO: 1289781 - protein, 9 aa, Homo Sapiens
SVSDISQYS

SEQ ID NO: 1289782 - protein, 9 aa, Homo Sapiens
CVVEAKTAP

SEQ ID NO: 1289783 - protein, 9 aa, Homo Sapiens
YCSIENVFL

SEQ ID NO: 1289784 - protein, 9 aa, Homo Sapiens
EKEKETFKA

SEQ ID NO: 1289785 - protein, 9 aa, Homo Sapiens
QLRLCMAET

SEQ ID NO: 1289786 - protein, 9 aa, Homo Sapiens
QRISRASDN

SEQ ID NO: 1289787 - protein, 9 aa, Homo Sapiens
TLVLNIKKP

SEQ ID NO: 1289788 - protein, 9 aa, Homo Sapiens
TYEIMTVHN

SEQ ID NO: 1289789 - protein, 9 aa, Homo Sapiens
KRKRKYDLR

SEQ ID NO: 1289790 - protein, 9 aa, Homo Sapiens
EHVFEVICT

SEQ ID NO: 1289791 - protein, 9 aa, Homo Sapiens
VSMGFVISN

SEQ ID NO: 1289792 - protein, 9 aa, Homo Sapiens
WDSYTTNNM

SEQ ID NO: 1289793 - protein, 9 aa, Homo Sapiens
NMLASADDS

SEQ ID NO: 1289794 - protein, 9 aa, Homo Sapiens
FFIYGTYLI

SEQ ID NO: 1289795 - protein, 9 aa, Homo Sapiens
SVGLPHCAV

SEQ ID NO: 1289796 - protein, 9 aa, Homo Sapiens
RLLERELTA

SEQ ID NO: 1289797 - protein, 9 aa, Homo Sapiens
ADIEAIVKV

SEQ ID NO: 1289798 - protein, 9 aa, Homo Sapiens
VKCEDSKNI

SEQ ID NO: 1289799 - protein, 9 aa, Homo Sapiens
SLLRDLEEN

SEQ ID NO: 1289800 - protein, 9 aa, Homo Sapiens
YYTEEDTEG

SEQ ID NO: 1289801 - protein, 9 aa, Homo Sapiens
VCVDYILQK

SEQ ID NO: 1289802 - protein, 9 aa, Homo Sapiens
IAYEAVKLQ

SEQ ID NO: 1289803 - protein, 9 aa, Homo Sapiens
DIEEYHRPE

SEQ ID NO: 1289804 - protein, 9 aa, Homo Sapiens
DSKMFQVHH

SEQ ID NO: 1289805 - protein, 9 aa, Homo Sapiens
THRRLYYSL

SEQ ID NO: 1289806 - protein, 9 aa, Homo Sapiens
SLYSAKTKS

SEQ ID NO: 1289807 - protein, 9 aa, Homo Sapiens
RIEKEKETF

SEQ ID NO: 1289808 - protein, 9 aa, Homo Sapiens
KKKYGIRLR

SEQ ID NO: 1289809 - protein, 9 aa, Homo Sapiens
GYFFNCDCC

SEQ ID NO: 1289810 - protein, 9 aa, Homo Sapiens
MSPIINNTE

SEQ ID NO: 1289811 - protein, 9 aa, Homo Sapiens
GTDTRILSI

SEQ ID NO: 1289812 - protein, 9 aa, Homo Sapiens
TYRQLPCNC

SEQ ID NO: 1289813 - protein, 9 aa, Homo Sapiens
LEKASENVL

SEQ ID NO: 1289814 - protein, 9 aa, Homo Sapiens
QAELCDYDP

SEQ ID NO: 1289815 - protein, 9 aa, Homo Sapiens
YTTEMDLRE

SEQ ID NO: 1289816 - protein, 9 aa, Homo Sapiens
LPILEELHK

SEQ ID NO: 1289817 - protein, 9 aa, Homo Sapiens
IIFTQLEFW

SEQ ID NO: 1289818 - protein, 9 aa, Homo Sapiens
LGWNDAGDN

SEQ ID NO: 1289819 - protein, 9 aa, Homo Sapiens
GQCIAAGCD

SEQ ID NO: 1289820 - protein, 9 aa, Homo Sapiens
LQTLLTIIV

SEQ ID NO: 1289821 - protein, 9 aa, Homo Sapiens
CRGNLVYNS

SEQ ID NO: 1289822 - protein, 9 aa, Homo Sapiens
MNHCNWHKM

SEQ ID NO: 1289823 - protein, 9 aa, Homo Sapiens
IPTSFHARQ

SEQ ID NO: 1289824 - protein, 9 aa, Homo Sapiens
GGPPRGSEC

SEQ ID NO: 1289825 - protein, 9 aa, Homo Sapiens
NLMQIQKCE

SEQ ID NO: 1289826 - protein, 9 aa, Homo Sapiens
QQIYEMLKS

SEQ ID NO: 1289827 - protein, 9 aa, Homo Sapiens
MGSNDIDVL

SEQ ID NO: 1289828 - protein, 9 aa, Homo Sapiens
EPWLLQSQH

SEQ ID NO: 1289829 - protein, 9 aa, Homo Sapiens
KKHGKEYTL

SEQ ID NO: 1289830 - protein, 9 aa, Homo Sapiens
TTHLFVKEQ

SEQ ID NO: 1289831 - protein, 9 aa, Homo Sapiens
PEVINFILQ

SEQ ID NO: 1289832 - protein, 9 aa, Homo Sapiens
NKKGTDIWL

SEQ ID NO: 1289833 - protein, 9 aa, Homo Sapiens
KEPSNSIFH

SEQ ID NO: 1289834 - protein, 9 aa, Homo Sapiens
VCNKIKSKG

SEQ ID NO: 1289835 - protein, 9 aa, Homo Sapiens
FVTFQYPYM

SEQ ID NO: 1289836 - protein, 9 aa, Homo Sapiens
IAAFIWNKC

SEQ ID NO: 1289837 - protein, 9 aa, Homo Sapiens
NMTQKDITF

SEQ ID NO: 1289838 - protein, 9 aa, Homo Sapiens
PDGSSHPPQ

SEQ ID NO: 1289839 - protein, 9 aa, Homo Sapiens
HPHIIKLYK

SEQ ID NO: 1289840 - protein, 9 aa, Homo Sapiens
ETAYSPGNK

SEQ ID NO: 1289841 - protein, 9 aa, Homo Sapiens
LLGSITCNV

SEQ ID NO: 1289842 - protein, 9 aa, Homo Sapiens
SKSVPVPLK

SEQ ID NO: 1289843 - protein, 9 aa, Homo Sapiens
RRMSTIKVT

SEQ ID NO: 1289844 - protein, 9 aa, Homo Sapiens
ERDKVVGHI

SEQ ID NO: 1289845 - protein, 9 aa, Homo Sapiens
GNCTEEPMD

SEQ ID NO: 1289846 - protein, 9 aa, Homo Sapiens
KNSWTHILM

SEQ ID NO: 1289847 - protein, 9 aa, Homo Sapiens
CVHEQKQQV

SEQ ID NO: 1289848 - protein, 9 aa, Homo Sapiens
ECRDTKPPD

SEQ ID NO: 1289849 - protein, 9 aa, Homo Sapiens
YTGKELPQT

SEQ ID NO: 1289850 - protein, 9 aa, Homo Sapiens
LYLSMPKRR

SEQ ID NO: 1289851 - protein, 9 aa, Homo Sapiens
GHRTDADSE

SEQ ID NO: 1289852 - protein, 9 aa, Homo Sapiens
LGSSAKNYF

SEQ ID NO: 1289853 - protein, 9 aa, Homo Sapiens
CITHLVCVL

SEQ ID NO: 1289854 - protein, 9 aa, Homo Sapiens
HACYHSTLG

SEQ ID NO: 1289855 - protein, 9 aa, Homo Sapiens
DGVDVSKVL

SEQ ID NO: 1289856 - protein, 9 aa, Homo Sapiens
ERVNRVNKC

SEQ ID NO: 1289857 - protein, 9 aa, Homo Sapiens
ILDNKNCTY

SEQ ID NO: 1289858 - protein, 9 aa, Homo Sapiens
QYSSKSPAP

SEQ ID NO: 1289859 - protein, 9 aa, Homo Sapiens
CILLIIASV

SEQ ID NO: 1289860 - protein, 9 aa, Homo Sapiens
LLKENFTGE

SEQ ID NO: 1289861 - protein, 9 aa, Homo Sapiens
VNRTVNRED

SEQ ID NO: 1289862 - protein, 9 aa, Homo Sapiens
ALFTQSGTM

SEQ ID NO: 1289863 - protein, 9 aa, Homo Sapiens
TWWKFKQKE

SEQ ID NO: 1289864 - protein, 9 aa, Homo Sapiens
YDGDSIKKI

SEQ ID NO: 1289865 - protein, 9 aa, Homo Sapiens
KKTEDVECL

SEQ ID NO: 1289866 - protein, 9 aa, Homo Sapiens
VLEEGVKCS

SEQ ID NO: 1289867 - protein, 9 aa, Homo Sapiens
IGKTWERPS

SEQ ID NO: 1289868 - protein, 9 aa, Homo Sapiens
PLQNSFEKK

SEQ ID NO: 1289869 - protein, 9 aa, Homo Sapiens
VCCLIGPDN

SEQ ID NO: 1289870 - protein, 9 aa, Homo Sapiens
AHMTASNTQ

SEQ ID NO: 1289871 - protein, 9 aa, Homo Sapiens
KHSGHLFFR

SEQ ID NO: 1289872 - protein, 9 aa, Homo Sapiens
LSPNIFALS

SEQ ID NO: 1289873 - protein, 9 aa, Homo Sapiens
IFGPVQHLF

SEQ ID NO: 1289874 - protein, 9 aa, Homo Sapiens
QETGKTMRK

SEQ ID NO: 1289875 - protein, 9 aa, Homo Sapiens
LYWKVKFTA

SEQ ID NO: 1289876 - protein, 9 aa, Homo Sapiens
QTLFGIIVR

SEQ ID NO: 1289877 - protein, 9 aa, Homo Sapiens
TLKEHFSGE

SEQ ID NO: 1289878 - protein, 9 aa, Homo Sapiens
KKHSKKKRK

SEQ ID NO: 1289879 - protein, 9 aa, Homo Sapiens
HSIPWSHAM

SEQ ID NO: 1289880 - protein, 9 aa, Homo Sapiens
ELDVKDIEG

SEQ ID NO: 1289881 - protein, 9 aa, Homo Sapiens
RQCQCTSVC

SEQ ID NO: 1289882 - protein, 9 aa, Homo Sapiens
LYNYRSVLE

SEQ ID NO: 1289883 - protein, 9 aa, Homo Sapiens
AEYFPLPYQ

SEQ ID NO: 1289884 - protein, 9 aa, Homo Sapiens
ILTDQLDGE

SEQ ID NO: 1289885 - protein, 9 aa, Homo Sapiens
GNKGILSRD

SEQ ID NO: 1289886 - protein, 9 aa, Homo Sapiens
HLGYFFVNR

SEQ ID NO: 1289887 - protein, 9 aa, Homo Sapiens
NYTAYFRGS

SEQ ID NO: 1289888 - protein, 9 aa, Homo Sapiens
YRRSVELNQ

SEQ ID NO: 1289889 - protein, 9 aa, Homo Sapiens
QKFQAFDLG

SEQ ID NO: 1289890 - protein, 9 aa, Homo Sapiens
YLDGFDQDD

SEQ ID NO: 1289891 - protein, 9 aa, Homo Sapiens
SKDSSLFES

SEQ ID NO: 1289892 - protein, 9 aa, Homo Sapiens
HDEITEREA

SEQ ID NO: 1289893 - protein, 9 aa, Homo Sapiens
DISQYSVEH

SEQ ID NO: 1289894 - protein, 9 aa, Homo Sapiens
DIECKNKSY

SEQ ID NO: 1289895 - protein, 9 aa, Homo Sapiens
VANQSQTPC

SEQ ID NO: 1289896 - protein, 9 aa, Homo Sapiens
EKKAHHNLL

SEQ ID NO: 1289897 - protein, 9 aa, Homo Sapiens
ANHTLLQQD

SEQ ID NO: 1289898 - protein, 9 aa, Homo Sapiens
SGQPLCPLL

SEQ ID NO: 1289899 - protein, 9 aa, Homo Sapiens
VCDGGSISK

SEQ ID NO: 1289900 - protein, 9 aa, Homo Sapiens
NDAGDNVTK

SEQ ID NO: 1289901 - protein, 9 aa, Homo Sapiens
AIQMNEEQY

SEQ ID NO: 1289902 - protein, 9 aa, Homo Sapiens
TIKVAQRID

SEQ ID NO: 1289903 - protein, 9 aa, Homo Sapiens
KPPDGKSKD

SEQ ID NO: 1289904 - protein, 9 aa, Homo Sapiens
ALHSTQSQE

SEQ ID NO: 1289905 - protein, 9 aa, Homo Sapiens
SNFAEDFCP

SEQ ID NO: 1289906 - protein, 9 aa, Homo Sapiens
KYKSANSFT

SEQ ID NO: 1289907 - protein, 9 aa, Homo Sapiens
IFMALEGEA

SEQ ID NO: 1289908 - protein, 9 aa, Homo Sapiens
KRLLYIMIE

SEQ ID NO: 1289909 - protein, 9 aa, Homo Sapiens
NKYIGLTQF

SEQ ID NO: 1289910 - protein, 9 aa, Homo Sapiens
QLRVSYVSK

SEQ ID NO: 1289911 - protein, 9 aa, Homo Sapiens
AAVTVCIGV

SEQ ID NO: 1289912 - protein, 9 aa, Homo Sapiens
QELFRSLIP

SEQ ID NO: 1289913 - protein, 9 aa, Homo Sapiens
DLMTNKLPG

SEQ ID NO: 1289914 - protein, 9 aa, Homo Sapiens
TTTTTIVIS

SEQ ID NO: 1289915 - protein, 9 aa, Homo Sapiens
EIVDYISGC

SEQ ID NO: 1289916 - protein, 9 aa, Homo Sapiens
YTPYDMFCP

SEQ ID NO: 1289917 - protein, 9 aa, Homo Sapiens
NDKSISTSL

SEQ ID NO: 1289918 - protein, 9 aa, Homo Sapiens
QCAGVELYP

SEQ ID NO: 1289919 - protein, 9 aa, Homo Sapiens
MDALLHAAS

SEQ ID NO: 1289920 - protein, 9 aa, Homo Sapiens
VERKHPLRG

SEQ ID NO: 1289921 - protein, 9 aa, Homo Sapiens
ENAHLHTLV

SEQ ID NO: 1289922 - protein, 9 aa, Homo Sapiens
YDFEDEYVG

SEQ ID NO: 1289923 - protein, 9 aa, Homo Sapiens
NVCDVVMVN

SEQ ID NO: 1289924 - protein, 9 aa, Homo Sapiens
SLTMTAEQN

SEQ ID NO: 1289925 - protein, 9 aa, Homo Sapiens
HNHNKGLTY

SEQ ID NO: 1289926 - protein, 9 aa, Homo Sapiens
QTLVNFGFV

SEQ ID NO: 1289927 - protein, 9 aa, Homo Sapiens
AAWSDHRHI

SEQ ID NO: 1289928 - protein, 9 aa, Homo Sapiens
AANSDNLMQ

SEQ ID NO: 1289929 - protein, 9 aa, Homo Sapiens
SSDEEDLHP

SEQ ID NO: 1289930 - protein, 9 aa, Homo Sapiens
HHRTHEIEK
